United States Patent 9,976,157 (ISOLATED POLYNUCLEOTIDES AND POLYPEPTIDES, AND METHODS OF USING SAME FOR INCREASING PLANT YIELD AND/OR AGRICULTURAL CHARACTERISTICS) - sequence listing, part 2

SEQ ID NO: 1613 - DNA, 674 bp, Parthenium argentatum
ctttcaaaccctactctcagaggttgaagttaatcagaggaaaagtttctgaaaatgagtaagcttcaaagtgaagcccttcgagaggcaattactcagatcactactgatgcgaaggaaaagaaacgtaacttcactgaaaccattgagcttcaaattggtttgaagaattacgacccacaaaaggacaaacgtttcagtggtaccgtgaaattgcctcacattcctcgccccaaacttaaagtttgcatgcttggagatgctcaacatgttgaagaggctcaaaaaattggccttgaatatatggatgtcgagagtctgaagaagttgaacaagaacaagaagttggtgaagaaacttgctaagaagcatcaagctttcttggcttctgagtctgtcatcaagcagattccccgtttgttgggccctggccttaacaaagcaggtaagttccctactcttgtttcccaccaagaatctcttgaggccaaggtcaacgagacgaaagcgacagtcaaatttcaacttaagaaggtgctctgcatgggagttgccgttggaaactgcagcatggaagaaaagcaaattttccagaatgttcaaatgagtgtcaatttcttggtttctttactcaagaagaattggcaaaatgtgcgatgcttgtacttgaagac

SEQ ID NO: 1614 - DNA, 877 bp, Euphorbia peplus
gttgagggaggctattactactatcatgactgcttcaaaggagaagaagcggaatttcactgagacaattgagctccagattgggcttaagaactacgatccccaaaaggataagcgtttcagtggctctgtcaaattgcctcacatccctcgccctaagatgaaggtttgcatgcttggagatgctcagcatgttgaggaggctacagcaattggccttcaatggatggatgttgaggctctcaagaagctcaacaagaacaagaagcttgtgaagaaactcgccaagcagtaccatgcctttttggcttctgaatctgtcatcaagcagattccccgtcttctgggacctggtctgaacaaggcaggtaagttccctactcttgtgacccaccaagagtccttggagtcgaaggtcaacgagacgaaagcaacagttaagtttcagttgaagaaggtgctttgcatgggtgttgctgtcggaaactgcgccatggaagagaagcaagttttccagaatgttcaaatgagcgtgaacttccttgtctccttacttaagaagaattggcaaaacgtgaagtgcctaaacctgaagactacgatgggttctccacaacgcgtcttttaaggagttagcttttgaactgcagtcgaacttgagagacagtttcttgataattatagaattttttattttatgctcgatctttcaatttggacggctgttttgttttgttgtgatgaaaccagtagttacattgtaatgctagtttttttgagagatgaacttgatttaccttgtttgcatgattaatttttagctctgcatctgtaacatgtttgtctatgtggtttgttgcagataactgaagcaatt

SEQ ID NO: 1615 - DNA, 988 bp, Silene vulgaris
agcagccacaaaccctaaacccctctttctctctcctggttttggcgtttgattcatcatgagtaagttatcgagtgatgctgtgagggaagctatctctggtattttaactgatgccaaggataaggaaaggaaatttgttcagacaatcgagctccagattggtctgaagaattatgatccccaaaaggataagcgtttcagtggttccgtcaaattgccccatgttcctcgtcccaagatgaaagtttgcatgcttggagatgctcaacacgttgaggaggctgagagagttggtttggaatcgatggatgtcgaagcattgaagaagcttaacaagaacaagaagttggttaagaagcttgctaagaagtaccattctttccttgcctcagaatctgtcatcaagcagattccccgtttgctcggtcctggtctcaacaaggcaggtaagttccctactctcgttacccaccaagaacctcttgagaacaaggtgaacgagatcaaggccacaatcaagttccaattgaagaaggtgctttgcatgggtgttgctgttggaaactgtgggatggatgagaagcagatcttccagaacgtgcaaatgagtgtcaacttccttgtctccctcttgaagaagaattggcaaaatgttaggtgcttgtacctgaagagtaccatgggaagaccctaccgtatcttctaagaatgttccaactctttttggttcaggttcttgatattatgagtgatcgtttttcttgtcacctgaaagtagttcagtgtatcgtcttgagcgtagaatacttgggaaactctttaatgggcgaacgttatcttgtcagttttgttatgacattgttcgatgactatttattacggatatgcttgttttgttggtcattgggttcgttttgaatctctctttttgttttcttacaagtttctccgtaaagttcccctattaactgttaagggaagttat

SEQ ID NO: 1616 - DNA, 946 bp, Medicago truncatula
tgtttttgatgtgattttgcagtaagcttcagagtgaagctgtgagagaagctattacaggaatcatggctgattccaaggaaaaaaaccgaaaatttgttgagactattgaactccagattggtcttaagaactacgacccacaaaaggataaacgtttcagtggttctgtcaaattgcctcacattcctcgacctaagatgaagatttgcatgcttggagatgctcagcatgttgaggaggctgagaaaataggattggaatcgatggatgttgaagctttgaagaagctaaacaaaaacaagaaactggtgaagaaattggcaaagaagtaccatgcctttttagcttctgaagctgttattaagcagattccccgtcttttgggtcctggtctcaacaaggcaggaaagttccctacacttgtttcccaccaagaatctctcgaggctaaggttaatgagactaaggctatggtcaagttccagcttaagaaagtgctgtgcatgggagtagctgttggcaatgtcagtatggatgagaaacaaatcttccaaaatgtacaactgagtgttaacttcctcgtgtccttgttgaaaaagaattggcaaaatgttaggtgcttgtatctgaaaagttcgatgggcaaatcttaccgtgtcttttaaacggtctttacatccaatgtttttgaaattgagcttaatattttggttactgtaatagctgagacagcaggtttcccttttctacagttttgtttgatgagattttgttgtcagtattgtgttcttgaagattatgtcagaagtgctaattttattccgcatggtttatttcttcagctttttgccctcttctttcatgtatattttttatgcaaagttgctcccatagtctttgtagaataattttattgttatgcatttcatcagatatctcgtct

SEQ ID NO: 1617 - DNA, 806 bp, Eragrostis curvula
  misc_feature (806)..(806): n is a, c, g, or t
tatcagagcttgcgcgatgtcgcttgtgccaacccaatggagttgagcggtagattgcaaccatgagtaagttgcaaaccgaggtcctcaatgatggcatcgccaatgtcgttaaggatgccaaggagaagaacaggaagttcaccgagacaattgagctccagattggtctgaagaactatgacccgcagaaggacaagcgtttcagcggctctgttaagctgccccatatcccccgcccgaagatgaaggtgtgcatgcttggtgatgcccagcatgtggaggaggctgggaagatggggcttgactacatggatgttgaatctcttaagaaaatgaacaagaacaagaagcttgttaagaaaattgccaagaagtaccacgctttcttggcatctgaggcgatcatcaagcagattccccgtctccttggtcctggtctcaacaaggcaggcaagttcccgaaactggttagtcaccaggagtctcttgaatccaaggtccatgagacaaagccagggccagttccagctgaagaacgttctttgcattggtgttgctgtgggcaacttgtccatggacggagaaggcgaatccagagcaacgtccaaattgagcgttaacttccttggtgtcctttctgaagacgaactgggcagaatgtcaagttccctgtcatcaagaagccccagtggcaaaaccggaaccgggtaggacctaactttactggggtccccgttgaagtcagaaaataccgggcctttgaccgggctgcttcagagcgagagtgtgaaccgtaaatttan

SEQ ID NO: 1618 - DNA, 912 bp, Citrullus lanatus
gtaaaaaaaccctagcttcacgtcttctcccaagtctgtagcttctccttaggaaagacaaagctttgaaaatgagcaaacttcagagcgatgctttgagagaagctatttcatctatcttcgctgatacaagtgaaaagaagcgcaactttactgagaccattgaacttcagattggactgaagaactatgatccacaaaaggacaagcgtttcagtggatcagtgaaattgccccatattcctcgccctaagatgaagatttgcatgcttggagatgcctctcatgttgaagaggcagagaacggtttggattatatggacgttgaaggtttgaagaagctaaacaaaaactagaagttaatgaagaaacttgccaagaagtatcatgcctttttagcatctgaagctattattaagcaaattccccgtcttctgggccctgggctcaacaaagggcccaacaaggcaggaaagttccctaccctggtcactcaccaagaatctctcgaatctaaagtaaatgagactaagtcaatggttaagtcccaattgaagaaggttctttgtatgggtgtggccataggcaatgttgccatggaagagaaacaagttttctagaacgttcaaatgggtgtcaatttccttgtttccttgttgaaaaagaattggcaaaacgtgaggtgcttgtacctgaagagtacaatggggaaggcatatcgagtctctgaggaattttcataacttagatagtattgtttgttcttaaattgaagaaggaccaagttgagatgaaattctatatttatgattgatgaaaaatttcctgcttgtttttttgtttagtaaaaaccattagctgcacaatcgttaacacttgtgatgggagtaatgtgtttaaaacacactatta

SEQ ID NO: 1619 - DNA, 742 bp, Brassica juncea
gcaagttcaccgagactatcgagctccagattggtctcaagaactatgaccctcaaaaggacaagaggtttagcggttccgttaagttgcctcacattcctaggcccaagatgaagatttgcatgctcggtgacgcccagcacgttgaagaggctgagaagattgggttagagtctatggatgtggaagctcttaagaagctgaacaagaacaagaagcttgttaagaagctcgccaagaagttccatgctttccttgcttctgaatccgtcatcaagcagattccacgtcttcttggtcctggtctcaacaaggcaggaaagttcccaactcttgtgagccaccaagagtctttggaggccaaagtgaatgagacaaaggcaacagtgaagttccagctcaagaaggttctttgcatgggtgtcgccgttgggaatctcggcatggaagagaagcagatcttccagaatgttcagatgagcgtcaacttccttgtttccctcttgaagaaaaactggcaaaacgtgaggtgcttgtacttgaagagcactatgagtccacctacccgtgttttctaagattattttatctctaaagtttctctcaaggtatcatcagggctgagaggagatttcattttcatttctgtcatgattaagattttgtttaaagacagttttatttatattattcctattactcttggtgaaaaaaaaaatcacagtacaagaaaaaaaaaaaa

SEQ ID NO: 1620 - DNA, 686 bp, Eschscholzia californica
ctaccaataaaaagctcggaaaccctagtttagggttttccatctcgctctctcgttaggttagaactttttagaggacctcagtaaaaggttccaaaatgagtaagcttcaaagtgaagttttgagagaagcaatcacccagatctctggagatgctaaggagaaagcccgtaagttcactgagacagtggaactacagattggtctgaagaactacgaccctcaaaaagataagcgtttcagtggttccgtaaagttgccacatatccctaggcctaagatgaaagtttgcatgcttggggatgctcaacatgtggaagaggctgagaagataggtttggactacatggatgtagaagggctaaagaagcttaacaagaacaagaaattggtcaaaaagctcgctaagaggtttcatgcttttctagcatcagaagctgtcattaagcagattcctcgtctactcggacctggtctcaacaaggcaggaaagttccctacccttgtgtctcatcaagaatcactggaagccaaagttaacgaaaccaaggctatggtgaagtttcaactaaagaaggttttgtgcatgggtgttgctgtgggtaaccttggaatggaagagaagcaaatcttccaaaatgttcaactcagtgtcaacttccttgtttcattgttgaagaagaac

SEQ ID NO: 1621 - DNA, 1077 bp, Populus trichocarpa
atatttatacaccttccttcagccaactgctctctggctagggtttcttcgtctttcggaaagaaaggaataaagaaagaaatcctgagagcccttgttgaaatcttggaacatgagtaagcttgcgggggataccatcagagaagctgtgacaaccataaagaatggtgtgaatgagaagccacgcaagttcacccagaccattgagcttcagattggcttgaaaaattatgacccacaaaaggataagcggtttagtggctctgttaagttgccccacattcctcgtcccaaaatgaaggtttgcatgcttggagatgctcagcatgtggaggaggcagtgtcaataggcttgcaatggatggatgttgaagcactgaagaagctgaacaaaaacaagaaattggtcaagaagctttcaaagcagtatcatgcctttttggcctcagagtctgtcatcaagcagattccccgtctcttgggccctggcctcaacaaggcaggaaagttcccaacccttgtgactcaccaagagtcgctagagtcaaaggttaatgaaatcaaggcaactgtgaagtttcagttgaagaaagtgttgtgcatgggtgttgctgttggtaactgcgatatggaggacaagcagatcttccagaatgtgcagatgagcgtcaatttccttgtctcacttttgaagaagaattggcaaaatgtcaagtccctgcaccttaagagtaccatgggaactcctgtccgcctttactaaggagttctaagcaaccatagttttgtaagaggagaagagtctaccatgagcagaactgagaaatgttatctttgaacattaggattttatgtttctggattattatttttttgaatgcttcttatttttatgattaccagaattgtatgaagtttttgctgaatagatgtgaactttgttttcttttgaatgattcatgttttgcctgacatatcttggagatgtccctggcatacacagaattaaacgtttggtttgactacacagccatttggccactattgtatgttcttacctgagtttctttcactcga

SEQ ID NO: 1622 - DNA, 779 bp, Ambrosia trifida
cccggtagtagtctaacgcgtaagaggttaactccggggggccggtcccggttctttcctatacttgacgtcttaggtgttttggtaagtaaagagactaactaaaaatacgagtaaacttacagaagcgaagcccttagggaagccattactcagatcaccaccaatgctgtagaaaagaaacgtaacttcaccgagaccattgagcttcagatcgggctcaagaactacgacccacaaaaggacaagcgttttagcggtactgttaagttgcctcacattcctcgtcccaaattgaaggtttgcatgcttggagatgcccagcatgtggaagaggctcaaaagattggtcttgaatacatggatgttgaaggactcaagaagcttaacaagaacaagaagctggtgaagaagctagccaagaagcaccaagcttttttggcttccgaatccgttatcaagcaaattcctcgtttgttgggccctggtctaaacaaggcaggaaagttcccaacacttgttagtcaccaggaatctctcgaggctaaggtgaatgaaaccaaagcaacggttaagtttcaactgaaaaaggtgctgtgcatgggagttgctgtcggcaactgcagcatggaggagaaacagattttccaaaacgtgcagatgagcgttaatttcctcgtttcattgttgaagaagaactggcaaaatgtgagatgtttgtacttgaagacaacgatgggaaagccgattcgcatcttttagatattgtgtttgttttt

SEQ ID NO: 1623 - DNA, 591 bp, Flaveria ramosissima
aaagaaacgtaacttcactgagaccatcgagctccagattgggctcaagaactatgacccacaaaaggacaagcgtttcagtggaaccgtgaaattgcctcacattcctcgtcctaaattgaaagtttgcatgctcggggatgctcagcacgtcgaagaggctcaaaagatcggtcttgaatacatggatgtagaaggactcaagaagctcaacaagaacaagaagctggtgaagaagcttgctaagaaacaccaggcttttttggcttctgaatctgttatcaagcagattccccgtttgttgggccctggtctaaacaaggcaggtaaatttccgacacttgttactcaccaagaatctctcgaggctaaggtgaatgaaacgaaggccaccgtcaagtttcaactgaaaaaagtgttgtgcatgggagtggctgttgggaactgcagcatggaggaaaaacagatttttcaaaacgtgcagatgagcgttaattttctcgtttcattgttgaagaaaaactggcagaatgtgcgatgtttgtacttgaagacaacaatgggaaagccagttcgcatcttttaggtgtt

SEQ ID NO: 1624 - DNA, 898 bp, Brassica oleracea
  misc_feature (689)..(690): n is a, c, g, or t
ggccttagagaaggttagagcttcctctgcttcacctttcaggctcagagattcgtcaattgagagcaactcaagatgagtaagcttcaaagtgaggttcttagagaagggatcacagctgtgaagggcaaagccgatgagaaaaagcgcaactttgtggagacagttgagcttcagattggtctcaagaactacgacccacaaaaggacaagcgtttcagtggatcagtcaagctccctcacattcctcgccctaaaatgaagatctgtatgctcggagatgctcagcatgttgaggaggctgagaagattggactagactatatggatgttgaggctttgaaaaagctcaacaagaacaagaagcttgtcaagaagcttgccaagaagtaccatgctttccttgcttctgaatccgtcattaagcagattcctcgtcttcttggtcctggtcttaacaaggcaggaaagttcccgactctagtgagtcaccaagagtcgttggaaggaaaggtgaatgagaccaaagcgacagtgaagttccagttgaagaaggttctgtgtatgggtgttgccgttggtaacctttccatggaagagaagcagctctttcagaatgttcagatgagcgttaacttccttgtctcgctcttgaagaagattggcaaaacgtgaggtgtttgtacttnnagagcaccatgggaccacctcaaaggatcttttgagctctctgcttttatcatctttggaaatttcgctttgcttttttttgtttcaaatatctagtgcttcttgagatatatggttcggattgattaatagcggaactcggctgctagtttgcttttcgttaaaagacaaatataatatatatgcaatgtttgcttttaaggcttcc

SEQ ID NO: 1625 - DNA, 1091 bp, Populus trichocarpa
gtccattaaaagtggctagctagggttttattagctccaaagatctctccaagacattttgcacactctctagccgttaccttctcttctccaagttcctccatttttgttctttggacaaaactctgaagagggttgctttaagaggtttcaatcatgagtaagcttgcaggggatacaattcgcgaagctgttacaactataaaaaatggtgtgaatgagaagccccgcaagttcgtccagaccatcgaactacagattggattgaaaaactatgacccccagaaggacaagaggttcagcggctctgttaagttgccgcacataccgcgtcccaaaatgaaggtctgcatgcttggagatgctcagcatgtggaggaggcaacttctataggtttgcaatggatggatgttgaagcattgaagaagctgaacaagaacaagaaattggttaagaagctttccaagcagtaccatgcctttttggcatcagagtctgtcatcaagcagattcctcgacttttaggccctggtctcaacaaggcaggaaagtttcctaccctcgtgactcaccaagagtcactggagtctaaagttaatgagatcaaggcaacggtgaagtttcaattaaagaaagtcctttgcatgggtgttgctgttggtaactgcgacatggaggataagcagatcttccagaatgttcaaatgtctgtgaacttcctggtctccttgttgaagaaaaactggcaaaatgtgaagtcgctgcacctaaagagtaccatgggtaccccagtccgcctctattaagctagttctaaactaccgctatgtttttggaatgcttagaaatatcaccccttttccttaaataactttattgttttttgagagatgaaattatgttcatggatttgttcttaattttttttttaatgcttaacccttaaatcagacctgttatgttgatagcattgcttcccttgaaatgtttaatgcctgtgggaaagccaactgcagaaagaaaaacgcaagtgtcaaacttgcctgagatgaatctgcctttgctttatatatagatggtaaaataggta

SEQ ID NO: 1626 - DNA, 2258 bp, Sorghum bicolor
cacgcacccaggccttcccttccatccctgtgccgcgccagctcccctgcagccactgctcactcctcagtcgtcacgcttgttttcacattcgttcctgcctgcctgcctgcctgctcctcgccctcaccggcagcagagtggtaaatcatccatgtcgggcggccgctgactgttggcgtcgaagctgcaaagttactggttctagcacgggcgcggcgcggttgcggaggaggaggagggatcggcggagatgaggatgaagacgctggcgtgctgccggcggcggccgcaggacttcagcatcgacatggacaaagagcccgacagggtgatgacatataatggcctcgagacctgcattatcaacagttccgcctatgacgatgatagtgccattagtgcaacaacaggcggagatggatgtgtcaccactgattcccttgatgatgaagtctctagttgctctagtaaagatgcttctggttcttccttctcttcacactgccttagcaagcaggatgagcattcactagatgagttgggtacacccatcgcaattcatctactccctttcaaagggaagaaaccaatcacatataccttgagcgcttcagatattgaaaacatgaaggaaaaatttgcaaagctattgctcggtgatgatacttcaggaggagctaggggcgtttgcgcggctctggccttgtccaatggcataatcaatctctctgcaactgtttttggagaactctggaagctggaaccattgtgcgaagataaaaagatcaggtggagaaaagaaatggactggttgctgtctcctacaacttatatggtggagttggttccaacgaagcaaagcggggcagatggatgcacatttgagattatgactccaaaggcccgctcagatgttcatgtgaaccttcctgcccttcagaagcttgatgcgatgctcattgaagtgatggactctatgatagatacagagttctggtatgaggagagtggtagcagagctgatggtcggggcaaaattacaggtccaaggaagagtaaaaagtggtggctcccatctcctcgtgtccctgaggaagggctatctcaatttcagcgaaaaaggcttgtttttcaggctaagcttgttcatcagatcctcaaagctgcaaaatccatcaacgaacaagtcctattccatatgcctattccggcagctgttatggatgcccttcctaagtctgggagagctagcttgggggaagatttgtatcaggctataaccacacagtatattcctatagaggaaatatttgtttcgctcagtttgaaaactgagcatagtgtgctcgagactattaaccggttggagggtgcagtgtttgcatggaaccaaagaattctagaggaaagaagcaagaggtccccaggacgccattcctggagcttcatgaaggatagctcatcagaacttgacaagatgtctgcatgcatcgaaagggttgacacacttgtgcagcttctgaaatccagatatccgaacctgcctccaacttttatagatgttttaaaggtccaatacaatgtggacgtggggcatgcaattgtggaggcctactctagggttcttgttggggtagcattcagcatactgtcacgtgtagccgagatactgctggaggatgacttgatcaagaagcccaacacccccatggccacactgaagttcgacctctcctcggacgtgtacttggcaggtatcacagagacgccaccgggacacatccgacggtcccttatggaccagatcagcatggttgacgggcgctttgatgctgttgtcaagaagaaaggggtgaaacagctgaggtggtgaggccacagttagctgttgtgaatcttttggccatgtacagggtgatgcagggcccagtgtccgctccacaaggttaccttaccttagctatagtgcagtgtaatgtatttggcgacgagtttatagcgtactgtaagagcagcattaggtgaaaatcctgcctgtcgaagtgtccggatgttgctgttgcgtctgaacaatctgatgctcttgatcagcctctgctgcatttcttgctggcacctgatgatggcatgttgatgacgagaccttgcttgagtgcgtgcttgacgggttcgtgctgacgcgtcttccgttctggaagccgtccgcgttgttggggcgtgtgggcctgtggattattatgaatggcgggaccgtg

SEQ ID NO: 1627 - DNA, 2217 bp, Sorghum bicolor
gcagccactgctcactcctcagtcgtcacgcttgttttcacattcgttcctgcctgcctgcctgcctgctcctcgccctcaccggcagcagagtggtaaatcatccatgtcgggcggccgctgactgttggcgtcgaagctgcaaagttactggttctagcacgggcgcggcgcggttgcggaggaggaggagggatcggcggagatgaggatgaagacgctggcgtgctgccggcggcggccgcaggacttcagcatcgacatggacaaagagcccgacagggtgatgacatataatggcctcgagacctgcattatcaacagttccgcctatgacgatgatagtgccattagtgcaacaacaggcggagatggatgtgtcaccactgattcccttgatgatgaagtctctagttgctctagtaaagatgcttctggttcttccttctcttcacactgccttagcaagcaggatgagcattcactagatgagttgggtacacccatcgcaattcatctactccctttcaaagggaagaaaccaatcacatataccttgagcgcttcagatattgaaaacatgaaggaaaaatttgcaaagctattgctcggtgatgatacttcaggaggagctaggggcgtttgcgcggctctggccttgtccaatggcataatcaatctctctgcaactgtttttggagaactctggaagctggaaccattgtgcgaagataaaaagatcaggtggagaaaagaaatggactggttgctgtctcctacaacttatatggtggagttggttccaacgaagcaaagcggggcagatggatgcacatttgagattatgactccaaaggcccgctcagatgttcatgtgaaccttcctgcccttcagaagcttgatgcgatgctcattgaagtgatggactctatgatagatacagagttctggtatgaggagagtggtagcagagctgatggtcggggcaaaattacaggtccaaggaagagtaaaaagtggtggctcccatctcctcgtgtccctgaggaagggctatctcaatttcagcgaaaaaggcttgtttttcaggctaagcttgttcatcagatcctcaaagctgcaaaatccatcaacgaacaagtcctattccatatgcctattccggcagctgttatggatgcccttcctaaggcaatctgggagagctagcttgggggaagatttgtatcaggctataaccacacagtatattcctatagaggaaatatttgtttcgctcagtttgaaaactgagcatagtgtgctcgagactattaaccggttggagggtgcagtgtttgcatggaaccaaagaattctagaggaaagaagcaagaggtccccaggacgccattcctggagcttcatgaaggatagctcatcagaacttgacaagatgtctgcatgcatcgaaagggttgacacacttgtgcagcttctgaaatccagatatccgaacctgcctccaacttttatagatgttttaaaggtccaatacaatgtggacgtggggcatgcaattgtggaggcctactctagggttcttgttggggtagcattcagcatactgtcacgtgtagccgagatactgctggaggatgacttgatcaagaagcccaacacccccatggccacactgaagttcgacctctcctcggacgtgtacttggcaggtatcacagagacgccaccgggacacatccgacggtcccttatggaccagatcagcatggttgacgggcgctttgatgctgttgtcaagaagaaaggggtgaaacagctgaggtggtgaggccacagttagctgttgtgaatcttttggccatgtacagggtgatgcagggcccagtgtccgctccacaaggttaccttaccttagctatagtgcagtgtaatgtatttggcgacgagtttatagcgtactgtaagagcagcattaggtgaaaatcctgcctgtcgaagtgtccggatgttgctgttgcgtctgaacaatctgatgctcttgatcagcctctgctgcatttcttgctggcacctgatgatggcatgttgatgacgagaccttgcttgagtgcgtgcttgacgggttcgtgctgacgcgtcttccgttctggaagccgtccgcgttgttggggcgtgtgggcctgtggattattatgaatggcgggaccgtgtca

SEQ ID NO: 1628 - DNA, 2334 bp, Zea mays
cacgtcctgctccgtccgaatcgctactccgccgcgcttctcatcaccgtcaagagatagtcagacagttccagccccctttccacacgcacactcctctcccttcctctcctccgcttccatccctgggctgtgcgctactactccccctgctggccgctgctctgctctcacgcatgttttcacatccaagcgcctgcccctcgccctcgccgccacagtggtaacccgatccatgccgggcggcggccgctgacttgctgctgttggcttcaacggccgcaggcaaagttactgctggtagcgctagcgcggcgcggcggcggcggcgtaggaggaggggtcggcggcggagatgaggatgaagacgctggcgtgctgccggcggcggcctcaagacttcagcatcgatatggaccaagagcccgacagggtggtgacatataatggcctcgagacctgcattatcaacagttccacctatgacgatgacagtggcatcagtgcaacaacaggcggagatggctgtatcaccactgattcccttgatgatgaagtctctagttgctctagtaaagatgcttctggttcttccttcacttcacacagtcttagcaagcaggaggagcattcactagatgagttgggtacacccatggcaattcatctactccctttcaaagggaagaaaacaatcacatataccttgagtgcttcagatattgaaaacatgaaggaaaaatttgcaaaactattgcttggtgatgatacttcaggaggagctaggggcgtttgtgtggctctggccttgtctaatggcataatcaatctctctgcaactgtctttggagaactctggaagctggaaccactgtgcgaagataaaaagatcaggtggagaaaagaaatggactggttgctgtctcctacaacttatatggttgagctggttccaacaaagcaaagcggagcagatggatgtacatttgagattatgactccaaaggcccgctcagatgtccatgtgaaccttcctgcccttcagaagcttgacatgatgctcattgaagtaatggactcaatgatagatacagaattctggtatgaggagagtggcagcagagctgatggtcgggggaaaattacaggtccaaggaagagtaaaaagtggtggctcccgtctcctcgtgtccctgagcaagggctatctcaattccagcggaaaaggcttgtttttcaggctaagcttgttcaccagatcctcaaagccgcaaaatccatcaacgaacaagtcctgtcccatatgcctattccggccgctgtcatggatgcccttccgaagtctgggagggctagcttgggtgaagatttgtatcaggctataaccacagattatattcctgtagaggaaatatttgtttcgctcagtttgaaaaccgagcatagtgtgctcgagactattaaccggttggagggcgccgtgtttgcatggaaccaaagaattctggaggaaagaagcaagaggtccccaggacgccattcctggagcttcatgaaggatagctcgtcggaagttgacaagatgtccgcatgcatcgaaagggttgacgctctcgtgcagcttctgaaatccagatatcccaacctgcccccgacttttatagatgttttaaaggtccaatacaacgtggacgtgggccatgcaatcgtggaggcctacgctagggttcttgttggggtagcgttcagcatattgtcgcgcgtggcggagatactgctggaggatgacctgatcaagaagccgaacacccccatgaccacgctgaagttcgacctctcctctgacgtgtacttggccggcatcaccgagacgccaccgggacacatccggcggtccctgatggaccagatcagcatggtggacgggcgctacgatgccgttgttggcaagaagaaagaagtgaagcagctgaggtggtgagggcagtcagcagctgttgtgtgaatcttttgccgatgtacagggtgatgcggggcccagtgtccgctccacaaggttacctttagcaaatagcgcgatgtaatgtatttttgcgacgagtttatagcgtactgtactgtaagatcagcattaggcgagtcctgcctgtcgaagtctccgggtgttgctgttgcgtctgaacgatctgacgatgctcttggtcagcctctgctgcttttcttgctggcaccttgatgatgatagcatgtcgatgacgagaccttgcttgagtgcttgacgggttcatgctgacgcgtcttccgttctcgaagcgcggtccgtgtttctggggc

SEQ ID NO: 1629 - DNA, 1641 bp, Pennisetum glaucum
ggagcatttacttgagcaacttgagacttcagcatcgacatggaccaggagcccgacagggtgatgacgtataatggcctcgagacctgcatcatcaatagttctgcctatgacgatgatagtggcattagtgcaacaacaggtggtgatggctgtgttaccactgattcgcttgatgatgaagtctcaagttgctctagtaaagatgtttcgggttcttccttctcttcccactgccttaccaagcaggaggagcatttacttgatgagttgggtacacccatcgcaattcacctacttcctttcaaagggaagaaaccaatcacctataccttgagtgcttcagatattgaaaacatgaaagaaaaatttgcaaagctattactcggtgatgatacttcaggaggagctaggggcgtttgtacggctctggccttgtccaatggcataatcaatctctcagcaactgttttggagagctttggaagcttgaaccattgtgtgaagagaaaaagatcaggtggagaaaagaaatggactggttgctgtctcctacaacttatatggtggagctggttccgacgaagcaaagtggggctgacgggtgcacatttgagattatgactccaaaggcccgttcagatgttcacgtgaaccttcccgctcttcagaagcttgatgcaatgctcattgaagtgatggactccatgatagatacagagttctggtacgaggagagcggtagtagagctgatggcgggaaaagttctggcccaaggaagagtaaaaagtggtggctcccgtctcctcgtgtccctgagcaagggctatctcaattgcagcgaaaaaggcttgttttccaggctaagcttgttcatcagatcctcaaagctgcaaaatccatcaatgaacaagtcctattccatatgcctattcctgcagctgttatggatgccctcccaaagtctgggagaactagcttgggtgaagatttgtatcaagctataaccacggagtatattcctatagaggaaatcttcatttcgctcagtttaaaaactgagcatagcgtgcttgagacaataaaccggttggagggcgcggtgtttgcatggaacgaaaggatttcagaggaaaagagcaagaggtccccaggacgtcattcctggaagttcatgaaggatggttcgtcagaactcgacaagatgtctgtgtgcatcgaaagagtggacactcttgtgcagcttctgaaatccagatttcccaaccttcctccaacttttatagatgttttaaaggtccaatacaacatggacgtggggcacgccattgtggaggcctactctagggctcttgtcggggtggcattcagcatactgtcccgggtggcggagatactgctggaggacgacttgatcaagaagcccaacacccccatggcgaccctcaagttcgacctctcctccgatgtgtacctggcgggcatcacggagacgccgccgggccacatccggcgctccctcatggaccagatcagcatggtcgacgggcgcttcgacgccgtcgtcgccaagaagaaaggggtgaagcagctgaggtggtgagtgaggaggactcagagacaggacgcatgcggtccgg

SEQ ID NO: 1630 - DNA, 1945 bp, Panicum virgatum
  misc_feature (437)..(437): n is a, c, g, or t
  misc_feature (443)..(443): n is a, c, g, or t
  misc_feature (476)..(476): n is a, c, g, or t
  misc_feature (494)..(494): n is a, c, g, or t
  misc_feature (563)..(563): n is a, c, g, or t
  misc_feature (566)..(566): n is a, c, g, or t
  misc_feature (575)..(575): n is a, c, g, or t
  misc_feature (577)..(577): n is a, c, g, or t
  misc_feature (638)..(638): n is a, c, g, or t
  misc_feature (641)..(641): n is a, c, g, or t
  misc_feature (698)..(698): n is a, c, g, or t
  misc_feature (1104)..(1104): n is a, c, g, or t
  misc_feature (1107)..(1107): n is a, c, g, or t
  misc_feature (1156)..(1156): n is a, c, g, or t
  misc_feature (1199)..(1199): n is a, c, g, or t
  misc_feature (1209)..(1209): n is a, c, g, or t
  misc_feature (1291)..(1291): n is a, c, g, or t
  misc_feature (1307)..(1307): n is a, c, g, or t
  misc_feature (1326)..(1326): n is a, c, g, or t
  misc_feature (1341)..(1341): n is a, c, g, or t
  misc_feature (1347)..(1347): n is a, c, g, or t
aggacttcagcatcgacatggaccaggagcccgacagggtgatgacatataatggcctcgagacctgcattatcaatagttcagcctatgatgatgatagtggcgttagtgcaacaacaggtggagatggctgtgtcaccaatgattcccttgatgatgaagtctcaagttgctctagtaaagatgcttccggttcttccttctcttcaaactgccttagcaagcaggaggagcattcgcttgatgagttgggtacacccatcgcagttcatctactccctttcaaagggaaggaaccaatcacatacacgttgagtgcttcagatattgaaaacatgaaggaaaaatttgcaaagctattgctcggtgatgatacttcaggaggagcgaggggcgtttgtactgctctggccttgtccaatggcataatcaatctntcagcnactgtttttggagaactttggaagctggaaccnttgtgtgaagagaaaaanatcagatggagaaaagaaatggactggttgctgtctcctacaacttacatggtggagctggttccgacnaancaaagtggngnagatggatgcacatttgagattatgactccaaaggcccgttcagatgttcatgtgaacctnccngctcttcagaagcttgatgcgatgctcattgaagtgatggactcaatgatagatacngagttctggtatgaggagagtggtagtagagctgatgggcgggggaaaattactggtctaaggaagagtaaaaagtggtggcttccatctcctcgtgtccctgagcaagggctgtctcaattccagcgaaaaaggcttgtttttcaggctaagcttgttcaccagatcctcaaagctgaaaatcatcaacgaacaagtcctattccatatgcctattcctgcagctgttatggatgccctcccaaagtctgggagagctagcttgggcgaagatttgtatcaagctataaccacggagtatattcctatagaggaaatctttgtttcgctcagtttgaaaacggagcacagcgtgcttgagactataaaccggttggagggtgcagtgtttgcatggaaccaaagnatnttagaggaaaaaagcaagaggtcaccaggacggcattcctggaacttcntgaaggacagttcctcagaactcgacaagatgtctgcgtgcancgaaagggcngacactcttgtgcagcttctgaaatccagatttcccaacctgcctccaacgtttatagatgttttgaaggtccaatacaacntggacgtggggcatgncattgtggaggcctactcnagggtccttgtcggngtcgcnttcagcatactgtcccgggtggcggagatactgctggaggacgacctggtgaagaagcccaacaccccgatggcgacgctgaagttcgacctctcctccgacgtgtacctggcgggcatcacggagacgccgccgggccacatccggcggtccctcatggaccagatccgcatggtcgacggccgccttgacgccgccgtcgtcaagaagaaaggggcaaagcagctgcggtggtgagggcgcgggcgccgccgggccggccgttgtgaatcttttggcgatgtgtacagggtggcgatgcggggcccagttgtccgctccacaagagtttgtttaccttactactagtactaatagcgtactccgggttatagtgtgttcgacgtgtttggcgactgatgatgagtttatagtgcactgtgtaagagcagcgttggccaaatgtcgcggtttccgggtgtgttgctgttgcgtttggtttggtttggacaaatgtggcgcccttgccgtcagccctgtgcgttccttgccccttgctggcaccaccagatgattaacctgttggaagggggagagctagaggtctcgctggactgca

SEQ ID NO: 1631 - DNA, 2547 bp, Zea mays
ctctctctctctctctctctctctctctctctctctctctctctctctctctctctctcgctctctctctctcgctctctctctctctctctctctctctcccccccccccgggctaagtccatttggcttctcctccgtgtcggacgcccgctggtcgctgactcgtgttgctgttggggcggcgtcgacgctgcaaagctgtttgcggtccggcgaccggcctgcttctcattcgaacccaatcaaatgctgatgctacggtggggtttcgtctcctcctgtctttttcagttattgctgctggcattgcggcgcggtaagaggagaggagcgaggagggatcggcggagaatgaagatgaaggcgctggcgtgctgccggcggcggccccaggacttgagcatcgacatggaccaagagcccgacagggtgatgacatataatggcctggagacctgcattatcaactgttccgcctatgacgatgatagtggcatcagtgcaacaacatgcggagatggctgtgtcaccgctgattcccttgatgatgaagtctctagctgctttagtaaagatgcttctggttcttccttctcttcacactgccttagcaagcaggaggagcattcgctagatgagttgggtacacccatcgcaattcatctactccctttcaaagcgaagaaaccaatcacatataccttgagtgcttcagatattgaaaacatgaagaaaaaatttgcgaagcttttgctcggttatgatacttcaggaggcgctaggggcgtttgtgcggctctggccttgtctaatggcataatcaatctctctgctactgtttttggagaactctggaagctggaaccattgtgcgaagataaaaagatcaggtggagaaaagaaatggactggttgatgtctcctacaacttatatagtggagctggttccaaggaaacaaagcggagcagatggatgcacatttgagattatgactccaaaggcccgctcagatgttcatgtgaaccttcctgcccttcagaagcttgatacgatgctcattgaagtaatggactctatgatagatacagagttctggtatgaggagagtggtagcagagctgatggtccggtgaaaattaccggcccaaggaagagtaaaaagtggtggctcccatctcctcgtgtccctgagcaagggctatctcgatttcagcggaaaaggcttgtttttcaggctaagcttgttcaccagatcctcaaagccgcaaaatccatcaacgaacaagtcctgttccacatgcctattccggcagctgttatggatgcccttccaaagtctgggagagctagcttgggtgaagatttgtaccaggctataacgaccgagtatattcccatagaggaaatatttgtttccctcagtttgaaaactgagcatagtgtgctcgagactatgaaccagttggagggggcaatgtttgcatggaaccaaagaatcttagaggagcgaagcaagaggtcaccgggacgtcattcctggagcttcatgaaggacagctcgtcagaactcgacaagatgtctgcatgcatcgaaagggtcgacacccttgtgcagcttctgaaagccagatatccgaacctgcctccaacttttatagatgttctaaaggtccagtacaatgtggatgtggggaatgcaatcgtggaggcatactctagggttcttgtcggggtagcattcagcatactgtcgcgcgtggcggagatactgctggaggatgacctggtcaagaggcccaacacccccatggcctcactgaagttcgacctctcctccgacgtgtacttggccggcataacagagacgccgccgggacacgtccggaggtcccttatggatcagatcagcatggtcgacgggcgcttcaacgctgctgtgaagaagaaaggagcgaagcagctgaggtggtgaggacagtcggctgttgtgtgaaatcttttggccatgtacagggtgggtgatgcagagcccagtgtccgctccacaaggacacaaggcaaggttaccatagcaatagcgccagtgtaatgtatttggcaacgagtttatagcttactgtaagagcaagcattaggcgaatcctgcctgtcgaagtctccggatgttgctgttccgtctgaacatctgatgctcttggtcagcctctgctgcatttcttgctggcacctgatgatagcatgtctatggcgagggaccttgcttgagtgcttgacgggttcatgctgacgcgtcttccgctctggaagcagtccgcgtgtggacgcttgtggaattgagactttagagaagagaacgaattccgaagtcagattgggagccagtcgggtgcaaaagggaaggaaatgcactcggcccaacaaatcttccccgcacggtcattcggtcagcgatcctctagttgtatccttgatttttcagatttctgtcatcaatgtcactattatagaatctacggcatacatatttttaggttttttttcac

SEQ ID NO: 1632 - DNA, 2577 bp, Oryza sativa
cgatgccaccaccacgagccgttgctgcagcggcacagtattttatccgaatccacatgcattcctcctcttcctctacttttcctgactttcctcctcactctcctctgccacttcgcttgcgttctgttcttcatctcctcctcctcggtgccgcatttattactcgacagagtcagacagttcgagcttccatttcacacacactccaccggctcccccttcttctgcccccttgcatttcaccaacgcttacctgctccatacgacctccagtgcagtgcagtgcctctgaggtctctctctctctctcacacacacacacgtcctctggtcaccgacgctcctcctactactagtacagtgtgatcgagcccctcctcacttaccttcgccgaagatccatggcggaggactaagctccggctgctgatttcttcgctttggacgcccgcaaaagttactgctgctactgccggtaccggctgccgaggaggggaatgaggatgaagacgctggcgtgctgccggcggcggccgcaggacttcagcatcgacatggaccaggagcctgacagggtgatgacgtacaatggccttgagagctgtattatcaacagttcctcttatgacgatgatagtggccttagtgcaacaacgggagcagatgggtgtgtaaccactgattccgttgatgatgaagtctcaagttgctcctcaagtaaagatgtttctagctcttcgttctcttcacaatgccatccactgagaaagcaagaggagcattcactttacgagttggatacactcagtgctgtccatctacttcctctcaaagggaagaagccaatcacgtataccttgagtgcttcagacattgaaaccatgaaggagaagtttgggaagctactgcttggtgatgatgcttcaggaggagctagaggtgtttgtgctgctctggctttgtccaatgccattattaatctctcagccactatatttggagaactctggaagctggaaccactctgtgaagagaaaaaagtcaggtggcggaaggaaatggactggttgctttctcctacaacctacatggttgagctggttcctacaaaacaaaatggagcagacgggtgcacgtttgagattatgaccccgaaagcacgttcagatgttaatgtgaaccttcctgcccttcagaagcttgattccatgctaattgaagtgctggactcgatggtagacacagagtattggtatgtggagagtggtagccgagctaatggccggggcaaaaagaatggtctgaggcagacgaagaagtggtggctcccatcacctcgtgtgccagatatagggttgtctcaatttcagagaaataggcttgtttttcaggctaagctggttcatcaaatcctcaaagctgcgatgtcaatcaatgaagaagtcctgcttcagatacctattcctccagctgtcacggatgctcttcctaagtctggcagagctggcttgggtgaagacttgtaccatgctataaccacagagtacattcccatagaggaaattttcctctctcttagtttaaaaacggagcataccgtgctcgagactatgaaccggttggagggtgcagtttttgcatggaatcaaaggatctcagaggaaaagagcaagaaatccccaggaaggcattcctggaatttcatgaaggatagttcatcagaactcgataagatgtccatgtgcatagaaagggttgaaacacttatgcagcttctgaaatccagattcccgagccttcctccaacttttatagaagttgtaaagatccaatacaatgtggacgtggggcatgccattgtggaggcctactcaagggttcttgttggggtggcattcagcatactgtccagggtagcagagattctgctggaagatgacctgatcaagaagcccaacacccctctggccacactcaagttcgacctctcctccgacgtgtacctcgccggcatcaccgagacgccgccgggccacatccggcggtcgctgatggaccagatcagcctggtcgacggcagcctcgacgcggtcgtcaggaagaagggggtgaagcagcttaggtggtgaaaaaggacatgaagctgtgaagtttttctttttggcagttgtacagggtttgtgatgatgatgcatgctgtgctgcgcgctggctggctacataaagttggttaagttcaccttgctaatacgtcctgtatggaacgggctaaatagtgtatgcatggtaaaagctactagcattggccgcatcgtacatcaacgtttgcagcgatcaaagcgtgctgttgcggtgcattggaccgtagcctgtggttgactgctggatggcacggcttgggtgtgtgtgcgacgagcagggtttatcaaactgtttgggaataagttcaccggaggtccttaacttaacagattttgagatcccttaaccacaaactagaaatgtgtatctctaaactcacacaaaccattcatttaaggtcctatgataatatatatggatggtttcgctgac

SEQ ID NO: 1633 - DNA, 2390 bp, Oryza sativa
tgactttcctcctcactctcctctgccacttcgcttgcgttctgttcttcatctcctcctcctcggtgccgcatttattactcgacagagtcagacagttcgagcttccatttcacacacactccaccggctcccccttcttctgcccccttgcatttcaccaacgcttacctgctccatacgacctccagtgcagtgcagtgcctctgaggtctctctctctctctcacacacacacacgtcctctggtcaccgacgctcctcctactactagtacagtgtgatcgagcccctcctcacttaccttcgccgaagatccatggcggaggactaagctccggctgctgatttcttcgctttggacgcccgcaaaagttactgctgctactgccggtaccggctgccgaggaggggaatgaggatgaagacgctggcgtgctgccggcggcggccgcaggacttcagcatcgacatggaccaggagcctgacagggtgatgacgtacaatggccttgagagctgtattatcaacagttcctcttatgacgatgatagtggccttagtgcaacaacgggagcagatgggtgtgtaaccactgattccgttgatgatgaagtctcaagttgctcctcaagtaaagatgtttctagctcttcgttctcttcacaatgccatccactgagaaagcaagaggagcattcactttacgagttggatacactcagtgctgtccatctacttcctctcaaagggaagaagccaatcacgtataccttgagtgcttcagacattgaaaccatgaaggagaagtttgggaagctactgcttggtgatgatgcttcaggaggagctagaggtgtttgtgctgctctggctttgtccaatgccattattaatctctcagccactatatttggagaactctggaagctggaaccactctgtgaagagaaaaaagtcaggtggcggaaggaaatggactggttgctttctcctacaacctacatggttgagctggttcctacaaaacaaaatggagcagacgggtgcacgtttgagattatgaccccgaaagcacgttcagatgttaatgtgaaccttcctgcccttcagaagcttgattccatgctaattgaagtgctggactcgatggtagacacagagtattggtatgtggagagtggtagccgagctaatggccggggcaaaaagaatggtctgaggcagacgaagaagtggtggctcccatcacctcgtgtgccagatatagggttgtctcaatttcagagaaataggcttgtttttcaggctaagctggttcatcaaatcctcaaagctgcgatgtcaatcaatgaagaagtcctgcttcagatacctattcctccagctgtcacggatgctcttcctaagtctggcagagctggcttgggtgaagacttgtaccatgctataaccacagagtacattcccatagaggaaattttcctctctcttagtttaaaaacggagcataccgtgctcgagactatgaaccggttggagggtgcagtttttgcatggaatcaaaggatctcagaggaaaagagcaagaaatccccaggaaggcattcctggaatttcatgaaggatagttcatcagaactcgataagatgtccatgtgcatagaaagggttgaaacacttatgcagcttctgaaatccagattcccgagccttcctccaacttttatagaagttgtaaagatccaatacaatgtggacgtggggcatgccattgtggaggcctactcaagggttcttgttggggtggcattcagcatactgtccagggtagcagagattctgctggaagatgacctgatcaagaagcccaacacccctctggccacactcaagttcgacctctcctccgacgtgtacctcgccggcatcaccgagacgccgccgggccacatccggcggtcgctgatggaccagatcagcctggtcgacggcagcctcgacgcggtcgtcaggaagaagggggtgaagcagcttaggtggtgaaaaaggacatgaagctgtgaagtttttctttttggcagttgtacagggtttgtgatgatgatgcatgctgtgctgcgcgctggctggctacataaagttggttaagttcaccttgctaatacgtcctgtatggaacgggctaaatagtgtatgcatggtaaaagctactagcattggccgcatcgtacatcaacgtttgcagcgatcaaagcgtgctgttgcggtgcattggaccgtagcctgtggttgactgctggatggcacggcttgggtgtgtgtgcgacgagcagggtttatcaaactgtttgggaataagttcaccggaggtccttaacttaacaga

SEQ ID NO: 1634 - DNA, 2728 bp, Secale cereale
gactgtggtagtggtatatttcatccggcacctgcacgctcacatgcttggcttccaggtttctgttctcttctcccttcccgcagcatttattatctatcgcaacatacatagtcagacacacacagagtaccactaccagcagcccccccttcgcaccgagagacacgcacgctcgctcttctccacttcttcgccgccgtgcctcccccctctcctcacgctcgaggccggcctcctccctctattcggaccactgttgtttccctgccgcagatccatgccggagcgctccggccgctgacttcctggctcccaacgccgccgccatcgccaaggttcgtcttccactgatcgtgcgggcctgtcggtgagggggggagatgaggatgaagacgctggcgtgctgccgccggcggccgcaggacttcagcatcgacatggaccaagagcctgaaaaggtgacgacatacaatggcctcgagagctgcattttcaacagttcctcgtatgacgaggatagtggcgttagcgcaacaacaggggcggatggctgcgtcaccgctgactcccttgaagatgaagcttcaagttgctcctccagcaaagacgttgatggctcttccttctcttcccaatgccttccgttgagcaagcaggaggagcattcactttatgagttggatacgctcgatgccatccatctactccctgtcaaagggaagaacccaatcacttatacgttgagtgctgccgatattgaaaccatgaaggagaagtttgcaaaattactgctcggtgatgatgtttctggaggtgccagaggagtttgcgctgctctggccttgtccaacggcataaccaatctctcagccactatttttggagagctgtggaagttggaaccactgtgtgaggaaaaaaagatcaggtggcggaaggaaatggactggttgctttctcctacgacctacatggtcgagctggtacccacaaagcaaaatggagcagatgggtgcatgtttgagattatgaccccgaaggcccgttcagatgttcatgtgaaccttcctgctctacagaagcttgattccatgctaattgaaattctggactcaatggtggacacagagtattggtacgtggagagtggtagccgatcaggtggccggagcaaaaccaacggtgaaaggcagaccaaaaagtggtggcttccatccccttgtgtccctgaacaagggctatctcagttccagagaaaaaggattgtgtttcaggctaaacttgttcatcaaatcctcaaagctgccaagtctatcaacgaacaggtcctgcttcagatccctattcccatggctgtcatggacgcccttccaaagtctggcagatctagcttgggggaagacctgtaccatgccataaccacggactatattcctatcgaagagatctttgtttctctgagtctaaaaaccgagcatagcgtgctggagaccatgaaccgtttggaaggcgcgctgtttgcatggaaccaaaggatctcagaggagagaagcaggaggtcccctgcacggcattcgtggaagttcatgaaggacagctcgtcggagctggagaagatgtcggcgtgcatcgaaagggtcgagaccctcatccagcttctgaagtgcagattccccaacctgcctccaacgttcatcgacgtcgtgaaggtccagtataacgaggacgtggggcacgccatcgtggaggcctactccagggtcctggtcggggtggcgttcagcatcctgtcccgggtggcggagatcatgctggaggacgacctgatcaagaagcccaacacgcccatggccaccctcaagttcgacctctcctccgacgtgtacctggcgggcatcaccgagacgccgccgggccacatccggcggtccctcatggaccagatcagcatggtcgacggccgcttcgacgccgtcgtcaagaagaaaggggccaagcagctcatgtggtgatgcgtgcgggcggggggggcggtgttgtacagggcgatgatggctgcgtgccggctgcgtacacaagttgcatttaccttgctactaatagtgcatttgtaatttggatgtaacagcagcattggccgagtcttgctgaattgtgctgacggcaacccagatgctgctgctgcttttgcgacggagcgaaacctgttgtgtcttggtcaggttcgtgtgcttggttggttgtagacttgtacctgacgatgcctgcctgtctgatgatgatgatgggtggaccgtggatgtgtacaagattggccctgcttgacgggctcacgacgacggacgcgtctccggttgtgggattggatgtgtgggtgtggccggtgtccgggcggaatggaacgtgtgaaatctgaagccgggctgacttggggttggagttttcggattgactggtcctatcgattcgccgggccgtgatctgaagcttcaagcgagagattgccgtggtgaccacgtaattctgtgagcacgtggttaatcgaagctggccatgttcagctgtgcaacaaccagatgcaaccggaactacagtgccgttgtccatcgcttgcccgtgttgacaaggcaataaatggtctggccgcgtccttttggagtaaagaaacacggcccaacgcgtggaagcaaacgcacaaatgtccattttcagtcaaaaaaaaaaa

SEQ ID NO: 1635 - DNA, 1911 bp, Hordeum vulgare
ggagcccgcctccttcttctcttgctgttcgccggtcgcctcgcctccaatcgccgccgcgttcgggttccactgattgtgcgggtggcgggcgcctgtcggggaggaggaagatgaggatgaagacgctggcgtgctgccggcggcggccgcaggatttcagcgtcgacatggaccaagagccggaaaaggtgacgacatacaatggcctcgagagctgcattttcaatagttcctcatatgacgaggagagtggtgttagcgcaacgacaggggcggatggctgtgtcaccgcagactcccttgaagatgaagtttcaagttgctcctccagcaaagatgttgatggttcttccttctcttcccaatgccttccattgagcaagcaggaggagcattcgctttatgagttggatacactcgatgctatccatctactccctgtcaaagggaagaatccgatcacatatacgctgagtgctgctgatattgaaaccatgaaggagaagtttgcaaagctactgcttggcgatgacgtttctggaggtgccaggggagtatgcgctgctctggccttgtccaatggcataaccaatctctcagccactatttttggagagctgtggaagttggaaccactgtgtgaggaaaaaaagatcaggtggcggaaggaaatggactggttgctttctccgacgacttacatggtcgagctggtacccacaaagcaaaacggagcagatgggtgcatgtttgagattatgaccccgaaggcccgttcagatgttcatgtgaaccttcctgctctacagaagcttgattccatgctaattgaagttctggactcgatggtggacacagagtattggtacgtggagagtggtagccgatcaggtggccggggcaaaaataatggtcaaagacagaccaaaaagtggtggctcccatccccttgtgtccctgaacaagggctatctcagttccagagaaaaaggattgtgtttcaggctaaacttgttcatcaaatcctcaaagctgcaaagtctatcaacgaacaagtcctgcatcagatccctattcccatggctgttatggacgcccttccaaagtctggcagatctagcttgggtgaagacctgtaccatgctataacgacagactatattcctatcgaagaaatctttgtttctctgagtctaaaaaccgagcatagcgtgctcgagaccatgaaccggttagaaggcgcgctttttgcgtggaaccaaaggatctcggaggagaaatgcaagaggtctccaggccggcattcctggaacttcatgaaggacaactcgtcggagctggagaagatgtcggcgtgcatcgaaagggtcgagaccctcatccagcttctgaaatccagattccccaatctgcctccaacgttcatagacgtggtgaaggtccagtacaacgaggacgtggggcacggcatcgtggaggcctactcgagggtgctcgtcggggtggcgttcagcatcctgtcccgggtggcggagatcatgctggaggacgacctgatcaagaagcccaacacgcccatggccaccctcaagttcgacctctcctccgacgtgtacctggagggcatcaccgagacgccgccgggccacatccggcggtccctcatggaccagatcagcatggtcgacggccgcttcgacgccgtcgtcaagaagagaggggccaagcagctcatgtggtgatgcggggtgtggtggcgctgtacagggtgatggggccggctgcgtacacaagttgcatttaccttttactactaatggtgcatctgtaatttgtacgtatgtaacggcagcattggccgagtcttgctgaatgctgatggcaacccagatgctgctgcttttgcaa

SEQ ID NO: 1636 - DNA, 2275 bp, Brachypodium distachyon
ttcctggttttgtttctctccctctttgctctcgccttttctgatcttcttccttcatgcagcatttattatacttgacatagtcagacagcaccagcagccccattcacacgcacacacagagaccaagcacactctcttcttctcccttcctggcgtctctgcctcctctggtctcccgtcctcacatctcgtcagtcttcagttcttcacgctcaagtgcctcctcgcatactgtagtgctgatccataccggagtgctccagccgctgatttcttcgccccgacgccgcaaatttcaggtcctactttctactgctcgtgccggtggcgcgtgcttgtcggcgatgagaatgaagacgctggcttgctgccgacggcggccgcaggacttcagcatcgacatggatcaagagccagacagggtgactacatacaatggcctcgagagatgcattttcaacagttcctcctatgatgaggatagtggcattagtgcaacaactggggtagatggatgtgtcaccactgattcccttgatgatgaagtttcaagttgctcctccagcaaagatgttgatgggtcttccttctcttcacaatacatttcatcgagcaagcaggaggagcattcagtttatgggttggatacacttgacactgtccatcaactacctgtcaaagggaagaatccaatcagatatacattgagtgcttcagatattgaaaccatgaaggagaaatttgcaaagctgctgctcggtgatgacatttcgggaggtgcgaggggtgtttgtgctgctctggccttgtccaatgggataaccaatctctcagccactatttttggagagctgtggaagctggaaccactgtgtgaggagaaaaagatcaggtggcggaaggaaatggactggttactttctcccacaacttacatggtcgagctggttccgacaaagcaaaatggagcagatgggtgcatatttgagattatgactccaaaggcccgttcagatgttcatgtgaaccttcctgctctgcagaagcttgattctatgctcattgaagttctggactcaatggtggacacagagtattggtacgtggagagtggtagccgagctggtgaccggggcaaaaataatggtccaagacagaccaaaaagtggtggctcccatccccttgtgtccctgaacaagggttatctcaatttcagagaaaaagaataatatttcaggctaaacttgtccatcaaatcctcaaagctgcaaagtcaatcaatgagcaggtcctgcttcagatacctattcccacagctgttatgggcgcccttcctaagtctggcagagctagcttgggtgaagacttgtaccatgctataaccaccgactatattcctatagaagatatcttcatttctctcagtttaaaaactgagcatagtgtgcttgagactatgaaccggttagaaggtgcattgtttgcatggaatcaaaggatctcagaggaaagaagcaagaaatccccagggcgtcattcctggaatttcatgaaggacagttcatcagaagtagagaagatgactgcatgtatagaaagggttgaaactctcatgcagcttctgaaatccagatttcccaacctgcctccaacatttacagatgttgtgaaggtccagtataacgaggacgttgggcatgccattgtggaggcatactccagggttcttgttggggtctcattcagcatactgtcaaggatagcagaggtcatgcttgaggacgacctgatcaagaagcccaacacacccatggccaccctgaagtttgacctgtcgtccgacgtatacctggcggggatcaccgagacgccgccaggccacatccgacggtcactcatggaccagatcagcatggtcgacggtcgcttcgatacggtcgtcaagaagaagggggctaagcagctgatgtggtgaaagatagaccatgtgaagtgaagctcttggcagtggtcgtagggctgttgtacagggtgatgcgagggggactgcgtcccggctacatacagaagttcttttaccttgctaatattagtgcactgcgttttgggtgaaccggttgtacggatagccaatagtatcatagtatagcacctgtggtgtaactgcagcattcgtcgattcatgccaatggcaacccaaatgctgcaattgcatctaagcaacctggtgaaaatcttgataagctatgttgcagaattcgtacgtcactg

SEQ ID NO: 1637 - DNA, 2345 bp, Brachypodium distachyon
tggacgagtacatattttatccggcacctgcacgctcacatgcttggcttcctggttttgtttctctccctctttgctctcgccttttctgatcttcttccttcatgcagcatttattatacttgacatagtcagacagcaccagcagccccattcacacgcacacacagagaccaagcacactctcttcttctcccttcctggcgtctctgcctcctctggtctcccgtcctcacatctcgtcagtcttcagttcttcacgctcaagtgcctcctcgcatactgtagtgctgatccataccggagtgctccagccgctgatttcttcgccccgacgccgcaaatttcaggtcctactttctactgctcgtgccggtggcgcgtgcttgtcggcgatgagaatgaagacgctggcttgctgccgacggcggccgcaggacttcagcatcgacatggatcaagagccagacagggtgactacatacaatggcctcgagagatgcattttcaacagttcctcctatgatgaggatagtggcattagtgcaacaactggggtagatggatgtgtcaccactgattcccttgatgatgaagtttcaagttgctcctccagcaaagatgttgatgggtcttccttctcttcacaatacatttcatcgagcaagcaggaggagcattcagtttatgggttggatacacttgacactgtccatcaactacctgtcaaagggaagaatccaatcagatatacattgagtgcttcagatattgaaaccatgaaggagaaatttgcaaagctgctgctcggtgatgacatttcgggaggtgcgaggggtgtttgtgctgctctggccttgtccaatgggataaccaatctctcagccactatttttggagagctgtggaagctggaaccactgtgtgaggagaaaaagatcaggtggcggaaggaaatggactggttactttctcccacaacttacatggtcgagctggttccgacaaagcaaaatggagcagatgggtgcatatttgagattatgactccaaaggcccgttcagatgttcatgtgaaccttcctgctctgcagaagcttgattctatgctcattgaagttctggactcaatggtggacacagagtattggtacgtggagagtggtagccgagctggtgaccggggcaaaaataatggtccaagacagaccaaaaagtggtggctcccatccccttgtgtccctgaacaagggttatctcaatttcagagaaaaagaataatatttcaggctaaacttgtccatcaaatcctcaaagctgcaaagtcaatcaatgagcaggtcctgcttcagatacctattcccacagctgttatgggcgcccttcctaagtctggcagagctagcttgggtgaagacttgtaccatgctataaccaccgactatattcctatagaagatatcttcatttctctcagtttaaaaactgagcatagtgtgcttgagactatgaaccggttagaaggtgcattgtttgcatggaatcaaaggatctcagaggaaagaagcaagaaatccccagggcgtcattcctggaatttcatgaaggacagttcatcagaagtagagaagatgactgcatgtatagaaagggttgaaactctcatgcagcttctgaaatccagatttcccaacctgcctccaacatttacagatgttgtgaaggtccagtataacgaggacgttgggcatgccattgtggaggcatactccagggttcttgttggggtctcattcagcatactgtcaaggatagcagaggtcatgcttgaggacgacctgatcaagaagcccaacacacccatggccaccctgaagtttgacctgtcgtccgacgtatacctggcggggatcaccgagacgccgccaggccacatccgacggtcactcatggaccagatcagcatggtcgacggtcgcttcgatacggtcgtcaagaagaagggggctaagcagctgatgtggtgaaagatagaccatgtgaagtgaagctcttggcagtggtcgtagggctgttgtacagggtgatgcgagggggactgcgtcccggctacatacagaagttcttttaccttgctaatattagtgcactgcgttttgggtgaaccggttgtacggatagccaatagtatcatagtatagcacctgtggtgtaactgcagcattcgtcgattcatgccaatggcaacccaaatgctgcaattgcatctaagcaacctggtgaaaatcttgataagctatgttgcagaattcgtacgtcactgaggttaaggcgttaagcagtaa

SEQ ID NO: 1638 - DNA, 1347 bp, Panicum virgatum
ccgggtagctagctgagtaccaaaaccaccagcaaacccatcgataatactttttgctctgctagcagccatggcttctactactacttgttgccttagcctgttagtgctggtagcgctggcctcggtggcgtcggcgcagctgtcgtcgacattctacgacacgtcgtgccccagggccctggccaccatcaagagcgccgtcaacgcggcggtggccaaggaggctcgcatgggggcgtccctgctcaggctgcacttccacgactgctttgtccaaggctgtgatgcgtccattctgctggcggggaacgagcagaacgatcctccgaatttaactctgagaggcttcgacgtcatcgccaacatcaaggcgcaggtggaggccatctgcaagcagaccgtctcctgcgccgacatcctcgccgtcgccgcccgcgactccgtcgtagcgctgggagggccgtcatggagtgttccgctggggagacgggactcgcccaaagctgcaagcacgagcacggtaaatcagtttctgatcccccctacagctagcctcgccgaactgattaaagggtacggcgacttgggcctcaacccaaccgacatggttgccctctcaggtgctcacacgatcgggcaggcgcattgcccgagctaccaagaccacatctacaacgacaccaacatcaaccaggcgttcgcgacctcgctccgggccagctgccccatgaccggcggcagcaacgtcatggcgccgctggacacggcgacgcccaccgcgttcgacaacgcctacttcaagaacctgctgtcccagaaggggctcctgcactcggaccaggagctcttcaacggcggcagcaccgacaacattgtgcgaaacttcgcctccagcccgtcggcgttcagcagcgccttcgtgacggccatggtgaagatgggcaacctcagcccgctgacggggacgcaggggcagatcaggacaacatgctccgccgccaactcctaggaagacgacgacgacgacgatattaattacatatgtgaaaaatacgaggaccacacgaacgaataataagctgatcgatcctgctcactacagccattatcaaatagcgcatgcatgcatgctttgtataagctgatgaaatactagcgtgccggccatctcgctttcttgatccatcaagtcttacatggaacagagagcgtgcgcgtggcgtggcatgcctacacgtgtaataacattctcttggctacaagaaggcatggaggattacgtatttacgtactacttacactcgtcttgataattgtttgtcttattattatgaaagataacca

SEQ ID NO: 1639 - DNA, 975 bp, Panicum virgatum
gcaaacccatcgataatactttttgctctgctagcagccatggcttctactactacttgttgccttagcctgttagtgctggtagcgctggcgtcggcggcgtcggcgcagctgtcgtcgacgttctacgacacgtcgtgccccagggccctggccaccatcaagagcgcggtgaacgcggcggtggccaaggaggctcgcatgggggcgtccctgctcaggctgcacttccacgactgctttgtccaaggctgtgatgcttccattctgctggcggggaacgagcagaaagatcctccgaacttaactctgagaggcttcaccgtcatcgacagcatcaaggcgcaggtggaggccatctgcaagcagaccgtctcctgcgccgacatcctcgccgtcgccgcccgcgactccgtcgtagcgcttggagggccgtcatggagtgttccgctggggagaagggactcgcccacagctgcaagcacgaccacagttttgcagtttctaatcccccctacagctagcctcggcgaactgattacagggtacggcaacttgggcctcaacccaaccgacatggttgcgctctcaggtgcgcacacgatcgggcaggcgcattgcccgagctaccaggaccacatctacaacgacaccaacatcaaccaggcgttcgcgacctcgctccgggccagctgccccatgaccggcggcgcgcgtcatggcgccgctggacacggcgacgcccaccgcgttcgacaatgcctacttcaagaacctgatggcgcagaaggggcttctgcactcggaccaggagctcttcaacggcggcagcaccgacaacattgtccggaacttcgcgtccaacccgtcggccttcagcagcgccttcgtgacggccatggtgaagatgggtaacctcagcccgctgacggggacgcaggggcagatcaggaccacatgctccgccgccaactc

SEQ ID NO: 1640 - DNA, 960 bp, Panicum virgatum
gtcttcctcctccactcgtcgaacatcacttgcgagccctcctcctgcagctccggatctggaaggccggggggaagtcgcgcgctggcagaagggaaacggcgcgattgagtcggaggagtacggggccgttgagtcgcaggccagtgagtcgcgattgaattcgggacagaggcatcgcgcagctgccactgggggaagctcgaggagaagacacacgacatggattggttgcctggagagctgtgcctcaagatcttccagctcctggatcaccagtccctcgcctccgctccccaagtttgcaggaaatggagggcgttgacctccgacgatgagctgtggcgcaagctgttcaccgacaggtgggggccggacgccgcggcgttctacgcgccggagggctccaagccctggaaggacgtcttcgtcgtgcaggaccgatgcgaccgatacggactgggtgtcaggatcatcagggaagggaaggactactacctgatctaccagggcgagatccagcggtacctgggctcgcgccaggacacggatggtgatggcggcaaggacgcgccgcggcaggacgctgacgacgacgagcagcggcagatagcgaaccggatcctgttcttcctgggggatctggaggcggcctgtgcggacgccaaacgtgtcaaggcgtgaacgcatttatcctgtgcggctctccagagcacattgccgccgccagtgtatgttgcataattgcatagctcgtgcatagttttgttctgtactacatgcatagtgcttcaccctcagtttatttgtacaaaatcatgtactcatgtgattcaccctgtgtaaagtcgagttgatcatatgctttgtttgtatgacacttttgtctatcaatgcacactcagaaccatggtgactgtcaaataagggccgcaaataataagttccaccgtttttttt

SEQ ID NO: 1641 - DNA, 841 bp, Pennisetum glaucum
ctttgcttctccttcccgcatgttctcctcctccactcatcgtccattatccatcgagctctccgccggcagctccggatctggaagatcggcggagtggcacacgctggcagaagactaggatagaagcagcgcgattgagccgtcggcggagggagaaacagagctgttgactcgccggccttggtgagaattcgattcggggcagagccatcgcgtagctgctgctaccgcggaaagctcgaggtgaagaccatggattggttgcctggagagctgtgcctcaagatcttccacctcctggatcaccagtccctcgcctccgctccacaagtttgcaggaaatggagggcgttgacctccgacgacgagctgtggcggaagctgttcagcgacaggtggggagcggacgccgcggcgttctacgcgccggcgggcaccaagtcctggaaggacgtcttcgtcgtgcaggaccggtgcgaccgatacggactgggtgtcaggatcatcagggaagggaaggactactacctgatctaccagggcgagatccagaggtacctgggctcccgccaggacacggacggtgacggcggcggcaaggacacggcgccacaggacgctgaggctgaggacaagcaacggcagatatccaaccggattatcttcttcctgggggatctggaggcggcctgcgccgacgccaaacgtgtcaaggcgtgaacgtgatctcctctacgggctgcggctgcgcccccgtccaggactccgggagcacattgccgcctgtatcatgcatagctcgtgcataatgttgtacctatactactgtatagtgctt

SEQ ID NO: 1642 - DNA, 970 bp, Sorghum bicolor
ggcaaagccgttggctgcatctaactaccggcgggggggccaacgacctttgcttgcttctccttcccgcatgttctcatcccctctctcctctccactcgtcgtccacccctcgtccctcgacctcctcttcaccttcagctccggatctggaaggccgaggagcagccgcatggtagaagacaaacagggctttcccgtctccgccgcagctctcttggtgagggcgagaattctggacggagaacccgggaaagcctcgaggagaattcagacatggatgggttgcctagagagctgtgcctcaagatcttccacctcctggatcaccagtccctcgcctctgcaccccaagtttgcaggaaatggagtgcgttgacctccgacggtgagctgtggcgcaagctgttcaacgataggtggggggcggacgccgcagcgttctacgcgccggagggcgacaagtcttggaaggacgtcttcgtcgtgcaggaccggtgcgaccgatacggactgggtgtcaggatcatcagggaagggaaggactactacctgatctaccagggcgagatccagaggtacttgggctcccgccaggacacggacacggatggcgattgcggcaaggacgcgccgcggcaggacgctggagacgagcaccggcagatatccaaccggatcctcttcttccttggggacctggagaaagcatgcgcggacgccaaacgtgtcaaggcctgaacctgaacatgtgctacccttgtgaccctgatcatcggcacattgttcagcgcttgtatgactcttgctaatctgcataactcgtgcatagtgttgctatactgcatgtatagtgcctcacattcaattcatgtaagttgaatatcatgtttacatccacctgaaattataattcaagtacagtcgattagggtgcaaatcgacatgatcgccacaagccttgtttgca

SEQ ID NO: 1643 - DNA, 958 bp, Sorghum bicolor
agggaccgcaagcggcaaagccgttggctgcatctaactaccggcgggggggccaacgacctttgcttgcttctccttcccgcatgttctcatcccctctctcctctccactcgtcgtccacccctcgtccctcgacctcctcttcaccttcagctccggatctggaaggccgaggagcagccgcatggtagaagacaaacagggctttcccgtctccgccgcagctctcttggtgagggcgagaattctggacggagaacccgggaaagcctcgaggagaattcagacatggatgggttgcctagagagctgtgcctcaagatcttccacctcctggatcaccagtccctcgcctctgcaccccaagtttgcaggaaatggagtgcgttgacctccgacggtgagctgtggcgcaagctgttcaacgataggtggggggcggacgccgcagcgttctacgcgccggagggcgacaagtcttggaaggacgtcttcgtcgtgcaggaccggtgcgaccgatacggactgggtgtcaggatcatcagggaagggaaggactactacctgatctaccagggcgagatccagaggtacttgggctcccgccaggacacggacacggatggcgattgcggcaaggacgcgccgcggcaggacgctggagacgagcaccggcagatatccaaccggatcctcttcttccttggggacctggagaaagcatgcgcggacgccaaacgtgtcaaggcctgaacctgaacatgtgctacccttgtgaccctgatcatcggcacattgttcagcgcttgtatgactcttgctaatctgcataactcgtgcatagtgttgctatactgcatgtatagtgcctcacattcaattcatgtaagttgaatatcatgtttacatccacctgaaattataattcaagtacagtcgattagggtgcaaatcgac

SEQ ID NO: 1644 - DNA, 989 bp, Saccharum officinarum
ccaaccctcgagctcttcaccatcagctccggatctggaaagccgaggagcactggcatggtagaagataaacaaagctttcgagtctccgccacagcttattggtgagtgcgagaattcgggactgagaagcgcatcgctaaaacagggaaagcctcgaggagacatcggacatggatgggttgcctagagagctgtgcctcaagatcttccacctcctggatcaccagtccctcgcctctgctccccaagtttgcaggaaatggagtgcgttgacctccgacgatgaactgtggcgcaagctgttcaacgacaggtggggagcggacgccgcagcgttctacgcgccggagagctccaagtcttggaaggacgtcttcgtcgtgcaggaccggtgcgaccgatacggactgggtgtcaggatcatcagggaagggaaggactactacctgatctaccagggcgagatccagaggtacttgggctcccgccaggacacggacacggatggcgactgcggcaagaacgcgccgcggcaggacgctggagacgagcaccggcagatatccaaccggatcctgttcttccttggggatctggagaaagcctgcgcggacgccaaacgtgtcaaggcctgaacctgaacatgtgctaccctgtgacctgatcatcaacacatttgttggacgcttgtatgactcttggtaatttgcatagctcgtgcatagtgctggtatactacatgttagtatctcaccttcaatccatgtaagttatacatgtttacatccacctgacattttaattcaaatagagtcccaaccttttgtttgcattcatttcttgcctggtaatgcgcacacaaaggactttaccggcgcccaaaatgaattacttccaaaaatggaataattggctttgttacacaaatacatatttttactgtctttcactcttctattatctatattaacctttactattataaa

SEQ ID NO: 1645 - DNA, 871 bp, Zea mays
atctaactaccggcggggccaacgaccttagcttctccttcccgcatgttctcgtcctctcctctcctctccgctcgtcgtccacccacccctcgtgctcgtctcactcttcacctccagctccggatctgaaacgccgagcaatctttcgtcgtttcgagtctcatccagagcttctcggtgagtgcgacaattgggccggagaactgggaaagcctcgaggagacatggatgggttgcccagagagctgtgcctcaagatcttccacctcctggatcaccagtccctcgcctcttctccccaagtttgcaggaaatggagggcgttgacctcggatgatgaactgtggcgcaagctgttcaacgacaggtggggagcggacgctgcagcgttctacgcgccggagggctccaagtcttggaaggacgtcttcgccgtgcaggaccggtgcgaccgatacggactgggtgtcaggatcatcagggaagggaaggactactacctgatctaccagggcgagatccagaggtacttgggctcccgccaggacacggatggcgactgcggcgaggacgcgccacggcgggacgctggagacgagcatcggcagatatccgaccggatcctgttcttcctcggggatctggagaaagcctgcgccgacgccaaacgtgttaaggcctgaacacgcgctacccttgtgcccctgatcatcatcagcacaatattccacgctgagtcttgttaatttgtgcatgtctcgtgcatagtttctcaccatcaattcatgtagttggaaatcatgctcacatcgacactgaaattataattcaagtacagtcgtttagagggtaaaactacctgatcccc

SEQ ID NO: 1646 - DNA, 3702 bp, Sorghum bicolor
atggcccccggcgggcgccggcgcgggattgccaccttcgccgctgcggcgatcgctctgatgcagatcagttctctactgttcccgatcagcgcacagcaattcagtggctcaagagttgtaccagcagaaggttactgttccatgtatggcatctgtgcgcaacgaagtgatgggaaggtcttaaactgtgcgaatgcaaccaaagctgttaagccagacactttgttttcttcaaggatccaaagtttgtgcccaacaatcactggcgatgtctgttgtactgtagatcagtttgacacattacaccaacaagtccaacaggctgttccatttcttgttggatgcccagcatgcttgaggaatttcttgaatctcttctgtgagatgtcttgttctccaaaccaaagcctcttcattaatgtgacttcagtaaagcaggtgcacttttgtctctttttttcgcagattaatagcactatgactgtcgatggcttagattactatgtaactactaactatggtgaagagctatatgactcatgcaaggatgttaagtttggcactctgaacacccgtgcaatggattttattggtgctggtgctaaaacttacaaagattggctggcatttattgggcgacaagcaaactctaatgagccagggtcaccttatttgataacatttcgatcggattttagtgattcttctggtgtgaagcctctaaattctacaatttattcttgtggcgacccttctctgggttgttcatgtggtgattgcccttcttcttctgaatgcacgggatccttgctacctcagctgaatacagaaacctcctgttcagttaaaatgggatctttaaaggccaaatgcttggacttctcactagtggttatttaccttgcgttactatgcgcttttctgctatggggtttgttacacagaacacgaggaagaactgctttcgggcaaacaagaccgttgaggaattcagataataagtcagactcgaacaaaaatggcaagagccctcataactcggttcaggtgcccgaagctgcatcctctactgtcaaaccatccaatccttctattgttcaagcttacatgtcaattttctttaggaagcatggaatttttgttgctagacaccctctccttgtgttatgtgtgtcattgcttgtccctgtcctcttatgcattggtctctttcgcttcaaggtggaaacccgaccagaaaagctttgggttagccctggaagtcaagctgctgatgagaagaattattttgacagccatctcgcaccattttataggatcgagcagcttgtgttggccacttctgcatctggtgggtccgaagctccttcaatagtaaatgacaacaatatgaaattactttttgacgttcagaaaaaggttgatgatctacgtgtaaattattctgggtctacagtagcccttgctgacatttgcttaaagccactcagtacagactgtgctactcaaagtgtcttgcagtatttccagctggatcctaaaaagtttgatgattctggaatagaccatgctaagttctgttttcagcattacacttctgaagagacatgtttgagcacttttcagtcacccattgatccaagtacaattttaggtggttttctaggaagcaattttaccgaggcttcggcatttgtaataacttatcctgtgaacaacaaggttgaaacaacaggaaaagagaacgggaaggccgtggcttgggaaagagcatttattaatcttgttaagcttgccaacccagctctcatattccagctgggctatttgaggatatgccatccctcaagaattagggaggaaatacgtccgatggtattagcgcagaacctgacattgtccttttcgtccgagagctctatccaagatgaattaaacagagaaagtacagctgatgcaattacaatagtgattagctatattgtgatgtttgcatatatatcattcacacttggagaccgtccttctcgttggctgttactatttgtttcatcgaaggtactgcttggtttgtctggtgttgttctggtgatgctttcagttttaggatcaatgggattctttagtgctattggagtgaagtccacccttattattatggaagtgattccttttcttgtgctggctaggttttcccttactttgtccatgtcaacaaacaattcggaatacctcgacttttcagaacagattaataaagccaattccacagccatatcaccatcatattttatccacattgctgttgtgactacattatgcctattttactggaaagcactggcggtctttatggatttccttctccaagtgacagcctttgtagcccttattgtatttgactttaggagggcacaggatggcagaattgattgtgtcccttgtgcgagaatcatgccaagtacaggtgctggtgatggtggcgatgagcagaggctccacttgcttgctagatatatgagggacattcatggaccaattctcagctaccgggcggtgaagttcgttgtagtcactgtatttttaggattgacatttgcaagcatagattattttgacgaccttgcaaagtacatgaaagtcggtccaccattatactttgttgtgaaggacttcaattacagctctgcatcggtgcatacgaatcaaatatgttcaatcaaccagtgtaattcgaattctcttttaaatgagatatcaagacaatcattatcccctgagaccagttacattgctaaacctgctgcttcatggcttgatgacttcctagtttggatgtcccctgaagcatttggatgctgtaggaaatttgtgaatggaaattactgccctccagatgatcagtgcttcctacactcagacttggataatgggcgtccatccacaacccaattcagagataaacttccatggtttcttgatgcacttccatcgagtgattgttctaaaggggggaaaggagcttattcaacaagtttagacctcagtggttatgaaagtggcattatacaagcgtcggcattccgaacataccatactccccttaacaagcagagtgactatgttaactcaatgagagctgcccgggacttcagttctaaaatgtccaaagatttacagatgaatattttcccatattcggtgttctatatattctttgagcaatacctaagcgtgtggaagacagctatcatgaacatatgtgtttgccttggtaccatatttgttgtttgcttcatagttaccggcagtttatgggcttcagcaatcattttaattgtgctagcgatgatagtcttggatctgatgggggtgatggccatccttggtattcagcttaatgcaattgctgttgtaaaccttgttatgtcgataggaatcgctgtcgagttctgtgttcatatcacacatgcctttatgattggcgctggggacagagaaactcgtgcaaggcaggctctatccacgatgggtgcgtctgtattcagtggaatcaccttgaccaaacttgtgggagttattgtcctccgttttgcgaaatctgaagtttttgtggtctattacttccaaatgtatttggctcttgtcatcattggattcctgcatgggcttatcttcctaccggttaggatctagata

SEQ ID NO: 1647 - DNA, 2522 bp, Panicum virgatum
ctctccgggagtgtagtggttggtgctcagggtggcctgccaatagaggcggggcggaggaggagtgttccgtttctcctccatggcctcctctcctcggctcctcgtcctgctcctcgctgtggctgtgctgcgtgtgctgcggaggcggcggacacgctgcagcaggggaagtcgctgtcggcggcggagacgctggtatccacgccggagggggtgttcgaggcgggcttcttcccgccggaccccaagcagccctcgcggctctacctcggcatctggtaccgcggcatcgcgccgaggaccgtcgtctgggtcgccaaccgcgctgcgcccgccacctcggcggcgccgtcgctcgcgctcacggacaccggcgagctccaggtcctcgacggcgcggcgtccaacgggacggccgcgccgccgctgctctggtcctccaacacctcctgggccgcgccgcgcgggggctactacgcgtccctcctggactccggcagcctccaggtgcgcagcgacgacggggcgctgtcgtgggacagcttctggcacccgacggacaccatcctgtccgggatgcagatcgccgtgcgggcgccggggccgcccggcaggggggcctccaatgagcggatgctcttcacgtcgtgggccagcgagacggacccggcgccggggcgctacgcgctcggcctcgacccggcaggctccggccaggcatacatgtggagagacggcaaagacatctattggagatcaggacaatggaatggggtgaattttattgggattccatggaggccactctacctgagtgggttctcactgtcaagtgatcgagacttaggactacactacacatacactgcaacaaacacatctctgcagaggtttgttgttctgccaaatggcacagacatctgctacatggttaagaactcaacaaaagagtgggagactgtctggcttcaaccatcaaatgtgtgcgaatactatgctgcatgtggtccaaatgcgaaatgtaccgtggggcaagatggcaaggcaaaatgcacctgcctgaaaggttttcagccgaagttgtgggaccagtggaatgcaggaaactggagtgaaggctgcaccaggaacccacctctcggttgccaggtcaaccaacctggggatggatttcttcctattggaaatataaagtggcctgatttctcatattggatgtctacagtggcggatgagacagggtgcaaaaatgcctgcttgaacaactgctcatgtggtgcctatgttcacacaactacaacagggtgtctagtctggggtgacaaactaattgacctccatgagttgccaactggggcatataccctaaacctgaagcttcctgcttctgagttacgagtacatcacgcagtttggagaatagccacgataatatctgctgtggttcttttcgttttgttagcttgccttgttctgtggtggaagcgtggcagaaatattaaagatgcagtgcatagaagttggaggtcaaggcagtcatctacctggtcccagcagaatagtgccatgctagatatctcacagtctattcgttttgatgatgaagtggaggatggaaaaagccatgaactcaaagtatactccctggaccgcataaaagctgctacaagcaattttagtgactccaacaagcttggagaaggaggatttggtcctgtctatatgggaacattacctgggggagaagaagtagccgtgaagaggctttgtaggaattcaggtcaaggccttgaagaattcaagaatgaggtaatacttattgcaaagttgcagcaccgcaatcttgtaagactactaggatgctgcatacagagagaagagaagatcttggtgtatgagtacatgcctaacaaaagtctagatgcattcctgttcaatcctgaaaagcaagggcttctagactggagcaaacggtttgatataattgaaggcatcgctagagggctgctatatctccaccgggactcaaggctacgtgttgtccaccgtgatctcaaggccagcaacatcctcctggacgcagatatgaaccccaagatatcagattttgggatggcaaggatgtttggcggtgaccagaaccaattcaatacgaatcgtgtcgtcggcacattcggctacatgtctcctgaatacgcgatggaaggcattttctcggtgaagtccgacgtctacagcttcggagtcctgatcttggagatcatcacaggaaagagggctgtgagcttccactatcatcaggactccatgaacatcgcaggatatgcatggcgacagtggaacgaagacaaggctacggagctgatcgacccgctgatacgggcatcgtgctcagtccggcaggtcctgagatgcatccacatcgcgctgctctgcgtgcaggatcacgccgacgagcgccccgacatccccaccgtaattatcatgctgagcagcgacagctcgagcctccccaaccc

SEQ ID NO: 1648 - DNA, 3025 bp, Sorghum bicolor
tggccgtggcctctgccgatagggccggggtggggcacaccgggagggaaaagagagatggtggggatgaagccagggggaggagtgttgcgtttctcctccaccatggccccctctcctcctcggctcctcttcccgctcctcgcctcgctatgctgtgcggtggcggcgcagacgacggacacgctgcggcaggggcagtcgctgtccggggcggccacgctggtgtcctcgccggagggggtgttcgagttgggcttcttcgcgccggacacgaaccagccgtcccgccagtacctcggcatctggtaccacggcatctcgccgcggaccgtcgtctgggtcgccaaccgcgtcgcgccggccacctcggcgctgccgtcgctcgcgctcaccgtcacaggcgagctccgcgtcctcgacggcaccacggccaacggcactgccgacgcgccgctgctctggtcctccaacgccacctcgcgcgcggccccaaggggcggctactcggcggtgctccatgacagcggcaacctcgaggtgcgcagcgaggatgatggggtgctctgggacagcttctcgcacccgacggacaccatcctgtccgggatgcgaatcaccttgcagacgcccgggaggggtcccaaggagcggatgctgttcacgtcctgggccagcgagacggacccctcgccggggcggtacgcgctcggcctcgaccccaacgctcaggcctacatctggaaagacggcaatgttacctactggaggtcgggacagtggaatggggtgaattttataggcattccatggaggccactctacttgagtgggttcacaccgtcgaatgatccagcgttaggaggaaaatattacacatacactgcaacaaacacttctctgcagaggtttgttgttttgccaaatggcacagacatctgctacatggttaaaaaatcttcacaagaatgggagactgtctggtaccaaccatcaaatgagtgtgaatactatgctacatgtggtccaaattcgttatgcactgcgttacaagatggcaaggcaaaatgcacctgcctaaaaggtttccgtccgaagctgcaggagcagtggaatgcaggaaattggagtcaaggttgcatcaggagccctcctctgggctgtgaggccaaccaatctggggatggatttcttccaatgagaaacataaaatggcctgatttatcatattgggtatctacagtggcagatgagactgggtgcagaactgactgcctgaacaactgctcatgtggtgcttatgtatacacgagtacaacggggtgcctagcctggggtaacgaactaatcgacatgcatgagttgccaactggggcatatactctaaacctgaagcttcctgcttctgagttacgaggacatcacccaatttggaaaatagccacgatagcatcagccatagtgctatttgttttggctgcttgccttcttctgtggtggaagcgtggtagaaatattaaagatgcagtgcacagaagttggagatcaaggcattcatcttcccgatcccagcagaatagtgctatgctggacatctcgcagtcgattcgttttgatgatgatgtggaggatgggaaaagtcatgaactcaaagtgtactccctggaacgcataaaagctgctacaagcaatttcagtgactctaacaagcttggagaaggaggatttggtcctgtctatatgggaacatttcctgggggagaagaagtagctgtcaagaggctttgtaggaattcaggtcaaggccttgaagaattcaagaatgaggtcatacttattgcaaagttgcagcaccgcaatcttgtaagactactggggtgctgcatacagagagaagagaagatcttggtgtatgagtacatgcctaacaaaagtctagatgcattcctcttcaatcctgaaaagcaagggcttctagactggaagaaacggtttgatataattgaaggcattgctagagggctgctatatctccaccgggattcgaggttgcgagttgttcaccgcgatctcaaggccagcaacattctcctggatgcggacatgaaccccaagatatcagattttggaatggcaaggatatttggaggggaccaaaaccaattcaatacgaatcgcgtcgtcggtacatttggctacatgtctcctgaatatgcaatggaaggcattttctcagtcaagtctgacgtctacggctttggagtcctgatcttggagatcatcacaggaaagagagctgtgagcttccactgtcatgaggactccttgaatatcgcaggatatgcatggcggcaatggaacgaagacaaggctgcggagctgatcgatccagtgattagagcgtcgtgctcggttcgacaagtcctgagatgcatccacattgcgttgctatgtgtgcaagatcacgccgatgagcgacctgacatccccaccgtcatccttatgttgagcaacgacagctcgagccttcctaatccgaggccgcctaccctgatgcttcgaggccgtgagatcgagtccagcaagtcgagcgagaaggaccggagccactccattggcactgtgtcaatgacacagctgcatggaagatagagtatagcacgaaaaatatactgaagttgtgatatctcttttcttttttgttctccctttgtgatgttgataatttgccgtttgctgtagattagtctctctctctctctcttttttatgatggcggcagtgaatttgtatgaaaatcaccttagcgtcatacatacgtaaagtggcaattaattttgcaaaggtgaggtattttttttacgtggttcttcgtaactttatatgggatttgtcaacccatagcatcctaccatcatgagataaaaattgaaaacttggtatcatcttaatttggtgacaagtttttctcccccttcccagtctgtttctgatatagcgagtcgtatgttgtggaactagttgt

SEQ ID NO: 1649 - DNA, 3497 bp, Sorghum bicolor
cggaaatcggtccttccggatctccatccgtcaacgtatcttcattcgaagcctgtcattctattccaaccgctgttcagaggcccgcatgaaaccacgcgccggggccccggaaggccggacccgtcctccggccgccgcgccgatcgagctcaccggagccggagctccggccgtcggccgcccattccgcgctggccgcttaaaaaattacttcgacacgcagctctcgcggcgccccctcaactcgctgccacgccacagtcttgagcaaaaccgaaagcaaagccacatgcttaatcacactaattaattcactctcgctcccacctgcagtgacacgccccgcaccgcagcgcggcgtgctctctcgccattaaaggcgcagtctttctctctccttcactccttttctctctccacagagtggagtggttggtgctctcagggtggctggccgtggcctctgccgatagggccggggtggggcacaccgggagggaaaagagagatggtggggatgaagccagggggaggagtgttgcgtttctcctccaccatggccccctctcctcctcggctcctcttcccgctcctcgcctcgctatgctgtgcggtggcggcgcagacgacggacacgctgcggcaggggcagtcgctgtccggggcggccacgctggtgtcctcgccggagggggtgttcgagttgggcttcttcgcgccggacacgaaccagccgtcccgccagtacctcggcatctggtaccacggcatctcgccgcggaccgtcgtctgggtcgccaaccgcgtcgcgccggccacctcggcgctgccgtcgctcgcgctcaccgtcacaggcgagctccgcgtcctcgacggcaccacggccaacggcactgccgacgcgccgctgctctggtcctccaacgccacctcgcgcgcggccccaaggggcggctactcggcggtgctccatgacagcggcaacctcgaggtgcgcagcgaggatgatggggtgctctgggacagcttctcgcacccgacggacaccatcctgtccgggatgcgaatcaccttgcagacgcccgggaggggtcccaaggagcggatgctgttcacgtcctgggccagcgagacggacccctcgccggggcggtacgcgctcggcctcgaccccaacgctcaggcctacatctggaaagacggcaatgttacctactggaggtcgggacagtggaatggggtgaattttataggcattccatggaggccactctacttgagtgggttcacaccgtcgaatgatccagcgttaggaggaaaatattacacatacactgcaacaaacacttctctgcagaggtttgttgttttgccaaatggcacagacatctgctacatggttaaaaaatcttcacaagaatgggagactgtctggtaccaaccatcaaatgagtgtgaatactatgctacatgtggtccaaattcgttatgcactgcgttacaagatggcaaggcaaaatgcacctgcctaaaaggtttccgtccgaagctgcaggagcagtggaatgcaggaaattggagtcaaggttgcatcaggagccctcctctgggctgtgaggccaaccaatctggggatggatttcttccaatgagaaacataaaatggcctgatttatcatattgggtatctacagtggcagatgagactgggtgcagaactgactgcctgaacaactgctcatgtggtgcttatgtatacacgagtacaacggggtgcctagcctggggtaacgaactaatcgacatgcatgagttgccaactggggcatatactctaaacctgaagcttcctgcttctgagttacgaggacatcacccaatttggaaaatagccacgatagcatcagccatagtgctatttgttttggctgcttgccttcttctgtggtggaagcgtggtagaaatattaaagatgcagtgcacagaagttggagatcaaggcattcatcttcccgatcccagcagaatagtgctatgctggacatctcgcagtcgattcgttttgatgatgatgtggaggatgggaaaagtcatgaactcaaagtgtactccctggaacgcataaaagctgctacaagcaatttcagtgactctaacaagcttggagaaggaggatttggtcctgtctatatgggaacatttcctgggggagaagaagtagctgtcaagaggctttgtaggaattcaggtcaaggccttgaagaattcaagaatgaggtcatacttattgcaaagttgcagcaccgcaatcttgtaagactactggggtgctgcatacagagagaagagaagatcttggtgtatgagtacatgcctaacaaaagtctagatgcattcctcttcaatcctgaaaagcaagggcttctagactggaagaaacggtttgatataattgaaggcattgctagagggctgctatatctccaccgggattcgaggttgcgagttgttcaccgtgatctcaaggccagcaacattctcctggatgcggacatgaaccccaagatatcagattttggaatggcaaggatatttggaggggaccaaaaccaattcaatacgaatcgcgtcgtcggtacatttggctacatgtctcctgaatatgcaatggaaggcattttctcagtcaagtctgacgtctacggctttggagtcctgatcttggagatcatcacaggaaagagagctgtgagcttccactgtcatgaggactccttgaatatcgcaggatatgcatggcggcaatggaacgaagacaaggctgcggagctgatcgatccagtgataagagcgtcgtgctcggttcgacaagtcctgagatgcatccacattgcgttgctatgtgtgcaagatcacgccgatgagcgacctgacatccccaccgtcatccttatgttgagcaacgacagctcgagccttcctaatccgaggccgcctaccctgatgcttcgaggccgtgagatcgagtccagcaagtcgagcgagaaggaccggagccactccattggcactgtgtcaatgacacagctgcatggaagatagagtatagcacgaaaaatatactgaagttgtgatatctcttttcttttttgttctccctttgtgatgttgataatttgccgtttgctgtagattagtctctctctctctctctctcccccccccccccccccccctctttctttttatgatggcggcagtgaatttgtatgaaaatcaccgtagcgtcatacatacgtaaagtggcaattaattttgcaaaggtgaggtattttttttacgtggttcttcgtaactttatatgggatttgtcaacccatagcatcctaccatcatgagataaaaattgaaaacttggtatcatcttaatttggtgacaagtttttctcccccttcccagtctgtttctgatatagcgagtcgtatgttgtgg

SEQ ID NO: 1650 - DNA, 2909 bp, Zea mays
tccagagtggagtggttggtgctctcagtcccaggacccagggtggccgtggcctctgccaatagggccgggccggggctccaccgcacaccgggagggagagatggtgggaacgagcccagggggaggagtgttctgtttctcctccatggtctcctctcctcggctcctcttcctgctcctcgccggcgcctcgctatgctgtgtggcggcgcagaagacggacacgctgcggcagggggagtcgctgtccggggcggcgacgctggtgtcctcgccggagggggtgttcgaggcgggcttcttcgcgccggaccccaagcagccttctcgccagtacctcggcatctggtaccacagcatctcgccgcggaccgtcgtctgggtcgccaaccgcgtcgcgccggccacctcggcctcgccgtcgctcacgctcaccgtcaccggcgagctccgcgtcctcgacggcacggcggccaacggcaccgccgacgcgccgctgctctggtcctccaacaccacctcgcgcgcgggcccgcggggcggctactcggcggtgctccaggacactggcagcctcgaggtgcgcagcgaggatggggtgctctgggacagcttctggcacccgacggacaccatcctgtccgggatgcgcatcaccttgcaggcgccagggaggggccctaaggagcggatgctgttcacgtcctgggccagcgagacggacccttcgccggggcgatacgcgctcggcctcgacccgggcaactccggtcaggcctacatctggaaagatggcaacgttacgtactggaggtcgggacagtggaatggggtgaattttataggcattccatggaggccactctacaggagtgggttcacaccggcaattgatccagtgcttggaaattattacacatacactgcaacaaacacttctttgcagaggtttgttgttttgccaaatggcacagacatctgctacatggttagaaaatcttcacaagattgggagcttgtctggtaccaaccatcaaatgagtgtgaatactatgctacatgtggtccaaatgcaaaatgcactgcatcgcaagatggcaaggcaaaatgcacctgcctaaaaggttttcatccgaagttgcaggagcagtggaatgcaggaaattggagtcaaggttgcatcaggagcccacctctgggttgtgagaccaatcagtctggggatggatttcttccaatgggaaacataaagtggcctgatttctcatattgggtatctacagtgggagatgagcctggatgcagaactgtctgccttaacaactgctcatgcggtgcttatgtttacacagctacaacagggtgcctagcctggggtaacgaactaattgacatgcatgagttgcaaacaggggcatatactctaaacctgaagcttcctgcttctgaattgcgaggacatcacccaatttggaaaatagccacgataatatcagccatagtgttatttgttttggctgcttgccttcttctgtggtggaagcatggtagaaatattaaagatgcagtgcacggaagttggagatcaaggcattcgtctacccaatcccagcagaatagtgctatgctggacatctcgcagtcaattcgttttgatgatgatgtggaggatggaaaaagtcatgaactcaaagtgtactcgctggaccgtataagaactgctacaagtaattttagtgactctaacaagcttggagaaggaggatttggtcctgtctatatgggaactttacctgggggagaagaagtagctgtgaagaggctttgtaggaattcaggtcaaggccttgaagaattcaagaatgaggtcatacttattgcaaagttgcagcaccgcaatcttgtaagactactagggtgctgcatacagagggaagagaagatcctggtgtatgagtacatgcctaacaaaagtctagatgcattcctctttaatcctgaaaagcaacggcttctagactggaagaaacggtttgatataatcgaaggcattgctagagggctgctatatctccaccgggattcgaggctgcgagttgttcaccgtgatctcaaggccagcaacattctcctggacgcggacatgaaacccaagatatcagattttggaatggcaaggatgtttggaggggaccaaaaccaattcaacacgaatcgggtcgtcggtacatttggctacatgtctcctgaatacgcaatggaaggcattttttcagtcaagtctgacgtctatggcttcggagtcctgatcttggagatcatcacaggaaagagggctgtgagcttccactgtcacgaggactccttgaacatcgctggatatgcgtggcggcaatggaacgaagacaatgctgcggagctgatcgatccagtgataagagcatcgtgctcagttcggcaggtgctgagatgcatccatattgcgttgctgtgcgtgcaagatcacgcagatgagcgacctgacatccccactgtcatccttatgctgagcaacgacagctcgagccttcctaatccgaggccgcctacgctgatgcttcgaggccgtgagatcgaatccagcaagtcaagcgagaaggaccggagccactccattggcactgtgacaatgacacagttgcatggaagatgaagtataacacgaaaaatatactgaatttgtgatatatttggttttttttgttctcccttcctgatgttgataatttgccatttgtcgcggattagtttcctctttttctccttttcatgacggcgaccgcgaagttgtatgaaaatcacattagcgtcatacattaagtgacaattaattttgcaaaggtgagatatttaccatgtggttcttc

SEQ ID NO: 1651 - DNA, 2080 bp, Pennisetum glaucum
ccccgccgccccccgcacagcccgcccatttcatgagtatttttctccccgtcccttggcgcgatccggtggatgcgagggacctgcccgggctcgacccgccttcaccccgatcctgctgcctccgccgccgtgctccgcggcggggaggtcccctgctctcgcctcccgttccaggagctagccgctggcccatgggctagggggtccccactcgccctcctgcgatcgcgcacgagcggaggggcagcccgcgggatccgcccgtctcctcctcgcgctctaggagcccggggacgattgctcccttgatcgatcggtcggagagtttcgcctgctcgtggatcggttcatgctgatgcgagtactgtgattttttttttggggttccttccttagtgtacagttttgctccttgggatgtgaaagctgtcccgggtggggatccagctcgcgctagattttcaccccgcttttgcctttcacttttcaccacttaatcattttgggagggtaaagattgggttcggcgggcgattaacgcccgatcactgtgcaggattctattctatttccaccttatcttctgatctccatttccgtgctgtttaatgcaagtggtggggaggcaaagtagagattgtgttgccggtttggtggagatattcttgggacatttgggcctgtacagagatatcccctgctccgagtttagtttcatgttcatagtggtggtggtggggaggagggcacgtattacgcgttctgattgtgccggccagttggggagatgggttcttcgcaggagtccaccttctcgtcggcctcggcagctgcgcaggtgaatgcttccgctctggacttgctcccggtctatgccaaggagcttatcgcaggcggcgctgctggtgcatttgcaaagactgcggtggcgcctctggaaagggtcaagatcttattacagacaagaactgaaggtttccagtcccttgggatcctccagtccttgaggaaactgtggcagtatgagggagtccgaggcttctacaaagggaacggtgcaagtgtgcttcggattgttccatatgcggcgttgcattacatgacatacgagcagtataggtgctggatattgagcaattttgctccgtcagtaggtacagggcctgttgttgatcttttagctggctcagctgctggtgggactgcagttttgtgtacatacccgttagacttggctaggaccaagctggcatatcaggtttcaaatgtgggcccatctggcaatgctttgggaaattctggtcgacaacaaacatataacggtataaaagatgtcttcaagactgtttacaaggaaggaggtgcacgatctttatatcgtggagtaggcccaactctgattggtattcttccatacgctggcttaaaattttacatatacgaggatctgaaatctcgagttccagatgattacaagaaatctgttatattgaaactctcttgtggagctttagctggtctatttgggcaaaccctcacttatccgttggatgttgtccggaggcaaatgcaggttcaaagcaagcagcctcaaaattcaagtgatggcttccgtataagaggaacttttcagggtctgatgcttatcattaggtgccaagggtggagacagctctttgctggcttgagccttaactatgtcaaggttgtcccttcggtagcaatcggtttcacaacatatgacatgatgaaggcattgctaggagttcctcctcgagagagaatccatgcatcgggtggtaacaaatgaagcaatgctcgcctcctttgtagcataaggaactctaatttgtagcattgtcattcttgttaagtcgggatgaaaattattgtatgtatctaggtcaattggatctgtgtctgtaacattctgttagttgcctatgacatcagttatgctacttgtgatttgtaaccgtaaatacacaataactacatgagattcatgtacattaactatacaagattagtaccatgattggagattctagttgggtttttttaaccctaagtaact

SEQ ID NO: 1652 - DNA, 1650 bp, Saccharum officinarum
gtcgacccacgcgtccgcttggggatgtgaatcctgtcctgggtggggatccagctcatgctagattttccccacttttgcctttcacttttttcactcgggaggggaaaaattggtttcctgggtgatttccgatcgctgtgcaggattctaccttatcttctaatttctgtttccgtactcttaatgcaagtagtggggaggcaaagtaaagattgtattgccagttttggggacatattgttggggatattccaccctgtacaaagatatcccttacccttagtttagtttgatgctcaaatcagtagtggtggggagtgcacatatcacaaatcctgattatactcggccgttcgggagatgggctcctcacaagaatccaccttctcctcggcctcagcggctgcacaagtgaatgcttcagctctggacttgctcccggtctatgccaaggagcttatcgccggcggcgctgctggtgcatttgcaaaaactgcggtagcaccgctggagagggtcaagatcttattgcagacaaggactgaaggtttccagtcccttgggatcctccagtcattgaggaagctgtggcaatatgagggaattcgaggcttctacaaagggaacggtgcaagcgtgcttcggattgttccatatgcagcattacattacatgacatatgagcagtataggtgctggatattgaacaattttgctccatcaataggtacagggcctgtcgttgatcttttagctggctctgctgctggtggtactgcagttttgtgtacatacccattagacttggctaggaccaagctggcataccaggtttcaaatgttggtcagcctggcaatgcttttggaaattctggtcaacaacaaacatataatggcataaaagatgtcttcaagactgtttacaaggaaggaggcgcacgatctttatatcgtggagtaggcccaactcttattggtattcttccatacgctggcttaaaattttacatatatgaagatctgaaatctcaagttccagaagattacaagaattctgttatattaaagctctcttgcggagctttagctggtctatttggacaaaccctcacttatccactggatgttgtccgaagacaaatgcaggttcagagcaagcagcctcaaaattctagtgatggcttccgtataagaggaactttccagggtctcttgttgatcattcggtgccaagggtggagacaactcttcgctggtttgagccttaactatgtcaaggttgtcccttcagtagctatcggtttcacaacatatgacatgatgaagacattgctaggggttcctccccgagagagagtccatgcgtcaggtggtaacaaatgaagcaatgttggccatccttgtgactgatgaactgaagaaactctaggctgtggcactgttgttcttgttatgaatcctattgctatcaccctatgttgcatacgatggagagtattgtatattggtcaaatagttttgtgtaacattcggacgagttgcttgtaccatccattatgctacttgtaatttgtaaccatgaatacaatgacggtacctgagattgccctacattaactatacaagattagtagtgcccttattggg

SEQ ID NO: 1653 - DNA, 2163 bp, Sorghum bicolor
gttcaaccctccccttccccagtccgcggccgcccagccaccgccgccgccaccacggctcctcgatcagggtcttccctcctcttcgcccttcgccccccgcaagtcccgcgcgattgatgagtatttttctccccgtcccttggagcgactcggtggatgcgagggacctgcccgcgctcgacccgccttcgccgctatctcgccgcctcgccgccgcccggcgggcagcctcctgctctcaccttccttccccggagctagccgcaggcccatgggctagcgactcacgtttcgccctcctgcgatcgcgagcggaggcgcggcctgcgggatccgcccgtctcctcctcgcgctctcggaataatccaaataactccttggtctcgatcctcggagttgctggcctgcgtgtagatcgcctcctgctgatgcgagtgttgtgctttccagtaacaagagtgtacagttgttgttgcgtcttggggatgtgaatcctgtcctcggtggggatccagctcacgctagatttttccccccttttgctttgcactttttcatcactcgggaggggaaagattgggttcctgggtgattaacactcaatcgctgtgcaggaggattctaccttatcttctaattgctgtttccgtactcctaatgcaagtagtggggaggcaaagtaacgattgtattgccggttttggggacatattcttggggatattccaccctgtacaaagatatcccttacccttagtttagtttgatgctcaaatcattagtggtggggagtgcacatatcacaaatcctgattatactcggccattcgagttatgggttcctcacaagaatccaccttctcctcggcctcagcggctgcacaagtgaatgcttccgctctcgacttgctaccggtctatgccaaggagcttattgctggcggcgctgctggtgcatttgcaaagactgcggtagcaccactggagagggtcaagatcttattgcagacaagaactgaaggtttccagtcccttgggatcctccagtccttgaggaagctgtggcagtacgagggaattcgaggcttctacaaagggaacggtgcaagcgtgcttcggattgttccatatgcagcattacattacatgacatatgaacagtacaggtgctggatattgaacaattttgctccatcaataggtacagggcctgtcgttgatcttttagcgggctctgctgctggtggtactgcagttttgtgtacatacccattagacttggctaggaccaagctggcataccaggtttcaaatgttggccagcctggcaatgcttttggaaattctggtcaacaacaaacatataatggcataaaggatgtcttcaagactgtttacaaggaaggaggcgcacgatctttatatcgtggagtaggcccaactcttattggtattcttccatacgccggcttaaaattttacatatacgaagatctgaaatctcaagttccagaagattacaagaattctgttatattgaagctctcttgcggagctttagctggtctatttggacaaacgctcacttatccactggatgttgtccgaagacaaatgcaggttcagagcaagcagcctcaaaattcaagtgatggcttccgtataagaggaactttccagggtctcttattgatcattcattgccaagggtggagacaactctttgctggtttgagccttaactatgtcaaggttgtcccttcagtagctatcggcttcacaacatatgacatgatgaagacattgctaggggttcctcctagagagagagtccatgcgtcaggtggtaacaaatgaagcaatattggccatccttgtgttatgactgaagaaaatctaggctgtcgcattgttattcttgttatgaatcctattgctatcaccctatgttgcatatgatggagagtattgtatattggtcaaatagttctgtgtctgtaaccgtcggtcgagttgcttgtaccatccattatgctacttgtaatttgtaatcatgaatacaatgatggtaccagagttgccctacattaacaatattagtagtgcccttattggagattctggtgtttatgtcatcaaatgtgcctgaagatatttta

SEQ ID NO: 1654 - DNA, 3573 bp, Sorghum bicolor
ctaaagatataaaactaattgcaataagaagataacatgtcctaaagttgctacttataatataacaaaatctaaataagatgaattggcattaaaagagttattactcatgacatatcaaaacctaataagatagattggcattggaacgcataagatagatgggttttggaagacaactcggatgaggcgctgttagaaaagccggaccagcatagagcgagtcctcgggctccgattcagagcccgaatcctctgacaagaactcataccttggcttcttgaaggagttgtcagccgacgacactccacagtcgactccaatgcgcttgacagggagattggtcgtggatgatccaatggcaagattggccgtgggcgctggtacagtagccgatactgtactggcagtagccagtagcttatctctaacccaattctcactgagagatgcacgtcccggaatcttgcctgttgttttgatcttggtgggcagtgcggcgagcgctgatttgtctctgatccaacttccgctggcggatgcgcggcctggcacggagggaaaagcagcggtgctcaccagtcggcgagtcgccggtggggttggcaacaaacccggcgaggtggagctcagcagcgaagcaggggtacggaagggtcggctgcaagcggctggtggtgatggtgttggaaccaaaccctgcgagataggattcagcggcggcggagcaatcgcggattcggccatgtgtacggcggggtcgcaaacgagaaccaaagaaaaagaaaccggaggaacaagaacagatgcgaaccgaaaggaacgagaacagatgcgaaccgaaggaacaagaacagatgcggaccttcaacgatttccgccgggtcggtggacgtcggcgtcggcgactcggcgagatggcgagttggcgcgggagcaaaaatcgaaggaagctgaggactcgccgagattgcggagagtcgaagacggcgacgggtgggatcaggggtctggcaggtgggcctttgtacgtataatatacaggtagatccgtatcccctacgttttttttagaaaccgtatcccttactataaggcggtatccttaaaaaaatactatacggcggcggtatgatacttgatacgtggtctgggccgcggcccaactcgagacgcgtcttcattgagtcggtggccggcccagcccactaaactggctccaatatgcgctcccctcttggctttccattgccagcgccagcaggaggaaggcagctgcagcctgcagcagagcagaccaaccgccaatcgtgtgacgccccccctgctgctgttcaaccctccccttccccagtccgcggccgcccagccaccgccgccgccaccacggctcctcgatcagggtcttccctcctcttcgcccttcgccccccgcaagtcccgcgcgattgatgagtatttttctccccgtcccttggagcgactcggtggatgcgagggacctgcccgcgctcgacccgccttcgccgctatctcgccgcctcgccgccgcccggcgggcagcctcctgctctcaccttccttccccggagctagccgcaggcccatgggctagcgactcacgtttcgccctcctgcgatcgcgagcggaggcgcggcctgcgggatccgcccgtctcctcctcgcgctctcggaataatccaaataactccttggtctcgatcctcggagttgctggcctgcgtgtagatcgcctcctgctgatgcgagtgttgtgctttccagtaacaagagtgtacagttgttgttgcgtcttggggatgtgaatcctgtcctcggtggggatccagctcacgctagatttttccccccttttgctttgcactttttcatcactcgggaggggaaagattgggttcctgggtgattaacactcaatcgctgtgcaggaggattctaccttatcttctaattgctgtttccgtactcctaatgcaagtagtggggaggcaaagtaacgattgtattgccggttttggggacatattcttggggatattccaccctgtacaaagatatcccttacccttagtttagtttgatgctcaaatcattagtggtggggagtgcacatatcacaaatcctgattatactcggccattcgagttatgggttcctcacaagaatccaccttctcctcggcctcagcggctgcacaagtgaatgcttccgctctcgacttgctaccggtctatgccaaggagcttattgctggcggcgctgctggtgcatttgcaaagactgcggtagcaccactggagagggtcaagatcttattgcagacaagaactgaaggtttccagtcccttgggatcctccagtccttgaggaagctgtggcagtacgagggaattcgaggcttctacaaagggaacggtgcaagcgtgcttcggattgttccatatgcagcattacattacatgacatatgaacagtacaggtgctggatattgaacaattttgctccatcaataggtacagggcctgtcgttgatcttttagcgggctctgctgctggtggtactgcagttttgtgtacatacccattagacttggctaggaccaagctggcataccaggtttcaaatgttggccagcctggcaatgcttttggaaattctggtcaacaacaaacatataatggcataaaggatgtcttcaagactgtttacaaggaaggaggcgcacgatctttatatcgtggagtaggcccaactcttattggtattcttccatacgccggcttaaaattttacatatacgaagatctgaaatctcaagttccagaagattacaagaattctgttatattgaagctctcttgcggagctttagctggtctatttggacaaacgctcacttatccactggatgttgtccgaagacaaatgcaggttcagagcaagcagcctcaaaattcaagtgatggcttccgtataagaggaactttccagggtctcttattgatcattcattgccaagggtggagacaactctttgctggtttgagccttaactatgtcaaggttgtcccttcagtagctatcggcttcacaacatatgacatgatgaagacattgctaggggttcctcctagagagagagtccatgcgtcaggtggtaacaaatgaagcaatattggccatccttgtgttatgactgaagaaaatctaggctgtcgcattgttattcttgttatgaatcctattgctatcaccctatgttgcatatgatggagagtattgtatattggtcaaatagttctgtgtctgtaaccgtcggtcgagttgcttgtaccatccattatgctacttgtaatttgtaatcatgaatacaatgatggtaccagagttgccctacattaacaatattagtagtgcccttattggagattctggtgtttatgtcatcaaatgtgcctgaagatattttatatatcaaatgttagcaaagacgaagatgaagccttgatggtttctatcaatagaatctccaacatttcatgagctt

SEQ ID NO: 1655 - DNA, 1292 bp, Panicum virgatum
gcaggagtccaccttctcgtcggcctcggccgctgcacaggtggatgcttccgcgctggacttgctcccggtctatgccaaggagcttatcgcaggcggcgctgctggtgcattcgcaaagactgcggtggcgccgctggagagagtcaagatcttattacagacgagaactgaaggtttccagtccctggggatcctccagtccttgaggaagctgtggcagtatgagggagttcgaggcttctacaaagggaacggtgcaagtgtgcttcgcattgttccttacgcggcattgcattacatgacatacgagcagtataggtgctggatattgaacaatttcgcttcatcagtaggtacagggcccgtcgttgatctttttgctggctctgctgctggtgggactgcagttttgtgtacatacccattagacttggctaggaccaagctggcataccaggtttccaatgtgggacaatctggcaatgctttgggaaattctggtcaacaacaaacatataacggcataaaagatgtctttaagactgtttacaaggaaggtggcgcacgatctttatatcgtggagtagggccaactctgattggtattcttccatacgctggcttgaaattttacatatatgaagatctgaaatctcgagttccagaagattacaagaaatctgttatactgaagctctcttgtggagctttagctggtctatttggacaaacccttacttatccactggatgttgtccggaggcaaatgcaagttcagagcaagcagcctcaaaattcaagtgatggcttccgaataagaggaactttccagggtctctcgctcatcattaggtgccaaggatggagacagctctttgccggcttgagccttaactatgttaaggttgtcccttcggtagcaatcggtttcacaacatatgacatgatgaaggcattgctaggagttcctccccgagagagagtccatgcatcaggtgctagcaaatgaagcaatgttcagcttccttgtgttaggaccaatgagctcgaggaactccagtctgtggcgttatcgttcttgttatgaatcatatctttatgttgcataggatggaaatcattgtatattggtcgattggatctgtgcatgtaacattcttatgaattgctcataacatcaagtatggtacttgtaatttgtaaccgtaaatacagtgacaacaagagattgctgtacattaactatactagattggtaccatgattggagattctgatcaggatttttt

SEQ ID NO: 1656 - DNA, 2209 bp, Zea mays
gtgtgacgccaccaccgctctctgactcttcctccacgaaccacatcaaaactgatcaactctctccctctgcttcccgctagagcaaacgccacgagagtcgcgattcttccaccacttccacgggaccggtcggatccaatctgctgccgcccagccaccgccaccgccgccaccgccggctcctctataggggtcttccctcctcttcgcccttcgcaacccgcaagttccgagcgattgatgagtatttttctccccgtcccttggagcgactcggtggatgcgagggacctgtccgcgctcgacccgccttcgcccctatctcgccgcccggcgggcaggctcctgctctcgccttccgttcccggagctagccgcaggcccatgggctagtgggtcgtcgttcgccctcctgcgatcgcgagcggagaggcggcctgcgggatccgcccgtctccaatccaaataactcctctccttggacgatttcggagttactggcctgcctgaaaatcgattcctgctaacgccagtattgtgcttttcagtaacaagagtgtacagttgttgcttcttgggatgtgaatcctgtcttgggtggggatccagctcacgctagatttccccccttttgcctttcactttttcactcgggagggaaaggttgggttcctgggtaattaacatccaatcgctctgcttgattctaccttatcttctaatcactatttccgtgctcttaatgcaagtggtgggaaggcaaagtaaatattgtattgccggttttggggacatattcttggggatattccggtctgtgcaaacatatctcttgcccttagtttagtttgatgctcatatcagtattcagtactggtggggagtgcacatatcacaaatcctgattatcctcggccgttggggagatgagttcctcacaagaatccaccttcacctcggcctcagcggctgcacaagttaatgcttccgctttggacttgctcccggtctatgccaaggagcttatcgccggcggcgctgctggtgcatttgcaaagactgcggtagcaccactggagagggtcaagatcttattgcagacaagaactgaaggtttccagtccctcgggatcctccagtccttgaggaagctgtggcaatacgagggaattcgaggcttctacaaagggaacggtgcaagcgtgcttcggattgttccatatgcagcattgcattacatgacatatgagcagtataggtgctggatattgaataattctgcttcatcaataggtacagggcctgtcgttgatcttttagctggctctgctgctggtggtactgcagttttgtgtacatacccattagacttggctaggaccaagctggcataccaggtttcaaatgttggccaaactggtaatgctttgggaaattctggtcaacaacaaacgtataatggcataaaagatgttttcaagactgtttacaaggaaggaggtgcacgatctttgtatcgtggagtaggcccaactcttattggtattcttccatatgctggcttgaagttttacatatatgaagatctgaaatctcaagttccagacgattacaaggattctgttatactgaagctctcttgtggagctttagctggtctatttggacaaaccctcacttatccactggatgttgtccggagacaaatgcaggttcagagcaagcagtctcaaaattcgagcgatggcttccgtataagaggaacttttcagggtctcttgctcatcattcggtgccaagggtggagacaactctttgctggcttgagccttaactatgtcaaggttgtcccttcagtagctatcggtttcacaacatacgacatgatgaaggcattgcttggagttcctccccgagagagagtccatgcgtcaggtggtaacaagtgaagcaatgttggccatccttgtgttatgactgatgaactaaagaaattctaggttgtgagttgtgacattgttattcttgttatgaatcccattgcatagggtggagagtgttgtatattggtcaaatagctatattcatgtaacattaagttgagatgcttgtatcatccattatgctgcttgtaatgtaaccatgaatacaatgacgcccctaaagatcactttaaattaactataaaagattagtattaccctta

SEQ ID NO: 1657 - DNA, 2413 bp, Oryza sativa
cccttcctccatcagcagcagcagcacgggcctgaccgtgaccgtcccccacgtcgtcctccccacacacgcgacgccagtacgccactgccagcgcgaaacaagcaacacacgcattcctcctcccgattcgctcgcggccgcaccgcaccgcagctctcctcctcctcctcccccacccaaacccacggcggcagattcgatctcgaattctcgaactctctcgatcgaaccctgtgccctctgctccccgcaaaatcctccgcatttgatgagtagtcctatcactcttcttcctccccgcgcaaatcctcgccgccacttggatgccagggagctccacctcgccgccgaccaccaccaccacccttctctcctccgctccccgccgcggcgcctaggccgctgccgccgccgatgggctaggagaggagagggatcgccgcctccctgcgatcgccaccgggggagccggaccctctccgcgagatctggttaattgatttgcctactaccagtattccgctagattctggaccgattcctctctgttgatgcaaccactgtacagttgttgctttccttgatgatcagaaggagctggcgatttcggaggtgaatgcgttgtttcatatgggtttgcagcttatgctacaacagctatctccgatttagtttattacctttggggagcgtagagattggattccgctttgcgttttcctctttcctgcgagattctagcttatccttcgattaaacctattcgcgcggctattagcgcaagtggttaggacggacgcagactaaaaaaggttaggttattagggatttggttttccatttggattgccgattgcgggagcatatcctattgggagattccggcactgtaaagatatccttggcaactgagttgatttaatgttaatgttagtggtggtggggagggcagataatacgcattctgatctgcctgtcaagttgggggagaagagatgggttcctcacaggaatccactttttcctccgcctcaacggccgcgcaggtgaatgcctgcgcgctggacttgctcccggtatacgccaaggagcttatcgccgggggtgcagccggtgcattcgcaaagactgcggtagcgccgctggagagggtcaagatcttactgcagaccagaactcatgggtttcaatcccttggtatcctccaatcattgaggaagctgtggcagtatgagggaattcgaggcttctacaaggggaatggcgccagtgtgcttcggattgttccatatgcggcattgcattacatgacttatgagcagtatcggtgctggatattgaataattttgctccatcagtgggtacagggcctgtggttgatctattggctggctcagccgcaggtgggactgcagttctatgtacctacccattagaccttgctaggacaaagctggcatatcaggtttcaaatgtgggccaacctggcaatgctttgggaaatgctggtagacagccagcatatggtggtatcaaggacgttttcaaaactgtttacaaggaaggaggcgcacgagctttataccgtggagtaggcccaactctgatcggtatcctaccatatgctggactaaaattctatatatatgaagacctgaaatcgcgagttccagaggattacaagagatctgttgtattgaaactctcttgtggtgctttagctggtctttttgggcaaaccctcacttatccactggatgttgtccgaagacagatgcaggttcagaataagcagccccataatgcgaacgatgccttccgtataagagggacatttcagggtctagcactcattattaggtgccaggggtggaggcaactcttcgctggcctaagccttaactatgtgaaggtcgtcccttcggttgctattggtttcacaacatatgacatgatgaagaatttgctgagagtgccaccccgagagagactttatcaatcgtctggtaacgcatgaaacggcactggcctaattgtatcaggacaaagtgaattcaataaactccacccggtggcgttgtattttcaatcataaattctatcgctatgttgcataggagggagataagtcgtaattaactgtttgatttgtaaataatgatagtcatttgagttactgtagacttggataagcttgtgtattgaatgtgctacctgtattatacaatttgatcaaatattgcaactgagagtaccctgcatgggttgtacatatactagtattaaccataattagagatcccttttcagtattttctacttaatacatcaactatttgtaagtaatattttggaagcagagatcatgaaatatgaaagggtaaacaccatgtggctcttaattaatca

SEQ ID NO: 1658 - DNA, 1366 bp, Brachypodium distachyon
ttcctggcatttggatatccaatttcggggacatattcctagcaagaccctgcactgtagaacatattctctgctctgaattgattttgtgttaatgttagtagtggtggggagggaaggtactaaatattcccatctgcccagccagttggaaagatgggttcctcgcaagaatccaccttctcatcagcttcaacggccgcgcaagtgaatgcgttggacttactaccagtctatgctaaggaacttattgctggcggtgcagctggtgcattcgcaaagactgcggtagcgccacttgagagggtcaagatattattgcagacaagaaccgaagggtttcaatcccttgggattgttcgatccttgaggaagctgtggcaatatgaaggaattcgaggcttctacaaaggcaatggtgcaagcgtgcttcggattgttccatatgcggcattgcattacatgacatatgagcagtataggtgctggatactgaataatgctccatcagtgggtacaggacccgtagttgatctcttggctggctcagctgctggcgggactgcagttctgtgtacctaccctttagacttggctaggaccaagctcgcatatcaggtttcgaatgtggcccaacctggcaactccttgggaaattccggccaccagccagtatataatggcgtaaaggatgttttcaaaactgtatacaaggaaggaggtgcacgatctttgtaccgtgggataggcccaaccctgatcggtattcttccatacgctggcctaaaattttacatatacgaagatctaaaatctcgtgttccagaagattacaagagatctgttgtattgaagctctcctgtggtgctttggctggtctttttgggcaaacgctcacttacccgctggatgttgtccgaaggcaaatgcaggttcagaacaagcagccacagaatgttaacgacaccttccgcataagaggaacatttcagggtctcttactcatcattcggtgccagggatggagacaactctttgctggcttgagccttaactatgtcaaggttgtcccttcagttgctatcggattcacaacatatgacatgatgaagaatttgctgggagtacctccacgcgagagagctcatccatcggctggtaacaaatgaagcagcgccgactctcttgtgttgcaggtctcgttttgaatcatattgctaggttgcataggatggtctcataattccgactgaactgttgggtctgtaagaatgacagctcaattgagctgctccagactcggatatgattgtatatactgattgtgctgatttgatagttgaattgataaagcatttcgtccgt

SEQ ID NO: 1659 - DNA, 2170 bp, Brachypodium distachyon
cgtttggcgcacgtgggactgcggtcgctctcccctttccgcgttccttcgaattcgttccagaacagaactactccgcgctccctcctacagactccaaacccgcgcgaccggattccgccgaatcgatcccctcctcctcggccggaccccggacggacgaatcactccctcccctcgacctcctctccccgcagatcccccgcgattgatgagtattcttcccccagtctcttggtggagcgatttggatgcgagggagctcggccccgagcattcttctccccgatctccccgccgggaaggcgccgacgtctctcccctctcgctgccggaggtaggcggccgatgggctagggagctggccctcctacaccttcggtcgccagcggcaggccggagccttgtgggatccgcccgcctcctctcgatttagaagcccactgcctgctcagttaattgagcctatatctctgaggttgattcagctattgggaaagagtatattgtcagttcttggatcatcagagcttacgattgggaactggatgttgcgtggtgatccagcttaatcctgtttagtttaactgtggaggataaagattggctttggttgtgtctttttgggtgtttagcactcagacagtactgtgcaagattctagcttatccttgactatcatagtctcttgttagtacgagtgttgaggagacagatcaaagctttgatttgttcctggcatttggatatccaatttcggggacatattcctagcaagaccctgcactgtagaacatattctctgctctgaattgattttgtgttaatgttagtagtggtggggagggaaggtactaaatattcccatctgcccagccagttggaaagatgggttcctcgcaagaatccaccttctcatcagcttcaacggccgcgcaagtgaatgcgttggacttactaccagtctatgctaaggaacttattgctggcggtgcagctggtgcattcgcaaagactgcggtagcgccacttgagagggtcaagatattattgcagacaagaaccgaagggtttcaatcccttgggattgttcgatccttgaggaagctgtggcaatatgaaggaattcgaggcttctacaaaggcaatggtgcaagcgtgcttcggattgttccatatgcggcattgcattacatgacatatgagcagtataggtgctggatactgaataatgctccatcagtgggtacaggacccgtagttgatctcttggctggctcagctgctggcgggactgcagttctgtgtacctaccctttagacttggctaggaccaagctcgcatatcaggtttcgaatgtggcccaacctggcaactccttgggaaattccggccaccagccagtatataatggcgtaaaggatgttttcaaaactgtatacaaggaaggaggtgcacgatctttgtaccgtgggataggcccaaccctgatcggtattcttccatacgctggcctaaaattttacatatacgaagatctaaaatctcgtgttccagaagattacaagagatctgttgtattgaagctctcctgtggtgctttggctggtctttttgggcaaacgctcacttacccgctggatgttgtccgaaggcaaatgcaggttcagaacaagcagccacagaatgttaacgacaccttccgcataagaggaacatttcagggtctcttactcatcattcggtgccagggatggagacaactctttgctggcttgagccttaactatgtcaaggttgtcccttcagttgctatcggattcacaacatatgacatgatgaagaatttgctgggagtacctccacgcgagagagctcatccatcggctggtaacaaatgaagcagcgccgactctcttgtgttgcaggtctcgttttgaatcatattgctaggttgcataggatggtctcataattccgactgaactgttgggtctgtaagaatgacagctcaattgagctgctccagactcggatatgattgtatatactgattgtgctgatttgatagttgaattgataaagcatttcgtccgtaattgtcctgcaccaacaatgcactggtaaaaccatgaccggagataagctgttgaactgttcttaggcccc

SEQ ID NO: 1660 - DNA, 1306 bp, Triticum aestivum
atgccactaataacggcgaggagggcacatcttacatattcccacctgcccagacccctggcaacatgggtcgctcgcaggaattcacattttcattcgccttaaccgccgcacaagtgaatgctttgggcttactacctgtctatgccaaggagcttattgctggtggtgcagctggtgcattcgcaaagaccgccgtcgcgccactagagagggtaaagatcttattgcagacaagaacccaagggtttcaatcccttgggattgtccaatccttgaggaagctgtggcaatacgagggaattcgaggtttctacaaaggaaatggtgcgagtgtgcttcggattgttccatatgcagcattgcattacatgacatatgagcagtataggtgctggatactgaataatgcgccatcagtgggtacaggacctgtggttgatctgttcgctggctcagctgctggcggaactgcagttctgtgtacctaccctttagacttggctaggaccaagctggcataccaggtttcaaatgtagcccaacctgtcaattcattgggaaattttggccgccaaccagtatataatggtgtaaaggatgtttttaaaactgtttacaaggaaggaggtgtacgatctttgtaccgtgggataggcccaaccttgatcggtattcttccatacgcgggtctgaaattttacatatatgaggacctaaaatctcgtgttcccgaagattacaagagatctgttatattgaagctctcttgtggggctttggctggtctttttggacaaaccctcacttacccactggatgttgtccgaaggcaaatgcaggttcagaacaagcagccccagaatgcaaatgatgccttccgcataagaggaacatttcagggtctctttcttatcattcggtgccaggggtggagacaactgttcgctggcttgagccttaattatgtcaaggttgtcccgtcagttgctattggtttcacgacatatgacatgatgaaaaatttgctgggagtacctccacgcgagaaagctcatccgttgactggtaacagcaacaaatgaagcaacatcgacctatttgcgttgtgggtctcatttgtaagctatgttgcatatgatggtcttaatagcaacttaactgttacatttgtaagaatgacagcccagttgagcatttgagctgctccagacttggatatgattgtatactgattgtgcttcttgaataattgaattgataaatcattttatttgtgattgccttgcatcggcaatacaatagt

SEQ ID NO: 1661 - DNA, 3976 bp, Setaria italica
gcctcgccaccgaccgccatgcccgccacggacaccgacgagcgccccctcgtcgagctcgccgcctccgccactaccccaaccgccacccccactgcctccgcctccgctcccgcccccttcttcccgccccccgcggccccggggttctcccgcgcggtccgctgcaacgcgccgtcctcgttcccggccgacgggggcggattcgggggcgcggggcagcagcagcatgcggcggcgtacccggggaacgcgatctcgaccaccaagtacaccgcggcgagcttcgtgcccaagtcgctcttcgagcagttccgccgcgccgccaactgcttcttcctcgtcgtcgcctgcgtctccttcagcccgctcgcgccctaccgcgccgtctccgtcctgctcccgctcctcgtcgtcgtcagcgcagccatggccaaggaggccgtcgaggactggaggcggaagcagcaggacatagaagtgaacaataggaaggttgaggtgtatgatgggacccagtcatttcatgagacagaatggaagaagcttcgagttggtgatatagttaaagttaaaaaggatgagttcttccctgcagatcttctttttctctcatctagctacgacgatggaatatgctatgttgagacaatgaatcttgatggagagacaaacttgaagcgaaaacaggcgctagatgtgactatgggcttgaatgatgagcagtttttccatagcttcaaagctttcattcgatgcgaggatccaaatgagaaactgtattctttcttagggacgttgtactacaatgaacaacaatatcctctgtctccacaacagatccttctaagggactcaaaacttcgcaatacaagctatatatatggcactgtaatattcacagggcatgatacaaaggtgatgcaaaatgcaatggagccaccatcaaagagaagctcagttgaacgaagaatggataaaataatatatctgctttttgctattctctttgctattgcaacgttcgggtcaattgtgtttgggatgaaaacaaagcatgagataagtccaggaaactatgcatggtacctcagaccagatcaagcaaatatattctttgatccaaacagagcatcatttgcagccttttgccattttctcacaagccttatgctgtatgtgaccttggtgcctatttcattgtatatatcgatagaaattgtcaaggtgttacagagcacattcataaatcaagaccagaatatgtattgtgcagagtctgataaacctgcaagagctcgcacttccaatttgaatgaagaacttggtcaagttcatactattttgtctgacaaaacaggaacattaacatgcaactcgatggagttcttgaaatgttctattgctggggttgcttatgggaatagtcctacagaaatggagacgtcttatggagaaatagctgaaactactgccaattatgggcacaagaacactactgaattcaagagattagtcaagggattcaacttcactgatggccgtttgatgaatggaagatgggccaaagaatgttctagggattctatagagatgtttttccgagtattagctgtttgtcatactgcaattcctgtggcagatagaaattctgctggtatgccttatgaagcagagtcacctgatgaaggagctcttgttacagctgctagagagtttggttttgaattttatcacaggacacagacaaccatatcagtgcatgaatatgatcctgtctttggtggaaaggtggatagaacctataaactactcaacatcttagagttcagcagtgctcgtaagcgtatgtctgttattgtgaggacagaagtgggtcggttattcctgttctgcaaaggagctgacagtgtaatattcgaaaggctctccaaagataatggaaaagcttgtctgagcaaaacgaagtgtcacatcaatgagtattctgaggcaggtctccggaccctagtacttgcataccgtgaacttactgaggagcaatatgttctatggaatcagaagtactcagctgccaagaattctgtacataccgatcatgatgaagctgtggagaaggcatcagaagatatcgagaaggatttggttctcttaggtgctactgcagtggaggacagattgcaaagtggggttcctgagtgtattcacaaacttgcacaagctggaattaagatctggattttaactggagacaagctggagacagctgtcaacataggttactcatgtaacttattgaggaaagagatggaggaaatttttatcacgctggataactcaagtacaagtgcttcagagggatgtagtggagaaggaaacagaatggccccatatgaagaaattgatagaaaattactagatgctagaacaaaggttttcatgagaggaacctcaactttatttgctcttattattgacggcaatgctctgacacatgctctcacgagcagcctcaagaactcatttctggatctagcagtcaactgtgcatctgtgttatgttgtcggatttctccaaaacagaaagcactggtcaccaggttggttaaaattaggacaggtaaaactactctagctattggagatggagcaaatgatgtcggtatgctacaagaggctgacattggggttggaataagtggcgctgaaggaatgcaggctgtgatggcaagtgactttgcaatagctcagtttcgtttcttagagcggttacttcttgtgcatggtcattggtgttatcgtcggattgcagctatgatatgctattttttcttcaagaacatcacattcggcattacacttttctggttcgaggcccatgctatgttctcagcccaacctgcgtacaatgactggttcatttctttctataatgttgccttcacatctctccctgtcattgcccttggtgtttttgacaaggatgtctcttcccgtgtttgtcttgaggtcccttcattacatcaagatggcgtgaataatgtattctttagttggtcccgaatactcagctggatgttaaatgggctgtgctgttcaataatcatatactttggttccctcaatgccatcctgattcaggctgtccggcaggatggtcgtgttgctgggtttgacatcctaggagtgaccatgtacacttgcgtagtgtggactgtgaactgccagctggctctctacatcagctatttcacctggatacaacattttgttatctggggcagtatactaatctggtacgcgtttctagtcatctatggactatttcccccggcaatatcaaccactgcatatcatgttttcttggaagcttgtgcgtcgagccctttgtactggttatcaaccctaatgattgtggtcacagccttgatcccattcttcgtctacaaaatatcgaggacactgtattacccacagtaccacgataaagttcagagaactaactcaaagaattggtgatgccagtcgtataagaagctactgaatgaatatatgtacagtcagtattctatttaacgtgcagtgtgcttaactttctagatcatgatgtcagcggcagtgtatataagcagaggtgttgtttattaggttctgtacatacttgggcttatgcccacaaatttgtagattcaggtcagcagtgcatctgccaaacatcagaatggaagtggtggctctttgctcggttggatggaacttgaatcaacaaattgatcttaggatcatgttaaaggtctacaacactacaccctctaggagcctggggttgcccaggaattgatgtagaaatgctaaaacgacaatttgggacggaggaagtagtatggttcctgtgctaacaagttcatatgatatcctacaatgtctttctgatttgtatctacttaggcatgcccagttcaaagtcattttcttt

SEQ ID NO: 1662 - DNA, 4018 bp, Sorghum bicolor
tcacccaccaccatgcccatggacacagacgagcgccccctcgtcgagctcgcctccgcctccgccggcgccgctgcggccgccactactcccaccgcctcgacctccgcctccgctcccttcccggcccctgccacaccggggttctcccgcgcggtccgctgcaacgcgcccgcttcctcgctcccgggcaccgatggcggcgcgcagcagccggcgtacccggggaacgcgatctcgacgaccaagtacacgcccgcgagcttcgtgcccaagtcgctcttcgagcagttccgccgcgccgccaactgcttcttcctcgtcgtcgcctgcgtctccttcagcccgctcgcgccctaccgcgccgtctccgtcctgctcccgctcgtcgtcgtcgtcagcgccgccatggccaaggaggccgtcgaggactggcgccggaagcagcaggacatagaagtgaacaataggaaggttgaggtgtttgatgggatccaatcatttcatgagacggaatggaagaagcttcgagttggcgatatagttaaagttaaaaaggatgagttcttccctgctgatcttcttttcctttcgtctagctctgatgatggattatgctatgtggagacaatgaatcttgatggtgagacaaacttgaagcggaaacaggcattagaggtgactatgggcttgaatgatgaccaggttttccatagtttcaaggctttcattcgatgtgaggatccgaatgagaaactgtattctttcttaggaactctgtactacaatgggcaacaatattctctgtctccggaacagatcctgctaagggactcaaaacttcgtaatacaatgtgtatatatggcactgtaatatttacgggacatgatacaaaggtgatgcaaaatgcaatggagccaccgtcaaagaggagttcagttgaacgaaggatggataaaataatatatctcctttttgtgattctctttgctattgcaacgttcgggtcagttgtgtttggaatgaaaacaaagcatgaggtaagtccaggaaactatgcatggtacctcagaccagatcaagcaaatatattctttgatccaaacaatgcatcatttgcagccttctgccattttctcacaagcctgatgctgtatgtgtgcttggtgcctatttcattgtatatatcgatagaaattgtcaaggtgttacagagcacattcataaatcaagaccagaatatgtattgtgcagagtctgataaacctgcaagagctcgcacttcaaatttgaatgaagaacttggtcaagttcacactatactgtctgacaaaacagggacattaacatgcaattcaatggagttcttgaaatgttctattgctggtgttgcttatggaaatatggctacagaagtggtgacatgttatggagaaatagctgaaactactggcagttttgggcacaaggacactgctgaattcaagagatcagtcaaggggtttaatttcactgatagtcgtttgatgaatggaagatgggccaaagaatgttcaagggatgctatagaaatgtttttccgagtgttagctgtttgccatactgcaattcctgtggcagatagaaattctgctggtatgccttatgaagctgagtctcctgatgaaggagctcttgttacagctgcaagagagtttggttttgaattttatcataggacacaaacgacaatatcagtgcatgagtatgatcctgttgttggtggaaaggtggatagaacatataaactactcaacatcttagagttcagcagtgctcgtaagcgtatgtctgtcattgtgaggacagaagagggtcgactatttctcttctgcaaaggagcggacagtgtaatatttgaaaggctctccaaggataatggaacagcttgtctgaccaaaacgaagtgtcacattgatgagtattctgaggcaggtctccggaccctggcacttgcatattgtgaacttactgaagaacaatatgttgtatggaatcagaagtactcgtctgccaagaattctgtacatactgatcacgatgcagctgttgagaaggcatcagaagacattgagaaggatttggttctcttgggtgctactgctgtagaggatagattgcaaaatggggtccctgaatgtatttacaaacttgcacaagctggaattaagatctggattttaactggagacaagttggagacagctgtgaacataggttacgcttgtaacctactgaggaaagagatggaggaaatttttatcacactggagaactcaggtacaaatgcttcagagggttccagtggagaaggaaacaaaatggccgcgtttgaagaaattgataggaaattacaagatgctagaggaaagatttcccaaaaaggaacttcaacttcatttgctcttatcattgatggcaatgctctgacacatgctctcacgggccgccttaagaactcatttctagatctagcagtcaactgtgcatcagttttatgttgtcgggtttcaccaaaacaaaaggcactggtcaccaggttgattaaaattaggacaagtaaaactactttagctattggcgatggagcaaatgatgttggtatgctacaagaggctgacattggggttggaataagtggtgctgaaggaatgcaggctgttatggcaagtgactttgcaattgcacagtttcgtttcttagagcgattacttcttgtgcatggtcattggtgttatcgtcggattgcagctatgatatgctattttttcttcaagaacatcacatttggctttacgcttttctggtttgaggctcatgctatgttctcagcacaacctgcgtacaatgattggttcatttctttctataacgttgccttcacatctcttcctgtcatcgccctcggtgtttttgacaaggatgtctcttcccgtgtttgtcttgaggtcccttcattacatcaagatggtgttaataatgtattcttcagttggtcccgaatactcagttggatgttaaatgggatgtgctgttcaataattatttactttggttccctcaacgctattctggttcaggctgtccgacaggatggtcgtgttgctgggtttgacatccttggggtgaccatgtacagttgtgtagtgtggactgtgaactgccagcttgctctctacatcagctacttcacctggatacagcattttgtcatctggggcagcatactgatctggtacactttcctggtcatctatggactattttccccagcaatatcgaccactgcatatcatgtttttgtggaagcttgtgcgcctagccctttgtactggttatctattctaatgattgtggtgaccgccttgatcccattctttgtctacaaaatatcgagaacactgtattacccacagtatcatgatcaagttcaaagggctaactcaaagaattggtagtgccagttgtataagatgctactgaatgaggatatgtacagtcagtaatttggtttaacataccacatggtttgctttctagatcatgatgtcagaggtagtgtatataaaaagttggctgtttaacagatcttgtatatacggtttatgcccacaaagttacaggttcaggttatggcagtgtatctgtgaaatatcagaacacaatggtgacttctcagtcatgcggaaggaactgcaagctgcaaattgattttttggatcaatgaccccactagaacacatttttcttttgttgtggatgggggtcatcatggaagcagattgcaattaggatttatatagaatgatgtatagcacgttggtaactgcaaatattagttccttaatgtatgagtattgttctaggaaaattagtgatcttgtagtatcaaactgtcaaaaccaatgttcttggaagcatagttaataccctttattgctccaatggtttgtggcttgtatgtaggcatctccagtt

SEQ ID NO: 1663 - DNA, 4225 bp, Sorghum bicolor
ccaggccgtgtccaaactccaaagcaccactcccactccctccgcccacgcgcacggcgcgcccgtcctgtgcacacatcacaacaccacacgccgcgctcgtcagttgtcacgcaccccacgacgcccacgccccaaccgtccctccaaacccagatcctcccccgcctcgcctcacccaccaccatgcccatggacacagacgagcgccccctcgtcgagctcgcctccgcctccgccggcgccgctgcggccgccactactcccaccgcctcgacctccgcctccgctcccttcccggcccctgccacaccggggttctcccgcgcggtccgctgcaacgcgcccgcttcctcgctcccgggcaccgatggcggcgcgcagcagccggcgtacccggggaacgcgatctcgacgaccaagtacacgcccgcgagcttcgtgcccaagtcgctcttcgagcagttccgccgcgccgccaactgcttcttcctcgtcgtcgcctgcgtctccttcagcccgctcgcgccctaccgcgccgtctccgtcctgctcccgctcgtcgtcgtcgtcagcgccgccatggccaaggaggccgtcgaggactggcgccggaagcagcaggacatagaagtgaacaataggaaggttgaggtgtttgatgggatccaatcatttcatgagacggaatggaagaagcttcgagttggcgatatagttaaagttaaaaaggatgagttcttccctgctgatcttcttttcctttcgtctagctctgatgatggattatgctatgtggagacaatgaatcttgatggtgagacaaacttgaagcggaaacaggcattagaggtgactatgggcttgaatgatgaccaggttttccatagtttcaaggctttcattcgatgtgaggatccgaatgagaaactgtattctttcttaggaactctgtactacaatgggcaacaatattctctgtctccggaacagatcctgctaagggactcaaaacttcgtaatacaatgtgtatatatggcactgtaatatttacgggacatgatacaaaggtgatgcaaaatgcaatggagccaccgtcaaagaggagttcagttgaacgaaggatggataaaataatatatctcctttttgtgattctctttgctattgcaacgttcgggtcagttgtgtttggaatgaaaacaaagcatgaggtaagtccaggaaactatgcatggtacctcagaccagatcaagcaaatatattctttgatccaaacaatgcatcatttgcagccttctgccattttctcacaagcctgatgctgtatgtgtgcttggtgcctatttcattgtatatatcgatagaaattgtcaaggtgttacagagcacattcataaatcaagaccagaatatgtattgtgcagagtctgataaacctgcaagagctcgcacttcaaatttgaatgaagaacttggtcaagttcacactatactgtctgacaaaacagggacattaacatgcaattcaatggagttcttgaaatgttctattgctggtgttgcttatggaaatatggctacagaagtggtgacatgttatggagaaatagctgaaactactggcagttttgggcacaaggacactgctgaattcaagagatcagtcaaggggtttaatttcactgatagtcgtttgatgaatggaagatgggccaaagaatgttcaagggatgctatagaaatgtttttccgagtgttagctgtttgccatactgcaattcctgtggcagatagaaattctgctggtatgccttatgaagctgagtctcctgatgaaggagctcttgttacagctgcaagagagtttggttttgaattttatcataggacacaaacgacaatatcagtgcatgagtatgatcctgttgttggtggaaaggtggatagaacatataaactactcaacatcttagagttcagcagtgctcgtaagcgtatgtctgtcattgtgaggacagaagagggtcgactatttctcttctgcaaaggagcggacagtgtaatatttgaaaggctctccaaggataatggaacagcttgtctgaccaaaacgaagtgtcacattgatgagtattctgaggcaggtctccggaccctggcacttgcatattgtgaacttactgaagaacaatatgttgtatggaatcagaagtactcgtctgccaagaattctgtacatactgatcacgatgcagctgttgagaaggcatcagaagacattgagaaggatttggttctcttgggtgctactgctgtagaggatagattgcaaaatggggtccctgaatgtatttacaaacttgcacaagctggaattaagatctggattttaactggagacaagttggagacagctgtgaacataggttacgcttgtaacctactgaggaaagagatggaggaaatttttatcacactggagaactcaggtacaaatgcttcagagggttccagtggagaaggaaacaaaatggccgcgtttgaagaaattgataggaaattacaagatgctagaggaaagatttcccaaaaaggaacttcaacttcatttgctcttatcattgatggcaatgctctgacacatgctctcacgggccgccttaagaactcatttctagatctagcagtcaactgtgcatcagttttatgttgtcgggtttcaccaaaacaaaaggcactggtcaccaggttgattaaaattaggacaagtaaaactactttagctattggcgatggagcaaatgatgttggtatgctacaagaggctgacattggggttggaataagtggtgctgaaggaatgcaggctgttatggcaagtgactttgcaattgcacagtttcgtttcttagagcgattacttcttgtgcatggtcattggtgttatcgtcggattgcagctatgatatgctattttttcttcaagaacatcacatttggctttacgcttttctggtttgaggctcatgctatgttctcagcacaacctgcgtacaatgattggttcatttctttctataacgttgccttcacatctcttcctgtcatcgccctcggtgtttttgacaaggatgtctcttcccgtgtttgtcttgaggtcccttcattacatcaagatggtgttaataatgtattcttcagttggtcccgaatactcagttggatgttaaatgggatgtgctgttcaataattatttactttggttccctcaacgctattctggttcaggctgtccgacaggatggtcgtgttgctgggtttgacatccttggggtgaccatgtacagttgtgtagtgtggactgtgaactgccagcttgctctctacatcagctacttcacctggatacagcattttgtcatctggggcagcatactgatctggtacactttcctggtcatctatggactattttccccagcaatatcgaccactgcatatcatgtttttgtggaagcttgtgcgcctagccctttgtactggttatctattctaatgattgtggtgaccgccttgatcccattctttgtctacaaaatatcgagaacactgtattacccacagtatcatgatcaagttcaaagggctaactcaaagaattggtagtgccagttgtataagatgctactgaatgaggatatgtacagtcagtaatttggtttaacataccacatggtttgctttctagatcatgatgtcagaggtagtgtatataaaaagttggctgtttaacagatcttgtatatacggtttatgcccacaaagttacaggttcaggttatggcagtgtatctgtgaaatatcagaacacaatggtgacttctcagtcatgcggaaggaactgcaagctgcaaattgattttttggatcaatgaccccactagaacacatttttcttttgttgtggatgggggtcatcatggaagcagattgcaattaggatttatatagaatgatgtatagcacgttggtaactgcaaatattagttccttaatgtatgagtattgttctaggaaaattagtgatcttgtagtatcaaactgtcaaaaccaatgttcttggaagcatagttaataccctttattgctccaatggtttgtggcttgtatgtaggcatctccagttccatgccattttcttaggaccattcattccttc

SEQ ID NO: 1664 - DNA, 4058 bp, Zea mays
gccaccgccaatccaccaccatgcccatggacaccgacgagcgccccctcgtcgagctcgcctccgctgcggccgccactactctcgccgcctcctccacctcctccgcccccttccccgcccctgccacgcctgggttctcccgcgcggtccgctgcaacgcccccgcttcctcgctcccggccgatggcggggccggcgcgcagccggcctacccggagaacgcgatctcgacaaccaagtacacgcccgcgagcttcgtgcccaagtcgctcttcgagcagttccgccgcgccgcgaactgtttcttcctcgtcgtcgcctgcgtctccttcagccctcttgcgccctaccgcgccgtctccgtcctgctcccgctcgtcgtcgtcgtcagcgccgccatggccaaggaggccgtcgaggactggcgccggaagcagcaggacatagaagtgaacaataggaaggttgaggtgtatgatgggatccaatcatttcatgagacagaatggaagaagcttcgagttggcgatataattaaagttaaaaaggatgagttcttccctgctgatcttattttcctttcgtctagctcttgtgatggattatgctatgtggagacgatgaatcttgatggtgagacaaacttgaagcggaaacaggcattagaggtgactatgggcttgaatgatgaccatttccatagtttcaaggctttcattcggtgtgaggatccgaatgagaaattgtattctttcttaggaacactatactacaatgggcaacaatattctctgtctccggaacaggtcctgctaagggattcaaaacttcgtaatacaatgtatatatatggcaccataatatttacgggacatgatacaaaggtgatgcaaaatgcaatggagccaccatcaaagaggagttcagttgaacgaagaatggataaaataatatatctcctttttgtgattctctttgttattgcaacgtttgggtcaattgtgtttggaatgagaacaaagcatgagataagtccaggaagctatgcatggtacctcaggccggatcaagcaaatatattctttgatccaaacaatgcatcgtttgcagcattctgccattttcttacaagcctgatgctgtatgtgtgcttggtgcctatttcattgtatatatcgatagaaattgtcaaggttttacagagcacatttataaatcaagaccagaatatgtattgcgccgagtctgataaacctgcaagagctcgcacttcaaatttgaatgaagaacttggtcaagtccatactatactgtctgacaaaacagggacattaacatgcaattcaatggagttcttgaaatgttccattgctggtgttgcttatggaagtaggcctacagaagttgaaacgtgttatggagaaatagttgaaactaatggcagttttgggcgcaaggacactactgaattcaagagatcagtcaagggatttaatttcactgatagtcatttgatgaatggaagatgggccaaagaatgttctagggatgctatagaaatgtttttccgagtcttagctgtttgccatactgcgattcctgtggcagatggaaattctgctggtatgccttatgaagctgagtctcctgatgaagcagctcttgttacagctgcaagagagtttggctttgaattttatcataggacacaaacaactatatcagtgcatgagtacgatcctgtcgttggtggaaaggttgatagaacatataaactactcaacatcttagaattcagcagtgctcgtaagcgtatgtctgttattgtgaggacagaagagggtcggctatttctgttctgcaaaggagctgacagtgtaatattcgaaaggctctccaaggataatggaacagctcatctgaccaaaacaaagtgtcacattgatgagtattctgaggcaggtctccggaccctggcacttgcatattgtgaacttactgaagaacaatatgttgtatggaatcaggattactcgtctgccaagaattctgtacatactgatcatgttgcagctgttgagaaggtgtcagaagacattgagaaggatttggttcttttgggtgctactgctgtagaggatagattgcaaaatggggtccctgagtgtatttataaacttgcacaagctggaattaagatctggattttaactggagacaagttggagacagctgtaaacataggttacgcttgtaacctactgaggaaagagatggaggaaatttttatcacactggagaactcaagtacaagtgcttcagaggggtccagtggagaaggaaacaaaattgccacatttgaggaaattgatagaaaattaaaagatgctagaggaaagatttcccaaaaaggaacttcaacttcatttgctcttatcattgacggcaatgctctgacacatgctctcacgggcagccttaagaactcatttctggatctagcagtcaactgtgcatctgttttatgttgtcgggtttcaccaaaacaaaaggcactggtcaccagattggttaaaattaggacaagtaaaactactttagctattggtgatggagcaaatgatgttggtatgctacaagaggctgacattggggttggaataagtggtgctgaaggaatgcaggctgttatggcgagtgactttgcaatagcacagtttcgttttttagagcgattacttcttgtgcatggtcattggtgttatcgtcggattgcagctatgatatgctattttttcttcaagaacatcacatttggctttacgcttttctggtttgaggctcatgctatgttctcagcacaacctgcgtacaatgattggttcatatctttctataatgttgccttcacatctcttcctgtcatcgccctcggtgtttttgacaaggatgtctcttcccatgtttgtcttgaggtcccttcattacatcaagatggcgttaataatgtattcttcagttggtcccgaatactcagttggatgttaaatgggatgtgctgttcaataattatttactttggttccctcaacgctattctggttcaggctgtccgacaggatggtcgcgttgctgggtttgatatccttggggtgaccatgtacacttgtgtagtgtggactgtgaactgccagcttgctctctacatcagctacttcacctggatacaacattttgtcatctggggcagcatactgatttggtacactttccttgtcatatatggtctattttccccagcaatatcaaccactgcatatcatgtttttgtggaagcttgtgcacctagccctttgtactggctatccactctaatgattgtggtgacagccttgatcccattctttgtctacaaaatatcgagaacactctattatccacagtatcatgatcaagttcagagggctaactcaaagaattggtagtgcctgttgtataagatgctactgaatgaggggatgtacagtcagtaatttggtttaacataccacatgctttgctttgtagatcatgatgcagaggtagtgtatataaacaaagttggctgtttaacagatcttgtatttacggtctatgcccacaaagttacagtttcaggttgtggcagtgcgtctgtcaaatatcagaacacaatggtgacttcgcagtcacgcgaaggaactgcaagcggcaaattgattctttggacctattaccccactaggacacgtttttcttcggggtgccatcatggaagcagattgcaattaggatttatatagaatgatgtatagcatgtcgataactcgaacatgacttcctcgatatatgtagtactgtcttccaaaaaatagcattcttgtagcatcaaacggccaaacctatgttcgtggaagcatagttaataccctttattgctccaatggtttgtacatagttgtatgaatatatgagatggatcttgatgttgtttaacatttgatatgaaatgaataaatgatatgatgttatctcta

SEQ ID NO: 1665 - DNA, 4032 bp, Brachypodium distachyon
tcctcctcctcctcacgccgaccatgcgcgcctccgccaccgacaccgacgagcggcccctcgtcgagctcgccgtcgtcacccccacgccttccacatcctcccccgccgccctcgccaccgggccgcccgcgccggccccggggttctcccgcgccgtccgatgcaacgccccctcctccgcctccgcctcgggagatggcgcctacccggggaacgcgatatccaccaccaaatacacggccgccagcttcctgcccaagtcgctcttcgagcagttccgccgcgtcgccaactgcttcttcctcgtcgtcgcctgcgtctccttcagcccgctcgcgccctaccgcgccgtctccgtcctgctcccgctcttcgtcgtcgtctccgccgccatggccaaggaggccgtcgaggactggcgccggaagcagcaggacatagaagtgaacaataggaaggttgaggtttatgatgggacccaatcttttcatgaaacagaatggaagaagcttcgagttggtgatatagttaaagtgaaaaaagatgagttcttccctgcggaccttcttttgctctcttcgtgccatgaggatggaacatgttatgttgaaacgatgaatcttgatggagagacaaacttgaagcgaaaacaatcgttggacgtgaccgttggcttgagtgaggagcattctttccatagtttcaaggcttttatacaatgtgaggatccaaacgagaaattatactccttcctagggacgttgtactatagggagcaacaatatcctctgtctccacaacagatcttgctaagggactcaaagcttcggaatacaaacttcatatatggcactgtaatattcacagggcacgaaacaaaggtgatgcagaatgcaacggagccaccatcaaagaggagttctgttgaacggagaatggacaaaatagtttatcttctctttgcagttctcttcactattgcatcttttgggtcaattttctttgggatcaagacgaaggccgaattaaatgtaggaagctatgcatggtacctaaggccagatcagtccagtatattctttgatccaaacagagcatcatttgcagccttttgccattttctgacaagtcttatgttgtatgtatgcttggtgcccatttcattgtatatatcaattgaaatggttaaagtcttacagagcactttcataaaccaagaccagaatatgtattgcgaggagtctgataaaccagcaagggctcgcacatcaaatttgaatgaggaacttggtcaggttcataccatactctctgacaaaacaggaaccttaacatgcaattcaatggagttctccaaatgttccattgctggtgttgcttatggcagtaggcttacagaagtggagatgtcttacggtgaaatagaggacgtgtctggccaaatgcatgcagctaaatctaaaagatcagtcaagggatttaacttcactgacggtcgtttgatgaacggagaatgggctaaagaatgtcatagagatgctatagagatgtttttccgtgcattagctgtttgtcacactgcaataccggtgtcagataaagattctattgggatgacttatgaagcggagtcacctgatgaaggagctcttgttgcagctgccagagaatttggttttgaattttatcataggacacagacaaccatatcggtgcacgagtatgagcctgtctttggtaaagaagtggatagaacatataagctactcaacatattagagtttagcagtgcccggaagcgcatgtctgttattctgaggacagaagagggtcggctatttctgttctgcaaaggagctgacagtgtaatactcgaaaggctctctaaggataatgaaaaatcttgtgtggccaatacgaagcagcacatcgaagtgtattctgaggcaggtctgcggacccttgcactggcatatcgtgaacttactgaggatgactatgctgcctggaatgaggagtactcatccgccaagaattctgtacacactgatcatgatgcagctgtggagaaggcctcagaaaatattgagaaagatttggttctcttaggtgctactgctgtggaagacagactgcaaaagggggttccagagtgtattcacaaactagcgcaagctggaattaagatctggattttaacaggagacaagttggagacagctgtcaacataggttattcttgcaacttattgaggaaggaaatggaggaattttttgtgacactggacaactcaggaacaaatgctccagagggatgcaaccaggaaggcagcagaatggctccatatgaacatatcggtagaaaattacaagatgctcgaaggcaaatttcattgaaaggaacttcaactccatttgctcttatcattgatggcaatgctctaacatatgctcttacgggcagtcttaaggactcatttctggatctagcagttgattgtgcatcagttttatgttgtcgcatgtcgcctaaacagaaagcactgatcaccaggttggttaaaacaaaaacaaagaaaaccacactagctattggtgatggagcaaatgacgttggtatgctacaagaggctgatattggtgttggaataagtggtgctgaaggaatgcaggctgtgatggcaagtgactttgcaatagctcagtttcgctttctagagcggttactccttgtgcatggtcactggtgttaccgccgtattgcagccatgatttgctattttttcttcaagaacattacatttggcttcacacttttctggtttgaggctcatgccatgttctcagctcaacctggttacaatgattggtttatatctttctacaatgttgccttcacatctctccccgtcatcgctctaggtgttttcaataaagatgtctctgccagtgtttgcctcgaggtccctttgttacatcaagatggcgtgaataatgtattcttcagctggtctcgtatactcagttggatgctaaacggactgtgctcttcaatcattatattctttggtgccatcaatgctgttctcattcaggctgttcgacaggatggccgtgttgctggatttgacatccttggagtgaccatgtacacttgtgtggtgtggactgtcaattgccagttagcactctacatcagctactttacctggatacaacatttcgtcatctggggcagtatactgatttggtacacttttctaatcatctatggctcattccctgctatgatatcgaccacagcgtatcatgttttctgggaagcttgtgcttcaagccctctgtactggctgtctactctagtcattgttgtgacagccttgctcccgttcttcctctacagagtaacttgttcactatttaacccacagcaccctgagcgagttcagagaactaactcgaagaactggtgaagcaagttaatataggtgggtagtgaagtaactttacatagagataccggctatcgatctaacataccttatggttcacttgctacagcatgatgtttctgtagatttttatatggtgaatattgtatcaaaacaaatgttgctactctatgtattagaattagattatgtacatacttgggttcatacctgacaagttcagctgagttatggtagatcagtcaacatcaacacggaaggaattccgagcaacaagttggtagtcctttgcatgatgcaacagcgtagcactcatcaggactggttgttcttgcctagtagtacccttcaggattggtggttcttgcatatcactcttcagctttgggccttgttggcagtttctggtctttgtttatacgtgttgtaccagcattcaatggatttatactcgggattcattttgtttactactgatctcaggtctaatcaggtttgtgctctgttctggttgtgacgaaacatgacatgcgctaacctgtaatttagttagtgtgccattatccttgagaccttg

SEQ ID NO: 1666 - DNA, 4248 bp, Brachypodium distachyon
actcgccacatggcagggcacgaacagccaggccccaccccgacgacgccgtctccgggacgtttacccccactcgtacacccacccgcccctaaccgcgccccacccagatcctcctcctcctcacgccgaccatgcgcgcctccgccaccgacaccgacgagcggcccctcgtcgagctcgccgtcgtcacccccacgccttccacatcctcccccgccgccctcgccaccgggccgcccgcgccggccccggggttctcccgcgccgtccgatgcaacgccccctcctccgcctccgcctcgggagatggcgcctacccggggaacgcgatatccaccaccaaatacacggccgccagcttcctgcccaagtcgctcttcgagcagttccgccgcgtcgccaactgcttcttcctcgtcgtcgcctgcgtctccttcagcccgctcgcgccctaccgcgccgtctccgtcctgctcccgctcttcgtcgtcgtctccgccgccatggccaaggaggccgtcgaggactggcgccggaagcagcaggacatagaagtgaacaataggaaggttgaggtttatgatgggacccaatcttttcatgaaacagaatggaagaagcttcgagttggtgatatagttaaagtgaaaaaagatgagttcttccctgcggaccttcttttgctctcttcgtgccatgaggatggaacatgttatgttgaaacgatgaatcttgatggagagacaaacttgaagcgaaaacaatcgttggacgtgaccgttggcttgagtgaggagcattctttccatagtttcaaggcttttatacaatgtgaggatccaaacgagaaattatactccttcctagggacgttgtactatagggagcaacaatatcctctgtctccacaacagatcttgctaagggactcaaagcttcggaatacaaacttcatatatggcactgtaatattcacagggcacgaaacaaaggtgatgcagaatgcaacggagccaccatcaaagaggagttctgttgaacggagaatggacaaaatagtttatcttctctttgcagttctcttcactattgcatcttttgggtcaattttctttgggatcaagacgaaggccgaattaaatgtaggaagctatgcatggtacctaaggccagatcagtccagtatattctttgatccaaacagagcatcatttgcagccttttgccattttctgacaagtcttatgttgtatgtatgcttggtgcccatttcattgtatatatcaattgaaatggttaaagtcttacagagcactttcataaaccaagaccagaatatgtattgcgaggagtctgataaaccagcaagggctcgcacatcaaatttgaatgaggaacttggtcaggttcataccatactctctgacaaaacaggaaccttaacatgcaattcaatggagttctccaaatgttccattgctggtgttgcttatggcagtaggcttacagaagtggagatgtcttacggtgaaatagaggacgtgtctggccaaatgcatgcagctaaatctaaaagatcagtcaagggatttaacttcactgacggtcgtttgatgaacggagaatgggctaaagaatgtcatagagatgctatagagatgtttttccgtgcattagctgtttgtcacactgcaataccggtgtcagataaagattctattgggatgacttatgaagcggagtcacctgatgaaggagctcttgttgcagctgccagagaatttggttttgaattttatcataggacacagacaaccatatcggtgcacgagtatgagcctgtctttggtaaagaagtggatagaacatataagctactcaacatattagagtttagcagtgcccggaagcgcatgtctgttattctgaggacagaagagggtcggctatttctgttctgcaaaggagctgacagtgtaatactcgaaaggctctctaaggataatgaaaaatcttgtgtggccaatacgaagcagcacatcgaagtgtattctgaggcaggtctgcggacccttgcactggcatatcgtgaacttactgaggatgactatgctgcctggaatgaggagtactcatccgccaagaattctgtacacactgatcatgatgcagctgtggagaaggcctcagaaaatattgagaaagatttggttctcttaggtgctactgctgtggaagacagactgcaaaagggggttccagagtgtattcacaaactagcgcaagctggaattaagatctggattttaacaggagacaagttggagacagctgtcaacataggttattcttgcaacttattgaggaaggaaatggaggaattttttgtgacactggacaactcaggaacaaatgctccagagggatgcaaccaggaaggcagcagaatggctccatatgaacatatcggtagaaaattacaagatgctcgaaggcaaatttcattgaaaggaacttcaactccatttgctcttatcattgatggcaatgctctaacatatgctcttacgggcagtcttaaggactcatttctggatctagcagttgattgtgcatcagttttatgttgtcgcatgtcgcctaaacagaaagcactgatcaccaggttggttaaaacaaaaacaaagaaaaccacactagctattggtgatggagcaaatgacgttggtatgctacaagaggctgatattggtgttggaataagtggtgctgaaggaatgcaggctgtgatggcaagtgactttgcaatagctcagtttcgctttctagagcggttactccttgtgcatggtcactggtgttaccgccgtattgcagccatgatttgctattttttcttcaagaacattacatttggcttcacacttttctggtttgaggctcatgccatgttctcagctcaacctggttacaatgattggtttatatctttctacaatgttgccttcacatctctccccgtcatcgctctaggtgttttcaataaagatgtctctgccagtgtttgcctcgaggtccctttgttacatcaagatggcgtgaataatgtattcttcagctggtctcgtatactcagttggatgctaaacggactgtgctcttcaatcattatattctttggtgccatcaatgctgttctcattcaggctgttcgacaggatggccgtgttgctggatttgacatccttggagtgaccatgtacacttgtgtggtgtggactgtcaattgccagttagcactctacatcagctactttacctggatacaacatttcgtcatctggggcagtatactgatttggtacacttttctaatcatctatggctcattccctgctatgatatcgaccacagcgtatcatgttttctgggaagcttgtgcttcaagccctctgtactggctgtctactctagtcattgttgtgacagccttgctcccgttcttcctctacagagtaacttgttcactatttaacccacagcaccctgagcgagttcagagaactaactcgaagaactggtgaagcaagttaatataggtgggtagtgaagtaactttacatagagataccggctatcgatctaacataccttatggttcacttgctacagcatgatgtttctgtagatttttatatggtgaatattgtatcaaaacaaatgttgctactctatgtattagaattagattatgtacatacttgggttcatacctgacaagttcagctgagttatggtagatcagtcaacatcaacacggaaggaattccgagcaacaagttggtagtcctttgcatgatgcaacagcgtagcactcatcaggactggttgttcttgcctagtagtacccttcaggattggtggttcttgcatatcactcttcagctttgggccttgttggcagtttctggtctttgtttatacgtgttgtaccagcattcaatggatttatactcgggattcattttgtttactactgatctcaggtctaatcaggtttgtgctctgttctggttgtgacgaaacatgacatgcgctaacctgtaatttagttagtgtgccattatccttgagaccttgacttcttgtgaccaagttgatgctgatgaatgctgaaatttgtactagtagttcgttacgtagtaactagccgtgcaatagctcaagaaggtggctgcaaaaaga

SEQ ID NO: 1667 - DNA, 4522 bp, Oryza sativa
ggaaaggagagccttttcttccctcagttcctctcctccaccacttcgcgtcacacccaccaccaccaccaccaccaccaccaccgccccactctccctctccccttcccttcccccagcagtagccctccagtccaccaccccaaccgccaaacccctctccaccccccagatccccctccgcctcgtcggccatgcgccccgcctccgcctccgccgccgacgagcgccccctcgtcgagctcacctccgccgccgcgaccgcacccgcgtccaccgagacctccacgttctcctccgcaccgggattcacccgcgcggtgcgctgcagcggcgcgggatcctcctcctcgtcctcatcctcctccgacgagggcggcggtggggtgtacccggggaacgcgatctcgacgaccaagtacacggcggcgagcttcgtgcccaagtcgctgttcgagcagttccgccgcgccgccaactgcttcttcctcgtcgtcgcctgcgtctcgttcagcccgctcgcgccgtaccgggccgtctccgtcctcctcccgctcgtcgtcgtcgtcggggccgccatggccaaggaggccgtcgaggactggcgacgaaagcagcaggacattgaagtgaatagcaggaaggtcgaggtttatgatggcacccaatcatttcatcagacagaatggaagaagcttcaagttggtgatatagtgaaagtgaagaaagatgagttcttccctgctgaccttgttttgctttcttcgagctatgaggatggaatatgttatgttgagacaatgaatcttgatggagagacaaacttgaagcgaaaacaatcattggacgtgactgcgggcttgaatgaggatcattctttccacaccttcaaggctttcattcaatgtgaggatccaaatgagaaattatattcctttttagggacattgcactataatgggcaacaatatcctctatccccacaacagatcctgttaagggattcaaagcttcggaacacaaatcaaatttatggcattgtaattttcacggggcatgacacaaaggtaatgcagaatgcaatggaaccaccatcaaagaggagttctgttgaacgaagaatggataagatcatttatcttctttttgtaattctctttgctattgcatcgtttgggtcggttatgtttggtatcagaacgagggctgaattaagtgcagggaactatgcctggtacctaaggccagataactcaactatgtactttgatccaaacagagcaacattagcagctatttgccattttctgacaagtctcatgctgtatgtgtgcttggtgcccatttccttgtatatatcgatagagatcgttaaagtcttacagagcacattcataaatcaagaccagaacatgtattgcgaagagtctgataaaccagcaagggctcgcacatcaaatttgaatgaggaacttggtcaagtgcacaccatactctctgacaaaacaggaaccttaacatgtaattcgatggagttcctgaaatgttccattgctggtgttgcttatggaaataggcctatagaagtgcagatgccttatggaggaatagaggaagaatgtgttgatattgggcagaagggtgctgttaaatctgtaagaccggtaaagggattcaactttactgatgaccgcttgatgaatggacagtggagcaaagagtgccatcaagatgttatagaaatgtttttccgtgtgttagctgtctgtcatactgcaattcctgttgcagatagaacttctggtgggatgtcttatgaggcggaatcacctgatgaaggagctcttgttgcagctgcaagggaacttggttttgaattttatcataggtcacagacaagcatatcagtgcatgaatatgatcctgtcttcggtagaaaggtggatagaacctataagctactgaacaccctagagtttagcagtgcccgcaagcgtatgtctgtcattgtgagtacagaagagggtcggctatttctgttctgtaaaggggcagacagtgttattcttgagaggctctctaaggataatagcaaagcttgtctgacaaatacaaagtgccacatcgacgagtattctgaggcaggtttgcggactctggcacttgcatatcgtgaacttactgaggacgagtatgttgcgtggaatatggagtactcagctgcaaagaattctgtacataatgatcatgatgtagctgttgagaaggcatcagaaaatatcgagaaagatttggttcttttaggtgctactgctgtggaggacagattgcaaaagggggtcccagagtgtattcacaaactagctcaagctggaattaagatctggattctcacaggtgacaaattggagacagctgtcaacatagggttagtaccatatgttgcttacgttcctgacaattatgcttgcaaccttttgaggaaagggatggaggaagtttatataactctggataacccaggcacgaatgttcctgaggaacacaatggagaaagcagtggaatggctccatacgaacaaattggtagaaagttagaagatgctcgaaggcaaattttgcagaaaggaacttcagccccatttgcccttataattgatggcaatgctctaacacatgctctcatgggtggtcttaaaaccgcatttctggatctagcagttgattgtgcgtctgttttatgctgtcgcatatccccgaaacagaaagcgctgattaccagactggttaaaaataggataaggaaaaccacactagcaattggcgatggagcaaatgatgtcggtatgctacaagaggctgacattggggttggaataagtggtgctgaaggaatgcaggctgtgatggcaagtgactttgcaatagctcaatttcgttttttagaacggttactccttgtacatggtcattggtgttatcgccgaattgcagcgatgatatgctactttttcttcaagaatatcacatttggctttacacttttctggtttgaggctcatgctatgttctcagcccaacctggttacaacgattggttcatatctttctacaatgttgcctttacatctctcccggtcattgctctaggtgtctttgataaagatgtctcttcccgtgtttgcctcgaggtcccttcattacatcaagatggcgtgaataatttattcttcagctggtctcgtatactcagttggatgctgaacggagtttgctgttcaataataatatactttggagccctccatgctgtcctcattcaagctgtccgacaggatggccacgttgctggatttgacatccttggagtgactatgtatacttgcgtagtttggactgtcaactgccaactagcactctacatcagctacttcacctggatacagcatttcgtcatctggggcagcatactgatttggtacacttttctggtcatctacggctcgtttcctccaacaatatcaaccagcgcatatcatgttttctgggaagcttgcgcttctagccctttatactggttatccactctagtcattgttgtgacagccttgatcccatacttcctctacaaaatcacacagtcgctgttttgcccacagcattgtgatcaagttcagagacctaattcaaaagaattggtggctcaataattatgggactgaaggggctcaattgagagattgctatggtatcctaacaactttacagttcagtttataaaccatgatattttagatggtgaatatagtatcaaaacaaaaatagctagttaatgtgttagagttagattgtgtacatacttgagctcatacccaaaaaattagagtcgggctatagtgttgcatgagttgatatgggaatggaagtggctgcttcgacaggctcattgtttccattatactggtaaagtacagttgcttcagcggggaacttgtgttttcggacacaaggctgatattgttactggtcaacaaacccgtgagttcactcttggtcctctgatatggctcgtccttttttttttgtttattagtaatcatgattgtaatttggttgccaggagggatgagatctgttggctagtgctttgtacagccgaattagatgtttatcccccttttatgcaccatcattgtaattaagtttaagcagataatgttggcgtttttttgtgaggccaaatgttgttcttacgtgagaccaatctttcttagcctgtcgttaagtggtaagtcggatgttgatgttccatagctttcaagatgattacaaggactggactgtggtgtggacttgtgcagttgtgcctggacttattcaaggcttgtaaaaatgaaaagaaaaaaaaatgcaggaaatctctcttttcctttgtaggaattgaattgtgctcaatggactgtaatgttatagaggtgattggaatttggatttcaaactcgagattacttaacaaggagag

SEQ ID NO: 1668 - DNA, 4119 bp, Oryza sativa
atgcgccccgcctccgcctccgccgccgacgagcgccccctcgtcgagctcacctccgccgccgcgaccgcacccgcgtccaccgagacctccacgttctcctccgcaccgggattcacccgcgcggtgcgctgcagcggcgcgggatcctcctcctcgtcctcatcctcctccgacgagggcggcggtggggtgtacccggggaacgcgatctcgacgaccaagtacacggcggcgagcttcgtgcccaagtcgctgttcgagcagttccgccgcgccgccaactgcttcttcctcgtcgtcgcctgcgtctcgttcagcccgctcgcgccgtaccgggccgtctccgtcctcctcccgctcgtcgtcgtcgtcggggccgccatggccaaggaggccgtcgaggactggcgacgaaagcagcaggacattgaagtgaatagcaggaaggtcgaggtttatgatggcacccaatcatttcatcagacagaatggaagaagcttcaagttggtgatatagtgaaagtgaagaaagatgagttcttccctgctgaccttgttttgctttcttcgagctatgaggatggaatatgttatgttgagacaatgaatcttgatggagagacaaacttgaagcgaaaacaatcattggacgtgactgcgggcttgaatgaggatcattctttccacaccttcaaggctttcattcaatgtgaggatccaaatgagaaattatattcctttttagggacattgcactataatgggcaacaatatcctctatccccacaacagatcctgttaagggattcaaagcttcggaacacaaatcaaatttatggcattgtaattttcacggggcatgacacaaaggtaatgcagaatgcaatggaaccaccatcaaagaggagttctgttgaacgaagaatggataagatcatttatcttctttttgtaattctctttgctattgcatcgtttgggtcggttatgtttggtatcagaacgagggctgaattaagtgcagggaactatgcctggtacctaaggccagataactcaactatgtactttgatccaaacagagcaacattagcagctatttgccattttctgacaagtctcatgctgtatgtgtgcttggtgcccatttccttgtatatatcgatagagatcgttaaagtcttacagagcacattcataaatcaagaccagaacatgtattgcgaagagtctgataaaccagcaagggctcgcacatcaaatttgaatgaggaacttggtcaagtgcacaccatactctctgacaaaacaggaaccttaacatgtaattcgatggagttcctgaaatgttccattgctggtgttgcttatggaaataggcctatagaagtgcagatgccttatggaggaatagaggaagaatgtgttgatattgggcagaagggtgctgttaaatctgtaagaccggtaaagggattcaactttactgatgaccgcttgatgaatggacagtggagcaaagagtgccatcaagatgttatagaaatgtttttccgtgtgttagctgtctgtcatactgcaattcctgttgcagatagaacttctggtgggatgtcttatgaggcggaatcacctgatgaaggagctcttgttgcagctgcaagggaacttggttttgaattttatcataggtcacagacaagcatatcagtgcatgaatatgatcctgtcttcggtagaaaggtggatagaacctataagctactgaacaccctagagtttagcagtgcccgcaagcgtatgtctgtcattgtgagtacagaagagggtcggctatttctgttctgtaaaggggcagacagtgttattcttgagaggctctctaaggataatagcaaagcttgtctgacaaatacaaagtgccacatcgacgagtattctgaggcaggtttgcggactctggcacttgcatatcgtgaacttactgaggacgagtatgttgcgtggaatatggagtactcagctgcaaagaattctgtacataatgatcatgatgtagctgttgagaaggcatcagaaaatatcgagaaagatttggttcttttaggtgctactgctgtggaggacagattgcaaaagggggtcccagagtgtattcacaaactagctcaagctggaattaagatctggattctcacaggtgacaaattggagacagctgtcaacatagggttagtaccatatgttgcttacgttcctgacaattatgcttgcaaccttttgaggaaagggatggaggaagtttatataactctggataacccaggcacgaatgttcctgaggaacacaatggagaaagcagtggaatggctccatacgaacaaattggtagaaagttagaagatgctcgaaggcaaattttgcagaaaggaacttcagccccatttgcccttataattgatggcaatgctctaacacatgctctcatgggtggtcttaaaaccgcatttctggatctagcagttgattgtgcgtctgttttatgctgtcgcatatccccgaaacagaaagcgctgattaccagactggttaaaaataggataaggaaaaccacactagcaattggcgatggagcaaatgatgtcggtatgctacaagaggctgacattggggttggaataagtggtgctgaaggaatgcaggctgtgatggcaagtgactttgcaatagctcaatttcgttttttagaacggttactccttgtacatggtcattggtgttatcgccgaattgcagcgatgatatgctactttttcttcaagaatatcacatttggctttacacttttctggtttgaggctcatgctatgttctcagcccaacctggttacaacgattggttcatatctttctacaatgttgcctttacatctctcccggtcattgctctaggtgtctttgataaagatgtctcttcccgtgtttgcctcgaggtcccttcattacatcaagatggcgtgaataatttattcttcagctggtctcgtatactcagttggatgctgaacggagtttgctgttcaataataatatactttggagccctccatgctgtcctcattcaagctgtccgacaggatggccacgttgctggatttgacatccttggagtgactatgtatacttgcgtagtttggactgtcaactgccaactagcactctacatcagctacttcacctggatacagcatttcgtcatctggggcagcatactgatttggtacacttttctggtcatctacggctcgtttcctccaacaatatcaaccagcgcatatcatgttttctgggaagcttgcgcttctagccctttatactggttatccactctagtcattgttgtgacagccttgatcccatacttcctctacaaaatcacacagtcgctgttttgcccacagcattgtgatcaagttcagagacctaattcaaaagaattggtggctcaataattatgggactgaaggggctcaattgagagattgctatggtatcctaacaactttacagttcagtttataaaccatgatattttagatggtgaatatagtatcaaaacaaaaatagctagttaatgtgttagagttagattgtgtacatacttgagctcatacccaaaaaattagagtcgggctatagtgttgcatgagttgatatgggaatggaagtggctgcttcgacaggctcattgtttccattatactggtaaagtacagttgcttcagcggggaacttgtgttttcggacacaaggctgatattgttactggtcaacaaacccgtgagttcactcttggtcctctgatatggctcgtccttttttttttgtttattagtaatcatgattgtaatttggttgccaggagggatgagatctgttggctagtgctttgtacagccgaattagatgtttatcccccttttatgcaccatcattgtaattaagtttaagcagataatgttggcgtttttttgtgaggccaaatgttgttcttacgtgagaccaatctttcttagcctgtcgttaagtggtaagtcggatgttgatgttccata

SEQ ID NO: 1669 - DNA, 942 bp, Panicum virgatum
ccactcacctgctgccaatcaaccaagaaacacgcgcagccaccaccgcacaccaagtcagggagaagctaggccatggccggcgtgaactcaaccagcgtcgtcgggctcaagcccgccgcggcggtgccgcaggccgccgccgcctcgccggcggcgaagcgggtgcaggtcgcgcccaaggaccgggcggccgagggccggcgcgcggcgctcctcggcctggcggccgtcttcgccgtcaccgccaccaccgggtcggccaaggccgggatcatcgacgagtacctcgagaagagcaaggccaacaaggagctgaacgacaagaagaggctggccaccagcggcgccaacttcgcgcgcgcctacaccgtagagttcggcagctgccagttcccctacaacttcaccggctgccaggacctcgccaagcagaagaaagttcccttcatcagcgacgacctcgagatcgagtgcgaggggaaggagaagtacaagtgcggctccaacgtcttctggaaatggtgaagcgcacgcttgattggccaggaacgggagggagcgctggcggtgtaacgtgtgtacctagatgcccaaactgcaggaaaaaattggatgtgtaatttaccgtcattgtatctgtgccatctcatcaatcgtctgaacgtgaacctcttgcattggggagtgtgaaattgtagtattggttgttggctgactcctcatttcattggctcttaagtcagtcttagtgaagagtgttatcgcacagttacaaaaaatgtgaactaggtaaccgagccgaatgggtgtcatagtgatgacagtcctctcacatcccatgacactcccccttctcttttatgtcatgtcagcaaatttaatgtccatgatattcccataacactattattgagattggctttacgagttcttccgcac

SEQ ID NO: 1670 - DNA, 759 bp, Panicum virgatum
ccacccacgacacgatcaaaaacaaaaccatcgccacccctcccactcacctgctgccaatcaaccaagaagcacgcgcagccacaccaagtcagggagaaggccatggccggcgtgaactcaaccagcgtcgtcgggctcaagcccgccgcggcggtgccgcaggccgccacctcctcgccggcggcgaagcgggtccaggtcgcgcccaaggaccgggcggccgagggccggcgcgcggcgctcctcggcctggcggccgtcttcgccgtcacggccaccaccgggtcggccaaggccgggatcatcgacgagtacctcgagaagagcaaggccaacaaggagctgaacgacaagaagaggctggctaccagcggcgccaacttctcccgcgcctacaccgtcgagttcggcagctgccagttcccctacaacttcaccggctgccaggacctcgccaagcagaagaaagttcccttcatcactgacgacctcgagatcgagtgcgaggggaaggagaagtacaagtgcggctccaacgtcttctggaagtggtgaagcgcacgcttgattggcttggaactggagggggcgctggcggtgtaacgtgtgtacctagatgcccaaactgcaggaaaaatttggatgtgtaatttaccgtcactgtatctgtgccatctcatcatcgtctgaacatgaacctcttgtattggggagtgtgaaattgtagttggttgactactctgagttcttccgcgc

SEQ ID NO: 1671 - DNA, 499 bp, Elaeis guineensis
catggccggcgtgaactcaaccagcgtcgtcgggctcaagcccgccgcggcggtgccgcaggccgccacctcctcgccggcggcgaagcgggtccaggtcgcgcccaaggaccgggcggccgagggccggcgcgcggcgctcctcggcctggcggccgtcttcgccgtcacggccaccaccgggtcggccaaggccgggatcatcgacgagtacctcgagaagagcaaggccaacaaggagctgaacgacaagaagaggctggctaccagcggcgccaacttctcccgcgcctacaccgtcgagttcggcagctgccagttccccctacaacttcaccggctgccaggacctcgccaagcagaagaaagttcccttcatcactgacgacctcgagatcgagtgcgagggaaggagaagtacaagtgcggctccgaacgtcttctggaagtggtgaagcgcacgcttgattggcttggaactgggagggggcgctggcgg

SEQ ID NO: 1672 - DNA, 903 bp, Cynodon dactylon
acgacgaacatacacagaccaaagagcatcagagagaggacatggccggcgtgaacactagcatcgtcgggcttaagcccgccgcggcggtgccgcaggcagcagcctcgtctccggccaagagggtgcaggtggcgcccgagggccgccgcgctgctcttcttggtctggctgccgtcttcgctgtcacggccaccaccggatcggccaaggctggaatcatcgacgagtatctcgagaagagcaaggccaacaaggagctgaacgacaagaagaggctcgccaccagcggtgccaacttcgctcgtgcctacaccgtcgagttcgggagctgccagttcccctacaacttcaccgggtgccaggaccttgctaagcagaagaaagtgccgttcatcagcgacgaccttgagattgagtgcgaggggaaggagaagtacaagtgcggctcaaatgtcttctggaagtggtgaagcagttgactgttccccaggaactctgtacctagatgcctgaactgcagaaaagatttcgatgtaacttgttgccgtatttgtatcacctcatttgatcatgaacctcttggggagagtgaaactgtagtttacgtgtgtcctttcttgattgcttcgttcatttttgtggcatcgcattaagttttcatgagaaaggagggcgagcttgacagttaaaaagggggccaaaaaatgataacagagaaatatcggcaacatgataatccttcttcacagaagtcaccagatgtacttcagacaaatttctctatgtgacactcatatataaataggttgtgcgtgtgtacgtatgttcataggggtgattactctatgtgaatgtttgtatttgaactatattcattgaaaaaagaagaaaactatttat

SEQ ID NO: 1673 - DNA, 663 bp, Eragrostis curvula
  misc_feature (20)..(20): n is a, c, g, or t
  misc_feature (112)..(112): n is a, c, g, or t
  misc_feature (193)..(193): n is a, c, g, or t
caccgggtggcggccgctgncaaccaggaacgacgagcacacacatagcccaaggacacatcagcaagaggacatggccggcgtgaactccagcgttgtcgggctcaagccngccgcggcggtgccgcagtccgccgccgcctcgccggtggccaagagggtgcaggtcgcgcccgagggccgccgcgcggcnctcctcggccttgcggccgtgttcgctgtcacggccaccaccggagctgccaaggccggcgtcatcgatgagtacctggagaagagcaaggccaacaaggagctgaacgacaagaagaggctggccaccagcggtgctaactttgcgcgcgcctacaccgtcgagttcgggagctgccagttcccctacaacttcaccgggtgccaggacctcgccaagcagaagaaagtgccgttcatctctgatgacctcgagattgagtgcgaggggaaggagaagtacaagtgcggctcaaacgtcttctggaaatggtgatgcggctgattattgacggccgggagttctgtacctagatgccccctactgaagaaaaatatttggatgtaactttgttgtcagtgtatttgtatcctcttatgtgatcatgaaccactttggggagagtgaacctgcagtatccaaaaaaaaaa

SEQ ID NO: 1674 - DNA, 1520 bp, Zea mays
tatatagcattctccatatataagatatgatttcactcatacaacccatataatacttataattgatatttaaacattcgatgtgacacagactaaacttttagtgagagaggaaccaaacaatccctaaataaaagtgggacagtgttgacaggcctccatgcgttcatctaagcaagcaatatctccctcaagatcagcgtacccaaggactactcgccacgtgtcatacgggacccatcgccgttcagataacgggtgccacgtttgcaatgcccagccaatgggatggaagcagcctcaccctatccacacgcccacgcgcagcaccacaaccttcgccttcctccatcagtttccctccaccgcacccacgatcaaaaacgtacaaaaccatcgctaccccctcaccctcactctccctgctgcaacccaaccaagcccgcacgacacgacaccaagtcgaggagctcgagagggcaccaataatggccggcgtgaactccagcgtcgtcgggctcaagcccgccgcggcagtgccgcaggccgccgccgcctcatcgccggcgaagcgggtgcagctggccgcgcccgagggccgccgcgccgctctgctcggcctggcggccgtcttcgccgtcacggccaccaccgggtcggccaaggccacgatcttcgatgagtacctcgagaagagcaaggccaacaaggagctgaacgacaagaagaggctggccaccagtggagccaactttgcgcgcgcctacaccgtggagttcggcagctgccagttcccctacaacttcactgggtgccaggacctcgccaagcagaagaaagtccccttcatcagcgacgacctcgagattgagtgcgaggggaaggagaagttcaagtgcggctccaacgttttctggaagtggtgaagcagctagcagcagcgtctgatgggaatggaggagatcatcacctgtcttgtcgaccctagatatgtccaaactgcagggaaattaaatcttcatgtgtaattgtgctcattctgtttcaatcatctcaacatccgatcatgaacctcttgcattattaactggctcgatcgtcttctcagtttaagacattggaggctgctttgtttgtttcagaggtccttcttaagatgatgctatattttgtcatggttaatgtgataaacagggtcaggtcggattattcttgaatatataaaatagaattttaggctctagcaaaccagtatatgagcaaaagaaaatttggaaacaagaaagtacctagatgtaaaaaaatatgaacaataagaagagaataataacagtagtagtctataccactagataatccaacagtttaaacattacaaaactcacctaaccaaatcatccacacaccaataacctccacaaacaaattgcacccagacttaacataccattaaaaccaaaggttcagatcttccattacttactcaaatccaataacaatattatttacatcatctctca

SEQ ID NO: 1675 - DNA, 666 bp, Setaria italica
cggcggtgccgcaggccgcctcggcggcgaagcgggtgcaggtcgcgcccaaggagcgggccgccgagggccggcgcgccgcgctgctcggcctggcggccgtcttcgccgtcaccgccaccaccgggtcggccaaggccgggatcatcgacgagtacctcgagaagagcaaggccaacaaggagctgaacgacaagaagaggcttgccaccagcggcgccaacttcgcgcgcgcctacaccgtggagttcggcagctgccagttcccctacaacttcaccggctgccaggacctcgccaagcagaagaaagtgccgttcatcagcgacgacctcgagatcgagtgcgagggcaaggagaagtacaagtgcggctccaacgttttctggaagtggtgattggccgcgaactggagggactgcttgcggtgtgacgtgatgcccaaactgcagggaaatttggatgtgtgtaatttaccgtcattatatttgtatcatctcatttatcgaacctcttgcaccggggagagtgaaactgtagcatcctttcttgcttggttgacgactcttttcatcggctttattcaatgacttcttccaaacaaaacgaggatgagaagattaaggaagcttcagtctattatgaaactctacgacaaaccggtac

SEQ ID NO: 1676 - DNA, 442 bp, Triticum aestivum
ccggcgtgaactccagcgtcgtcggactcaagcccgccgcggcagtgccccaggccgccgccgccgccgcctcgtcgcaggcgaagcgggtgcagctggtcgcgcccgagggccgccgcgccgcgctgctcggcctggcggccgtcttcgccgtcaccgccaccaccggatcggccaaggccgggatcatcgacgagtaccttgagaagagcaaggccaacaaggagctgaatgacaagaagaggctggccaccagcggcgccaactttgcgcgcgcctacaccgtcgagttcggcagctgcacgttcccctacaacttcactgggtgccaggacctcgccaagcagaagaaagtgcccttcatcaccgacgacctcgagatcgagtgcgaggggaaggagaagttcaagtgcggctccaacgttttctggaagtggggtga

SEQ ID NO: 1677 - DNA, 741 bp, Sorghum bicolor
ctgcaggcacccacgatcaaaaacaaaaccatcctcactctcccctgctgccagccaaccaagctccaagctccaagcacgcacagccactcagccacaccacaccaagatcatggccggcgtgaactccagcgtcgtcggactcaagcccgccgcggcagtgccccaggccgccgccgccgccgcctcgtcgcaggcgaagcgggtgcagctggtcgcgcccgagggccgccgcgccgcgctgctcggcctggcggccgtcttcgccgtcaccgccaccaccggatcggccaaggccgggatcatcgacgagtaccttgagaagagcaaggccaacaaggagctgaatgacaagaagaggctggccaccagcggcgccaactttgcgcgcgcctacaccgtcgagttcggcagctgcacgttcccctacaacttcactgggtgccaggacctcgccaagcagaagaaagtgcccttcatcaccgacgacctcgagatcgagtgcgaggggaaggagaagttcaagtgcggctccaacgttttctggaagtggggtgaagcaaaatgaggaggcgacctggtggtgtacatgtacgtgtgtgtgtacctagatgtgcgcccaaactgcaggaagaatttggatgtgtaattgtggtcagtgtatttgtgtcatctcatcatctgattgatcatcatgaacctcttgcattaattggggagagtgaattatagtattttgtc

SEQ ID NO: 1678 - DNA, 1492 bp, Sorghum bicolor
tatgtataattcagattataataaccaagtcatgatccaaacagctagaccttaaaataaaaagcaatgctaagtaatgtaagtagaacgctatatatcaagtcgtggctccagatattataggaaacattatatatagcaaaaatatgccactaaataaaattggaatggggttggactctctgaaagtcacaggcctctccatccatgccacctaagcaagcaatgccttcctcaagatctgcatacccaagggtcacccgccacgtgtcacacgggcccaccgacatttggataatttgtgccacgtgtgcaaagcccagccaatgggatggaagcagcctcaccctatccacacgcccggcaccacaaccacaaccctctacagcctccacacctgcaggcacccacgatcaaaaacaaaaccatcctcactctcccctgctgccagccaaccaagctccaagctccaagcacgcacagccactcagccacaccacaccaagatcatggccggcgtgaactccagcgtcgtcggactcaagcccgccgcggcagtgccccaggccgccgccgccgccgcctcgtcgcaggcgaagcgggtgcagctggtcgcgcccgagggccgccgcgccgcgctgctcggcctggcggccgtcttcgccgtcaccgccaccaccggatcggccaaggccgggatcatcgacgagtaccttgagaagagcaaggccaacaaggagctgaatgacaagaagaggctggccaccagcggcgccaactttgcgcgcgcctacaccgtcgagttcggcagctgcacgttcccctacaacttcactgggtgccaggacctcgccaagcagaagaaagtgcccttcatcaccgacgacctcgagatcgagtgcgaggggaaggagaagttcaagtgcggctccaacgttttctggaagtggggtgaagcaaaatgaggaggcgacctggtggtgtacatgtacgtgtgtgtgtacctagatgtgcgcccaaactgcaggaagaatttggatgtgtaattgtggtcagtgtatttgtgtcatctcatcatctgattgatcatcatgaacctcttgcattaattggggagagtgaattatagtattttgtccttgatcgccttctcgtttcataggcgcttatgagttttccctacaaaacacgacaaaagaaagatataatttttctattacgataagccctggaactcgattaatatgctgctcaaattttatatatttgttgagcacttaacgatctcaaatgacaaaaatcagtactaggaatatgtggatctcatcaagggttataattttgatatacaaagtatctttatctgacaccatgcaagaaaaatataatttttctaatataataattaatatgcttcccaaacttaatactccctccagacttgtaaaagaaatcgttttggatagcgacacagtcttcaaatcataacttt

SEQ ID NO: 1679 - DNA, 1029 bp, Oryza sativa
tagcgcgccaccacgagtgccaatggcagccaatgagatggcagcaagcctcaccctatccacacgccaaccacacccacaacattttccctcccaaatccgaatatccccaacccaactctcatcacacacaaaaccaataaaccatcaccacaccgtcctggtcgtcgtctccaaccaaccaaattcttgcacacgcgcagctcgagccatggccggagtgagcaccagcgtcgtcggcctcaagcccgccgcggcggtgccgcagtcggccgcctcgccggtgccgaagcgcgtgcacgtcgctgtgccgcccaaggaggagcagggcggtggcaggcgcgccgcgctgctgggtctcgccgccgtgttcgccgccaccgccgccgggcaggccaaggccggcgtgttcgacgagtacctcgagaagagcaaggccaacaaggagctgaacgacaagaagaggctggcgacgagcggcgccaacttcgcgagggcgtacaccgtcgagttcggcagctgccagttcccctacaacttcaccggctgccaggacctcgccaagcagaagaaagtcccattcatctcagatgatctcgagatcgagtgcgaggggaaggagaagtacaagtgcggatccaacgtcttctggaaatggtgatgatctgatgatgatcatcgatcgattggccagccatgaaaacattcctgtacctagaacctttgtgatatgacacaactgcatgcataattgaacgcttgtcgtgctcactgtgtatttgtatcatctgagtggagatttgtagcgaattttctctcgattcgtcgatctcactttgatttctaatcatgcatcttatattggttcaccaagaatagattcaatcaatgtgatccagaccaacaagggaaagggaaaagaacacttaatttactaatttgaaagaagtgagtatatatctgacacgtacaagcacaaaaactgcagtttatgttcgttggaatataagactcacctttaaacatgag

SEQ ID NO: 1680 - DNA, 875 bp, Oryza sativa
ccccaacccaactctcatcacacacaaaaccaataaaccatcaccacaccgtcctggtcgtcgtctccaaccaaccaaattcttgcacacgcgcagctcgagccatggccggagtgagcaccagcgtcgtcggcctcaagcccgccgcggcggtgccgcagtcggccgcctcgccggtgccgaagcgcgtgcacgtcgctgtgccgcccaaggaggagcagggcggtggcaggcgcgccgcgctgctgggtctcgccgccgtgttcgccgccaccgccgccgggcaggccaaggccggcgtgttcgacgagtacctcgagaagagcaaggccaacaaggagctgaacgacaagaagaggctggcgacgagcggcgccaacttcgcgagggcgtacaccgtcgagttcggcagctgccagttcccctacaacttcaccggctgccaggacctcgccaagcagaagaaagtcccattcatctcagatgatctcgagatcgagtgcgaggggaaggagaagtacaagtgcggatccaacgtcttctggaaatggtgatgatctgatgatgatcatcgatcgattggccagccatgaaaacattcctgtacctagaacctttgtgatatgacacaactgcatgcataattgaacgcttgtcgtgctcactgtgtatttgtatcatctgagtggagatttgtagcgaattttctctcgattcgtcgatctcactttgatttctaatcatgcatcttatattggttcaccaagaatagattcaatcaatgtgatccagaccaacaagggaaagggaaaagaacacttaatttactaatttgaaagaagtgagtatatatctgacacgtacaagcacaaaaa

SEQ ID NO: 1681 - DNA, 764 bp, Avena sativa
ttctccctccacggcattccccggccacgatcaaaaacaaaaccatcaccacaccccgtgaccttgatgccaaccaaacacacagtacacagaccaaactaatcaagaaatcttaccaggaccatggcaggtgtgaactccagtgtggtcggcctcaagcccgccgcggcggtgccgcaatctgccaacgcctcgcccgcagcggcaaagcgcgtgcaggtcgccccggccaaggaccggaggtcggcgcttctcggcctagcggccgtcttcgccgtcactgctgccaccggctccgcacaggccagcgtgttcgacgagtacctcgagaagagcaaactcaataaggagctgaacgacaagaagagggcggccactagcggcgccaacttcgcgcgcgcctacaccgtgcagttcggcagctgcaagttcccctacaacttcaccggctgccaggacctcgccaagcagaagaaagtcccgttcatatctgacgacctcgagatcgagtgcgagggaaaagagaagttcaagtgcggatcaaacgttttctggaaatggtgaagctgaacgattggccagggaatatggcgagtgctgatgtgatgcgtgcatctcagttcgtgtacctagatgttcaaactgcaggagtatttcggctgtaaacttattgtcattgaatttcaccaacaagtgggaattatattttcacctggatatacacgtgtttgtttgcacaaccagaacataaaaattcttcagtg

SEQ ID NO: 1682 - DNA, 795 bp, Avena sativa
ccaccctatccacacgctcaccacaaccccattctccctccacggcattccccggccacgatcaaaaacaaaaccatcaccacaccccctgaccttgatgccaaccaatcacacagtacacagaccaaactaatcaagaaatcttaccaggaccatggcaggtgtgaactccagtgtggtcggcctcaagcccgccgcggcggtgccgcaatctgccaacgcctcgcccgcggcggcaaagcgcgtgcaggtcgccccggccaaggaccggcggtcggcgcttcttggcctagcggccgtcttcgccgtcactgctgccaccggctccgcacaggccagcgtgttcgacgagtacctcgagaagagcaaactcaacaaggagctgaacgacaagaagagggcggccacgagcggcgctaacttcgcgcgcgcctacaccgtgcagttcggcagctgcaagttcccctacaacttcaccggctgccaggacctcgccaagcagaagaaagtcccgttcatatctgacgacctcgagatcgagtgcgagggaaaagagaagttcaagtgcggatcaaacgtcttctggaaatggtgaagctgaacgattggccagggaatatggcgtgtgctgatgtgatgcgtgcatctcagttcgtgtacctagatgttcaaactgcaggagtatttcggctgtaaacttattgtcattgaatttcaccaacaagtgggaattatattttcacctggatatacacgtgtttgtttgcacaaccagaacataaaaattacttcggt

SEQ ID NO: 1683 - DNA, 613 bp, Festuca arundinacea
acaccccctcaccttgatgccaatcaaacacactccacacacaccaaattaatcaagaaacctcaacaggaccatggcaggtgtgaactccagtgtggtcggcctcaagcccgccgctgcggtgccgcagtctgccaacgcctcgcccgcggcggcaaagcgcgtgcaggtcgccccggccaaggaccggcggtcggcgcttctcggcctagcggccgtcttcgccgtcacggctgccaccggctccgcaaatgccagcgtcttcgacgagtacctcgagaagagcaagctcaacaaggagctgaacgacaagaagagggcggccaccagcggcgccaacttcgcacgcgcctacaccgtgcagttcggtagctgcaagttcccctacaacttcaccggctgccaggacctcgccaagcagaagaaagtaccgttcatctccgacgacctcgagatcgagtgcgagggaaaggagaagttcaagtgcggatccaacgtcttctggaaatggtgaagcggaacgattggccaaggaatatggcgagtgctgatgtgatccgtgtatgtcagtgcgtgtaactagatgatcaaactgcagaagtatttcggctgt

SEQ ID NO: 1684 - DNA, 764 bp, Festuca arundinacea
  misc_feature (651)..(651): n is a, c, g, or t
ggcacgaggcaacacccccccaccttgatgccaatcatacacactccacacacaccaaattaatcaaggaacctcaacaggaccatggcaggtgtgaactccagtgtggtcggcctcaagcctgccgcagcggtgccgcagtctgccaacgcctcgcccgcggcggcaaagcgcgtgcaggtcgccccggccaaggaccggcggtcggcacttctcggcctagcggccgtcttcgccgtcacggctgccaccggctccgcaaatgccagcgtcttcgacgagtacctcgagaagagcaagctcaacaaggagctgaacgacaagaagagggccgccaccagcggcgccaacttcgcacgcgcctacaccgtgcagttcggaagctgcaagttcccctacaacttcaccggttgccaggacctcgccaagcagaagaaagtcccgttcatctccgatgacctcgagatcgagtgcgagggaaaggagaagttcaagtgcggatccaacgtcttctggaaatggtgaagctgaacgattggccaaggaatatggcgagtgctgatgtggtgtgtgtatgtcggtgtgtctacctagatgctcaaactgcaggagtatttcggctgtaaacttattgtcattgtatttcaccancaagtgggaattatgttttcacctggatatacacgtgtttgttggcacaaccaggagtccagaacacaaacatttcttcatctaatctaactgggtacttctcccacttaatt

SEQ ID NO: 1685 - DNA, 697 bp, Lolium multiflorum
caccccctcaccttgatgccaatcaaacacactccacacacaccgaattaatcaaggaacctcaacaggaccatggcaggtgtgaactccagtgtggtcggcctcaagcccgcggcagcggtgccgcagtctgccaacgcctcgcccgcggcggcaaagcgcgtgcaggtcgccccggccaaggaccggcggtcggcgcttctcggcctagcggccgtcttcgccgtcacggctgccaccggctccgcaaatgccagcgtcttcgacgagtacctcgagaagagcaagctcaacaaggagctgaacgacaagaagagggcggccaccagcggcgccaacttcgcacgcgcctacaccgtgcagttcggcagctgcaagttcccctacaacttcaccggctgccaggacctcgccaagcagaagaaagtaccgttcatctccgacgacctcgagatcgagtgcgagggaaaggagaagttcaagtgcggatccaacgtcttctggaaatggtgaagctgaacgattggccaaggaatatggcgagtgctgatgtgatgcgtgtatctcagtgcgtgtacctagatgtttgaaccgcagaattatttcggctgtaaacttattgtcattgtatttcaccaacaagtgggaattatgttttcacctggacatacacatgtttggtggcacaaaaaaaaaa

SEQ ID NO: 1686 - DNA, 1537 bp, Avena sativa
gagcaagcctcaccctatccacacgctcaccacaaccccattctccctccacggcattccccggccacgatcaaaaacaaaaccatcaccacaccccgtgaccttgatgccaaccaatcacacagtacacagaccaaactaatcaagaaatcttaccaggaccatggcaggtgtgaactccagtgtggtcggcctcaagcccgccgcggcggtgccgcaatctgccaacgcctcgcccgcagcggcaaagcgcgtgcaggtcgccccggccaaggaccggaggtcggcgcttctcggcctagcggccgtcttcgccgtcactgctgccaccggctccgcacaggccagcgtgttcgacgagtacctcgagaagagcaaactcaacaaggagctgaacgacaagaagagggcggccacgagcggcgccaacttcgcgcgcgcctacaccgtgcagttcggcagctgcaagttcccctacaacttcaccggctgccaggacctcgccaagcagaagaaagtcccgttcatatctgacgacctcgagatcgagtgcgagggaaaagagaagttcaagtgcggatcaaacgtcttctggaaatggtgaagctgaacgattggccagggaatatggcgtgtgctgatgtgatgcgtgcatctcagttcgtgtacctagatgttcaaactgcaggagtatttcggctgtaaacttattgtcattgaatttcaccaacaagtgggaattatattttcacctggatatacacgtgtttgtttgcacaaccagaacataaaaattcttcagtgtctactgctaagagatttatttcaccagcttcaaggcacatacatacagaacacatgataattattcttctctcctgaccacaaattcgcatcaagcaagcaatccagaattccagatcattcatggtagtttccccagaccaactcacaactcacacgcaacatcagtttcagatctccctctcacttattcagctactagtacatggtataagtttcagaattctaatctgccagttgaaggcaacggggcttctgaccagttgcttcctgttctccgaggaaatgtggccgaagtcccatgtcctggccggcctcacctttccttatgaaggacgctgaaaaacattgccgaagtttcataaccgaaaaacttgtcgaagctcacaacatctcatcgtcctatccgggaagaagcaaaacacgggaaggcgtcaacgtgctcggggaagacggaggaagcacgggggtggcgaattccaggtgagtccgtgctcgtcgtcagggaagaagctcccaattcccagcgatctaggaagtttcggctcttgatcttctgcagagtggttggtgacagcgtcatggttccgttcccgagctccgttcgagatgatgaagttcattgcgacgcctgggcagacatactgtggtggtgctgaaggtagaggttttctcctctccctgatgtggaagaaaaagggggaggagagggtggatggcggcgcgagggagc

SEQ ID NO: 1687 - DNA, 604 bp, Secale cereale
  misc_feature (39)..(39): n is a, c, g, or t
gcacacgcacacactgacacacaccagattcatcaaganaacctcgagaggatcatggccggtgtgaacaccagtgtggtcggcctcaagcccgccgcggcggtgccgcagtccgcctcgccggcggcggcaaagcgcgtgcaggtcgccccggccaaggaccggcggtcggcgcttctcggcctggcggccgtcttcgccgtcacggccgccaccgccgggtcggccagggcaagctcttcgacgagtacctcgagaagagcaagctcaacaaggagctgaacgacaagaagagggcggcgacgagcggcgccaacttcgcgcgcgcctacaccgtccagttcggcagctgcaagttcccctacaacttcaccggctgccaggacctcgccaagcagaagaaagtcccgttcatcaccgacgacctggagatcgagtgcgagggcaaggagaagttcaagtgcggatccaacgtcttctggaaatggtgaagctgatcgacttgccaggcaatatggcgagtgctgatgtatgccagtgcaccagtgtacctagatgtccaaaccgcacaagtgtttcgactgtgaagttatcgtcgctgtaa

SEQ ID NO: 1688 - DNA, 738 bp, Secale cereale
cactgacacacaccagattcatcaagagaacctcgagaggatcatggccggtgtgaacaccagtgtggtcggcctcaagcccgctgcggcggtgccgcagtccgcctcgccggcggcggcaaagcgcgtgcaggtcgccccggccaaggaccggcggtcggcgcttctcggcctggcggccgtcttcgccgtcacggccgccaccgccgggtcggccagggcaagcgtcttcgacgagtacctcgagaagagcaagctcaacaaggagctgaacgacaagaagagggcggcgacgagcggcgccaacttcgcgcgcgcctacaccgtccagttcggcagctgcaagttcccctacaacttcaccggctgccaggacctcgccaagcagaagaaagtcccgttcatcaccgacgacctggagatcgagtgcgagggcaaggagaagttcaagtgcggatccaacgtcttctggaaatggtgaagctgatcgacttgccacgcaatatggcgagtgctgatgtatgtcagtgcacaagtgtacctagatgtccaaaccgcacaagtgtttcgactgtgaagttatcgtcgctgtaattttatcatcatgtggaattctgttttcacctggatatggatatacgcatgttagcatgtatcttgtcacattcagaacgcaaacattcgtcagttgggaaaaaaaaaaaaaaaaacaaaaaaacaaaaaaaacaaaaaacaaa

SEQ ID NO: 1689 - DNA, 654 bp, Secale cereale
atcatggccggtgtgaacaccagtgtggtcggcctcaagcccgccgcggcggtgccgcagtccgcctcgccggcggcggcaaagcgcgtgcaggtcgccccggccaaggaccggcggtcggcgcttctcggcctggcggccgtcttcgccgtcacggccgccaccgccgggtcggccagggcaagcgtcttcgacgagtacctcgagaagagcaagctcaacaaggagctgaacgacaagaagagggcggcgacgagcggcgccaacttcgcgcgcgcctacaccgtccagttcggcagctgcaagttcccctacaacttcaccggctgccaggacctcgccaagcagaagaaagtcccgttcatcaccgacgacctggagatcgagtgcgaggggaaggagaagttcaagtgcggatccaacgtcttctggaaatggtgaagctgatcgacttgccaggcaatatggcgagtgctgatgtatgccagtgcacaagtgtacctagatgtccaaactgcacaagtgtttcgactgtgaagttatcgtcgctgtaattttatcatcatgtggaattctgttttcagctggatatggatatgtgcatgttagcatgtatcttctcacatcctgatcacaaacatccatcagttagaa

SEQ ID NO: 1690 - DNA, 633 bp, Leymus cinereus x Leymus triticoides
  misc_feature (1)..(2): n is a, c, g, or t
  misc_feature (11)..(12): n is a, c, g, or t
nnaacacacanncacacacacaccccaccaaattcatcaagaaacctcgagaggatcatggccggtgtgaacaccagtgtggtcggtctcaagcccgccgcggcggtgccgcagtccgcctcgcccgcggcggcaaagcgcgtgcaggtcgccccggccaaggaccggcggtcggcgcttctcggcctagcggccgtcttcgccgtcacggccgcctccaccgggtcggccagggcaagcgtcttcgacgagtacctcgagaagagcaagctcaacaaggagctgaacgacaagaagagggcggcgacgagcggcgccaacttcgcgcgcgcctacaccgtccagttcggcagctgcaagttcccatacaacttcaccggctgccaggacctcgccaagcagaagaaagtcccgttcatcaccgacgacctggagatcgagtgcgaggggaaggagaagttcaagtgcggatccaacgtcttctggaaatggtgaagctgatcgatttcccaagcaatatggcgagtgctgatgtatgtcagtgcgtgtacctagatgtccaaactgcacaagtgtttcgactgtgaagttatcgtcgctgtaattttatcatcaagtggaattctgttttca

SEQ ID NO: 1691 - DNA, 718 bp, Pseudoroegneria spicata
accgaacacacacacacacacacacacaccaccaaattcatcaagaaccctcgagaggatcatggccggtgtgaacaccagtgtggtcggtctcaagcccgcggcggcggtgccgcagtccgcctcgcccgcggcggcaaagcgcgtgcaggtcgccccggccaaggaccggcggtcggcgcttctcggcctagcggccgtcttcgccgtcacggccgccaccgccgggtcggccagggcaagcgtcttcgacgagtacctcgagaagagcaagctcaacaaggagctgaacgacaagaagagggcggcgacgagcggcgccaacttcgcgcgcgcctacaccgtccagttcggcagctgcaagttcccgtacaacttcaccggctgccaggacctcgccaagcagaagaaagtcccgttcatcaccgacgacctggagatcgagtgcgagggcaaggagaagttcaagtgcggatccaacgtcttctggaaatggtgaagctgatcgatttgccaggcaatacggcgagtgctgatgtatgtcagcgcgtgtacctagatgtccaaactgcacaagtgtttcggctgtgaagttatcgtcgctgtaattttatcatcaagtggaattctgttttcacctggatatatgcatgttagcatgtatcttgtcatatccagcacacacaaacattcatcagtaaaaatctttctagcaagc

SEQ ID NO: 1692 - DNA, 666 bp, Avena sativa
ccaaccgaacacactgggcacgcaccaaattaatcaagaaagctcaccaggaccatggcaggtgtaaactctagcgtggtcggcctcaagcccgccgcggcggtgccgcagtccgccaacgcctcacccgcggcggcaaagcgcgtgcaggtcccccccggtcaaggaccggcggtcggcgcttctcggcctagcggccgtcttcgccgtcacagctgccaccggctccgcacaggccagcgtgttcgacgagtacctcgagaagagcaagctcaacaaggagctgaacgacaagaagagggcggccaccagcggcgccaacttcgcgcgcgcctacaccgtgcagttcggcagctgtaagttcccctacaacttcaccggctgccaggacctcgccaagcagaagaaagtcccgttcatctcggacgacctcgagatcgagtgcgagggaaaggagaagttcaagtgcggatccaacgtcttctggaaatggtgaagctgaacgattggccagggaatatggcgagtgcggatgtaatgtgtgtatctcagtgtgtgtacctagatgttcaaactgcacaagtatttcgaaagtaaacttattgtcattgtatttcaccaacaagtgggaattctcttttcacgtggatggatatacacgtgttt

SEQ ID NO: 1693 - DNA, 769 bp, Triticum aestivum
cacacacaccagattcatcaagaaaacctcgagaggatcatggccggcgtgaacaccagtgtggtcggcctcaagcccgccgcggcggtgccgcagtccgcctcgccggcggcggcaaagcgcgtgcaggtcgccccggccaaggaccggcggtcggcgcttctcggcctggcggccgtcttcgccgtcacggccgcctccgccgggtcggccagggcaagcgtcttcgacgagtacctcgagaagagcaagctcaacaaggagctgaacgacaagaagagggcggcgacgagcggcgccaacttcgcgcgcgcctacaccgtccagttcggcagctgcaagttcccctacaacttcaccggctgccaggacctcgccaagcagaagaaagtcccgttcatcaccgacgacctggagatcgagtgcgaggggaaggagaagttcaagtgcggatccaacgtcttctggaaatggtgaagctgatcgatctgccaggcaatatggcgagtgctgatgtacgtcagcgcaccgcgtgtacctagatgtccaaactgcgcaagtgtttcgactgtgaagttatcgtcgctgtaattttatcatcaagtggaattctgtaattttatcaggcttgtcagaacacaaacattcatcagttagaatctttcaagaaagctgcttaggcaaattcgagatcagataggaaaacgcaaaaaatttatactcctacatagtaacacctaaagaagatagtatcatcataagtataaag

SEQ ID NO: 1694 - DNA, 817 bp, Brachypodium distachyon
acacccccttctcctgttgccaaccaaacacaacacacacacacaaaactaatcaagaaaactcaagagtataatcatggccggcgtgaactccagcgtggtcggtctcaagcccgccgcggcggtgccgcaaaccgccgccgccttctcggcgaagcgcgtgcaggtcaaggaccggcggtcggcgctcctcggcctggcggccgttatcgccgttactgccggcgcctccgggtccgccagggccagcgtcttcgacgagtacctcgagaagagcaagctcaacaaggagctgaacgacaagaagagggcggcaaccagcggcgccaacttcgcccgggcatacaccgtgcagttcggcagctgcaagttcccctacaacttcaccggctgccaggaccttgccaagcagaagaaagtgccgttcatcagtgacgacctggagatcgagtgcgagggcaaggagaagtacaagtgcggatccaacgtcttctggaaatggtgaagatgatacgaatatgccggccgggtgctgatattgtgatgcgtgtgtatgtggcatgccagcgtttgtacctagaagatgtgaaaaactgcagaaatgttttggatgttaacttgtcgtccgtccgccttgtattcttatcatcaagtggaaatcctattttcacctgggtacttacgtgcctgtatcttgtattctcgtcccgtcctcctccagaacgcaagcatccgtcagatcatctcctgccaagaaatactagagacacgtttcaccgaattctgctggaaatatataataggcaatatttgaatt

SEQ ID NO: 1695 - DNA, 1059 bp, Brachypodium distachyon
cccatttggataaacgggagccacggtggcgccaatgccagccaatgggatggaagcaagcctcaccctatccacacgcccaccacagagccccaagtttccctccacagatcaaaaacaaaaccatcaccagacacccccttctcctgttgccaaccaaacacaacacacacacacaaaactaatcaagaaaactcaagagtataatcatggccggcgtgaactccagcgtggtcggtctcaagcccgccgcggcggtgccgcaaaccgccgccgccttctcggcgaagcgcgtgcaggtcaaggaccggcggtcggcgctcctcggcctggcggccgttatcgccgttactgccggcgcctccgggtccgccagggccagcgtcttcgacgagtacctcgagaagagcaagctcaacaaggagctgaacgacaagaagagggcggcaaccagcggcgccaacttcgcccgggcatacaccgtgcagttcggcagctgcaagttcccctacaacttcaccggctgccaggaccttgccaagcagaagaaagtgccgttcatcagtgacgacctggagatcgagtgcgagggcaaggagaagtacaagtgcggatccaacgtcttctggaaatggtgaagatgatacgaatatgccggccgggtgctgatattgtgatgcgtgtgtatgtggcatgccagcgtttgtacctagaagatgtgaaaaactgcagaaatgttttggatgttaacttgtcgtccgtccgccttgtattcttatcatcaagtggaaatcctattttcacctgggtacttacgtgcctgtatcttgtattctcgtcccgtcctcctccagaacgcaagcatccgtcagatcatctcctgccaagaaatactagagacacgtttcaccgaattctgctggaaatatataataggcaatatttgaattccgagatttattaagtgacagaagttacaaaaaaaaactaatgatgcaaatataagacaaacttcttaccatgccagtacaagctataggtaatcaagttctctcgtgg

SEQ ID NO: 1696 - DNA, 615 bp, Triticum aestivum
aaacctggagaggatcatggccggcgtgaacaccagtgtggtcggcctcaagcccgccgcggcggtgccgcagtccgcctcgccggcgacggcaaagcgcgtgcaggtcgccccgcccaaggaccggcgggcggcgcttctcggcctggcggccgtcttcgccgtcaccgccgcctccgccgggtcggccagggcaagcgtcttcgacgagtacctcgagaagagcaagctcaacaaggagctgaacgacaagaagagggcggcgacgagcggcgccaacttcgcgcgcgcctacaccgtccagttcggcagctgcaagttcccctacaacttcaccggctgccaggacctcgccaagcagaagaaagtcccgttcatcaccgacgacctcgagatcgagtgcgaggggaaggagaagttcaagtgcggatccaacgtcttctggaaatggtgaagccggtcgatctgccaggcaatatggcgagtgctgatgtacttcagcgcaccgcgtgtacctagatcgatgtccaagctgcacaagtgtttcgactgtgaagttatcgtcgctgtaattttatcatcaagtggaattctgtaattttaccaggcttgtca

SEQ ID NO: 1697 - DNA, 797 bp, Hordeum vulgare
acacagacacaccgcaaaccccagtttccctccacagcatcctccacgatcaaaaacaaaaccatcaccccccatcccccgaggccaccacacacgcgcgcgcacacaccagattattccaagaagacctcgggaggatcatggccggcgtgaacaccagcgttgtcggcctcaagcccgccgcggcggtgccgcagtcggcctcgcccgcggcggcaaagcgcgtgcaggtcgccccggccaaggaccggcggtcggcgcttctcggcctggcggccgtcttcgccgccaccgccgcctccgccgcctccgccagggcaagcgtcttcgacgagtacctcgagaagagcaagctcaacaaggagctgaacgacaagaagagggcggcgacgagcggcgccaacttcgcgcgcgcctacaccgtccagttcggcagctgcaagttcccctacaacttcaccggctgccaggacctcgccaagcagaagaaagtcccgttcatcaccgacgacctcgagatcgagtgcgaggggaaggagaagttcaagtgcgggtccaacgtcttctggaaatggtgaagctggtcgatatggcgagtgctgatgtatgtcagtcaggctgtacctagatgtccaaactgcacaagtgtttcggctgtgaagtcatcgtctctgtaattttatcatcaagtggaatcctgtttttcacctgtaattgcactagtggaaacctgcatatatcctgtcacatccagcacgcaaacattcattagttaggatctttcaggcaatccccgt

SEQ ID NO: 1698 - DNA, 1666 bp, Panicum virgatum
gcaccacctccccctcccgcggtctccgtctctcaccttctcgctgcacacgcatctcctgattggatcaattgggcttcgtgtgccgtctgatccgtggagcacccgctgccgagcggaatcgtcacctgatttggcgagactagcagatatttgtgaagtcatggcacacgatgaagctgtggctacccagaagactggaaatacagcatcatctcctaaggatcaaccagctccttctccatatcctgattggtcgagcatgcaggcatactatggacccggtgtcttgccaccaacatattttgctccagcaatagctccaggtcatccaccgccatatatgtggggtcctcagcctctaatgccacacccttttgggacaccatatgctgcaatgtacgcacatggcacagcttacccgcacccccttgtgcccatggtatcaaatcccttgagtgtggagccaacgaagtctgcaaacagtaaggaaaaaagttccaacaagaaacttaaagaaattgatcggacggcagtatctgctggtagcggtaacagtaaaagagcaatgtcatccagtgaagattacagtgcagaaggctccagcgatgtaaatgatcagaaggtgaacaaaacttccaggaaactgagctcagttgatggacctgctgcaaggattgaaggtgttatagctcctaaccatacactggcaaatacagccattttgccacatcactgctttccagctccagtagttaagaccagcactacaaatgttgctaactcaagggcaatgggtggatcgatatctccatatcctggtgtgattgttccgcctcatactggaggaccagctgacttatcaatcaaggatgagagagaactgaagcgtgaaaagaggaagcagtcaaatagagagtctgctagacgatcaaggctgagaaaacaggttgagacagaggagctggcaacacaagtggaatctcttacagcagaaaacacgtcccttagatctgaaatcggcaggctaacagagagttcagagcagctcagattagagaattcagctctgatggtgaaactgaaggatcctgaagtgccggcccctgcagagccgtctccaaaagccaccgcatcctcgccctctccccgccccaccgcggagaatttcctgtcgatgatcgacggcaccacgagcgcgccgggcgcgagccggcacacggagcacggcaagcccaagctccggcagctcctcgactccaatccgtcgacggacgtcgctgccataagctgatgctgatctgcctctctttcccccctggcacggagagaggccggctaatacaacacaggtgcatgtggccgatcttggtcgcgagctcatgctgtctcaccataacgttctgcgttgcagtgtactaggaggcattgattccggtatagcatttgagaacacaggtgacaagtatctgtctgccctagtgcagtcactggcaggggatgcctgatgtatcgtgtgttaattagttttacttgctatgagctttagcagtgttgtaacatagggtgttgtgctgcatgccaacctgaaaacttttttttcgcaaacgtggctgagcacgtatttcattaagaggaaagcaatacgaccagtacaaattttaat

SEQ ID NO: 1699 - DNA, 1720 bp, Sorghum bicolor
gccgcctctctccgtcgcaccacacctgccccccctcccggtctctctctcctccgcgccacacgcatctcctgctgattgaatcaacttggcctcgcgactccggctgatccgtggcgcctcgctgccgagcggaaccatcacctgatttggcgagactagcagataaaatcatggctcaggatgaagctgtggctacccagaagactggaaatacagcatccccttctaaggattatccaactccttctccatatcctgattggtcgaccatgcaggcatattatggccctggtgtcttgccaccaacatattttgctccagcaatagctccaggccatccaccgccatacatgtggggtcctcagcctataatgccacccccttttgggacaccatatgctgcagtatacccacatggtggagcttacccacacccccttgtgcccatgatgtcaactccattgagcatggagcccgccaaatctgcaaacagcaaggagaaaaattccaataagaaacttaaggaaatagatcggactgcagtgtctgctggcagtggtaacagtaaaagaacaatgtcatccagtgaagattacagtgcagagggctccagcgatgtaaacgaccagaaggtgaacaaaacgtccaggaagcagaactcagatgatggacctggtgcagaaaccaccacaggtgcaaacacggaatgtgttttagctcctaaccatacgatggggaatggtgctattttgccacatcactgctttccagctccagtaattaagcccagcgctacaaatgtcgccaactcgagggtgataggcacagcgatatctccatcacctagtgtgatggtcccagctcatactgcattaccagctgacttatcagtcaaggatgagagggaattgaagcgtgaaaagaggaagcagtcaaatagggagtctgctagacgatcaaggctgagaaaacaggctgagacagaggagttggctacacaagtggagtcccttactacagagaacacgtcccttaggtctgaaatcggcaggctaacagagagctcggagaagctcagattagaaaattccgctctaatggtgaagctgaaggacactgcagcactgacccctgcagaaccatctccgcacacagcagtcacatcctcgtcctctccgggtgccgccgcggaaaatttcctttccatgatcgacagcgccaaggcggccggcgtcagcaggcacacggagcacggcgagcccaagctccggcagctcctggactccagtccggcaacagacgtcgctgccgtaagctgatgacgatccggctaatattacagcacagcacatgcatgtggcctggggatttcacaagctcatgctgcgcaccataaatgtcagagttattacagacttagtacaccagtttaggcactgattccagtaaagtaactgaggacaccggtaattttatctgctccgctgagtgccggactgcgacctctcctagtgtaccagtgttgtaacatagggtgttgtgctgcatgccaacctttgaaacttcgagatcgtcctccttgggaccattttcggcgtaataacaaaatatagttcggagtttgtacaacagaataagacggatactggtgtgtgctgtgtgcaatcctctactgcagtgttggtttgttctcaatgtagtttcattcttcttctct

SEQ ID NO: 1700 - DNA, 3013 bp, Sorghum bicolor
ctccagcctttggcgcccctcccaccgtccccttcctcctcctctcctcccccactcccctgcctcgccgcctctctccgtcgcaccacacctgccccccctcccggtctctctctcctccgcgccacacgcatctcctgctgattgaatcaacttggcctcgcgactccggctgatccgtggcgcctcgctgccgagcggaaccatcacctgatttggcgagactagcagataaaatcatggctcaggatgaagctgtggctacccagaagactggaaatacagcatccccttctaaggattatccaactccttctccatatcctgattggtcgaccatgcaggcatattatggccctggtgtcttgccaccaacatattttgctccagcaatagctccaggccatccaccgccatacatgtggggtcctcagcctataatgccacccccttttgggacaccatatgctgcagtatacccacatggtggagcttacccacacccccttgtgcccatgatgtcaactccattgagcatggagcccgccaaatctgcaaacagcaaggagaaaaattccaataagaaacttaaggaaatagatcggactgcagtgtctgctggcagtggtaacagtaaaagaacaatgtcatccagtgaagattacagtgcagagggctccagcgatgtaaacgaccagaaggtgaacaaaacgtccaggaagcagaactcagatgatggacctggtgcagaaaccaccacaggtgcaaacacggaatgtgttttagctcctaaccatacgatggggaatggtgctattttgccacatcactgctttccagctccagtaattaagcccagcgctacaaatgtcgccaactcgagggtgataggcacagcgatatctccatcacctagtgtgatggtcccagctcatactgcattaccagctgacttatcagtcaaggatgagagggaattgaagcgtgaaaagaggaagcagtcaaatagggagtctgctagacgatcaaggctgagaaaacaggctgagacagaggagttggctacacaagtggagtcccttactacagagaacacgtcccttaggtctgaaatcggcaggctaacagagagctcggagaagctcagattagaaaattccgctctaatggtgaagctgaaggacactgcagcactgacccctgcagaaccatctccgcacacagcagtcacatcctcgtcctctccgggtgccgccgcggaaaatttcctttccatgatcgacagcgccaaggcggccggcgtcagcaggcacacggagcacggcgagcccaagctccggcagctcctggactccagtccggcaacagacgtcgctgccgtaagctgatgacgatccggctaatattacagcacagcacatgcatgtggcctggggatttcacaagctcatgctgcgcaccataaatgtcagagttattacagacttagtacaccagtttaggcactgattccagtaaagtaactgaggacaccggtaattttatctgctccgctgagtgccggactgcgacctctcctagtgtaccagtgttgtaacatagggtgttgtgctgcatgccaacctttgaaacttcgagatcgtcctccttgggaccattttcggcgtaataacaaaatatagttcggagtttgtacaacagaataagacggatactggtgtgtgctgtgtgcaatcctctactgcagtgttggtttgttctcaatgtagtttcattcttcttctctagtgatctgtgagtcttttgtcaagcattaacgccagatggttgtgatgcgggcttgcttggtttgggacttcaatttgtcatactaaagatttgcccagtaaaagttggctaaaaaatttgctatagatttggaagcgaaatatgagaggttagcaagttttggtaacaaagcaaataacaaccaaagtaatggctttccttattttggaagtgtcaagcaggcctgcagtcgcaactcacgccctaacagccttgatcactgactgattcactggacaatccggatgtcgatctcgatggggaaacgcgcgcagcgagagaggaatcgtcgtcgtcttgcccttgctcctgtccctgctcctcctcctccctctgggtcgtcgtccatcgattttggcgagtcccgcgcctccaccccactctctcaatctacaagaagttggtacatcttatttcaatcttgcaggataactgtgatatgtttttcatatagcatatacattgtgttatcttagcacactgagctctgattacaatgcaataatttgataaatgaggacttaaatacgggcaatgcttttatcatcttcatcctttcttaacggacaactgacaaacatccatgagtgggttcatccaacgggagccgcgcggcagcacacactaattattttcatattttttaacggaacctgattattttcatattgaggcataatcacgggccagtccaccaaaaacaggctaggtaacacaccaattattttcggatggactcgcatcacaggctggtaacacaggtaggcgcgcggcaacgccgtgcctagtttctagttcatactatggccgaaacagcaggcaatcagacatctgaaaactgaactaagaaatagcagaatggcagcacatacccttcactggagcccatcggagacgaatttctccaccactcaggtaaaccagcggcttgaagactccatcttgaaccaaactgatgagacggtagcagcgacagtcagatacgtacacgaaacacacgttgaccgctgtaacttgtaagagccttttaggatgtcgacgactctatggattttcatcccagagagcttcgcatcacacaacaccaaccaatacccgcaggctacaaatcttggatgcagtaggcgccgcgttagtgcatatactactcggagttaagtgggagattaggtaacagaaaaaagat

SEQ ID NO: 1701 - DNA, 1610 bp, Saccharum officinarum
ccgcctctccccgtcgcaccacctgccccctcccggtctctctctctccttcgcgctagcgcatctcctgattggaccaatttggcctcgcgactccggctgttccgtggcgcctcgctgccgagcggaaccaccacctgatttggcgagacttgcaggtactgtcatggctcaggatgaagctgtggctccccagaagactggaaatacagcatccccttctaaggattatccaactccttgtccatatcctgattggtcgaccatgcaggcatattatggccctggtgtcttgccaccaacatattttgctccagcaatagctccaggtcatccaccgccatatatgtggggtcctcagcctataatgccaccccctttcgggacaccatatgctgcagtgtacccacatggtggagcttacccgcacccccttgtgcccatgatgtcaactccattgagcatggaggcagccaaatctgcaaatagcaaggagaaaacttccaataagaaacttaaggaaatagatcggacttcagtgtctgctggcagtggtaacagtaaaagaacaatgtcatccagtgaagattacagtgcagagggctccagtgatgtaaacgatcagaaagtgaacaaaacgtccaggaagcggagctcagatgatggacccggcgcagaaaccaccacaggtgcaaacacggaatgtgttttagctcctaaccatactctggggaatgctgccattttgccacatcactgctttccagctccagtaattaagcccagtgctacaaatatcgctaactcgagggcgataggcacagagatatctccatcacctggtgtgatggttccagctcatactgcagtacaatctgacttatcaatcaaggatgagagggaattaaagcgtgaaaagaggaagcagtcaaatagggagtctgctagacgatcaaggctgagaaaacaggctgagacacaggagttggctacacaagtggagtcccttactgcagagaacacgtcccttaggactgaaatcggcaggctaacagagagctcggagaagctcagattagaaaattcggctctaatggtgaagctgaaggacactgcagcaccgacccctgcagacaaagcagccacatcctcgtcctctccgtgtgccgccgcggaaaatttcctttccatgatcgacagcgccaaggcggcgggtgtcagcaggcacacggagcatggcgaacccaacctccggcagctcctggactccagtccggcagccgacgtcgctgccgtaagctgatgccgatccggctaatatattacagcacagcacatgcatgtggcagctcatgccgctcaccataaatgtcagcgttacagacttagtactccagtttaggcactgattccagtaaagtaactgaggacaccggtaattttatctgctctagcgccagagtgccggactgcgacctctcctagtataccagtgttgtaacatagggtgttgtgctgcatgccaacctttgaaacttcgagatcgtcctccttggaccattttcggcgcaattacaaaatatagatcggagtttgtacaacagtataag

SEQ ID NO: 1702 - DNA, 1129 bp, Setaria italica
ggtgggtccacgcacgcaggcggtggtgcccatggcgtcgtggctgctgctccccctcccctccttcccctggcttccccctccgccaccgcccggatcctcctccggcggccgcggcggagggggcgggggcggagacggcggcgactggaggcccaacgtcgtcgcggccttcgccggcgcgcaggtcggcagcgccctccgccgccgcttcgcgggcctcctccgctcgccggaggtgcgacatcttgaagccttgccgaacatgggtgacatttgttttgggggatcacactcatttgcaacacacccaattcttggcgcgttggggaatgtgttccctgcgtcatatgtttgcagcttcactctattcaatgggaatgggtcaggtgggacatacatcggcaaaggaaaggtgctgtctagacgacctcgcagaattgattcgaagaagaggctgtggacttgctattaatgtcctggcttatatcgctcaggtagcatcacaaggaaagcttcttatgtggggagccaagatcaacagtctgattgatagaggacaattttggcgtttggcaacatcatctctccttcacgcaaatgtcactcaccttgctgtatgttttcgttcaattgagttaatattttataggagttttttctagctaatttcctacctgttaacataatgttctctttaaactcaattgggcccatggtggaaatgctaagtggtcctagaagatttattgctgtttatatcagttcagcgctggcaggttcactgatgagttatcgctgttgtgagtcacctgctgttggtgcgtcaggtgccatttttggattggttggcgcccatgcagtttatatgtggaggcatagaagttattttggcaatgcaagggaaagtttagagcatatcgggcgtgtggttgtcttgaatatgggtatgggcctcctttcaaggggaattgataactggggtcatctgggaggcttgctagggggagttgctgtggcatggttcctaggtccggcatggcaatatcagtatgtgggaaaggatggcagagtggttttcaaagacagggctccagtcctccggctaataaaggggtaggcttaggct

SEQ ID NO: 1703 - DNA, 1595 bp, Sorghum bicolor
gaaagctcaaaaaaaaggcgtcgcggctccccggggtccacacacaggcggtggggtggtgcccatggcttcgtggctgttgctccctctcccctccttcccgtggcctcccccgcccccgcccggctcctcctccggccgaggcggcggtggcggcggagacggcggcgattggaggccgaacgtcgtcgcggccttcgccggcgcgcaactcggccgctccctccgtcgccgcttcgccggcctcctccgctcaccggaggtgcgacatctcgatgccttgccgaaaatgggtgacttctggttcgaaggatcagaaccgtttgcaacattcccaattcttggtgcgatagggaatgtgctctctgcaccctatgtttgcagctctgctctgttcagtgggaacgggtcagggggtagatacatcagtaacgggaagttgttgtccagacggcctcgtggaatcgattcgaagaagaggctctggactaatgtccttcttgctcttaatgtcctggcttatgtcgctcaggtagcatcacaaggaaagcttcttttgtggggagccaagatcaacagtctgattgatagagggcaattttggcgtttggcaacatcatctctacttcatgcagatctcacccaccttgcattcaattgtttctctttgaattctattgggcccatggttgaaatgttaactggacctagaagatttcttgctgtttatttcagttcggcactggcaggttcactgatgagctatcgctgtagtgcgtcacctgcagttggtgcgtcaggtgccatttttggattggttggcgcccatgcagtttatatgtggagacatagaagattctttgggaattctagggagagtttagaacatattgggcgtgtggttgtcctgaatatgggtatgggcctcctctcaaggggaatcgataactggggccatctgggaggcttgcttggcggagttgccatggcatggttcctaggtccggcatggcaatatcagtatgtggcaaaggatggtagagcggttttcaaagacagggctccagtcctccgactaataaaggggtagacttgtgttgttttgtatgtacttacgagagtattcgtgaaaataatgtggaagagaagcaaaagggagaatggtgaagattcagacataggccgagcaaggaagtggcagaaaaaaaaacttttaactagtttgggtatcgaaacatttcattgcagggctaattgttgaggaaacacacacgaggagcttattgctttgttcggatcgtggcaattgttaaatcttcaaagccgagacgtgttgaggcctgtcaattgtattttcaggtgttccagcccttaacacacattttgtactaaccttaggatctaccgtcaagttctgacctcggacattgactgttactaggtttcttctggtcctgtattgcacgagatgataaaatatgtaaagagtgttctcagcgaacagcgatccataagtgattaagatatttgttgtaagaacatatgtttttgccccaacaagattttaggaccagtgcaaaatactcagcttggaa

SEQ ID NO: 1704 - DNA, 1530 bp, Sorghum bicolor
aatagacgaaagctcaaaaaaaaggcgtcgcggctccccggggtccacacacaggcggtggggtggtgcccatggcttcgtggctgttgctccctctcccctccttcccgtggcctcccccgcccccgcccggctcctcctccggccgaggcggcggtggcggcggagacggcggcgattggaggccgaacgtcgtcgcggccttcgccggcgcgcaactcggccgctccctccgtcgccgcttcgccggcctcctccgctcaccggaggtgcgacatctcgatgccttgccgaaaatgggtgacttctggttcgaaggatcagaaccgtttgcaacattcccaattcttggtgcgatagggaatgtgctctctgcaccctatgtttgcagctctgctctgttcagtgggaacgggtcagggggtagatacatcagtaacgggaagttgttgtccagacggcctcgtggaatcgattcgaagaagaggctctggactaatgtccttcttgctcttaatgtcctggcttatgtcgctcaggtagcatcacaaggaaagcttcttttgtggggagccaagatcaacagtctgattgatagagggcaattttggcgtttggcaacatcatctctacttcatgcagatctcacccaccttgcattcaattgtttctctttgaattctattgggcccatggttgaaatgttaactggacctagaagatttcttgctgtttatttcagttcggcactggcaggttcactgatgagctatcgctgtagtgcgtcacctgcagttggtgcgtcaggtgccatttttggattggttggcgcccatgcagtttatatgtggagacatagaagattctttgggaattctagggagagtttagaacatattgggcgtgtggttgtcctgaatatgggtatgggcctcctctcaaggggaatcgataactggggccatctgggaggcttgcttggcggagttgccatggcatggttcctaggtccggcatggcaatatcagtatgtggcaaaggatggtagagcggttttcaaagacagggctccagtcctccgactaataaaggggtagacttgtgttgttttgtatgtacttacgagagtattcgtgaaaataatgtggaagagaagcaaaagggagaatggtgaagattcagacataggccgagcaaggaagtggcagaaaaaaaaacttttaactagtttgggtatcgaaacatttcattgcagggctaattgttgaggaaacacacacgaggagcttattgctttgttcggatcgtggcaattgttaaatcttcaaagccgagacgtgttgaggcctgtcaattgtattttcaggtgttccagcccttaacacacattttgtactaaccttaggatctaccgtcaagttctgacctcggacattgactgttactaggtttcttctggtcctgtattgcacgagatgataaaatatgtaaagagtgttctcagcgaacagcgatccataagtgattaag

SEQ ID NO: 1705 - DNA, 1766 bp, Zea mays
gccaaatccgataatctaccagtgggccctggttgacagcccaacgcacggctctcctgtgcgcctccgatgccgtttccccgaagcaaagggagacgaaagctcaaaaggtccccccgcttcctgtggtccacgcacgcacgcaggcggcggtggtgcccatggcttcgtggctgttgctccccttctcctccttcccgtggcctcccccgcccccaccaggctcctcctccggccgcggcggcgatggcggcggagacggcggcgattggaggccgaccgtcgtcgcagccttcgcaggcgtgcaagtcggccgcgctctccgccgccgcttcgccggcctcctccgctcaccggaggtgcgacatcttgatgccttgccgaaaatgggtagcttttggtttgaaggatcagaatcgcttgcgacattccacattcttggcgcgatagggattgtgttctctgcaccttatgtttgcagctctgctctgttcagtgggaacgggtcagggggtagatacatcagcaacgggaagttgttgtccagacggcctcgtggaatcgattccaagaagaggctctggactaatgtccttcttgctcttaatgtcctggcttatgtcgctcaggtagcatcacaaggaaagcttctcatgtggggagccaagatcaacagtctgattgatagagggcaattttggcgtttggcaacatcatctctacttcatgcaaatctcacccaccttgcattcaattgtttctctttgaactctattgggcccatggttgaaatgttaagtggtcctagaagatatctagctgtttatttcagttcggcgctggcaggttcactgatgagctaccgttttagtgcgtcacctgctgttggtgcgtcaggtgccatttttggattggttggagcctatgcagtttatatgtggaggcatagaagattttttgggaattctagagagagtttagaacatattgggcgtgtggttgtcctgaatatgggtatgggcctcctttcaaggggaattgataactggggccatctgggaggcttgcttgggggagttgccatggcatggttcctaggtccggcatggcaatatcagtacgtggcaaaggatggtagagcggttttcaaagacagggctccagtcctccgactaataaaggggtagacctgtgggtattcgtggaaatagcgtggaagaggatgaaaaggggaaagggggtgaagattcagacatgcgccgagcaaagggagtggcgaaaaaacaattaggccctctttggaatgaaagaatttcagagaaatcatacatgaatcagttcatttttcatagaaaaaacacatgaaccttaacatgtaactagttttggtgtcgaaacatttcactgcagagctaattgctgaggaaacacacacgagaatcatattgctttgttcgaatcgtggcaattgttaaatcttcaaagctaagacgagttgtggactgtcagttgtatttccaggtatcaatagccctttttgtactaaccataggatctgctgtcaagttcctacgttggacattgttacgcaaccggatcctctacagtaacttgaagtagctgctgataggtcaggtcattgacgtgcggggttggccttgtctggcccatgcacttaagttgtcggatattactgcagatgaatggcttccgactgttactacgtttcttcttgtccagtactgcaagagatgataaaatatgta

SEQ ID NO: 1706 - DNA, 1451 bp, Setaria italica
tttttttttttgcttcgccttgcgttccatttcgttcctcttcttagctactgtgtgagcccgagagggaacactaaccgcgttcagatagcctgtgattcgtgtgttgtttcttggagcgctttgagttttgattccttgagtccttgttattgattggatgacaaattatcatgcttgatcgaataacttaatctgaagtgaattatgcatctaggaggtgcgacatcttgaagccttgccgaacatgggtgacatttgttttgggggatcacactcatttgcaacacacccaattcttggcgcgttggggaatgtgttccctgcgtcatatgtttgcagcttcactctattcaatgggaatgggtcaggtgggacatacatcggcaaaggaaaggtgctgtctagacgacctcgcagaattgattcgaagaagaggctgtggactaatgttcttcttgctattaatgtcctggcttatatcgctcaggtagcatcacaaggaaagcttcttatgtggggagccaagatcaacagtctgattgatagaggacaattttggcgtttggcaacatcatctctccttcacgcaaatgtcactcaccttgctttcaattgtttctctttaaactcaattgggcccatggtggaaatgctaagtggtcctagaagatttattgctgtttatatcagttcagcgctggcaggttcactgatgagttatcgctgttgtgagtcacctgctgttggtgcgtcaggtgccatttttggattggttggcgcccatgcagtttatatgtggaggcatagaagttattttggcaatgcaagggaaagtttagagcatatcgggcgtgtggttgtcttgaatatgggtatgggcctcctttcaaggggaattgataactggggtcatctgggaggcttgctagggggagttgctgtggcatggttcctaggtccggcatggcaatatcagtatgtgggaaaggatggcagagtggttttcaaagacagggctccagtcctccggctaataaaggggtaggcttaggcttctgttattttgtatttggggagaaacatagggaagagaaaagtaaaagagggtgaagattcattcaacgcaccaagaagagctaattccttaggaaacatacaaggagcctgttgcccgtgttcggatcattagattgtcaatattcaatgctgtggcaggttatggttaatcaatcgcataacattttattaggtgttagtgttaccagcggctgacaaacacacattgttctttctgttcctgcctatgattctcgatgtaagttctgcctatgattctcttgaggtcactaggttctttctgttcctgtactacaagaaatggtcaaacctgtaaaattgttctcagtgatccactaacatactccctccgtttctgtttataaggtgca

SEQ ID NO: 1707 - DNA, 1264 bp, Setaria italica
atcagccatgggcgtgggcaaggtcctgaacgaggtgaagccgtacctgtacatggtgctcctgatggtggggttctccgggatgtacatcgtctccgtcgcctccctccggcgcggcatgagccacttcgtcctcgtcgtctaccgcaacttcgtcggcaccgtccttatgacccccttcgcgctcctcttcgagaggtacactactctgatcatgaacgacgacggctcatgcccggccacacgtcctcatggtgaggcttgttattggagtgaggcccaagatgacgccgctcgtcttcgtcaaggtcatggggctcgccttgctggagcctgtgctggaccagaacatgtactacctgggcgcgaagctgacctccgcgggcttcgcctcggccctcgtcaacatgctcccggcggtcaccttcctcatggcgctcgtcctcaggatggagaagctcaggctgcggagcctccacagccaggccaagatcctcggcacggtctgcaccgtcgccggcgccgtactcatggtcctctaccacggccccgtcgtgccgttcccgtggtccagcggcggcgcccaccaccacgctgcggtggccgccggcacggcggcgagccaaagcggcggtgcctggctctacggcgtcgccatggtcatcggcagctgcgtgtgctgggccggcttcttcatcctccagtcgaacacgctgcagagctacccggcagagatgtcgctgacggcgctcatctgcggcgtgggcacggtgatgagcggcgcggtggcgctttttgcggagcgccgcgacatgagcgcctgggtcatcggcttcgacacccgcctcttcaccgtcgtctactccgggatcgtgtgctccggcgtggccttctacgtgcaggggctagtgacgcgggtgcgcggcccggtgttcgtgacggcgttccagcccctctgcatgatcttcaccaccatcatgggctccaccatactcaaagaagagaccaccttgggaagcgtggttggcgcggcgatcatagtggtggggctctactccctcatctggggcaagagcaaggaccacctcggcgacggcaagcccggcgccggggtcgtcaccgagctgcccctgacctcggctccgacccccaacggcaacggatacggcaagcagcacgcgctcggcggccatgtcgttaccgacgtcgagacgccggcggccaccgtgaccaagtgcgcttactgacaagccgatcgatcgag

SEQ ID NO: 1708 - DNA, 1495 bp, Panicum virgatum
gatcagcagagcagaggagcacaagtgaagcgagctctgatctagccgcctagctagctgcctcaagctgcatagctagtggtggtataattagcaggcaggcatccgccatgggcgtgggcaaggtcctgaacgaggtgaagccgtacctgtacatggtgctgctgcaggtggggttctccgggatgtacatcgtctccgtcgcctccctccgcctcggcatgagccacttcgtcctcgtcgtctaccgcaacctcgtcgccaccctcctcctcgcccccttcgccctcctcctcgagaggggagtgaggcccaagatgacgccgctcatcttcctcaaggtcatggggctcgtcctgctcgagcctgtgctggaccagaacatgtactacctgggggcgaagctgacatcggcggggttcgcctccgcgctcgtcaacatcctcccggccgtcaccttcatcatggcgctgctcctcaggatggagaggctgaggctgcggagcctccacagccaggccaagatcttcggcacggtctgcaccgtcgccggcgccgtgctcatggtcctctaccacggccccgtcgtggagttcccgtggaccaggggccaccaccacgccgccgccgcgggcgccgcggcgacccagagcggcgccgcctggctcaacggcgtcgccatggtcatcggtagctgcgtcacctgggccggcttcttcatcctccagtcgaacacgctgcagagctacccggcggagatgtcgctggcggcgctcatctgcgggctgggcacgctgatgagcggcgcggtggcgctcgtggcggagcgccgcgacatgagcgtctgggccatcggcttcgacacccgcctcttcaccgtcgtctactccgggatcgtgtgctccggcgtggccttctacgtgcagggggtcgtgacgcaggtgcgcggcccggtgttcgtcacggcgttccagcccctctgcatgatcatcaccaccttcctgggctccaccattctcaaagaagaaaccaccatgggaagcgtgattggggcggcgatcatagtggtggggctctactccctcatctggggcaagagcaaggaccacctcagcaagcccggcgccgccgccgtcgccgagctgcccacgatgaccccgccggccatcgccgccaacggcaagcacgcgctcgccgccgccgacgtcgagacgccggccgccgtggccaagtgcgcctactgatctgacaagccagccggtcgagctccctcgatcccattacactgcacaccagtagtgccgtgcctgcatgcactgtcagtggctgtaattgccttcacgattattgctctgctctcgtagagacgggactgcaactaccattctgcattaacggcttctgtttgacctgatgatccgccgcatctgcttctgcgttttgatttgttgtgcgccaccgccactaattaatataagctcgtttaattcgtgtc

SEQ ID NO: 1709 - DNA, 3716 bp, Setaria italica
acccgtgcgccgcgggtaggttctggaagctctccggagatgaggaggggtagaggacatggaggaggaggggtgtccgcgtccctcgccgcgctgctgtgctgcggctgcgtcatggtcctcgccggtgcagccgccgcgcagggcccctggcttccctacgcgtacaaaaccctaagtggtgatgctccacgagttgtggccaaaggcgggttctcaggagtgtttcccgactccagctcagatgcctactcctttacgttgatggccagcgcagccggtacaactctgtggtgtgacgtccagctgacaaaggatggcgtgggagtctgccttcgggacattaacatggataattgcaccaacgtcgcccaagcttaccctgcgagaaagcggacctatgtcatcgatggcgtgcggaaaaatggatggtttgctctggactttaccaaggatgagcttcagtctgttattttaacacaagcaatttggtctcgcacctacagtttcgattctgtcgggtattctatcctctctgtcacagacttgctgtccattgtcaagcagccttctgtttggttgaatgttcagcatgacaccttctacaaagaacatggtttgaacatgaggaactacatattttccatccaaaagcgtgtatctgtggattatatctcgtcacctgaacttggcttcctccaaaatatatctggaacagttcgtggcaagacaaagcttgtgtttagctttcttgataaatccctcttggatcattctataaaccgaacatatggttcacttttgagtaacctaacgcttattaagtctattgcatttggcataatggtcccgaagacatacatttggccagtgacaaaggataactatctacagccgtccacatcaattgtcgccgaagcccacaatgcagggctggaaatatatgcctctgattttgcaaatgatagaattattccctataactacagttatgatccattggcagaatacctaaactttatcagcgatggtggcttctctgttgatggtgtattgtcagaacacccttttactgcatcagaggctattggttgcttggctagtctgaattcaagtaagactgatcatggggaacctttagttatctcgcataatggtgctagtggagattatccagactgtacggacctggcctaccatagtgcaattaatgatggcgcagatgtcattgattgtcctgttcaagtgacaagtgatggagttcttatgtgcatgagttccattaacctgcttgataccacgaatgtgcagggaacaactttcagctctcgtagttctgttgttccagaaattcaggctacagcaggaatcttcacattcaaccttacttgggatgacattaatagtagcaccttaaaacccaaaatatcttccccagtgagtgattattatcttgtaaggaacccaaggtacacaaatcaagggaagtttctgaagttatctgactttctagcaatcggaatggatacagatttgtctggtgtcatgatcatcattgagaatgctgcatttgtggcaaagtcattaggaattgacatagttgattctgtaaatgctgccttaagtgctgctggttacgataatcagactaccaagcaagttctgatccagtcgaaagatagtgctgttcttgtcaaactgaagcagcagaaaacaaaatgcaagcttgtttacactctccccttaggcattggggatgcttctacttcctcattagaagccatgaagaactttgctaatgctgtagttgttgataggaaatctgtttttaccttaagtcgagcttttgcgatccgacagaacagtcttgtgaaacatctacagtcagcagggctagctgtgtacgcacaggtgttccggaatgagtttgtatcccaaccgttggacttctttgcagatgaaactgttgagatcaattactatgttcaatcatttaatctgtcaggcatcataactgacttcccgaagacagtcagaagatacaaaaaaatgcccgactacatgcagagcattgacgttggctccctttaccagttacttcaacccttcaaagcccagccgccatctttgccgccaatgccgacactgaatgcttcaagcgtggaggagccaccgcttcctcctgttgcgtcaaggaagagagatcttttacgactcaagattcgtaaggccagaaaaatgagggagaaattcttcaagcgaaaccgcgggttgctgcttcgacaactagtagacaaggacattgccgaaaggatgatcttcagcttggaagagctcgaaaaggcaacaaataagtttgatgaggctcgcatcctgggcggcggagggcacggcacggtgtacaaaggcatactgtcaaaccagcgtgttgttgccattaaagtgtcaaggcttgtagttcaaagagagatcgatgaattcataaacgaagttgccatcctttcgcaaataaaccatagaaatgtagtgaagctttttgggtgttgccttgagacagaagttccattgttggtctacgagttcgttccaaatggcacactttacgaccaccttcatgttgacaaccctcaaagaccactgacatggaaagatcggctgcgtatcgcctctgaagttgccagttctctcgcctatcttcactcagctgcttcgacatcggttgtgcacagggacatcaagacatccaacatactacttgatgatcgattgacagccaaggtttcggacttcggtgcctcgagaggcatcgcaatcgatcaatcgggagtgacaaccggcatacaaggaacattcggctatttggatcccgagtactactacacaaggcgattgaccgataaaagtgatgtctacagctacggcgtcatgcttgttgaacttctaacaagaacgaaaattatgtacatttcgcctgaaggtgtgagcctcgtggcacactttgtcacgtccctggatcaaggtgagctcaatgagatactagatgagcaggtcatcgaagaaggagaagaggagggcaaacaagtggcagaaatagcagcaatgtgcttgaggatgaagggagaagacaggccaaccatgcggagcgtggagatgaggcttcaagggctgctgggttcagagattaacacttcagtgattggagagggtcatgtgaatggactcaacggcctaacatttcaaggaggaaatgccaatgccggcgacaactactgcagtagacggtacagcatcgaggaagagatcttagtttctgcgagcttggagcgctgatcctcacgccacattctcatccaacagcaaagctatctactcctatacgatgcagtagtagtaccagtactcactcctcagccaattgactgctggctttcatcccacttgtgtcatcctaaaattattcgtgcactcctcaaattagcttcagatattagcattaggttattctaagctacctcccatgttttgaaccaaggacctgattttgaaccaaggacctgattttggccattgtgacgagggagggagggagggagctttcctcatctcttagtgagagttgagatagagatattcttgatgcgggactctggatgcgttagggatgaccatggtgtggttacgttggtttcgggatggagatcatactagtttttatc

SEQ ID NO: 1710 - DNA, 2753 bp, Sorghum bicolor
atctcctttccacccccgccgcttctcagtcccgaccgtttgcgccgctggaaggttctggaaccttctgagatgaggaggagcagacgccaacgcaatggacgaggaggagggagtggccagcgcggtgtaagggtggcctttgccttcgccgtgctgctgggctgtgtcatgcccctcgtcggcggcgccgccgcgcagggcccccggctcccctccgactacaaaaccctcagcggcgccgctccacttgtggtcgccaaaggtggattttcgggagtgtttccagattccagccaaggtgcctattcttttgcgatgatcgccagcgcaccggacacagccatgtggtgtgacgttcaactaacaaaggatggtgttggagtttgccttcgggatataaatatgaaaaattgcaccactgtcgaccaagcgtaccctgcgagaacgcggacctatgtcatcgatggtgtgcagaaatctggatggtttgtttcagacttcaccattgctgagcttcagtctgtttctctaacacaagcaatttggtctcgcactgagagattcgatggtatctatcctatcgtcagtgttactgactttcggtcccttgtcatgccatctcctgtttggttgaatgtccagcatgacatcttctacaaacaacatggtttggacatgaggaactacatattttcaatcaaaaagcgtgtatccatggattatatctcatcacctgaactgggcttcctcaaaaatatatctggaagagttggtcgcaaaacaaagcttgtgtttagatttcttgataaagccctcttagatcattctataaaccaaacatatggttcactgtcgagtaacctaacgtttattaagtctattgcatctggcataatagtccctaagagttacatttggccggtgacaaaggataactatctactgccatccacatcaattgtcacagaagcccacaatgcagggctggaaatatatgcctctgattttgccaatgatagaattattccctataactacagctatgatccgttggcagaatacctcaactttgtcaatgatggtggcttctctgttgatggtgtattgtcagagcacccaattactgcatcagaggcaattggttgttttactaaactgaattcaaataagactgatcatggagaacccttagttatctcacataatggtgctagtggagactacccggactgtacagacctggcctaccatagtgcaattgataatggtgcagatatcattgattgtcctgttcaagtgacaagtgatggagttcttatgtgcatgagttccggtaacctgcttgacaccacgaatgttcagacaacaacttacagctctctggtttctgttgttccaaaaattcagcctcaaccaggaatcttcacattcaacctcacttgggccgacatgaacagcaatgctttaaaacccaaaatatcttctccagcaagtggttattctcttgtaaggaacccaaggtacacaaatcaagggaagtttttgaagttatctgactttctagcaatcgcaatggataaggacttgtcgggtgtcatgatcatcattgagaatgctgcatttttaataaattcattgggaatcgacattgttgattctgtaaccactgccttaagtgctgctggcttcaataatcatcctaccaaggaagttctgatccagtcaaaagatagtgctgttcttgtcaaattgaagcaaaagaaaacaaaatccaagcttgtttacactctaccctcaggcatcggggatgcttctaattcctcactgaaagacattaagaagtttgctgaagctgtggttgtggacagcaaatctgtttttactctaagttctgactttatcataagacagaacagtcttgtgcaagatctgcagtcagcagggctagctttgtatgcagaggtgttccggaatgagtttgtagcacaaccgttggatttcttcggagatgaaactgtagaaatcaattactatgttcaatcatttaatttatcaggcatcataactgatttcccgaagacagtcagaagatacaaaaaaaacacttgtacagttctgggaaatgatatgcccaactacatgcagcctcctcaggctggctcccttgcacagtttctccaaaccttcaaaacccagccaccatctctgccacctatgccgacactgagttcttcaagcgtggaggagccacctcttcctactgttgcctcaagaagtgtatctgatggtagttcatcagggggcaccagaactcctggcacaccttctgatgctcacacggctactatgagtgctggcatgctacttgtgatggttttcacagctctgctgatctgacaagacacatgagactgtatagtagacgactgaagctaatctatcacccttcgattcgggcaagctttgactggtgatctgtagcagcagaagcggcactggggagtgagagactaaggaagcttggggatctggagagggaagggccggcggggtgaggcagcttctcaaaatagtcccacagccccaccaacagcagcaggcccagcaacactaagaaatagtatatgcctatacctgcttgcggtttgtggctttatgttatatttgttgttatatatgtatgagacatgatacattttggacacttgatcaaattctgaatcgaactctatatcatcattagccgcaag

SEQ ID NO: 1711 - DNA, 712 bp, Setaria italica
ctggcctcctggaggagaagaggatggacggccaaggggagaaggagatgccggccaggcagcggcaggaggacgaacacctcctgtcctcgttgctcaccaagccagatgcactggagagagatccagattcggacacgttggaaacacactccctgcacccgagtcatcagcctgggagaagcgaaaccagcaaagaggtggagctagccgacatcgccaaggacctgaacaagatcaagaggcagaacactgtcacccacatcctgctcggcgccgtcatcgtcctgacggcggtgtggcaggttaacgaggtgtcgttcctcctctgggtgcagaggaaactgagcaacccgttcaagtccctcggggacatgatcaagggatccctcaagctgaaggggaggaagcccgtgatcgagtcgtcgccgctgccgccggtcggcgtccccgatgtcagccggcctgatctgccgtcgttcgtcatcggcagcactgaaggcaggtagtaagactagctgcgtggtgatgctaggaaaaacagggttcgtttgtgattgaggtccatttttttttgggttcagtttgtctgttcatcaaagttgaaatttagaagttatgccactagttccatagtgtttctgaaatagcgcacccggattgattctcgaagagaaactagatcacttcttgcgagcataatggctcagag

SEQ ID NO: 1712 - DNA, 2135 bp, Setaria italica
ggccgacgtcgacctcggcccggacagcgacgagcactacatcagccccaacgtcaaagctcctcgcgtcgcagggctcctggtgaagctgctggcctgggtgctggagatgcccgtcgtcggctggatcgtgctctccgtcctcaaacgcgacaacctcgtctacaagctcgtctccgacgccgagatcccggagccgccgctgttcacggccacccacacctggcaagacatcccggagcagaacgtcaggctgacgaagcccggcctgccgccgccggagcgcgtccaggaggccgtcgtctgcctcactgctcccctgccggagccggcggcggagctcgctgatccgtcgccggggttcaggcgctggacggtacgggacttccacgaggcctacagctcggggcagacgacccctgtcatggtggcgcggaggttcttggcggcggtgaaggagtgctccggcccggaggtgaacatggccttgttcatcagctgcgacgccgccgacgtgatgcggcaggccgaggactccacacgcagataccagcaaggggcgccgctgtcggccatggacggggtgctggtggcggtgaaggacgagctggactgcgcgccgtacccgaccacgggcgggacgcggtggctggcggcggcgcggcggccgtgcggcgcgggcgacgctgcgtgcgtggcgcagctgcgggcatgcggcgccgtcatggcggggaaggccaacatgcacgagctcggcgccgggaccagcggcatcaacccgcaccacggcgccaccaggaacccctactgcctcgccagggtctccggcggttcatcgggcggatccgccgccgcagtctgcgcaggactatgccccgtcgccctcggcgccgacggaggcgggtccgtgcgcatgccagcggcgctctgcggcgtcgtcgggttcaagcccaccgccggcaggctctccaactccgggctgcttcctctgaactggacggtcggcatgccggggatcctggcagcaaccgtcgaggatgcgctcatcgcttatgcggccattgttgatcagtctaaaccaagtcatttacagcctgaactgaacctgccaatgctgacgtgtacgagatccatgcctaacatcaggctagccaaatacgtaaagtggtttgacgattgctccgaggacatcaggagcctctgcggcaaggccctccagatgctgcgaacgcagtacggttgggagtgtgtggacgtgactgtccctgagatcgaagagatgcgtctggcgcactacgtgacgatgggctccgagtgcacggcctccctcgctaaatacctcgacaacatgagcaagtctgagatcgggtgggacgtgcggatcggcctgagcgcctaccgatccttcagcagcagggactacctcaacgcacagcgcctccggaaccgtcagatgttcttccacaacaagatctttgagaccgccgacgcgatcgtgacgccgatgacaggagtgacggcgtacccgctgcaggaggacgcgctgggcaccggggagctcgactacatcaacggagctgcgctggtgcggtactcgatcgcgggcaacttcctggggctgccggcgatcaccgtgccggtggggtacgacacgggagggctccccgtcgggctgcagttcatcggcaggccatggtcggaggcgacgctgctgcacctcgcctacgccacgcaggaggcctgcgccagggagcaccgcaagcccaaggtgcactacgacctcctcctcagcaaagagtactagccttcagtcttccacagagttgggatcgacgatgatccaacaggtgtatggtgaaattggtcagtgatttatttgttgactggcagtacaaagaaaaaagaaactgtgggttgcgattatgagtgcataattattgtttttgtgccgggagagcacatcgattaatctaagagttggtcacggaattagtgcctctcttttttcgtccaaaagggggaaaaactactgtatcgacagattcttgggtgcaattgaaactctttttaggagagtgctggagtgctaaagagtttgcagacattctaaaaattttactatagatgaagatgag

SEQ ID NO: 1713 - DNA, 2245 bp, Zea mays
gaaaccatccctgcaggtccctgctccctggttatattaagcagctcccaatctttggcatttgcaggcacacaacacaacacagttctccctttccactccagtccaaccaaccgtccatgggtttcttcatcccgccgcccaaggtgtacaagccggcggcagaggtcgacctcgggccggacagcgacgagcactacatcagccccaacgtgaaagcgccccgcgtggccgggttcctggtgaagatgctggcctgggtgctggagacgccggtgcttggctggatcgtgctcggcgtcctcaagagggacaacctcgtctacaagctcgtctcggacgctgagatcccggagccgccgctattcacggccacccacacatggcaagcagcgatccaggagcagagcgtgcgcgtgacggagtcgaggctgtcgccggcggagcgcgtgcaggaggccgtcgcctgcgtcccagctgctgcccaggcccagttggagccggcggcggggttcaggcgctggacggtgcgggacttccacagggcgtacagatcaggacaggctacccctaccatggtggcgcggcgattcctggcagccgtggaggaatgttcagggccggacctgaacatgggcttcttcatcagctgcgaccctgcggacgtgctgcggcaggccgaggactccacccgcagataccagcaaggggcgccgctgtccgccatggacggagtactggtcgccgtcaaggacgagctcgattgcctgccgtacccgaccagcggcggcacgcggtggctggggtcggcgcggcggtgcgcggcggacgcggcgtgcgtggcgcagctgcgcgcgtgcggcgccgtgatggccggcaaggccaacatgcacgagctgggcgcgggcaccagcggcatcaacccgcaccacggcgccacgcgcaacccctacaacgtgggcagggtgtcgggcggctcctcgggcgggtccgccgccgccgtctgcgccgggctctgccccgtcgccctcggcgccgacggaggcgggtccgtgcgcatgccggcggcgctctgcggcgtcgtcgggttcaagcccactgccggccgcctctccaactccgggcttcttcctctgaactggaccgtcggcatgccggggatcctagcagcgacggtcgaggacacgctgatcgcgtatgcggcgattgctgatcagtcaaaaccaagccctttgcagcagcctgaactgaacctgcccatgctgacacgcacgaggtccatgcccagcatcaggctcgccaaatacgcaaagtggttcgacgacagctcggaggacatcaggagcctctgcgggaaggcgctgcagatgctgcgcacgcactacggctgggagagcgtggacgtcaccgtccctgagatcgaagagatgcggctggcgcactacgtgaccatgggctcggagtgcactgcctccctcgccgccaagtacctggacagcatggacaggtccgaggtcgggtgggacgtgcggatcgcgctcagcgcctacgggtccttcagcagccgagactacctcagcgcgcagcgtctccgatgccggcagatgtacttccacgagaagatcttcgagactgccgacgccatcgtcacgccgatgacaggggtgacggcgtacgcgctgcaggacgacgcgctgagcacgggggagctggactacatcaacggagctgcgctggtgaggtactcgatcgcgggcaacttcctggggctgccagcgatcaccgtgcccgtcgggtatgacaggggagggctccccgtggggctccagttcatcggccgcccgtggtcggaggccacgctgctgcacctcgcctacgccatgcaggaggcgtgcgggaagaaggtgctccggaagcccaaggtgcactacgacctcctcaccaaagagtagctccagcgagcatcgatccggcagattgctctctatgaggcgcgcggttgctgattgcatgcacctctagtgtgattgattgtttgtttgattgattgagcttgtgatgagagagtgggggaagttgaatggaatgccgtcaatgtcggacaactctcaactaggagaagaaaaaaaaacatggttgccagcaccatgcatgtgcaccaccattcgttttttaatgtcgtcctcattgaaacattatgtaagtattgtgtatacgtgtgctttagattcgtttttcactgccc

SEQ ID NO: 1714 - DNA, 3428 bp, Sorghum bicolor
gcaggcctcctctctctgtttctgagctgaaaccattcctgctccatccctggttataagcagctcacaatcttggcacttgtagtcgtaggcaggcacaacagtcgtcagaggagtgaagcttctcacgcaacacaatcgtcttccagctctgctgcttcactacactcatccaaccaaacccatccatgggtctcttcagctcgccggccaaggtgtacaagccggcggcggaggtcgacctcggcccgcacagcgtcgccggcgagcactacatcagccccaacgtcaaagctcctcgcgtggccgggttgctggtgaagatgctggcgtgggtgctggagactcccgtcctcggctggatcgtcctctccgtcctcaagagagacaacctcgtctacaagctcgtctccgacgccgagatcccggagccgccgctgttcacggccacccacacatggcaagcagcgatgcccgagaagaacgtgagcgtgacggaggccggcgtgtcgccggcggagcgcgtccaggtggctgtcgccggcatcccagctgacatggagccggcggcgacggcggcggcgctcgctgatggcccgtcgtcctcgttcaggcgatggacggtgcgggatttccacagcgcctacagctcaggacagactacccctgtcatggtggcgcggagattcctggcagcagtggaggaatgttcaggcccggatcggaacatgggtttgttcatcagctgtgaccccggcgacgtgctgcgtcaggcccaggaatccacccgcagataccaacaaggggcgccgctgtccgccatggacggagtgctggtcgccgtcaaggacgagatagactgcctgccgtacccgaccaccggcggcacgaggtggctggggtcagcgcggcggtgcgtggcggacgcggcgtgcgtggcgcagctgcgcgcgtgcggcgccgtgatggcggggaaggccaacatgcacgagctcggcgcgggcaccagcggcatcaacccgcaccacgggtccacgcgcaacccttacaacgtcggcagggtctccggcgggtcctcgggcgggtccgccgccgccgtctgcgccggcctctgccccgtcgccctcggcgccgacggaggcgggtccgtgcgcatgccggcggcgctctgcggcgtcgtcgggttcaagcccaccgccggccgcctctccaactccgggttgcttcctctgaactggaccgtcggcatgccggggatcctagcagcgacggtcgaggacacgctcatcgcttatgcagccattgctgatcagtcaaaaccaagccctttgcagcagcctgaactgaacctccctttgctgacaagcacgaggtccatacctaacatcaggctcgccaaatacgcaaagtggttcgacgacagttcagaggacatcaggagcctgtgtgggaaggctctgcagatgctgcgcacgcactacggttgggagagtgtggaggtgactgtccctgagatcgaagagatgcggctggcgcactacgtgaccatgggctcagagtgcactgcctccctcgcaaagtatctcaacaacatggacaggtctgagatcgggtgggacgtgaggatcgcgctcagcgcctacggatccttcagcagcagagactacctcaactcgcagcgcctccgatgccgtcagatgtacttccacgagaagatcttcgagacagccgacgccatcgtcacgcccatgacaggggtgacggcgtacgcgctgcaggacgacgcgttgagcaccggcgagctggactacatcaacggagcggcgctggtgaggtactcgatcgcgggcaacttcctggggctgccggcgatcaccgtgccggtcgggtacgacagggaagggctccccgtggggctccagttcatcggccgcccgtggtcggaggccacgctgctgcacctcgcctacgccatgcaggagtcgtgcggcaaggagcactgcaagaagcccaaggtgcactacgacctcctcaagaaacagtagctccggccggcggtccgtccggcctcgagcaaattaaaatggtggccgtggtgtttcaggaggagatttaagtacagctatatatagggcgattgattgattgattgattgtgctcttgatcatcaggatttgtccgagagaagttcaatgtcatcgttgtcgagaattaagttggaaattctatatatccatgtgcaataatgtgcccatattctccaaattttatccaacatctgtattcccccttattggtactaataactaagtactttattcttcattcatcaagctattccttgacgcgtcgctggttaatttcttcattaattactgtagcttagtcctgacggcgatgagctggggtagaggccattgacggtcatgccgccgtcgacggcgatggtctgtccggtgatgtaggacgcgcagggcatgcagaggaaggccaccagcgacgagatctcctcgggctcgccgacgcgccgctgcggcgtccgccggaggatctcctccacgtactgcccccgcgacaggtccccttccacgagcggcgtcctggtgtaccacggcgcaacggagttggcccggatgccgtcgccggcccactcgcacgccaggttcctcgccagctggttcatgccggccttcgccatggcgtagacggagcccgtgcacactgccacgccgccgcacacggaggagacgagcaccacgctgccgccgttaccgttgccggcggcggcggcgggggctttcagcagcgggtaggcgagctggcacaggtggtaggcggactccaggttggtggacatcaggaacgcgtagtcctcggcggtgtactccgccgtcggcttgccgaagttggtgcccacgttgttcaccaggatgttgagcttgccgccgaagcgctcggccacgtcgcggaggagacgctctcgctggtcacgcgccgacacgtcgcagacggagcccgtgacgaccccgccgccgccgttggtcttggcggcggcctcccactcggccaggcggtcgcggagctccgcctcgttccgggagcacgtgtgcaccgccgcgcccagcgccgccagctcctcgaccacggcacgcctgagcacatggagttcagttaccgttacacagcaagccagcatgcgccacctgttgattgtgcgtagttagtacccgatgccgcgggtgccgccggtgacgagggccgtcatgccacgaagggaccacctgctcctcccggcggcgggctcggagctgatgatggtggccgtgtcgtcgttgcgcgccgccgccatgatcttgtagctagctggcctgctgctgccggtttctagctagctctgccgccggctgggtgttgggtgatcgtcggt

SEQ ID NO: 1715 - DNA, 2079 bp, Panicum virgatum
tgggtgctggagacgcccgtcctcggctggatcgtcctgaccgtcctcaagagggacaacctcgtctacaagctcgtctccgacgccgagatcccggagccgccactgttcaccgccacccacacctggcgagacatccccgagcagaacgtcaggcggacgaagccggggttgtcaccggcggagcgcgtccaggaggccgtcagctgcctcccagctcgcctgccggagccggctgcggcgctcgctgtccctggtggcccggcgtcggggttcaggcgctggacggtccgggacttccacagggcctacagctcgggacagacgacccctgccatggtggcgcggaggttcctgacggcggtgaaggaatgctcggatctgaagatggccgtgttcatcagctgcgacgccgccgacgtgatgcggcaggccgaggactccacccgcagataccagcaaggggcgccgctgtccgccatggacggagtgctggtcgccgtcaaggacgagctcgactgcctgccctacccgaccaccggcgggacgcggtggctgggggcggcgcggcggtgcgcggcggacgcggcgtgcgtggcgcagctgcgggcgtgcggcgccgtcctcgccggcaaggccaacatgcacgaactcggcgccgggaccagcggcatcaacccgcaccacggctccacgcggaacccctacgaccccgccagggtctccggcggctcatccggcggctccgccgccgccgtctgcgccggcctctgccccgtcgccctcggcgccgacggaggcgggtccgtgcgcatgccggcggcgctctgcggcgtcgtcgggttcaagcccaccgccggccgcctctccaacgccgggctgcttcctctgaactggaccgtcggcatgccggggatccttgcagccaccgtcgaggacgcgctcatcgcttacgcggccatcgttgatcagtccaaaccaagtcctctgcagcagcctgaactgaacctgccgttgctgacgtgcacgagatcaatttccaacatcaaactggcaaaatatgcaaagtggttcgacgacagttcagaagacatcaggaacctctgcggcaaggctcttcagatgctgaaagcgcagtacggttgggagaccgtggaggtgactgtccctgagatcgaggagatgcggctggcgcactacgtgaccatgggatccgagtgcacggcgtccctcgccaagtacctcaacaacatgagcaggtctgagatcgggtgggacgtgcggatcgggctgagcgcctaccgctccttcagtagcagggactacctcaacgcgcagcgcctccggtgccggcagatgtacttccacgagaggatcttcgaggcggccgacgcgatcgtcacgccgatgacaggggtgaccgcgtacccgctgcaggacgacgcgctgagcacgggggagctcgactacatcaacggagctgcgctggtgcggtactcgatcgcgggcaacttcctgggtctgccggcgatcaccgtgccggtggggcacgacggaggggggctccccgtggggctgcagctcgtcggccggccatggtcggaggccacgctgctgcacctcgcccacgccgtgcaggaggcctgctgggagcaccgccgcgagccgcccaaggtgcacttcgacctgctcgctcctcgccaaagactgacgacaggccttgccccttgacgacaggcaattgctcctcggttgcgattgagtgcataattgttaatttgttattcttgtgccaggagagtgcgttggttaatttgagcatcaataagatgataacgaactttatgcctctatttttcatgcgaatatatcaggtgtaaaccgaattttttagttcgtaaaatatacaaatttacaatctgtgtccccaatatctgtaacggtcgtaggtcacgacttaataccggtgtaatcgtgccgagtttctttctgggtcggttcctgctttaggaacttcttgtattgtttgtactgcttccctcttaatgaaaaacatgctcatgcacggcacgggttgcg

SEQ ID NO: 1716 - DNA, 6168 bp, Oryza sativa
gtagcagcagaccgtggcagtactctctgcccggtcaaagacaggaagtatttatcagtatacaagtaacagctgcggtaacaacatttttttttcttctcccttctcccttttcttcttgagatgaaagtggtagcagcacaggtagtactagtactacaataatgacacattgaagagcagtagaagaggagaggagaggaggggaggcaagaacaccagcagctgaaagtgagtcctggtttgagctgcctgggcgggaaagagaggaggcgaaccgcgaagaagaagaagaagagaagagagaaaaaaggaagcaaaaaaggaggcggtttttggattcttgctgcgatttctacgcactcgaggctctcatctcgtcaaaagcagtggcctttttccctcctcctcctttcttgggcatggtgtcattcatggtgatgctgctgctctgacttcagtgatccaaaccatgctttttgatggtggctggtagaccaagtgatcactattgatgctttgattgtctgatgaccggtggttgcaagatggatctccaagagttgactctggaggcacaagtttgaatgccctggttcgatgtcattgcactccggtgatcaggtcacatgtttgatttccactttggtggcttgagagcatactctagttgtctgaatcaagttctctgaaagagagaccggagatgagagaggagggaggaattgcttctccgggcgaaaagcctattccgaatggtgcttccccaaatcatagccaatcacctaaaatttgctcaagaattacagataatgagactcaaggaactgcaacagcaaaatctttaaatgaaaagctagtgttggaaactgtgtcagatgattcttccacacagcattgtcagtcaccacagccagatgtcttcacaaatgtcaaagatgaagatatgcaagattctgtgaagagtttgagtgagaagcttgcttcagcccttttgactatcaatgctaaagatgacttggtgaagcagcatacaaaggttgcagaagaggctgttgcaggttgggaacaagctgaagctgaagttagtaccctgaagaggttactcgaagcttcaactcagaagaatgcctctttggatgatcaagtgaaccacctagatgatgctctcaaagaatgtgtcaggcagcttcgccaagctagggaagaacaagaggagaaaattcgtgatgcagttgctaagaagactcaagaattggattctcacaagtctgagctccagaaccatatttatgagctaaagcagcagctggaagccgctaaattagaagctgccactgtggctgtccagcatgatctgcaggataaacttcaggctgcagagaaggaaaacaagggcctgaagatcgagctgctcacgctagccaaggacttgaagagactgtcactggaaagagatctgagcaatgaagcagcagagacagcaagtaaacaacatttggaaagtgtgaaaaagattgcaagggttgaggcagaatgccgtaagctgcgccatctgacacgaagaacttccttggccaatgattctaggcctgcgcctaacaatgcttgcatggaatctctcactgatagccagtctgacagtggggagcgtatgctgactgttgacagtgaaatgagaaattctgattcatgggcctcggctctgatagccgaacttgatcagttcaagaacagtagtgccagctcaagagatgttgtaaacaatcatgttgagattgacctgatggatgatttccttgagatggaaaagctggctgcattgtctgaagtagaacgtgtaagctctagctttggaacagaaactgattctgaccaggctgtggctatagataaagcttcaaaagtcgaaactgaaacactaaagagccaggtcacagatttgcaggcaaaggttgaaaagcttgagactgagaaaagggatcttgaaatggcccttgcagaggctagagtccagcttgacgcgtcgtgtgatgccctgatggcagccaacaacaagttggcagaattacaaatgcagttcaacttggcaaatgagtctaaaattgctgctttgggacaagctgatcagttagatgctgagagaggatctttggcattgcagcttgagtcgaagtcaatagaagttgagaaacttcaggcagttgtggcttcgttggaagaaagtacagataagaaagagctggagtcacagttagagtcaacttctgtagagttagcggatctttgcaagacagtggcatccttgcaagagcagattgatgccgagagaactctgtctttgcagcacaaagcatatgcagacatggcagatgcagataaaaagtcactagaggcacaactgcagtccgcacatgcggatatcgggaaactgaggggatctattgaaacactggagagcgagttgcaaaaagagaaaaccatgtatgaagaacttgtggtccaaatggagtcaatgaagattgaatcagagaaaaaacttggcgtggaatctgccaaagaagcattggaggcacggctcctggtagtgaactcagaaattgcgaaactgcatggaacagtgaacgatctggagtgcgatgcagcaaaggagaaggcattttcttcggaactgaagatgcaactagaggcagtggaaggcatccgaaagatgttggagtctgagcttgagagttcacaccaggaaaccatgaagctccaggagaagatctcattgttggaagtaagacttaaggaccagactgcattgttggtagaattcactgccaaggccgaggatgcagcggtgggaaggaaggcaatggaaggccaacttgaaggagctaaactggaaatcacaaaacttacaaatagggtaagcttgctgcaaggtaagattgagcaggagaagctgctgtcagaggagtacgaagcaaaatgccgcaagttagaggctcagctgtcaagagacagtcgggaggcaaggctttggcgactggccaacacaaatggtgacctgaaggtcaagcaggataaagagctctccagtgctgctggaaaactcgtggagtgccagaagacgattgcgaacctcggtcgtcagctaaaatcgctgaccgatctcgacagtgtaacagccgagcctgaaaagctagagtctggggatgcacttctggactttagagaacccgatgttgaggtgccaccagcaggctttgcaaatggcctgtacgatttggatcttccaaagagcaatgggagctgcctgtcacccattcctcgtgttcagtcgtcttccacacattcgcaaacgtcagtgttctctggcggtttatcgtcgcttggtagctacaggaacaaaacaagaaagtgaaatctgatgaaaaagatttgtgcataaacttatttaacagttcgtggatgtttgtcagttgtcacctgatgcttagatcagtgtacatttacaggaaaatgatggttacttgtgcttgttccgcctgatgattttactgctatgagctcagcctcattttctttacttttcagcgttcaccagtttctgatgcaagtcttgttgaaagttgagactgatgtttgtcatatagtaccattctcacaagctagtcagttcgagctgaagatgtgctgaacatataagtaggcaattcactgaatgcaagatgaataatctgtcactgaagaaatgcagcttgaaacttgtatagtgctttgctcgagtttataagcctggaaactaaatgcttgagatatatagctcgaatgtctgaaagtgatgagagctggttttcagtaactgtaggttccgtacgattgaatttacctctgtaagatgcaaccacctccacactaccgtccaaaactgcgacatggagtactacataagctgtggcatggttgcactctatcgcacactcgaatcgtctcccattgttgagcaagcaaaggtctttgttcttcttgagctcagctcagctcatcagcttccatccatgggtgtcttcagctcggctccgaaggtgtacaagccggcgtcggaggtcaatctcggcgccgacagcaacgagttctacatcagccccaacgtcaaagctccacgggttgctgggcttctggtgaagatattcgcatgggttcttgaggcgccgatcatcggctcaatcgtgctctacatcctcaagagagacaatcttgtcaacaagcttgtctcggatgccgaaatcccggagccaccactgttcactgcagctcacacctggcaagacatccctgagcagaatgtgagcctgacgaagccggacatgtcgccggcagagcgcgttcaggaggccgtcgtctgcctcccggctcgcctcgaatcggtgctcgctgacccgccatcgccggggttcaggcgctggacaatccgggacttcaccagtgcctacatctcaggagagatcactcctgtcatggttgcgaggagatttctcgctgcagtgaaggagtgttcaggccctgatctgaacatggccttgttcatcagctgcaatcctcaggacgtcatcagacaggccgaggcatccaccctcagataccagcaaggagctcctctctctgccatggatggcgtcctggtggccgtcaaagacgagatcgactgcctgccatacccaacaacaggaggaacgagatggctgcagaggatgcggccgtgcgtgcaggacgcggcggtggtggcgcagctgcgggcgtgcggcgcggtgctcgccggcaagaccaacatgcacgagctcggcgccggcaccagcggcatcaacccgcaccatggatcgacgaggaatccgtacaacaccggcaaggtggccggcggctcgtcgggcgggtccgccgccgtcgtctgcgccggcctctgccccgtcgcacttggagccgacggaggcggatctgttcgcatgccagccgcgctctgcggtgtggtgggcttgaagccgacggcagggcgtttctccaaggatgggcttcttcctcttaactggaccgtcgggatgccagggatcttagccgcgacagtggaggatgcgcttatcgcctatgcagctattgctgatcagtcccaaccaagccacttgcagcctgaactgaatcttcccctgctgaaagctgcaagctcgatgcctaccatcagactagcaagatatgcaaagtggttcaatgactgttctgaagacatcagaagttgctgctacaaagctgtccatacgctgcggactcgatacggttgggagactgctgatgtgacaattcctgaaattgaggagatgcggctcgcgcattacgtgacaatgggttcagaatgcaccgcctccttcgataagtatctgaagaagctgagcaagtctgagattggttgggatgtgaggatcgcgctgagcgcctacgggtcgttcagcagcagagcttacctgaactcgcaacgaatccggaaccgtcagatgtacttccacgacaagatctttgagacattcgacgtgatcgtcacaccaatgacaggagtgacagcgcacgaattgcaggacaacgcggggcacaccggagagctggactacataaacggagctgcgctggtgaggtactcgatcgccgggaacttcctggggttgccggcgatcaccgtgaaggttgggtacgacagggaagggctccccgtcgggctgcagttcatcgggaggccgtggtcggaggccacgctgctgcacctcgcctacgccatgcaggaggcgtgcggcaagaactacaggaagcccatggtgtactacgatctcctcaacaagaacaaatactagtttcagtttcaaaagaacaaatagtagctatatatgttgtgagagttgagtgacagtttgattctgagagatttggactggggagaaatttatcatcgatcattcttaccatcccaaatacagaatgtgatggacattattattgtaattgttgttatgtttgttgttgttgctgctgcttgacataagcatgcatgtaagtcatatgcatgtcgctgtatatgtttactattattgaatgtgcctactgatttactaaatatgatatttcatttcttttactcta

SEQ ID NO: 1717 - DNA, 6028 bp, Oryza sativa
acaggtagtactagtactacaataatgacacattgaagagcagtagaagaggagaggagaggaggggaggcaagaacaccagcagctgaaagtgagtcctggtttgagctgcctgggcgggaaagagaggaggcgaaccgcgaagaagaagaagaagagaagagagaaaaaaggaagcaaaaaaggaggcggtttttggattcttgctgcgatttctacgcactcgaggctctcatctcgtcaaaagcagtggcctttttccctcctcctcctttcttgggcatggtgtcattcatggtgatgctgctgctctgacttcagtgatccaaaccatgctttttgatggtggctggtagaccaagtgatcactattgatgctttgattgtctgatgaccggtggttgcaagatggatctccaagagttgactctggaggcacaagtttgaatgccctggttcgatgtcattgcactccggtgatcaggtcacatgtttgatttccactttggtggcttgagagcatactctagttgtctgaatcaagttctctgaaagagagaccggagatgagagaggagggaggaattgcttctccgggcgaaaagcctattccgaatggtgcttccccaaatcatagccaatcacctaaaatttgctcaagaattacagataatgagactcaaggaactgcaacagcaaaatctttaaatgaaaagctagtgttggaaactgtgtcagatgattcttccacacagcattgtcagtcaccacagccagatgtcttcacaaatgtcaaagatgaagatatgcaagattctgtgaagagtttgagtgagaagcttgcttcagcccttttgactatcaatgctaaagatgacttggtgaagcagcatacaaaggttgcagaagaggctgttgcaggttgggaacaagctgaagctgaagttagtaccctgaagaggttactcgaagcttcaactcagaagaatgcctctttggatgatcaagtgaaccacctagatgatgctctcaaagaatgtgtcaggcagcttcgccaagctagggaagaacaagaggagaaaattcgtgatgcagttgctaagaagactcaagaattggattctcacaagtctgagctccagaaccatatttatgagctaaagcagcagctggaagccgctaaattagaagctgccactgtggctgtccagcatgatctgcaggataaacttcaggctgcagagaaggaaaacaagggcctgaagatcgagctgctcacgctagccaaggacttgaagagactgtcactggaaagagatctgagcaatgaagcagcagagacagcaagtaaacaacatttggaaagtgtgaaaaagattgcaagggttgaggcagaatgccgtaagctgcgccatctgacacgaagaacttccttggccaatgattctaggcctgcgcctaacaatgcttgcatggaatctctcactgatagccagtctgacagtggggagcgtatgctgactgttgacagtgaaatgagaaattctgattcatgggcctcggctctgatagccgaacttgatcagttcaagaacagtagtgccagctcaagagatgttgtaaacaatcatgttgagattgacctgatggatgatttccttgagatggaaaagctggctgcattgtctgaagtagaacgtgtaagctctagctttggaacagaaactgattctgaccaggctgtggctatagataaagcttcaaaagtcgaaactgaaacactaaagagccaggtcacagatttgcaggcaaaggttgaaaagcttgagactgagaaaagggatcttgaaatggcccttgcagaggctagagtccagcttgacgcgtcgtgtgatgccctgatggcagccaacaacaagttggcagaattacaaatgcagttcaacttggcaaatgagtctaaaattgctgctttgggacaagctgatcagttagatgctgagagaggatctttggcattgcagcttgagtcgaagtcaatagaagttgagaaacttcaggcagttgtggcttcgttggaagaaagtacagataagaaagagctggagtcacagttagagtcaacttctgtagagttagcggatctttgcaagacagtggcatccttgcaagagcagattgatgccgagagaactctgtctttgcagcacaaagcatatgcagacatggcagatgcagataaaaagtcactagaggcacaactgcagtccgcacatgcggatatcgggaaactgaggggatctattgaaacactggagagcgagttgcaaaaagagaaaaccatgtatgaagaacttgtggtccaaatggagtcaatgaagattgaatcagagaaaaaacttggcgtggaatctgccaaagaagcattggaggcacggctcctggtagtgaactcagaaattgcgaaactgcatggaacagtgaacgatctggagtgcgatgcagcaaaggagaaggcattttcttcggaactgaagatgcaactagaggcagtggaaggcatccgaaagatgttggagtctgagcttgagagttcacaccaggaaaccatgaagctccaggagaagatctcattgttggaagtaagacttaaggaccagactgcattgttggtagaattcactgccaaggccgaggatgcagcggtgggaaggaaggcaatggaaggccaacttgaaggagctaaactggaaatcacaaaacttacaaatagggtaagcttgctgcaaggtaagattgagcaggagaagctgctgtcagaggagtacgaagcaaaatgccgcaagttagaggctcagctgtcaagagacagtcgggaggcaaggctttggcgactggccaacacaaatggtgacctgaaggtcaagcaggataaagagctctccagtgctgctggaaaactcgtggagtgccagaagacgattgcgaacctcggtcgtcagctaaaatcgctgaccgatctcgacagtgtaacagccgagcctgaaaagctagagtctggggatgcacttctggactttagagaacccgatgttgaggtgccaccagcaggctttgcaaatggcctgtacgatttggatcttccaaagagcaatgggagctgcctgtcacccattcctcgtgttcagtcgtcttccacacattcgcaaacgtcagtgttctctggcggtttatcgtcgcttggtagctacaggaacaaaacaagaaagtgaaatctgatgaaaaagatttgtgcataaacttatttaacagttcgtggatgtttgtcagttgtcacctgatgcttagatcagtgtacatttacaggaaaatgatggttacttgtgcttgttccgcctgatgattttactgctatgagctcagcctcattttctttacttttcagcgttcaccagtttctgatgcaagtcttgttgaaagttgagactgatgtttgtcatatagtaccattctcacaagctagtcagttcgagctgaagatgtgctgaacatataagtaggcaattcactgaatgcaagatgaataatctgtcactgaagaaatgcagcttgaaacttgtatagtgctttgctcgagtttataagcctggaaactaaatgcttgagatatatagctcgaatgtctgaaagtgatgagagctggttttcagtaactgtaggttccgtacgattgaatttacctctgtaagatgcaaccacctccacactaccgtccaaaactgcgacatggagtactacataagctgtggcatggttgcactctatcgcacactcgaatcgtctcccattgttgagcaagcaaaggtctttgttcttcttgagctcagctcagctcatcagcttccatccatgggtgtcttcagctcggctcccaaggtgtacaagccggcgtcggaggtcaatctcggcgccgacagcaacgagttctacatcagccccaacgtcaaagctccacgggttgctgggcttctggtgaagatattcgcatgggttcttgaggcgccgatcatcggctcaatcgtgctctacatcctcaagagagacaatcttgtcaacaagcttgtctcggatgccgaaatcccggagccaccactgttcactgcagctcacacctggcaagacatccctgagcagaatgtgagcctgacgaagccagacatgtcgccggcagagcgcgttcaggaggccgtcgtctgcctcccggctcgcctcgaatcggtgctcgctgacccgccatcgccggggttcaggcgctggacaatccgggacttcaccagtgcctacatctcaggagagatcactcctgtcatggttgcgaggagatttctcgctgcagtgaaggagtgttcaggccctgatctgaacatggccttgttcatcagctgcaatcctcaggacgtcatcagacaggccgaggcatccaccctcagataccagcaaggagctcctctctctgccatggatggcgtcctggtggccgtcaaagacgagatcgactgcctgccatacccaacaacaggaggaacgagatggctgcagaggatgcggccgtgcgtgcaggacgcggcggtggtggcgcagctgcgggcgtgcggcgcggtgctcgccggcaagaccaacatgcacgagctcggcgccggcaccagcggcatcaacccgcaccatggatcgacgaggaatccgtacaacaccggcaaggtggccggcggctcgtcgggcgggtccgccgccgtcgtctgcgccggcctctgccccgtcgcacttggagccgacggaggcggatctgttcgcatgccagccgcgctctgcggtgtggtgggcttgaagccgacggcagggcgtttctccaaggatgggcttcttcctcttaactggaccgtcgggatgccagggatcttagccgcgacagtggaggatgcgcttatcgcctatgcagctattgctgatcagtcccaaccaagccacttgcagcctgaactgaatcttcccctgctgaaagctgcaagctcgatgcctaccatcagactagcaagatatgcaaagtggttcaatgactgttctgaagacatcagaagttgctgctacaaagctgtccatacgctgcggactcgatacggttgggagactgctgatgtgacaattcctgaaattgaggagatgcggctcgcgcattacgtgacaatgggttcagaatgcaccgcctccttcgataagtatctgaagaagctgagcaagtctgagattggttgggatgtgaggatcgcgctgagcgcctacgggtcgttcagcagcagagcttacctgaactcgcaacgaatccggaaccgtcagatgtacttccacgacaagatctttgagacattcgacgtgatcgtcacaccaatgacaggagtgacagcgcacgaattgcaggacaacgcggggcacaccggagagctggactacataaacggagctgcgctggtgaggtactcgatcgccgggaacttcctggggttgccggcgatcaccgtgaaggttgggtacgacagggaagggctccccgtcgggctgcagttcatcgggaggccgtggtcggaggccacgctgctgcacctcgcctacgccatgcaggaggcgtgcggcaagaactacaggaagcccatggtgtactacgatctcctcaacaagaacaaatactagtttcagtttcaaaagaacaaatagtagctatatatgttgtgagagttgagtgacagtttgattctgagagatttggactggggagaaatttatcatcgatcattcttaccatcccaaatacagaatgtgatggacattattattgtaattgttgttatgtttgttgttgttgctgctgcttgacataagcatgcatgtaagtcatatgcatgtcgctgtatatgtttactattattgaatgtgcctactgatttactaaatatgatatttcatttcttttactcta

SEQ ID NO: 1718 - DNA, 923 bp, Setaria italica
cgcgcctctctgcttttagtttcctctgcaactcttcctctctgcagctgctcacagcatcctctccttcctagtcacaaacaagaacacgagcagggggagtttcttccatggcggtggccacggagactccgttccatgtcctggccgtggacgacagcctcccagacaggaagctcatcgagaggctcctcaagacctcttcattccacgtcaccactgtcgattccgggagcaaggctctcgagttcctggggatccatggcgaggacagcagcccggtttctgttcatgcggatcagctggaggtcgcggtgaatctgataatcacagactactgcatgccgggcatgacaggatatgatctgctcaagaagatcaaggaatcatcgtctctaagagatatcccagtggtgatcatgtcatccgagaacattccttcaaggatcaatagatgcctggaagaaggagccgatgagtttttcctaaaaccagtgaggctatcagacatgagcaagctgaagccccacatattgaaaagcagatgcaaggagcactaccaggaacagcaccagcaaagcgacagcaacagcaacgaatgcagtaaccccacagacgacagcagcagcagcagcagcgataacagcaacagccgcaagagagaggcagaagacaacgaagaaattttgccccagagaaacagatcaaggcacagttagctgcaaactgattataggagaattaacccccttttttctccctttattctttgttttacttagcttttggcaaactaatttgcaacacagatgttagcccttgatttgcaaaatataatggaatccgtaaacggatactgataagatcgaatcaagaaattttgcagcaaatttctggtatcagatgacagctaagatagcagc

SEQ ID NO: 1719 - DNA, 1392 bp, Setaria italica
aagcaaagccccataccaagcacacgcacctctctgctttttagtttcctctacaactcttcctctctgcagctgctcataccatcatccttcctagtcagacacaagaacacgagcagggggagtttcttccatggcggtggccacggagactccgttccacgtcctggccgtggacgacagcctcccagacaggaagctcatcgagaggctcctcaagacctcttcattccacgtcaccactgtcgattccgggagcaaggctctcgagttcctggggatccatggcgaggacagcagcccagtttctgttcatgcggatcagctggaggttgcggtgaatctgataatcacagactactgcatgcctggcatgacaggatatgatctgctcaagaagatcaaggaatcatcgtctctaagagatatccctgtggtgatcatgtcgtccgagaacattccttcaaggatcaatagatgcctggaagaaggagcggacgagtttttcctaaaaccagtgaggctatcagacatgagcaagctgaagccccacatactgaaaagcagatgcaaggagcactaccaggaacagcaccagcaaagcgacagcaacagcaacgaatgcagtaaccccacaaacgacagcagcagcagcgataacagcagcagccgcaagagaaaggcagaagacaacgaagttttgccccagacaaacagattaaggcacagttagttagctgcaaactgattataggaagaattagcccccttttttctccctttattctttgttttacttagcttttggcaagctaatttgtaacacagatgttagcccttgatttgcaaaatataatggaacccgtaaaccggatactgataagatcgaatcaagaaattttgcagcacatttctggtatcagatgacagctgagatagcagtttaacaggccagtggacagaacgtgtaccatactttctaaggaacatctgctgactctcggatagtcagatagcttacaacgaaattagtttcctacttacgaaaatagtttcttactgttttcaagcttagactttaaacgagtactcacataggacaatacagtagaggaataacttagctgcaagacgattttttaccaataccttacagcaaactcatcctacacaggcctagaactagaagggcaagataatctgccgacaagttatttttactaattgcttaggagaccatccatcgaaaggcaccagggcctcagaaaatacacctgtacgtcacatggttcccggtaagctcactgtcatacgtaactttgacaacggttcccttgccaaggccgtggtagcgagcaacagcatcagtttccagcatgcggggcagctgaa

SEQ ID NO: 1720 - DNA, 962 bp, Panicum virgatum
caaagcctctcatgccaagcacgcatacctccctgcttttagtctcctctgcaactcttcctctctgcagctgctcctaagtcaggaacaaagaacacgagcaggaggacacagaagggagttcagttcagctctcttgtttcctccatggcggtggccacagagaccccgttccatgtcctggccgtggatgacagcctcccggacaggaagctcatcgagaggctcctcaagacctcctccttccaagtcaccactgtcgattccggaagcaaggctctgaagttcctggggatccatggcgaggacagcagcccaccagtttccgtccacgaagatcagctggaggttgcggtgaatctgatcatcacagactactgcatgcctggcatgacgggatacgatctgctcaagaagatcaaggaatcaacatctctaagagacatcccagtggtgatcatgtcatccgagaacattccttcaaggatcaatagatgcctggaggaaggagcggatgagtttttcctaaagccagtgcggctatcagacatgagcaagctgaagccccacatactgaaaagcagatgcaaagagcagtgccaccaggaacagcagcagcaaagcgacagcaacagcaacgaatgcagtgtgcccacgagcagcagcagcgataatagcaacggccgtaagagaaaagcagaagataacgaagaagttttgccccagacaaacagatcaaggcacagttagctgcaaactgattataggagaattaaccctcttttctcctttgtttttttgttttacttagattttggcctactgatttgtaacacaggcgttaaccatcatttgcaaaatattatgacttcttcaatagaatcaagtaactctgcaacagttatcagaggacacctgtgctaacagcctaattaataggtcactggacacatattacgccg

SEQ ID NO: 1721 - DNA, 901 bp, Panicum virgatum
aaagcctctcatgccaagcacgcatacctccctgctttttttagtctcctctgcaactcttccgctctgcagctgctcgtagcatagcatcctcctcctcctcctcctagtcaggtgcaagaacacgagcaggagaacatctgctctcttgtttcttccatggcggtggccacagagaccccgttccatgtcctggccgtggatgacagcctcctggacaggaagctcatcgagaggctcctcaagacctcttccttccaagtcaccactgtcgattccgggagcaaggcgctggagttcctggggatccacggcgaggacagcagcccaccagtttcggatgcagaccagctggaggttgcggtgaatctgatcatcacagactactgcatgcctggaatgacgggatatgatctgctcaagaagatcaaggaatcaacatctcttagagatatcccagtggtgatcatgtcgtccgagaacattccttcaaggatcaatagatgcctggaggaaggagcagatgaatttttcctaaagccagtgcggctatcagacatgagcaagctgaagccccacatactgaaaagcagatgcaaggagcactaccaccaggaacagcaccagcaaagcgacagcgacagcaacagcaacgaatgcagtaaccccacgaacaacagcagcagcgataacagcaacagccgcaagagaaaggcagaagacgacgaagttttgccccagacaaacagatcaaggcacagttagctgattataggagaattaaccccccttttctccctttgttctttgttttacttagattttggcctactgatttgtaacacaggtgtcaacccttcatttgcaaaatattatagacttcttgaatagaatcaagtga

SEQ ID NO: 1722 - DNA, 805 bp, Saccharum officinarum
ctcatatcatagcatcctccttgcttccttcgccgtcctgctctctttcttgcctctgccatggcggtggtggccacggagacgccgttccatgtcctggccgtggacgacagcctcccggacaggaagctcatcgagaggctcctcaagacctcctccttccaagtaaccactgtcgactccgggagcaaggccctccagttcttggggatccatgacgacgacgccagcacggtatctgttcacgtgcaccagctggacgtcgcggtgaacctgatcatcacggactactgcatgcccggcatgacagggtatgatctgctcaagaagatcaaggaatcgtcgtctcttagagatatcccggtcgtgatcatgtcgtcagagaacatcccttcaaggatcaatagatgcctggaggaaggagcggacgagtttttcctaaaaccagtgcggctatcagatatgagcaagctcaagccccacatactaaaaagcagatgcagggagcactaccagcaggaacaacagcaccagcaaagtgacagcaacagcaacgattgcagtaaccccacgaacaagagcagcagcgatagcagccgaaagcgaaaggcagaggacaacggagaaattttgccccagaaaaacagaccaaggcacagttagctgcagactgataataggacaattaacccccatcttttcccttttttctccccttctctttgttctttcttttacttagcctttggcgtttggcctactgatttgtaacacagatgttcgcatctgatgtgcaaaatataaa

SEQ ID NO: 1723 - DNA, 967 bp, Sorghum bicolor
acacccacatccttcatcattcagaaagcatagcacagcaaaagcctctcatgccaacaaacccaagcacacacacctccagccttccttcttctacaactcttgcttcctgcagctctactctcttgtttcgatcggccatggcggcggcggcggcggcggcggtggccacagagactccgttccatgtcctggcggtggacgacagtctcccggacaggaagctcatcgagaggctcctcaagacctcttccttccaagtgaccactgtcgactcagggagcaaggcgctgcagttcctgggactccatgacgaccacagccctgttcctgtccacacagaccagctggatgtggcagtgaacctgatcatcacagactactgcatgcccggcatgacaggatatgacctgctcaagaagatcaaggagtcgtcgtctctcagagatatcccagtggtgatcatgtcctctgagaacattccttcaaggatcaataggtgcctggaggaaggagctgatgagtttttcctaaaaccagtacggctatcagacatgaacaagctcaagccccacatactgaaaagcagatgcagagagcacaatcaccaggaacagctccagcaaagtgacagcaacagcgaggaatgcagtaatcccacgagcagcagcagcagcagcggtagcagcagcaaccgcaagagaaagggagcagacaacgaagaaatcttgccccaggcaaacagatcaaggcatagttagctgcaaactgactagtaccgctaaccttttttctgttttccttggtcatttgccttatactcagttttgggcttttggcctactgatttataacatagatattagcactagatttgcaaaatataatggaatctgtaaaaggatactgcttgagtcaaatcaagtgattctgcaacaaatttccctgtttcatatcagaaaaccag

SEQ ID NO: 1724 - DNA, 2186 bp, Sorghum bicolor
gtcagcactatcacacagaaagctactcctttcaaaaaacacagaaagctactcctaccagaggacaaaaaaccaccccaagaactcaaaaactaacagagccatatgcccatatgatatggtagggtagcagcactagcagcagtatgaaaaggctgagggaagggaacaatagaaaatggtggtggtggatcctttctgtgcatgttgctctagaatactagcacaactgattacatactacacgcacagagacacacagagagagggtgtgtctgactgtctcatgatactctgtcgtggatggatggagtcaattcgtggcaagatttggagcaaatctgctccaggatcttgctttccatgcgcggggactttcttagtcatcacaccttcttttcccctcctcctccttcgctttactttccatgattccatcacatcacatctcctcgaatcctttcatgtgcttgtgtgtatatatatatgtattgtatctactcaaccacacccacatccttcatcattcagaaagcatagcacagcaaaagcctctcatgccaacaaacccaagcacacacacctccagccttccttcttctacaactcttgcttcctgcagctctactctcttgtttcgatcggccatggcggcggcggcggcggcggcggtggccacagagactccgttccatgtcctggcggtggacgacagtctcccggacaggaagctcatcgagaggctcctcaagacctcttccttccaagtgaccactgtcgactcagggagcaaggcgctgcagttcctgggactccatgacgaccacagccctgttcctgtccacacagaccagctggatgtggcagtgaacctgatcatcacagactactgcatgcccggcatgacaggatatgacctgctcaagaagatcaaggagtcgtcgtctctcagagatatcccagtggtgatcatgtcctctgagaacattccttcaaggatcaataggtgcctggaggaaggagctgatgagtttttcctaaaaccagtacggctatcagacatgaacaagctcaagccccacatactgaaaagcagatgcagagagcacaatcaccaggaacagctccagcaaagtgacagcaacagcgaggaatgcagtaatcccacgagcagcagcagcagcagcggtagcagcagcaaccgcaagagaaagggagcagacaacgaagaaatcttgccccaggcaaacagatcaaggcatagttagctgcaaactgactagtaccgctaaccttttttctgttttccttggtcatttgccttatactcagttttgggcttttggcctactgatttataacatagatattagcactagatttgcaaaatataatggaatctgtaaaaggatactgcttgagtcaaatcaagtgattctgcaacaaatttccctgtttcatatcagaaaaccagctgagataacaacttaacggagtcacagtaacagaccattggggacagcgtgtgccgaagccaagaaatctctgagtgattgtcagataactaacgatgagattagttttttttactgtttctatgctttattagtctggatacaagtactcactacagcagtcagtaacttggctgggatatgatttttaccaacagcaacagctaacagcaaacttcatccctacatagtattgtgcttacaccggcttacaagtgcatcatcatctgctgggaggtgattgttactaactgcttattagaaacttcatcacggaaacgaggtgggcccctcagaaaatacaccggtatgtcacatggttcccagtaagctcattgtcatatgtaactttaacaacggttccttggcggaagccttggtagtgagcaaccgcatcactctccagcatgagaggcaactgaaagatacaggcaccaatttcagtaaacttgcatgaaactactttgcaacaatttgcgctagctttaccaaaataaatttccaagggaaacaaaccaagctattaataagcaggaatttgcaatgcagggatgctagaaatccactagccaaaacaaatgaattgcagtatccccatgacaactaataaaacatattgtttgacatacgttttaaattctgatttgcatatcattatgtaaggagcctgcg

SEQ ID NO: 1725 - DNA, 754 bp, Saccharum officinarum
aacacagcaaagcaaaagcctctgccctctgatgccaagcccaagcacacacacctccagcgtttcttcttctacaactcttgcttcctgcagctctgctctcttgtttcgatcagccatggcagcggcggtggccacagagactccgttccatgtcctggcggtggacgacagcctcccagacaggaagctcatcgagaggctcctcaagacctcttccttccaagtgaccactgtcgactcagggagcaaggcgctgcagttcctggggctccatgacgaccacagccctgttcctgtccacacagaccagctggatgtggcggtgaacctgatcatcacagactactgcatgcccggcatgacaggatatgacctgctcaagaagatcaaggagtcgtcgtctctcagagatatcccagtggtgatcatgtcctctgagaacattccttcaaggatcaataggtgcctggaggaaggagctgatgagttcttcctgaaaccagtacggctatcagacatgaacaagctcaagccccacatactgaaaagcagatgcagagagcactatcaccaggaacagcaccatcaaagtgacagtaacagtgacgaatgcagtaaccccactagcaacagcagcagcagcgatagcagcagcagccgcaagagaaagggagcagacaacgaaaaatcttgcccaggcaaacagatcaaggcatagttagctgcaaactgctagacagctaaccttttt

SEQ ID NO: 1726 - DNA, 1057 bp, Sorghum bicolor
tgtggtgtgtgtgtgtgtgtgtatatatatacaatacgtgaactcaaccacacccacacacccttcaccttcaaaaagcaagcaaaggaagctctttcatgccaagaacacatacctcctgcttttttcagtttccttcctctactgcaaaccttcctacactctgcctctgctgctagctcatagcatcctccttccttggccgtcctgctgctggctcctcttgcttgcctctgccagccatggcggtggtggccaccgagacgccgttccatgtcctggccgtggacgacagcctcccggacaggaagctcatcgagaggctcctcaagacctcttccttccaagtaaccactgtcgattccgggagcaaagccctgcagttcttggggatccacgacgacgacgccagcacggtctctgttcacgcgcaccagctggatgtggcggtgaacctgatcatcacggactactgcatgcccggcatgacagggtatgatctgctaaagaagatcaaggaatcgtcgtctcttagagatatcccggtcgtgatcatgtcgtctgagaacatcccttcaaggatcaatagatgcctggaggaaggagcggacgagtttttcctaaaaccagtgcggctatcagacatgagcaagctcaagccccacatactgaaaagcagatgcagggagcactcccagcaggaccaggaacaacagcaccagcagagtgacagcaacagcaacgattgcagtaaccccacgaacaagagcagcagcgatagcagccgaaagcgaaaggcagaggacaacgaggaaattttgccccagaaaaacagaccaaggcacagttagctgcagactgattataggacaattaaccccctctttttttccccctttctctttgttctttcttttacttagcctttggcctactgatttgtaacacagatgtttgccactgatttgcaaaatataaaggaatccataactggatactgcttgattcaaatcaagtgattttgcaacacatttcaggacagctatgataacagcct

SEQ ID NO: 1727 - DNA, 1455 bp, Sorghum bicolor
aggaaaaagggcgagggaacaggaacacgagcaaatggtggtgctgctctggtggaccctgcgaaaggctctccggctgctcctccagaattcaggattccaaggggtccgcctcatgatgctgctgctgcctgccccggcctccctcttctattctatgtactgactctatcgtggatggatgtggaagggaaggagtcaattcctggcaagatttggagcaaatccgccggggatcttgcttttttccatgcgctgggattttcttggtcatcacacgcacctctctcccctttttccccgggccgctctctattccttcgatcgctttccctcatatctcctggaatcctttcatgtgctgcttgccttgtgtgtagtgtagtctagtgtagtatgtggtgtgtgtgtgtgtgtgtatatatatacaatacgtgaactcaaccacacccacacacccttcaccttcaaaaagcaagcaaaggaagctctttcatgccaagaacacatacctcctgcttttttcagtttccttcctctactgcaaaccttcctacactctgcctctgctgctagctcatagcatcctccttccttggccgtcctgctgctggctcctcttgcttgcctctgccagccatggcggtggtggccaccgagacgccgttccatgtcctggccgtggacgacagcctcccggacaggaagctcatcgagaggctcctcaagacctcttccttccaagtaaccactgtcgattccgggagcaaagccctgcagttcttggggatccacgacgacgacgccagcacggtctctgttcacgcgcaccagctggatgtggcggtgaacctgatcatcacggactactgcatgcccggcatgacagggtatgatctgctaaagaagatcaaggaatcgtcgtctcttagagatatcccggtcgtgatcatgtcgtctgagaacatcccttcaaggatcaatagatgcctggaggaaggagcggacgagtttttcctaaaaccagtgcggctatcagacatgagcaagctcaagccccacatactgaaaagcagatgcagggagcactcccagcaggaccaggaacaacagcaccagcagagtgacagcaacagcaacgattgcagtaaccccacgaacaagagccacagcgatagcagccgaaagcgaaaggcagaggacaacgaggaaattttgccccagaaaaacagaccaaggcacagttagctgcagactgattataggacaattaaccccctctttttttccccctttctctttgttctttcttttacgtagcctttggcctactgatttgtaacacagatgtttgccactgatttgcaaaatataaaggaatccataactggatactgcttgattcaaatcaagtgattttgcaacacatttcaggacagctatgataacagccta

SEQ ID NO: 1728 - DNA, 1496 bp, Setaria italica
ttcgcgtctcttccctgtcactgacttgtgtgtgttgcgggggctcgcagcacgcctcggcctgccttgttgtcggagcggccgctgctccacccctgctcaaatcgacgcccaggcgaagcgaatggctcccctcttcgccgccgcgtcccacgcgtccctcatccccctcttctccccggaccccgccgccgcccgcctggtccgtggcaccctcaggtcccgcacctcgggcctccgcctccgcggtgccccgagggccgccgggcgtggacgcggccgcggccgcgggagcgggggcatccccgacgagtggggtgagcgctctccgccgggcgcccccgagccccccgcgcagcccgacctgcccgtcgacgaggacgagtggggcggcgacaccgccgagggcaactcgcgccccatcgtcgtcgacgagtggggcgagcccgcggagcccgagcccgagcccgagcccgagccgccctccgccgcggacccgcccagcccttccgccgacaacgagtgggggaaggatccctcggcgccggcgccggcgccggcggcggaggaggtggatgagcaggcggagaggagggaggacctcaagcggtgcctggtggacacggtgtacggctccgagctcgggttccgggcgtccacggaggtcagaggggaggtcgtcgagctagtcacccagctcgaggcggtcaaccccacgcccgcacccgtcgaggcgccggatctcctcgacggcaactggatcctcatatatacagcatattctgaactcctgcctattctagctgctggggcaactccttttgtgaaagtaaagcagatatcccaagaaattgactcaaaaagcatgacgatagtcaatgcttcaacccttacgactccattcgcgtcattttcattcagtgcaactgcctcttttgaggttcaaagtccatcaaggatagaggtccaatttaaggaggggagctttcagcctccagcgatatcatcaacagtggatctacctgaacaggtcgatatattcgggcagaagatcagcctggggccagtccagcaggtgctgaaccctttgcagcaaacgtttgctagcattgcaggctccatttctggacagccacccctcaaggtacagattcctggcaacaatagaggccggtcgtggctcctgacaacctacctggacaaagacttcaggatctcaagaggtgatggaggcttgttcattctcgctaaagaggggagccctttcctagatcaattgtaaatctgtaataggtcacggtgggaaaggaaaggcatcattattcagaactgcacagaacttaatagaagacactgtttcattctttacctctgcttatcaaacaagcttgagatatgcattgctatgagatctcactctcagtaaccagtattgaatcagctaccttgtgttactcaagagtcagactaagattgaaaaaaccaagaatactttg

SEQ ID NO: 1729 - DNA, 978 bp, Zea mays
ttttttttgtcgagcaccaggtgacattcgataaagacaaaaagtattcaacaaagaaacagttgcgatgtacaatttaccgagttttcttttatcaagtcacacactcacactcgataaaaaaattaccgtaccgagtacgctggtgcccgacccgatgtttgaacacccactaacctctgtatgatggtgccggtgtcggtgtaaccgcagtccattttggaccatctagagcgacctctgtatgctagtgcgggctacagaaaaatgatggatatgcatgcactcagctccacgactcgatcgatctactggcagtgactcgcgtaacacgtgttttttcaaataaaaaaagatagatgccagtcccggtgcacatggcatgtgtcccggcccgatcgatcaggacacacccggcctatatattgagtacctagttacgtgtgcttctcagcagtgaccaactcgaagcttgcgttcttgtagtagaggtcggcagcaagcggtagagcgagaggtcgagaagatgaagagcagcactctgttggcgatcctagttctccaggcccttctggtctctgcggccgtggccaaaggacctgcagggccgacgacgaagaagcagtgctggtgcggcgagtgcaccagctggtcgggcgtgtggacctgcgacgacctcctcaccaagtgcgccgccacctgcaagaactgcgtccccgtgtccacggacaagggcgccaccaagtacaggtgccgcgacttcctccccgaaaactgcggctgcaagatccactagactcatccacagcggcacagccgatggatccttccatgctcctccgtccgtccgccttgctacaagcaggcagccaccaataagctagctcttgctgttgttttgcatgtttgattgggtgtcccttcccagtcgagatggaataaaataaatgtcaggcgcacgtacagacgtgttattac

SEQ ID NO: 1730 - DNA, 937 bp, Zea mays
taggatgcattattattgaggcctctgcatgatgccctgatggtgccggtgtcagcgtaacagcaggccatctttgaccagctagacctaggacgaccaaatatagtgcgcgtgctacagggacgaaatgatggatatgcattcagctccacgactcgccgcgcatctactagcagtaagactcgcgtaacacgtgtgtttgcaaaaagaaattttaaaaaaaagatagatgggcccgcactgcaatgagtctatgcgcacatggcatgtccccgatcgatcgaccgaccaggagaggacacccccgccccggcctatatagagagtaccgagttcgtctagtgaagcagcacatgtgcatctcagcagcactagcagtgacaaactcgaagcttgccttcttgtttacaccctaaaactaaaactagagtcgtcggcggcaacaagcggtacgtacgtagaggatgaagagcaggagcagcactctgttggtgatcctagttctccaggcccttctgctctctgcggctgtggccaaaggacctgcagggccgaagaagcagtgctggtgcggcgagtgcaccagctggtcgggcgtgtggacctgcgacgacctcctcaccaagtgcgccgccacctgcaagaactgcgtccccgtgtccacgggcaagggcgccaccaagtacaggtgccgcgacttcctccccgaaaactgcgggtgcaagatccactaaactcatccaattccaccatggccacagcagccgatggatccttcttccatatgcatgttctcctccgtccgtccgcctagctttgctacaagcaggcgctaataagcaagctgttgttgttgttttgcatgtttgattaggtgaccctttccactcgagatggaataaaataaaagtcaggcgcacgtactgacgtgttatta

SEQ ID NO: 1731 - DNA, 479 bp, Zea mays
gcccttctggtctctgcggccgtggccaaaggacctgcagggccgacgacgaagaagcagtgctggtgcggcgagtgcaccagctggtcgggcgtgtggacctgcgacgacctcctcaccaagtgcgccgccacctgcaagaactgcgtccccgtgtccacggacaagggcaccaccaagtacaggtgccgcgacttcctccccgaaaactgcggctgcaagatccactagactcatccacagcggcacagccgatggatccttccatgctcctccgtccgtccgccttgctacaagcaggcagccaccaataagctagctcttgctgttgttttgcatgtttgattgggtgtcccttcccagtcgagatggaataaaataaatgtcaggcgcacgtacagatgtgttattacgatatttctcccctacaaataaaaactcgatttgtggggttaacactgtcccctagtattacaatt

SEQ ID NO: 1732 - DNA, 718 bp, Saccharum officinarum
agcacatgtgcctctcagcagtgacaaactcgaagcctcctttcttgttaccactccaagctaagtagcgtcggcaacaagagggtagaggtcgagaagatgaagagcagcacgctcttggcgatcctggttctccaggcccttctggtctctgcagctgtggccaaaggacaaggaccgaagaagccgtgctgcaacgagtgcaccagctggtcgggggtctacacctgcgacgacctcctgaccaagtgcgccgccacctgcaagacctgcgtccccgtgtccacggacaagggcacccgctacaggtgccgcgacttcctccccgaaggctgcccctgcaagaccaactgatccatccaccatggtccatggcccgcgcgcgcgcgccacacacagccgatggatcgatccatgcaccaccgtccgccttgctataaggcgccaataattaagtctgctgttgttttgcatgtttgggtgtcccttctccatcgagatggaaataaagtcaggcgcactgacgtgttagcatatttctctctatatataaactagtatatttgtctgtgttacacaccacacaacgcaccaacatcaaacacgtacacagagacccgctccgttcgagacataataataattctggcggccggccaaaaggaacaaagctaaccgtccctggagtgggacatcctacccctcctcataggcccac

SEQ ID NO: 1733 - DNA, 515 bp, Saccharum officinarum
cagcagtgacaaactcgaagcctcctttcttgttaccactccaagctaagtagcgtcggcaacaagagagtagaggtcgagaagatgaagagcagcacgctcttggcgatcctggttctccaggcccttctggtctctgcagctgtggccaaaggacaaggaccgaagaagccgtgctgcaacgagtgcaccagctggtcgggggtctacacctgcgacgacctcctgaccaagtgcgccgccacctgcaagacatgcgtccccgtgtccacggacaagggcacccgctacaggtgccgcgacttcctccccgaaggctgcccctgcaagaccaactgatccatccaccatggcccggcgcgccagcgcgcgccactgccgatggatcgatccatgctctgtccgccttactataaggcgccaataagtaataagttgttggtttgcatgtttgggtgtcccttctcaatcgagatggaataaaataaagtcaggcgcactgacgcgttagcata

SEQ ID NO: 1734 - DNA, 1428 bp, Sorghum bicolor
tggcagatcccgcctcccccattggccaggccacggcaccaccccgtgtggcccccacccgctaaactgccaggaaccttcctctccttcctcgcgaagcaaagactttcgagagataggagagtcggctataaaaccgcacagctgcgcccaccgcggcaaaatatctcgccgtccgtcccgatggacatcgacctcttcgccgacatcgacctcgacgccctcctcgcctccttctccggcgaacccgccgccgtctccgacctcatcgtcccgtccccgcctccgccggccccggcggcgcacgatgcggcggaagcggggtcgccggagtcggtgacctcccgggcgaacccggccggggaggtgggtctctcggagatcgagaggttcctgatgcaggaaggggaggcggaggcggagttgggcggggaggtcgaggggatcagcgtggaccagttcttcgacgcgctgtacgacggcggggaggggaaagatgaaggggaggcagaggcgggggcaagcacggatgcggactccggcagggacgaggtggtggaagtcgtgacgccggaggcggagacggtggaggtggatggcgatgatcccgtcagcaagaagaagaagaggcaaatgaggaacagagattcggcaatgaaatccagggagaggaagaagtcgtacataaaggacttggagacgaagagcaagtatttggaggcagagtgccgccgcctcagctacgcacttcagtgctacgcagctgagaacatggtactgcgccagagcttgatgaaggataggcctgttggtgctcccacagccatgcaggagtctgccgtactcacggaaaccctgccgctggtttccctgctgtggctggtgagcatcgtctgcctcttcctgatgcccgttctgcccaaccgaagcccagctgctccaagcagcggcggaagagatctcgtgatggcagccggaaagacaagcagtgaaaccccagagatactggaactcatcctccatggaaggcgttgcaagagcacgagggcgaggattaagctatataatttaccatttcatccagtaattgcttgctagttgctaggctttcagcctcttgcaagcttacctgtagtagtgtacttgcaattgcaaatcgtagcgtgcccgctatgtgcctgtcatgcagagaagcctgtcgatatccatggagtgggtagtaccttttttctctgttcattttttgtttgtttaatagatcctgtgctatccagtaatagtttaaaacctggattttgtgttatttttctatttcgccaccttgttgctggttgctcctgatatgaagttcctttgctcgaaaatctttggaagtacaatatatggtatgatctgtttatactaaataaaattgagacatgagtagat

SEQ ID NO: 1735 - DNA, 1964 bp, Sorghum bicolor
gacgtggcagatcccgcctcccccattggccaggccacggcaccaccccgtgtggcccccacccgctaaactgccaggaaccttcctctccttcctcgcgaagcaaagactttcgagagataggagagtcggctataaaaccgcacagctgcgcccaccgcggcaaaatatctcgccgtccgtcccgatggacatcgacctcttcgccgacatcgacctcgacgccctcctcgcctccttctccggcgaacccgccgccgtctccgacctcatcgtcccgtccccgcctccgccggccccggcggcgcacgatgcggcggaagcggggtcgccggagtcggtgacctcccgggcgaacccggccggggaggtgggtctctcggagatcgagaggttcctgatgcaggaaggggaggcggaggcggagttgggcggggaggtcgaggggatcagcgtggaccagttcttcgacgcgctgtacgacggcggggaggggaaagatgaaggggaggcagaggcgggggcaagcacggatgcggactccggcagggacgaggtggtggaagtcgtgacgccggaggcggagacggtggaggtggatggcgatgatcccgtcagcaagaagaagaagaggcaaatgaggaacagagattcggcaatgaaatccagggagaggaagaagtcgtacataaaggacttggagacgaagagcaagtatttggaggcagagtgccgccgcctcagctacgcacttcagtgctacgcagctgagaacatggtactgcgccagagcttgatgaaggataggcctgttggtgctcccacagccatgcaggagtctgccgtactcacggaaaccctgccgctggtttccctgctgtggctggtgagcatcgtctgcctcttcctgatgcccgttctgcccaaccgaagcccagctgctccaagcagcggcggaagagatctcgtgatggcagccggaaagacaagcagtgaaaccccagagatactggaactcatcctccatggaaggcgttgcaagagcacgagggcgaggattaagctatataatttaccatttcatccagtaattgcttgctagttgctaggctttcagcctcttgcaagcttacctgtagtagtgtacttgcaattgcaaatcgtagcgtgcccgctatgtgcctgtcatgcagagaagcctgtcgatatccatggagtgggtagtaccttttttctctgttcattttttgtttgtttaatagatcctgtgctatccagtaatagtttaaaacctggattttgtgttatttttctatttcgccaccttgttgctggttgctcctgatatgaagttcctttgctcgaaaatctttggaagtacaatatatggtatgatctgtttatactaaataaaattgagacatgagtagatcgttgatattcatagtttattttgacagtaagggtcaaatttatatgtgaattcttccgggctttggttcatgaatgtcggccaccagtaacgccacggcgccacaagagcttcaaaaaatgacattggtggaggcagatgaacttattttttgaatgatttgacatatcagtataaacagttaaatgtatgttagtagataaagagatgactagagcagcggggtagtggggaagatgaacctatatgcaaaactcctaccccaaacaagcctttgttttgagatccattgacgaactcagatcatatccttctggacaacgttattcattcatcagttatcgataactacttcttttttaatgcatcgtataaataccttttttcgatctttcagcagttccagtgagcgaagaaaggagtaattgccccgctacagtcgcttattcattaggaaagtgctttgggccctgtctgaaatacatgtgctagttgactataattgcaagttttagtggattgttgatgtgga

SEQ ID NO: 1736 - DNA, 1430 bp, Setaria italica
gacctggcacattccgcttctcccattggccaggccacggcaccaccccgtgtaggccccaccccgttaaagtgcaaggaaccttcctctccttcctcgcgaagcaaaacttctgaacgctggagtccgctataaagtcgcacagcggcgacgaccaccacaaaatatctcgcaatccccatggacatcgacctgttcgccgacatcgaccttgacgccctcctcgcctccttctccggcgagcccgccggcgtctccggcctcatcgacccgtccccgcctccgccggcgccgacggcggcgcacgatgcggaggcggggtcgccggagtcggtgacctccagggcgagcccgcccggggaggaggcgctgacggagatcgagaggttgctgatgcaggagggggaggcggagttgggcggggaggccgaggggatcagcgtggaggagttcttcgacgcgctgtacgacggtggagagggggagcgggaggggaaggagagcgaggcgggtggaagcacggatggggactccgggagggatgaggtggtggaggttgtgacgccggaggcggagacggtggaggtggatggcgatgatcccgtcagcaagaagaagaggaggcaaatgaggaacagagattccgccatgaaatcaagggagaggaagaagacgtatgtgaaggacttggaggcgaagagcaagtatttggaagcagagtgccgccgcctcagctatgcacttcagtgctatgcagctgagaacatggtactgcgccagagcttgttgaaggataggcctgttggtgctcccacagccatgcaggagtctgccgtactcacggaaaccctgccgctggtttccctgctttggctggtgagcatcgtgtgcctgttcctgatgcccggtctgcccaaccgaagtccggctgctccaagcagcgccggaagagatctcgggatggtaaccggaaagacaagcagtgaaaacccagatatactggaactcatcctccatggaaggcgctgcaagggcacaagggcgaaaatcaagctagataaattaccatttcatgcagtagctgcttgctagcctttccataggcctcctgcaagcctccagtatgtagtgtaattgccaagcttagcatgcctgctttatatatgtcatgcagcagccagttgatatccctggattatcttttcttttgtgtttggtttttttgttcttttttctttaaatataattgcccctgtaggaccagattccagagtagttttaaaatttggacttgttataaatcctatcgtggcatcttgttgttcctggatctgaagttcctgtaatcgtgaatcttttgaagtgctagtacagtatgatatgataataaagttaacaagaccagagatgctcgtggtggttcatgattt

SEQ ID NO: 1737 - DNA, 1277 bp, Setaria italica
ggagtccgctatatagtcgcacagcggcgacgaccaccacaaaatatctcgcaatccccatggacatcgatctgttcgccgacatcgaccttgacgccctcctcgcctccttctccggcgagcccgccggcgtctccggcctcatcgacccgtccccgcctccgccggcgccgacggcggcgcacgatgcggaggcggggtcgccggagtcggtgacctccagggcgagcccgcccggggaggaggcgctgacggagatcgagaggttgctgatgcaggagggggaggcggagttgggcggggaggccgaggggatcagcgtggaggagttcttcgacgcgctgtacgacggtggagagggggagcgggaggggaaggagagcgaggcgggtggaagcacggatggggactccgggagggatgaggtggtggaggttgtgacgccggaggcggagacggtggaggtggatggcgatgatcccgtcagcaagaagaagaggaggcaaatgaggaacagagattccgccatgaaatcaagggagaggaagaagacgtatgtgaaggacttggaggcgaagagcaagtatttggaagcagagtgccgccgcctcagctatgcacttcagtgctatgcagctgagaacatggtactgcgccagagcttgttgaaggataggcctgttggtgctcccacagccatgcaggagtctgccgtactcacggaaaccctgccgctggtttccctgctttggctggtgagcatcgtgtgcctgttcctgatgcccggtctgcccaaccgaagtccggctgctccaagcagcgccggaagagatctcgggatggtaaccggaaagacaagcagtgaaaacccagatatactggaactcatcctccatggaaggcgctgcaagggcacaagggcgaaaatcaagctagataaattaccatttcatgcagtagctgcttgctagcctttccataggcctcctgcaagcctccagtatgtagtgtaattgccaagcttagcatgcctgctttatatatgtcatgcagcagccagttgatatccctggattatcttttcttttgtgtttggtttttttgttcttttttctttaaatataattgcccctgtaggaccagattccagagtagttttaaaatttggacttgttataaatcctatcgtggcatcttgttgttcctggatctgaagttcctgtaatcgtgaatcttttgaagtgctagtacagtatgatatgataataaagttaaca

SEQ ID NO: 1738 - DNA, 1184 bp, Panicum virgatum
acgtcgacctcttcgccgacatcgacctcgacgccctcctcgcctccttctccggggagcccaccggcgtctccgacctcatcgtaccgtccccgcctccgccggcgccggcgccggcgcgcgatgcggaggcggggtcgccggagtcggttacctcccgggcgagcccacccggggaggaggcgctgacggagatcgagaggttcctgatgcaggagggggaggctgagctgggcggggaggccgagggcatcagcatggaggagttctttgacgcgctgtacgacggcggggagggggagcgggaggggaaggagagcgaggcgggtggaagcacggatgaggattccggaagggatgaggtggtggaggttgtaacgccggaggttgagacggtggaggtggacgacgatgatcctgtcagcaagaagaagaagatgaggaaaatgaggaacagagattccgccatgaaatcgagggagaggaagaagacgtatataaaggacttggagacgaagagcaagtatttggaggcagagtgccgccgcctcagctatgcacttcagtgctatgcagctgagaacatggcactgcgccagagcttgttgaaggataggcttgttggtgctcccacagccatgcaggagtctgccgtactcacggaaaccctgccgttggtttccctgctttggctagtgagcatcgtgtgcctgttcctgatgcccggtctgcccaaccgaagtccagcagctccaagcagcgccggaagagatctcgggatggtagccggaaagacaagcagtgaaaacccagagatattggaactcatcctccatggaaggcgctgcaagggcacaagggcaaaaatcaagctagatacagtaccatttcatgaagtagctgcttgctagcctttccataggcctcttttgcaagcatccagtatgtagtgtagtacttgccaagctcagcatgcctgttatatatgtgtcatgcagttgatatccatggaatatcttttcttttctatttggatttttcttttgttctttttggtttcaatagctactgtcttatccagattccgaatgggcttttgtgttcgtatattggcagctactgtcttatccagattccgaatgggcttttgtgttcgtatattggcatcttgttgttcctggacc

SEQ ID NO: 1739 - DNA, 741 bp, Sorghum bicolor
gaaaaaccccgtccccctcggctgccgaaacagcctgcctctgaccgccgcccgagcccgacgcgacgccagctgcccaggtcttcgccgtcgccggcgacgagcacccacccatcacgcgctccaccagtggagaagacgaggggatttcaagatgccgagggccaccagcgatgcgaagcttctgatccagtcccttggcaaggcgtatgccgccacaccaacaaatctcaagattattgacctctacgtggtttttgccgttgccactgcccttattcaggttgcttacatgggattggttgggtcgtttcccttcaactccttcctctcaggagtcctttcatgcataggaactgcagttcttgctgtttgcctccgcattcaagtgaacaaagacaacaaagaatttaaggatcttcccccagaaagggcctttgctgacttcgtcctgtgcaatctggtgctccacctggtgatcatgaacttcctcggataagcaactgctgcaccatgtggttaagattttgtagccccagattgtggacgctgatcgttgcgtttaaatgtttggaactatcataatattgaatatccataggatctgttgaatattacatatgtaacctgagtattcctggatgaactattagtcaaatggacaatttgtttggcttttgttggtccagtgctgagaatttgatttaacacaggcattttcttatttgaagatatacttca

SEQ ID NO: 1740 - DNA, 871 bp, Sorghum bicolor
aaaaattacgtggagaaggaacgacggcccagcccaggaaacacgacacggtccagagaaatcaagagaaaaaccccgtccccctcggctgccgaaacagcctgcctctgaccgccgcccgagcccgacgcgacgccagctgcccaggtcttcgccgtcgccggcgacgagcacccacccatcacgcgctccaccagtggagaagacgaggggatttcaagatgccgagggccaccagcgatgcgaagcttctgatccagtcccttggcaaggcgtatgccgccacaccaacaaatctcaagattattgacctctacgtggtttttgccgttgccactgcccttattcaggttgcttacatgggattggttgggtcgtttcccttcaactccttcctctcaggagtcctttcatgcataggaactgcagttcttgctgtttgcctccgcattcaagtgaacaaagacaacaaagaatttaaggatcttcccccagaaagggcctttgctgacttcgtcctgtgcaatctggtgctccacctggtgatcatgaacttcctcggataagcaactgctgcaccatgtggttaagattttgtagccccagattgtggacgctgatcgttgcgtttaaatgtttggaactatcataatattgaatatccataggatctgttgaatattacatatgtaacctgagtattcctggatgaactattagtcaaatggacaatttgtttggcttttgttggtccagtgctgagaatttgatttaacacaggcattttcttatttgaagatatacttcattttcactgaggttcatattctacaaataagcaattgcttgaaattggcgaggtacacacgtt

SEQ ID NO: 1741 - DNA, 656 bp, Saccharum officinarum
aaagagaaaaaccccgtccccctcggccgaaacagcctctgaccgccgcccgagcgcgacgccagctgcccaggtcttcgccggcgacgagcacccacccatcacgcacgcactccaccagtggagaagacgaggggattccaagatgccgagggccaccagcgacgcgaagctcctgatccagtcccttggcaaggcgtatgctgccacaccaacaaatctcaagattattgacctctacgtggtttttgcggttgccactgcccttattcaggttgcttacatgggattggttgggtcgtttcccttcaactccttcctctcaggagtcctttcatgcataggaactgcagttcttgctgtttgcctccgcattcaagtgaacaaagacaacaaagaatttaaggatcttcccccagaaagggcctttgctgacttcgtcctgtgcaacctggtgctccacctggtgatcatgaacttcctcggataagcaactgccgcaccatgtggttaagattttgtagccccagattgtggacactgatgtttgcgtttaaatgtttggaactctgataatgtcgaatatccgtatgatctgttgaaggattacatatgtaagctgagtattcctggaggaactatagtcaaatcgacag

SEQ ID NO: 1742 - DNA, 1060 bp, Oryza sativa
gacggtgtccctgcagctgcaggttcaggtgaggcaaaccgtggaacgacttggagaggccgatcctgacggcccaggacggctggaccagggcccagcgtgaccggcccagcccatctcccctctttgactcctcttctccttctccactccatctttctctcttcggtatcctccacacctcgtcgccgatctcccaccccgcgcggcgccggcgcccgtccgtcctctcctctcctgcctccgccgcatcctcgcctcgcctcgccgaacacacaagattttgaggatgccgagggccacgagcgatgcgaagcttctaattcagtccctgggcaaggcttatgctgccacaccaacaaatctcaagatcattgacctctatgtggtctttgcagtcgccactgcccttattcaggttgtttacatgggaatagtggggtcatttcctttcaactctttcctttctggcgtcctctcatgcataggaactgcagtcctcgctgtttgccttcgtattcaagttaacaaagataacaaggaattcaaggatcttcctcctgaaagggcgtttgcagatttcgttctgtgcaatctggtgctccacttggtgatcatgaacttccttggttgatgtcctgcccctacaactgatcaaggttttgtagccccagtttatggtcactggtcagaacaccctgatgtttgggagtgtcatagtatgagatattcatatgatctttcacacttcaccgatgtaattcgacaatttttcgagaaactataagttctctacctgccgttcgctgcggcttatctttatatctgtgtatttagtgtttaacaatcttagaacatgtgatcctgttttcttcaagtgaccgaaggttggcaacatgctattcgaccatgctgttaactgttgtttgtcctttgttccaacgttgcctacgcatggattttacaggattttaaaatccctccattccaaaggaagaaatttgattgcactactgcaattcaaaacatttcttgcacttgcgcaatcccagtgacccac

SEQ ID NO: 1743 - DNA, 854 bp, Oryza sativa
ccactccatctttctctcttcggtatcctccacacctcgtcgccgatctcccaccccgcgcggcgccggcgcccgtccgtcctctcctctcctgcctccgccgcatcctcgcctcgcctcgccgaacacacaagattttgaggatgccgagggccacgagcgatgcgaagcttctaattcagtccctgggcaaggcttatgctgccacaccaacaaatctcaagatcattgacctctatgtggtctttgcagtcgccactgcccttattcaggttgtttacatgggaatagtggggtcatttcctttcaactctttcctttctggcgtcctctcatgcataggaactgcagtcctcgctgtttgccttcgtattcaagttaacaaagataacaaggaattcaaggatcttcctcctgaaagggcgtttgcagatttcgttctgtgcaatctggtgctccacttggtgatcatgaacttccttggttgatgtcctgcccctacaactgatcaaggttttgtagccccagtttatggtcactggtcagaacaccctgatgtttgggagtgtcatagtatgagatattcatatgatctttcacacttcaccgatgtaattcgacaatttttcgagaaactataagttctctacctgccgttcgctgcggcttatctttatatctgtgtatttagtgtttaacaatcttagaacatgtgatcctgttttcttcaagtgaccgaaggttggcaacatgctattcgaccatgctgttaactgttgtttgtcctttgttccaacgttgcctacgcatggattttacaggattttaaaatccctccattccaaaggaagaaa

SEQ ID NO: 1744 - DNA, 1100 bp, Setaria italica
tcggtcgcctcctcctactcgccgtcgtcgtctctcctcttcccttcccggcggtcgcgcggcaccggggcacgcgacgccacctatcttcttccctgtctcctcgcttcgagcagcagactacgcttcttcaagatgccgagggccacgagcgacgcaaagcttctgatccagtccctcagcaacgcgtatgctgccacaccaacaaatcttaagattatcgacctgtacgtgatttgtgctgttgctactgcccttattcaggttgcttacatgggattagttgggtcattccccttcaactccttcctctcaggtgtcctttcatgcataggaactgcagtacttgctgtttgcctccgtattcaagtgaacaaagacaacaaggaatttaaggaccttcccccggagagggcctttgctgactttgttctgtgcaatttggtgctccacctggtgatcatgaacttccttggataagcaactgctgtaccaagtggttaagattttgtagccccagattatggtcgctgatcagtgcggtttaatgtttggaactgtcataatgtttgagtatccatatgatctctcacagattacctttgtaagcccaggattcttcaatgaactgttagttgaatggacagtatgtttcactttggtagtttggttgatccagtcttgacaaagtaataccgagcatttgcgtaattcaaggaagtgaaatggctatgttacatcattttggtcgaagcattccacagatgttattcgccatgcaacggaaatttagttgtttattgataggagatacacaagtgcatatatgatacacgcataaaaacattgctgttccaagattatgcattttggcatggatgttgcaaacgacaacacacgataacaagttgatagtgattttttttttgtttgaacaataatttgccagtttggactagtgatccatttttctcgccagctgatgggtcgcgtccggcgacacggcggcccagaactcgccgtcgttctccagcgccgtcatgtgctccggcgccagcgccacctcgacatcgccactgccaccggcctcccgccctggg

SEQ ID NO: 1745 - DNA, 1548 bp, Pennisetum glaucum
ggggggcaagaaaccgcggagcgtcctcctcctcccgtctataaattccactcctttgctccctccatatatagggggcatcgacgccaggaagagggggaggagcaccaaggacttccgccgattgttcaggatccacatctttcccgagcgagttcttggttgatctcttcctcttccaccacctcccaaggctcttggtgtagcttgccactcccacaagtcaagttttcatgtctgatctcgacgttcagatcccaactgccttcgatccctttgctgaagccaatgctggggactctggtgcggcagcaggatcaaaggactacgttcatgtacgcatccagcagcgtaatggtcgcaagagtctgactactgtccagggattgaagaaggaattcagctacagcaagatcctaaaagatctcaagaaagagttttgctgcaatggtacagtggtccaggacccagagcttggacaggtcattcaactccagggtgatcagaggaagaacgtctcaaatttccttgtccaggctggcattgtgaagaaggaacatatcaagattcatggtttctgagcaactgccaggtccgtagcaagccctgtatgccaagcagcagctatatatccgtggtggagtatatcttacggctgtgtaagagcaggcctacacctgcgcgttctaccatacacataaaacctagccacctctctgcgtgtatgcttgttaccgtggcctcaactcctgtacgaggctccatcgccaccgttcgatggcttccctctctatcagaacaagtttgaataaacgctgttttacaattgccgtgtgtcaactgtcaagtgcttttgctttaacatgtatatagccatttcactttgaataacacaaaatgttcacggttttacattgtcaacactggatcaaccaaactaccaaagtaaaacatactgtcgattcaactagcagttcatcgaagaatcctgggcttacaaaggtaatctgtgagatatcttatggatactcaacattatgacagtttcaaacattaaaccgcactgatcagtgaccataatctggggctacaaaatcttaaccacttggtacggcagttgcttatccgaggaagttcatgatcaccaggtggagcaccagattgcacagaacaaagtcagcaaaggccctctctgggggaaggtccttaaactccttgttgtctttgttcacttgaatacggagacaaacagcaagtactgcagttcctatgcatgaaaggacacctgagaggaaggagttgaaagggaacgacccaactaatcccatgtatgcaacctgaataagggcagtagcaacagcacaaatcacatagaggtcgataatcttaagatttgttggcgtggcagcgtacgccttgctgagggactggatcagaacctttgcgtcactcgtggccctcggcatcttgaagaagcgtagtctgccacttgaagcgaggagaaagggaagaagctgataggtggcgtcgcgtgctccggtgctgcgg

SEQ ID NO: 1746 - DNA, 916 bp, Pennisetum glaucum
gcccctccggctttcgtttcccagcggcatcgtgaagaattgtagtctgccgcttgaagctgtcggatgttcgtcgcccaaccggccgagctgccctccccttcctccctagcgcccgcgtgcgcctcgtagctgaagcctgattatctgaagcccctccggctttcgtttcccagcggccaattttgcctttctccgctccatcctctcggcctttatttcctagcggcgacgacaaggcgagcagccacatctggccttcgtcgggcgacgaacatccgacagcttcaagcggcagactacaattcttcacgatgccgcgggccacgagcgacgcaaatcttctgatccagtccctcagcaaggcgtatgctgccacgccaacaaatcttaagattatcgacctgtatgtgatttgtgctgttgctactgcccttattcaggttgcatacatgggattagttgggtcattccctttcaactccttcctctcaggtgtcctttcatgcataggaaccgcagtacttgctgtttgcctccgtattcaagtgaacaaagacaacaaggagttcaaggaccttcccccagagagggcctttgctgactttgttatgtgcaatctggtgctccacctggtgatcatgaacttccttggataagcaactgccataccaagtggttaacattttgtagcccagattatggtcgctgatcagtgcagtttaatgttttgaactgtcataattttgagtatctgtatgatctctcgcagactacctttgtaagcccaggattcttcgatgaactgttagtcgaatggacaatatgttttactttgtaagtttgattgatcacttggtccagtgttgacaaagtaataccgagcatttgcgtaattaaaggaagtgaaatggtt

SEQ ID NO: 1747 - DNA, 783 bp, Panicum virgatum
gggagccttgacgtagcaggctcgctcgagctaggctcaggggggtcggggctcatctcctccgtctgtttctcgagcaaacctttcccttctcttggacagcgacgactcgactgggcgagcggcggcgccgtctgtcacgtcttcgcccagctctttgccggcgacgagcgcatcctccagcttcaagcggaaggcgccgcttcttcaagatgccgaggtccacgagcgatgcaaagcttctgatccagtccctgagcaaggcgtatgctgccacaccaacaaatcttaagattatcgacctgtatgtcatttgtgctgtcgctactgccgtgattcaggttgcatacatgggattggttgggtcattccctttcaactccttcctctcaggtgtcctttcatgcataggaactgcagtacttgctgtttgcctccgcattcaagtgaacaaagacaacaaggaatttaaggatcttcccccagaaagggcctttgctgacttcgttctgtgcaacctggtgctccacctggtgatcatgaacttccttggataagcaaccgctgtacaccgagtggttaagattttgtagccccagattgtgttcgctgatcagtgtgtttaaatctttggaactgtcataatgccgagtatccatatgacttgtcacagattacctatgtaaagacagaattcttgagtccagtgttgacaatgttatactgcgagcatttgcgtaattcaaggaagtgaaatggctatatgttacatcattttagctg

SEQ ID NO: 1748 - DNA, 729 bp, Panicum virgatum
ctcttccttccctggcggcgacgactgggcgagcggcggcgccatttgtcacgtcttcgcccagccctttgccggcgacgagcgcatcctccagccacttcttcgagatgccgagggccacgagcgacgcaaagcttctgatccagtccctcaacaaggcgtatgctgccacaccgacaaatcttaagattatcgacctgtacgtgatttgtgctctcgctaccgccgtgattcaggttgcatacatgggattggttgggtcattccctttcaactccttcctctcaggtgtactttcatgcataggaactgcagtgcttgctgtttgtctccgcattcaagtgaacaaagacaacaaggaatttaaggatctacccccagaaagggcctttgctgactttgttctgtgcaacctggtgctccacctggtgatcatgaacttccttggataagcaactgccgtacaccgagtggttaagattttgcagccccagattttggtcgctgatcagtgttttaaagtttggaactgtcataataccgagtatccatatgatctctcacagattacctatgtaaagctagaattctcgaggaactgttagtcgaatggacagtgttgatccagtattgacaatgttatactgcgagcatttgcgtaatttcaaggaagtgaaatggctatgttacatcattttagctgaagcattacacggatgaggaattgtt

SEQ ID NO: 1749 - DNA, 865 bp, Panicum virgatum
ctcagggcctggcctcaggctcatctcctccctctgtttctcaaacctttcccttcgctcggactctccttccctggcggcgacgactgggcgagcggcggcgccatttgtcacatctttgcccagcccttcgccggcgacgagcatccaccagcttcaagcagaagacaccacttcttcaagatgccaagggccacgggcgatgcaaagcttctgatccagtccctgaacaaggcatatgctgccacaccaacaaatcttaagattatcgacctgtatgtgatttgtgcactcgctactgccatgattcaggttgcgtacatgggattggttgggtcattccccttcaactccttcctctcaggtgttctttcatgcataggaagtgcagtacttgctgtttgcctccgcattcaagtgaacaaagacaacaaggaatttaaggatctccccccagaaagggcctttgctgactttgttctgtgcaacctggtgctccacctggtgatcatgaacttccttggataagcaactgctgtacactgagtggttaagattttgtagccccagattgtggtcactgatcagcgcattttaatgtttggaactgtcataatgtcgagtatgcatatgatttctcacagattacctatgtaagcccagaattcttcgaggaactattagtggaattgacagtgttgatccagtgttgacaatgtaatactgcgagcatttgtgttcaaggaagggaaatggctatatgttacatcattttagttgaagcattacatggatgaggaatcgttcgctatgatggaaatattatttttattgattggagaagcagaagtgtacgtctatttta

SEQ ID NO: 1750 - DNA, 1049 bp, Panicum virgatum
attggaggcgttgttgcaatacggatccttccttccggaaagtgtcatcttgaggaacttttgatgctgtcgtccttgttggcgcgcacgtggtgcatttcgacagtctgctattctttgattgcagggcagttgctgctgattatctctggtgcttctggattagtgtggttgtttggtggtggggactactttcattgcgtattggagctaaggcggttgttttcttttctgtgttttctagtcttatgtcacaatgctaacatctgtgtggtcgactataactatgcgcttcgggggctctcttgaagttgcgtcactcttattgaaatacgtgctcaggcatgttctaaaaaatcaggtgtacatgtgtacacccatgtcctatgctgggtccacccctgcttcaaagttcaaagtctaggtgcagctgtgcatctctcttgttactgcttctgatgcctgtctcctggcgtctatagtttttttttcccccaatttgatctgctttgctaaggtccaggcgatctgattatgccttgctttctgtactttccacttagcttcaagcagaagacaccacttcttcaagatgccaagggccccgggcgatgcaaagcttctgatccagtccctgaacaaggcatatgctgccacaccaacaaatcttaagattatcgacctgtatgtgatttgtgcagtcgctactgccgtgattcagattgcgtacatgggcttagttgggtcattccctttcaactccttcctctcaggtgtcctttcatgcataggaactgcagtacttgctgtttgcctccgcattcaagtgaacaaagacaacaaggaatttaaggatcttcccccggaaagggcctttgctgactttgttctgtgcaacctggtgctccacctggtgatcatgaacttccttggataagaaactaccggacactgagtggttaagattttgtagccccagattgtggtcgctgatcagtgcgttttaatgtttggaactgtcataatgttgagtatccatatgatctctc

SEQ ID NO: 1751 - DNA, 739 bp, Eragrostis curvula
ggattccttgtttctccgtccaaactgaagggtggccaccgtcgtctccttccggcgaacgagcaagcggccggtcctttaaatgcccttccactgcgccccgcgacgccgcccctctcgtttgaagtagaagactcgaggttttcaggatgccgagcgccacgagtgatgcaagggttctgatccagtccctgatcagggcgtatgctgctacaccaacgaaccttaagatcattgacctgtatgtggttttcgctgttgctactgctctcgttcaggttgcgtacatgggattggtcggtacatttcccttcaactcattcctctcaggtgtcctttcatgcattggaactgcagtacttgctgtttgcctccgtattcaggtgaataaagataacaaggaatttaaggatcttcccccagaaagggcttttgctgactttgttctgtgcaatctggtgctccacctggtcatcatgaacttccttggataatcaactgccttcaagttgagattttgtagcctcagattgtggtcgctagttcatgcgccttaatgtctggaactctagtaatgtcagatattcttatactctcacaatttacctatgtaagagttttaaaaggaactattagtcaagttgccagttgttttttctttggtggatccaatgttgacaatgtaataccgtgagtgctggcttaatttgaggaaatgaaaaacctgatgttactaatt

SEQ ID NO: 1752 - DNA, 927 bp, Setaria italica
cggcagcggtggaggcctcctcctactcgccgtcgtcgtctctcctcttcccttcccggcggtcgcgcggcaccggggcacgcgacgccacctatcttcttccctgtctcctcgcttcgagcggcagactacgcttcttcaagatgccgagggccacgagcgacgcaaagcttctgatccagtccctcagcaacgcgtatgctgccacaccaacaaatcttaagattatcgacctgtacgtgatttggcccttattcaggttgcttacatgggattagttgggtcattccccttcaactccttcctctcaggtgtcctttcatgcataggaactgcagtacttgctgtttgcctccgtattcaagtgaacaaagacaacaaggaatttaaggaccttcccccggagagggcctttgctgactttgttctgtgcaatctggtgctccacctggtgatcatgaacttccttggataagcaactgctgtaccaagtggttaagatgtagccccagattatggtcgctgatcagtgcggtttaatgtttggaactgtcataatgtttgagtatccatatgatctctcacagattacctttgtaagcccaggattcttcaatgaactgttagtcgaatggacagtatgtttcactttggtagtttggttgatccagtcttgacaaagtaataccgagcatttgcgtaattcaaggaagtgaaatggctatgttacatcattttggtcgaagcatccacagatgttattcgccatgcaacggaaatttagttgtttattgataggagatacacaagtgcatatatgatacaagcataaaaacattgctgttccaagattatgcattttggcatggatgttgcaaacgacaacacacgataacaagttgatagtgattttttttttgtttgaac

SEQ ID NO: 1753 - DNA, 631 bp, Secale cereale
cagctcgaagcggggtgagggcgggagcgggctcgcggggaaggcaggatgccgaaggccgcgggcgatgccaagctcctgatccagtccctcagcaaggcctacgccgccacgccgacgaatctcaagatcattgacctgtacgtcgttttcgccgtcgccactgccctggttcaggtcgtttacatgggaatagttgggtcattccccttcaactctttcctgtctggtgtcctctcatgcatcggaactgcagtgcttggcgtttgccttcgaattcaagtcaacaaggacaacaaggaattcaaggatctccccccggaaagggcctttgcagatttcgtcctgtgcaatctcgtgctccacctggtgatcatgaacttcctcggatgagcaactgtcattcaagctatcgagattttgtagtgtcctaatgtctgagactgtcatcatgttagatattcatgtggcatcatacacacctatgtaatccgagggtttctctatgaactataagaattcagtggatttagcgttaactttgtggaacatgagaacttatttgagggagtgaaggcaggggaaagtgatcacttaaatattatcattgttcacacctgctgctgtgcaa

SEQ ID NO: 1754 - DNA, 741 bp, Secale cereale
aaagctgcccgagctcgcagttctcacctctgaatctccgcgtcgtcgtcgtcttcacagctcgcacagctagaagccgagggcgggagcgggctcgcggcgaagcaagcaaggatgccgaaggccgcgggggatgccaagctcctgatccagtcgctcaccaaggcctacgccgccacgccgaccaatctcaagatcattgacctgtacgtcgttttcgccgtggccactgccctggttcaggtcgtttacatgggaatagttgggtcattccccttcaactctttcctgtctggtgtcctctcatgcatcggaactgcagtgcttggcgtttgccttcggattcaagtcaacaaggacaacaaggaattcaaggatctccccccggaaagggcctttgcagatttcgtcctgtgcaatctcgtgctccacctggtgatcatgaacttcctcggatgagcaactgtcatgcaagctatcgagattttgtagtgtccctaatgtctgagactgtcatcatgttagatattcatgtggcatcatacacacctatgtaatccgacagtttctctatgaactataagaattcagtggatttagcgttaactttgtggaacatgagaacttatttgagggagtgaaggcagggaaaagtgatcacttaaatattatcattgttcacacctgatgctgtgcagaaaaaaatgaagtggcctgcttaacatgcagttctgttgggtt

SEQ ID NO: 1755 - DNA, 643 bp, Secale cereale
gcagttctcacctctgaatctgcgcgtcgtcgtcgccttcacagctcgcacagctcgaagctgagggcgggagcgggctcgcggggaagtaaggaaggatgccgaaggcggcgggcgatgccaagctcctgatccagtccctcaccaaggcctacgccgccacgccgacgaatctcaagatcattgacctgtacgtcgttttcgccgtcgccactgccctggttcaggtcgtttacatgggaatagttgggtcattccccttcaactctttcctgtctggtgtcctttcatgcatcggaactgcagtgcttggcgtttgccttcgaattcaagtcaacaaggacaacaaggaattcaaggatcttcccccggaaagggcctttgcagatttcgtcctgtgcaatctggtgctccacctggtgatcatgaacttccttggatgagcaactgtcatgcaagctatcgagattttgtagcatcctaatgtctgagactgtcatcatgttcgatattcatgtagcatcatacacacctatgtaatccgagggtttctctatgaactataagaattcagtggatttagcgttaactttgtggaacatgagaacttatttgatggagtgaaggcagggaaaagtgatca

SEQ ID NO: 1756 - DNA, 609 bp, Secale cereale
agggcgggagcgggctcgcagggaagtaaggaaggatgccgaaggccgcgggggatgccaagctcctgatccagtcgctcaccaaggcctacgccgccacgccgaccaatctcaagatcattgacctgtacgtcgttttcgccgtcgccactgccctggttcaggtcgtttacatgggaatagttgggtcatttcccttcaactctttcctgtcgggtgtcctctcatgcatcggaactgcagtgcttggcgtttgccttcggattcaagtcaacaaggacaacaaggaattcaaggatcttcccccggaaagggcctttgcagatttcgtcctctgcaatctggtgctccacctggtgatcatgaacttcctcggatgagcaactgtcatgcaagctatcgagattttgtagtgtccctaatgtctgagactgtcatcatgttagatattcatgtggcatcatacacacctatgtaatccgagggtttctctgtgaactataagaattcagtggatttagcgttaactttgtggaacatgagaacttatttgaggaagtgaaggcaggggaaagtgatcacttaaatattatcattattttcacagtc

SEQ ID NO: 1757 - DNA, 612 bp, Secale cereale
cacagctcgaagctgagggcgggagcgggctcgcggggaagtaaggaaggatgccgaaggcggcgggcgatgccaagctcctgatccagtccctcaccaaggcctacgccgccacgccgacgaatctcaagatcattgacctgtacgtcgttttcgccgtggccactgccctggttcaggtcgtttacatgggaatagttgggtcatttcccttcaactctttcctgtcgggtgtcctctcgtgcatcggaactgcagtgcttggcgtttgccttcggattcaagtcaacaaggacaacaaggaattcaaggatcttcccccggaaagggcctttgcagatttcgtcctctgcaatctggtgctccacctggtgatcatgaacttcctcggatgagcaactgtcatgcaagctatcgagattttgtagtgtccctaatgtctgagactgtcatcatgttagatattcatgtggcatcatacacacctatgtaatccgagggtttctctgtgaactataagaattcagtggatttagcgttaactttgtggaacatgagaacttatttgaggaagtgaaggcaggggaaagtgatcacttaaatattatcatt

SEQ ID NO: 1758 - DNA, 694 bp, Cynodon dactylon
aagaccgcaactgaagtggatctctctccggcggccggggcgaggcgaggcggcgcatccttcccttccaccgagctgcgcggcgccgtcgttctcgtttgaagtagaagacaacagggtttcaggatgccaagggccacgagtgatgcaatgcttttggtccagtccctgagaaaggcttatgctgctacaccaaccaacctcaagatcattgacctgtatgtggtttttgccattgcgacttctctcattcaggttgcttacatggggttagtggggacatttcccttcaactcattcctgtcaggtgtcctttcaggcattggatctgcagtgcttgctgtttgtctccgtattcaagtcaacaaagacaacaaagaattcaaggatcttcccccggaaagggcgtttgcagacttcgttctgtgcaacctggtgctccacctggtgatcatgaacttccttggatgagcaactgccttcttgttgagagtttatggtcgctagtcagctgctgtaatgtcatattcatataatcactcacattttacctaagacagtagtttacgagaactattagtcaagctgtgacaatgtaatgctgtgaacacttgcgataatttgagtgaaaaacaagctattactagaacacatttttgtagtttttcaccggtgaatactgatattcagctcc

SEQ ID NO: 1759 - DNA, 653 bp, Avena sativa
ggagtacccccggccgtaaacaggtcgtgttacccggcgacggctcgagcaagagcgatccctcgatccctcgatcccttccacctcctccgtcgagttgagcggcagcgctggttgcggtggaggctccaatcccccgtccccctctcgactatcttccctgcttgagctggctcaaagaggtctgacggcgcaaggtttgcgacgatgccgaaggccgcgggggatgccaagctcctgatccagtccctaaacaaggcgtatgccgccacgcccacaaacctcaagatcattgacctgtatgtgattttcgctgtgactactgccctcgttcaggttgtttacatgggaatagttgggtcatttcccttcaactctttcctctctggtgtcttgtcgtgcataggaactgcagtgcttgctgtgtgcctccgtattcaagtcaacaaggacaacaaggaatttaaggatcttcctccagaaagggcctttgcagattttgtcctgtgcaatcttgtccttcaccttgtgatcatgaacttcctcggataagaaactgccctacaagttattaagatgcactgtcctagtgtttgagatattcatatggtatcacacactatctatgtaatccgaaagttcctctatgaact

SEQ ID NO: 1760 - DNA, 641 bp, Avena sativa
ggagtacccccggccgtaaacaggtcgtgttacccggcgacggctcgagcaagagcgatccctcgatccctcgatcccttccacctcctccgtcgagttgagcggcagcgctggttgcggtggaggctccaatcccccgtccccctctcgactatcttccctgcttgagctggctcaaagaggtctgacggcgcaaggtttgcgacgatgccgaaggccgcgggggatgccaagctcctgatccagtccctaaacaaggcgtatgccgccacgcccacaaacctcaagatcattgacctgtatgtgattttcgctgtgactactgccctcgttcaggttgtttacatgggaatagttgggtcatttcccttcaactctttcctctctggtgtcttgtcgtgcataggaactgcagtgcttgctgtgtgcctccgtattcaagtcaacaaggacaacaaggaatttaaggatcttcctccagaaagggcctttgcagattttgtcctgtgcaatcttgtccttcaccttgtgatcatgaacttcctcggataagaaactgccctacaagttattaagatgcactgtcctagtgtttgagatattcatatggtatcacacactatctatgtaatccgaaagtt

SEQ ID NO: 1761 - DNA, 689 bp, Pseudoroegneria spicata
  misc_feature (100)..(100): n is a, c, g, or t
  misc_feature (209)..(209): n is a, c, g, or t
  misc_feature (218)..(218): n is a, c, g, or t
ggagctcgcaaatcgaagtctgaatctgcgcgtcgtcgtcgtcgtcgtcttccccgtgcagcgcagcacagcacagcgcaccacagctcgaagcggagtnggggcgggagcgagctcgcggggaaggaaggatgccgaaggccgcgggggatgccaagctcctgatccagtccctcaccaaggcctacgccgccacgccgacgaatctnaagatcatngacctgtacgtgcttttcgccgtcgccactgccctggttcaggttgtttacatgggaatagttgggtcattccccttcaactctttcctgtctggtgtcctgtcatgcataggaactgcagtgcttggtgtttgcctccgtattcaagtcaacaaggacaacaaggaattcaaggatcttcccccggagagggcctttgctgatttcgttctgtgcaatctggtgctccacctggtgatcatgaacttcctcggatgagcaactgtgctacaagttatcaagattttgtagtgtcctaatgtctgagactgtcatcatactattagatattcatgtggcatcatacacacctatgtaatcccagagtttctctatgaactataagaattcagtgggtttagcgtaactttgtggaacatgagaacttatttgagggagtgaagacagggaaaagtgaccacttaaatatta

SEQ ID NO: 1762 - DNA, 793 bp, Hordeum vulgare
cgggggccggagatcgcaattctcaggtctgaatctgcgcgtcgtcttcttccccagcacagcacagcacagcacggagcggggtgagggtgggagcgagctcgcgaggaaggaaacaaagatgccgaaggccgcgggcgatgccaagctcctgatccagtccctcaacaaggcctacgccgccacgcccacgaatctcaagatcattgacctgtacgtggttttcgccgtggccactgccctggttcaggttgtttacatgggaatagttgggtcattccccttcaactctttcctgtctggtgtcctgtcgtccattggaactgcagtgcttggtgtttgcctccgtattcaagtcaacaaggacaacaaggaattcaaggatctccccccagagagggcctttgctgatttcgtcctgtgcaatctggtgctccacctggtgatcatgaacttccttggatgagcaactgtgctccaagttgtcaagattttgtagtgtcctaatgtctgagactgtcatcgtgttagatattaatgtggtacacacctatgtaatctgagagttcctctatgaactataagatttcagtggatttagcattaactttgtgcgacatgagaacttatttgagggagtgaagactgggaaaagtgatcgcttaaaaaagcacaacctaccctactcatccattcatccgtccgtaaggcaggttttctatcggaccaatgggctctttcttacgcgcttctcggagcctcgggcacgggcgggctcaaccggacccctgga

SEQ ID NO: 1763 - DNA, 676 bp, Brachypodium distachyon
aaacccgaggaaaagaaagaatcccagaactgaactgaaggagttctctcctcctcgtcttcgtcttcttcctcttcccaagcgcagaggctgctcgtagcgggggtttcgaggatgccgaaggccgcgggcgacgccaagctcctgatccagtccctcagcaaggcctacgccgccaccccgacgaatctcaagatcattgacctgtatgtggttttcgccgtggcgactgccgttgtgcaggtcgtttacatgggagtagttgggtcatttcccttcaactctttcctctctggtgtgctgtcatgcataggaactgcagtgcttgccgtttgcctgcgcattcaagtcaacaaagataacaaggaattcaaggatcttgccccggaaagggcctttgcagattttgtcctgtgcaatctggtgctccacctggtgatcatgaacttcctcggataagcaactgctgttcaagttatcaagattttgtagtgtcgaaacggtcatcctattagatacttatgtgttctcgcatactacctatgtaatctgaaaatttcttgatgaactataggaattttcaaccagttactcactgcagtttatcagaatttgttgtgtttaacgtgacaatggaagaacatgaatgaaaaacttggtttctttgagggagtgg

SEQ ID NO: 1764 - DNA, 760 bp, Brachypodium distachyon
acagaggaacaaataaacccgaggaaaagaaagaatcccagaactgaactgaaggagttctctcctcctcgtcttcgtcttcttcctcttcccaagcgcagaggctgctcgtagcgggggtttcgaggatgccgaaggccgcgggcgacgccaagctcctgatccagtccctcagcaaggcctacgccgccaccccgacgaatctcaagatcattgacctgtatgtggttttcgccgtggcgactgccgttgtgcaggtcgtttacatgggagtagttgggtcatttcccttcaactctttcctctctggtgtgctgtcatgcataggaactgcagtgcttgccgtttgcctgcgcattcaagtcaacaaagataacaaggaattcaaggatcttgccccggaaagggcctttgcagattttgtcctgtgcaatctggtgctccacctggtgatcatgaacttcctcggataagcaactgctgttcaagttatcaagattttgtagtgtcgaaacggtcatcctattagatacttatgtgttctcgcatactacctatgtaatctgaaaatttcttgatgaactataggaattttcaaccagttactcactgcagtttatcagaatttgttgtgtttaacgtgacaatggaagaacatgaatgaaaaacttggtttctttgagggagtggaaactggaaagagtactttaataatgtcattgttctttaccgacatttaactgttgtttgtccttattgc

SEQ ID NO: 1765 - DNA, 639 bp, Avena sativa
gtagtctcttctccggcatcgtcgtcttcttccccgtggcagcacagctcgaagctgaggagccgccaggatgccgaaggccgcgggcgatgccaagctcctgatccagtccctgaacaaggcctacgccgccacgcccaccaatctcaagatcatcgacctgtacgtggttttcgctgtggcgtctgccctcgttcaggtcgtctacatgggaatagttgggtcatttcccttcaactctttcctatctggtgtcctgtcatgcataggaactgcagtacttgctgtttgcctccgtattcaggtcaacaaggacaacaaggaattcaaggatcttgctccagagagggcctttgcagattttgtcctgtgcaatctggtgctccacctcgtgatcatgaacttccttggataagcaagtggcctacaagttgtcaagattttgtagtgtcttaatgtttgagactgataatgttagatattcatgtggtatcacacaatctatgtaatccaagagttactctatgaagtataagagtttgatggacttaacactagcgatgtaagaacagcagagttactttattttgacggagtgaggactgcaaaggtcactcaaatattatcattgggttgttc

SEQ ID NO: 1766 - DNA, 649 bp, Avena sativa
ggggaaccagaactgtagtctcttctccggcatcatcgtcttcttccccgtgcagcacagctcgaagcggaggagccgccaggatgccgaaggccgcgggcgatgccaagctcctgatccagtccctgaacaaggcctatgccgccacgcccaccaatctcaagatcatcgacctgtacgtcgttttcgcggtggcgtctgccctcgttcaggtcgtctacatgggaatagttgggtcatttcccttcaactctttcctatctggtgtcctgtcatgcataggaactgcagtacttgctgtttgcctccgtattcaggtcaacaaggacaacaaggaattcaaggatcttgctccagagagggcctttgcagattttgtcctgtgcaatctggtgctccacctcgtgatcatgaacttccttggataagcaagtggcctacaagttgtcaagattttgtagtgtcttaatgtttgagactgataatgttagatattcatgtggtatcacacaatctatgtaatccaagagttactctatgaagtataagagtttgatggacttaacactagcgatgtaagaacagcagagttactttattttgacggagtgaggactgcaaaggtcactcaaatattatcattgggttg

SEQ ID NO: 1767 - DNA, 766 bp, Triticum aestivum
ccccatccactcccatcggcgcgataaaccgcaggaaagaaaaggaaaatcccaagccaaagctgccggagctcgcaattctcacctctgaatcttcgcgtcgtcgtcttcacagcacagctcgaagcggggaagcaaggatgccgaagcccgcgggggacgccaagctcctgatccagtccctcaccaaggcatacgccgccacgcccacgaatctcaagatcattgacctgtacgtggttttcgccgtcgcaactgccctggttcaggtcgtttacatgggaatagttgggtcattccccttcaactctttcctgtctggtgtcctgtcatgcattggaactgcagtgcttggtgtttgcctccgtatccaagtcaacaaggacaacaaggaattcaaggatcttcccccggaaagagcctttgctgatttcgtcctgtgcaatctggtgctccacctggtgatcatgaacttcctcggatgagcaactgtcatacaagctgtcgagattttgtagcgtcctaatgtctaagactgtcagcatgttagatattcatgtggcatcatacacagctatgtaatccgagagtttctctatgaactataagaattcagtggatttagcgttaactttgtggaacatgacaacttatttgagggagtgaaggctgggagaagtgatcacttaaatattatcattgttcaacaaaaaaaaagaaaaaaaaacaaaagactctgcgttgataccactgcttgacacgcgag

SEQ ID NO: 1768 - DNA, 608 bp, Triticum aestivum
cacagcacagctcgaagcggcggaagcaaggatgccgaaggccgcgggggacgccaagctcctggtccagtccctcaccaaggcctacgccgccacgcccacgaatctcaagatcattgacctgtacgtggttttcgccgtggccactgccctggttcaggtcgtttacatgggaatagttgggtcattccccttcaactctttcctgtctggtgtcctgtcgtgcatcggaactgcagtgcttggtgtttgcctccgtattcaagtcaacaaggacaacaaggaattcaaggatcttcccccggaaagggcctttgctgatttcgtcctgtgcaatctggtgctccacctggtgatcatgaacttcctcggatgagcaattgtcatacaagctgtcgagattttgtagtgtccttatgactgagactgtcagcatgttagatattcatgtggcatcatacacacctatgtaatccgagagtttctctatgaactataagaattcagtggatttagcgttaactttgtggaacatgggaacttattggagggagtgaagacagggaaaagtgatcacttaaatattagtattgttcaaaaaaaaaaaa

SEQ ID NO: 1769 - DNA, 874 bp, Hordeum vulgare
gaacgagcagtccagtgcgcgcaagccgactgtacagcccaacttcttccaccccaatcttcttcatctccgtctagtcgcagcagcgccgccggcggagggcccccgatccgatccccacctgcgagttccttacgttacgcgccgccggaagcccgtcttcacactgcttgagctccaagcgttctgagtgcgcaaggttcgcgaggatgccgaaggctgcgggggatgccaagctcctgatccagtccctgaacaaggcctatgccgccacgcccacaaatctcaagatcattgacctgtacgtggtttttgccgtggtgactgcccttcttcaggttgtttacatgggaatagttgggtcatttcccttcaactctttcctctctggtgtcctgtcatgcataggaactgcggtgcttgctgtgtgcctccgtattcaagtcaacaaggacaacaaggaattcaaggatcttgctccagaaagggcctttgcagatttcgtcctgtgcagtctggtgctccacctggtgatcatgaacttcctcggataagccaccgtcctacgggctttcgagattttgtagtgtcctgatgtttgaggctgtcatcatgttagatgttcatgtggtgtcacacaactgtctctgtaatccgagagtttctctgtgagctataataattttttggatttagtattagcaatgtatgaaaatgagaactcaatttcttttgaggaggtgaaactggcaagatcacttcaatattgattgcccggaccattcttctttactatccaagaccattgtatgtgtaatccgagaccattgttctttactatccaagctgttaagggaaaaaaaaaaaaaaatac

SEQ ID NO: 1770 - DNA, 553 bp, Eragrostis curvula
  misc_feature (227)..(227): n is a, c, g, or t
gcaaacgagcaagcggccagtaggcagcctcccgttccactgcgccacgcgacgccgcccctctcgtttgaagtagaagacgtgaggttttcaggatgccgagggccacgagtgatgcaagggttctgatccagtccctgagcacggcttacgctgccacaccaaagaaccttaagatcattgacctgtatgtagttttcgctgttgctactgctctcgttcaagtngcctatatgggattagtgggtacatttcccttcaactcattcctctcaggtgtcctttcatgcatgggaactgcagtacttgctgtttgcctccgtattcaggtgaacaaagataacaaggaatttaaggatcttcccccagaaagggctttggctgacttggttctgtgcaatctggtgctccacctggtgatcatgaactttctgggataatcaactgccttcaaagttgagatttggtagccccagattgtggtcgctagtccagtgtgtcttagtatctggaactctcgtaatgtcagatatcctgatactctctcacaact

SEQ ID NO: 1771 - DNA, 677 bp, Avena sativa
gtagtctcttctccggcatcgtcttcttccccgtggcagcacagctcgaagcggagaagccgccaggatgccgaaggccgcgggcgatgccaagctcctgatccagtccctgaacaaggcctatgccgccacgcccaccaatctcaagatcatcgacatgtacgtggttttcgccgtggcgtctgccctcgttcaggtcgtctacatgggaatagttgggtcatttcccttcaactctttcctatctggtgtcctgtcatgcataggaactgcagtgcttgctgtttgcctccgtattcaggtcaacaaggacaacaaggaatttaaggatcttgctccagagagggccttcgcagattttgtcttgtgcaatctggtgctccacctcgtgatcatgaacttccttggataagcaaatgacatacaagttctcaagattttgttgtgtcctaatgtttgagattgataatgttagatatgcatgcggtatcacacagtctatgtaaaccaagagttaatctatgaactataagagattggtggacttagcattaacgatgtaagaactggagaattcctttatttgatggagtgaagactgcaaaaatcacttcaaatattgtcattgggttgttcgaaaaaacagttgtcattggttttcacttattaagttaaat

SEQ ID NO: 1772 - DNA, 633 bp, Avena sativa
gtagtctcttctccggcatcgtcgtcttcttccccgtggcagcacagctcgaagcggaggagccgccaggatgccgaaggccgcgggcgatgccaagctcctgatccagtccctgaacaaggcctatgccgccacgcccaccaatctcaagatcatcgacctgtacgtggttttcgctgtggcgtctgccctcgttcaggtcgtctacatgggaatagttgggtcatttcccttcaactctttcctatctggtgtcctgtcatgcataggaactgcagtacttgctgtttgcctccgtattcaggtcaacaaggacaacaaggaattcaaggatcttgctccagagagggcctttgcagatttgtcctgtgcaatctggtgctccacctcgtgatcatgaacttccttggataagcaaatggcctacaagttgtcaagattttgtagtgtcttaatattcgagactgataatgttagatattcatgtggtatcacaatctatgtaatccaagagttactctatgaagtataagagtttgatggacttaacattagcgatgtaagaacaacattgttattttatttgacggagagaagactgcaaaagtcactcaaatattatcattgggctgt

SEQ ID NO: 1773 - DNA, 487 bp, Secale cereale
aggatgccgaaggccgcggggatgccaagctcctgatccagtccctcacaaaggcctacgccgccacgccgacgaatctcaagatcattgacctgtacgtggttttcgcggtcgccactgccctggttcaggtcgtttacatgggaatagttgggtcattccccttcaactctttcctgtctggtgtcctgtcatgcattggaactgcagtgcttggtgtttgcctccgtattcaagtcaacaaggacaacaaggaattcaaggatcttcccccggagagggcctttgctgatttcgtcctgtgcaatctggtgctccacctggtgatcatgaacttccttggatgagcaactgtcatacaagctgtcgagattttgtagtgtcctaatgtctaagactgtcagcatgttagatattcatgtggcaccatacacacctatgtaatccgagagtttctctatgaactataagaattcagtggatttag

SEQ ID NO: 1774 - DNA, 862 bp, Secale cereale
ctccaacgccgaacggtcccttaacgtacgaaaaaaaaccttcacccccgtccgatccccgacgtccccacgtctctttctccacgagcgccggcggtggacgacgcccccgatctgcctccccttcgacctccccctcgcgagcagccaccggcgcgcgcagccctccactgcttgaggtccaggcgttttgacggattcacgaggatgccgaaggctgcgggtgatgccaagctcctgatccagtccctgaacaaggcctattccgccacacccacgagtctcaagatcattgatctgtatgtggtttttgccatagtgactgcccttgttcaggttgtttacatgggagtagttgggtcatttcccttcaactcgttcctctcgggtgtcctgtcatgcataggaactgcagttcttgctgtgagcctccgtattcaagtcaacaaggacaacaaggaattcaaggatcttcctccggaaagagcctttgcagattttgtcctgtgcaatctggtgctccacctggtgatcatgaacttcctcggataagccactggcctacgagttaccgagattttgtagtgtcctgatgtttgagactgtcatcatgttagatattcatgtggtatcatcacacaactgtctgcgtgatccgagagtttctctatgagccataataattttgtggatttggtattaacaatgtatgaaaatgagaaatttaattaccaaaaaaaaaaaaaaagaaaaaaaaaaaagaaaaaaaaaaaagaaaaaaaaaaaacaaaaaaaacaaaaagaaaacaaaagaaagaaataaagaaagaagaagaagaagtaacaagataagataacatac

SEQ ID NO: 1775 - DNA, 652 bp, Secale cereale
gcggtggacgacgcccccgatctgcctccccttcgacctccccctcgcgagcagccaccggcgcgcgcagccctccactgcttgagctccaggcgttttgacggattcacgaggatgccgaaggctgcgggtgatgccaagctcctgatccagtccctgaacaaggcctattccgccacacccacaagtctcaagatcattgatctgtatgtggtttttgccatagtgactgcccttgttcaggttgtgtacatgggaatagttgggtcgtttcccttcaactcgttcctctcaggtgtcctgtcatgcataggaactgcagtgcttgctgtgagcctccgtattcaagtcaacaaggacaacaaggaattcaaggatcttcctccggaaagggccttcgcagattttgtcctgtgcaatctggtgctccacctggtgatcatgaacttcctcggataagccactggcctacgagttaccgagattttgtagtgtcctaatgtttgagactgtcatcatgttagatattcatgtggtatcatcacacaactgtctgtgtgatccgagagtttctctatgagccataataattttgtggattcagtattaacaatgtatgaaaatgagaatttgattccttttgaggggggtg

SEQ ID NO: 1776 - DNA, 723 bp, Triticum aestivum
ccccgcatggcagtggcccaacttgagtctgacgccccctcccccgccccattcttctccgtagtcgccgccggccccccgatccgatccccactgcgccggcttcactgcttgagctccaagccttctgagggtgcaaggtttgcgaggatgccgaaggctgatggggatgccacgctcctgatccagtccctgaacaaggcctatgccgccacgcccacgaatctcaagatcattgacctgtatgtggttttcgctgtggtgactgcccttgttcaggttggttacatgggaatagttggatcacttcccttcaactcgttcctatctggtgtcctgtcatgcataggaactgcagtgcttgctgcgtgcctccgtattcaagtcaacaaggacaacaaggaattcaaggatcttcctccagaaagggcctttgcagatttcgtcctgtgcaatctggtgctccacctggtgatcataaacttcctcggataagccactgtcctacgagtttttgagattttgtagtgtcctaatgtttgagactgtcatcatgttcgatgttcatgtggtaccgcacaccatctatgtaatccgagagtttctctgtgaactataataatttcgtggatttagtgctaacaacataaggacatgagaacttgctttcttttgatgcggtgaagactggcaagatcatttcaatattatcactgttcttta

SEQ ID NO: 1777 - DNA, 642 bp, Cleome spinosa
ggaggagaaagggtttttttttaaagttcgcgaaaatggcgagatccaccagtaaggatgctcaagatctcttccattctcttcgttctgcttacgccgccacccctaccaatctcaagatcattgacctctatgtcggtttcgcggtcttcacagctctgatccaggttgcttacatggctcttgtgggatcgtttccattcaactcttttctgtcgggagttctctcgtgtgttgggacagcagttcttgctgtttgcctccgaattcaagtgaacaaggaaaacaaggaattcaaggatttgccaccggagagagcatttgccgatttcgtgctatgcaacttggtcctccacctagtgatcatcaacttcctcggttaaattgccctccttccttcctccattaaccttccaacactttcttcttcaccttactgctaccacttccgtatccataataaggtaaagtaaggaacaaagcaaaaggagggtggatgatagaaaacaagttgctttttcattatgcatttagaaaaattctgggatttttttttaaattttattttaggtattgcttgatgaacatacatacatatatatatatatagatatgcaattattatgcatttaactattttcg

SEQ ID NO: 1778 - DNA, 750 bp, Ricinus communis
gttatttccctttttaacagtccggtccgggctggttttgaaatgatcggcccggaaccgatgtcaggtttaatttcaagactcttctgtctgcacaagacgaccgaaggaaatttttaatttattaaagacctaattgttgaaatcagtaaaataaaattgggattgaagtttgatttcgcacattggaaatggcgagatcaacgagcaaggatgcacaagctctcttcaattcacttcggtctgcttatgctgctacgcccacgacccttaagatcatcgatctctatgtgggctttgctgttttcactgctctgattcaggtagtctacatgggtattgttggatcattcccattcaattcttttctttcaggagtactttcttgtgtaggcacggccgtccttgctgtttgcctccgtattcaggtgaacaaagaaaacaaggaattcaaggatttacctccggagcgcgcctttgctgattttgttctctgcaacttggtgctccatttggtgataatgaatttcttaggttaaaatttttgggcatagattttgttatgtgtaactgcgagtcataaaaaggtttaatgctagcaatgcagcaaatttcctttggctactattgcagtttggagttttgtttatttagttatttacaacaatgagaactatgcattgcttaggtgaccatatatacccctgataaattgttttgtattaatcaagaatgattgacttttttctt

SEQ ID NO: 1779 - DNA, 642 bp, Tropaeolum majus
cggccgggggtaatcacgctacaccagataagcacggtacacgcactctctcgaggaagaagaagaagaagaaggggtttccttttcgcaaatggcgagatcaacaagtaaggatgcccaagcccttttccaaactcttcgttctgcgtacgctgcaacccccaccaatctcaagatcatcgatctctatgtcggtttcgcagttttcacagctctgatccaggttgcctacatggctgttgtaggatcattccctttcaactctttcctctcaggagttctctcctgtgtaggaactgctgttctggccgtttgcctccgaattcaagttaacaaagaaaacaaagaattcaaggatttagcaccagagcgggcttttgcagattttgttctatgtaacttggtgctgcacttggtgattatgaatttccttggataacttaacctctgtgacgaatcatactttcatgaccgaagctagaaagacgtagttactaaactatttatgcaattatgtgctggattttgtagatttacatggtatatgaaatttggagttgtagttttggatttgtgatatagttctttcttttggtaatccttataacaatgcatttctattaggtcagatgttaatcttaa

SEQ ID NO: 1780 - DNA, 745 bp, Tropaeolum majus
cggccgggggtttgactccaatcacgctacaccagataagcacggtacacgcactctctcgaggaagaagaagaagaagaaggggtttccttttcgcaaatggcgagatcaacaagtaaggatgcccaagcccttttccaaactcttcgttctgcgtacgctgcaacccccaccaatctcaagatcatcgatctctatgtcggtttcgcagttttcacagctctgatccaggttgcctacatggctgttgtaggatcattccctttcaactctttcctctcaggagttctctcctgtgtaggaactgctgttctggccgtttgcctccgaattcaagttaacaaagaaaacaaagaattcaaggatttagcaccagagcgggcttttgcagattttgttctatgtaacttggtgctgcacttggtgattatgaatttccttggataacttaacctctgtgacgaatcatactttcatgaccgaagctagaaagacgtagttactaaactatttatgcaattatgtgctggattttgtagatttacatggtatatgaaatttggagttgtagttttggatttgtgatatagttctttcttttggtaatccttataacaatgcatttctattaggtcagatgttaatcttaacatgtttgcagagtaatattcatgtaatgggtcatatatgatttgtggtttacatttcgaggtttcattatatatgtcgcaaaagcggcgcgact

SEQ ID NO: 1781 - DNA, 759 bp, Fagus grandifolia
tgaattgcacgagtcgacgacccgtgaaaacgagtcaagactcaagagggttttctgttttcattccattttgtgttgaacattgtgtagtagtgaagcactgcaagaagaattagggttgcaatggcgaggtcgaccagcaaggacgcccaggctcttttccactctctccgttctgcttatgcagccactcccacaaatctcaagatcatcgatctctatgtggttttcgctgtcttcactgctttgatccaggtagtatacatggctattgttggatcattcccattcaactcgtttctttcaggagtactttcttgcatagggacggcagtccttgctgtttgtctccgcatccaagtgaacaaagaaaacaaggaatttaaggatttaccaccagagcgtgcttttgcagattttgttctctgcaatttggtgcttcatttggttattatgaatttccttggatagattgccatctatggccgttctgtaatgttgttcccctggagagctcactatatatgaaaaaaggacctgcaattgatttttctgtgatttgtttcagatttagaaacttagtactttattaaagaaacaattacctaaacaaagtttttgttgctactcggcatccttggtttctcaggggtattaagtttgtgctttctttaggacctggttttgaagcatttttgttgtctttttacatggaatcagtaaaataaaagttttgtcatagagatggtgcttggttgg

SEQ ID NO: 1782 - DNA, 3449 bp, Ricinus communis
gttatttccctttttaacagtccggtccgggctggttttgaaatgatcggcccggaaccgatgtcaggtttaatttcaagactcttctgtctgcacaagacgaccgaaggaaatttttaatttattaaagacctaattgttgaaatcagtaaaataaaattgggattgaagtttgatttcgcacattggaaatggcgagatcaacgagcaaggatgcacaagctctcttcaattcacttcggtctgcttatgctgctacgcccacgacccttaagatcatcgatctctatgtgggctttgctgttttcactgctctgattcaggtagtctacatgggtattgttggatcattcccattcaattcttttctttcaggagtactttcttgtgtaggcacggccgtccttgctgtttgcctccgtattcaggtgaacaaagaaaacaaggaattcaaggatttacctccggagcgcgcctttgctgattttgttctctgcaacttggtgctccatttggtgataatgaatttcttaggttaaaatttttgggcatagattttgttatgtgtaactgcgagtcataaaaaggtttaatgctagcaatgcagcaaatttcctttggctactattgcagtttggagttttgtttatttagttatttacaacaatgagaactatgcattgcttaggtgaccatatatacccctgataaattgttttgtattaatcaagaatgattgacttttttctttttcttctttctttttaatgtagatccttgattttacttgataatcgaaggtgtttgttcttttctccagcgtcgccctctttaaaactcaacctttctgtgcaagttcaggccctaagctgatctcttggttttattagattattaactttttcataaattttgtcctcaacaaaaagataacaactgtttacttctcattgctcttgaagtttcacttgccattgtaatttaagaattaagaaaagaaaattatttaataggagaaaaaaagttcaatttttttaataagataatagaggataattatggagaagtatgaataataaataaaaataatagaaaagtgtacatggagaagtatgaaattgttacaactattttttttttttctgtgaagaaattgttataacttattagagagtattgaattttctagaattgaaagagtgttaaaaaatttgaaatattgaaaaaataagaaacacaaccggtaatattgctgttataaaagaaaagaaagagtaaatttatattttttaaaattaaacggaaaaacaacatatttgaaacacaaaatgagagtatttgcgatcattgtgtatataataattgttagggtttcacatcggaactaaatccctggtctgattttacaagcaggaaccgatccctaattacatataatccattaattattaaaaaaataagttaaaaaaaaaaaaacattataattttaaatattcttatgataaagtaactgctacgtggcgtctttagtcctgtgaaagatgaactgaatcttctagaaaataggcccaagtggacactggcaaccaagacatcaaaattggaaaaaggggaaaaaggaaagaaaaaaggaaaaagcacagctcttgctctgaacaaccgttcccagtcactctttatcagtaagatttttttgtttttgcagagagaaaaaggaaatgaagataaccgggggaggcggatcaataagtgaggttttggtgctaattccgtctactggagctctcgatctcaggtctcctcctcatttgagacaccaccaccaccacttccattctttctcctttctctcttctgccctcttcaaaagatgtccttcgtttggcatgccaaagcaaggaattggaactattaagtggcgtcaaagaggcttaaccctgagagcctcaggggacgctaacaattattcagttccactccctcctcttaaatttgagtccccggttggccagcttttggctcaaattttgcaaacccatcctcatttactcccttcagctattgatcagcagcttgagaaccttcaatctgatagagatgcctccacggatcaatctccttcgtctcaagatctcctttacaagagaatagctgaagtgaaggagaaggaaaggcggaagacactggaggagatcatttactcattgatagtgcagaaatttttagacaatgacattttaatgatcccaaaagtatcagcaacctcagatcctacaggaagagtagatttttggccaaaccaggaacagaaattagaatctgttcattcacctgaagcctttgaaatgatattgagccatttgacccttgtattgggagagcgtgtggtgggtccccttgaaacgattgttcaaattagcaaaatcaaacttgggaagttgtatgctgcatctataatgtatgggtatttcctcagaagagtggacgagcgatttcagctggagagaactatgaataccttacccaaggattatgatgaaaaccgggcacgatatgacgaaccaagcccaatgaatcgactttgggatccagattcgttgataaggattcaacctgataatggaggtttcatggatactgttgaaggaaaatcatacagactgagatcatatgtgatgtatttggatgtagagacacttcaaagatatgcgacaataagatccaaggaagcgatgtcgttaattgagaagcaaacacaagcactgttcgggaggcctgatataaggattgctgaggatggttccattgacacagcgaatgatgaagtgatttctatcactttctctggactgaccatgctcgtcttggaggcagtagcatttggatcattcctatgggagggagaaagctatgtcgaatcgaaataccattttatcagcagttaataagacaattttatttttatatttcacatttttgtcgagtcattgttgctgttgtgtaattataattgcagtcttgttctggcatgctgttaaacatgagttgtgcagttgaagtatagatacttagataggggcatctggccatgaatacaatgttgtaatagctcctaaagatgtatagccagccatctcttcctagcaaatgtccgtctccaccacacacaagacaagagtcattattgcaagtatctcagggcaatttcaacgtaaagaagcgagacaattgagcaaagtgtaaattagtgcaaggccataatatgcggttttaatcttgatttcagcttttgacaatccaacgctaataaattagatacaaaatgaagcttcttgtatattctcaataataaatttatggttttctttgcataaattgtccctgtatgctgttttcgtacctgtatgatatcaagtagcaaatctgttcctttttcctgaaaatccaaa

SEQ ID NO: 1783 - DNA, 943 bp, Secale cereale
ggccctaccgcccccacgtcttcgttctcacgagcgccggcggtggacgacgcccccgatctgcctccccttcgacgtccttagctcgcgagcagccaccggcgcgcgccagcccttcgctgcttgaggtccaggcgttttgacggattcacgaggatgccgaaggctgcgggtgatgccaagctcctgatccagtccctgaacaaggcctattccgccacgcccacaagtctcaagatcattgatctgtatgtggtttttgccatagtgactgcccttgttcaggttgtgtacatgggagtagttgggtcatttcccttcaactcattcctctcaggtgtcctgtcgtgcataggaactgcagtgcttgctgtgagcctccgtattcaagtcaacaaggacaacaaggacaacaaggaattcaaggatcttcctccggaaagggcctttgcagattttgtcctgtgcaacctggtgctccacctggtgatcatgaacttcctcggataagccactggcctacgagtttccgagattttgtagcgtcctaatgtttgagactgtcatcatgttggatattcatgtggtatcatctcacaactgtctgcgtgatccgagagtttctctatgagccgtaataattttgtggatttagtattaacaatgtatgaaaatgagaatttaattccttttgagggggtgaaactggcaagatcacttcagtatgatcattgttctttactatccaagctgttgagggaaataccgattgcccggatggccgcaatgccttcgagctccaaacttgaggttgcaaacattggcacctggatttctgtacttcgagttccatttgtgtcgaagagtgaaatattgtgtggtactggatatccaagctcttcattcaatccaagattgcttcagttttattacaccaaaaaaa

SEQ ID NO: 1784 - DNA, 609 bp, Carpinus betulus
acgacgacctgcgaaacgactcaccccgtcagagggttttgcttccactaaacttgaatctcgcttgttgtcacatacgcacacgagaagaagggttgcgatggcgaggtcgacgagcaaggacgcccaagctcttatccaatctctccgctctgcctatgcagccactcccaccaatctcaaaatcatcgatctctatgtggtttttgctatcttcactgctctgatccaggtagtttacatggctattgttggatcgttcccattcaacgcgtttctctctggtgtactttcttgcactgggacggcagtccttgctgtttgtcttcgcatccaagtgaacaaagaaaacaaggaattcaaggatttgccgccagagcgtgcttttgcagattttgttctctgcaatttggtgctgcatttggttattatgaatttcctaggataaattaccatcctcgagtgttctacaatgttgtttccttggacttttactactagaatcggccataatacagttatttgccattgatgcagcaatttttctagtttgtaactcatggagcttactatttatgaaaaatggattcaacatcagaaatttttgcc

SEQ ID NO: 1785 - DNA, 448 bp, Eutrema halophilum
tttcaccgaaagtaagcatactcgtgagaagaaaaattgaggagcgaagaagaagcagaagcagaaggaagacgacaaagtgttgttgctcttggaagaaatggcgagatcgactagtaaggatgctcaggatctcttccattctcttcgttctgcttatgccgctacaccaacgaatctcaagctcatcgacctgtatgtttgttttgcggtcttcacagctctgatccaggttgcttacatggctctcgtgggatcgtttccattcaactcatttctctcaggagttctctcgtgtatcggaacagcagttcttgctgtctgcctccggattcaagtgaacaaagaaaacaaggaatttaaggatttagcaccagagcgagcttttgctgattttgttctctgcaacttggtcctgcacctggtgatcataaactttctcggataa

SEQ ID NO: 1786 - DNA, 642 bp, Amaranthus tuberculatus
gagaaagagagagaagaattgaattggtgaaatacagacatcaatggcgaaatcaagtagcaaggatgctcaagcattgttccaatctcttcggtctgcttatgctgccacccctaccaatcttaagatcatcgatctctatgtaattttcgcggtttccactgctctcattcaggttgcttacatggcgatagttggatcatttccttttaactcctttctgtccggtgtactttcttgtgtgggtacagctgttcttgctgtatgccttcgaattcaggtgaacaaggagaacaaggaatttaaggatttgccaccggagcgggctttcgcagactttgttctttgcaatctagttctccatttggttataatgaacttcctgggataaggacgatacggttggagcatttttggtaaatttatggagttttaccttgtgtgctttatgagtatacaacatagtatcagttttaggctttttccctgttttcttttcagaagcttttcacagactccttatggacgaaagaataatttcgcaaatagacagatttgctgaattaagtttaaatcttaaaactcttatttccaggatgtgcaaatttctttgtcagtttttttgcttctaaaaagacggta

SEQ ID NO: 1787 - DNA, 654 bp, Manihot esculenta
catcgctttttcgtttgaaatggctagatcgaccggcaaggatgcccaagctctcttcagttcacttcgctctgcttatgccgccactccaactagccttaagatcatcgatctctatgtgggttttgcggttttcaccgctctgattcaggtagtttacatggctgtagttggatcatttccatttaattcttttctttcaggagtactttcctgcataggtacagcagtccttgctgtttgtctccgtatccaagtgaacaaagaaaacaaagaattcaaggatttacctccagagcgcgcatttgctgattttgtcctctgcaatttggtgctgcatttggtgatcatgaatttccttggttaacttttagcagccattttggtctgctggatacacattacttgatatttaacttagacaaacaccattacatcaaattctcattggccattacttgggaaacttgccacatgaaatgctgcaatggagttggtattttattttattttcatttaggcttggtggaaaggacttgtctatggaactatttttgagaaaggatttggtttttgttttattttgtttttaactttttgctttttgtttttattgcaatgctgaaaatctatacatgatagtgttttgtgtta

SEQ ID NO: 1788 - DNA, 588 bp, Manihot esculenta
aagtccttcagctgctgcagaacagtgtggagcttcgctttttgatttggaaaatggccagatcgacaggcaaagatgcccaagctctctttagttcccttcgcgctgcttatgctgccactcctactagccttaagatcatcgatctgtacgtgggttttgcggttttcactgctctgattcaggtagtttacatggctatcgtaggatcatttccatttaattcctttctttcaggagtgctttcctgtataggcacagcagtcctcgctgtttgtctccgtatccaagtgaacaaagaaaacaaagaattcaaggatttacctccagagcgcgcatttgctgattttgtcctctgcaacctggtgcttcatttggtgatcatgaatttccttggttaatttttagaatttacttgatatgtaaataagacataattatatagtaggtttaggacacctttacaacaagttcttattggtcgttcttgcgaaacttgccagatgaaatgcttattaatatatatatatatattccatcaaggcttggtggaaaacagggggcactcgaagtttgaatggaaccatc

SEQ ID NO: 1789 - DNA, 687 bp, Citrus sinensis
gagagagagagagagagagagaaagagagattacagagaggaaatggcgagatcgaccggcaaagacgctcaagcccttttccattcccttcgctctgcttatgctgccactcccacaactcttaagatcatcgatctgtatgtgggtttcgcggtttttactgccttaattcaggtagtttacatggctattgttggatccttcccattcaactcttttctttcgggagtactttcttgtgttgggacggccgtccttgctgtttgtctacgtattcaagtgaacaaggacaacaaggaatttaaggacctaccaccagagcgagcttttgcagactttgttctctgcaatttggtgctgcatttggtgatcatgaatttccttggataaaccttgaccctgggtcaacttaaaatacaatttttcttggtcgatgacagtgtgacctagctgtaaaagttagttacgacattaatgcagatatttttcttagaatgtgaacttactataaatgaagatgtggaccatttttggatccttttagttctatatttacaattccaggaactttgtgtctctcgctgcctgtatcggattgacaattacacaaaccttgcggtttcccgatacagagaccggaaacctgagttgcatgactctttctttctagtgatcattggatttcg

SEQ ID NO: 1790 - DNA, 694 bp, Citrus clementina
aaagtgagtcgttgatcagagagaaagacagattacagagaggaaatggcgagatcgaccggcaaagacgctcaagcccttttccattcccttcgctctgcttatgctgccactcccacgactcttaagatcatcgatctgtatgtgggtttcgcggtttttactgccttaattcaggtagtttacatggctattgttggatccttcccattcaactcttttctttcaggagtactttcttgtgttgggacggcagtccttgctgtttgtctacgtattcaagtgaacaaggacaacaaggaatttaaggacctaccaccagagcgagcttttgcagactttgttctctgcaatttggtgctgcatttggtgatcatgaatttccttggataaaccttgaccctgcgtcaacttaaaatacaatttttcttggtcgatgacagtgtgacctagctgtaaaagttagttacgacattaatgcggatatttttcttaggatgtgaacttactataaatgaagatgtggaccatttttggatccttttagttctatatttacaattccaggaactttgagtctcttgctgcctgtatcggattgacaattacacaaaccttgcggtttccgatacagagaccggaaacctgagttgcatgactctttctttctagtgatcattggatttcgccttca

SEQ ID NO: 1791 - DNA, 821 bp, Populus trichocarpa
tcgactcacaaacggcgtcggttttttgttccactgctactacgaattttacaattccctgcatttgcgtagacagactcccataataaaacaaagaaaaagttggaagcttttttcgcggcagttatagtgtctgtgtgtggactgtgtgagattgaaaatggggagaactaccagcaaagacgcacaagcactcatccattcccttcgttctgcttatgctgccactcctactagccttaagatcatcgatctgtatgtgggttttgcagttttcgctgctataattcaggtagtttacatggccattgttgggtcatttccgttcaactcttttctctctggagtactttcttgtattgggactgcagtccttgctgtttgtctccgtatccaagtgaacaaggaaaacaaggaattcaaggatttaccaccagagcgtgcctttgctgattttgttttgtgcaatttggtgctccatttggtgattatgaatttcctaggttaagatcgagcccttctggtctgcaggatccatgtttcgttgggctgtaactgtgaaacatgtttacagagtaattccatctattcagcaaatttttcttaggacatggcttattcttgaattgctgacttgcaattgatatttttgttatttatttgtctgcaatgatgagaagtttgcattgctagtaagaaaatgcaattgagcatactgagaaattgcagtgatcaaacctttgtaatagatccttagctaggaaagtttgtccataaaactgccccttctccctttgaataaatgttatgattgtgaggca

SEQ ID NO: 1792 - DNA, 660 bp, Fagopyrum esculentum
gggggagtatttgccagagcgatgtacgtactaaaccagtaaaccctacccggagaattcaagagatcagagagatcaagggcgagcatttccaatggtgagggctacgagcaaggatgcacaagctctcttccagtctcttctctccgcttacaccgccaccccaactagtctcaagatcatcgacttgtatgttggttttgcgtgttctactgctctgatccaggtggcttacatggcactggttggtacatttcctttcaattcctttctttctggtgtactttcatgtgtaggaacagctgttcttgctgtttgtctccgcattcaagtaaacaaagaaacaaggaatttaaggatttacctccagaacgcgcatttgcagactttgttctttgcaacctggtgctttacttggttattatgaatttccttggataagaaccgtagcatcattggacacggtgaaatgcctaagatagacatagttcttatgagttcacttgaattcttagtgtttcgcaaatagaagctctatttctggctgaatataatggatattatgcaccttttttttgttttgctcttcttgagaaatgagaatgtggatgagcttgcttgaattcttgaagagtttacttctgctctctttggatgatt

SEQ ID NO: 1793 - DNA, 408 bp, Secale cereale
cacagctagaagccgagggcgggagcgggctcgcggcgaagcaagcaaggatgccgaaggccgcgggggatgccaagctcctgatccagtcgctcaccaaggcctacgccgccacgccgaccaatctcaagatcattgacctgtacgtcgttttcgccgtggccactgccctggttcaggtcgtttacatgggaatagttgggtcattccccttcaactctttcctgtctggtgtcctctcatgcatcggaactgcagtgcttggcgtttgccttcggattcaagtcaacaaggacaacgaaggaattcaaggactccgtacccccggaaacggtcctttgcagtattcgtcctgtgcaatctcgtgctccacctggtgatcatgaacctcccgtcggatgagcaact

SEQ ID NO: 1794 - DNA, 540 bp, Fagus grandifolia
aagcactgcaagaagaatagggttggcaatggcgaggcgaccagcaaggacgcccaggctcttttccactctctccgttctgcttatgcagccactcccacaaatctcaagatcatcgatctctatgtggttttcgctgtcttcactgctttgatccaggtagtatacatggctattgttggatcattcccattcaactcgtttctttcaggagtactttcttgcatagggacggcagtccttgctgtttgtctccgcatccaagtgaacaaagaaaacaaggaatttaaggatttaccaccagagcgtgcttttgcagattttgttctctgcaatttggtgcttcatttggttattatgaatttccttggatagattgccatctatggccgttctgtaatgttgttcccctggagagctcactatatatgaaaaaaggacctgcaattgatttttctgtgatttgtttcagatttagaaacttcgtactttattaaagaaacaattacctaaacaaagtttttgttgctactcggcatc

SEQ ID NO: 1795 - DNA, 561 bp, Coffea canephora
agacatctggcaagtcgacggctaagagagagcaagagtgggtgaagaaatggcgagatcgtcgacggcgaaggacgctcaggctcttatccaatctctccgatctgcttatgccgccactccgaccaatctcaagatcatcgatctttatatcatttttgccgtctccactgccctaattcaggtagtgtacatggctcttgttggatcatttcccttcaactcattcctctcaggagtcctttcttgcgttggaactgcagttcttgctgtttgccttcgcatccaagtaaacaaagaaaataaggaatttaaggatttaccaccagagcgtgcttttgcagatttcgttctctgtaacctagtacttcatttggtgatcatgaatttccttggataagctggtgccgtgccctttgactagaagtgactgcgcctgttacaatttttgtttgatatgtaatgtgactataatgcctaattactgaactgagcaagtaggcatatgacattctaactcctccatattttcatgagtaagttcttacttgttttcccaat

SEQ ID NO: 1796 - DNA, 615 bp, Capsicum annuum
gcacgagggtagagtgaagcaaaagaaaaatggcaaagccgtcggcgaccaaagacgcccaagctcttttccattctctccgctctgcttatgccgctactcccaccaatctcaagatcattgatctatatgtcgtgtttgcgatctccactgcgttaattcaggtggtatacatggctcttgttggatcattcccgttcaactcttttctctctggggtgctttcttgtattggcacagcagtccttgctgtttgtcttcggatccaagtaaacaaagaaaacaaggaattcaaggatttgcccccggaacgtgcttttgctgattttgttctctgcaatttagtgctccatttggtgatcatgaactttcttggctagattgaggcaccaaatcccagaaggcgaaaacatgttgctttcttttacaaatctttggtgatttatatgtaaggataatatagagtcaatcgtaaggattttgttaggccttgaaatattttctcatgcatgaacctataacattcatgaatcttatatgagtatcagtgaagtagacaaactttggcccttttgagttctatatagccaaaaaagagacgaacatttttggtat

SEQ ID NO: 1797 - DNA, 850 bp, Eucalyptus grandis
cgggcaacccgccgtgtagactggatagtaggttattgcactccaccgaggagcgaggccggggaggaaagaagacgacgacgacgacgacgacgagggtcgagaagcgaagcgcagggttgcagcaggaagaaagaatggcgagatcgagcggcgacgacgctcaggctctgttccactcgctccgatccgcttacgccgccactcccaagaacctcaagatcatcgatctgtacgtggccttcgccgtcttcacagcactgattcaggttgtttatatggctctggttggctctttccctttcaattcgttcctgtctggggtcctttcttgtattggaacggccgtcctggctgtttgtctccgtatccaagtcaacaaggagaacaaggagttcaaggatttaccacctgagcgtgctttcgcagattttgttctctgcaatttggtgcttcacttggtgattatgaatttccttggttaagctggagccatgggttttgcaggatctacatagcttgaggagtgatcgaatagtagtaaaataactagttgccaattcattttgctttactggactgtgaggtgcaaagctagtgatatgtgctgaatgataggattttgtggattgactggggagcccaaatttatgttcttgtttgaggtacaccaagaaaagaatgatttttcttctgccgagaacaccatagcttgctttatttgattagcttagttttgtatcatggttgtgcttagtctgccgacatttggtcctgtcaaggatgtcaatgggctgtggcatgtcggattttataagtaatccaaaattttctgttctggggagttggt

SEQ ID NO: 1798 - DNA, 805 bp, Eutrema halophilum
agatagaagttcgtaaagagggagtgatgttagtcttcaagactcgcgaagacgaagacgaagacagtagaagaaagagggaaaagggatttgtgattgcttaatcttcgaaaatggtgaaatcgacaagtaaggatgctcaggatctatttcgctctcttcgttccgcttattcggctactccgactaatctgaagatcatcgacttgtatgtcgttttcgccgtcttcactgctctgattcaggttgcttatatggctttggtgggatcatttccatttaactcattcctatctggagttctctcttgtatcggaacagcagttcttgctgtgtgcctccggattcaagtgaacaaagaaaacaaggaattcaaggatttggcaccggagcgagcatttgctgattttgtcctctgcaacttggtcctccacttggtgatcatcaacttccttggataggtttccttctcctattacaggttgttttcatgttttcagatactggagtttttaggtgtcacttggaatcaaaactgtagtttgagatattttatgttattgtcaaagaatcaaacttttagtatctcaataacattttcatgcagtcatgggacccttggttcgctatgcctatattctgaccacttgtaagcttacacgtgtttataatctcaatcttcaagttggtgtgtgagttctgtgccgttcaggtcacacaaacaaactcactacatctttcataagaaacaaaaaagcgaatctaataattgaaccttatctattatgtgtaaaaacatcaggag

SEQ ID NO: 1799 - DNA, 801 bp, Citrullus lanatus
tgtaagtagatttttatctaatcagggccgaattttataaaagggtacaaatgacctttcactcctaaaaactagtgagatttccctagaattttcattttggaggaaaagtcttcattcgtcttccttccttgagattccagagctcgatactactctgccatggcgagatccacaagtaaggacgctcaagctcttttccagtctctccgctcagcttatgccgccactccaacaactctcaagatcattgatctctatgtgatttatgctgtgttcaccgccctgatccaggtagcatacatggcgattgttggatcgttcccattcaactccttcctctcaggagttctttcttgtatcgggacagctgtccttgctgtttgtctccggatccaagttaataaagaaaacaaggaattcaaggatttggcccccgaacgagcttttgcagatttcgtcctgtgcaacctggttctccatttggtgattatcaacttccttggataaaacacctcatcttgggttctactttctttttgccttcagagaatttaattaaacccaggaagtagcttatgctagaaatttcctaccaaacttagcatattagaaagagaaaaagagagagaattcgtgcaacttagttaatgtcattctgagttattttctacggtgatgtttttccagacaatcaaatatgtcaacagttttctggccattatgttgcaaaagtgagaactatgtttatactttctctttaacaatgaaagataacaagaagaaaaaagtaagagagac

SEQ ID NO: 1800 - DNA, 635 bp, Arabidopsis lyrata
agagtagaagtttgtgaagagtgataaaaaagacttgaagactcgcgaagacgaagaaaagcaatcgaagaaatacgaagaagaagagagggattggtgtttgtttgttgttctttgattcgaaatggtgaaatcgacaagtaaggatgctcaggatctgtttcgatctcttcgttcagcttattccgctactccgactaatctgaagatcatcgacttgtatgtcgtttttgctgtcttcaccgctctgattcaggtggcttatatggctctggtgggatcatttccgtttaactcattcctatctggagttctctcttgtatcgggacagcagttcttgctgtttgcctccgaattcaagtgaacaaagaaaacaaggaattcaaggatttggcaccggagagagcttttgctgattttgttctctgcaacttagtcctccatttggtgatcatcaacttcctcggatagaggtttcactctgctatctacaagttgctttcatgtttacatgtactggagtttttaggtgtcacttggaatcaaaactctagtttgagatatttttgttgttgtcaaataatcaaacttttattagtctctctctcaataacacagtctcctgcagtaatgg

SEQ ID NO: 1801 - DNA, 631 bp, Arabidopsis thaliana
atttcagcgagagcaccagactcgtgaagaagagaaaaagaagaagcaggagaaaagtttgcttgctgtgcctgtgttggtcagtctttgaagaaatggtgaaatcgactagtaaggatgctcaggatctcttccattctcttcactctgcttataccgctacaccaacgaatctcaagatcatcgacctttatgtttgtttcgcggtcttcacagctttgattcaggttgcttacatggctcttgttggatcgtttcctttcaactcatttctctctggagttctctcgtgtatcgggacagcggttcttgctgtctgcctccggattcaagtgaacaaagaaaacaaggaatttaaggatttagcaccggagcgagcttttgctgattttgtcctctgcaacttagtcctccacctagtgatcataaacttcttgggataaactaaacacctctcaagccggacataaatctcatgagatttttgagaacaatcactgcacttgctttccatacatcataaactttatttctgatatttgagattttatcatcttagtagcccttatgtgaagagcttgtttttcttttgttaatgctactttctcatagtgattgagccaactccaca

SEQ ID NO: 1802 - DNA, 844 bp, Aristolochia fimbriata
gtaataccgctttcttacttcttggaggtccgagaggaccgcgagtgctcagcgactcaacgcaaagtcgaagcaacagctcgagagcttcacaaacatctgcctgaaatagggagagacaagggtgacaataatggcaaaatctacatcaaaagatgctcaagcgctggttcaatctctgcgctcagcctattctgctacgcctactaatcttaagataatagatctttatgtggtttttgcggttcttactgcagtgattcaggttggttatatggccattgtcggatcatttccattcaattcattcctctcaggagttctctcctgcattggcactgctgtgcttgcagtttgtctccgcatacaagtgaacaaagagaacaaagaattcaaggatttgccaccagaacgtgcttttgcagattttgtgctctgcaatcttgtactccatttggtgatcatgaacttccttgggtaggtgcagttaaaagaccttttgttcccctaggtttcagttaaagaccttttgtgtcccttggtgatgcgataactcactccagatgttcagacatacaaattttgggtatttttatatttcaacgatgagattgagaaaagtctataagcaagtttgagactaaatgatggaactcaaccgggtgaattcgagggtaaaatgtggaccttgaattcttcttttactgtcttattctttgcctttctttcttcaattttaggagagagcagacctggtactaggcgacagtgttgtccactgatgaattttgctccttggtcctacgtacaatttaagcttaatatagattaacatgctatcttt

SEQ ID NO: 1803 - DNA, 541 bp, Brassica juncea
ggagaaaaaagatatttgtgtttgtttgattttctgagaagaatggtgaaatcgacaagtaaggatgctcaggatctattccgttctctacactccgcttattccgctactcccaccaatctgaagatcatcgacttgtatgtcgttttcgcggtcttcactgctctgattcaggtggcttacatggctttggtgggatcatttccatttaactcattcctatctggagttctctcttgtatcgggacagctgttcttgctgtttgcctccggattcaagttaacaaagaaaacaaggaattcaaggatttggcaccggaacgagcatttgcagattttgtactctgcaacttggtcctccacttggtgatcatcaacttcctcggataggttttccatctcttatcttacatgttgcttttgtgttggagtgttttagatgtcactttggaatcagaacttgtagtgttgagataattttatgtttttgtcaaaagaatcagaactttttagtctcaccaataaaacactgttccgtgca

SEQ ID NO: 1804 - DNA, 654 bp, Musa acuminata
tttttcccctgatataaacccatgtgcttcccttcggcatcgacggcggagagaaggcgcggccggtgtccatctgcgctcactcgtctcggattcagaaaagcaagcgctgataatggcaaagtcaaatgcaagtgatgcccaagctctcattcgttcactgcgctcagcttatgctgccacgccaaccaatctcaaaattattgatctatatgtggtgtttgcaatcgccacagcaattattcaggttgtatacatgggaatagttggatcatttcccttcaactctttcctctctggtgttttgtcctgtgtggggacagcagtactggctgtttgtctccgcattcaagtcaacaaagagaacaaggagtttaaggatttacctcctgaacgggctttcgccgattttgttctctgcaatctggtactccacctggtgatcatgaacttcctcggctagctagttgcacttccaaggactctctctctctctctttactggaccaaaatttatgacctccttggccatgcatgcttcatgttacaattacaaagttctgtattggaccaaaatttacaagtactctggtggtgttgttagtgcttttgttagaacattaagaaagtgatggaatgttaaggttggtaata

SEQ ID NO: 1805 - DNA, 743 bp, Ricinus communis
tcactcgtctatgttcgttcagattttcgcacctatttctgttgttatctcatagatctgcactatcaattaaaatcctaaattgctcaacaaaggtcaggctttcagagattgactacaagatcaaacgctctggccagggcgaaactgcatctccttcttctagagctgagtcacattcctaatctaagaaaccaaagacaccttcatagaaaaacagagaggtttgtgttttacggtttgaatggcgagatcaaccagccgggatgcccaagctctattccattcccttcgctctgcatatgctgctactcccactagcctcaagatcattgatctgtatgtgggttttgctgttttcactgctttgattcaggtagtttacatggctattgttggttcctttccattcaattcttttctctcaggagtactttcttgtgttggcacagcagtgcttgctgtttgtctccgtatccaggtgaacaaagaaaacaaggaattcaaggatcttacaccggagcgagcttttgccgattttgtcctctgcaatctggtgctccatttggtgataatgaatttcctaggctaggtttttaggcattttgaaactactggacactggtttcctttcaagtcataaatataaaaatagttccatgcgatcaattcagcaaattgcattggcttttataatgttgcttataaaatattgggtttatcaagaatgattggtttttatc

SEQ ID NO: 1806 - DNA, 846 bp, Ricinus communis
ccggacagaaagcaacccgacccgcaaaacagtctactttagatcagcttctccaaaatacgcttcactcgtctatgttcgttcagattttcgcacctatttctgttgttatctcatagatctgcactatcaattaaaatcctaaattgctcaacaaaggtcaggctttcagagattgactacaagatcaaacgctctggccagggcgaaactgcatctccttcttctagagctgagtcacattcctaatctaagaaaccaaagacaccttcatagaaaaacagagaggtttgtgttttacggtttgaatggcgagatcaaccagccgggatgcccaagctctattccattcccttcgctctgcatatgctgctactcccactagcctcaagatcattgatctgtatgtgggttttgctgttttcactgctttgattcaggtagtttacatggctattgttggttcctttccattcaattcttttctctcaggagtactttcttgtgttggcacagcagtgcttgctgtttgtctccgtatccaggtgaacaaagaaaacaaggaattcaaggatcttacaccggagcgagcttttgccgattttgtcctctgcaatctggtgctccatttggtgataatgaatttcctaggctaggtttttaggcattttgaaactactggacactggtttcctttcaagtcataaatataaaaatagttccatgcgatcaattcagcaaattgcattggcttttataatgttgcttataaaatattgggtttatcaagaatgattggtttttatctatttatctgcaacattagacaattagaaatagttttta

SEQ ID NO: 1807 - DNA, 611 bp, Castanea mollissima
ccattaccatatatttgttgtatagtcaagctcggtagcgagaaagaagaagaagaagaaaaaaagtagggttttgcaatggtgaagtcgacgagcaaggacgcccatgctcttttccactctctccgatctgcttatgcagccactcccactaatctcaagatcatcgatctctatgtggttttctctgtcttcactgctttgatccaggtagtatacatggctattgttggatcatttccattcaactcgtttctgtcaggagtactttcttgcatagggactgcagtccttgctgtttgtctccgcatccaagtgaacaaagaaaacaaggaattcaaggatttaccaccagagcgtgcttttgcagattttgttctctgcaatttggtgcttcatttggttattatgaatttccttggatagattgcaatctatgggcgttctgtaatgttgttccttggacttttactagacttggccataaagtagttattgccattactagactttgccattgatgctgcaatttttcttaggttgtaacttatggagctcgctatatatgaaaaaaggacctgcaactgaattttctatgatttgtttttatt

SEQ ID NO: 1808 - DNA, 714 bp, Cucumis sativus
attagggctgggttttaatataagggtacaaaagacttttcactcacaaaaaactattgaggtttccttaggattttgatttttggacgagaaattttcatttgttcttcttcgtttcctgagattacagagctccatacttctcagccatggcgagatccacgagcaaggacgctcaagctcttttccaatcacttttttcagcttatgctgccactccaacaactctcaagatcattgatctttatgtgatttatgctgtgttcaccgctctgatccaggtagcatacatggcaattgtaggatctttcccattcaactctttcctctcaggtgttctttcttgtatcgggacagctgtccttgctgtttgtctccggatccaagttaataaagaaaacaaggaattcaaggatttggcaccggagcgagcttttgcagatttcgtcctgtgcaacttggttctccatttggtgattatcaacttccttggttaaaatacctcattttggattctacttcttttcttgtttccttttggagaatttatttcagcccaggaaatagcttatgctagaaattccccatcaaacttagcattttagaaagagaaaaagagagaattgctacatcttagttataatgacgttctgagttattttctacaccatgtttttccagtaaatcaaatacgtcaacagttttctggccatt

SEQ ID NO: 1809 - DNA, 671 bp, Eucalyptus grandis
attgcactccaccgaggagcgaggccgaggaggaaagaagacgacgacgacgacgacgacgagggtcgagaagcgaagcgcagggttgcagcaggaagaaagaatggcgagatcgagcggcgacgacgctcaggctctgttccactcgctccgatccgcttacgccgccactcccaagaacctcaagatcatcgatctgtacgtggccttcgccgtcttcacagcactgattcaggttgtttatatggctctggttggctctttccctttcaattcgttcctgtctggggtcctttcttgtattggaacggccgtcctggctgtttgtctccgtatccaagtcaacaaggagaacaaggagttcaaggatttaccacctgagcgtgctttcgcagattttgttctctgcaatttggtgcttcacttggtgattatgaatttccttggttaagctggagccatgggttttgcaggatctacatagcttgaggagtgatcgaatagtagtaaaataactagttgccaattcattttgctttactggactgtgaggtgcaaagctagtgatatgtgctgaatgataggattttgtggattgactggggagcccaaatttatgttcttgtttgaggtacaccaagaaaagaatgatttttcttctgccgagaaca

SEQ ID NO: 1810 - DNA, 765 bp, Cucumis melo
atttatgaatgtaatgtataagtaattagggctgggttttaataaaagggtacaaaagacttttcaccttccatttccttaggattttgacgtttagacgagaaatcttcatttgttcttcttcgttgcttgagattacagagctccatacttctcagccatggcgagatccacgagcaaggacgcgcaagctcttttccaatcgctttgttcagcttatgccgccactccaacaactctcaagatcattgatctttatgtgatttatgctgtgttcaccgctctgatccaggtagcatacatggcaattgtaggatcgttcccgttcaactctttcctctcaggtgttctttcttgtatcgggacagctgtccttgctgtttgtctccggatccaagttaataaagaaaacaaggaattcaaggatttggcacccgagcgagcttttgcagatttcgtcctgtgcaacttggttctccatttggtgattatcaacttccttggttaaaatacctcattttgggttctacttcttttcttgtttcctttggagaatttatttcagcccaggaaatagcttatgctagaaattccccatcaaacttagcattttagaaggaggaaaagagaaaatttctacatcttagttaatggcgttctgagttatttttctacggcatgtttttccagtaaatcaaatacgtcaacagttttctggccgttgcaaaggtgagaaactactttatactctcacttaaataatga

SEQ ID NO: 1811 - DNA, 768 bp, Momordica charantia
gttcattcattgagagcacggaagcaagggagaactggtactccactgttgccatggcgagatccacaagcaaggacgctcaagctcttttccaatcgctacgctcggcttatgccgccactccgacgtctctcaagattattgatctctatgtgatttatgctgtatttacggctctgatccaggtagcatacatggcgattgttggatcattcccattcaactccttcctctcaggcgtactttcttgtattgggaccgctgtccttgctgtttgtcttcggattcaagttaataaagaaaacaaggaattcaaggatttggccccggagcgagcttttgcagactttgttctgtgcaacctggttctccatttggtgattatcaacttcctcggataagacacctatatttggttctgcttcttttcttgtttccttcggagaattatttaaacccaggaagtagcttatgctagaaattttctgccaatcttagaagattagagagagagagaaaaaaggaacgcctgcaactgaactgagtgtcattctgagttatttttctacaggtgagaactttgtttatatattttctttcatttaaacagggaagatagcaaatgaggactttatttcccattttccccattttcctaggactttatttttcagtaatggtgtttaaattctgaaaacaagtttttacaactccttcacaatcacttgaagataaaatttgcaatatagtcttattattattattaac

SEQ ID NO: 1812 - DNA, 695 bp, Carica papaya
gttcctgttcgattgcagtaaattctgaagatagtgaaacctccattagggatctgcaaatggcgagatctacaggcaaggacgctcgagcccttttccactcccttctttctgcttatgctgctacgcctaccaaccttaaggtcatcgatctgtatgtgggttttgcggtattcacagctctaatccaggtagtatacatggctattgttgggtctttcccattcaattcttttctttcaggagtactctcttgtgtaggaactgcagtacttgctgtttgtctccggattcaagtgaacaaagaaaataaggaatttaaggatttaccaccagagcgagcttttgcagattttgttctctgcaacttggtgcttcacttggtgattatgaacttccttggttaggtattgttagtggtttatttatacaacatatctgcatctcaaactttgcaggctgacttacgaggcaatagcaatacagaattattttttggattatatgaattggtacctcattgcatgaatcagatatacaaatttgtttcaaaattctagcggtctgatggttctttatgtcataccaagctggtgacagttgaaaagaagagttgtgatctgaaagggtttttctatagtactttgccagtaccctatctcgaacttacatgtatcaaagtaaaaattttgtgg

SEQ ID NO: 1813 - DNA, 715 bp, Raphanus sativus
ggatagtagattgtgtctagagagataggggtacagtaaaagttgactctaagtctacgagacgagggaggcacaagtagtagaaggaaggagaaatagatatttgtgtgtttgatttttttgagaagaatggtgaaatcgacgagtaaggatgctcaggatctattccgttctcttcactccgcttattccgctactcccactaatctgaagatcatcgacttgtacgtcgttttcgccgtcttcactgctctgatccaggtggcttatatggctttggtgggatcatttccctttaactcattcctatctggagtcctctcttgtattggaacggctgttcttgctgtttgcctccggattcaagtgaacaaagaaaacaaggaattcaaggatttggcacctgaacgagcgtttgcagattttgtcctctgcaacttggtcctccacttggtgatcatcaacttccttggataggtgtccatctcctagtcctatcttaaatgttgctttcatgtcatggagcttttaggtgtcactttggtatcaaaattgtagtttgagatatttatatttctgtcagaatcaaacctttttagacttttagtctctcaagaacattctcatgcactaatgtgacactggtccgctcaggcctgtattgtgacacgtgtcaatattcagagtctttaagttggtgcggtgttgatagaaa

SEQ ID NO: 1814 - DNA, 753 bp, Raphanus sativus
  misc_feature (8)..(8): n is a, c, g, or t
  misc_feature (10)..(10): n is a, c, g, or t
  misc_feature (12)..(12): n is a, c, g, or t
  misc_feature (41)..(41): n is a, c, g, or t
  misc_feature (593)..(593): n is a, c, g, or t
ggacgagngntnagactcgtgaagacaaaaacgaaagcagnagtcgaaagaaaaaaaggagatttgggtttgatcgatcagtgagaagaatggtgaaatcgacaagtaaggatgctcaggatctgttccgatctcttcactccgcttattccgctactcccactaatctcaagatcatcgacttgtatgtcgttttcgccgtcttcactgctttgattcaggtggcgtatatggctttggtgggatcatttccatttaactcattcctatctggagttctctcttgtattgggacagctgttcttgctgtttgcctccggatccaagtgaacaaagaaaacaaggaattcaaggatttggcaccggaacgagcatttgctgatttcgtcctctgcaacttggtcctgcacttggtgatcatcaacttcctcggataggtttccgtctcccattttacagggttgctttcatgttatggactttttagttgcgacttggaaatataacggtagtgttgagatattttatatttctgtcaaagaatactttttatgcactaaacggaacccctggttttgctcggcctaaattcnaaccactcataatccggtgcgtgtcaacagtcgttagtgttggtatgagctctgtgccgttcagtgcaaactgcaatctgatagttgaagctttatctactcgtgttacacgagtagcgaacattgagaagaaatagctatacagttgactttgactcga

SEQ ID NO: 1815 - DNA, 502 bp, Raphanus sativus
  misc_feature (195)..(195): n is a, c, g, or t
gatatttgtgtgtttgattttttgagaagaatggtgaaatcgacgagtaaggatgctcaggacctattccgttctcttcactccgcttattccgctactcccactaatcttaagatcatcgacttgtatgtcgttttcgccgtcttcactgctctgatccaggtggcttatatggctttggtgggatcatttccntttaactcattcctatctggagtcctctcttgtattggaacggctgttcttgctgtttgcctccggattcaagtgaacaaagaaaacaaggaattcaaggatttggcacctgaacgagcgtttgcagattttgtcctctgcaacttggtcctccacttggtgatcatcaacttccttggataggtgtccatctcctagtcctatcttaaatgttgctattcatgtcatggatcttttaggtgtcactttggtatccaaattgtagtttgagatatttatatttctgtcagaatcatatacctattta

SEQ ID NO: 1816 - DNA, 375 bp, Aquilegia formosa
atggcgaagttgtcgacttcttcatcttcaacaacaacaagtgatgctaaagctctatttcaaactcttcgatctgcttattctgctacacctaccaatctcaagattattgatctctatgtgatatttgcaattctcactgctctaattcaggtggtttacatggcacttgttggatctttcccattcaactctttcctctcgggcgttttatcttgtgttgggacagcagttcttgctgtttgtcttcgcatccaagtaaacaaagagaacaaggaattcaaggatttacctccagaacgcgcttttgctgactttgtgctatgcaacttggtgctccatttggtgattatgaatttccttggatagaatgga

SEQ ID NO: 1817 - DNA, 485 bp, Bupleurum chinense
gagagagaagaaaaatggggaagtcgtcggcgacgagtaaggatgctcaactactatttcaatctctccgttctgcctacgcagccactcccactaatttgaagatcatcgatttgtatgtaatttttgctgtctccactgctgtgatccaggtagtctacatggctatcgtagggtcattcccatttaactctttcctgtctggagtgctctcttgtgtgggaactgcagttctagctgtctgtcttcgcatccaggtcaacaaagaaaataaggaattcaaggatttgcctccagaacgtgcatttgcagattttgttctttgcaacttggtgctacatttagtaatcatgaatttccttggatgattatttgttttataacaatcgtattgcggaatcatcaaaactatgtttttgaagtccatcttggtaggatgaaggccccagttgcaaagccatttcagtaggctattagcttttacc

SEQ ID NO: 1818 - DNA, 485 bp, Bupleurum chinense
gagagaaaagaaaaatggggaagtcgtcggcgacgagtaaggatgctcaactactatttcaatctctccgttctgcctacgcagccactcccactaatttgaagatcatcgatttgtatgtaatttttgctgtctccactgctgtgatccaggtagtctacatggctatcgtagggtcattcccatttaactctttcttgtctggagtgctctcttgtgtgggaactgcagttctagctgtctgtcttcgcatccaggtcaacaaagaaaataaggaattcaaggatttgcctccagaacgtgcatttgcagattttgttctttgcaacttggtgctacatttagtaatcatgaatttccttggatgattatttgttttataacaatcgtattgccgaatcatcaaaactatgtttttgaagtccatcttggtaggatgaaggccccagttgcaaaaccatttcagtaggctattagcttttacc

SEQ ID NO: 1819 - DNA, 497 bp, Bupleurum chinense
aagaaaaatggggaagtcgtcggcgacgagtaaggatgctcaactactatttcaatctctccgttctgcctacgcagccactcccactaatttgaagatcatcgatttgtatgtaatttttgctgtctccactgctgtgatccaggtagtctacatggctatcgtagggtcattcccatttaactctttcctgtctggagtgctctcttgtgtgggaactgcagttctagctgtctgtcttcgcatccaggtcaacaaagaaaataaggaattcaaggatttgcctccagaacgtgcatttgcagattttgttctttgcaacttggtgctacatttagtaatcatgaatttccttggatgattatctgttttataacaatcgtattgccgaatcatcagaactatgtttttgttgttgaagtccatcttggtaggatgaaggccccaattgcaaaaccatttcagtaggcttattagcaggcttattagcttttacc

SEQ ID NO: 1820 - DNA, 351 bp, Arabidopsis lyrata
atggcgagatcgtcgactagtaaggatgctcaggatctcttccattctcttcgttctgcttatctcgctacaccgacgaatctcaagatcatcgacctttatgtttgtttcgcggtcttcacagctttgatccaggttgcttacatgtctcttgttggatcgtttcctttcaactcgtttctctcaggagttctctcgtgtattgggacagcggttcttgctgtctgcctccggattcaagtgaacaaagaaaacaaggaatttaaggatttagcaccggagcgagcttttgctgattttttcctgtgcaacttagtcctccacctagtgatcataaacttcttaggataa

SEQ ID NO: 1821 - DNA, 636 bp, Solanum tuberosum
gattgaggtcacacacagaaagaactgaagagtgacaaaaatggcaaagtcgtcggcgaccaaagacgcccaagctctttttcattctctccgttctgcttatgccgcaactccgacgaatctcaagattattgatctatatgtcatctttgcgatctctactgccttaattcaggtggcatacatggctattgttggatcatttccattcaactcttttctctctggggtgctttcctgtattggcacagcagtccttgctgtttgtcttcggatccaagtaaacaaagaaaacaaggaattcaaggatttgcctccggaacgtgcttttgcagattttgttctctgcaatttagtgctccatttggtgatcatgaactttcttggctagattgaggcaccaaatctcaaaaatgtcgctcttacaaatcttggtgatttttatgtaagaataatatagagtcaatcgtaaaggattttgttaggtcctcagaaatattaagtttcccatacatgaaactattaacattcatgaatcttatatgagtatgagtaagtagacaatctttggcccttctgagttctatagcccaaaaggagccaaacttcttcgatatcaaaaaaaaaaaaaaaaaa

SEQ ID NO: 1822 - DNA, 496 bp, Brassica napus
aaaggagatctgatttgatcattgagaagaatggtgaaatcgacaagtaaggatgctcaggatctgttccgatctcttcactccgcttattccgctactccgactaatctcaagatcatcgacttgtatgtcgttttctccgtcttcactgctttgattcaggtggcgtatatggctttggtgggatcatttccatttaactcattcctatctggagttctctcttgtatcgggacagcagttcttgctgtttgcctccggattcaagtgaacaaagaaacaaggaattcaaggatttggcaccggaacgagcatttgctgatttcgttctctgcaacttggtcctgcacttggtgatcatcaacttcctcggataggttcccgtctcctatcttgcagggttgcttccatgttatggacttttttagacgtgacttaaggaatcattactgtagtattgagatattttatatttctgtcaaagaatcgaactttt

SEQ ID NO: 1823 - DNA, 617 bp, Cucurbita pepo
ctggtactgccatggcgagatccaccagcaaagatgctcaagctcttttccaatcgcttcgttcagcttatgctgccactccaacaaccctcaagatcattgatctgtatgtgatgtatgctgttttcacggctctgatccaggtagcttacatggcaattataggttcattcccattcaactccttcctctcaggcgtactttcttgtattgggacggctgtccttgctgtatgtctccggattcaagttaataaagaaataaggaattcaaggatttggctccggagcgagcttttgcagatttcgttctttgcaacctggttctccatttggtaattatcaatttccttggataaacacctcatcttgggttctaattttcttctttcctttggagaattatttaaacctaggaagtagcttatgctagagatttccttccaaacttagcacattagagagagagagagcgagagaaagaaggcatgcaactgagtcaatgtcattctgagtacttttctacagtaatgttttccagacaatgaaatacgtcaacatttcttggccattatgatgcaacagtgagaactatgattattaattttctttgtcact

SEQ ID NO: 1824 - DNA, 552 bp, Cucurbita pepo
caatggcgagatccacaagcaaggacgctcaagctcttttccagtcgcttcgctcagcttatgctgccactccaacaacactcaagatcattgatctctatgtgatttatgctgtgttcacggctctgatccaggtagcatacatggcgattgttggatcgttcccattcaactccttcctctcaggcgttctttcttgtatcgggacagctgtccttgctgtttgtctccggattcaagttaataaagaaacaaggagttcaaggatttggccccggagcgagcttttgctgatttcgttctgtgcaacctggttctccatttggtgatcatctgcttcctcggataaacacctcattttgggttctacttctttcttgctttctttggagaattaatttaaacccagaaagtagcttatgctagaaattttctaccaaacatagcatattagaaagagagagttattcctgcaactgaattaatgtcattctgagttattttctacagtgatgtttttccagacaatcaaatgcgtcaacacttttctgg

SEQ ID NO: 1825 - DNA, 563 bp, Cucurbita pepo
tccagagctcggtattgcaatggcgagatccacaagcaaggacgctcaagctcttttccagtcgcttcgctcagcttatgctgccactccaacaacactcaagatcattgatctctatgtgatttatgctgtgttcacggctctgatccaggtagcatacatggcgattgttggatcgttcccattcaactccttcctctcaggcgttctttcttgtatcgggacagctgtccttgctgtttgtctccggattcaagttaataaagaaacaaggagttcaaggatttggccccggagcgagcttttgctgatttcgttctgtgcaacctggttctccatttggtgatcatctgcttcctcggataaaacacctcattttgggttctacttcttttcttgctttctttggagaattaatttaaacccagaaagtagcttatgctagaaattttctaccaaacatagcatattagaaagagagagttattcctgcaactgaattaatgtcattctgagttattttctacagtgatgtttttccagacaatcaaatgcgtcaacac

SEQ ID NO: 1826 - DNA, 585 bp, Fagopyrum esculentum
cgtactaaaccagtaaaccctacctggagaattcaagagatcagagagatcaagggcaaacatctccgatggcgaggcctacgagcaaggatacacaagctctcttccattctcttctctccgcttacaccgccaccccaactagtctcaagatcatcgacttgtacgttggttttgcgtgttttactgctctgatccaggtggcttacatggcactggttggtacatttccgttcaattcctttctttctggtgtactttcatgtgtaggaacagctgttcttgctgtctgtctccgcattcaagtaaacaaagaaacaaggaatttaaggatttacctccagaacgtgcatttgcagactttgttctttgcaacttggtgctccacttggttattatgaatttccttggataagaaccgtagcatcattcggacacagtgaaatgctaagatagacatagttcttataagttcacttgaatacttagtgtttcgcaaatagaagctctatttctggctgaatataatggatattatgcacttttttttgcccttcttgaggaaatgagaatgtggatgagctt

SEQ ID NO: 1827 - DNA, 626 bp, Brassica napus
agagagatagatttgtgtgttgtaggtttggtcattgagaagaatggtgaagtcgacaagtaaggatgctcaggatctattccgttctcttcactccgcttattctgctactccaactaatctgaagatcatcgacttgtacgttgttttcgctgtcttcactgctctgattcaggtggcttatatggctttggtgggatcatttccgtttaattcattcctgtctggagtactctcttgtgtcgggacggcagttcttgctgtttgcctccggattcaagtgaacaaagaaaacaaggaattcaaggatttggcaccagaacgagcatttgcagattttgtactctgcaacttggtcctccacctggtgatcatcaacttcctcggataggttttcctctcctatcttccagaggttgctttcatgttatggagtttcttagatgtcactttggaatcagaacttgtagttttgagataattttatatttttgtcaaaagaatcaaaactttttcggctctccaataaacactgtttcgtgcactgatggggaccctggactcgaattggtccgcctatatccggaccagtcatagtctgagacgtgtcaataataacaatcttc

SEQ ID NO: 1828 - DNA, 545 bp, Euonymus alatus
gaccaagacccttacaggacggcaagaggactatacgaggctgaggggaagaagagggtttagcaatggcgagatctacaagcaaggatgcccaagacctcttacatactcttcgatctgcttatgccgccacgcctacctctctcaagatcatagatttatatgtcattttcgctgtcttcactgctctgattcaggtggtttacatggccgttgttgggtcattcccattcaactcttttctttcaggagttctttcgtgtgtaggcactgcagtccttgcagtctgtcttcgtattcaagtgaacaaagaaaacaaggaatttaaggatttgccaccagagcgtgcttttgcagattttgttctctgcaacttggtgcttcatttggtcattatgaatttccttggataattgtgagccttcagtctgttggaaattggaataggtctgatgccattgatcagtaattttctttgtttatgagtggaccgttatgaacgctttatgtgttaaatgtggacttgtgatagtgagttttgctat

SEQ ID NO: 1829 - DNA, 707 bp, Fagopyrum esculentum
aggagaattcagagatttactccaatggcgaggacaacgaccaaggatgcgcaagctctattccagtctcttatcgccgcctatggtgctaccccaaccaacctcaagatcatcgacttgtacgttgtttttgctgtgtctaccgctctgatccaggctgtttatatggcactggttgggacatttcctttcaattcttttctatctggtgtactgtcttgcgttggcacggccgtccttgctgtttgtcttcgcattcaagtgaacaaagaaaacaaggagttcaaggatttacctccagaacgtgcgtttgcggactttgttctctgcaatttggttcttcacttggttataatgaatttccttggataagaaccacatcccatcccgactccggatcattatatgtcttgtgaggttatagtttataaacttctttctgattctaactctttgatagaaaacaagtttatctttgaaacatcatttggcctttcttttgagtttaaaatttggtaatgttgagaaaacaagtttatctttggtagtgtaattctatgggctattggtggcataggtagccctcaaccatattttaggctacacttattatggattgacatttaggcacccacaatataatggaaatgatcccactcataattaatctatcgtcctgtagctgaataatccaactcataattaat

SEQ ID NO: 1830 - DNA, 542 bp, Fagopyrum esculentum
aattcaggagaactcagagatttactccaatggcgaggactacgaccaaggatgcgcaagctctattccagtctcttatcgccgcctatggtgctaccccaaccaatctcaagatcatcgacttgtacgttgtttttgctgtgtctaccgctctgatccaggctgtttatatggcactggttggaacattccctttcaattcttttctatctggtgtactgtcttgcgttggcactgctgtccttgctgtttgtcttcgcattcaagtgaacaaagaaaacaaggagttcaaggatttacctccagagcgtgcgtttgcggactttgttctctgcaatttggttcttcacttggttataatgaatttccttggataagaagcgcgtcccacatcctgactccagagccaatatatgtcttatgaggttatagtttatgaacttctttctgatactaaatctttgatagaagaagggagatgtatgagttaattatctctatgcaacctttggggaaattttcaactactccttttgaaccat

SEQ ID NO: 1831 - DNA, 579 bp, Humulus lupulus
tgggtgttgttgatcctagcggcagagaagaacagtggtggaactagaagacgaagaagaagaagaaagaaaggtacaccatggccagatctacgaccaaggacgctcaagctctttttcaatctctccgttctgcttatgcagccacacccactaacctcaaggtcatagatctctacgtggtttttgctatcatgacagctttcattcaggtagcttacatggctattgttggatccttcccattcaattcctttctttcaggagtgctttcttgtattgggactgcagtccttgctgtttgtcttcgcattcaagtgaataaggagaacaaggaattcaaggatttaccagcagagagagcttttgcagattttgttctctgcaacttggtgcttcatttggttataatgaacttccttggataaattagcatctttacctactgtagacaatgaaaatgagacaactactggttactctttttgaagcttgtactgtatgcaacatgagaatgaagttaatgtgggtcagaaattttggattgatataattattaatttaagctacgtagggctg

SEQ ID NO: 1832 - DNA, 938 bp, Phalaenopsis aphrodite
gaagctttctggttcggctactcattctcctttcaaaatctcaaaatcgcgaaaaggctttcggcctgcagagcttagggtttgccgtttttgttcgttctctaacatctacttctatttttctttgatatagtctctttatcctcggcgagtcagcctttggctcgactgcttggtattcttgctcggttgctcgattgctcgattgcttgtgtggctaccgtggcgttatctttgagtatccttctctaatatttcatatttatcaccagagaacaaaaatttgtagattgcaatggcaaagccggcatccaatgatattcttactcttattcgctctttacgctcagcttatgcagcgactcctaccaatctgaagatcattgatctgtatgtgatttttgcaattgccacagcttttattcaggtggtttacatgggaatagttggatcgtttcctttcaactctttcctttcgggtgtactctcttgtgtgggcactgcagtgcttgctgtctgccttcgcattcaggttaacaaagagaacaaggaatttaaggacctccccccagagcgtgcttttgctgattttgttctctgcaaccttgtcctccatttggtgatcatgaacttcctaggctaatatgctaaaattggcttgtgggatgaatcataaatatttcccccggcgtgaggaaatcgctcattttgaatctttgaaattttattgaagaccttgatgttatgttagtctgatagattttgttttaaattaactgatgaggcacaccctatttcttcttccgagagcgcttagttattgggactgatttatttaaataatggcttgcgtatggactctggttctccaactactgcttattgtgttttatgcttttattcatgtcattggtcttatttcaatttcaaatgaaaac

SEQ ID NO: 1833 - DNA, 808 bp, Eutrema parvulum
aaacgacgccgtggagagtagtttgtaaagtgagtgataagtcttcaagactcgtgaagacgaaggaggaggaggaagaagaaaaagagatttgtgtttgtttgtttaatctttgacaacaatggtgaaatcaacaagtaaggatgctcaagatctattcctttcccttcgttccgcttattccgctactccgactaatctgaagatcatcgacttgtatgtcgttttcgctgtcttcactgctctgattcaggtggtttatatggctttggtgggatcatttccatttaactcattcctatctggagttctctcttgtatcgggacggctgttcttgcggtttgcctccggattcaagtaaacaaagaaaacaaggaattcaaggatttggcaccagaacgagcttttgctgattttgtcctctgcaacttggtcctccacttggtgatcatcaacttcctcggataggtttccctctcctatcttaaaggttgctttcatgtcttcatgttatggagtttttaggtatcactttggaatcaaaactgtagtttgagatattttatatttttttttgtcaaaagaaccaaactttgtagcctctcaataacactgtttcatgcaccaatgggacccttgactcgaattggttccctcggccaatattcagaccaaccataaccgaacacgtgccagtaatcacaatcttcaagtttgtgtgagttctgcgccgttcaggtcacactacaacttcacgacacttttaataagagaacaaggaatctaataattgaaagcttatctact

SEQ ID NO: 1834 - DNA, 776 bp, Arabidopsis thaliana
atctagagtataagtttgttaacagtgataaacgacttgaagactcgtgaagacgaagaagaagagcaatcgaagaaaagagggatttgtgtttgtttgttgttcttcgattgaaaatggtgaaatcgacgagtaaggatgctcaggatctatttcgatctcttcggtctgcttattctgctactccgactaatcttaagatcatcgacttgtatgtcgttttcgctgtcttcaccgctctgattcaggtggtttatatggctttggtgggatcatttccatttaactcgttcctatctggagttctctcttgtatcgggacagcagttcttgctgtttgcctccggattcaagtgaacaaagaaaacaaggaattcaaggatttagcacctgagagagcttttgctgattttgttctctgcaacttagtcctccatttggtgatcatcaacttcctcggatagaggtttcactctcctgtctacaagttgctttcatgctttaatgtactggagtttttaggtgtcacttggaatcaaaactctagtttgagatatttttgttgttgtcgaagtatcaaacttttattagtgtctctctcactcaataacagagtctcctgcagtaatggcctaatgggaccctttgattcgattcggttctctcggcctatatataaaccactcagactctgacacttgtcataaaacccaatcctcaagttggtggaattgagttttgtgccgtttatgtcacaaacaaactcacgatactct

SEQ ID NO: 1835 - DNA, 533 bp, Brassica juncea
gcagagtacccggggagatttgtgtgttgtaggtttggtcattgagaagaatggtgaagtcgacaagtaaggatgctcaggatctattccgttctcttcactccgcttattctgctactcctactaatctgaagatcatcgacttgtacgttgttttcgctgtcttcactgctctgattcaggtggcttatatggctttggtgggatcatttccattcaactcattcctgtctggagtactctcttgtgtcgggacggcagttcttgctgtttgcctccgtattcaagtgaacaaagaaaacaaggaattcaaggatttggcaccagaacgagcatttgcagattttgtactctgcaacttggtcctccacctggtgatcatcaacttcctcggataggttctcctctcctatcttacagaggttgctttcatgttatggagtttcttagatgtcactttggaatcagaacttgtagttttgagataattttatatttttgtcaaaagaatcaaaactttttcggctctccaa

SEQ ID NO: 1836 - DNA, 545 bp, Brassica juncea
gaagacgaagacgagatttggttgtttgatagatcattgagaagaatggtgaaatcgacaagtaaggatgctcaggatctgttccgatctcttcactccgcttattccgctactccgactaatctcaagatcatcgacttgtatgtcgttttctccgtcttcactgctttgatccaggtggcgtatatggctttggtgggatcatttccatttaactcattcctatctggagttctctcttgtatcgggacagcagttcttgctgtttgcctccggattcaagtgaacaaagaaaacaaggaattcaaggatttggcaccggaacgagcatttgctgatttcgtcctctgcaacttggtcctgcacttggtgatcatcaacttcctcggataggtccccgtctcctatcttactgggttgctttcatattatggactttttagacgtgacttaaggaatcattactgtagtattgagatattttatatttctgtcaaagaatcgaactttttatgcactaatgagacgcttggtttcgctcggcc

SEQ ID NO: 1837 - DNA, 976 bp, Brassica rapa
aaaacgacgccgtgaagaggaggagagtgataaagtcttcaagactcgtcaagaaagaagaaagagagagagatagatttgtgtgttgtaggtttggtcattgcgaagaatggtgaagtcgacaagtaaggatgctcaggatctattccgttctcttcactccgcttattctgctactccaactaatctgaagatcatcgacttgtacgttgttttcgctgtcttcactgctctgattcaggtggcttatatggcgttggtgggatcatttccattcaactcattcctgtctggagtactctcttgtgtcgggacggcagttcttgctgtttgcctccggattcaagtgaacaaagaaaacaaggaattcaaggatttggcaccagaacgagcatttgcagattttgtactctgcaacttggtcctccacctggtgatcatcaacttcctcggataggttctcctctcctatcttacagaggttgctttcatgctatggagtttcttagatgtcactttggaatcagaacttgtagttttgagataattttatatttttgtcaaaagaatcaaaacttttcggctctccaataaacactgtttcgtgcactaatggggaccctggactcgaattggtccgcgtatatccggaccagtcatagtctgagacgtgtcaataataacaatcttcaagttggtgtgggcgctgtgccgttcagggcacacaacaacaaattcactgacacttttgagaagaaaagagggaatctaaaaataattgaagcttatctactcgtgaaatgaaggagatagatcgctagggtttcgtatgttggaagatgtctacgccggcgctcttaatctctgccgcaaacctgaagctagggttcttaatctccgtcgcaaactttggaagaaagtgaaagagagagaaaagaggggaaatgaggaagatagatcgctaggtttcgtataa

SEQ ID NO: 1838 - DNA, 638 bp, Brassica rapa
aaagagagagagatagatttgtgtgttgtaggtttggtcattgcgaagaatggtgaagtcgacaagtaaggatgctcaggatctattccgttctcttcactccgcttattctgctactccaactaatctgaagatcatcgacttgtacgttgttttcgctgtcttcactgctctgattcaggtggcttatatggcgttggtgggatcatttccattcaactcattcctgtctggagtactctcttgtgtcgggacggcagttcttgctgtttgcctccggattcaagtgaacaaagaaaacaaggaattcaaggatttggcaccagaacgagcatttgcagattttgtactctgcaacttggtcctccacctggtgatcatcaacttcctcggataggttctcctctcctatcttacagaggttgctttcatgctatggagtttcttagatgtcactttggaatcagaacttgtagttttgagataattttatatttttgtcaaaagaatcaaaacttttcggctctccaataaacactgtttcgtgcactgatggggaccctgggactcgaatttggtccgccttatatcgggaccagtcatagtctgagacgtgtcaataataacaatcttcaaac

SEQ ID NO: 1839 - DNA, 790 bp, Brassica rapa
tgtcaagtctcgtgaagacacgaaagcagtagtaggacggaagaagaagaaaaggagatctgtatttgatcattgagaagaatggtgaaatcgacaagtaaggatgctcaggatctgttccgatctcttcactccgcttattccgctactccgactaatctcaagatcatcgacttgtatgtcgttttctccgtcttcactgctttgattcaggtggcgtatatggctttggtgggatcatttccatttaactcattcctatctggagttctctcttgtatcgggacagcagttcttgctgtttgcctccggattcaagtgaacaaagaaaacaaggaattcaaggatttggcaccggaacgagcatttgctgatttcgtcctctgcaacttggtcctgcacttggtgatcatcaacttcctcggataggtccccgtctcctatcttactgggttgctttcatattatggactttttagacgtgacttaaggaatcattactgtagtattgagatattttatatttctgtcaaagaatcgaactttttatgcactaatgagacgcttggtttcgctcggcctaaattctaactactcataatcagatacgtgtcaacagtcgcatggttcatgttggtatgagctctgtgccgttcagagcaactccaaaaggttgtaatctaatagttgaagcttatctactcgtgtgtaaaaacatcagtagcgaacgtggtgtagaagagaaaactgtacagttgttacgtttactacacacaaacacgacttcgtc

SEQ ID NO: 1840 - DNA, 539 bp, Brassica rapa
  misc_feature (133)..(133): n is a, c, g, or t
ggtagtaggacggaagaagaaaaaggagatctgtatttgatcattgagaagaatggtgaaatcgacaagtaaggatgctcaggatctgttccgatctcttcactccgcttattccgctactccgactaatctnaagatcatcgacttgtatgtcgttttctccgtcttcactgctttgattcaggtggcgtatatggctttggtgggatcatttccatttaactcattcctatctggagttctctcttgtatcgggacagcagttcttgctgtttgcctccggattcaagtgaacaaagaaaacaaggaattcaaggatttggcaccggaacgagcatttgctgatttcgtcctctgcaacttggtcctgcacttggtgatcatcaacttcctcggataggtccccgtctcctatcttactgggttgctttcatattatggactttttagacgtgacttaaggaatcattactgtagtattgagatattttatatttctgtcaaagaatcgaactttttatgcactaatgagacgcttg

SEQ ID NO: 1841 - DNA, 1682 bp, Phaseolus coccineus
aatttcttggagtgatttggcaaagacgactttagagttctgtgcgttgaagttggagtttagagaagagaagagaagagaagagggtttttgtggtgcattgccaaatcgcgaagatctgagagaatggcgaggtctagcagcaaggatgcacaagaccttttccgagctctttggtctgcttatgccgcaacccccacaaatctcaagatcattgacctctacgtcatgttcgctgttttcaccgctctcatccaggtagtttacatggctttggtgggatcatttccttttaactccttcctatcaggagtactttcttgtgtcggaactgctgttcttgctgtttgtctcaggatccaagtgaataaagagaataaggaattcaaggatcttgcacctgagcgagcttttgcagattttgttctctgtaatctggtgcttcatttggtgatcatgaacttccttggttaatttgggttcatgtggctgttgttggttttgatcaaaccttggataataaaaagtaatagtagtatacctagacttttgtaatagtatttataggcagtaacttccaactatctgctttagtattttgttgattcccgggtctctgttttgattgtagagaagggtgagttacagaagttattattattttcatggatatctaaatctgagtaatacccaaaacgctgtctgtctttctcaatcacaacgaatctatacatttttcctttgagggcaaattttcaggcatgacgggacacaaaggaataaaggatttaaagggagagattagaccgtggcatgatatactgatatgaatgtgaaaacaataagttgcatgggtggccatgaaccaggatctgacacattactttattgagcaatttatcagttcgtctttccttcacctaactttttatttgctccatggtttctttaatgtatctattccaccattggcttcttcatcaactttatcttttcctattgattatctccgatgagatggagatcgcaaaagggattttgtaggtgtcagtctaatctgagtatcatcaggatgttgtcatctatgaattctgtaaattgtttcatgtaaacagaaaagtttttgatttgtcaacttcacgggggacaagaaaggcaaagcaatcttgaacagggtgagccagccccaataaagttttggcgtcttcctccttacatagtaggctaccatattttggtaaaatactaccgtgtttgacatatagtataatcagtcaagttttctcttactgaataaattggctaaagaagctcttgtcggaacaaaatcgatagcagggaagcttttgccgtgatacaaatctcaacccgaaggaaattaacgtcttagaacgagtttagactgttatggctaagctaaaaaaatggctgtacaaattcagaagggaagaggttatatcttttatggtgtgtttggattggagagtaggtttgatagagtgatttgaatggaaagtttgaataaagtgagattatttgaattgaggtattgtagtgtattaatgagaaaagtttattaaagttggttagtgatgtaatgattgtggaaatttttttatttcttttaaaatgtgtaaaatataagttagtaaatttatctttgttataagaaataaaaaata

SEQ ID NO: 1842 - DNA, 777 bp, Phaseolus coccineus
caaaagagtggatatcttaccatttttgaatgcgtttaatgtttgtttttgttctacgtttagagttctgtgcgttgaagttggagtttagagaagagaagaaaagagaagagggtttttgtggtgcattgccaaatcgcgaagatctgagagaatggcgaggtctagcagcaaggatgcacaagaccttttccgagctctttggtctgcttatgccgcaacccccacaaatctcaagatcattgacctctacgtcatgttcgctgttttcaccgctctcatccaggtagtttacatggctttggtgggatcatttccttttaactccttcctatcaggagtactttcttgtgtcggaactgctgttcttgctgtttgtctcaggatccaagtgaataaagagaataaggaattcaaggatcttgcacctgagcgagcttttgcagattttgttctctgtaatctggtgcttcatttggtgatcatgaacttccttggttaatttgggttcatgtggctgttgttggttttgatcaaaccttggataataaaaagtaatagtagtatacctagacttttgtaatagtatttataggcagtaacttcctactatctgctttagtattttgttgattcccgggtctctgttttgattgtagagaagggtgagttacagaagttattattattttcatggatatctaaatctgcgtaatacccaaaacgctgtctgtctttctcaatcacaacgaatctatacatttttcctttgagggc

SEQ ID NO: 1843 - DNA, 689 bp, Brassica napus
gaaaaacgacgccgtgaagattaggagagtgataagtcttcaagagactcgtgaagaaagagagagatagatttgtgtgttgtaggtttggtcattgagaagaatggtgaagtcgacaagtaaggatgctcaggatctattccgttctcttcactccgcttattctgctactccaactaatctgaagatcatcgacttgtacgttgttttcgctgtcttcactgctctgattcaggtggcttatatggctttggtgggatcatttccgtttaattcattcctgtctggagtactctcttgtgtcgggacggcagttcttgctgtttgcctccggattcaagtgaacaaagaaaacaaggaattcaaggatttggcaccagaacgagcatttgcagattttgtactctgcaacttggtcctccacctggtgatcatcaacttcctcggataggttttcctctcctatcttccagaggttgctttcatgttatggagtttcttagatgtcactttggaatcagaacttgtagttttgagataattttatatttttgtcaaaagaatcaaaactttttcggctctccaataaacactgtttcgtgcactgatggggaccctggactcgaattggtccgcctatatccggaccagtcatagtctgagacgtgtcaataataacaatcttcaag

SEQ ID NO: 1844 - DNA, 690 bp, Brassica napus
gaaaaacgacgccgtgaagattaggagagtgataagtcttcaagagactcgtgaagaaagagagagatagatttgtgtgttgtaggtttggtcattgagaagaatggtgaagtcgacaagtaaggatgctcaggatctattccgttctcttcactccgcttattctgctactccaactaatctgaagatcatcgacttgtacgttgttttcgctgtcttcactgctctgattcaggtggcttatatggctttggtgggatcatttccgtttaattcattcctgtctggagtactctcttgtgtcgggacggcagttcttgctgtttgcctccggattcaagtgaacaaagaaaacaaggaattcaaggatttggcaccagaacgagcatttgcagattttgtactctgcaacttggtcctccacctggtgatcatcaacttcctcggataggttttcctctcctatcttccagaggttgctttcatgttatggagtttcttagatgtcactttggaatcagaacttgtagttttgagataattttatatttttgtcaaaagaatcaaaactttttcggctctccaataaacactgtttcgtgcactgatggggaccctggactcgaattggtccgcctatatccggaccagtcatagtctgagacgtgtcaataataacaatcttcaaga

SEQ ID NO: 1845 - DNA, 511 bp, Cleome gynandra
tttttcgaaagttcgctgaaatggcgagatccactagtaaggatgctcaggatctcttccattctcttcgttatgcttattccgccactccgaccaatctgaagatcatcgacctctatgttggtttcgcggttttcacatctctcatccaggttgcatacatggcacttgttggaacatttcccttcaactcgtttctctctggagttctgtcatgtgttggaacagcagttcttgcagtttgcctacgcattcaagtgaacaacgaaaacaaggaattcaaggacttaccgccagagagagcatttgctgattttatcctctgcaacttggtcctccacctagtgatcatgaacttcctcggataaatccagagtgacgagtgctttcctgcattcaaaattgtgaattttttaggttgtcggcttgaaagatattcattcactagtgaggtatgtttatgaatttttgcagagcattacattaatagtaccccatgtttggccgttgt

SEQ ID NO: 1846 - DNA, 695 bp, Cyamopsis tetragonoloba
  misc_feature (655)..(655): n is a, c, g, or t
  misc_feature (679)..(679): n is a, c, g, or t
cacgaggagggtttaggcttgttcttcttctctattgacactgcgaaacgattacgaagatcagggagagagaaagagagaatggcgaggtcgagcagcaaggatgcacaagaccttttccgcgctctttggtctgcgtataccgctacccctacaaatctcaagatcatagatctctatgtcgccttcgctgtcttcaccgccctcatccaggtagtttacatggctttggtggggtcatttccattcaattccttcctttcaggagtactttcttgcatagggactgcagttctggctgtttgtctccggattcaagtgaacaaagagaataaggaattcaaggatcttgctcctgaacgtgcttttgcagattttgttctctgcaatttggtgcttcatttggtgatcatgaacttccttggttaaattgggttcgtgagctttcttgtttccgtttgaatccttggataataaatattaatagtagtatacctggactttttgctatagtatctataaacatcattagtacttatctaattactttagttttaaatagtcattggcacttaactagttactttggttttatgccgattcccacctcccccttttttcccttttgagtctttgttttaaacacaaatactanagccatctctacattttgaatggnggacaaaaaaaggggg

SEQ ID NO: 1847 - DNA, 505 bp, Glycyrrhiza uralensis
ttctggggctgtgaagacgacttcagttgaagaccagttccagtggaagttgaggcagagagagagagagagagagaggttggagaagaagagtggagtgaagagaagagagagttgaagaagagaatggcgaggtctagcagcaaggatgcccaagacctttttcgcgctctttggtctgcttattccgcaacccctacaaatctcaagatcattgatctctatgttgcgttcgctgtctccaccgcccttatccaggtagtttacatggctctggttggatcatttccatttaactccttcctttctggtgtactttcttgcatagggactgcagttctggctgtatgtctccggatccaagtgaataaagagaataaggaattcaaggatcttgcgcctgagcgtgcttttgcagattttgttctctgcaatttggtgctccatttggtgatcatgaacttccttggttaaattaaattgggctcgtgtggcttttgtcgtt

SEQ ID NO: 1848 - DNA, 677 bp, Cajanus cajan
ggagtttggtgcgttgaatttggagaagaccagagtgaaggtagaagagaagagagggtttgtgttttcgtaaaatctcgaagatctgagagaatggctcggtctagcagcaaggacgctcaagaccttttccgtgctctttggtctgcttatgctgcaacgcctactaatctcaagatcatcgatctctatgtcctcttcgctgtcttcaccgccctcattcaggtagtttacatggctttggtgggatcgtttccatttaactctttcctatcaggagtactttcttgtgtaggaactgctgttctggctgtttgtctccggatccaagtgaataaagagaataaggaattcaaggatcttgcacctgaacgcgcttttgcagattttgttctctgcaatttggtgcttcatttggtgatcatgaatttccttggttaaattgggtttgtgtggctgttgtttctgattgaacccttggataaaaatgaatagtatacctagagattttgccatttatgttgattccccattccccctcaccatttttgtatctctgttttgaacgtagagattttgccatcttttgaagttcaaactacttttgaatggtgactacagaaggtgtccacatggatatctaaatcttaaagatgccaagttgtagtcacaagaaa

SEQ ID NO: 1849 - DNA, 921 bp, Cajanus cajan
caagacagagtgaaaatggtgatgttagtaggacaattggagtttggtgcgttgaatttggagaagaccagagtgaaggtagaagagaagagagggtttgtgttttcgtaaaatctcgaagatctgagagaatggctcggtctagcagcaaggacgctcaagaccttttccgtgctctttggtctgcttatgctgcaacgcctactaatctcaagatcatcgatctctatgtcctcttcgctgtcttcaccgccctcattcaggtagtttacatggctttggtgggatcgtttccatttaactctttcctatcaggagtactttcttgtgtaggaactgctgttctggctgtttgtctccggatccaagtgaataaagagaataaggaattcaaggatcttgcacctgaacgcgcttttgcagattttgttctctgcaatttggtgcttcatttggtgatcatgaatttccttggttaaattgggtttgtgtggctgttgtttctgattgaacccttggataaaaaaatgaatagtatacctagagattttgccatttatgttgattccccattccccctcaccatttttgtatctctgttttgaacgtagagattttgccatcttttgaagttcaaactacttttgaatggtgactacagaaggtgtccacatggatatctaaatcttaaagatgccaagttgtagtcacaagaaatttgtaattttttcggtgagattaaattttcggacatgacaggagaccaacgaatataaggatcaaaagggggagaggattggtgagtagggtaatatattacagctgattccatagtgatgcttccaaaagagcaaacgaagctgcgtagcatatggcatggtatatcgaagaaaatgaaaaaataaaaaataaaaaaataac

SEQ ID NO: 1850 - DNA, 812 bp, Populus trichocarpa
gtttggtccttccaattagcaatccctaaaattgacttcttagggcaattccctgcatagactccacctccgataaaaacaaagaaaaagttggaagctttgcgctagttagtgttgataatggcgagaacgaccagcagagacgctcaagctctcttccaatcccttcgttctgcgtatactgccactcctactagcctcaagattatcgatctgtatgtggtttttgcagttttcactgctataattcaggtagtttacatggccattgttgggtcatttccattcaactcttttctttctggtgtactttcttgtgtagggactgcagtccttgctgtttgtctccgtatccaagtgaacaaggaaaacaaggaattcaaggatttaccaccagagcgtgcgtttgctgattttgttctctgcaacttggtgctccatttggtgattatgaatttcctaggttaaggttgagccctgctggctccctgttttgttgggctgtagctgtgaaacatatttatagagtaattttatcaattcaagcaaattttcataggacatggcttataagtgaattgctggattgcaattaagatttttggtgcttagttgtttgctttgatgagaagtccgtattgctcgcaaggaaatgctatttagcattgatcaaacatggtttatagatcctttacctagaaaggtgtgtcctaaaaaactttccctttccttcccttgaatgattgttaggcgtggttagatgttggctttgatttccaataaaacagaaacttttcgtgttttcaagtaaa

SEQ ID NO: 1851 - DNA, 728 bp, Raphanus sativus
ggggtagtagaaggaagaagaaagagagatcagagattgagaaagaatggtgaaatcgacaagtaaggatgcgcaggatctattccgttctcttcactccgcttactccgctactcccactaatctcaagatcatcgacttgtatgttgttttcgctgtcttcactgctctgattcaggtggcttatatggctttggtgggatcatttccgtttaattcattcctgtctggagtgctctcttgtgttgggacggcagttcttgctgtttgcctccggattcaagttaacaaagaaaacaaggaattcaaggatttggcaccggaacgagcatttgcagattttgtactctgcaacttggtcctccacttggtgatcatcaacttcctcggataggttctcctctcctatcacaccgaggttgctttcatgttatggagtttcttagttgtcacttggaatcagaacttatagttttgagataattttgtactgtatttgtcaaaagaatcaaaccttttcggctctccaataaaacactgtttcgtgcactaatggcgatcccctggactcgaattggttggcctccgtccgggccaatcatagtctgagacgtgtcaataataacgatcttcaagttggtgtgggctcttgtgccgttcagggcacacaacgacaaatcactgacacttttgatatgaaaagagggaatctaaaaataattgaagca

SEQ ID NO: 1852 - DNA, 566 bp, Cichorium intybus
aacgcacgagggtgtctctgtgtgagaaaaaaaggagaaatggggagggtcgccgacgacgaaagatgatgcacaggctctttttcaatctctccgatctgcatatgccgctactccgactaatctcaagatcatagatctgtacgtggtgtttgctgtgtccaccgctgtaattcaggtggtttacatggcaatagtgggatcatttccattcaactcttttctctcgggtgtgctttcttgtgtagggacagctgtcctagctgtttgtttgcgtattcaagtgaacaaagaaaacaaggaattcaaggatttaccaccagaacgcgcttttgcagactttgttttatgcaatttggtgcttcatttggtgattatgaatttccttggataagttatattaatgaattttgatatgagggagttgaattatgtaatgacaatagaataattgtttcgaacctttttagctattaaatttcaaagaattagaaaccaatattacaatgaggtctatttagtttattttaatttcatatttccgtttggtggataatttcaaggtc

SEQ ID NO: 1853 - DNA, 1772 bp, Lactuca sativa
tattaaacactactaataatagtaataaacgaaaaaagtaaaacaaagccttcggtgtaacagatgtagcctaacaattgaacaatatgtcttgcattgaattacaaatttcgaaatgaaatgactaaacagacctcattgcaaaacccaatttctatttctttgacattttaaaagttttaaaggttcgacttaattattatatcaaaattcagtcatataatattctttatatattaaacctatccaaggaaattcataatcaccaaatgtagcaccaaattgcatagaacaaagtctgcaaaagcacgctcaggaggtaaatccttgaattccttgttttctttgttcacttgaatacgaagacaaacagctaggacagctgtcccaacacaagaaaggacaccagagagaaaagagttgaatggaaatgacccaaccactgccatgtaaaccacctgaattacagcggtgaacacagcaaaagccacgtacagatctatgatcttgagattagtaggagtagcggcataagcagatcggagagactgaaaaagagcctgtgcatcatctttcgtcgtcggcgatctccccatttcctctgatcacagtttctgtgcgtttactcttcagtctcccccggccgtacggccgggatacgactttgttcttcatcttcttccccctttcacccacttctctccttccaaaaacccaaaatctcccatcaaaatccccaattcctacatgtaggaaacgcaatcacgattcaaaccaattgaatcttgcaacatgggttgtgggaatttcttcttcactctcacaataacgttttcagtagctctaatcacatacaacatcatcatttcagccaacgctccactcaggcaagaactcccaggctcatcacaaggggttctctctgttgacccgataatcaagatgccggggaatagaaagtcagctttggccgataagaagaggatgtttcatactgcagttactgcatctgattctgtttataacacatggcagactaggatcatgtactattggtttaagaagatgaaggaaaacggcggagtgaattgcgaaatgggcggatttacgaggatcttacattctggaaaagccgatcagttcatggatgagatcccgacttttgttgctcagccacttccagctggaacagatcagggttatatagtcctcaatcgaccctgggcatttgtgcaatggctacaacaagtcgacattaaagaagactatatattaatgtcagagccagatcatgttattgtaaaaccaataccaaatttatccaaaaatgggcttggagcagcttttccttttttctacattgagcctaaaaaatacgagccaattcttagaaaattctacccagaagaaaaagggccaattaccaatattgaccctataggaaattcacctgttatcgttggaaaggaatctcttaaaaagatagctcccacatggatgaatgtgtctttggccatgaaaaaagaccctgaagctgataaggctttcggttgggttcttgaaatgtatgcttatgctgtttcatctgctttgcatgatgttggaaacatcttacataaagacttcatgcttcagccaccatgggatacagaaattggggagaagtttattattcactacacgtatggatgtgattatgatatgaagggtaaattgacatatggaaaaattggagagtggagatttgataaaagatcatttgacacaatcta

SEQ ID NO: 1854 - DNA, 711 bp, Centaurea maculosa
  misc_feature (18)..(18): n is a, c, g, or t
  misc_feature (664)..(664): n is a, c, g, or t
tattctctgtgtgtgtgngtgtttgtgtgtgtgagaaaaggagtgaaaatggggaaatcggcgaccaccaaagacgatgctcaagctctatttcaatctctccgatctgcttactctgctactccaactaatctcaagatcatagatctatacgtggtgtttgctgtgttcactgccctaattcaggtggtttacatggcaatagttgggtcgtttccattcaactcttttctctcgggtgtgctttcctgtgtagggacagccgtcctagctgtttgtcttcgtattcaagtgaacaaagaaaacaaggaattcaaggatttacctccagagcgcgcatttgcggatttcgttctatgcaatttggtgttgcatttggtgattatgaatttccttggatgagttgagatggatgcattttaatgaggtagtagcagcaatagatctcttggggtattgctttgtgatgctttgagtcttgaattgtggattgacagtaggataattattatgaagcttttaaaattttgaatctcaaaagaattggatacttcttatattgtattctcattagttccttttttatctttttctcacattttctttataagccgggggtctttatagaaacagtcgttctaccccatatccgagatattgttanatgagtttgatttggtttgcttgttagttcgaaaaaaaacaagaaag

SEQ ID NO: 1855 - DNA, 524 bp, Senecio madagascariensis
gacatgatgacgaaagatgacgcacaagctttatttcaatcgctccgatctgcttattcagctactcctactaatctcaagatcatagatctgtacgttgtgttcgctgttttcaccgccttaattcaggtggcttacatggcaatagttgggtcgtttccatttaactcttttctctcgggcgtgctttcttgtgttggcacagcggtcttagctgtttgtcttcgtattcaagtcaacaaagaaaacaaggaattcaaggatttacctccagaacgtgcttttgcggatttcgttctctgcaatttggtgctgcacttggtgatcatgaatttccttggataagttgtgtctttatgactgcattttgacaagggaataggaaatagatctcttggtttcgctttttgatgctgagtcttgaattatgtattgccaataggaaaaattatcccgaacattttaagtactttgaaacatcaaagaatatttacttataaatgcaatgaggtccatttatgtag

SEQ ID NO: 1856 - DNA, 656 bp, Solanum phureja
cattctcactccatcgaaattgaggtcacacagaagaactgaagagtgacaaaaatggcaaagtcgtcggcgaccaaagacgcccaagctcttttccattctctccgttctgcttatgccgcaactccgacgaatctcaagatcattgatctatatgtcatctttgcgatctctactgccttaattcaggtggtatacatggctattgttggatcatttccattcaactcttttctctctggggtgctttcctgtattggcacagcagtccttgctgtttgtcttcggatccaagtaaacaaagaaaacaaggaattcaaggatttgcctccggaacgtgcttttgcagattttgttctctgcaatttagtgctccatttggtgatcatgaactttcttggctagattgaggcaccaaatctcaaaaatgtcgctcttacaaatcttggtgatttttatgtaagaataatatagagtcaatcgtaaaggattttgttaggtcctcagaaatattaagtttcccatacatgaaactattaacattcatgaaatcttatatgagtatcagtaagtagacaatctttggcccttctgagttctatagcccaaaaaggagccaaactttttcggtatcaaattattttgcctttttcttt

SEQ ID NO: 1857 - DNA, 844 bp, Solanum lycopersicum
ggtcattttcatttttacttttaacgccttcggggtttagaccgtccattctcactccatcgaaattgaggtcacacaagagaactgaagagtgacaaaaatggcaaagtcgtcggcgaccaaagacgcccaagctcttttccattctctccgttctgcttatgccgcaactccgacgaatctcaagatcattgatctatatgtcatctttgcgatctctactgccttaattcaggtggtatacatggctattgttggatcatttccattcaactcttttctctctggggtgctttcttgtattggcacagcagtccttgctgtttgtcttcggatccaagtaaacaaagaaaacaaggaattcaaggatttgcctccggaacgtgcttttgcagattttgttctctgcaatttagtgctccatttggtgatcatgaactttcttggctagattgaggcaccaaatcttgaaaatgttgctcttacaaatcttggtgatttttatgtaagaataatatagagtcaatcgtaaaggattttgttaggctttcggaaatattaagtttctcatgcatgaaactattttacatttatgaatcttatatgagtattagtaagtagacaatctttggccattctgagttctatagcccaaaaaggagccaaactttttcggtatcaaattattttgcctttttctttccaagtggtgacaccagtagcctgaacttgttccaacacttgatcatgaactgtgtgcatatccttgggcagattactcacaaagagaggaactctatgaccatttctttattggtatttttgatatcactataatgtatgg

SEQ ID NO: 1858 - DNA, 713 bp, Euonymus alatus
atacgaggctgaggggaagaagagggtttaacaatggcgagatctacaagcaaggatgcccaagacctcttacatactcttcgatctgcttatgccgccacgcctacctctctcaagatcatagatatatatgtcattttcgctgtcttcactgctctgattcaggtggtttacatggccgttgttgggtcattcccattcaactcttttctttcaggagttctttcgtgtgtaggcactgcagttcttgcagtctgtcttcgtattcaagtgaacaaagaaaacaaggaatttaaggatttgccaccagagcgtgcttttgcagattttgttctctgcaacttggtgcttcatttggtcattatgaatttccttggataattgtgagccttcattctgttgggaattggaataggtctgatgccatttatcagcaattttctttgtttatgggtgggccgttatgaacgctgtatgtgttaaatgtgcacttgtgatagttgagttttgctataaattttcaaatttcttgaaatttgtattattagattaaggtaggagtaatatcaattggaaataagtttctcgaaaaatatttaagatagtatggacatgtataatatagagatggtggtgaaaatttgtataagaggaattgagagcgatgaagacaacctaaacagacgtggtaaatagaatccatttttatgggg

SEQ ID NO: 1859 - DNA, 669 bp, Linum usitatissimum
agacttcttctgctgctgctcagttgcctggatcctatctctcttcgtctcatttcgatcttacttcgaaaatggcgcgatctacagtgaaggacacgcaggcactcttccagtcccttcgatctgcttacgccgccacgcctaacaacctcaagatcatcgatctctacgtggctttcgctgtcttcaccgccgtaattcaggtggtttacatggccgttgtaggttcattccctttcaattcattcctctccggagtgctttcttgcattggaactgcagtgctcgctgtttgtctacgcatccaagtgaacaaggacaacaaggacttcaaggatttggcaccagagcgagcttttgccgatttcgttctatgcaacttggtgcttcacttggtgatcatgaacttcctgggctgaagtgtgcaactcccagccgcgacctttgttcacatctcttttaagttgctgaacttttttagtcgagataggaattttttcaatagtactgttaaaacaatatgatgatacagtgaacacactttcgatcaatgccgatattgaatagagtatgttaagggtcacagaggctgtaaactggcgtttcttttaccggtattgtttgtatgttgcttctgcgtaatcaaattgagtcccggaatgattgtac

SEQ ID NO: 1860 - DNA, 627 bp, Linum usitatissimum
gctgctcagttgcctggatcctatctctcttcgtctcatttcgatcttacttcgaaaatggggcgatctacagtgaaggacacgcaggcactcttccagtcccttcgatctgcttacgccgccactcctaacaacctcaagatcatcgatctgtacgtcgctttcgctgtcttcaccgctgtaattcaggtggtgtacatggcagttgtgggttcattccctttcaattcgttcctctccggagtgctctcttgcattgggactgcagtgcttgctgtttgtctacgcatccaagtgaacaaagacaacaaggacttcaaggatttggctccagagcgcgcttttgccgatttcgttctatgcaacttggtgcttcacttggtgatcatgaacttcctaggctgaagcgtgcaactcctagccgcaaccggtgttcacatttcttttaagttgctgaactttcgtagacaagataggaaattttccatagtactgctaaacaatatgatgctacagtgaacacacttttttcaataatgccaatattgaatagaatatgttaagggccacagtggctgtgaactgttgtttctttactggtatcattcgtatgctgcttctgcgtaa

SEQ ID NO: 1861 - DNA, 839 bp, Phalaenopsis aphrodite
aaaatctcaaaatcgcgaaaaggctttcggcccgcggagcttagggtttgccgtttttgttcgttctctaacatctacttctatttttctttgatatagtctctttatcctcggcgagtcagcctttggctcgactgcacgatattcttgctcggttgcacgatattcttgctcgattgcttgtgtggctaccgaggtgttatctttgagtatccttctctaatatttcatatttgtcaccagagaacaaaaattcgtagattgcaatggcaaagccggcatccaatgatattcttactcttattcgctctttacgctcagcttatgcagcgactcctaccaatctgaagatcattgatctgtatgtgatttttgcaattgccacagcttttactcaggtggtttacatgggaatagttggatcgtttcctttcaactctttcctttcgggtgtactctcttgtgtgggcactgcagtgcttgctgtctgccttcgcattcaggttaacaaagagaacaaggaatttaaggacctccccccagagcgtgcttttgctgattttgttctctgcaaccttgtcctccatttggtgatcatgaacttcctaggctaatatgctaaaattggcttgtgggatgaatcataaatatttcccccggcgtgaggaaatcgctcattttgaatctttgaaattttattgaagaccttgatgttatgttagtctgatagattttgttttaaattaactgatgaggcacaccctatttcttcttccgagagcgcttagttattgggactgatttatttaaataatggcttccgtatggactctggttct

SEQ ID NO: 1862 - DNA, 834 bp, Plantago ovata
gggctgactctctgtctgtaattccatcttcgcgtattccatagtcgcgaaaatggcgagatcgaccacaaaggatgctcaggcgctcttccgttctctccgctctgcttacactgctacgcctaccaatttaaagatcattgatctatacattgtgttcgctattgccactgctctcgttcaggtggtttacatggctcttgttggatcttttccgttcaactcatttctttctggggtactttcatgcgtggggactgctgtcctggctgtttgccttcgaattcaagtcaacaaagaaaacaaggaattcaaggatttgcctccagaacgtgcttttgcagattttgtactctgcaacttggtgcttcatttggttatcatgaacttcctcggataaattgaatgtgtccatcatgcctggttgagagtctcttaaagtgtctatgtagaagaaaaacccagattttggttcaaagatatgacagtaattttgagaagtattagatattaatcacctctcttctggcagtgtagctttttcgccaggtcttgaattgatactagtatatacactctggcatgttatgggtgctcatttctgctgttgctttcatatatgtcactctaacctacatgagcaaaacctattcaacatgggtaatccatgggactccctatgcttatgtggcagcatatagtccgaccccccccccccctttcctgttctttggcatgtttcctgtccaaattgttttgcaacaggggtgtactttgatcttgcattgatcttgagtgtgtctatttgctttgcatgtggtcctcatgagtcac

SEQ ID NO: 1863 - DNA, 628 bp, Brassica juncea
ctcttccgatctctcggggaagacgaagacgagatttggttgtttgatagatcattgagaagaatggcgaaatcgacaagtaaggatgctcaggatctgttccgatctcttcactccgcttattccgctactccgactaatctcaagatcatcgacttgtatgtcgttttctccgtattcactgctttgattcaggtggcgtataaggctctggtgggatcatttccatttaactcattcctatctggagttctctcttgtattggtacagccgttcttgctgtttgcctcaggatccaagtgaacaaagaaaacaaggaattcaaggatttggcgccggaacgagcatttgctgatttcgtcctctgcaacttggtcttgcacttggtgatcatcaacttcctcggataggtttccgtctctcctatcttacatgatatggagtgttttaggtgtcacagtattgagatattttatatttctgtcaaaagaatgcactacacttttaataagaaagaaggggaatacaaacattgaagcttatctactcgtgtgtaaaaacatattgactttgaaatgtcttattttgtcaactagaaaccatttaagactttatcattgttacaat

SEQ ID NO: 1864 - DNA, 727 bp, Brassica oleracea
  misc_feature (10)..(10): n is a, c, g, or t
gagtcgaagnaggaagaaagagagatagatttgtgtgttgtaggtttgatcattgagaagaatggtgaaatcgacaagtaaggatgctcaggatctattccgttctcttcactccgcttattctgctactccaactaatctgaagatcatcgacatgtacgttgttttcgctgtcttcactgctctgattcaggtggcttacatggctttggtgggatcatttccattcaactcattcctgtctggagtactctcttgtgtcgggacggcagttcttgctgtttgcctccgtattcaagtgaacaaagaaaacaaggaattcaaggatttggcaccagaacgagcatttgcagattttgtactctgcaacttggtcctccacctggtcatcatcaacttcctcggataggttctcctctcctatcttacagagtttgctttcatgttatggagtttcttagttggaatcagaacttgtagttttgagataattttatacttttgtcaaaagaatcaaacctctctaataaacactgtttcgtgcactaatggggaccctggactcgaattggttcgcctatagccggaccagtcatagtctgagacgtgtcaataatgacaatcttcaagttggtgtggacgctgtgccgttcagggacacaacacaaattcactgacacttttgataagaaaagagggagcctaaaaataattgaagtttatctac

SEQ ID NO: 1865 - DNA, 970 bp, Beta vulgaris
aacaaatctgaaacgaaaaagagcaaaaaccaaagtgagtcgacttcgagtaattgagtttctgcacagaagagtgagaactgagaagggaaagagttgtagagagagaaagcatggcgaagtcaacaaccaaggacgctcaagccttgttgcagtctctccgatctgcttatgccgccacaccgactaatctgaagattatcgacctttacgtcatttttgctatttcgaccgctctaattcaggtggtttacatggcagttgttggatctttcccattcaactcttttttgtctggtgtactttcttgtgttggtacagctgttcttgctgtctgtcttcgcattcaggtgaacaaggaaaataaagaatttaaggatttagctccagagcgagcctttgcggactttgttctttgcaatctagttctccatttggttattatgaatttcctgggataaggtggagcaagtggaaaagttgcagctttttaccttgtgctttttgagtatacaacgtagcattagttataggtggttttcctgtttccttttcagaagctaatatagatgtaattcgatggaaatggatggcagatactcaatttttgcacaatgatgtttaaaccttaaatccttgtaatctcaggatggatgtagcctgttgcgttggctggtcgtaaatttatgaatctttttatgttctgtttggatcagagcatttcatttcaaatgaagaatttggctgacttcagcgacttggaaatagcaagcatttgcagttcgatttggtccaattccatacacatgctaaaaacaagccaaaatgaggattccaaatccctactataaacctctcatttcaatttccaactatcagatgtttattactccatttatttctgcatctttaaccatcacagtttcatcaaagcttcaatttctctctcctcagtccatttatcctcttt

SEQ ID NO: 1866 - DNA, 724 bp, Beta vulgaris
  misc_feature (151)..(151): n is a, c, g, or t
cggacgcgtggggagtaattgagtttctgcacagaagagtgagaactgagaagggaaagagttgtagagagagaaagcaatggcgaagtcaacaaccaaggacgctcaagccttgttgcagtctctccgatctgcttatgccgccacaccnactaatctgaagattatcgacctttacgtcatttttgctatttcgaccgctctaattcaggtggtttacatggcagttgttggatctttcccattcaactcttttttgtctggtgtactttcttgtgttggtacagctgttcttgctgtctgtcttcgcattcaggtgaacaaggaaaataaagaatttaaggatttagctccagagcgagcctttgcggactttgttctttgcaatctagttctccatttggttattatgaatttcctgggataaggtggagcaagtggaaaagttgcagctttttaccttgtgctttttgagtatacaacgtagcattagttataggtggttttcctgtttccttttcagaagctaatatagatgtaattcgatggaaatggatggcagatactcaatttttgcacaatgatgtttaaaccttaaatccttgtaatctcaggatggatgtagcctgttgcgttggctggtcgtaaatttatgaatctttttatgttctgtttggatcagagcatttcatttcaaatgaagaatttggctgacttcagcgac

SEQ ID NO: 1867 - DNA, 720 bp, Brassica napus
gtcgaaggaagaagaaagagagatagatttgtgtgttgtaggtttgatcattgagaagaatggtgaaatcgacaagtaaggatgctcaggatctattccgttctcttcactccgcttattctgctactccaactaatctgaagatcatcgacatgtacgttgttttcgctgtcttcactgctctgattcaggtggcttacatggctttggtgggatcatttccattcaactcattcctgtctggagtactctcttgtgtcgggacggcagttcttgctgtttgcctccgtattcaagtgaacaaagaaaacaaggaattcaaggatttggcaccagaacgagcatttgcagattttgtactctgcaacttggtcctccacctggtcatcatcaacttcctcggataggttctcctctcctatcttacagagtttgctttcatgttatggagtttcttagttggaatcagaacttgtagttttgagataattttatatttttgtcaaaagaatcaaacctctccaataaacactgtttcgtgcactaatggggaccctggactcgaattggttcgcctatatccggaccagtcatagtctgagacgtgtcaataatgacaatcttcaagttggtgtgggcgctgtgccgttcagggaacacaacaacaaattcactgacacttttgataagaaaagagggagcctaaaaataattgaagtt

SEQ ID NO: 1868 - DNA, 1541 bp, Brassica napus
ttatatttaaacccattaggctaacatgagtacaagtggatcttttatgaacacagcccaatcacacaacaaacccacccaagcccaacaaaattagataagatcaataacacatgttcaaatcgagctctctggaagctcttccacgtgtcgctctacgcatctgttgaaggatgagtcgtcgcttggtttgcttgagatcccaccgatcttcttctccggctagaagcaaaaactactctccgaccatggtgagattcctccggtttgatccacttgcttctcccttcccctatctaccgtcgagactaagaagatttcaagacttcctccggatgtgaacagtagtgaaaagcttcataagaatcccggaaagagactttgttgaaacacttctctatatgagaaacttcaactctactgagtcttccgaaaattcccaagcaaaatcaataaactcactgactaaatttgatcagatacttttcttagaggcacatgccaatattttagaaagcaaagattgattcttttcaaatattagccatgagaataaccggagtaaaaccatcatctcttcaatatcaaacgggatttaaagagggtgaaaatcaaaagagaagggaagatgaaactaaactaaaacaccacaaaaagatcgccaagcgaagatgatatccgctaccggaaatttagatcgatcttcaagatcgaatttattatacaagaacaaacaaaaaaaccaaagggaggtggtgaccggcggcgagaagccaccggccaccggaaacgtaaattttttttttttttagtctagtgagaagttagagagaatagagagagatagatttgtgtgttgtaggtttgatcattgagaagaatggtgaaatcgacaagtaaggatgctcaggatctattccgttctcttcactccgcttattctgctactccaactaatctgaagatcatcgacatgtacgttgttttcgctgtcttcactgctctgattcaggtggcttacatggctttggtgggatcatttccattcaactcattcctgtctggagtactctcttgtgtcgggacggcagttcttgctgtttgcctccgtattcaagtgaacaaagaaaacaaggaattcaaggatttggcaccagaacgagcatttgcagattttgtactctgcaacttggtcctccacctggtcatcatcaacttcctcggataggttctcctctcctatcttacagagtttgctttcatgttatggagtttcttagttggaatcagaacttgtagttttgagataattttatatttttgtcaaaagaatcaaacctctccaataaacactgtttcgtgcactaatggggaccctggactcgaattggttcgcctatatccggaccagtcatagtctgagacgtgtcaataatgacaatcttcaagttggtgtgggcgctgtgccgttcagggaacacaacaacaaattcactgacacttttgataagaaaagagggagcctaaaaataattgaagtt

SEQ ID NO: 1869 - DNA, 536 bp, Citrus clementina
atgtatcagagagagagagagagagagagattacagagaggaaatggcgagatcgaccggcaaagacgctcaagcccttttccattcccttcgctctgcttatgctgccactcccacaactcttaagatcatcgatctgtatatgggtttcgcggtttttactgccttaattcaggtagtttacatggctattgttggatccttcccattcaactcttttctttcggaagtactttcttgtgttgggacggccatacttgctgtttgtctacgtattcaagtgaacaaggacaacaaggaatttaaggacctaccaccagagcgagcttttgcggactttgttctctgcaatttggtgctgcatttggtgatcatgaatttccttggataaaccttgaccctgggtcaacttaaaatacaattttcttggtcgatgacagtgtgacctagctgtaaaagttagttacgacattaatgcagatatttttcatagaatgtgaacttactataaatgaagacgttgaccatttttggat

SEQ ID NO: 1870 - DNA, 724 bp, Vigna unguiculata
  misc_feature (480)..(480): n is a, c, g, or t
  misc_feature (580)..(580): n is a, c, g, or t
aattttggaaggtaatctggcagagacgacttcagagttgtgggcgttgaagtttggagtttagagaagagaagagggtttttgttgtgcattgccaaatcgcgaagatctgagagaatggcgaggtctagcagcaaggatgcacaagaccttttccgcgctctttggtctgcgtatgctgcaactcctacgaatctcaagatcattgacctctacgtcatgttcgccgttttcaccgctctcatccaggtagtttacatagctttggtgggatcatttccttttaactccttcctatcaggagtgctttcttgtgttggaactgctgttcttgctgtttgtctcaggatccaagtgaataaagagaataaggaattcaaggatcttgcacccgagcgagcttttgcagattttgttctctgtaatttggtgcttcatttggtgatcatgaacttccttggttaattttggttcatgtgnctgttgttggttttgattgaacccttggataataaacagtaatagtagtatacctagacttttgtaatagtatttatagacagtaacttccaactaactnctttagtattttgttgattcccccattctggggtctctgttttgattgtagaagcgatcttttccatattttgaagtttaagctaccaaaaacactgtctgtctttctcaatcacaacgaatctatacattttttgtgaaggca

SEQ ID NO: 1871 - DNA, 809 bp, Arachis hypogaea
ccgattacgggggaggtggcagtggagttgagttttcatttcaacgctgaaaagagtgttagaacccagtgaagaagatacagagtgtcgttcctattcttgttccaattccgaatcggaagacaaggatttgcattgcgatctaagaagagagaagagaaaatggcgaggtcaaccagcaaggacgcacaagacctcttccgtgcgctttggtctgcgtattccgcaactccaacaaatctcaagatcattgatctctacgtcatgtacgctgttttcaccgctctcatccaggtagtttacatggctttggtgggatcatttccatttaactccttcctttcaggagtactttcttgtgtagggactgcagttctggctgtttgtctccgtatccaagtgaataaagagaacaaggaattcaaggatcttgctcctgaacgtgcctttgcagattttgttctctgcaatttggttctccatctggtgatcatgaacttccttggttaaattggatttgtgtggggttttgcctccaattgaaccccgaagggttaaaatgaaaagtagaatacctggaccttgttttgttatagtatttgtagattcagtgacaatacgagtccttgttttgaacaaagagatgctagatgtttactatgcgatcttttacattaatttttgaatggtgaattactcatggtgttgactttgatgtctaaagatgagtcttggtactacctttaaaaagagtctagctgtaatctaattttttaacaattgctctctctctcactctctaattatgt

SEQ ID NO: 1872 - DNA, 544 bp, Cucurbita pepo
ctccagagctcggtattgcaatggcgagatccacaagcaaggacgctcaagctcttttccagtcgcttcgctcagcttatgctgccactccaacgactctcaagatcattgatctctatgtgatttatgctgtgttcacggctctgatccaggtagcatacatggcgattgttggatcattcccattcaactccttcctctcaggcgttctttcttgtatcgggacagctgttcttgctgtttgtctccggattcaagttaataaagaaacaaggagttcaaggatttggccccagagcgagcttttgctgatttgttctgtgcaacctggttctccatttggtgatcatctgcttcctcggatagaacacctcattttgggttctacttcttttcttgttttctttggagaattaatttaaacccaggaagtagcttatgctagaaattttctaccaaacatagcaatattagaagagagagtattcctgcaactgaattatgtcattctgagttattttctacagtgtatgtttttccagac

SEQ ID NO: 1873 - DNA, 458 bp, Cleome spinosa
atgctcaagatctcttccattctcttcgctctgcttattccgccactcctaccaatctcaagatcatcgacctctacgtcggttttgctgtcttcacagctctgatccaggttgcatacatggctcttgttggatcatttccattcaactcgtttctctcgggagttctctcttgtgttgggacagcagttcttgctgtttgcctccggattcaagtgaacaaaggaaaacaaggaattcaaggacttggcaccggagagggcatttgcggattttgtcctctgcaacttggtcctccacctagtgatcatgaacttcctcggctaaatcagacattttcacaaggtaatggcaccaaagagagaacggtgggtagattagatagagagaaacagttgctttcatgcatttaaagatgtggggtttttaggtgtcttcttggaacatatgcatacgca

SEQ ID NO: 1874 - DNA, 616 bp, Prunus persica
cgaagaagaagaagagtgaagtacatcgaggaagagaaaaatggggaaagcatcgacatcgtcaacgaccaaggacgcgcttgtcctcttcgattctcttcgctcagcttactctgcaactcccaccactctcaagatcattgatctctatgttggttttgctgtgttcacagctctcatccaggtagtttatatggctctcgtcggatcattcccatttaactcttttctctcaggagtactttcttgtacagggacagcagtcctcgctgtttgtctccgtattcaagtgaacaaagaaaacaaagactttaaggatttaccaccagaacgggcttttgcagattttgttctctgcaacttggtgctgcacttggtgattatgaatttcctcggataagttagcatcttttggtcttcattgattctgtttcctggaacaatgatgataagatatggatcctaaagaagttttaagaatttgatgtggtaactttttcttggtagttttattttatttgataaactttacatgataagttatgtaaccacaatatgtgaaaaatgaacctgcaatagaatctgtcttttattacattatcaggatctatttctt

SEQ ID NO: 1875 - DNA, 400 bp, Heritiera littoralis
atcatcgagcaaggacgacgctcaagccctcttccattctctccgatctgcttacgctgccactcctatcaatctcaagatcattgatctatatgtgggtttcgcagtcttcacagctctgattcaggttgtttatatggctattgtgggatcatttcctttcaactcatttctttctggagtgctttcttgtgttgggacagcagtccttgctgtttgtcttcgtattcaagtgaacaaagaaaacaaggaattcaaggatctaccacctgagcgagcttttgcagactttgttctttgcaacttggtgctccatttagtgatcatgaatttccttggataaatcttgcctcaagatttgcagcactgctgttttctcggtttctggcagtgattcata

SEQ ID NO: 1876 - DNA, 733 bp, Gossypium hirsutum
ctaagttgaatttaagttcaatgtgaattttatgtttttccttttaaaatttccagctacaacttgtcaaactatgcatgaaagagatcccaaaatataaagtgcttgtataaatgacaatcatgtaaagaaatcagaacgatcaaatctatactcaaatgtcttttgtttctcatcaagttatcttgaaactcttttagccaaagataaaatatcaaattcctactacagttctggatctatgctcaagctcataatgatgatctaagaacttcatttcatgctaaaattatgaatcacggccggaaactgagaaaacagcagtccagcaaaacctggaaattatgattttatccaaggaaattcatgatcaccaaatggagcaccaagttgcaaagaacaaaatctgcaaaagctctctcaggtggtagatccttgaattccttgttttccttgttcacctgaatgcgaagacaaacagcaaggacagcagtcccaacacaagaaagcactccagaaagaaaagagttgaaaggaaatgatcccacactagccatgtaaaccacctggatcagagcagtgaagactgcgaaacccacatacagatcaatgatcttgagattgactggagtggcagcataagcagagcgaagagaatggaataaagcttgagcattttctttgctggatgatgttctcgccatttttgctctgccctaatttcccaattgcc

SEQ ID NO: 1877 - DNA, 484 bp, Bupleurum chinense
gagagagaagaaaaatggggaagtcgtcggcgacgagtaaggatgctcaactactatttcaatctctccgttctgcctacgcagccactcctactaatttgaagatcatcgatttgtatgtaattttttctgtctccactgctgtgatccaggtagtctacatggctatcgtagggtcattcccatttaactctttcctgtctggagtgctctcttgtgtgggaactgcagttctagctgtctgtcttcgcatccaggtcaacaaagaaaataaggaattcaaggatttgcctccagaacgtgcgtttgcagattttgttctttgcaacttggtgctacatttagtaatcatgaaattccttggatgattatttgttttataacaatcgtattgccgaatcatcaaaactatgttttgaagtccatcttggtaggatgaaggccccagttgcaaaaccatttcagtaggctattagcttttacc

SEQ ID NO: 1878 - DNA, 813 bp, Gossypium hirsutum
gttagtacagtttacaaagagaagttctggcggagaagcttggaagaagccaacggaggcaattgaattagggcaaaatgggaagaacatcatccaccaaggaagacgccggcgccctcttccattctcttcgatctgcttacgctgctacccctgtcaatctcaagatcattgatttatatgttggttttgcaatcttcaccgctctgatccaggtagtttacatggcaatggtgggatcatttcctttcaattcatttctttctggagtgctttcttgtgttggaacagcagtccttgccgtttgtcttcgtattcaagtgaataaagaaaacaaggaattcaaggatctaccacctgagcgagcttttgcagattttgttctttgcaatttggtgctccatttagtgatcatgaatttccttggctaaatcgcgcctccaggtttgctgtggactgctggctgtgattcatatttaaagcatgaaatgaaattcttaggtcattactatgagtttatgcatatagcgtatatgatcaggaattgtagtaagaattcagtggtgtctttagttaaagaattttgaagttgcttggagaggaacagtagacgttttagtgtcaatttgcttgttctgattcctttctgtgttcatctttcatacaaggcattttatagacttcggatctctctctggtgcttaacttaacaatcctaagtgcatgcatcggcatatggttggtaacgttaattttcttctagtttatgagttggatgaacatttgaaaagtagtgaatttacgtgttgccgg

SEQ ID NO: 1879 - DNA, 807 bp, Gossypium hirsutum
taaaataagaagaatgaatggtggagattgaatcttgacattcgatatcggttgaccaaaaaggttcattgttattataagagagacgattcagtaaggcgttagctagttcagcaatagaaaacccttacgggcaattgggaaattagggtagagcaaaaatggcgagaacatcatccagcaaagaaaatgctcaagctttattccattctcttcgctctgcttatgctgccactccagtcaatctcaagatcattgatctgtatgtgggtttcgcagtcttcactgctctgatccaggtggtttacatggctagtgtgggatcatttcctttcaactcttttctttctggagtgctttcttgtgttgggactgctgtccttgctgtttgtcttcgcattcaggtgaacaaggaaaacaaggaattcaaggatctaccacctgagagagcttttgcagattttgttctttgcaacttggtgctccatttggtgatcatgaatttccttggataaaatcataatttccaggttttgccggactgcgtgttttctcagtttccggccgtgattcataattttagcatgaaatgaagttcttagatcatcattatgagcttgagcatacatccagaactgtagtaggaatttgatattttatctttggctaaagagtttcaagataacttgatgagaaacaaaagacatttgagtatagatttgatcattctgatttctttacatgattgtcatttatacaagcactttatattttgggatctctttcatgcatagtttgacaagttgt

SEQ ID NO: 1880 - DNA, 1378 bp, Gossypium raimondii
gtagatgaagggtccatattcaatctgaaatctgatcacagttgacttggagtaaaacagctctttgctcgacgttatttcatttattgttatttttcaagttagtacagtttacaaagagaagttttggcagagaagcttggaagaagccaacggaggcaattgaattaggtcaaaatgggaagaacatcatccaccaaggaagacgccggcgccctcttccattctcttcgatctgcttacgctgctacccctgtcaatctcaagatcattgatttatatgttggttttgcaatcttcaccgctctgatccaggtagtttacatggcaatggtgggatcatttcctttcaattcatttctttctggagtgctttcttgtgttggaacagcagtccttgccgtttgtcttcgtattcaagtgaataaagaaaacaaggaattcaaggatctaccacctgagcgagcttttgcagattttgttctttgcaatttggtgctccatttagtgatcatgaatttccttggctaaatcgcgcctccaggtttgctgtggactgctggtctgtgattcatatttaaagcatgaaatgaaattcttaggtcattactatgagtttatgcatatagcgtatatgatcaggaattgtagtaagaattcagtggtgtctttagttaaagaattttgaagttgcttggagaggaacagtagacgttttagtgtcaatttgcttgttctgattcctttctgtgttcatctttcatacaaggcattttatagacttcggatctctctctgatgcttagcttaacaatcctaagtgcatgcatcgggatatggttggtaacgttaattttcttctagtttatgagttggatgaacatttgaaaagtagtgaatttacgtgttgtcggtaatagcatcgagtcataaaacataatgagcttgctttatatttttgataatgcacaagtttcatgatgttcatgagttgcaaaggaaaccgttcatgaagaacctatagtcattgatttagaagtttaacatgtttgaatccagctgataaacaggacaaattagtctctgtacgttagatgaaagagtaaactggtcttttttgataaaaacttcatccatttttactgttaaaaattagtgtaactgacaaaataactagacagttatatttggcgtgccacatttaccagtttacaatgacaagtttttaacggtagaaatggatgaactttacatcagaatgactagtttgtcctttgatctaatgtgtagagattaatttattcttttttttttattagaggggacaagggtgtctatagtacttttaccgtgttaaatgccaattcaaatatgacat

SEQ ID NO: 1881 - DNA, 1094 bp, Gossypium raimondii
tgattaatgtatattttaaataaaataagaagaatgaatggtggagattgaatcttgacattcgatctcggttgaccaaaaaaggttcattgttattataagagagacgattcagtgaggcgttagctagttcagcaatagaaaaccctttgggcaattgggaaattagggtagagcaaaaatggcgagaacatcatccagcaaagaaaatgctcaagctttattccattctcttcgctctgcttatgctgccactccagtcaatctcaagatcattgatctgtatgtgggtttcgcagtcttcactgctctgatccaggtggtttacatggctagtgtgggatcatttcctttcaactcttttctttctggagtgctttcttgtgttgggactgctgtccttgctgtttgtcttcgcattcaggtgaacaaggaaaacaaggaattcaaggatctaccacctgagagagcttttgcagattttgttctttgcaacttggtgctccatttggtgatcatgaatttccttggataaaatcataatttccaggttttgccggactgcgtgttttctcagtttccggccgtgattcataattttagcatgaaatgaagttcttagatcatcattatgagcttgagcatacatccagaactgtagtaggaatttgatattttatctttggctaaagagtttcaagataacttgatgagaaacaaaagacatttgagtatagatttgatcgttctgatttctttacatgattgtcatttatacaagcactttatattttgggatctctttcatgcatagtttgacaagttgtagctggaaattttaaaagaaaaacataaaattcatattgaacttaaattcaacttagaaatttacatctactaagagcatatactggctcatgattttctaatctaggatatacatggatcatttgaaagttgtaggactgatgaagcacgtacgtggactaggaagtgcctaccaactgcttaaatttctcttacagcaatatacttgccactgtagttctttattggtgctcgttcaattaaagtgttgcaaccttgagcagaaa

SEQ ID NO: 1882 - DNA, 742 bp, Gossypium hirsutum
aacccattgggcaattgggaaattagggcagagcaaaaatggcgagaacatcatccagcaaagaaaatgctcaagctttattccattctcttcgctctgcttatgctgccactccagtcaatctcaagatcattgatctgtatgtgggtttcgcagtcttcaccgctctgatccaggtggtttacatggctagcgtgggatcatttcctttcaactcttttctttctggagtgctttcttgtgttgggactgctgtccttgctgtttgtcttcgcattcaggttaacaaggaaaacaaggaattcaaggatctaccacctgagagagcttttgcagattttgttctttgcaacttggtgctccatttggtgatcatgaatttccttggataaaatcataatttccaggttttgctggactgctgttttctcagtttccggccgtgattcataattttagcatgaaatgaagttcttagatcatcattatgagcttgagcatagatccagaactgtagtaggaatttgatattttatctttggctaaaagagtttcaagatcacttgatgagaaacaaaagacatttgagtacagatttgatcgttctgatttctttacatcattgtcatttagacaagcactttatattttgggatctctttcatgcatagtttgacaagttgtagctggaaattttaaaaggaaaaacataaaattcacagtgaacttaaattcaacttag

SEQ ID NO: 1883 - DNA, 546 bp, Tragopogon dubius
ttgttgatagagtaaacgcacataaactgtgataagagtgtgattgtgtgagagaaaaatacgaaatggggaagtcgccgacgacgaaagatgatgcacaggctctatttcagtctctccgatctgcctacgccgctactcccactaatctcaagatcatagatctgtacgtggtatttgctgtgttcaccgctctaattcaggtggtttacatggcaattgttggatcgtttccattcaactcttttctctcgggtgtgctttcttgtgtagggacagccgtcttagctgtttgtcttcgtattcaagtgaacaaagaaaacaaggaattcaaggatttacctcccgaacgggcttttgcagactttgttctatgcaacttggtgctccatttggtgattatgaatttccttggttaaagtttgttcttggctgaattttgatattagagagatgctttgagctttgaattatgtaatgccaataggataattatttccaacttttgaaatgttatatactttgatgctaaagatatcaacaaca

SEQ ID NO: 1884 - DNA, 677 bp, Olea europaea
tgaggagtagactgcaacctgcgactatcttctccagcaaaaattgcttatactttcagtggcagatcgggcgaccaatccacgatcgcaaccccgttcactgtactatcacccgcacgctcacaaagaagtgaaaaaaaatggggagatcaacgccatcaaaagatgcccaagcactttttcattctcttcactctgcatatgctgcaacccccactaatctcaagatcatcgacttatatattttgtttgcagttttcactgctgtaattcaggtagtttacatggcaattgttggatcattcccattcaactccttcctttctggggtactttcatgtgtagggactgctgtccttgctgtttgtctacgtatccaagtgaacaaagaaaacaaggaattcaaggatttacctccagaacgagctttcgcagattttgttctttgcaatttggtgcttcatttggttatcatgaacttcctcggctaagttggtccctctgcaaacgaataatcagtttcaagatttgataattaggcaagacaaagattgacatttacaagaagacatgaaattatctgttgagccaatcatcaaccgtgttaactgttttgtctttgttgttaaatgacatatgcttaaaatgttggactgatgtcttttacctttttattt

SEQ ID NO: 1885 - DNA, 529 bp, Scabiosa columbaria
gtgattcagtagtaaaaccagtcgaagaacacagggacgaagaactgtaagaatggggaaatcatcgacgagtaaggatgctcaagctcttgttcaatctcttcgttctgcatattctgcaactccaactaacctcaagatcatcgatctatacgtgctcttcgcgatctccactgccgttattcaggtagtttacatggctgttgttgggtcatttccatttaactcttttctctctggagtactctcatgtgtaggcacagctgtccttgctgtttgtctgaggattcaagtaaacaaggagaacaaggaatttaaggatttacctccagagagagctttcgcggattttgtcctttgcaatttggtgcttcacttggtcatcatgaacttccttggataaaatttgaaggccataaaaagacttaaacgatgagagatgtagtgtaatgatttagcattttgcaacttgtatcgtatttccagatacgcataaattgaaaggatatatgaattaaacattacaatg

SEQ ID NO: 1886 - DNA, 550 bp, Valeriana officinalis
caagccaaggtagaggcgaaaagagagaaaaaatggtgaagtcgtcgacgagtaaggatgcacaagcacttgttcagtctcttcgttcggcttatgccgccactccgactaacctcaagatcatagatctgtacgtcatttttgcgatctccactgccgttattcaggtagtttacatggctgttgttggatcatttcccttcaactcgtttctctctggagtactctcttgcgtagggacagctgtcctcgctgtttgtcttagaatccaagtaaacaaagagaacaaggaatttaaggatttacctccggagagagcttttgcagatttcgttctgtgcaatttggtgcttcatttggtgataatgaacttccttggataattgttaggaaattttcttgaaaggtatttttatttgtagaagctattttgctcgagatcttgtagtgagacatgtactctgcttagggtttagaggcacatgaatcttaccttatgcgattgaggaaaacttacactcctgaacttattggaatctaataaattcct

SEQ ID NO: 1887 - DNA, 671 bp, Solanum melongena
attctcactccatcgaaattgaggtcacacagaataactgaagagtgacacaaatggcaaagtcctcggcgaccaaagacgcccaagctcttttccattctctccgttctgcttatgccgcaacaccgacgaatctcaagatcattgatctatatgtcatctttgccatctccactgccttaattcaggtggtatacatggctattgttggatcattcccattcaactcttttctctctggggtgctttcttgcattggcacagcagtccttgctgtttgtcttcggatccaagtaaacaaagaaaacaaggaattcaaggatttgcctccggaacgtgcttttgcagattttattctctgcaatttagtgctccatttggtgatcatgaactttcttggctagattgaggcaccaaatctcgaaaatatgttgcttttacaaatcttggtgatttatatgtaagaataatatagtcaatcgtaaggattttgttagaccttcagaaatattaagtttctcaggcatgaaactataacattgatgaatattacaagggtatcagtcagtagaaaaactatggcctctttgaactctttagccaaaaaagaaatgggctttgtcgagttatatcagtcagtagaaaaactatggcctctttgaactctttag

SEQ ID NO: 1888 - DNA, 544 bp, Heritiera littoralis
gaatttagggcaaaatggggagatcatcgagcaaggaggacgctcaagccctcttccattctcttcgctcagcttacgctgccactcctgtcaatctcaagatcattgatctatatgtgggtttcgctgtcttcacggctctgattcaggtggtttacatggctgttgtgggatcatttcctttcaactcatttctttctggagtgctgtcttgtgttgggacagcagtccttgctgtttgtcttcgaattcaagtgaacaaagaaaacaaggagtttaaggatctaccacctcagcgagcttttgcagattttgttctttgcaacttggtgctccatttagtgatcacgaatttccttggataaatcatgcctccaggtttgctgggctgctgttttctcggtttctgacagtgattcataattatagcatgaaatgaaactctttaagttgttattacgagcttatgcatacagcatgagtgtctgaattatagtaggaattcaatgttttgtcttatggctaaagagtttggaaattactt

SEQ ID NO: 1889 - DNA, 514 bp, Actinidia deliciosa
gagaggggtcgaaaatggggaagtcgtcgacgacgaaggacgctcaagcactcgtccactcgctccgttctgcttatgcggccactcctacaaatctcaagatcatcgatctgtacgtgatgtttgcggtcttcactgccctgattcaggtagtttacatggctattgttgggtctttcccattcaactcttttctatcaggagttctttcctgtgtaggcacagcagttcttgctgtttgtctccgtatccaagtgaacaaagaaaacaaggaatttaaggatttgccaccagaacgtgcttttgcggacttcgtcctctgcaatttggtgctccacttggtgattatgaacttccttggatagaaatcgggcattaggactgtcggattgttgtttattgacagttccaggccagcagttgccttttttgttaggttattaaccctatgaatttcacattataagattatgtacctgctactggaatatttaatcaattgccggggagttca

SEQ ID NO: 1890 - DNA, 599 bp, Actinidia deliciosa
ttgatattacacacacgcagagagagagagagagagagagagggagagagtagggacgtcgaaaatggggaagtcggcgacgacaaaggacgctcaagcacttttccactcgctccgatctgcttatgcggccactcccactaatctcaagatcatcgatctgtacgtgatgtttgcggtcgtcaccgctctgattcaggtagtttacatggctattgttgggtctttcccattcaactcttttctttcaggagttctttcttgtgtaggcacagcagttcttgctgtttgtctccgtatccaagtgaacaaagaaaacaaggaatttaaggatttgccaccagaacgtgcttttgcagacttcgttctctgcaatttggtgctccacttggtgattatgaacttccttggatagaagtagcgcattacgacagttggatatgttgtttagtgacagttcgaggtcagcggttgcctttcttgttaggttattaatcatatgaagttcacattataagaattttgtacctgctactggaatatttgatcaattgccggggagttcagactgttccagtattcattttaaaaaaaaaaaa

SEQ ID NO: 1891 - DNA, 524 bp, Petunia hybrida
atggcaaagtcgtcggcgaccaaagatgcacaagcacttttccattctctccgttctgcttatactgctactcccactaatctcaagatcattgatctatatgtcatctttgcaatcttcactgccttaattcaggtggtatacatggctcttgttggatcattcccattcaactcttttctctctggggtgctctcttgtgttggcacagcagtccttgctgtttgtcttcggatccaagtaaacaaagaaaacaaggaattcaaggatttgcccccggaacgtgcttttgcagattttgttctctgcaatttagtactccatttggtgatcatgaactttcttggttagattgaggcaccaaatttcaaaaatatatcgctttaaatattcggtgatttatatgtaaggataatatattgagtcaattgtgaggattttgttaggcctttatgaacattaagcttttcatgcatgaaactattgcatcctctatcatttgtgaatctgactgagtatcaatc

SEQ ID NO: 1892 - DNA, 504 bp, Camellia sinensis
tacagaagagaaagaaacagaagaaaggggagagagagagagagaggggtcgaaaatggtgaaatcgtcgacgacgaaggacgctcaagcactgttccactcgctccgttctgcttatgcagccactcccacaaacctcaagatcatcgatctgtacgtgatgtttgcggtcttcactgctctgattcaggtagtttacatggctattgttggatccttcccattcaactcttttctctcgggagttctttcttgtgtagggacagcagttcttgctgtttgtctccgtatccaagtgaacaaagaaaacaaggaattcaaggatttgccaccagaacgtgcttttgcagactttgttctctgcaatttggtgctccatttggtgattatgaacttccttggatgaagtctgaggccctaggactgtaggaatattgttcactgaaatacttacagcctgttggttgcctttcttgttagattattaacttcaccacataagaa

SEQ ID NO: 1893 - DNA, 522 bp, Platanus occidentalis
gagaagaatggcgaggtcgtcaaccaaggatgctcaggccctttttcattccctacgctcggcttatactgccacccccacaaatctcaagatcatcgatctctacgttgatttttgtcgatttctacagctctgattcaggtggtttacgatggcaatcgttggatcattcccattcaactctttcctctcaggagtactttcttgtgtggggactgcagtcctcgcggtttgtctccgtattcaagttaacaaagagaacaaggagttcaaggatttacccccagaacgtgcatttgcggatttcgtgctatgcaatttggtactccatctggtgattatgaatttcctaggatagattaggggctttaagggttgtagacatgttcccttatattttgacagtgagggggcatgccattgatgtgactttcatcataggttgctcaccatatttaacttcttttcaaaccatatatctttttcagaaagccatgtagagaagtctgagtttgacctttt

SEQ ID NO: 1894 - DNA, 481 bp, Tamarix hispida
  misc_feature (403)..(403): n is a, c, g, or t
  misc_feature (422)..(422): n is a, c, g, or t
  misc_feature (447)..(447): n is a, c, g, or t
ggggaagcgcagatataaggggatgcccgctttcgacacactccgagaagggtttattagcaaaggtcaaacggaagaagaggaaagctagagagtgcaatggcgaggtctacaagcaaggatgcgcaagccctattgcacactctcctttccgcttatgctgccacaccaacgaaactcaagatcattgatctgtacgttgcgttttccgttgctacagctataattcaggttctttacatggcagttgttggatcatttcctttcaattcgttcctgtctggtgtgctctcgtgcattggtacagctgtcctcgctgtgtgtctgcgcattcaggtcaacaaagaaaacaaggagttcaaggatttacctccggagcgtgctttcgctgactttgtccttngcaatttagttctccatcnagtcataatgaacttccttggatanactgcaacatcgagggctatcgaatgctatctcc

SEQ ID NO: 1895 - DNA, 714 bp, Amorphophallus konjac
cgctctcgctctcgcaaacgactattgacagtggaagaatggcaaaaacaaccactagtgatgctcgggcccttattcactctttgtattcagcttattctgccacaccaaccaatctcaagatcattgatctttatgtgctttttgcagtcctcagtgctgcagtccaggtagtttacatgggaatagtcggatcatttcctttcaactctttcctctctggtgtactttcttgcgttggcacagcggtgcttgcagtctgtctccgcatccaggtcaacaaagagaacaaagacttcaaggatctcccacccgagcgtgcttttgcggactttgttctctgcaacctggttcttcatctggtaatcatgaacttcctaggatagatacccatacaggatcgtcctagatgcggcaaggtcttagacggacaaaagtgcagtcttgttagggatttcatgtatttgttctcgtttctgtgttacaggcttgttgcctaggttgccttcggaatcatgaagtaaaaagggaaaaaaaatctacgagattatctatggataaaacgtagacaagagctcataaacttggaacattatttttgcggtcaaattagattttttgcttttcactgttgctttatttacctttataatcgtagtcccctaataaaatatttttatctccattctcgcttcttttccagaagaaaaaact

SEQ ID NO: 1896 - DNA, 637 bp, Amorphophallus konjac
ggtgccgtcctctggttcgtgctcgcgctctcgcaaacgtggaagaatggcaaaaacaaccactagtgatactcgggcccttattcactctttgtattcagcttattctgccacaccaaccaatctcaagatcattgatctttatgtgatttttgcagtcctcactgctgcagtccaggtagtttacatgggaatagtcggatcatttcctttcaactctttcctctctggtgtactttcttgcgttgggacggcggtgcttgcagtctgtctccgcatccaggtcaacaaagagaacaaagacttcaaggatctcccacccgagcgtgcttttgcggactttgttctctgcaacctggttcttcatctggtaatcatgaatttcctaggatagatacccatacaggatcgtcctagatgaggcaagattttagacggacaaaagtgcagtcttgttagggatttcatatatttgttctcgtttctgtgttaacaggcttgttgcctaggttgccttcggaatcatgaagtacaagggtaaaaaaatctatgagattatctatggataaaacgtagacaagagctcataaactcggaacattatttttgcggccaaattagatttattttgctttac

SEQ ID NO: 1897 - DNA, 1097 bp, Cannabis sativa
tttgggggtacacaatttggttctaacaaaattttgggcaaaatttaaataatttttgtgtcaaatgacgatattatccctggagcggagacgacctgcgggcaaaagggctttaatactggtgattgttgatcctagcggcagagaacgccagtggtggaactagaagaagaaaaaaagaaagaaagtaacgtacgccatggccagatctacaaccaaggacgcccaagctctttttcaatccctccgttctgcctatgcagccacaccaactaagctcaaggtcatagatctctacgtggtttttgctgtcatgacagctttcgttcaggtagcttacatggctgttgttggatccttcccattcaattccttcctttcaggagtgctttcttgtgttgggactgcagtccttgctgtttgtcttcgcattcaagtgaacaaagagaacaaggaattcaaggatttaccagcagagagagcttttgcagattttgttctctgcaacttggtgcttcatttagttataatgaacttccttggataatagcatctttaactacgataatgtttttttaggaccatcaaaatgagacaactataaagttatatgcctttggtgcagcattcactgatggttactctttgtgaagtttgtgatgtatgcaacatgagaatgaagataatgtgggtcagaaattttggcttgattttaattattgtcaattttagagctacatagttttttttttattattcttttttatgagtaggttaaagttctttttttttggttgttgttgtgaaatccttggtcagagagagggccaggagaaaaatatcattgatgctaaacacatgtctggccctgaatagaagaaatacaattagggtctatttggtaagcatgattggacttgattattagtgtttaggcacgtcgaaagtctagagaactaatccagcttatctcatctgttagggattatttatctcattcagtagggttaggggtgttcatccattccaatttgcactattttgctcatagtacattcgatctgcactaagtgcggatttcattttttggatccaat

SEQ ID NO: 1898 - DNA, 744 bp, Elaeis guineensis
acggctctttcgctgcggttttgttcgagaaggcgatagcgaagcgattccaaattagctaaggaaatagaaaaaaagttgagaatggcaaagtccacctccagtgatgctcagatgctcattcgttctctccgtactgcttatgctgccacgccaactaatctcaaaatcattgatctttacgtggtgtatgctatcgttacagctgtaattcaggttgtctacatgggagtagtagggtcatttccatttaactctttcctctctggagttctctcttgtgtaggtacagcggtacttgcagtttgtcttcgaattcaagtcaataaagagaataaggaatttaaggatctaccaccagaacgagcttatgctgattttattctctgcaatctagtgctccatcttgtcatcatgaacttcctgggatagagaagttttctcttggtgcatcatgaggcatagaattatttctgatactttttgtcggactttaaagtggtagaacatcttagagtttcgtcatgtataaacctaatgatctacatgcccgatagtttgcgcttgttgtttcgtgaattgatcatcatcactttcaagaggttgttctttctggatgttctgccataaaaatgacgtagcatgatagtttatttattttgctttcaggtgtttctaccacagtgataccagagccatttgctaaatgttgcttaactaaagaatatttttattaagaaaaga

SEQ ID NO: 1899 - DNA, 607 bp, Elaeis guineensis
agtggttttattaggaaacagaaaagaagttgagaatggcaaagtccacctctagtgatgctcagatgctcattcgttctctccgtactgcttatgctgctacgccaactaatctcaaaattattgatgtttacgtggtgtatgctattgttacagctgtaattcaggttgtctatatgggagtagttggatcatttccatttaactctttcctctctggagttctctcctgtgtaggtacagcggtacttgcagtttgtcttcgaattcaagtcaacaaagaaaataaagaatttaaggatctaccaccagaacgagcgtatgctgattttgttctctgcaatctagtgctccatcttgtcatcatgaacttccttggataggaaaactatatcttagcacaccatgagacatagaattgtttttggtacttcccgtcggacttcaaagtgataaaacatcttatcgtttcgtcatgtataaacctgatgatctacatgtccgatggtttgcactttttgtttcatgaattgatcatcgccaccttcaagaggctatattttctgagaaatattcttcccataaagtgacgcagtatgataattta

SEQ ID NO: 1900 - DNA, 569 bp, Musa acuminata
agctgtagcgaccggcgacgcagagagggagcggccgatctccgtctgctcttctctcgggaaaccaattgttgggaatggcaaagtcaaatacgagtgatgccaaagttctcattcgctctctgcgttcagcttatgctgccacaccaattagtctcaaaattatcgatctttatgtggtttatgcaattactacagcagtaattcaggtcgtgtacatgggaatagttggatcatttcccttcaactctttcctttctggtgttctttcctgtgtagggacagcagtacttgcagtttgtcttcgcattcaagtcaacaaagagaaaaaggagtttaaggacctaccacccgaacgggcttttgctgattttgttctctgcaatctggtgctccacctggtgatcatgaactttcttggatagatagacggaaaccaacatgataactttaccattccttccaagttggtttttggtggacaaaatctgtgacagcacaagtttttacttcctatgatattatatgtggctactcgagaaacattatcaaaattttctttgcctttg

SEQ ID NO: 1901 - DNA, 676 bp, Lotus japonicus
ggaaagtcgtgtttggagaagactttagaggatgtggagctgaaagcagagagaagaagagtgaagtgtagaaggaagaagaagagagttctggtttgtgagaaatggcgaggtctaccaccaaggatgcccaggaccttttccgtgctctttggtctgcgtattcttcaacccccacaaatctcaagatcattgatgtgtacgtcgccttcgccgtcttcaccgctctcatccaggtagcttatgtggctcttgtgggatcatttccatttaactccttcctttcaggagtactttcttgcatagggactgcagttcttgctgtctgtcttcggattcaagtgaataaagagaataaggagttcaaggatcttgcaccggagcgtgcttttgcagattttgttctctgcaatttggtgctccatttggtgatcatgaacttccttggttaaattgggttcatgtggcttttgttgttttcaagagaaccctcggatgataaaaatgagtagtattatacctggatttttgcaatagtgtttacaaacagtcactagcatttaactgattacttcattttgcaatactgttttgaacatagagatgatagatgttgaatttgccatattttaaactactttttaaatggtgaatcacacaaggcactcatatggag

SEQ ID NO: 1902 - DNA, 665 bp, Elaeis guineensis
accacggctctttcgctgcggtttgttcgagaaggcgatagcgaagcgattccaaattagctaaggaaatagaaaaaaagttgagaatggcaaagtccacctccagtgatgctcagatgctcattcgttctctccgtactgcttatgctgccacgccaactaatctcaaaatcattgatctttacgtggtgtatgctatcgttacagctgtaattcaggttgtctacatgggagtagtagggtcatttccatttaactctttcctctctggagttctctcttgtgtaggtacagcggtacttgcagtttgtcttcgaattcaagtcaataaagagaataaggaatttaaggatctaccaccagaacgagcttatgctgattttattctctgcaatctagtgctccatcttgtcatcatgaacttcctgggatagagaagttttctcttggtgcatcatgaggcatagaattatttctgatactttttgtcggactttaaagtggtagaacatcttagagtttcgtcatgtataaacctaatgatctacatgcccgatagtttgcgcttgttgtttcgtgaattgatcatcatcactttcaagaggttgttctttctggatgttctgccataaaaatgacgtagcatgatagtttatttattttgc

SEQ ID NO: 1903 - DNA, 640 bp, Eschscholzia californica
agatcgacgacaaccaccaccaccaccacctcaaccaccaccaaggatgctcaagcccttctgaattctctccgatcagcttacgccacaactcccaccaatcttaagatcatagatctatacgtagtttttgctgttttgacagctcttattcaggtcgtttacatggcaatcgttggatcattcccattcaactctttcctctcaggcgtactttcttgtgttggtacagcagtacttgctgtttgtctaaggattcaagttaacaaagaaaacaaggaattcaaggatttagctccagaacgtgcttttgcagattttgtgctgtgcaatttggttctccatttggtgatcatgaatttccttggttaggttgtctgatcattcaggcaatctgaatctagggtatgaatagtttttgttgctaattcactgtttaagctctgagagatcccctcccatgaaatgtttagttattatcataaagttatctgatacaacagttttggtaaagtgagatttgagattatgagacgcatccatttactgatggttttagagatctctctggtgtcttcgtctttttggaatactcttctcttttatatatatttcaacaacacaaaaactctgttctttc

SEQ ID NO: 1904 - DNA, 884 bp, Sarracenia psittacina
attgatgttattgcaagccttctaagcggtagactcgtccgtgagcggattggcccggccatgctaagtgcggtgcaaagtcagatgggtgccgttgagccaagtttcgaagagatccccaatatctttgataccgggggttcaaagggtttgcctgacgattcagttgaaaagatcccgaagatcaaaataaacagcaataacaatgtagatgcgtcgggggagaaagcctcctgttcggtttgccttcaggactttcagcttggagagactgttaggagtttgcctcattgccatcacatgtttcacctaccttgcattgataggtggttggtaaggcatggctcttgcccactatgcagaagggaggccggaaatggggaagtcatcgacgacgaaggacgctcaagcgcttttccactcgctccgttctgcttatgccaccacaccctcgaacctcaagatcattgacctgtacgtgatgtttgcggttttcaccgctctgattcaggtagcttacattgctattgttggatctttcccattcaactcttttctttcaggagttctttcttgtgtagggacggcagttctcgctgtttgtctccgtatccaagtgaacaagaaacaaggaattcaaggatctaccacccgaacgtgcttttgcggactttgttctttgtaatttggtgcttcatttggtgattatgaacttccttgggtaaattgagttcttaggactgtaggaacattgttttaagaaatagttccaggtcattgactccctttcttgttaggttattaacaatatctagttaagaatcagtacccactacttcaatatttctcaagggacaggtgggaatatttatcatggtacattt

SEQ ID NO: 1905 - DNA, 735 bp, Fragaria vesca
aaaagtcttggatctagtagagcaagtgagattgtaacagagtcgaaggagggtttcgccggagctgaactcgattcgatcttttctcgaaaatggtgaagccgccgtcgtcgtcatcgtcgtcgtcgtcgacgacccaggacgcccttgcccttttcaattcgctgagatcggcttactctgccactcctacctctctcaaggtgattgatctctatgtgggtttcgctgtatccactgccatcatccaggtcgtctacatggctcttgttggatcattcccatttaactcttttctctctggagtactctcatgcatagggacagcagtccttgctgtttgccttcgtattcaagtgaacaaagaaaacaaggaatttaaggatttagcaccggagcgggcttttgcagattttgttctctgcaatttggtgctgcatttggtgatcatgaatttccttggatgaattagcactttttggcctttgatactgtttcctagaacaatgagaactagatatgatcgacgataaacaattattatgtatccgctgtagcaaagtttgcttgccattttgattttatttttaaattcacatggtaagttaccaagttatgcaggccccatatatggaaaaattggaccttaaatgaaatttcagtcattacattatcaggatctcttgtcaaaactatatgatttattatgtgaatttttatggcgtggtgctggac

SEQ ID NO: 1906 - DNA, 633 bp, Triphysaria pusilla
gggtcttcagtctccattgctggtcttcgaggggaaagatagagagagagaaagagatcaggagagtgagaaatgggaagatcggcgacgacagctacgaccaaggatgcccaagccgtgtttcaatctcttcgttctgcctatgtggccaccccaactaatctcaagatcatagatctctacattgtcttcgcagtcgccacagctgtaattcaggtcgtttacatggctcttgttggatcattccccttcaactcctttctttcgggggtgctttcttgtgtggggactgctgttcttgctgtttgtcttcgaattcaagttaacaaagagaacaaggaattcaaggatctgcctccagaacgtgctttcgcagattttatactctgcaatttggtacttcacttggttatcatgaacttccttggatgagctggtccttggaaaagaagcaatttctcatcgttttttatagtaatcaagagattaaatcggagagaacgagcgagactttgatgtcatctttttgttgttatgtattacacaaggcaatttgcttgctttgtcgttaaactttgctgctatgaatcactacttagtatacatccagaattcaatgtttcaattgtctcg

SEQ ID NO: 1907 - DNA, 658 bp, Tabernaemontana elegans
caacgagtcgataagcagcaccactgtcgcccataccggctggagtgaagaaatggcgagatcgtcgtcgacaaaggacgctgacgccattcaggcgctcttccactctctccgctctgcttacgccgccacccctaccaagctcaagatcatcgatctatacattatttttgctgtcgtgaccgctctcattcaggtagtgtacatggctattgttggatcatttcccttcaactcatttctctctggagtactttcttgtattggtacagcagtccttgctgtttgcctccgaatccaagtgaacaaggacaacaaagaatttaaggatttgccaccagaacgtgcttttgcagattttgtcctctgtaaccttgtgcttcatttggtgataatgaatttccttggataagctgtaggaatctgaagtgaaggaacactgcctttcttacaatgttgtttaatatacaaatgaaacagaactagctactcattttccttcatttaagagtttagaagcttacatgtggagggcttctcgtgctgaggctttttccatttttctctgaggtggcaagcattttatttctgaggacatgattttgtaagaattagaaaaatatagactggatatgaatggttctataatttcatttcc

SEQ ID NO: 1908 - DNA, 545 bp, Vinca minor
ccaccggagactcaaagtgaagaagaaatggcgagatcgtcggcgaccaaggacagtgagagctttctggctctctttcattctctccgatctgcttacgtcgctacccccaccaatctcaagatcattgatctgtacattatttttgccgtcgtgaccgctgtaattcaggtagtatacatgggtgtcgttggatcatttcccttcaattcgtttctctcaggagtactttcttgtattggtacagcagtccttgctgtttgcctccgaatccaagtgaacaaggacaacaaggagttcaaggatttaccaccagaacgcgcctttgcagactttgtcctctgtaacctcgtgcttcatttggtgatcatgaatttccttggataagccgggtaaatttgaagcagagtaacatttcattctcagaatgttattttacataccaaatgaaacagaaactagttactcattttccttggactttaaaggctttacatgtaagagggtttcaagtgctgaggcctttgagatttttttctgcatcg

SEQ ID NO: 1909 - DNA, 615 bp, Flaveria ramosissima
agaaactgcgattcagagtgtgttgtgtgtgcgaagagaaagacgaaatggtgaagtcgccgacgacgaaagatgacgcacatgctctctttcactctctccgatctgcatatgccgctactcctactaatctcaagatcatagatctgtacgttgtttttgctgtatccaccgctctaattcaggtggtttacatggcaatagttgggtcgtttcccttcaactcttttctctcgggcgtgctttcttgtgttgggactgccgtcctagctgtttgtctccgtatccaagtgaataaagaaaacaaggaatttaaggatctacctccagaacgtgcttttgctgattttgtactctgcaatttggtgctgcatttggtcattatgaatttccttggataagttccgtcgttggacatgttatatgactgcattttgatgatgaggctagcaatagatcttttgggtatatgatgctggataatgaatgctgtattggcactaatagcataattatgttgttacttatattgcagtatgtgattcatatcgaattatcgattcagtggtactgacctggtatactacatgtcatattaacgaatttggtttttaa

SEQ ID NO: 1910 - DNA, 564 bp, Flaveria ramosissima
gtgtgttgtgtgtgtgaagagaaagacgaaatggtgaggtcgccgacaacgaaagatgacgcacatgctctctttcactctctccgatctgcgtatgccgctactcctactaatctgaagatcatagatctgtacgttgtgtttgctgtatccacggctctaattcaggtggtttacatggcaatagttgggtcgtttcccttcaactcttttctctcgggcgtgctttcttgtgttgggactgccgtcctagctgtttgtctccgtatccaagtgaataaagaaaacaaggaatttaaggatctacctccagaacgtgcttttgctgattttgtactctgcaatttggtgctgcatttggtcattatgaatttccttggataagttccgtctttggacatgttatatgactgcattttgacgatgaggctagcaatagatcttttgggtgataatgaattctgtatcggcactaatggcataattatgttgttacttatattgcagtatgtgattcatatcgaattatcgattcagtggttacttacctgatatactaaggtt

SEQ ID NO: 1911 - DNA, 594 bp, Flaveria ramosissima
gtgcgaagagaaagacgaaatggtgaagtcgccgacgacgaaagatgacgcacatgctctctttcactctctccgatctgcgtatgccgctactcctactaatctgaagatcatagatctgtacgttgtgtttgctgtatccaccgctctaattcaggtggtttacatggcaatagttgggtcgtttcccttcaactcttttctctcgggcgtgctttcttgtgttgggactgccgtcctagctgtttgtctccgtatccaagtgaataaagaaaacaaggaatttaaggatctacctccagaacgtgcttttgctgattttgtactctgcaatttggtactgcatttggtcattatgaatttccttggataagttgcgtctttggacatgttatatgactgcattttgatgatgaggctagcaatagatcttttgggtatatgatgctggataatgaattctgtatcggcactaatagcataattatgttgttacttatattgcagtatgtgattcatatcgaattatcgattcagtggttactgacctggtatactacatgtcatattaacgaattcggttttttagaggtg

SEQ ID NO: 1912 - DNA, 488 bp, Flaveria ramosissima
ggggaggtcgacgacgacgaaagatgatgcacaagctctttttcactctctccgatctgcttattcggctacacctacaaacctgaagatcatagatctgtacgttgtgtttgctgtcttcaccgccctaattcaggtggtttatatggcaatagttgggtcgtttccattcaactcttttctctcgggtgtgctttcttgtgtcgggacagctgtcctagctgtttgtctccgtatccaagtgaacaaagaaaacaaggaattcaaggatttacctccagagcgcgcttttgcagattttgttctgtgcaatctggtgctgcatttggtgattatgaatttccttggataagttatatgtttgggcatgttatatgactgcattttgatgagggattagcaatacatccattggatacattgatttgtgatgatgtcttgaattctatgatggcaataggataattgttctgaagcttttatagctt

SEQ ID NO: 1913 - DNA, 608 bp, Helianthus annuus
cacagaaactgcaatcactgtttgtgtgagagaaatggtgaaatcggcgacgacgaaagatgacgcacacgctctgtttcactctctccgatctgcttattcggccactccaacaaatcttaagattatagatctgtacgtcgtgtttgctgtcttcactgccctaattcaggtggtttacatggcaatagttgggtcctttccattcaactctttcctctcgggtgtcctttcttgtgtagggacagcagtcctagctgtttgtcttcggatccaagtgaacaaagaaaacaaggaattcaaggatttaccaccagaacgtgcttttgcggattttgttttgtgcaatttggtgctgcatttggtgattatgaatttccttggataagttatgtgtttggacatgttatacgactgcattttgatgagggctagggacaggactttagatattgatttgtgatgcttgaatcttgaaatttttactggtaataggttatattgaaccttgttataactttgaaatgtcggtgaatcggtcacttgtagtgcaatgaggtacacattcttgtagctcagctgaaataaaacgctaacgaggattgtta

SEQ ID NO: 1914 - DNA, 710 bp, Taraxacum officinale
cggggattcagagtgtgttggtgtgtgagaaaaaaagaggaaatggggaggtcgccgacgacgaaagatgatgcacaggctctttttcagtctctccgatctgcttatgctgctactcctactaatctcaagatcatagatctgtacgtggtttttgctgtgttcaccgctgtaattcaggtggtttacatggcagtagttgggtcgtttccattcaactcttttctctctggtgtgctttcttgtgtaggaacagctgtcctagctgtttgtcttcgtattcaagtcaacaaagaaaacaaggaattcaaggatttacctccagagcgtgcttttgcagactttgtgttatgcaatttggtgctgcatttggtgattatgaatttccttggataactttcatttttgatattatggagttgaattatgtacccaaaataggatacttcatttcaagcttataatgtcaacgaaatagaaccagatttttaacagttgagagatgtgtttagtcaatttcatttctttttcccatttggtggattccaagattatggttttactataaaagatcaaacaaaatttaaaaaatagtcgtctattatgattgtttagtatgaattttcatattttgaaaacaatttataagcatgttgttgctaataatgtgcaacaattctttctcaagatatgataatagactattattc

SEQ ID NO: 1915 - DNA, 611 bp, Helianthus annuus
tgtgtgagagaacggagaaatggtgaaatcggcgacgacgaaagatgacgcacacgctctttttcactctctccgatctgcttattccgctactccgactaatctcaagattatagatctgtacgtcgtgtttgctgtcttcactgccctaattcaggtggtttacatggcagtagttgggtcgtttccattcaactctttcctctcgggtgtcctttcttgtgtagggacagcagtcctagctgtttgtcttcgtatccaagtgaacaaagaaaacaaggaattcaaggatttaccaccagaacgtgcttttgcggattttgttttgtgcaatttggtgctgcatttggtgattatgaatttccttggataagttatgtgtttgggcatgttatatgactgcattttgatgagggctagggacaggactttagatattgatttgtgatgcttgaatcttgaaatttttattggtaataggtatattgaacattgttataactttgaaatgtcggtgaatcggtcacttgtagtgcaatgaggtacacattcttgtagctcagctgaataaaacgctaacgaggattgttagaatcatcaggatcgagatg

SEQ ID NO: 1916 - DNA, 808 bp, Helianthus annuus
gagaaatggtgaaatcggcgacgacgaaagatgacgcacacgctctttttcactctctccgatctgcttattccgctactccgactaatctcaagattatagacctgtacgtcgtgtttgctgtcttcactgccctaattcaggtggtttacatggcagtagttgggtcgtttccattcaactctttcctctcgggtgtcctttcttgtgtagggacagcagtcctagctgtttgtcttcgtatccaagtgaacaaagaaaacaaggaattcaaggatttaccaccagaacgtgcttttgcggattttgttttgtgcaatttggtgctgcatttggtgattatgaatttccttggataagttatgtgtttggacatgttatatgactgcattttgatgagggctagggacaggactttagatattgatttgtgatgcttgaatcttgaaatttgtactggtaataggttatattgaaccttgttataactttgaaatgtcggtgaatcggtcacttgaagtgcaatgaggtacacattcttgtagctcagctgaataaaacgctaacgaggattgttagaaacatcaggaatgagatgatgcttgttcagactgcggtctccaacaaccaagttaggtcttgttaagagaaaatgagcaagcctgtttagctaggcttgattctagctttttgtgagtcaatctttagtagctcacgagcgctcgactcgtctacacccctaccttcgatgtaggttcgtcgtttttgtggtattgtgctcctacaacatcaaatctactcatttggt

SEQ ID NO: 1917 - DNA, 475 bp, Flaveria ramosissima
gggtaggtcgccgacgacgaaagatgatgcacaagctctttttcactctctccgatctgcttattcggctacacctactaacctgaagatcatagatctgtacgttgtgtttgctgtcttcaccgccctaattcaggtggtttatatggcaatagttgggtcgtttccattcaactcttttctctcgggtgtgctttcttgtgtcgggacagctgtcctagctgtttgtctccgtatccaagtgaacaaagaaaacaaggaattcaaggatttacctccagagcgcgcttttgcagattttgttctgtgcaatttggtgctgcatttggtgattatgaatttccttggataagttatgtgtttgggcattttatatgactgcattttgatgagggattagcaatacatccattggatatcttgatttgtgatgatgagtcttgaattctatgatggcaataggataattgttctg

SEQ ID NO: 1918 - DNA, 567 bp, Fraxinus spp
ggccgggggagaaggagaagactgcaacttgcgactatcttctccagcaaaaattgctgatactttcagtggcagatcgggcgacaaatcctcgatcgcaaccgttcactgtactaataccagcacgctcacaaagaagtgaaaaaaatggggagatcaacgacatcaaaggatgcccaagcactttttcattctttttactctgcatatgctgcaacccccactaatctcaagatcatcgatttatatatgttgtttgcagttctcactgctgtaattcaggtagtttacatggcaattgttggatcattcccattcaactccttcctttctggggtactttcatgtgtagggactgctgtccttgctgtttgtctacgtatccaagtgaacaaagaaaacaaggaattcaaggatttacctccagaacgagctttcgcagattttgttctttgcaatttggtgcttcatttggttatcatgaacttcctcggctaagttggtccctttgcaaacaaataatcagtttcaagttttgataattagacgagacatagattgacattt

SEQ ID NO: 1919 - DNA, 626 bp, Lippia dulcis
aatagagagatttagaactgtgagaaatggggagatcggccaccaccaaagatgcccacgctctgtttcactctctccgctctgcctacgcggctacccctaatcatctcaagatcattgatctctatattctgttcgctgtcgccaccgctgtgattcaggttgcttatatggctatcgtcggatcattcccatttaactcctttctttctggtgtactttcgtgtgtggggactgctgtccttgctgttagtctgcgaattcaagtaaacaaagacaacaaggaattcaaggatttgcctcctgaacgtgcttttgcagattttgttctctgcaatctagtgcttcatttggttattatcaacttcctggggtaaatcaatgtcgcagaaaagagacgagctttttaagttttttgaattactccgagggaatcattgtcatggactttatttgaagttttacctgttattggatatctgatacaagaaagtcaccagcagttggcctgtaactgagagactgaaatattttgaggaaatatgtttctgaactatctttttggttgggactattgcaatgttgttgtggcctgtttttgaggtatttatttattgtggttctga

SEQ ID NO: 1920 - DNA, 750 bp, Glycine max
ccaagagagagagattgaaaaaaatccatttgacaaaaatccatttgactttagaggttggtgactttgtgcgttgaagttatagagagagaggagtttggagagaagagtgaagaaggcaaatcgcgaagactagatctgatctgagagaatggctcctcggtctagcagcaaggacgcccaagaccttttccgcgctctttggtctgcttatgctgcaacccccactaatctcaagatcattgatctctatgtcatctatgccgtattcaccgctttcatccaggttgtttacatggctttggttggatcatttccatttaactccttcctatcaggagtactttcttgtgtaggaactgctgttcttgctgtttgtctcaggatccaagtgaataaagagaataaggaattcaaggatcttgcacctgagcgcgcttttgcggattttgttctctgtaatttggtgcttcatttggtgatcatgaacttccttggttaaattgggtttgtgtggcggttgttgtttctgattgaacccttcgataataaaaattaaatagtagtatacctagacttttgtaatagtatttatagacagtagccggcattctactaattgctttagctttatgttgattacccccacctcccatttttggttccctgttttgaacgaagagattttgccatcttttgaagtttaaagtacttttgaatggcgaaataaagaaggtattgttattattc

SEQ ID NO: 1921 - DNA, 596 bp, Camellia sinensis
gatatacgaagacaaggaccagggaagagaggtcggaaatggggaagtcgtcgacgaccaaggacgctcaagcgctttttcagtctctccgatctgcttattccgccactcccactaacctcaagatcatcgatctgtacgtgatgtttgctgtcttcactgctctgattcaggtagtttacatggctgttgttggatctttcccattcaactcttttctgtccggagttctttcttgtgtagggacagcagttctcgctatttgtctccgtatccaagtgaacaaagaaaacaaagaattcaaggatttgccaccagaacgtgcttttgcggactttgttctctgtaatctggtgctccatttggtgattatgaatttccttggataaagcggattcttaggaacataggattattgttcaacgagatagttccaggccattggctgcctttcttgttaggttgttaaccatttgagttcaccatgtaaaagaatctgtacttgctattggaatatttcttcaattacaggaaagttcaaactgctgtggacgagaatgacttaaaaacataaagctagttttatctttttgcac

SEQ ID NO: 1922 - DNA, 591 bp, Nicotiana tabacum
gtcacacagacagagtgagaggaagtgaagagtgacaaaaaatggcaaaatcgtcggcgaccagagacgcccaagctcttttccattctctccgttctgcttatgctgccactcctactaatctcaagatcattgatctatatgtcatgtttgccatcttcactgccttaattcaggtggtatacatggcttttgttggatcgtttccattcaactcttttctctctggggtgctctcttgtattggcacggcagtccttgctgtttgtcttcgaatccaagtaaacaaagaaaacaaggaattcaaggatttgcctccggaacgtgcttatgcagattttattctctgcaatttagtgctccatttggtgatcatgaactttcttggctagattgaggcatcaaatatggaaaatatgttacttttacaaatattggtgaattatatatgcaaggataatactgagtcaatcgtgaggattttgttagggctttagaaatattaagcttctcgtgcgtgaaactattgcgcccttctctatcatttgtgaattcgatagaatatcaatcaggtagacagactttggcccg

SEQ ID NO: 1923 - DNA, 640 bp, Quercus alba
atcccattaccatatatttgttgtatagtcaagctcggtagcgagaaagaagaagaagaaaaaagtagggttttgcaatggtgaagtcgacgagcaaggacacccaggctcttttccactctctccgatctgcttatgcagccactcccaccaatctcaagatctctatgtggttttctctgtcttcactgctttgatccaggtagtatacatggctattgttggatcatttccattcaactcgtttctgtcaggagtactttcttgcatagggactgcggtccttgctgtttgtctccgcatccaagtgaacaaagaaaacaaggaattcaaggatttaccaccagagcgtgcatttgcagattttgttctctgcaatttggtgcttcatttggttattatgaatttccttggatagattgcaatctatgggcgttctgtaatgttgttccttggacttttactagacttggccataaagtagttattgccattactagactttgccattgatgctgcaatttttcgtaggttttaacttatggagctcactatatatgaaaaaggacctgcaattgaattttctatgatttgttttttatttgagaagcctcgttctttattaaagaactagacacct

SEQ ID NO: 1924 - DNA, 748 bp, Carthamus tinctorius
  misc_feature (99)..(99): n is a, c, g, or t
  misc_feature (265)..(265): n is a, c, g, or t
  misc_feature (293)..(293): n is a, c, g, or t
gaatactcattacgactccattgttgagagtaacgcatagaaactgtgatattgtgtgtgtgtgtgtgtgtgtttgtgtgtgtgagaaagaagagaaanatggggaaatcgccgacgacgacgaaagacgatgctcaagctctatttcaatctctccgatctgcttactccgctactccaactaatctcaagatcatagatctgtacgtggtgtttgctgtgttcaccgctctaattcacggtggtttacatagcaatagttggntcgtttccattcaactcttttctctcgngtgtgctttcctgtgtagggacagccgtcctagctgtttgtcttcgtattcaagtgaacaaagaaaacaaggaattcaaggatttacctccggagcgtgcatttgcggatttcgttctatgcaatttggtgttgcatttggtgattatgaacttccttggataagttgacatggatgcattttgatgagggagtagcaaatagcaataggtctattggggtattgctttgtgatgctttgagtcttgaattgtggattgacaataggataattattttgaagcttttaaaattttgaatctcaaaagaattggatacttcttatattgcattctctaagtagtttcttttatctttttctcacatcttctttctaagggttctttatagaaacagtctttctaccctatatccaagatataattagatgagtttgatttggtttgctttttaaaa

SEQ ID NO: 1925 - DNA, 514 bp, Euphorbia peplus
gcgtagagagctctgtttttggtaaattgaaatggcaagatcaacgaccaaggatgcccaagctcttttccattcccttcgctcttcgtatgccgccactcccactaccctcaagatcatcgatttgtatgtggtttttgcagttttcactgctctaatccagatagtttacatggctattgttggatcatttccgttcaattcttttctttccggactactttcttgcgtaggcacagcagtcctagcggtctgtctccgcatccaggtgaacaaagaaaacaaggaattcaaggatttaccaccagagcgtgcttttgctgattttgttctctgcaatttggtgctccatttggtgattatgaatttccttggttaatatttagcagtgtggagtgtggactcctggttatgagttttatatatccttaacttttgagtcatagcacaaaatagttcattagcaaattatgaacccaccctatatgaatgttgaactgtaactggaattttt

SEQ ID NO: 1926 - DNA, 1028 bp, Antirrhinum majus
gatcagcaaaatggtgttcaacaggaaacacaatttttttacatgtcacaagataggcaaaagtaacaaacataatgcataggcaacacaacaaacagaaatgttttacaagtattgcatattcctttcctcccaacactaatccaattttacagcatacactgaactgctgtggtgtctgagttaccatatgcagctccagatttaaaacatttgttgggtcattcataaatatgcagtcctatatttatctttcacaaacaaaccaggacaagattcctgacttgagctctacatgcagcaaaaccattttttaccctgaggctttaaaggttcccctccatggtttgtatttgcatttccatccacctttgaaggagaatctggcttcccaccagtcttcttctcatccctggccttgttaaatattattcacgttgttgagcgagagagagagagagagagagagaaaatgggtcgatcgacaacaaaggatgctcaagcgcttcttcacactctccgctctgcctatgtcgccaccccgaccaatctcaagatcatcgatctatacattgtgttcgctgtcgtcactgctttgattcaggtcgtttacatggccgctgttggaaccttcccattcaactcctttctttctggggtactttcatgcgtcggaactgcagttctggctgtttctcttcgaattcaagtaaacaaggacaataaggaattcaaggatttaccaccagaacgtgctttcgcagattttgttctctgcaatttggtacttcatttggttatcatgaacttccttggataagtccgtattcttgataagatcattcagattttggtattaagaagagagaattagagaggtggatactttgttggaatttacttgttttaaagaccagtgacatggactatgaaggtccttttacgggaaattgcatgcatttggttcttcactaactgaagttttcaagacattgatcatacaatatattgattttggtagctttagc

SEQ ID NO: 1927 - DNA, 489 bp, Cleome gynandra
agaagcagaagaagaggtgaaaatggcgagatccaccagtaaggacgctcaagatctcttccattcccttcgttcggcttattccgccactcctaccaatctcaagatcatcgacctctatgtcgttttttcggtcttcacagctctgatccagattgcatacatggcttttgttggaacatttccattcaactcatttctctcgggagttctctcatgtgttggaacagcagttcttgctgtttgcctccggattcaagtgaacaaggaaaacaaagaattcaaggacttgccatcggaacgagcatttgcggactttatcctttgcaacttagtcctccacctagtaatcatgaacttcctcggataagtcgtcccctctaatgttatcttcgatcatcgccttcttctagatcttacgatcgatataaaaactattactttcatgcattatttaaagttagtggtgattttaggttaccgtttgta

SEQ ID NO: 1928 - DNA, 716 bp, Zingiber officinale
  misc_feature (431)..(431): n is a, c, g, or t
  misc_feature (462)..(463): n is a, c, g, or t
  misc_feature (480)..(480): n is a, c, g, or t
  misc_feature (499)..(499): n is a, c, g, or t
  misc_feature (509)..(509): n is a, c, g, or t
  misc_feature (516)..(516): n is a, c, g, or t
  misc_feature (527)..(527): n is a, c, g, or t
  misc_feature (569)..(569): n is a, c, g, or t
  misc_feature (599)..(599): n is a, c, g, or t
  misc_feature (602)..(602): n is a, c, g, or t
  misc_feature (607)..(608): n is a, c, g, or t
  misc_feature (610)..(610): n is a, c, g, or t
  misc_feature (613)..(613): n is a, c, g, or t
  misc_feature (657)..(657): n is a, c, g, or t
  misc_feature (680)..(680): n is a, c, g, or t
  misc_feature (683)..(683): n is a, c, g, or t
  misc_feature (714)..(714): n is a, c, g, or t
tggacaaggcagcggcggatctcgatcgttcaaagcattcgggaggctagaactcagaatggttaaatccagtacaagtgatgcccaagctctcattcgctctctgcgttcagcttatgctgccacgcctaccaaacttaaaattattgatctttatgtggtttatgcaatcgctacagcagtaattcaggtggcatatatgggaatagttggatcatttcccttcaactctttccttgccggcgttctgtcctgcgtcggcacagcagtacttgcagtctgtcttcgcatccaagtgaacaaagagaacaaggaattcaaggatctaccagctgaacgagctttcgctgattttgttctttgcaacttggtgctccacctcgtggtgatgaacttcctcggctagagggtgttcttcctccttcattgtnttaatctttgcagtctttttgttgaacttgnntacaccatctatgattnccgttatcaaacaagtctngttcttcttncttgctntgtgttgttcnttgatgagcaacatgtaactgcaatctctccccccctccctngtcattaccaagtcaattatacaaattagnttntttannanttnatcatatttagtttcttatttttttaatctccattcttaaatantattgcaagttcattgttacaangancattataatatttataaatcgttgcataatnaa

SEQ ID NO: 1929 - DNA, 718 bp, Vitis vinifera
ccatattgcagcaactgatctgatccgttgaatggattgcattataagaaagaaacacccctcttcttctccgaagcgaaggaccagagtcaaccgatcttcacaggaagagcaatggcgaggtcgaccaccaaggacgctcaagcccttttccactctctccgctccgcctattctgcaactcctacgaatcttaagatcattgatctctatgtgattttcgcagtgttaacagctattattcaggtgggctacatggctattgttggatcattcccattcaactccttcctttcaggagtactttcctgtgttgggactgcagtccttgctgtttgtctccgcattcaagttaacaaagaaaacaaggaattcaaagacctaccaccagaacgggcttttgctgactttgttctctgcaatttggtgctccatttggtgatcattaacttcatgggttaaaattttaggagggatacctgctccaatcttgacagtgagtgttatatgaatagttatgtggctatttttcatagggcgtgtaatatggagatcaccattttacaagtggtgaacaattggaattttgggttttttttttttggctcggatttagcagtcatacttatctattatattaaaccaatgaattggagtatcattgctcttcatatagccattttgaaaattctcaaatgccttggtaaatattaaaaaa

SEQ ID NO: 1930 - DNA, 603 bp, Vitis vinifera
gaagcgaaggaccagagtcaaccgatcttcacaggaagagcaatggcgaggtcgaccaccaaggacgctcaagcccttttccactctctccgctccgcctattctgccactcctacgaatcttaagatcattgatctctatgtgattttcgcagtgttaacagctattattcaggtgggctacatggctattgtcggatcattcccattcaactccttcctttcaggagtactttcctgtgttgggactgcagtccttgctgtttgtctccgcattcaagttaacaaagaaaacaaggaattcaaagacctaccaccagaacgggcttttgctgactttgttctctgcaatttggtgctccatttggtgatcattaacttcatgggttaaaattttaggagggatacctgctccaatcttgacagtgagtgttatatgaatagttatgtggctatttttcatagggcgtgtaatatggagatcaccattttacaagtggtgaacaattggaattttgggttttttttttttggctcggatttagcagtcatacttatctattatattaaaccaatgaattggagtatcattgctcttcatata

SEQ ID NO: 1931 - DNA, 595 bp, Silene vulgaris
gtctcgagtcaagggaaggagagcacacaacaaataggcgagatcaacaaagacaaggacgcacaagcgctctttcactctcttcgttccgcttacgctgccactcctataaacctcaagatcatcgatctctacattatcttcgctgtttccactgctctaattcaggtcgcttatatggcgacagttggatcattcccattcaattctttcttgtctggcgtgctttcttgtgttgggacagctgttcttgctgtgtgtctccgcattcaagttaacaaggagaacaaggaattcaaggatttagccccagagcgggcctttgcggactttgttctttgcaatcttgtacttcatttggtgattatgaacttcctgggataaactagagcatcctggaaactctgttatgtgttagccatcctcgagtatccagcatagaactagtcttaggcatttctaagtttgcttgttgagaattgttgagatagagatcgggaaattgagaccctgtttaaagaacattttccgaaccttgaatacatacattgttggaaatcattgatatctctcacaaagttcacatcatcagaat

SEQ ID NO: 1932 - DNA, 584 bp, Prunus persica
cagaaaccagccgacgacgacgaagtagtgaagtatagaggaagagaaacaatggggaaagcatcgacatcgtcaacgaccaaggacgcgcttgccctcttcagttctcttcgctcagcttactctgccactcccatcaccctcaagatcattgatctctatgttgctttcgctgtgtccacagctctcatccaggtagtttacatggctatcgtcggatcattcccatttaactcatttctctcaggagtactttcttgtacagggacagcagtccttgctgtttgtctccgtattcaagtgaacaaagaaaacaaagaatttaaggatttaccaccagaacgggcttttgcagattttgttctctgcaacttggtgctgcacttggtgattatgaatttccttggataagttagcatcttttggtcttcattgatactgtttcctggaacaatgatgataagatatgatgcggtaactttttcttggtagttttcttgtatttgataaacttaacatgataagttatgtagccacaatatttgaaaaatgaacctgcaatagaatctgtcttttattacatt

SEQ ID NO: 1933 - DNA, 707 bp, Glycine max
gctaaaaaatgattcggcctaaagcccaagagagattgaaatgtacacctgaccctgagaaagtggcgaagagaatgggtgggtctagcagtagcagtagcagtagcagcaaggacgcccaagaccttttccgcgctctttggtctgcttatgcttcaaccccaacaaatctcaagatcattgacctctacgtaatctatgccgtcttcaccgctctcatccaggttgtttacatggctttggtgggatcatttccatttaactccttcctatcaggagtactttcttgtgtaggaactgctgttcttgctgtctgtctcaggatccaagtgaataaagataacaaggaattcaaggatcttgcacctgagcgtgcttttgcggattttgttctctgtaatttggtgcttcatttggtgatcatgaacttccttggttaaattggttcgtgtggctgttgttgttttcgattgaacccttgaataataaaaattagtagtatacctagactttttgtaatagtatttatagacagtaactggcatccaactaattgctttagttttatgttgattccccctccccccgccacttttggttctctgttttgaaagaagagattttgccatcttttgaagtttaaacaacttttgaatggtgaagaattacagaaggtattatttttcacatggatatctaaatctgag

SEQ ID NO: 1934 - DNA, 608 bp, Cirsium arvense
ggacaacactgaacacagtgaaaccattaacagcgtgagtttgtgtgtgagagtcaattagtaaatgggaaagccgccggcgacgacgaaagatgacgcccaagctctttttcactctctacgttctgcttattcggccactcccactaatcttaagctcatagatctgtacgtggtgtttgctgtcttcacagctctgattcaggtgggttacatggcgattgttggatcttttccgttcaactcttttctctcgggtgtactttcttgtgtagggacggccgttcttgctgtttgtcttcgtatccaagtaaacaaagaaaataaggaattcaaggatttacctccagagcgtgcttttgcggattttgttctgtgcaatttggtgctgcatttggtgatcatgaacttccttggataacttgtatccattatacatcaaaattatataactacattttgattttaaggattggctgaatattatttctaggttcttcatcttttcgtttacaccaaacgaatttaacatgttatcaggaatattacaaaattgctatctattaaaagaactcttgacgtcaaaaaagaaaaaagtaccgactgcg

SEQ ID NO: 1935 - DNA, 556 bp, Lactuca sativa
aggggagaagaatacactgaaactgttaaacagcaaagtaacgaagatgggaaagtcgacggcgacgacgaaagatgatgctcaagctcttttccgctctctgcattctgcttattccgctactccaactaatctcaagatcatagatctatacgtggtgttcgccgtcttcaccgctctgattcaggtgggttatatggccattgttggctcctttccattcaactcctttctctcaggtgtactctcttgtgtaggaacagctgttcttgcagtttgtcttcggatccaagtaaacaaagaaaacaaggaatttaaggatctacctcctgagcgtgcttttgcagattttgttttgtgcaatttggtgttgcatttggtgatcatgaactttcttggataaaattaggtcccgagtttattgcatcaaaagattatataaactaaattttcaatattgaggattagctgaatatctctaggctctttgctacattatgcttgatatgtataacattcaaaccttttatatttgctaaaggaaaacttttatccc

SEQ ID NO: 1936 - DNA, 530 bp, Lactuca sativa
aagaatacactgaaactgttaaacagcaagtaaggaagatgggaaagtcgacggcaacgacgaaagatgatgctcaagctctatttcgttctctgcattctgcttattccgctactcctactaatctcaagatcatagatctgtacgtggtgttcgccgtcttcaccgctctgattcaggtgggctatatggccattgttggctcctttccattcaactcctttctctcgggtgtactctcttgtgtaggaacagctgttcttgcagtttgtcttcgtatccaagtaaacaaagaaaacaaggaattcaaggatttacctcctgagcgtgcttttgcggattttgttttgtgcaatttggtgctgcatttggtgatcatgaactttcttggataaattaggtcccgagtttattgcatcaaaaagttatataactaaattttcgatattgaggaaggattaactgcatatctctaggctcttgctacattatgcttgatatgtataacatttaacccttttttatttgct

SEQ ID NO: 1937 - DNA, 635 bp, Helianthus annuus
agaacactgaacacagtgaagaaacaaagactgcctgagttctgtgtgacggaaaaacaatagaatggggaagtcgacggtgacgacgaaagatgatgcacatgctctttttcactctctacgttctgcttattccgctacccctaccaatctcaagatcatagatctgtacgttatgtttgccgtcttcaccgctctgattcaggtgggttacatggccattgttggttccttcccgttcaactcatttctctcaggcgtactctcttgtgtagggactgccgttcttgctgtctgtcttcgtatccaagtaaacaaagaaaacaaggaattcaaggatttacctcctgagcgcgcttttgcggattttgttctgtgcaatttggtcttgcatttagttatcatgaacttccttggataacttgtgtatctgatattgagaattacctgaatatctttaggttgttgctacatgagactcagatacatacatacttcactgttcagaccttttgctttgccaaagtaacttttatctagacccatatatcaatcacatagcaaacctgaatatctgaaattttgaatgtcaagtcatatttgaattgttgtgtatgagattctttcaaaacagc

SEQ ID NO: 1938 - DNA, 707 bp, Helianthus annuus
aactcatagtacgctgggagaacactgaacacagtgaagaaacaaagactgcctgagttctgtgtgacggaaaaacaatagaatggggaagtcgacggtgacgacgaaagatgatgcgcatgctctttttcactctctacgttctgcttattccgctacccctaccaatctcaagatcatagatctgtacgttatgtttgccgtcttcaccgctctgattcaggtgggttacatggccattgttggttccttcccgttcaactcatttctctcaggcgtactctcttgtgtagggacagccgttcttgctgtctgtcttcgtatccaagtaaacaaagaaaacaaggaattcaaggatttacctcctgagcgcgcttttgcggattttgttctgtgcaatttggtcttgcatttagtgatcatgaacttccttggataacttgtgtatctgatattgagaattacctgaatatctttaggttgttgctacatgagactcagatacatacagaattcactgttcagaccttttgatttgccaaagtaacttttatctagacccatatatcaatcacatagcaaacctgaatatctgaaattttgaatgtcaagtcatatttgaattgttgtgtatgagattctttcaaaacagccagctcacatataaaggaaattacaaggcatcaattgaacaaaattttatcttc

SEQ ID NO: 1939 - DNA, 568 bp, Arnica chamissonis
aatggtgaggtcgccggcgacgaaagatgacgcacatgctctttttcactctctccgatctgcgtattccgctactcctactaatctcaagatcatagatctctacgtggtgtttgctgtgttcacggctctaattcaggtggtttacatggcaatagttggctcttttccattcaactcttttctctcgggtgtgctttcttgtgtggggactgccgtcctagctgtttgtcttcgtattcaagtgaataaagaaaacaaggaattcaaggatttacctccagaacgtgcttttgctgattttgtgctatgcaatttggtgctgcatttggttattatgaatttccttggataagttgcgtttttaaacatgttatatgattgcatgttgatgacgggtttagcaatagatctcaaggtatcgttttgtggtgccgagtattgaattctgtattgggaataggataatcatgttgttacttatattgcaatatgtagttcatttcaattcattgtttactattgacatggtcttctacttgtcatatcagatgtcttttcaacaatg

SEQ ID NO: 1940 - DNA, 1420 bp, Cirsium arvense
aatatgttacgacatctctcacggatgcctaattaaaaagggcttgtatacagaaacaagtagttacaacattatactacatacgtgttctagatgaaaatagcatagcgattcctacggattaataattatacacgcaaatgatacacaaacctccggatcggagatccatcaatcaaaagtgtgtttcaaaaacttgcgaatttgcttcatgaaattgaaacggccattgttttctctcttctccttatggtggtgtgacatgtactttggcacgaattcttcgtctttgtcatcgtgatgatcgcggtggttgtggtggtggtggtgatggccgtagttgtgcttgaactccagccacttcgtcggaacctgatcatcgcctaaagttttcggatcaaaattataagttttgccagatgagatcatgtcgttgccgtatgaccgagggatcatgaacgtcttttcatacttccggcatggatgacgtcggacgaatctgagtggaatccgagtagttttatcaaaaacatgacgcttgatcggatgtaatctggcaaaattcagacgtttcgttggatcaatagtgctgacgtcaatcgtttgagtcttttcaatttccagcagacgatcattagcggtggtttcatcgaattctgatttcggcttctcgatcggaagaacgatatctgaatcggcgacagcgactgattccggcgaaaacttggatacaccatcagtcagtacgacgacctgatcgaggatacgagcggtggagacggcgaaccataagaacgtgaatatggtgaagactccgatctttttctccatggttatcgcctctgtgtgtgtgtgtgtgagagaagaagagaaaatggggaagtcgccgacgacgaaagatgatgctcaggcactttttcagtctctccgatctgcttactctgctactccaactaatctgaagatcatagatctgtacgtggtgtttgctgtgttcaccgctctagttcaggtggtttacatggcaatagttgggtcgtttccattcaactcgtttctctcgggtgtgctttcctgtgtagggacagctgtcctagctgtttgtcttcgtattcaagtgaacaaagaaaacaaggaattcaaggatttacctccagaacgcgcttttgcggatttcgttctatgcaatttggtactacatttggtgattatgaatttccttggataagttgacatggctgcattttgataaagggggtagcaaatagcaatagatgatctctttggggtattgctttgtgatgcttttgagtcttgaattgtgtattcacaataggataattattttcaaccttttttaaaagttttgaatctcaaagaattggatacttaatgaatagttcctcttaccttttggcta

SEQ ID NO: 1941 - DNA, 532 bp, Cirsium arvense
gaaagaaagagaaaaatggggaaatcggcgacgacgaaagccgatgctcaagctctatttcaatctctccgatctgcttactctgctactccaactaatctcaagatcatagatctgtacgttgtgtttgctgtgttcactgccctaattcaggtggtttacatggcaatagttggatcgtttccattcaactcgtttctctcgggtgtgctttcctgtgtagggacagccgttctagctgtttgtcttcgtattcaagtgaacaaagagaacaaggaattcaaggatttacctccggagcgcgcatttgcggatttcgttctatgcaatttggtgttgcatttggtgattatgaatttccttggataagttgagatagatgcattttaatgagggagtagcaaatagcaatagatctcttggggtattgctttgtgatgctttgagtcttgaattgtggattgacaataggataattattttgaagcttttaaaattttgaatctcaaagaactggatacttcttatattg

SEQ ID NO: 1942 - DNA, 558 bp, Flaveria ramosissima
aatattttgtgtgtgaaaagggggaaatggggaagtcgccgacgacgaaagatgatgcacaagctctttttcactctctccgatctgcttattcggctacacctactaacctgaagatcatagatctgtacgtggtgtttgctgtcttcaccgccctaattcaggtggtttacatggcaatagttgggtcgtttcccttcaactcttttctctcgggtgtgctttcttgtgtcgggacagctgtcctagctgtttgtctccgtatccaagtaaacaaagaaaacaaggaattcaaggatttacctccagaacgcgcttttgcagattttgttctgtgcaatctggtgctgcatttggtgattatgaatttccttggataagttatatctttgggcatgttatatgactgcattttgatgagggattagcaatatatccattggatattttgatttgtgatgatgagtcttgaattctatgatggcaataggataattgttctgaagcttttataactttgaaatatcaatgaactggttacttatattgcaatgaggc

SEQ ID NO: 1943 - DNA, 888 bp, Flaveria ramosissima
ctgttacatttcattatatctatatctaataccattaaacgcttgttaactcgctctagttgggtaccttaaatccaatcaacgagttcagaggccccgtcatcttataaaaagataaaaaggaaaagtacaatgcaaaaagtctatggccccatgcaggtctcgaacctgcgaccttcgcgttattagcacgacgctctaaccaactgagctaataggccttgatgtgcaatcttcgattcatacatattactacatcactttaactcgtcagatgtagggtttatcttgattcaacaccaccatcgataatcaagagtaaacgcagagaatctctgatcagtgtgtgtgtgtgtttgtgtgtaaaaagggggaaatggggagatcgccgacgacgaaagatgacgcacaagctctttttcactctctccgatctgcttattcggctactccgactaacctgaagatcatagatctgtacgttgtgtttgctgtcttcaccgccctaattcaggtggtttatatggcaatagttgggtctttccccttcaactcttttctctcgggcgtactttcttgtgtagggacagctgtcctagctgtttgtcttcgtatccaagtgaacaaagaaaacaaggagttcaaggatttacctccagaacgcgcttttgcagattttgttctgtgcaatctggtgctgcatttggtgattatgaatttccttggataagttatatctttgggcatgttatatgactgccttttgatgaggggttagcaatagatccatcagatattttgacttgtgatgatgagtcttaagttctgtgctgcctataggataactattagaaccttattataaatttgaaatatcaatgaactggt

SEQ ID NO: 1944 - DNA, 497 bp, Flaveria ramosissima
agaaactgcgattcagagtgtgctgtgtgtgcgaagagaagacgaaatggtgaggtcgccgacgacgaaagatgacgcacatgctctttttcactctctccgatctgcttattccgccactcctactaatctgaagatcatagatctctacgttgtgtttgctgtatcaacggctctaattcaggtggtttacatggcaatagttgggtcgtttcccttcaactcttttctctcgggcgtgctttcttgtgttgggactgccgtcctagctgtttgtctccgtatccaagtgaataaagaaaacaaggaatttaaggatctacctccagaacgtgcttttgctgattttgtactttgcaatttggtgctgcatttggtcatcatgaatttccttggataagttgcgtctttgggcatgttatatgactgcaatttgatgatgtgtctagcaatagatcgtttgggtatatcatgctggatattgaattctgtatcgg

SEQ ID NO: 1945 - DNA, 493 bp, Helianthus annuus
agaaatggtgaaatcggcgacgacgaaagatgacgcacatgctctttttcactctctccgatctgcttattccgctactccgactaatctcaagattatagatctgtacgtcgtgtttgctgtcttcactgccctaattcaggtggtttacatggcaatagttgggtcctttccattcaactctttcctctcgggtgtcctttcttgtgtagggacagcagtcctagctgtttgtcttcgtatccaagtgaacaaagaaaacaaggaattcaaggatttaccaccagaacgtgcttttgcggattttgttttgtgcaatttggtgctgcatttggtgattataaatttccttggataagttatgtgtttggacatgttatatgactgcattttttatgagggctagggacaggactttagatactgatttgtgatgcttgaatcttgaaatttatactggtaataggttatattgaaccttgttataactttg

SEQ ID NO: 1946 - DNA, 711 bp, Utricularia gibba
gttgaagtcgaggaaggagacgattgctcttcctgttggtgctctcgtagtacgatccatttacttgaggcttctgaggggggattgcgcgtgaagaagatatgggcagatctacgacaacgaaggatgccgaagcgcttgtgcattctcttcgctccgcctactcggccacaccaactaacctcaagataattgatctttacattgcctttgcggtggttactgccttgattcaggttgtttacatggccgttgttggatcgttccccttcaactcctttctttcaggagtactttcctgtgtggggacagctgtcctcgctgcttgtcttcggattcaagtaaacaaggaaaacaaggaggaattcaaggatttgcctccagagcgtgcctttgcggattttgtgctctgcaacctggtgcttcatttggtgatcatgaatttccttggatgatctcttcagtggtaagtccgaaaggaggggagacattcccactacgaacttctgctgctcttgtcaaagaattatctgagctcaagactgaaatgcgatcatgatcttgagagttctgtgcaacccatttctccattctcttcctgctgtgtgtgtgcatgttggatccggtctatatctgggcaatgtccggtctacatttcagaaaatttcgcatttaggatcttttttgaaacaaaatatttttcaaagttct

SEQ ID NO: 1947 - DNA, 823 bp, Artemisia annua
aagcagtggtaacaacgcagtactccgacggggacactgaagaaacaaagagaaagaaaatggtgaaaccaacagcagcgacgactaaagatgacgcgcaggcactttttaagtcactacgatctgcttattcagctacacctactaatctcaagattatagatctgtatgttgcgtttgctgtattcactgctgttattcaggtgggctacatggcaattgttggctcctttcctttcaactccttcctctcaggtgtactttcttgtgtcgggacagccgtccttgctgtttgtctccgtatccaagtaaacaaagaaaacaaggaattcaaggatttacctcccgagcgtgcttttgctgattttgttctttgcaatttggtcttgcatttggtgatcatgaacttccttggataacttgtgttctcagtttattacatcaaaagattatagactaaaattttgttatcgaggatttaccgaatatttctaggcccttgctgcatgatgattcatgatatgtgcaacatccaaacccgtttaatttacgaaagaagaaacttttatatcgctgctactagtttaccgatgttcaagtgtttgcatggatagatcatgtcaacttgaacttgtttgtgtcaacatataagctatatttctatcctgatgccattttccgtagaatctctatcctaatgctaaaaagtttcaaagattaagataaaacttgcccatgtgtattattctgatttatccgcaaaactgtatttttggtgaattcttgtgggtaacgatttctaccaacttgccctagagacacg

SEQ ID NO: 1948 - DNA, 589 bp, Cynara scolymus
  misc_feature (8)..(8): n is a, c, g, or t
  misc_feature (40)..(40): n is a, c, g, or t
  misc_feature (337)..(337): n is a, c, g, or t
  misc_feature (422)..(422): n is a, c, g, or t
  misc_feature (544)..(544): n is a, c, g, or t
  misc_feature (546)..(546): n is a, c, g, or t
ctgtggtntgtgtgtgtgagaagaagagaaaatggggaantcgccgacgacgaaagatgatgctcaggctctttttcagtctctccgatctgcttactccgctactccaactaatctgaagatcatagatctgtacgtggtgtttgctgtgttcaccgctctagttcaggtggtttacatggcaatagttgggtcgtttccattcaactcttttctctcgggtgtgctttcctgtgtagggacagccgtcctagctgtttgtctccgtatacaagtgaacaaagaaaacaaggaattcaaggatttacctccggaacgtgcatttgcggatttcgtnttgtgcaatttggtgctgcatttggtgattatgaatttccttggataagttgacatgattgcattttgatgagggagtagcaaanagcaatagatctcttggggtattgctttgtgatgctttgagtcttgaattgtgtattgacaaataggataattgttttgaaccttttaaaattttgaatctcaaagaactattttatgatcnanaatgttacccgataagataagtgaagtgataacttttgccggc

SEQ ID NO: 1949 - DNA, 628 bp, Panax ginseng
ggggacagcaaaagaagggtggagaaaaagagcgaaaatggggaagtcgtcgtcgaccagtaacgatgctcaagcactttttcagtctctccgttctgcttacgccgccactccgcctaatctcaagatcatcgatctgtacgtgattttcgcggtttccactgctttgattcaggtagtctacatggctattgttgggtcattcccattcaactctttcctgtctggagtactctcttgtgtagggactgcggtcctagctgtttgtcttcgcatccaagtgaacaaagaaaacaaagaatttaaggatttacctcctgaacgagcatttgcagattttgttctttgcaacttggtgctccatttagtgatcatgaacttccttggataagtagatgttttaggacactataatgttgtttttcctgaacttgggacatggtaaaatattttgaggccgctgagtctttcttggtaggttttagccacattcagactcatcctatatgaaaattttacctgcaactgggataatttatcaatagatggaattttgaactcctctttttattagttttaagtatgtttcttgagtattgcagtgcttctgagaattcaaaacctcttg

SEQ ID NO: 1950 - DNA, 590 bp, Helianthus annuus
gggactgtgtgtgtgagagaacggagaaatggtgaaatcggcgacgacgaaagatgacgcacacgctctttttcactctctccgatctgcttattccgctactccgactaatctcaagattatagatctgtacgtcgtgtttgctgtcttcactgccctaattcaggtggtttacatggcaatagttgggtcgtttccattcaactctttcctctcgggtgtcctttcttgtgtagggacagcagtcctagctgtttgtcttcgtatccaagtgaacaaagaaaacaaggaattcaaggatttaccaccagaacgtgcttttgcggattttgttttgtgcaatttggtgctgcatttggtgattataaatttcctcggataagttatgtgtttgggcatgttatatgactgcattttgatgagggctagggacaggactttagatattgatttgtgatgcttgaatcttgacatttgtactggtaataggttatattgaaccttgttataactttgaaatgtaggtgaatcggtcacttgtagtgcaatgaggtacacattcttgtagctcagctgaataaaacgctaac

SEQ ID NO: 1951 - DNA, 509 bp, Helianthus annuus
tgtgtgtgagagaacggagaaatggtgaaatcggcgacgacgaaagatgacgcacacgctctttttcactctctccgatctgcttattccgttactccgactaatctgaagattatagatctgtacgtcgtgtttgctgtcttcactgccctaattcaggtggtttacatggcaatagttgggtcgtttccattcaactctttcctctcgggtgtcctttcttgtgtagggacagcagtcctagctgtttgtcttcgtatccaagtgaacaaagaaaacaaggaattcaaggatttaccaccagaacgtgcttttgcggattttgttttgtgcaatttggtgctgcatttggtgattatgaatttccttggataagttatgtgtttggacatgttatacgactgcattttgatgagggctagggacaggactttagatattgatctgtgatgcttgaatgttgaaatttttactggtaataggttatattgaaccttgttataactttg

SEQ ID NO: 1952 - DNA, 523 bp, Helianthus annuus
cggagaaatggtgaaatcggcgacgacgaaagatgacgcacacgctctgtttcactctctccgatctgcttattccgctactccaactaatctcaagattatagatctgtacgtcgtgtttgctgtcttcactgccctaattcaggtggtttacatggcaatagttgggtcgtttccattcaactctttcctctcgggtgtcctttcttgtgtagggacagcagtcctagctgtttgtcttcgtatccaagtgaacaaagaaaacaaggaattcaaggatttaccaccagaacgtgcttttgcggattttgttttgtgcaatttggtgctgcatttggtgattataaatttcctcggataagttatgtgtttgggcatgttatatgactgcattttgatgaggactagggacaggactttagatattgatttgtgatgcttgaatcttgaaatttgtactggtaataggttatattgaaccttgttataactttgaaatgtcggtgaatcggtcacttgaagt

SEQ ID NO: 1953 - DNA, 626 bp, Helianthus annuus
atcagagtttgcaatcggaaaatggcgaaatctccgacgacgaaagatgacgcacaagctcttttttactctctccgatctgcgtattctgctactcctactaatctcaagatcatagatctgtacgtcgtctttgctgtcttcactgctctaattcaggtggtttacatggcaatagttgggtcgtttccattcaactcttttctctcgggcgtgctttcttgtgtagggaccgccgtcctagccgtttgtcttcgtatccaagtgaataaagaaaacaaggaattcaaggatctacctccggaacgtgcttttgctgattttgttctgtgcaatttggtgctgcatttggttataatgaatttccttggataagtcgagtctttggacatgctatatggactacattttgataatgaggttagcaatagatctcctgggtatggatttgtgaggctgagtaatgaattctgtatttgcaataggataatttgtttgttacttgtattgcaatatgtgggtcattgatattcagtggttactggcctggactaccatatgtcatatcaaatctctatatcaacaaattcggtttttaaatgactaaacctgttgtgttaccaaaa

SEQ ID NO: 1954 - DNA, 555 bp, Euphorbia peplus
cgagcaactaccagtaaggacgctcaagctcttcttcattctcttcgctcttcctatgccgccacacccaccactctcaagatcatcgatttgtatgttttgtttgcgatttccactgctgtgatccaggtagtttacatggcaattgtcggatcatttccattcaattcttttctttcaggagtactttcttgtgtaggcacagcagtcctagctgtctgcctccgtatccaggtgaacaaagaaaacaaggaattcaaggatttgcctccagagcgtgcttttgctgattttgttctctgcaatttggtactgcatttggtgattatgaatttccttggttaatatttggacttatggactgctgaatatgcattcctgtatccataacttcaagagttacagtaacaagtagttctttggaagattatgaaatatatgaaatgttgaattagttggaatgtttgccatataggtgtttacaattagaaatttgtgacttttatttatgtgaataatttccttatgaaatttgattcagtttgattgacaaac

SEQ ID NO: 1955 - DNA, 609 bp, Olea europaea
gacgactgcaacttgttactcatcttctcaatataattggtgatacagcggcagatccggcggccatatccgcgatcgcaaacgatcactgtactagcagatgcacaaaaagtgaaaaaaatggggagaacaacgacatcaaaggatgcccaagcactttttcattctcttcgctctgcatatgtggcaacccccactaatctcaagatcatcgatttgtatattatgtttgcagttgtcactgctgtaattcaggtagtttacatggctattgttggatcattccctttcaactcctttctttctggggtactttcgtgtgtcgggactgcagttcttgctgtttgtctacgtatacaagtgaacaaagaaaacagggaattcaaggatttacctccagaacgtgcatttgcagattttgttctctgcaatttggtgcttcacttggttatcatgaacttccttggataagattgtcacttgagaaacgaataatcgttttctagttttgataattaggctagaaacaaagttggcatttacaagaaaacatgaaaattgtctgtttatgagccaacagaacttgatcaatcgactgtctttgtctgt

SEQ ID NO: 1956 - DNA, 596 bp, Lippia dulcis
caagggttttgactaaattcctgcgcagagagatttagattgtctgaagaaatggcgagatcggggacgacgaaggatgcccaagctcttcttcattctctccgcttggcctacgccgccacgcctacgaatctcaagatcatcgatctctacattgttttcgcagtcctcaccgctgtgattcaggtagtttacatggccattgttggaacgttcccgttcaactccttcctctcaggggtgctttcatgtgtgggaactgcagtccttgctgttagtcttcggattcaagtgaacaaggaaaacaaggaattcaaggatttacccccggaacgtgcttttgctgattttgtactctgcaacctggtgcttcatttggttataatgaacttcttaggataagttgattttctggaaagggagagcttgttcagattctgataggctttgattaaatcagacaagagaaaccattgttatgcacttttttaaagtttcaactgctgctctggtctaagacaattaatttttggttatgtagaattgcaatattactgtattttgcactttattatttggattattaaaatataaaa

SEQ ID NO: 1957 - DNA, 621 bp, Ipomoea nil
gggaactcagtctatttggtccatagagatcgtagtgagagagagagagagagactgcagaagaagagagatggcgagatcgtcgacaggtaaagatgctcaagcactcttccactctctgcgctctgcgtatgccgccactcctactaacctcaagatcattgatctgtatgtcatgtttgccctcttcactgctgtaattcaggtggtgtacatggccattgttggatcatttccattcaattcctttctctcaggggtactttcttgtatagggacagcagtcctagctgtttgtcttagaatccaagtaaacaaagagaacaaggagtttaaggatttgcctccagaacgagcttatgcagattttgttctctgcaatctggtgctccatttggtgatcatcaacttccttggataaaaccgaggcttctataatttactgattactgctttctgcaaagcggtggttatatgtcattagaacaattgaggcattgacgtagacatgttgagacttgcttcttatacattcgccttctgggactgtattttcgttgattttgtagaaattttatttgcctattgagttaaagagaacacagataaatattttgcttt

SEQ ID NO: 1958 - DNA, 523 bp, Salvia sclarea
ctagtggatccccgggctgcaggaattcggcacgaggctcatcactctcaaacaaattagagagatttagagtgagagaaatggggagatcggcgacgacgaaggatgcccacgccctgtttcactctctccgctctgcctacgccgcaacccctaatcaactcaagatcattgatctctacattctgttcgctgtcgtcaccgctgtgattcaggttgcttacatggctattgttggatcattcccatttaactcctttctttctggtgtactttcatgcgtggggactgctgtacttgctgttagtctccgaattcaagtaaacaaagacaacaaggaattcaaggatttacctcctgaacgtgcttttgcagattttgtactctgcaatctagtgcttcatttggttattgtgaacttcctaggataactggaaaagagatgagcttgtttgagctttgagttgtactccaatagaatcattgtaatggtcttattacaagtgttacctgttactggatt

SEQ ID NO: 1959 - DNA, 574 bp, Salvia sclarea
accttggctgtcactcaggggtttcagtctgcatagactctgttcttacagtctcaaacaaaatacagagatttgaagtgtgagaaatggggagatcggcggcgacgaaggatgcacaagctctctttcactctctccgctctgcctacgccgcaacacctaataatctcaagatcattgatctctacattctgtttgctgtcgtcaccgctgtgattcaggttggttacatagctatcgtcggatcattcccatttaactccttcctttctggtgtactttcgtgcgtggggactgctgtccttgctgtgagtctccgaatccaagtaaacaaagacaacaaggaattcaaggatttgcctcccgagcgtgctttcgcagattttgtattctgcaatctagtgcttcatttggtaatcatgaacttcctagggtaaatcgatgtcctggaaatgagacgagcttgtttgagtttttattgtactccgatggaatcgttgccgtggacttgttagaagttttacatgttaatggatatctgatacaagaaaattgccaagaggttggcatgtaa

SEQ ID NO: 1960 - DNA, 559 bp, Sesamum indicum
ggcttttagttctcgtattcacttcacagaccttgttcgttcttctacctgcacacagggaaatggggagatcggcgacgacaaaggatgcgcaggctctttttcattctctccgctctgcctacgccgccactcccaataatctcaagatcatcgatctctacattgtattcgcggttgttactgctgtaattcaggtagtttacatggccattgttggatcattccctttcaactcctttctttcaggggttctttcatgtgtgggaactgctgtccttgctgttagtcttcggattcaagtaaacaaagaaaacaaggaattcaaggatttacctccagagcgtgcttttgctgattttgttctctgcaatttggtacttcatttggttatcatgaacttcctgggataagttgatgttctgccgaaggaacaagctctccagattctgattacactctctctgatgcaatcagacagtgtgataacattttttatgcacttaatttaaacttccatctgttattgaggtcgaatacaagaaggaaatataaaaaa

SEQ ID NO: 1961 - DNA, 835 bp, Zingiber officinale
  misc_feature (239)..(239): n is a, c, g, or t
  misc_feature (245)..(245): n is a, c, g, or t
  misc_feature (266)..(266): n is a, c, g, or t
  misc_feature (273)..(273): n is a, c, g, or t
  misc_feature (278)..(278): n is a, c, g, or t
  misc_feature (290)..(290): n is a, c, g, or t
  misc_feature (323)..(323): n is a, c, g, or t
  misc_feature (359)..(359): n is a, c, g, or t
  misc_feature (425)..(425): n is a, c, g, or t
  misc_feature (466)..(467): n is a, c, g, or t
  misc_feature (477)..(477): n is a, c, g, or t
  misc_feature (487)..(488): n is a, c, g, or t
  misc_feature (497)..(497): n is a, c, g, or t
  misc_feature (507)..(507): n is a, c, g, or t
  misc_feature (522)..(522): n is a, c, g, or t
  misc_feature (528)..(528): n is a, c, g, or t
  misc_feature (608)..(608): n is a, c, g, or t
gcacgcggtctcgtgccgaattcggcacgaggggagcggcgatctccgttggcctaattgcgtcagaaagctaagatctaagaatggcaaagtcaagttcgaatgatgctcaagcactcattcgctctctgcgatctgcttatgctgctacaccaactaatctcaaaatcattgatctttatgtggtctatgcaatcactacagcagtaattcagatcgtgtacatgggaatagttggntcattnccctttaattctttcctctcnggcatcntgtcntgtgttgggacngcagttcttgcagtttgcctgcgcattcaagtnaacaaagagaacaaggagtttaaggatctttcaccngaacgagcttttgctgattttgttctctgcaacttggtgctccacctggtgatcatgaacttcctngggtagatggaactgtctgctgtagcattcttctttttctnncctttagatntatttgggcnngaactgtgngattaggagnttatttctcatatcntacgantaacatgattttgtccttgtttatggaaaatctaaaggaactccatgagcttgtttgagtaaaaaaacctcgtgccgaantcggcacgaggcctcgtgcgaattcggcacgagggatgactggtatatgcttctattcaatgttgttctcacttcattgccagtcattacattgggtgtatttgagcaagacgtctcttctgaagtttgcttgcagttcccagcattgtaccaacaagggcaaaagaacctattttttgattggtacagaattatcggatggatgttcaatggcctatatacatcca

SEQ ID NO: 1962 - DNA, 581 bp, Triphysaria pusilla
gggaaaaccggcgacgacaaaggatgcgcaagctctttttcagtctctccgatctgcctacgctgccactcccgcaaatctcaagatcatcgatatctatattgtgttcgccgttgttactgctctaattcaggtagcttacatggccattgttggatcattcccgttcaactcctttctttcaggggtactttcttgtgttgggactgctgtcctggctgtcagtcttcggattcaagtaaacaaagaaaacaaggaattcaaggatttacccccagaacgtgcttttgcagattttatactctccaatttggttcttcatttggttataatgaatttcctaggataactttctggaaaaggaaaatgcttcttcgggttctgatgaatcaggcgcatttgccatacacttagttttttacctgttactcatatgagaaaattgccggaatgtcgcctcacttatagagatttgcaatgtattagattgaagaatataaaattttgaaccatgaaccattttaacacagacaataatacttgtatcgttgcggcattttacatataaaagatgttttgag

SEQ ID NO: 1963 - DNA, 714 bp, Acacia harpophylla
ggacgactttgcgaatggtgtgacctggttcgacccaaaagatttgagggttctgcgatcttcgtcatcgactgccaatcgaagctgtagaaagtagcagtctaagaggagagacgagtagcaccagttcgaggatggcgaagtcaactagcaaggatgctcaagaccttcttcgcgctctttggtctgcttattccgccactcccactaatctcaagatcattgacttgtatgtcatgttcgcagtgttcacagctctgatccaggtagtttacatggctttggtgggtcattcccattcaactccttcctttcaggagtattttcttgcgttgggactgcagttcttgctgtttgtctccggatccaagtaaacaaggagaacaaggaattcaaggatctggcaccagagcgtgcttccgcagattttgttctgtgcaatttggtactccatttggtgatcatgaacttccttggctaagttgtggctgtggctctcgttatgtgcaatgaaccacatagattataaaaaaaaaattcaaaagtattgtgtattagctccccccccccctcttctttcctttcttcctcaacagagttaccttatcaatagccttgtgttgaacatttttggggaatttttcagctatgttgtaattttacattgcaactaatgaaatgaatttttgaatagcttaaaaaaaaaaaaaaaaa

SEQ ID NO: 1964 - DNA, 720 bp, Catharanthus roseus
ctgaagcatagaggcaggcaccggaagagtgaagaaatggcgagatcgtcgtcgtcgacaaaagatggtgagagctttctggcgctcttccattcactccgctctgcttatgccgccacccctactaatctcaagatcatcgatctatacattatttttgctgtcttgaccgctctaattcaggtagtatacatgggtattgttggatcgtttcctttcaactcatttctgtcgggggtactctcttgtattggtacagcagtcctcgctgtttgcctccgaatccaagtgaacaaggacaacaaggagtttaaggatttaccatcagaacgtgcctttgcggattttcttctctgtaacctcgtgcttcatttggtgatcatgaatttccttggatgataagctagagaattttaaagtgaaggaagagagtgccttcttggaatgttgttcgagataggaatgaaacagaaactagtctcattttcattcttagaccccaaaaccttacatgtcgcgaggctttttagcgctcagtctttagacattttttgtatgcactggacaattgttttatttctaaagaacttgaatttgtaagaattagaaaaaaatatatacctgactttaatggttctagaatttcattacttgtacaactggattgtttctgcagtgtgagatttagccataccgtgtgatgatgccatatgttttgcc

SEQ ID NO: 1965 - DNA, 707 bp, Ambrosia trifida
agatcagatcagtgtgtgagtataataatcgaacaaatggcgaaatcaacgacgacgacgacgaaagatgacgcacatgctcttttccattctctccgatctgcctattccgccactcctactaatctcaagatcatagatctgtacgtggtgtttgctgtcttcactgctcttattcaggtggtttacatggcaatagttggttcgtttccattcaactcttttctctcgggcgtgctttcttgtgtagggaccgccgtcctagctgtttgtcttcgtatccaagtgaacaaagaaaacaaggaattcaaggatttacctccggaacgtgcttttgctgactttgttctgtgcaatttggtgctgcatttggttatcatgaatttccttggataatttgagtctttggacatgttctatgaccacattttgatgatgaggttagcaatagatctcctgggtatggatttgtgaggctgagtaatgaattctgtatttgcagtaagatattgtttgttacttatattgcaatatgtggttcattaaaatacagtggttactggcatggtctaccatatgtcatatcaaatatctatatcaacgaattaaataactaaacatgtgctatcatcatgatattgttaatgatgtgactatgatgccaatccgtagaagattaaatgtatggtacaatttattcaaaaaga

SEQ ID NO: 1966 - DNA, 700 bp, Ambrosia trifida
cctgtatttgactatccaatctccagagtaaacgcacagatcagatcagatcagatcagatcagtgtgtgagaataataataaatcgaaaaaatggcgaaatcaacaacgacgacgacgaaagatgacgcacacgctcttttccattctctccgatctgcctattccgctactcctactaatcttaagatcatagatctctacgtagtgtttgctgtcttcactgctctaattcaggtggtttacatggcaatagttggatcgtttccattcaactcttttctctcaggcgtgctttcttgtgtagggaccgctgtcctagctgtttgtcttcgtatccaagtgaataaagaaaacaaggaattcaaggatttacctccagaacgtgcttttgctgactttgttctgtgcaatttggtgctgcatttggttatcatgaatttccttggataatttgagtctttggacatgctctatgaccatattttgatgatgaggttagcaatagatctcctgggtatggacttgtgaggctgagtaatgaattctgtatttgcaataagacaatttgtttgttacttatattgcaatatgtggttcattaaattacagtggttactggcatggtctaccatatgtcatatcaaatatctatatcgggaacaatttggtttttaaataactaaacgtgttgtgctatc

SEQ ID NO: 1967 - DNA, 566 bp, Lippia dulcis
cagtatcaatctcaagcaaaatacagaggtttagagtgtgagaaaatggggaaatcagcgacgacgagggatgtccacgctctgtttcactctcttcgctctgcctacgccgcaaccgctaatcatctcaagatcatcgatctctacattttcttcgctatcgccaccgctctgatccaggttgcttacatggctattgttggatcattcccatttaactcctttctttctggtgtgctttcatgcgtgggaactgctgtccttgctgttagtctccgaattcaagtaaacaaagacaacaaggaattcaaggatttacctcctgagcgtgctttcgcggattttgtactctgcaatctagtgcttcatttggttattatgaacttcctaggataagtcaatgtcctggaacagacatgagctcatgtggttttgaattgtacaatcattgtcatcgatttattagaagtttttgctgttacacttgatatttgatacaagaaaactgagagaatttaattaatgtactaatattttaactaaacgaaatactatgttttgagcca

SEQ ID NO: 1968 - DNA, 569 bp, Persea americana
gttgagagcaccagccggcgcacagggagagaattgaattgaaggggaatggcaaagtcatcctcgtcttccacagccaaggatgctcaggctctcatccaatctcttcgctctgcatattctgccacacccaccaatctcaagatcatcgatctgtacgtgatgtttgctattttcacgggcctgattcaggtggtttacatggcattagtcggatcatttccattcaactcattcctgtcgggagtactttcttgcatcgggacggctgttcttgcagtttgcctccgcattcaggtcaacaaagagaacaaggaatttaaggatctgccaccagaacgtgccttcgctgattttgtcctctgcaatttggtgctccatttggtgatcatgaacttccttggatagttcagatcagttactgatcatgggcctgttaacaggacggaacttgttacatttagaagattgcggttgctcttacatgagtatgatgtgttgtcatagctgagtttttgagtaactttttcatagattatgagaaaccatactaaattaatatatttata

SEQ ID NO: 1969 - DNA, 670 bp, Nicotiana tabacum
gatatcagttagaggtcgcaactagcaagtgagagagaaaaatggcgaaatcttcagcgaccaaagacgctcaagcacttctccactctctccgttctgcttacgcttcaactcccactaatctcaagatcattgatatatatgtactgtttgcgatattcaccgctgtaattcaggttgggtacatggctattgttgggtccttcccattcaactcttttctctctggggtactctcttgtgtaggcactgcagtccttgctgtttgtctccgaatccaagtaaacaaagaaaacaaggaattcaaggatttgccaccagaacgtgcttatgcagattttgttctctgcaatttagtgctccatttggtgatcatgaatttccttggatagattgacgttcttaatctcgagtgaatgctgcttatccaaatattcttgtctgtaaggatgctgttaaggcaagcactttagcaatatgagagttctgtttgccctttttcatcatcatttatgaacctgataatttgtcaattagacataggtactttggatagctgttctttgcagttttaaaagtatgaactttacctcatgaaatatacgtacctgtcctcccttggatttttgtttgcgctcatcatttttaataatttagctgttcaagcctt

SEQ ID NO: 1970 - DNA, 715 bp, Triphysaria pusilla
caattgcagactgaaattaggagccagagaaatgggaaagccggcgacgacaagggatgcgcaagctcttttacattctctccgatccgcctacgctgccacacccgcaaatctcaagatcattgatatctatattgtgttcgccgttgttactgctctaattcaggtagtttacatggcaatggttggatcatttccgttcaactcatttctttcaggggtactctcctgtgttgggactgctgtccttgctgttagtcttcgtattcaagtaaacaaagaaaacaaggaattcaaggatttacctccagaacgtgcttttgcagattttatactctgcaatttggttcttcatttggttatcatgaatttcctaggataactaatggtcggaaaaggaaagagcttttccgggtcctgaggaatcagtcgtcatagtttaaaatgttagattttactcatttgagaatattgccagcacgtggaccttcacttatagagatttgcaatgtaatagattggagaatataaatttctgaattatgaatcatacactggacaataatctttttatagttgcgaaaagttacatacatgtaagagatgtttggagtcctggctgatatatcttagctactgtgatattgtgacgtgtcttagaagttgagttgtttttagtccgaataaaattggaatcatatgagcttgttttatg

SEQ ID NO: 1971 - DNA, 663 bp, Rosa hybrid cultivar
gagagttggatctagtagagcaagccagacagtgtaacagagagacgaagaagaagaagaaggggttgccagagttgaactcaattcgatctttcgaaaatggtgaggccttcgtcatcgtcgtcctctacgagccaggacgcccttgcccttttcaattctctgagatcggcttactccgccactcctaccgctctcaagatcattgatctctatgttggtttcgctgtatccacagctatcatccaggtagtctacatggctcttgttggatcattcccatttaactcttttctctctggagtactctcatgcatagggacagcagtccttgctgtttgcctccgtattcaagtgaacaaagaaaacaaggaatttaaggatttagcaccggagcgggcttttgcagattttgttctctgcaatttggttctgcatttggtgatcatgaatttccttggatgaattagcaccttttggcctgctttgatactgtttcctagaacaatgagaactagatatgatcgatgataaacaattattatgtatccgctgtagcaatttgcttgccattttgattttatttgataaattcacatggtaagttaccaagttatgcagaccccatatatgaaaaatcctgcaattaatttttcggtcact

SEQ ID NO: 1972 - DNA, 648 bp, Rosa hybrid cultivar
gagagcaagcaagacagtgtaacagagagacgaagaagaagaagaaggggttgccggagttgaactcaattcgatctttcgaaaatggtgaagccttcgtcatcgtcgtcctctacgagccaggacgcccttgcccttttcaattctctgagatcggcttactccgccactcctaccgctctcaagatcattgatctctatgttggtttcgctgtatccacagctatcatccaggtagtctacatggctcttgttggatcattcccatttaactcttttctctctggagtactctcatgcatagggacagcagtccttgctgtttgcctccgtattcaagtgaacaaagaaaacaaggaatttaaggatttagcaccggagcgggcttttgcagattttgttctctgcaatttggttctgcatttggtgatcatgaatttccttggatgaattagcaccttttggcctgctttgatactgtttcctagaacaatgagaactagatatgatcgatgataaacaattattatgtatccgctgtagcaatttgcttgccattttgattttatttgataaattcacatggtaagttaccaagttatgcagaccccatatatgaaaaatcctgcaattaatttttcggtcact

SEQ ID NO: 1973 - DNA, 616 bp, Ambrosia trifida
aaacgcacagaaattgagatcagatcagatcagatcagtgtgtgagaataataataatcgaaaaaatggcgaaatcaacgacgacgacgaaagatgacgcacacgctcttttccattctctccgatctgcctattccgctactcctactaatcttaagatcatagatctctacgtgctgtttgctgtcttcactgctctaattcaggtggtttcatggcaattgttggatcgtttccattcaactctttcctctcaggcgtgctttcttgtgtagggaccgccgtcctagctgtttgtcttcgtatccaagtgaataaagaaaacaaggaattcaaggatttacctccagaacgtgcttttgctgactttgttctgtgcaatttggtgctgcatttggttatcatgaatttccttggataatttgagtctttggacatgctctatgaccatattttgatgatgaggttagcaatagatctcctgggtatggacttgtgaggctgagtaatgaattctgtatttgcattaagataatttgtttgttacttatattgcaatatgtggttcattaaaatacactggttactggcatggtcacccatatgtcatatcaaa

SEQ ID NO: 1974 - DNA, 561 bp, Cichorium intybus
tggcgggggagggagaccacagaaactgtcaacagcaacgaagatgggaaagtcgacggcgacgacgaaagatgatgcgcaagctctttttcgctctctgcattcggcttattccactactcccactaatctcaagatcatagatctgtacgtggtgtttgccgttgtcaccgctctgattcaggtggtttacatggccattgttggctcctttccattcaactcctttctctcgggtgtactttcttgtgtagggacagctgtccttgctgtttgtctccgtatccaagtaaacaaagaaaacaaggaattcaaggatttacctccagaacgtgcttttgctgattttgttttgtgcaatttggtgctgcatttggtgatcatgaatttccttggatagtttatatccaaagtttgttgcatcaaagattatattactaaattttggatattgagaattagctaaatatctttaggctcttgctacattatgctatatacatataacattcaaaccctttaatttcctaaagaaaaaacctctacctgtattggttgttt

SEQ ID NO: 1975 - DNA, 492 bp, Cynara scolymus
cggggacccagaaactgttagagcgtgagtgtgtgtgcgagtgacaaataggaaatgggaaggtcgccggcgacgacgaaagatgatgcgcaagctctatttcactctctacgttctgcttattcggccactcccactaatcttaagctcatagatctgtacgtggtgtttgctgtcttcaccgctctgattcaggtgggttacatggcgattgttggatcctttccgttcaactcttttctctcgggtgtactttcttgtgtagggacagccgttcttgctgtttgtctccgtatccaagtaaacaaagaaaacaaggaattcaaggatttacctcctgagcgtgcttttgcggattttgttctgtgcaatttggtgctgcatttggtgatcatgaacttccttggataactcgtatccttagtctactacatcaaagttatataactacattttgatattgaggattggctgaatgtttcaaggttcttc

SEQ ID NO: 1976 - DNA, 482 bp, Taraxacum officinale
tagaactgtgaacagcaaggaagatgggcaagtcgacggcgacgacgaaagatgatgcgcaagctcttttccgctctctgcattctgcttattcagctactcccactaatctcaagatcatagatctgtacgtggtgtttgccgtcttcaccgctctgatccaggtgggttacatggccattgttggttcctttccattcaactcctttctctcaggtgtactttcttgtgtaggaacagctgttcttgcagtttgtcttcgtatccaagtaaacaaagaaaacaaggaattcaaggatttacctccggaacgtgcttttgcggattttgttttgtgcaatttggtgttgcatttggcgatcatgaacttcctagggtaacatatgtcgtttttatagcataaacaaattatagaactaaaatattgctacattatgctccggtatgttaaacattcaaactttttttttaaatttgccgaa

SEQ ID NO: 1977 - DNA, 386 bp, Aquilegia formosa
atggtgagatcgtcgacttcttcatcaacaagtacgaaggaagatgcccaagctcttattcaatcccttggatctgcttacgctgttacaccaaccaatctcaagataattgatctctatgtaatgtttgcaattctcactgctctgattcaggtggtttatatggcaatcgttggttcatttccattcaactctttcctttcgggtgtattatcttgtgtaggaacagcagttctagccgtttgtctccgcatccaagttaacaaagagaacaaggaattcaaggatttaccaccagaacgtgcttttgccgattttgtgctatgcaatttggtgcttcatttggtgatcatgaacttccttggatagattggagaactacagat

SEQ ID NO: 1978 - DNA, 603 bp, Helianthus annuus
atcagagtttgcaatcggaaaatggcgaaatctccgacgacgaaagatgacgcacaagctctttttcactctctccgatctgcgtattccgctactcctactaatctcaagattatagatctgtacgtcgtctttgctgtcttcactgctctaattcaggtggtttacatggcaatagttgggtcgtttccattcaactcttttctctcgggcgtgctttcttgtgtagggaccgccgtcctagctatttgtcttcgtatccaagtgaataaagaaaacaaggaattcaaggatctacctccggaacgtgcttttgctgattttgttctgtgcaatttggtgctacatttggttataatgaatttccttggataagttgagtctttggacatgctatatggactacattttgataatgaggttagcaatagatctcctgggtatggatttgtgaggctgagtaatgaattctgtatttgcaataggataatttgtttgttacttatattgcaatatgtggttcattaatattcagtggttactggcctggactaccatatgtcatatcaaatctctatatcaacgaattcggtttttaaatga

SEQ ID NO: 1979 - DNA, 535 bp, Gerbera hybrid cultivar
tcataaactgtgatccgagtgtgtttttgtgcgacgaaaatggggaaatcgtcgacggctaaagatgatgcacaagctctttttcactcgctccgatctgcttattctgctactccgactaatctgaagatcatagatctgtacgtggtgttcgctgtctccaccgctataattcaggtggtttatatggcaatcgttgggtcgtttccattcaactcttttctctcgggtgtgctttcttgtgtaggcacagctgtcctagcagtttgtcttcgtattcaagtgaacaaagaaaacaaggaattcaaggatttacccccagaacgagcttttgcagattttgttctatgcaatttggtgctacatttggtgattatgaatttccttggataggtttatctttggaaatgccataccaaaagatttcatgttgaattttgtaatggcaataggatcattatgttgaccttttacaaatttttaaatgttgaagaattagaaacatggacaatattcatttactccaatttatttc

SEQ ID NO: 1980 - DNA, 626 bp, Helianthus annuus
atcagagtttgcaatcggaaaatggcgaaatctccgacgacgaaagatgacgcacaagctctttttcactctctccgatctgcgtattccgctactcctactaatctcaagatcatagatctgtacgtcgtctttgttgtcttcactgctctaattcaggtggtttacatggcaatagttgggtcgtttccattcaactcttttctctcgggcgtgctttcttgtgtagggaccgccgtcctagccgtttgtcttcgtatccaagtgaataaagaaaacaaggaattcaaggatctacctccggaacgtgcttttgctgattttgttctgtgcaatttggtgctgcatttggttataatgaatttccttggataagttgagtctttggacatgctatatggactacattttgataatgaggttagcaatagatctcctgggtatggatttgtgaggctgagtaatgaattctgtatttgcaataggataatttgtttgttacttatattgcaatatgtggttcattaatattcagtggttactggcctggactaccatatgtcatatcaaatctctatatcaacgaattcggtttttaaatgactaaacctgttgtgttaccaaaa

SEQ ID NO: 1981 - DNA, 674 bp, Sarracenia psittacina
ttccaaacacgaactttgtcgccggtgccggcgcggtttctaggttacacttccgagagagaagaagaagaagaagagagttcgagaatgggaaaatcttcgacgacaaaggacgcacaagcgcttttccactcgctccgttccgcttacgtggctactcccacaaatctcaagataatcgatctctacgtgatttttgcggccgtcaccgctctgattcaggtagtttacatggctattgttggatctttccccttcaactcttttctctcaggaattctttcttgtgttgggacagcggttcttgccgtttgtctccgcatccaagtgaacaaagaaaataaggaattcaaggatttgccacctgaacgcgcctttgcggactttgttttatgcaatttagtgcttcatttggtgattatgaacttccttggataaagtgggggcttggggactatagtagggttgtttaataaaatgtagtttgaggccatttgttgccttgttaggttattaaccttataaatcaggttcaacattatgggagtttgtatccgttatgaaaatatttctgcaatgaccgggaactggaagtttgaactgctctgtttaatgagttaaagacaaccccttgacgtcgaactattctatttgctttgatctcttgatggttg

SEQ ID NO: 1982 - DNA, 546 bp, Sarracenia psittacina
ttcgagaatgggaaaatcttcgacgacaaaggacgcacaagcgcttttccactcgctccgctccgcttacgtggctactcccacaaatctcaagataatcgatctctacgtgatttttgcggccgtcaccgctctgattcaggtagtttacatggctattgttggatctttccccttcaactcttttctctcaggaattctttcttgtgttgggacagcggttcttgccgtttgtctccgcatccaagtgaacaaagaaaataaggaattcaaggatttgccacctgaacgcgcctttgcggactttgttttatgcaatttagtgcttcatttggtgattatgaacttccttggataaagtgggggcttggggactgttttaagggttgtttaataaaatagttttgaggccatttgttgccttgttaggttattaaccttataaatcaggttcaacattatgggagtttgtatccgttatgaaaatatttcttcaatgaccggaaactggaagtttgaactgctctgtttaatgagttaaagaca

SEQ ID NO: 1983 - DNA, 929 bp, Amborella trichopoda
tactttaagcgctgcgaggcatctcgcgaggcacagagcaacagcgcctctcgctctctttcccaacaaaacagcagctcctctgcgaaagttttctctcgtcctatcttcccagaaaaggcacctcgccaagtactattcgcggccttgctacctcaacaactaccttcaatcaagagaaagagagagagagagagagagaatatggcgaggtcgtcgtcatcgtcttcaagcactgctaaggatgcccaggctcttatacaatccctccgatctgcttatgctgcaacccccaccaaccttaagctcatagatttgtacgttgtttttgcagtcctcacagccttgatccaggttgtatacatggcaatagttggatcatttccattcaactctttcctttctggagttctttcttgtgtaggcactgctgttattgcagtttgtctcaggattcaagtcaacaaagagaacaaggaattcaaggatcttgcacctgaacgagcttttgcagactttgttctatgcaatctagtcctccatctggttattatgaacttcctgggctagaagtatagcatctcataccgaatggttatggtatcatggatattaaactatgagaaaagaactggcaaatttgagttcatggatattaaactatgagaaaagaactggcaaatttgagttaaatttgggtatctacaaaatttttggatgttacatttagctttgtttaatcacagagggtttgctaagctggccatgaaatcaccctggtggcatgtagtttgggaattccctattggcttcttgtttttgtttgattgcatcgaccccctttgttttcaatattacggactagaaatgcatcccaaatcattataaattcatttccaccttaaacccatagattgggattccaaaaa

SEQ ID NO: 1984 - DNA, 714 bp, Amborella trichopoda
  misc_feature (52)..(52): n is a, c, g, or t
ctctcgctctctttcccaacaaaacagcagctcctctgcgaaagtttctctngtcctatcttcccagaaaaggcacctcgccaagtactattcgcggccttgctacctcaacaactaccttcaatcaagagaaagagagagagagagagagagaatatggcgaggtcgtcgtcatcgtcttcaagcactgctaaggatgcccaggctcttatacaatccctccgatctgcttatgctgcaacccccaccaaccttaagctcatagatttgtacgttgtttttgcagtcctcacagccttgatccaggttgtatacatggcaatagttggatcatttccattcaactctttcctttctggagttctttcttgtgtaggcactgctgttattgcagtttgtctcaggattcaagtcaacaaagagaacaaggaattcaaggatcttgcacctgaacgagcttttgcagactttgttctatgcaatctagtcctccatctggttattatgaacttcctgggctagaagtatagcatctcataccgaatggttatggtatcatggatattaaactatgagaaaagaactggcaaatttgagttcatggatattaaactatgagaaaagaactggcaaatttgagttaaatttgggtatctacaaaatttttggatgttacatttagctttgtttaatcacagagggtttgctaagctg

SEQ ID NO: 1985 - DNA, 829 bp, Medicago truncatula
agacaaacttcaattaattagtctttacaggaagtaccgcaagaattccagcggctgatccacgtctgtagtagttgtctgaatatcggaatccaaaggtagaaggaagagttgaagacaatggttaagtctactgctaaggatgcacaagatcttatccgcactctttggtctgcttattccgcaacccctacaaatctcaagatcattgatcattatgttgtgttcgctgtcttcactgccctcatccaggtagtttacatggctttggtgggaacatttccattcaactccttcctgtcgggagtactttcttgcgttggaactgcagttttggctgtttgtctccggatccaagtgaataaagagaacaaggaattcaaggacattgctcctgagcgtgcttttgcagattttgttctctgcaatgtggtgctccatttggtgatcatgaatttccttggttaaattgggttcatgtagctttgcttgattccattagaacagaactcattgactcaaaagacgaagaaaaatagagcagagacctgggataggaaaaataatagtagttgtacctggaccctttccttttccgggaattttgtttggacagagaaatgctaggagtttactttgcattcttttaaatgtttgttgaatttgaattacacaagatgttcacatcaactatctaaatctgagcaaggtgttcgcatgttttagtcttctgaacaaatttgaatgatctgttataactgccttctcctgcatctaaatgaaaggaatgttggattagagtacctccaacaatgatttgggtgttgtt

SEQ ID NO: 1986 - DNA, 843 bp, Medicago truncatula
ctggggctgctgagacaaacttcaattaattagtctttacaggaagtaccgcaagaattccagcggctgatccacgtctgtagtagttgtctgaatatcggaatccaaaggtagaaggaagagttgaagacaatggttaagtctactgctaaggatgcacaagatcttatccgcactctttggtctgcttattccgcaacccctacaaatctcaagatcattgatcattatgttgtgttcgctgtcttcactgccctcatccaggtagtttacatggctttggtgggaacatttccattcaactccttcctgtcgggagtactttcttgcgttggaactgcagttttggctgtttgtctccggatccaagtgaataaagagaacaaggaattcaaggacattgctcctgagcgtgcttttgcagattttgttctctgcaatgtggtgctccatttggtgatcatgaatttccttggttaaattgggttcatgtagctttgcttgattccattagaacagaactcattgactcaaaagacgaagaaaaatagagcagagacctgggataggaaaaataatagtagttgtacctggaccctttccttttccgggaattttgtttggacagagaaatgctaggagtttactttgcattcttttaaatgtttgttgaatttgaattacacaagatgttcacatcaactatctaaatctgagcaaggtgttcgcatgttttagtcttctgaacaaatttgaatgatctgttataactgccttctcctgcatctaaatgaaaggaatgttggattagagtacctccaacaatgatttgggtgttgttaa

SEQ ID NO: 1987 - DNA, 400 bp, Tamarix hispida
gggggcaatggtgaagtctacaaccaaggatgctcaagcacttatccagtctctcctttctgcttatgccgtcacacctactaatctcaagatcattgatttgtacgttgcgttcgccatttctactgcactaattcagattctttatgtggccatagttggatcatttcctttcaattccttcctgtctggtgtgctctcatgtgttggcactgctgttcttgctgtatgtctccgcatccaggtcaacaaagaaaataaggaattcaaggatttacctccggagcgtgcttatgcggactttgctctctgtaatttagttctccatttggtcatcatgaatttccttggataacctgttgtatcaagggttactaaatactatatccttgataatgca

SEQ ID NO: 1988 - DNA, 2861 bp, Sorghum bicolor
aatcatcatcaaagcctaggccccccctcctccaccgcggctccgcctacccagtgccgcgaggctcgtgacgtgacgccgccgggccgcgcgctctctccgggccggacgcctcgcgccgccgttcgaatccatggacgccgaggcaggtgtcgccggcgccgatcagctgccgcggaggcagtactacatgaatctattgcttttagcttaccagagctttggtgttgtttacggggacctaagcacatcgcctctttacgtttataaaagtacattctctggaaagctcagtcagtaccaagatgaggagacggtgttcggtgtgctttccctgatcttttggaccttcactctgattcctttgctcaagtatgtcaccattgtcttgagtgctgatgataacggtgaaggtggaccattcgctctctattcgctcctttgcaggcatgcaaaactcagtttgcttccaaatcaacaagcagccgatgaggaactctcttcatactacagaaatggctttgcaccccgcaatggatcttcaccttggttaaaaaggtttctggagaagcacaaaaaaatgagaactgtgctccttctcatagttctctgtggcgctagcatggtgattggtgatggtgtccttaccccagcaatctcagtcctctcatctatgtctggattacaagttcgagctactggtttagagcatagttctgtagttctcctttcgtgcattgtgttggttggtctatttgccttgcaacaccgaggtactcagaaggttgcattcatgtttgcaccaattgtcatcatctggctgctttccattggaggaattggtttatacaacatttttcattggaacccaaatatatatcaagctctctctccatattatatggttaagttctttagaaagacaggtaaagatggatggattgctttaggagggatccttctttctatgacaggcagtgaagcaatgtttgctgaccttggtcactttacgagtgcatctgttagggtggcctttattaccgtcatatatccatgccttatactacaatatatgggtcatgctgcatttctgtcgaagaacacatttcacatgccaacaagtttttatgatactatcccagaacctgtgttttggcctgtattcgtggtggccacactcgctgcagttgttggtagccaagctgttatttcagcaacattctccattgtgaaacaatgccatgctttgggatgtttcccacgagtgaaggttgttcacacatcgaggtggatctatgggcagatatatattccagaaataaattggatccttatggttctttgtgtcgctgtcactattgcatttcgtgatactacacttatcggcaatgcctacggtgttgcctgcatgactgttatgcttgttactacattcttgatggcattgataatcatctttgtttggcaaaggaacataatatttgccctagttttcctggttttctttggatccattgaagctgtatatctttcttcatctctcatgaaggttcctcagggaggatgggtgcctcttgtgcttgctttcatattcatgtcagtcatgtatatctggcactatgggttaaggaggaagtaccagtttgacctacaaaacaaagtatcaatgagatccatcttgtctctgggtccaagccttggcatagttcgggttcctggtattggattgatttacacagagctggtcactggtgtaccctccatcttctcacattttgtcacaaacctccctgccttccatgaagtcctagtcttcctttgtgtgaagtcagtgccagtgccatatgtttcacaagatgagcgataccttgtgggtaggattggacctaaagaatatcggatgtaccgttgcattgttagatatggttacaaagacgtgcagagagatgatgacaattttgagaacatgttagttatgagcattgcaaagttcattatgatggaagccgaggatgcttcttcttcagcaagttatgatatcgctaatgaaggaaggatggcggtcataacaaccactgatgcctctggcagtccattggccatgagggatttcaacggcctagctgactccatgactacgaggagcagcaaatcagaaagccttcgaagtttgcaatcctcttacgagcaagaatccccaagtgtaagccggcgccgccgtgttcgctttgaggtcccagaggaggatgacatgggtcagcaagtgaaagaagaactcatggcactagtggaagcgaaacatgctggggtggcatacatcatgggtcattcttatatcaaagctaggaggagctcaagtttcctgaagaagtttgctattgatgttggctactctttcctccggaagaactgcagaggtccatcagtcactctgcacattccacacattagtctgatagaagtcggcatgatctactatgtttaacctgaagcccattgtataagttcacatgtggatacccgattgggacaaagcttgtgctatctgccgattttcatctggagttcaggcctgtgctttctgggccaaggatcctcgtgtgcttaagtttcagcttgtagagagaaggcagacttccttgttaatattatttttagcctaaataaaccagcagaatgttgccggttacgtttctcatttggcatatttgcatgcatgctctgtaattttttctgcgagctatgtgatggaaatatatgcattctctttataaactggtcagcgttctctatcgtagcagtaatctttaacaatgttggctggtacttgaaaattgaaatcaatgatagtcgatcgccca

SEQ ID NO: 1989 - DNA, 2826 bp, Sorghum bicolor
aatcatcatcaaagcctaggccccccctcctccaccgcggctccgcctacccagtgccgcgaggctcgtgacgtgacgccgccgggccgcgcgctctctccgggccggacgcctcgcgccgccgttcgaatccatggacgccgaggcaggtgtcgccggcgccgatcagctgccgcggaggcagtactacatgaatctattgcttttagcttaccagagctttggtgttgtttacggggacctaagcacatcgcctctttacgtttataaaagtacattctctggaaagctcagtcagtaccaagatgaggagacggtgttcggtgtgctttccctgatcttttggaccttcactctgattcctttgctcaagtatgtcaccattgtcttgagtgctgatgataacggtgaaggtggaccattcgctctctattcgctcctttgcaggcatgcaaaactcagtttgcttccaaatcaacaagcagccgatgaggaactctcttcatactacagaaatggctttgcaccccgcaatggatcttcaccttggttaaaaaggtttctggagaagcacaaaaaaatgagaactgtgctccttctcatagttctctgtggcgctagcatggtgattggtgatggtgtccttaccccagcaatctcagtcctctcatctatgtctggattacaagttcgagctactggtttagagcatagttctgtagttctcctttcgtgcattgtgttggttggtctatttgccttgcaacaccgaggtactcagaaggttgcattcatgtttgcaccaattgtcatcatctggctgctttccattggaggaattggtttatacaacatttttcattggaacccaaatatatatcaagctctctctccatattatatggttaagttctttagaaagacaggtaaagatggatggattgctttaggagggatccttctttctatgacaggcagtgaagcaatgtttgctgaccttggtcactttacgagtgcatctgttagggtggcctttattaccgtcatatatccatgccttatactacaatatatgggtcatgctgcatttctgtcgaagaacacatttcacatgccaacaagtttttatgatactatcccagaacctgtgttttggcctgtattcgtggtggccacactcgctgcagttgttggtagccaagctgttatttcagcaacattctccattgtgaaacaatgccatgctttgggatgtttcccacgagtgaaggttgttcacacatcgaggtggatctatgggcagatatatattccagaaataaattggatccttatggttctttgtgtcgctgtcactattgcatttcgtgatactacacttatcggcaatgcctacggtgttgcctgcatgactgttatgcttgttactacattcttgatggcattgataatcatctttgtttggcaaaggaacataatatttgccctagttttcctggttttctttggatccattgaagctgtatatctttcttcatctctcatgaaggttcctcagggaggatgggtgcctcttgtgcttgctttcatattcatgtcagtcatgtatatctggcactatgggttaaggaggaagtaccagtttgacctacaaaacaaagtatcaatgagatccatcttgtctctgggtccaagccttggcatagttcgggttcctggtattggattgatttacacagagctggtcactggtgtaccctccatcttctcacattttgtcacaaacctccctgccttccatgaagtcctagtcttcctttgtgtgaagtcagtgccagtgccatatgtttcacaagatgagcgataccttgtgggtaggattggacctaaagaatatcggatgtaccgttgcattgttagatatggttacaaagacgtgcagagagatgatgacaattttgagaacatgttagttatgagcattgcaaagttcattatgatggaagccgaggatgcttcttcttcagcaagttatgatatcgctaatgaaggaaggatggcggtcataacaaccactgatgcctctggcagtccattggccatgagggatttcaacggcctagctgactccatgactacgaggagcagcaaatcagaaagccttcgaagtttgcaatcctcttacgagcaagaatccccaagtgtaagccggcgccgccgtgttcgctttgaggtcccagaggaggatgacatgggtcagcaagtgaaagaagaactcatggcactagtggaagcgaaacatgctggggtggcatacatcatgggtcattcttatatcaaagctaggaggagctcaagtttcctgaagaagtttgctattgatgttggctactctttcctccggaagaactgcagaggtccatcagtcactctgcacattccacacattagtctgatagaagtcggcatgatctactatgtttaacctgaagcccattgtataagttcacatgtggatacccgattgggacaaagcttgtgctatctgccgattttcatctggagttcaggcctgtgctttctgggccaaggatcctcgtgtgcttaagtttcagcttgtagagagaaggcagacttccttgttaatattatttttagcctaaataaaccagcagaatgttgccggttacgtttctcatttggcatatttgcatgcatgctctgtaattttttctgcgagctatgtgatggaaatatatgcattctctttataaactggtcagcgttctctatcgtagcagtaatctttaacaatgttggctggta

SEQ ID NO: 1990 - DNA, 2830 bp, Setaria italica
atcatgcgagagcccccctcttcctccgccgcctcctctcccctgcgtgacgtgacgtgaccgagccgcgcctacccccggccggacgccgcgcgccgccgctcgaatcgatggacgccgaggccggcgtcgtcggcgccgaccagctgccgcggaggcagtactacatgaatctattacttctagcttaccagagctttggtgttgtttatggggacctaagcacatcacctctctacgtttataaaagtacattctctggaaagctccgccaataccaagatgaagagacagtattcggtgtactctccctcatattttggacattcactcttattcctttgctgaagtatgtcactattgtcttgagtgctgatgataatggcgaaggtggaccatttgcattgtattcactgctttgcaggcatgcaaaacttagcttgcttccaaatcaacaagcagccgatgaggaactatcttcatactacagaaatgggtttgctcctcgcaatggatctgcaccttggctaagaaggtttctagagaagcacaaaaaagtgagaactgtgctgcttctcgtagttttgtgtggtgctagcatggtgatcggtgatggtgttcttaccccagcaatatcagtcctgtcatctatgtccggattacaagttcgagctactggtttagagcaccgttctgtagttctcctttcgtgcattgtattggttggtctatttgccttgcaacaccgaggtactcagaaggttgcattcatgtttgcaccaattgtcatcatctggctgttttccattggtggaattggtttatacaacatacttcattggaacccaaatatatatcaagctctctctccatattatatggttaagttttttaggaagactggtaaagatggctggatttctttaggagggattcttctttcaatgacaggcagtgaagcaatgtttgctgaccttggccactttacgagtgcatctgtcagggtggctttcgttaccgtcatatatccatgccttatactacaatatatgggtcatgctgcatttctatcgaagaacacctttcacatgccgacaggtttttatgatactatcccagaacctgtattttggcctgtatttgtggtggccacactcgctgcagttgttggtagccaagctgtgatttcggcaacgttctccattgtgaaacagtgccatgctttgggatgtttcccacgagtgaaggttgtccacacatcaaggtggatctatgggcagatatatattccagaaataaattggatccttatggtgctttgtgtagctgtcacggtttctttccgtgacactactcttatcggcaatgcttatggtattgcatgcatgactgttatgcttgttactacattcttgatggcattgatcgtcatctttgtttggcaaaggaacataatatttgccctaattttcctggttttctttggatccattgaagctgtatatctttcctcatctctcatgaaggttcctcaaggaggatgggtgcctcttgtgcttgctttcatattcatgtctgtcatgtacatctggcactatgggttaaggaggaagtaccagtttgacctacagaacaaagtatcaatgagatcgatcctgtctctgggtccaagccttggcatagttcgggttcctggtattggattgatttatacagagctggtgactggtgtaccctccatcttctcacattttgtcactaatctccctgctttccatgaagtcctagtctttctctgcgtgaagtcagtgccagtgccatatgtttcgccagatgagcgataccttgtgggtaggattggacctaaagaatataggatgtaccgttgcattgttagatatggctacaaagatgtgcagagagatgatgacaattttgagaacatgttagttatgggtattgcaaagtttattatgatggaagctgaggatgcttcttcttcggcaagttatgatatcgctaatgaaggaaggatggcagtcataacaaccactgatgatgctggcactccattgactatgagagatttcaatggcctagctgactccatgactacgaggagcagcaaatcagagagccttcgaagtttgcaatcctcttacgagcaagaatccccaaatgtaagccggcgccgccgtgttcgctttgaggtgccagaggatgacgacatgggccagcaagtgaaagatgagctcatggcacttgtggaagcaaaacatgctggggtggcatacatcatggggcattcttatatcaaagctaggaggagctcaagtttcctgaagaagtttgctattgatgttggctactctttcctccggaagaactgcagaggtccatcggtcacactgcacattccgcacattagtctgatagaagtgggcatgatctaccatgtttagccttgtgcccattgccaagttccatgtggataacctggttgcgacaaagcatgtgctacctgcagcttttgatctgaagttcaggcttgtgttttctgggacaggagttgctgcatcctcatgtgcttctagtttcagcttgtagagatgaaggcagactttccttgttaatattatttcgtctaaataaactatcagaatggtgcgagttacgctaagttttcgttttgtgtatttacatgcatgctctgtaatttttcttagagctatgtaatggaaatatgcattatcttacggtctgctttctctatcgtaactgcattgtcttgctagtttcgcggtggtggtaatattttttggtacatttg

SEQ ID NO: 1991 - DNA, 2843 bp, Setaria italica
atgcgagagcccccctcttcctccgccgcctcctctcccctgcgtgacgtgacgtgaccgagccgcgcctacccccggccggacgccgcgcgccgccgctcgaatcgatggacgccgaggccggcgtcgtcggcgccgaccagctgccgcggaggcagtactacatgaatctattacttctagcttaccagagctttggtgttgtttatggggacctaagcacatcacctctctacgtttataaaagtacattctctggaaagctccgccaataccaagatgaagagacagtattcggtgtactctccctcatattttggacattcactcttattcctttgctgaagtatgtcactattgtcttgagtgctgatgataatggcgaaggtggaccatttgcattgtattcactgctttgcaggcatgcaaaacttagcttgcttccaaatcaacaagcagccgatgaggaactatcttcatactacagaaatgggtttgctcctcgcaatggatctgcaccttggctaagaaggtttctagagaagcacaaaaaagtgagaactgtgctgcttctcgtagttttgtgtggtgctagcatggtgatcggtgatggtgttcttaccccagcaatatcagtcctgtcatctatgtccggattacaagttcgagctactggtttagagcaccgttctgtagttctcctttcgtgcattgtattggttggtctatttgccttgcaacaccgaggtactcagaaggttgcattcatgtttgcaccaattgtcatcatctggctgttttccattggtggaattggtttatacaacatacttcattggaacccaaatatatatcaagctctctctccatattatatggttaagttttttaggaagactggtaaagatggctggatttctttaggagggattcttctttcaatgacaggcagtgaagcaatgtttgctgaccttggccactttacgagtgcatctgtcagggtggctttcgttaccgtcatatatccatgccttatactacaatatatgggtcatgctgcatttctatcgaagaacacctttcacatgccgacaggtttttatgatactatcccagaacctgtattttggcctgtatttgtggtggccacactcgctgcagttgttggtagccaagctgtgatttcggcaacgttctccattgtgaaacagtgccatgctttgggatgtttcccacgagtgaaggttgtccacacatcaaggtggatctatgggcagatatatattccagaaataaattggatccttatggtgctttgtgtagctgtcacggtttctttccgtgacactactcttatcggcaatgcttatggtattgcatgcatgactgttatgcttgttactacattcttgatggcattgatcgtcatctttgtttggcaaaggaacataatatttgccctaattttcctggttttctttggatccattgaagctgtatatctttcctcatctctcatgaaggttcctcaaggaggatgggtgcctcttgtgcttgctttcatattcatgtctgtcatgtacatctggcactatgggttaaggaggaagtaccagtttgacctacagaacaaagtatcaatgagatcgatcctgtctctgggtccaagccttggcatagttcgggttcctggtattggattgatttatacagagctggtgactggtgtaccctccatcttctcacattttgtcactaatctccctgctttccatgaagtcctagtctttctctgcgtgaagtcagtgccagtgccatatgtttcgccagatgagcgataccttgtgggtaggattggacctaaagaatataggatgtaccgttgcattgttagatatggctacaaagatgtgcagagagatgatgacaattttgagaacatgttagttatgggtattgcaaagtttattatgatggaagctgaggatgcttcttcttcggcaagttatgatatcgctaatgaaggaaggatggcagtcataacaaccactgatgatgctggcactccattgactatgagagatttcaatggcctagctgactccatgactacgaggagcagcaaatcagagagccttcgaagtttgcaatcctcttacgagcaagaatccccaaatgtaagccggcgccgccgtgttcgctttgaggtgccagaggatgacgacatgggccagcaagtgaaagatgagctcatggcacttgtggaagcaaaacatgctggggtggcatacatcatggggcattcttatatcaaagctaggaggagctcaagtttcctgaagaagtttgctattgatgttggctactctttcctccggaagaactgcagaggtccatcggtcacactgcacattccgcacattagtctgatagaagtgggcatgatctaccatgtttagccttgtgcccattgccaagttccatgtggataacctggttgcgacaaagcatgtgctacctgcagcttttgatctgaagttcaggcttgtgttttctgggacaggagttgctgcatcctcatgtgcttctagtttcagcttgtagagatgaaggcagactttccttgttaatattatttcgtctaaataaactatcagaatggtgcgagttacgctaagttttcgttttgtgtatttacatgcatgctctgtaatttttcttagagctatgtaatggaaatatgcattatcttacggtctgctttctctatcgtaactgcattgtcttgctagtttcgcggtggtggtaatattttttggtacatttgaaatttaacataaaag

SEQ ID NO: 1992 - DNA, 2754 bp, Pennisetum glaucum
cctccctcgtgacgtaaccgatccgcgtctcctccggccggacgccgcgcgccgccgctcgaatcgatggacgccgaggccggcgtcgtcggcgccgaccagatgccgcggaggcggtactacatgaacttattacttctagcttaccagagctttggtgttgtttatggggacccaagcacatcacctctctacgtttataaaagtaccttttctggaaagctccgccaataccaagatgaagagacagtgttcggtgtactctccctcatattttggacattcactcttattcctttgctgaagtatgtcactattgtcttaagtgctgatgataatggcgaaggtggaccatttgcattgtattcactgctttgcaggcatgcaaaactcagcttgcttccaaatcaacaagcagccgatgaggaactatcttcatactacagaaatgggtttgctccccgcaatggatctgcgccgtggctaagaaggtttctagagaagcacaaaaaagtgagaactgtgcttcttcttgtagttctttgtggtgctagcatggtgatcggtgatggtgtccttaccccagcaatatcagtcctgtcatctatgtctggattacaagttcgagctactggtttagagcatcgttctgtagttctcctttcatgcattgtattggtcggtctatttgccttgcaacaccgaggtactcagaaggttgcattcgtgtttgcaccaattgtcatcatctggctgttttccattggtggaattggtttatacaatatacttcattggaacccaaatatatatcaagctctctctccatattatatggttaagttttttaagaagactggtaaagatggttggatttctttaggagggattcttctttcaatgacaggcagtgaagcaatgtttgctgaccttggtcactttacgagtgcatctgtcagggtggctttcgttaccgtcgtgtatccatgccttgtactgcaatatatgggtcatgctgcatttctatcgaagaacacctttcacatgccgacaggtttttatgatactatcccagaacctgtgttttggccggtttttgtggtggccacacttgctgcagttgttggtagccaagctgtgatttcagcaactttctctatagtgaagcagtgccaagctttgggatgtttcccacgagtgaaggttgtccacacctcaaggtggatctatgggcagatatatattccagaaataaattggatccttatggtactttgcgtagctgtcacggtttctttccgtgacactactcttattggcaatgcttatggtattgcatgcatgactgttatgcttgttactacattcttgatggcattgatcgtcatctttgtttggcaaaggaacatgatatttgccctaattttcctggttttcttcggatccatcgaagctgtatacctttcctcatctctcatgaaggttcctcaaggaggatgggtgcctcttgtgcttgcttttatatttatgtctgtcatgtacatctggcactacgggttaaggaggaagtaccagtttgacctacagaacaaagtatcaatgagatcgatcctgtctctaggtccaagccttggcatagttcgggttcctggtattggattgatttatacagagctggtgactggtgtgccctccatcttctcacattttgtcacaaatctccctgctttccatgaagtcctagtctttctctgcgtgaagtcagtgccagtgccatatgtttcgccggatgagcgataccttgtgggtaggattggacctaaagaatatcggatgtaccgttgcattgttagatatggctacaaagatgtgcagagagatgatgacaattttgagaacatgttggttatgagtattgcaaagttcattatgatggaagctgaggatgcttcttcttcagcaagttatgatatcgctaatgaaggaaggatggcagtcataacaaccgctgatgacgctggcactccattgaccatgagagatttcaatgccctagctgactcaatgactacaaggagcagcaaatcagagagccttcgaagtttgcaatcctcttatgaacaagaatccccaaatgtaagccggcgccgccgtgttcgctttgaggtgccagaggatgatgacatgggccagcaagttaaagatgagctcatggcactcgtggaagcgaaacatgctggggtggcatacatcatggggcattcttatatcaaagctaggaggagctcgagtttcctgaagaagtttgctattgatgttggttactcattcctccggaagaactgcagaggtccatcggtcacactgcacattccacacattagtctgatagaagtgggcatgatctactatgtttagccttttgcccattgccaagatcatatgtggatacctggttgtgacaaagcatgtgctacctgcggcttttgatctggagttacagcactgtgccttctgggacaaagaagttgctgcatcctcgtgtgcttctagtttcagcttgtagagatgaatgaaggcggaccttgttaatatttatttttagcctgaataaactatcagaactgtgcgagttacgctaagttttcttctcgtttggtgtatttacatgcatgctctgtaatttttcccaagagctatgtaatggaaatatgcgttatgttacgatcttgtcgcagcggcattgtcctaccc

SEQ ID NO: 1993 - DNA, 3512 bp, Brachypodium distachyon
taccgccggtgggacacctcgcgccgccgccgccaccgccagagtccgatcgtatggacgccgaggccggcgccgccggcgccgaccagcttccgtggcggcaacgctacaggaatctactacttctagcataccagagctttggcgttgtctatggggacctaagcacatcgcctctttatgtatataaaagtgcattctcaggaaggctatctcgataccaagatgaacagacagtattcggtgtactttccctgatattttggaccttcacacttgttcctttgctcaagtatgtcattattgtattgagcgctgatgacaacggcgaaggtggaccatttgctctgtattcactcctctgcaggcatgcaaagcttagcttgcttccaaatcaacaagcagcggatgaggaactttctacatactacagagatgggtttgcagctcaacatggatctacaccttggctacgaaggtttctagagaagcacaaaacaatcaaaactgtgcttctccttgtagttctttgtggtgctagcatggtgattggtgatggtgtccttactccagcaatctcagtcctgtcatctatgtctggattgcaagttcgagctactggtttacaggatcgttctgtggtgctactttcatgcattgtattggttggtctgttttccttgcaacaccgaggtactcagaaggtagcattcatgtttgcaccgattgtcatcatctggctcttttgcattggtggaatcggtttgtacaacatagttcattggaatccaaggatataccaagcactctctccatattatattgttaagttctttcagacaaccggtacagatggctggattgctctaggaggaatactgctttctatgacaggaagtgaagctatgtttgctgacctcggtcattttacaagtgcatctgtcaggctggcttttattaccatcatatatccatgcctcacattacaatatatgggccaagcagcatttctgtcaaagaacatgtttcacatgcgcacaagtttttatgactccatcccaggacctgtattttggcctgtatttgtggtggccactcttgctgcagtcgttggaagccaggctgttatctcagctacattctctattgtaaagcaatgccatgctttgggatgtttcccacgagtgaaggttgttcatacatcgaggtggatctatgggcagatatacattcctgaaataaattggatccttatggtgctttgcgtagctgtcacagttgcattccgtgatactacccttatcggaaatgcctatggtattgcttgcatgactgtcatgcttgttactacattcttgatggcattgatcatcatctttgtttggcaaaagaacataatatttgccttgttgttcctatttttcttcggatccattgaaactgtctatctttcttcatctctcatgaaggttcatcaagggggatgggtgcctcttgtgcttgcttttatattcatgtctgtcatgttcatttggcactttggaacaagaaggaagtaccagtttgatcttcagaacaaagtgtcaatgagatcgatcttgtctctaggtccaaaccttggcatagtccgggttccaggaattggactgatttacactgagctggtgactggtgtgcctgccatcttcacacattttgtcactaatcttcctgcctttcatgaagtcctagtctttctttgtgttaagtcagtaccggtcccgtatgttccaccagatgagagataccttgtgggtaggattggacctagagcatatcggatgtaccgttgcattgtcaggtatggttacaaagatgtgcagagagacgatgaaaattttgagaacatgttagttatgagcattgcaaagttcattatgatggaagctgaggatgtctcgtcttcagccagttatgatatggctaacgaaggaagaatggccgtcataagaaccactgacgatgctggcacaccattgggcatgagagatttgagtggtctagcggagtccatttctactacgaggagtagcaagtctgagagccttcgaagcttgcagtcctcttatgagcaggaatcaccaagtgtaagccgtaggcgccgtgttcgctttgagctgccagacgaggacaacatggatcaacaggtgaaagatgagttactagcactcgtggaggcgaaacatgcaggggttgcgtacataatgggccattcttacattaaagctaggaggagctccagttttctgaagaaatttgcaatcgatgttggctactctttcctccggaagaactgcagaggtccatcagtctcgctgcatattcctcatattagtctgatagaagttggtatgatctactacgtgtagcctaatgctcttgttcacatgtgggcatcaggtggcaaccaagcatgtgctgcctatggacccctgtggtttttgtctggagttgaagttgcaatctctagggacggaatgctgcatcaaagtgctcccagtttcagtctggtagagatgaaggcgctgtgcatgttaatattacttgtcagcccaaataaaacgccagatccgtattattgattctagttcttttttttcttttggtatatctctatacatgcgatgtattttcttttccctgggaacgacgtcacggaagtcaattctgtcatataaattaattttgccgcttccaccataacttgcctgcgataaaaatcttacaatggcgtcattcaaattccatatcgcaagtcacaagttcacaaccaatgtgacacattgcccacttattcttgtatactagtatacccgcatgtaacaaggattcaacacataacaattccctttcaaaaaaaaaaacagagaacaactccagtttctagtgcatgttcgttgttcagagcgtatagaacacatatgaagtgcatggacataagatgggcgtatagaacacatggacataacatagctttgtcctttattggaaacatctatttacaagccaacgggctcaagaggtttctcaactgttagtagtgtgagcctcagacagatgaaccagcagtagccaccgtcttgttgagcagctcacgcagcgctcctggagaggtcactggagggctgcacttgaagtcctggcacacatgcgccaccactagcttctccggtgggctgctccgtgccatctgagcgatgttggcgttgttgctctcccagaatcccatttcttccgtgttcctggggtctatctggatcacagttctgttcgggtcgtatgacgagaatgtagctgcaaccatgtcttgaaattctgtggatcctttatcccccaccagcactacttgcttccttgacgggacagagagcatgtctgctgcgcagcacatcaatggcaacgctataccaagttccctcagtctcgtctcaaaaaccgcctgaaaagttataaatgcataggcaagcagatat

SEQ ID NO: 1994 - DNA, 2718 bp, Brachypodium distachyon
cgccgccgccgccaccgccagagtccgatcgtatggacgccgaggccggcgccgccggcgccgaccagcttccgtggcggcaacgctacaggaatctactacttctagcataccagagctttggcgttgtctatggggacctaagcacatcgcctctttatgtatataaaagtgcattctcaggaaggctatctcgataccaagatgaacagacagtattcggtgtactttccctgatattttggaccttcacacttgttcctttgctcaagtatgtcattattgtattgagcgctgatgacaacggcgaaggtggaccatttgctctgtattcactcctctgcaggcatgcaaagcttagcttgcttccaaatcaacaagcagcggatgaggaactttctacatactacagagatgggtttgcagctcaacatggatctacaccttggctacgaaggtttctagagaagcacaaaacaatcaaaactgtgcttctccttgtagttctttgtggtgctagcatggtgattggtgatggtgtccttactccagcaatctcagtcctgtcatctatgtctggattgcaagttcgagctactggtttacaggatcgttctgtggtgctactttcatgcattgtattggttggtctgttttccttgcaacaccgaggtactcagaaggtagcattcatgtttgcaccgattgtcatcatctggctcttttgcattggtggaatcggtttgtacaacatagttcattggaatccaaggatataccaagcactctctccatattatattgttaagttctttcagacaaccggtacagatggctggattgctctaggaggaatactgctttctatgacagggaagtgaagctatgtttgctgacctcggtcattttacaagtgcatctgtcaggctggcttttattaccatcatatatccatgcctcacattacaatatatgggccaagcagcatttctgtcaaagaacatgtttcacatgcgcacaagtttttatgactccatcccaggacctgtattttggcctgtatttgtggtggccactcttgctgcagtcgttggaagccaggctgttatctcagctacattctctattgtaaagcaatgccatgctttgggatgtttcccacgagtgaaggttgttcatacatcgaggtggatctatgggcagatatacattcctgaaataaattggatccttatggtgctttgcgtagctgtcacagttgcattccgtgatactacccttatcggaaatgcctatggtattgcttgcatgactgtcatgcttgttactacattcttgatggcattgatcatcatctttgtttggcaaaagaacataatatttgccttgttgttcctatttttcttcggatccattgaaactgtctatctttcttcatctctcatgaaggttcatcaagggggatgggtgcctcttgtgcttgcttttatattcatgtctgtcatgttcatttggcactttggaacaagaaggaagtaccagtttgatcttcagaacaaagtgtcaatgagatcgatcttgtctctaggtccaaaccttggcatagtccgggttccaggaattggactgatttacactgagctggtgactggtgtgcctgccatcttcacacattttgtcactaatcttcctgcctttcatgaagtcctagtctttctttgtgttaagtcagtaccggtcccgtatgttccaccagatgagagataccttgtgggtaggattggacctagagcatatcggatgtaccgttgcattgtcaggtatggttacaaagatgtgcagagagacgatgaaaattttgagaacatgttagttatgagcattgcaaagttcattatgatggaagctgaggatgtctcgtcttcagccagttatgatatggctaacgaaggaagaatggccgtcataagaaccactgacgatgctggcacaccattgggcatgagagatttgagtggtctagcggagtccatttctactacgaggagtagcaagtctgagagccttcgaagcttgcagtcctcttatgagcaggaatcaccaagtgtaagccgtaggcgccgtgttcgctttgagctgccagacgaggacaacatggatcaacaggtgaaagatgagttactagcactcgtggaggcgaaacatgcaggggttgcgtacataatgggccattcttacattaaagctaggaggagctccagttttctgaagaaatttgcaatcgatgttggctactctttcctccggaagaactgcagaggtccatcagtctcgctgcatattcctcatattagtctgatagaagttggtatgatctactacgtgtagcctaatgctcttgttcacatgtgggcatcaggtggcaaccaagcatgtgctgcctatggacccctgtggtttttgtctggagttgaagttgcaatctctagggacggaatgctgcatcaaagtgctcccagtttcagtctggtagagatgaaggcgctgtgcatgttaatattacttgtcagcccaaataaaacgccagatccgtattattgattctagttcttttttttcttttggtatatctctatacatgcgatgtattttcttttccctgggaacgacgtcacggaagtcaattctgtcatataaattaattttgccgcttccacc

SEQ ID NO: 1995 - DNA, 3876 bp, Oryza sativa
atctgtgatccatccataacccgttccgttccattcctgtctcctcgtgatctctacctctcgacggaatcgcgcgccgcgctctcgcgacgccgccgccgccgatcgatcgatggacgccgaggccggcgtcggcggcgccgaccagctgccgtggaggcaacactacaggaatttactgcttttagcataccagagttttggtgttgtttatggggacctaagcacatcacctctttacgtttataaaagtacattctcaggaagactacgtcgatatcaagatgagcaaacagtctttggtgttctttccttgatattttggaccttcacacttattcctttgctgaagtatgtcactattgtattaagtgctgatgacaatggtgaaggtgggccgtttgctctttattcactgctttgcaggcatgcgaaacttagttttcttccaaatcaacaatcagcagatgaagagctatcgacatactacagaaatggttttacttcacgtcatggatctttaccttggctaagaaggttcatggagaagcacaagaatgccagaaccgtgcttctcctcatagttctgtgcggtgctagcatgatgattggtgatggtatccttactccagcaatctcagttctgtcatctatgtctggattgaaagttcgagctactggtttacatgatcgttctgttgtactcctttcatgcattgtgttggttggtctatttgcattgcaacaccgaggtactcagaaggtagcgttcatgtttgcaccaattgtcgtcatctggctcttttgcattggtggaattggtttatacaacataatacattggaacccaaggatataccaagctctctctccatattatattgttaagttctttaggacgacaggtaaagatggttggattgctctaggaggcatacttctttctatgacaggctgtgaagctatgtttgccgaccttggtcacttcacgagtgcatctgtcaggctagcttttatcaccatcatatacccatgtcttatattacaatatatgggtcaggcggcatttctgtcaaaaaatatccttgacatgcccacaggtttttatgattctatcccaggacctatattttggcctgtgtttgtggtggccactctcgctgctgttgttggtagccaagctgtcatttcagcaacattctctattgtgaagcagtgccattcgttgggatgtttccctcgagtgaaggttgtccacacatcaaggtggatctatggacagatatacattcctgaaataaattggatccttatggtgctctgtgtagctgtcacagttgcattccgtgatattacacttattggtaatgcctatggtgttgcgtgcatgactgttatgtttgtcactacattcttgatggcattgatcatgatcttcgtttggcaaaagaacataatatttgctctatctttctttttattattcggatccgttgaagttgtttatctctcctcatccctcatgaaggttactcagggaggatgggtgccgcttgtgcttgctttaatattcatgtctgtcatgtatatttggcactatgggacaaggaagaagtaccagtatgatcttcagaataaggtatcaatgagatatatcctgtccctgggtccaagccttgacgtagttcgtgtcccaggaattggtctgatttacacagaactggtgactggtgtacccaacatcttcacacatttcactactaatctccctgcctttcatgaagtcctagtctttctttgtgtcaagtcagtaccagtaccatatgtgtcgccagatgaacgataccttgtgggcaggattggacctagagcatatcggatgtaccgctgcattgttaggtatggttacaaagatgttcagagagatgatgacaattttgagaacatgttagttatgaacattgggaagttcattatgatggaagctgaggatgcatcttcttcagcaagttatgatactgctaatgaaggacgaatggccgtcataacaacatctgatgactatgactctccactagctgtgagagattccaatgacctagctgactccatgacgatgaggagcactaaatcagagagtcttcgaagcttgcaatcctcttatgagcaggaatcacctaatgtgagccggaggcgacgtgttcgctttgagctgccagaggaggatgacatggatcaacaggttaaagatgagctgttagcacttgtggaggcaaaacatacaggggtaacctacgtcatggggcatgtctatatcaaagctaggaagaactctagtttttttaagagatttgcaattgatgttggctactctttcctccggaagaactgcagaggtccatcggtcacactgcacattccacatattagtctgatagaagttggaatggcgtaccaagtgtagcgcgatgctcatcgcaggtcacgacgtcacgtggatacccggtagcaacaaatcatgtgctacctgtggccgcctttttggagtcgaggctttgattcctatgctttatccatgcgttttcagtttcagttggtacagatgaagaggctctctatgttaatatgatcatttagctcaaataaagcatcagatctaatgatcgtagtttgctcttcccttttggtatatttacatgcatgctctgtaatttttatgggagctatgtaatggaaatatgcgtccccgtttttattgcagctatgtaatggaaatatgcgttctcgtagctgatatatcccaatttttgttaggaagcgattaccacatatattctttcatgtatgaatttcttatggaacagaacatctgtagatatacagtgcctcgtggaatttctctgcaaataaaccagatactagataacatcagtatgatttcctttttcatttggaactccacttttcctgagatcccttgggccgggatctttgtaacgcaaactggttttttttatctcgtgtgaaatgtgagattcatacattccaaacagcctgcaactcaaggggaagcaagatgaaaacagtgcttttattaagagaaaaatatctacacacaaccgaggcggctcaaagagctttgggaacccgaaagctaaaccttctgcaggctaaaaactctgccgatttgttacttatgtactttccagaggagctccatagccgtaggagggaaagacgcttcaggcagcagcagacgaagtagcagctgccactgtcttgttgagcagcacgcggagagcgtctgcagaggtcaccggagggctgcacttgaagtcctggcagacgtgcgccaccgctggcttctccggtgggctgctacgtgccatctgcgcgatgatggcgttgttgctctcccagaatcccatttcctcggtgttcctggggtctatttggatcacctagatcaacaaacagggtggccagatcagtaaaaacagtagagacgctacgtcgaatgtagaatttatgatcaactagttcatcgctcacagttctatttggatcatatgtcgaaaatgcggcagcaaccatgtcacggaattcagtcgattctttgttccccaccagaaccacctgcttcctggacgggacagatagcatgtctgccgcacaacacatcaacggcagtgctataccaagttccctcagcctcgtctggaagacagcctacgaaacaaaaaaatgtataacacgcatgagcaaatctcttgttcccagatgcttagctggaaacgttacttcttgttcgccaattgacatcagaggctaaccttgagcctcatgttggaactattttttatatataattaaatc

SEQ ID NO: 1996 - DNA, 2924 bp, Oryza sativa
atctgtgatccatccataacccgttccgttccattcctgtctcctcgtgatctctacctctcgacggaatcgcgcgccgcgctctcgcgacgccgccgccgccgatcgatcgatggacgccgaggccggcgtcggcggcgccgaccagctgccgtggaggcaacactacaggaatttactgcttttagcataccagagttttggtgttgtttatggggacctaagcacatcacctctttacgtttataaaagtacattctcaggaagactacgtcgatatcaagatgagcaaacagtctttggtgttctttccttgatattttggaccttcacacttattcctttgctgaagtatgtcactattgtattaagtgctgatgacaatggtgaaggtgggccgtttgctctttattcactgctttgcaggcatgcgaaacttagttttcttccaaatcaacaatcagcagatgaagagctatcgacatactacagaaatggttttacttcacgtcatggatctttaccttggctaagaaggttcatggagaagcacaagaatgccagaaccgtgcttctcctcatagttctgtgcggtgctagcatgatgattggtgatggtatccttactccagcaatctcagttctgtcatctatgtctggattgaaagttcgagctactggtttacatgatcgttctgttgtactcctttcatgcattgtgttggttggtctatttgcattgcaacaccgaggtactcagaaggtagcgttcatgtttgcaccaattgtcgtcatctggctcttttgcattggtggaattggtttatacaacataatacattggaacccaaggatataccaagctctctctccatattatattgttaagttctttaggacgacaggtaaagatggttggattgctctaggaggcatacttctttctatgacaggctgtgaagctatgtttgccgaccttggtcacttcacgagtgcatctgtcaggctagcttttatcaccatcatatacccatgtcttatattacaatatatgggtcaggcggcatttctgtcaaaaaatatccttgacatgcccacaggtttttatgattctatcccaggacctatattttggcctgtgtttgtggtggccactctcgctgctgttgttggtagccaagctgtcatttcagcaacattctctattgtgaagcagtgccattcgttgggatgtttccctcgagtgaaggttgtccacacatcaaggtggatctatggacagatatacattcctgaaataaattggatccttatggtgctctgtgtagctgtcacagttgcattccgtgatattacacttattggtaatgcctatggtgttgcgtgcatgactgttatgtttgtcactacattcttgatggcattgatcatgatcttcgtttggcaaaagaacataatatttgctctatctttctttttattattcggatccgttgaagttgtttatctctcctcatccctcatgaaggttactcagggaggatgggtgccgcttgtgcttgctttaatattcatgtctgtcatgtatatttggcactatgggacaaggaagaagtaccagtatgatcttcagaataaggtatcaatgagatatatcctgtccctgggtccaagccttgacgtagttcgtgtcccaggaattggtctgatttacacagaactggtgactggtgtacccaacatcttcacacatttcactactaatctccctgcctttcatgaagtcctagtctttctttgtgtcaagtcagtaccagtaccatatgtgtcgccagatgaacgataccttgtgggcaggattggacctagagcatatcggatgtaccgctgcattgttaggtatggttacaaagatgttcagagagatgatgacaattttgagaacatgttagttatgaacattgggaagttcattatgatggaagctgaggatgcatcttcttcagcaagttatgatactgctaatgaaggacgaatggccgtcataacaacatctgatgactatgactctccactagctgtgagagattccaatgacctagctgactccatgacgatgaggagcactaaatcagagagtcttcgaagcttgcaatcctcttatgagcaggaatcacctaatgtgagccggaggcgacgtgttcgctttgagctgccagaggaggatgacatggatcaacaggttaaagatgagctgttagcacttgtggaggcaaaacatacaggggtaacctacgtcatggggcatgtctatatcaaagctaggaagaactctagtttttttaagagatttgcaattgatgttggctactctttcctccggaagaactgcagaggtccatcggtcacactgcacattccacatattagtctgatagaagttggaatggcgtaccaagtgtagcgcgatgctcatcgcaggtcacgacgtcacgtggatacccggtagcaacaaatcatgtgctacctgtggccgcctttttggagtcgaggctttgattcctatgctttatccatgcgttttcagtttcagttggtacagatgaagaggctctctatgttaatatgatcatttagctcaaataaagcatcagatctaatgatcgtagtttgctcttcccttttggtatatttacatgcatgctctgtaatttttatgggagctatgtaatggaaatatgcgtccccgtttttattgcagctatgtaatggaaatatgcgttctcgtagctgatatatcccaatttttgttaggaagcgattaccacatatattctttcatgtatgaatttcttatggaacagaacatctgtagatatacagtgcctcgtggaatttctctgcaaataaaccagatactagat

SEQ ID NO: 1997 - DNA, 2567 bp, Sorghum bicolor
cccacgcagacgcagtgccgtgccgcactgctgccctgccatctcccataactcactcgcctccgcacgcgcacccgcctgtcccccagctcgctcgtgtcgtgcatccgtcccgccccccacccgccaagaactcgcattgccgccgccgagcccagccaggcaggggacggaggagctagcggccgcgtcggcgcgggaggaggaggaggagagcaggcggcggcaggatgttcgggagggacccctggggcgggccgctggagatctccaacgccgactcggcgacggatgacgaccggagccgggacctggacagggcggcgctgatgcggcagctggacgagacgcagcagagctggctcctggcggggcccggcgaccaggccggcaagaagaagaagaagtacgtcgacctgggatgcgtcgtcgtcgaccgcaagatcttcatgtggaccgtcggcaccatcctcggcctcggcgtcttcatcggattcatcatgatgatcgtcaagctcgtcccgcacaagcggcccccgccgccgccccccgaccagtacacgcaggcgctgcacaaggcgctcatgttcttcaacgcgcagcgatccggtccgttgccaaagcacaatggcgtcagctggaggggcaattcctgcatgaaggatggcctctccgacagcaccgtccgccggagcttggttgggggctactacgatgcaggggacgccatcaagttcaactatcccatggcctggtccatgaccatgctcagctggagtgtgatcgagtacagggctaagtatgaggccatcggtgagctcgaccatatcaaggagctgatcaagtggggaacagactacatcctcaaaacattcaattcatctgccgacacgatagacaggattgtcgctcaggtgggtgtaggtgacacctctaaaggtggcagtcagcctaatgaccattactgctggatgagaccagaggacatcgattacaaaaggccagtcactgagtgtcactcttgctcagatctagcatctgaaatggctgccgccctggctgcagcttccatagtgttcaaggacagcaaaacctactctgacaagctcgtcaaaggtgcaaaagctctgtacaaatttggcaggctgcagcgcgggcgatacagccccaatggatccgatcaggcaattttctacaattccaccagctactgggatgagtttgtgtggggtggtgcgtggatgtacttcgccacagggaacaattcatatctcacagtcgccacagccccaggaatggcaaagcatgctggagcctattggtttggaagtccaaactatggagtatttacctgggatgacaaacttccaggagctcaggtccttctcagcaggctgcgactcttcctaagtccagggtacccttacgaagaaatactgaggacattccacaaccaaactgacaacgttatgtgctcgtatttacctctattcaattcattcaacttcactaaaggaggattaatacaactcaaccatggaaggcctcaaccacttcagtatgctgtcaatgcagctttccttgcttctttatacagtgattatcttgaagctgcagacacgcctgggtggtactgtggacctaatttctacaccacagaagtcctccgcaagtttgccaggtcacagcttgattacatccttggaaagaacccattaaagatgagctacgttgtgggttttggaaacaagtacccgaagcgccctcatcacagaggtgcatcaatacctcataatggcgtcaagtatggatgcaaaggaggttacaaatggagggatacaaaaaaggcaaaccctaatatccttgttggagcaatggtggctggccctgacaggcatgatggctacaaagatgtccgcacaaactacaattactcagagcctactcttgcagcaaatgctggtttggttgcagcactgatttctatatctgatatcaaaactggacggttcggcattgataagaacaccatcttctctgcaattcctccaatgttcccaacacccccaccaccgccatcagcatggaaaccataaagagacagacctctgaatattttccaaagcatcaaatagggaagtggagcaaacatatgatcatttggtacagcaaaggccaggaacaggaaagcggacagcataagcttatagagcttgtatttctgtacccgtatgacagatcagtataaaatcctctgtcaaacatagatcggaagttgtgtgcatcgcgtgaagctaatttttgggggtgttgttgctattggcattccagctcatgtgtgaagttctttttgtagaaatggcacctttacaaattattttataggagtgacttttcatcatagtaaagaatttgtgtgacatatactcttgcttcattttgatcctgttattttgtatttaaaaaatccctatttcaagggaaacatgttcactaagttctcagacattacaagggaattgcaaaagcacgaataggaaaatgatttatagcagttgcattgtgca

SEQ ID NO: 1998 - DNA, 3706 bp, Sorghum bicolor
tcgctttcatgcattattgcgccccaatctacctttgtcacgtactactactcctttcatgaggcgcgtacaaacaatgaaacaactgtgcctcccccaccgagatctactactgtacaaaagttaatgacgaagacctaccctcccttttattacatgattgcccaaaatggccaaatacaaatacagtagcctgcaactaccccgcggtgaggaccgcggtttctcctgcatgctgtgaattgcttagccaggttccaaagttccaaacagtacaggcagcagcatgtgagacctgaacaacgggcgctcgatgggttcgtctcgtcggtgcctacgctcagcgcagctcaggtgggtgtgggtggatgcacacatacacatgacagcagcttcaaatctcgtaccgtatgaatcggtacaaactcgggcccgagcctcagcaatgccctcaaagcgggcaaccgactgccgagcgggagcctcctcttgtacgcgaccgagctctttttgtacccatgcaatcacgcaattgcgcggggctgcacctgcatagacaccgcggcgcagagagcggagcggcgcccaccccccccatcggacgcgcataggcgcagcagaccgaccccacgagtgaagtggagtggcctcccactgtccaccacccccggcgcggcgcacccacccacccacccacccgtcggtcgatagggcagcggcaacgacagagggagagacgagaaaaggagacgcacccgagacccgaaccgatcaccttcacccagcccaaagagtcggcgagcgggcgggcgggggaaagcaacgccccaaccacctacctgatccctccaccccatcgcacgccataacaaagcacagcacccacgcagacgcagtgccgtgccgcactgctgccctgccatctcccataactcactcgcctccgcacgcgcacccgcctgtcccccagctcgctcgtgtcgtgcatccgtcccgccccccacccgccaagaactcgcattgccgccgccgagcccagccaggcaggggacggaggagctagcggccgcgtcggcgcgggaggaggaggaggagagcaggcggcggcaggatgttcgggagggacccctggggcgggccgctggagatctccaacgccgactcggcgacggatgacgaccggagccgggacctggacagggcggcgctgatgcggcagctggacgagacgcagcagagctggctcctggcggggcccggcgaccaggccggcaagaagaagaagaagtacgtcgacctgggatgcgtcgtcgtcgaccgcaagatcttcatgtggaccgtcggcaccatcctcggcctcggcgtcttcatcggattcatcatgatgatcgtcaagctcgtcccgcacaagcggcccccgccgccgccccccgaccagtacacgcaggcgctgcacaaggcgctcatgttcttcaacgcgcagcgatccggtccgttgccaaagcacaatggcgtcagctggaggggcaattcctgcatgaaggatggcctctccgacagcaccgtccgccggagcttggttgggggctactacgatgcaggggacgccatcaagttcaactatcccatggcctggtccatgaccatgctcagctggagtgtgatcgagtacagggctaagtatgaggccatcggtgagctcgaccatatcaaggagctgatcaagtggggaacagactacatcctcaaaacattcaattcatctgccgacacgatagacaggattgtcgctcaggtgggtgtaggtgacacctctaaaggtggcagtcagcctaatgaccattactgctggatgagaccagaggacatcgattacaaaaggccagtcactgagtgtcactcttgctcagatctagcatctgaaatggctgccgccctggctgcagcttccatagtgttcaaggacagcaaaacctactctgacaagctcgtcaaaggtgcaaaagctctgtacaaatttggcaggctgcagcgcgggcgatacagccccaatggatccgatcaggcaattttctacaattccaccagctactgggatgagtttgtgtggggtggtgcgtggatgtacttcgccacagggaacaattcatatctcacagtcgccacagccccaggaatggcaaagcatgctggagcctattggtttggaagtccaaactatggagtatttacctgggatgacaaacttccaggagctcaggtccttctcagcaggctgcgactcttcctaagtccagggtacccttacgaagaaatactgaggacattccacaaccaaactgacaacgttatgtgctcgtatttacctctattcaattcattcaacttcactaaaggaggattaatacaactcaaccatggaaggcctcaaccacttcagtatgctgtcaatgcagctttccttgcttctttatacagtgattatcttgaagctgcagacacgcctgggtggtactgtggacctaatttctacaccacagaagtcctccgcaagtttgccaggtcacagcttgattacatccttggaaagaacccattaaagatgagctacgttgtgggttttggaaacaagtacccgaagcgccctcatcacagaggtgcatcaatacctcataatggcgtcaagtatggatgcaaaggaggttacaaatggagggatacaaaaaaggcaaaccctaatatccttgttggagcaatggtggctggccctgacaggcatgatggctacaaagatgtccgcacaaactacaattactcagagcctactcttgcagcaaatgctggtttggttgcagcactgatttctatatctgatatcaaaactggacggttcggcattgataagaacaccatcttctctgcaattcctccaatgttcccaacacccccaccaccgccatcagcatggaaaccataaagagacagacctctgaatattttccaaagcatcaaatagggaagtggagcaaacatatgatcatttggtacagcaaaggccaggaacaggaaagcggacagcataagcttatagagcttgtatttctgtacccgtatgacagatcagtataaaatcctctgtcaaacatagatcggaagttgtgtgcatcgcgtgaagctaatttttgggggtgttgttgctattggcattccagctcatgtgtgaagttctttttgtagaaatggcacctttacaaattattttataggagtgacttttcatcatagtaaagaatttgtgtgacatatactcttgcttcattttgatcctgttattttgtatttaaaaaatccctatttcaagggaaacatgttcactaagttctcagacattacaagggaattgcaaaagcacgaataggaaaatgatttatagcagttgcattgtgcatggcctgaagcaaagcagaagtatctctaagaacttgtgcagaaattatagccgtgaacattggctgcggctgcaaggtttctagttcatgctacagtacttgcccaggggtaaacagctgtaggcagctgcagcgtctgccgcagcgaacaggccaatatgatgaccttagacttcccacgaaagcatttccaacaatacttttatttccttgagggattggaaggcatttacaaccgttaacgaactattatcgca

SEQ ID NO: 1999 - DNA, 2425 bp, Zea mays
accccatcgcacgccataacaaagcagagcgccacgccaccaccaccccagctcactcgtgccgtgcactcgacccgtcccccctccctccactcgatccaccctccaagacctcgcattgccaccgccgccgccgagccaggggagaggagagaggccagccgcgtcgcggcgggcggaggaggaggacgagcgggagagcggagcgagccggccgggcaggatgttcgggcgggatccctggggcgggccgctggagatctccaacgccgactcggcgacggacgacgaccgcagccgcgacctggaccgggcggcgctgatgcggcagctggacgagacgcagcagagctggctcctggccgggcccggcgaccaggccggcaagaagaagaagcggtacgtcgacctcggctgcctcgtcgtcgaccgcaaggtcttcatgtggaccgtcggcaccgtcctcggcctcggcgtcttcatcggcttcgtcatcatgatcgtcaagctcgtcccgcacaagcgccccccgccgccgccgcccgaccagtacacgcaggcgctgcacaaggcgctcatgttcttcaacgcgcagcgatccggcccgctgccgaagcacaatggcgtgagctggaggggcaactcctgcatgaaggacggcctctccgacagcaccgtccgccggagcctggtcggaggcttctacgacgcgggggacgccatcaagttcaactaccccatggcatggtccatgaccatgctcagctggagcgtgatcgagtacagggccaagtacgaggccatcggcgagctcgaccatatcagggagctcatcaagtggggaacggactacatcctcaagaccttcaattcgtctgccgacacgatagacaggatcgtcgctcaggtgggtgtaggtgacacctctaaaggcagcagtcagcctaacgaccattactgctggatgaggccagaggacatcgactacaagaggccggtcaccgagtgccactcctgctcagatctagcgtcggaaatggctgccgccctggccgcagcttccatagtgttcaagaacagcaagacctactccgacaagctcgtcaagggcgccaaggccctgtacaagttcggcaggctgcagcgtgggcgatacagccccaacggatctgaccaggccatcttctacaactccaccagctactgggacgagttcgtgtggggcggtgcgtggatgtacttcgccacggggaacaactcgtacctcaccgtcgccacagccccgggaatggcgaagcacgctggagcatactggtttggaagtccaaactacggagtgtttacctgggatgacaaacttccaggagctcaggttcttctcagcaggttgcgactcttcctaagtccagggtacccttacgaagaaatactgaggacattccacaaccaaaccgacaacgtcatgtgctcgtatttacctgtattcaattcattcaacttcaccaaaggaggattaatacagctcaaccatggaaggcctcaaccgcttcagtacgctgtcaacgcagctttccttgcttctttatacagcgactatcttgaagcggctgacacgcctgggtggtactgtggaccgaacttctacaccatagaagtcctccgcaagtttgccaggtcacagcttgactacatccttggaaagaacccattgaagatgagctacgttgtgggtttcggaaacaagtacccgaagcgccctcaccacagaggtgcgtcgatacctcataacggcgtcaagtatggatgcaaaggaggttacaaatggagggacacgaagaaggcaaaccctaacatccttgttggagcaatggtggctggccctgacaggcgtgacggctacaaagatgtccgcacgaactacaactacacagagcctacccttgcggcaaacgctggcctggttgcagcactgatttctatatctgatatcaaaaccggacggttcggcatcgacaagaacaccatcttctctgcgatccctccgatgtttccgacaccaccgccgccgccatcagcatggaaaccatagagagacagacctctgaatatcttttcccccccaaagcatcaacacagggaagtggagcaaacatatgatcagttggtacagcaaaggccaggaacaggaaagcggacagcataagcttatagagcttctatttctgtaccagtgtgacagatcagtataaaatcctctgtcatacatagaccagaagttgtgtgcatcgcgtgaaagctaatttttggggtcttgttgctgtgggcattcctgctcatgtgtgaagttattttttgtagaaattgtacctttacaaattgttataggagtgacttttcatagtagtaaagcatttgtgtgacctgt

SEQ ID NO: 2000 - DNA, 2540 bp, Panicum virgatum
tgccgtgccgcactgccttccctgccatctcccaccataactctctcacccgccccgcacgcctgcctgtctgtccctcccgctctgctccgcacactcggcgcaggtgcagcgtccctgctctgctccccacccggcgcccgcattgctgccggagagcggaggcggaccaccggccgcggcggcggaaccaggaggaggaggaggggcaggaagagaggcggcaggatgttcgggcgggacccgtggggcgggccgctggagatctccaacgccgactcggcgacggacgacgaccggagccgggacctggaccgggcggcgctgatgcggcagctggacgagacgcagcagagctggctcctagccggcccgggcgaccaggcgggcaagaagaagaagaagtacgtcgacctcggctgcgtcgtcctcgaccgcaagatcttcatgtggaccgtcggcaccatcctcggcctcggcgtcttcatcggcttcatcatgatgatcgtcaagctcgtcccgcacaagcgcccgccgccgccgccgcccgaccagtacacgcaggcgctgcacaaggcgctcatgttcttcaacgcccagcgatctggtccgctgcccaagcacaacggcgtcagctggaggggcaattcctgcatgaaggacggcctctcggacagcaccgtccggcggagcttggtcggaggcttctacgatgcaggggacgctatcaagttcaactaccccatggcctggtccatgaccatgctcagctggagtgtgatcgagtacaaggccaagtatgaggccatcggcgagctcgaccatatcaaggagctgatcaagtggggaacagattacatcctcaagaccttcaattcgtcagctgacacaatcgacaggattgttgcccaggtgggtttaggtgacacctccaaaggcagctcccagcctaatgaccactactgctggatgagaccagaggatatcgattacaaaaggcctgtcactgagtgccactcttgctcagatctagcatctgaaatggctgccgccctggctgcagcttccatagtgttcaaggacagcaagacctactctgataagctcgtcaaaggtgcaaaagccctgtacaaattcggcaggctgcagcgcgggcgatacagtccgaatggatccgaccaggcaattttctacaattccaccagctactgggatgagtttgtgtggggtggtgcttggatgtactttgccacagggaacaattcatatctcacaatcgccacagccccgggaatggcaaagcatgctggagcctactggtttggcagtccaaactatggagtatttacctgggatgacaaacttccaggagctcaggttcttctcagcaggttgcgactcttcctaagtccagggtatccttacgaagaaatactgaggacattccacaaccaaactgacaacgttatgtgctcatatttacctttattcaattcattcaacttcactaaaggaggattaatacaactcaaccatggagggcctcaaccacttcagtatgctgtcaacgcagctttccttgcttctttatatagtgactatcttgaagctgcagacacacctgggtggtactgtgggcctaatttttacaccacagaagtcctccggaagtttgccaggtcacagcttaattacatccttggaaagaacccactaaagatgagctacgttgtgggttttggaaataagtaccccaaacgtcctcatcacagaggtgcatcgatacctcataatggcgtcaagtatggatgcaaaggaggtttcaaatggagggagactaaaaaggcaaaccctaatgttctcgttggagcaatggtggctggccctgacaggcatgatggtttcaaagatgttcgcacaaactacaattacacagagcctactcttgcagcaaatgctggtttggttgcagcactgatttctatagctgatataccaactggaaggtacagcatcgacaagaacacaatcttctctgcaattcctcctatgttcccaacaccgccaccgccgccatcagcatggaaaccgtaaagagacagacctctgaatattttccaagcatcaaactgggaagtggagcaacatatgatcatttggtacagcaaaggccagaaacagaaaatcagacgacataagcttatagagcttctatttctgtaccagtatgacagatcagtataaaatcttctgtcaaacatagatcggaagttgtgtgcgccgtgtgaagctaatttttggggtccttgtttctattggcattccagctcatgtgtgaagttctttttgtagaaatggcacctttacaaaattattttataggagtgacttttcatcatagtaaagaatttgtgacccctatgcttgcttcattttgatcctgccattttatatttagaagtccctatttcacgggcagcatgttcactaagttctcagattacatgggaatggcaaaagcacggataggaaaatgagtt

SEQ ID NO: 2001 - DNA, 2474 bp, Pennisetum glaucum
gccgcactgccacctcccataacacacccgcctcgcacgcacgcccgcccacctgcctgcctgtccctcaccctctgctccgcacacactcgtgcagtgcaggtgcggcctctctcactcccttcccagggagcccgcattgccgccggtgagcagaggcggaaggagcggccgcggcggagcggaagcagcgcaccaggaggaggaggagcggcaaggagagaggcggcaggatgttcgggcgggacccgtggggcgggccgctggagatctccaacgccgactcggcgacggacgatgaccggagccgggacctggaccgggcggcgctgatgcggcagctggacgagacgcagcagagctggctcctcgccggccccggcgaccaggcgggcaagaagaagaagaagtacgtcgacctcggctgcgtcgtgctcgaccgcaagatcttcatgtggaccgtcggcaccatcctcggcctcggcgtcttcatcggcttcatcatgatgatcgtcaagctcgtcccgcacaagcacccgcctccgccgccgcccgaccagtacacgcaggcgctccacaaggcgctcatgttcttcaacgcccagcgatctggtccgctgccgaagcacaacggcgtcagctggaggggcaactcctgcatgaaggatggcctctctgatagcaccacccggcggagcttggtcggaggcttctacgatgcgggggacgccatcaagttcaactaccccatggcctggtccatgaccatgctcagctggagtgtgatcgagtacaaggctaagtatgaggccatcggcgagctcgaccatatcaaggagctgatcaagtggggaacagattacatcctcaagaccttcaactcgtccgccgacacaatcgacaggattgtcgcccaggtgggtgtaggtgatacctccaaaggcggctctcagcctaatgaccactactgctggatgagaccagaggatatcgattacaaaaggcctgtcaccgagtgccactcttgctcagatctagcatctgaaatggctgctgccctggctgcagcttccatagtgttcaaagacagcaagacctactcagacaagctcgtcaaaggtgcaaaagccctgtacaaattcggaaggacgcagcgtgggcgatacagtcctaatggatccgaccaggcaatcttctacaattccaccagctactgggatgagtttgtgtggggtggtgcgtggatgtactttgccacagggaacaattcatatctcacagtcgccacagccccaggaatggcaaagcatgctggagcttactggtttggcagtccaaactatggagtatttacctgggatgacaaacttccaggagctcaggttcttctcagcagattgcgactcttcctaagtccagggtacccttacgaggaaatactgaggacattccacaaccaaactgacaacgttatgtgctcatacttacctttattcaattcattcaacttcactaaaggaggattgatacaactcaaccatggagggcctcaaccacttcagtatgctgtcaatgcagctttccttgcttctttgtatagtgactatcttgaatctgcagacacacctgggtggtactgtgggcctaatttctacaccacagaagtcctccgcaagtttgccaggtcacagcttgattacatccttggaaagaacccactaaagatgagctacgttgtgggttttggaaataagtaccccaagcgtccccatcacagaggtgcgtcgattcctcataatggcgtcaagtatggatgcaaaggaggtttcaaatggagggagagtaaaaaggcaaaccctaatgttctcgttggagcaatggtggctgggcctgacaggcatgatcgcttcaaagatatccgcacaaactacaattacactgagcctactcttgcagcaaatgctggtttggtcgcagcactgatttctatagctgatataccaactggaaggtacagcattgataagaacacaatcttctctgcaattcctcctatgttcccaacacccccaccaccaccatcagcatggaaaccgtaaagagacagacctctgaaaatttcccacgcatcaaacagggaagtggagcaacatatgatcgtttggtacagcaaagtccagaaacagaaaagcagacaacataagcttatagagcttttatttctgtaccagtatgacagatcagtataaaatcttctgtcaaacatagatcggaaaatgtgtgcatcgcgtgaagctaatttttggggtccttgttccattggctttccagctcatgtgtgaagttctttttgtagaaatggaacctttacaaattattttataggagtgacttttcatcatagtaaagaatttgtgtgacatctatgcttgcttcattttgatcctattatatacaatggtctccattttcta

SEQ ID NO: 2002 - DNA, 2620 bp, Setaria italica
gaccccccaacccaaaaagacggcaagagggcgggggaaagcaacggcgcaaccacctgatccctccaccccatcgcacggcataacaaatcacacccccacgcacccacgccacaccccccacgcagtgccgtgccgcactgccatctcccaccaccataactcacccgcctcgcacgctcgcctgcctgcctgcctgtccctcagcctctgctccgcacactcgtgcagtgcaggtgcagcctctctcactcccttcccgggtgcccgcattgccgccggtgagcagaggcggagcggccgcgggggcgcggaagcagcagcaggaggaggaggagcagcagcaagagagccggcaggatgttcgggcgggacccgtggggcgggccgctggagatctccaacgccgactcggcgacggacgacgaccggagccgggacctggaccgggcggcgctaatgcggcagctggacgagacgcagcagagctggctcctcgccggccccggggaccaggcgggcaagaagaagaagaagtacgtcgacctcggctgcgtcgtcctcgaccgcaagatcttcatgtggaccgtcggcaccatcctcggcctcggcgtcttcatcggcttcatcatgatgatcgtcaagctcgtcccgcacaagcgcccgccgccgccgccgcccgaccagtacacgcaggcggtccacaaggcgctcatgttcttcaacgcccagcgatctggtccgctgccgaagcacaacggcgtcagctggaggggcaattcctgcatgaaggatggcctttctgacagcaccacccggcggagcttggtcggaggcttctacgatgcaggggacgccatcaagttcaactaccccatggcctggtccatgaccatgctcagctggagtgtgatcgagtacaaggccaagtatgaggctatcggcgagctcgaccatatcaaggagctgatcaagtggggaacagattacatcctcaagaccttcaattcgtcagccgacacaatcgacaggattgttgcccaggtgggtataggtgacacctccaaaggtggctcccagcctaatgaccactactgctggatgagaccagaggatatcgattacaaaaggcctgtcactgagtgccactcttgctcagatctagcatctgaaatggctgccgccctggctgcagcttccatagtgttcaaggacagcaagacctactctgacaagctcgtcaaaggtgcaaaagccctgtacaaattcggcaggacgcagcgagggcgatacagtcccaatggatccgaccaggcaattttctacaattccaccagctactgggatgagtttgtgtggggtggtgcgtggatgtactttgccacagggaacaattcatatctcacagttgccacagccccaggaatggcaaagcatgctggagcctactggtttggcagtccaaactatggagtatttacctgggatgacaaacttccaggagctcaggttcttctcagcaggttgcgactcttcctaagtccagggtacccttacgaagaaatactgaggacattccacaaccaaactgacaacgttatgtgctcatatttacctttattcaattcattcaacttcactaaaggaggattaatacaactcaaccatggagggcctcagccacttcagtatgctgtcaacgcagctttccttgcttctttgtatagtgactatcttgaatctgcagatacacctgggtggtactgtgggcctaatttctacaccacagaagtcctccgcaagtttgccaggtcacagcttgattacatccttggaaagaacccgcaaaagatgagctacgttgtgggttttggaaataagtacccaaagcgtccccatcacagaggtgcatcgatacctcataatggcgtcaagtatggatgcaaaggaggtttcaaatggagggagagtaaaaaggcaaaccctaatattctcgttggagcaatggtggctggccctgacaagcatgatcgcttcaaagatatccgcacgaactacaattacactgagcctactcttgcagcaaatgctggtttggtcgcagcactgatttctatagctgatataccaactggaaggtacagcattgataagaacacaatcttctctgcaattcctcctatgttcccaacacccccaccgccaccatcagcatggaaaccgtaaagagacagacctctgaatattttcccaagcatcaaacagggaagtggagcaacatatgatcgtttggtacagcaaaggccagaaacagaaaagcagacaacataagcttatagagcttctatttctgtaccagtatgacagatcagtataaaatcttctgtcaaacatagatcggaagttgtgtgcatcgcgtgaagctaatttttggggtccttgttgctattggcattccagctcatgtgtgaagttctttttgtagaaatggcacctttacaaattattttataggagtgacttttcatcatagtaaagaatttgtgtgacctctatgcttgcttcattttgatcctgttatttatatttaaaagtccctatttcaggggtggcatgttca

SEQ ID NO: 2003 - DNA, 3414 bp, Oryza sativa
cctgaatttcccatttccttgacttgatggtttcatcttttattcctccatcctccaatcccaccaactctgtccaacttgattgaagtataaaactgagtggcacatacattttgaatcactaatacaggcaataccagttaacaaccacaccataatcgtttgcttcaagccttgagcaacggtaactgctttgcaaaggaaaggcacggagacaagttaatgctgtcgctttcttgcattattgggacctatatatcttctttgccacgtacagtttgataatgtacaaacaactttgcatcccagatctaccaaagttaacactcctaacaaaggcctactactactcttctatatcacctgataatgcccaaacgtcccacaactactactcccactttacaacagtaaacaatcacaacttccgtaagatctaaacaccgttttctttttctgtttcttattccacccagacacaaaagtgaaccccactgggtaagtgcaaccctgttactactacctaccccaaccccaacgcaccaccctctattgtgaatcggatggttattaatgacatttatcgaattttctcttatagtagtatacttcccagttctaaaatataagagcatgatgcattccatctaattcaatattttatattttgagatggaagagtagctattccccaatcacgtcccgtagagagcagcagtagcgtagagccgtggaggggcttgtaccggcaggcaccagcaccggcgcccgccgacgcccacaagcccccaccgagcgcggccgcaccaccaaccgatagcggagcggcaacaacaaaacgaagccgaaacgaaaagacggggggcgacgaggcgagcgcgagaaagagaaagagagagcaacgccccaaccaccaccccctctgcccaggccccagatccctccaccccatcgcacgccacaacataacataacaccgcaaacacgcaccctcccaacagacgcctcctcccctccctccctcccacctacactccgctgcgcagccagcttcgctcgcccgctacctcactcactctcgggtgagcgcggccaccgctgccggcgacgaggtagggaggaggaggagggcaagatgttcgggcgggacccgtggggcgggccgctggagatctcgaatgcggactcggcgacggacgacgaccggagccgggacctggacaggggggcgctgatgcggcagctggacgagacgcagcagagctggctcctggccgggccgggcgaccaggccggcaagaagaagaagaagtacgtcgacctcggctgcatggtcctcgaccgcaagatcttcatgtggaccgtcggcaccatcctcggcgtcggcctcttcatcggcttcgtcatgatgatcgtcaagctcgtcccccacaagcgcccccctcctcctccccccgaccagtacacccaggccctccacaaggccctcatgttcttcaacgcgcaacgatctggtccgctgccgaagcataacggcgtcagctggagggggaattcttgcatgaaggatggcctctccgacagcaccgtccggaagagcttggtcggaggcttctacgacgcaggagacgccatcaagttcaactaccccatggcctggtccatgaccatgctcagctggagtgtgatcgagtacaaggccaagtatgaggcgatcggtgagctcgaccatgtcaaggagctgatcaagtggggcacagattacctcctcaagaccttcaattcatcagccgatactatcgatcggatcgtcgcacaggtgggtgtaggtgacacctcaaaaggtggtgcccaacctaatgaccactactgctggatgaggccagaggatatcgattaccccagacctgtcactgagtgccactcttgctcagatcttgcttccgaaatggctgctgcccttgctgcagcttccatagtgttcaaggacagcaagacttactctgacaagctcgtgcgtggcgcaaaggccctgtacaagttcggtaggctgcagcgtgggagatacagccccaatggctctgatcaagcaattttctacaattccaccagttactgggatgagtttgtgtggggtggtgcgtggatgtactttgccacagggaacaatacatacctatcggttgcaacagctccggggatggcaaagcatgctggagcatactggctcgatagtccgaattatggagtttttacctgggatgacaagcttccaggagctcaggttcttctgagcaggttgcggcttttcctaagtcctggatatccttacgaagaaatactgagaacatttcacaaccaaacagacaatgttatgtgctcgtatctgccgatgtacaattcattcaactttaccaaaggaggaatgatacagctcaaccacggaaggcctcagccacttcagtatgttgtcaatgcggctttccttgcctctctatacagcgattacctggatgctgcagatacacctgggtggtattgtggacctactttctacactacagaagtcctccgcaaatttgcaaggtcacagctcgattatgtcctaggtaagaacccactgaagatgagctacgttgtgggttttggaaacaagtaccccaagcgcgctcatcacagaggtgcatcaatccctcataatggtgtcaaatatggatgcaaaggaggctttaaatggagggagactaagaagccaaatcctaatatccttattggagcactggttgctggccctgataggcatgatggcttcaaagatgtccgtacaaactacaattacacggagcctactcttgcagcaaatgctggcctggtggcagccttgatttccctaactaacattcacgtcaaaagtggaatcgataagaacaccatcttctctgcagttcctccgatgtttccaactcccccacctccaccgtcagcttggaaaccatgaagagtcagatcgctgaatatttcttgagcatcaaacggagggaacgacagatgtttgtttggtacagcaaaggacacatacagaaagcagacaacataagcttacagagcctctattttctgtatcagtatgacagatcggtataaattcatctgtcgacaatagaccgggatgttgtgtgcaccttgtgaaactaatttttggggtccttgttgttattcgttcagagctcatgtgtgaagttctttttgtagaaatggaacctttataaaccgttttataggagtgactttatcatcatactaaaggatttgtgtaacctttatacagctttcttgattccatttttatctctttgccttacatttcagccacacttcaggggcatgttcactaaattctcatcatatccaatg

SEQ ID NO: 2004 - DNA, 2476 bp, Oryza sativa
gaaacgaaaagacggggggcgacgaggcgagcgcgagaaagagaaagagagagcaacgccccaaccaccaccccctctgcccaggccccagatccctccaccccatcgcacgccacaacataacataacaccgcaaacacgcaccctcccaacagacgcctcctcccctccctccctcccacctacactccgctgcgcagccagcttcgctcgcccgctacctcactcactctcgggtgagcgcggccaccgctgccggcgacgaggtagggaggaggaggagggcaagatgttcgggcgggacccgtggggcgggccgctggagatctcgaatgcggactcggcgacggacgacgaccggagccgggacctggacaggggggcgctgatgcggcagctggacgagacgcagcagagctggctcctggccgggccgggcgaccaggccggcaagaagaagaagaagtacgtcgacctcggctgcatggtcctcgaccgcaagatcttcatgtggaccgtcggcaccatcctcggcgtcggcctcttcatcggcttcgtcatgatgatcgtcaagctcgtcccccacaagcgcccccctcctcctccccccgaccagtacacccaggccctccacaaggccctcatgttcttcaacgcgcaacgatctggtccgctgccgaagcataacggcgtcagctggagggggaattcttgcatgaaggatggcctctccgacagcaccgtccggaagagcttggtcggaggcttctacgacgcaggagacgccatcaagttcaactaccccatggcctggtccatgaccatgctcagctggagtgtgatcgagtacaaggccaagtatgaggcgatcggtgagctcgaccatgtcaaggagctgatcaagtggggcacagattacctcctcaagaccttcaattcatcagccgatactatcgatcggatcgtcgcacaggtgggtgtaggtgacacctcaaaaggtggtgcccaacctaatgaccactactgctggatgaggccagaggatatcgattaccccagacctgtcactgagtgccactcttgctcagatcttgcttccgaaatggctgctgcccttgctgcagcttccatagtgttcaaggacagcaagacttactctgacaagctcgtgcgtggcgcaaaggccctgtacaagttcggtaggctgcagcgtgggagatacagccccaatggctctgatcaagcaattttctacaattccaccagttactgggatgagtttgtgtggggtggtgcgtggatgtactttgccacagggaacaatacatacctatcggttgcaacagctccggggatggcaaagcatgctggagcatactggctcgatagtccgaattatggagtttttacctgggatgacaagcttccaggagctcaggttcttctgagcaggttgcggcttttcctaagtcctggatatccttacgaagaaatactgagaacatttcacaaccaaacagacaatgttatgtgctcgtatctgccgatgtacaattcattcaactttaccaaaggaggaatgatacagctcaaccacggaaggcctcagccacttcagtatgttgtcaatgcggctttccttgcctctctatacagcgattacctggatgctgcagatacacctgggtggtattgtggacctactttctacactacagaagtcctccgcaaatttgcaaggtcacagctcgattatgtcctaggtaagaacccactgaagatgagctacgttgtgggttttggaaacaagtaccccaagcgcgctcatcacagaggtgcatcaatccctcataatggtgtcaaatatggatgcaaaggaggctttaaatggagggagactaagaagccaaatcctaatatccttattggagcactggttgctggccctgataggcatgatggcttcaaagatgtccgtacaaactacaattacacggagcctactcttgcagcaaatgctggcctggtggcagccttgatttccctaactaacattcacgtcaaaagtggaatcgataagaacaccatcttctctgcagttcctccgatgtttccaactcccccacctccaccgtcagcttggaaaccatgaagagtcagatcgctgaatatttcttgagcatcaaacggagggaacgacagatgtttgtttggtacagcaaaggacacatacagaaagcagacaacataagcttacagagcctctattttctgtatcagtatgacagatcggtataaattcatctgtcgacaatagaccgggatgttgtgtgcaccttgtgaaactaatttttggggtccttgttgttattcgttcagagctcatgtgtgaagttctttttgtagaaatggaacctttataaaccgttttataggagtgactttatcatcatactaaaggatttgtgtaaccttt

SEQ ID NO: 2005 - DNA, 2118 bp, Saccharum officinarum
tattcccggcctcgcccacgcgtccgagaagaagtacgtcgacctgggctgcgtcgtcgtcgaccgcaagatcttcatgtggaccgtcggcaccatcctcggcctcggcgtcttcatcggcttcatcatgatgatcgtcaagctcgtcccgcacaagcggcccccgccgccgccgcccgaccagtacacgcaggcgctgcacaaggcgctcatgttcttcaacgcgcagcgatccggtccgctgccgaagcacaatggcgtcagctggagaggcaattcctgcatgaaggatggcctctccgacagcaccgtccgccggagcttggtcggaggctactacgatgcaggggatgccatcaagttcaactatcccatggcctggtccatgaccatgctcagctggagtgtgatcgagtacagggctaagtatgaggccatcggtgagctcgaccatatcaaggagctgatcaagtggggaacagactacatcctcaaaaccttcaattcatctgccgacacgatagacaggattgtcgctcaggtgggtgtaggtgacacctctaaaggcagcagtcagcctaacgaccattactgctggatgagaccagaggatatcgattacaaaaggccagtcactgagtgtcactcttgctcagatctagcatctgaaatggctgccgccctggctgcagcttccatagtgttcaaggacagcaaaacctactctgacaagctcgtcaaaggtgcaaaagccctgtacaaatttggcaggctgcagcgcgggcgatacagccccaatggatctgaccaggcaatcttctacaactccaccagctactgggatgagtttgtgtggggtggtgcgtggatgtactttgccacagggaacaattcatacctcacagtcgccacagccccaggaatggcaaagcatgctggagcctactggtttggaagtccaaactatggagtatttacctgggatgacaaacttccaggagctcaggttcttctcagcaggttgcgactcttcctaagtccagggtacccttatgaagaaatactgaggacattccacaaccaaactgacaacgttatgtgctcatatttacctctattcaattcattcaacttcactaaaggaggattaatacaactcaaccatggaaggcctcaaccacttcagtatgctgtcaatgcagctttccttgcttctttatacagtgactatcttgaagctgcagacacgcctgggtggtactgtggacctaatttctacaccacagaagtcctccgcaagtttgccaggtcacagcttgattacatccttggaaagaacccattaaagatgagctacgttgtgggttttggaaacaagtacccgaagcgccctcatcacagaggtgcatcaatacctcataatggcgtcaagtatggatgcaaaggaggttacaaatggagggatacaaagaaggcaaaccctaatatccttgttggagcaatggtggctggacctgacaggcatgatggctacaaagatgtccgcacaaactacaattacacagagcctactcttgcagcaaatgctggtttggttgcagcactgatttctatatctgatatcaaaactggacggtttggcattgataagaacaccatcttctctgcaattcctccaatgttcccaacacccccaccaccgccatcagcatggaaaccataaagagacagatctctgaatattttcgaaagcaccaaacagggaaatggagcaaacatatgatcatttggtatagcaaaggccagaaacagggaagcggacagcataagcttatagagcttctatttctgtaccagcatgacagatcagtataaaatcctctgtcaaacatagatcggaagttgtgtgcatcgcgtgaagctaatttttggggtcttgttgctattggctttccagctcatgtgtgaagttctttttgtagaaatggcacctttacaaattattttataggagtgacttttcatcatagtaaagaatatgtgtgacctacgcttgcttcattttgatcctgttattttgtatttaacaatccctatttaaggggaaacatgttcact

SEQ ID NO: 2006 - DNA, 2443 bp, Triticum aestivum
ggcaacgagaccaaaccgaaaagacgggccaaggggacgacgaaagcaacgccccaaccaccaccccgacccctccctccgtttcacttcatcataacatagcgccgtgccatcgctcaccaccccggacggacatcattcattcattcctagtaccaccaccaccttcgtctcccccctctccacccacactccaattgagaaacagctccgtcgtcctcctccggccattgccgtcgcgaattaagcggcaaggaggcggccggcggcaagatgttcgggcgggacccgtggggcgggacgctggagatctcgaacgcggactcggcgacggacgacgaccggagccgggacctggaccggggcgccatgatgcggcaccagctggacgagacgcagcagagctggctgctggccggcccgggcgaccaggccgggaagaagaagaagaagtacgtggacatcggctgcatggtcatcgaccgcaagatcttcatgtggaccgtcggcctcatcctcggcgtcggcctcttcgtcggcttcgtcatgatgatcgtcaagctcgtcccgcacaagaagcccccgccgccgccgccggaccagtacaccctcgcgctgcacaaggcgctcatgttcttcaacgcccagcgatctggtcatctgcccaagcacaacggcgtgagctggaggggcaactccggcatgaaggacggcctctcggacagcaccgtcaagaagagcttggtcggaggcttctacgacgcaggcgacgccatcaagttcaactaccccatggcctggtccatgaccatgctcagctggacggtgatcgagtacagggccaagtacgaggccatcggcgagctcgaccatgtcaaggagatcatcaagtggggcaccgactacatgctcaagaccttcaactcgtccgccgacaccatcgaccggattgtcgcccaggtcggcgtgggtgacacctctaaaggccccatgccgaacgaccactactgctggatgaggccagaggacattgattacaagaggcctgtcatcgagtgccactcttgctcggatcttgccgctgagatggccgccgctctcgctgcggcttccatagtgttcaaggacagcaaggcgtactctgacaagctcgtccatggtgccaaggcgctgtacaagttcggtaggctgcagcgcggccgatacagccccaatggctctgatcagtcgctgttctacaattccaccagctactgggatgagtttgtgtggggtggtgcgtggatgtacttcgccacgggaaacacatcgtacctgacgatcgccacagctccagggatggcaaagcatgcaggcgcgttctggattggcagcccaaactatggagtgtttacctgggatgacaagcttccaggatctcaggttcttctcagcaggttgcggctcttcctaagtccagggtatccttatgaagaaatattaaggacattccacaaccaaactgacaatgtcatgtgctcatatttaccagtattcaattcattcaacttcactaaaggaggattgatacaactcaaccatggagggcctcaaccacttcagtacgtcgtcaatgcagctttccttgcctctttgtatgctgattatctggacaccgcagatacaccagggtggtattgtggacctaatttctataccacagatgtcctccgcaagtttgcaaagtcacagcttgattacatcctaggcaagaacccacaaaagatgagctacgtcgtgggttttggaaagaagtacccgaagcgtgttcatcacagaggggcatcaatccctcataacggtgtcaagtacggatgcaaaggaggttttaaatggagagagtctaagaaagcaaaccctaatatcctcgtcggagcaatggttgctggccctgacaagcatgatggcttcaaagatatccgcacaaattacaattacacagaacctacccttgcagcaaatgctggcttggttgcagcattgatttctctagctgacatcgataccggcagatattcaattgataagaacaccatcttctcagcagttcccccaatgttcccgacacccccaccacctccatcagcttggaaaccatgaagagtcagatccctgaacatttcataagcatcaaatggagggagcaacagatggttgtttggtatatacagcgaaggccacgaacagaaagcagacaacataagcttacagagtttctacttctgtatcggtatgacggatcagtataaatcatctgtcaaccatggactggaagttgtgtgcaatttgtgaaactaatttttggggtccttgttgttatccatattccgagttcatgtgtgaagttctttttgtagaaatggtacctttgtaagtcattttgttttataggagtgacttattc

SEQ ID NO: 2007 - DNA, 2458 bp, Triticum aestivum
ggcaacgagaccaaccgaaaagacgggccaaggggggcgaaagcaacgccccaaccaccaccccgaccccctccctccgtttcatttcatcataacatagcgccgtgccatcgctcaccaccccggacggacatcattcattcattcctagtaccaccaccaccttccttcgtctctcccctctctgcccacactccaattgagaaacagctccgtcgtcgtcctcctccggccattgccgtcgcgaattaagcagcaaggaggctgccggcgaaaggcggcggcaggatgttcgggcgggacccgtggggcgggacgctggagatctcgaacgcggactcggcgacagacgacgaccggagccgggacctggaccggggcgccatgatgcggcaccagctggacgagacgcagcagagctggctgctggccggcccgggcgaccaggccgggaagaagaagaagaagtacgtggacatcggctgcatggtcatcgaccgcaagatcttcatgtggaccgtcggcctcatcctcggcgtcggcctcttcgtcggcttcgtcatgatgatcgtcaagctcgtcccgcacaagaagccgccgccgccgccccccgaccagtacaccctcgcgctccacaaggccctcatgttcttcaacgcccagcgatccggtcatctgcccaagcacaacggcgtgagctggaggggcaactccggcatgaaggacggcctctcggacagcaccgtcaagaagagcttggttggaggcttctacgacgcaggcgacgccatcaagttcaactaccccatggcctggtccatgaccatgctcagctggacggtgatcgagtacagggccaagtacgaggccatcggcgagctcgaccatgtcaaggagatcatcaagtggggcaccgactacatgctcaagaccttcaactcgtccgccgacaccatcgaccggattgtcgctcaggtcggcgtgggcgacacctctaaaggccccatgccgaacgaccactactgctggatgagaccagaggatattgactataagaggcctgtcatcgagtgccactcttgctcggatcttgccgctgagatggctgccgccctcgccgccgcttccatagtgttcaaggacagcaaggcgtactctgacaagctcgtccacggtgccaaggcgctgtacaagttcggtaggctgcagcgcggtcgatacagccccaatggctctgatcagtcattgttctacaattccaccagctactgggatgagtttgtgtggggtggtgcgtggatgtacttcgccacggggaacacatcatacctcaccatcgccacagctccaggaatggcaaagcacgcaggcgcgttctggattggtagcccaaactatggagtgtttacctgggatgacaagcttccaggatctcaggttcttctcagcaggttgcggctcttcctaagtccagggtatccttatgaagaaatattaaggacattccacaaccaaactgacaatgtcatgtgctcatatttaccagtattcaattcattcaacttcactaaaggaggattgatacaactcaaccatggagggcctcaaccgcttcagtacgtcgtcaatgcagctttccttgcctctttgtatgctgattatctggacactgcggatacaccagggtggtattgtggacctaatttctataccacagatgtcctccgcaagtttgcaaagtcacagcttgattacattctaggcaagaacccacaaaagatgagctacgtcgtgggttttggaaagaagtaccccaagcgtgttcatcacagaggggcatcaatccctcataacggtgtcaagtacggatgcaaaggaggtttcaaatggagagagtctaagaaagcaaaccctaatatcctcgttggagcaatggttgctggccctgacaagcatgatggcttcaaggatatccgcacaaattacaattacacagagcctactcttgcagcaaatgctggcctggttgcagcattgatttctctagctgacatcgataccggcagatattcaattgataagaacaccatcttctcagcagttcccccaatgttcccgacacccccaccaccaccatcagcttggaaaccatgaagagtcagatccctgaacatttcataagcatcaaatggagggagcaacagatggttgtttggtatatacagcgaaggccacgaacagaaagcagacaacataagcttacagagtttctacttctgtatcggtatgacggatcagtataaatcatctgtgaaccatggactggaagttgtgtgcgatttgtgaaactaatttttgaggtccttgttgttcttcaaattccaagttcacgtgtgaagttctttttgtagaaatggtacctttgtaagtcgttttgttttataggagtgacttattc

SEQ ID NO: 2008 - DNA, 2304 bp, Triticum aestivum
gtaccaccaccaccttcgtctcccccctctccacccacactccctccaattgagaaacagccccgtcgtcctcctccggccattgccgtcgcgaactagacagcaaggaggcggccggcgaaaggcggcggcaggatgtttgggcgggacccgtggggcgggacgctggagatctcgaacgcggactcggcgacggacgacgaccggagccgggacctggaccggggcgccatgatgcggcaccagctggacgagacgcagcagagctggctgctggccggcccgggcgaccaggccgggaagaagaagaagaagtacgtggacatcggctgcatggtcatcgaccgcaagatcttcatgtggaccatcggcctcatcctcggcgtcggcctcttcgtcggcttcgtcatgatgatcgtcaagctcgtcccgcacaagaagccgccgccgccgccccccgaccagtacaccctcgcgctccacaaggcgctcatgttcttcaacgcccagcgatctggtcatctgcccaagcacaacggcgtgagctggaggggcaactccggcatgaaggacggcctctcggacagcaccgtcaagaagagcttggtcggaggcttctacgacgcaggcgacgccatcaagttcaattaccccatggcctggtccatgaccatgctcagctggacggtcatcgagtacagggccaagtacgaggccatcggcgagctcgaccatgtcaaggagatcatcaagtggggcaccgactacatgctcaagaccttcaactcgtccgccgacaccatcgaccggatcgtcgcccaggtcggcgtgggtgacacctccaaaggccccatgccgaacgaccactactgctggatgagaccagaggacattgattacaagaggcctgtcatcgagtgccactcttgctcggatcttgccgctgaaatggctgccgcccttgccgcagcttccatagtgttcaaggacagcaagacgtactctgacaagctcgtccacggtgccaaggcgctgtacaagttcggtaggctgcagcgcggccgatacagccccaatggctctgatcagtcgctgttctacaattccaccagctactgggatgagtttgtgtggggcggtgcgtggatgtacttcgccacggggaacacatcatacctcaccatcgccacagctccagggatggcgaagcacgcgggagcgttctggattggtagcccaaactatggagtgtttacctgggatgacaagcttccaggatctcaggttcttctcagcaggttgcggctcttcctaagtccagggtatccttatgaagaaatattaaggacattccacaaccaaactgacaatgtcatgtgctcctatttaccagtattcaattcattcaacttcactaaaggaggattgatacaactcaaccatggagggcctcaaccacttcagtacgtcgtcaatgcagcattccttgcctctttgtatgctgattacctggacactgcagatacaccagggtggtattgtggacctaatttctataccacagatgtcctccgcaagtttgcaaagtcacagcttgattatattctaggcaagaacccacaaaagatgagctacgtcgttggttttggaaagaagtaccccaagcgcgttcatcacagaggggcatcaatccctcataacggtgtcaagtacggatgcaaaggaggttttaaatggagggagtctaagaaagcaaaccctaatatcctcgtcggagcaatggttgctggccctgacaagcatgatggcttcaaagatatccgcacaaattacaattacacagagcctactcttgcagcaaatgctggcctggttgcagcattgatttctctagctgacatcgatactggaagatactcaattgataagaacaccatcttctcagcagttcccccaatgttcccgacacccccaccaccgccatcagcttggaaaccgtgaagagtcagatccctgaacatttcataagcatcaaatggagggagcaacagatggttgtttggtatatacagcgaaggccacgaacagaaagcagacaacataagcttacagagtttctacttctgtatcggtatgacggatcagtataaatcatctgtcagccttgaactggaagttgtgtgcaatttgtgaaactaaattttgggtccttgttgttatccatattccgagttcgtgtgtgaagttctttttgtagaaatgctaccttagtaagtcattttgttttataggagtgacttattc

SEQ ID NO: 2009 - DNA, 2592 bp, Hordeum vulgare
gaagcggcgcacctagaaccaacccatccgatagcggcaacgaggccgaaccgaaaagacggggccaagggggaggacgaaagcaacgccccaaccaccgtctcggcctcatttcatttcatcataacatagctagcgccgtgccatcgctcaccaccaccaccaccccggacggccaccattcattcattcattcattcctagtaccaccaccagcagcagcagcaccttggtctctcccccctctccgtcctcctcctccggccattgccgtcgcggattagctaggcgacgggggcaagatgttcgggcgggacccgtggggcgggacgctggagatctcgaacgcggactcggcgacggacgacgaccggagccgggacctggaccggggcgccatgatgcggcaccagctggacgagacgcagcagagctggctgctggccggcccgggcgaccaggcaggcaagaagaagaagaagtacgtcgacatcggctgcatggtcatcgaccgcaagatcttcatgtggaccgtcggcctcgtcctcggcgtcggcctcttcgtcggcttcgtcatgatgatcgtcaagctcgtcccgcacaagaagccgccgccgccgccgccggaccagtacaccctcgcgctccacaaggcgctcatgttcttcaacgcccagcgatctggtcacctgcccaagcacaacggggtgagctggaggggcaactccggcatgaaggacggcctctcggacagcaccgtcaagaagagcctggtcggaggcttctacgacgccggcgacgccatcaagttcaactaccccatggcctggtccatgaccatgctcagctggacggtgatcgagtacagggccaagtacgaggccatcggcgagctcgaccatgtcaaggagatcatcaagtggggcaccgactacatgctcaagaccttcaactcgtccgccgacaccatcgaccggatcgtcgcccaggtcggcgtgggtgacacctctaaaggccccatgccgaatgaccactactgctggatgagaccagaggacattgactacaagaggcctgtcatcgagtgccactcctgctcggatcttgccgctgagatggccgccgccctcgccgcggcttccatagtgttcaaggacagcaaggcgtactctgacaagcttgtccacggtgccaaggcgctgtacaagttcggtaggctgcagcgggggcgatacagccccaatggctctgatcagtcgctgttctacaattccaccagctactgggatgagtttgtgtggggtggcgcgtggatgtacttcgccacggggaacacatcgtacctcacgatcgccaccgctccagggatggccaagcacgcgggggcgttctggattggtagtccaaactatggagtgttcacctgggatgacaagcttccaggatctcaggttcttctcagcaggttgcggctcttcctaagcccagggtatccttatgaagaaatattaaggacattccacaaccaaactgacaatgtcatgtgctcatatttaccagtattcaattcattcaacttcactaaaggaggactgatacaactcaaccatggagggcctcaaccacttcagtacgtcgtcaatgcagcattccttgcctctctgtatgctgattatctggacactgcagatacaccagggtggtattgtggacctaatttctataccacagatgtcctccgcaagtttgcaaagtcacagcttgattacattctaggcaagaacccacaaaagatgagctacgtcgtgggttttggaaagaagtaccccaagcgtgttcatcacagaggggcatcaatccctcataacggtgtcaaatatggatgcaaaggaggttttaaatggagagagtctaagaaagcaaaccctaatatcctcgtcggagcaatggttgctgggcctgacaagcatgatggcttcaaagatatccgcacaaattacaattacacagagcctactcttgcagcaaatgctggcctggttgcagcattgatttctttagctgacatcgatactggcagatattcaattgataagaacaccatcttctcagcagttcccccaatgttcccgacacccccaccaccgccgtcagcttggaaaccttgaagaatcagattcctgaacatttcataagcatcaaatggagggagcaacagatggttgtttgatatacagcaaagaccataaacagaaagcagacaacataagcttacagagtttctacttctgtatcggtatgacggatcattataaatcatctgtcaaccatggactggaagttgtgtgcgatttgtgaaactaaattttgaggtccttgttgttcttcatatcccaagttcacgtgtgaagttctttttgtagaaatggtacctttgtaagtcattttgttttataggagtgacttattcgtcacagtaaagaatgtgtgaccttcatacagcttgttttatagtgcttgacatacactatacacttcatgggcatgttcaccaaattctcaaacattatatagcaatggagaatgaagtga

SEQ ID NO: 2010 - DNA, 2420 bp, Secale cereale
catcagtcattcgttcgtagtaccaccaccaccttcgtctctccccactctgcccacgctccaactgagaaacagctccgtcgtcctcctcctccggccattgccgtcgcaaattaagccggcaagatgttcgggcgagacccgtggggcgggacgctggagatctcgaacgcggactcggcgacggacgacgaccggagccgggacctggaccggggcgccatgatgcggcaccagctggacgagacgcagcagagctggctgctggccgggccgggcgaccaggccgggaagaagaagaagaagtacgtggacatcggctgcatggtcatcgaccgcaagatcttcatgtggaccgtcggcctcgtcctcggcgtcggcctcttcgtcggcttcgtcatgatgatcgtcaagctcgtcccgcacaagaagccgccgccgccgccccccgaccagtacaccctcgcgctccacaaggcgctcatgttcttcaacgcccagcgatctggtcacctgcccaagcacaacggcgtgagctggaggggcaactccggcatgaaggacggcctctcggacagcaccgtcaagaagagcttggtcggaggattctacgacgccggcgacgccatcaagttcaactaccccatggcctggtccatgaccatgctcagctggacggtgatcgagtacagggccaagtacgaggccatcggcgagctcgaccatgtcaaggagatcatcaagtggggcaccgactacatgctcaagaccttcaactcttccgccgacaccatcgaccggattgtagcccaggtcggcgtgggtgacacctctaaaggccccatgccgaacgaccactactgctggatgaggccagaggacattgattacaagaggcctgtcatcgagtgccactcttgctcggatctcgccgctgagatggctgccgcccttgctgcggcttccatagtgttcaaggacagcaaggcgtactctgacaagctcgtccacggtgccaaggctctgtacaagttcggtaggctgcagcgcggccgatacagccccaatggctctgatcagtcgctgttctacaattccaccagctactgggatgagtttgtgtggggcggtgcgtggatgtacttcgccacggggaacacatcatacctcaccatcgccacagctccagggatggcaaagcacgcaggcgcgttctggattggtagcccaaactatggagtgtttacctgggatgacaagcttccaggatctcaggttcttctcagcaggttgcggctcttcctaagtccagggtatccttatgaagaaatattaaggacattccacaaccaaactgacaatgtcatgtgctcatatttaccagtattcaattcattcaacttcactaaaggaggattgatacaactcaaccatggagggcctcaaccacttcagtatgttgtcaatgcagcattccttgcctctttgtatgctgattatctggacactgcagatacaccagggtggtattgtggacctaatttctataccacagatgttctccgcaagtttgcaaagtcacagattgattacattctaggcaagaacccacaaaagatgagctacgtcgttggttatggaaagaagttccccaagcgtgttcatcacagaggggcgtcaatccctcataacggtgtcaagtacggatgcaaaggaggttttaaatggagagagtctaagaaagcaaaccctaatatcctcgtcggagcaatggttgctggccctgacaagcatgatggcttcaaagatatacgcacaaattacaattacacagagcctactcttgcagcaaatgctggcctggttgcagcattgatttctctagctgatatcgataccggcagatattcaattgataagaacaccatcttctcagcagttcccccaatgttcccgacacccccaccaccaccatcagcttggaaaccatgaagagtcagatccctgaacatttcacaagcatcaaatggagggagcaacagatggttgtttgatatatacagcgaaggccacgaacagaaagcagacaacataagcttacagagtttctacttctgtatcggtatgacggatcagtataaatcatctgtcaaccatggactggaagttgtgtgcgatttgtgaaactaatttttgaggtccttgttgttcttcaaattccaagttcacgtgtgaagttctttttgtagaaatggtacctttgtaagtcattttgttttataggagtgacttattcgtcacagtaaagaatgtgtgaccttcgtacagcttgctctatattatttgacatacactactacacgagtggctatgttccaacctaattcactaaacatctatatagactagaggacgtatcg

SEQ ID NO: 2011 - DNA, 2365 bp, Secale cereale
tagcgccgtgccatcgctcaccaccaccccggacggacatcagtcattcgttcgtagtaccaccaccaccaccttcgtctctcccctctctgcccacgctccaactgagaaacagctccgtcgtcctcctcctccggccattgccgtcgcgaactaagccggcaagatgttcgggcgggacccgtggggcgggacgctggagatctcgaacgcggactcggcgacggacgacgaccggagccgggacctggaccggggcgccatgatgcggcaccagctggacgagacgcagcagagctggctgctggccgggccgggcgaccaggccgggaagaagaagaagaagtacgtggacatcggctgcatggtcatcgaccgcaagatcttcatgtggaccgtcggcctcgtcctcggcgtcggcctcttcgtcggcttcgtcatgatgatcgtcaagctcgtcccgcacaagaagccgccgccgccgccccccgaccagtacaccctcgcgctccacaaggcgctcatgttcttcaacgcccagcgatctggtcatctgcccaagcacaacggcgtgagctggaggggcaactccggcatgaaggacggcctctcggacagcaccgtcaagaagagcttggtcggaggattctacgacgcaggcgacgccatcaagttcaactaccccatggcctggtccatgaccatgctcagctggacggtgatcgagtacagggccaagtacgaggccatcggcgagctcgaccatgtcaaggagatcatcaagtggggcaccgactacatgctcaagaccttcaactcttccgccgacaccatcgaccggattgtcgcccaggtcggcgtgggtgacacctctaaaggccccatgccgaacgaccactactgctggatgaggccagaggacattgactacaagaggcctgtcatcgagtgccactcttgctcggatctcgccgctgagatggctgccgcccttgctgcggcttccatagtgttcaaggacagcaaggcgtactctgacaagctcgtccacggtgccaaggctctgtacaagttcggtaggctgcagcgcggccgatacagccccaatggctctgatcagtcgctgttctacaattccaccagctactgggatgagtttgtgtggggcggtgcgtggatgtacttcgccacggggaacacatcatacctcaccatcgccacagctccagggatggcaaagcacgcaggcgcgttctggattggtagcccaaactatggagtgtttacctgggatgacaagcttccaggatctcaggttcttctcagcaggttgcggctcttcctaagtccagggtatccttatgaagaaatattaaggacattccacaaccaaactgacaatgtcatgtgctcatatttaccagtattcaattcattcaacttcactaaaggaggattgatacaactcaaccatggagggcctcaaccacttcagtatgttgtcaatgcagcattccttgcctctttgtatgctgattatctggacactgcagatacaccagggtggtattgtggacctaatttctataccacagatgttctccgcaagtttgcaaagtcacagattgattacattctaggcaagaacccacaaaagatgagctacgtcgttggttatggaaagaagttccccaagcgtgttcatcacagaggggcgtcaatccctcataacggtgtcaagtacggatgcaaaggaggttttaaatggagagagtctaagaaagcaaaccctaatatcctcgtcggagcaatggttgctggccctgacaagcatgatggcttcaaagatatccgcacaaattacaattacacagagcctactcttgcagcaaatgctggcctggttgcagcattgatttctctagctgatatcgataccggcagatattcaattgataagaacaccatcttctcagcagttcccccaatgttcccgacacccccaccaccaccatcagcttggaaaccatgaagagtcagatccctgaacatttcacaagcatcaaatggagggagcaacagatggttgtttgatatatacagcgaaggccacgaacagaaagcagacaacataagcttacagagtttctacttctgtatcggtatgacggatcagtataaatcatctgtcaaccatggactggaagttgtgtgcgatttgtgaaactaatttttgaggtccttgttgttcttcaaattccaagttcacgtgtgaagttctttttgtagaaatggtacctttgtaagtcattttgttttataggagtgacttattcgtcacagtaaagaatgtgtgaccttcgta

SEQ ID NO: 2012 - DNA, 2391 bp, Brachypodium distachyon
cagatcccatttcttcttcgtcatcataacataacgccaggccacaccacacggccatcgctcgctcactcactgcacccacccgtccttcattgtagtactccgcactctctgctctcgctcgcccaacagcgccggccgcggccattgccgttcgtggtctccggcggcggcgtcttcgtgcggcaagatgttcgggcgggacccatggggcgggacgctggagatctcgaacgcggactcggcgacggacgacgaccggagcagggacctggacaggggcgcgctgatgcggcaccagctggacgagacgcagcagagctggctgctggccggccccggcgaccaggccgggaagaagaagaagaagtacgtcgacatcggctgcatggtcatcgaccgcaagatcttcctgtggaccgtcggcaccatccttggcgtcggcctcttcatcggcttcgtcatgatgatcgtcaagctcgtcccgcacaagaagcccccgccgccgccgcccgaccagtacacccaggcgctgcacaaggcgctcatgttcttcaacgcgcagcgatctggtccgctgcccaagcacaacggcgtcagctggaggggcaactccggcatgaaggacggcctctctgatagcaccgcccggaaaagcttggtcggaggcttctacgatgcaggggacgccatcaagttcaacttccccatggcctggtccatgaccatgctcagctggactgtgatcgagtacaaggccaagtacgaggccatcggcgagctcgaccatgtcaaggaggtgatcaagtggggaacagactacatcctcaagacattcaactcatccgccgataccatcgatcggatcgtcgcccaggtgggtgtaggtgacacctctaaaggtcccatgcctaatgaccactactgctggatgagaccagaggatatcgattacaaaaggcctgtcattgagtgccactcttgctcggatcttgctgctgaaatggctgctgcccttgcttctgcctccatagtgttcaaggacaacaagaaatactctgacaaactcgtccacggtgcgaaggcgctgtacaagtttggcagactgcagcggggacgatacagccccaatggctctgatcagtcactgttctacaattccaccagctactgggatgagtttgtgtggggtggtgcttggatgtactttgccacggggaacacatcatacctcacaatcgccacagctccaggaatggcaaagcatgctggagcgttttggcttggtagtccaaactatggagtatttacctgggatgacaaacttccaggatctcaggttcttctcagcagactgcggctcttcctaagtccaggatacccttacgaagaaatattaaggacattccacaaccaaactgacaatgttatgtgctcatatttacctcaattcgagtctttcaacttcactaaaggaggattaatacagctcaaccatggaaggcctcagccacttcagtatgttgtcaatgcagccttccttgcctctttgtatgctgattacctggacactgcagatacaccagggtggtattgtggacctcatttctttaagacggatgtgctccgcaagtttgcaaagtcgcagattgattacatccttggcaataatccacaaaaaatgagctatgtcgtgggttttggaaagaagtaccccaagcgtgttcatcacagaggggcatcaatcccccataacggtgtcaagtacggatgcaaaggaggtttcaaatggagggagtctaagaaggcaaacccaaatatccttgttggagcaatggtcgctggtcctgacaggcatgatggcttcaaagatatccgcacaaactacaattacacagagccaactcttgcagcaaatgctggcttgattgcagcactgatttctctagcggacatcgatactggcagaactgcaattgataagaacaccatcttctcagcagttcccccaatgttcccaactcccccaccaccaccatcagcctggaaaccgtgaagaatcagatctccgaacatttcataagcatcaaaaggagggagcaacagatggttgtttggtacacagcaaagaccacagacagaaagcagacaacataagcttacagagtttctatttccgtgtcagtatgacagatcagtataaaatcatctgtcgaccatacactggaagttgtgtgcaatttgtgaaactaattttgggggtcctttgttgttattcatattccgagctcatgtgtgaagttcttttttgtagaaaaggtacctttgtaagtcattttgttttataggagtgacgtttttgtcacagtaaaggatgtgtgaccttcatac

SEQ ID NO: 2013 - DNA, 2648 bp, Brachypodium distachyon
cggcgcaccaaacccaaacccatccgatagctagatagcggcaacggggccagccaaaccgacgcggcgggcaaaggggacgagagcgacgccccaaccacaccgcctgcccagatcccatttcttcttcgtcatcataacataacgccaggccacaccacacggccatcgctcgctcactcactgcacccacccgtccttcattgtagtactccgcactctctgctctcgctcgcccaacagcgccggccgcggccattgccgttcgtggtctccggcggcggcgtcttcgtgcggcaagatgttcgggcgggacccatggggcgggacgctggagatctcgaacgcggactcggcgacggacgacgaccggagcagggacctggacaggggcgcgctgatgcggcaccagctggacgagacgcagcagagctggctgctggccggccccggcgaccaggccgggaagaagaagaagaagtacgtcgacatcggctgcatggtcatcgaccgcaagatcttcctgtggaccgtcggcaccatccttggcgtcggcctcttcatcggcttcgtcatgatgatcgtcaagctcgtcccgcacaagaagcccccgccgccgccgcccgaccagtacacccaggcgctgcacaaggcgctcatgttcttcaacgcgcagcgatctggtccgctgcccaagcacaacggcgtcagctggaggggcaactccggcatgaaggacggcctctctgatagcaccgcccggaaaagcttggtcggaggcttctacgatgcaggggacgccatcaagttcaacttccccatggcctggtccatgaccatgctcagctggactgtgatcgagtacaaggccaagtacgaggccatcggcgagctcgaccatgtcaaggaggtgatcaagtggggaacagactacatcctcaagacattcaactcatccgccgataccatcgatcggatcgtcgcccaggtgggtgtaggtgacacctctaaaggtcccatgcctaatgaccactactgctggatgagaccagaggatatcgattacaaaaggcctgtcattgagtgccactcttgctcggatcttgctgctgaaatggctgctgcccttgcttctgcctccatagtgttcaaggacaacaagaaatactctgacaaactcgtccacggtgcgaaggcgctgtacaagtttggcagactgcagcggggacgatacagccccaatggctctgatcagtcactgttctacaattccaccagctactgggatgagtttgtgtggggtggtgcttggatgtactttgccacggggaacacatcatacctcacaatcgccacagctccaggaatggcaaagcatgctggagcgttttggcttggtagtccaaactatggagtatttacctgggatgacaaacttccaggatctcaggttcttctcagcagactgcggctcttcctaagtccaggatacccttacgaagaaatattaaggacattccacaaccaaactgacaatgttatgtgctcatatttacctcaattcgagtctttcaacttcactaaaggaggattaatacagctcaaccatggaaggcctcagccacttcagtatgttgtcaatgcagccttccttgcctctttgtatgctgattacctggacactgcagatacaccagggtggtattgtggacctcatttctttaagacggatgtgctccgcaagtttgcaaagtcgcagattgattacatccttggcaataatccacaaaaaatgagctatgtcgtgggttttggaaagaagtaccccaagcgtgttcatcacagaggggcatcaatcccccataacggtgtcaagtacggatgcaaaggaggtttcaaatggagggagtctaagaaggcaaacccaaatatccttgttggagcaatggtcgctggtcctgacaggcatgatggcttcaaagatatccgcacaaactacaattacacagagccaactcttgcagcaaatgctggcttgattgcagcactgatttctctagcggacatcgatactggcagaactgcaattgataagaacaccatcttctcagcagttcccccaatgttcccaactcccccaccaccaccatcagcctggaaaccgtgaagaatcagatctccgaacatttcataagcatcaaaaggagggagcaacagatggttgtttggtacacagcaaagaccacagacagaaagcagacaacataagcttacagagtttctatttccgtgtcagtatgacagatcagtataaaatcatctgtcgaccatacactggaagttgtgtgcaatttgtgaaactaattttgggggtcctttgttgttattcatattccgagctcatgtgtgaagttcttttttgtagaaaaggtacctttgtaagtcattttgttttataggagtgacgtttttgtcacagtaaaggatgtgtgaccttcatacagcttgttttcatctcattttacatacatttacaagctggcagcatgttcaccaaattctcagatattatatagcaatggcaaaggcataatgcgaagaagaaaaatgagttatgacagcctaatttgtttatgcattgagcgaga

SEQ ID NO: 2014 - DNA, 2344 bp, Festuca arundinacea
  misc_feature (69)..(69): n is a, c, g, or t
  misc_feature (137)..(137): n is a, c, g, or t
  misc_feature (231)..(231): n is a, c, g, or t
  misc_feature (282)..(282): n is a, c, g, or t
  misc_feature (288)..(288): n is a, c, g, or t
  misc_feature (741)..(741): n is a, c, g, or t
  misc_feature (888)..(888): n is a, c, g, or t
  misc_feature (897)..(897): n is a, c, g, or t
  misc_feature (975)..(975): n is a, c, g, or t
  misc_feature (998)..(998): n is a, c, g, or t
  misc_feature (1056)..(1056): n is a, c, g, or t
  misc_feature (1777)..(1777): n is a, c, g, or t
  misc_feature (1929)..(1929): n is a, c, g, or t
  misc_feature (2119)..(2119): n is a, c, g, or t
  misc_feature (2148)..(2148): n is a, c, g, or t
gcacgagggtggtagtactctgctctcgctcatcaccgattaccagcagctccgtcgtcaccggccgtncacggctccggccattgccgccgtcgtcgtcgtaaccatcgtcggaggaggaggaacagcggcggcgncaagatgttcgggcgggacccgtggggcgggacgctggagatctcgaacgcggactcggcgacggacgacgaccggagccgggacctggaccgnggcgccatgatgcggcaccagctggacgagacgcagcagagctggctcctngccggncccggcgaccaggcgggcaagaagaagaagaagtacgtcgacatcgggtgcatggtcatcgaccgcaagatcttcatgtggaccgtcggcaccatcctcggcgtcggcctcttcatcggcttcgtcatgatgatcgtcaagctcgtcccgcacaagaagcccgcgccgccgccgcccgacgagtacacgctcgcgctgcacaaggcgctcatgttcttcaacgcacagcgatccggtcctctgcccaagcacaacggcgtgagctggaggggcaactccggcatgaaggacggcctctccgacagcaccgccaagaagagcctggtcggcggcttctacgacgccggggacgccatcaagttcaactaccccatggcctggtccatgaccatgctcagctggaccgtcatcgagtacaaggccaagtatgagaagatcggcgagctcgaccangtcaaggagatcatcaagtggggcaccgactacatgctcaagaccttcaactcctccgccgacaccatcgataagatcgtcgcccaggtgggtataggtgacacctccaagggcccctcgccaaatgaccactactgctggatgagnccagagganatcgattacaagaggcctgtcatcgagtgccactcttgctctgaccttgccgctgaaatggctgctgccctcgctgcngcttccatagtgttcaaggacancaaggcatactctgacaagctcgtccacggtgccaaggcgctctacaagttcggtagngtgcagcggggccgatacagccccaatggctctgaccagtcgctgttctacaactccaccagctactgggacgagtttgtatggggcggtgcctggatgtacttcgccacagggaacacgtcatacctcacggtcgccacagctccaggaatggcgaagcacgcgggagcgttttggcttggcagtccaaactatggtgtgtttacctgggatgataaacttccaggatctcaggttcttctcagcaggttgcggctcttcctaagtccagggtacccttacgaagaaatactaaggacattccacaaccaaactgacaatgtcatgtgctcatatctaccagtatacaattcattcaacttcactaaaggaggattgatacaactcaaccatggaaggccgcagccacttcagtatgttgtcaatgcagctttccttgcctctttgtatgctgattatctggacactgctgatacaccagggtggtactgtggacctaatttctataagaccgatgtcctccgcaagtttgcaaagtcacagctcgattacatcctaggcaagaacccacaaaagatgagctacgtcgtgggttatggaaagaagtaccccaagcgtgttcatcacagaggggcatcaatccctcataacggtgtcaagtacggatgcaaaggaggttttaaatggagggagtctaaaaaggcaaaccctaatgtcctcntcggagcaatggttgctggccctgacaggcatgatggcttcaaagatatccgcacaaactacaattacacagagcctactcttgcagcaaatgctggcttggttgcagcactgatttctctagctgacatcgataccggcagcagaacttcnattgataagaacaccatcttctcagcagttcccccaatgttcccaactccaccaccaccaccatcagcttggaaaccatgaagagtcagatccctgaacattcataagcatcaaatggagggagcaacagatggttgtttgatatacagcaaaggccacaaacagaaagcaggcaacataagcttacagnaagagtttctacttctgtatcggtatganggaccagtataaatcatctgtcaaccatggagtggaagttgtgtgtaatttgtgaaactaatttttggggtccttgttgttatccatattccgagttcacgtgtgaagttctttttgtagaaatggtacctttgtaagcccttttgttttataggagtgactttttcgtcacagtatagtaaaggatgtgtgacct

SEQ ID NO: 2015 - DNA, 1996 bp, Setaria italica
cccgccgccgccgccgcccgaccagtacacgcaggcggtccacaaggcgctcatgttcttcaacgcccagcgatctggtccgctgccgaagcacaacggcgtcagctggaggggcaattcctgcatgaaggatggcctttctgacagcaccacccggcggagcttggtcggaggcttctacgatgcaggggacgccatcaagttcaactaccccatggcctggtccatgaccatgctcagctggagtgtgatcgagtacaaggccaagtatgaggctatcggcgagctcgaccatatcaaggagctgatcaagtggggaacagattacatcctcaagaccttcaattcgtcagccgacacaatcgacaggattgttgcccaggtgggtataggtgacacctccaaaggtggctcccagcctaatgaccactactgctggatgagaccagaggatatcgattacaaaaggcctgtcactgagtgccactcttgctcagatctagcatctgaaatggctgccgccctggctgcagcttccatagtgttcaaggacagcaagacctactctgacaagctcgtcaaaggtgcaaaagccctgtacaaattcggcaggacgcagcgagggcgatacagtcccaatggatccgaccaggcaattttctacaattccaccagctactgggatgagtttgtgtggggtggtgcgtggatgtactttgccacagggaacaattcatatctcacagttgccacagccccaggaatggcaaagcatgctggagcctactggtttggcagtccaaactatggagtatttacctgggatgacaaacttccaggagctcaggttcttctcagcaggttgcgactcttcctaagtccagggtacccttacgaagaaatactgaggacattccacaaccaaactgacaacgttatgtgctcatatttacctttattcaattcattcaacttcactaaaggaggattaatacaactcaaccatggagggcctcagccacttcagtatgctgtcaacgcagctttccttgcttctttgtatagtgactatcttgaatctgcagatacacctgggtggtactgtgggcctaatttctacaccacagaagtcctccgcaagtttgccaggtcacagcttgattacatccttggaaagaacccgcaaaagatgagctacgttgtgggttttggaaataagtacccaaagcgtccccatcacagaggtgcatcgatacctcataatggcgtcaagtatggatgcaaaggaggtttcaaatggagggagagtaaaaaggcaaaccctaatattctcgttggagcaatggtggctggccctgacaagcatgatcgcttcaaagatatccgcacgaactacaattacactgagcctactcttgcagcaaatgctggtttggtcgcagcactgatttctatagctgatataccaactggaaggtacagcattgataagaacacaatcttctctgcaattcctcctatgttcccaacacccccaccgccaccatcagcatggaaaccgtaaagagacagacctctgaatattttcccaagcatcaaacagggaagtggagcaacatatgatcgtttggtacagcaaaggccagaaacagaaaagcagacaacataagcttatagagcttctatttctgtaccagtatgacagatcagtataaaatcttctgtcaaacatagatcggaagttgtgtgcatcgcgtgaagctaatttttggggtccttgttgctattggcattccagctcatgtgtgaagttctttttgtagaaatggcacctttacaaattattttataggagtgacttttcatcatagtaaagaatttgtgtgacctctatgcttgcttcattttgatcctgttatttatatttaaaagtccctatttcaggggtggcatgttcattgagttctcaggttacatgggaatagcaaaacgacag

SEQ ID NO: 2016 - DNA, 744 bp, Saccharum officinarum
ccgctagggttttggagggaggatcgccgatgtcgacggctcccaggcgcccctccttccgaggccgcggcgccccgcctcccggcaccggctacgtccgccgcggcccagccccaggccccgccgacggcgccaagaccctgcgcaagcccgtcttcaccaccgtcgaccagctgcgcccccagacgcacggccacaccctcaccgcccgcgtcatctccgcccgcaccgtcctcgacaagccctccacgcacctcgcccgcacccgcgtcgccgagtgcctcgtcggagacagcaccggcaccgtcctcgtcaccgcgcgcaacgaacaggttgaccttctgaagccagatacaacagtgatcttccgcaacgccaagattgacatgttcaagggcaccatgaggctggcagtagacaagtggggccggattgaggtgactcagcctgccgatttcaaggtgaaccaagacaacaacatgtcgctggtggagtacgagctggtggatgtcgatgaagaggaatgaggcacaagcgatattaccatctgttgggcgaagtcgggctgtggacatatatttcagtcaaggaagcggtagtggtaggcttctatgatcctatctagttattattattatcctgaaggctggcgattgggactgttagttttaagattatcttaaagaagaagcatgtcgaattatgtacagcagcagcaggtgttctgtctgactgatgctatcc

SEQ ID NO: 2017 - DNA, 964 bp, Zea mays
ctagtactttaaaaacccagctggcagttgcccactcgcaaggcgcaacaacaactttgcgtcttcccgaatcggggcctccaccatctccaactgcaaccccaccccataccgccgccgcctccgctagggttttggagtgaggatcgccgatgtcgacggctcccaggcgccccttccgaggccgcggcgccccgccccctggcaccggctacgtccgccgcggccccgcccctgccccaggccccgccgacggcgccaagaccctgcgcaagcccgtcttcaccaccgtcgaccagctgcgcccccagacgcacggccacaccctcaccgcccgcgtcatctccgcccgcaccgtcctcgacaagccctccacgcacatcggccgcacccgcgtcgcagagtgcctcgtcggagacagcaccggcaccgtcctcgtcaccgcccgcaacgaacaggttgaccttctgaagccagatacaacagtgatcttccgcaacgctaagattgacatgttcaagggtaccatgaggctggtggtggacaagtgggggcggattgaggtgactcagcctgctgatttcaaggtgaaccaagacaacaacatgtcgctggtggagtacgagctggtggatgtggacgaagaggagtgaccagaaacgaagtcgggctgtggacatatattttggttatggaggcggtagcgttaggctcctatctagctattgttatcctggaccgctggcgattgggactttgttttaagtttatcttgaagaagcatgtcgaattatgtacagcagcagcaggtctctgtctgactgatgctttacgtttccgtgacgctttgactcttaatgctagtactacctttttttttctatctcacgatgggtgtatttgcgaatccatttgagctggcagcgcctgtttgggtttcgtggtatggtatggtgaaaaaatg

SEQ ID NO: 2018 - DNA, 1011 bp, Sorghum bicolor
cccacctggcagttgccctctcgcaagtcgcaacaacaacaactcgtcttctcgaatcggccgccaccaactccaactgcagccccgccgcccacgcccccgcccccgctagggttttggagggaggatcgccgatgtcgacggctcccaggcgaggcaccttccgaggccgcggcgcccctccgcccggcaccggctacgtccgccgcggccccgcccctgccccggcggccacaggccccgccgacggcgccaaggccctgcgcaagcccgtcttcaccaccgtcgaccagctgcgcccccagacgcacggccacaccctcaccgcccgcgtcatctccgcccgcaccgtcctcgacaagccctccacgcacctcggccgcacccgtgtcgccgagtgcctcgtcggagacagcaccggcaccgtcctcgtcaccgcccgcaacgaacaggttgaccttctggagccagatacaacagtgatcttccgcaacgccaagattgacatgttcaagggcaccatgaggctggcagtggacaagtggggccggattgaggtgactcagcctgctgatttcaaggtgaaccaagacaacaacatgtcgctggtggagtacgagctggtggatgtggatgaagaggaatgagcagaaacaaatgttaccatctgttgggcgaagtcgggctgtggacatatatttcagttaaggaggcggtagcgttaggctcctatgatcctatctagttattattatcctggaaggctggcgattgggactgttagttttaagatttatcttgaagaagcatgtcgaattatgtacagcagcagcagcaggatgctatccgttccgtgacgcctagtccattaatgctacaactcttttttcccctctcagtttgggtgcgtttgtgaatccatttgagctggcagtgtctgtttaagttttgtggtatggtgaaaaaaatgaagttggcaattgcattttccgttgtggtgttaattcttgc

SEQ ID NO: 2019 - DNA, 1277 bp, Sorghum bicolor
cagcccacatgcccagcccaggcgtcgtatcgtcttcttcgacccttcttcttcccccgatgcggcgtgcgggtcccagattctgacttctctgggcccacgtgtccgtcttagtggagcagtattaaatacagggcgtcccccaccccacctggcagttgccctctcgcaagtcgcaacaacaacaactcgtcttctcgaatcggccgccaccaactccaactgcagccccgccgcccacgcccccgcccccgctagggttttggagggaggatcgccgatgtcgacggctcccaggcgaggcaccttccgaggccgcggcgcccctccgcccggcaccggctacgtccgccgcggccccgcccctgccccggcggccacaggccccgccgacggcgccaaggccctgcgcaagcccgtcttcaccaccgtcgaccagctgcgcccccagacgcacggccacaccctcaccgcccgcgtcatctccgcccgcaccgtcctcgacaagccctccacgcacctcggccgcacccgtgtcgccgagtgcctcgtcggagacagcaccggcaccgtcctcgtcaccgcccgcaacgaacaggttgaccttctggagccagatacaacagtgatcttccgcaacgccaagattgacatgttcaagggcaccatgaggctggcagtggacaagtggggccggattgaggtgactcagcctgctgatttcaaggtgaaccaagacaacaacatgtcgctggtggagtacgagctggtggatgtggatgaagaggaatgagcagaaacaaatgttaccatctgttgggcgaagtcgggctgtggacatatatttcagttaaggaggcggtagcgttaggctcctatgatcctatctagttattattatcctggaaggctggcgattgggactgttagttttaagatttatcttgaagaagcatgtcgaattatgtacagcagcagcagcaggatgctatccgttccgtgacgcctagtccattaatgctacaactcttttttcccctctcagtttgggtgcgtttgtgaatccatttgagctggcagtgtctgtttaagttttgtggtatggtgaaaaaaatgaagttggcaattgcattttccgttgtggtgttaattcttgctaccatatcagaaatatggttatggtgggctctgttcctgtgaagtgaatgaaaatgggtgggtggtttggagattgacggcgctgttgagcaatcgtcataaaatttacccctacatca

SEQ ID NO: 2020 - DNA, 1053 bp, Setaria italica
cccacctggcagttgcccacccacgacttgtcttctcgcatcggccgccaccaactccctccgatcccccccactgcaagcaactccaccgccgccgccgctagggtttagcagtgaagggaggatcgccgatgtcgacgcctgcgaggcgcaccaaccgccgcggccccccgccccccggcaccggctacgtgcgccgcgccccggctcccgcccccggccccggccccggccccgccgacgccgccaagcccctgcgcaagcccgtcttcactaccatcgaccagctgcgcccccagacgcacggccacaccctcaccgcccgcgtcctcgaagcccgcaccgtcctcgaaaagcactccccgcacatcggccgcacccgcgtcgcagagtgcctcgtcggagaccacaccggcaccatcctcgtcaccgcgcgcaacgaccaggttgaccttgtgaagccgaatactacagtgatcttccgcaacgccaagattgacatgttcaaggggaccatgaggctggcagtggacaagtggggacggatcgaggtgactgatgctgctgatttcaaggtgaaggaagacaacaacatgtcgctggtggagtacgagctggtggacgtggcagaggaagaggattgagtagagtcatatgaccctctgttgaatgaagtcgggctgtggacatagatttgagtaaggcggccgtagtggtaggctcctttttagttatcctggtgattgggacttgttagctttaagatatggttgaagaagcaggttaattatgtacagcagcagcagcaagcacagcagcagcagcaggtggtctgtctggctgttgctttctgtcgcgaggcctggtctatcttaatgctattctctcattcggtgtttatgaatcaatttccatgttgacatctgtttaagtttgtggtatggtgaagatgggtgatgataatggatgcgatgatgttttgatatgttgaggtgttgctcttactagcataacaatatgcatgttgtgcgttggaatagctaagttggtttg

SEQ ID NO: 2021 - DNA, 1007 bp, Setaria italica
ccgccaccaactccctccgatcccccccactgcaagcaactccaccgccgccgccgctagggtttagcagtgaagggaggatcgccgatgtcgacgcctgcgaggcgcaccaaccgccgcggccccccgccccccggcaccggctacgtgcgccgcgccccggctcccgcccccggccccggccccggccccgccgacgccgccaagcccctgcgcaagcccgtcttcactaccatcgaccagctgcgcccccagacgcacggccacaccctcaccgcccgcgtcctcgaagcccgcaccgtcctcgaaaagcactccccgcacatcggccgcacccgcgtcgcagagtgcctcgtcggagaccacaccggcaccatcctcgtcaccgcgcgcaacgaccaggttgaccttgtgaagccgaatactacagtgatcttccgcaacgccaagattgacatgttcaaggggaccatgaggctggcagtggacaagtggggacggatcgaggtgactgatgctgctgatttcaaggtgaaggaagacaacaacatgtcgctggtggagtacgagctggtggacgtggcagaggaagaggattgagtagagtcatatgaccctctgttgaatgaagtcgggctgtggacatagatttgagtaaggcggccgtagtggtaggctcctttttagttatcctggtgattgggacttgttagctttaagatatggttgaagaagcaggttaattatgtacagcagcagcagcaagcacagcagcagcagcaggtggtctgtctggctgttgctttctgtcgcgcgaggcctggtctatcttaatgctattctctcattcggtgtttatgaatcaatttccatgttgacatctgtttaagtttgtggtatggtgaagatgggtgatgataatggatgcgatgatgttttgatatgttgaggtgttgctcttactagcataacaatatgcatgttgtgcgttggaatagctaagttgg

SEQ ID NO: 2022 - DNA, 1086 bp, Setaria italica
aaggcccatcatcaaactcacagcccaagcccactcacctttctccgtccaaggcgacggatcctttgctcaccaaaccagcacctgctacggccgaatcgtcgtgtcagatcgggccagaggggaaattcggggaggcgagggagctgacgccgccatggacgaggaagagcacgaggtttacggccaggagatcccggaggacggcgacatggacggcgccgacgtcgatatggccgccggcggggacgacgcggcgaagctgcaggagctcgacgagatgaagcgcaggttgaaggagatggaggaggaggctgctgccctccgtgatatgcaggccaaggtcgccaaggagatgcaaggaggtgaccctagtgcatctacagctgaggcaaaggagcaggtggatgcccgctctgtctatgttggaaatgttgattatgcatgtacaccggaagaagtgcagcagcacttccaagcttgtggaactgtcaatcgggtgacaatcttgactgacaagtttgggcagccaaaaggttttgcctatgttgaatttctggaacaagaagctgtccaggaggctcttaatttgaatgaatctgaattgcatggtcgccagattaaggttgcaccaaagaggactaatgttcctgggatgaagcagcgtccaccacgtggatataacccctaccacggctacccttatagatcatatggagcaccgtacttccccccatatggatatgggagggctccaagattccgccggcctatgcgctacagaccttacttctgaagtacggtgtcatgaagttaaatgcaaatccagccacagtcagtctcgggaataattctactctacctgctggtgtttcatttgcacaattgcctgtttcatagtaagacattattgttgcggttgaatgctcctgccccaggtgccttttgtgacctctgtttaagtgccgccttatgggacttgtaatatcgtcttgctgtgatacaagatgtaataactgaaaaaacaacattgtgtaatactgatttgtgctctttccccggagttatttcagtattctattgccc

SEQ ID NO: 2023 - DNA, 958 bp, Saccharum officinarum
acgtctctgcgctccgtccggattaccggtcgacccacgcgtccgggggaggcgagggagctcacgcggtgccatggacgaggaggagcacgaggtttacggccaggagatcccggaggacggcgacatggacggcgccgacgtcgatatggccgccgccggggatgacgcggcgaagctgcaggagctcgacgagatgaagcgcaggctgaaggagatggaggaggaggccgccgccctccgcgatatgcaggccaaggtcgctaaggagatgcaaggaggtgaccctagtgcatctacagctgaggcgaaggagcaggtcgatgctcgctctgtctatgttggaaatgttgattatgcttgcaccccagaagaagtgcagcagcatttccaagcatgtggaactgtcaacagggtgacaatcttgactgacaagtttgggcagccaaaaggttttgcttatgttgaatttctggaacaagaagctgtccaggaagctcttaacttgaatgaatctgaattgcatggtcgccagattaaggttgcgccgaagaggactaatgttcctgggatgaagcagcgtccaccacgtgggtataatccctaccatggctacccttatagatcatacggtgcaccgtacttcccaccatatggttatgggagagctcccagattccgccgccctatgcgctacagaccctacttctgaagtacagggtaatgaagttcaatgcaaaaccagccatggtcactgctcagtcccgggaataattaaacctgctgctgtatcgtttgcactgttcgataattgacattgttgcggctcaatgcccctgtatcagttgccttttctgacctctgtattaactaataagtgccttcataagcgacacgtggtattggcttgtaatacaggacgtagtaagaacgcaatatatccccgtgctttcccagg

SEQ ID NO: 2024 - DNA, 1012 bp, Panicum virgatum
tcgcgatctagcgggtcagatcgggccatcggggggactctgggagtcgaaggccgaaggagctcacgccgcgatggacgaggaggagcacgaggtgtacggccaggagatcccggaggacggcgacatggacggcgccgacgtcgatatggccgccggcggggacgacgcggcgaagctgcaggagctcgacgagatgaagcgcaggctgaaggagatggaggaggaggctgccgccctccgcgatatgcaggccaaggtcgccaaggagatgcaaggaggtgaccctagtgcatctacagctgaggcgaaggagcaggtggatgcccgctctgtgtatgttggaaatgttgattatgcgtgtacaccagaagaagtacagcagcacttccaagcttgtggaactgtcaatcgggtgacaatcttgaccgacaagtttgggcagccaaaaggttttgcttatgttgaatttctggaacaagaagctgtccaggaggctcttaatttgaatgaatcagagttgcatggtcgccaaattaaggttgcaccgaagaggactaatgtccctgggatgaagcagcgtccaccacgcgggtataacccgtaccatggctacccatatagatcatacggagcaccatacttccccccatatggttatgggagggctccaagattccgccggccaatgcgctacaggccttacttctgaagtacggtggtcatccatagacagtcccgggaataattctactccactctacctgctgctatttcatttgcactgtttcatagtagtcactgttgcggcctgaatgctcctgccccagttgtcttttgtgacctctgtttaagtgccgccatgtgcgacttgtaatatcggcctgctgtgatacaagacgtagtaacaaacagcactgtgatactgattcgtgcgcttttcccggagtcatttcagtatgcacatttgaagaattaacagtgatatggatacagctgagcatgtgccgtc

SEQ ID NO: 2025 - DNA, 1115 bp, Pennisetum glaucum
ggggaaattcggggaggcgagggagctgtcgttgcgggcggcgttgccatggacgaggaggagcacgaggtttacggccaggaaataccggaggacggcgacatggacggcgccgacgtcgatatggccgccgggggtgacgacgcggcgaagctgcaggagctcgacgagatgaagcgcaggttgaaggagatggaggaagaggctgctgccctccgtgatatgcaggccaaggtcgccaaggagatgcaaggaggtgaccctagtgcatctacagctgaggcaaaggagcagttagatgcccgctctgtctatgttggaaatgttgattatgcatgtacaccggaagaagtgcagcagcacttccaagcttgtggaactgtcaatcgggtgacaatcttgactgacaagtttgggcagccaaaaggttttgcttatgttgaatttctggaacaagaagctgtccaggaggctcttaatttgaatgaatctgaattgcatggtcgccagattaaggttgcgccaaagaggactaatgtccctgggatgaagcagcgtccaccacgtggatttaacccctatcatggctacccttatagatcatatggagcaccgtacttcccaccatatggatatgggagggcaccaagattccgccggcctatgcgctacagaccttacttctgaagtaccgtgttatgaagttaaatgcaaatccaaccatagtcagtcccgggaataattatactctacctgctgctgtttcatgtgcacaattgcctgtttcatagtagacattgttgcggttgaatgcttctgccccaggtgtcttttgttacctctgtttaagtgccgccgcatgcgacaagtctagctgtgatacaagatgtaataactgaaaaaacaacattgtgtactgatttgcgtgctttctttatagttatttcagaagagctgtgcatttaaagaattggcggtgatatggatacagccaaacatgagtcatcagtataaatgcaaatgaaacccagaaatcgtgagtgatggtgatatatatttgtcctaatgaagccaacgtgcctcattacgtaaaaaaaaaaaaaacaaagtactac

SEQ ID NO: 2026 - DNA, 1062 bp, Sorghum bicolor
aaggcccataaaactttcagcccattggaggcccacgacctctctccgtccgatccctaggcggcggatccttcctccaccaaacctggacctgccgcaactgaatcgggtcagatcgggccgtcggggaggtgagggagctcacgcggcgccatggacgaggaggagcacgaggtttacggtcaggagatcccggaggacggcgacatggacggcgccgacgttgatatggccgccgccggggatgacgcgacgaagctgcaggagctcgacgagatgaagcgcaggctgaaggagatggaggaggaagccgccgccctccgcgatatgcaggccaaggtcgccaaggagatgcaaggaggtgaccctagtgcatctacagctgaggcgaaggagcaggtggatgcccgctctgtctatgttggaaatgttgattatgcttgcaccccagaagaagtgcagcagcatttccaagcatgtggaactgtcaacagggtgacaatcttgactgacaagtttgggcagccaaaaggttttgcttatgttgaatttctggaacaagaagctgtccaggaagctattaacttgaatgaatctgaattgcatggtcgccagattaaggttgcgccgaagaggactaatgttcctgggatgaagcagcgtccaccacgtgggtataatccctaccatggctacccttatagatcatacggagcaccgtacttccccccatatggttatgggagggctcccagattccgccgccctatgcgctacagaccctacttctgaagtacggggtagtgaagttcaatgcaaaaccagccatggtcactgctcagtcccgggaataattaaacctgctgctgtatcgtttgcactgttcgataattgacatgttgcgggcttgcggctcaatgctcctgtatcagttgccttttctgacctctgtattaactattaagtgccttcataagcgacacatggtattggcttgtaatacaggacgtaagaacgcaatataaccccgtgatttcccaaggtcactattgtttgcatttt

SEQ ID NO: 2027 - DNA, 1091 bp, Sorghum bicolor
tccaccaaacctggacctgccgtcttgtcaaaaaaaaaaacctggacctgccgcaactgaatcgggtcagatcgggccgtcggggaggtgagggagctcacgcggcgccatggacgaggaggagcacgaggtttacggtcaggagatcccggaggacggcgacatggacggcgccgacgttgatatggccgccgccggggatgacgcgacgaagctgcaggagctcgacgagatgaagcgcaggctgaaggagatggaggaggaagccgccgccctccgcgatatgcaggccaaggtcgccaaggagatgcaaggaggtgaccctagtgcatctacagctgaggcgaaggagcaggtggatgcccgctctgtctatgttggaaatgttgattatgcttgcaccccagaagaagtgcagcagcatttccaagcatgtggaactgtcaacagggtgacaatcttgactgacaagtttgggcagccaaaaggttttgcttatgttgaatttctggaacaagaagctgtccaggaagctattaacttgaatgaatctgaattgcatggtcgccagattaaggttgcgccgaagaggactaatgttcctgggatgaagcagcgtccaccacgtgggtataatccctaccatggctacccttatagatcatacggagcaccgtacttccccccatatggttatgggagggctcccagattccgccgccctatgcgctacagaccctacttctgaagtacggggtagtgaagttcaatgcaaaaccagccatggtcactgctcagtcccgggaataattaaacctgctgctgtatcgtttgcactgttcgataattgacatgttgcgggcttgcggctcaatgctcctgtatcagttgccttttctgacctctgtattaactattaagtgccttcataagcgacacatggtattggcttgtaatacaggacgtaagaacgcaatataaccccgtgatttcccaaggtcactattgtttgcattttctgtcgttcttgattttgatcgtcctatacaacacttaccgaatgagatgcagtgacagtgacaagctctggg

SEQ ID NO: 2028 - DNA, 920 bp, Panicum virgatum
cgaaggagctctctcgccgccatggacgaggaggagcacgaggtgtacggccaggagatcccggaggacggcgatatggacggcgctgacgtcgatatggccgccggcggggacgacgcggcgaagctgcaggagctcgacgagatgaagcgcaggctgaaggagatggaggaggaggctgccgccctccgcgatatgcaggccaaggtcgccaaggagatgcaaggaggtgaccctagtgcatcaacagctgaggtgaaggagcaggtggatgcccgctctgtgtatgttggaaatgttgattatgcgtgtacaccagaagaagtacagcagcacttccaagcttgtggaactgtcaatcgggtgacaatcttgaccgacaagtttgggcagccaaaaggttttgcttatgttgaatttctggaacaagaagctgtccaggaggctcttaatttgaatgaatcagagttgcatggtcgccagattaaggttgcaccgaagaggactaatgtccctgggatgaagcagcgtccaccacgcgggtttaacccgtaccatggctacccatatagatcatacggagcgccgtacttccccccatatggttatgggagggctccaagattccgcaggccaatgcgctacaggccttacttctgaagtactggggtcataaagttaaatgcaaatccatcctagacagtcccgagaataattctactctactctactctacctgctgctgtttcattggcaccgtttcaaacactgctgcggcctgaatgctcctgccccagaccccagttgtcttttgtgccgccatgtgcgacttgtaatatcggcatgctgtgataccatacgtagtaacaaacatcactgtaatactgattcatgcgattttcccggagtcatttcagtat

SEQ ID NO: 2029 - DNA, 1519 bp, Zea mays
ccctttcctcaccaaacccacacctgcctcaactaatcgggtcagatcaggtcatcgggaaggccgccatggacgacgaggagcacgaggtttacggccaggagatccctgaggacggcgatatggacggcgctgacgttgatatggccgccgccggggacgacgcggcgaagcttcaggagcttgacgagatgaagcgcaagctgaaggagatggaggaggaggccgccgccctccgcgatatgcaggccaaggtcgccaaggagatgcaaggaggtgaccctagtatatctacagctgaggcgaaggagcaggtggatgcccggtctgtgtatgttggaaatgttgattatgcttgcaccccagaagaagtgcagcagcatttccaagcttgtggaactgtcaacagggtgacaatcttgactgacaagtttgggcagccaaaaggttttgcttatgttgaatttctggaacaagaagctgtccaggaagctctgaacttgaatgaatcggaattgcatggtcgacagattaaggttgcgccgaagaggactaatgtccctgggatgaagcagcgtccaccacgcgggtataatccctaccatggctacccttatagatcatatggagcaccgtacttccccccatacggttatgggagggctcctagattccgccgccctatgcgctacagaccttacttctgaagtacgtgcggggtaataatgttcaatgcaaaaccagccatggttagtggtcagtctcgggaataattaaacctactgctgtatcgtttgcgctgttcaatagttgacatcgttgcggttcaatgctcctttaccagctgccttttctgacctctgttctcgcataagcgacatgtagacacaggacgtagggttacaattgtttgcattttctgtcattcttgattctgatgaccctatacagcactcaccgaataagatgcagtgtcaagctctgggtaggtcggttaggacatgggagtggaccgttccttgcttatttgcgatagattagttatatgaagagaaatcatcgtgcactctcagattgctacctcagccctatggtagagctctcctaaatccagcgggagctctgctaaacaggtcacagaagtgatttaagaggccggaaggtgaaaaaggtagactcctttgattctgtgaaatgattctccacaatcaattgtatctattagagaatgaggttttatagagaattagaatcagctctacctgttacgtacactgttaagtcagcagcgtccacaatcctcaaacgtctctgctgagcatcagttccggtgtcggattctgaggtaatcaaaagctgaactaatagacagtctctctctaccagactattttaccgcgggcaaatctggtccgtcgttagactatcttaacgactatctccagcagactctcactctctatttcaatcttcaccatacaaataatgtcatctaactctctatttcaatcttcaccat

SEQ ID NO: 2030 - DNA, 2701 bp, Oryza sativa
ctgaaatggagctatagcttcttgaagcttcagcaatccagcttgaagctgctgtcaccaactcaccatacatattaccgaacggattcctctagccaagtttttgattttttttatgaattctgtcaccattccaattacagaacgggttcctctaaccaaattttgaattttatcatgcacagcaaaatgattcctctcgccaagttttgatttttcatggatatatgtagagcaaaatgaaggacgccttggctttaattgtctcgcgcacggttcttccgcttcacgtgcgcgctcgctccgttttcgcgcggagtccgcctgaatttgaccacgacgcgagagatctcgcgatacgagatcaatcgcataagtaaaatttttttatcataagtaaaccaaaacttttatctccataacttcgaaaacaaaacaaagctacagcacgccgcatttcttattggataaaaggagacgatccatccgcatcctgcaacttcgcacgccgaacgcgcgcggattgagctcctactcgacgttgacctggaagacgtccctgcgctgctcctccttcaccttgggcacgaccaccttgagcacgccgttcttcatctccgccttgatctggtccatcctgtacacctccggcgcgagctcgatgcggccgctgtacctcgccggggcggcgccctcgtcctcgccggcctccttctccccctcgcccttgatcacgaggctgttctgctccgcccacaccttcacgtgctccttccccaggcccggcatgtccaccctcaggtgcagcgcctcctcgctctccttcgcgttccacccgcgccgcagcgtcgcggcgccggcgcgcccggccggcgtcgccaggtcgtccatgaggctcagcagccgcccgaggctctgcggcgcgctgaacggatcacggaacacatctgcaaatcgatcgggaaatcgagaacatgttcaggacagcgatttgatgagatcaattggtgcaaactccggatgagcttgacacggcgagagatgacgactacctgagaagaaggcgggcatggtggcgtcgcgtgtggggcgcctggtgtcgtacccacggccgctgtcgtcgtccgactcgtccctctcgtgccggcggagctgcgcgccggtgttgtatgcacgggacccgccggcgacggccaccggcctgagagcggaggcggcgccttgggccggcgacgcggcgaggagctgctccacgaggcggaacagtgggatcctcttcgatgccacgatggaagccatggctctccactcctctctcgctctcgctgcgtaactgtgcttatcttttggattttgcgttgagaatgaatcagcgagcggagaaacgagaggatttatcgtcgcggcaaatcttggagaagaattcagaagcttccggaagctgccgctgcaaggctgtatgccccttccacgggaaggttccagaaggcgcgggactgagcgccgccttcagttatcccttatccggcggaacgcacaattcagatgggccgatatctttagtcccagtaaaataaccggcccgttttgggcccacccattcgcttccgattcgatcccttgccaaaagtcacgaacaccaaaggagagacccgagtcagattggggatcgacgaaggtggggaggggcgaacgccatggacgaggaggagcacgaggtgtacgggcaagagatcccggaggacggggacatggacggcgcggacgtcgacatggcctccggcggggacgacgccgcgaagctgcaggagctcgaccagatgaagcgaaggctgaaggagatggaggaagaggccgcggccctccgcgacatgcaggccaaggtcgccaaggagatgcaaggaggagatcctagcgcgtctacagctgaggcaaaggagcaggtggatgctcgatctgtgtatgttggaaatgttgattatgcatgtaccccagaagaagtgcagcagcattttcaagcgtgtggcacagtcaatagagtgacgatcttaactgacaagtttggacagccaaaaggttttgcttatgtggaatttctggaacaagaagcagttcaggaggctctgaatttgaatgaatctgaactgcatggtcgtcagataaaggtggcaccaaagaggactaatgtccctgggatgaagcagcgtccaccgcgtggatacaatccttatcatggttacccatatagatcgtatggggccccatatttcccaccatatggttacgggagagtccccagattccgccgtccaatgcgctacaggccatacttttgaagtaagaggttttcatgacgtggaacacaacaccaagcctagtcgctagtcagccaagtcggtcccagaaataattctactatctggtattttagtttcccagcagacatgctgggtgaatgcttccacccccaccatattccattttggtaacgtccgctcactagttatcagtatcttgtatcgttggttctgcagtacgcaaaacgtagtgttatcttattatattatatatacctgcatcatatgatattggtttgccatacttggtaatatgtctggatataagcgtgggattgtgatggttgattacagcccttatcagaagcgatgatgcttgggtacaacaagattgctgatctaaa

SEQ ID NO: 2031 - DNA, 1106 bp, Oryza sativa
acccattcgcttccgattcgatcccttgccaaaagtcacgaacaccaaaggagagacccgagtcagattggggatcgacgaaggtggggaggggcgaacgccatggacgaggaggagcacgaggtgtacgggcaagagatcccggaggacggggacatggacggcgcggacgtcgacatggcctccggcggggacgacgccgcgaagctgcaggagctcgaccagatgaagcgaaggctgaaggagatggaggaagaggccgcggccctccgcgacatgcaggccaaggtcgccaaggagatgcaaggaggagatcctagcgcgtctacagctgaggcaaaggagcaggtggatgctcgatctgtgtatgttggaaatgttgattatgcatgtaccccagaagaagtgcagcagcattttcaagcgtgtggcacagtcaatagagtgacgatcttaactgacaagtttggacagccaaaaggttttgcttatgtggaatttctggaacaagaagcagttcaggaggctctgaatttgaatgaatctgaactgcatggtcgtcagataaaggtggcaccaaagaggactaatgtccctgggatgaagcagcgtccaccgcgtggatacaatccttatcatggttacccatatagatcgtatggggccccatatttcccaccatatggttacgggagagtccccagattccgccgtccaatgcgctacaggccatacttttgaagtaagaggttttcatgacgtggaacacaacaccaagcctagtcgctagtcagccaagtcggtcccagaaataattctactatctggtattttagtttcccagcagacatgctgggtgaatgcttccacccccaccatattccattttggtaacgtccgctcactagttatcagtatcttgtatcgttggttctgcagtacgcaaaacgtagtgttatcttattatattatatatacctgcatcatatgatattggtttgccatacttggtaatatgtctggatataagcgtgggattgtgatggttgattacagcccttatcagaagcgatgatgcttgggtacaacaagattgctgatctaaa

SEQ ID NO: 2032 - DNA, 934 bp, Secale cereale
tcgaggagagacggccatggacgaggaggagcacgaggtgtacggccaggagatccccgtggacggcgacatggaaggcgccgacgtcgacatggccgccaccggagacgacgcggcgaaggagctcgacgagatgaagcgtaggctcaaggagatggaggaggaggccgccgccctgcgcgacatgcaggccaaggtcgccaaggagatgcaaggaggagatgccaatgcgtctacagctgaggcaaaggagcaggtggatgctcgctctgtttatgttggaaatgttgattatgcgtgtacaccagaggaagtgcaacagcattttcaagcttgtggcaccgtcaacagagtgacaatcttgaccgacaagttcggacagccaaaaggctttgcttacgtggaatttctagaacaagaagccgtccaggaggctcttaatctgaatgaatctgaattgcatggtcgtcagatcaaggtgtccccaaagaggactaatgtccccgggatgaagcagcgtcctccacgcgggttcaatccctaccatgcttacccttatagatcatacgggtcaccgtatttcccgccgtacggatacgggagagttcccagattccgcaggccgactcgctacaggccgtacttctgagaggaggaggcttccatgaagttcaatgcaacgacagtagccataccgtggaataatctagctgccgctgtttcagttacgttgtttgactagagacataatctgacgacgagcgaatggctcttaagttcgattgtactgtgggcttgcagtatggattcagttatgtgatattggttcgctgctcaattgtactgtgggcttgcagttggattctcctctgtatgtgatatttggtttgctgtgctcggatgcgtgtaatccaagccaagtgcgatacgagtt

SEQ ID NO: 2033 - DNA, 966 bp, Triticum aestivum
ccacgcgtccgcggacgcgtgggctggacgctgtgtggctggccatggacgaggaggagcacgaggtgtacggccaggagatccccgtggacggcgacatggaaggcgccgacgtcgacatgaccgccgccggagacgacgcagcgaaggagctcgacgagatgaagcgtaggctcaaggagatggaggaggaggccgccgccctgcgcgacatgcaggccaaggtcgccaaggagatgcaaggaggagatgccaatgcgtctacagctgaggcaaaggagcaggtggatgctcgctctgtttatgttggaaatgttgattatgcgtgtacaccagaggaagtgcagcagcatttccaagcttgtggaactgtcaacagagtgacaatcttgaccgacaagtttggacagccaaaaggctttgcttacgtggaatttctagaacaagaagccgttcaggaggctcttaatctgaatgaatctgagttgcatggtcgccagatcaaggtgtcaccaaagaggactaacgtccctgggatgaagcagcgtcctccacgcggattcaatccctatcatgcctacccttatagatcatacggggcaccgtatttcccaccgtacggatatgggagagttcccagattccgccggccgacacgctacaggccgtacttctgagaggacgaggcttccatgaagctcaacgcaatgccagtagccatactgcggaataatctagctgccgctgtttcagttacattgtttgactggtagacataatctgacgacggtcgaatgcccctatcgtgtcatcttaagctctgttgtactgtgggcttgcagtatgcattcagtcatgtggtgaagttggtttgctgtacttggtagtcgtattgtctgacgtggttattatgttggctcgaatgaagttacgatgccatgttctgatgtcaaaatttaaaagaaa

SEQ ID NO: 2034 - DNA, 988 bp, Hordeum vulgare
gcacgaggcccaaatccacccgagctgggtttagatcgaagagagacggccatggacgaggaggagcacgaggtgtacggccaggagatccccgtggacggcgacatggaaggcaccgacgtcgacatggccgctgccggagacgacgcagcaaaggagctcgacgagatgaagcgtaggctcaaggagatggaggaggaggccgccgccctgcgcgacatgcaggccaaggtcgccaaggagatgcaaggaggagatgccaatgcgtctacagctgaggcaaaggagcaagtggatgctcgctctgtttatgttggaaatgttgactatgcttgtacgccagaggaagtgcagcagcattttcaagcttgtggaaccgtcaacagagtgacaatcttgactgacaagtttgggcagccaaaaggctttgcttacgtggaatttctagaacaagaagctgttcaggaggctcttaatctgaatgaatctgaattgcatggtcgtcagatcaaggtgtcaccaaagaggactaacgtccctgggatgaagcagcgtcctccacgaggattcagtccctaccatgcttacccttataggtcatacggggcaccgtattttccaccatatggatatgggagagttcccagattccgccggccaacacgatacaggccgtacttttgagagaagaaggctctcatgaagtccaatgcattgccagtagccatactgcggaataatctagctgcccctgcttcagttacattgtttggctagtagacataatctgacgacggtcgaatgcccctatcgtgtcgtgtcctcttaatcatcgctgtactgtgggcttgcagtatggattcggtcatgtggtgatattggtttgctgtactctgtagccgtattgtctgatctcgctatgtgtgcgtactctgttggccagaaaatgtgactcttctgctgatcaaaattggacgagatctgattc

SEQ ID NO: 2035 - DNA, 974 bp, Pseudoroegneria spicata
aaaaaatccaccgaattgggcttagatcgaagagagacggccatggacgaggaggagcacgaggtgtacggccaggagatccccgtggacggcgacatggaaggagccgacgtcgacatgaccgccgccggagacgacgcagcgaaggagctcgacgagatgaagcgtaggctcaaggagatggaggaggaggccgccgccctgcgcgacatgcaggccaaggtcgccaaggagatgcaaggaggagatgccaatgcgtctacagctgaggcaaaggagcaggtggatgctcgctctgtttatgttggaaatgttgattatgcgtgtacaccagaggaagtgcagcagcatttccaagcttgtggaactgtcaacagagtgacaatcttgaccgacaagtttggacagccaaaaggctttgcttacgtggaatttctagaacaagaagccgttcaggaggctcttaatctgaatgaatctgagttgcatggtcgccagatcaaggtgtcaccaaagaggactaacgtccctgggatgaagcagcgtcctccacgcggattcaatccctaccatgcctacccttgtagatcatacggggcaccgtatttcccaccgtacggatatgggagagttcccagattccgccggccgacacgctacaggccgtacttttgagaggacgaggcttccatgaagttgaatgcaacgccagtagccatactgaagaataatctagctgccgctgtttcagttacattgtttgaatcttacgacgggcgaatgcccctatcgtgtcctcttaagctctgttgtactgtgggcttgcagtatggattcagtcatgtggtggtattggtttgctgtactcggtagccgtattgtctgatgacgtatgtgcgcgtactctgttggccagaaaatgtgactctgctgctgatcaaatttcaacaagaaaatgtgattctttacatgca

SEQ ID NO: 2036 - DNA, 971 bp, Brachypodium distachyon
ctcgggctctgatcttccttggcaaattcccgcaccgtggacaccatagtgggttagatagatccaagggagcgcgccggcatggacgaggaggagcacgaggtttacggccaggagatcccggttgacggcgacatggaaggcggcgacgtcgacatgaccaccggcggagacgacgcagcgaaggagctcgatgagatgaagcgtaggctcaaggagatggaggaggaggccgcggcccttcgcgatatgcaggccaaggttgccaaggagatgcaaggaggtgatgctaatgcatctactgctgaggcaaaggagcaagtggatgctcgctctgtttatgttggaaatgttgattatgcatgtacaccagaggaagtacagcagcattttcaagcttgtggaactgtcaacagagtgacaatcttgactgacaagtttggacagccaaaaggattcgcttatgtggaatttctcgagcaggaagctgtccaggaagctcttaatttgaatgaatccgaactgcatggtcgtcagatcaaggtgtcaccaaagaggactaacgtcccagggatgaagcagcgtccaccacgcgggttcaatccataccatggttacccatatagatcatatggggcacaatatttcccgccgtatggttatgggagagttcccagatttcgccggcctacgcgctacaggccgtacttttgaagtattgaggtctccaggaagcaacgcagtgtcaacgtcactccgcagaataatttcaccagctgctcttttaactatattattatggttgactagtagacagacataattcccttgagctcgatctgtaccgttggcttgcagtacccaaaacacatgatcaaattaattatgtgatattctgtgcgacgtactgtctcagtgtctcgtgatagtactctgttggctggaatgcagctattttaacatgccgataa

SEQ ID NO: 2037 - DNA, 806 bp, Avena sativa
gaccccaaaaaaaaaaatccactaaactcggtttagatcggagagacaaagggaaccgccatggacgaggaggagcacgaggtctacggccaggagatccccgtggacgccgatatggaaggcgccgacgtcgacatgaccgccggcggagacgacgcagcgaaggagctcgacgagatgaagcgtaggctgaaggagatggaggaggaagccgccgcccttcgcgatatgcaggccaaggtcgccaaggagatgcaaggaggggatgccaatgcatctacagccgaggcaaaggagcaagtggatgctcgctctgtatatgttagcaatgttgattacgcttgtactccagaggaagtgcagcagcattttcaagcttgtggaactgtcaacagagtgacgatcttgactgacaagtttggacagccaaaaggctttgcttatgttgaatttctcgaacaagaagccgttcaggaggctcttaatttgaatgaatctgaattgcatggtcgtcagatcaaggtgtcaccaaagaggaccaatgtccctgggatgaagcagcggccaccacgcggagcatttaacccgtaccatggctacccttatagatcatacgggtcaccgtacttcccaccctatggttatgggagagttcccagattccgtcggccaacccgctacaggccttacttctgaagcaggaggtttcatgaagagggatgtcaactaaggccgtccatggaataattttatacatgcttgctgctttgatgttggacataatctgacaggagaatgctcctgta

SEQ ID NO: 2038 - DNA, 893 bp, Brachypodium distachyon
ggacaccatagtgggttagatagatccaagggagcgcgccggcatggacgaggaggagcacgaggtttacggccgggagatcccggttgacggcgacatggaaggcggcgacgtcgacatgaccaccggcggagacgacgcagcgaaggagctcgatgagatgaagcgtaggctcaaggagatggaggaggaggccgcggcccttcgcgatatgcaggccaaggttgccaaggagatgcaaggaggtgatgctaatgcatctactgctgaggcaaaggagcaagtggatgctcgctctgtttatgttggaaatgttgattatgcatgtacaccagaggaagtacagcagcattttcaagcttgtggaactgtcaacagagtgacaatcttgactgacaagtttggacagccaaaaggattcgcttatgtggaatttctcgagcaggaagctgtccaggaagctcttaatttgaatgaatccgaactgcatggtcgtcagatcaaggtgtcaccaaagaggactaacgtcccagggatgaagcagcgtccaccacgcgggttcaatccataccatggttacccatatagatcatatggggcacaatatttcccgccgtatggttatgggagagttcccagatttcgccggcctacgcgctacaggccgtacttttgaagtattgaggtctccaggaagcaacgcagtgtcaacgtcactccgcagaataatttcaccagctgctcttttaactatattattatggttgactagtagacagacataattcccttgagctcgatctgtaccgttggcttgcagtacccaaaacacatgatcaaattaattatgtgatattctgtgcgacgtactgtctcagtgtctcgtgatagta

SEQ ID NO: 2039 - DNA, 933 bp, Avena sativa
gaccccaaaaaaaaaaatccactaaactcggtttagatcggagagacaaagggaaccgccatggacgaggaggagcacgaggtctacggccaggagatccccgtggacgccgatatggaaggcgccgacgtcgacatgaccgccggcggagacgacgcagcgaaggagctcgacgagatgaagcgtaggctgaaggagatggaggaggaagccgccgcccttcgcgatatgcaggccaaggtcgccaaggagatgcaaggaggggatgccaatgcatctacagccgaggcaaaggagcaagtggatgctcgctctgtatatgttagcaatgttgattacgcttgtactccagaggaagtgcagcagcattttcaagcttgtggaactgtcaacagagtgacgatcttgactgacaagtttggacagccaaaaggctttgcttatgttgaatttctcgaacaagaagccgttcaggaggctcttaatttgaatgaatctgaattgcatggtcgtcagatcaaggtgtcaccaaagaggaccaatgtccctgggatgaagcagcggccaccacgcggagcatttaacccgtaccatggctacccttatagatcatacgggtcaccgtacttcccaccctatggttatgggagagttcccagattccgtcggccaacccgctacaggccttacttctgaagcaggaggtttcatgaagagggatgtcaactaaggccgtccatggaataattttatacatgcttgctgctttgatgttggacataatctgatgggagaatgctcctgtaagcagtatttgtaccgtcgcctcgcatggtccgaaacattagcgtcaccatgcgatattggatttgccttaactcaggctgttgtgtgctgtccggtattccagctagagtgacaggtcatgacgca

SEQ ID NO: 2040 - DNA, 3192 bp, Setaria italica
gcccgacctgcttccagtggagggaaagcaccgaaaggcgcggtctttttctcgctttgtttccaccttcttttcacttccctccctttcctttcctccttccccccttccatggcgccgccggctttcgcctacgcggcggtcgcggtggccgtgctcgccgcggcggcgtcggcggccgtcacctacgaccgcaaggccgtggtggtgaacggccagcgccggatcctgctctccggctccatccactaccccaggagcgtccccgagatgtggccggatctgatacagaaggccaaggacggcggcctcgacgtggtgcagacgtacgtcttctggaacggccacgagccctcccctggacagtactacttcgaggggcggtatgatctggtgcacttcatcaagctggtgaagcaggccggactctacgtgcacctccgcattggcccctacgtctgcgccgagtggaattttggtggtttccctgtttggcttaagtatgtcccaggcatcaggtttaggactgataatgagccgttcaagtctgagatgcagaaattcaccacaaagattgttgacatgatgaagtcagaagggctctttgaatggcagggaggaccaatcatcctctcccagattgagaatgagtttgggcccttggagtgggatcagggcgaacctgccaaggcctacgcgtcatgggcagctaacatggcggttgcactcaacacgggtgtcccatggatcatgtgcaaagaagatgatgccccggatccaattattaatacgtgcaatggattttattgtgactggttctccccgaataaacctcacaagcctaccatgtggactgaggcttggacagcttggtatacaggctttggtattccagttccacatagaccagtagaggatctagcatatggtgttgccaaatttattcagaagggtggctcttttgttaattattacatgtatcatggaggaacaaactttgggcgcacagctggtggtccattcattgcaactagctatgactacgatgctcctattgatgagtatggcttgttgagagaaccaaaatggggtcacttaaaggagttgcataaagctatcaagctatgcgaaccagccttggttgcaggagaccctattgttacttcacttggcaatgctcagcaggcatctgtttttagatcaagcacaggcgcttgtgtggccttccttgagaacaaggataaagtatcttatgctagggtagcattcaatggaatgcattatggtctacctccctggtccataagtattctcccagattgcaaaacaactgtatacaacactgccagggttgggagtcaaatttcacaaatgaaaatggaatgggctggaggattgacatggcaatcatacaatgaggatataaactccttgggtgaggaatcgtttacgacaatagggttactggaacagataaacgtgacaagggataaaacagactacttatggtatacaacatatgttgaaatagctcaggatgagcagttcctgagtaatgggaagaatccaacgctaactgttatgtcagctggtcatgctttgcatattttcattaatggacaactaacaggaactgtctatggaaatgtagaagacccaagattgacatataggggaagcgtgaaactttggccaggcagtaacaccgtttcatgcttaagtatagcagttggcctcccgaatgtgggagaacattttgagacttggaatgcaggaattctaggtcccgtgacactggatggcctgaatgagggaagaagagatctcacatggcagaaatggacctatcaggttggtctgaaaggtgagactttgagtcttcattcacttagtggaagctcatcagtagagtggggagaacctgtgcagaaacagcctctaacatggtacaaggctttcttcaacgcaccagatggcgacgagccattggctttggatatgagtagcatgggtaaagggcaaatctggataaatggacaaggtattgggcggtattggcctggctacaaagcctctggaacctgtggaaactgtgattaccgtggagagtatgatgagaaaaagtgtcaaaccaactgtggtgactcttcgcagagatggtaccacgttcctcgttcatggcttaatcctacagggaaccttttggttatatttgaggagtggggtggtgatcctactggaatctcaatggtgaaaagaaccacagggagtatctgtgctgatgtctctgaatggcagccatcaatgaagagctggcatacaaaagactatgagaaagccaaggtccaccttcagtgtgatcatggacggaagataactgagataaaattcgccagctttggcacaccacagggctcctgtgggagctactctgaaggaacttgccatgcacacaagtcgtacgacatatttttgaagaactgcattggtcaagaacgctgtggggtaagcgtggttccagatgtatttggtggggatccatgccctgggactatgaaaagggctgttgttgaggctatatgcggttgagccatataatccatataagccatcggtttctacaataacgccgctttatcaaccttctggcaggacgtgaaagtcacaagcaaccgtgacgcgcagactgtcaggagttacaggaattagttgtatgttagatttaagcatcgatatctgtatgtaatttatgtaatttagccgacacaagaatttgcatggaagaaatggttaggactctaggtgtgagaaattaagggctgtggcactctagacacaacagataggtttggctggtggagggcgcggatgagactctgcttattacctgagtccatgtgcgtggtggctcttgggttggaggacgccaagaagcgaaccgttggttttgcatttcctgacttctcattttagctcgttggagggtgcaatgtactgttcagggcccatcattcaggtactgtccttgctagtaatgaagcagccaagaatatctgattcggattataaatgagaactgtgtcctattctgtctaaaacttacctgattccgtgctttgttgggcatggtttacatgaataccatcttgctgaatgcttatatgttttatcagaaacgacccatgaccatgc

SEQ ID NO: 2041 - DNA, 3257 bp, Oryza sativa
aaggagagagagagagagtgtcctcatgtgccgtcagtgagagaggaagcctctcactctctccggtggagggaaaagcaccgaaaagcgcggcctttttttcttctttttttccctcccttgttcttccccacactccactccactcctcgcatcgcatcccatccatggccgcctccgccgtcgccgtcgcgttcgtcgtggcggtggccgccgtgctggccgcggcggcgtccgcggccgtgacgtacgaccggaaggctgtggtggtgaacgggcagcggaggatcctcatctccggctccatccactacccgaggagcacccccgagatgtggccggatctgatagagaaggccaaggacggcggcctcgacgtggtgcagacgtacgtcttctggaacggccacgagccgtcccccggccagtactacttcgaggggaggtatgatctggtgcacttcatcaagctggtgaagcaggccggcctctacgtgaacctccgcattggcccctacgtctgcgccgagtggaacttcggtgggttccctgtttggctcaagtatgtccccggcatcagctttaggactgataatgagccgttcaaggctgagatgcagaagttcaccacaaagatcgtcgaaatgatgaagtcggaagggctctttgaatggcaaggagggcctataatcctctcccagatagagaacgagtttgggcccttggagtgggatcaaggtgagcctgccaaggcatatgcatcatgggcagctaacatggcagttgcgctcaacaccagtgtgccatggatcatgtgcaaagaagatgatgcccctgatccaattattaatacatgcaatggattttactgtgattggttctccccaaataaacctcacaaacctaccatgtggactgaagcctggactgcttggtatacaggctttggtattccagttccacatagaccagtagaggatctagcatatggtgtcgccaagtttatccagaagggtggctcttttgtgaattattacatgtatcatggtggaacaaactttggacgcacagctggtggcccattcattgccactagttatgactatgatgctcctattgatgaatatggtttgttgagagaaccaaaatggggccacttgaagcagttgcataaagccataaaactttgtgaacctgccttggttgcaggagaccccattgtaacttcacttggaaatgctcagaagtcatcagtttttagatcaagcacaggagcttgtgcagctttccttgagaacaaggataaagtatcttatgcaagggtagcatttaatggcatgcactatgacctgcctccgtggtccataagtattctcccagactgcaaaacgacagtcttcaatactgctagggtgggaagtcagatttcacagatgaaaatggaatgggctggaggatttgcatggcaatcatacaacgaggagataaattcctttggtgaggatccacttacaacagtaggattactggaacaaataaatgtgacgagggataacacagactacttatggtataccacatatgtcgatgttgcccaggatgagcagttccttagcaatggggagaatctcaagcttactgtgatgtcagctggtcatgctttgcatattttcattaatggacaactgaaaggaactgtttatggcagcgtagatgacccaaaactgacttatactgggaatgtgaagctctgggcaggcagcaatacaatttcctgcttaagtatagcagttggcctcccaaatgtgggagaacattttgagacttggaatgctgggattcttggcccagtgacgcttgatggcctgaatgagggaagaagggatctgacatggcagaaatggacttatcaggtaggactgaaaggtgagtctatgagtcttcattcactcagtggaagctcaacagtggagtggggagaacctgtgcagaagcagcctctaacatggtacaaggcttttttcaatgcaccggatggtgatgagccattagctttggacatgagtagtatggggaaggggcaaatctggataaatggacaaggtattgggcgatattggcctggctacaaggcttctggaaactgtggaacctgtgattatcgaggtgaatacgatgaaacgaagtgtcaaaccaactgtggtgactcttctcagagatggtaccatgttcctcgttcatggcttagtcccacaggaaaccttttggtcatattcgaggagtggggtggtgaccctactggaatctcaatggtcaaaagaagcatcggaagtgtctgcgctgatgtgtccgaatggcagccatcaatgaagaactggcatacaaaagactacgagaaagcaaaagtccacctccaatgtgacaatggacagaagataactgaaataaaatttgctagctttggcacaccacagggctcctgtggaagctacaccgaaggaggctgccatgcgcacaagtcgtacgacatattttggaagaactgcgtcggtcaagaacgctgcggggtaagcgttgttccagaaatatttggtggagatccatgcccagggacaatgaaacgggctgttgttgaggctatatgcggttgagaaccgcaaactcagatcctcccaaatcatcctatatcttagtttcgacacggttttcggcttaccgaccttctggcaagaggtgaaagtcacagcaacagtgacgcacggaccgtcagaagttacagaaaatttagttgtaattgaagcatcagtgtatgtacattattctacatagaaattcactgggaaggaaagattcaggactctgcagtgcaggaatgggaaaccaaggggctgtatgtatggtcctctggacagtattggtttttggctggggaagggcgcataggagactctgctgatacatgagtccatatgcgcaatggcttttgcatattggattggaggatcaactctgtttcatacgtgatgtgatgattcatttttaagctcactgaaaactactgcaatgtaatgctggtaatgtgcagggtccatcattgatgtattaaattgtcctcttaattagctaattagcaatgtactaccttttcagcttataaataaatctgctgtatgttattcaaccgtatgtgaatgaattctctcaggtggtcatctcaatgcccacttgatgattaatctgatacacattcctgcccc

SEQ ID NO: 2042 - DNA, 3567 bp, Sorghum bicolor
gtcatcttgacgacaccagtccaggctgtgggtccatcaatgcgctctctctctaattaacaacgctattagctggactcccatgccatcacgctctgcgctctctcatacccctcctagatcctcgcgaccctttcttgtggagacacatcctgttttttctttttaactattcaaagaaacgaggggctggtggtttaatcagcacttgcttctccaatcccaaaggccagatatctccagagagagaagcaccacaccatagaagggggccggagagagtgatacggtgtgatacctccctgagtgtcatcttgtgccctcaccctcagtgacagtgagcggcgcttcactccgtccgtccggtggcccgcccgacctgcttccagttccagtcatccagtggagggaaagcaccgaaaggcgcggccttttttcctctcgctttgcttgcgccttcttttcacttccctccctttcctctcctcacctcctccccgctcctggcccccgcggcgccggcgggcctcgccgccgtcgtcgtcgtcgccgtgctcgccgccgcggtgtcggcggcagtcacctacgaccgcaaggccgtggtggtgaacggccagcgccggatcctgatgtccggctccgtccactacccaaggagcgtccccgagatgtggccggatctgatacagaaggccaaggacggcggcctcgacgtcgtgcagacgtacgtcttctggaacggccatgagccctcccgtggacagtactacttcgaggggcggtatgatctggtgcacttcatcaagctggtgaagcaggccggactctacgtgcacctccgcattggcccttacgtctgcgccgagtggaatttcggtggcttccctgtttggctcaagtatgtcccgggcatcagctttaggaccgataatgaaccgttcaaggctgagatgcagaaattcaccacgaagatcgttgacatgatgaagtccgaagggctctttgaatggcagggagggccaataatcctctcccagattgagaatgagtttgggcccttagagtgggatcagggagagcccgccaaggcctacgcgtcatgggcagctaacatggcggttgcactcaacacgagtgttccatgggtcatgtgcaaagaagatgatgccccggatccaattattaatacttgcaacggattttattgtgactggttctccccaaacaaacctcacaagcctaccatgtggactgaggcttggacatcttggtatacaggatttggcattccggttccacatagaccagtagaggatctagcatacggtgttgccaagtttattcagaagggtggctcttttgttaattattacatgtatcatggaggaacaaattttgggcgcacagctggtggtccattcattgcaactagctatgactatgatgctcctattgatgaatatggcttgctgagagaaccaaaatggggtcacttgaaggagttgcataaagctatcaagctttgcgaaccagcattggttgcaggagatccaattgtaacttcacttggcaatgctcagcaggcatctgtttttagatcaagcactgatgcttgtgtggccttccttgagaacaaggataaagtatcttatgctagggtatcattcaatggaatgcattataatctacctccctggtccataagtattctcccagactgcaaaacaactgtttacaacactgccagggttggaagtcagatttcacaaatgaaaatggaatgggctggaggattcacatggcaatcatacaatgaggatataaactccttgggtgatgaatcatttgtgacagtagggttactggaacagataaatgtgacaagggataacacagactacttatggtatacaacatacgttgatgttgctcaggatgagcagtttctcagtaatgggaagaatccagtgctaactgttatgtcggctggtcatgctttgcatattttcgttaatggacaactaactggaactgtatatggaagtgtagatgatccaaaactgacatatcgtggaaatgtgaagctttggccaggcagtaacactatctcatgcttaagtatagcagttggtctcccgaatgtgggagaacattttgagacttggaatgctggaattctaggtcctgtgacactcgatggccttaatgagggaaggagagatctcacgtggcagaaatggacctataaggttggtctgaaaggtgaggatttgagtcttcattcacttagtggtagctcttcagtagagtggggagaacccatgcagaagcagcctctgacatggtacaaggctttcttcaatgcacctgatggtgatgagccattagctttggatatgagtagcatgggtaaaggtcaaatctggataaatggacaaggtattggaaggtattggcctggctacaaagcttctggaacctgtggaatctgtgattaccgtggagagtatgatgaaaagaagtgccaaaccaactgtggtgactcttctcagagatggtaccatgttcctcgttcatggcttaatccaacggggaaccttttggttatatttgaggagtggggtggtgatcctaccggaatctcgatggtgaaaagaacaacagggagtatatgtgctgatgtctctgaatggcagccatcaatgacgaactggcgtacaaaagactatgagaaagccaagatccacctccagtgtgatcatggacggaagatgactgacataaagttcgccagctttggcacaccacagggctcctgtgggagctactctgaaggtggttgccatgcacacaagtcatatgacatattttggaagaactgcattggtcaagagcgctgtggggtaagtgtggttcctaatgtatttggtggggatccatgccctgggactatgaaaagagccgttgttgaggctatatgcggttgagtcatataatccatatagcatattggtttctacaaaaatgttacccgatcaacctggcaaggggtgaaagtcgcggcaactgtgacgcacggattgtcaggagttacgggaattagttgtatgttagatttaagcattgatatctgtatgtaacttaggctacataagacttgcatggaagaaatggttaggaccctagctgtgagaaattgagtgttgtggctctctagacacagtaaattggtctggcaggggagtgacgcgcagatgagactctgcttatacctgagtccatgtgcgcggtggcttttgggttggagattgccaaaaagccagcacttggctttgcattgtctgattattcatttttggtcattggagggtgcaatgtaaatgcgcagggcccatcattcatgatttttcctagctagtaatgaaacagtaaagaaaatattggttcagatcataaatagcagttgtcttacatttgcttgactcggtgttttgttgggcatggtttacgtgaatgccatcttgctgaatacttcaaacttgcatcagaaacaaatcgtgctcatgc

SEQ ID NO: 2043 - DNA, 3108 bp, Sorghum bicolor
cgcccgacctgcttccagttccagtcatccagtggagggaaagcaccgaaaggcgcggccttttttcctctcgctttgcttgcgccttcttttcacttccctccctttcctctcctcacctcctccccgctcctggcccccgcggcgccggcgggcctcgccgccgtcgtcgtcgtcgccgtgctcgccgccgcggtgtcggcggcagtcacctacgaccgcaaggccgtggtggtgaacggccagcgccggatcctgatgtccggctccgtccactacccaaggagcgtccccgagatgtggccggatctgatacagaaggccaaggacggcggcctcgacgtcgtgcagacgtacgtcttctggaacggccatgagccctcccgtggacagtactacttcgaggggcggtatgatctggtgcacttcatcaagctggtgaagcaggccggactctacgtgcacctccgcattggcccttacgtctgcgccgagtggaatttcggtggcttccctgtttggctcaagtatgtcccgggcatcagctttaggaccgataatgaaccgttcaaggctgagatgcagaaattcaccacgaagatcgttgacatgatgaagtccgaagggctctttgaatggcagggagggccaataatcctctcccagattgagaatgagtttgggcccttagagtgggatcagggagagcccgccaaggcctacgcgtcatgggcagctaacatggcggttgcactcaacacgagtgttccatgggtcatgtgcaaagaagatgatgccccggatccaattattaatacttgcaacggattttattgtgactggttctccccaaacaaacctcacaagcctaccatgtggactgaggcttggacatcttggtatacaggatttggcattccggttccacatagaccagtagaggatctagcatacggtgttgccaagtttattcagaagggtggctcttttgttaattattacatgtatcatggaggaacaaattttgggcgcacagctggtggtccattcattgcaactagctatgactatgatgctcctattgatgaatatggcttgctgagagaaccaaaatggggtcacttgaaggagttgcataaagctatcaagctttgcgaaccagcattggttgcaggagatccaattgtaacttcacttggcaatgctcagcaggcatctgtttttagatcaagcactgatgcttgtgtggccttccttgagaacaaggataaagtatcttatgctagggtatcattcaatggaatgcattataatctacctccctggtccataagtattctcccagactgcaaaacaactgtttacaacactgccagggttggaagtcagatttcacaaatgaaaatggaatgggctggaggattcacatggcaatcatacaatgaggatataaactccttgggtgatgaatcatttgtgacagtagggttactggaacagataaatgtgacaagggataacacagactacttatggtatacaacatacgttgatgttgctcaggatgagcagtttctcagtaatgggaagaatccagtgctaactgttatgtcggctggtcatgctttgcatattttcgttaatggacaactaactggaactgtatatggaagtgtagatgatccaaaactgacatatcgtggaaatgtgaagctttggccaggcagtaacactatctcatgcttaagtatagcagttggtctcccgaatgtgggagaacattttgagacttggaatgctggaattctaggtcctgtgacactcgatggccttaatgagggaaggagagatctcacgtggcagaaatggacctataaggttggtctgaaaggtgaggatttgagtcttcattcacttagtggtagctcttcagtagagtggggagaacccatgcagaagcagcctctgacatggtacaaggctttcttcaatgcacctgatggtgatgagccattagctttggatatgagtagcatgggtaaaggtcaaatctggataaatggacaaggtattggaaggtattggcctggctacaaagcttctggaacctgtggaatctgtgattaccgtggagagtatgatgaaaagaagtgccaaaccaactgtggtgactcttctcagagatggtaccatgttcctcgttcatggcttaatccaacggggaaccttttggttatatttgaggagtggggtggtgatcctaccggaatctcgatggtgaaaagaacaacagggagtatatgtgctgatgtctctgaatggcagccatcaatgacgaactggcgtacaaaagactatgagaaagccaagatccacctccagtgtgatcatggacggaagatgactgacataaagttcgccagctttggcacaccacagggctcctgtgggagctactctgaaggtggttgccatgcacacaagtcatatgacatattttggaagaactgcattggtcaagagcgctgtggggtaagtgtggttcctaatgtatttggtggggatccatgccctgggactatgaaaagagccgttgttgaggctatatgcggttgagtcatataatccatatagcatattggtttctacaaaaatgttacccgatcaacctggcaaggggtgaaagtcgcggcaactgtgacgcacggattgtcaggagttacgggaattagttgtatgttagatttaagcattgatatctgtatgtaacttaggctacataagacttgcatggaagaaatggttaggaccctagctgtgagaaattgagtgttgtggctctctagacacagtaaattggtctggcaggggagtgacgcgcagatgagactctgcttatacctgagtccatgtgcgcggtggcttttgggttggagattgccaaaaagccagcacttggctttgcattgtctgattattcatttttggtcattggagggtgcaatgtaaatgcgcagggcccatcattcatgatttttcctagctagtaatgaaacagtaaagaaaatattggttcagatcataaatagcagttgtcttacatttgct

SEQ ID NO: 2044 - DNA, 3057 bp, Setaria italica
ccctccctttcctttcctccttccccccttccatggcgccgccggctttcgcctacgcggcggtcgcggtggccgtgctcgccgcggcggcgctacgaccgcaaggccgtggtggtgaacggccagcgccggatcctgctctccggctccatccactaccccaggagcgtccccgagatgtggccggatctgatacagaaggccaaggacggcggcctcgacgtggtgcagacgtacgtcttctggaacggccacgagccctcccctggacagtactacttcgaggggcggtatgatctggtgcacttcatcaagctggtgaagcaggccggactctacgtgcacctccgcattggcccctacgtctgcgccgagtggaattttggtggtttccctgtttggcttaagtatgtcccaggcatcaggtttaggactgataatgagccgttcaagtctgagatgcagaaattcaccacaaagattgttgacatgatgaagtcagaagggctctttgaatggcagggaggaccaatcatcctctcccagattgagaatgagtttgggcccttggagtgggatcagggcgaacctgccaaggcctacgcgtcatgggcagctaacatggcggttgcactcaacacgggtgtcccatggatcatgtgcaaagaagatgatgccccggatccaattattaatacgtgcaatggattttattgtgactggttctccccgaataaacctcacaagcctaccatgtggactgaggcttggacagcttggtatacaggctttggtattccagttccacatagaccagtagaggatctagcatatggtgttgccaaatttattcagaagggtggctcttttgttaattattacatgtatcatggaggaacaaactttgggcgcacagctggtggtccattcattgcaactagctatgactacgatgctcctattgatgagtatggcttgttgagagaaccaaaatggggtcacttaaaggagttgcataaagctatcaagctatgcgaaccagccttggttgcaggagaccctattgttacttcacttggcaatgctcagcaggcatctgtttttagatcaagcacaggcgcttgtgtggccttccttgagaacaaggataaagtatcttatgctagggtagcattcaatggaatgcattatggtctacctccctggtccataagtattctcccagattgcaaaacaactgtatacaacactgccagggttgggagtcaaatttcacaaatgaaaatggaatgggctggagcattgacatggcaatcatacaatgaggatataaactccttgggtgaggaatcgtttacgacaatagggttactggaacagataaacgtgacaagggataaaacagactacttatggtatacaacatatgttgaaatagctcaggatgagcagttcctgagtaatgggaagaatccaacgctaactgttatgtcagctggtcatgctttgcatattttcattaatggacaactaacaggaactgtctatggaaatgtagaagacccaagattgacatataggggaagcgtgaaactttggccaggcagtaacaccgtttcatgcttaagtatagcagttggcctcccgaatgtgggagaacattttgagacttggaatgcaggaattctaggtcccgtgacactggatggcctgaatgagggaagaagagatctcacatggcagaaatggacctatcaggttggtctgaaaggtgagactttgagtcttcattcacttagtggaagctcatcagtagagtggggagaacctgtgcagaaacagcctctaacatggtacaaggctttcttcaacgcaccagatggcgacgagccattggctttggatatgagtagcatgggtaaagggcaaatctggataaatggacaaggtattgggcggtattggcctggctacaaagcctctggaacctgtggaaactgtgattaccgtggagagtatgatgagaaaaagtgtcaaaccaactgtggtgactcttcgcagagatggtaccacgttcctcgttcatggcttaatcctacagggaaccttttggttatatttgaggagtggggtggtgatcctactggaatctcaatggtgaaaagaaccacagggagtatctgtgctgatgtctctgaatggcagccatcaatgaagagctggcatacaaaagactatgagaaagccaaggtccaccttcagtgtgatcatggacggaagataactgagataaaattcgccagctttggcacaccacagggctcctgtgggagctactctgaaggaacttgccatgcacacaagtcgtacgacatattttggaagaactgcattggtcaagaacgctgtggggtaagcgtggttccagatgtatttggtggggatccatgccctgggactatgaaaagggctgttgttgaggctatatgcggttgagccatataatccatataagccatcggtttctacaataacgccgccttatcaaccttctggcaggacgtgaaagtcacaagcaaccgtgacgcgcagactgtcaggagttacaggaattagttgtatgttagatttaagcatcgatatctgtatgtaatttatgtaatttagccgacacaagaatttgcatggaagaaatggttaggactctaggtgtgagaaattaagggctgtggcactctagacacaacagataggtttggctggtggagggcgcggatgagactctgcttattacctgagtccatgtgcgtggtggctcttgggttggaggacgccaagaagcaaaccgttggttttgcatttcctgacttctcattttagctcgttggagggtgcaatgtactgttcagggcccatcattcaggtactgtccttgctagtaatgaagcagccaagaatatctggttcggattataaatgagaactgtgtcctattctgtctaaaacttacctgattccgtgctttgttgggcatggtttacatgaataccatcttgc

SEQ ID NO: 2045 - DNA, 3213 bp, Brachypodium distachyon
gtgtcctgttgcgccgtcctcactggctcactccacactcccactcctgcctcttccagtggagggaaaaggcaccgaaaggcgcggcgtcttcgctttttttctttttcaccacgcccttccctccctttcttgcttgcttccttccccatggcctcctccgcgccgccggccccggccgtcctcgccgtcgcgctcacggttgccctcctggcctcgtcggcgtgggcggccgtcacctacgaccgcaaggcagtcgtggtgaacgggcagcgccgcatcctgctctccggctccatccactacccgcggagcgtccccgagatgtggccggatctgatacagaaggccaaggacggcggcctcgacgtggtgcagacgtacgtgttctggaacggccacgagccttcccctggccagtaccacttcgagggaaggtatgatctggtgcacttcataaagcttgtgaagcaggccggcctctacgtgcacctccgcattggcccctacgtctgcgccgagtggaactttggtggtttccccatttggctgaagtatgtcccaggtatcagttttagaactgacaatgagccattcaaggctgagatgcagaagttcaccacgaagatcgttcaaatgatgaagtcagaaaggctctttgagtggcagggagggccgataatcctctcccagattgagaatgagtttgggcccttggagtgggatcagggcgagcctgccaaggactacgcgtcgtgggcagctaacatggcaatggcgcttaacacgggtgttccgtggatcatgtgcaaagaggatgatgccccagatccaattataaatacttgcaatggattttactgtgactggttctctccaaataaaccccacaagcctaccatgtggactgaagcttggacagcctggtatacgggttttggtattcctgttccacatagaccagtagaggatctagcatatggtgttgccaagtttatccagaagggtggttcttttgttaattattacatgtatcatggaggaacaaactttgagcgcacggctggtggtccattcattgcaactagctatgactatgatgctcctcttgatgaatatggcttgttgagagaaccaaaatggggtcacttgaaggagttgcatagagccatcaagctttgtgaaccagccttggttgcagcagatcctattttatcttcactcgggaatgctcagaaggcatctgtttttagatcaagcacaggagcttgtgcagcttttcttgagaacaagcataaactatcctatgcgagggtatcattcaacggaatgcactatgatttgcccccatggtccataagtattctcccggattgcaagacaacagtcttcaacactgctagggttggcagtcagatttcacaaatgaaaatggaatgggcaggaggactcacatggcagtcatacaatgaggagataaattcctttagtgagttggaatcattcacaacagtaggattactggaacaaataaatatgacgagggataacacagactatttgtggtatacaacatatgttgatgttgccaaggatgagcagttcctcaccagtgggaagaaccccaaactcaccgtgatgtcggctggtcatgctttgcatgttttcattaatggacaattatcaggaactgtgtatggcagtgtagaaaatccaaaacttacatatactgggaaggtgaaactttggtcagggagcaacactatttcctgcttaagtatagcagttggtcttccaaatgtcggagaacatttcgagacttggaatgctggaattcttggtccggtgacacttgatggcctgaatgagggaaaaagagatctcacatggcagaaatggacttatcaggttggtttgaaaggcgaggctatgagtcttcattcacttagtggaagctcatcggtagagtggggagaacctgtgcagaagcagcctctaacatggtacaaggcttttttcaacgcaccagatggcgatgagccattagctttggacatgaatagcatggggaaggggcaaatctggataaatgggcaaggaattggtcgatattggcctggctacaaggcctctggaacatgtggtcactgtgattaccgaggtgaatataatgagaccaagtgtcaaaccaactgcggcgacccttctcagagatggtaccatgttcctcgaccatggcttaatcctacaggtaaccttttggtgatatttgaggagtggggcggtgatcctactggaatctcaatggtgaaaagaaccactggaagtgtttgtgctgatgtgtctgaatggcagccatccataaaaaattggcgtacaaaagactatgagaaagctgaggtccacctccagtgtgatcatggccgaaaaataactgaaataaaattcgccagctttggcacaccgcaggggtcctgcgggaactactcagaaggtggatgtcatgcccacaggtcatatgacatatttaagaagaactgcattaaccaagaatggtgtggggtaagcgtagttccagaggcatttggtggagatccatgccccgggacaatgaaaagggcggttgtggaggttacgtgcagttgaatcgcaaatgtcgaacctcacaaatcatctccaggtacatcgactgtgccagtccacagagtcttcttctggcaagaggtgaaagtcacagcgaaagtgacgcatggactgtcagaagttacagaaattggttgtatcattagactgaatcatcaatatatgtatgtacattgtccacgtaagaatttgcagcgaagggaagattaggattgtaggcttgcaaaggggttatggctgattggtattgttcggagagggcacatttgatgagactctgctgtacctgagtccatatgtgcaatagcttctggttggaggaggccaagacccaagaagcaacccattgatttgcatgagacgattcatttctttgctcattggagggtgcaagatgtaatgtgcagggcagtggctatcatttattcatgtattgcctccttgattaatggtaaaaccaggataatggttaagctcataaataaaactgctctgttctgtcctgatgtatctgttttattcagctgcgctcttgatgagtgggcgaaccattctacctgtctaaactgg

SEQ ID NO: 2046 - DNA, 3027 bp, Brachypodium distachyon
tcttgcttgcttccttccccatggcctcctccgcgccgccggccccggccgtcctcgccgtcgcgctcacggttgccctcctggcctcgtcggcgtgggcggccgtcacctacgaccgcaaggcagtcgtggtgaacgggcagcgccgcatcctgctctccggctccatccactacccgcggagcgtccccgagatgtggccggatctgatacagaaggccaaggacggcggcctcgacgtggtgcagacgtacgtgttctggaacggccacgagccttcccctggccagtaccacttcgagggaaggtatgatctggtgcacttcataaagcttgtgaagcaggccggcctctacgtgcacctccgcattggcccctacgtctgcgccgagtggaactttggtggtttccccatttggctgaagtatgtcccaggtatcagttttagaactgacaatgagccattcaaggcaagactcgctgagatgcagaagttcaccacgaagatcgttcaaatgatgaagtcagaaaggctctttgagtggcagggagggccgataatcctctcccagattgagaatgagtttgggcccttggagtgggatcagggcgagcctgccaaggactacgcgtcgtgggcagctaacatggcaatggcgcttaacacgggtgttccgtggatcatgtgcaaagaggatgatgccccagatccaattataaatacttgcaatggattttactgtgactggttctctccaaataaaccccacaagcctaccatgtggactgaagcttggacagcctggtatacgggttttggtattcctgttccacatagaccagtagaggatctagcatatggtgttgccaagtttatccagaagggtggttcttttgttaattattacatgtatcatggaggaacaaactttgagcgcacggctggtggtccattcattgcaactagctatgactatgatgctcctcttgatgaatatggcttgttgagagaaccaaaatggggtcacttgaaggagttgcatagagccatcaagctttgtgaaccagccttggttgcagcagatcctattttatcttcactcgggaatgctcagaaggcatctgtttttagatcaagcacaggagcttgtgcagcttttcttgagaacaagcataaactatcctatgcgagggtatcattcaacggaatgcactatgatttgcccccatggtccataagtattctcccggattgcaagacaacagtcttcaacactgctagggttggcagtcagatttcacaaatgaaaatggaatgggcaggaggactcacatggcagtcatacaatgaggagataaattcctttagtgagttggaatcattcacaacagtaggattactggaacaaataaatatgacgagggataacacagactatttgtggtatacaacatatgttgatgttgccaaggatgagcagttcctcaccagtgggaagaaccccaaactcaccgtgatgtcggctggtcatgctttgcatgttttcattaatggacaattatcaggaactgtgtatggcagtgtagaaaatccaaaacttacatatactgggaaggtgaaactttggtcagggagcaacactatttcctgcttaagtatagcagttggtcttccaaatgtcggagaacatttcgagacttggaatgctggaattcttggtccggtgacacttgatggcctgaatgagggaaaaagagatctcacatggcagaaatggacttatcaggttggtttgaaaggcgaggctatgagtcttcattcacttagtggaagctcatcggtagagtggggagaacctgtgcagaagcagcctctaacatggtacaaggcttttttcaacgcaccagatggcgatgagccattagctttggacatgaatagcatggggaaggggcaaatctggataaatgggcaaggaattggtcgatattggcctggctacaaggcctctggaacatgtggtcactgtgattaccgaggtgaatataatgagaccaagtgtcaaaccaactgcggcgacccttctcagagatggtaccatgttcctcgaccatggcttaatcctacaggtaaccttttggtgatatttgaggagtggggcggtgatcctactggaatctcaatggtgaaaagaaccactggaagtgtttgtgctgatgtgtctgaatggcagccatccataaaaaattggcgtacaaaagactatgagaaagctgaggtccacctccagtgtgatcatggccgaaaaataactgaaataaaattcgccagctttggcacaccgcaggggtcctgcgggaactactcagaaggtggatgtcatgcccacaggtcatatgacatatttaagaagaactgcattaaccaagaatggtgtggggtaagcgtagttccagaggcatttggtggagatccatgccccgggacaatgaaaagggcggttgtggaggttacgtgcagttgaatcgcaaatgtcgaacctcacaaatcatctccaggtacatcgactgtgccagtccacagagtcttcttctggcaagaggtgaaagtcacagcgaaagtgacgcatggactgtcagaagttacagaaattggttgtatcattagactgaatcatcaatatatgtatgtacattgtccacgtaagaatttgcagcgaagggaagattaggattgtaggcttgcaaaggggttatggctgattggtattgttcggagagggcacatttgatgagactctgctgtacctgagtccatatgtgcaatagcttctggttggaggaggccaagacccaagaagcaacccattgatttgcatgagacgattcatttctttgctcattggagggtgcaagatgtaatgtgcagggcagtggctatcatttattcatgtattgcctccttgattaatggtaaaaccaggataatggttaagctcataaataaaactgctctgttctgtcctg

SEQ ID NO: 2047 - DNA, 1468 bp, Sorghum bicolor
agcgccgcacgaatctcggcgcgggccgcgcctgcatcttctccctcgttatccactgggtcactcgctcgtcgctcccacgaagctgtctgtcccccgaccactccgccgcccgctccaatggcggcgccggccaactcctcatgcttccacccccgcgcgaccttcagcccgccgtcttctctcagcgtcggaaccaaggtcttcgtcgggctcagggcgcagaccaagctcggttcgtcggagtcgtcatgcccgaatgtcagcgctgggttctacactgccgtcaaccggaggatctctctagggttgtcaagcaagaaggccaccagagcccgcatttcgatgatgcctattggtactccgcgtgtgccttacagaacacctggtgaaggaacctggcaatggcttgacatatggaatgctctgtaccgtgagcggattatcttcattggggacaatatagatgaagagttcagcaaccaagtgttggcaagcatgctgtatctagacagcattgataattccaaaaagataatgctgtacattaatggaccaggaggagatcttactccatgtatggcactatatgataccatgctaagtctaaaaagtcctattggtacgcactgcttgggctttgcattcaacctggcaggatttattcttgcagctggtgaaaagggttcacgtactggtatgcctctatgccgaatttcacttcagtcacctgctggagcagctcgaggccaggctgatgatatagaaaatgaagcaaatgagcttattcgtatcaagaactatctctatggcaagcttgcagagcacacaggtcattctgttgagaagatccatgaggacctctctagggtgaagcgcttcgacgctgaaggggctctcgaatatgggattattgaccgtattatcaggccttctaggatcaagaaagagggctccactgcccaaaggagggatatgcgaaatctgggacttggctaatagatgctatcctattgtatcagttttttgtgtgctggactgcgctactccaaacttcaacttgcagtttcagactctaggacttaaataatagataacacgataagcaggaaggctggatgaagtagggtgtagcagctcttccttccatttcatcatatgtatcgagaaatgcagaacatcggacttgatggtgcgacgtgcgagaatgtcgttgttggagggcaatgtaactgttcgaagttctacgcgtaggtgttttgttggtgtgcagtgtctagtacgcttttgctaactgtcagtattatattgctggtgtttgttgatgaacacagcaaagaaaaagaccggagggcactagcctctaggcgtctcgtgcgctacttttgtaccatcaatcaggtgcccatgttttggatggagactacagttacatgcaggagtaccactactttctcttttccaggtt

SEQ ID NO: 2048 - DNA, 1885 bp, Sorghum bicolor
agcgccgcacgaatctcggcgcgggccgcgcctgcatcttctccctcgttatccactgggtcactcgctcgtcgctcccacgaagctgtctgtcccccgaccactccgccgcccgctccaatggcggcgccggccaactcctcatgcttccacccccgcgcgaccttcagcccgccgtcttctctcagcgtcggaaccaaggtcttcgtcgggctcagggcgcagaccaagctcggttcgtcggagtcgtcatgcccgaatgtcagcgctgggttctacactgccgtcaaccggaggatctctctagggttgtcaagcaagaaggccaccagagcccgcatttcgatgatgcctattggtactccgcgtgtgccttacagaacacctggtgaaggaacctggcaatggcttgacatatggaatgctctgtaccgtgagcggattatcttcattggggacaatatagatgaagagttcagcaaccaagtgttggcaagcatgctgtatctagacagcattgataattccaaaaagataatgctgtacattaatggaccaggaggagatcttactccatgtatggcactatatgataccatgctaagtctaaaaagtcctattggtacgcactgcttgggctttgcattcaacctggcaggatttattcttgcagctggtgaaaagggttcacgtactggtatgcctctatgccgaatttcacttcagtcacctgctggagcagctcgaggccaggctgatgatatagaaaatgaagcaaatgagcttattcgtatcaagaactatctctatggcaagcttgcagagcacacaggtcattctgttgagaagatccatgaggacctctctagggtgaagcgcttcgacgctgaaggggctctcgaatatgggattattgaccgtattatcaggccttctaggatcaagaaagagggctccactgcccaaaggagggatatgcgaaatctgggacttggctaatagatgctatcctattgtatcagttttttgtgtgctggactgcgctactccaaacttcaacttgcagtttcagactctaggacttaaataatagataacacgataagcaggaaggctggatgaagtagggtgtagcagctcttccttccatttcatcatatgtatcgagaaatgcagaacatcggacttgatggtgcgacgtgcgagaatgtcgttgttggagggcaatgtaactgttcgaagttctacgcgtaggtgttttgttggtgtgcagtgtctagtacgcttttgctaactgtcagtattatattgctggtgtttgttgatgaacacagcaaagaaaaagaccggagggcactagcctctaggcgtctcgtgcgctacttttgtaccatcaatcaggtgcccatgttttggatggagactacagttacatgcaggagtaccactactttctcttttccaggttatatgtgagttttctataataatatatcatcaggtgaccatgtttggtgtatcttcatatcaatgtgacagcaggctgttgggagaagagggtagctttcaatggagcagcagccactggtggtgaccagccaccttacatactgtacataaacgtgccgaatgtttcttcatcacagaagaaaccgatgctccggaaaggatgcccattgggaggcgaaaggaatgctaccagcctaccaggaagtccaaatgcaccagcacatcgcactcaccactcagcctgctttgacatggcttcaatttgcaaagatgctgcatacgcactgttgacgaaacagatgaaaatgtgcaacaactccagaggtgacagtccaacggacatgaccaggtctcctggccgttactactcaccaaa

SEQ ID NO: 2049 - DNA, 1259 bp, Saccharum officinarum
caccaagctgtctgtcccccgaccactccgccgcccgctcaatggcggcgccggccaactcctcatgcttccacccccgcgcgaccgccagcccaccgtcttctctcagcgtcggcaccaaggtcttcgtcgggctcagggcgcagaccaagctcggttcgtcggagtcgtcgtgcccgaatgtcagcgctgggttctacactgctgtcaaccggaggatctctctggggctgtcaaacaagaaggcgaccagagcccgcatttcgatgatgcctattggtactccacgggtaccttacagaacacctggtgaaggaacctggcaatggcttgacatatggaatgctctgtaccgtgagcggattatcttcattggggacaatatagatgaagaattcagcaaccaagtgttggcaagcatgctgtatcttgacagcattgataattccaaaaagataatgttatacattaatggaccaggtggagatcttactccgtgtatggcactatatgataccatgctaagtctaaaaagtcctattggtacgcactgcttgggctttgcatttaacctagcaggatttattcttgcggctggtgaaaagggttcacgtactggtatgcctttatgccgaatttcacttcaggcacctggtggagcagctcaaggccggctgatgatatagaaaatgaagcaaatgagcttattcgtatcaagaactatctctatggcaagctcgcagagcacacaggtcattctgtcgagaagatccatgaggacctctctagggtgaagcgtttcgacgctgaaggggctctcgaatatgggattattgaccgtattatcaggccttctaggatcaagaaagagggctccactgcccaaaggagggatatgcgaaatctgggacttggctaatagatgctatcctatcctattgtatcagattttgtgtgctggactgcgctactccaaacttcaaccttggggttcagactcttacgacgtaataatagataaccagaagtaagcctggaaggctgggctgaagcctagggtagcaacttttcctttccatttcatcatatgtatcaagaaatgcagccacatggtaaacttggtgcgcgagaatgtcctggctgagaagcattggtactggtccgagctttatggcataaagttattttggtgggggcagcgggccaagtatgcttttggcctaactgtcaggaaataataaatttgcctggggtgtgat

SEQ ID NO: 2050 - DNA, 1267 bp, Setaria italica
gctgcacgaatcttgatgcaagggcgcccgcctcttcgtctcccgttatccacccggtcacacactcccccctcccagctctactccccttccccgagcactccgccgcccgctccaatggcggcgccggccaattcctcctgcttccacgcccgcgccgccgccagccagacctcctctctcagcgtgggcaccagggtcttcgtcgggctcagggcgcagaccaagctaggttcgtccgagtcgtcgtgcccgaatgtcagcgctgggttctacaccgccgtcaaccggaggatctctctcgggttgtcaaacaagaaggctaccagagctcgtatttcgatgatgcctataggtactccacgagtgccttacagaacccctggtgaaggaacctggcaatggcttgacatatggaatgctttgtatcgtgaaaggattatcttcatcggggacaatatagatgaagaattcagcaaccaagtgttggcaagcatgttgtaccttgacagcattgataatacaaagaagattcttctatacattaatggacctggaggagatcttactccatgtatggcactatatgataccatgctaagtctaaagagtcctattggtacacactgcttgggctttgcattcaacttggcaggatttattcttgcagctggtgaaaagggttcacgtactggtatgcctttatgccggatttcacttcagtcacctgctggagctgctcgaggccaggctgatgatattgaaaatgaagcaaatgagcttattcgtatcaagaactatctgtatggcaagcttgcggagcacacaggtcattctgtcgaaaagattcatgaggacctgtccagggtgaagcgctttgacgctgaaggggctctcgaatacgggattatcgatcgcattatcaggccttctcggatcaagaaagaggggtccactggtcacaggaaggatatgcgaaatctgggacttggctagtagatatgctatattattgtatcagatctgtgtgttggattgcattaccccaaacttcagtttacgatctcgaactctaggattttctactagatagcaagataagcaggcatggtggctgaagtgaaatgaaggacctattcttccatttcatcatatgcgtcggacgcagcatgtgctctgctttttcccgagaacgttcttgttggagagaaatgtactgtccaaaattttgcacaaagctttcactgaggggctgtttggatacgag

SEQ ID NO: 2051 - DNA, 1182 bp, Panicum virgatum
ctttccccccgaccactccgccgcccgctccgatggcgctgtccccggcggcgccggcgaactcctcctgcttccacgcccgcaccgccgctaaccagacatcctctctcagcgtgggcaccagggtcttcgtcgggctcagggcgcagaccaagctaggttcgtcggagtcgtcgtgcccgaatgtcagcgcggggttctacaccaccgtcaaccggaggatctctctcgggttgtcaaacaagaaggctaccagagcccgcatttcgatgatgcctataggtactccacgtgtgccttacagaacccctggtgaaggaacctggcaatggcttgacatatggaatgctttgtatcgtgaaaggattatcttcattggggacaatatagatgaagaattcagcaaccaagtgttggcaagcatgctgtaccttgacagcattgataatacaaaaaagattcttctatacattaatggaccaggaggagatcttactccgtgtatggcactatatgataccatgctaagcctaaagagtccaattggtacacactgcttgggatttgcattcaacttggcagggtttattcttgcagctggtgaaaagggttcgcgtactggtatgcccctatgccggatttcacttcagtcacctgctggagctgctcgaggccaggctgatgatattgaaaatgaagcaaatgagcttattcgtatcaagaactatctgtatggcaaactcgcggagcacacaggtcactctgtcgaaaagattcacgaggacttgtctagggtcaagcgctttgatgctgaaggggctcttgaatacggggttattgaccgcattgtcaggccttctcggatcaagaaagagggctccactgctcaaaggaaggacatgcgaaatctgggacttggctaatactcctagattctatgttactagcatcagatctatgtactgtgttgaattgcattaccccgaacttcagtttacggaactctaggatttactagttagcaagataggcaggcatgctggctgaagtggaatgtagcacctattcttccatttcattatatgtgtcggacgcagcatgcgctctactttttcccgagaaccttctatttgaagaggaatgtactgtccaaattttccacaaagcttatactgaatctgc

SEQ ID NO: 2052 - DNA, 1294 bp, Pennisetum glaucum
tccaaacgcctccagtgttatccactcggtcacactccccgcttcccagctttactccccttcccgagcactccgccgtccgctccgatggcggcgccggccaattcctcctgcttccacgcccgcgccgccgccagccagacctcctctctcagcgtgggcaccagggtcttcgtcgggctcagggcgcagaccaagctaggttcgtccgagtcgtcgtgcccgaatgtcagcgctgggttctacaccgccgtcaaccggaggatctctctcgggttgtcaaacaagaaggctaccagagcccgcatttcgatgatgcctataggtactccacgagtgccttacagaacccctggtgaaggaacctggcaatggcttgacatatggaacgctttgtatcgtgagaggatcatctttattggggacaatatagatgaagaattcagtaaccaagtgttggcaagcatgttgtacctcgacagcattgataatacaaagaggattcttctatacattaacggacctggaggagatcttactccatgtatggcattatatgataccatgctaagtctaaagagtcctattggtacacactgcttgggctttgcattcaacttggcaggttttattcttgcagctggtgaaaagggttcacgtactggtatgcccctatgccggatttcacttcagtcacctgctggagctgctcgaggccaggctgatgatattgaaaatgaagcaaatgagcttattcgtatcaagaattatctgtatggcaagcttgcggagcacacaggtcattcggtcgataagattcatgaggacctgtctcgggtgaagcgcttcgacgctgaaggggctctagaatacgggattatcgaccgcattatcatgccttctcggatcaagaaagaggggtccactggtcacaggaaggatatgcgaaatctgggacttggctagtagacatgctatattattgtatcagatctatgtgttggatcgcgttacctcagtttacggtctcgagctctaggatttactactaaatagcaagataagcaggcatgctcctggctgaagttaaatgcagcacctattcttccatttcatcatatggagcatgtgctctacttttcccatgaacgttcttgttggagagaaatgtactgtccaaaattttgcacaaagtctactgaatctgcagttccccacagtagctattatgcttttgctaactgccaatatcattctttagtgagctgcactgcttttgtattgcacaatcagg

SEQ ID NO: 2053 - DNA, 1121 bp, Cynodon dactylon
ccggccaactcctcctgcttccacccccgtgccgccgccagcacgccgtcctctctcagcgtgggtaccagggtcttcgttgggctcagggcgcagaccaagctcggttcgtcagagtcgtcgtgcccgaatgtcagcgccgggttctacaccgccgtcaacaagaggatttctctagggctgtcgaacaagagggccaccagagcacgcatttcaatgatgcccattgggactccaagagtgccttacagaacacccggtgaaggaacctggcaatggctcgacatatggaatgctttgtatcgtgaacggattatcttcattggggacaatatagatgaagaattcagcaatcaagtgttagctagcatgttgtatcttgacagtgttgataatacaaaaaagatacttctatacatcaatgggccaggaggagatctcacaccatgcatggcattgtatgacaccatgctaagcctcaagagtcctattggtacgcactgcttggggtttgcattcaacttggcaggatttattcttgcagctggtgaaaagggttcacgtactggaatgcctctatgccggatttcacttcaatcacctgctggagcagctcgaggccaggctgatgatatagagaatgaagcaaatgagcttattcgtatcaagaactatctttatggcaagctcgcggagcacactggccattccgtcgaaaagattcatgaggatctatctagggtgaagcgctttgatgctgaaggggctcttgaatatgggattatcgaccgtattattagaccctcccggattaagaaagagggatccactggagaaaggaaggatcgtcgaaacctgggacttggctaatggatgctatgctactgcgtcactgttagacatgctagactgtactatcctggagttcagttcacttcatgctattctactctaggacttaatagaaatcaggataagcaggcagattggctgagatgaattgtagcagccatttttctattccgtgacatgtgttggagtgcatcatgtccttactttagtacgtgaatgttcttgtcagagagcaatgtactcctgaaaatctgcactattttcttgtc

SEQ ID NO: 2054 - DNA, 1499 bp, Oryza sativa
cacgcttcctcttctgcacctacggtgatcgagcgacgcacgaatctcaacgcgcatcttcgttatccactactgcgtcagtcactccccgcgagctaagctctcctccccatcactccgatggcgctgtccgcggcggcgccggcgaactcctcctgcttccacccgcgcgccgccgccgccagcgcgccctcatctctcagcgtgggcaccaaggtcttcgtcgggttgaaggcccagaccaagctaggctcgtcggagtcgtcgtgcccgaatgtcaccgccgggttctacaccgccgtcaaccggaggatctctctgggattatcaaacaagagggctaccagggcgcgcatttcaatgatgcctgttggtacaccacgggtgccttacagaacacctggtgaaggaacttggcaatggcttgatatatggaatgctctatatcgcgaacgaattatcttcattggggacagtatagatgaagagtttagtaaccaagtattggcgagcatgttgtatcttgacagcgttgataacactaaaaagattcttctatacattaatggtccaggaggagatcttacaccatgcatggcattatatgatacaatgctaagcctaaaaagtcctattggtactcattgcctgggctttgcattcaacttggcaggatttattcttgcagctggtgaaaagggttcacgtacgggtatgcctctttgccggatttcacttcagtcacctgctggagcagctcgagggcaggctgatgatatagaaaatgaagcaaatgaacttattaggatcaagaactatctttacagcaagttgtcagagcacacaggtcatcctgttgataagattcatgaagatctatctagggtgaagcgcttcgatgctgaaggagctttggaatatgggattattgaccgtattattaggccttctcgcatcaagaaagagggatccactgctcaaaagaaggatctacgtaatctgggacttggctagtagatgctattgtatcagttatacgtgttagattgtattgttctcccctcattactcctgctttgaaatcctactgctttatttcatcaacaggagttcatgtggagatatgagatttgttttgctgtctccattggtattggacttaaaagagagaataatgttgtagcagtcataagagaaatacggtactctagttgccattctggtgatctcattttgtcaaacatatcgagagacgcgtcatacattttgtgatatcaggcgagaatgttcttgttaaataatgtgttcgttgcctgaaaatctgcagaaaggttgctgtggtctgcaatatgatactcctaactgaactctctgtatcagtacacatgctagtgatcacagggcaaggtccaaaggggaagaattcttggctgcacaactgtttcaaacttaatactttcctccgtttcacaatgtaagtcattctagcattttcaaca

SEQ ID NO: 2055 - DNA, 1318 bp, Oryza sativa
acgaatctcaacgcgcatcttcgttatccactactgcgtcagtcactccccgcgagctaagctctcctccccatcactccgatggcgctgtccgcggcggcgccggcgaactcctcctgcttccacccgcgcgccgccgccgccagcgcgccctcatctctcagcgtgggcaccaaggtcttcgtcgggttgaaggcccagaccaagctaggctcgtcggagtcgtcgtgcccgaatgtcaccgccgggttctacaccgccgtcaaccggaggatctctctgggattatcaaacaagagggctaccagggcgcgcatttcaatgatgcctgttggtacaccacgggtgccttacagaacacctggtgaaggaacttggcaatggcttgatatatggaatgctctatatcgcgaacgaattatcttcattggggacagtatagatgaagagtttagtaaccaagtattggcgagcatgttgtatcttgacagcgttgataacactaaaaagattcttctatacattaatggtccaggaggagatcttacaccatgcatggcattatatgatacaatgctaagcctaaaaagtcctattggtactcattgcctgggctttgcattcaacttggcaggatttattcttgcagctggtgaaaagggttcacgtacgggtatgcctctttgccggatttcacttcagtcacctgctggagcagctcgagggcaggctgatgatatagaaaatgaagcaaatgaacttattaggatcaagaactatctttacagcaagttgtcagagcacacaggtcatcctgttgataagattcatgaagatctatctagggtgaagcgcttcgatgctgaaggagctttggaatatgggattattgaccgtattattaggccttctcgcatcaagaaagagggatccactgctcaaaagaaggatctacgtaatctgggacttggctagtagatgctattgtatcagttatacgtgttagattgtattgttctcccctcattactcctgctttgaaatcctactgctttatttcatcaacaggagttcatgtggagatatgagatttgttttgctgtctccattggtattggacttaaaagagagaataatgttgtagcagtcataagagaaatacggtactctagttgccattctggtgatctcattttgtcaaacatatcgagagacgcgtcatacattttgtgatatcaggcgagaatgttcttgttaaataatgtgttcgttgcctgaaaatctgcagaaaggttgctgtggtctgcaatatgatact

SEQ ID NO: 2056 - DNA, 1153 bp, Brachypodium distachyon
acatccagcctgctcctcccttcgttatccgctcggccactccctttctccgaccactccgcccgcagctctctgctccaatggcgctgtgccggacggcgcccgccaactcctcctgcttccacccccgcgccgtcgcaagctcgccctcttctctctgcgtgggcaccaaggtcttcgtcgggctgaaggcccagaccaagctcggatcgtcggagtcgtcgtgcccgaatgtcaacgcccggttctacaccgccgtcaaccggagggtctccctggggttatcaaacaagagggctaccagggcacgcatttcaatgatgcctgtcggtacaccccgggtaccttacagaacacctggtgaaggaacctggcagtggcttgacatatggaatgctctatatcgtgaacgtattatcttcattggggacaatatagatgaagaatttagtaaccaagtattggcaagcatgctgtatcttgacagtgttgatgactcaaaaaagattattctatacatcaatggcccaggaggagatcttacgccgtgtatggcgttatatgataccatgctaagcttaaaaagtcctattggtacacattgcctgggctttgcattcaacttggcaggatttattcttgcagctggtcaaaagggttcacgtactggtatgcctctttgccggatttcacttcagtcacctgctggagcagctcgaggccaggccgatgatatagaaaatgaagctaacgaacttaatagaatcaggaactatctttatggcaagttatcagagcacacaggtcatcctgttgagaagattcacgaggacctggacagggtgaagcgctttgatgctgaaggagccctcgaatacggaattattgaccgtattgttatgccttctcggatcaagaaagaggggtccactggtcaaaagaaggatctacggaatctgggacttggctaatagatgctactgtatcagagttagtgttagacagcaccatttcccatagttcgctcctgctttaaaaccttaatggttgttgatcagttcatgttgagatatgagatcgactttgtcatctccaatctccttagacttaaagtacaatcagtagcaggcagaaatgaatggtttcatctgtt

SEQ ID NO: 2057 - DNA, 1374 bp, Brachypodium distachyon
gacgcacgattctcaacgcacatccagcctgctcctcccttcgttatccgctcggccactccctttctccgaccactccgcccgcagctctctgctccaatggcgctgtgccggacggcgcccgccaactcctcctgcttccacccccgcgccgtcgcaagctcgccctcttctctctgcgtgggcaccaaggtcttcgtcgggctgaaggcccagaccaagctcggatcgtcggagtcgtcgtgcccgaatgtcaacgcccggttctacaccgccgtcaaccggagggtctccctggggttatcaaacaagagggctaccagggcacgcatttcaatgatgcctgtcggtacaccccgggtaccttacagaacacctggtgaaggaacctggcagtggcttgacatatggaatgctctatatcgtgaacgtattatcttcattggggacaatatagatgaagaatttagtaaccaagtattggcaagcatgctgtatcttgacagtgttgatgactcaaaaaagattattctatacatcaatggcccaggaggagatcttacgccgtgtatggcgttatatgataccatgctaagcttaaaaagtcctattggtacacattgcctgggctttgcattcaacttggcaggatttattcttgcagctggtcaaaagggttcacgtactggtatgcctctttgccggatttcacttcagtcacctgctggagcagctcgaggccaggccgatgatatagaaaatgaagctaacgaacttaatagaatcaggaactatctttatggcaagttatcagagcacacaggtcatcctgttgagaagattcacgaggacctggacagggtgaagcgctttgatgctgaaggagccctcgaatacggaattattgaccgtattgttatgccttctcggatcaagaaagaggggtccactggtcaaaagaaggatctacggaatctgggacttggctaatagatgctactgtatcagagttagtgttagacagcaccatttcccatagttcgctcctgctttaaaaccttaatggttgttgatcagttcatgttgagatatgagatcgactttgtcatctccaatctccttagacttaaagtacaatcagtagcaggcagaaatgaatggtttcatctgttcttctgttttgtcacacacacacacacgcacaccgagaagcgcagcatacatttttctagtttcatgcaagagaatatatcgttgctggagcaatgtgctgtctgaaagcattcagaaaggttgttgcagacactgcaatgtagtacgtgcatgctaactgaactggaaaataaaatcatagcaacggctgtggtctgccaa

SEQ ID NO: 2058 - DNA, 1224 bp, Hordeum vulgare
gagccactccgcagcactcctccaatggcgctgtgccggacggcgcccgccaactcctcctgcttccacccccgcgccgtcgccagctcgccctcctctctcagcgtgggcaccaaggtcttcgtcgggctgaaggcgcagacgaggctcggctcgtcagagtcgtcgtgcccgaacgtcaacgcccggttctacaccgccgtcaaccggagggtctcccttgggttgtcaaacaagagggctaccagggcacgcatttcaatgatgcctgtcggcacaccacgggtaccttacagaacacctggtgaaggaacctggcagtggcttgacatatggaatgctttatatcgtgaacggattatcttcattggggacaatattgatgaagaattcagtaaccaagtactggcaagcatgctgtatcttgacagtgtcgacgacacaaagaagattcttctatacatcaacggtccaggaggagatcttacaccatgcatggcgttatatgataccatgctaagcctaaagagtccaattggtacccattgcctgggctttgcattcaacttggcaggattcattcttgcagctggtcaaaagggttcacgtactggtatgcctctttgccgtgtttcacttcagtcacctgctggggcagctcgaggccaggctgatgatatagaaaacgaatcaaacgaacttaatcggatcaagaactatctttatggcaagctagcagagcacacgggtcattctgttgagaaggttcacgaggacttgtccaggtcgaagcgcttcgacgccgaaggagccctggagtacgggatcatcgaccgtatcgtcaggccttctcggatcaagaaagagggcggctcgaccaccggccagaagaaggaactgcggaatctgggactcggctagtagatgtcagcgcaccagagctagtgttagaccgtgcgacgattttccacgttcgatcctgcttcgacgcattgacgcttccttttgtcagtccatgtggatgtatgtcatttaatctgttgtgtccgttgtccttagactttaagacagctcgatatcgggaagatgtggtaggcggcggtgatcttctctgttctttcatatgtaccgagaaacggcccgcacaattgttgactccatggacggattattgttcttgttgggccagtttgtgatccagcaagatgctgtctgaaggttacc

SEQ ID NO: 2059 - DNA, 1199 bp, Secale cereale
tcactcccgagccactccgcagccctgctccaatggcgctgtgccggacggcgcccgccaactcctcctgcttccacccccgcgccgtcgccagctcgccctcctctctcagcgtgggcaccaaggtcttcgtcgggttgaaggcccagaccaggctcggctcgtcggagtcgtcgtgcccgaatgtcaacgcccggttctacaccgctgtcaaccggagggtatcccttgggttgtcaaacaagagggctaccagggcacgtatttcaatgatgcctgtcggcacaccacgggtaccttacagaacacctggtgaaggaacctggcagtggcttgacatatggaatgctttatatcgtgaacggattatcttcattggggacactattgatgaagaattcagtaaccaagtactggcaagcatgctgtatcttgacagtgttgatgacacaaagaagattcttctatacatcaatggtccaggaggagatcttacaccatgcatggcgttatatgataccatgctaagcctgaagagtccaattggtactcattgcctgggctttgcattcaacttggcgggattcattcttgcagctggtcaaaagggttcacgtactggtatgcctctttgccgtgtttcacttcagtcacctgctggagcagctcgaggccaggctgatgatatagaaaacgaatcaaacgaacttaaccgaatcaagaactatctttatggcaaactagcagagcacacgggtcattctgttgaaaaggttcatgaggacttatcgaggtcgaagcgcttcgacgccgaaggagccctcgagtacgggatcatcgaccgtattgtcaggccttcccggatcaagaaagagggcggctcgaccaccggtcagaagaaggaactgcggaatctgggacttggctgatggatgttagtgtaccagagttagcgttagactgccacggtttttccacgttcgatcctgcttcgaaatatagacgctttcttttgtcagttcatgtggacatatgacatttaatctcttgtctccggtgtccctacactttaagacaactcaatatcaggaagagctggtaggtggtggtgatcttttatgatctttcatatgtaccgagaaacggctgcgcatgcatttgttcactccgtgggcggattaatgttcttgttggggcga

SEQ ID NO: 2060 - DNA, 1234 bp, Leymus cinereus x Leymus triticoides
  misc_feature (1042)..(1042): n is a, c, g, or t
  misc_feature (1047)..(1047): n is a, c, g, or t
  misc_feature (1061)..(1061): n is a, c, g, or t
  misc_feature (1082)..(1082): n is a, c, g, or t
  misc_feature (1084)..(1084): n is a, c, g, or t
  misc_feature (1088)..(1088): n is a, c, g, or t
  misc_feature (1090)..(1090): n is a, c, g, or t
  misc_feature (1106)..(1106): n is a, c, g, or t
  misc_feature (1115)..(1115): n is a, c, g, or t
  misc_feature (1120)..(1120): n is a, c, g, or t
  misc_feature (1123)..(1124): n is a, c, g, or t
  misc_feature (1130)..(1130): n is a, c, g, or t
cgatccgccactgttcactcccgagccactccgcagccctgctccaatggcgctgtgccggacggcgcccgccaactcctcctgcttccacccccgcgccgtcgccagctcgccctcctctctcagcgtgggcaccaaggtcttcgtcgggttgaaggcccagaccaggctcggctcgtccgagtcgtcgtgcccgaatgtcaacgcccggttctacaccgccgtcaaccggagggtctccctggggttgtcaaacaagagggctacgagggcacgtatttcaatgatgcctgtcggcacaccacgggtaccttacagaacacctggtgaaggaacctggcagtggcttgacatatggaatgctttatatcgtgaacggattatcttcattggggacactattgatgaagaattcagtaaccaagtactggcaagcatgctgtatcttgacagtgttgatgacacaaagaagattcttctatacatcaatggtccaggaggagatcttacaccatgcatggcgttatatgataccatgctaagcctaaagagtcctatcggtactcattgcctgggctttgcattcaacttggcggggttcattcttgcagctggtcaaaagggttcacgtactggtatgcctctttgccgtgtttcacttcagtcacctgctggagcagctcgaggccaggctgatgatatcgaaaacgaatcaaacgaacttaatcggatcaagaactatctttatggcaagctagcagagcacacaggtcattctgttgaaaaggttcatgaggacttatccaggtcgaagcgctttgatgccgaaggagccctcgaatacgggatcatcgaccgtatcgtcaggccttcccggatcaagaaagagggcggctcgaccaccggccagaagaaggaactgcgaaatctgggacttggctaatcgtagatgttagcgcaccagagttagatgtagactaccacggttctccatgttcgatcctgctttgaaacctcgacgcttcctttcgtcggttcatgntgtangtttgttgtctccngtgtccctagactttaaacanancaanancaggaagaggtgatangtggtggtnatctntcnntttttnatacgcacaaagaaacgccgcgcatgtttgatgatttcgtgcgacattaatgttcttgttgaggcagtgtgctccggcaagatgctttctgatggttggttaca

SEQ ID NO: 2061 - DNA, 1171 bp, Avena sativa
agtcccggtcactccgcagacctgctccaatggcgctgtccccgacggcgcccgccaactcctcctgcttccacccccgcgcactcgccagcccggcctcctctctcagcgtgggcaccaaggtcttcgtcggactgaaggcacagacgaggctcggctcgtcggagtcgtcttgccccaatgtcaacgcccggttctacaccgccgtcaaccggagggtctccctggggttatcaaacaagagggctaccagggcacgcatttcaatgatgcctgtgggtacaccacgggtaccttacagaacacctggtgaaggaacctggcaatggcttgacatatggaatgctttatatcgtgaacgtattatcttcattggggacagtattgatgaagaatttagtaaccaactattggcaagcatgctgtatctcgacagtgttgatgactcaaaaaagattcttctatacatcaatggtccaggaggcgatcttacaccatgcatggcgttatacgataccatgctaagcctaaaaagtcctattggtactcattgcctgggctttgcattcaacttggcaggattcattcttgcagctggacaaaagggttcacgaactggtatgcctctttgccgggtttcacttcagtcacctgctggagcagctcgaggacaggctgatgatatagaaaatgaagcaaacgaacttaaccgaatcaaaaactatctttatggcaagttagcagagcacacaggccatactgttgaacaggttcatgaggacctgtccagggtgaagcgcttcgacgctgagggagccctcgattacgggatcatcgaccgcatcgtccggccatctcgtatcaagaaagagggcggctcgaccaccggccagaagaaggatctgcggaacctggggcttggctaatcgtagatgctggctagcgtatcagagtcgtagcgttagaccgccactatttttttccacgtctgatcctgcttcgaaacctcggtgcttccgttattcagttgatgtggagctatgagattttgtagtttgttttctccggtgcccctggacttgagacagcaatattagaatgtataagtgacacgcatggcagtttttttattaacattccaaggaacacgcggcatatacatttggtagtt

SEQ ID NO: 2062 - DNA, 1177 bp, Avena sativa
agtcccggtcactccgcagacctgctccaatggcgctgtccccgacggcgcccgccaactcctcctgcttccacccccgcgcactcgccagcccggcctcctctctcagcgtgggcaccaaggtcttcgtcggactgaaggcacagacgaggctcggctcgtcggagtcgtcttgccccaatgtcaacgcccggttctacaccgccgtcaaccggagggtctccctggggttatcaaacaagagggctaccagggcacgcatttcaatgatgcctgtgggtacaccacgggtaccttacagaacacctggtgaaggaacctggcaatggcttgacatatggaatgctttatatcgtgaacgtattatcttcattggggacagtattgatgaagaatttagtaaccaactattggcaagcatgctgtatctcgacagtgttgatgactcaaaaaagattcttctatacatcaatggtccaggaggcgatcttacaccatgcatggcgttatacgataccatgctaagcctaaaaagtcctattggtactcattgcctgggctttgcattcaacttggcaggattcattcttgcagctggacaaaagggttcacgaactggtatgcctctttgccgggtttcacttcagtcacctgctggagcagctcgaggccaggctgatgatatagaaaatgaagcaaacgaacttaaccgaatcaaaaactatctttatggcaagttagcagagcacacaggccatactgttgaacaggttcatgaggacctgtccagggtgaagcgcttcgacgctgagggagccctcgattacgggatcatcgaccgcatcgtccggccatctcgtatcaagaaagagggcggctcgaccaccggccagaagaaggatctgcggaacctggggcttggctaatcgtagatgctggctagcgtatcagagtcgtagcgttagaccgccactatttttttccacgtctgatcctgcttcgaaacctcggtgcttccgttattcagttgatgtggagctatgagattttgtagtttgttttctccggtgcccctggacttgagacagcaatattagaatgtataagtgacacgcatggcagtttttttattaacattccaaggaacacgcggcatatacatttggtagttcagttg

SEQ ID NO: 2063 - DNA, 1217 bp, Triticum aestivum
ctcttcctccctccgttatccgttccgccactgttcactcccgagccactccgcagccctgctccaatggcgctgtgccggacggcgcccgccaactcctcctgcttccacccccgcgccgtcgccagctcgccctcctctctcagcgtcggcaccaaggtcttcgtcgggttgaaggcccagaccaggctcggctcgtccgagtcgtcgtgcccgaatgtcaacgcccggttctacaccgccgtcaaccggagggtctccctagggttgtcaaacaaaagggctaccagggcacgtatttcaatgatgcctgtcggcaccccacgggtaccgtacagaacacctggtgaaggaacctggcagtggcttgacatatggaatgctttatatcgtgaacggattatcttcatcggggacactattgatgaagaattcagtaaccaagtactggcaagcatgctgtatcttgacagtgtcgatgacacaaaaaagattcttctatacatcaatggtccaggaggagatcttacaccatgcatggcgttatatgataccatgctaagcctaaagagtccaattggtactcattgcctgggctttgcattcaacttggcaggattcattcttgcagctggtcaaaagggttcacgtacgggtatgcctctttgccgtgtttcacttcagtcacctgctggagcagctcgaggccaggctgatgatatagaaaatgaatcaaacgaacttaatcggatcaagaactatctttatggcaagctagcagaacacacgggccattctgttgaaaaggttcatgaggacctatcgaggtcgaagcgctttgacgccgaaggagccctcgaatacgggatcatcgaccgtatcgtcaggccttcccggatcaagaaagagggcggctcgaccaccggtcagaagaaggagctgcggaatctgggactcggctaatctttagatgtcagcgcaccagagttagccgtagaccgccacagtttttccacgtctagtcctgcttcgaaatctcgacgcttcctttcatcggttcatgcggatgtacgagatttagcttgtctctccggtatccccagacttttaagacagagcgatagcacactgagaaacgccgcgcacgtttgatgatttcgcgcgacattaatgttcttgttgagtcagtggtccggcaagacgctgtctgatactag

SEQ ID NO: 2064 - DNA, 1291 bp, Triticum aestivum
gattcggcacgagccaccctcttcctccctccgttatccgttccgccactgttcactcccgagccactccgcagccctgctccaatggcgctgtgccggacggcgcccgccaactcctcctgcttccacccccgcgccgtcgccagctcgccgtcctctctcagcgtgggcaccaaggtcttcgtcgggttgaaggcccagaccaggctcggctcgtccgagtcgtcgtgcccgaatgtcaacgcccggttctacaccgccgtcaaccggagggtctccctggggttgtcaaacaagagggctaccagggcacgtatttcaatgatgcctgtcggcacaccacgggtaccttacagaacacctggtgaaggaacctggcagtggcttgacatatggaatgctttatatcgtgagcggattatcttcattggggacactattgatgaagaattcagtaaccaagtactagcaagcatgctgtaccttgacagtgttgatgacacaaagaagattcttctatacatcaatggtccaggaggagatcttacaccatgcatggcgttatatgataccatgctaagcctaaagagtccaattggtactcattgcttgggctttgcattcaacttggcaggattcattcttgcagctggtcaaaagggttcgcgtactggtatgcctctttgccgtgtttcacttcagtcacctgctggagcagctcgaggccaggctgatgatatagaaaatgaatcaaacgaacttaatcggatcaagaactatctttatggcaagctagcagagcacacgggtcattctgttgaaaaggttcatgaggacctatccaggtcgaagcgcttcgacgcagaaggagccctcgagtacgggatcattgaccgtatcgtcaggccttcccggatcaagaaagagggcggctcgaccaccggtcagaagaaggagctgcggaatctgggactcggctaatcttagatgtcagcacaccagagttagccgtagactgccacagtttttccacgtctagtcctgcttcgaaatctcgacgcttcctttcatggttcatgcggatgtacgagatttagtttgttgtctccggtttccccagacttttaagtcagcgcgatagcaggaagaggtgataggcggtggtgatattcgtcgttttttcatgcacaccgagaaacaccgtgcatagttgatgattttgcgccacattaatgttcatgttgagtcagtggtccgcaagatgctgtctgatatttatcttttatttttt

SEQ ID NO: 2065 - DNA, 3619 bp, Sorghum bicolor
gaaagaaaagaaaagcaaaggcaaaaaggtgagcgagaccggattagttaggcttggctagctaaccccggaagtagaagaaaagcctccgattccttccctcccatcctctccctcctcgccgaaagggagaaggagaaggatggacagctcagggctgcgggctcaggcgccggttcacatggccgcgggatgctgcagcgaggactgaggactctggatgggtgttcgtcccgccggccgagagagacagagaaagagagagagggagaaggggatagagacgagtggagtcagaaagggccggccggtgaagaagctccattccgtgtttgctcagtgtgatcatcaggtccaactggtgctgatctctctcatgaactgagcaatcaatagaagaaacaaaagggtcatttccgctacagaaaaataaatcatcaggaatgggaagacgaggccacaggcggtctgcatcacaagatgaggacaatgtgggctgtgtgtggggcctcatgcgcatgctatacttccgccgagacccaaactcttgctggatgcaaagcaattgagtgggaggcatacgttccgggaggtcactgagaggggacattcagcaaagaggcccaacgattttgacgagatagaagaagacggtaacatagaagaatacacttgtcagaaaccaacagtcaaaaaccttatggaggatgaattgggaaaagtaaagctgctgaagaaaaatccaaatgacgaggttcagagaagattagcggaactgggagatgatgtctctcttgataggagttcagagcatacaaataaatcaacagataactcatatcaccaggcaggaatctctacgccttcaactccaatggattctggggtttcgaattatgctgaagaatttgatcttgaatctgtcctgatgaatttcctaggtgaaatatatagttgtcacaatgaatgcccacacagtgattgcaagaataagaatgaattgtgtccttcactgaaggccctaatccataaaaaggtcaatgaattgaataatcttcctcgcaatattagctgtgggcagtctcaagagggtaatgatgttaagctacctgaccagaataatctttctaacaccatggcagcccaatccaaacaattcaaggatgcattggaaatactgggttcaaacaatgaacttttcgtgaagctgcttcagaagccaaatccacatatagctgacagtatccaaaagcatgaaaacagtaaggtagctgctggattagagcccaataaaattcatggacagaccaattttgttggaggaagaggaggctcaagacagcatcctttggctacaaaagagcaagctaaagagagaaaatatatgttcttctggaggaagggtaaatcaaatagaaggcagatgcttgaggcaactgacgcagctcagactgttagcaaaattgttattctgaagccaaatccagaaagagggattaatcagaaagcagctactggaagaactttacatcaacagccttgtacatctcatgctcctgaatgtagtggaagggaaaactcaaagttttcaattaaggaagtcaagaaaagattcagatttgtgactggtgagagtagaagagaaaaaaatttggcacctgcagaggagcttcaaggagggccacgtaagctcaaagattctgttattgcaattaataaagattttagacatctcccggaagggagcttgggaaacaagtctgtgtcagacattaagaatgacatcaaacctttcatcagcagtaagcaaaagcagcaaaatgggaacataagcgaaatcaatggccatattgtaacaccaaaaggtgtgtctatcttctatgaagaggccaagagacatttaacagagatgctaaaagataatgactgttctgtaaactacccagcagttcaaatctcaaaatccttggaaggcatactttctcttcctcatggcaatgtgtcaacccctaggagtagcctgaggggaaaggattaccttgacccctcacctggagaaacagatgtttgcattgcatgtgaggttgagagagaagaatgcacacaagagagaaaccaatcacaaaaggatttaggaagcattgttctctgtaccagtgcagcagttgatgatcaggtgacagttcgagaaggatattacacgaatgaagcacaaaaaggaccaagacatgctgatgatgagccaagcactctgtatactgaaggaattgacaaactcatttgcggtgaaaacgtttgcaatgaacggtccattccagcagaacaaagcattgatgatgtatgtcaggaaacactagaagaaataaaacaaggaaaagaacatgtaaaagtgtccccgacttctgctgagggcatagtcgaaaaattggggcagcaagagccagaaacaccagaaccaagagcagcaaccaaattaatctcagatggttctcctgagcaaagcgatgaaaagcaagagaggcccagtccagtatctgttcttgagtcattctttgaagatattggcagtccagactgcataaataagaaagaatgtgagctgcatggtctccaaaggaccctgtattttccagataatgaaccagatgctaatgtcctttgggaggacaagaatgtcagggtggattacataaagttggtgctagaactctcagagttgtgtgcagaacaaaatttagaggtatggtacctagaggatgaattaatcagcccctgcttgtttgaagaactacagagtcagggtgatcaaacagatgatctaaagcttctgtttgactgtatctgtgaagctctaacagagatccaagagagatattttagactctcttcttggctaacgtttctaaaacacgacatacggacacctccgataggagaaaacctcatcacagaagttgatagatatgtttacgggtatatccaatatagtcttccaagtactctagagcagacaatgaagagggatctagaagttcagacgtggatgaacattagatcgaaaactgaagggattgttatggagatctgggagtttgtattggatgagttgatagatgagactgtctttgatttgtggatgtgaagttctgattatatctcgtccatggtgctttgtgagtgagtatagtgagtaggatacatgagttttcgtgctgacaataaccaattctatgcggcagaataacatgatgggctactactactagtcaagtgtgtaactacagtggaaatggttctcgtggattgagaacaaaagtttaggtcagcaaaatctccagagttgtgcagtttgtacggatgaagttgggcacggtctgtcaccagaactcacagccatgcctctgagcagcgaagtgtacagcagtctgaagcgcattgcaattttcctcttgcccattgagatttgagagtttgtgtgcatacgtgtgatgcgtcccacttttcagcgggatcggatcacgcttattgtatatgctttgttttttgtgtgtaaatgtgcaagaaaataatcatacatcattaatccaatgacatgttttctgtatgcttagcattattt

SEQ ID NO: 2066 - DNA, 3343 bp, Sorghum bicolor
tttcgtcctttgctatctcctgttggaaccaggctgatgaattatttttattcaaatccagtgtgatcatcaggtccaactggtgctgatctctctcatgaactgagcaatcaatagaagaaacaaaagggtcatttccgctacagaaaaataaatcatcaggaatgggaagacgaggccacaggcggtctgcatcacaagatgaggacaatgtgggctgtgtgtggggcctcatgcgcatgctatacttccgccgagacccaaactcttgctggatgcaaagcaattgagtgggaggcatacgttccgggaggtcactgagaggggacattcagcaaagaggcccaacgattttgacgagatagaagaagacggtaacatagaagaatacacttgtcagaaaccaacagtcaaaaaccttatggaggatgaattgggaaaagtaaagctgctgaagaaaaatccaaatgacgaggttcagagaagattagcggaactgggagatgatgtctctcttgataggagttcagagcatacaaataaatcaacagataactcatatcaccaggcaggaatctctacgccttcaactccaatggattctggggtttcgaattatgctgaagaatttgatcttgaatctgtcctgatgaatttcctaggtgaaatatatagttgtcacaatgaatgcccacacagtgattgcaagaataagaatgaattgtgtccttcactgaaggccctaatccataaaaaggtcaatgaattgaataatcttcctcgcaatattagctgtgggcagtctcaagagggtaatgatgttaagctacctgaccagaataatctttctaacaccatggcagcccaatccaaacaattcaaggatgcattggaaatactgggttcaaacaatgaacttttcgtgaagctgcttcagaagccaaatccacatatagctgacagtatccaaaagcatgaaaacagtaaggtagctgctggattagagcccaataaaattcatggacagaccaattttgttggaggaagaggaggctcaagacagcatcctttggctacaaaagagcaagctaaagagagaaaatatatgttcttctggaggaagggtaaatcaaatagaaggcagatgcttgaggcaactgacgcagctcagactgttagcaaaattgttattctgaagccaaatccagaaagagggattaatcagaaagcagctactggaagaactttacatcaacagccttgtacatctcatgctcctgaatgtagtggaagggaaaactcaaagttttcaattaaggaagtcaagaaaagattcagatttgtgactggtgagagtagaagagaaaaaaatttggcacctgcagaggagcttcaaggagggccacgtaagctcaaagattctgttattgcaattaataaagattttagacatctcccggaagggagcttgggaaacaagtctgtgtcagacattaagaatgacatcaaacctttcatcagcagtaagcaaaagcagcaaaatgggaacataagcgaaatcaatggccatattgtaacaccaaaaggtgtgtctatcttctatgaagaggccaagagacatttaacagagatgctaaaagataatgactgttctgtaaactacccagcagttcaaatctcaaaatccttggaaggcatactttctcttcctcatggcaatgtgtcaacccctaggagtagcctgaggggaaaggattaccttgacccctcacctggagaaacagatgtttgcattgcatgtgaggttgagagagaagaatgcacacaagagagaaaccaatcacaaaaggatttaggaagcattgttctctgtaccagtgcagcagttgatgatcaggtgacagttcgagaaggatattacacgaatgaagcacaaaaaggaccaagacatgctgatgatgagccaagcactctgtatactgaaggaattgacaaactcatttgcggtgaaaacgtttgcaatgaacggtccattccagcagaacaaagcattgatgatgtatgtcaggaaacactagaagaaataaaacaaggaaaagaacatgtaaaagtgtccccgacttctgctgagggcatagtcgaaaaattggggcagcaagagccagaaacaccagaaccaagagcagcaaccaaattaatctcagatggttctcctgagcaaagcgatgaaaagcaagagaggcccagtccagtatctgttcttgagtcattctttgaagatattggcagtccagactgcataaataagaaagaatgtgagctgcatggtctccaaaggaccctgtattttccagataatgaaccagatgctaatgtcctttgggaggacaagaatgtcagggtggattacataaagttggtgctagaactctcagagttgtgtgcagaacaaaatttagaggtatggtacctagaggatgaattaatcagcccctgcttgtttgaagaactacagagtcagggtgatcaaacagatgatctaaagcttctgtttgactgtatctgtgaagctctaacagagatccaagagagatattttagactctcttcttggctaacgtttctaaaacacgacatacggacacctccgataggagaaaacctcatcacagaagttgatagatatgtttacgggtatatccaatatagtcttccaagtactctagagcagacaatgaagagggatctagaagttcagacgtggatgaacattagatcgaaaactgaagggattgttatggagatctgggagtttgtattggatgagttgatagatgagactgtctttgatttgtggatgtgaagttctgattatatctcgtccatggtgctttgtgagtgagtatagtgagtaggatacatgagttttcgtgctgacaataaccaattctatgcggcagaataacatgatgggctactactactagtcaagtgtgtaactacagtggaaatggttctcgtggattgagaacaaaagtttaggtcagcaaaatctccagagttgtgcagtttgtacggatgaagttgggcacggtctgtcaccagaactcacagccatgcctctgagcagcgaagtgtacagcagtctgaagcgcattgcaattttcctcttgcccattgagatttgagagtttgtgtgcatacgtgtgatgcgtcccacttttcagcgggatcggatcacgcttattgtatatgctttgttttttgtgtgtaaatgtgcaagaaaataatcatacatcattaatccaatgacatgttttctgtatgcttagcattatttcac

SEQ ID NO: 2067 - DNA, 3778 bp, Zea mays
cgccgaaagggagggagaaggatggacagctcagggctgcgggctccggcgccgattcacatggccgggggatgctgtgaggactgaggaccttggatgggcgttcgtcccgccggccgagcgcccgcgcgagagagaaggggacagaaacgagtcagaaaggccggccggtgaagctccgtccgtgattgctcaggtaggcttttttccttgcttcgaaggtatttctgctggctttctttcttggtgtcgcactgtagctactatttgtattagtgtgacgaatctgagctttcttctccgtgccaatacactgactgagcggctgattgataacgtgttgggggatttcgttttttttttgctttttagaaaataggtttaacgtttcgatatgcttccatcaattttttctgtctgtatctggaagtgttcagattgtttgaacgtcctttgctatcgcctgtcggaacctggctgacgaactattttcattcaaactgcggtgttcatcatcaggtccaactgctgctgatctccctcatgaactgagcaatcaacagaagaaacaaaagggccgtttccgctacagagagaacgaataaatcaccggaaatgggaaggcgaggccacggggggtcagcgtcacaagacgacgacggtgtgggctgtgcatggggcctcatgcgcatgctctacttccgccgagaccccaagctcttgctggatgcaaagcagttgagtgggaggcatgcgttccgtgaggtcagtgagagggggcattcagcaaagaggtccaaggattttgacgagatagaagaagatggtaacatagaagaatgcacttcgcagaaaccaacagtcaaaaaccttatggaggatgaattgggaaaagtaaagctgctgaagaaaaatccaaatgatgagattcagagaagattagtggacctgggaaatgatgtctctcttggtaggagttcagagcatacaaataaatcaatagatagatcatatcaccaggcaggaatctctacaccttcaattccaccaatggattctggggttttgaattatgctgaagaatatgatcttgaatctgtcctgatgaatttcctaggtgaaatttatagttgtcacgatgaatgcccacacagtgattgcaagaataagaatgaattgtgtccttcactgaagtccctaatccataaaaaggtcaatgaattgaataatcttcctcgcaatattggctgcgcgcaatctcaagagggtaatgatgctaagctatctgaccagaataatctttctaacaccatggcagcccgatccaaacaattcaaggatgcattggaaatactgggttcaaacaatgaacttttcatgaagctgcttcagaagccaaaccaacatatagttgacagtatccaaaagcatgaaaacagtaaggtggctgccggattagagcccaataaaattcatggacagaccaattttctggtaggaagaggaggctcaagacagcatcctttggctacaaaggagcaggctaaagagagaaaatatatgttcttctggaggaagggtaaatcaaatagaaggcagatgcttgaggcaactgacacagatcagactgttaccaaaattgttattctgaagccaaatccagaaagagggtttaatcagaaagcagctactgcaagaactttacatcaacagccatgtacatcgcatgctcctgaatgtggtggaattgataactcaaagttttcaattaaggaagttaagacaagattcagatttgtgaatagtgagagtagaagagaaagcaatttagcacctgcagaggaccttcaaggatacccacggaagttcaaagattcttttgttgcaattaataaagattttagacatttcccagaagggagcttggcaaacaagtctggatcagacatcaagaatgcaatcaaacctttcatcagcagtaagcaaaatgggagcataagcggaaacagtggtcatatagtagcaccaaaaggtgcatctatcttctatgaagaggccaggaggcatttatcagagatgctaaaggataatgactgttctgtaaactatccagcagttcaaatctcaaaatccttggaaggcatactttctctgcctcatggcaatgtgtcaacccctaggagtagcctgtggggaaaggattaccttggcccctcacctggagaaacagatgtttttgttgcatgtgaggttcagagagaagaatgcacacaagagagaagccaatcacaagaggattttggaagcattgctcgatgtactagtgcagcagttgatgatcaggtgacagttcgagatggatattacacgaatgaagcacaagaaggatcaaggcatgctcagaatgagccaggccttctgtatactgaaggaattcacaaattcatttgcggcaaaaacatttgcgacgaacagtccgttccagcagaacaaagtagacacgatgtatgtcaggaaatactagaagaaataaaacaaggaaaagaacatatcaaaatgtccccaacctctgctgaggggatagttgaaacgttggggcagcaagagccagaaacaccagaaccaagagcatcaaccgaactaatctcagatggttctcccgagcaaagcgatgaaaagcaagagaggcccagtccagtatctgttcttgagtcattctttgaagatattgacaatccagactgcataaacaagaaagaatgtgagctgcatggtctccaaaggaccctgtattttccagataatgaaccagatgttagcctccttggggaggacaggagtgtcagagtggattacataaagttggtgctagaactctcggagttgtgtgcagaacaaaatttagaggtatggtacctagaggacgaattaatcagcccctgcttgtttgaagaactacagagtcagggcgatcaaacggatgatctaaagctcctatttgactgtatctgtgaggctctaacagagatccaagagagatattttagactctcttggctaactttcctaaagcaagacataaggacacctccgattggagaaaacctcatcacagaagttgatagatatgtttacgggtatatccaacatagtcttccaatcactctagagcagataatcaagagggacctggaagttcagacgtggatgaacattagatcgaaaactgaagggattattatggagatgtgggagtttgtattggatgagttgatagatgagactgtctttgatttgtggatttgaagttctgattagatctcgtccatggtgccttgtggcgagtatagtgagtaggatacgtgagttttcgtgctgacaataaccagttgtatgcggcagaataacatgatgggctactactagtcaagtgtgtaactacagtggaaatggttctcgtggatgaaaacaaaagtttaggttcagcaaatctccagaattgtgcagtttgtgtggatgaagttggttggggacggtctgtcaccagaactctcagccatgcctctcaacagcgaattgtacagcagatttgagagtttgtctgtgcatgtgtgatgcgtacacttttcagcgtgatcagatcacgcttatcgtataggtttgttttgtgtgtaaatgtgcaaaaaagtaatcatacatgttaatcaaatggcatgttttgagtatgcttgagcattatttgaaggaccaaattcgttaatcagaggaagggaaatgg

SEQ ID NO: 2068 - DNA, 964 bp, Saccharum officinarum
cagctgctgacaagcccacaagagcgcacgattgccaggacgacgacgaccaattaagagaggagggcgtccgattccatggagggcggcgagacggcgctgtcggggttcggcggcggcggcgcggggccccccggcgtcgacaccaaggtgctgcacgcgttccagacgagcttcgtgcaggtgcagacgctgctggaccagaaccggctcctcatcaacgagatcaaccacaaccacgagtccaaggtgcccggcgacctctcccgcaacgtcggcctcatcagggagctcaacaacaacatccgccgcgtcgtcgacctctacgccgacctctcctcgctcttcgccgcctccgacggccgcgccgcgtccgagggcggctccgtcggcaccgtccgcctggcggccggcgccgggcacaagaggatcaggtccggcctcgactgactgacttgttggagaattccaccaaagccattcctgattccttcttatcttagctactactccacgagtacagtagctagccaccaccagccgcagcagccaaagggacctcctcccttttctcttctttgacttgagctcttcttatatctatcgacggacggtactcctgcctatctatatctatctagctatctccattacgactgctactattacttactgtgtgatatgagcaagagcaatcctctccttcaattaattaccatcttcttgttgctgctatatgagctactagtacttcgtatgagaggtatgtatttttgatgcaatgcaatgcaatgcaattcatgatgacgcacaagaaaaaaaaaataagggcggcccgtttaaaggatccaacttacgtacacctgcatgcgacggatagctttttattgtgcaccctaatcaattcatggcggcgtttacactatcgttctgtgaaaacctgggtttccacattatatatctt

SEQ ID NO: 2069 - DNA, 683 bp, Cynodon dactylon
tagtaattaactgctagctagctgcacagcgcagccggaaaagatggagggcggcgagacgacgctgtccgggttcggcagcggcgccggcgccggcgtggacaccaaggtgctgcacgcgttccagaccagcttcgtgcaggtgcagagcctgctggaccagaaccgggtgctcatcaacgagatcaaccagaaccacgagtccaaggtgcccggcgacctgtcccgcaacgtcggcctcatcagggagctcaacaacaacatccgccgcgtcgtcgacctctacgccgacctctcctcgctcttcgccaccgccgagggaggacgcgcagcctccgagggcggctcagtcggcacggtgcggcaggccggcgccgggcacaagaggatcaggtccggcctcgactaacttcgttcttctcctagctagcttagctagtggctctcttgacactttgagctgttcttgtatttgtatctacctaccgacaacctacctctgtactcctactactactgtactgtatgtatgagcaaagagcaatcttctcctacaattacttatgatgatcttcttgtagctgacgatgttaatctcactacattgtctgtatgagagctactacttatgaggtactatgatgaatttgggatgcaatacacagtgagaagttctctgcatt

SEQ ID NO: 2070 - DNA, 1156 bp, Setaria italica
agagagagaaagcagcgcggaaggaaggtcggcctggcctgcctgtttcgtgtgtctgaggatctcctgatctcctcctgtccatcgtcatccacctccccactctccttcccccctcgcagcctcgctcctcagtcctccccactctcctccctccgacgcccccccgtctctcatgatctgacggagtacccgacggacggaacctcctcaccggcgatgctacggagtagtaccgagactatgcagagctgacaagtcctcccaaaatttaagtagacgccaagaattcaggcacaggcgcgcagcaagccaacagcaagacgacgaagcggagcagagctactgataaagaagcagaggagggagcgcatcctattccatggagggcggcgagacgacgctgtcggggttcggcggcggcgccggcgccgccggcgccggcgtggacaccaaggtgctgcacgcgttccagacgagcttcgtgcaggtgcagagcctgctggaccagaaccgcgtcctcatcaacgagatcaaccagaaccacgagtccaaggtgcccggcgacctctcccgcaacgtcggcctcatccgggagctcaacaacaacatccgccgcgtcgtcgacctctacgccgacctctcctcgcttttcgccgcctccgacggcggccgcgcggcctccgagggcggatccgtcggcaccgttcggcaggccggcgccggccacaagcggatcaggtccggcctcgactgacttcttgttgttcatcatctcttagctagctagccagggaccgacctctctctccactcttttgacttgagctgttcttgtatctatcgacctatccactacggcactacctatcgtcctatctcccattacgactgctactgttacatatgagcgagagcaatcctctcgactcatgatattcttgtagccgatgttaatcatcttcttgttgctatgagccagtatgaggtaatgtatttttgatgcaattcatggacgatgcaacagcaacacagagcgtgagagaagtttgtctgaaattcccgatctgaaacttctcttgcagctggcagcggcagttcacacttcacagtgctgcatcgatgtgcagtagaactgtacaagtgtggatttcta

SEQ ID NO: 2071 - DNA, 1178 bp, Setaria italica
gagggaggagagtggggaggactgaggagcaaagcagcgcggaaggaaggtcggcctggcctgcctgtttcgtgtgtctgaggatctcctgatctcctcctgtccatcgtcatccacctccccactctccttcccccctcgcagcctcgctcctcagtcctccccactctcctccctccgacgcccctccgtctctcatgatctgacggagtacccgacggacggaacctcctcaccggcgatgctacggagtagtaccgagaccatgcagagctgacaagtcctcccaaaatttaagtagacgccaagaattcaggcacaggcgcgcagcaagccaacagcaagacgacgaagcggagcagagctactgataaagaagcagaggagggagcgcatcctattccatggagggcggcgagacgacgctgtcggggttcggcggcggcgccggcgccgccggcgccggcgtggacaccaaggtgctgcacgcgttccagacgagcttcgtgcaggtgcagagcctgctggaccagaaccgcgtcctcatcaacgagatcaaccagaaccacgagtccaaggtgcccggcgacctctcccgcaacgtcggcctcatccgggagctcaacaacaacatccgccgcgtcgtcgacctctacgccgacctctcctcgcttttcgccgcctccgacggcggccgcgcggcctccgagggcggatccgtcggcaccgttcggcaggccggcgccggccacaagcggatcaggtccggcctcgactgacttcttgttgttcatcatctcttagctagctagccagggaccgacctctctctccactcttttgacttgagctgttcttgtatctatcgacctatccactacggcactacctatcgtcctatctcccattacgactgctactgttacatatgagcgagagcaatcctctcgactcatgatattcttgtagccgatgttaatcatcttcttgttgctatgagccagtatgaggtaatgtatttttgatgcaattcatggacgatgcaacagcaacacagagcgtgagagaagtttgtctgaaattcccgatctgaaacttctcttgcagctggcagcggcagttcacacttcacagtgctgcatcgatgtgcagtagaactgtacaagtgtggatttcta

SEQ ID NO: 2072 - DNA, 1148 bp, Sorghum bicolor
aaacaggtgaaggcagtccatcctgcccgtttcgtgtgtctgaggatctcctgatctccttcctcccttgtcctcctcctcctcccccctcccacatcgtcatccacccccctctccagctcccctcctcctcgccccctcccctccctcccctcctcctactcctccgatgatgatgatccgagcatctgaaggatagatagcaagcaaaggacgctgctcacctccccggagctgctgctgctgctgctacggcggaggaggactgcaactgctactgctactgctacgaggctgactccgcggccgcagctgctgacaagcccacaagagtgcagaattcacagcaccacgacgacgacgacgacgacgaccaggaacaggaggagaggagattaaaaagcgaagatggagggcggcgaggcgacgctgtcggggttcgtcggcggcgggggcggtgcggggggaagccccggcgtggacaccaaggtgctgcacgcgttccagacgagcttcgtgcaggtgcagacgctgctggaccagaaccggctgctcatcaacgagatcaaccagaaccacgagtccaaggtgcccggcgacctctcccgcaacgtgggcctcatcagggagctcaacaacaacatccgccgcgtcgtcgacctctacgccgacctctcctcgctcttcgccgcctccgacgccggccgcgccgcgtccgagggcggctccgtcggcaccgtccgccaggcgcccggcgccgggcacaagcggatcaggtccggcctcgactgacttgactagtcaaattccaaactccttcttagctagtacagtagctagccaccaccagggaacctcccttttctttaacttgagctcttcttgtatctatcgacgtacgccactcctgcctatctataatatctatctagtatctatctatctccattacgacgaccactgctactgttacttactgtgtgatacttatgagcaagagcaaatcctctcctacaattaatcaccatcttcttgttgctactatatgagatacttactagtacttattttgagaggtatgtaatttggatgcaatgcaattcatggtgatgcacgcaacatacagagtgaacttgtctgaatttcca

SEQ ID NO: 2073 - DNA, 1830 bp, Sorghum bicolor
attgaatactacggtcaatgcaaaagcaaacgcatgggcagaaatatcaggaggggacggtacagcgcacaccgacgcgagacgagagcgagagcacacacagacacaggcagaaacgtgtcggaaatctcggcctccctccctctgctctcctctctctccaacagcaaaaagattctccctccatctcctcacgcccggcaataaaaaaaaaaaaacaaaaacaggtgaaggcagtccatcctgcccgtttcgtgtgtctgaggatctcctgatctccttcctcccttgtcctcctcctcctcccccctcccacatcgtcatccacccccctctccagctcccctcctcctcgccccctcccctccctcccctcctcctactcctccgatgatgatgatccgagcatctgaaggatagatagcaagcaaaggacgctgctcacctccccggagctgctgctgctgctgctacggcggaggaggactgcaactgctactgctactgctacgaggctgactccgcggccgcagctgctgacaagcccacaagagtgcagaattcacagcaccacgacgacgacgacgacgacgaccaggaacaggaggagaggagattaaaaagcgaagatggagggcggcgaggcgacgctgtcggggttcgtcggcggcgggggcggtgcggggggaagccccggcgtggacaccaaggtgctgcacgcgttccagacgagcttcgtgcaggtgcagacgctgctggaccagaaccggctgctcatcaacgagatcaaccagaaccacgagtccaaggtgcccggcgacctctcccgcaacgtgggcctcatcagggagctcaacaacaacatccgccgcgtcgtcgacctctacgccgacctctcctcgctcttcgccgcctccgacgccggccgcgccgcgtccgagggcggctccgtcggcaccgtccgccaggcgcccggcgccgggcacaagcggatcaggtccggcctcgactgacttgactagtcaaattccaaactccttcttagctagtacagtagctagccaccaccagggaacctcccttttctttaacttgagctcttcttgtatctatcgacgtacgccactcctgcctatctataatatctatctagtatctatttatctccattacgacgaccactgctactgttacttactgtgtgatacttatgagcaagagcaaatcctctcctacaattaatcaccatcttcttgttgctactatatgagatacttactagtacttattttgagaggtatgtaatttggatgcaatgcaattcatggtgatgcacgcaacatacagagtgaacttgtctgaatttccaactagtttgctgtgacaacaaatttgtcgatgctagactaccttttttttaccccgcatcgttcaccagagaacaaaacaaactcctttcgataacgtaattcaggggatgatgccatgaccatgacgggccccaaaaatccaagggaactcttgagctgtcagacacacacacacaggtgaaaatttttccctggatttcatctctgctttacacacgctgtcagagagaaaagaaagcaatgatctcttgcgcaagctcatgctcatgctatgcacagcagaatctgctgccgctttccatgattgcgagcaagcagctggctctgctttgcctgaaatgcctttttttggttgcccccctttgttttccacgctgtcctgcttctttttctttcgtcatgctcgctcgcttgcggagttcccctgcgacgccaccatttcttctttccagcgctctcg

SEQ ID NO: 2074 - DNA, 863 bp, Zea mays
aagaaaaaaaaaacagaagaaagcagtccagcctgcctctgcctgtttcgtgtgtctgaggatctcctgatctccttcctccctgtccttctcctcccctccccggctacggaggtgctggtgggtgctacggaggagtactacgacgacgacggcgaggaggagcctgtctttttgtttgtggacaagtgaacccacatcctcctcaccgcccatcgcagactctgcgcggctgctgacaaagagtgcagaattgccaaagactagtacgccgacgacgaccagcagcagctgtccgggttccatggagggcggcgacggcgagacgacgctgtccgggttcggcgtcggcggcgtggacaccaaggtgctgcacgcgttccagaccagcttcgtgcaggtgcagacgctgctggaccagaaccgcctcctgatcagcgagatcaaccacaaccacgagtccaaggtgcccggcgacctctcccgcaacgtcggcctcatcagggagctcaacaacaacatccgccgcgtcgtcgacctctacgccgacctctcctcgctcttcgccgcatccgacggcgcgtccgagggcgggtccgtcggcaccgtccgccaggcgggcgccgccggacacaagaggatcaggtccggcctcgactgacctgtttaattaggcagcttccagatcaaccaaccccttcgtcttgtcttagcttagtacctgtaccagtacagtagctatatcatgccagtagtgccaccaccagccagggacctcccttttcatttttgacttgagctcatcttctcaattgcatctgtccacgacgtacgctatatatatatctatccatattatctcc

SEQ ID NO: 2075 - DNA, 1410 bp, Zea mays
agcagaggagataatatggatagatatatatatagcgtacgtcgtggacagatgcaattgagaagatgagctcaagtcaaaaatgaaaagggaggtccctggctggtggtggcactactggcatgatatagctactgtactggtacaggtactaagctaagacaagacgaaggggttggttgatctggaagctgcctaattaaacaggtcagtcgaggccggacctgatcctcttgtgtccggcggcgcccgcctggcggacggtgccgacggacccgccctcggacgcgccgtcggatgcggcgaagagcgaggagaggtcggcgtagaggtcgacgacgcggcggatgttgttgttgagctccctgatgaggccgacgttgcgggagaggtcgccgggcaccttggactcgtggttgtggttgatctcgctgatcaggaggcggttctggtccagcagcgtctgcacctgcacgaagctggtctggaacgcgtgcagcaccttggtgtccacgccgccgacgccgaacccggacagcgtcgtctcgccgtcgccgccctccatggaacccggacagctgctgctggtggtcgtcggcgtactagtcttggcaattctgcactctttgtcagcagccgcgcagagtctgcgatgggcggtgaggctgctgaggaaagcaagccactagctggggcatgggaggacagtgtacaacactagtatatgctacaagatcagatgtacttgccgaatctttccagcttgggcccggaaaactcgacacggatcgatctcggaattaacgaccgcgatttgctttcgctttgctcgaactcgaagacggggcacgatgagcgagaggaatgaatgaacgagggagcgaatccagctccaggcaactcaacaccaggacgattcccaacaagagaagagagcaaggtacggtggtggtgcttcttacctcctcctcgccgtcgtcgtcgtagtactcctccgtagcacccaccagcacctccgtagccggggaggggaggagaaggacagggaggaaggagatcaggagatcctcagacacacgaaacaggcagaggcaggctggactgctttcttctgttttttttttcttttcttcctactagtaggagtattttttttattgtcggccgtgagatggagagaatcttttggcttgcgacggcggcgagggagggcgacattttaggaggcacgtttctgcttctgcccgcgtctcagtctcagcgtctgctgtctgtctgtgtctgctatcatcgccctctgcgtgcgccgcccgctggatgcgttgtacgcggctgtctcctgatatttctgcatcgcatttgacgggcatgagtatctatatttgtttatttatgtggtctttgctactc

SEQ ID NO: 2076 - DNA, 905 bp, Brachypodium distachyon
gagagagagagaaggagagtagggggggcctgccagagctctctgtttcgtgtgtctgaggatctcctgatctcctctttcctctcccatcgtcatccatccccttccccccttcacttcacccctttccctctttcatccatactctaatgatctaatcggcgccccggaaatgctacggaatcccgaggattgaatcaaacagagcctgcagtgtcagcaaaaccagcaagggcgaccttggttagcaccaagaaggcgagaattaggcgcagaggcaagcagcccaagcgaatcatcttcttgtatccatggagggtgacacgctgtcggcgtcggcgcacggcgtggacaccaaggtgctgcacgcgttccagacgagcttcgtgcaggtgcaagggctgctggaccagaaccgggtgctcatcaacgagatcaaccagaaccatgagtccaaggtgcccggcgatctctcccgtaacgtcggtctcattagggagctcaataacaacatccgtcgcgtcgtcgacctctacgccgacctctcctcgctcttcgccgcctcctcaggcggtggcggtggccgtgccacgtccgaagggggatccgtcggcaccatccggcaggctgggcacaagaggatcaggtccggcatggactaaccagctgtcgtgctcttcttgtatctagtagtattatctacattaattgctcatccatcgtgctatataggggtatatgagctagaacaatgcctccatgatatttttcttcctgtagcttgttgctgctatgaggtagtaatcagttgtggatttgatgcaacaatccaaggatgaatctaacagagagtgagcacttctctgaatttaacacccagtatgcaatcatcgatgctgctgtct

SEQ ID NO: 2077 - DNA, 1199 bp, Brachypodium distachyon
gcggaggagagagaggcagaggctgtttgtgagcgaaagacaggaggaggagaggaaacgtgtccgaacgtgccgcaaatctctctccaggaaaagattctctctatctacggagcaacagcaatacgatacgatacgagagagagagagaaggagagtagggggggcctgccagagctctctgtttcgtgtgtctgaggatctcctgatctcctctttcctctcccatcgtcatccatccccttccccccttcacttcacccctttccctctttcatccatactctaatgatctaatcggcgccccggaaatgctacggaatcccgaggattgaatcaaacagagcctgcagtgtcagcaaaaccagcaagggcgaccttggttagcaccaagaaggcgagaattaggcgcagaggcaagcagcccaagcgaatcatcttcttgtatccatggagggtgacacgctgtcggcgtcggcgcacggcgtggacaccaaggtgctgcacgcgttccagacgagcttcgtgcaggtgcaagggctgctggaccagaaccgggtgctcatcaacgagatcaaccagaaccatgagtccaaggtgcccggcgatctctcccgtaacgtcggtctcattagggagctcaataacaacatccgtcgcgtcgtcgacctctacgccgacctctcctcgctcttcgccgcctcctcaggcggtggcggtggccgtgccacgtccgaagggggatccgtcggcaccatccggcaggctgggcacaagaggatcaggtccggcatggactaaccagctgtcgtgctcttcttgtatctagtagtattatctacattaattgctcatccatcgtgctatataggggtatatgagctagaacaatgcctccatgatatttttcttcctgtagcttgttgctgctatgaggtagtaatcagttgtggatttgatgcaacaatccaaggatgaatctaacagagagtgagcacttctctgaatttaacacccagtatgcaatcatcgatgctgctgtctcatgcctggttgcttctgaatcactcccttcagaggattcgtgcatttacttgtctgcttgctctaaaagttgtactagttgacaaaatgctctttcatcttaaaatatatcctgatttggtcaagaataaactaatatatgcctgttttcttga

SEQ ID NO: 2078 - DNA, 612 bp, Pennisetum glaucum
gtcatcccccccgcctcctcttcacttcttccgcttcctcgttctccctcctcctgcggtcgcacgcagccgctgctcctctcagtccttctcttcctccccggcggagtactcagaccgacgggaccggaacctcctccccggagatgctacggcgtagcaccgagactctgcagagctgacagaagtccaccaagatttcagccgcgcagcacggcaacagcaagacgacgaagcggaggatcagataaaagaagcggaggagggagcgcaccctattccatggagggcggcgagacgacgctgtcggggttcggcggcggcggcgccgccggcgcgggcgtggacaccaaggtcctgcacgcgttccagacgagcttcgtgcaggtgcagagcctgctggaccagaaccgcgtccttatcaacgagatcaaccagaaccacgagtccaaggtgcccggcgacctctcccgcaacgtcggcctcatccgggagctcaacaacaacatccgccgcgtcgtcgacctctacgccgacctctcctcgctcttcgccgcctccgacggcggcggcggccgcgcggcctccgagggcggatccgtcggcaccgtc

SEQ ID NO: 2079 - DNA, 2742 bp, Setaria italica
ttccaatggcttggcacctgagtatccttatcatggccacaacctgttttatgttattcccaagaagtgaacagtcttcagagagcgaactgctgcagcagctcaggaagcagctggagtaccccaggcagctggatgcatggggcagcccaagcagcgatccctgctacactcaacccactgcggtacttgctgtaacctgtgagggaaatgccatcacagagctaaagataatcggtgacaggatcaccaaaccaccaaagttcagtggctattctgttcctaatgtcaccctttcagaagcctttgttgttgattcgtttgttactacgttggcaaggttgactaccttgcgggttgttatccttgtgtctttgggcctatggggtcccctcccggataagattcaccgcttgtcttcccttgaagtgcttgatttgagctccaattttctgtatggatcgatccctcctaagctgtcagtcatgtcaaagctccataccgtgacactggatcgtaactatttcaatgaaagtgtgccagattggcttgactcgttctcaaacctcactgttcttcggttgcagagtaacaggctgaaaggatccataccagcatcaattggcaaagctgccatgcttacggagctcgcgcttgctggcaatagcatctcgggggatgttccaaatttagcctacctaaataaacttgagatgctggatttaagggacaatcagttggatggagatcttccagagatgcctacagcattggtaacaatcttactcagcaagaattcactaaagggtgaaattcccaagcagtttggtgagctaaaccggcttcagcaccttgatctctcattcaactttcttgtggggagtcctcctgaagggctctttgctctccccaacatcagttatctgaacttggcagcaaatatgcttagtggatcactctcgagtagcttaacatgcagcagtactctgggctttgtggacctgtccactaaccgactcacaggtgatctgcctgcttgtctgaatggcaatatgaataacaaggtcgttaagtttgatgggaattgctttagtgttggccctgctcaccagcatgaagctaaatattgccaacaatctcataagggatcaaacaaggatgttggacttgtagtcactgttgtcggtattttgtttattgtgcttgtgctttctctggtgttaatggcttcaaacagaagaagctgtcagaaagttcttgctgaacaacagttcctgcaaaagcataaacaagataattcaacttcaggaatgtcctcagaattgttagttaatgcaaggtgtatatctcaagctgtcaaattaggaacacaaatacagccttcatatcgcatattttctttagaggaactcaaggaagcaacaaaaagctttgaaaggtcagcatttttaggcgagggagcaattggaaagctatacaagggaaagctagagaatggcaccctgattgccataagatgtttggcattacaccagagatattcaatcagaaatttaaagcttcgtttagatctccttgcaaagcttcgccacccaaatttggtttgcctcttggggcactgcattgatagtgcagttgatgaatcaagtgtgaagagggtatttcttgtatatgaatatgttcctggtggaactctctcttcttatctttctggctctagtccagagaagaccctaaagtggtgtgataggctgcagttgctgattgccatagctaaggctgttcatttcctacatacaggaataattcctggttccttatataaccggctaaaatcttctagtattttgcttgacgaacaccttgtgtcaaagttgagcgactatggattatcgataatcacagaggagatatacaaacatgaggtagtagaagagaaaagatacttacaaaacaatgctgcagaaacggaggattcggaggatgatgtctactcctttggttgtattctactggaagcacttatgggaccaaaattacatgaaaaagggggcccttttgttttaaatgatttggttgcgtcaatatcatgccaggaagagcgagaggaagttctggattcagtcgttattggcacttcatcacaggactccttgtccatagtggtttctatcatgatcaaatgcctatctgcccaatcctcaacccgaccgtccatcgaagaggttctctggaacctgcaatatgctgcacaagttcaggtgacaactgatggtgatcagagatcagaagtttcctcacaagcatgttagcatacctgaaaatagcaacatggaagcaatctggaacccagtggcatctgtatatttttgcagtttaaatagcatgctaagttctgtaagcttagcggggatatggttatctagctactcccagtgaaggatagccggcggcggtaacattttccctgctagcagaacgagtgcgtcaccatggtgttatgtagagcttccagcattttgccatgaatttcacacctccgtcgtcaatccagaaatgcagcacatgctgcgttcactcagagcatagaactaggtagctccacttccacaaaatcaagaattgttgcagacctgttgcgctttctaaatgcttcatgataaaacgaaacataagaatttaaaaaaaaaagaaaatgtatttttcaccttcaagtattgtaaaagtgtgaatttcatccct

SEQ ID NO: 2080 - DNA, 2617 bp, Setaria italica
ttccaatggcttggcactgagtatccttatcatggccacaacctgttttatgttattcccaagaagtgaacagtcttcagagagcgaactgctgcagcagctcaggaagcagctggagtaccccaggcagctggatgcatggggcagcccaagcagcgatccctgctacactcaacccactgcggtacttgctgtaacctgtgagggaaatgccatcacagagctaaagataatcggtgacaggatcaccaaaccaccaaagttcagtggctattctgttcctaatgtcaccctttcagaagcctttgttgttgattcgtttgttactacgttggcaaggttgactaccttgcgggttgttatccttgtgtctttgggcctatggggtcccctcccggataagattcaccgcttgtcttcccttgaagtgcttgatttgagctccaattttctgtatggatcgatccctcctaagctttcagtcatgtcaaagctccataccgtgacactggatcgtaactatttcaatgaaagtgtgccagattggcttgactcgttctcaaacctcactgttcttcggttgcagagtaacaccataccagcatcaattggcaaagctgccatgcttacggagctcgcgcttgctggcaatagcatctcgggggatgttccaaatttagcctacctaaataaacttgagatgctggatttaagggacaatcagttggatggagatcttccagagatgcctacagcattggtaacaatcttactcagcaagaattcactaaagggtgaaattcccaagcagtttggtgagctaaaccggcttcagcaccttgatctctcattcaactttcttgtggggagtcctcctgaagggctctttgctctccccaacatcagttatctgaacttggcagcaaatatgcttagtggatcactctcgagtagcttaacatgcagcagtactctgggctttgtggacctgtccactaaccgactcacaggtgatctgcctgcttgtctgaatggcaatatgaataacaaggtcgttaagtttgatgggaattgctttagtgttggccctgctcaccagcatgaagctaaatattgccaacaatctcataagggatcaaacaaggatgttggacttgtagtcactgttgtcggtattttgtttattgtgcttgtgctttctctggtgttaatggcttcaaacagaagaagctgtcagaaagttcttgctgaacacagttcctgcaaaagcataaacaagataattcaacttcaggaatgtcctcagaattgttagttaatgcaaggtgtatatctcaagctgtcaaattaggaacacaaatacagccttcatatcgcatattttctttagaggaactcaaggaagcaacaaattgaaaggtcagcatttttaggcgagggagcaattggaaagctatacaagggaaagctagagaatggcaccctgattgccataagatgtttggcattacaccagagatattcaatcagaaatttaaagcttcgtttagatctccttgcaaagcttcgccacccaaatttggtttgcctcttggggcactgcattgatagtgcagttgatgaatcaagtgtgaagagggtatttcttgtatatgaatatgttcctggtggaactctctcttcttatctttctggctctagtccagagaagaccctaaagtggtgtgataggctgcagttgctgattgccatagctaaggctgttcatttcctacatacaggaataattcctggttccttatataaccggctaaaatcttctagtattttgcttgacgaacaccttgtgtcaaagttgagcgactatggattatcgataatcacagaggagatatacaaacatgaggtagtagaagagaaaagatacttacaaaacaatgctgcagaaacggaggattcggaggatgatgtctactcctttggttgtattctactggaagcacttatgggaccaaaatccttttgttttaaatgatttggttgcgtcaatatcatgccaggaagagcgagaggaagttctggattcagtcgttattggcacttcatcacaggactccttgtccatagtggtttctatcatgatcaaatgcctatctgcccaatcctcaacccgaccgtccatcgaagaggttctctggaacctgcaatatgctgcacaagttcaggtgacaactgatggtgatcagagatcagaagtttcctcacaagcatgttagcatacctgaaaatagcaacatggaagcaatctggaacccagtggcatctgtatatttttgcagtttaaatagcatgctaagttctgtaagcttagcggggatatggttatctagctactcccagtgaaggatagccggcggcggtaacattttccctgctagcagaacgagtgcgtcaccatggtgttatgtagagcttccagcattttgccatgaatttcacacctccgtcgtcaatccagaaatgcagcacatgctgcgttcactcagagcatagaactaggtagctccacttccacaaaatcaagaattgttgcagacctgttgcgctttctaaatgc

SEQ ID NO: 2081 - DNA, 728 bp, Sorghum bicolor
cagcgatgcatcaggcatgggcatcggcacgtcgggtcgttccgtgccctatccgttgccggccgtcacaacagcagcagcgccgcctccctgttgccttgactctggcagcagaaaccagcggcgagtcgtcggcgacggcgagggaaggccaaggcttggcctgagagaatgcaagacccaagggatgatgatttctcagcaccaaagctgcataagaagaaggttgtgtaccggccactgccatcaggccagctcaagggtgaacctgaactgctgcggagagagtttccacagtcatcaggcatggtccaaaagccacccaaaagaagcttgaaggttgagcctcacacgtccccttctgacagagggactccagattccctgacggaatctggtcctactgatgaataccgggcgttacggaggaagtacctgatgctggaggaagagaactttgcactggacaaagaactgagcatggaagaggaagaaatgaaggccctagaggatgaaaagcttgcactgcttgatcagcttgttgtcttggaaggtcttgtggagccatcccagctgcagtctcagcgtaggccgtgaggtgttttggtttatgtgtaatctcgttgtcgttcagtgtaatactgcaactagtagatgttaaactttctgggtctgaacagtgtgtagaaacagcataaacctgttatcggcgaataaaaaactcttat

SEQ ID NO: 2082 - DNA, 1114 bp, Sorghum bicolor
cgtcgcctgggcctccgttagaaatcttccgacccgaccaggcagccgcactctgttcgccggcggcagtcgctggcggcaacgggcggatggcatggcacaaggctactgctagtttgtagtaggaaacaatccgattcctctccccggccgcccccagcccccagccccctaacgcctgacctgaggaatcctgtccgcgtcgccgtctccagctctccgcctccagccctccatacagcacactgccgccccgcgccccctgacggccgagtgcccaacggagggaggaatcgaggaaggcagccggcgcacctgggaaggccaaggcttggcctgagagaatgcaagacccaagggatgatgatttctcagcaccaaagctgcataagaagaaggttgtgtaccggccactgccatcaggccagctcaagggtgaacctgaactgctgcggagagagtttccacagtcatcaggcatggtccaaaagccacccaaaagaagcttgaaggttgagcctcacacgtccccttctgacagagggactccagattccctgacggaatctggtcctactgatgaataccgggcgttacggaggaagtacctgatgctggaggaagagaactttgcactggacaaagaactgagcatggaagaggaagaaatgaaggccctagaggatgaaaagcttgcactgcttgatcagcttgttgtcttggaaggtcttgtggagccatcccagctgcagtctcagcgtaggccgtgaggtgttttggtttatgtgtaatctcgttgtcgttcagtgtaatactgcaactagtagatgttaaactttctgggtctgaacagtgtgtagaaacagcataaacctgttatcggcgaataaaaaactcttatgaatatttgcagggtcggcaacttcttagtgtgtttgtgtaaagtatggagaatcagaagaaaatttagttgcgaagtttagtttggtgcgtatgaagccttgttgcggcttacctgaagttgagctcatgatgtgtaacaggaatgatgcacttgttttcatacttaatgggtaatgcctacgaggaaattggttgcgtcataactcataag

SEQ ID NO: 2083 - DNA, 757 bp, Saccharum officinarum
gcgatgcatcaggcatgggcatcggcgtgtcgggcgtgtcctatccgtcgccggcggtcacaacagcagttgtgccgcctccctatcgccctgactctggcagcagaaaccggcggcaagtcgtcagcgacggcaagggaaggccaaggcttggcctgagagaatgcaagacccaagggatgatgatttttcagcgccaaagttgcataagaagaaggttgtctaccggccactgccatcaggccagctcaagggtgaacctgaactgctgcggagagaggttccacagtcatcaggcatggtccataagccacccaaaagggacacccaaaagaagcttgaaggctgagcctcacacgtccccttctgacagagggactccagattccctgccggaatctggtcctaccgatgaataccgggcgttacggaggaagtacctgatgctggaggaagagaactttgcactggacaaagaactgaacatggaagaggaagaaatgaaggccctagagaatgaaaagcttgcactgcttgatcagcttgttgtcttggaaggccttgtcgagccgtcccagttgcagtctcagcgtaggccgtgaggtgttttggtttatgtataatcgttgtcgttcagtgttaatctgcaactagtagctgttatactttctgggtctaaacagtgtgtagaaatagcataaacctgttatatcgtccatcggcgaataaaaaactcctatgaatgtttgcaggggtc

SEQ ID NO: 2084 - DNA, 1084 bp, Panicum virgatum
gcctctccgaagacatttgtgaagctgcgatgggggctagggtttcctagtgcctcttccctccatcgccgccttcgctcagcgctccgctccacccggacggtagatcgagtcttctccaagtcaaatcacatttggatctctaggcgtgcgcgaggagacaaggagcgagcagatcagcaccgcacctgctcctgggcagcggcgagcagattggcaccctcctccccatcggcgacctccctctccgtcgggcatcagcgaataggggccgttcccgtccgcagcttcactccccaccagggattcgacaccgtctgcgcctccttcccgttctggtgtgagcgtcactgaaacagcaagatcggtgccccgacgtcccatcgacgacctccctcaaccgcacggagaggccggggtttggcctgagagaatgcaagatcctaacggcgacgatttctctgccccaaagttgcacaagaagaaggttgtataccggccgcttccatcaggcatgctgaagggtgaacctgaactgctgcgtagagaggttccgcattcatcaggcatggtccataagctgcccaaaagaagcttgaagagtgagcgccctgccacacctccatctgacagagggactcctgattccctgccggactctggtcctaccgatgaatatcgtgcgctgcggaggaaatacatgatgctggaggaagagaactttgccctggaccaagaactgaacatggaagatgaggaaatcaaggcacttgaggaggaaaagcttgcccttcttgatgagctcgttgtcttggaaggccttgttgagccatcgcagctgcagtctcaccgtaggccatgagtgtagtattttggtttctgactttctgtgattgctgtcgtttagtgcaattcagtaaccggtacctgttaatacgttctggatgtaaacattgtggttgaaatagcataaacctgttatgaatcgaaaaccccttagattaatcctagcagggtcagctacttgtgttttgtgtaacatgatagggtattacaatcagatgaaaatttggttgcaagggta

SEQ ID NO: 2085 - DNA, 987 bp, Setaria italica
acactttgtgttatggctgccagttcctcttcttcctctcgccgtctccctcacccccatccagatctacaaattgtgccgatgattgctcgcccccttcccgtcccttcaacaacaactcaccctccttcccatccatcattgttcgcccacctgccttccctctcaccggtggcatattacctccctccccttcgcttggtgtctcctcccctcccaccaggtcctcctcatctgttaccacaaggcaagtctcacaagcggaggcgggcaccatcatcgcgcacaactaggaatggaaactccaaggctttgcctgacaggatgcaagacccaagcggtgatgatttccctgccccaaagttgcacaagaagaaggttgtgtaccggccgcattcatcaggccagctgaagggtgaacccgaactgctgcggagagacgttccgcattcatcaggcatggcccaaaagccacccaaaagaagcttgaagagtgagcgccctgccactcctccatctgacagaggaactccagattccctgccagactctggtcctaccgatgagtaccgtgcactacggaggaagtacatgatgctggaggaagagaactttgccctggacaatgaactgcgcatggaagatgaggaaatcaaggcacttgaggaggaaaagcttgcacttcttgatgagcttgttgtcttagaaggccttgtcgagccatcgcagctgcagtttcagcgtaggccgtgagaggcatttggtttctgtgatcgtcgtcgttcagtgtaattcagcaactggtagctgttaatactttctggatgtaaacattgtggttgaaacagcataaacctgttatgaattgaactcccttggatgaatgttttgaagggtcggcaagttgttagcgtataagatgatagggtatgagaatcagataaatttcggtcgcgaaggtagttcagtgcatatgaaacctgctta

SEQ ID NO: 2086 - DNA, 1092 bp, Setaria italica
gggatggcgcgttggttcttccgcgtctgcgccgcccgcggcctcccaccgccgcccgcggcctcccaccgccgcccgccgcccagccgcctgagtgcccaacgcgccatcccttctacttctccaggctacgcggcgccgctctggtctaggccgccccgcccgttctcctggtgcccgacgccgcgacgggggtcctggcctcctgcgcggcttcgccctgagaacctgaggctgagtcccctgacgtcgacgggccattgcggcgcgcggcagatcagcaacgggcagccatcccgagatcgtaatcggcagcagcaaatcccatcactggaaactccaaggctttgcctgacaggatgcaagacccaagcggtgatgatttctctgccccaaagttgcacaagaagaaggttgtgtaccggccgcattcatcaggccagctgaagggtgaacccgaactgctgcggagagacgttccgcattcatcaggcatggcccaaaagccacccaaaagaagcttgaagagtgagcgccctgccactcctccatctgacagaggaactccagattccctgccagactctggtcctaccgatgagtaccgtgcactacggaggaagtacatgatgctggaggaagagaactttgccctggacaatgaactgcgcatggaagatgaggaaatcaaggcacttgaggaggaaaagcttgcacttcttgatgagcttgttgtcttagaaggccttgtcgagccatcgcagctgcagtttcagcgtaggccgtgagaggcatttggtttctgtgatcgtcgtcgttcagtgtaattcagcaactggtagctgttaatactttctggatgtaaacattgtggttgaaacagcataaacctgttatgaattgaactcccttggatgaatgttttgaagggtcggcaagttgttagcgtataagatgatagggtatgagaatcagataaatttcggtcgcgaaggtagttcagtgcatatgaaacctgcttatctgaagttgagctcatgatgcggaacaggaatgatgcactatctacatattttatctggtgatgactac

SEQ ID NO: 2087 - DNA, 1243 bp, Panicum virgatum
gcaaaaacggaaagcgactccacttcccttccgactccccggcgtccttaatcaaaaaaaaaaaaagactccccggcgtccccgctcctctcggctcccgaagacatggcgatgggggctagggtttcctagtgccgccccatccatggcctcctccgctcagctctccgctccaccctgccggtagatcgagtcttctagtgcgtcagcgcatttggatctctaggcgtgcgcgaggagacaaggggcctgggcagcggcgagcagattgacaccctcctccccatcggcgacctccctctttgtcgagcatcagcgaataggggccgtccccttccgcagcttcactccccaccagggattcgacaccgtctgcgcctccttcctgttctggtgtcagcgtcactgcaacagcaagatcggtgccccgacgtccccatcgacgacctccctcaaccgcacggtctcagcttcgtttccacaacgcttggcctgagaatgcaagaccctaacagcgacgatttctctgccacaaagctgcacaagaagaaggttgtataccggctgcttccatctggcatgctgaagggtgaacctgaactgctgcgtagagagggtccgcattcatcaggcatggtccataagccacccaaaagaagcttgaagagtgagtgccctgccacacctccatctgacagagggactcctgattccctgctggactccggtcctactgatgaataccgtgctttgcggaggaaatacatgatgctggaggaagagaactttgccctggaccaagaactgagcatggaagatgaggaaatcaaggcacttgaggaggaaaagcttgcgtttcttgatgagctcgttgtattggaaggccttgttgagccgtcgcagctgcagtctcaccgtaggccatgagtgtagtattttggtttctgtgatcgttgtcgttcagtgcaattcagtaaccggtacctgttaatactttctggatgtggaaattgtatttgaaacagcataaacctgttatgaatcgaaaccccttagatgaatgcttgcagggtcagcgacttgtgttttgtgtaacatgatattacaataggatgaaaatttggttgcaagggtaattcatagtgcttatgaagcctgattggctgaagttgagctcatgatgcggaataggaatatctgggtggtgactacagggaaatattatggttctgatactactgtc

SEQ ID NO: 2088 - DNA, 595 bp, Pennisetum glaucum
ggcccaggatttgccggacaggatgcagaacccaagcggtgatgatttccctgccccaaagctgcacaagaagaaggttgtgtaccggccgcattcatcaggccagctgaggggtgaacccgaattgctgcggagagatgttccgcattcatcaggcatggtccaaaagccacccaaaagaagcttgaagagtgagcgccctgtcactcctccatctgacagagggactccagattcccagccagactctggtccaactgatgagtaccgtgcactacggaggaagtacatgatgctggaggaagagaactttgccctggacaatgcactgcgcatggaagatgaggaaatcaaggcacttgagtcagaaaagcttgcacttcttgatgagctcgtcgtcttagaaggccttgtcgatccgtcggagctgcagtctcagcgtaggccgtgagaggcatttggtttctgtcatcattgtcgttcagtgtaattcagcaacccgtagctgttaaagtggtaatactttctggatgtaaacagcgtggttgaaacagcaacagcataaacctgttatgaattgaaaccccttggtttg

SEQ ID NO: 2089 - DNA, 2925 bp, Saccharum officinarum
gtcgacccacgcgtccgaacaggttgcactccactcacaccgcgctgcccacccgcctttataacgcggcgagcccagtgcggaggcagagaacccaaggacgcgcatcgccttccccttcctcgctcctcttcgagatccgcgcggaggaccaccgcgaccgctccggtcggttccggcgaggtgccgcgcggctgtagcagcctagagcagacaaagctctgatttttgggggttcttagtccagccgtagttgttggagacaaaccgcgtgaaggtcggtgctccggtacatgttcgccaggcactgatggcatttggccgaggtgggaagatggacggccgccggccgtcgtcgtcgtcgtcgtcgtcgtcgttctgcacgaccaccacggtcgtcgtctttgtggcgctctgcctggtcggcgcgtggatgatgacctcgtccactgtcttcccgctggagatctcatcgaataagaagccggtgatgaagcaacagcctgcgcctgtcaattttggggcgtcacaggagacaccatctggcaatgctggtgaaggttctgagaaatttgaggacaccgacaacaacgatgccacggtcccagaggagccgaataacaaggatgcccctgaggaagagaagttcactgagaaaccagaggagaagcctgaagagaaggagccggaagtgccgacagagaaagcggagaccaaggatatgtttgatgatgcaaatgggaaatcagaagggcggtcagatgacttgaagaatgatgatgatggggagaagagtggggagaagaaagatgatgaaatcacaaatgagagtggtgatgaaaaacctgatggtgagagcaaggacgatcaagaagagaagcctgaaggtgatgtcactcaggaggagcaacctcaaatagaagagaaggtggaagaaaatggagagaaggatcagagctctaactccaacgaggtgtttcctgatggggcccaatcagagcttctgaaggagtcaaatacccagaatggttcattccccacacaggctgcagaatcaaagaatgaaaagaaagtccaagcgtcatccaagtcttcaggtgatgcgaccagctatacctggaaattatgtaatagcagtgcctcgacagattacataccttgccttgacaacgagaaggctatcaagaagcttcgaactaccaaacattatgaacatcgtgagaggcattgccctgaggagcctcctacctgccttgttccactcccagaaggatataaacgcccaattgagtggccaaagagcagggacaaggtatggtacagcaatgttcctcacactaggctcgcagagtacaaggggcatcaaaattgggttaaagtctcaggtgactacctcctgttccctgggggtgggactcagttcaagaatggtgccctccactatattgatactattcagcaggcactgcctgatattgcatggggcaaacgaagccgtgtcattctagatgtcggttgtggagttgccagctttggagggtacatgtttgatagagatgtgcttaccatgtcttttgctccgaaagatgagcatgaagctcaagtacagtttgcattagaaaggggaattccagcaatatcagctgtgatgggcaccaagagacttccataccccagcagagtctttgatgtcattcattgtgctcgctgcagggtcccttggcacattgaaggtggcatgcttttgctggaattgaaccgattgctacgacctggtggttactttgtctggtctgccactcctgtttaccaaaagctcccagaggatgttgagatttggaatgcgatgtccactttgacaaaatccatgtgctggaagatggtcaacaagactaaggataagttaaatcaagttggtatggtcatatttcagaagccaatggacaacgtttgctacgagaaaagatccaaaaacaacccaccattgtgcaaggaatctgatgatgcagacgctgcttggaatgtacctttggaagcatgcatgcacaaactgcctgttggctcgaaagttcgaggatcaaaatggccagagttttggccgcaaaggcttgagaagacccctttctggattgatgcttccaaggttggtgtctatggaaagcctgcaaatgaagattttgaggcagataatgctcactggaaacgggttgtaagtaaatcgtatgtgaatggcatgggaattgactggtccaaagtgagaaatgtcatggacatgagagctgtgtatggcggttttgctgcagctctgagggaccaaaaggtctgggtcatgaatattgtgccgattgattcaccagacacactgcccatcatttacgagcgtggcttgtttggtatgtaccatgactggtgcgagtctttcagcacttacccaagaacgtatgaccttctgcacgcggaccatctattctcaaagctcaaaaagagatgcaaattgacggcagtttttgccgaggttgatcgtgtattgaggccacaaggcaaactgattgtgagggacactgcagacacaataaatgaactggaaagcatggccaagtccctgcagtgggaggtgcgaatgacctacaccaagggcaacgagggcttgctctgcgtcgagaagtcgatgtggcggcccaaggaacttgatgcaagcacgtgaaatatatgtgttgaagaaaactggtaccaagtagggtaaaattagaggaattttgtcgctagatatgcatatgattcttgttgatgctgaaaggacaaactctttggcgtaactgtagaataatacagatctgtttttccccatttgttgtttcattcacaacgcagctgtaagatagtgtgctggaaatcacaggtacattcagttcaatcgggcccctt

SEQ ID NO: 2090 - DNA, 2982 bp, Sorghum bicolor
gcccgcccgcctttataacgcggcgaggcccagtgcggtggcagagaacccaaggacgcgcatccgccttccccttcctcgctcctcttcgagatccgcgcggagggccaccgcgaccactccggtcggttccggcgaggtgccgcgcggctgtagcagcacaaagcagacaaaggtgcgatttttttgggggttcttggtccagcagtagttggtggagataaatcgcgtgaaggtcggtgctctggtacatgttcgccaggcactaatggcatttggccgaggtgggaagatggacggccgccggccgtcctcgacgtcgtcgtcgttctgcacgaccaccacggtcgtcgtctttgtggcgctctgcctggtcggcgcgtggatgatgacctcgtccactgtcttcccgctggagatctcctcgaataagaagccggtggtgaagcagcagcctgcgcctgtcaattttggggcctcacaggacaatgctggtgaaggttctgagaaatttgaggacaccgacaacaatgatgccacgatgccggaggagccgaataacaaggatgccacgatggaagagaagttcactgagaagccagaggagaagcctgaagagaaggagccggaagtgccgacagagaaagctgagaccaaggatatgtttgatgatgcaaatggaaaatcagaagggcggtcagatgacatgaagaacgatggtgacggggagaagagtggggagaagaaagatgatgaaatcacaaatgagagtggtgatgaaaaacctgatggagagagcaaggatgatcaagaagagaagcctgaaggtgatgccactcaggaggagcaacctcagatagaagagaaggtggaagaaaatggagagaaggatcagagctcaaactccaacgaggtatttcctgatggggcccaatcagagcttctgaaggagtcaaatacccagaatggttcattccccacacaggctgcagagtccaagaatgaaaaggaagtccaagcgtcatcaaagtcttcaggtgatgcgactagctattcctggaaactatgtaatagcagtgcctcgacagattacataccttgccttgacaacgagaaggctatcaagaagcttcgaactactaaacattatgaacatcgtgagaggcattgccctgaggagcctcctacctgccttgttccactcccagaaggatataaacgcccaattgagtggccaaggagcagggacaaggtatggtacagcaatgttcctcacactaggctcgcagagtacaagggacatcaaaattgggttaaagtatcaggtgactacctcctgttccctgggggtgggactcagttcaagaatggtgccctccactatattgatactattcagcaggcactgcctgatattgcatggggcaaacgaagccgcgtcattctagatgtcggttgtggagttgccagctttggaggctacatgtttgatagagatgtgcttaccatgtcttttgctccgaaagatgagcatgaagctcaagtacaatttgcattagaaaggggaattccagcaatatcagctgtgatgggcaccaagagacttccataccccagcagagtctttgatgtcattcattgcgctcgctgcagggtcccttggcacattgaaggtggcatgcttttgctggaattgaaccgcttgttacgccctggtggttactttgtctggtctgccactcctgtttaccaaaagctcccagaggatgttgagatttggaatgcgatgtccactttgacaaagtccatgtgctggaagatggtcaacaagactaaggataagttaaatcaagttggtatggtcatatttcagaaaccaatggacaacatttgctatgagaaaagatccgaaaacaacccaccattgtgcaaggaatctgatgatgcagatgcagcttggaatgtacctttggaagcatgcatgcacaaactgcctgttggctcgaaagttcgagggtcaaaatggccagagttttggccacaaaggcttgagaagactcctttctggattgatggttccaaggttggggtctatggaaagcctgcaaatgaagatttcgaggcagataatgctcactggaaaagggttgtaagtaaatcgtatgtgaatggcatgggaattgactggtccaaagtgagaaatgtaatggacatgagagctgtgtatggaggttttgctgcagctctgagggaccaaaaggtctgggtcatgaatattgtgccgattgattcaccagacacactgcccatcatttacgagcgtggtttgtttggtatgtaccatgactggtgcgagtctttgagcacttacccaagaacttatgaccttctgcacgcggaccatctattctcaaagctcacaaagagatgcaaattgatggcagtttttgccgaggttgatcgtgtactgaggccccaaggcaaactgattgtgagggacactgcggacacaataaacgaactggaaagcatggccaagtccctgcagtgggaggtgcgaatgacctacaccaagggcaacgagggcttgctttgcgtcgagaagtcgatgtggcggcccaaggaactcgatgcaagcacgtgaaatatatgtgttgaagagaactgttaccaagtagggtaaaattagaggaatttttgtcactagatatgcatatgattcttgttgatgctgaaaggacaaactctttggtgtaactgtagaataatacacatctgttttcccccatttgttgtttcattctcaacgctgctgtaagatagtgtgctggaaatcactggtacattctgttcaattgggcagcttcttcagtttgtcggatagcagtcgaacaatcttgtgcataattgcatatgctatatttgaactgttgtgcaagtcgttgttaaacgcccaagtctacagcgacttgcttggtgcta

SEQ ID NO: 2091 - DNA, 3119 bp, Sorghum bicolor
atctaacccaagtactagtatagcgtataattacgtacggtcgtctaatgcgaacccatctcctccgcttccgcttccgcctcttcacacactacacaacagattgcactccactcacactgcgctgcccgcccgcccgcccgcctttataacgcggcgaggcccagtgcggtggcagagaacccaaggacgcgcatccgccttccccttcctcgctcctcttcgagatccgcgcggagggccaccgcgaccactccggtcggttccggcgaggtgccgcgcggctgtagcagcacaaagcagacaaaggtgcgatttttttgggggttcttggtccagcagtagttggtggagataaatcgcgtgaaggtcggtgctctggtacatgttcgccaggcactaatggcatttggccgaggtgggaagatggacggccgccggccgtcctcgacgtcgtcgtcgttctgcacgaccaccacggtcgtcgtctttgtggcgctctgcctggtcggcgcgtggatgatgacctcgtccactgtcttcccgctggagatctcctcgaataagaagccggtggtgaagcagcagcctgcgcctgtcaattttggggcctcacaggacaatgctggtgaaggttctgagaaatttgaggacaccgacaacaatgatgccacgatgccggaggagccgaataacaaggatgccacgatggaagagaagttcactgagaagccagaggagaagcctgaagagaaggagccggaagtgccgacagagaaagctgagaccaaggatatgtttgatgatgcaaatggaaaatcagaagggcggtcagatgacatgaagaacgatggtgacggggagaagagtggggagaagaaagatgatgaaatcacaaatgagagtggtgatgaaaaacctgatggagagagcaaggatgatcaagaagagaagcctgaaggtgatgccactcaggaggagcaacctcagatagaagagaaggtggaagaaaatggagagaaggatcagagctcaaactccaacgaggtatttcctgatggggcccaatcagagcttctgaaggagtcaaatacccagaatggttcattccccacacaggctgcagagtccaagaatgaaaaggaagtccaagcgtcatcaaagtcttcaggtgatgcgactagctattcctggaaactatgtaatagcagtgcctcgacagattacataccttgccttgacaacgagaaggctatcaagaagcttcgaactactaaacattatgaacatcgtgagaggcattgccctgaggagcctcctacctgccttgttccactcccagaaggatataaacgcccaattgagtggccaaggagcagggacaaggtatggtacagcaatgttcctcacactaggctcgcagagtacaagggacatcaaaattgggttaaagtatcaggtgactacctcctgttccctgggggtgggactcagttcaagaatggtgccctccactatattgatactattcagcaggcactgcctgatattgcatggggcaaacgaagccgcgtcattctagatgtcggttgtggagttgccagctttggaggctacatgtttgatagagatgtgcttaccatgtcttttgctccgaaagatgagcatgaagctcaagtacaatttgcattagaaaggggaattccagcaatatcagctgtgatgggcaccaagagacttccataccccagcagagtctttgatgtcattcattgcgctcgctgcagggtcccttggcacattgaaggtggcatgcttttgctggaattgaaccgcttgttacgccctggtggttactttgtctggtctgccactcctgtttaccaaaagctcccagaggatgttgagatttggaatgcgatgtccactttgacaaagtccatgtgctggaagatggtcaacaagactaaggataagttaaatcaagttggtatggtcatatttcagaaaccaatggacaacatttgctatgagaaaagatccgaaaacaacccaccattgtgcaaggaatctgatgatgcagatgcagcttggaatgtacctttggaagcatgcatgcacaaactgcctgttggctcgaaagttcgagggtcaaaatggccagagttttggccacaaaggcttgagaagactcctttctggattgatggttccaaggttggggtctatggaaagcctgcaaatgaagatttcgaggcagataatgctcactggaaaagggttgtaagtaaatcgtatgtgaatggcatgggaattgactggtccaaagtgagaaatgtaatggacatgagagctgtgtatggaggttttgctgcagctctgagggaccaaaaggtctgggtcatgaatattgtgccgattgattcaccagacacactgcccatcatttacgagcgtggtttgtttggtatgtaccatgactggtgcgagtctttgagcacttacccaagaacttatgaccttctgcacgcggaccatctattctcaaagctcacaaagagatgcaaattgatggcagtttttgccgaggttgatcgtgtactgaggccccaaggcaaactgattgtgagggacactgcggacacaataaacgaactggaaagcatggccaagtccctgcagtgggaggtgcgaatgacctacaccaagggcaacgagggcttgctttgcgtcgagaagtcgatgtggcggcccaaggaactcgatgcaagcacgtgaaatatatgtgttgaagagaactgttaccaagtagggtaaaattagaggaatttttgtcactagatatgcatatgattcttgttgatgctgaaaggacaaactctttggtgtaactgtagaataatacacatctgttttcccccatttgttgtttcattctcaacgctgctgtaagatagtgtgctggaaatcactggtacattctgttcaattgggcagcttcttcagtttgtcggatagcagtcgaacaatcttgtgcataattgcatatgctatatttgaactgttgtgcaagtcgttgttaaacgcccaagtctacagcgacttgcttggtgctaccg

SEQ ID NO: 2092 - DNA, 2989 bp, Setaria italica
ctgtgcgtgcgcgcccgccctccctttataacgcggcgaggccagcgcggaggcagagagcccaaggacgcgcctcgcctcgtcgcctccttttcgagatccgcgcggaggccggcctcgaccgctccgattccggcgaggtgccgcgcggcctagaggctactacagcagacaagctgcggtttttggggttcttggtcgacccggtagttggtgcagacaaatcgcgtgaagcttggtgacctgtacatgtgcgtgagggactgatggcatttggccggggtgcaaagatggacggccgccggccgtcctcgtcgtcctcgtcgttctgcacgaccaccacggtcgtcgtctttgtggcgctctgcctggttggcgcgtggatgatgacgtcgtccaccgtcttcccgctggagatttcgtcgaataagaagtctgtggtgaagcaacagccagcgcctgttaacttcggtgcgtctgaggatgcagcatctggcaatgctggtgaaagttctgggaaatttgaagataccgacaacaacgacaccactgtcccagaagagtcgaataacaaggaagctcctgaggaagagaagttcaccgagaacatggcggagaagcctgaagagaaggagcaggaaccaccaagagagagagaggagaacaaggatatgtttgacgatgcaaatggaaaatcagaagggcggtcagatgatgtgaagaatgacaatgatgatggagataagagcgaggaaaagaaagatgatgaaatcacaaatgagagtggtgatgagaaacctgacggtgagaggaaggatgatcgagaagaaaagtctgaaggtgatgccactcaggaggagcaacctcaaatagaagagaaggtggaagaaagtggagagaagaaggaacagagctcaaactctaatgaggtatttcctgatggggctgaatcagagcttctaaaggagtcaaatacccagaatggttcgttccccacacaggctgcagagtcaaagaatgagaaggaagttcgagcatcatcaaaatcatcaggtgatgagtccagctatagctggaaactatgcaatagcagtgcctcgacagattatattccttgccttgacaatgagaaggctatcaagaagcttcgaagtaccaaacattatgaacatcgtgaaagacattgccctgaggagcccccgacctgccttgttccactcccagaaggatataaacgcccaattgaatggccaaagagcagggacaaggtatggtacagcaatgttccacacaccaggcttgcggagtacaagggtcaccaaaactgggttaaagtctctggtgactacctcctgtttcctgggggagggactcagttcaagaatggtgcacttcactacattgatactattcagcaggcgctgcctaatattgcatggggcaaacgaagccgtgtcattctagatgttggttgtggtgttgccagttttggaggttacatgtttgacagagatgtgcttaccatgtcttttgctccaaaagatgagcatgaagctcaagtacaatttgcactagaaaggggaattccagcaatatcagctgtgatgggcacaaagagacttccataccccagcagggtctttgatgtcattcattgtgctcgctgcagggtcccttggcacatcgaaggtggcatgcttttgctagaacttaaccgccttctacgccctggtggttacttcgtctggtctgccactcctgtttaccagaaactcccagaggatgtcgagatttggaatgccatgtcggctctgacaaagtccatgtgctggaagatggtcaacaagactaaggataagttaaaccaggttggtatggcaatatatcagaaaccaatggataacaattgctatgagaaaagatcagaaaacaacccgccattatgcaaggattctgatgatgcagatgctgcttggaatgtacctttggaagcatgcatgcacaagttgcccgctggcccgactgttcgaggagcaaaatggccagagtcatggccacaaaggcttgagaagacccctttctggcttaatggttcccaggttggagtctatggaaaacctgcaaatgaagactttgaggcagacaatgctcactggaaacgggttgtaagtaaatcatatgtgaatggcatgggaattgactggtccaaagtgagaaatgtcatggacatgagagcagtgtatggaggttttgctgcagctctgagggaccaaaaggtctgggttatgaatatcgtgccaattgattcgccagacaccttgcccatcatttatgagcgcggtttgtttggtatgtatcatgactggtgtgagtctttcagcacttacccaagaacatatgaccttctgcacgcagaccatctgttctcgaagctcaaaaagagatgcaaattgatggcagtttttgccgaggtcgaccgtgtgttgaggccacaaggcaaactgattgtgagggacaccgcggacacaataaacgaactggagagcatggccaagtccctgaagtgggaggtgcgcatgacctacaccaagggtaacgaggggttactctgcgtcgagaagtcgatgtggcggcccaaggagcttgaagcaagcacgtgaagtatatgtgttgaagaaaactgtcactgggtagggtaaattagacgaatttttgctctagatatgcatatgattcttgttgacgctgaaaggacaaatatctttggtgtaactgtagaataatacatccgtttttccccatttttttgtttcaccacgttgctgtaagatagtgctggaaatcacatgtacgacgttcagttcaattggtacctctttcaccttgtcgggtagcagtcgaacactccggaatttcggctgtgtttgaactgttctgcaagttgttgctcaacacccagcagtcaacagtgacatgcttggtgcttccg

SEQ ID NO: 2093 - DNA, 2857 bp, Setaria italica
ctttataacgcggcgaggccagcgcggaggcagagagcccaaggacgcgcctcgcctcgtcgcctccttttcgagatccgcgcggaggccggcctcgaccgctccgattccggcgaggtgccgcgcggcctagaggctactacagcagacaagctgcggtttttggggttcttggtcgacccggtagttggtgcagacaaatcgcgtgaagcttggtgacctgtacatgtgcgtgagggactgatggcatttggccggggtgcaaagatggacggccgccggccgtcctcgtcgtcctcgtcgttctgcacgaccaccacggtcgtcgtctttgtggcgctctgcctggttggcgcgtggatgatgacgtcgtccaccgtcttcccgctggagatttcgtcgaataagaagtctgtggtgaagcaacagccagcgcctgttaacttcggtgcgtctgaggatgcagcatctggcaatgctggtgaaagttctgggaaatttgaagataccgacaacaacgacaccactgtcccagaagagtcgaataacaaggaagctcctgaggaagagaagttcaccgagaacatggcggagaagcctgaagagaaggagcaggaaccaccaagagagagagaggagaacaaggatatgtttgacgatgcaaatggaaaatcagaagggcggtcagatgatgtgaagaatgacaatgatgatggagataagagcgaggaaaagaaagatgatgaaatcacaaatgagagtggtgatgagaaacctgacggtgagaggaaggatgatcgagaagaaaagtctgaaggtgatgccactcaggaggagcaacctcaaatagaagagaaggtggaagaaagtggagagaagaaggaacagagctcaaactctaatgaggtatttcctgatggggctgaatcagagcttctaaaggagtcaaatacccagaatggttcgttccccacacaggctgcagagtcaaagaatgagaaggaagttcgagcatcatcaaaatcatcaggtgatgagtccagctatagctggaaactatgcaatagcagtgcctcgacagattatattccttgccttgacaatgagaaggctatcaagaagcttcgaagtaccaaacattatgaacatcgtgaaagacattgccctgaggagcccccgacctgccttgttccactcccagaaggatataaacgcccaattgaatggccaaagagcagggacaaggtatggtacagcaatgttccacacaccaggcttgcggagtacaagggtcaccaaaactgggttaaagtctctggtgactacctcctgtttcctgggggagggactcagttcaagaatggtgcacttcactacattgatactattcagcaggcgctgcctaatattgcatggggcaaacgaagccgtgtcattctagatgttggttgtggtgttgccagttttggaggttacatgtttgacagagatgtgcttaccatgtcttttgctccaaaagatgagcatgaagctcaagtacaatttgcactagaaaggggaattccagcaatatcagctgtgatgggcacaaagagacttccataccccagcagggtctttgatgtcattcattgtgctcgctgcagggtcccttggcacatcgaaggtggcatgcttttgctagaacttaaccgccttctacgccctggtggttacttcgtctggtctgccactcctgtttaccagaaactcccagaggatgtcgagatttggaatgccatgtcggctctgacaaagtccatgtgctggaagatggtcaacaagactaaggataagttaaaccaggttggtatggcaatatatcagaaaccaatggataacaattgctatgagaaaagatcagaaaacaacccgccattatgcaaggattctgatgatgcagatgctgcttggaatgtacctttggaagcatgcatgcacaagttgcccgctggcccgactgttcgaggagcaaaatggccagagtcatggccacaaaggcttgagaagacccctttctggcttaatggttcccaggttggagtctatggaaaacctgcaaatgaagactttgaggcagacaatgctcactggaaacgggttgtaagtaaatcatatgtgaatggcatgggaattgactggtccaaagtgagaaatgtcatggacatgagagcagtgtatggaggttttgctgcagctctgagggaccaaaaggtctgggttatgaatatcgtgccaattgattcgccagacaccttgcccatcatttatgagcgcggtttgtttggtatgtatcatgactggtgtgagtctttcagcacttacccaagaacatatgaccttctgcacgcagaccatctgttctcgaagctcaaaaagagatgcaaattgatggcagtttttgccgaggtcgaccgtgtgttgaggccacaaggcaaactgattgtgagggacaccgcggacacaataaacgaactggagagcatggccaagtccctgaagtgggaggtgcgcatgacctacaccaagggtaacgaggggttactctgcgtcgagaagtcgatgtggcggcccaaggagcttgaagcaagcacgtgaagtatatgtgttgaagaaaactgtcactgggtagggtaaattagacgaatttttgctctagatatgcatatgattcttgttgacgctgaaaggacaaatatctttggtgtaactgtagaataatacatccgtttttccccatttttttgtttcaccacgttgctgtaagatagtgctggaaatcacatgtacgacgttcagttcaattggtacctctttc

SEQ ID NO: 2094 - DNA, 2760 bp, Pennisetum glaucum
ttcgaagatccgcgcggaggaaggcctcgaccgctccgattccggcgaggtgccgcgcggcctagaggctactgcagcagacaagctgcggcttttggggtcgacccggtagttggtgcagacaaatcgcgtgaagcttggtgacctgtacatgtgcgtgagggactgatggcatttggccggggttcaaagatggacggccgccggtcgtcctcaccatcctcgtcgttctgcacgaccaccacggtcgtcgtctttgtggcgctctgcctggtcggcgcgtggatgatgacgtcgtccaccgtcttcccgctcgagatttcgtcgaataagaagccggtggtgaagcaacagccggcggctgttaacttcggtgcgtccgaggacgcatcatctggcaatgtcggtgaaagttctgccaaatttgaagatactgacaacaatgacactacagtcccagaggagtcaaataataaggaagctcctgaggaagacaagttcaccgagaacacggtggagaagcctgaagagaaggagcaggaaccaccaaaagagagagaggagaccaagaacatgtttgatgatgcaaatggaaaatcagaagggcggtcagatgatgtcaagactgataatgatgatggggataagagtgaggaaaagaaagatgacgagatcacaaatgagagtggtgatgagaaacctgacggtgacaggaaggatgagcaagaagaaaagtctgaagttgatgccactcaggaggagcaacctcaaatagaagagaaggtggaagaaaatggagagaaggaacagagctcaaactctaatgatgtatttcctgatggggctcagtcagagcttctgaaggagtcgaatacccagaatggttcattccccacacaggctgcagagtcaaagaatgagaaggaagttcgagcatcatcaaaatcttcaggtgacgagaccagctatagctggaaactgtgcaatagcagtgcctcgacagattacattccttgccttgacaatgagaaggctatcaagaagcttcgaagtaccaaacattatgaacatcgtgagcgacattgccctgaggagcccccaacctgccttgttccactaccagaaggatataaacgcccgattgagtggccaaagagcagggacaaggtatggtacagcaatgttccacacaccaggcttgcagagtacaagggtcaccaaaactgggttaaagtttctggtgactacctcctgtttcctgggggagggactcagttcaagaatggtgcactccactacattgatactattcagcaggcactgcctgatattgcatggggcaaacgaagccgcgtcattctagatgttggttgtggagtggcaagctttggaggttacatgtttgacagagatgtgcttaccatgtcttttgctccaaaagatgagcatgaagctcaagtacaatttgcactggaaaggggaattccagcaatatcagctgtgatgggcacaaagagacttccataccccagcagggtctttgatgtcattcattgcgctcgctgcagggtcccttggcacattgaaggtggcatgcttttgctagaacttaaccgccttttacgccctggtggttactttgtctggtctgccactcctgtttaccagaaactctcagaggatgtcgagatttggaatgccatgtccgctctgacaaagtccatgtgctggaagatggtcaacaagactaaggataagttaaaccaggttggtatggccatatatcagaaaccaatggacaataattgctacgagaaaagatcagaaaacaacccgccattatgcaaggattctgatgatgcagatgctgcttggaatgtacctttggaagcatgcatgcacaaattgcctgctggtccgacagttcgaggagcaaaatggccagagtcatggccacaaaggcttgagaagacccctttctggcttaatggttcccaggttggagtctatggaaaacctgcaaatgaagacttccagtcagacaatgctcactggaaacgggttgtaagtaaatcatatgtgaatggaatgggaattgactggtccaaagtgagaaatgtcatggacatgagagcggtgtatggaggtttcgctgcagctctgagggaccaaaaagtctgggttatgaatatcgtgccaattgattcgccagacacgctgcccatcatttatgagcgcggtttgtttggtatgtatcatgactggtgcgagtctttcagcacttacccaagaacatatgaccttctgcatgcagaccatctgttctcaaagctcaaaacgagatgcaaattaatggcagtttttgccgaggtcgaccgtgtgttgaggccacaaggtaaactgattgtgagggacactgcagacacaataaacgaactggaggccatggccaagtccctgaagtgggaggtgcgcatgacctacaccaagggtaacgaggggttgctctgcgtcgagaagtcgatgtggcggcccaaggagcttgaagcaagcacataaagtatatgtgttgaagaaaactgtcactggtagggtaaattagacgaatttttgctctagatatgcatatgattcttgtggatgctgaaaggacaaatatctttggtgtaactgtagaataatacatctgtttttccccattttttttgtttggcaacgttgttgtaagatagtgctggaaatcacatgtactacgttcag

SEQ ID NO: 2095 - DNA, 2981 bp, Panicum virgatum
ctcccctccctccgcccccgcctacacactaccgcttgcactccactcaccagtcaccactgcgctgtgctgccgcttccacccctcttctccgctcgcgcaagctgtgcgtgcccgcccgcccgcccgccctcctttataacgcggcgaggccagcgcggaaggcagagagcccaaggacgcgcctcgcctcgcctccctcctcttcgagatccgcgcggaggcccctcctcgaccgctccgacagtccgattccggcgagaggtgccgcgcagccgagtgcagacaagctgcgatttctggggttcttggtcgacccggtagttggtgcagacaaaccgcgtgaagctcggtgatccgtacatgtgcgtgagggactgatggcatttggccggggcgcaaagatggacggccgccggccgtcctcgtcatcttcatcgttctgcacgaccaccacagtcgtcgtctttgtggcgctctgcctggtcggcgcgtggatgatgacatcgtccaccgtcttcccgctggagatttcatcaaataagaagccggtggtgaagcaacagccatcgcctgttaacttcggcgcatctgaggatgcagcatctggcaatactggtgaaggttcaggaaaatttgaggacaccgacaacaacgacaccacagtcccagaggagctgagtaacaatgaagctccggagaaagagaagtccactgagaacatggcagagaagcctgaagaaaaggagccggaacaaccaaaagagaaagagcggaccaaggatatgtttgatgatgcaaatggaaaatcagaagggtggtcagatgatgtaaagaatgacggtgatagggataagagtgaggaaaagaaagacgatgagatcacaaatgagagtggtgaggagaaacctgatggcgagaggaaggatgatcaagaagaaaagtctgaaggcgatgccactcaggaggagcaacctcaaatagaagagaaggtcgaagaaaatggagaaaaggaacagagctcaaactctgctgaggtatatcctgatggggctcagtcagagcttctgaaggagtcaaatgcccagaatggttcattccccactcaggctgcggagtcgaagaatgagaaggaagttcaagcatcatcaaaatctttaggtgatgagaccagctatagctggaaactatgcaatagcagtgcctccatggattacattccttgccttgacaatgtgaaggctatcaagaagcttcgaagtactaaacattatgaacatcgcgagaggcattgccctgaggagcctcctacctgccttgttccactcccagaaggatataaacgcccaatcgagtggccaaagagcagggacaaggtatggtacagcaatgttccacacaccaagcttgcagagtacaaggggcaccagaactgggttaaagtctctggtgattacctcctgtttcctgggggtggcactcagttcaagaatggtgcactccactacattgatactattcagcaggcactgcctgatattgcatggggcaaacgaagccgcgtcattctagatgttggttgtggtgttgccagctttggaggctacatgtttgacagagatgtgcttaccatgtcttttgctccaaaagatgagcatgaagctcaagtacaatttgcactagaaaggggaattccagcaatatcagctgtaatgggcaccaagagacttccataccccagcagggtctttgatgtcatccattgcgcccgctgcagggtcccttggcacattgaaggtggcatgcttttactggaattgaaccgccttttacgccctggtggttactttgtctggtctgccactcctgtttaccaaaaactcccagaggacatcgagatttggaatgccatgtccattctgacaaagtccatgtgctggaagatggtcaacaagactaaggataagttaaaccaagttggtatggccatatatcagaaaccaatggacaacaattgctacgagaaaagatcagaaaacaacctaccattatgcaaggaatcagatgctgcagatgctgcatggaatgtacctttggaagcatgcatgcacaaattgcctgttggcccaacacttcgaggagcaaaatggccagagtcgtggccgcaaaggcttaataagacccctttctgggttgatggttcccaggttggagtctatggaaaacctgcaaatgaagattttgaggcagacaatgctcactggaaacgggttgtaagtaaatcatacttgaatggcatgggcattgactggtccaaagtgagaaatgtcatggacatgagagcagtatatggaggttttgctgcagctctgaagaaccaaaaggtctgggttatgaatatcgtgccaattgattcaccagacacgctgcccatcatttatgagcgtggtttgtttggtatgtatcatgactggtgtgagtctttcagcacttacccaagaacatatgaccttctgcacgcagaccacctgttctcgaagctcaaaacgagatgcaaattgttggcagtttttgctgaggttgaccgtgtgttgaggccagaaggcaaactgatcgttagggacaccgcggacacaataaacgaactggaaagcatggccaagtccctaaagtgggaggtgcgcatgacctacaccaagggtaacgaggggctgctctgcgtcgagaagtcgatgtggcggcccaaggaggttgaagcaagcatgtgaagtatgtgttgaacaaaactgtcactgggtagggcactttagattaattttggctctagatatgcgtatgattcttgttgatgctgaaaggacaaaaatctttggtataacttgtagaataatacatctgtttttccccaattcgttgttcgacaacgttgctgtaagacagtgccggaaatcacagctacattacattcagtccaatagcta

SEQ ID NO: 2096 - DNA, 3073 bp, Hordeum vulgare
ctctcactgtcacacacacgacacactccactgcctgccctcgctcctccccctccccctcccgcacgctagctggaggccagccctttataacccggcgaggccacgctgcggatccaagcactcctcgatcccctcgccccctcctcgagatccgctcggagccgcgccccagctccccggccggcgaggtgcgcgcggtgtgtggcaggaagcagcaagccagcaaagctctgaacctttggtggatcgagctgatataaacaggccgcgtgcagcggggtggtcctgtacatgtgctagtgggactgatggcattcggccgaggcgggaagatggacggcaggcggccctcgtcgccgtcttcgtcgttgtgcacgacgaccaccgtcgtggtgtttgtggcgctctgcgtggtgggcgcctggatgatgacgtcgtccaccgtcttcccggtagagccgacttcaaacaagaggtcggagccactagaggtatcaacatccaataagaagacggaggtcaaggatcaacgagcagaagttggctttggtgaaaccgaggagacggcgacatccggcaatgctggctcggagaaattcgaggacactgacaataatgacaatgttccagatgagtcgcatagtaacagggatgctcctgaggaagagaagttcactgagaacacaatggagaagcctgtggagatgtctgaagaaaaggaaccgccaaaagaaaaggaggacagcaaggattcctttgatgatgcgaatggaaaatccgaagggcatagtgctaaggagggtggggagtctggcgatgaggaggagaagagcgaggagaggaaagataaggagaccaacactgacaatgatgttgaaaaatctgatggagagaagaaggaagatcaagaaggaaagtctgaggatgatgcaactgaacagcctcaaatcgaggagaaagtggaagaaagtggagagaaggaaccagctgcaaaagctaacgaggtatttcctgatggagctcaatctgaacttctcaaggagtcgaataccgagaatgggtcattccctacacaggccgcagagtcaaagaatgagaaggaagctcaagcagcatcaaaatcttcaggtgatgaaatcacctatagctggaaattatgtaatagcagcgctgtgacagattacataccttgccttgacaatgagaaggctatcaagaagcttcattctaccaaacattatgaacaccgcgagaggcattgccctgaggagcccccgacatgccttgtcccacttccggaaggatataagcgccccatcgagtggcccaagagcagggacaaggtatggtacagcaacgttcctcacaccaagcttgcagagtacaagggccatcagaattgggttaaagtttctggggatcaccttctgtttcctgggggcggaactcagttcaagaatggcgcactccactacatcgatactattcagcaggctttacctgatattgcatggggtaaacgaagccgtgtcattctagatgttggttgtggagttgctagctttggtggctacatgtttgatagagatgtgcttaccatgtcatttgctccaaaagacgagcatgaagctcaagtacagtttgcgctggagagaggaattccagcaatatcagctgtaatgggcaccaagagacttccatatcctagcagggtttttgatgtcattcactgtgctcgctgcagagtcccttggcacattgaaggtggcaagcttttgctggaattaaaccgactattacgtcctggtggttacttcgtctggtctgccactcctgtttaccaaaagctccctgaagatgttgaaatttggaacgccatgtcttctctcacaaagtccatgtgctggaaaatggttaagaaaacaaaggatacattaaatcaagttggtatggccatatatcagaagccaatggacaacaactgctatgagaaaagatcagaagacagcccaccgctatgcaaggaaaccgacgatgcagatgctgcatggaatgtacctttacaagcgtgcatacccaaattgccgcctggtccatcagtaagaggatcaaaatggccagagatgtggcctcaaaggcttgagaagactcccttctggattgatggttctcgtgttggagtttatggaaaaccagcgaatgaagacttcgaggcagactatgcacactggaaacgtgttgtaagtaagtcgtatgtgaatggcatggggattgactggtccaaagtgagaaatgtcatggacatgagagccgtatacggaggttttgctgcagcactgagggaccaaaaagtctgggttatgaatatcgtgccaatcgattcgcctgacacactgcccattgtttatgagcgtggcttgtttggaatgtatcatgactggtgcgaatctttcagcacttacccgagaacgtatgacctcctacacgcagaccatctcttttcaaagctcaaaaagagatgtaaattgttgggagtgtttgctgaggttgaccggatattgaggccagaagggaaactgatcgtgcgggacgacgcggagacaataagagcgctcgaaggcatggcgaagtccctgcagtgggaggtgcgcatgacctacgccacgggcaaggaagggctgctctgcgtccagaagaccacgtggcggcccaaggagatcgaagcaagcatgtagtgagacatacattcaagacaaaccgttacgtattacactagactgaatttcggctctaggtataagcacatgattcttgttgatgctaaaaaaggcaaatgcattgtgcagctgtagaatcatgtatgtgtttttcggcctttcattctttcttttgcttggacaacatttgttgtaaaatgaatgtaatgctgtactgtaagtcgataggtagagccacagcacgcagggtggtaccagttcttcaggaaaacctcacttgtggtattgctatagcagtcaagtatcattgaattcatgatgtcccaacagaaaaaaagaagttggattgtttc

SEQ ID NO: 2097 - DNA, 2903 bp, Triticum aestivum
cctcctcgatcccctcgccccctcctcgagatccgctcggagctgccgcaccccagctccccggccggcgaggtgcgcgcggtgtgtgccagaaagcagcaacgctctgcaacctctgatataaacaagccgcgtgcagcggggggtggtcctgtacatgtgctagcgggactgatggcatttggccgaggcgcgaagatggacggcaggcggccctcgtcgccgtcctcgtcgatgtgcacgacgaccaccgtcgtcgtgtttgtggcgctctgcatggtcggcgcctggatgatgacgtcctccaccgtcttcccggtagagcctacttcaaacaagaagtcggagccgatagaggtgtcaacatcgaataagaagaccgaggtcaaggatcagcgcgcagaagttggctttggtgaaaccgacgaggcggcgaaatccggcagtgttagctcggaaagattcgaggacactgacaataatgacaatgttccagatgagtcgcatagtaacagggatgctcctgaggaagagaagttccctgagaacgcaatggagaagcctgtcgagatggctgaagaaaaggaaccaccaaaggagaaggaggacagtaaggattcgttcgatgatgcaaatggaaaatcagaaggacagagtgctaaggagggtggggagtctggtgatgaggaggagaagagcgaggagaggaaagataaggagaccaccactgacaatgatgttgaaaaatccgatgcagagaagaaggaagatcaagaaggaaagtctgaggatgatgcaactgagcagcctcaaatcgaggagaaagtggaagaaagtggagagaaggaaccagctgcaaaagctaatgaggtatttcctgatggagctcagtctgaacttctaaaggagtcgaataccgagaatgggtcattccctacacaggctgcagagtcaaagaatgagaaggaagctcaagcagcatcaaaatcttcaggtgatgaaataacctatagctggaaattatgtaatagcagtgccgtgacagattacataccttgccttgacaatgagaaggctatcaagaaacttcattctaccaagcattatgaacaccgtgagaggcattgccctgcggagcctccgacctgccttgttccacttccggaaggatataagcgccccatcgagtggcccaagagcagggacaaggtatggtacagcaacgtccctcacaccaagcttgcagagtacaagggtcatcagaactgggttaaagtttctggggatcatcttctgtttcctgggggcgggactcagttcaagaatggcgcactccactacatcgatactattcagcaggctttacctgatattgcatggggtaaacgaagccgtgtgattctagatgttggttgtggagttgctagctttggtggctacatgtttgatagagatgtgcttaccatgtcatttgctccaaaagacgagcatgaagctcaagtacagtttgcgctcgagaggggaattccagcaatatcagctgtaatgggcaccaagagacttccatatcctagcagggtttttgatgtcattcactgtgctcgctgcagggtcccttggcacattgaaggtggcaagcttttgctggaattgaaccgactattacgtcctggtggttacttcgtctggtctgccactcctgtttaccaaaagctccctgaagatgttgaaatttggaatgccatgtcttctctgacaaagtccatgtgctggaaaatggttaagaaaacaaaggatacattaaatcaagttggtatggccatatatcagaagccaatggacaacaattgctacgagaaaagatcagaagacagcccaccgctatgcaaggaaactgacgatgcagatgctgcatggaatgtacctttgcaagcgtgcatacccaaattgccgattggtccatcagtaagaggatcaaaatggccagagatgtggcctcaaaggcttgagaagactcccttctggattgatggttctcgtgttggagtttatggaaaaccagcaaatgaagacttcgaggcagactatgcacactggaaacgtgttgtaagtaagtcgtatgtgaatggcatgggaattgactggtctaaagtgagaaatgtcatggacatgagagccgtatacggaggttttgctgcagcactgagggaccaaaaagtctgggttatgaatatcgtgccaatcgattcgcctgacacactgcccattgtttatgagcgtggcttgtttggaatgtatcatgactggtgcgaatctttcagcacttacccaagaacatatgacctcctacatgcagaccatctcttctcaaagctcaaaaagagatgtaaattgctgggagtgtttgccgaggttgaccggatattgaggccagaaggcaaactgatcgtgagggacgacgcagagacaataagcgagctcgaaagcatggcgaagtccctgcagtgggaggtgcgcatgacctacgccaggggcaaggaagggctgctctgcgtccaaaagaccacgtggcggcccaaggagatcgaagcaagcatgtagtgaaacatacattcaagataaaccgttatcggttagtgggtacgtattacactagactgaattttggccctaggtataagcatatgattcttgttgatgctaagaaaggcaaaagcattgtgcagctgtagaatcatgtatgtgttttttcgcccagtgagggcggccttccattctttcttttgcttggacaacatttgttgtaaaatgaatgtaatgctgtactggaagtcgataggtagagccacggcactgagggtggtatcagttcttaaggaaaacctcacttctggtaatgctat

SEQ ID NO: 2098 - DNA, 2878 bp, Secale cereale
cactccactgctctcgctcctccccctcccgcacgctagctggaggccagcctttataacgcggcgaggccgcactgcggatccaaggacgcctcgcctcctcgatcccctcgcttcctcctcgagatccgctcggaccgccgcgccccagctccccggctggcgaggtgcgctcggtgtggcagaaagcagcaaagctctgcaacctttgtgggtgtgcttggtggatcgagctgatataaacaggccgcgtgcagcgggggtggtcctgtacatgtgctagcggtactgatggcatttggccgaggcgcgaagatggacggcaggcggccctcgtcgccgtcctcgtccttgtgcacgacgaccaccgtcgtcgtgtttgtggcgctctgcctggtcggcgcctggatgatgacatcctccaccgtcttcccggtagagcctacttcaaccaagaagtcggagtcactagaggtatcaacatcgaataagaagacggaggtcaaggatcagcgcgcagaagttggctttggtgaaacagacgacgcggccaaatccggcagtgttagctcggagaaattcgaggacaccgacaataatgacaatgttccagatgagtcgcatagtaacagggatgctcccgaggaagagaagttccctgagaacacaatggagaagcctgtggagatggctgaagaaaaggaaccaccaaaggagaaggaggacagtaaggattcgtttgatgatgcaaatggaaagtcagaaacgcagaatgctaaggagggtggggagtctggtgatgaggaggagaagcgcgaggagaagaaagatgaggagaccacaaccgacaatgatgttgaaaaatctgatggagagaagaaggaagatcaagaaggaaagtctgaggatgatgcaactgagcagcctcaaatcgaggagaaagtggaagaaagtggggagaaggaaccagctgcaaaagctaatgaggtgtttcctgatggagctcagtctgaacttctgaaggagtcgaataccgagaatgggtcattccccacacaggctgcagagtcaaagaatgagaaggaagctcaggcagcatcaaaatcttcaggtgatgaaatcacctatagctggaagttatgtaataccagcgccgtgacagattacataccttgccttgacaatgagaaggctatcaagaagcttcactctaccaaacattatgaacaccgtgagaggcattgccctgaagagcttccgacttgccttgttccacttccggaaggatataagcgccccatcgagtggcccaagagcagggacaaggtatggtacagcaacgtccctcacaccaagcttgcagagtacaagggccatcagaactgggttaaagtttctggggatcatcttctgtttcctggaggtgggactcagttcaagaatggtgcactccactacattgatactattcagcaggctttacctgatattgcatggggtaaacgaagccgtgtaattctagatgttggttgtggagttgctagctttggtggctacatgtttgatagagatgtgcttaccatgtcatttgctccaaaagacgagcatgaagctcaagtacagtttgcgctggagagaggaattccagcaatatcagctgtaatgggcaccaagagacttccatatcccagcagggttttcgatgtcattcactgtgctcgctgcagagtcccttggcacattgaaggtggcaagcttttgttggaattgaaccgactattacgtcctggtggttacttcgtctggtctgccactcctgtttaccaaaagctcccagaagatgttgaaatttggaatgccatgtcttctctgacaaagtccatgtgctggaaaatggttaagaaaacaaaggatacattaaatcaagttggtatggccatatatcagaagccaatggacaacaattgctatgagaaaagaccagaagacagcccaccgctatgcaaggaatccgacgatgcagatgctgcatggaatgtacctttacaagcgtgcattcccaaattgccgattggtccatcagtaagaggatcaaaatggccagagacatggcctcaaaggcttgagaagacccccttctggattgatggttctcgtgttggagtttatggaaaaccagcgaatgaagacttcgaggcagactatgcacactggaaacgtgttgtaagtaagtcgtatgtgaatggcatgggaattgactggtctaaagtgagaaatgtcatggacatgagagccgtatacggaggttttgctgcagctctgagggaccaaaaagtctgggttatgaatattgtgccaatcgattcacctgacacactgcccattgtttatgagcgtggcttgtttggaatgtatcatgactggtgcgaatctttcagcacttatccgagaacatatgatctcctacatgcagatcatctgttctcaaaactcaagaagagatgtaaattgttgggagtgtttgccgaggttgaccggatattgaggccggaaggcaaactgatagtgagggacaacgcggagacaataagcgagctcgaaggcatggcgaagtccctgcactgggaggtgcgcatgacctacgccaagggcaaggaagggctgctctgcgtccaaaagaccacgtggcggcccaaggagatcgaagcaagcatgtagtgaaacatacattcaagacgacaaaccgttaccggttagtgggtacgtattattacactagactgaattttggctctaggtataagcatatgattcttgttgatgctgaaaaaggcaaaagcattgtgcagctgtagaatcatgtatgtgtttttttttc

SEQ ID NO: 2099 - DNA, 3111 bp, Secale cereale
gactagattctcgcactaatttaacccgtgcgtacggcctaatgccattgcccctacccccatccatctccttcgctcactcgcactgtcacacacacgacacactccactgctctcgctcctccccctccccctcccgcacgctagctggaggccagcctttataacgcggcgaggccgcactgcggatccaaggacgcctcgcctcctcgatcccctcgcttcctcctcgagatccgctcggaccgccgcgccccagctccccggccggcgaggtgcgctcggtgtggcagaaagcagcaaagctctgcaacctttgtgggtgtgcttggtggatcgagctgatataaacaggccgcgtgcagcgggggtggtcctgtacatgtgctagcggtactgatggcatttggccgaggcgcgaagatggacggcaggcggccctcgtcgccgtcctcgtccttgtgcacgacgaccaccgtcgtcgtgtttgtggcgctctgcctggtcggcgcctggatgatgacatcctccaccgtcttcccggtagagcctacttcaaccaagaagtcggagtcactagaggtatcaacatcgaataagaagacggaggtcaaggatcagcgcgcagaagttggctttggtgaaacagacgacgcggccaaatccggcagtgttagctcggagaaattcgaggacaccgacaataatgacaatgttccagatgagtcgcatagtaacagggatgctcccgaggaagagaagttccctgagaacacaatggagaagcctgtggagatggctgaagaaaaggaaccaccaaaggagaaggaggacagtaaggattcgtttgatgatgcaaatggaaagtcagaaacgcagaatgctaaggagggtggggagtctggtgatgaggaggagaagcgcgaggagaagaaagatgaggagaccacaaccgacaatgatgttgaaaaatctgatggagagaagaaggaagatcaagaaggaaagtctgaggatgatgcaactgagcagcctcaaatcgaggagaaagtggaagaaagtggggagaaggaaccagctgcaaaagctaatgaggtgtttcctgatggagctcagtctgaacttctgaaggagtcgaataccgagaatgggtcattccccacacaggctgcagagtcaaagaatgagaaggaagctcaagcagcatcaaaatcttcaggtgatgaaatcacctatagctggaagttatgtaataccagcgccgtgacagattacataccttgccttgacaatgagaaggctatcaagaagcttcactctaccaaacattatgaacaccgtgagaggcattgccctgaagagcttccgacttgccttgttccacttccggaaggatataagcgccccatcgagtggcccaagagcagggacaaggtatggtacagcaacgtccctcacaccaagcttgcagagtacaagggccatcagaactgggttaaagtttctggggatcatcttctgtttcctggaggtgggactcagttcaagaatggcgcactccactacatagatactattcagcaggctttacctgatattgcatggggcaaacgaagccgtgtcattctagatgttggttgtggagttgctagctttggtggctacatgtttgatagagatgtgcttaccatgtcatttgctccaaaagacgagcatgaagctcaagtacagtttgcgctggagagaggaattccagcaatatcagctgtaatgggcaccaagagacttccatatcccagcagggttttcgatgtcattcactgtgctcgctgtagagtcccttggcacattgaaggtggcaagcttttgttggaattgaaccgactattacgtcctggtggttacttcgtctggtctgccactcctgtttaccaaaagctcccagaagatgttgaaatttggaatgccatgtcttctctgacaaagtccatgtgctggaaaatggttaagaaaacaaaggatacattaaatcaagttggtatggccatatatcagaagccaatggacaacaattgctatgagaaaagaccagaagacagcccaccgctatgcaaggaatccgacgatgcagatgctgcatggaatgtacctttacaagcatgcattcccaaattgccgattggtccatcagtaagaggatcaaaatggccagagacatggcctcagaggcttgagaagacccccttctggattgatggttctcgtgttggagtttatggaaaaccagcgaatgaagacttcgaggcagactatgcacactggaaacgtgttgtaagtaagtcgtatgtgaatggcatgggaattgactggtctaaagtgagaaatgtcatggacatgagagccgtatacggaggttttgctgcagctctgagggaccaaaaagtctgggttatgaatattgtgccaatcgattcacctgatacactgcccattgtttatgagcgtggcttgtttggaatgtaccatgactggtgtgaatctttcagcacttacccgagaacatatgatctcctacatgcagaccatctgttctcaaagctcaaaaagagatgtaaattgttgggagtgtttgctgaggttgaccggatattgaggccggaaggcaagctgatggtgagggacaacgcggagacaataagcgagctcgaaggcatggcgaagtccctgcactgggaggtgcgcatgacctacgccaagggcaaggaagggctgctctgcgtccaaaagaccacgtggcggcccaaggagatcgaagcaagcatgtagtgaaacatacattcaagacgacaaacccttaccggttagtgggtacgtattattacactagactgaattttggctctaggtataagcatatgattcttgttgatgctgaaaaaggcaaaagcattgtgcagctgtagaatcatgtatgttttttttttttcgcgtccaggcgaggcggtcctttcattctttcttttgtcttggacaactatttgttagtaaaatgaatgtaatgctgtacgtggaagtcaagtaggtagagccacggcgtggaagggtggtatc

SEQ ID NO: 2100 - DNA, 2964 bp, Triticum aestivum
gcacgctagctggaggcgttcccagcctttataacgcggcgaggccgcactgcggatccaagcacgcctcgcctcctcgatcccctcgccccctcctcgagatccgctcggaccgacgcgccccagctccccggccggcgaggtgcacgcggtgtgtggcagaaagcagcaaagctctgcaacctctgatataaacaagccgcgtgcatcgggggtggtcctgtacatgtgctagtgggactgatggcatttggccgaggcgcgaagatggacggcaggcggccctcgtcgccgtcctcgtcgatgtgcacgacgaccaccgtcgtcgtgtttgtggcgctctgcctggtgggcgcctggatgatgacatccaccaccgtcttcccggtagagcctacttcaaacaagaagtcggagccgatagaggtatcaacatcgaataagaagacggaggtcaaggatcagcgcgcagaagttggctttggtgaaaccgacgaggcggcgaaatccggcagtgttagctcggagaaattcgaggacactgacaataatgacaatgttccagatgagtcgcatagtaacagggatgctcctgaggaagagaagttccctgagaacacaatggagaagcctgtggagatggctgaagaaaaggaaccaccaaaagagaaggaggacagtaaggattcctttgatgatgcaaatggaaaatcagaaggacagagtgctaaggagggtggggagactgggcaatctggcgatgaggaggagaagagcacaactgacaatgatgttgaaaaatccgatggggagaagaaggaagatcaagaaggaaagtctgaggacgatgcaactgaacagcctcaaatcgaggagaaagtggaagaaagtggagagaaggaaccggctgcaaaagctaatgaggtatttcctgatggagctcagtctgaacttctcaaggagtcgaataccgagaatgggtcattccctacacaggctgcagagtcaaagaatgagaaggaagctcaagcagcatcgaaatcttcaggtgatgaaatcacctatagctggaaattatgtaatagcagtgccgtgacagattacataccttgccttgacaatgagaaggctatcaagaaacttcattctaccaagcattatgaacaccgtgagaggcattgccctgcggagcctccgacttgccttgttccacttccggaaggatataagcaccccatcgagtggcccaagagcagggacaaggtatggtacagcaacgtccctcacaccaagcttgcagagtacaagggccatcagaactgggttaaagtttctggtgatcatcttctgtttcctgggggcgggactcagttcaagaatggcgcactccactacatcgatactattcagcaggctctacctgatattgcatggggtaaacgaagccgtgtgattctagatgttggttgtggagttgctagctttggtggctacatgtttgacagagatgtgcttaccatgtcatttgctccaaaagacgagcatgaagctcaagtacagtttgcgctcgagaggggaattccagcaatatcagctgtaatgggcaccaagagacttccatatcctagcagggtttttgatgtcattcactgtgctcgctgcagggtcccttggcacattgaaggtggcaagcttttgctggaattgaaccgactattacgtcctggtggttacttcgtctggtctgccactcctgtttaccaaaagctccctgaagatgttgaaatttggaatgccatgtcttctctgacaaagtccatgtgctggaaaatggttaagaaaacaaaggatacattaaatcaagttggtatggccatatatcagaagccaatggacaacaattgctacgagaaaagatctgaagacagcccaccgctatgcaaggaaacggacgatgcagatgctgcatggaatgtacctttacaagcgtgcatacccaaattgccgattggtccatcagtaagaggatcaaaatggccagagatgtggcctcaaaggcttgagaagactcccttctggattgatggttctcgtgttggagtttatggaaaaccagcgaatgaagacttcgaggcagactatgcgcactggaaacgtgttgtaagtaagtcgtatgtgaatggcatggggattgactggtctaaagtgagaaatgtcatggacatgagagccgtgtatggaggttttgctgcagcactgagggaccaaaaagtctgggttatgaatatcgtgccaatcgattcacctgacacactgccaattgtttatgagcgtggcttgtttggaatgtatcatgactggtgcgaatctttcagcacttacccgagaacatatgatctcctacatgcagaccatctgttctcaaagctcaaaaagagatgtaaattgttgggagtgtttgccgaggttgaccggatattgcggccagaaggcaaactgatcgtgagggacaacgcggagacaataagcgagctcgaaggcatggcgaagtccctgcagtgggaggtgcgcatgacctacgccaaggacaaggaagggctgctctgcgtccaaaagaccacgtggcggcccaaggagatcgaagcaagcatgtagtgaaatatacattcgacgcaaaactgttcccggttagtgggcacgtattacactagactgaattttggctctagatataagcatatgattcttgttgatgctgaaaaaggcaaaagcattgtgcagctgtagaatcatgtatgtgtttttttttccgcgccaagcgagggcggccttgcattctttcttttgcttggacaacatttgttgtaaaatgaatgtaatgctgtactggaagccaataggtagaaccacggcacggagggtggtatctgttcttaaggaaaacctcacttctggtaatgctat

SEQ ID NO: 2101 - DNA, 2825 bp, Secale cereale
tgtacatgtgctagtgggactgatggcatttggccgaggcgcgaagatggacggcaggcggccctcgtcgccgtcctcgtccttgtgcacgacgaccaccgtcgtcgtgtttgtggcgctctgcctggtcggcgcctggatgatgacatcctccaccgtcttcccggtagagcctacttcaaccaagaaggcggagccactagaggtgtcaacatcgaataagaagacggaggtcaaggatcagcgcgcagaagttggctttggtgaaaccgacgacgcggcgaaatccggcagtgttagctcggagaaattcgaggacaccgacaataatgacaatgttccagatgagtcgcatagtaacagggatgctcccgaggaagagaagttccctgagaacacaatggataagcctgtggagatggctgaagaaaaggaaccaccaaaggagaaggaggacagtaaggattcgtttgatgatgcaaatggaaagtcagaaacgcagaatgctaaggagggtggggagtctggtgatgaggaggagaagcgcgaggagaagaaagatgaggagaccacaaccgacaatgatgttgaaaaatctgatggagagaagaaggaagaccaagaaggaaagtctgaggatgatgcaactgagcagcctcaaatcgaggagaaagtggaagaaagtggggagaaggaaccagctgcaaaagctaatgaggtgttcctgatggagctcagtctgaacttctgaaggagtcgaataccgagaatgggtcattccccacacaggccgcagagtcaaagaacgagaaggaagctcaagcagcatcaaaatcttcaggtgatgaaatcacctatagctggaagttatgtaataccagcgccgtgacagattacataccttgccttgacaatgagaaggctatcaagaagcttcactctaccaaacattatgaacaccgtgagaggcattgccctgaagagcttccgacttgccttgttccacttccggaaggatataagcgccccatcgagtggcccaagagcagggacaaggtatggtacagcaacgtccctcacaccaagcttgcagagtacaagggccatcaaaactgggttaaagtttctggggatcatcttctgtttcctggaggtgggactcagttcaagaatggcgcactccactacatcgatactattcagcaggctttacctgatattgcatggggtaaacgaagccgtgtaattctagatgttggttgtggagttgctagctttggtggctacatgtttgatagagatgtgcttaccatgtcatttgctccaaaagacgagcatgaagctcaagtacagtttgcgctggagagaggaattccagcaatatcagctgtaatgggcaccaagagacttccatatcccagcagggttttcgatgtcattcactgtgctcgctgcagagtcccttggcacattgaaggtggcaagcttttgttggaattgaaccgactattacgtcctggtggttacttcgtctggtctgccactcctgtttaccaaaagctcccagaagatgttgaaatttggaatgccatgtcttctctgacaaagtccatgtgctggaaaatggttaagaaaacaaaggatacattaaatcaagttggtatggccatatatcagaagccaatggacaacaattgctatgagaaaagaccagaagacagcccaccgctatgcaaggaatccgatgatgcagatgctgcatggaatgtacctttacaagcgtgcattcacaaattgccgattggtccatcagtaagaggatcaaaatggccagagacatggcctcaaaggcttgagaagacccccttctggattgatggttctcgtgttggagtttatggaaaaccagcgaatgaagacttcgaggcagactatgcacactggaaacgtgttgtaagtaagtcgtatgtgaatggcatgggaattgactggtctaaagtgagaaatgtcatggacatgagagccgtatacggaggttttgctgcagctctgagggaccaaaaagtttgggttatgaatattgtgccaatcgattcacctgacacactgcccattgtttatgagcgtggcttgtttggaatgtatcatgactggtgcgaatctttcagcacttatccgagaacatatgatctcctacatgcagatcatctgttctcaaaactcaagaagagatgtaaattgttgggagtgtttgccgaggttgaccggatattgaggccggaaggcaaactgatagtgagggacaacgcggagacaataagcgagctcgaaggcatggcgaagtccctgcactgggaggtgcgcatgacctacgccaagggcaaggaagggctgctctgcgtccaaaagaccacgtggcggcccaaggagatcgaagcaagcatgtagtgaaacatacattcaagacgacaaaccgttaccggttagtgggtacgtattattacactagactgaattttggctctaggtataagcatatgattcttgttgatgctgaaaaaggcaaaagcattgtgcagctgtagaatcatgtatgtgtttttttttttcgtcgccaggcgaggcggcctttcttttctttcttttgtcttggacaaacatttgttgtaaaatgaatgtaatgctgtactgggaagtcaataggtagagccacggcgtgaagggtggtatcagttcttcaggaaaacctcacttctggtgtgctatagcagtcaaatgtctttgaattcgtgatgtcccaacagagagaaaaaacttgaatattt

SEQ ID NO: 2102 - DNA, 1515 bp, Sorghum bicolor
agccgatagcacgttccgattccgctcagaagtcagaaatctccaactccaatctccctcgcctctccggcctcaccatttcgctatgctgccgtcgcacctcaacgggcactccgccctcggtcgcggccgcccgcgcctctccgccgccgccgcctccggggatttcgcggcagcggggataggggcggcggctccgctggaggagcacgaccgcatctacttccagtcttactcccacctcggcatccacgaggctatgatcaaggatcgcgtcaggactgatgcttaccacacagctatcatgcgccaccagaaatttgtcgaggggaaggttgtgctggatgtggggtgtgggactggaatactctctgtgttctgtgctcgtgctggtgcaaagcgagtgtatgctattgaagctagtgaaattgctgtccaggctcgtgaaatcgtaaaagcaaacaacctaactgatcaggttgtagtcatccatggacgtgtcgaggatgttgaccttgaggagaaggttgatgtgataatatcagaatggatgggctatatgcttctctatgagagtatgctgccaagcgtcctatttgcaagagataaatggcttaagcctgggggtcttattcttccttctcatgctacgctcttcatggctcccataacaaatcccgagagatatgaaagcagtgttgatttctggcgtgatgtctatggcataaacatgtctgctcttgtgccacttgccaaaaagtttacatctgaggaaccttccattgaaacaattggtggagagaatgttataagttggccagctgtgttcaagcacatcgattgctataattttacagctgaggaattcaaatctattaccacaaaatacaaagtttcatcaatgatgttagctcctattcatggctttggtttctggtttgaggtggagttcaatgggcctgcagagtcctctcataattttccttccaatttggatccacttgagattattcagaagaaaaggagacgatcatcagaagatgcagttttgtccacagcccccgaggatgagccaactcattggcaacagactattttgtatttcccagatcctatagaggtgaagcaggaccaaattatagaaggttctgtaacagtgtcccagagcgaggagaacccacgttttctgaatattcatctagagtgcaccacaggaggacagacattggtaaaggactgcgccatgcgatgaactgttttttttttttatacttttatagtggctggagtcccctgacaaagatcatacaacttgcaaaagggcattggcatttagcagtgaggagctgaagacatgattttagatttctttaatggaaccagagagtttgtactacttatgcaaaattttcatctaatatgaagggaggattcagtaattgtactgtcttattctatagagtatagactggtagttgatttagttgactttgcatccgcacgctgtgatcatgc

SEQ ID NO: 2103 - DNA, 1861 bp, Sorghum bicolor
gggagccgaacgcccggagcctcggaccgttgaggagagcagagccgatagcacgttccgattccgctcagaagtcagaaatctccaactccaatctccctcgcctctccggcctcaccatttcgctatgctgccgtcgcacctcaacgggcactccgccctcggtcgcggccgcccgcgcctctccgccgccgccgcctccggggatttcgcggcagcggggataggggcggcggctccgctggaggagcacgaccgcatctacttccagtcttactcccacctcggcatccacgaggctatgatcaaggatcgcgtcaggactgatgcttaccacacagctatcatgcgccaccagaaatttgtcgaggggaaggttgtgctggatgtggggtgtgggactggaatactctctgtgttctgtgctcgtgctggtgcaaagcgagtgtatgctattgaagctagtgaaattgctgtccaggctcgtgaaatcgtaaaagcaaacaacctaactgatcaggttgtagtcatccatggacgtgtcgaggatgttgaccttgaggagaaggttgatgtgataatatcagaatggatgggctatatgcttctctatgagagtatgctgccaagcgtcctatttgcaagagataaatggcttaagcctgggggtcttattcttccttctcatgctacgctcttcatggctcccataacaaatcccgagagatatgaaagcagtgttgatttctggcgtgatgtctatggcataaacatgtctgctcttgtgccacttgccaaaaagtttacatctgaggaaccttccattgaaacaattggtggagagaatgttataagttggccagctgtgttcaagcacatcgattgctataattttacagctgaggaattcaaatctattaccacaaaatacaaagtttcatcaatgatgttagctcctattcatggctttggtttctggtttgaggtggagttcaatgggcctgcagagtcctctcataattttccttccaatttggatccacttgagattattcagaagaaaaggagacgatcatcagaagatgcagttttgtccacagcccccgaggatgagccaactcattggcaacagactattttgtatttcccagatcctatagaggtgaagcaggaccaaattatagaaggttctgtaacagtgtcccagagcgaggagaacccacgttttctgaatattcatctagagtgcaccacaggaggacagacattggtaaaggactgcgccatgcgatgaactgttttttttttttatacttttatagtggctggagtcccctgacaaagatcatacaacttgcaaaagggcattggcatttagcagtgaggagctgaagacatgattttagatttctttaatggaaccagagagtttgtactacttatgcaaaattttcatctaatatgaagggaggattcagtaattgtactgtcttattctatagagtatagactggtagttgatttagttgactttgcatccgcacgctgtgatcatgccccattctcgctgtctgagtttgggacgagatgagagaaggataaaatagaaagggataaactgagataaccagtttctcctcttctaccaaaaaggatacttgctgacctttacctgtcgagagattgatgattgagcctttctttgttgagaggattgtactttagtcatggtggaaaagcctgcagaaaggcgagactttgttgatggtgttctccaatcgcgagtcaagtttgtcaagtgaatcctaccgctccttgttgctgcagtaaaacacagattaggtgtgcatgatgttagcag

SEQ ID NO: 2104 - DNA, 1568 bp, Setaria italica
ggcaaatcaaattcgaggaaggcagccgaaccgttgggggagaggagagcacgttccgctcgatttctccattggaatccctctcgcccctccctccttacgctcaccaattcgccatgctgccgtcgcacctcaacggccactcccccctcgcgcggcgccgcccgcgcctctgcgccgcttccccacccgccgccgccggggagtcgccggcagcgggggcgggggcgacgtcggcggcgctttcgctggaggagcatgaccggatctacttccagtcctactctcacatcggcatccacgaggctatgatcaaggaccgcgtcaggactgatgcttaccacacagcgatcatgcaccatcagaaatttatcgaggggaaggttgtgctggatgtggggtgtgggactggaatactctcagtgttctgtgctcgtgcaggtgcaaaacgggtgtatgctgttgaagctagtgaaattgctacccaggctcgtgaaattgtaaaagcaaacaacctaactgatcaggttgtagtcatccatggacgtgttgaggatgttgaccttgaggaaaaggttgatgtaataatatcagaatggatgggctatatgcttctgtatgagagtatgctgccaagcgtcctatttgcaagagataaatggcttaaacctgggggtcttattcttccttctcatgctacgctcttcatggctcccataacaaatcctgaaagatatgaaggcagtgttgatttctggtgtgatgtctatggcataaatatgtctgctcttgtgccacttgccaaaaaatttacatctgaagaaccctccattgaaacaattggtggagagaatgttataagttggccatctgtggtcaaacacatcgattgctataattttacagctgaggagttcaaatctatcaccgcaaactacaaagtttcgtcaatgatgttagctcctattcatggctttggtttctggtttgaggtggagttcaatgggccccaagagtcctctcataatattccttccaatttgaatccacttgaaattattcataagaaaaggagacgatcatctgaagataccgttcttctgtccacagccccagaggacgagcctacccattggcaacagactattctgtacttccctgatcctatagaggtgaagcaggatcaaactgtagaaggctctgtaacggtgtcccagagcaaggagaacccacgttttctgaatattcatctagagtgctccacaggaggacagacgttggtaaaggactgtaccatgcgatgaactcgcgcactttacttttagttacagtactgtgtctggctgggctccccctttcaaagatatcctataacttgggagaggtctttctttctgcttctgagaactgaattctagcattggcagcgaggagttcaagaatctgcactgacaatttatttcccctcattttctgttatctttactggaagcagagaatttgtactatttatgcgacaagttttggccatttttaatgaaaggtgggattgcagggttttagtttgt

SEQ ID NO: 2105 - DNA, 1441 bp, Setaria italica
gaggaaggcagccgaaccgttgggggagaggagagcacgttccgctcgatttctccattggaatccctctcgcccctccctccttacgctcaccaattcgccatgctgccgtcgcacctcaacggccactcccccctcgcgcggcgccgcccgcgcctctgcgccgcttccccacccgccgccgccggggagtcgccggcagcgggggcgggggcgacgtcggcggcgctttcgctggaggagcatgaccggatctacttccagtcctactctcacatcggcatccacgaggctatgatcaaggaccgcgtcaggactgatgcttaccacacagcgatcatgcaccatcagaaatttatcgaggggaaggttgtgctggatgtggggtgtgggactggaatactctcagtgttctgtgctcgtgcaggtgcaaaacgggtgtatgctgttgaagctagtgaaattgctacccaggctcgtgaaattgtaaaagcaaacaacctaactgatcaggttgtagtcatccatggacgtgttgaggatgttgaccttgaggaaaaggttgatgtaataatatcagaatggatgggctatatgcttctgtatgagagtatgctgccaagcgtcctatttgcaagagataaatggcttaaacctgggggtcttattcttccttctcatgctacgctcttcatggctcccataacaaatcctgaaagatatgaaggcagtgttgatttctggtgtgatgtctatggcataaatatgtctgctcttgtgccacttgccaaaaaatttacatctgaagaaccctccattgaaacaattggtggagagaatgttataagttggccatctgtggtcaaacacatcgattgctataattttacagctgaggagttcaaatctatcaccgcaaactacaaagtttcgtcaatgatgttagctcctattcatggctttggtttctggtttgaggtggagttcaatgggccccaagagtcctctcataatattccttccaatttgaatccacttgaaattattcataagaaaaggagacgatcatctgaagataccgttcttctgtccacagccccagaggacgagcctacccattggcaacagactattctgtacttccctgatcctatagaggtgaagcaggatcaaactgtagaaggctctgtaacggtgtcccagagcaaggagaacccacgttttctgaatattcatctagagtgctccacaggaggacagacgttggtaaaggactgtaccatgcgatgaactcgcgcactttactttttagttacagtactgtgtctggctgagctccccctttcaaagatatcctataacttgggagaggtctttctttctgcttctgagaactgaattctagcattggcagcgaggagttcaagaatctgcactgact

SEQ ID NO: 2106 - DNA, 1981 bp, Panicum virgatum
gggagccaagccgttgaggggagtagagcacatttcgctcagaaatctccactcgaatccctctcgccaccaccaatccgccatgctgccgtcgcacctcaacggccactcccccctcgcgcggcgccgcccgcgcctctccgctgcttccccacccgccgccgccgccggggagtccccggccgcgggggctggggctacatccacggcggattcgctggaggagcacgaccgcatctacttccagtcttactcccacatcggcatccatgaggcaatgatcaaggaccgcgtcaggactgatacttaccactcagccatcatgcaccatcagaaatttatcgaggggaaggttgtgctcgatgtggggtgtgggactggaatactctctgtgttctgtgctcgtgctggcgcaaaacgggtgtatgctgttgaagctagtgaaattgctatccaggcttgtgaaattgtaaaagcaaacaacctaagtgataaggttgtggtcatccatggacgtgttgaggatgttgaccttgaggagaaggttgatgtaataatatcagaatggatgggctatatgcttctgtatgagagtatgctgccaagtgtcttatttgcaagagataaatggcttaaacctgggggtcttattcttccttctcatgctacgctcttcatggctccgataacaaatcctgagagatatgaaggcagtgttgatttctggtgtgatgtctatggcatagacatgtctgctcttgtgccacttgccaaaaaaattacatctgaagaaccctccattgaaacaattggtggagagaatgttataagttggccatctgtggtcaaacacatcgattgctataattttacagttgaggaattcaaatgtatcaccgcaaaatacaaagtttcatcaatgatgttagctcccattcatggctttggtttctggtttgaggtggagttcaatgggccccaagagtcctcccataatattccttccaatttgaatccacttgaaattattcagaagaaaaggagacgatcatctgaagatacagttcttctgtccacagcccctgaggatgagccgacccattggcagcagactattctgtacctccctgatcctatagaggtgaagcaggatcaaactgtagaaggctctgtaacggtgtcccagagcaaggagaacccacgttttctgaatattcatctagagtgctccacaggaggacatacgttggtaaaagactgtgccatgcgatgaactggtcctttttactttttagttacggtactgggtccccccagcaaagatcctataacttgcaacttgcatgaggtcttctactcttcctttcagcttccgcgaactgaattctatcatctgcaacgaggagttcaagattctctactgatagtttatttcccctcattttctgaatttttactggaagcagagaatttgtattattaatgcattttttgttcactgttaatgatggcggggattgcatgatttcagtttgtcttatgctatagattggtaatttcttttggctctgcatcatcagattaagcccggctgactgtctaggagttcaggatgagataagaaggttaaagtaggaaaaggtggataaactgagataagctgttttccctttacaacctaaggatactgcttgacctttacctgcacaacactagaactttttctttgagaggcttgtactttagttatggtgaaaaaaggctgcagaaaggtgagacttttgatggtgttctccaatcgtgagttctgcaaactcaagtttctgtgtccagtagattgatgtgggtgatactcgtgccgcccccttttgctgcagcaaaacatggataaggtgtctttgaatgaaatcaagtgcatgatatgggcagaaaataaaaggtcttacctgccgctgttgtggctcctgaattgctttgaaaa

SEQ ID NO: 2107 - DNA, 1469 bp, Brachypodium distachyon
gcccttccccctctcccaccatgctgccctcgcacctcaacggccactcccctctggcgcgccgcccgcgcctctcagccgccgccggggaccccccggcggcggcggcggaggcggccggggctgcttccctggaggcgcacgaccgcgtctacttccagtcctactcccacatcggcatccacgaggccatgatcaaggaccgggtcaggactgatgcttatcgcacagcgatcatgcaccaccagaaattcatcgaggggaaggttgtgatggatgtggggtgtggaactggaatactgtcggtgttctgtgctcgtgctggtgcgaaaagagtatatgctgtggatgctagtgaaatcgctacccaggctactgaaattgtaaaagcgaacaacttagcggataagatcgtggtcattcatggacgtgttgaggatgttgacattaaggagaaggttgatgtaataatatcagaatggatgggttatatgcttctctatgagagtatgctgccaagtgttctgtttgcgagggataaatggcttaagcctgggggtcttatccttccttcacatgctacgcttttcatggcgcctataacaaattctgatagatatgaaggcagtgttgatttctggtgtgatgtttatggcataaacatgtctgctcttgtgccacttgccaaaaaatttacatccgaggagccctccattgaaataatcagtggagagaatgttataagttggccatttgtggtcaagcacattgattgctacacttttacggttgaggaattcaaatctgtcaccacaacatacaaagtttcatcaatgatgttagctccgattcatggctttggtctctggtttgaggtggagttcaatgggcccgcagagtctttggacgatttgtccgctaattctaatccacttgatatcatccagaagaaaaggcggcgaggatcagataacacagttctgttgtccacagccccagaagatgaaccaacacattggcatcagactattttgtacttccctgatcctatagaagtgaagcaggatcaaataatagaaggctctgtaatggtcaccccgagcgaggaaaatccacgctgtctaaacattcgcttagagtgctcaacaggaggtcaaaccttggtgaaggattttgcaatgagatgaactggtgtgattccccagcctcctcaaggaagatcccagcactcagaagagtctctttcagcaaccatgaatcggaatcactggtcatcctgttgagcttcttgtctgtaagttagagagaacgacagcatccaagatgcctcctttttcctctcctcaattttttggttgtgttattggagatggaaaaaaaaaatgtaggaattttgccctcctgcgtgtaatgaagataacatccattgtagaatttcaatttgtcaaatgttctctgtggttaaccct

SEQ ID NO: 2108 - DNA, 1722 bp, Brachypodium distachyon
cccgggcaaaaggccgattcaaaatcaaaccggaaccaaagcaaagcaaaggggcgaactcagaagagcgcagttcgccgagcagcaagcaatctcccctcgaatcccctgcccttccccctctcccaccatgctgccctcgcacctcaacggccactcccctctggcgcgccgcccgcgcctctcagccgccgccggggaccccccggcggcggcggcggaggcggccggggctgcttccctggaggcgcacgaccgcgtctacttccagtcctactcccacatcggcatccacgaggccatgatcaaggaccgggtcaggactgatgcttatcgcacagcgatcatgcaccaccagaaattcatcgaggggaaggttgtgatggatgtggggtgtggaactggaatactgtcggtgttctgtgctcgtgctggtgcgaaaagagtatatgctgtggatgctagtgaaatcgctacccaggctactgaaattgtaaaagcgaacaacttagcggataagatcgtggtcattcatggacgtgttgaggatgttgacattaaggagaaggttgatgtaataatatcagaatggatgggttatatgcttctctatgagagtatgctgccaagtgttctgtttgcgagggataaatggcttaagcctgggggtcttatccttccttcacatgctacgcttttcatggcgcctataacaaattctgatagatatgaaggcagtgttgatttctggtgtgatgtttatggcataaacatgtctgctcttgtgccacttgccaaaaaatttacatccgaggagccctccattgaaataatcagtggagagaatgttataagttggccatttgtggtcaagcacattgattgctacacttttacggttgaggaattcaaatctgtcaccacaacatacaaagtttcatcaatgatgttagctccgattcatggctttggtctctggtttgaggtggagttcaatgggcccgcagagtctttggacgatttgtccgctaattctaatccacttgatatcatccagaagaaaaggcggcgaggatcagataacacagttctgttgtccacagccccagaagatgaaccaacacattggcatcagactattttgtacttccctgatcctatagaagtgaagcaggatcaaataatagaaggctctgtaatggtcaccccgagcgaggaaaatccacgctgtctaaacattcgcttagagtgctcaacaggaggtcaaaccttggtgaaggattttgcaatgagatgaactggtgtgattccccagcctcctcaaggaagatcccagcactcagaagagtctctttcagcaaccatgaatcggaatcactggtcatcctgttgagcttcttgtctgtaagttagagagaacgacagcatccaagatgcctcctttttcctctcctcaattttttggttgtgttattggagatggaaaaaaaaaatgtaggaattttgccctcctgcgtgtaatgaagataacatccattgtagaatttcaatttgtcaaatgttctctgtggttaaccctgagtctcgctgtcttgatatttcttttggaactgattgttaaaaatattcaaagttatcacgagatcttgttaaccctgagtctcgctgtcacaaaagttatgacgagatgagaagtataaagtgaacgataaatcgaggcaa

SEQ ID NO: 2109 - DNA, 2379 bp, Oryza sativa
accccccccccccaaaaaaaaaaaaaagcgcaaagcgacgggaggtcggagcgagcagagaagaacgcatttgattcagaaatctccatttgaatctctctcgtctcccctcgatccctagcttcctccctgacaccatgctgccgtcgcacctcaacggccactcccccctcgcgcgccgctgccctcgcctctccgccgcctcgccgccagccaccggggattccgatgcggcggcggcggcggcggacgctccgctggcggagcacgaccgcatctacttccagtcatactcccacatcggaatccacgaggccatgatcaaggatcgcgttaggacggatgcttaccgctctgccatcatgcaccaccagaagttcatcgaggggaaggttgtgatggatgtggggtgtggaactggaatactctcggtgttctgtgctcgcgctggtgcaaaatgtgtgtatgcagtggaagctagtgaaatggcaactcaggctcgtgaaattgtaaaggcaaataatctggatgataaggtcgtcgttgttcatggacgcgttgaggatgttgaagttgaggataaggttgatgtgataatatcagagtggatgggttatatgcttctctatgagagtatgctgcctagtgtcctgtttgcaagggataaatggcttaaacctggtggtcttatccttccatctcatgctacgctcttcatggcacccataacaaattctgagaggtatgaaggaagtgttgatttctggtctgatgtctatggcataaatatgtctgcacttgtgccacttgccaaaaagtttacatcggaggagccctccattgaaataatcggtggagagaatgttttgagctggccatttgtggtcaaacacatagattgctacacttttaaggccgaggagctcaaatctttcacaactaaatacaaagtttcatccatgatgttagctcccattcatggctttggtttatggtttgaagtggagttcaatggcccttcaaatcccacagacaaatctccttccgatttgaatccactcgatgttattcgtaagaaaaggcgccgaggatcagaagatccagtggtgctatccacagccccagaggatgagccaactcattggcatcagactattctgtacttccctgatcctatagaggtgaaacaagaccaaattatagaaggctctgtaaaagtgtctcagagtgaggaaaacccacgttttctgaatattcaactagattgcaccacgggaggccaaacattggtgaaagattatgccatgcgatgaatggtgttcttagtttgctgatctggattccccgacttctgatggtaagatcctacaacttgcaagagggtctcttccagcaatcatgaactgaggtcattggcaattgatgctgaattgttgtatgcatgttgataacagtaacgagaattcctccacttattttctttcctttattcttttgagtttttccttgtgtttattttttctagttttcactggcgatgtagatgaaccgagaatgcaaattttcggtttaagtgcagtggagataggattgcattatttcagtttgtcgaatgctttagttttgtggatgctttttcgttggtatcttgtctgactttgatgtgcttaactccgagtctccgtgtcagcagtcaggatgagagataagggtaaagtgagaagatgggaaaaatggagacgagctgtttttctcttgaaccaaaaaggctacagcataacctttgcctgctgtgacattgagcttttactttcttgagacgcttgtactttagtcattgcgtcagcctgcacaaagtgagcctctttttttttgttggtggtgttccagctcaaagcgaccaatgtggttgaattggaccttttggtttcacccaatcgtgaagcaggatgtagacttaagattttctgtcagatagattgacttaatgaatctcgtgatattcttctttcgctgcagtaataaactatagttaacgtgcctgtagattaaagctgctgtagccatcgtaaactttaaccccttgaattcttacttcccggtgttgactggtgagtgctgacagtcaggtgctttgagcgtgcagtcgtgcgtgtgttcacgtggatgcgactgacactggtcttaatttactaatcttttccctgacactgctctgtttgaagtttccagataaattatgttaagcgtgatcttacgtgtgcatcatttcccgcagcaaatggctgctagcgttgtctccacatctgcacaggccacaagcccacaacaggtcaggttgaaatgcaaaagctgatgtgctacattattgttcccagg

SEQ ID NO: 2110 - DNA, 1682 bp, Oryza sativa
accccccccccccaaaaaaaaaaaaaagcgcaaagcgacgggaggtcggagcgagcagagaagaacgcatttgattcagaaatctccatttgaatctctctcgtctcccctcgatccctagcttcctccctgacaccatgctgccgtcgcacctcaacggccactcccccctcgcgcgccgctgccctcgcctctccgccgcctcgccgccagccaccggggattccgatgcggcggcggcggcggcggacgctccgctggcggagcacgaccgcatctacttccagtcatactcccacatcggaatccacgaggccatgatcaaggatcgcgttaggacggatgcttaccgctctgccatcatgcaccaccagaagttcatcgaggggaaggttgtgatggatgtggggtgtggaactggaatactctcggtgttctgtgctcgcgctggtgcaaaatgtgtgtatgcagtggaagctagtgaaatggcaactcaggctcgtgaaattgtaaaggcaaataatctggatgataaggtcgtcgttgttcatggacgcgttgaggatgttgaagttgaggataaggttgatgtgataatatcagagtggatgggttatatgcttctctatgagagtatgctgcctagtgtcctgtttgcaagggataaatggcttaaacctggtggtcttatccttccatctcatgctacgctcttcatggcacccataacaaattctgagaggtatgaaggaagtgttgatttctggtctgatgtctatggcataaatatgtctgcacttgtgccacttgccaaaaagtttacatcggaggagccctccattgaaataatcggtggagagaatgttttgagctggccatttgtggtcaaacacatagattgctacacttttaaggccgaggagctcaaatctttcacaactaaatacaaagtttcatccatgatgttagctcccattcatggctttggtttatggtttgaagtggagttcaatggcccttcaaatcccacagacaaatctccttccgatttgaatccactcgatgttattcgtaagaaaaggcgccgaggatcagaagatccagtggtgctatccacagccccagaggatgagccaactcattggcatcagactattctgtacttccctgatcctatagaggtgaaacaagaccaaattatagaaggctctgtaaaagtgtctcagagtgaggaaaacccacgttttctgaatattcaactagattgcaccacgggaggccaaacattggtgaaagattatgccatgcgatgaatggtgttcttagtttgctgatctggattccccgacttctgatgtcaggatgagagataagggtaaagtgagaagatgggaaaaatggagacgagctgtttttctcttgaaccaaaaaggctacagcataacctttgcctgctgtgacattgagcttttactttcttgagacgcttgtactttagtcattgcgtcagcctgcacaaagtgagcctctttttttttgttggtggtgttccagctcaaagcgaccaatgtggttgaattggaccttttggtttcacccaatcgtgaagcaggatgtagacttaagattttctgtcagatagattgacttaatgaatctcgtgatattcttctttcgctgca

SEQ ID NO: 2111 - DNA, 1518 bp, Secale cereale
tgcgctctaccgcagagaaccagcgaaatctcccattcgaatctctcctctcctcggccgcccggatccctcccccgctctccgccatgctgccctcgcacctcaacggccactccccgctggcgcgccgccgcccccagctccccgccgcctccccgcccgcctccgccggggaacccccggcggcggcggcggcgctggaggcgcacgaccgcgtctacttccagtcctactcccacatcggcatccacgagtccatgatcaaggacagggtcaggaccgacgcgtaccgcgaggcaatcatgctccaccagaagttcatcgaggggaaggttgtgatggatgtgggttgcgggactgggatactctctgtgttctgcgctcgtgccggcgcgaaacgagtttatgctgtggatgctagtgaaatcgctacccaggctagtgaaattgtaaaagcaaacaatttagctgataagatcgtggtcattcatggacgtgttgaggatgttgatgttgaggagaaggttgatgtaataatatcagaatggatgggctatatgcttctctacgagagcatgctgccaagcgttctatttgcaagggataaatggcttaagccagggggtcttatcctgccttctcatgctacgcttttcatggcgcctataacaaattctgatagatatgaaggcagcgttgatttctggtgtgatgtttatggcataaacatgtctgctcttgtgccacttgccaaaaaattcgcatccgaggagccctccattgaaatagttggtggagaaaatgttataagttggccatttgtggtgaagcacattgattgctacacttttacggttgaggaattcaagtctatcaccacaacgtacaaagtttcatcaatgatgttagctccaattcacggctttggtctctggtttgaggtggagttcaatgggcctgcagagtcttgtagcaatttgtcctctgattcgagtccactagatattattcagaagaaaaggcgcagggcatcagataacacagtcgtgctgtccacagccccagaagacgagccaacccattggcaccagacaattttgtacttccctgatcctataggggtgacgcaggatcaaatcatagaaggctctgtaacaatcaccccgagcgaggagaatccacgctgtctgaatattcacttggagtgctccacgggaggtcaaaacctggtgaaggattttgcaatgcggtgatcggcgtgttcctcaacctgtcagctcaattacgcggtaactagcccgtgggcccaaggcctaatccacattccccactgacccgaacctggcacaagacctggctgtactctctctactcaactggttcgaaaaatatatccatgttacttaggaggcacagggccaggattttttggtcgaagaaagttgcaggtagccgtcccgtacttttgttattgtctggtgatcactttttactgtaacagtaggcgaaggcggtagt

SEQ ID NO: 2112 - DNA, 1200 bp, Sorghum bicolor
caaattctaagcaaattcacatacgctttctttgtatgaaggcgtatttggtgagtcgcctccgagcagacgacgtcattaggataaggggacctagccgcaaacaagagcgccctatccgcatccgcataaatccgcagtcaaattgaacgagagcgccactccccttctgctaatctctcccgaagcaagcatggccatggcggccgtgggcgtcggcggcgcagtggcctctctcctcccgcagcgccgccgaggcggcaccgtcgtcacctggagcggcgcggcggcctgcgtcgggcggcggcggcgggcgtccgtggcggtgcgcgcgtcgtacgaggccggggtgggcgtgatggcgaccaaggtggggatgatgacctacttcgacccggagacggggaagccggtgcccgtgacggtcgtcgggttccgggagggcggcaacgtggtgacgcaggtgaagacggccgccacggacgggtacgacgccgtccaggtcgggtaccacggcgtgcgcgaggacaagctcacccgcccggagctgggacacctgggcaaggccggcgccccgccgctgaagcacctgcaggagttcaggctcaccgccgtcgacgccttcgagcccggccagccgctcgacttcgccgacctcttcaaggagggcgacatcatcgacgtctccggcaacaccatcggcaaggggttccaaggtggcatcaagaggcacaacttcaagcgagggctgatgacacacggttccaagagccacaggcagctgggttccatcggagcggggacgacgccggggcgtgtatacaaggggaagaagatgcccgggaggatgggaggaaagaagaccaagatcaggaagctcaagatcgtcaagatcgacaatgatctccgggtgctcatgatcaagggtgccgtgccaggaaagcccgggaacctcctccgcattacgccggccaagatcgtcggcaagaacatccccaagaactagacgagttctttttttttttgaggggtgaattcttagtgtttccaaccctgctgtaaactggatgtaattctttgccaattaccagttttttgtacacatgcaacttcagatgagtgtcgttgactatggagtatgggctaacacaatctctctcacatgatgcttggatgagtgataatcttgcaagcagattc

SEQ ID NO: 2113 - DNA, 1215 bp, Sorghum bicolor
tggaggtgtactagccgtacaaattctaagcaaattcacatacgctttctttgtatgaaggcgtatttggtgagtcgcctccgagcagacgacgtcattaggataaggggacctagccgcaaacaagagcgccctatccgcatccgcataaatccgcagtcaaattgaacgagagcgccactccccttctgctaatctctcccgaagcaagcatggccatggcggccgtgggcgtcggcggcgcagtggcctctctcctcccgcagcgccgccgaggcggcaccgtcgtcacctggagcggcgcggcggcctgcgtcgggcggcggcggcgggcgtccgtggcggtgcgcgcgtcgtacgaggccggggtgggcgtgatggcgaccaaggtggggatgatgacctacttcgacccggagacggggaagccggtgcccgtgacggtcgtcgggttccgggagggcggcaacgtggtgacgcaggtgaagacggccgccacggacgggtacgacgccgtccaggtcgggtaccacggcgtgcgcgaggacaagctcacccgcccggagctgggacacctgggcaaggccggcgccccgccgctgaagcacctgcaggagttcaggctcaccgccgtcgacgccttcgagcccggccagccgctcgacttcgccgacctcttcaaggagggcgacatcatcgacgtctccggcaacaccatcggcaaggggttccaaggtggcatcaagaggcacaacttcaagcgagggctgatgacacacggttccaagagccacaggcagctgggttccatcggagcggggacgacgccggggcgtgtatacaaggggaagaagatgcccgggaggatgggaggaaagaagaccaagatcaggaagctcaagatcgtcaagatcgacaatgatctccgggtgctcatgatcaagggtgccgtgccaggaaagcccgggaacctcctccgcattacgccggccaagatcgtcggcaagaacatccccaagaactagacgagttctttttttttttgaggggtgaattcttagtgtttccaaccctgctgtaaactggatgtaattctttgccaattaccagttttttgtacacatgcaacttcagatgagtgtcgttgactatggagtatgggctaacacaatctctctcacatgatgcttggatgagtgataatcttgcaagcag

SEQ ID NO: 2114 - DNA, 1228 bp, Setaria italica
gtggatacgcctctccgcttctctctaacgaaggcgtatttttcagaaggcgcctccgagcaggcgggaggataagggggagttggccgcaagcagagcccccctatcccaatcgaattcaactagagagggagcccagcacaagcaggagcagccactcccccaactcaaatcaagcatggccatggcggccgtgggcatcgccggcggcgcactggcgctcctcctcccgcagcagcgtggccgccggggcggcggctgcgcggtgtcgttcaggcgcgcgggggcgtcggtgacggtgcgcgcgtcgtacgaggccggggtgggcgtgatggcgaccaaggtggggatgatgacctacttcgacccggagacggggaagccggtgccggtgacggtagtcgggttccgggatggcgggaacgtggtgacgcaggtgaagacggcggccacggacgggtacgacgccgtgcaggtcgggtaccacggcgtgcgcgacgacaagctcacgcgcccggagctgggccacctgggcaaggccggcgcgccgccgctgcgccacctgcaggagttcaggctcaccaccgtcgacgcgttcgagcccggacaggagctcgacttcgccgagctcttcaaggagggcgacctcgtcgacgtctccggcaactccatcggcaaggggttccaaggtggtatcaagaggcacaacttcaagcgtgggttgatgactcacggttccaagagccacaggcagctgggttccattggtgctggaacaacgccggggcgcgtgtacaaggggaagaagatgcccgggaggatgggaggaaccaagaccaagatcaggaagctcaagatcgtcaagattgacaacgacctccgggtcgtcatgatcaagggcgctgtgccagggaagcccggcaacctcctccgcatcgcgcctgccaagattgttggcaagaacatccccaagaactagaattgtttttgctgattttttagtgtttccctaccctgctgcaaaatggatgtaatttcatcgccaattgacagtttttgtacacacgaagattagtaaaaaacatcctcatatgagcgttgtcatccgttctgctgacagcttgttcatttgcattatttgcactgagctaatagaatctctcaccagatgcttgtgtgatagatctgcaagcagattctgttgcccaggaattgccaaagaataagt

SEQ ID NO: 2115 - DNA, 1835 bp, Pennisetum glaucum
cggccgtgggcatcgccggcggcgcactggcgctcctcctcccgcagaagggtggccgccggggcggcggctgcacggtctcgttcaggcgcgcggcggcgtcggtggtggtgcgcgcgtcgtacgaggccggggtgggcgtgatggcgaccaaggtggggatgatgacctacttcgacccggagacggggaagccggtgccggtgacggtcgtcgggttccgggacggcgggaacgtggtgacgcaggtgaagacggcggccacggacgggtacgacgccgtgcaggtcgggtaccacggcgtgcgcgaggacaagctcacgcgcccggagctgggacacctgggcaaggccggcgcgccgccgctgaagcacctgcaggagttcaggctcaccgccgtcgacgcgttcgagcccggacaggagctcgacttcgccgagctcttcaaggagggcgacctcgtcgacgtctccggcaactccatcggcaaggggttccaaggtggcatcaagaggcacaacttcaagcgtgggttgatgactcacggttccaagagccacaggcagttgggttccatcggtgctggaacaacgcccgggcgtgtgtaccctgggaagaagatgcccgggaggatgggaggaaccaagaccaagatcaggaagctcaagatcgtcaagattgacaacgacctccgggtcgtcatgatcaagggcgctgtgccagggaagccgggtaacctcctccgcatcgcgcctgccaagatcgttggcaagaacatccccaagaactaggagctattttttttgctgaattttgagtgttttcctaccctgctcatgtcccgtatgcacacaaggggttgctgcccatgttccgcgacgaggaagatcccggaagagttgagcaggatcaagagtgtggtgatccaatcacaatgaatatagatgaggccaacataaaggggttcttgtcgacgatgaaaggaggcagcatccgtttcgtggcgccatgcacgttccatggcacaccacctaccaaagaatacgctgacggcaaggcggcggcttggttcatgctggtggccttctgcatccctgtggctccggggagaagcaggttaatctggtcaaactcgaggaatgtcggggtttggcgcctcaagatgataccacggtggttctcccaccacgccattaatcgtatattggattcagacattagccttgtccatcttgaggagcgcaattttattgcggcgggacttgataaatggcacaaagcttgctatgtgcccacatcttcggacgctatggtcgtcgcgttcaggaattggtttaggaagtattgcaagaatcaggttggctggggaagcccacaagttgaacagttaccaccaacccctaccaaggataagctcttggagaggtattggtcacacgtcatgcagtgcaccagctgcagtgcggcgctcaagtccatgaaggtgctcgaggtcgccctgcaggtcatgtcagttgccattgttgggttcctctccgttgccaaagggacgttgctcgcatcgactgttcagaggaccgcggtcatgtctgcagctgtgctgtgctttgttgcatcccgttggcttgctaattacatacaaaacaatttctattttcaagattatgttcactcttacaagtgaatgagtttcgagggatcttgaaagtaaatttatgtttaatagatagaagatgcaatcgtttatccattatctaaataaaaaatctatatgtacataaattttagcagatactttcttattttatttgtctctaatgcataaggtttttttt

SEQ ID NO: 2116 - DNA, 1039 bp, Brachypodium distachyon
cagcagcagagcgagcacactccgctgcactaatctcgctcgaatcccatcagcaatggcagccatggcggccgcgagcgtcggcggcgcgctgggcttcctcgccccgcgccgccgcatcgccgtcggagcagcgccgaggagggtcgcggtgcgggcgtcgtacgaggcgggggtaggggtgatggcgaccaaggtggggatgatgacctacttcgacccggccaacgggaagccggtgcccgtcacggtggtcgggttccgggacggcgggaacgtggtgacgcaggtgaagaccgccgccacggacggctacgacgccgtgcaggtggggtaccacggcgtgcgggaggacaagctcaccaggccggagctggggcacctgggcaaggccggcgcgccgccgctgcgccacctgcaggagttccggctccaggccgtcgacgcgttcggccccggccaggcgctcgagttcgccgagctcttcaaggagggcgacctcgtcgacgtctccgccaaaaccatcggcaaggggttccaaggtgggattaagaggcacaacttcaagcgcggtctgatgactcacggttccaagagccacagagccctgggttcgatcggtgcggggacaacaccagggcgggtgtacaaggggaagaagatgcccgggaggatgggagggaccaagaccaagatcaggaagctcaagatcgtccggatcgacaacgatcttaaagttgtgatgatcaagggtgccattcccgggaagcaggggaaccttctccgcatcacgcccgccaagatcgtcggcaagaacatccccaagagctagatttatcatgtgttttgtcttgtcaagagttcttttgtttcctactccttgctgctggatgtgttgtactcccaggggttcaggttttgtatacatgcaatttcagtttgccaaagctaattatctgagattaagggcattcccttccatgttgtacaccaattgttcttcacctacttgggactaaaagctagtagcaggatatct

SEQ ID NO: 2117 - DNA, 1063 bp, Brachypodium distachyon
gccccaatccgcacctgcaacagcagcagagcgagcacactccgctgcactaatctcgctcgaatcccatcagcaatggcagccatggcggccgcgagcgtcggcggcgcgctgggcttcctcgccccgcgccgccgcatcgccgtcggagcagcgccgaggagggtcgcggtgcgggcgtcgtacgaggcgggggtaggggtgatggcgaccaaggtggggatgatgacctacttcgacccggccaacgggaagccggtgcccgtcacggtggtcgggttccgggacggcgggaacgtggtgacgcaggtgaagaccgccgccacggacggctacgacgccgtgcaggtggggtaccacggcgtgcgggaggacaagctcaccaggccggagctggggcacctgggcaaggccggcgcgccgccgctgcgccacctgcaggagttccggctccaggccgtcgacgcgttcggccccggccaggcgctcgagttcgccgagctcttcaaggagggcgacctcgtcgacgtctccgccaaaaccatcggcaaggggttccaaggtgggattaagaggcacaacttcaagcgcggtctgatgactcacggttccaagagccacagagccctgggttcgatcggtgcggggacaacaccagggcgggtgtacaaggggaagaagatgcccgggaggatgggagggaccaagaccaagatcaggaagctcaagatcgtccggatcgacaacgatcttaaagttgtgatgatcaagggtgccattcccgggaagcaggggaaccttctccgcatcacgcccgccaagatcgtcggcaagaacatccccaagagctagatttatcatgtgttttgtcttgtcaagagttcttttgtttcctactccttgctgctggatgtgttgtactcccaggggttcaggttttgtatacatgcaatttcagtttgccaaagctaattatctgagattaagggcattcccttccatgttgtacaccaattgttcttcacctacttgggactaaaagctagtagcaggatatctctat

SEQ ID NO: 2118 - DNA, 870 bp, Panicum virgatum
  misc_feature (57)..(57): n is a, c, g, or t
  misc_feature (396)..(396): n is a, c, g, or t
  misc_feature (401)..(401): n is a, c, g, or t
  misc_feature (431)..(431): n is a, c, g, or t
  misc_feature (482)..(482): n is a, c, g, or t
  misc_feature (485)..(485): n is a, c, g, or t
  misc_feature (488)..(488): n is a, c, g, or t
  misc_feature (521)..(521): n is a, c, g, or t
  misc_feature (566)..(566): n is a, c, g, or t
  misc_feature (596)..(596): n is a, c, g, or t
  misc_feature (611)..(611): n is a, c, g, or t
  misc_feature (647)..(647): n is a, c, g, or t
  misc_feature (650)..(650): n is a, c, g, or t
  misc_feature (662)..(662): n is a, c, g, or t
  misc_feature (677)..(677): n is a, c, g, or t
  misc_feature (720)..(720): n is a, c, g, or t
gctgcgcggtctcgttcaggcgcgcggcgtcggtggcggtgcgcgcgtcgtacgagnccggggtggcgtgatgcgaccaaggttgggatgatgactacttcgacccggccacggggaagccggtgccggtgacggtcgtcgggttccgggagggcgggaacgtggcgacgcaggtgaagacggcggccacggacgggtacgacgccgtgcaggtcgggtaccacggcgtgcgcgaggacaagctcacgcgcccggagctgggccacctgggcaaggccggcgcgccgccgctgaggcacctgcaggagttcaggctcaccgccgtcgacgcgttcgagcccggccaagagctcgacttcgccgagctcttcaaggagggcgacctcgtcgacgtcnccggnaactccatcggcaaggggttccaaggtggnatcaagaggcacaacttcaagcgtgggttgatgactcacggttccaagagncanagncaactgggttccattggtgctggaacaacaccngggcgggtgtacaaggggaagaagatgcctgggaggatgggaggnaccaagaccaagatcaggaagctcaagatngtcaagatcgacaangacctccgggtcctcatgatcaagggcgctgtaccnggnaagcctggtaanctcctccgcatcgcncctgccaagatcgtcggcaagaacatccccaagaactagaatntttcactaaactttgagtgttccccaccctgctggctgctgcaaactggatgtaatttcttcaccaactaccagtttttgtacacataagatttcagattagtaatcatcagatatgagtgttatcgtccattctgaagacagcttgtcc

SEQ ID NO: 2119 - DNA, 1060 bp, Hordeum vulgare
caaaaacatcaccggcagcagcagagtgagcgcctccgttgcactaatctcgctcgaatacagcagccatggccatggcggccgcgagcatcggcggcgcactgggcttcctcgccccgcgccgtcgcggcgtgtccttcgcggcggcggtaggccggaggaggccgtctctggcggttgtgcgggcggcgtcctacgaggcgggcgtcggggtgatggcgaccaaggtggggatgatgacctacttcgacccggccaacgggaagccggtgccggtgacggtggtcgggttccgggaggggggcaacgtggtgacgcaggtgaagaccgcggccaccgacggctacgacgccgtgcaggtcgggtaccacggcgtgcgcgaggacaagctcacccgcccggagctgggccacctcggcaaggctagcgcgccgccgctgcgccacctgcaggaattccggctggtggccgtcgacgccttcgaccctggccaggagctcgagttcaacgagctcttcaaggagggcgacctcgtcgacgtctccgccaaatccatcggaaagggattccaaggtggaatcaagaggcacaacttcaagcgtggtctgatgactcacggttccaagagccacagagccctaggttcgatcggtgcggggacaaccccagggcgggtgtacaaggggaagaagatgcccgggaggatgggcggaaccaagaccaagatcaggaagctcaagatcgtcaggatcgacaatgatctcaaagttgtgatgatcaagggggccattcctgggaagcaggggaaccttctccgcatcacgcccgcgaagattgtcggcaagaacatccccaagagctagacctgtgctgcgtttcatcttgtaagagtttgttttgtttcctttctgttgtattcccaggtccaggttttctatacatgctcagtttgctaaagctaatctttggatccaagtgcgtcgtcctccatgttgtcaaccacttcttcaccttcttttggactcaaaaaaacaaagccagcagattctctctatggtct

SEQ ID NO: 2120 - DNA, 938 bp, Setaria italica
gtgtcgttcaggcgcgcgggggcgtcggtgacggtgcgcgcgtcgtacgaggccggggtgggcgtgatggcgaccaaggtggggatgatgacctacttcgacccggagacggggaagccggtgccggtgacggtagtcgggttccgggatggcgggaacgtggtgacgcaggtgaagacggcggccacggacgggtacgacgccgtgcaggtcgggtaccacggcgtgcgcgacgacaagctcacgcgcccggagctgggccacctgggcaaggccggcgcgccgccgctgcgccacctgcaggagttcaggctcaccaccgtcgacgcgttcgagcccggacaggagctcgacttcgccgagctcttcaaggagggcgacctcgtcgacgtctccggcaactccatcggcaaggggttccaaggtggtatcaagaggcacaacttcaagcgtgggttgatgactcacggttccaagagccacaggcagctgggttccattggtgctggaacaacgccggggcgcgtgtacaaggggaagaagatgcccgggaggatgggaggaaccaagaccaagatcaggaagctcaagatcgtcaagattgacaacgacctccgggtcgtcatgatcaagggcgctgtgccagggaagcccggcaacctcctccgcatcgcgcctgccaagattgttggcaagaacatccccaagaactagaattgtttttgctgattttttagtgtttccctaccctgctgcaaaatggatgtaatttcatcgccaattgacagtttttgtacacacgaagattagcaaaaaacatcctcatatgagcgttgtcatccgttctgctgacagcttgttcatttgcattatttgcactgagctaatagaatctctcaccagatgcttgtgtgatagatctgcaagcagattctgtt

SEQ ID NO: 2121 - DNA, 1085 bp, Avena sativa
cacctaaatcacagaccagagcaacaccatcagagtgagcgccaccgctgcactaatctcgctcgaatccaccagcaatggccatggcggccgcgagcatcggcggcgcgctgggcttcctagcccctcgccgccgcggcgtatccttctccggtgccggaggagcgcggaggaggccgccgctggcggtggtccgggcggcgtcgtacgaggcgggcgtcggggtgatggcgaccaaggttgggatgatgacctacttcgacccgtccaacgggaagccggttccggtgacggtggtcgggttccgggacggcgggaacgtggtgacccagataaagaccgccgccaccgacggctacgactccgtgcaggtcggctaccacggcgtgcgcgaggacaagctcactcgcccggagctgggacacctcggcaaggcgggcgcgccgccgctgcggcacctgcaggagttccggcttgtggccgtcgacgcattcgaccctggacaggagctcgagttcaacgagctattcaaggagggcgacctcgtggacgtctccgccaaaaccatcggaaagggattccaaggtggaataaagaggcacaacttcaagcgtggtctgatgactcacggttccaagagccacagagcccttggttcgattggtgccgggacaacaccggggcgtgtgtacaaggggaagaagatgcccgggaggatgggcggaaccaagaccaagatcaggaagctcaagattgtcaggatcgacaacgatcttaaagttgtgatgatcaagggagccattcctgggaagcagggaaaccttctccgcatcacacccgcgaagattgttggcaagaacatccccaagagctagatctatgatgtgttccatcttgttaagagttaatttggttttttattttattgctggatgtgctgtatttccaggtccaggttttgtatacaggcaatttcagtctgctaaagctaatcttcggatacatgtgcattctccttcgtgctgttgaccgcttgttctttaccttttgaactcaaaactagcttaatatatgtattggcgtat

SEQ ID NO: 2122 - DNA, 1086 bp, Avena sativa
cacctaaatcacagaccagagcaacaccatcagagtgagcgccaccgctgcactaatctcgctcgaatccaccagcaatggccatggcggccgcgagcatcggcggcgcgctgggcttcctagcccctcgccgccgcggcgtatccttctccggtgccggaggagcgcggaggaggccgccgctggcggtggtccgggcggcgtcgtacgaggcgggcgtcggggtgatggcgaccaaggttgggatgatgacctacttcgacccgtccaacgggaagccggttccggtgacggtggtcgggttccgggacggcgggaacgtggtgacccagataaagaccgccgccaccgacggctacgactccgtgcaggtcggctaccacggcgtgcgcgaggacaagctcactcgcccggagctgggacacctcggcaaggcgggcgcgccgccgctgcggcacctgcaggagttccggcttgtggccgtcgacgcattcgaccctggacaggagctcgagttcaacgagctattcaaggagggcgacctcgtggacgtctccgccaaaaccatcggaaagggattccaaggtggaataaagaggcacaacttcaagcgtggtctgatgactcacggttccaagagccacagagcccttggttcgattggtgccgggacaacaccggggcgtgtgtacaaggggaagaagatgcccgggaggatgggcggaaccaagaccaagatcaggaagctcaagattgtcaggatcgacaacgatcttaaagttgtgatgatcaagggagccattcctgggaagcagggaaaccttctccgcatcacacccgcgaagattgttggcaagaacatccccaagagctagatctatgatgtgttccatcttgttaagagttaatttggttttttattttattgctggatgtgctgtattcccaggtccaggttttgtatacaggcaatttcagtctgctaaagctaatcttcggatacatgtgcattctccttcgtgctgttgaccgcttgttctttaccttttgaactcaaaactagcttaatatatgtattggcgtatg

SEQ ID NO: 2123 - DNA, 3721 bp, Oryza sativa
gcggagtctgtacggtcgcccgacctgcccaggaggtagctccgcctgtctagcctaacctgtaatttattatgcacccgtggtattttgcaactgttacggaatccacctccccggcaaagaaagcgtattcctaaaaagcgcctctctgcaggcgggaggataagggggcattagccgcaaaccccaatccaatcgaattcaacacgaaaaacaaccaaagcagcaagcgaagccgggacactgctggagtgagcaaatccccgctcgaatccggggcaccaagaatggccatggcggccgtgggcaggcggcgcggcggcggccgctggtggcggtggtgcgcgcgtcgtacgaggccggggtcggggtgatggcgaccaaggtcgggatgatgacctacttcgacccggccaccggcaagccggtgccggtgaccgtcgtggggttccgggagggcggcaacgtggtgacgcaggtgaagacggcggccaccgacgggtacgacgccgtgcaggtggggtaccacggcgtccgcgaggagaagctcacccgcccggagctcggccacctcggcaaggccggcgcgccgccgctccgccacctgcaggagttccgcctccagtccgtcgacgggtacgaccccggccagccgctcgacttcgccgacatgttcaaggagggcgacctcgtcgacatctccggcaagtccatcggcaaggggttccaaggtggcatcaagaggcacaacttcaagcgagggctgatgacccacggctccaagagccacagagctctgggatcgatcggtgccgggacgacgccgggtcgggtgtacaaggggaagaagatgcccgggaggatgggaggaaccaagaccaagatcaggaagctcaagatcgtcaagatcgacaacgacctgaaagttgtcatgatcaagggcgccgttccagggaagcccgggaacctcctccgcatcgctcctgccaagatcgtcggcaagaacatccccaagaactagactatttttctcatgtgtttcgtcctgttctgtgagatttgtgatctgttgtttactgaattactgtaaattggagatgttctttgcccatgtccaggttttgtatacgcgtaactttgaatttcgtaaagctaattttttttctactcaatcttatcgatctcccgttctcagttcacactctctttggactagaagctaacagaatcttaatcatcttgtgcttggatgtcaaatttgcaatcactgtttattctgtgttcagggaatggaaacatgtaatggtagacggtagtgtaacaaacacatcttgagaatcaaacttcaccaagcgtcaacaatctgacagttttaccaacttctccaatactgaattattgtaaactctcatgtctgaacaaccgaagagtgcagagcgcgacatggccaaccgcagcaagtgcaacagagggaaaatgttaactaagcatcatgtacaaactacacatcaagtgcaacagcacgaaatgtcaatgtaaagcttccagtcaccattaacgctaacttctacaatatcttcagcaatgacacagggacaataggtttcttgcatcagtcaatgcgacacattattaggccatgaaatattctcacacaagtcaccgaagctggtagtccaacagaacaagacctaaaactgacgaagcaatagtttccatgaaattagctgagttccatggccacgaatatagactcacttgcccaaactactatgtacaaagttatgcatcactgctcaacctgcacatacatagagatcgatgaatcaagttagaagagttaaaccagtagcatatagataacaccctattttgctattcaagaatagaaaaagagagggcatgctctaagcaaaccccccatcttcatccccttgccacacaccaccaccatattcacaggctgatggcaccatcatcaggtttttaaattaaataatccttgtgccatctaaagttagtgtattgtggcaacctaaaggataatacatcagatgaattttctttattcagctggccgttccatttatgtacttctctgtttagtttttcatgctcagactagctcttaagttgaaaaataatgcaactagtaactaccgagcccatgtaacagtagagtatgcatgctgatgcctagttgagtgcctaaggatggagtattggactaacatccagctacaatcttcttcagcatcacatgaggaataggaagctcacggtggacaaaatgtctaaggtgcaagaacagtgttcgataaacactgtttattagctgtcacaaatcaactgtctcatgatgcaataacttcgacccattttttgttgtgcttaggataaacaacaggtaaactcaagggcctgaaagacagaatcccaccaaggcagacttctgcagaatgttctcatacagccatgtgaagacattccacaaattaccgcttaaatatggaagtgccatatgcataccaatcaacacgggaatacttagagagttaattttccgccacaaacccccacaatccaatccaatgcaagaccagaaaattaaatggaagaaaaggggaaatgtgtctagttgtgattttgcctaaagtttgattaccttaagcagtaccatcaatatctgattaatcgcttccaaaatcttcataactaacaccctcggatatggtatctagccgtctatttcctatttctgacaatagcaagagaaacattagctagattgagcgttacatcaatgcctcagtgccgtatgttcaagtcaatatttccttgtctagcttgccttacatgttgtgggggtggggtgtactgtggtggtggataagaacgaaacagaaaactggagggaaggggataattaacctgcatggtctccaggagtagactctgagaaattatttggttcagaagggataaaaggggatctgccataattctccaatatttctgcagacaacccaaaataaaaggtgtatgtatacattacacagcaaacagcaatgctgaagaaaaggaaaactaaaaaaaaaaaaggtaatatcacagaaaataatacctgcactttggctaaagtcttcagttaaatctgaaaaactgaaattccgaggaatttggctcaagaaaccaaaagatgatgaatccatgtccataattggatcacctagtggctgtccattcagctcagagctgctgaaggatccaccagaggcatccccaattgactggcaaggttctaggaaagcgctctcattgcagaaaccaaaatcagagttgcccgagtagcttgcttctgtcttgattgttgttccattgtctccattaaacctcccagcagttgagttatgtgctgccagtagactagatgaagcatccatactgctaggaagaccatgaatgactttaccagcatagataaattggtcactggatggagtgccatttacaataccgctggaacttccattgggtagcaagctatctggcattgcagtgctgggagtagtgtctggcaaaaagcatgcattttgattcactgagagtcaacagtgaactatgtcagaacataataaaatttggtccggacatcacaaaaattacaaacttagtaataagctatgtatcaggattcaggactagggaacaaactttctca

SEQ ID NO: 2124 - DNA, 1009 bp, Oryza sativa
caatcgaattcaacacgaaaaacaaccaaagcagcaagcgaagccgggacactgctggagtgagcaaatccccgctcgaatccggggcaccaagaatggccatggcggccgtgggcaggcggcgcggcggcggccgctggtggcggtggtgcgcgcgtcgtacgaggccggggtcggggtgatggcgaccaaggtcgggatgatgacctacttcgacccggccaccggcaagccggtgccggtgaccgtcgtggggttccgggagggcggcaacgtggtgacgcaggtgaagacggcggccaccgacgggtacgacgccgtgcaggtggggtaccacggcgtccgcgaggagaagctcacccgcccggagctcggccacctcggcaaggccggcgcgccgccgctccgccacctgcaggagttccgcctccagtccgtcgacgggtacgaccccggccagccgctcgacttcgccgacatgttcaaggagggcgacctcgtcgacatctccggcaagtccatcggcaaggggttccaaggtggcatcaagaggcacaacttcaagcgagggctgatgacccacggctccaagagccacagagctctgggatcgatcggtgccgggacgacgccgggtcgggtgtacaaggggaagaagatgcccgggaggatgggaggaaccaagaccaagatcaggaagctcaagatcgtcaagatcgacaacgacctgaaagttgtcatgatcaagggcgccgttccagggaagcccgggaacctcctccgcatcgctcctgccaagatcgtcggcaagaacatccccaagaactagactatttttctcatgtgtttcgtcctgttctgtgagatttgtgatctgttgtttactgaattactgtaaattggagatgttctttgcccatgtccaggttttgtatacgcgtaactttgaatttcgtaaagctaattttttttctactcaatcttatcgatctcccgttctcagttcaca

SEQ ID NO: 2125 - DNA, 1019 bp, Secale cereale
ccgcgagcatcggcggcgcactgggcttcctcgccccgcgccgtcgcggcgtgtccttcgccgcggcggtcggtcgtcggaggccgtcgctggcggtggtgcgggcggcgtcgtacgaggcgggcgtcggggtgatggcgaccaaggtggggatgatgacctacttcgacccggaaaacgggaagccggtgccggtgacagtggtcgggttcagggagggcggcaacgtggtgacgcaggtgaagaccgccgccaccgacggctacgacgccgtgcaggtcgggtaccacggcgtgcgcgaggacaagctcacccgcccggagctgggccacctcggcaaggccagcgcgccgccgctgcggcacctgcaggagttccggctggtggccgtcgacgccttcgaccccggccaggcgctcgagttcaacgagctcttcaaggagggcgacctcgtcgacgtctccgccaaaaccatcggaaagggattccaaggtggaattaagaggcacaacttcaagcgtggtctgatgactcacggttccaagagccacagagcgctaggttcgatcggtgcggggacaaccccagggcgggtgtacaaggggaagaagatgcctgggaggatgggcggaaccaagaccaagatcaggaagctcaagatcgtcaggatcgacaatgatctcaaagttgtgatgatcaagggagccattcccgggaagcaggggaaccttctccggatcacgcccgcgaagattgtcggcaagaacatccccaagagctagatttgtgctgcatttaatcatcttgtaagagttaatttgttttctacctcattactggatgcgttgtattcccaggtccaggttttgtatacatgttcagtttgctaaagctaatctttggatacaagtgcgttctcctctatgttgtcaaccacttcttcatcttctttggctccaaacgaagctgattctctcttattgtcatatgcttgggatcagtattttactagttaatta

SEQ ID NO: 2126 - DNA, 842 bp, Leymus cinereus x Leymus triticoides
  misc_feature (13)..(16): n is a, c, g, or t
gagcatcggcggnnnntgggcttcctcgccccgcggcgtcgcggcgtttccttcgccgcggcgggaggtcggaggaggccgccgctggcggtggtgcgggcggcgtcgtacgaggcgggcgtcggggtgatggcgaccaaggtggggatgatgacctacttcgacccggccaacgggaaaccggtgccggtgacggtggtcgggttccgggacggcggcaacgtggtgacgcaggtgaagaccgccgccaccgacggctacgacgccgtgcaggtcgggtaccacggcgtgcgcgaggacaagctcacccgcccggagctggggcacctcggcaaggccagcgcgccgccgctgcggcacctgcaggagttccggctggtggccgtcgacgcctttgaccccggccaggcgctcgagttcaacgagctcttcaaggagggcgacctagtcgacgtctccgccaaatccatcggaaagggattccaaggtggaattaagaggcacaacttcaagcgtggtctgatgactcacggttccaagagccacagagcactaggttcgatcggtgcggggacaaccccagggcgggtgtacaaggggaagaagatgcccgggaggatgggcggaaccaagaccaagatcaggaagctcaagatcgtcaggatcgacaatgatctgaaagttgtgatgatcaagggagccattcctgggaagcaggggaaccttctccgcatcacgcctgcgaagattgtcggcaagaacatacccaagagctagacctgtgccgcgtttcatcttgtaagggttcattcgtttccttttccatgactggctatgttgta

SEQ ID NO: 2127 - DNA, 1297 bp, Sorghum bicolor
ccggctccccgtcctccactttccccgccgacgacgccatgtcggagcaccgcgcgccccgcagctccgtaggaagccgcagctccgcgctgccccatcaccaccagcgccttccgcccgctcccgacccgctcgcctccatctggatccgccgcctccacctctcccccaaccccccgccgccgccgccgccgccgccgcggcccccgcccctgcacatccgcgcgccgccgtctgcacatcaggacgccatctccaccgacgagtcccgcacgccgccgccgctcccgccgccaagcaccgggttcggtcccttccgctggagcccgcgcccgtcgctgggcgcgccggccggcgcgtgggccgccgctgctggtcgtagtgccgttggcggcggccaaacgatgctctcgccgttctttcgtctcccagcgccgctaccaccggtcttggatttcgaggaagtcatgcctttgaggccgttgatcggtctcagaagccacagcggcagtggcgggttccctgggttgtcacgacagatggtcggcgggggcgaccccggcgacgcctggctgtcggccagagctgcaggtgctgcatatcctagccatgctttggacatggttcccataagaacacttaatgatctgcatgatagacagcatggtgcaatacaagtacaaccaaatcttgcaaggcatgatcctagctctagcagccaagatgatgaacctttctcgtattggaacatggggaggttccggagaaacaccacaacttcgtcaatgacacctattggtgttgctcctgtcaattttggcacaaagaggaatgctgattcaaacaattttctccctctgaagctcaggaaactaagtggggctatttagtgttgatgaaatatctggtctgagggttttgaaatgcataagaagcacacatatgctgttatatgtaacagcatgcagtaacacttcaccacgttagagcttgagaaggctggagatggacgcatttggtggcaaccattgtaaattgtactttgctcccaaatcgttgcatttggcatcctttgagccactgacctgtatgtttgtataattttggtgtgatatatagggagatgtcttatgccacgtttcctctatggcgtgtacattcacacaaattgactcaaaacgtgtaatgttccttccaaggaattgtacgttttccctctgcccttgtgtttgtaattgcaattccatccttaccatattttttaccctgaagtttgctaagaagttacaggtgttgc

SEQ ID NO: 2128 - DNA, 1351 bp, Sorghum bicolor
tgcagccacgagaaagcagtgagcaattccactctacttctccctcaccggctccccgtcctccactttccccgccgacgacgccatgtcggagcaccgcgcgccccgcagctccgtaggaagccgcagctccgcgctgccccatcaccaccagcgccttccgcccgctcccgacccgctcgcctccatctggatccgccgcctccacctctcccccaaccccccgccgccgccgccgccgccgccgcggcccccgcccctgcacatccgcgcgccgccgtctgcacatcaggacgccatctccaccgacgagtcccgcacgccgccgccgctcccgccgccaagcaccgggttcggtcccttccgctggagcccgcgcccgtcgctgggcgcgccggccggcgcgtgggccgccgctgctggtcgtagtgccgttggcggcggccaaacgatgctctcgccgttctttcgtctcccagcgccgctaccaccggtcttggatttcgaggaagtcatgcctttgaggccgttgatcggtctcagaagccacagcggcagtggcgggttccctgggttgtcacgacagatggtcggcgggggcgaccccggcgacgcctggctgtcggccagagctgcaggtgctgcatatcctagccatgctttggacatggttcccataagaacacttaatgatctgcatgatagacagcatggtgcaatacaagtacaaccaaatcttgcaaggcatgatcctagctctagcagccaagatgatgaacctttctcgtattggaacatggggaggttccggagaaacaccacaacttcgtcaatgacacctattggtgttgctcctgtcaattttggcacaaagaggaatgctgattcaaacaattttctccctctgaagctcaggaaactaagtggggctatttagtgttgatgaaatatctggtctgagggttttgaaatgcataagaagcacacatatgctgttatatgtaacagcatgcagtaacacttcaccacgttagagcttgagaaggctggagatggacgcatttggtggcaaccattgtaaattgtactttgctcccaaatcgttgcatttggcatcctttgagccactgacctgtatgtttgtataattttggtgtgatatatagggagatgtcttatgccacgtttcctctatggcgtgtacattcacacaaattgactcaaaacgtgtaatgttccttccaaggaattgtacgttttccctctgcccttgtgtttgtaattgcaattccatccttaccatattttttaccctgaagtttgctaagaagttacaggtgttgcgataaag

SEQ ID NO: 2129 - DNA, 764 bp, Zea mays
gctcccccaaattcgtttgtttcccacggcgcaagaaagaaacaagggtacaagaacagcccgctaaaggaaagaaacaagggctacacaagaacagcttgagagctcctctccgatcccgacccaccgcctgcaactcttcttctctcctacgtgttcgtcagcccgctaagtgttaagatggcttcaagcgatggtcagacagaagctgcggccccatctgtccccaaaaaccctgctatggcatcatgccggaagaagaaaacagatgatgctaccttcctcgaagatctgaaagaccacatcgatgagttcatccatgcctccatggatgagcacaagacctgctttaagaagacgatccagaagatgtttgggatgtcgaaggctgttgcagagagatccgcggcagaagcgaaggaagctggagttgaaagtgctttgccacttcagaccagtgtctcgcagtagaatttcacgttggtagtttcttgcttgacgccggcctttttttatacaagggttttgttgctctgtgttgtctgaaacgtataagcgtctcagtggcatgttttcataactgtattgtagtgctttcatcattctccgaagtttgttgtgtgagtatgccttaaatataccagtgtagtttgcttcattctccgatgccttgtatggccgtagaccccatgcatatggacatcctgaacccaactgtcaactgattgagtggttcctgattggctaaaggaaagacatcttgc

SEQ ID NO: 2130 - DNA, 840 bp, Sorghum bicolor
ggcgcccgctgtgtccgccatcccccaaatccgtttgtttcccacggcgcaagaaagaaataaacaagacaggatcaactcgagggctcctctcccattccgatcgccaattcgccatccacaccgcctgcgactgcgaggctgcgacccttcttccccctctgcaccactgtcacggcgtcacgcgcgtgcgctctccttctcccacgagttcgtcagcctgctaagtgttaagatggcttcaagcactagtcagacagaagctccagccccatctgtccccaaaaatcctgcaatggcatcatgccggaagaagaaaacagatgatgctaccttccttgaagatctgaaagaccacatcgatgagttcattcatgcctccatggatgagcacaagacctgctttacgaagacgatccaaaagatgtttgggatgtcaaaggctgttgcagagagatctgcggcagaagcaaaggaagctgaagttgaaagtgctttgccacttcagaccagcgtctctcagtagaatttcatgttggtagtttcttgctcgatgccaaacttttatacaagggttttgttgctctgtgttgtctgaaacgcataagcttgtcagtagcatgttttcgtaattggattgtagtgcttgattctctacagttttttgtctgtgtgtatcatagaccaatgtaacagcttagcttgcttcattctccgaaatcttgtatggctgtactgtacacccaggtatttgggcatcctgaacccaactgattgtgtggtttctgatttgactgattggctaaatgaaagagatctcgttgcaaagttcatccaaca

SEQ ID NO: 2131 - DNA, 907 bp, Sorghum bicolor
atccttctggcccgtccctggtctggtctgcgtccttctttcccacgctccaagaaagaaaaccagaggcgcccgctgtgtccgccatcccccaaatccgtttgtttcccacggcgcaagaaagaaataaacaagacaggatcaactcgagggctcctctcccattccgatcgccaattcgccatccacaccgcctgcgactgcgaggctgcgacccttcttccccctctgcaccactgtcacggcgtcacgcgcgtgcgctctccttctcccacgagttcgtcagcctgctaagtgttaagatggcttcaagcactagtcagacagaagctccagccccatctgtccccaaaaatcctgcaatggcatcatgccggaagaagaaaacagatgatgctaccttccttgaagatctgaaagaccacatcgatgagttcattcatgcctccatggatgagcacaagacctgctttacgaagacgatccaaaagatgtttgggatgtcaaaggctgttgcagagagatctgcggcagaagcaaaggaagctgaagttgaaagtgctttgccacttcagaccagcgtctctcagtagaatttcatgttggtagtttcttgctcgatgccaaacttttatacaagggttttgttgctctgtgttgtctgaaacgcataagcttgtcagtagcatgttttcgtaattggattgtagtgcttgattctctacagttttttgtctgtgtgtatcatagaccaatgtaacagcttagcttgcttcattctccgaaatcttgtatggctgtactgtacacccaggtatttgggcatcctgaacccaactgattgtgtggtttctgatttgactgattggctaaatgaaagagatctcgttgcaaagttcatccaaca

SEQ ID NO: 2132 - DNA, 688 bp, Panicum virgatum
ccccttccgccgccgttccgaaccgtttgtttcccaccgtccaagcaagaccaccgagcaaacgccaattcgttcgccgtccaccgcccgaagctgttcctctctccagtctccaccgccgtcgctcgtcaggctcctcaagtgttaagatggattcaagcaatgttcaatccgaaggttcagccccatctgttccaaaaaacccggccatggcttcatgcaggaagaagaaaaccgatgatgctacgttccttgaagatctgaaagaccacatcgatgagtttgttcatgcctccatggatgagcacaagacctgctttaagaagacaattcagaagatgtttgggatgtcaaaggctgttgcagagcgatcagcagcgggggcaaaggaagctgaagttgaaagtgctctgcctcttcagaccagtgtctcgcagtagaatgtaatggtgataatctgttgctctgtgttacctgaaaagctgaagttctggctgtagtatgtttctgttactggattctagtgtttcattctccaaagctttatgaatactagtatgtcataaaatagattttaaaagataggagtgcaagtttgggattgaaatatcgccgtgcttattactggtttctgatgttgtaataatcaagttaattcaggatcaattcagttactgaatttgtgggt

SEQ ID NO: 2133 - DNA, 731 bp, Setaria italica
gttccgaaatccgtttgtttcccaacgtgcaagaaagagagagaaggcaggaagaccagagactgccagcttcacctcccattccaatcgccaactcgccattgttcccctccccaccaccgtcctcgagcgctcacgagcatcaggctcctcaagtgttaagatggatccaagcaatgctcaatctgaagcttcagccccatctgttccaaaaaaccctgccatggcttcatgtcggaagaagaaaaccgatgatgatgttaccttcctcgaagatctgaaagaccacatcgatgagttcattcatgcatccatggatgaacacaagacctgctttaagaagacaattcagaagatgtttgggatgtcaaaggttgttgcagagcgatcagccgcgggggcaaaggaagctgaagttgaaagtgctctgcctcttcagaccagtgtctcgcagtagaatgtaatggtgtggtaatctgttcctctgtgttatctgcaacaccgaagtgtcggcagtattatgttttggttactggattctagtgtttcattctccaaagtttgctttatgagtacaagcatgtcataaaacagattttagacgataggagtgcaagtttgggattgaaatatcggtgcctatactggtttctgatgttgtaatcaagttaattcaggtttgactcggtttaacagaatttgtgtgtgtttgatgcttcctattatctctg

SEQ ID NO: 2134 - DNA, 732 bp, Setaria italica
ccttgcgccgccgttccgaaatccgtttgtttcccaacgtgcaagaaagagagagaaggcaggaagaccagagactgccagcttcacctcccattccaatcgccaactcgccattgttcccctccccaccaccgtcctcgagcgctcacgagcatcaggctcctcaagtgttaagatggatccaagcaatgctcaatctgaagcttcagccccatctgttccaaaaaaccctgccatggcttcatgtcggaagaagaaaaccgatgatgatgttaccttcctcgaagatctgaaagaccacatcgatgagttcattcatgcatccatggatgaacacaagacctgctttaagaagacaattcagaagatgtttgggatgtcaaaggttgttgcagagcgatcagccgcgggggcaaaggaagctgaagttgaaagtgctctgcctcttcagaccagtgtctcgcagtagaatgtaatggtgtggtaatctgttcctctgtgttatctgcaacaccgaagtgtcggcagtattatgttttggttactggattctagtgtttcattctccaaagtttgctttatgagtacaagcatgtcataaaacagattttagacgataggagtgcaagtttgggattgaaatatcggtgcctatactggtttctgatgttgtaatcaagttaattcaggtttgactcggtttaacagaatttgtgtgtgtttgatgcttcc

SEQ ID NO: 2135 - DNA, 752 bp, Panicum virgatum
ggatctttctttcccacgctccaagaaagaaaaccagaggcgcccccttccgcttccgccgccgttccgaaacccgtttgttttcccaccgtccaagcaagaccaggggcgcgcgatcaaaagctgagacctcccattccaatcgccaattcgccgtccaccgcccgaagctgttcctctctccagtctctaccgccgtcgctcgtcaggctcctcaagtgttaagatggattcaagcaatgcccaatctgaaggttcagccccatctgttccaaaaaactctgccatggcttcatgcaggaagaagaaaactgatgatgctaccttcatcgaagatctgaaagaccacatcgatgagttcattcacgcctccatggatgagcacaagacctgctttaagaagactattcagaagatgtttgggatgtcaaaggttgttgcagagcgatcagccgcgggggcaaaggaagctgaagttgaaagtgctctgcctcttcagaccagtgtctcgcagtagaatgtaatggttgtaatctgctgctctgtgttacctgaaaagctgaagtgccggcagtagtatgtttctgttactggattctagtgttccattctccgaagtttgctttatgaatactagtatgtcataaaatagattttaaatgataggagtgcaagtttggcattgaaatatcgccgtgcttatacagttatactggtttctgatgctttaataatcaagttaattcaggatc

SEQ ID NO: 2136 - DNA, 702 bp, Pennisetum glaucum
tccgaaatccgttggtttcccaccgtgcaagaaagggggaggaggcaagaacaccagcctgccagcttcacctcccgctccactcgccaattcgcccatcccgcccgcaactgctcccctttccattccaccaccatcgcccgcgcgctcacgagtcacaagctcgtcaggctctttgagatggattcaagcaatgctcagtctgccccatctgttccaaaaaaccctgccatggcctcatgccggaagaagaaaactgatgatgatgttaccttcctcgaagatctgaaagaccacatcgatgagttcattcatgcctccatggatgaacataagacctgctttaagaagacaattcagaagatgtttgggatgtcaaaggttgttgcagagcgatcagccgcaggggcaaaggaagctgaagttgaaagtgctctgcctcttcagaccagtgtctcgcagtagaatcatgtaatggtgtggtaatctgttcctctgtgttatctgcaacactgaagtgtcagcagtagtatgttttggttgctggattctagtgtttcgttctccgaagtttgctttatgagtactagcatgtcataaaacagattacgttatagtggtttctaatgttgtaatcaaagttaattcaggtttgatttggactaaaccaaaaaaaaaaaaagtaaaaactctgcgttgata

SEQ ID NO: 2137 - DNA, 641 bp, Secale cereale
aagaaactgagccaaatctcgtgcaatttcctccccctccccctccccgtcggtctcaggcagccgcgcctccgctccgcccttcccccgacgatcctcggagctcgaccaagcattgacatggattccggtaatacgcagacagaaggttctcagccacctgttcctaaaaaccctgccatgacgtcgtgccggaagaagaaaactgatgatgatgtcaccttccttgaagatgtgaaagaacacatcgacgagttcatccacgcgtccatggatgagcacaagacctgcttcaagaagaccattcagaagatgtttgggatgtcgaaggttgtcgcggagcggtccgctgcagcaaaggaagctgaagtcgaaagtgctctgccccttcagaccagtgtgtcccagtagaagaatgcgctggtggcggccccttgttcctttctggtgttcttgttcttgtatcaggagtccagctagtgtcctttttccaacgttgctgtatggttgctataaatttcgtgtaagaaacctcgagtgaaagaaagtacaggagtatgacctgagactggagtactggcccgcgatagtaggcggaaaaaaattgtatgagacctggtctcatagaccagcttgtgaga

SEQ ID NO: 2138 - DNA, 672 bp, Secale cereale
aaagaaaccgagagccaaatctcctgcaatttcctccccctccccgtcggtctcaggcagcggcgcctccgctccgcccttcctccgacgatcctcggagctcgaccaagcattgacatggattccggtaatacgcagacagaaggttctcagccacctgttcctaaaaaccctgccatgacgtcgtgccggaagaagaaaactgatgatgatgtcaccttccttgaagatgtgaaagaacacatcgacgagttcatccacgcgtccatggatgagcacaagacctgcttcaagaagaccattcagaagatgtttgggatgtcgaaggttgtcgcggagcggtccgctgcagcaaaggaagctgaagtcgaaagtgctctgccccttcagaccagtgtgtcccagtagaagaatgcgctggtggcggcccttgttcctttctggtgttcttgttcttgtatcaggagtccagctagtgtcctttttccaacgttgctgtatggttgctataaatttcgtgtaagaaacctcgagtgaaagaaagtacaggagtatgacctgagactggagtactggcccgcgatagtaggcggaaaaaaattgtatgagacctggtctcatagaccagcttgtgagaccctaccggatggacgacatgtggcaaaaaaaaaa

SEQ ID NO: 2139 - DNA, 726 bp, Hordeum vulgare
cctgcctccccccttgctccaagaaagaaacgggaagccaaatctcctgcaacttcccccctctccgccggcctcctccgcccttcctccgacgacccccggagctcaaccaagcattgacatggattccggtaacacgcagacagaaggttcccagccacccgttcctaaaaaccctgccatgacgtcgtgccggaagaagaagaccgatgatgatgtcaccttccttgaagatgtgaaagaacacatcgacgagttcatcaatgcatccatggatgagcacaagacctgcttcaagaagaccattcagaagatgtttgggatgtcgaaggctgtcgccgagcggtctgctgctgccaaggaagctgaagtcgaaagcgctttgccccttcagaccagtgtgtcccagtagtagaagaatgcgctggtggcgttgttcttgtatcagaagtctagctggtgtcttttttttctttcccccaactgttgctgcatggtcactataaatttcgtgtaagaaacctcgagtaaaagtacaggagtgtgacctgagactggagcgccggcaggttttgccgtacaaggcccacgataatagtaggcaggcatacaattcaagtataggccagtaacagcaattgacaagaaacaagtcttgcgctcgtggattgtgatgggccgatccacgtgtgtatcttaaaactcggctgatcgcccagttcaccc

SEQ ID NO: 2140 - DNA, 717 bp, Triticum aestivum
cgcagagtacgcgggaaggccagggaggattacggttttcccttccccctcctaccaaagaaaaaaacgaaagccaaatctccgcaatttcctcctctcccaagtctccggcagccgcgcctccgcccttccgccgacgatcctcggagctcaaccaagcattgacatggattctggtaatacgcagacagaaggttctcagccacctgttcctaaaaaccctgccatgacgtcgtgccggaagaagaaaactgatgatgatgtcaccttccttgaagatgtgaaagaacacattgacgagttcatccacgcgtccatggatgagcacaagacctgcttcaagaaaaccattcagaagatgtttgggatgtcgaaggttgttgcggagcggtccgctgcagcaaaggaagctgaagtcgaaagcgctttgccccttcagaccagtgtgtcccagtagaagaatgcgctggtgtcgggccctagttgctttctggtggcctcgttcttgtatcaggtgttttgtttcaactggtcactacaaatttcgtgtaagaaagctcgagtaataacatgagtataacctgagactggatcgctggcaggccttggtatgcaaggcccacggtatagatttccagagtatagcccaataagagcaacggaaaggcaacaagtcttgcgcatgtgatgggccgattcgtgtgtatcttaaactcg

SEQ ID NO: 2141 - DNA, 651 bp, Avena sativa
ggcgcaccgccggtgttccacggtcctttcccatcccgcaagaaagaaagcgcgagccgcttcgcgagagagaaatcaagaacgaccgtcacctcctccccctctccagtcccctgcaatttcccccctcctcatcctcctcctcttcgtcggtcccagccaggcgcctccgtcaccgcttcctccacaccgaccctcgcggcttccccaagcattgagatggattccagcaatgcacagtctgaaggatcacagccatctgttcccaaaacccccgccatggcgtcgtgccggaagaagaaaaccgacgacgctagcttcctcgaagacgtgaaagagcacctcgacgagttcatcaatgcatccatggatgagcacaagacctgcttcaagaagaccatttctaagatgtttgggatgtcaaagatggttgcggagcggtccgctgcggcgaaggaagctgaggtcgagagcgctctgcctcttcagaccagtgtgtcccagtagaagcggtggcagcttgccgcttggttttgtatcagtagctactgctttttccacctgtttgctgtatgagcaccgctataaaatttcgtgtaacaaacattttcctgaatcttatactagtagaattaagtaaccttgaataac

SEQ ID NO: 2142 - DNA, 802 bp, Oryza sativa
aaagccatctcgaacattccgggtgtttcctcccttcccgtgtgctatcccctccgctccgcggctttctcccgcggtttcccttcctccaagaaagaaaaaccgacgtcgtcgctcgctcgtccaagaaaaccacgatctccttcctctttccaccatccacgatccaatccattcggtcgccgtcatccccctcgtcctcctctcgtgacagatcacttcctcaagacttcggatggaatccattaagacacaatctcaaggttctgcctcttctgttccaaagaacccagccatgtcctcttgtcggaagaagaagtctgacgacgctacgttcctcgaagatctgaaagaccatatcgacgagttcatccatgcctccatggatgagcacaagcattgcttcaaaaacaccatccagaagatgtttgggatgtcaaaggttgtcgcagagcgttccgctgaagcaaaagaagctgaagtcgagagcgctttgcctcttcagaccagtgtctcgcagtaggatgccatggctgatggcagcttgtttgccttctgttgcctgtgttccgtcctgtggagcttaacaatcagtaatacctgtaatagcagtgaatatggagtctactgctttatgtttccttgtattttgctgtttttttcatatattttgagaacaaatcttgaacaaaatggggtataactaaaaagtctacttcaacaagtgtcgaattgctgatctgttttgctcatgtagcagattcctagtctatcctaaattcctaaccttgtttctggggtc

SEQ ID NO: 2143 - DNA, 689 bp, Oryza sativa
gtgctatcccctccgctccgcggctttctcccgcggtttcccttcctccaagaaagaaaaaccgacgtcgtcgctcgctcgtccaagaaaaccacgatctccttcctctttccaccatccacgatccaatccattcggtcgccgtcatccccctcgtcctcctctcgtgacagatcacttcctcaagacttcggatggaatccattaagacacaatctcaaggttctgcctcttctgttccaaagaacccagccatgtcctcttgtcggaagaagaagtctgacgacgctacgttcctcgaagatctgaaagaccatatcgacgagttcatccatgcctccatggatgagcacaagcattgcttcaaaaacaccatccagaagatgtttgggatgtcaaaggttgtcgcagagcgttccgctgaagcaaaagaagctgaagtcgagagcgctttgcctcttcagaccagtgtctcgcagtaggatgccatggctgatggcagcttgtttgccttctgttgcctgtgttccgtcctgtggagcttaacaatcagtaatacctgtaatagcagtgaatatggagtctactgctttatgtttccttgtattttgctgtttttttcatatattttgagaacaaatcttgaacaaaatggggtataactaaaaagtctacttcaacaagtgtcg

SEQ ID NO: 2144 - DNA, 1009 bp, Oryza sativa
ggaagaaagccatcgtttttcacgtgcacgcttcccaaactactaaacggtgagttttttgcaaaaattttctatcaggaaagtttttttaaaaaatcacattaatctatttttgaaatttaaaatagttaataatcaattaatcacattaatccatcgtcgtctgccgccgccactgccgccgccatctgctgccgccgctctactccccagatctacacaaaccaggctgcttcgctttcgcagatcaccggcgtctcaaacaagctagggtagtcgtcggggggaggggggcgcttgctgctccctccgccggcaccatctccagtgccggtgccgtctctccctactggatccggatccggagtcgcgcctccactttcttcatcctggtcgagccgagccccttgggatctaccgttgctgtctgtatactacttcggatggaatccagcaagacacaatctcaaggttctgcctctgttccaaagaacccagccatgtcctcttgtcggaagaagaagtctgacgacgttacgttcctcgaagatctgaaagaccatatcgacgagttcatccacgcctccatggatgagcacaagcattgcttcaaaaacaccatccagaagatgtttgggatgtcaaaggttgtcgcagagcgttccgctgaagcaaaagaagctgaagtcgagagcgctttgcctcttcagaccagtgtctcgcagtaggatgctatggctgatggcagcttgttgccttctgttggctgtgtgccatcctgtggagcttaacaatcagtagtacctgtaataggtgaatcgggagtctactgctgtttttttttataagaaatcttgaacaaattagggtcaacaactgttgaattgctgatttgttttgctcatatagcacattcctactctatcctaaccttgtctaaccttgtatatgaggggtcaataaagaattctgcccacaagattcctcgagctaatgatgagtatgggct

SEQ ID NO: 2145 - DNA, 771 bp, Oryza sativa
ccatcgtcgtctgccgccgccactgccgccgccatctgctgccgccgctctactccccagatctacacaaaccaggctgcttcgctttcgcagatcaccggcgtctcaaacaagctagggtagtcgtcggggggaggggggcgcttgctgctccctccgccggcaccatctccagtgccggtgccgtctctccctactggatccggatccggagtcgcgcctccactttcttcatcctggtcgagccgagccccttgggatctaccgttgctgtctgtatactacttcggatggaatccagcaagacacaatctcaaggttctgcctctgttccaaagaacccagccatgtcctcttgtcggaagaagaagtctgacgacgttacgttcctcgaagatctgaaagaccatatcgacgagttcatccacgcctccatggatgagcacaagcattgcttcaaaaacaccatccagaagatgtttgggatgtcaaaggttgtcgcagagcgttccgctgaagcaaaagaagctgaagtcgagagcgctttgcctcttcagaccagtgtctcgcagtaggatgctatggctgatggcagcttgttgccttctgttggctgtgtgccatcctgtggagcttaacaatcagtagtacctgtaataggtgaatcgggagtctactgctgtttttttttataagaaatcttgaacaaattagggtcaacaactgttgaattgctgatttgttttgctcatatagcacattcctactcta

SEQ ID NO: 2146 - DNA, 622 bp, Triticum aestivum
cagagagaaagaaacgggaaaccacagccggccgaagcctccgctgccccaccgccggtacaggagccaagcagcaacgccgccgcccggagctacgccggcgacgaatccataggcagaacagggcatcaacattgtcaattggagaggcttggagctgctttggcatccacagtagagcaaacacaagaagtatcgacatggattccagcaatgcacagtctgaaggttctcagccacctgttcctcctaaaaaccctaccatgtcgtcgtgccggaagaagaaaaccgatgatgatgccaccttcctcgaagacgtgaaagagcacattgacgagttcatccatgcctccatggacgagcacaagacctgcttcaagaagaccatccagaagatgttcgggatgtcgaaggctgttgcggagcggtccgctgcagcaaaggaagctgaagtcgaaagcgctttgcctcttaagaccagtgtgtcccagtaggaggttgcattggtggtggctggccggttcttgctttctggtggcctggttcttgtatcagcaatctagctagtgtttttttcctactattgctgtgtggtcactatatatttttctgtaagaaatgt

SEQ ID NO: 2147 - DNA, 829 bp, Secale cereale
ttggtacttttttttcttttgaaaggcacgatttctgtcttttcccgtgtgcgccccccggtgatttccctttcctttccggtcctccaagaaagaaaagaaggctagggatagccgccgcttcccccttcctccaagaaagaaaccgagagccaaatctcctgcaatttcctccccctccccgtcggtctcaggcagcggcgcctccgctccgcccttcctccgacgatcctcggagctcgaccaagcatcgacatggattccggtaatacgcagacagaaggttctcagccacctgttcctaaaaaccctgccatgacgtcgtgccggaagaagaaaactgatgatgatgtcaccttccttgaagatgtgaaagaacacatcgacgagttcatccacgcgtccatggatgagcacaagacctgcttcaagaagaccattcagaagatgtttgggttgtcgaaggttgtcgcggagcggtccgctgcagcaaaggaagctgaagttgaaagtgcacttccccttcagaccagtgtgtcacagtagaagaatgcgcccgtggcgggcccttgttgctttctggtgttcttgttcttgtatcaggagtccagctagtgtccttcttttccaacggttgctgtatggtcgctataaatttcgtgtaagaaacctcgagtgaaagaaagtacaggagtataacttgagactggagtactggcccatgataatactccctccgttccaaattactaaccacgacgagtaatttggaacgaagggagtagtaggcaggctaattccagaatagcccagtaacagcaactgaaaa

SEQ ID NO: 2148 - DNA, 748 bp, Triticum aestivum
tccggtcctccaagaaagaaaagaggatagccgcttcccccttcctccccctccccgtcggtctcaggcagccgcgcctccgctccgcccgtcctcggacgatcctcggagctcaaccaagcattgacatggattccggtaatacgcagacagaaggttctcagccacttcctaagaaccctgccatgacgtcatgccggaagaagaaaactgatgatgatgttaccttccttgaagatgtgaaagaacacatcgatgagttcatccacgcgtccatggatgaacacaagacctgcttcaagaagaccattcagaagatgtttggcatgtcgaaggttgtcgcagagcggtccgctgcagcaaaggaagctgaagtcgaaagtgctttgccccttcagaccagtgtgtcccagtagaagaatgcgctggtggctggcccttgttgccttctggtggccttgttcttgtatcaggtgttttttcatttgtttcaactggtcactataaatttcgtgtaagaaacctcgagtaatagcatgagtataacctgagactggatcgctggcaggccttgctatacaaggcccacggtatagagttccagagtatagcccaataagagcaacagaaaggcaacaagtctttgcgcatgtgatgggctgagtcgtgtgtatcttaaactcgtccagttcatccaaccaactgattccgctcaaaaaaatacatcgaactcattttgatacaaaaa

SEQ ID NO: 2149 - DNA, 666 bp, Brachypodium distachyon
cctctacccgcctccaagaaagaaacgagcatcctctttctcaaaaaaagaaaaagaaacgaccggaccctcttcccccttttctccaggaaaggaaactctcggctgctgcctgctggccgatcccttgaaatttccatctcctcttcctcgtcggtctgagccaggcgccctctcccccggaatccttgcagcttgtccaagtatagagatggattcaagcaatacgcagcctgaaggttcacgcccatctgttaccaaaaaccctgccatgtcgtcgtgcaggaagaagaaaaccgatgatgctaccttcctcgaagatgtcaaagaccacatcgacgagttcatcaatgcctccatggatgagcacaagacctgcttcaagaagaccattcagaagatgtttgggatgtcaaagattgttgcggatcggtccgctgcggcaaaggaagctgaagtggaaagtgtgttgcctcttcagaccagtgtgtcaaggtagaagaatggttgatggtggcagcttgttgcttcctggacttggttcttgtatctggaatctagctagtgttttcaccactaaatttcgtgtaacaggtgagtaatactaatacagtagtacaatcatctaaaaatgaaaataaagtactccgtggattgtgagacttg

SEQ ID NO: 2150 - DNA, 867 bp, Brachypodium distachyon
cctctacccgcctccaagaaagaaacgagcatcctctttctcaaaaaaagaaaaagaaacgaccggaccctcttcccccttttctccaggaaaggaaactctcggctgctgcctgctggccgatcccttgaaatttccatctcctcttcctcgtcggtctgagccaggcgccctctcccccggaatccttgcagcttgtccaagtatagagatggattcaagcaatacgcagcctgaaggttcacgcccatctgttaccaaaaaccctgccatgtcgtcgtgcaggaagaagaaaaccgatgatgctaccttcctcgaagatgtcaaagaccacatcgacgagttcatcaatgcctccatggatgagcacaagacctgcttcaagaagaccattcagaagatgtttgggatgtcaaagattgttgcggatcggtccgctgcggcaaaggaagctgaagtggaaagtgtgttgcctcttcagaccagtgtgtcaaggtagaagaatggttgatggtggcagcttgttgcttcctggacttggttcttgtatctggaatctagctagtgttttcaccactaaatttcgtgtaacaggtgagtaatactaatacagtagtacaatcatctaaaaatgaaaataaagtactccgtggattgtgagacttgaatactgccaggtttagctccattgtaggggttgtctcgctttaaatatatatcaaggcccaacctagttgctgcaatgtagcccatgaaaaacaacttgagcgttgctgatgtccgagttgtatctcgactgcacactcatctctatactagccgcgtaaattcccttaaaaaatgaaaccagccccccaaaatttccct

SEQ ID NO: 2151 - DNA, 656 bp, Secale cereale
caacagccggccgaagcctccgccgccccgccgccggtacaggagccaagcagcgcctcccttcgtcgagcagcaacgccgccgcccggagctacgccggcgaccaatccataggcagaacagagcatcaacattgtcaattggagaggcttggagctgttttggcatccacagcatagcagacaagaagtatcgacatggattccagcaatacacagtctgaaggttctcagccaccagttcctcctaaaaaccctaccatgtcgtcgtgccggaagaagaaaactgatgatgatgctaccttcctcgaagacgtaaaagagcacattgacgagttcatccatgcctctgtggacgagcacaagacctgcttcaagaagaccatccagaagatgttcgggatgtcaaaggctgttgcggagcggtccgctgcagcagcaaaggaagctgaagtcgaaagcgcgttgcctcttgagaccagtgtatcccagtaggagattgcattggtggtggctggccggttcttgctttctggtggcatggttcttgtatcaggaatctagctagtattcttttttcctaatgttgatgtatggtcactatatattttttctgtaagataagaaatgttgaataatattaacatgaatataacc

SEQ ID NO: 2152 - DNA, 627 bp, Cynodon dactylon
ccgggggagcagccgttggtttgctgcccaccgtgcaagaaagaaacgaggcgaaaaccggcggcgtgatcgtgacgcggccactcccactcattccaatcgccaattcgtcctccaccgccgtctgcagccacttccctctccgcaaattcgccctccaccgcaagttttaagatggactcaggcagtactcaacctgcaggttcagcagccccttctgttcccaaaaatcctgcaatgacttcgtgcaggaagaagaaatctgaggaggctaccttccttgaagatgtgaaagaccacatcgatgagttcattcatgcctccatggatgaacacaagacctgcttcaagaagaccattcagaagatgtttggcatgtcaaaggttgttgcagagagatccgcggaaaaagcaaaggaagctgaagtagaaagtgcattgccgcttcagaccagtgtttcacagtaggaggcaatggtgtctgctaggctaagctttttggtcgtagcttgtgtttatagtttgtatgagttcagtttttattctcttcgtttgctgtattacttctactgtcttgcactgcataaatatgaataataagagcacaagttgagatttgaataccgc

SEQ ID NO: 2153 - DNA, 1250 bp, Pseudoroegneria spicata
tttggtaatcctgggccttgtatagcaaatcctgccagtactccactcatgtattacatacacgaaatttattgtgaccatacagcaacagttgttaaaaaaaacaaaaaaacactagctggactcctcctgatacaagaacaaggccaccaccaatgcattcttctactgggacacactggtctgaagaggcagagcgctttcgacttcagcttcctttgctgcagcggaccgctccacgacaaccttcgacatcccaaacatcttctgaatggtcttcttgaagcaggtcttgtgctcatccatggaggcatggatgaactcgtcgatgtgttctttcacatcttcaaggaaggttacatcatcatcagttttcttcttccggcacgacgacatgggagggtttttaggaacagatggctgacaaccttcggtctgtgtattgcagcgagcggggagggacggggcagcctcgggcgacgccgtccggcggcgagggcggcgcgagcaacttcttccacttcgatcgatcgagaaagagaggggttccgatggggctgcagtggatgctcctgacgtgcgtggtgggggcggaggcggcggtggccgcgctgctcacgctcccggcgccgcgggccgtgcgggcacagatcgtcgggctcacctcgatgcttctgcagcccttggccgccgtgctccccttcgccgccttccagctactcgatatctactggaagaacgagcacaggctgatttgcacgggagagatgtgcacctccgaggagcgtgtccgcttcgagaaatccattttcaagtcccagaggaatgtcatcctttgtgtttcagtatttatcctttattggtccatctatcgtatttgcaagttcaacaaggacattaaggcactggaggaggttgagaagcgcatcaaggaagagtagattcgtcctagtttgtgatggattttgtggtattcccggccttcagcagatgtatccagtaggatatccaatgtatatttggttctcctttgagcaaatagaatgtaacctgtttcgacgcttcacatcctcctttcttggactggctgttctatatgtaacttgtggcggtggctactgcaaagacatctaaacgtttccatattagtcatccttgaagtttgaacatctgctagaatgttgtctggaccgacctttcggtggtcttccgtgttgaaataatctggtatttctgtagaattttactca

SEQ ID NO: 2154 - DNA, 737 bp, Hordeum vulgare
aaacaacagccggccgaagcctccgccgccgcgccgccggtacagtacaggagcgcagcagcgcctccctccaccgaacagccgctcccgcccagcaacgccggcgacctgtccattggcagaacagggcatcaacattgtcaactggagaggcttggagctgctttggcatccacagtagagcaaacaagaagtgttgacatggattccagcaatacacagtctgaaggttctcagccacatgttcctaaaaaccctagcatgtcatcgtgccggaagaagaaaaccgatgatgatgctacactccttgaagatgtaaaagagcacattgacgagttcatcaatgcctccatggacgagcacaagacctgcttcaagaagaccattcagaagatgttcgggatgtcaaaggctgttgcggagcggtccgctgcagcaaaggaagctgaagtcgaaagcgccttgcctcttgagaccagtgtgtcccagtaggagattgcattggtgatggcctattcttgctttctggaggcctggttcttgtatcaggaatctagctagtgtttccccccttatactgttgctatatattttctgtaagagatgctgaataatattagcatgagtttttttagtctaataatattagcatgagtataaacttgagctatacaaggcccactgccaggttttgctatacaggcccacgataattaatgtaggcagtgattccagta

SEQ ID NO: 2155 - DNA, 604 bp, Triticum aestivum
cgaaagccaaatctcctgcaacttcttcctcctctccccctctccgtcggtctcaggcagccgcgcctccgcccttccgccgacgatcctcggagctcaaccaagcattgacatggattccggtaatacgcagacagacggttctcagccagctgctcctaagaaccctgccatgacgtcgtgccggaagaagaaaactgatgatgatgttaccttccttgaagacgtgaaagaacacatcgacgagttcatccacgcgtccatggatgagcacaagacctgcttcaagaagaccattcagaagatgtttgggatgtcgaaggttgtcgcggagcggtccgctgcagcaaaggaagctgaagtcgaaagcgctttgccccttcagaccagtgtgtcccagtagaagaatgcgctggtggcgggcccttgttgctttctggtggccttgttcttgtatcaggtgttttttcatttgtttcaactggtgactataatttcgtgtaagaaacctcgagactggatcactggcaggccttgctatacaaggcccacggtatagagttccagagtatagcccaataagagcaacggaaacgcaacaagt

SEQ ID NO: 2156 - DNA, 772 bp, Panicum virgatum
atcgatagtagagcagagcagagcagagtcttcctcaacccatcctcgctcccctacaccaattcgttcagcgatctttcgtgcttggccctcctgtcctgcacatggcatccgccgctgccccgccgacgccgccgccggagccgggcgccgccgcatcgtggtggccgtggacgagggcgaggagagcgcgcacgcgctcgcctggtgcctcgccaacgtcgtctccccggcgggcggcgacacgctcgtgctcgtgcacgcgcgccgcccgccccccgtctacgccgccatggacagcgcagggtacatgctgacctcggacgtgctggcgagcgtggagcggcacgccagcgccgtctcggcggcggccgtcgacaaggccaggcgcctctgcgccgggcacccgcacgtggcggtggagacgctggtggagagcggggacccgcgggacgtgatctgcgacgccgccgacaaggtgggcgccgacctgctcgtcatgggcagccatgggtacggcttcatccagagggcgttcctgggcagcgtcagcaaccactgcgcgcagaactgcaaatgcccggtcctcatcgtcaagaggcccaaggagtagaacggtccttgcaaatgctgcatcttgccagcctgtagcatcatatatgtaaatatttttttttaacgtccgatggcactggtttcttgttcgagaacatgatcagagcactgcagtttttttttgctggaataagagattcagacagagtatttcgcc

SEQ ID NO: 2157 - DNA, 911 bp, Setaria italica
aaacccagcggcggccgcggccgcccaaacccagggcagtgtcacacggagacggggacagccagccaggcgccgtggcagcccgtgcagagcacctagccgcgggcttctccccctgttttaaagcaggcctctcccctcagccccttctcatcgtcatcgccatcgatagcagcatccaattcttgtgcgacccgctccgctcccccccaacaacaattcgtccagcgatcctcgtgctcagttctccagcatggcatccgccgctccccccgccaccgccgccgccggagccgggcgccgcatcgtggtggccgtggacgagggcgaggagagcgtgcacgcgctcacctggtgcctcgccaacgtcgtctccccggcgggcggcgacacgctcgtcctcgtgcacgcgcgccgctcgcgccccgtctacgccgccatggacagcgcagggtacatcatgacctcggacgtgctggcgagcgttgagaggcacgccaccgccgtctcggcggcggccgtcgacaaggcaaagcgcatctgcgccgagcacccgcacctggcggtcgagacgctggtggagagcggggacccgcgggacgtcatctgcgacgccaccgacaaggtgggcgccgacctgctcgtcatgggcagccatggatacggcttcatccagagggcgttcctgggcagcgtcagcaaccactgcgcgcagaactgcaagtgcccggtcctcatcgtcaagaggcctaaggagtagtagaatgacatccttgcaatgcaatgctgcagcttgcgagcctgtggcatcaactatatgtaaatatatattttttctcttcacatgccactggtttcttgttcaagaacatgatccgagcgcttcagctttctgtcagttgttgtgctgc

SEQ ID NO: 2158 - DNA, 867 bp, Pennisetum glaucum
cggagtcgcacggggacggggcaggactggacagccaggcaggaggcgccgctggccccgtgcagagcacctcgccgcggccttctcccccgcctctcttttttaaagcaggccgccctcctcctcccccatgtcatcgatagcagcttccgccaattcttgtgcgacccgctccctccgctcccccctaacaacaattcgtccagcgatcctcgtggtcagccctcccgctgtcccgcatggcatcccgcgccgccatagccgggcgccgcatcgtggtggccgtggacgagggcgaggagagcatgcacgcgctcacctggtgcctcgccaacgtcgtctcccccgcggacggcgacacggtggtcctcgtgcacgcgcgccgcccgcgccccgtctacgccgccatggacagcgcagggtacatgatgacctcggacgtgctggcgagcgtggagaggcacgccagcgccgtctcggctgcggccgtcgacaaggccaagcgcctctgcgccgagcacccgcaggtggccgtggagacgctggtggagggcggggacccgcgggacgtcatctgcgacgccgccggcaaggtgggcgccgacctgctcgtcatgggcagccatggatacggcttcatccagagggctttcctaggcagcgtcagcaaccactgcgcgcagaactgcaagtgcccggtcctcatcgtcaagaggcccaaggagtagtggaatggtcctgttttgtaatgctgcagcatcagcatgggagcctgtggcatgaactgctatgtaaatatttttagtttactagaaattctaaagttttctttactgtctctccatcatatcacaacaaatacaccaa

SEQ ID NO: 2159 - DNA, 1874 bp, Sorghum bicolor
ctccccctgcgaaggctcttcggctcttccaccaccactagctagagctaaccccgcgtgctgctgctgcctgctgcctgctgccgcgcgccgttccttgccgtgcgggcgtgctctgggacgccggtgtggtgcggtgcggtggtggcagcggtggttggtggtgcgcggcgtgaaagaaagaaagaaagaaaaggcccgccgctttgcgctgctctgctcccgtaggtgtcacgagatttgggcctagcctttcgctttccttttttcctctcgctcacaagggaaggcaccgagggacggaggcgttggggaggggagggggagggcagcgagcgagccgtaacatccgagctgttccaatggcgacccctgccgctgccgttgctttcgtcgccagcgctttgttggggcggtggtagactggcgctacaagcggagctgcagtactaggttggtaggtggttgtggctttggcgctgcgcgtgacggacccgagccgctcgctcgctcgtgtgcgtgcctgtctacctcgcttgcgttgcgttgcgttgcgtgcgccgggaaggcagaagtgggtgactggtccgttctcgcgagaggtggctgctgctgctgctgctgctggtgttcctcctcctcagctcccccggttgatgagcatgggccattgctccgagcagcggacggggttcgaggtcaccaaggactggaacggcgccgaccaggtcgcgatccggtccccgcggggggcttccgtccgggtctgcctgcacggcgggcaggtcgtctcgtggaggaaccaccgcggcgaggagctcctcttcagcagtagcaaggcaatcttcaagccgcccaaagcgacgcgtggtggcattccaatatgcttcccccagtttggaaactgtggaacactggagcaacatggatttgcaaggaacaagatatggacaatagatgatgaggctccaccactaaattctggtgataacaacaacaacaaagcttctgttgaccttctgctaaagccatctgaagatgacctgaagtgctggccacactgtttcgagttacgtctcagagtttctctttcaatggatggagacctttcactgatatcacgggttaggaatgttaacgggaagccattcagttttgcatttgcttatcatacacacctttctgtttctgacatcagtgaagtgaggatagaaggtctggagacccttgattatcttgacaaccttagccagcgggaacgttttactgaacagggagatgctataacatttgaatcagaggttgatcgagtctatgttggctgcccaggcgtaatagctgttcttgaccatgaaaagaaacgcacattcatcatccgaaaagaaggccttcctgatattgttgtgtggaacccctgggaaaagaagtccaagacgatgacagacttcggcgacgacgagtacaagcagatgctgtgcgtggatgcggccgcggtcgagaggaccatcacgctgaagcccggcgaggagtggacggggaagctggagctctccgccgtggcgtcgaccaactgcagcgaccacctggatcacccgggcaggctgtagagcactgggtgggttcgtcgcccctgacgaaaggcatgtactactttttttcatgtatgtacatgggggcgctaggtctgcaggctgcagtatgatctgcctgccaggcgtgtcatgtgtgagtttaaactaaatatgtcagatgcaagtatttctgtgatctacatgttcgatgttgttcgaagtctcaagcgtttatatatctgcatctttcgaagtctcaagcgcttacagtcctgaagctaacttgtactgctaccatcagag

SEQ ID NO: 2160 - DNA, 2579 bp, Sorghum bicolor
tcctcgctccaataccggtccaccacccaccccgcgcttctcggattccagctgttccctcggatccttggcccgtcccacggcaacgccgaggtggctcccatgatgcgctctcgccacgccaccccgccatgtgcgtgccgcttttgacagaggacgacgacgacgcggatctctcctcccgtctccctctcccctgcccctccccctgcgaaggctcttcggctcttccaccaccactagctagagctaaccccgcgtgctgctgctgcctgctgcctgctgccgcgcgccgttccttgccgtgcgggcgtgctctgggacgccggtgtggtgcggtgcggtggtggcagcggtggttggtggtgcgcggcgtgaaagaaagaaagaaagaaaaggcccgccgctttgcgctgctctgctcccgtaggtgtcacgagatttgggcctagcctttcgctttccttttttcctctcgctcaccgccaccccgccatgtgcgtgcccgctttgacagaggacgacgacgacgcggatctctcctcccgtctccctctcccctgcccctccccctgcgaaggctcttcggctcttccaccaccactagctagagctaaccccgcgtgctgctgctgcctgctgcctgctgccgcgcgccgttccttgccgtgcgggcgtgctctgggacgccggtgtggtgcggtgcggtggtggcagcggtggttggtggtgcgcggcgtgaaagaaagaaagaaagaaaaggcccgccgctttgcgctgctctgctcccgtaggtgtcacgagatttgggcctagcctttcgctttccttttttcctctcgctcacaagggaaggcaccgagggacggaggcgttggggaggggagggggagggcagcgagcgagccgtaacatccgagctgttccaatggcgacccctgccgctgccgttgctttcgtcgccagcgctttgttggggcggtggtagactggcgctacaagcggagctgcagtactaggttggtaggtggttgtggctttggcgctgcgcgtgacggacccgagccgctcgctcgctcgtgtgcgtgcctgtctacctcgcttgcgttgcgttgcgttgcgtgcgccgggaaggcagaagtgggtgactggtccgttctcgcgagaggtggctgctgctgctgctgctgctggtgttcctcctcctcagctcccccggttgatgagcatgggccattgctccgagcagcggacggggttcgaggtcaccaaggactggaacggcgccgaccaggtcgcgatccggtccccgcggggggcttccgtccgggtctgcctgcacggcgggcaggtcgtctcgtggaggaaccaccgcggcgaggagctcctcttcagcagtagcaaggcaatcttcaagccgcccaaagcgacgcgtggtggcattccaatatgcttcccccagtttggaaactgtggaacactggagcaacatggatttgcaaggaacaagatatggacaatagatgatgaggctccaccactaaattctggtgataacaacaacaacaaagcttctgttgaccttctgctaaagccatctgaagatgacctgaagtgctggccacactgtttcgagttacgtctcagagtttctctttcaatggatggagacctttcactgatatcacgggttaggaatgttaacgggaagccattcagttttgcatttgcttatcatacacacctttctgtttctgacatcagtgaagtgaggatagaaggtctggagacccttgattatcttgacaaccttagccagcgggaacgttttactgaacagggagatgctataacatttgaatcagaggttgatcgagtctatgttggctgcccaggcgtaatagctgttcttgaccatgaaaagaaacgcacattcatcatccgaaaagaaggccttcctgatattgttgtgtggaacccctgggaaaagaagtccaagacgatgacagacttcggcgacgacgagtacaagcagatgctgtgcgtggatgcggccgcggtcgagaggaccatcacgctgaagcccggcgaggagtggacggggaagctggagctctccgccgtggcgtcgaccaactgcagcgaccacctggatcacccgggcaggctgtagagcactgggtgggttcgtcgcccctgacgaaaggcatgtactactttttttcatgtatgtacatgggggcgctaggtctgcaggctgcagtatgatctgcctgccaggcgtgtcatgtgtgagtttaaactaaatatgtcagatgcaagtatttctgtgatctacatgttcgatgttgttcgaagtctcaagcgtttatatatctgcatctttcgaagtctcaagcgcttacagtcctgaagctaacttgtactgctaccatcagaggaaggcagaatccaagttgatggatttggctgtttacattattcgtttctgtacacgatacctataaggttacacgggatatgatatggcgtggtgggggcatgcatggctgcatgggcggcactacagacactcctgc

SEQ ID NO: 2161 - DNA, 1537 bp, Setaria italica
tctcgctcgccaagggatcgagggagggaggcgtcggtgagcgtcggggaggggagcgaaccgtaacatccgagctgttccaatggcgacccctgccgctgttgctgtcgtctccggcgctttgctggggcggtggtagcgctggaggtatacctgtgtactgcagcggacggaggagtactaggttggtaggtggttgtagctttgcgcgtgacccgggcgcgcgctcgctctcaggcttagcagctcgtgtgctctcgctcgcttgcgtgcgccgggaaggcagtgggtggctggtcggttctcgcgagggtggaggtgtactggtgttggtggtggtgctcctcctccggttgatgagcatggggcattgctccgagcagcggcccggtttcgaggtgaccaaggactggaacggcgccgaccaggtcgcgatccggtcgccccggggggcctccgtccgggtctgcctgcacggcgggcaggtcgtctcgtggaagaacgaccgcggcgaggagcttctcttcactagcagcaaggcaatcttcaagccgccaaaagcgacacgcggtggaattccaatatgcttcccacagtttggaaactgtggaacattggagcagcatggatttgcaaggaacaagatatggacaatagatgaagaggctccaccactaaattatggtgataacaacaacaaagcttctgttgaccttctgctaaagccatctgaagatgacctgaagtgttggccacactgtttcgagttacgtctcagagtctctctttcaatggatggagacctttcgctgatatcacgtgtcaggaatgttaatgggaagccattcagtttcgcatttgcttatcatacttatctttctgtttctgacatcagtgaagtgaggatagaaggtctggagacccttgattatcttgacaaccttagccagcgagaacgttttaccgaacaaggagatgctataacatttgaatctgaggttgatcgagtctatgttggctccccaggcgtaattgctgttcttgaccatgagaagaaacgcacattcatcatacgaaaagaggggctccctgatattgttgtgtggaacccctgggagaagaagtcgaagacgatggcggacttcggcgatgacgagtacaagcagatgctctgcgtggacgcggccgcggtagagcgggccatcacgctgaagcccggcgaggagtggacggggaagctggagctctccgccgtgccgtcgaccaactgcagcgaccacctggaccacccgggcaggctgtagtagagccccccccgaggcctgagcctgagctcgctcgcccctgacgaaaggcatgtactactttttttcaatgtttgtacatgggggcgctaggtccagccctgctggctgcagtattttcagcctgccagctgttgagtttaaacttatgtcagatgcaagtattgctgtaatcgacatggttcccgttcccgcaatgtgatgtctcaatagtttatatgcttctgattttt

SEQ ID NO: 2162 - DNA, 1605 bp, Panicum virgatum
agccgcggcgctttgcgctgctctgctcccgtaggtgtcacgagatttgggcttaggggcttagcctttcgctttcctttttcctctcgcgcacaaggggccgagggggaggcgcgtcgtagaggggaggggagcgagccgtaacatctgatctgttccaatggcgacccctgctgccgttgctgtcgtctccggcgcgtcgttggggcggtggtagcgctggaggcagactagtgctgcagcgaggggagtactaggttggtaggtgagaagggggtggttgtagctctgctcgtggcccgggcgctcgctctctcgctcgtgtgctctcgctcgctcgctcgctcgcgtacccgcgccgggaaggcagtgggtgcctagtcggtgtctcgcgcgcgagggtggtggtggtggtgctgctgctgctgctcctcctcctcctcctccggttgatgagcatggggcattgctccgagcagtggcccggcttcgaggtgaccaaggactggaacggcgccgaccaggtcgcgatccggtcgccgaggggggcctccgtccgggtctgcctgcacggcgggcaggtcgtctcgtggaggaacgaccgcggcgaggagctcctcttcaccagcagcaaggcgatcttcaagccgccaagagcgacacgtggtggaattccaatatgcttcccacagtttggaaactgtggaacattggagcagcatggatttgcaaggaacaagatatggacaatagatgaagaggctccaccactaaattatggtgataacaacaacaacaaagcttctgttgaccttctgctaaagccatctgaagatgacctaaagtgctggccacactgttttgagatacgtctcagagtttcactttcaacggatggagacctttcactgatatcacgtgtcaggaatgttaatgggaagccattcagtttcgcatttgcttatcatacatatctttctgtttctgacatcagtgaagtgaggatagaaggtttggagacccttgattatcttgacaaccttaaccagcgagaacggtttaccgagcaaggagatgctataacgtttgaagcagaggttgatcgagtctatgttggctccccaggcgtaattgctgttcttgaccatgaaaagaaacgcacattcatcgtacgcaaagaggggctccctgatattgttgtgtggaacccctgggagaagaagtcgaagacgatggcggacttcggcgacgacgagtacaagcagatgctctgcgttgacgccgccgcggtggagcgagccatcacgctgaagcccggagaggagtggacggggaagctggagctctccgccgtgccgtcgaccaactgcagcgaccacctggaccacccgggcaggctctagagccccgcccgctcgcccctggcgaaaggcatgtactgcgttttttcatgtacatgggggcgccgctaggtctgccggccctgctggcagcagtatgttcagcctgctagctgttgagtttaaaactttatgtcagatgcaagtattgctgtcatcgacatggttcccgttcctgcaatgtgaatctcaagagtttatctgc

SEQ ID NO: 2163 - DNA, 1987 bp, Oryza sativa
ctgattcgcattcgctccatccgcttcttctcggattccagctgttcccccgtggcctttcttggattcccccgccccccggcccgcggctcccccgccccacgtacccatggcgttgccgaggtggctcccatgatgcgctctcgccgcctcgccatgtgacccgcgcgccacgccgcttttccgagaccgagagacggagagagagaaaaaaacgtagagatccacgccgcattctccatttctccccctcccggctgcagctcgccgtatcctgctttcttgccttgcgggcgtcgtcgtagcgtggtaggagtaggggagcccggcgcgcgggcgggcgcgggtggttggtgagtgcgcgcgcaacgcgcagcagcagcagcagcgggaaaaaaaaaaggctaactaagctaggacagaggagagaaaagccgtggcgctttgcggtcacgagattcagggggtggtttgcttttgctcgcaagggaagtgttgggggagccgtagacatccgaactgttctaatggcgaccctctggggggcggtggcggtggcgttgctttgcgcgatgtattggtgaggccggtactaggggagggggtagtagtagtggtacaagtggtggttgtcgtcgtcgtagtcttgtgggttgcgtgcgtgcgttcgtgcgcgccagcgaagttcttgcgacgatcgtgtggggtgggttcgtgtgctctctcgctcctgccattggttgatgagcatggggcattactccgagcagaggccggggttcgaggtgaccaaggactggaacggcgccgaccaggtcatgatccggtcgccgcggggggcgtccgtcctggtcagcctgcacggcgggcaggtcgtctcctggaggaacgaccgcggcgaggagctcctcttcaccagcagcaaggctatcttcaagccaccaaaagcgatgcgaggtggaattcccatatgctttccacagtttggaaattgtggaacattggagcagcatggatttgcaaggaacaggctatgggccatagatgatgaggctccaccactaaatcataatgataacaacggcaaagtttctgttgaccttctgttaaagccatctgaagatgatctcaaatgttggccacactgctttgaattccgtctcagagtttctctttcgacggatggagatctctcgttagtatcacgagtcaggaatgttaatgggaagccattcagtttttcgtttgcttaccatacatatctttcagtctctgacatcagtgaggtgagaatagaaggtctggagacacttgattatcttgacaaccttagccaaagagaacgttttacagaacaaggagatgctataacatttgagtctgaggttgacagagtctacgttggttccccaagcgtaattgctgtgcttgaccatgagaagaaacgcaccttcattgtaaggaaagaagggcttcctgacgtcgttgtttggaacccatgggacaagaagtcgaaaacgatggcggattttggcgacgaggagtacaagcagatgctgtgtgtggacgctgccgcagtcgagcgagccatcacgctgaagccaggcgaggagtggacggggaagctggagctgtccgccgtcgcttccaccaactgcagcgaccatctggactacccttgtagctagctccagtgttcctataatgcgttccagtagctatattcagatgcttagttttgccccccctaaatcgaaaatcatgtactacgtttttccttgtacatgggagtgtgtactacgtttttcattgtacaacatgggggcgctagctaggtccgtcgtcttgatcagcctgttgctgatcagtctacccgtgtcatttgtcagatactactatatattcagatgcaaagttgttgtgacaagacttcacttgagttttctgaaaaagtatttgccgtgaagaccttcttttgtacacagca

SEQ ID NO: 2164 - DNA, 1903 bp, Oryza sativa
ggattcccccgccccccggcccgcggctcccccgccccacgtacccatggcgttgccgaggtggctcccatgatgcgctctcgccgcctcgccatgtgacccgcgcgccacgccgcttttccgagaccgagagacggagagagagaaaaaaacgtagagatccacgccgcattctccatttctccccctcccggctgcagctcgccgtatcctgctttcttgccttgcgggcgtcgtcgtagcgtggtaggagtaggggagcccggcgcgcgggcgggcgcgggtggttggtgagtgcgcgcgcaacgcgcagcagcagcagcagcgggaaaaaaaaaaggctaactaagctaggacagaggagagaaaagccgtggcgctttgcggtcacgagattcagggggtggtttgcttttgctcgcaagggaagtgttgggggagccgtagacatccgaactgttctaatggcgaccctctggggggcggtggcggtggcgttgctttgcgcgatgtattggtgaggccggtactaggggagggggtagtagtagtggtacaagtggtggttgtcgtcgtcgtagtcttgtgggttgcgtgcgtgcgttcgtgcgcgccagcgaagttcttgcgacgatcgtgtggggtgggttcgtgtgctctctcgctcctgccattggttgatgagcatggggcattactccgagcagaggccggggttcgaggtgaccaaggactggaacggcgccgaccaggtcatgatccggtcgccgcggggggcgtccgtcctggtcagcctgcacggcgggcaggtcgtctcctggaggaacgaccgcggcgaggagctcctcttcaccagcagcaaggctatcttcaagccaccaaaagcgatgcgaggtggaattcccatatgctttccacagtttggaaattgtggaacattggagcagcatggatttgcaaggaacaggctatgggccatagatgatgaggctccaccactaaatcataatgataacaacggcaaagtttctgttgaccttctgttaaagccatctgaagatgatctcaaatgttggccacactgctttgaattccgtctcagagtttctctttcgacggatggagatctctcgttagtatcacgagtcaggaatgttaatgggaagccattcagtttttcgtttgcttaccatacatatctttcagtctctgacatcagtgaggtgagaatagaaggtctggagacacttgattatcttgacaaccttagccaaagagaacgttttacagaacaaggagatgctataacatttgagtctgaggttgacagagtctacgttggttccccaagcgtaattgctgtgcttgaccatgagaagaaacgcaccttcattgtaaggaaagaagggcttcctgacgtcgttgtttggaacccatgggacaagaagtcgaaaacgatggcggattttggcgacgaggagtacaagcagatgctgtgtgtggacgctgccgcagtcgagcgagccatcacgctgaagccaggcgaggagtggacggggaagctggagctgtccgccgtcgcttccaccaactgcagcgaccatctggactacccttgtagctagctccagtgttcctataatgcgttccagtagctatattcagatgcttagttttgccccccctaaatcgaaaatcatgtactacgtttttccttgtacatgggagtgtgtactacgtttttcattgtacaacatgggggcgctagctaggtccgtcgtcttgatcagcctgttgctgatcagtctacccgtgtcatttgtcagatactactatatattcagatgcaaagttgttgtgacaagacttcacttgagttttctgaaaaagtatttgccgtgaa

SEQ ID NO: 2165 - DNA, 1903 bp, Brachypodium distachyon
ggattcccccgccccccggcccgcggctcccccgccccacgtacccatggcgttgccgaggtggctcccatgatgcgctctcgccgcctcgccatgtgacccgcgcgccacgccgcttttccgagaccgagagacggagagagagaaaaaaacgtagagatccacgccgcattctccatttctccccctcccggctgcagctcgccgtatcctgctttcttgccttgcgggcgtcgtcgtagcgtggtaggagtaggggagcccggcgcgcgggcgggcgcgggtggttggtgagtgcgcgcgcaacgcgcagcagcagcagcagcgggaaaaaaaaaaggctaactaagctaggacagaggagagaaaagccgtggcgctttgcggtcacgagattcagggggtggtttgcttttgctcgcaagggaagtgttgggggagccgtagacatccgaactgttctaatggcgaccctctggggggcggtggcggtggcgttgctttgcgcgatgtattggtgaggccggtactaggggagggggtagtagtagtggtacaagtggtggttgtcgtcgtcgtagtcttgtgggttgcgtgcgtgcgttcgtgcgcgccagcgaagttcttgcgacgatcgtgtggggtgggttcgtgtgctctctcgctcctgccattggttgatgagcatggggcattactccgagcagaggccggggttcgaggtgaccaaggactggaacggcgccgaccaggtcatgatccggtcgccgcggggggcgtccgtcctggcgagcctgcacggcggccaggtcgtctcctgaaagaacaagcgaggcgaggagctcatcttcaccagcagcaaggctatcttcaagccaccaaaagcgatgcgaggtggaattcccatatgctttccacagtttggaaattgtggaacattggagcagcatggatttgcaaggaacaggctatgggccatagatgatgaggctccaccactaaatcataatgataacaacggcaaagtttctgttgaccttctgttaaagccatctgaagatgatctcaaatgttggccacactgctttgaattccgtctcagagtttctctttcgacggatggagatctctcgttagtatcacgagtcaggaatgttaatgggaagccattcagtttttcgtttgcttaccatacatatctttcagtctctgacatcagtgaggtgagaatagaaggtctggagacacttgattatcttgacaaccttagccaaagagaacgttttacagaacaaggagatgctataacatttgagtctgaggttgacagagtctacgttggttccccaagcgtaattgctgtgcttgaccatgagaagaaacgcaccttcattgtaaggaaagaagggcttcctgacgtcgttgtttggaacccatgggacaagaagtcgaaaacgatggcggattttggcgacgaggagtacaagcagatgctgtgtgtggacgctgccgcagtcgagcgagccatcacgctgaagccaggcgaggagtggacggggaagctggagctgtccgccgtcgcttccaccaactgcagcgaccatctggactacccttgtagctagctccagtgttcctataatgcgttccagtagctatattcagatgcttagttttgccccccctaaatcgaaaatcatgtactacgtttttccttgtacatgggagtgtgtactacgtttttcattgtacaacatgggggcgctagctaggtccgtcgtcttgatcagcctgttgctgatcagtctacccgtgtcatttgtcagatactactatatattcagatgcaaagttgttgtgacaagacttcacttgagttttctgaaaaagtatttgccgtgaa

SEQ ID NO: 2166 - DNA, 976 bp, Pennisetum glaucum
agtgctttgagctggttaggcaacaactagtgcgatgtggcgtcgccggtgcagaatatgtcacatcctcaccagcagcaaggcaatctcaagccgccaaaagcaacacgcggtggaattccaatatgcttcccacagtttggaaactgtggaacattggagcaacatggatttgcaaggaacaagatatggacaatagatgaagaggcaccaccactaaattatggtgataacaacaacaaagcttctgttgaccttctgctaaagccatctgaagatgacctgaagtgttggccacactgtttcgagttacgtctcagagtctctctttcaatggatggggacctttcgctgatatcacgtgtcaggaatgttaatgggaagccattcagttttgcatttgcctatcatacacatctttctgtttctgacatcagtgaagtgaggatagaaggtctggagacccttgattatcttgacaaccttagccagcgagaacgttttaccgaacaaggagatgctataacatttgaatcagaggttgatcgagtctatgttggctccccaggcgtaattgctgttcttgaccatgaaaagaaacgcacattcatcatacgaaaagaggggcttcctgatattgttgtgtggaacccctgggagaagaagtctaagacgatggcagacttcggcgacgacgagtacaagcagatgctctgtgtggacgctgctgcggtggagcgggccatcacgctgaagcccggtgaggagtggacggggaagctggagctctccgccgtgccgtcgaccaactgcagcgaccacctggaccacccgggcaggctgtagtagaagccctcctgaggcctagagcctgagctcgctcgcccctgacgaaacgcatgtactacttttttttcaatgtttgtacatgggggcgctaggtccagccctgctggctgcagtattttcagcctgc

SEQ ID NO: 2167 - DNA, 1882 bp, Oryza sativa
ggtatcagcatcaacctctcctctcctagcctcggatcctctcatcctcctcgcgcactagagaagctagagcttcacccactcgtgcttctctcctcgcctcgcctccctcatctcgatcttccaatggcgacgtgacgaggtggttgccctgcgctgcgcttctgaccaccacgtgcatttccatttcccgctgcatccgatccgtttgttgttgttgccgtggcgtgccttgtgaatttgctgctgcgagcgagagcgagccggtggtttggttggttgcagaagctttggcttccgctgaggctgcgctggtgtggccggtggctcacgggtttcaggccgcgcgcgcgctcgcgcggtgctttttttttttttttgcgctcacaaggaaagcgcagacgcgcagtgtaaaacgtcgtggcaaccccaaccgtcccaatggcgacgccgcccactgcttcccgcgcgtcgccataaaatctcgtacgcgtacgtgcgcgcgctcgtgtgcgtctctccttctcctctactctctcttcacgcgggctggctggctggctgttgatgagcatggggcactacaccaacctgacggatccgaggacggagctggaggtggtcagggactggaacggcgtcgaccaggtcgtgctccgctcgccgcggggcgcctacgcgcgggtgagcctgcacggcgggcaggtcctctcctggaggaacgaccgcggcgaggagcttctcttcaccagcagcaaggcaatcttcaagccaccaaaggcgatgcgtggtggaatcccgatatgttttccacagtttggaaattctggaacattggagcaacatggatttgcaagaaacaggatatgggccctagatgaggagcatccaccattaaatcaaaatgataacaacagcaaagcttctgttgaccttatactaaagccatctgaagatgacctgaagtgctggccacatggttttgagttccgcctgagagtttctcttacaaaggatgggaacctgtcactagtatcacgcatcagaaatgttaatggcaagccattcagtttctcatttggttatcacacatatctgtctgtttctgacatcagtgaggtgaggatagaaggccttgagacacttgattatctcgataatcttagccagagagaacgttttacagaacaaggagatgccataacatttgaatcggaggttgaccgagtctatgttagctcaccaaatgtaatagctgttctggaccatgagaagaaacgcacatttgtcataagaaaggaaggactgcctgacgttgttgtgtggaatccgtgggaaaagaaatcgaaaaacatcgtggacttcggcgatgaggagtacaaacagatgctgtgcgttgatgcggctgcagcggagagacaaatcactctgaaaccgggagaggagtggacagggaagcttgagctttctgaagttccatcgactaactgcagtggccatcttgatcaacccggtatcatcatttagaatatggcttgatagtttagaattttaccattttccttttttacatgagatcgatatgctcctcctctgccatcttggtaaaaattcttcttgtacgtgtacaaagattttaccatcttggtcagcggttcgttttaagcttatgccagagtcatcttgtttgttttggtttctgtgataccaatacatgtgggcgcaagatatactgaacttttctgatcagaattcagagctaacagctacgcagacagaattcagacttcagggtgacacttaaaaaaaagaggacttttacggtacattatactgcaagtatatactagcagtatatttatgggtataataggaatttgtc

SEQ ID NO: 2168 - DNA, 1775 bp, Oryza sativa
gcatcaacctctcctctcctagcctcggatcctctcatcctcctcgcgcactagagaagctagagcttcacccactcgtgcttctctcctcgcctcgcctccctcatctcgatcttccaatggcgacgtgacgaggtggttgccctgcgctgcgcttctgaccaccacgtgcatttccatttcccgctgcatccgatccgtttgttgttgttgccgtggcgtgccttgtgaatttgctgctccgagcgagagcgagccggtggtttggttggttgcagaagctttggcttccgctgaggctgcgctggtgtggccggtggctcacgggtttcaggccgcgcgcgcgctcgcgcggtgttttttttttttttttttttttttttttttgcgctcacaaggaaagtgcagacgcgcagtgtaaaacgtcgtggcaaccccaaccgtcccaatggcgacgccgcccactgcttcccgcgcgtcgccataaaatctcgtacgcgtacgtgcgcgcgctcgtgtgcgtctctccttctcctctactctctcttcacgcgggctggctggctggctgttgatgagcatggggcactacaccaacctgacggatccgaggacggagctggaggtggtcagggactggaacggcgtcgaccaggtcgtgctccgctcgccgcggggcgcctacgcgcgggtgagcctgcacggcgggcaggtcctctcctggaggaacgaccgcggcgaggagcttctcttcaccagcagcaaggcaatcttcaagccaccaaaggcgatgcgtggtggaatcccgatatgttttccacagtttggaaattctggaacattggagcaacatggatttgcaagaaacaggatatgggccctagatgaggagcatccaccattaaatcaaaatgataacaacagcaaagcttctgttgaccttatactaaagccatctgaagatgacctgaagtgctggccacatggttttgagttccgcctgagagtttctcttacaaaggatgggaacctgtcactagtatcacgcatcagaaatgttaatggcaagccattcagtttctcatttggttatcacacatatctgtctgtttctgacatcagtgaggtgaggatagaaggccttgagacacttgattatctcgataatcttagccagagagaacgttttacagaacaaggagatgccataacatttgaatcggaggttgaccgagtctatgttagctcaccaaatgtaatagctgttctggaccatgagaagaaacgcacatttgtcataagaaaggaaggactgcctgacgttgttgtgtggaatccgtgggaaaagaaatcgaaaaacatcgtggacttcggcgatgaggagtacaaacagatgctgtgcgttgatgcggctgcagcggagagacaaatcactctgaaaccgggagaggagtggacagggaagcttgagctttctgaagttccatcgactaactgcagtggccatcttgatcaacccggtatcatcatttagaatatggcttgatagtttagaattttaccattttccttttttacatgagatcgatatgctcctcctctgccatcttggtaaaaattcttcttgtacgtgtacaaagattttaccatcttggtcagcggttcgttttaagcttatgccagagtcatcttgtttgttttggtttctgtgataccaatacatgtgggcgcaagatatactgaacttttctgatcagaattcagagctaacagct

SEQ ID NO: 2169 - DNA, 1110 bp, Sorghum bicolor
ttcaaatggctgctgaatcagagaacagcaactgcaacgcttgggcagcgagagatccttctggagttctgtcaccttacagctttaaccgcagagcagtgcaaagcaacgatgttgcgctgaagattatatactgtggagtctgttatgctgacgttgcttggacaaggaacgtgctcaatgattcaaaatatcctttggttcctgggcacgagatagctggagttgtaactcaggttggtgcagatgtcaaaggatttaaagtgggtgaccatgtaggtgttggaacatatgtgaactcatgccgagattgtgagaactgcaatagctctctagagaaccactgcccaaaagcagtttatactttcaatggcattgatacagatggaactgtcacaatgggaggttattccacgcacattgtagtccatgcaaggtattgcttccaaatacctgatggctaccctttggcaaaggcagcacctcttctgtgtgctgggataactgtgtatactccaatgatgcgacacaatatgaaccaacctggaaagtcacttggggtcattggactcggtggtctgggtcacatggctgtgaaatttggtaaagcatttggtctgaaggtcacagttttcagtacaagtgaatccaagagagatgaagccatcaacctccttggagcagataattttgttatatcatcggacacacagcagatggagtccctgaagaactccctgcacttcatagttgacaccgcttctggtgaccatccgtttgatccatttctctctctccttaaggctggtggtgtgatgacagtagtgggctctcccagtgagatcaaaatgcagcctgcaagccttattcttggtgcgcggaccttgtcaggcagtcttgttggaggtacaaaagacatccaagaaatggttaacttttgtgcagcgaacaaaatctatccaaagattgaggtcattaggatagattatatcaatgaggctttggcaaggcttgttaatcgagatgtgaaataccgctttgtaattgacatcgagaactctttcaagtagcgtgctggttcacatgctcgtctttctggtagtgtacaag

SEQ ID NO: 2170 - DNA, 1540 bp, Sorghum bicolor
ctgacgcatgcgctgatggttcggccaggcacaatcagcgatgaactcatggctggcgagaagccccgtaagcttgatccgcgacgtcactgctgtcggcaccctctccaatccaatccatccaccggtcaacggagcaggatcccgtctgcgcctttccaactccttccccatttgtaatttgctcactcgccggcggccgctacctgcaacccggcgacacccgaccgacagcctgcttgccacgcttgcatcgaggagagttcggggaccggccggtgcggacggaatcgacgcagggttcagttcgaatggccgctgaatcagagaacggcaactgcaatgcatgggcagcgagagatccttccggagttctctcaccatacacgtttaaccgcagagcagtgcaaagcagcgatgttgcgctgaagatcatatactgtggagtctgttatgctgacgttaaatggacacggaatatgcagcatgattcaaaatatcctctggttccagggcatgagatagctggagttgtaactcaggttggtgcagatgtcaaaggctttaaagtgggtgaccatgtaggtgttggaacatatgtgaactcatgccgagattgtgagaactgcaatctctctctagaaaaccactgcccaaaaggagtttatactttcaatggcatcgacacagatggaactgtcacaaaggggggttactccactcacattgtagtccatgaaaggtattgcttccaaatacccgatggctaccctttggcaaaggcagcacctcttctgtgtgctggaataactgtgtatactccaatgatgcgacacaacatgtaccaacctgggaagtcacttggggtcattggacttggtggtctgggtcacatggctgtgaaatttggtaaagcatttggtcttaaggtcacagttttgagtacaagtgaatcaaagagagatgaagccatcaccctccttggagcagataattttgttatatcatcagacacacaacagatggagtccctgaaaaactccctgcacttcatagttgacaccgcttctggtgaccatccatttgatccatatctctctctccttaaggttggtggtgtgatggcaatagtgggttttccaagtgagatcaaaatgcatcctgcaagccttaatcttggtgcgcggaccttgtctggtagtcttgttggaggtacaaaagacatccaagaaatggttaacttctgtgcagagaacaaaatctatccggagatcgagatcattaagatagattacatcaatgaggctttggcaaggcttgtgaatcgagatgtgaaataccgctttgtaattgacatcgagaactctttcaagtagcatgctggttcacatcctctcatctttctgttagtgtacaagagcaatcgcaaatcagagtcatgtcaaataaacttgatgtaatgctgcagcacatttacaattctagtctgtgttaatttcattatcgtagtatttatccccactttcttttctgttttttt

SEQ ID NO: 2171 - DNA, 1559 bp, Sorghum bicolor
atggttcggccaggcacaatcagcgatgaactcatggctggcgagaagccccgtaagcttgatccgcgacgtcactgctgtcggcaccctctccaatccaatccatccaccggtcaacggagcaggatcccgtctgcgcctttccaactccttccccatttgtaatttgctcactcgccggcggccgctacctgcaacccggcgacacccgaccgacagcctgctcgccacgcttgcatcgaggagagttcggggagcggccggtgcggacggaatcgacgcaggggtcagtcttttcccctcccctcccctgtattgcccgcctcgattcgactccaagggtcaacgattttcattctgcagttcagttcgaatggccgctgaatcagagaacggcaactgcaatgcatgggcagcgagagatccttccggagttctctcaccatacacgtttaaccgcagagcagtgcaaagcagcgatgttgcgctgaagatcatatactgtggagtctgttatgctgacgttaaatggacacggaatatgcagcatgattcaaaatatcctctggttccagggcatgagatagctggagttgtaactcaggttggtgcagatgtcaaaggctttaaagtgggtgaccatgtaggtgttggaacatatgtgaactcatgccgagattgtgagaactgcaatctctctctagaaaaccactgcccaaaaggagtttatactttcaatggcatcgacgcagatggaactgtcacaaaggggggttactccactcacattgtagtccatgaaaggtattgcttccaaatacccgatggctaccctttggcaaaggcagcacctcttctgtgtgctggaataactgtgtatactccaatgatgcgacacaacatgtaccaacctgggaagtcacttggggtcattggacttggtggtctgggtcacatggctgtgaaatttggtaaagcatttggtcttaaggtcacagttttgagtacaagtgaatcaaagagagatgaagccatcaccctccttggagcagataattttgttatatcatcagacacacaacagatggagtccctgaaaaactccctgcacttcatagttgacaccgcttctggtgaccatccatttgatccatatctctctctccttaaggttggtggtgtgatggcaatagtgggttttccaagtgagataaaaatgcatcctgcaagccttaatcttggtgcgcggaccttgtctggtagtcttgttggaggtacaaaagacatccaagaaatggttaacttctgtgcagagaacaaaatctatccggagatcgagatcattaagatagattacatcaatgaggctttggcaaggcttgtgaatcgagatgtgaaataccgctttgtaattgacatcgagaactctttcaagtagcatgctggttcacatgctctcatctttctgttagtgtacaggagcaatcgcaaatcagaggcatgtcaaataaacttgatgtaatgctgcagcacatttacaattctagtctgtgttaatt

SEQ ID NO: 2172 - DNA, 1312 bp, Saccharum officinarum
ccgctaacccactataaatcgttgcatcccggcgatacccgacagcctgcttgccgcgcttgcatcgaggagagttcggggaccggccggtgcggaaggaatcgacaggagttcagttcaaatggctgctgagtcagagaacggcaactgcaatgcttgggcagcgagagatccttccggagttctctcaccatacaagtttaaccgcagagcagtgcaaaacaacgatgttgcgctgaagatcatatactgtggagtctgttatgctgacgttggttggacacgaaacatgcacaatgattcaaaatatcctttggttcctgggcatgagatagctggagttgtaactcaggttggtgcagatgtcaaaggctttaaagtgggtgaccatataggtgttggaacatatgtgaactcatgccgagattgtgagaactgcaatagctctctagagaaccactgcccagaaagagtttttactttcaatggcattgatacagatggaactgtcacaatggggggttactccacgcacattgtagtccatgaaaggtattgcttcaaaatacccaatggctaccctttggcaaaggcagcgcctcttctatgtgctggaataactgtgtatactccaatgatgcgacacaacatgaaccaacctggaaagtcacttggggtcattggactcggtggtctgggtcacatggctgtgaaatttggtaaagcgtttggtcttaaggtcacagttttgagtacaagtgaatcaaagagacatgaagccatcagcctccttggagcagataattttgttatatcatcagacacacagcagatggagtccctgaaaaactccctgcacttcatagttgataccgcttctggtgaccatccatttgatccatatctctctctccttaaggttggtggtgtgatggcaatagtgggctttccaagtgagatcaaaatgcatcctgcaagccttaatcttggtgcgcggaccttgtctggtagtgttactggaggtacaaaagacatccaagaaatggttaacttctgtgcagcgaacaaaatctatccagagattgagatcattaagatagattatatcaatgaggctctcacgaggcttgttaaccgagatgtgaaataccgctttgtaatcgacatcgagaactctttcaagtagcatgctagttcacatgctctcatctttctgttagtgtacaggagcactcacaaatgtaagtcatgtcaaataaacttgatgtaatgctgcagcgcatttacaatactagtcaaaactctgcgcgtc

SEQ ID NO: 2173 - DNA, 1404 bp, Sorghum bicolor
ttataatttgctcactcgccggcggccgctacctgctgcaacccggcgacacccgaccgacagcctgcttgccacgcttgcatcgaggagagttcggggaccgcccggtgcagaaggaatcgacgcagggttcagttcgaatggctgctgaatcagagcacggcaactgcaatgcttgggcagcgagagatccttctggagttctctcaccatacagctttaaccgcagaccagtgcaaagcagcgatgttgcgttgaagatcttatactgtggagtctgttatgctgacgttgtctggacacggaatatgcaccatgattcaaaatatcctgtggttcctgggcatgagatagctggagtcgtaactcaggttggtgcagatgtcaaaggctttaaagtgggtgaccatgtaggtgttggaacttatgtgaactcatgccgagattgtgagaactgcaatagctctctagagaaccactgtccaaaaggagtttatactttcaatggcattgatacagatggaactgtcacaaaggggggttactccactcacattgtagtccatgaaaggtattgcttccaaatacctgatggctatcctttggcgaaggcagcacctcttctgtgtgctggaataactgtgtatactccaatgatgcgacacaacatgaaccaacctggaaagtcacttggggtcattggactcggtggtctaggtcacatggcagtgaaatttggtaaagcatttggtctgaaggtcacagttttgagtacaagtgaatcaaagagacatgaagccatcagcctccttggagcggataattttgttatatcatcagatacacagcagatggagtccctgagaaactccctgcacttcatagttgacaccgcttctggcgaccatccatttgatccatatctctctctccttatggttggtggtgtgatggcaattgtgggctttccaagtgagatcaaaatgcatcctgcaagccttaatcttggtgcacggaccttgtctggtagtgttactggaggtacaaaagacatccaagaaatggttaacttctgtgcggcgaacaaaatctctccagagattgagatcattaagatagattatatcaatgaggctctcacgaggcttgttaaccgagatgtgaaataccgctttgttatcgacatcgagaactctttcaagtaacatgctggtctacatgctctcagtctttctattaatatactagagcaaacacaaatgtgaaagtcatgtcaaataaacttgatgtaatgctgcagcggttttacgatgctagttaattaaaaccctgtggcatgggcgtcaaatagcaaatgtaaacatccatagttggacagcaaggggagataagtatattgtgacg

SEQ ID NO: 2174 - DNA, 1608 bp, Sorghum bicolor
ttataatttgctcactcgccggcggccgctacctgctgcaacccggcgacacccgaccgacagcctgcttgccacgcttgcatcgaggagagttcggggaccgcccggtgcagaaggaatcgacgcagggttcagttcgaatggctgctgaatcagagcacggcaactgcaatgcttgggcagcgagagatccttctggagttctctcaccatacagctttaaccgcagaccagtgcaaagcagcgatgttgcgttgaagatcttatactgtggagtctgttatgctgacgttgtctggacacggaatatgcaccatgattcaaaatatcctgtggttcctgggcatgagatagctggagtcgtaactcaggttggtgcagatgtcaaaggctttaaagtgggtgaccatgtaggtgttggaacttatgtgaactcatgccgagattgtgagaactgcaatagctctctagagaaccactgtccaaaaggagtttatactttcaatggcattgatacagatggaactgtcacaaaggggggttactccactcacattgtagtccatgaaaggtattgcttccaaatacctgatggctatcctttggcgaaggcagcacctcttctgtgtgctggaataactgtgtatactccaatgatgcgacacaacatgaaccaacctggaaagtcacttggggtcattggactcggtggtctaggtcacatggcagtgaaatttggtaaagcatttggtctgaaggtcacagttttgagtacaagtgaatcaaagagacatgaagccatcagcctccttggagcggataattttgttatatcatcagatacacagcagatggagtccctgagaaactccctgcacttcatagttgacaccgcttctggcgaccatccatttgatccatatctctctctccttatggttggtggtgtgatggcaattgtgggctttccaagtgagatcaaaatgcatcctgcaagccttaatcttggtgcacggaccttgtctggtagtgttactggaggtacaaaagacatccaagaaatggttaacttctgtgcggcgaacaaaatctctccagagattgagatcattaagatagattatatcaatgaggctctcacgaggcttgttaaccgagatgtgaaataccgctttgttatcgacatcgagaactctttcaagtaacatgctggtctacatgctctcagtctttctattaatatactagagcaaacacaaatgtgaaagtcatgtcaaataaacttgatgtaatgctgcagcggttttacgatgctagttaattaaaaccctgtggcatgggcgtcaaatagcaaatgtaaacatccatagttggacagcaaggggagataagtatattgtgacgataaagtcgctctatgaataaggcatcatgtcgatgtgttccacaatatttcctagtgcatgtatggcggtggtcagtaccatcactttcacatccggttgaatacatgccaattggagaaaaaaaattggatggatactatctccaccgtactccattgcataccaccctcgatctgctgccaatctcatggatccagtaaca

SEQ ID NO: 2175 - DNA, 1576 bp, Panicum virgatum
ggagagacacgtcacgtgggggcagcatcgtccgaggattgacgcacgcgctgatgcgccgccgctctgctacaggatcagcgacgtcaccgcttctccgtcgccaccgtctccctcccatccaatccagcagccgccccttccctataacagctagctcctcgccagtcgggcgccctccgcctgccgcccgtgcatcgaggagagcttggggaccggccggcgcggaagggatcgagatcgaccccccggagttgagttcccatggcttctgaatcaggggacggcaactgcgatgcttgggcagcgagagatccttctggagttctctcaccgtacaaatttaaccgcagggcagtgcaaagtgacgatgtttcattgaagatcacacactgtggagtctgttatgctgacgttatttggacacaaaataggctcaatgattcgaaatatccgttggttcctgggcatgagatagcaggagttgtaaccgaggtcggttcagacgtcaaaggctttaaagtgggtgaccatgtaggtgttggaacctatgtgaactcatgccgagattgtgagaattgcaatagctctctagagaaccactgcccaagatcagtttatactttcaatggcattgatacagatggcactgtcacaaaagggggttactccactcacattgtagtccatgaaaggtactgcttcaaaataccagatggctaccctttggcaaaggcagcacctcttttatgtgctggaatcactgtgtatactccaatgatgcgacacaacatgaaccaacctggaaaatcactaggggtcattggactaggtgggctgggtcacatggcagtgaaatttggtaaagcctttggtcttaaggtcacagttttcagtacaagtgaatccaagagagatgaagccatcaacctccttggagcagataattttgttatatcatcaaacacacagcagatggagtccctgaaaaactctctgcacttcatagttgacactgcttctggtgaccatgcatttgatccgtatctctcactccttaaggttggtggtgtgatggcaatagtgtgctttccaagtgagatcaaagtgcatcctgcaagccttaatattggtgcacgtaccttgtctggcagtattactggaggtacaaaagacatccaagaaatggttaacttctgtgcagcaaacaaaatctatccagaggttgagatcatcaagatagattatatcaatgaggctctcacaaggctcgtcaatcgagatgtgaaataccgcttcgtaatcgacatagagaactctttcaagtagcatgcctcattttcatgatctaatctttctgtcgatgtatgagcaagcgtgggaatcatgttggaaaaacttgatgtaattccgcattggatttgtattattcttatttcttagtgtgtgctgtgcggctacctgcatcccttctatatacggttagcgtatgaccaattggcagcgacgctgtacttggtttgacatcgttgtatcttttctagcaatattaatatacataaatgtcaacgtcatc

SEQ ID NO: 2176 - DNA, 1571 bp, Pennisetum glaucum
cccgcctcttcgtgctcccctactcctcgcctactcccctctccgcatcccgccgaccgcttgccttgcctgcatccaggagagtcgggggaccgaccggacggtgcggaaggaatcgacccggagcccgttgggttcgcatggcttctgaatcaggggacggcaactgcaatgcttgggcagcaagagatccttctggagttctctcgccatacaagttcgaccgcagagcagtgcaaagcggcgatgtttcactgaggatcacacactgtggggtctgttatgctgacgttgtttggacacaaaacaggcacaacgattctaaatatcctttggttcctgggcatgagatatctggagttgtaactgaggttggttcagatgtcaaaggctttaaagtgggtgaccatataggtgtcggaacctacgtgaactcatgccgagattgtgagaactgcaatagctctctagagaactactgcccaaaatcagtgtatactttcaatggcattgatacagatggcactgtcacaaaggggggttactccactcacattgtagtccatgaaaggtactgcttcaaaataccagatggttaccctttggcaaaggcagcacctcttctatgtgctggaatcactgtatatactccaatgatgcgacacaatatgaaccaacctggaaaatcactagggatcattggacttggtgggctgggtcacatggcagtcaaatttggtaaagcctttggccttaaggtcacagttttcagtacgagtgaatcgaagagagatgaagccatcaacatccttggagcagataattttgttatatcatcaaacacacagcaaatggagtccctgaaaaactctctgcacttcatagttgacactgcttcgggtgatcatccgttcgatccatatctttcacttcttaagattggtggtgtgatggcagtagtgggctttccaagtgagattaaagtgcatcctgcaagccttaatcttggtggacggaccttgtccggtagtattgttggaggcacaaaggacatacaagaaatggttaacttctgtgcagtgaacaaaatctatccagagattgagatcatcaagatagattatataaatgaggctctcaaaaggcttgttaatcgagatgtgaaataccgctttgtaatcgacattgagaactctttcaagtagcatctcattctcatgctcttgtctttctgtcgacggatgagcaagcacatgtggcatcacatttacattgttcctggtgttctgtactgctgtgcagctacctgcatctctcctatgtatggttagcatttttttcgctgacttatgtatggttggcgttgtcacctttgcatagtataacaaataggcagtgatgctgccgttggtgtgacatcgttgtaagttttatagcaatatcaataaacataattatcaacgtcatatgggtgcattggaatacggccaagtgcaaatgttaagatgtacacacaacttcgctttctgtaccaaattattgcaaaatgttctggaaacattggatgcacg

SEQ ID NO: 2177 - DNA, 1384 bp, Zea mays
atggagccccggccgtcagccagccaggtccggcgtccgggtctgcgccctgcggcgtcactgctgtcgccaccgtctccgatggtcccacatccatccagcgggccgcgcgtggtacaaaaggctcttcctcgccgtcaggtgcagctgcccaaacaccagacacagactccaccaccccgcttcgatcttctgttgcagctgaaatctgtcagattctgcagttcattccaaatggctgctgcagcagagcacggcaactgcgatgcttgggcggccagagacccttctggggttctctcaccatacaagtttaaccgcagggcagtgcaaagcagcgacgtttcgctgaagatcatatactgcggggtgtgttacggtgacgttatgtggatacagaacaagcacaacgactcagtttatcctctggttcctgggcatgagatagctggggttgtgactgaggttggcgcagacgtcaaggccttcaaggtgggtgaccacgcaggcgttggaacctacgtgaactcgtgccggcactgcgagaactgcaacagctctctggagaactactgcccagaaacagttttcacttacaacacaactgatgctgatgggaccatcacaaaggggggctactccactcacattgtcgtccatgaaaggtactgcttcaagatacccgatggctaccctctggcgcaggcagcgcctcttctgtgtgctggaatcaccgtctataccccaatggcgcggcacaacatgaagcagcctgggaagtcgctgggagtcattgggctcggtggcctaggccacatggcggtcaaatttggcaaggccttcggcctcaaggtcacggttttcagcacgagcgaatcgaagagggaagaagccattaacctccttggagcagataactttgttatatcgtcagacacgcagcagatggaggccctgaaaaactccctgcacttcatagttgacactgcttctggtgaccatccattcgatccgtatctctcgctccttaaggttggcggtgtgatgacaatagtgtgctttccaagtgagatcaagatgcaccctgcgagcctcaatcgtggtgggcggaccttgtctggtagtattgtcggaggtacaaaagacatccaggagatggttaacttttgcgcggagaacaaaatctatccagagatcgagatcatcaagatggattatatcaacgaggctctcgccaggcttgttaaccgagacgtgaaataccgctttgtcatcgacatcaagaactctttcgagtagcatgctcattcacatgatccctgtcttctttgtcaatgtatgagagataatgagtcgtttcgaataaagcttagacatgataaat

SEQ ID NO: 2178 - DNA, 1180 bp, Setaria italica
ccgagtctttctctgctcactgacctggctcctattgattctggagttcggttcgcatggcttctgaatcaggggacggcaactgcaatgcttgggcagcgagagatccttctggagttctctcgccatacaagttcgaccgcagagcagtgcaaagcggcgatgtttcattgaagatcacacactgtggagtctgttatgccgacgttgtttggacacagaatatgcacaatgattctaaatatcctttggttcctgggcacgagatagctggagttgtaactgaggttggttcagatgtcaaaggctttaaagtgggtgaccatataggcatcggaacctacgtgacctcatgctgagattgtgagaactgcaatactctctagagaactattgcccaaaatcagtttatacattcaatggcattgataaagatggcactgtcacaaaggggggttactccactcacattgtaatccatgaaaggtactgcttcaaaataccagggcaaaggcagcacctcttctatgtgctggaatcactatgtatactccaatgatgcgacacaatatgaaccaacctggaaaatcactaggggtcattggacttggtggactgggtcacatggcagtgaaatttggtaaagactttggccttaaggtcacagttttcagtacgagtgaatcgaagagagatgaagccatcaacatccttggagcagataattttgttatatcatcaaacacacagcagatggagtccctgaaatactctcttcacttcatagttgacgctgctttgggtgaccatccttttgatccatatctctcacttcttaaggttggtggtgtgatggcagtagtgtgctttccaagtgagatcaaagtgcatcctgcaagccttaatcttgtgcgcggaccttgtctggtagtattgttggaggtacaaaagacatccaggaaatggttaacttctgtgcagcgaacaaaatctatccgcagattgagatcatcaagatagattatatcaatgaggctctcaaaaggcttgttaatcgagatgtgaaataccgcttcgtaatcgacattgagaactcgttcaagtagcatgtctcattctcatgctcttgtctttttgtcgatgtatgagcaagcacacatgtggcatagcatttgaatta

SEQ ID NO: 2179 - DNA, 1609 bp, Oryza sativa
ctcctcaaaaactacctccaaccaaaacagggccgtaaaggaaaatcttccgtgtcgtcgtctcctccgctccttgcgccaagacgagtcgcggctcaacagcggagaggcggcgatctcccatctggcgagcagagcaggggaggggaagggatcttgttagagtggcatggctgctgaatgtggaagtggcaactgtgatgcttgggcagcgagagatccttcagggatcctctccccgtacaagttcaaccgcagggctgtacaaagtgacgatgtttccttgaggatcacacactgtggtgtttgttatgctgatgttgcatggacaaggaatatactcaacaattcgatgtaccctttagtccctgggcatgagatagcaggagttgtaactgaggttggtgcagacgtcaagagcttcaaagtgggtgaccatgtaggtgttggcacatacgtgaattcatgccgggactgtgagaactgcaatagctctctagagaactactgctcacaacatgtcttcactttcaatggtgttgacactgatgggactgtcacaaagggaggatattctactcacatagtagtacatgagaggtattgctttaaaatacctgatggctaccctttggaaaaggcagcacctttactttgtgctggcatcactgtatatagtccgatgatgcggcataatatgaaccagccagggaagtcactcggcgtcattggacttggtggcttgggtcacatggcagtaaaatttgggaaagcctttggactgaaagtcacagttattagtactagtgaatcaaagagaaaagaagctattgaccttcttggtgcagataatttcgtggtgtcatcggatgaaaatcagatggagaccttgaaaagctctctgaacttcattattgacacagcctccggcgatcacccattcgatccttatctcacgcttctgaaagttggtggtgtaatggcactacttagcttcccaagtgaaatcaaagtgcatcctgcaaaccttaatctcggtgggcggagtttatctggtagtgtaactggaggtacgaaggacatccaggagatgataaacttctgtgcggcaaacaaaatctacccagatatcgagatgatcaagatagattacatcaacgaggctcttcagaggcttgttgaccgggatgtcagatttcgctttgtaatcgacattgagaactcgttcaagtagtatcttgatatcttcagtacaccattaatgatagaagtgtatgcaataataataagtttaaatgtcctacaagatgatgagaccatgagacagttccagaacaaaatgttccattttaagaagcaatttggttctgttttcagttattttcaggagtaaattgtattggtggtacacaaacttatttggtgggtgtaatttaatacataaacttgtttgttgggtgtaatttagtatataaatttgtttgttgggtgtagtttagtacataaactaaacttgtgaagtacttattttggtacatgaacttatctaattcgtatgaatcacaatcaaaatggcttggcaaagttgatccttcaaagttgattttga

SEQ ID NO: 2180 - DNA, 1553 bp, Oryza sativa
agggccgtaaaggaaaatcttccgtgtcgtcgtctcctccgctccttgcgccaagacgagtcgcggctcaacagcggagaggcggcgatctcccatctggcgagcagagcaggggaggggaagggatcttgttagagtggcatggctgctgaatgtggaagtggcaactgtgatgcttgggcagcgagagatccttcagggatcctctccccgtacaagttcaaccgcagggctgtacaaagtgacgatgtttccttgaggatcacacactgtggtgtttgttatgctgatgttgcatggacaaggaatatactcaacaattcgatgtaccctttagtccctgggcatgagatagcaggagttgtaactgaggttggtgcagacgtcaagagcttcaaagtgggtgaccatgtaggtgttggcacatacgtgaattcatgccgggactgtgagaactgcaatagctctctagagaactactgctcacaacatgtcttcactttcaatggtgttgacactgatgggactgtcacaaagggaggatattctactcacatagtagtacatgagaggtattgctttaaaatacctgatggctaccctttggaaaaggcagcacctttactttgtgctggcatcactgtatatagtccgatgatgcggcataatatgaaccagccagggaagtcactcggcgtcattggacttggtggcttgggtcacatggcagtaaaatttgggaaagcctttggactgaaagtcacagttattagtactagtgaatcaaagagaaaagaagctattgaccttcttggtgcagataatttcgtggtgtcatcggatgaaaatcagatggagaccttgaaaagctctctgaacttcattattgacacagcctccggcgatcacccattcgatccttatctcacgcttctgaaagttggtggtgtaatggcactacttagcttcccaagtgaaatcaaagtgcatcctgcaaaccttaatctcggtgggcggagtttatctggtagtgtaactggaggtacgaaggacatccaggagatgataaacttctgtgcggcaaacaaaatctacccagatatcgagatgatcaagatagattacatcaacgaggctcttcagaggcttgttgaccgggatgtcagatttcgctttgtaatcgacattgagaactcgttcaagtagtatcttgatatcttcagtacaccattaatgatagaagtgtatgcaataataataagtttaaatgtcctacaagatgatgagaccatgagacagttccagaacaaaatgttccattttaagaagcaatttggttctgttttcagttattttcaggagtaaattgtattggtggtacacaaacttatttggtgggtgtaatttaatacataaacttgtttgttgggtgtaatttagtatataaatttgtttgttgggtgtagtttagtacataaactaaacttgtgaagtacttattttggtacatgaacttatctaattcgtatgaatcacaatcaaaatggcttggc

SEQ ID NO: 2181 - DNA, 1249 bp, Cynodon dactylon
gagcgagtcccaaaaaagtcaataatctcctcccccagcagcttctccccctttccatcgaatcaagctcttcgtcccaaatctcagacgagctagcaggagggcatccacctgcggcggagcctagcttccgccggcacctgtccatccgccgcctccagcgccccttctctcgggttcgtcttcgtcgccagcccaatcgttatggcttgtgattccaagagtggcaactgtaatgcttgggctgcgagagatccttctggacttctctcaccatacaacttcaatcgcagatctgtacaaagtggtgatgtttcattgaagataacacactgtggagtctgttatgctgatgttatttggacacgaaatatgcacaatgattccaagtaccctttggtccctgggcatgagatagctggcgttgtaactgaggttggttctgacgtcaagacctttaaaattggtgaccatgtaggtgtcggaacgtatgtgaattcatgccaggactgtgaaaactgcaataactttcttgagaatcattgctcaaaaaatgtttacaccttcaacgccattgacacagatggcactatcacaaagggaggatattccacacacattgtagtccatgaaaggtactgctttaaaatacctgatggctaccctttggaaaaggcagcaccactactttgtgctggaataactgtatatactccaatgatgcgacacaatatgaaccaacctggaaaatcacttggggtcattggactcggtgggttgggtcacatggcagttaaatttggtaaatcatttgggcttaaggtcacagttttcagtacaagcgagtcaaagagagatgaagccatcaacctccttggtgcagagaactttgtgatatcatcaaatacacagcagatggagtcccttaaaaactccctgcacttcattgttgacactgctgctggggaccatgcatttgatccctatctctcactccttaaagttggtggtgtgatggcactagtgggttttcctagtgagatcaaagtgcatcctgctaaccttaatcttggtgcacggactctagctgggagtgttactggaggaacaaaggacatccaagaaatgcttgacttctgtgcttcgaacagaatttatccagagactgagatcatccaaatggactacatcaatgaagctctcaagaggctagttaatcgagatgtaaaatcccgctttgtaatcgaca

SEQ ID NO: 2182 - DNA, 1400 bp, Setaria italica
atgaaaggattgacgcaagcgctgatgcgccgccggccgctcagtcaactgtttaatcagcaagaactcctagttcaccggaagatccaaaagtcagaagtctctgatccagtccagcggccgcagattcttcctccctatagaagcagctcatcgcagtcgggtgctctccgcatcccggcgacggcgagtcggcgaacgcgctaccctgccgcctgtgcatcgaggagagttgcggaacctgccggtgccgaaggtgccgggtgctttgctccctttacggttcacatggcctctgaatcaggggatggcaactgcaatgcttgggcagcaagatatccttctggagttctctcaccctacaagtttaaccgcagatcagtgcaaagcagtgatgtttcattgaagatcacacactgcggagtctgttatgctgttatttggacacgaaataagcacaataattcaaaatatcctttgtttcctgggcatgagatagctggagtcgtaactgaggttggttcagatgtaagtgggtgaccatgtaggtgttcgaacctatgtgaactcatgccaggattgtgaaaattgcaataactctctagagaaccactgcccacaatcagttttttactttcaattgcactgatacagatggcactatcacaaagggaggttactccactcacattgtagtccatgaaaggtactgcttcaaaataccagatggctaccctttggcaaaggcagcaccacttctatgtgctggaatcactgtgtatactccaatggtgcaacacaacatgaaccaaccaggaaaatcactgggggtcattggactcggtgggctgggtcatatggcagtgaaatttggtaaagccttttgtcttaaggtcactgttttcagcacaagtgaatcaaagagagatgaagccatcaacatccttggagcagataattttgttatatcattaaacacacagcagatggagtccctgaaaagctctctgcacttcatagtttgacactgattccattgatcatccatttgatccatatctctcactccttaaagttggtggtgtgatggcattagtgagctttccaagtgagatcaaaatacatcctgcaagccttaatcttggtagtgcatggaccttgtctggtagtattgttggaggtacaaaggacatccaagaaatggttaacttctgtgcagcaaacaaaatctatccagagattgagatcatcaagatggattatatcaacgaggctctcatgaggcttcttaattgagatgttaaataccactttgtaatcgacatctagaactctttcaagtagcatgtctcattctcacgcgatcctcttaattttgttgatgtataagagccagcaca

SEQ ID NO: 2183 - DNA, 1446 bp, Secale cereale
tactacttctaaaatgtgcgctgcgattgcagggggcgctgccagttaaagcggccacgcctccgcttaccaccgccgcacatctcaccgaaactggaaccgcgcctcggctggtttctggttccgccgccctgcctgcctgcttctcccgatccccttccgcgagtttagctggccggcatggctgctgaatccgagagctgcaactgcagcgcctgggcagcgaaagatccttctggactactctcccctcacagtttcaaccgtagggctgtacggcatgatgatgtttctttgaggatcacacactgtggtgtctgctatgctgatgttcagtggacaagaaatttgcaccatgactcggtgtaccctttagtccctgggcatgagattgctggagttgtaactgaggtcggtttagacgtcaagggcttcaaattgggcgaccatgtggctgttggcacatatatcaactcatgccgtgactgtgataactgcagtagcctcctcgagaaccactgctcaaattttgttttcactttcaatggtgttgatacggacggtactgtcacaaagggaggatattccactcacattgtagttcatgaacggtactgctataaaatacctgatgggtacccactggaaaaggcagcacctttagtttgtgctgggatcactgtgtatacaccgatgatgcgacataacatgaaccagcccgggaagtcacttggtgtcattggtcttggtgggttgggtcacatggcagtgaaatttgggaaagcctttgggctgaatgtgactgttcttagtacaagtgaatccaaaagagatgaagctatcaacctacttggtgcagataattttgtggtatcatcagataaaaccagatggagtccctgaaaaattctctggacttcattgtcgatactgcctctggtgaccacccatttgacccttatctcgcgcttctgaaagttcgtggcctaatggcactagttggctttcctggagaaatcagagtgcatcctgcaacactcaatctgggtgcacggacactttctggcagtgtagtcggaggcaccaaggacacccaagagatgataaacttctgcgccgcaaacaaaatataccccgatgttgaggtgataaagatagactacatcaacgaggctctcgagaggcttgtcaaccgggatgtgaagtaccggtttgtaatcgacatagagaactctttcaagtaatatcttcacggttggaacatcttgaatccttgtaaaagtgtgtagaataaagtttaatcttccaaacaatcgcggctgactggtgatacagggctttcctctgtaatgttctggtatgctttcctgtctgtgatagaatatttttgtaaagatatacatattactttcagaaaatatgtaaatatacctcctaaaaaaagtc

SEQ ID NO: 2184 - DNA, 1539 bp, Brachypodium distachyon
agcggtctcccattgacagcgccgcccaacacctatgccaactccctgcttcatagaagatcccttccaggaaacccaacaaaatactagaagatcccttcctgcacgcgaggtttctgggttcttcgccgccaccgaagatagagaggcgcgcaccggtgcgaggagaggttggcgctggttcttggttcctctgcctgcttctctcactacctccaagttgtttctgcagtttaattggcatggctgctgaatgcgagagtggcaactgtcatgcttgggcagcaaaagatccttctggaacactctctccatacaaattcaatcgcaggactgtacagagtggtgatatttctttgaggatcacacattgtggagtctgttatgctgatgttatctggacaaggaatcagcacaatgactcggtgtaccctttagtccctgggcatgagatagctggagttgtaactgaagttggatcagacgtcaatgggtttaaagtgggcgaccatgtatgtgttgggacatatgtgaattcatgccgggattgcgagaactgcaatagcttccttgagaaccactgctcaaaatttgttttcactttcaatggtgttgatacagatggtactgtcaccaagggaggatactcaggtcacatagtagttcatgaaaggtactgctataaaatacctgatggctacccattggaaaaggcagcacctttagtttgtgccggaatcactgtgtatactccaatgattcgacataacatgaaccaaccagggaagtcacttggtgtcattggacttgggggattgggtcacatggcagtaaaatttgggaaatcctttggactgaaggtcacagtttttagtacaagtgaatcaaagagagaagaagctatcagccttcttggtgcagataattttgtgatatcatcagataaaaagcagatggagtcgctgaaaagttccctgcacttcattgttgatactgcctctggtaaccacccgtttgatccttacctctcacttctgaaagttgggggtgtaatggcgctacttagctttccagaagaaatcagaattcaccctgcaactcttaatctgggcgcacggactttggctggaagtgtaactggggggacgaaggatacccaggagatgataaacttctgcgcagcaaacaaaatctacccagatattgagctgataaagatagactacatcaatgaggctctcgggaggcttgttaaccgggatgtgagataccgcttcgtaatagacatagagaactctttcaagtaatatgttagcagctcgcacctttgggtgatggttattacttaaaaaagtttgtggtataagtttcatcttctacaaaacggtggctgataggagtgggctatgtttcatgcctgtgtacagctcctcctttgttctgttcggttctggtaactttagtaatagcatctaccgtgccaaacgattgcagtatttttctatatataaagtaaggattttattgctctttgtttcc

SEQ ID NO: 2185 - DNA, 1697 bp, Brachypodium distachyon
acgcgtcgcccactcgccccctagcggtctcccattgacagcgccgcccaacacctatgccaactccctgcttcatagaagatcccttccaggaaacccaacaaaatactagaagatcccttcctgcacgcgaggtttctgggttcttcgccgccaccgaagatagagaggcgcgcaccggtgcgaggagaggttggcgctggttcttggttcctctgcctgcttctctcactacctccaagttgtttctgcagtttaattggcatggctgctgaatgcgagagtggcaactgtcatgcttgggcagcaaaagatccttctggaacactctctccatacaaattcaatcgcaggactgtacagagtggtgatatttctttgaggatcacacattgtggagtctgttatgctgatgttatctggacaaggaatcagcacaatgactcggtgtaccctttagtccctgggcatgagatagctggagttgtaactgaagttggatcagacgtcaatgggtttaaagtgggcgaccatgtatgtgttgggacatatgtgaattcatgccgggattgcgagaactgcaatagcttccttgagaaccactgctcaaaatttgttttcactttcaatggtgttgatacagatggtactgtcaccaagggaggatactcaggtcacatagtagttcatgaaaggtactgctataaaatacctgatggctacccattggaaaaggcagcacctttagtttgtgccggaatcactgtgtatactccaatgattcgacataacatgaaccaaccagggaagtcacttggtgtcattggacttgggggattgggtcacatggcagtaaaatttgggaaatcctttggactgaaggtcacagtttttagtacaagtgaatcaaagagagaagaagctatcagccttcttggtgcagataattttgtgatatcatcagataaaaagcagatggagtcgctgaaaagttccctgcacttcattgttgatactgcctctggtaaccacccgtttgatccttacctctcacttctgaaagttgggggtgtaatggcgctacttagctttccagaagaaatcagaattcaccctgcaactcttaatctgggcgcacggactttggctggaagtgtaactggggggacgaaggatacccaggagatgataaacttctgcgcagcaaacaaaatctacccagatattgagctgataaagatagactacatcaatgaggctctcgggaggcttgttaaccgggatgtgagataccgcttcgtaatagacatagagaactctttcaagtaatatgttagcagctcgcacctttgggtgatggttattacttaaaaaagtttgtggtataagtttcatcttctacaaaacggtggctgataggagtgggctatgtttcatgcctgtgtacagctcctcctttgttctgttcggttctggtaactttagtaatagcatctaccgtgccaaacgattgcagtatttttctatatataaagtaaggattttattgctctttgtttccgcaacaaacacaattctcaattttctagaagtagtgcagatgtattagatgatctttacaatttaacttggtgaccgtgggagtggcgggtggaaaatggaacaaaagagaatacgtctaatctgtacctgataat

SEQ ID NO: 2186 - DNA, 1245 bp, Sorghum bicolor
atggggcatttgagtgagcattttaggtctgatgggatttccagaaatttaagtgcaaacagcaacgtgcttgtctttctgttcagctactgctcgtggtctgtcaaactaaattatgaaactgatgcttactatggggcattgagtgagcattttagagcagtgcaaagcagcgatgttgcgctgaagatcatatactgtggagtctgttatgctgacgttggttggacacggaacatgctcaatgattcaaaatatcctttggttcctgggcatgagatagctggagttgtaactcaggttggtgcagatgtcaaagcctttaaagtgggtgaccatgtaggtgttggaacatatgtgaactcatgccgagattgtgagaactgcaatagctctctagagaaccactgcccagaaagagtttttactttcaatggcattgatacagatggaactgtcacaaaggggggttactccactcacattgtagtccatgaaaggtattgcttcaaaatacccgatggctaccctttggcaaaggcagcacctcttctatgcgctggaataactgtgtatactccaatgatgcgacacaacatgaaccaacctggaaagtcacttggggtcattggactcggtggcctaggtcacatggcggtgaaatttggtaaagcgtttggtcttaaggtcacagttttgagtacaagtgaatcaaagagacatgaagccatcagcctacttggagcagataattttgttatatcatcagacacacagcagatggagtccctgaaaaactccctgcacttcatagttgacaccgcttctggtgaccatccgtttgatccatatctctctctccttaaggttggtggtgtgatgacactgctgggctttccaagtgcgcgggccttgtctggtagtgttgttggaggtacaaaagacatccaagaaatggttaacttctgtgcagagaacaaaatctatccagagatcgagatcattaagatagattacatcaatgaggctttggcaaggcttgttaatcgagatgtgaaataccgctttgtaattgacatcgagaactctttcaagtaggatgctggttcacatgctctcgtctttctgttggtgtacaagagcaatcacaaatttgagtcatataaaataaacttgatgtaatgctgcagcgcatttacaattctagtcatgtgttaatttcattattgtagtatttattctctc

SEQ ID NO: 2187 - DNA, 1172 bp, Sorghum bicolor
atggggcatttgagtgagcattttaggtctgatgggatttccagaaatttaagtgcaaacagcaacgtgcttgtctttctgttcagctactgctcgtggtctgtcaaactaaattatgaaactgatgcttactatggggcattgagtgagcattttagagcagtgcaaagcagcgatgttgcgctgaagatcatatactgtggagtctgttatgctgacgttggttggacacggaacatgctcaatgattcaaaatatcctttggttcctgggcatgagatagctggagttgtaactcaggttggtgcagatgtcaaagcctttaaagtgggtgaccatgtaggtgttggaacatatgtgaactcatgccgagattgtgagaactgcaatagctctctagagaaccactgcccagaaagagtttttactttcaatggcattgatacagatggaactgtcacaaaggggggttactccactcacattgtagtccatgaaaggtattgcttcaaaatacccgatggctaccctttggcaaaggcagcacctcttctatgcgctggaataactgtgtatactccaatgatgcaacacaacatgaaccaacctggaaagtcacttggggtcattggactcggtggcctaggtcacatggcggtgaaatttggtaaagcgtttggtcttaaggtcacagttttgagtacaagtgaatcaaagagacatgaagccatcagcctacttggagcagataattttgttatatcatcagacacacagcagatggagtccctgaaaaactccctgcacttcatagttgacaccgcttctggtgaccatccgtttgatccatatctctctctccttaaggttggtggtgtgatgacactgctgggctttccaagtgcgcgggccttgtctggtagtgttgttggaggtacaaaagacatccaagaaatggttaacttctgtgcagagaacaaaatctatccagagatcgagatcattaagatagattacatcaatgaggctttggcaaggcttgttaatcgagatgtgaaataccgctttgtaattgacatcgagaactctttcaagtaggatgcgggttcacatgctctcgtctttctgttggtgtacaagagcaatcacaaatttgagtcatataaaataaa

SEQ ID NO: 2188 - DNA, 2368 bp, Saccharum officinarum
cgccttctcggggcagcgcagtactacgagcttagcagcaccaggactccctctctctcttctctctcgagaatggttgtgtaggcgggcgcaggagggagggagggaggagagaaagaggggagctagggttttgcgccgccgccttctaccaccctcaggctctgaacccctccggtccggtgcgcggcggattaggctgcaatggggaagtctccggcgaagtggatcaagtccgtgctcttcgggaagaagtcgtcgtcgaggtccggctccaccaaggccaaggatttatcgaagggtgcgagtaacaaagggtatgctgctgacgggaaggagcccgctttctccgagagctctccggtgatctcggagcctgtgcttgttagcgcccacaacaatgagaccgcgcgggaggtggccaggggtgagaattccagcgtgcaagaagaagtgccagtgactgatgtcagtcaagacttggagaagcagggcactgtgggatctgatacgtccaatgatgctgagaggttgagggaagagcaagcggccgtgaaggcacaagctgccttccgtggctatctggcacgccgagcattccgtgccctcaaagggatcataagactacaggcgctgattcggggacatcttgtaaggaggcaagctgtttcaactctccgtgcaacatggttgattgtgaagtttcaagccctggtccgtggaaggaacgttagactttctcaagcttccattcaagcaactagggaactttcccaacagaagttcagggatgctaaaccttgttcctggaaggagaagttgtcttcaaatgcatttgctcgcaagcttctatcttcaccaattgtggttgaggctcttcacttccagtatgatgagatggaccccaattcagccttcaattggttagagaggtggacgataagtcatgtctggaagcccatttcccaaccaaagagagttggtgctgatgctaagccacatacaaggaaggccagttatgcaatggaaacagagtcagcgaaattgaagcgtaatgcaaggaagagctctttagtgccatttgaaccttctcaaacaaacaccgccattgaaattgagaagacaagacggaatccaaggaaattaagtagtactcctgcagagtcggttcctgatggccagttaacagaacttgagaaggttaaacgtagccttaggaaggttactaattccgtggctgaaacctcaaagacacctaatccaacaactgagattcctgaccatcaagaggtccaatgtgagagaccactaagaagtgcaaagcaagttccaattcatcctgagaatcaagagcctcggaatgttaatctatcggacaatgcaaagatggatattctggtacctgatatccagcctgacgtggaagttgcttcagatccagtcacaatcacaaatgaagaaaaagttgatgaaccaccgtcagttgttgctccagcggctgaaattatgccgctgcaagacattaacaatgaagaaaatgctttggtgaatgatgtggaagagagatccaaagaagaacatccttctactgagagcctgaaaggcagcaagaggaggtcttcattctcaactaagcctgaatatccagaaaatggctccaaaaattctccagctctgccaagctacatggctgctacacaatctgcaaaggcgaaactgcggggaaatagttcaccaagacttagctctgattcagcagagaaaaacgggttcactcgtcgtcactcccttccgtcctctaacaatggtaagatgatttcacattctccacgtacacaaaggccaacccatgctggtggcaaggatggagcaaaaggcgacaaggctatgctgtcatcaagagatgcgagtgagagaccactgaaagctgagtggagacgttgaggtggcgaatcaaaccccaaatcctccatttgattagcgcaactgttttggtggatggatggcgtctgcagtttgctcggattgttttgcttgtgatgtaaaaaagatgttatcatcatcatctgcggcgatgaacggaaccggctttgttgtgatgaatctgctgggagtcaacttatttatagggttttcggtcatgccttttgtgatgtatagctgaagtattttccctgtttgcattggttcccagatcccctgacttttcccctcctgcttgttgagagctgctgatgttagagagaacgagaacctgtatggattgagttgaacaatcatagtcctgtgtgggcaatctgggctgcgttttgactgatggttgtgccattcatgattattgtccttgaagcagtagtattctttttcc

SEQ ID NO: 2189 - DNA, 2524 bp, Sorghum bicolor
tcggcgctgcctgtgctgtgcagtagtacgagcctcttcccagttctcacacttccgctctctctctctctctctctctctctctctcctctcgagaatggttgtgtaggcggcgggcgcaggagggaggagagagagagaggggagctagggttttgcgccgccgcctactaccaccctcaggctctgaacccctccggtccggtttgcggcggattaggctccaatggggaagtctccggcgaagtggatcaagtccgtgcttttcgggaagaagtcgtcgtcgaggtccggctccgccaaggccaaggatttatcgaagggtgcgagtaacaaagggtatgctgctgccgggaaggaacccgctttctccgagagctctccggtgatctcggagcctgtgcttgttagcgcccacaacgatgagaccgcgcgggaggtggccaaggctgagaattccagcgtgcaagaagaagtgccagtgactgatgtctgtcaagacttagagaagcagggcgctgtggggtctgattcgtccaatgatgctgatagggtgagggaagagcaagcggcagtgaaggcacaagctgccttccgtggttatctggcacgcagagcattccgtgccctcaaagggatcataagactacaggcgctgattcggggacatcttgtaaggaggcaagctgtttcaactctccgtgcaacatggttgattgtgaagtttcaagccctggtccgtggaaggaacgttagactttctcaagctttcattcaagcaactagggagctttccctagagaagtttgggggtgctaaacctggttcctggaaggagaagttgtcttcaaatgcatttgctcgcaagcttctatcttcaccaattgtggttgaggctcttcacttccagtatgatgaaatggaccctaattcagccttcaattggttagagaggtggacgataagtcatgtctggaagcccatttcccaaccaaagagggttggtgctgatgctaagccacatacaaggaaggccagttatgcaatggaaacagagtcagcgaaattaaagcgtaatgcacggaagagctctgcagtgccatctgaagcttctcaaacaaacaccaccattgaaattgagaagacaagacggaatccaaggaaattaagtagtactcctgctgagtcggttcctgatggccagttaacagaacttgagaaggttaaacgtagccttaggaaggttactaattccatggctgaaacctcaaagacacctaatccaacaactgagattcctgaccctcaagaggtccaatgtgagagaccactaagaagtgcaaagcaagttccaattcatcctgagaatcaagatcctcggaatgttaatctatcggacaattcaaagatagatattctggtacctgatatccagcctgacgtggaagatgcttcagatccagtcacaatcacaaatgaagaaaaagttgatgagccaccatccgttgttgctccagtggctgaaattatgccactgcaggacattaacaatgaagaaaatgctttggtgaatgatgtggaagagagatccaaagaagaacatccttctactgagagcctgaaaggcagcaagcggaggtcttcattctcaactaagcctgaatatccagaaaatggctccaaaaattctccagctttgccaagctacatggctgctacacaatctgcaaaggcaaaactgcgggggagtagttcaccaagacttagctctgattcagcagagaaaaacgggttcactcgtcgtcactcccttccatcctctaacaatggtaagatgatttcacattctccacgtacacaaaggccaacccttgctggtggcaaggatggagcaaaaggcgacaaggctatgctgtcatcaagagatgcaagcgagagaccactgaaagctgagtggagacgttgagatggcgaatgaaaccacaaatcctccatttgattagtgcaactgttttggtggatggatggcgtctgcagtttgctcggattgttttgcttgtgatgtaaaaaagatgttttcatcatcatccgcggcgatgaatgaacgaaccagctttgttgtgatgaatctgctgggagtcaacttatttatagggttttcggtcatgccttttgtgatgtatagctgaagtgttttccctgtttgctttggttcccagatcccaagacttttcccctccttgttgagagctgctgatgttagagagaacgagaacctgtatggattgagttgaacaatcttagtcctgtttgggcaatctgggctgcgttttgactgatggttgtgtgccattcatgattattgtgcttgaagcagtagtattcttttccaaatttcttgatctgggtgtcatgcaatgcaacgctggcttgcaaaaaggatccatgtatcatgtgatctatcaaagtagaagcctcgggttgcttcaaaattcaaatgcatggcgtcgcatcgctcggagac

SEQ ID NO: 2190 - DNA, 2651 bp, Sorghum bicolor
gggggggtgggtgtagtaagaatctgggctttgcctgcttccggcgtttcctgtggatggaattgtggccgtggagtagatctgtgcactgatgcgcggttctgctgcaggctctgaacccctccggtccggtttgcggcggattaggctccaatggggaagtctccggcgaagtggatcaagtccgtgcttttcgggaagaagtcgtcgtcgaggtccggctccgccaaggccaaggatttatcgaagggtgcgagtaacaaagggtatgctgctgccgggaaggaacccgctttctccgagagctctccggtgatctcggagcctgtgcttgttagcgcccacaacgatgagaccgcgcgggaggtggccaaggctgagaattccagcgtgcaagaagaagtgccagtgactgatgtctgtcaagacttagagaagcagggcgctgtggggtctgattcgtccaatgatgctgatagggtgagggaagagcaagcggcagtgaaggcacaagctgccttccgtggttatctggcacgcagagcattccgtgccctcaaagggatcataagactacaggcgctgattcggggacatcttgtaaggaggcaagctgtttcaactctccgtgcaacatggttgattgtgaagtttcaagccctggtccgtggaaggaacgttagactttctcaagctttcattcaagcaactagggagctttccctagagaagtttgggggtgctaaacctggttcctggaaggagaagttgtcttcaaatgcatttgctcgcaagcttctatcttcaccaattgtggttgaggctcttcacttccagtatgatgaaatggaccctaattcagccttcaattggttagagaggtggacgataagtcatgtctggaagcccatttcccaaccaaagagggttggtgctgatgctaagccacatacaaggaaggccagttatgcaatggaaacagagtcagcgaaattaaagcgtaatgcacggaagagctctgcagtgccatctgaagcttctcaaacaaacaccaccattgaaattgagaagacaagacggaatccaaggaaattaagtagtactcctgctgagtcggttcctgatggccagttaacagaacttgagaaggttaaacgtagccttaggaaggttactaattccatggctgaaacctcaaagacacctaatccaacaactgagattcctgaccctcaagaggtccaatgtgagagaccactaagaagtgcaaagcaagttccaattcatcctgagaatcaagatcctcggaatgttaatctatcggacaattcaaagatagatattctggtacctgatatccagcctgacgtggaagatgcttcagatccagtcacaatcacaaatgaagaaaaagttgatgagccaccatccgttgttgctccagtggctgaaattatgccactgcaggacattaacaatgaagaaaatgctttggtgaatgatgtggaagagagatccaaagaagaacatccttctactgagagcctgaaaggcagcaagcggaggtcttcattctcaactaagcctgaatatccagaaaatggctccaaaaattctccagctttgccaagctacatggctgctacacaatctgcaaaggcaaaactgcgggggagtagttcaccaagacttagctctgattcagcagagaaaaacgggttcactcgtcgtcactcccttccatcctctaacaatggtaagatgatttcacattctccacgtacacaaaggccaacccttgctggtggcaaggatggagcaaaaggcgacaaggctatgctgtcatcaagagatgcaagcgagagaccactgaaagctgagtggagacgttgagatggcgaatgaaaccacaaatcctccatttgattagtgcaactgttttggtggatggatggcgtctgcagtttgctcggattgttttgcttgtgatgtaaaaaagatgttttcatcatcatccgcggcgatgaatgaacgaaccagctttgttgtgatgaatctgctgggagtcaacttatttatagggttttcggtcatgccttttgtgatgtatagctgaagtgttttccctgtttgctttggttcccagatcccaagacttttcccctccttgttgagagctgctgatgttagagagaacgagaacctgtatggattgagttgaacaatcttagtcctgtttgggcaatctgggctgcgttttgactgatggttgtgtgccattcatgattattgtgcttgaagcagtagtattcttttccaaatttcttgatctgggtgtcatgcaatgcaacgctggcttgcaaaaaggatccatgtatcatgtgatctatcaaagtagaagcctcgggttgcttcaaaattcaaatgcatggcgtcgcatcgctcggagacgtggcatgtaactctggcatgcgtgtctgatcaaattgtatccgaggctctggccgaatgataatgaaaagcagggctgtaaaaaaaaaaatgcatggcaaccgatcgagagccgtcccttgaaagtttggactgcactatacacagtgaaggctggcccagctgttgtttcaagtaacactcgggatcaaacacattgc

SEQ ID NO: 2191 - DNA, 2202 bp, Zea mays
attgattttttttttccgcgcagccgatttcttttcgtctctctcgctctcgccttctcggcgcagcgcagtactacgagctagcagcaccaggaacctcttcccacacttccgcgctcctccctctgtctcgagactcgagaatggttgtgtaggcgggcgcaggagggagggaggcgagagggggagctagggtttttcgccgccgccttctgttatcctcaggctctgaaccccctcctgtccggtgcgcggcggattagactccgatggggaagtctccggcgaagtggatcaagtccgtgctcttcgggaagaagtcgtcgtccaggtccggctccaccaaggccaaagatttatcgaaaggtgcgagtaacaaaggagctgctgctgcggggaaggagcccgtgttctctgagagctccccagtgatctcggagcctgtgcttgttagcgcccacaacaatgagaccgtgcgggaggtggcgaagggtgagaattccagcgtgcaagaagtgccagtgaccgatgtcagtcaagacttggagaagcagggcagtgtggggtctgatacgtccaatgatgctgagagggtgaaggaagagcgagcggccgtgaaggcacaagctgccttccgtggttatctggcacgccgagcattccgtgccctgaaagggatcataagactacaggcattgattcggggtcatcttgtaaggaggcaagctgtttcaactcttcgtgcaacatggttgattgtgaagtttcaagccctggtccgtgggaggaatcttagactttctgaagcttccattcaagcaaccatggaactttcccaacagaaccttgcgggtgctaaacctggttcctggaaggagaagttgtcgtcaaatgcatttgctcgcaagcttctatcttcatcaattgtggttgaggctcttcacttccagtatgatgagatggaccctaattcagccttcaattggttagagaggtggacgataagtcatgtctggaagcccgcttcccaaccaaggagagttagtgctgatgctaagccacatacaaggaaggccagctatgcaatggaaacagagtcagtgaaattaaagcgtaatgcacggaggagctctgcagggccatttgaaccttctcaaacaaacactgccattgaaattgagaagacaagacggaatccaaggaaattaagtagcactcctgctgagtcagttcctgatggccagttaacagaacttgagaaggttaaacgtagccttaggaaggttactaattccgtggctgaaacctcgaaggcatctagtccaaaaactgagattcctaaccatcaagaggtccaatgtgagagaccactaagaagagcaaaacaagttccaattcatcttgagaatcaagagcctgataatgttaatctgtcggacaatgcaaagatggatattctggtacctgatatccagcctgatgtggaagttgcttcagatccagtcaccatcactaatgaagaaaatgttgatgaaccaccatctgttgttgctccagtggccgaaattatgcctctgcaagacatcaacaacgatgaaaatgctttggtgaatgatgtggaagagagatccaaagaagaacatccttctactgagagcctgaaaggcagcaagaggaggtcttcattctcagctaagcctgaatatccagaaaatggctccaaaaattctccagctctgccaagctacatggctgctacacaatcagcaaaggcgaaactgcggggaaatagctcaccaaaacttagctctgattcagcagagaaaaacggcttcactcgtcgtcactcccttccatcctctaacaacggtaagatggtttcacattctccacgtacacaaaggccagctaatgctggtggcaaggatggagcgaaaggtgacaaggctatgctgtcatcaagagatgcaagcgagagaccactgaaagctgagtggagacgttgaggcggcgaatcaaatccaaatccttcatttgattagcgcgaccgtttgggtggatggatcgcccttgcagtttgctcggatttgttttgtttgtgatgtaaaaaaatgatgtccttatcgtcggcgagatgaatgaaccggctttgttgtgatgaatccgctgggagtcaacttatttattatagggttttccgtc

SEQ ID NO: 2192 - DNA, 2436 bp, Setaria italica
ctcatttcttcctctgggagccatttcggcgcagtactacgagccaacgccagtagcctcctcccacactgacccgctctctctcttctctctctctctggaatggttgtgtaggcaggcaggcaggcaggggggagggagggagggaggagagagagagggggagcgagggtggcgcgccgccgcggcctcagcctctgaaccctccggcgtgcggcggatttggctccaatggggaagtctccggcgaagtggatcaagtccgtgctcttcgggaagaagtcgtcgtcaaggtccggctccaccaaggccaaggacttatcgaagggtgcaagcaacaaagggtatgctggtaaggagcctgcattctccgagagctctccggttatctcggagcctgtgcttgttagcgcccacaacaatgaggccgtgcgggaggtgccaaagggtgagaattccagcgtgcaaggtgaagttgcagtgcctgatgtcaatcaagatttggagaagcatgacactgtgggttctgatgcatccaatgatgctgagaggttgagggaagagcaagcggctgtgaaggcgcaagctgcgttccgtggttatctggcacgccgagcattccgtgcattgaaagggatcataagacttcaggctctgattcgggggcatcttgtaaggaggcaagctgtttcaactctccgggcaacatggttgattgtgaattttcaagccctgatccgtggaaggaatgtcagactttctcaagctgccattcatgccagtcggaaactgacccaacagaactttgggggtgctaaacctgatttatggaaggagaaattatcttcaaatgcttttgctcgtaagcttctatcttcaccaattgtggttgaagctcttcactttcagtatgatgagatggaccctaattcagccttcaactggttggagaggtggaccattagtcatgtctggaagcccatttcccaaccaaagagagttggcactgatgcgaagccacatgcaaggaaggccagttatgcaatggaaactgagtcagcgaaattaaaacgcaatgctaggaagagctctgcaacaccatttgagccttcacaaacaaatacaaccacagaaattgagaagacaaaacggattccaaggaaaatgagtagtgctcctgctgattcagtgcctgatggacagttaactgaacttgagaaggttaaacgtagccttaggaaggttactaattccatggcagaaacctcaaaggtatctaatccagcacctgagatccctgatgatcaagaggtccgatgtgacagaccactaagaagtgcaaagcaagttccggttcaccccgagagtcaagagccccagaatgttaatctattggataatgcaaagatggctattctggtacctgatctccagcctgatgaggaaattgcttcagatccagtcataaatgaagaaaaagttgatgaactgtctgttgttactccaccagctgaaattatgccactgcaagacattaacaatgaagaaaatgctttggtgaatgatacggaacagaggtccaaagaagaacctctttctactgaaagccttaaaggcagcaagaggaggtcttcattctcaactaagccagaatatcctgaaaatggttccaaaaattctccagctctgcccagctacatggctgcaacacaatctgcaaaggcgaaactgcggggacagaattcaccgagactcagctctgattcagcagagaaaaatggcttcactcgccgtcactctcttccttcctctactaatggtaagatggtttcgcattctccacgtacacaaaggccaaccaatgctggtggaaaggatggagcgaagggtgacaaggctatgctgtcatcaagagatgcaagtgagagacccctgaaagctgagtggagacgttgaagaggcgcaccaaactgtgaaatccccatttgatcagcgcaaccgtttggttggaaggtgtctgcagtttgctcagattgttttgcttgtgatgtaaaaaagatgttctcatcatcccgcgacgatggctttgttgtcctgaacgcctgaacctgctgcaagttgtgacttatttatagggttttccgtccagccttttgtgatgtatagctgaagtgtcttcccagtttgttttttggtcccgaggacatacccccttcctgcttgttgagagagctgctgatgttagagagaatcggaacctgtatggatcgagttgaacaatctcagtcccgtctgggcatcctgggctgcgttttgactgacggttgtgtgccatccatgatttgatgtccttgattgctacttacagtatttgctagtagtcgcattctttcctggcttccagtttcctgttctggttgtcctgcaacgccgatg

SEQ ID NO: 2193 - DNA, 2287 bp, Setaria italica
cacaaccattccagagagagagagaagagagagagcgggtcagtgtgggaggagagagagagggggagctagggtttcgcgccgccgctgcctcagcctctgaaccctccggcgtgcggcggatttggctccaatggggaagtctccggcgaagtggatcaagtccgtgctcttcgggaagaagtcgtcgtcaaggtccggctccaccaaggccaaggacttatcgaagggtgcaagcaacaaagggtatgctggtaaggagcctgcattctccgagagctctccggttatctcggagcctgtgcttgttagcgcccacaacaatgaggccgtgcgggaggtgccaaagggtgagaattccagcgtgcaaggtgaagttgcagtgcctgatgtcaatcaagatttggagaagcatgacactgtgggttctgatgcatccaatgatgctgagaggttgagggaagagcaagcggctgtgaaggcgcaagctgcgttccgtggttatctggcacgccgagcattccgtgcattgaaagggatcataagacttcaggctctgattcgggggcatcttgtaaggaggcaagctgtttcaactctccgggcaacatggttgattgtgaattttcaagccctgatccgtggaaggaatgtcagactttctcaagctgccattcatgccagtcggaaactgacccaacagaactttgggggtgctaaacctgatttatggaaggagaaattatcttcaaatgcttttgctcgtaagcttctatcttcaccaattgtggttgaagctcttcactttcagtatgatgagatggaccctaattcagccttcaactggttggagaggtggaccattagtcatgtctggaagcccatttcccaaccaaagagagttggcactgatgcgaagccacatgcaaggaaggccagttatgcaatggaaactgagtcagcgaaattaaaacgcaatgctaggaagagctctgcaacaccatttgagccttcacaaacaaatacaaccacagaaattgagaagacaaaacggattccaaggaaaatgagtagtgctcctgctgattcagtgcctgatggacagttaactgaacttgagaaggttaaacgtagccttaggaaggttactaattccatggcagaaacctcaaaggtatctaatccagcacctgagatccctgatgatcaagaggtccgatgtgacagaccactaagaagtgcaaagcaagttccggttcaccccgagagtcaagagccccagaatgttaatctattggataatgcaaagatggctattctggtacctgatctccagcctgatgaggaaattgcttcagatccagtcataaatgaagaaaaagttgatgaactgtctgttgttactccaccagctgaaattatgccactgcaagacattaacaatgaagaaaatgctttggtgaatgatacggaacagaggtccaaagaagaacctctttctactgaaagccttaaaggcagcaagaggaggtcttcattctcaactaagccagaatatcctgaaaatggttccaaaaattctccagctctgcccagctacatggctgcaacacaatctgcaaaggcgaaactgcggggacagaattcaccgagactcagctctgattcagcagagaaaaatggcttcactcgccgtcactctcttccttcctctactaatggtaagatggtttcgcattctccacgtacacaaaggccaaccaatgctggtggaaaggatggagcgaagggtgacaaggctatgctgtcatcaagagatgcaagtgagagacccctgaaagctgagtggagacgttgaagaggcgcaccaaactgtgaaatccccatttgatcagcgcaaccgtttggttggaaggtgtctgcagtttgctcagattgttttgcttgtgatgtaaaaaagatgttctcatcatcccgcgacgatggctttgttgtcctgaacgcctgaacctgctgcaagttgtgacttatttatagggttttccgtccagccttttgtgatgtatagctgaagtgtcttcccagtttgttttttggtcccgaggacatacccccttcctgcttgttgagagagctgctgatgttagagagaatcggaacctgtatggatcgagttgaacaatctcagtcccgtctgggcatcctgggctgcgttttgactgacggttgtgtgccatccatgatttgatgtccttgattgctacttacagtatttgctagtagtcgc

SEQ ID NO: 2194 - DNA, 2500 bp, Panicum virgatum
catccatccgtcggtggcacaccacccttctctccctcttcctctccctgtccatcagctcgtgcgcgcgtagggtttccccgcaccagtcgcccctcgcgccgccgccgaggccgagcacggcggaccgcgggactgcttcggggcgccgctgaccgcgcgcggctctcctcccgcctcgggcgacggccctccgccagggtaggctgacgcccctccgccaggctcgcccgaccgcagcaaggcgccgccgccgccgcatcagtactcctccaggccgtgaaagcctctgaacccccggcgagcggcggaataggctccaatggggaagtctcccgcgaagtggatcaagtccgtgctcttcgggaagaagtcgtcgtcgcggtccacctccaccaagtccaaggatttatcgaagggtgcaagcaacaaagggtatgctggtaaggagcccgcattctcggagagctccccggtgatctcggagccagtgcttgttagcgcccacaacactgagactgcgcgggaggtggctaagggtgagaattcaaacgtgcaaggtgaagttgcagtgcctgatgtcaatcatgatttggagaagcatgtcagtgtggggtctgatgcgtccaatgatgctgagaggttgagggaagagcaagcggctgtgaaggcacaagctgcgttccgtggttatctggcacgccgagcattccgtgcattgaaagggatcataagacttcaggctttgattcgggggcatcttgtaaggaggcaagctgtttcaactctccgtgcaacatggttgatcgtgaaatttcaagccctgatccgtggaaggaatgtcagactttcacaagctgccattcatgcaagtcggaaacttacccaacagaactttgggagtgctaaacctgattcatggaaggagaaattatcttcaaatgcatttgctcgtaagcttctatcttcaccaattgtggtcgaagctctccactttcagtatgatgaaatggacccaaattcagccttcaaatggttggagaggtggaccactagtcgtatctggaaggccatttcccaaccaaagagagttggtgctgatgcaaagccacatgcaaagaaggccagttatgcaatggaaactgagtcagggaaattaaagcgcaatgctaggaagagctctgcaatgccatttgagccttcacaagcaaacacatccatagaaattgagaagacaaaacggaatccaaggaaaccgagtagtgctcctgctgattcagtgcctgatggacagttaactgaacttgagaaggttaaacgtagtcttaggaaggttactaattccatgcctgaaacctcaaaggtatctaatccagcacctgagatccctgaccatcaagaggtccaaagcgagcgaccactaagaagtgcaaagcaagttccggttcaccctgagaatcaagagccccagaatgttaaactatcggataatgcaaagatagatatcctggtacctgatctgcagcctgatgaggaagttgcttcagatccagtcacaaacgacgaaaaagttgatgaaccaactgttgttgctccaccagctgaaattatgccactgcaagacattaacaatgaagaaaatgctttggtgaatgatacagagcagagatccaaagaagaacctctttctactgaaagccttaagggcagcaagaggagatcctcattctcgactaagccagaatatcctgaaaatggctccaaaaattctccagctctgcccagctacatggctgcaacacaatctgcaaaggcaaaactacggggacagaattcaccaagactcggctctgattcagctgagaaaaatggcttcactcgccgtcactcccttccatcctctaccaatggtaagatgattgcgcattctccacgtacacaaaggccaacccatgctggtggcaaggatggagcgaaaggtgacaagactatgctgtcatcaagggatgcgagtgagagaccattgaaagcggagtggaggcgctgaagaggcacaccaaactctgaaatcgtccatttgattagcataactgttttggtggaaggcctctgcagtttgctcgaattgttttgcttgtgatgtaaaaaaagatgttctcatcatcccgcgacgatggctttgttgtgctgaacctgctgcgagttgacttatttatagggttttccgtccagccttttgtgatgtagctgaagtgtttgcccggtttgttttggtcccgagacatgcccccagttcctgcttgttgggagagccgctgatgttagagaacgagaacctgtatggattgagttgaacaatctaagtcccgtttgggcattctggtgttttgactgacagttgtgagacatcatccatgatgatccctggttattaatatccttttggttgctgtttggtattagtttgtactttcccggcttccttttttcttgtcctgat

SEQ ID NO: 2195 - DNA, 2217 bp, Pennisetum glaucum
aggcaggcaggagggagggaggagagagaggggggagctagggttttgcgccgccgctgcctcagcctctgaaccatcgggtgtgcagcggatttggctccaatggggaagtctccggcgaagtggatcaagtccatgctcctcgggaagaagtcctcgtcgaggtccggctccaccaaggccaaggacttatcgaagggtgcaagcaacaaagggtatgctggtaaggagcccgcattctccgagagctctccggtgatatcggagccagtgcttgttagcgcccacaacaatgaggccgcgcgggaggtgccaaagggtgagaattccagcgtgcaaggtgaagtcgcagtgactgatgtcaatcaagagttggagaaacatgacactgtgggttcttatgtgtccaatgatgctgagaggttgagggaagagcaagcggctgtgaaggcacaagctgccttccgtggttatctggcacgccgagcattccgtgcattgaaagggataataagacttcaggctctgattcgaggacatcttgtaaggaggcaagctgcttcaactctccgtgcaacatggttgattgtgaagtttcaagccctaattcgtggaaggaatgtcagactctctcaggctgccattcatgcctgtcggaaactgacccaacagaactttgggggtgctaaacctgattcatggaaagggaaattatcttcaaatgcttttgctcgtaagctcctatcttcaccaattgtggttgaagctcttcactttcagtatgatgagatggacccaaattcagccttcaactggttggagaggtggactattagttatgtctggaagcccatttcccaaccaaagagagttggcactgatgcgaagccacatgcaaggaaggccagttatgcaatggaaactgagtcagcgaaattaaaacgcaatgcaaggaagagctctgcctctgcaacaccatttgatccttcacaaacaaatacaactacagaagttgagaagacaaaaagggttccaaggaaaatgagtagtgctcctgctgattcagttcctgatgggcagttaactgaacttgagaaggttaaacgtagtcttaggaaggttactaattccatagctgaaacctcaaaggtacctaatccggcacctgagacccctgatcatcaagaggtccaatgtgagagaccactaagaagtgcaaagcaagttccagttcacctcgagaatcaagaggcccagaatgttagtctaccagataatgcaaagactgctatcctggtacctgatctccagcctgatcaggaaattgcttcagatccagtcacaaatgaagaaaaagttgatgaacaatctgttgttactccaccagctgaaattatgccactgcaagacattaacaatgaagaaaatactttggtgaatgatatggaacagagatccaaagaagaacctctttctactgaaacccttaaaggcagcaagaggaggtcttcgttctccactaagccagaatatcctgaaaatggctccaaaaattctccagccctgcccagctacatggctgcaacacaatctgcaaaggcaaaactgcgggggcagaattcacccagacttagctctgattcagcagagaaaaatggcttcactcgccgtcactctcttccttcctctactaatggtaaagtggtttcgcattctccacgtacacaaaggccaagccatgctggtggaaaggatggagcgaagggcgacaaggctatgctgtcatcaagagatgcaagtgagagacccctgaaagctgagtggaaacgttgaaaaggcgcaccaaactctgaaatccccatttgatcaggtggaaggcgtctgcagtttgctcggattgttttgcttgtgatgtaaaaaagatgttctcatcatcccgcgacgaatggctttgttgtcctgaacacctgaacctgctgcaagttgtgacttatttatagggttttccgtccagccttctgtgatgtatagctgaagtgttttccctgtttggttttgggcctgcttgctgagagagctgctgatgttagagagaatcggaacctgtatggatcgagttgaacaatctcagtcccgttttggggcgtgctgggctgctttttctgactgacggttgtgtgccatccgtgatttaatgtccttgagattgctacgagt

SEQ ID NO: 2196 - DNA, 2109 bp, Panicum virgatum
ctctgaacccccggcgagcggcggaataggctccaatggggaagtctccggcgaagtggatcaagtccgtgctcttcgggaagaagtcgtcgtcgcggtccacctccaccaattccaaggatttatcgaagggtgcaagcaacaaagggtatgctggtaaggagcccgcattcgctgagagctccccggtgatctcggagccggtgcttgttagcgcccacaacaatgagaccgtgcgggaggtggctaagggtgagaattccaactcgcaaggcgaagttgcagtgcctgatgtcaatcaagatttggagaagcatgtcactgtggggtctgatgcttccaatgatgctgagaggttgagggaagagcatgcggctgtgaaggcacaagctgcgttccgtggttatctggcacgccgagcattccgtgcattgaaagggatcataagacttcaggctttgattcggggtcatcttgtaaggaggcaagctgtttcaactctccgtgcaacatggttgatcgtgaaatttcaagccctgatccgtggaaggaatgccagagtttcacaagctgccattcatgcaagttggaaacttacccaacagaactttgggagtgctaaacctgattcatggaaggagaaattatcttcaaatgcatttgctcgtaagcttctatcttcaccaattgtggttgaagctctccactttcagtatgatgaaatggaccctaattcagccttcaactggttggagaggtggaccactagtcatgtctggaagcccatttcccaaccaaagagaattggtgctgatgcgaagccacatgcaaagaaggccagttatgcaatggaaactgagtcagggaaattaaagcgcaatgctaggaagagctctgcgacgccatttgagccttcacaaacaaacatatccatagaaattgagaagacaaaacggaatcccaggaaaccaagtcctcctgctgattcagtgcctgatggacagttaaccgaacttgagaaggttaagcgtagccttaggaaggttactaattccatggctgaaacctcaaaggtatctaatccagcacctgagatccctgatcatcaagaggtccaaagtgagagaccactgaaaaatgcaaagcaagtccaggttcattctgagaatcaagagccccagaatgttaaactatcggataatgcaaagatagatatcctggtacctgatctccagcctgatgaggaagttgcttcagatccagtcacaaacgacgaaaaagttgatgaaccaactgttgttgctccaccagctgaaattatgccactgcaagacattaacaatgaagaaaatgctttggtgaatgatacagaacagagatccaaagaagaacctctttctactgaaagccttaaaggcagcaagaggaggtcctcattgtcgactaagtcagaatatcctgaaaatggctccaaaaattctccagctctgcccagctacatggctgcaacacaatcagcaaaggcaaaactacggggacagaattcaccgagactcagctctgattcagcagagaaaaatggcttcactcgccgtcactcccttccatcctctaccaatggtaagatgattgcgcattctccacgtacacaaaggccaacccatgctggtggcaaggatggagcgaaaggtgacaaggctatgctgtcatcaagagatttgagtgagagaccattgaaagctgagtggaggcgctgaagaggcacaccaaactccgaaatcgtccatttgattagcacaactgttttggtggaaggcgtctgcagtttgctcggattgttttgcttgtgatgtaaaaaagatgttctcatcatcccgcgacgatggctttgttgtgctgaaccttctgtgagtcgacttatttatagggttttccgtccagccttttgtgatgtatagctgaagtgtttgcccggtttgttttggtcccgagacatgccccagttcctgcttgtttggagagctgctgatgttagagagaacgagaacctgtatggattgagttgagcaatctaagccccgtttgggcattctgggctgtggtttgact

SEQ ID NO: 2197 - DNA, 2421 bp, Saccharum officinarum
cgagaaactccctctctcccccctcgcgtcccctctcgctcgctactcgccgcgcgacggaaacgccacgcccggggtgagatccgcgccggcctccgccgtcctcgtcaccgccccgtcgcctccgatctccacagggcgtgcggaggaggaggaggagggggcagagggagatggcggcggaggagggggcgatgtcgccgacgaggatgcttgcggaggggcacctgcgggtggccaccggcgggggcacgccggcggacggcgggatcgccgtcagacacctcccgcaccatcactccactaagaaagatggtgttggtgggaaaactgaacaagacaatcatgaaggtgtagattctttaccatctcaagagttgaaaaaactagctaatgggaatagcaagattcctggtacattagatgactatagaaagcttgtagttccaataattgaggagtattttagtacaggagatgtggaattggcatcttctgagctaaggggtcttggatctgatcagtttcagcattactttgtgaagaaactcatatctatggcaatggatcgtcatgacaaagaaaaagaaatggcatcaattctgttatcttctttgtatgctgatctactgagctcctacacaatcagtgaaggttttatgatgcttctggagtctacagatgatctgactgttgatataccagatgctactgatgtcttggcagtttttattgcacgggctattgttgatgaaattttacctcctgttttcctcactcgagctagagcactacttccagaattttccaaaggcattcaagttctgcaggttgttgaaaagagctatttgtcagctccccaccatgcagaggtggtcgaacgcaaatggggtggaagcacacactttactgtagaagaagcaaaaaggaggattcagaatattctcagagagtatattgagagtggagacatagatgaagcctttaggtgtataagagagcttagccttccgtttttccatcatgaggttgtgaagcgtgctctcacctttggtatggagaacatatcctcgcagccattaatccttaagttattgaaggaggcagctgcaggttgcttgatcagtcctaatcaaatctcaaagggtttttctcgactagctgagggtgttgatgacctgagtcttgatattccttctgctaaagctctttttgacaagctggtttcaacagctatatctgagggatggcttgatgcttcttttggtaaatctgctgcccctgacgaagagatgcaaaatacaagtgctgtaaaggtgaagcgttttaaagaagaatctggccacataattcatgagtattttctctcagatgatgtcccagaacttattcgaagccttgaagagctctctgctccagaattcaatcccattttcctcaagaagcttgtcacacttgctatggacagaaagagtagagagaaggagatggcctctgtactcctttcttcactgagattagaattgttttcgactgaagacatcatgaaggggtttgtaatgctcttgcagtcagcagaagacactgcccttgacattgtggatgctccaagtgaacttgccctcttcctagctagggcagtgattgatgaagtattaattccgctgaatttggatgaaatcagcattaagcttcgcccgaacagcagtggtagccaaactgtccagatggcccgtgccctactgtcagctcgccactctggtgagcgaatactgcggtgctggggtggtggcactggatgggctgtggaagatgccaaggacaagatcactaagctcttggaggaatacaacacgggtggtgacctgggagaagcctgcagatgcatccgtgatcttgggatgcccttcttcaaccatgaggtggtaaagaaggcactagtcatggcgatggagaagcatagtgacaccagcatcttggccctgctgcaggagtgtttcggcgaggggctgataaccatcaaccagatgaccaaaggctttgcccgtgtcaaggaaggccttgatgatctgatcctcgacatcccaaatgctcaggagaagtttggagagtatgtggagctcgcaacagagcgcggctggctgctgccgaccttcgcctccattacctgagcttccaccactggcgataccttccctgtgtgtacatttgtgcccatgatgtcattagctccataccaaagttttcctgttcctagttaacttatgttaccgtatactggaggattgtaggatggatgtggtgtcgcttgttgagatagtgttctattggtctggtcggggagggtacttttgagagttaaaagaataaaacaatttgtttcaggttatgagatgtatgccgtaacctttggtatttttg

SEQ ID NO: 2198 - DNA, 2504 bp, Sorghum bicolor
acgagaaactccccctcgcgtcccctctgccccccatcgcgtcccctctcgctcgctacctcgccgcgcggcggaaacgccacgccaggggtgagatccgcgccgtcctccgccgtcctcgtcaccgccccgtcgcctccgatctccacagggcgtgcggaggaggaggaggagggggcagagggagatggcggcggaggagggggcgatgtcgccgacgaggatgcttgcggaggggcacctgcgggtggccaccggcgggggcgcgccggcggacggcgggatcgccgtcagacacctcccgcaccatcaccccactaagaaagatggtgttggtgggaaaactgaacaagacaatcatgaaggtgtagactttttaccatctcaagagttgaaaaaactagctaatgggaatagcaagattcctggtacattagatgactatagaaagcttgtagttccaataattgaggagtattttagtacaggagatgtagaattggcagcttctgagctaaggggtcttggatctgatcagtttcagcattactttgtgaagaagctcatatctatggcaatggatcgtcatgacaaagaaaaagaaatggcgtcaattctgttatcttctttgtatgctgatctactgagctcctacacaatcagtcaaggttttatgatgcttctggaatctacagaagatctgactgttgatataccagatgctactgatgtcttggctgtttttattgcacgggctattgttgatgaaattttacctcctattttcctcactcgggctagagcactacttccagaattttccaagggcattcaagttctgcaggttgttgaaaagagctatttgtcagctccccaccatgcagagttggtcgaacgcaaatggggtggaagcacacactttactgtagaagaagcaaaaaggaggattcagaatattctcagagagtatattgagagtggagacatagatgaagcctttaggtgtataagagagcttagccttccgtttttccatcatgaggttgtgaagcgtgctctcaccttcgctatggagaacatatcctcgcagccattaatccttaagttattgaaggaggctgctgcaggttgcttgatcagtcctaatcaaatctcaaagggtttttctcgactagctgagggtgttgatgacctgagtcttgatattccttctgctaaagctctttttgacaagctggtttcaacagctatggctgaaggatggcttgatgcttcttttggtaaatctgctgcccctgacgaagagatgcaaaatacaagtgctgtaaagatgaagcattttaaagaagaatctgcccacataattcatgagtattttctctcagacgatgtcccagaacttattcgaagccttgaagagctctctgctccagaattcaatcccattttcctcaagaagcttgtcacacttgctatggacagaaagagtagagagaaggagatggcctctgtactcctttcttcactgagattagaattgttttcgactgaagatatcatgaaggggttcataatgctcttgcagtcagcagaagacactgcccttgacattgtcgatgctccaagtgaacttgccctcttcctagctagggcagtgattgatgaagtattaattccgctgaatttggatgaaatcagcattaagcttcgcccgaacagcagtggtagccaaactgtccagatggcccgtgcgctactgtcagctcgccactctggtgagcggatactgcggtgctggggtggtggcactggatgggctgtggaagatgccaaggacaagatcactaagctcttggaggaatacaacacaggtggtgacctgggagaagcctgcagatgcatccgtgatcttgggatgcccttcttcaaccatgaggtggtaaagaaggcactagtcatggcgatggagaagcagaatgacaccagcatcttggccctgctgcaggagtgttttggcgaggggctgataaccatcaaccagatgaccaaaggctttgcccgtgtcaaggaaggccttgatgatctcgtcctcgacatcccgaatgcccaggagaagtttggagagtatgtggagcttgcaacagagcacggctggctgctgccaaccttcgaatccattccctgagcttcactactggcgataccttccctgtgtgtacatttgtgcccatgatgtcattagctccataccaaagttttcctgttattagtttacttatgttactgtatactggaggattgtaggatggatgtggtgtcccttgttgagatagtgttctattggtctggtctgggagggtacttttgagagttaaaagaataaaaccatttcgtttcaggttatgagatgtatcccgtaacctttggtatttttgtaactagctccgcatggtttctggttatctgggcatctgccctttcagcaatgctgctcgttttcacct

SEQ ID NO: 2199 - DNA, 2823 bp, Sorghum bicolor
tgaggccgataaataaaacgagaaactccccctcgcgtcccctctgccccccatcgcgtcccctctcgctcgctacctcgccgcgcggcggaaacgccacgccaggggtgagatccgcgccgtcctccgccgtcctcgtcaccgccccgtcgcctccgatctccacagggcgtgcggaggaggaggaggagggggcagagggagatggcggcggaggagggggcgatgtcgccgacgaggatgcttgcggaggggcacctgcgggtggccaccggcgggggcgcgccggcggacggcgggatcgccgtcagacacctcccgcaccatcaccccactaagaaagatggtgttggtgggaaaactgaacaagacaatcatgaaggtgtagactttttaccatctcaagagttgaaaaaactagctaatgggaatagcaagattcctggtacattagatgactatagaaagcttgtagttccaataattgaggagtattttagtacaggagatgtagaattggcagcttctgagctaaggggtcttggatctgatcagtttcagcattactttgtgaagaagctcatatctatggcaatggatcgtcatgacaaagaaaaagaaatggcgtcaattctgttatcttctttgtatgctgatctactgagctcctacacaatcagtcaaggttttatgatgcttctggaatctacagaagatctgactgttgatataccagatgctactgatgtcttggctgtttttattgcacgggctattgttgatgaaattttacctcctattttcctcactcgggctagagcactacttccagaattttccaagggcattcaagttctgcaggttgttgaaaagagctatttgtcagctccccaccatgcagagttggtcgaacgcaaatggggtggaagcacacactttactgtagaagaagcaaaaaggaggattcagaatattctcagagagtatattgagagtggagacatagatgaagcctttaggtgtataagagagcttagccttccgtttttccatcatgaggttgtgaagcgtgctctcaccttcgctatggagaacatatcctcgcagccattaatccttaagttattgaaggaggctgctgcaggttgcttgatcagtcctaatcaaatctcaaagggtttttctcgactagctgagggtgttgatgacctgagtcttgatattccttctgctaaagctctttttgacaagctggtttcaacagctatggctgaaggatggcttgatgcttcttttggtaaatctgctgcccctgacgaagagatgcaaaatacaagtgctgtaaagatgaagcattttaaagaagaatctgcccacataattcatgagtattttctctcagacgatgtcccagaacttattcgaagccttgaagagctctctgctccagaattcaatcccattttcctcaagaagcttgtcacacttgctatggacagaaagagtagagagaaggagatggcctctgtactcctttcttcactgagattagaattgttttcgactgaagatatcatgaaggggttcataatgctcttgcagtcagcagaagacactgcccttgacattgtcgatgctccaagtgaacttgccctcttcctagctagggcagtgattgatgaagtattaattccgctgaatttggatgaaatcagcattaagcttcgcccgaacagcagtggtagccaaactgtccagatggcccgtgcgctactgtcagctcgccactctggtgagcggatactgcggtgctggggtggtggcactggatgggctgtggaagatgccaaggacaagatcactaagctcttggaggaatacaacacaggtggtgacctgggagaagcctgcagatgcatccgtgatcttgggatgcccttcttcaaccatgaggtggtaaagaaggcactagtcatggcgatggagaagcagaatgacaccagcatcttggccctgctgcaggagtgttttggcgaggggctgataaccatcaaccagatgaccaaaggctttgcccgtgtcaaggaaggccttgatgatctcgtcctcgacatcccgaatgcccaggagaagtttggagagtatgtggagcttgcaacagagcacggctggctgctgccaaccttcgaatccattccctgagcttcactactggcgataccttccctgtgtgtacatttgtgcccatgatgtcattagctccataccaaagttttcctgttattagtttacttatgttactgtatactggaggattgtaggatggatgtggtgtcccttgttgagatagtgttctattggtctggtctgggagggtacttttgagagttaaaagaataaaaccatttcgtttcaggttatgagatgtatcccgtaacctttggtatttttgtaactagctccgcatggtttctggttatctgggcatctgccctttcagcaatgctgctcgttttcacctactcggtttcgtgtatacgatgtatgtgttctgtgtccatggattctggcgaggttgtcaatgatctaataaagggaaaagatggcgaaaatgatggtttccagtgcttctcgtatacggacagttgcaaatacgagtacagccaatacgactgcggattcaagtatgagacgagcagtcgtgagtcgtgacttcagcgtttccaacagttttgtatttgtcatttgcattcttgtaatttatcaaaattattgagatgagatatccaacagttttgtatttgtattttgcaatttgggcaa

SEQ ID NO: 2200 - DNA, 2502 bp, Setaria italica
ctcgcaccccccctccctccgctcgctcgctcagcgctcgctcgctcgcccgcgactctccgagcggcggaaactccacgcccgggttgagatccgcgccgtctcccgccgtccccgccgcctccgatctccacagggcggggggaggaggacggtgctgagggagatggcggcggaggagggggcgatgtcgccgacgaggatgctggcggaggggcacctgcgggtggccaccggcgggggcgcgccggccgacggcgggatcgccgtcaggcacctcccgcaccaccaccccgcgaagaaagatggtgttggtgggaaaactgaacaagacaaccatgaggatgtagattctttaccatctcaagagttgaaaaaactagctaatggaaacaataaggttcctggtacattagatgagtataaaaggcttgtagttccaatagttgaggagtattttagtaccggagatgttgaattggcatcttctgagctaaggagtcttggatctgatcagtttcagcattactttgtcaagaagctcatatcaatggcaatggaccgtcatgacaaagaaaaagaaatggcatcagttctgttatcatctttgtatgctgatctactgagttcctacatgatcagtgaaggttttatgatgcttctggagtctatagaagatctgactgtagatataccagatgccgttgatctcttggcagtttttattgcacgggctgttgttgatgaaattttgcctcctgtattcctcgctcgagctagagcactgcttccagaattttccaagggtattcaagttctgcaggttgttgaaaagagctatttgtcagctccccatcatgcagaattagttgaacgcaaatggggtggaagcacacactttactgtggaagaggcaaagaagaggattcaggatattctgagagagtatattgaaagtggtgacatagatgaagccttcaggtgcataagagagcttagtctaccgttcttccatcatgaggttgtgaagcgtgctctcacccttggtatggagaacatatcctcgcagccattaatcctgaagttattgagggaggcagctgcaggttgcttgattagttctaatcaaatatcaaagggtttttctcgactagctgagagtgttgatgacctgagtcttgatattccttctgctaaagatctttttgacaaactggtttcaacagccatatctgaaggatggcttgatgcttcttttagtaaatctgctgcctctgaggaagagatgcggaatacaagtgctgataaggtgaagcgtttcaaggaagaatctggtcacataattcatgagtattttctctcagatgatgtccctgaactcattcgaagccttgaagagctttctgccccagaatacaatcccattttcctcaagaagcttgttacgcttgctatggacagaaagaacagagagaaggagatggcatctgtactactttcttcgctcagcttggagctgttttccactgatgacatcatgaaggggttcataatgctcttgcagtcagcagaagacactgcccttgacattgtggatgctcccagtgagcttgccctcttcctagctagggcagtgattgatgaagtactgattccgctaaacttggatgagatcagcagcaagcttcggccgaacagcagtggcagccagactgtccagatggcccgagccctgctgtcagctcgccactccagcgagcggattctgcgttgctggggcggtggcaccggctgggccgtggaagatgccaaggacaagatcgctaagcttctggaggagtacagcactggcggtgacctgggagaagcctgcagatgcatccgcgaccttgggatgcccttcttcaaccacgaggtggtgaagaaggcgctggtcatggcgatggagaagcagaacgacgcaggcatactggccctgctgcaggagtgcttcggcgaggggctgataaccatcaaccagatgaccaaaggcttcacccgtgtcaaggaaggcctggacgacctggtcctcgacatcccgaacgcgcaggagaagtttggggcgtacgtggagctcgcgactgggcgcggctggctgctgccagccttcacctcggttccctgaggcctcttcctttggcctgcgatgcgaggcttgatgagtctcctatgtgtacattttgcacccgtgctgtcatcagcatcataccaaaagtttttctgcccctagtttacttgaaaatgttaccttataccggaaggattgtagggtggatgtggtgtcgcttgtgttgagaatagtgtcttattggtctggtctgggaggggtatgacttttggagagttgaaaagaataaaaccatttcgtttcaggttatgaagatgtataccctgtcccttgggttttttgtaactagctctgcgtggtatctgttttctccatatctgcgcatctgttctttc

SEQ ID NO: 2201 - DNA, 2550 bp, Panicum virgatum
ctcccctcctcctccctggctcgctcgctcgctcgccgctcgcgaccccgccgcgcggcggaaacgccacgcccggggtgagatccgagccggcctccgccgcccccgtcgccgccccgccgcctccgatctccacagggcgggaggaggaggaggaggggcagtgggagatggcggcggaggagggggcgatgtcgccgacgaggatgctggcggaggggcacctgcgggtggccaccggcgggggcgcgccggccgacggcgggatcgccgtcaggcacctcccgcaccaccaccccgcaaagaaagacggtgttggtgggaaaactgaacaagacaaccatgaagatgtagattctttaccatctcaagagttgaaaaaactagctaatggaaacaataaggttcctggtacattagatggctataaaaggcttgtagttccaatagttgaggagtattttagtaccggagatgtggaattggcagcttgcgagctaaggggtcttggatctgatcagtttcaacattacttcgtcaagaagctcatatctatggcaatggaccgtcatgacaaagaaaaagaaatggcatcagttctgttatcatctttgtatgctgatgtactgagctcgtacatgatcagtgaaggttttattatgcttctggagtctatagaagatctgactgttgatataccagatgctgttgatgtcttggcagtttttattgcacgggctgttgttgatgaaatattgcctcctgtgttcctcgctcgagcaagagcactgcttccagaattttccaagggtattcaagttctgcaggttgttgaaaagagctatttgtcagctccccatcatgcagagttagttgaacgcaaatggggtggaagcacacactttaccgtagaagaggcaaaaaagaggattcaaggtattctaagagaatatattgaaagtggagacatagatgaagccttcaggtgcataagagagctcagtcttccattcttccatcatgagattgtgaagcgtgctctcacctatggtatggagaacatttcctctcagccattaatcctgaagttactgaaggaggcagctgcaggttgcttgattagttctaatcaaatgtcaaagggtttctctcgactagctgagagtgttgatgacctgagtctagatattccttctgctaaagatctttttgataagctggtttcaacagccatatctgaagaattgcttgatgcttcttttagtaagtctgctgtctctgaggaagagatgcagaatacaagtgctgaaaaggtgaagcgttttaaggaagaatctggtcatataattcatgagtattttctctcagatgacgtccctgaacttattcgaagccttgaagagctttctgccccagaatacaatcccattttcctcaagaagcttgttacacttgctatggacagaaagaacagagagaaggagatggcatctgtacttctttcttcactcagcttggagctgttttccactgatgacatcatgaaggggttcataatgctcttgcagtcagcagaagacactgcacttgacatcgtggatgcgcccagtgagcttgccctcttcctagctagggcagtgattgatgaagtattgattccactgaacttggatgaaatcagcagcaggcttcggccgaacagcagtggtagccaaactgtccagatggcccgctccctgctgtcagctcgccactccggtgagcggatactgcgttgctggggtggtggcactggctgggctgtggaagatgccaaagacaagatcactaagctcttggaggaatacaacactggcggtgacctgggagaagcctgcagatgcatccgcgacctcgggatgcccttcttcaaccatgaggtggtgaagaaggcgttggtcatggcgatggagaagcaggacgacgccagcatactggccctgctgcaggagtgctttggcgaggggctgataaccatcaaccagatgaccaaaggcttcacccgggtcaaggatggcctggatgatctggtcctcgacatcccgaacgtgcaggagaagtttggagcgtatgtggagctcgcgacggggcgcggctggctgctgccgaccttcgcctccgttccctgaggcttcttcctgggcctgctaggcttgatgagtttctgatcctatgtgtacattttgaactcatgctgtcattagcatcataccaaagttttcctcccccacccccctagtttacttgtgttaccgtataccagaggattgtaggatggatgtggtgtcgcttgctgagatagtgttctattggtctggtctgggagggtatatgacttgagacttgaaagaataaaaccatttcgtttcaggttaaaaaaaaaaaaaaaaaaaagaaaaaaaaaaagggcggcccgccgccgccattgtcacagcggagagccgtgcagaacctccccgcggagccgcgaaggaatgggctgatcgggttgagtgtatacttctgctttgg

SEQ ID NO: 2202 - DNA, 2452 bp, Avena sativa
gcctcgcctcgccccaactcaccgcgcccgtgatccgcccctcgcctttcctcgccgccgcctccgatctccacaggggagggcgcgcggaggaggcagagggagatggcggcggaggacggggcgaggtcgcccaccaggatgctggcggaggggcatctgcgggtcgccacgggcgggggcgcgccggctgacggcgggatcgccgtacgccacctcccacaccaccacacctctaagaaagaaggtgttggtggaaaaagtgaagaaaacaaccatggagatgcagatttttcaccatcccaagagttggacaaattagttaatgggaataataaggttcctgctacattagatgactataggaagcttgtagttccagtaattgaggagtattttagtacaggagatgtggaactggcagcttccgagctaaggagtcttggatcagatcagtttcactattactttgtgaagaagctcatatccatggcgatggatcgccatgataaagaaaaagaaatggcgcaattctgctgtctgccttgtatgctgatctattgggctcgttcaagatgagtgaaggttttatgatgcttctggagtcaacagaagatctatctgtggatataccggatgctattgatgttttggctgttttcattgcacgcgccgttgttgatgaaatattgcctcctgtttttctcactcgagccagggcattacttccagagtcttcaaaaggtgttgaagttctgcaggttgctgagaagagttacttgtcagcccctcaccatgcagaattagttgagcgcaagtggggcgggagcacatacttcactgtagaagaggcgaaaaagaagatccagaatattctgagggagtacattgagagtggagatacggatgaagcctttaggtgcataagggagctgggccttccattcttccatcatgaggttgtgaaacgggctctcatctttggcatggagaatccatcctcacaaccattaatccttaagttgctgaaggaatcaacagcggggggtttgatcagttctaatcaagtgtcaaagggtttttcgcgggtagctgagagtgttgatgacctgagccttgatgttccttctgctaagacactttttgacaagctgctttcagcagcaatatctgaaggatggcttgatgcttcattcagtaaatctgccgcctctgatgaagatatgttgaatgcaagcggtgaaaaggtcaagcgttttaaagaagaatctggtcacataattcaggagtattttctctcggatgacgtcccggaactcataagaagcctccaagagctttctgcccctgaatacaacgccattttcctcaagaagctcatcactgttgctatggacagaaagaacagggagaaggagatggcttctgtactcctttcttcgctcagcttggaactattttccacagatgatatcatgaaggggtttgtaatgctcctgcagtctgcagaggacactgccctcgacatcgtggacgctccaagtgagctcgccctcttcctggccagagcggtgatcgacgaggtcttggttccactgaatttggatgacatcagcagcaagctacgcccgaacagcagcggtagccagaccgtccagatggccagctccctgcttgcggcccgccactccggcgagaggatactgcgctgctggggcggcggcaccggctgggcggtggaagacgcgaaggacaagatctccaagctcctcgaggagtacaacaccggcggccacctgggagaagcctgccagtgcatccgcgacctcgggatgcccttcttcaaccacgaggtggtgaagaaagcgctggtgatggcgatggacaagcagaacgaggccagcatcctggccctgctgcaggagtgctttggcgagggcctgataaccatcaaccagatgaccaaaggctttgcccgcgtcaaggaaggcctggacgacctggtcctcgacatccccaacgcgcaggagaagtttggagccttcgtggagctcgcgacgggacgtggctggctgctgccgtcctttgccaccgcgccttgagcttcctcaacccaggcgactggctgggtagacttaaaagaaacatgtttctcttgtatatctttactacacccactcgtgctgtgtctaccaccataccaaaattttcctgttcctagccctttgttaagacgatgtgttgtcatataccggagtttgataggatcgatgtgttgagacattgtcttgttggtttggtgttggaggttagacttggagagttgagaaaaataacaccatttcgtgtccggttatgggatatatgtcatgaacagttgcgatgttcgagactagtgcagttttcattgtactagcatatagtatgtttttcgacaaaaaaaaaaaaaact

SEQ ID NO: 2203 - DNA, 2258 bp, Brachypodium distachyon
agggaaggcgcacggaggaggcagggggagatggctgcggaggacggggctatgtcgcctaccaggatgctggcggaggggcatctgcgggtggctacgggcgggggcgcgccggcggacggcgggatcgccgtccgccatctcccacaccaccacgccgctaagaaagaaggtgttggtgggaaaattgaacaagacaaccttggtgttgcagatccattaccatctcaagagtttagcaaactagttaatgggaataataaggttcctggtacattagatgactatagaaagcttgtagttccagtcattgaagagtattttagcacaggagatgtgtcactggtagcttccgagctaaagagtcttggatctgatcagtttcacaattactttgtcaagaagctcatatccatggcaatggaccgccatgataaggaaaaagagatggcgtcaattctgttgtctgccctgtatgctgatctattggggtcctccaagatgagtgaaggttttatgatgcttctggagtcagcagaagatctatctgtggatataccagatgctgttgatgtcttggctgttttcattgcacgtgctgttgttgatgaaatattgcctcctgtttttctcgctcgagccagggcattgcttccagaatcctcaaaaggtattgaagttctgctagttgctgagaagagctacttgtcagctccccaccatgctgagttagttgaacgcaagtggggtgggagcacttacttttctgtagaggaggcgaaaaagaggatccaggatattctgagggagtatgttgagagtggtgatgcaaatgaagcctttaggtgcataagggagctgggccttccattcttccatcatgaagtagtgaaacgtgctctcatccttggcatggagaatctttcgtcacagccattaatcctgaagttattgaaggaatcggcagcaggttgtttgatcacttctaatcaagtgtcgaagggttttgctcgggtagctgagagtgttgatgacctgagccttgatattccttctgccaaaactctttttgacaagctgctttcagcagccatatccgaaggatggcttgatgcttcattcactaaatctgctgcctctgatgaagatatggtgactgcaagtggtgaaaaggtcaagcgttttaaagtagaatctggccacataattcaggagtattttctctcagatgacataccggaactcattagaagccttcaagaactttctgccccagaatacaatgccatttttctcaagaagcttataacgcttgccatggacagaaagaacagggagaaggaaatggcttctgtactcctttcttcactcaggttggaactgttctccacagatgacatcatgaagggattcataatgctcctgcagtcagcagaagacactgccctcgacattgtggatgctcccagtgaacttgccctgttcctggccagggcagtgattgatgaagtcttgatcccactgaatttggatgacatcagcatcaagctacgcccaaacagctgtggtagtcagactgtccagatggccagcgccctgcttgcagctcgccattctggtgagagaattctgcgctgctggggcggcggcactggctgggcagtagaagacgctaaggacaagatctcaaagctccttgaagaatacaaaactggtggcgacttgggggaagcctgccaatgcatccgtgaccttggaatgccgttcttcaaccatgaagtggtgaagaaagcactggtcatggcaatggagaagcagaatgaagctagcatcttggctctgctgcaggagtgcttcagtgaggggctgataaccatcaaccagatgacaaatggttttggtcgtgtcaaggaaggcctcgatgatctgatcctcgacatcccgaacgcgcaggagaagttcggcgcctatgtggagctcgcaacaggacgtggctggctgctaccatccttcgcctccctgccttgatcttccccgccccccaaatgtatccctgtatatctaccgtaccaatgcagtcttcaccgctgtaccaaaattttcctgttcctagtcgttcttaagccgatctgttcatccatcgtataccagagtttcatagaattgccgtgttggtaaacttgttgggataatgcttattggatctgggaaaccatttcgtttcaggttatgagatatcataaacagcgttttgtaat

SEQ ID NO: 2204 - DNA, 2504 bp, Brachypodium distachyon
aacctcagcgcggcccataaatctcaggtgtcagggcgaggaacccgatcataataataataaaaaaacttcctccgctcctccgctcgggtccgctcctccccgtctcgtactcaccgcgcggcgcaccgcgcacgcctgtgatccgtccgccgcgccggcttccaccgcccgcctccgatctccgaagggagggaaggcgcacggaggaggcagggggagatggctgcggaggacggggctatgtcgcctaccaggatgctggcggaggggcatctgcgggtggctacgggcgggggcgcgccggcggacggcgggatcgccgtccgccatctcccacaccaccacgccgctaagaaagaaggtgttggtgggaaaattgaacaagacaaccttggtgttgcagatccattaccatctcaagagtttagcaaactagttaatgggaataataaggttcctggtacattagatgactatagaaagcttgtagttccagtcattgaagagtattttagcacaggagatgtgtcactggtagcttccgagctaaagagtcttggatctgatcagtttcacaattactttgtcaagaagctcatatccatggcaatggaccgccatgataaggaaaaagagatggcgtcaattctgttgtctgccctgtatgctgatctattggggtcctccaagatgagtgaaggttttatgatgcttctggagtcagcagaagatctatctgtggatataccagatgctgttgatgtcttggctgttttcattgcacgtgctgttgttgatgaaatattgcctcctgtttttctcgctcgagccagggcattgcttccagaatcctcaaaaggtattgaagttctgctagttgctgagaagagctacttgtcagctccccaccatgctgagttagttgaacgcaagtggggtgggagcacttacttttctgtagaggaggcgaaaaagaggatccaggatattctgagggagtatgttgagagtggtgatgcaaatgaagcctttaggtgcataagggagctgggccttccattcttccatcatgaagtagtgaaacgtgctctcatccttggcatggagaatctttcgtcacagccattaatcctgaagttattgaaggaatcggcagcaggttgtttgatcacttctaatcaagtgtcgaagggttttgctcgggtagctgagagtgttgatgacctgagccttgatattccttctgccaaaactctttttgacaagctgctttcagcagccatatccgaaggatggcttgatgcttcattcactaaatctgctgcctctgatgaagatatggtgactgcaagtggtgaaaaggtcaagcgttttaaagtagaatctggccacataattcaggagtattttctctcagatgacataccggaactcattagaagccttcaagaactttctgccccagaatacaatgccatttttctcaagaagcttataacgcttgccatggacagaaagaacagggagaaggaaatggcttctgtactcctttcttcactcaggttggaactgttctccacagatgacatcatgaagggattcataatgctcctgcagtcagcagaagacactgccctcgacattgtggatgctcccagtgaacttgccctgttcctggccagggcagtgattgatgaagtcttgatcccactgaatttggatgacatcagcatcaagctacgcccaaacagctgtggtagtcagactgtccagatggccagcgccctgcttgcagctcgccattctggtgagagaattctgcgctgctggggcggcggcactggctgggcagtagaagacgctaaggacaagatctcaaagctccttgaagaatacaaaactggtggcgacttgggggaagcctgccaatgcatccgtgaccttggaatgccgttcttcaaccatgaagtggtgaagaaagcactggtcatggcaatggagaagcagaatgaagctagcatcttggctctgctgcaggagtgcttcagtgaggggctgataaccatcaaccagatgacaaatggttttggtcgtgtcaaggaaggcctcgatgatctgatcctcgacatcccgaacgcgcaggagaagttcggcgcctatgtggagctcgcaacaggacgtggctggctgctaccatccttcgcctccctgccttgatcttccccgccccccaaatgtatccctgtatatctaccgtaccaatgcagtcttcaccgctgtaccaaaattttcctgttcctagtcgttcttaagccgatctgttcatccatcgtataccagagtttcatagaattgccgtgttggtaaacttgttgggataatgcttattggatctgggaaaccatttcgtttcaggttatgagatatcataaacagcgttttgtaattagctgccaatggctttgagctgaagtgtctgtcatcttatgtacccatgcttt

SEQ ID NO: 2205 - DNA, 2159 bp, Pennisetum glaucum
gacggtgttggtgggaaaactgaacaagacaaccatgaggatgtagattctttaccatctcaagagttgaaaaaactagctaatggaaacaataaggttcctggtacattagatgagtataaaaggcttgtagttccaatagttgaggagtattttagtacaggagatgttgaattggcagcttccgagctaagaagtcttggatctgatcagtttcatcattactttgtcaagaagcttatatcaatggcaatggaccgtcatgacaaagaaaaagaaatgacatcagttctattatcatccttgtatgctgatctactgagctcctacatgatcagtgaaggttttatgatgcttctggagtccatagaagatctgactgttgatataccagatgctgttgatgtcttggcagtttttgttgcgcgggctgttgttgatgaaattttgcctcctgtgttcctcgctcgagctagagcactgcttccagaattttccaaaggtattcaagttctgcaggttgttgaaaagagctatttgtcagctccccatcatgcagaattagttgaacgcaaatggggtggaagcacacacttcactgtggaagaggcaaagaagaggattcaggatattctgagggagtatgttgaaagtggagacatagatgaagccttcaggtgcataagagagcttagtcttccgttcttccatcatgaggttgtgaagcgtgctctcacccttggtatggaaaacatatcctcgcagccattaatcctgaagttattgagggaggcaactgcaggttgcttgattagttctaatcaaatatcgaagggtttttctcgactagctgagactgttgatgacctgagtcttgatattccttctgctaaagatctttttgacaagctggtttcaaaagccatatctgaaggatggcttgatgcttctttcagcaagtctgctgcctctgaggaagagatacataatacaagtgctgataaggtgaagcatttcaaggaagaatctggccacataattcatgagtattttctctcagatgatgtccctgaactcattcgaagccttgaagagctttctgccccagaatacaatcccattttcctcaagaagcttgttacgcttgctatggacagaaagaacagagagaaggagatggcgtctgtactcctttcttcgctcagcttggagctgttttccactgatgacatcatgaaggggtttataatgctcttgcagtcagcagaagacactgccctcgacattgtggatgctcccagtgagcttgccctcttcctggctagggcagtgattgatgaagtactaattccactgaacttggatgagatcagcagcaagcttcgtccgaacagcagtggcagccaaactgtccagatggcccgcgccctgctgtctgctcgccactccggcgagcggattctgcgttgctggggcggtggcactggctgggccgtggaagatgccaaggacaagatagctaagcttctggaggagtacagcactggtggtgacctgggagaagcctgcagatgcatccgcgacctcgggatgccattcttcaaccacgaggtggtgaagaaggcgctggtcatggcgatggagaagcagaacgacgccggcgtactggccctgctgcaggagtgcttcggtgagggcctgataaccatcaaccagatgactaaaggcttcgcccgcgtcaaggaaggcttggacgacctggtcctcgacattcccaacgcgcaggagaagttcggggcgtacgtggagctcgcgacgggccgcggctggctgctgccgaccttcgcctccgtcccctgaggccctgcggtgcgagaggcatgacgagtctcctgtgtgtacattttgcaccccatgctgtcaaaccagcatcataccaaaagtttttcctgcctagtttactctaaaatggtactacattataccggaaggattgtaggatggatgtggtgtcgcttgtgttgagaatagtgttctattggtctggtctgggaggggtatgacttttggagagttggaaagaataaaaccatttcgttgcgggttatgagatgctcgtaccttatccttcgggttttttgttggcaattagctccgcg

SEQ ID NO: 2206 - DNA, 2888 bp, Oryza sativa
ggtgtctctaatcccgcgagtatttaagtgcgcgtagcgatctctcagttcacacagtgctactgcttgatgagaaataagaaaatagagaaaaaaaatgggtggaaaagattagcttaatacagcgcggtaaaagtaattagaggcagatagtaataagtgagagagacgggaggcaaaaaaaaaaagataaaataaaaactctcccttctcgtctccgctcgcgtcccccgttgcgttggcccccctctctcttcgcctcgcccccgcgcggccgcaccgctcgcctgagatccgcgtcggcgctcgccgtctccgcctccgatctccacagggcgggcggaggagaccgcataggtgggggggagatggcggcggaggagggggcgaggtcgccgacgaggatgctggcggaggggcacctgcgggtggccaccggcgggggcgcgccggccgacggcgggatcgccgtccgccacctcccacaccaccacgcatctaagagagaaggtgctggtgggaaaaatgaacaatacaaccttgaggatgtagattctgtaccatctaagatgtcgaacaaactagttaatgggaacaataaggttcctgctacattagatgactataaaaggcttttagttcctgtaattgaggagtactttagtacaggagatgtggaactggcagcttctgagttaaggagtcttggatctgatcagttccacagttactttatcaagaagctcatatccatggcaatggatcgtcatgacaaagaaaaagaaatggcgtcaattctgttgtctgcgttgtatgcggatctactaggctcttccaagatgagtgaaggttttatgatgcttcttgagtcaacagaagatctatctgtcgacataccggatgctattgatgtcttgtctgtttttgttgctcgtgctgttgtggatgaaatactgcctcctgttttcctcactcgagccagagcactgcttcctgaattttctaaaggtattgaagttctgcaagtttctgagaaaagctacttgtcagccccccatcatgctgagctagttgagcgcaagtggggtgggagcactcactttactgtggaagaggcgaaaaggagaatccaggatattctgaaggagtatattgagagtggagatattgatgaagcttttaggtgtataagggagctgggccttccatttttccatcatgaggttgttaaacgcgctctcaccttgagcatggagaatctgtcatcacagccattaatcctgaagctgttgaaggaatcaactgcaggttgcctgatcagttctaatcaaatgtctaagggtttttgtcggctagcagagagtattgatgatctgagccttgatattccttctgccaagattctctttgacaagctggttctgactgctacatctgaaggatggcttgatgcttcattcactacatcttctgcccctaatgaagatatgcgaaatgcaagtggtgaaaagatcaagcatttcaaagaagaatctggacacataatccaagagtattttctctcagatgatgtcccagaactcattataagccttcaagagctttctgccccagagtacaatcctatcttcctcaagaagcttatcaccctcgctatggacagaaagaatagggagaaggagatggcttctgccctgctttcttcactcagcttggaacttttctccactgatgacatcatgaagggattcatattgctcctgcagtcagcagaagacactgccctcgacattgtggatgctcccagtgaacttgccctcttccttgccagggcagttattgatgaagttctgattccactgaatttggatgagatcggtaacaggcttcgccctaacagcagtggtagtcaaactgtccagatggctcgtgcccttcttgctgctcgccactctggtgagaggatactgcgttgctggggtggcggcactggctgggctgtagaagatgcgaaggacaagatcgcaaagctccttgaagaatacaatactggcggtgacttgggggaggcttgccaatgcatccgtgaccttggaatgcccttcttcaaccatgaagtggtgaagaaagcgcttgttatggcaatggagaaggagaatgaagcaaggatcttggctctgctacaggagtgcttcggtgaggggctgataacaatcaaccagatgacattaggcttcactcgcgtcaaggaaggcctcgatgatctgatcctcgacatcccaaatgcacaggagaagtttggagcatatgtggatctcgcaactgaacgtggatggctgcttccacccttcgcctaggcggttaaacttgatgaatcttctcaatgtacatctccacccctgctgtctttagcaccataccaaaagttttcctgttcctagtgtacttgttgtgttaccgtataccggaggatgataggttggttggccgtgttggtacttgttgaggtagtgttcatcattggtttggtttgggagtttatgccctgggagagttatgaataaccatatcgtttcaggttatgacatgctatgcaatgaacaatagagctgttcatgaccagtggaatttttgtaattagctggcgatgggcttccagcttctgaagctccgtcattgtgaatgtgcttgcccatctttgctgcttaaatttcaattgctctaggatacttttatatatcatcatctgccacatatccatcctctttttttttgttttgtttagcctgcttaggaggatactattagagtccatcttttttttttgtttagcctgcttagggggatactattaatgaaatcggtgtctgcctttgatgacaataaaa

SEQ ID NO: 2207 - DNA, 2798 bp, Oryza sativa
tactgcttgatgagaaataagaaaatagagaaaaaaaatgggtggaaaagattagcttaatacagcgcggtaaaagtaattagaggcagatagtaataagtgagagagacgggaggcaaaaaaaaaaagataaaataaaaactctcccttctcgtctccgctcgcgtcccccgttgcgttggcccccctctctcttcgcctcgcccccgcgcggccgcaccgctcgcctgagatccgcgtcggcgctcgccgtctccgcctccgatctccacagggcgggcggaggagaccgcataggtgggggggagatggcggcggaggagggggcgaggtcgccgacgaggatgctggcggaggggcacctgcgggtggccaccggcgggggcgcgccggccgacggcgggatcgccgtccgccacctcccacaccaccacgcatctaagagagaaggtgctggtgggaaaaatgaacaatacaaccttgaggatgtagattctgtaccatctaagatgtcgaacaaactagttaatgggaacaataaggttcctgctacattagatgactataaaaggcttttagttcctgtaattgaggagtactttagtacaggagatgtggaactggcagcttctgagttaaggagtcttggatctgatcagttccacagttactttatcaagaagctcatatccatggcaatggatcgtcatgacaaagaaaaagaaatggcgtcaattctgttgtctgcgttgtatgcggatctactaggctcttccaagatgagtgaaggttttatgatgcttcttgagtcaacagaagatctatctgtcgacataccggatgctattgatgtcttgtctgtttttgttgctcgtgctgttgtggatgaaatactgcctcctgttttcctcactcgagccagagcactgcttcctgaattttctaaaggtattgaagttctgcaagtttctgagaaaagctacttgtcagccccccatcatgctgagctagttgagcgcaagtggggtgggagcactcactttactgtggaagaggcgaaaaggagaatccaggatattctgaaggagtatattgagagtggagatattgatgaagcttttaggtgtataagggagctgggccttccatttttccatcatgaggttgttaaacgcgctctcaccttgagcatggagaatctgtcatcacagccattaatcctgaagctgttgaaggaatcaactgcaggttgcctgatcagttctaatcaaatgtctaagggtttttgtcggctagcagagagtattgatgatctgagccttgatattccttctgccaagattctctttgacaagctggttctgactgctacatctgaaggatggcttgatgcttcattcactacatcttctgcccctaatgaagatatgcgaaatgcaagtggtgaaaagatcaagcatttcaaagaagaatctggacacataatccaagagtattttctctcagatgatgtcccagaactcattataagccttcaagagctttctgccccagagtacaatcctatcttcctcaagaagcttatcaccctcgctatggacagaaagaatagggagaaggagatggcttctgccctgctttcttcactcagcttggaacttttctccactgatgacatcatgaagggattcatattgctcctgcagtcagcagaagacactgccctcgacattgtggatgctcccagtgaacttgccctcttccttgccagggcagttattgatgaagttctgattccactgaatttggatgagatcggtaacaggcttcgccctaacagcagtggtagtcaaactgtccagatggctcgtgcccttcttgctgctcgccactctggtgagaggatactgcgttgctggggtggcggcactggctgggctgtagaagatgcgaaggacaagatcgcaaagctccttgaagaatacaatactggcggtgacttgggggaggcttgccaatgcatccgtgaccttggaatgcccttcttcaaccatgaagtggtgaagaaagcgcttgttatggcaatggagaaggagaatgaagcaaggatcttggctctgctacaggagtgcttcggtgaggggctgataacaatcaaccagatgacattaggcttcactcgcgtcaaggaaggcctcgatgatctgatcctcgacatcccaaatgcacaggagaagtttggagcatatgtggatctcgcaactgaacgtggatggctgcttccacccttcgcctaggcggttaaacttgatgaatcttctcaatgtacatctccacccctgctgtctttagcaccataccaaaagttttcctgttcctagtgtacttgttgtgttaccgtataccggaggatgataggttggttggccgtgttggtacttgttgaggtagtgttcatcattggtttggtttgggagtttatgccctgggagagttatgaataaccatatcgtttcaggttatgacatgctatgcaatgaacaatagagctgttcatgaccagtggaatttttgtaattagctggcgatgggcttccagcttctgaagctccgtcattgtgaatgtgcttgcccatctttgctgcttaaatttcaattgctctaggatacttttatatatcatcatctgccacatatccatcctctttttttttgttttgtttagcctgcttaggaggatactattagagtccatcttttttttttgtttagcctgcttagggggatactattaaaga

SEQ ID NO: 2208 - DNA, 2161 bp, Triticum aestivum
atcgccacaggcgggcgggcgccggcggacggcgggatcgccgtccgccacatcccacaccaccacaccgctaagaaagaagatgttggtgggaaaattgaacaagacaaccttggagatgcaaatctgttaccatcccaagagttgggcaaattagttaatggaactaaaaaggttcctgctacattagatgactacaggaagcttgtagttccagtaattgaggagtattttagtacaggagatgtggaactgtcagtttccgagctaaggagtcttggatccgatcagtttcacaattactttgtgaagaagctcatatccatggcaatggaccgccatgataaagaaaaagaaatggcgtcaattctgctgtctgccttgtatgctgatctattggactcctccaagatgagtgaaggttttatgatgcttctagagtcaacagaagatctatctgtggatataccagacgctattgatgtcttggctgtttttgtggcacgtgccattgttgatgaaatactgcctcctgtttttctcactcgagccagagcattgcttccagaatcttcaaaaggtattgaagttctgcaggttgctgagaagagctacttgtcagctcctcaccatgcagagttagttgaacgcaagtggggcgggagcacacactttactgtagaagaggcgaaaaagaggatccaggatattctgagggagtacattgagagtggagatacagatgaagcctttaggtgcataagggagctgggcctcccattcttccatcatgaggttgtgaaacgtgctctcatccttggtatggagaatctgtcgtcacagccattaatcctgaagttgttgaaggaatcaacaacgggttgtttgatcagttctaatcaagtgtcgaagggtttttctcgggttgctgacagtgttgatgacctgagccttgatgttccttcagccaaaacactttttgacaagctgctttccacagccatatctgaagggtggcttgatgcttcattctgtaaatctgctgcccctggtgaagatatgtggaatgcaagcaatgaaaaggtgaagcattttaaagaagagtctggtcacataattcaggagtatttcctctcagatgacgtcccggaactcattagaagccttcaagagctttctgcccctgaatacaacgccattttcctaaagaagctcatcacgcttgctatggacaggaagaacagggagaaggagatggcttctgtacttctttcttcactcagcttggaactattttccacaggtgatatcatgaagggattcataatgctcctgcagtcagcagaagacactgccctcgacattgtggatgctcctagtgaactcgccctcttcctggccagggcagtgatcgatgaagtcttgcttccactgaatttggatgacatcagtagcaagctgcgcccaaacagcagtggtagtcaaactgtccagatggccagctctctgcttgcggcccgccattctggtgagaggatactgcgctgctggggtgggggcactggctgggctgtggaagatgcaaaggacaagatctccaagctccttgaggagtacaacacaggcggcgacctgaaggaagcctgccagtgcatccgcgaccttgggatgcccttcttcaaccatgaagtggtgaagaaagcgctggtgatggcgatggagaagcagaatgaagctagcatcttggctctgctgcaggagtgcgccagcgaggggctgataaccatcaaccagatgaccaacggcttcgcccgcgtcaaggaaggcctggacgatctgaccctcgacatcccgaacgcgcaggagaagttcagaggctatgtggagctcgcgacagagcgcggctggctgctaccttccttcgcctccctgccctgagctcttcccccacagacggctgaacttggaaaaaatacctctgtatatcttacacccatgctgtctttaccaccataccgaacttcttctcctgttcctagtcttttctgagccgaaatggtatggtataccggagtgtgatagggttgttggtgtattggtctgtgacttggagagtttaaggaataacgccatttggcttcaggactagtggagttgtttt

SEQ ID NO: 2209 - DNA, 2219 bp, Secale cereale
gccggcggacggcgggatcgccgtccgccacatcccacaccaccacaccgctaagaaagatgttggtgagaaaattgaaaaagacaaccttggagatgcaaatcagttaccatcccaagagttgggcaaattagttaatggaactaagaaggttcctgctacattagatgactacaggaagcttgtagttccagtaattgaggagtattttagtacaggagatgtggaactgtcagtttccgagctaaggagtcttggatccgatcagtttcacaattactttgtgaagaagctcatatccatggcaatggaccgccatgataaagaaaaagaaatggcgtcaattctgctgtctgccttgtatgctgatctattggactcctccaagatgagtgaaggttttatgatgcttctagagtcaacagaagatctatctgtggatataccagacgctattgatgtcttggctgttttcgtggcacgtgccattgttgatgaaatattgcctcctgtttttctcactcgagccagagcattgcttccagaatcttcaaaaggcattgaagttctgcaggttgctgagaagagctacttgtcagctcctcatcatgcggagttagttgaacgcaagtggggtgggagcacacactttactgttgaagaggcgaaaaagaggatccaggatattctgagggagtacattgagagtggagatacagatgaagcctttaggtgcataagggagctgggcctcccgttcttccatcatgaggttgtgaaacgtgctctcatccttggtatggagaatctctcgtcacagccattaatcctgaagttgttgaaggaatcaacgacaggttgtttgatcagttctaatcaagtgtcgaagggtttttctcgggttgctgacagtgttgatgacctgagccttgatgttccttcagccaaaacactctttgacaagctgctttccacagccatatctgaagggtggcttgatgcttcattctgtaaatctgctgcccctgatgaagatatgtggaatgcaagcagtgaaaaggtcaagcattttaaagaagagtctggtcacataattcaggagtatttcctctcagatgacgtcccggaactcattagaagccttcaagagctttctgcccctgaatacaacgccattttcctgaagaagctcatcacgcttgctatggacaggaagaacagggagaaggagatggcttctgtacttctttcttcactcagcttggaactattttccacaggtgatatcatgaagggattcataatgctcctgcagtcagcagaagacactgccctcgacattgtggatgctcctagtgaactcgctctcttcctggccagggcagtgatcgatgaagtcttggttccactgaatttggatgacatcagtagcaagctgcgcccgaacagcagtggtagtcaaactgtccagatggccagctctctgcttgcggcccgccattctggtgagaggatactgcgctgctggggtgggggcactggctgggctgtggaagatgcaaaggacaagatctccaagctccttgaggagtacagcaccggcggcgacctgaaggaagcctgccagtgcatccgcgaccttgggatgcccttcttcaaccatgaagtggtgaagaaagcgcttgtgatggcgatggagaagcagaatgaagctagcatcttggctctgctgcaggagtgcgccggcgaggggctgataaccatgaaccagatgaccaacggcttcgcccgcgtcaaggaaggcctggacgatctgaccctcgacatcccgaacgcgcaggagaagttcagaggctatgtggagctcgcgacagagcgcggctggctgctaccatccttcgcctccctgccctgagctcttcttccccagatggctaaacttggaagaaatacctctgtatatcttacacccatgctgtctttaccaccataccgaacttcttctgttcctagtcttttctgagccgaaatggtatggtataccggagtgtgatagggttgttggtgtattggtctgtgacttggagagttttaaggaataacgccatttggcttcaggactagtggagttgcttttaagttgctgtccatggctttcaccttttgaagttccttgttgtgcatgtggagcaatatatagtatgttttcgcggccagtc

SEQ ID NO: 2210 - DNA, 1169 bp, Setaria italica
ctgctcccactcccctcactcccacgcgcacgcaaaccactgcgcccgcaccgccctccacgctccacgcgcccccgccccgcaccatgcgccgcctccgcctcgccgacgcgctcctccccctcctcctcgccctcgcggccggtggcgccgccacaacagctgcggccgccgccgcgaaggctcccgcggccccgccggcgccgccgaacgtgacggcggagatggccaagggcgggtgcaaggcgttcgcggacctgatcgcggcgtcccccgacgcgtcgtccacgtaccagtcggccgtggagggcggcatgacggtgttctgcccctcggacgacgccgtcagggcgttcctgcccaagtacaggaacctcaccgccgacgggaaggccgagctgctgctgttccacgccgtgccggtgcactactcgctggggagcctcaagtccaacaacgggccgatgaacacgctcgccaccgacggcgccgccaagaactacaacttcacgctgcagaaccagggcgacgtcgtcaccatcaggaccggggcgtcggcgggcgcccccgcgcgggtcaagtccacggcgctcgacaaggacccgcttgccatctacgtcatcgaccgcgtcgtccagcccgtcgagctcttcaagcccgcgccggcgccgacgcccgcgcccgcgcccgcccccgccgcggacgcgccgaaagcggccggtggcaagcccgcgcgccgcccggcacccgccgtggccgacgcgcccgggcccgctgaggatgacgccgctccggtggaccagaagaaggacgccaagaagagcgcggcggcggctggcgcgccgtgcttccggtggtggctcgccaccgcattagcggcggcggccgcggcctccacattggcttagctgtcgaccgaggggctttcctttttgttttcttttattttcggtgttggtctattggcgtgtggtcgtgggtgtgatggcgtgcttgcgagatttgtgcttctttcttggaagaaaatagtgtatgtgtgcttgcatattcgtgcttcattttagaattttgttcttgttttttggtacttgtgctccactagagtgtggcttaagtgttcatcaggagcactctttttccttcttcttgttctgactaatgcaatctgg

SEQ ID NO: 2211 - DNA, 769 bp, Sorghum bicolor
cagcccagcccatataaattccgcggaccctagaaacttgcagccgcgtctccgaccatcgccgaggaaccaaagcgagagacagacaaccactgcgaacgaatccatcgccatggcgtctcgtctcgttgcggcggcggcggcctcctcctcctcctcagcgtcccccctcgcccgcctaatctctcgccgcggccttgccggtgccgctgacggccatggacctgccaaggtgcccttgtggaaagatccgttgagcccgagcaagtggaaggaagagcactttgttctagcaagcctgtctatgtggggggctcttatttatggcggtttcaagctttttggtggaaagaaggaagacaagactgaggtggcaccagcaaaggcatagttgcttgagatggagctctacctatttctgcggtcaggcaacaatgttaaataaaaaagaacgttctatgttgtgctttaaagttgataaattgtggcaaccagagattttgatttatgtaggcaagatacacttactctcatccaccatgaataatcttgctgcagtggaatttcatgtcggcaaacactgcaaatgatgtacttctttcatgtgattgagtagatgttttacttctgttgacatcaacacttcagcactgtacttccaaattgattcgcgcactgtgcagtgcttcctttctattgtgctgttactgatgaatttaacacaagtttgattgatacatttatttgcactgcttagtttggaaattgg

SEQ ID NO: 2212 - DNA, 829 bp, Sorghum bicolor
cagcccagcccatataaattccgcggaccctagaaacttgcagccgcgtctccgaccatcgccgaggaaccaaagcgagagacagacaaccactgcgaacgaatccatcgccatggcgtctcgtctcgttgcggcggcggcggcctcctcctcctcctcagcgtcccccctcgcccgcctaatctctcgccgcggccttgccggtgccgctgacggccatggacctgccaaggtgcccttgtggaaagatccgttgagcccgagcaagtggaaggaagagcactttgttctagcaagcctgtctatgtggggggctcttatttatggcggtttcaagctttttggtggaaagaaggaagacaagactgaggtggcaccagcaaaggcatagttgcttgagatggagctctacctatttctgcggtcaggcaacaatgttaaataaaaaagaacgttctatgttgtgctttaaagttgataaattgtggcaaccagagattttgatttatgtaggcaagatacacttactctcatccaccatgaataatcttgctgcagtggaatttcatgtcggcaaacactgcaaatgatgtacttctttcatgtgattgagtagatgttttacttctgttgacatcaacacttcagcactgtacttccaaattgattcgcgcactgtgcagtgcttcctttctattgtgctgttactgatgaatttaacacaagtttgattgatacatttatttgcactgcttagtttggaaattggaatgtaggttgttgcaaagtatttggaggtatttgcgtgccatcataaggccttccacag

SEQ ID NO: 2213 - DNA, 650 bp, Saccharum officinarum
gagagacaaccactgcgtgaacgaatccatcgccatggcgtctcgtctcgttgcggcggcggcggcctcctcctcctcctcctccgcgtcccccctcgcccgcctaatctctcgccgcggccttgctggtgccgctgacggccatggacctgcgaaggtgcccttgtggaaagatccgttgagcccgagcaagtggaaggaagagcactttgttctagcaagcctctctatgtggggggctcttatttacggtggtttcaagctttttggtggaaagaaggaagacaagactgaggtggcaccagcaaaggcatagttgcttgagatggagctctacctatttctgtggcctggcaacaatgttctgttaaataaaaagaagtgttctatgtcgtgctttcaagttgatataaattgtggcaaagagagattttgatttatgtaggcaagattttgagaaggtacacttgctctcatccaccatgaataatcttgctgcagtggaacttcatgtctgcgaacactgcaaatgttgtacttctgtcatgtgattgagtagatgtacttctgttgccatcaacacttgagcactatgcttccaaattgattcacgcaccgtgcttcgtttctatttaacaagtttgattgat

SEQ ID NO: 2214 - DNA, 687 bp, Setaria italica
aacccaccacagcagaagaagcgagacacccgaacctgaaacgagtcgattcgtcgcgatggcatctcgtctcgttgcggcggcggcgtcctccacttcctcccccctcgcccgcctagtctctcgccgcggcctcgccggtgccgcagacggccatgggcctgcgaaggtgcccttatggaaggacccgatgagcccgagcaagtggaaggaagagcactttgtgctagccagcttgtctatgtggggtgctgttatttatggtggtatcaagtttttcactggggggaagaaggaagacaaggcagaggcggctccagcacaggcggcatagttggttgcaccagagttgtaccacctttctgcggccaagcaactatgtcaaataaaaagaaatgttatgttgtgctttcaagttgttgacgacaaattgtggcaaccagagattttgatttatgtaggcaagatttggagaagctacacttactctcagccaccattgaataatcttgcggcagtgtaactaaatgttagcggacactgcaggtgttgtacttgtttttcgcaattgattaattgatgttttaatttctgttgccacctacattttttcttgctccctctgtacttgaagcatgctctgcacgccatacttcattattggtttgtcactaagctatcagtttg

SEQ ID NO: 2215 - DNA, 1194 bp, Saccharum officinarum
ccctcgctcgctgcgccgggaccgggacaggccgcgtgccgtgtccgtgtgcgtatgctggatataaaggctgccccgcgccaccggttttccctccctctttctcttctcccaatccccaggacccaggtagtagtaggcaggtcggcgaagagggctggtgaggcagcaaggccgagccgtgggaagcgggggctcgggacgggacaggcagaggagaacacaaaaatcccagatccttcctgccgcccgcccgcccgcccgtgcccgtcggcgcgtcgttcttgccggccgcgccatacctccggcttctcctcatccaggggaatcggatacacaacaagctgcaggatggtgctgtgggtcttcggctacgggtccctcatctggaaccccggcttcgacttcgacgacaaaatccttggctttatcaagggctacaagcggacctttaatctcgcttgcattgaccacagaggcacaccggagcatccggcgaggacctgcacgcttgaaactgacgacgaggccatatgctggggaattgcatattgtgtcaagggtggtccagaaaaagagcgaaaagcaatgcagtacttggagagaagggagtgtgagtatgaccagaagatatccattgatttctacaaggaaggagatcccctgaaaccagctgtgacgggcatcttagtttttgtgtccactccagatccaattggcaacaagtactaccttggctctgctcctttgcaggatatggcaaggcaaattgctacagccaatggccctactggctataatagggattacctgttctcaatggagaaggcattagccagcataagccacgaagatgattcaatcatagagcttgcagacgaggtgaggaaggtgctcaacagaacaaaggagaccaaaatcactggtgccaatgcttccctgaaatctcatgtgcctcttgtgcacctgtctgctcttccagaaggcaccgttgtggactcgagatagcaagagccttggacgttcgacctctactacccggaatttactttcagctcttgcatgtttgtttgtggctatcgtgtactgatttttccttttcaacggttgttgtgaggctgtatcttcctgagtgaaaaatgctaaagccggcactaataatgatattaattttaatatcgaggccatattgtc

SEQ ID NO: 2216 - DNA, 1166 bp, Sorghum bicolor
cctcgctcgctgcgccgggaccgggacgggccgtgtccgtgtgtgtacgctggcgcctggcgggatataaaggcggccccgcgcccaccgcttcttcctccctctttcacttctccgaatccccaggcaggcaggtcggcgaagagggcaggtgaggcagcaaggccgagccgcgcgggggctcgggacgggacaggcagaggagacctacagaatcccagatccttcctgcccgcccgtgcccgtcggcgcgtcgttcttgccggccgcgcccgacctccggctcctcctccaggggaatcggatacacaacaagctgcaggatggtgctgtgggtcttcggctacgggtccctgatctggaaccccggcttcgacttcgacgacagaatcctcggctttatcaagggctacaagcgcacgtttaatctcgcttgcattgaccacagaggcacaccggagcatccggcgaggacctgcactcttgaaacggatgacgaggccatatgctggggaattgcatattgtgtcaagggtggcccagaaaaagagcgaaaagcaatgcagtacttggagagaagagagtgtgagtatgacctgaagatatccattgatttctacaaggaaggagatcccctgaaaccagctgtgacgggtgtcttagtttttgtgtctactccagatccaattggcaacaagtactatcttggccctgctcctttgcaggatatggcaaagcaaattgctacagccaatggccctactggctataatagggattacctgttctcaatggagaaggcattagccagcataagccacgaagatgagtcaatcatagagcttgcaaacgaggtgaggaaggtgctcaacaaaacaaaggagaccaagatcactggtgccaatgcttccctcaaatctcatgcccctcttgtgcacctgtctgcgcttccagaaggcaccgttgtggactcgagatagcaagagccttggacgctcgacctctactacccggaatttactttcagctcttgcatgtttgtgcccatcctgtactgaatttcccttctcaatggttgatgtgaggctgtatcttccagagtgaaaaacgctaaagccggcactaataatgatattaattttaacatggaggccatgttgtcactt

SEQ ID NO: 2217 - DNA, 1496 bp, Sorghum bicolor
aaaaagacaagggcctcgttttcctgcgagatcccgtagaaaacggccgggcgcggcaggagaggccgccacgcacgccggggcccggggtgcatcacgtgccggtgaccaccagtccaccagccacagcccacaccgtcctgatcctcatccgggtcatcgcctcgctcgctgcgccgggaccgggacgggccgtgtccgtgtgtgtacgctggcgcctggcgggatataaaggcggccccgcgcccaccgcttcttcctccctctttcacttctccgaatccccaggcaggcaggtcggcgaagagggcaggtgaggcagcaaggccgagccgcgcgggggctcgggacgggacaggcagaggagacctacagaatcccagatccttcctgcccgcccgtgcccgtcggcgcgtcgttcttgccggccgcgcccgacctccggctcctcctccaggggaatcggatacacaacaagctgcaggatggtgctgtgggtcttcggctacgggtccctgatctggaaccccggcttcgacttcgacgacagaatcctcggctttatcaagggctacaagcgcacgtttaatctcgcttgcattgaccacagaggcacaccggagcatccggcgaggacctgcactcttgaaacggatgacgaggccatatgctggggaattgcatattgtgtcaagggtggcccagaaaaagagcgaaaagcaatgcagtacttggagagaagagagtgtgagtatgacctgaagatatccattgatttctacaaggaaggagatcccctgaaaccagctgtgacgggtgtcttagtttttgtgtctactccagatccaattggcaacaagtactatcttggccctgctcctttgcaggatatggcaaagcaaattgctacagccaatggccctactggctataatagggattacctgttctcaatggagaaggcattagccagcataagccacgaagatgagtcaatcatagagcttgcaaacgaggtgaggaaggtgctcaacaaaacaaaggagaccaagatcactggtgccaatgcttccctcaaatctcatgcccctcttgtgcacctgtctgcgcttccagaaggcaccgttgtggactcgagatagcaagagccttggacgctcgacctctactacccggaatttactttcagctcttgcatgtttgtgcccatcctgtactgaatttcccttctcaatggttgatgtgaggctgtatcttccagagtgaaaaacgctaaagccggcactaataatgatattaattttaacatggaggccatgttgtcacttaaagcgctctgcatttgaatcgcctaattgttatggttatcctagcgccggacgtttggcgcgagctgagcacggaagctgctccccttctcaaaacggtccacaccgtgtacaatcggatcgaaaatagaatggaatagaatagagaactgcctgtccctccgcacc

SEQ ID NO: 2218 - DNA, 1205 bp, Setaria italica
actttctcttttccgaatccccaggcaggcaagtgcgccggcgaggagagcggaccaggcagcgagaccgagccgcgcggaggctcgggacgggagaggacgaggagaccccagaatcgcagatctttcctcctccatcccgcccgcccgtgcccaatcagcgcgtcgttcttgccgccgccgctgccgccgcttcctccgagggaaatcgaataaacaaggagctgcaggatggtgctctgggtcttcggctacgggtccctgatctggaaccccggattcgacttcgatgacaagatcctcggcttcatcaagggctacaagcgcaccttcaatcttgcttgcattgaccatagaggcacaccggagcacccggcaaggacctgcacgcttgaaacagacgaggaggccatatgctggggaatcgcatattgcgtcaagggtgatacagacaaagagcagaaagcaatgcagtacttggagagaagagagtgtgagtatgaccagaaaatatctgttgacttcttcaaggaaggagattctctgaaaccagctgtgaccggcgtacttgttttcgtatccacacctgatccaatcggcaacaagtactaccttggtcctgcccctttgcaggatatggcaaggcaaattgctacagccaatggccccactggctataatagggattacctgttctcaatggagaaggcattggccagcataatccatgaggacgattcgatcattgagcttgcgaatgaggtgaggaaggtgctgaacagaacaaaggaggccaagatcactggctctgacgtatccttgcaatctcatgttcctctggtgcacctgtctgcgcttcccgaaggcactgttgtggactcgagatagcaagatccttgaagcccagttggatcagcggaggagatggaatgtcctccgaccatactcactcttgatgttgttccaccagagactctgaatttgctttcagttcttccatgtttgtggccatcgtgtactgaattttcctttgcaacggttgtggtgaggctgtatgtacctttcagattgaaaatgctaaagccggcactagtgacatttgttttaacccggaggccaaaatgtcatttatgttttctatagtttctttgtcttctacagtttatgaggtacttaacagaattttttttgcgggaatactaacc

SEQ ID NO: 2219 - DNA, 1140 bp, Setaria italica
ttccgaatccccaggcaggcaagtgcgccggcgaggagagcggaccaggcagcgagaccgagccgcgcggaggctcgggacgggagaggacgaggagaccccagaatcgcagatctttcctcctccatcccgcccgcccgtgcccaatcagcgcgtcgttcttgccgccgccgcttcctccgagggaaatcgaataaacaaggagctgcaggatggtgctctgggtcttcggctacgggtccctgatctggaaccccggattcgacttcgatgacaagatcctcggcttcatcaagggctacaagcgcaccttcaatcttgcttgcattgaccatagaggcacaccggagcacccggcaaggacctgcacgcttgaaacagacgaggaggccatatgctggggaatcgcatattgcgtcaagggtgatacagacaaagagcagaaagcaatgcagtacttggagagaagagagtgtgagtatgaccagaaaatatctgttgacttcttcaaggaaggagattctctgaaaccagctgtgaccggcgtacttgttttcgtatccacacctgatccaatcggcaacaagtactaccttggtcctgcccctttgcaggatatggcaaggcaaattgctacagccaatggccccactggctataatagggattacctgttctcaatggagaaggcattggccagcataatccatgaggacgattcgatcattgagcttgcgaatgaggtgaggaaggtgctgaacagaacaaaggaggccaagatcactggctctgacgtatccttgcaatctcatgttcctctggtgcacctgtctgcgcttcccgaaggcactgttgtggactcgagatagcaagatccttgaagcccagttggatcagcggaggagatggaatgtcctccgaccatactcactcttgatgttgttccaccagagactctgaatttgctttcagttcttccatgtttgtggccatcgtgtactgaattttcctttgcaacggttgtggtgaggctgtatgtacctttcagattgaaaatgctaaagccggcactagtgacatttgttttaacccggaggccaaaatgtcatttatgttttctatagtttctttgtcttctac

SEQ ID NO: 2220 - DNA, 1159 bp, Cenchrus ciliaris
  misc_feature (46)..(46): n is a, c, g, or t
  misc_feature (57)..(57): n is a, c, g, or t
  misc_feature (89)..(89): n is a, c, g, or t
  misc_feature (96)..(96): n is a, c, g, or t
  misc_feature (103)..(106): n is a, c, g, or t
  misc_feature (108)..(108): n is a, c, g, or t
  misc_feature (163)..(163): n is a, c, g, or t
  misc_feature (505)..(505): n is a, c, g, or t
  misc_feature (927)..(927): n is a, c, g, or t
  misc_feature (1081)..(1081): n is a, c, g, or t
ggcaagtacgccggcgaggagggcggacagcgagatcgagccgcgngggggctcggnacgggagaggacgaggagaccccaaaatcgcngatcttncctcctnnnncncgcccgcccgtgcccaatcagcgcgtcgttcttgccgccgcccgccgcttcctcngaggggaatcgaataaacaaggagctgcaggatggtgctctgggtcttcggctacgggtccctgatctggaaccccggcttcgacttcgacgacaagatactcggcttcatcaagggctacaagcgcaccttcaatcttgcttgcattgaccatagaggcacaccggagcacccggcgaggacctgcactcttgaaaccgaagaggaagcaatatgctggggaatagcatattgcgtcaagggtggcacagacaaagagcgcgtagcaatgcagtacttggagagaagagagtgtgagtatgaccagaagatatctgttgacttcttcaaggaaggagattntctgaaaccagctgtaacgggtgtactagtttttgtatccacacctgacccgatcggcaacaagtactaccttggtcctgcccctttgcaggatatggccaggcaaattgctacagccactggccccactggctataatagggattacctgttctcaatggagaaggcattggccagcataagccatgaagatgattcgatcattgagctcgcgaatgaggtgaggaaggtgctgaacagaacggagaccaagatcattggctctgacgtatccttgcaatctcatgttcctctggtgcacctgtctgtgcttcccgaaggcactgttgtggactcgagataggaagatccttgaagcccagttggatatgcggagatggcatgtcctctgaccgtactcactctcgatgttgttccaccgngactgaatttgctttcagttcttccatgtttgtggccatcgcgtactgaatttttctttgcaacggttgtggtgaggctgtatgtacctttcagagtgaaaatgctaaagccggcactagtgacatttgtgttttctacattttcttcttctancgcttgagttggcaacccttatgattgaaccttccattgacatgctggaccagttactaacaggttccacaatttaca

SEQ ID NO: 2221 - DNA, 1167 bp, Panicum virgatum
gctgccccctctctcgctcctctccgaatccccgcgcaggcaagggcggcgaggaggagggcagacgaggcagcaggaccgaaccgcgccgggggctcgggacgggggaggccgaggagacccctgaagtcgcagatcctacctcctccttaccgcccgcccgtgcccaatcagcgcgccgttcttgccgccgcttcctccgagggacatcgcataaacaagaagctacaggatggtgctctgggtcttcggctacgggtccctgatctggaaccccggcttcgacttcgacgacaagatccttggcttcatcaagggctacaagcgcaccttcaaccttgcatgcattgaccatagaggcacactagagcacccggcgaggacctgcacgcttgaaaccgacgaggaggccatctgctggggtatcgcatattgcgtcaagggtggtatagacaaagagcggaaagcaatgcagtacttggagagaagggagtgtgagtatgaccagaagatatctgttgacttcttcaaggaaggagattctctgaagccagctgtgacaaacgtgctagtttttgtatccacacctgatccaatcggcaacaagtactatcttggtcctgcccctttgaaggatatggcaagacaaattgctacagccaatggccccaatggctataatagggattacctgttctccatggagaaggcattggccagcataagccatgaagatgatgcgataattgagcttgctaatgaggtgaggatggtgctgaacagagcgaaggaggcgaagatcactggctccgacagaaccctgaaatctcatgttccgctggtgcacctgtctgctcttcccgaaggcactgttgtggactcgagatagcaagaaccttgaagcccagctggatcagcgaaggagatgaatgtcctctgaccctacctttgatgttgttccatcggagactccaaatttgctttcacctcttccatgtttgtcttctgtacctttcagtgtggaaatgccagacagtacttgtgatatttgtttttgagctctttcacagtgcataatattagattatacaaatgtttgataatactaggttatacaaatatttgataaggattcctatataaatataggacggtttagatttaaaa

SEQ ID NO: 2222 - DNA, 1239 bp, Pennisetum glaucum
tctcttctccgaatcccccagccaggcaagtgtgtcggcgaggagggcggaccaggcagcgagaccgggccgcgcgggggctcgggacgggagaggacgaggagaccccgaaatagcagatctttcctcctccatcccgcccgcccgtgccctatcagcgcgtcgttcttgccgccgaccgctgcgtcctccgaggggaatcgaataaacaaggagctgcaggatggtgctctgggtcttcggctatggttccctgatatggaaccccggcttcgacttcgacgccaagatcctcggattcatcaagggctacaagcgcaccttcaatcttgcttgcattgaccatagaggcacaccggagcacccagcgaggacctgcacgcttgaaaccgaagaggaggccatatgttgggggatagcatattgcgtcaagggtggcacagacaaagagcgcaaagcaatgcagtacttggagagaagagagtgcgagtatgaccagaagatatctgttgacttcttcaagtgtcaggaaggagattctctgaaaccagctgtaacgggtgtactagtttttgtatctacacctgatccgatcggcaacaagtactaccttggtcctgcccctttacaggatatggccaggcaaattgccacagccaatggccccactggccataacagggattacctgttctcaatggagaaggcattggccagcataagccatcaagacgattcaatcattgagcttgcgaatgaggtgaggaaggtgctgaacagaacgaaggagaccaagatcactggctctgacgtatccttgccatctcatgttcctctggtgcacccgtctgcgctctccgaaggcactgttgtggacgcgagatagcaaaattcttgaaggccagttggatcagcgaaggagatggaatgtcctctgacaatactcgctcttgatgttgttccacccgagactctgcatttgctttcagttctttcatgtttgtggccatcgtgtactgaattttactttgcaacggttgtggtaggctgtatgtacctttcagagtgaaaatgctaaagccggcactagcgacatttgttttaacccggaggccaaaatgccatttatgtttctccacattttcttcatcttgtactactattgatccaggatggattgacggtgcaccacatttgtattcatcagttcagagcatttcaatgcccgtatgaagttcg

SEQ ID NO: 2223 - DNA, 1138 bp, Panicum virgatum
ctcgctcctctccgaatccccgcgcaggcaagggcggcgaggaggagggcagacgaggcagcaagaccgagccgccggggtcgggacgggggaggccgaggagacccctgaaatcgcagatcctacctcctccttcccgcccgcccgtgcccaatcagcgcgccgttcttgccgccgccgccgcatcctccgagggacatcgcataaacaagaagctgcaggatggtgctctgggtattcggctacggctccctgatctggaaccccggcttcgacttcgacgacaagatccttggcttcatcaagggctacaagcgcaccttcaaccttgcatgcattgaccatagaggcacaccagagcacccagcgaggacctgcacgcttgaaaccgacgaggaggccatatgttggggaatcgcgtattgcgtcaagggtggtatagacaaagagcggaaagcaatgcagtacttggagagaagagagtgtgagtatgaccagaagatatctgttgacttcttcaaggaaggagattctctgaagccagctgtgacaaacgtgctagtttttgtatccacacctgatccaatcggcaacaaatactatcttggtcctgcccctttggaggatatggcaaggcaaattgctacagccaatggccccaatggctataatagggattacctgttcaacatggagaaggcattggccagcataagccatgaagatgatgcgataattgagcttgcgaatgaggtgaggatggtgctgaacagagcgaaggaggcgaaggtcactggctccgacataaccctgaaatctcatgttcagctggtgcacctgtctgctcttcccgaaggcaccgttgtggactcgagatagcaagaaccttgaagcccagctggatcagcgaaggagatgaatgtcctctgaccatacttttgatgttgttccatcggagactccaaatttgctttcacctctttaatgtttgtggccatcgtgtactgaatttgaattcttctttaccacggttgtggtgagtctgtacctttcagtgtggaatgctaaagacagcactagcgatatttgtttctgagctcctttacggcgcataatattaggttatacaaagtttgat

SEQ ID NO: 2224 - DNA, 1501 bp, Oryza sativa
ccctcggtctcccctccgtctgcagggagccagacacacggggtcgcggccctcacgtgcctcgcgccgtgcggcccccatcgccgtcctcatcctgatcctaatcccaagcgaccgcggcgcgatcacgcggcgaccaaccatttctctcgtcgacgagacgacgtgcccgccgctcgccaccccccccacccgctcgcgcggcataaatacagcacgccacgcccatccctctccctctcaccaacaacagtaacccaaccagagagcttgcggaagcgggggtttggtgcgggcgcgcgcgtgtgaggggggagagaaggccaggaggaggcgacgccgtcgcccgagggaggcaaaaatccgatcctcctcctgccctgctcgctcgctcgctcgcctgcgctgcgcgcacttggccccgtcccgtccgttcccgctcgccaggcatagaaagatggtgctctgggtcttcggctatggctccctgatctggaaccccggattcgacttcgatgagaagatcctgggcttcgtcaagggctacaaacgcaccttcaatcttgcttgcattgaccatcggggcacgccggagcatcctgcgaggacctgcacacttgagtccgacgaggaagccatatgctgggggattgcatactgtgtcaaaggggggcttaaaaaggagcaagaagcaatgaagtacttggaaagaagagagtgtgagtatgaccagaagatctctgtggatttctacaaggaaggagattctttgaagccagctgtgacaggtgtactagtctttgtatccactcctgatccagtaggcaacaaatactatcttgggcctgctcctttggaggacatggcaaggcaaattgctacagccaatggccccaatgggaataacagggattacctgttctcaatggagaaggcattgtccaacatatgccatgaagatgattcaatcatcgagctagctaacgaggtcaggaaggtgttgagccggccgaaggagaagatcactggctccgatagcccacaaaaatctcacgctctcgtacacctgtctgcgcttcctgagggcactgttgtggactcaagatagcaagctcggcggtggaagagatgagatctcctctgacctactcactcttgacgctggattgaacgagtttaacagtctgcttcgagctccctggcacactggggaaccagaatgtgctgattttctttcgcaaccgctgcggcaatgctgtaactttcattttgctaatactagagccgagactggtgtgctgctgtttcctttgacacactaaataataaagggattccatgagcttttcactcttgagctgttgcaacttggttctcctcgattgttgatatttggagagttgtaggagagctcgagaaaatgaaattttcacctatccatgatttccccgttgtctacacatcatctgtgcacatgaattttgttgaacagatagatgta

SEQ ID NO: 2225 - DNA, 1349 bp, Oryza sativa
ctcccctccgtctgcagggagccagacacacggggtcgcggccctcacgtgcctcgcgccgtgcggcccccatcgccgtcctcatcctgatcctaatcccaagcgaccgcggcgcgatcacgcggcgaccaaccatttctctcgtcgacgagacgacgtgcccgccgctcgccaccccccccacccgctcgcgcggcataaatacagcacgccacgcccatccctctccctctcaccaacaacagtaacccaaccagagagcttgcggaagcgggggtttggtgcgggcgcgcgcgtgtgaggggggagagaaggccaggaggaggcgacgccgtcgcccgagggaggcaaaaatccgatcctcctcctgccctgctcgctcgctcgctcgcctgcgctgcgcgcacttggccccgtcccgtccgttcccgctcgccaggcatagaaagatggtgctctgggtcttcggctatggctccctgatctggaaccccggattcgacttcgatgagaagatcctgggcttcgtcaagggctacaaacgcaccttcaatcttgcttgcattgaccatcggggcacgccggagcatcctgcgaggacctgcacacttgagtccgacgaggaagccatatgctgggggattgcatactgtgtcaaaggggggcttaaaaaggagcaagaagcaatgaagtacttggaaagaagagagtgtgagtatgaccagaagatctctgtggatttctacaaggaaggagattctttgaagccagctgtgacaggtgtactagtctttgtatccactcctgatccagtaggcaacaaatactatcttgggcctgctcctttggaggacatggcaaggcaaattgctacagccaatggccccaatgggaataacagggattacctgttctcaatggagaaggcattgtccaacatatgccatgaagatgattcaatcatcgagctagctaacgaggtcaggaaggtgttgagccggccgaaggagaagatcactggctccgatagcccacaaaaatctcacgctctcgtacacctgtctgcgcttcctgagggcactgttgtggactcaagatagcaagctcggcggtggaagagatgagatctcctctgacctactcactcttgacgctggattgaacgagtttaacagtctgcttcgagctccctggcacactggggaaccagaatgtgctgattttctttcgcaaccgctgcggcaatgctgtaactttcattttgctaatactagagccgagactggtgtgctgctgtttcctttgacacactaaataataaagggattccatgagcttttcactcttga

SEQ ID NO: 2226 - DNA, 1371 bp, Brachypodium distachyon
acccgtcctaatcctaatccccaaaagccaaggccgctcgatataaatgcccgctgccacgccaccgtcttctcccctctctccccaatcgaattccccacggaggccgaggagaggagagtgctgcagtgcaccccgcgcgctagggctcgggagaggcggaggagacgcagtcgagtcaactccaatccttactcctcctcctcctgccccgccccgccaacccacacccgcggcattctctccggtgttcctcaaggaaaaaaaaggcaagagaggcagcaagatggtgctgtgggtcttcgggtatggctccctgatctggaaccccggtttcgatttcgacgagaagatcctggggttcatcaagggccacaagcgaacgttcaacctcgcttgcattgaccatagaggcacaccaaagaatccggcgaggacttgcacgcttgagtccgaagatgaagccatatgctggggaattgcatattgtgtcaaaggtggtctagaaaaagagcgagaggcaatgcagtacttggagagaagagaatgtgagtatgaccagaagatttcagttgatttctacaaggatggagattctctgaaaccagctgtgacgggtgtattagttttcgtatccactcctgatccagttggcaacaaatactatcttggccctgcccctttggaggatatggcaaggcaaattgctacagccaatggccctaatggaaataatagggactacctgttctcaatggagaaggcactgtccaacataagccatgaggatgattcgatcattgagcttgcaaatgaggtgaggaaggtcctgagcaggtcagagaagattaccggctccgacatatcactaaaatcacatactcctcttgtgcacttgtctgcccttccagagggcactgtcgtggattcaagatagtaataaagagcggcatggctggatcagcggaaggaaaggcaattttgcccgaccatactcactcttgacattgtctggttgaaggatctgcattttgattcagctctggcataactgaggatccgtgtgtactgattgtcttccaaggctgtaaacctttggagtgctagtgtgaaagcctgagaccacgttatgttggttcgtttgataccctaataagaaacgcttttggcgagtttacacacttttgtgctgttaagttctgatgcctgtttctggatcctgcttttctatttgactgtagtgttatgcatatgatttagtagagtaccgttcattctgtgtatgcgctatatacttgcattgcatctccaccatttgttctgttcagaacattatgggcctatggtaggcaattaaggccgggtttggaa

SEQ ID NO: 2227 - DNA, 1005 bp, Euonymus alatus
cgagtcaactcgaatccttactcctcctcctcctgccccgccccgccaacccacacccgcggcattctctccggtgttcctcaaggaaaaaaaaggcaagagaggcagcaagatggtgctgtgggtcttcgggtatggctccctgatctggaaccccggtttcgatttcgacgagaagatcctggggttcatcaagggccacaagcgaacgttcaacctcgcttgcattgaccatagaggcacaccaaagaatgcggcgaggacttacacgcttgagtccgaagatgaagccatatgctggggaattgcatattgtgtcaaaggtggtctagaaaaagagcgagaggcaatgcagtacttggagagaagagaatgtgagtatgaccagaagatttcagttgatttctacaaggatggagattctctgaaaccagctgtgacgggtggattagttttcgtatccactcctgatccagttggcaacaaatactatcttggccctgcccctttggaggatatggcaaggcaaattgctacagccaatggccctaatggaaataatagggactacctgttctcaatggagaaggcactgtccaacataagccatgaggatgattcgatcattgagcttgcaaatgaggtgaggaagtcctgagcagtcagagaagattaccggctccgacatatcactaaaatcacatactcctctgtgcacttgtctgcccttccagagggcactgtcgtggattcaagatagtaataaagagcggcatggctggatcagcggaaggaaaggcaattttgcccgaccatactcactcttgacattgtctggttgaaggatctgcattttgattcagctctggcataactgaggatccgtgtgtactgattgtcttccaaggctgtaaacctttggagtgctagtgtgaaagcctgagaccacgttatgttggttcgtttgataccctaataagaaacgcttttggcgagtttacacat

SEQ ID NO: 2228 - DNA, 1079 bp, Leymus cinereus x Leymus triticoides
  misc_feature (67)..(68): n is a, c, g, or t
  misc_feature (116)..(116): n is a, c, g, or t
  misc_feature (139)..(139): n is a, c, g, or t
  misc_feature (148)..(148): n is a, c, g, or t
  misc_feature (187)..(187): n is a, c, g, or t
  misc_feature (283)..(283): n is a, c, g, or t
  misc_feature (292)..(292): n is a, c, g, or t
  misc_feature (508)..(508): n is a, c, g, or t
  misc_feature (643)..(643): n is a, c, g, or t
  misc_feature (664)..(664): n is a, c, g, or t
  misc_feature (673)..(673): n is a, c, g, or t
  misc_feature (697)..(697): n is a, c, g, or t
  misc_feature (712)..(712): n is a, c, g, or t
  misc_feature (742)..(742): n is a, c, g, or t
  misc_feature (806)..(806): n is a, c, g, or t
  misc_feature (811)..(811): n is a, c, g, or t
  misc_feature (815)..(815): n is a, c, g, or t
  misc_feature (868)..(868): n is a, c, g, or t
  misc_feature (883)..(883): n is a, c, g, or t
  misc_feature (887)..(887): n is a, c, g, or t
  misc_feature (925)..(925): n is a, c, g, or t
  misc_feature (986)..(986): n is a, c, g, or t
  misc_feature (989)..(989): n is a, c, g, or t
  misc_feature (1016)..(1016): n is a, c, g, or t
gctgtcgccctatctatcctggggagaagaccgcaggcggaggagacgcgggtgataagaggagtcnnaactcctcctcccgcgccgccgacccacccgcggcattctctccggtnttcctcctccagccagcagcaanatggtgctntgggtcttcgggtatgggtccctgatctggaaccccggnttcgatttcgacgaaaagatcctgggattcatcaagggctacaagcgaacgtttaatctcgcttgcattgaccatagaggcacaccacagaatccngccaggacntgcacccttgaatccgaagatgaagccatatgctggggaattgcttattgtgtcaaaggtggtctagaaaaagagcgagaagcaatgcagtacttggagagaagagaatgcgagtatgaccagaagatctctgtggatttctacaaggatggaaattctctggaaccagctgtgacggatgtattagttttcgtatccactcctgatccagttggnaacaaatactatcttggccctgctgctttggaggatatggcaaggcaaattgctacagccagtggccctaatggatataatagggactacctgttctcaatggagaaggcactgtccaatataagccatgaagangactcgatcattgagcttgcngatgaggtnaggaaggtgctgagcaggtcgacngagaagaaggttacnggctccgacataccattaaaatcgcatacncctgttgtgcacatctctgctcttcctgagggcaccgtcgtggtttcaacatagtaagaagagnggcanggcnggatcagcgaaagagatggcattttcctctgaccatactcactcttgacattntctgattgaaagatntgcngtttacttcagctctggcaccattgagggtgtgcgctnattttctttggcaactattgtggcaaaggctgtagcttccagagtgctaatgcgaaagccnganacttggtgttattgcttcccttgtganaccctaataataaatgcatttggcgacttcagcacttttgcgccgctgaagtgtgatgcttta

SEQ ID NO: 2229 - DNA, 1284 bp, Secale cereale
gacttggccacggcgggagcgactgccacgcgcgcccggccttcacgtgccgcccaccgcccctgaccctaatccccagacgagcccaccacgactatcctctcctctctcgccggcctctcggtataagtgctcccccacccccgccaccgtcttcttctccgacccgaaacccccatccgtccgtcccggagagaagaccgccggcggaggagaggagacgcgtgcgaggcaagaggatagtcaaatcctcctcccgcgccgccgacccccaccctcccgcggcattctctccggcgcccctcctccggccaggggaaaacagcagcaagatggtgctgtgggtattcgggtatgggtccctgatctggaaccccggcttcgacttcgacgacaagatcctgggattcatcaagggctacaagcggacgttcaatctcgcttgcattgaccatagaggcacaccacagcatccggccaggacctgcacccttgaatcccaagatgaagccatatgctggggaattgcttattgtgtcaaaggtggtctagaaaaagagcgagaagcaatgcagtacttggagagaagagaatgcgagtatgaccagaagatctctgtggatttctacaaggatggaaattctctggaaccagctgtgacggatgtattagtattcgtatccactcctgatccagttggcaacaagtactatcttggccctgctgctttggaggatatggcaaggcaaattgctacagccagtggccctaatggatataacagggactacctgttctcaatggagaaagcactgtccaatataagccatgaagacgacacgatcattgagcttgcggatgaggtgaggaaggtgctgagcaggtcgacggagaagaaggtcaccggctccgacatgccattaaaatcgcatacacctgttgtgcacatctctgctcttcctgagggcaccgtcgcggtttcaacatagcatagcaagaagagcggcacggctggatcagcgaaagagatggcattttcctctgaccacactcactcttgacgttctcccactgaaaggtctgcagtttacttcagctctggcaccattgagggtgtgcgctaattttctttggcaactattgtggcaaaggctgtagcttccagagtgctaatgtgaaagcctgaggcttgaaagtgttattgcttcccttgtgataccctaataataaatgcatttggcgacttcatcactcacttctgcgcggcagaggtgtgatgctttg

SEQ ID NO: 2230 - DNA, 1273 bp, Hordeum vulgare
atcccgcccgcccgcccgctgacgcgacgtacaccgcaccaagaaaccgccggaacccgcgtccggagctcgtgccacgcgcgcgcggcctcacgtgccgcccaccgcccgtgaccccaaatccccagacgaggccaccactatcctctccgccctcggtataactgctcccccaccaccgtcttctccccccctcccctcctccgacccgaaacccccatccgtccgccccggggagaagaccgccggagccgccgccggcccctcccgcggcattctctccggtgctcctcctccggccagcgtctgcaggggaaaaacagaagcggcaggatggtgctgtgggtcttcggatacgggtccctgatctggaaccccggcttcgatttcgacgacaagatcctcggattcatcaagggctacaagcggaccttcaatctcgcttgcattgaccatagaggcacgccgcagcatccggccaggacttgcacccttgaatccgaagatgaagccatatgctggggaattgcttattgtgtcaaaggtggtctagaaaaagagcgagaagcaatgcagtacttggagagaagagaatgcgagtatgaccagaagatctctgtggatttctacaaggatggaaattctctggaaccagctgtgacggatgtattagtattcgtatccactcctgatccagttggcaacaagtactatcttggccctgctgctttggaggatatggcaaggcaaattgctacagccagtggccctaatggatataatagggactacctgttctcaatggagaaggcactgtccaatataagccatgaagacgactcgatcattgtgcttgcggatgaggtgaggaaggtgctgggcaggtcgacagagaagaaggttaccggctccgacgtaccattaaaatcgcatactccagctgtgcacatctctgctcttcccgagggcaccgtcgcggtttcaacatagcaagaagagcggcatggctggattagcgaaacagatggcattttcctctgaccatactcactcttgacattctcccattgaaagatccgcggtatacttcggctctggcaccattgagggtgtgtgctaattttctttggcaactattgtggcaaaggctgtagcttccagagtgctaatgcgaaagcctgagacttcaagtgttattgcttcccttaataataaatgcatttggcgacttcagcacttctgtgctgctgagtgtgatgctatgctttgcttc

SEQ ID NO: 2231 - DNA, 1085 bp, Pseudoroegneria spicata
ccgacccgaaacccctatcccatcccggggagaagaccgcaggcggaggagacgcgggtgagataagaggagtcaaatcccatcctaactcctcctcccgcgccgccgaccccacccgcggcattctctccggtgttcctcctccagccaggggaaaaacagcagcaggatggtgctctgggtcttcgggtatgggtccctgatctggaaccccggcttcgatttcgacgaaaagatcctggggttcatcaagggctacaagcgaacgtttaatctcgcttgcattgaccatagaggcacaccacagaatccagccaggacctgcacccttgaatccgaagatgaagccatttgctggggaattgcttattgtgtcaaaggtggtctagaaaaagagcgagaagcaatgcagtacttggagagaagagagtgcgagtatgaccagaagatctctgtggatttctacaaggatggaaattatctggaaccagctgtgacggatgtattagttttcgtatccactcctgatccagttggcaacaaatactatcttggccctgctgctttggaggatatggcaaggcaaattgctacagccagtggccctaatggatataatagggactacctattctcaatggagaaagcactgtccaatataagccatgaagacgactcgatcattgtgcttgcggatgaggtgaggaaggtgctgaataggtcgacagagaagaaggttaccggctccgacattccattaaaatcacatacacctgttgtgcacatctctgctcttcctgagggcaccgtggtttcaacatagcaagaagagcggcactgctggatcagcgaaagagatggcattttcctctgaccatactcactcttgacattctcccattgaaagatctgcggtttacttcagctctggcaccattgagggtgtgcgctaattttctttggcaactattgtggcaaaggctgtagcttccagagtgctaatgcgaaagcctgagacttaaaagtgttattgcttcccttgtgataccctaataataaatgcatttggcgacttcagcgcttca

SEQ ID NO: 2232 - DNA, 1232 bp, Triticum aestivum
cacgcgcgcacggcctcacgtgccgcccaccgcccgtgaccccaatccccaaacgagcccacgactatcctctcggtataagtgctcccccaccaccgccaccgtcttcccccccctctccgacccgaaacccccatccgtccgtccgtcccggggagaagaccgccggcggaggagaggagacgcgggcgaggcaagaggagagtcaaatccccatcttgctcccccccccgcgccgccgaccccacccgcggcattctctccggcgtccctcctccggccagggggaaaagcagcagcaggatggtgctgtgggtcttcgggtatgggtccctgatctggaaccccggattcgacttcgacgagaagatcctgggattcatcaagggatacaagcgaacgtttaatcttgcttgcattgaccatagaggcacaccacagcatccggccaggacctgcacccttgaatccgaagatgaagccatatgctggggaattgcttattgtgtcaaaggtggtctagaaaaagagcgagaagcaatgcagtacttggagagaagagaatgcgagtatgaccagaagatctctgtggatttctacaaggatggaaattctctggaaccagctgtgacggatgtattagttttcgtatccactcctgatccagttggcaacaaatactatcttggccctgctgctttggaggatatggcaaggcaaattgctacagccagtggccctaatggatataatagggactacctgttctcaatggagaaggcactgtccaatataagccatgaagacgactcgatcattgtgcttgcggatgaggtgaggaaggtgctgagcaggtcgacggagaagaaggttaccggctccgacataccattaaaatcgcatacacctgttgtgcacatctctgctcttcctgagggcaccgttgcggtttcaacatagtaagaagagcagcacggctggatcagcgaaagagatggcattttcctctgaccacactcactcttgacattctaccattgaaagatctgtggtttacttcagctctggcaccattgagggtgtgcgctaattttctttggcaactattgtggcaaaggctgtagcttccagagtgctaatgcgaaagcctaagacttcaagtgttattgcttcccttgtgataccctaataataaatgcatttggcgacttcagcacttctgcgccgctgag

SEQ ID NO: 2233 - DNA, 1089 bp, Festuca arundinacea
ggcacgaggcgagtctcctacccaggccgaggagagaagactgcaggctcgggagaggcggcggctaagaggagtcaaatccaatcctactcctacccctcctcctcctgccccgccagccacccgcggcattctctcccgcgtttcttcttctagggcaataaaaaggagagagggatcaagatggtgctatgggtcttcgggtacgggtccctcatctggaacccaggcttcgatttcgacgagaagatcttgggattcatcacgggctacaagcgaacgttcaatctcgcttgcattgaccacagaggcacgccaaaggacccagccaggacctgcacgcttgaatccgaagagggagccatatgctggggaattgcatattgtgtcaatggtggtccagaaaaagagcgagaagcaatgcagtacttggagagaagagaatgtgagtatgaccagaagatctctgtggatttctacaaggatggaaattctctggaaccatctgtgacaggtgtattagttttcgtatccactcctgatccagttggcaacaaatactatcttggccctgctccgttggaggatatggcaatgcaaattgctacggctagtggccctactggaaataatagggactacctgttctcaatggagaaggcattgtccaacataagccatgaagatgattccatcattgagcttgctgatgaggtgaggaaggtgctgagcaggtcgaatgagaagaagattaccggccctgacataccacttaaatctcaaactcctcttgtgcacttgtctccgcttcttgaaggcactgtagtggattcgagatactaagagtggcatgtcttgatcagctgaagacatggcattttcctctgatcatactcactcttgatattctccgattgaaagttttggttctttgcttcagctctggcatcactgaggatccatatgtaccgatttacttgtggcaaaactatgtagcttccagagcgctaatgcgacagcttgtgacttcagccttgttgcttcgtttggtaccctaataataaatgcgtttggctacgttaagcattt

SEQ ID NO: 2234 - DNA, 1217 bp, Triticum aestivum
cgcgcgcgcggcctcacgtgccgcccaccgcccgtgaccctaatccccaaacgagcccacgactatcctctcccctcctctctcggtataagtgctcccccaccaccgccaccgtcttctccccctcctctccgacccgaaacccctatccgcccgtccgtcccggggagaagaccgccggcggaggagaggagacgcgggcgaggcaagaggagagtcaaatccccatcctgctcctccctcccgcgccgccgaccccacccgcggcattctctccggtgcccctcctccggccaggggaaaaaacgaacatcagcaggatggtgctgtgggtattcgggtatgggtccctgatctggaaccccggattcgacttcgacgagaagatcctgggattcatcaagggctacaagcgaacgtttaatctcgcttgcattgaccatagaggcacaccacagcatccggccaggacctgcacccttgaatccgaagatgaagccatatgctggggaattgcttattgtgtcaaaggtggtctagaaaaagaacgagaagcaatgcagtacttggagagaagagaatgcgagtatgaccagaagatctctgtggatttctacaaggatggaaattctctggaaccagctgtgacggatgtattagttttcgtatccactcctgatcctgttggcaacaagtactatcttggccctgctgctttggaggatatggcaaggcaaattgctacagccagcggccctaatggatataatagggactacctattctcaatggagaaggcactgtccaatataagccatgaagacgagtcgattattgtgcttgcggatgaggtgaggaaggtgctgagcaggtcgacggagaagaaggttaccggctccgacatgccattaaaatcgcatactcccgttgtgcacatccctgctcttcctgagggcaccgtcgtggtctcaacatagcaagaagagcggcacggctggatcggcgaaagagatggcattttcctctgaccacactcacccttgacattctcccattgaaagatctgcggtttacttcagctctggcaccattgagggtgtgcgctaattttctttggcaaaggctgtagcttccagagtgccagtgcgaaagcctgagacttgaaagtgttattgcttcccttgtgataccctaataataaatgcatttggcgactt

SEQ ID NO: 2235 - DNA, 1293 bp, Triticum aestivum
ccgtgcccgcccgctgacgcgacgtacaccgcaccaagaacccgtcggaccctccgccggccacggcgggagcgactgccacgcgcgcgcggcctcacgtgccgcccaccgcccctgaccctaatccccaaaccagcccacgactatcctctcccctcctctctcggtataagtgctcccccaccaccgccaccgtcttctcccccctctccgacccgaaacccccatcccgtccgtccgggggagaagaccgccggcggaggagaggagacgcgggcgaggcaagaggagcgtcaaatccccatcttgctcctcctcccgcgccgccgacccacccgcggcattctctccggcgcccctcctccggccagcaggatggtgctgtgggtattcgggtatgggtccctgatctggaaccccggattcgacttcgacgacaagatcctgggattcatcaagggctacaagcgaacgttcaatctcgcttgcattgaccatagaggcacaccacagcatccggccaggacctgcacccttgaatccgaagatggagccatatgctggggaattgcttattgtgtcaaaggtggtctagaaaaagaacgagaagcaatgcagtacttggagagaagagaatgcgagtatgaccagaagatctctgtggatttctacaaggatggaaattctctggaaccagctgtgacggatgtattagttttcgtatccactcctgatccagttggcaacaaatattatcttggccctgctgctttggaggatatggcaaggcaaattgctacagccagtggccctaatggatataatagggactacctattctcaatggagaaggcactgtccaatataagccatgaagacgacacgatcattgagcttgcggatgaggtgaggaaggtgctgagcaggtcgacggagaagaaggttaccggctccgacatgccattaaaatcgcatactcccgttctgcacatccctgctcttcctgagggcaccgtcgtggtctcaacatagcaagaagagcggcacggctggatcggcgaaagagatggcattttcctctgaccacactcacccttgacattctcccattgaaagatctgcggtttacttcagctctggcaccattgagggtgtgcgctaattttctttggcaaaggctgtagcttccagagtgctaatgcgaaagcctgagacttgaaagtgttattgcttcccttgtgataccctaataataaatgcatttggcgacttaagcacttatgcgccgctgag

SEQ ID NO: 2236 - DNA, 1293 bp, Triticum aestivum
ccgtgcccgcccgctgacgcgacgtacaccgcaccaagaacccgtcggaccctccgccggccgcggcgggagcgactgccacgcgcgcacggcctcacgtgccgcccaccgcccgtgaccccaatccccaaacgagaccacgactatcctctcggtataagtgctcccccaccaccgccaccgtcttctcccccctctccgacccgaaacccctatccatccgtccgtcccggggagaagaccgccggcggaggagacgcgcgtgaggcaagaggagtcaaatcctcctcccgcgccgccgaccccacccgcggcattctctccggcgcccctcgtcaggccagttaaaaaaacagcagcaagatggtgctgtgggtcttcgggtatgggtccctgatctggaaacccggattcgacttcgacgagaagatcctgggattcatcaagggctacaagcgaacgtttaatctcgcttgcattgaccatagaggcacaccacagcatccagccaggacctgcacccttgaatccgaagatgaagccatatgctggggaattgcttattgtgtcaaaggtggtctagaaaaagagcgagaagcaatgcagtacttggagagaagagaatgcgagtatgaccagaagatctctgtggatttctacagggatggaaattctctggaaccagctgtgacggatgtattagttttcgtatccactcctgatccagttggcaacaaatactatcttggccctgctgctttggaggatatggcaaagcagattgctacagccagtggccctaatggatataatagggactacctgttctcaatggagaaggcactgtccaatataagccatgaagatgactcgatcattgtgcttgcggatgaggtgaggaaggtgctgagcaggtcgacagagaagaaggtcaccggctccgacataccattaaaatcgcatacacctgttgtgcacatctctgctcttcctgagggcaccgttgcggtttcaacatagtaagaagagcagcacggatggatcagcgaaagagatggcattttcctctgaccacacatactctttgacattctcccattgaaagatctgcggtttacttcagctctggcaccattgagggtgtgcgctaattttctttggcaactattgtggcaaaggctgtagcttccagagtgctaatgcgaaagcctgagacttgaagtgttattgcttcccttgtgataccctaataataaatgcatttggcgacttcagcacttctgcgccgctgag

SEQ ID NO: 2237 - DNA, 1067 bp, Avena sativa
ctccccgaatcgaaatcccccaccccagccgaggagagaagactgtagcctcgggtgaggcggcggcagctaagaggagtcaaatccaatcctacccatactcctcctcctgccccgccgaccacccgcggcctattctctccggcgtttcttccaggaaacacaaaaggagggatcaagatggtgctatgggtcttcgggtatgggtccctcatctggaacccaggcttcgatttcgatcaaaagatgctgggattcataaagggctacaagcgaacgttcaatctcgcttgcattgaccacagaggcacgccaaaggatccggccaggacttgcacgcttgaatccgaagaggaagccatatgctggggaattgcatattgtgtcaatggtggtctagaaaaagagcaagaagcaatgcggtacttggagaaaagagaatgtgagtatgaccagaagatctctgtggatttctacgaggatgcaaattctctggaaccatctgtgacgggtgttttagttttcgtatccactcctgatccagttggcaacaaatactatcttggccctgctccattggaggatatggcaaggcaaattgctacagccaatggccctactggaaataatagggactacctgttctcaatggagaaggcattgtccaatataagccatgaagatgattccatcattgagcttgctgatgcggtgagaaaggtgctgagtaggtcgaatgagaagaagattaccggctctgacataccacttaaatcgcatactcctcttgtgtacttgtctccgcttcttgaaggcactgtcatggattcgagatagtaagagcggcatgtcttgatcatcgggaaagatgcaattttcctctgaccataatcactcttgacattctccgatgaaagtttggttgtttgcttcagctctggcatcactgatgatccatatgtactgatttacttgtggcaaaactatacagcttccagagtgctaatgcgaaagcctgggacttgagcattgttgcttcttttgatatcctaataataaatgcattt

SEQ ID NO: 2238 - DNA, 2003 bp, Sorghum bicolor
accgggcgccaaaccaaacgtgaggagctgatgagtcccgccgcgcccaccccgccgttcctcctccaccgttggcgagcccatccagcagtgtgagcacgacgcgacgccacacacgcacacgcctgcctgctgctcccgtgtactacgcatgcaatcatgcagatcccgcagctaccgcgcggggcgggcccttaaaaccccaagcacatgctatgctaactagcaacgctgccctgcagcattttgtctggagttccaagcaaagctccgatctccggatcacactgatccccgccaggcgtgccggcgtccagtggttgcgtcgagggagccttggctagcgaccatgctcgtgaggagcgcatccacgccggtcctcggcgcgctgctcccctccggcagccactcgccggcggtgtcctccccggccgtccactttcccgagtcgccggcggcagccgcctaccacccgccgcccatctcctgccacctggccgggcccgggtccgggtccgaccacgagcgcactcgcggcctcggcaccggcatacgccgcacgtgctccgaggacaacctcgcgtctctggccggcgtccgcgcggacgaccaccaccaccaccacctcccgccgtccggcaagggcgcgccccgggcgcgcccggtgccgctcgagaccatccagtcgttcaggggccggcaggcgtcgtccaccgacgacgaagaggaggacgaggaggaggacgcgtacgaggtggagcgggagctgcgcttcggccagttcagctttgctggcggcgacggcaacggcagcacctactcgcaggagcacccgctgttcctggccaggggcctcggcatcgaccgcctcggctcgggcctcctcagcgccgacggcggcggcgggttcggtggcagcgatggcggtggtggcgggaacttggtggcgtcggggaacggaggggaccgctccggcatcgagatgcactacaagaagatgatcgaggaggacccctgcaacggcctcttcttgaggaactatgcacagttcctgtaccaggtgaaaggggactacaggagggcagaggagtactactcccgtgcgatactcgccgaccccgacgacggcgagctcctgtcggagtacgccaagctggtgtgggacgtgcaccgcgacgaggagcgcgcctccagctacttcgagcgggcggccaaggcgtccccgcagaacagccacgtcctcgccgcgcacgccgccttcctgtgggacacggacgacgacgaagagggcggcggcgatgtgctcagctgctacacggggttcgctcagcctgcgcactcgtcgcctctggcttcggcgacaacctgaacagaacagcctctccgatccgatcgtctctgaactatgaagtgaattgttggaggtagctagtatgatagtgtggcctgtgctcgtctctgtagctaccaataatatacgagcgaacataggcctagtccagcgtatgtctacttgtgtttgtttcagcaatgagaaagcagattggtactctcttttctttgggagcttaaccttgatctgttgttaatctatgttgtatatgcttatctgaagatgcgatgctagtcttcggctatacagtcctattataaatagcgcgctatagcactatttagcgtttctggaagagaactgctaagctaggaagatttcaacgctaaatgatggtttccgctattagcagctaatagcacgctaatttcgctaaattgggttagtttagcgcccctatttggccttgggcttcatttccatcggcccaaatagcagggatatgtccctatgtgatgtatgttattattgatgtatcatgtatgaactacgaattttgatgtaatatgttagtaagacttttaaatatctatctctattggtatccataatgttttatctttattatgtgtaaaattacatgatgtttgacatattttttgctcagccg

SEQ ID NO: 2239 - DNA, 1910 bp, Sorghum bicolor
accgggcgccaaaccaaacgtgaggagctgatgagtcccgccgcgcccaccccgccgttcctcctccaccgttggcgagcccatccagcagtgtgagcacgacgcgacgccacacacgcacacgcctgcctgctgctcccgtgtactacgcatgcaatcatgcagatcccgcagctaccgcgcggggcgggcccttaaaaccccaagcacatgctatgctaactagcaacgctgccctgcagcattttgtctggagttccaagcaaagctccgatctccggatcacactgatccccgccaggcgtgccggcgtccagtggttgcgtcgagggagccttggctagcgaccatgctcgtgaggagcgcatccacgccggtcctcggcgcgctgctcccctccggcagccactcgccggcggtgtcctccccggccgtccactttcccgagtcgccggcggcagccgcctaccacccgccgcccatctcctgccacctggccgggcccgggtccgggtccgaccacgagcgcactcgcggcctcggcaccggcatacgccgcacgtgctccgaggacaacctcgcgtctctggccggcgtccgcgcggacgaccaccaccaccaccacctcccgccgtccggcaagggcgcgccccgggcgcgcccggtgccgctcgagaccatccagtcgttcaggggccggcaggcgtcgtccaccgacgacgaagaggaggacgaggaggaggacgcgtacgaggtggagcgggagctgcgcttcggccagttcagctttgctggcggcgacggcaacggcagcacctactcgcaggagcacccgctgttcctggccaggggcctcggcatcgaccgcctcggctcgggcctcctcagcgccgacggcggcggcgggttcggtggcagcgatggcggtggtggcgggaacttggtggcgtcggggaacggaggggaccgctccggcatcgagatgcactacaagaagatgatcgaggaggacccctgcaacggcctcttcttgaggaactatgcacagttcctgtaccaggtgaaaggggactacaggagggcagaggagtactactcccgtgcgatactcgccgaccccgacgacggcgagctcctgtcggagtacgccaagctggtgtgggacgtgcaccgcgacgaggagcgcgcctccagctacttcgagcgggcggccaaggcgtccccgcagaacagccacgtcctcgccgcgcacgccgccttcctgtgggacacggacgacgacgaagagggcggcggcgatgtgctcagctgctacacggggttcgctcagcctgcgcactcgtcgcctctggcttcggcgacaacctgaacagaacagcctctccgatccgatcgtctctgaactatgaagtgaattgttggaggtagctagtatgatagtgtggcctgtgctcgtctctgtagctaccaataatatacgagcgaacataggcctagtccagcgtatgtctacttgtgtttgtttcagcaatgagaaagcagattggtactctcttttctttgggagcttaaccttgatctgttgttaatctatgttgtatatgcttatctgaagatgcgatgctagtcttcggctatacagtcctattataaatagcgcgctatagcactatttagcgtttctggaagagaactgctaagctaggaagatttcaacgctaaatgatggtttccgctattagcagctaatagcacgctaatttcgctaaattgggttagtttagcgcccctatttggccttgggcttcatttccatcggcccaaatagcagggatatgtccctatgtgatgtatgttattattgatgtatcatgtatgaactacgaattttgatgtaatatgttagtaag

SEQ ID NO: 2240 - DNA, 1341 bp, Saccharum officinarum
gcaaagctccggcctccggatcactctgacccccggttgcgtcgagggaacctcggctagcgagaaacagccagccaccagcccaccaccatgctcgtgaggagcgcctccacgccggtcctcggcgcgctgctcccctccggtagccactcgccggctgtctcctccccggccgtccacttccacgagtcgccggcggtcgcctaccacccaccgaccatctcatgccacctggccgggccagggtccgggtccgaccacgagcgctcgcgcgtcggcatgcgccgcacgtgctccgaggacaacctcgcgtctctggccggcgtccgcgcggacgaccaccagcaccaccacctcccgccgtccggaaagggcgcgccccgggcgcggccggtgccgctcgagaccatccagtcgttcaggggccggcaggcgtccaccgacgacgaagaggaggaggaagcgtacgaggtggagcgggagctgcgcttcggccagttcagctttgccggcagcacctactcgcaggagcacccgctgttccttgccaggggcctcggcatcgatcgcctcggctcgggcctcctcagcgccgacgtcggcggcggcggattcggtggcagcgacggcggcgccgggttcgggggcagcgatggcggcggcggcagtaacttggtggcgtcggggaacggaggggaccgctccggcatcgagatgcactacaagaagatgatcgaggaggacccctgcaacggcctcttcctgaggaactatgcacagttcctgtaccaggtgaaaggggactacaggagggcagaggagtactactcccgtgcgatactcgccgaccccgacgacggcgagctcctgtcggagtacgccaagctggtctgggacgtgcaccgcgacgaggagcgcgcctccagctacttcgagcgggcggccaaggcgtccccgcagaacagccacgtcctcgccgcgcacgccgcgtttctgtgggacacggacgacgacgaagagggcggcggcgacgtgctcagcagctacgcggggttcgctcagcccgcgcactcgtcgactctggcttcggcgacaacctgaacagaacagcctctccgatcgtctctgaactctgaagtgaatgaatggaggtagctagcatgatagtggcctgtgctcgtctctgtagcttatcaataatactagcgaacataggcctagtgcagcgtatgtctacttatgtttgtttcaacaatgagcaagcagattccgtactctcttttctttgggagataaccttcatctggtgtaatctctgatgcttatctgaagtgcaaagct

SEQ ID NO: 2241 - DNA, 996 bp, Saccharum officinarum
gcgacggacggttccaccgcacccgcaccagccctatccctatctccggcaccggtatgatggccgctgcgagaatggcgctcgcctcttgcgcccgcctcctcccgtcctcaccctctccgctcaccctcgcgaggccccgcgccggcgccgtctcgttcctggctgcccgaccgtcgccgagatccggcaggaatcttgctctcttgtgctctttaacaccgacgtcgctatcgctaacggaggtctccgtagcaccgccgcccccgcaggatgcggtggatgagacgaagcacccggtgccgggcggggacgagaaagcggaaccgaccgtggaggagctagtggggctgctggacgtccgggtgggccgggtggtgaaggcgtggaggcacccggaggcggacacgctctacgttgaggaggtggacgtaagcgaggcggagccccggaccatctgcagcggccttgtcaacttcctccccatcgaagagctccaggacagcaacgtgattgttcttgctaacctcaaaccaaggaacatgcgtggcatcaagtcaaatggcatgctcatggctgcctctgatgcttcccatgagaatgtggagctgctcatccctccagaaggttcctttcctggtgaaagagtatggtttggttcagaagaagaaatgcatcgtcgatctgaccctgcatcaccaaatcaggtccaaaagaagaagatctgggaagctgttcagcctcatcttagaacaacagataactgcattgtggttcttggtgataaacaaatgcgtacctctgctggcctaattttctgcaaatcgcttcagggtgcaagagtgtcataaatctttatgatgaacatctttcttgtatcatggaatcgtgtgtcatgtaccttccctgcaaataataactatatgagtagagcaacagtgaaagaattttcttccagttattgagataattaccatactggaatcattcacattt

SEQ ID NO: 2242 - DNA, 1122 bp, Sorghum bicolor
gggcttatcataccgggaagcagccccccagtcgtatcccccctatctccggcagcgccgcagcggcacggcaccggtatgatggccgctgcgagaatggcgttcgcctcttgcgcccgcctcctcccgtcctcatcctctccgctcaccctcgcaaggccccgcgccggcgccgtctcgttcctggctgcccgaccgtcgccgagatccggcaggaatcttgctctcttctgctcttcatcaccgacgtcgctaccgctaacggatgcggtggaggagacgaagcccccggtgccgagcggggacgacaaggcggaaccgaccgtggaggacctagtgggcttgctggacgtccgggtgggccgggtgttgaaggcgtggaggcacccggaggcggacacgctctatgttgaggaggtggacgtaggcgaggcggagccccggaccatctgcagcggcctcgtcaacttcatccccatccaagacctccaggacagcaacgtgattgttcttgctaacctcaaaccaaggaacatgcgtggcatcaagtcaaatggcatgctcatggctgcctctgatgcttcccatgagaatgtggagctgctcatccctccagaaggttccttgcctggtgaaagagtatggtttggttcagaagaagaaaagcatcgtcaatctgaccctgcatcaccaaatcaggtccaaaagaagaagatctgggaagctgttcagcctcatcttagaacaacagataactgcattgtggttcttggtgataaacaaatgcgtacctctgcaggcccaattttctgcaaatcgcttcagggtgcaagagtgtcataaatctttatggtgaacatctttcttgtatcatggaatcgtgtgtcatgtaccttccccgcaaataataactatacgagtagaacaacagtgacagaattttctttccgactattgagatattcaccatactggaatcattcacatttagttctcacttttcagtgtcaaaactaagtgcttcctggacattatatttaggaatttacattatttcctagctaaatttcaattgaagattcaaggttgacggaataatcttgaataaatatgtgaattatg

SEQ ID NO: 2243 - DNA, 1824 bp, Sorghum bicolor
aaataaaaatataaacgaagaggaaaataaagaaatgagaacaataacaaaaatggaaaacaaaagaaagccgatcccgcgacatgaaacacgaaaagaaaaaaaatagatacaaaaaagaaaagaaaagaaaagttaaataaagaaaggataagaaaaaaaaagaaaagtaacgtactcacctgaatgtcgtcgactccctcgcctcggaggaacagcgcccgcggaaagcagcacgagcacggcctccgcgtgggggttatggactcaggggtaagaaggacatttttctacatgggacccacgtgtctgatcttttgaacgtcacaaaacaaacggaactgagacggaatggcacacgggtatagtcgaagatgaagttggtcacagcggtgcgaaacaactttttagtgacctgctggtttggtcaatctttcataatggcatacaggtaaaaagctcccaaacctttgccctggtcaattaagattacatttcattcagatcttgctgcactgcagccttccatgtttttttttttaaaaaaaagcaagcctccaacattacacagggcttatcataccgggaagcagccccccagtcgtatcccccctatctccggcagcgccgcagcggcacggcaccggtatgatggccgctgcgagaatggcgttcgcctcttgcgcccgcctcctcccgtcctcatcctctccgctcaccctcgcaaggccccgcgccggcgccgtctcgttcctggctgcccgaccgtcgccgagatccggcaggaatcttgctctcttctgctcttcatcaccgacgtcgctaccgctaacggatgcggtggaggagacgaagcccccggtgccgagcggggacgacaaggcggaaccgaccgtggaggacctagtgggcttgctggacgtccgggtgggccgggtgttgaaggcgtggaggcacccggaggcggacacgctctatgttgaggaggtggacgtaggcgaggcggagccccggaccatctgcagcggcctcgtcaacttcatccccatccaagacctccaggacagcaacgtgattgttcttgctaacctcaaaccaaggaacatgcgtggcatcaagtcaaatggcatgctcatggctgcctctgatgcttcccatgagaatgtggagctgctcatccctccagaaggttccttgcctggtgaaagagtatggtttggttcagaagaagaaaagcatcgtcaatctgaccctgcatcaccaaatcaggtccaaaagaagaagatctgggaagctgttcagcctcatcttagaacaacagataactgcattgtggttcttggtgataaacaaatgcgtacctctgcaggcccaattttctgcaaatcgcttcagggtgcaagagtgtcataaatctttatggtgaacatctttcttgtatcatggaatcgtgtgtcatgtaccttccccgcaaataataactatacgagtagaacaacagtgacagaattttctttccgactattgagatattcaccatactggaatcattcacatttagttctcacttttcagtgtcaaaactaagtgcttcctggacattatatttaggaatttacattatttcctagctaaatttcaattgaagattcaaggttgacggaataatcttgaataaatatgtgaattatgaagcattgattaaaattcgaggtcagctacatagctgttgctgctcctggtctgtgtgaactatgatgatgacttcgattgatctcagacatagtttgcaaaagtgcaaagaattaacaaaatctcttcggg

SEQ ID NO: 2244 - DNA, 1119 bp, Setaria italica
gctctctgcggcggagaacggcggccgacgccccaaccgcacccacccgcgcctccgggatgctggccgcggcgagaatggcgttcgcctcctgcgcccgcctgctcccatcctctccctctacgctcacctccgtgagggcccgcgccggcgccgtctcgttcctggttcccccgccggcgccgtcggcggccgcaagatcctcccggaacctcgcgctctgctgctcttcctcgtcgcctccgccggcggacgccgccgtagcgccgcctcccacgcagaccgcggcggaggaggcgaagccggcggcgccgggcggggacgagaaggcggagcctaccgtggaggagctggcggggctgctggacatccgtgtggggcgggtggtgaaggcgtggagacacccggaggccgacactctctacgtcgaggaggtggacgtaggcgaggcggagccgcgcaccatctgcagcggcctcgtcaacttcctccccattgaagagctccaggacagcagtgtgattgttcttgctaacctcaaaccaaggaacatgcgtggcatcaagtcaaatggcatgctcatggcagcttctgatgcttcgcatgagaatgtcgagctgcttacccctccggaaggatctgttcctggtgaaagagtatggtttggttcagaagaagaaaaggatcgtcaatcagaacctgcatcgccaaatcagatacaaaagaagaagatttgggaatctgtgcagccacatcttaaaacaacggataactgtgtagcagttctcggtgagcatccaatgcgtacctctgcagggtcggttttctgcaaatcacttcagggtgctagagtgtcataaatctttatcgatggcctttttgtttcgctggaccttatgctgtgtaccatccctaaaaataattacaccagtagagcaactgtcaaagaattttgtttccaaattccaagttttgaggatgatctcatattcagaattttgaatgttcagcattttctataatggagctatgtggtagttgcgttctgttgggtgtaatcatcaggcattcctttttgctgaaggatcgaggacagctatgctacggagctgctgttgc

SEQ ID NO: 2245 - DNA, 1108 bp, Setaria italica
cggagaacggcggccgacgccccaaccgcacccacccgcgcctccgggatgctggccgcggcgagaatggcgttcgcctcctgcgcccgcctgctcccatcctctccctctacgctcacctccgtgagggcccgcgccggcgccgtctcgttcctggttcccccgccggcgccgtcggcggccgcaagatcctcccggaacctcgcgctctgctgctcttcctcgtcgcctccgccggcggacgccgccgtagcgccgcctcccacgcagaccgcggcggaggaggcgaagccggcggcgccgggcggggacgagaaggcggagccgaccgtggaggagctggcggggctgctggacatccgtgtggggcgggtggtgaaggcgtggaggcacccggaggccgacacgctctacgtcgaggaggtggacgtaggcgaggcggagccgcgcaccatctgcagcggcctcgtcaacttcctccccattgaagagctccaggacagcagtgtgattgttcttgctaacctcaaaccaaggaacatgcgtggcatcaagtcaaatggcatgctcatggcagcttctgatgcttcgcatgagaatgttgagctgcttacccctccggaaggatctgttcctggtgaaagagtatggtttggttcagaagaagaaaaggatcgtcaatcagaacctgcatcgccaaatcagatacaaaagaagaagatttgggaatctgtgcagccacatcttaaaacaacggataactgtgtagcagttctcggtgagcatccaatgcgtacctctgcagggtcggttttctgcaaatcacttcagggtgctagagtgtcataaatctttatcgatggcctttttgtttcactggaccttatgctgtgtaccatccctaaaaataattacaccagtagagcaactgtcaaagaattttgtttccaaattccaagttttgaggatgatctcatattcagaattttgaatgttcagcattttctataatggagctatgtggtagttgcgttctgttgggtgtaatcatcaggcattcctttttgctgaaagatcgaggacagctatgctacggagctgctgttgc

SEQ ID NO: 2246 - DNA, 730 bp, Saccharum officinarum
ccggaccggaaccgcagccatccagctctttccggcgaggacgagacaagtaggcggcgcctgcggtttcggcggtccttaatcccctctctcggcagggcacagatggcgtccggcggtccggcgctcgagccgctcgtcgaccaggtcatctccgtcatcaccaacgatggacgcaacattgtgggtacgctcaggggattcgatcaggccaccaacattatcctcgacgagtcccacgagagggtctattctagaaaggagggagtccaacaacttgtacttggtctgtacattatcaggggtgacaacataagcgttgtgggcgaggttgacgaagagctggattcaagattggatatgtcgaagctaagggcgcacccactgaagcccgttatccactgaggtccgtccgagtgtgtcttgggtactgtggactggatgagtcattattgttgaatgcaggatgtatcatcatcatcatcatcatgaagtggggactgatgagtaatatgaacatgtatcttgcgtattgtgaatcaatgaatatgtgttggttgttgggttgcttgcctacgcattctgtaagactgcagttgcctatgttctttttcctttttgctttttttttcaaaaaaaggattgcaattattggaatttggatcccgtgggatggatgccagtggcgggtggggttgacatatgaatagcagcgataaatatccaatgc

SEQ ID NO: 2247 - DNA, 677 bp, Sorghum bicolor
agagaaacgcagcgtcgtgtcgtggctagggttttggcgtccggaaccgcaggcagccatccagttctttgcggcgaggacgagacacgttgtggggctagtaggcggcgcctgaggcttcggcggccctagtctcttctctcggcagggcacagatggcgtccggcggtccggcgctcgagccgctcgtcgaccaggtcatctccgtcatcaccaacgatggccgcaacattgtgggtacgctcaggggattcgatcaggccaccaacattatcctcgacgagtcccacgagagggtctattctagaaaggagggagtccaacaacttgttcttggtctgtacattatcaggggtgacaacataagcgttgtgggcgaggttgacgaagatctggattcaagattggatatgtcgaagctaagggcacatccactgaagcctgttatccactgaggtccgtccgagtgtgtgttttgggtaccctgtggactggatgagtcattgttgcatgcgggatgtagcatcgtcatcatcatgaagagacagggggactgatgagtaatatgaacatgtatcttgcgtattgtgaatcaatgaatatgtgttggctgtttgggctgcttgcctacgcattcgatctgtaagatatatactaagattgcagttgcctctttt

SEQ ID NO: 2248 - DNA, 775 bp, Sorghum bicolor
gtggctagggttttggcgtccggaaccgcaggcagccatccagttctttgcggcgaggacgagacacgttgtggggctagtaggcggcgcctgaggcttcggcggccctagtctcttctctcggcagggcacagatggcgtccggcggtccggcgctcgagccgctcgtcgaccaggtcatctccgtcatcaccaacgatggccgcaacattgtgggtacgctcaggggattcgatcaggccaccaacattatcctcgacgagtcccacgagagggtctattctagaaaggagggagtccaacaacttgttcttggtctgtacattatcaggggtgacaacataagcgttgtgggcgaggttgacgaagatctggattcaagattggatatgtcgaagctaagggcacatccactgaagcctgttatccactgaggtccgtccgagtgtgtgttttgggtaccctgtggactggatgagtcattgttgcatgcgggatgtagcatcgtcatcatcatgaagagacagggggactgatgagtaatatgaacatgtatcttgcgtattgtgaatcaatgaatatgtgttggctgtttgggctgcttgcctacgcattcgatctgtaagatatatactaagattgcagttgcctctttttttttttttctgcaattgcttgttgcttggatcccgtgggaggatggatcgtggatgcaattgcgagactgccggccgggtggggtgatatatgaatagcagcgataaagatccaatgc

SEQ ID NO: 2249 - DNA, 584 bp, Panicum virgatum
agggttttggcgtccgaaatcgcagccatcgacgccgcctcatccaactccagcgagcaaggagattccaaggcggcgtcggccccggcccctaatcccctctatcggcagcgcagatggcttccggcggcccggcgctcgagtcgctcgtcgaccaggtcatctccgtcatcaccaacgatggccgcaacattgtgggcacgctcaggggatttgaccaggccaccaacattatcctcgacgagtcccacgagagggtctattctacgaaggagggagtccaacaacttgttcttggtttgtacattatcagaggtgacaacataagcgttgtgggtgaggtggacgaagacctggatgcaaggttggatctgtcgaagctaagagcacacccactgaagccggtcatccattgagcgctgctgcgggatcagatgcacttggactgggtgcgtcggtattctgattattgttgaatgcgggatgtagcatggtcgtcgagggggatcgagtaatatggacactgtatcgtgcttactattgtgaatcaatgaatgtgttggctgtcgggttgcacgtagaca

SEQ ID NO: 2250 - DNA, 630 bp, Panicum virgatum
aaagagatcgagaaaaagaaacgaggagggggcgctagggttttggcgtccgaaatcgcagccatcgacgccgccgcatccaactccggcgagcgagcagattccaggtcggcggcggcccctaatcccctctatcggcagcgcagatggcgtccggcggcccggctctcgagtcgctcgtcgaccaggtcatctccgtcatcaccaacgatggccgcaacattgtgggcacgctcaggggattcgaccaggccaccaacattatcctcgacgagtcccacgagagggtctattctacaaaggagggagtccaacaacttgttcttggtttgtacattatcaggggtgacaacataagcgttgtgggtgaggtggatgaagacttggatgcaaggttggatctgtcgaagctaagagcgcacccactgaagccggtcatccactgatcgctgctgccagatcagatgcacttgtttgttgggtagcttgtggactggatgcgtcggtattctgattattgttgaatgcgggatgtagcatcgtagtcgagggtaactgagtaatatgaacgctgtatcttgcttacaattgtgaatcaatgaatgtgtgttggctgtcgggttgcacgca

SEQ ID NO: 2251 - DNA, 702 bp, Setaria italica
tacaaaaatcgaaaagaaagagagagagagaaaaagaaaggagaaggggctagggttttggcgtccgaaatcgcagccatcgacgccgccgcatccaactccggcgagggagaggattcaggcctgaggcagtagtagtaggcggcggcggcggcccctaatctccttcctcggtagcgcagatggcgtccggaggcccggcgctcgagtctctcgtcaaccaggtcatctccgtcatcaccaacgatggccgcaacatcgtgggcacgctcagaggatttgaccaggccaccaacattatcctcgacgagtcccacgagagggtctattcgacaaaggagggagtccagcaacttgttcttggtttgtacattatcaggggtgacaacataagcgttgtgggtgaggtggatgaagacctggatgcaaggttggatctgtcgaagctacgagcgcacccactgaagccagtcatccactgaccgctgctgcgagatcagacacacttgtttcgtgggtagtctgaggaccggatagatgagtcggtattctgattgttgaatgcaggatgtaagcaccatcatcgagggggacgggactactgagtaatatgaacattgtatcttgcttattgttgtgaatcaatgagtgtgtgttggcacagttgactaggtgcttgttctgaagattgcaaggcgagat

SEQ ID NO: 2252 - DNA, 568 bp, Setaria italica
gcggcggcggcggcggcggcggcccctaatctccttcctcggtagcgcagatggcgtccggaggcccggcgctcgagtctctcgtcaaccaggtcatctccgtcatcaccaacgatggccgcaacatcgtgggcacgctcagaggatttgaccaggccaccaacattatcctcgacgagtcccacgagagggtctattcgacaaaggagggagtccagcaacttgttcttggtttgtacattatcaggggtgacaacataagcgttgtgggtgaggtggatgaagacctggatgcaaggttggatctgtcgaagctacgagcgcacccactgaagccggtcatccactgaccgctgctgcgagatcagacacacttgtttcgtgggtagtctgaggactggatagatgagtcggtattctgattgttgaatgcaggatgtaagcaccatcatcgagggggacgggactactgagtaatatgaacattgtatcttgcttattgttgtgaatcaatgagtgtgtgttggcacagttgactaggtgcttgttctgaagattgcaaggcgag

SEQ ID NO: 2253 - DNA, 590 bp, Cynodon dactylon
ggggaccgaacgaaacaaaagctagctagggttttgacgccgcatccaacaactccggcgacccatcccccacagaaacaaaagctccggcgagaggagcggcgtcaggaggatcaccctctcgaccgtacaggatggcttcaggtggtccggcgctcgagtctctcgtcgaccaggtgatctccgtcatcacaaacgatggccgcaacatcgtgggcactttgagaggattcgaccaggcgaccaacgttattctcgacgagtcccatgagagggtttattccacaaaagagggtgttcagcaacttgttcttggtttgtacattatcaggggtgacaacataagtgttgtgggggaggtggatgaagacctggacgcaaggttggacctgtcgcagctacgagcgcacccgctgaagcctgtcatacactgaccattgcggagatgggatgcacttatgtagtttcggatggctgaatgtcaggatgtagcagcatgatcaagggtgactgactgaggttaccgttgcttattgtgaatcattgaatgttgttcgtgtcgcacgtgcagttgagaagctggttgaact

SEQ ID NO: 2254 - DNA, 689 bp, Avena sativa
ggtcttcgaccgaggtttgaacgaaccaaccctaggtgaggtgaggtgaggtgagctgctccgccctctcgtctccggccgcctctgattcgattcgattcgattcccccgccgccggcaagtcgtacgtatggcgtccgtcggcccgacgctcgagtccctcgtcgaccaggtgatctccgtcatcaccaacgacggccgcaacatcgtgggtactctgagggggttcgaccaggccaccaacatcatcctcgacgagtcccacgagagggtctactctaccaaggagggtgtacagcaacttgttcttggactgtacattatcaggggcgacaacataagcgtggtgggtgaggtggacgaggagctggatgcggcactggatatgtccaagcttagagcgcagccgctcaagccggtgatccactgaagctcaagttgtttccgtaccttagttaatctgatgattggccgataatgatatatcatatcgactgtgagagcgtttgtgcatcaagtcacttttccatgtctcatttgggtcggtcggtcggtcagattcttgtattagaaatatactagtactaatgaagtaggtaatgctggaatcatggatctgttgctacatatatatatgtaatctattaacagcaagcaaggagaaacattgaaacgaaacaaatatgcac

SEQ ID NO: 2255 - DNA, 607 bp, Avena sativa
aacgaacgaaccctaggtgaggtgaggtgaggctctcgtctccggccgccgctgattcgattccaccgccgccgccgccgccggaaagtctaagtcggatggcgtccgtcggcccgacgctggagtccctcgtcgaccaggtgatctccgtcatcaccaacgacggccgcaacatcgtggggactctgagggggttcgaccaggccaccaacatcatcctcgacgagtcccacgagagggtctactctaccaaggagggagtacagcaacttgttcttggactgtacattatcaggggcgacaacataagcgtggtgggtgaggtggacgaggagcttgatgcggcgctggatatgtccaagctgagagcgcagccgctcaagccggtgatccactgaagctaaagttgtttccctaccttagttaatctgatcggtcgatatatcatatggactgtgagagcgtttgtgcatgaagtcacttttctatgtctcatttctgtcggtcgatcagattcttgtattagaaagatactaatgaagtagataatgctggaatcatggatctgttgctacatatattatatatataatccattaacagcaag

SEQ ID NO: 2256 - DNA, 607 bp, Avena sativa
ccgaggtttgaacgaacgaaccctaggtgaggtgaggtgaggctctcgtctccggagtccggccgccgctgattcgattccaccagcaccgccgccgccgccgccgccggaaagtctaagtcggatggcgtccgtcggcccgacgctggagtccctcgtcgaccaggtgatctccgtcatcaccaacgacggccgcaacatcgtggggactctgagggggttcgaccaggccaccaacatcatcctcgacgagtcccacgagagggtctactctaccaaggagggagtacagcaacttgttcttggactgtacattatcaggggcgacaacataagcgtggtgggtgaggtggacgaggagcttgatgcggcgctggatatgtccaagctgagagcgcagccgctcaagccggtgatccactgaagctaaagttgtttccctaccttagttaatctgatcggtcgatatatcatatggactgtgagagcgtttgtgcatgaagtcacttttctatgtctcatttgtgtcggtcgatcagattcttgtattagaaagatactaatgaagtagataatgctggaatcatggatctgttgctacatatat

SEQ ID NO: 2257 - DNA, 1660 bp, Secale cereale
tttcttgttgcttctcctctcctgatgagatgaagtgaaccctagctcgattcgattcgattccgccgccgccgccgccgccgaaccaagaagaaggaaggaaggaagagaagagaagaggagagggatggcgtccgttgggccgacgctcgagtccctcgtcgaccaggtcatctccgtcatcaccaacgacggccgcaacatcgtcgggactctgcggggattcgaccaggccaccaacatcatcctcgacgagtcccacgagagggtctactccactaaggagggagtacagcagcttgtcctcggtctctacatcatcaggggcgataacataggcgtggtgggtgaggtggacgaggagctggacgcggcgctggacatgtcaaagctcagagcgcagcccctcaagcccgtcatccactgaagatgatgacatctcctatccatctcatcctcatcgcgcaagccaaagctcatgttgctcagtcaacctgtaccgtaggttagtcgattgatcgctctcactcatatctcatatcatggacccatgtatgatgaaaaacaacatggtttggtgtgtcgatggaccggtcatgttcttgtatgagagagagagagatacatgcatctctgtacgcgtaagtaatgaatgaatgaatgaatgaagtaggcaattaatgttggaagctacattgatattatgatgatccatttatagttgacagcagacaagagaaatcgtcgaaagcaaattgaaatcgattttttactacaggtagagtagtaaatatacactatgtatgtgtgtacgtagatgatatacatttgcttgcattgcattgcattgcatgtgagggagggagggagggtggaaggaagggtaataataataatagtacagtagagcagatatctagatagatagatgggtaggtgaggtggatgatggtgctccggctccggtggtggttcaggtggggttggaggcggcggcggtggtggcgttgggcctaacggcgctgtagttgcaggagatgatgaactggccttggcgggggcccttgaggcagggggcgcggccgcacccgacgtagtgatagatcttctggatcatgatgacgaagtggccgcagtcacggaagtcgtggccggaggtgcagtgatcggtgcccttctcgtagatgtactcctccctctcccagctgcacagcgcgtcctcggcggtgccgttgttgcccacgaagaagcactcgccgtagcccagcggatgggcctgcggcgagtgcctggcctgatcgcagtcctgctgtatctgcgccgcccaccgtcgcgcgtacagggccagcgtcttgtcccactccagcgtcggcgcatggtacctggagcgcaccttgttgtgctcgttcacaaactcgcgggacatgcccttgtagaaccccggccctggcgggggcggtggcgcacctgctcctgctcctgctcctgctggagacgatgatggtgttgctgctgctcctgctggagacgacgatggtgttgctgctgctcctgctggagacgacgatgatggtgttgctcctgctggagacgatgatgatggcggtgatggtgttgctccgtgctggagacgatgatgatggcgtgatggtgttgctcc

SEQ ID NO: 2258 - DNA, 671 bp, Brachypodium distachyon
accctagctagcctgggcggaagaaggaggaggaggtgggcggccgcctttcgctttgccttgaatcccttgtccggttgtcccctccgcctccggcaagcagagaagagcatggcatccgccggcccgacgctcgaatccctcgtcgaccaggtgatatccgtcatcaccaacgacggccgcaacatcgtggggactttgaggggattcgaccaagccaccaacatcattctcgacgagtcccatgagagggtctactctaccaaggagggagtacaacagcttgtccttggtctgtacatcatcaggggcgacaacataggtgtggtgggtgaggtcgatgaggagctcgatgcggcgctggacatgtccaagctgagagcgcagccgctcaagcctgtgatccactgaagatgcagactctgttgtctgtctttgtctctctgtgtgtgtttcttggttgattgttttgtagggtgtaagcttattactagctgctacgtagggttccctttggtttggtttggtttggttggtttgaatggactgatcgttgaacgtcctgattgctggaggtgaattaagcttgatgatgtaccgcgcctattaagaattatgagacggaggtagtagcatctaaaaaaaatagagtaaaatcataaattatcatc

SEQ ID NO: 2259 - DNA, 886 bp, Brachypodium distachyon
aggaaacgaaacgaaacgaagaaccctagctagcctgggcggaagaaggaggaggaggtgggcggccgcctttcgctttgccttgaatcccttgtccggttgtcccctccgcctccggcaagcagagaagagcatggcatccgccggcccgacgctcgaatccctcgtcgaccaggtgatatccgtcatcaccaacgacggccgcaacatcgtggggactttgaggggattcgaccaagccaccaacatcattctcgacgagtcccatgagagggtctactctaccaaggagggagtacaacagcttgtccttggtctgtacatcatcaggggcgacaacataggtgtggtgggtgaggtcgatgaggagctcgatgcggcgctggacatgtccaagctgagagcgcagccgctcaagcctgtgatccactgaagatgcagactctgttgtctgtctttgtctctctgtgtgtgtttcttggttgattgttttgtagggtgtaagcttattactagctgctacgtagggttccctttggtttggtttggtttggttggtttgaatggactgatcgttgaacgtcctgattgctggaggtgaattaagcttgatgatgtaccgcgcctattaagaattatgagacggaggtagtagcatctaaaaaaaatagagtaaaatcataaattatcatcaaaaacggtttagtcgatcttaatcttatgatgattgtagtactctgtttggacagagaagagtagtagtagaaaagaagcctatgcatgtgtgtgtctgtagtgtatgatccatccattggttggtggctggctggctgttgaaagaagggaggtaagcagaaggtgggtagcgaggacgccgggcgacctt

SEQ ID NO: 2260 - DNA, 621 bp, Leymus cinereus x Leymus triticoides
ctcgattcgattcgaccagcgccgccgccgaagcaggaggaagaggaggggatggcgtccgtcggcccgacgctcgaatccctcgtcgaccaggtgatctccgtcatcaccaacgacggccgcaacatcgtggggactctgcgggggttcgaccaggccaccaacatcatcctcgacgagtcccacgagagggtctactccactaaggagggagtacagcagcttgtcctcggactatacatcatcaggggcgacaacataggcgtggtgggtgaggtggacgaggagctggacgcggcgctggacatgtcgaagctgagagcgcagccgctcaagccggtcatccactgaagatgatggtatcttctatcaatctgatcctgatcacgcaagccgaagctgctgatgttgttcagtcaatctgtaccgtaggttaatcgatcgatcgctcactcatatctcatatcatggaccgagagcgtgcgtcttgttgtatgatgaaaacatggtttgctgcgtcgatcgaccagtcatgctcttgtgtgtgagagagaaacatacatatgtgtacgcgtaagtaatgaatgaatgaatgaagtaggcaattaatgttggaagcta

SEQ ID NO: 2261 - DNA, 766 bp, Pennisetum glaucum
tacaaaaatccaaaagaggagaggggctagggttttggcgtccgaaatcgcagccatcgacgccgccgcatccaactccggcgagagaggggattcaggtcggaggcagtaggcggcggcggcggcccatcatctcctctctcggcagcgcagatggcgactggcggccctgcgctcgagtcgctcgtcaaccagatcatctccgtcatcaccaacgatggccgcaacatcgtgggcacgctcagaggatttgaccaggccaccaacattatcctcgacgagtcccacgagagggtgtattccacgaaggagggagttcagcaacttgttctgggtctgtacattattaggggtgacaacataagcgttgtgggtgaggtggatgaagaccttgatgcaaggttggatttgtcgaagctaagagcgcaccccctgaagccggtcatccactgaccgcagctgcgagatcagacacttgttttgtgggtagtctgtggaccggatagatgagtcggtattctgattgctgaatccaggatgtaatcatcctcagattgctgaatgcaggatgtaaacatcatcaattgaggggggacgacggtctaccaatatgaacattgtatcttgcctattgttgtgaatcagtgaatgtgtgctggattaggtgcttccttgtggatattgcaaggcgagattgctgcctggatcccgtgaccgttccttggatgggatggtacattggcacaatcatatgtctagactctgt

SEQ ID NO: 2262 - DNA, 645 bp, Triticum aestivum
agtgaactgagggaaccctagctcgctcgcctccggccgccctcgattcctctattcgattcgaccagcgccgccgccgaagcccgaggaggagaggaggaaagggggatggcgtccgtggggccgacgctcgagtccctcgtcgaccaggtgatctccgtcatcaccaacgacggccgcaacatcgtggggactctgcgggggttcgaccaggccaccaacatcatcctcgacgagtcccacgagagggtctactccactaaggagggagtacagcagcttgtcctcggactgtacatcatcaggggcgacaacataggcgtggtgggtgaggtggacgaggagctggacgcggcgctggacatgtccaagctgagagcgcagcccctcaagccggtcatccactgaagatgatgaaatgttctatcgatctgatcctgatcgcgcaagccgaagctgatgttgttcagtcaatctgtaccgtaggttaatcgattgatcgctcactcatatctcatatctcatatcatggacccttgtatgatgaaaaaaaacagggtttgctgcgtcgatggaccggtcatgttcttgtatgagagagagagatacatgcatctctgtgcacgtaagtaatgaatgaatgaa

SEQ ID NO: 2263 - DNA, 1901 bp, Oryza sativa
aggattttccctgtaggggctctgtgctctccattgattaaagagtggctaccacaaggtgcaggccctaaaacaggcagtaaaaaggacagtaaagtattggacatagaacaaaatcaagcaagtgtgaagtataataggttatcagtaactagttgtcagaagtgtactgcatgccaattgagatgaacaaaaggtactgtagtctgaaagtagtagctgcctttagaactttgtgcatatgagaatgaaaacattatgcgcatgtgttggtaaaatacagaaaaatgcacttgtgaaggattaaagaagactagatctataaatttatgtacactagagtctttgttgtgcagtatttgcatcttcaagtagcacgtaggcaactgacaaattagtatttacataaagaaattcctgcgtctgcgtgcttgtagatttgtaatttgtaaggtggtttctttgggctttataagatattattactgcattacttttgtgctgctgtagtgttatttcatagtggagaaccaacgtgacccaaaaaacggcgaagactagccaaaaaccctagcagctagcaagtcgcattaacataaaactcgtcaatgattagcttgtttgcaggggctagttccttacaggatggtgcagtgttttatgtttgtttatttttttttcttacatgtagatgtaagcaaggagagcaaaataggtgggtgatctataagattttgctggtaaggacccaagaaaaacatgagcaataaaatcgattggagcagccgtcctagaaagagagatttggattggagagaggaacaggtagggcaagggagaagaaaatatcttagaaacaatggagcaagagttggtcaccactcagtcactcaccaacaagtgggggattacggaggagggctggacgtcgtcgtcgtcgtcggcggcggcggcgggacgggaggagagggattctccgacgcgatgtgatgtgatttggggaggcgatgacgacgggagggggagcagagaaggatctctcatggtgggctgggcttctcttagctgggctggagaggcccgcccacgcatttgatggcccatataaaagcccgctcggcaactccaaagacgaagttgagctagggttttcaatctctttcttctctccaaaacacaaatcgtcgccgcatcccctcaactccggcgatccccttggcggcggcggcggcttccccaatcaccccactccacctgaactacaggatggcgtccgccggcccggggctcgaatcgctcgtcgaccagatcatatccgtcatcacaaacgatggccgcaacattgtggggacactcagaggattcgatcaagccaccaacatcatcctcgatgagtcccatgagagggtctattctaccagggagggagtgcaacagcttgttcttgggttgtacatcataaggggcgacaacatcagcgtggtgggggaggtggatgaagaactggatgcgaggctggatctatcgaatctgagagcgcacccgctgaagcccgtgatccactaatggaaacgaatgaatgatgtactactactagtagtaagctaaacctaaatgtagtgttgtcccagaagttgtgaagaagtgggtgctagtgttgccgatgagtgaacttctttaacgtacgcgaggaagtccagcaagcggatgagcgagcatgaagaagaatgttatggttttatgtggtggtggatgggtgatgcatgtttgttgaacacgaacacagacacagtgactcagtgagtgaagatttggtttccattgtattgtattgtttgtgcagctgtatcaatgtacatgaatgaggaaggcaggcaggtcagttgttgaagagaagaaga

SEQ ID NO: 2264 - DNA, 758 bp, Oryza sativa
gaagttgagctagggttttcaatctctttcttctctccaaaacacaaatcgtcgccgcatcccctcaactccggcgatccccttggcggcggcggcggcttccccaatcaccccactccacctgaactacaggatggcgtccgccggcccggggctcgaatcgctcgtcgaccagatcatatccgtcatcacaaacgatggccgcaacattgtggggacactcagaggattcgatcaagccaccaacatcatcctcgatgagtcccatgagagggtctattctaccagggagggagtgcaacagcttgttcttgggttgtacatcataaggggcgacaacatcagcgtggtgggggaggtggatgaagaactggatgcgaggctggatctatcgaatctgagagcgcacccgctgaagcccgtgatccactaatggaaacgaatgaatgatgtactactactagtagtaagctaaacctaaatgtagtgttgtcccagaagttgtgaagaagtgggtgctagtgttgccgatgagtgaacttctttaacgtacgcgaggaagtccagcaagcggatgagcgagcatgaagaagaatgttatggttttatgtggtggtggatgggtgatgcatgtttgttgaacacgaacacagacacagtgactcagtgagtgaagatttggtttccattgtattgtattgtttgtgcagctgtatcaatgtacatgaatgaggaaggcaggcaggtcagttgttgaa

SEQ ID NO: 2265 - DNA, 841 bp, Cucurbita pepo
ctgcatcctcttcttcttcacgccggcccctcctccatttcagcagcttagtgtcaccgcctccgccgcctctcacccgttcagtgccgtcgccgtcgtcattttcttccgctcgtgctgtcgcagtctctctcctagcgagttgtattgatcttctagttgttactggagttgtttttgattgacagaacaacctcaaccagatatatatttgtacatttcggagggagacgcagatttcacttgcagtcgttggcgtgaaattagggaagattgaagctagttgatttctggatctagctgatcggataatagagaataactcgtagctcattgtaagggtcttcaaaatggcaagtggacctggacttgaatcactggttgatcaaacaatatcagttatcactaatgatggccgcaatatagtgggagtgttgaaaggatttgaccaggctacaaatattatcctcgatgaatctcatgaacgtgtttactcgaccaaggaaggagttcagcaacttgttttgggtctatatataatcagaggcgataatataagcattgttggggagctagatgaagaacttgattcaaatttggacttgtcgaagttgagagcccatcctctaaagcctgtgattcattaattgtggaccatcaagaagaaaaagctgtcaaacggtttttagctttaacctttcatcacattttacagctctgtttagatggcgggcattatattcgttatgaatatattacatatttgaaattgaaaatatttcggatattttatttgctaagagaatttaatgttgtcctatgagaatagacaaattgcata

SEQ ID NO: 2266 - DNA, 492 bp, Platanus occidentalis
tctcccttgttacatgattcaaggtccagagtttttaaggtgtgataaccagtttgtggaggaagttgacaatggcaagtggtcctggacttgagtcccttgtggatcaaaccatatcagttataacgaacgatgggcgcaatatagtgggagtcctaaaaggttttgaccaggctacaaatatcattctcgatgaatctcatgagcgggtttactccacaaaggaaggcgtccagcagcttgtattaggcttgtatatcatacggggtgataacataagtattgttggggaattggatgaggagctcgattcgaatctggacttgtcaaaactgagagcgcatcccctcaagcccgtaatccactaactctcaagaatgtattggtaattctattttacattctagacttgatcaatgtaaaagatgctatgaatatagatacaaggaacccaaaattttgatgtattatattagatgtaattctaatttg

SEQ ID NO: 2267 - DNA, 458 bp, Platanus occidentalis
ggccgcacgccgaaaacgaaaccttgaattaaaagctcttcgggttctctcccgtgttacctgacttcaaggttcagagtttttaaggtgtgagaatcagtttgttggaggaagttgaacaatggcaagtggtcctggacttgagtcccttgtggatcaaaccatatcagttataacgaacgatgggcgtaatatagtgggtgttctaaaaggttttgaccaggctacaaatatcattctcgatgaatctcatgagcgggtttactctacaaaggaaggcgtccagcaacttgtattaggcttgtacatcatacggggtgataacataagtattgttggggaattggatgaggagctcgattcgaatctggacttgtcaaaactgagagcgcatcccctcaagcccgtgatccactaattatcaagaatgtattggcaattctattttgcattctaga

SEQ ID NO: 2268 - DNA, 583 bp, Papaver somniferum
gggttttagggtttggcggttttgcgagcacctaatatttgaaccatcaatttacgccgaaccatcatcatccctggttaccagcattgacagttgggattttgctgataagctgtaagaacctcaattgtgaagaaatgtcaggtggacctggacttgagtctcttgttgatcagcaaatctcggttataacaaatgatgggcgaaatatagtgggagttctaaaaggttttgaccaggctaccaatatcattctggatgaatctcatgaaagggtttactctacaaaggaaggtgtccaacaacttgtattaggcttgtacatcataaggggtgacaacataagtattgttggggaagtagatgaagaactcgactccaatctagacatgtcaaaattaagagcacatcctcttaaaccaataattcactgattataacattataggaaggtatgctatcttaagttttagagattctagacctaaaaagtgatgtaagaatgaaattggctgtaagatctgaagacccaaatacttatcatgtatttactagaattcattcaggtttcaaaccaaaaaaa

SEQ ID NO: 2269 - DNA, 947 bp, Trigonella foenum-graecum
aagagaaatgttccatgatttcaatgtgaataagtttgttttttggcccaagcccgctatattttttgttggctccatttgaaggagcggcccaattcacaatatcagtttttcacctaatcccccaaacatgggaaaaactgttttcgtttcttcattcttctcccaaccctaatccccaaatcgaattctgtctctactttctcaccatctccggcgttggcaaccgtcttccggcgcgattcatactccggtttccctccgtttccctccttcgtttgagctgtcagattaattatcagtatggcaaccggggggcctggactcgagtctctagtagatcagcaaatttcagtcattacaaatgacggacgaaatatagtgggagttctaaaaggttttgaccaggcaacaaatataattcttgatgaatcccatgaacgagttttttctaccaaggaaggtgttcagcaacttgttctgggtttatacatcattaggggtgacaacataagcgttgttggtgaattggatgaggaactagattctagcctagatttgtccaagcttagagctcatcccttaaagcctgtcatccactgaagtaaaacaatgttagaattgttgggagatgcttgctttcttgatggaaaggattggagcattattagtacaccacatacggcattaagcagtggaatgaaaaagtataagaatatgctgataacataatatgctaaataagtaaatatcttgattatgtttttgatgttggcatgagaatcatggttttctgcttgttggattatgcaatgcaacaaactcctgactatcttatctgaagaaactgttttttattcattgtagtttgcatgtttgggtaaatgtttgtcttacgtttgatattatgcttctatgggataaatgtggaaatatgttaaatgtat

SEQ ID NO: 2270 - DNA, 786 bp, Citrullus lanatus
aaaccctttcatcttcctctccctctcacgtgctccgccttcttcttcacagttcacgccggctcttctctttgaggagctcagtatcgccgccgtcgccgccgtctctcttacgctcgtgacgacggcgtttcttcccctcgtcctgccgcagtcttccttgtattgcactgatattctactgagtattgttaaagaatctagccgagctgataatatagaatagctactggattattgtaagggtcttcaatatggcaagtggacctggacttgaatctctggttgatcaaacaatatcagttatcacaaatgacggtcgcaatatagtgggagtgttgaaagggtttgaccaggctacgaatattatccttgatgaatctcatgaacgtgtttactcaaccaaggaaggcgttcagcaacttgttttgggtttatatataatcagaggcgacaatataagcattgttggggagctagatgaagaacttgattctaatctggacttgtccaaattgagagctcatcctctcaaacctgtgattcattaattggaccaggaagcaataaatgagtgtttattatgagaacaagtgaagctgttaaacgggtttttggctttaaccttttagcacctttgacggctttgcttagatagcgggtattattgaatggttatggatattaaatatttgaaatttaaatatttgggatattaaatattggtagttgaatattcaatatgattaaacctagtaaggttagacagttgttcaataagaatga

SEQ ID NO: 2271 - DNA, 890 bp, Nicotiana tabacum
  misc_feature (889)..(889): n is a, c, g, or t
cggggaacacgcattttctcaccttcacacacacgagatagctaaaaaggggtctggaattcagaggaaaaaatctaaatttgaaacagaacaaaaatcaaaagaaaagctgagaaactgcttcttctctcctctatacactgcttcaatcatttctggggtctcagtttgtttgagagctgaaatagaagctgttgctgtttctttctgctgattttgctatcactttgtggttcgagtttcatcatctccttatcagacctttattcggtccttgttcaagctgtttcggttttccaacttaggtttaagcatcagtctactgtaagatctgacaagtaaattgcttctgatttggcaacatggctagtggacccggacttgagtctcttgtcgatcaaaccatctcagttattacaaacgatgggcgaaatatagtgggagttttgagaggatttgaccaggctacaaatttgattctcgatgaatctcatgaaagggtgtattcaacaaaggaaggtgtacaacagcttgtgttaggtctttatatcatacgaggagacaacataagtgttgttggggaattagatgaagagctggatgcaaacttggatatgtcgaaactaagagcacatcctttaaagccagttgttcattgatctgcatcttggcatgagtttgtaatgttggcaatggaatggatcaaacgtcggttacacaaggaacttttggtacagtttgtagaattaaattcagatgtgttgtgcacctctgaacacatacttctagtctgtgattcaccactgtatgcctttggttatgctctagttttgtgtaagttacatttggtacatagtcttccagttatgctctacttttgtcccaaaana

SEQ ID NO: 2272 - DNA, 597 bp, Musa acuminata
gccggcgtgcttcctggaagagcaaaacccccactgagatagttgcagttagacatgtcaacaggccctggactcgagacattggtagatcaaacaatatcagtcattacaaatgatgggcgcaacattgtgggagttttgagaggctttgaccaggctacaaatattattcttgatgaatctcatgagagggtttactctaccaaggaaggtgtgcagcaacttgtcttagggctctatattataagaggcgataacataagtgtagtgggagagttagatgaagaactggatgcaaatctcgacttgtccaaactcagggcgcatcctcttaaacctgtgatacattaacagaggaagcatgatcaagacaagaggacgggctaaatgtttgtagcagaatattgttcttgttttagagctcaacgtgagtatgttgtaccaccttcaatattgatcacaatgccaatgatcagtactaaagatttgtggacttgctgcttctaagttagttcatctgctttcctttttcctctgttaagcatgtcaggagaccagcagaattcctttaaaaatagtattcatgttgtcctcttg

SEQ ID NO: 2273 - DNA, 699 bp, Citrus clementina
atgacgggagtgaaaaggaagaaagggttttaactttcaatcgttctactacagtggctgaagctctgcgcatacgagctctctgtctctcttactaatttttgtttgctaccagtctcgtgaaggatttttcaattaagggtttcttaagttgcaaaatgtcaggcggccctgggcttgagtctcttgtagatcagcaaatatcagttatcacaaatgatggacgtaacatagtgggagtcttgaaaggatttgaccaggctacaaatataatccttgatgaatctcatgagcgtgtttactcgactaaggaaggtgttcagcaacttgtgttgggattgtacataataaggggtgacaacataagcatcgttggggaagttgatgaagagctggattctcatcttgacttgtccaatttgagagctcatcccctcaaaccagtgatccattaatggactgttaaaagatgtagagctgttgtggactcaatgaaggattagaacaaaaactgataaattttatgcattagatgtatttattacttctgaagtcttcgttttgatgttactgaaatttgtatattattgatgttaaaggaccagttaccgaacgttggggcaagattgatatcagctaaatcatagtcgtctgcgcttattcatatttttaagcaatgcagattgcatgaagtataag

SEQ ID NO: 2274 - DNA, 654 bp, Coffea canephora
cgagaactcctcgacgattttttttcgcaggttttagcatcagtttaccaagaagctgacaactaagtttcagctcactctgcaacatggcatctggacttgggcttgagtctcttgttgatcaaactatctcagttattacaaatgatggacggaatattgtgggagttctgagaggattcgaccaggctacaaacttgattcttgatgaatctcatgagagagtatattcaacaaaggaaggtgtacagcaacttgtgttaggtctttatatcataaggggagacaacataagcgtcgttggggaattagatgaagatcttgatagtaacttggatatgtcaaaactgagagcacatcctctaaagccagtcgttcactgacctgcaacttggtgtgagccttgtaatcctgtgaacggatgatggatggatcaaacatcagtttagttgatagactttggtacaactatcaaatgaaaacttcagacatgttatgtagctaggaacacaaactgttatagttcgttagtcgtcgttatatgtcttataagtttccctttctgatattggcttgcgaaagattttgaactttgtataactatcatattaaaactgcaggcatgtttctgtgcctaagagcacaagctgtttt

SEQ ID NO: 2275 - DNA, 850 bp, Cucumis sativus
aaaccctttcgtcttcctgactctcacgtactacaccttcttcttcttcttcacagttacccccggctcttcctttcagcagctcagtatcgcccccgtctttcttccgctcgtgccggcggcgttttcttctccttgtcctgccgcagccttccttttgttgtactgactttctactctctcttgctactgttaaagccgcaagcgtgaaattggaaaaaatcgaggctagttcatttctgaatctagccgagctgataacatagaatagctcccggcttattgtaagggtcttcaatatggcaagtggacctggacttgattctctggttgatcaaacaatatcagttatcacaaacgacggccgcaatatagtgggagtgttgaaagggtttgaccaggctacaaatattattcttgatgaatctcatgaacgtgtttactctaccaaggaaggcgttcaacaacttgttttgggtctatatataatccgaggcgacaatataagcattgttggggagctagacgaggaacttgattctaatctagacttgtccaaattgagagctcatcctctcaaacctgtgattcactaattggagcaggaagcaatgagtttgtgtttattattattatgagaagcttccactaaaacaagtcaagctgttatcggttctttttttggctttaacctctttcatcacctttcacagctttgcttagatagtgagtattatttgatgcttatggatattattaaatatttgaaagttaaatatttgagatgtttattacttgtggttgaatattttggtagagttaggtagttgttcaaataatgattcagtga

SEQ ID NO: 2276 - DNA, 930 bp, Cucumis melo
cttcctctcactctcacgtactccaccttcttctacttcacagtccccccccccccccccagcttttcctttcagcagctcagtatcgccgccgtttttcttccgctcgtaccggcggcgttttcttcagcttgtcctgccgcagccttccttttgttgtattgattttccactctctcgtgttactgttagagccgcaggcgtgaaattggaaaagatcgaggctagttcatttctgaatctagccgaggtgataatatagaatagctcccggttgcttatcttaaggtcttcattatggcaagtggacctggacttgattctctggttgatcaaacaatatcagtcatcacaaacgacggccgcaatatcgtgggagtcttgaaagggtttgaccaggctacaaatattattcttgatgaatctcatgaacgtgtttactcaaccaaggaaggcgttcaacaacttgttttgggtctatatataatcagaggggacaatataagcattgttggggagctagacgaggaacttgattctaatctagacttgtccaaattgagagctcatcctctcaaacctgtgatccattaattattggagccggaagctatgaatttgtgtttattatgagaagcttccattaaacaagtcaagctgttatccattctttttttggctttaacctctttcaccacctttgacagctttgcttagatagtgagtattatttgatgcttatggatattattaaatatttgaaatttaaatacttgagatatttattatttgtggttgaatattctggtacagttaggtagttgttcaaataatgattcagtgatcgagtcttagtttctaatactaaagctttaattattgacaaattgtataaatattttcccaagttcatcaaattgaacaagcact

SEQ ID NO: 2277 - DNA, 688 bp, Glycine max
cgaaatgagtctgcgactgagaagtgcgacgctgctgcaaagtgcaagcggatttggtcttcttctttactcccaatcatttctctgtgcaaggataagtgtgttatctatctaaaaacacaagatgtcagctgggcctggacttgaatctctagtagatcagacaatttcagtcattacaaatgatggacgaaatatagtgggagtcctgaaaggttttgaccaggcaacaaatattattcttgatgagtcccatgaacgggtttattctacaaaggaaggtgtgcaacaacttgttcttggtttgtacatcatcaggggtgacaatataagtgttgttggtgaactggatgaagaactagattctagtctggatttgtcaaaactcagagctcatcctttgaaacctgttatccattgaagtgaaatactatgtgccggatttaatgaatgtatgcctacttggtggaaacagtcttagatttgcggcattgtatactagagtacgttgtgaaactctataagaatatgcagacagcataatatttctaatattctgattctgttagcatgtaagtcttgtcaaacaaacaaattctgagactatttgatgtgaaaaaactatcttctatttggccattgttttacatatagatgtttctttcagtgggagacttatatggtggct

SEQ ID NO: 2278 - DNA, 903 bp, Glycine max
aacacacttgttattttttgtctttcgaaccctttctgctcccattcgatcctttgtggctcattgtattcgaacgaaccctaacaacgtctgtggctctgtgtgagactgcgagccacgaacccaatctccgacgacgacgacctcggtccagggacgacttatctccggagacccacaacttttccggcgaccaaccgtgcgcaggtgcaaggataagtgtgtgatctatctataaacgcaagatgtcagctgggcctggacttgaatctcttgtagatcagacaatttcagtcattacaaatgatggacgaaatatagtgggagtcctgaaaggttttgatcaggcaacaaatataattcttgatgagtcccatgaacgagtttattctaccaaggaaggtgtacaacaacttgttcttggtttatacatcatcaggggtgacaacataagtgttgttggtgaactagatgaagaactggattctagtctggatttgtcaaaactcagagctcatcccttgaaacctgttatccattgaggtgaaatactatgtgatggatttaatgaatgcatgcctacttggtggaaagagtcttagatttgcggcattgtatactagagtaggctgtgaaactctaagaatatgccgacagcataatatttctaatattctgattctgttagcatgtaactcttgtcaaacaaacaaattctgagactatctgacgtgaagaaactatcttctaattggccattattatacatatagatatagatgtttctttcggtgagacttatatgattgctacacgaatgtatcttatataagaaagtgcatttactatttatacatgtgtcaccgatgatctttgtcaaaaggcatgatttcttttaattgc

SEQ ID NO: 2279 - DNA, 794 bp, Solanum lycopersicum
gtctcactctcctcctcagttcgagtttcgagaactcctcgacgattttttttcgcaggttttagcatcagtttaccaagaagctgacaactaagtttcagctcactctgcaacatggcatctggacttgggcttgagtctcttgttgatcaaactatctcagttattacaaatgatggacggaatattgtgggagttctgagaggattcgaccaggctacaaacttgattcttgatgaatctcatgagagagtatattcaacaaaggaaggtgtacagcaacttgtgttaggtctttatatcataaggggagacaacataagcgtcgttggggaattagatgaagatcttgatagtaacttggatatgtcaaaactgagagcacatcctctaaagccagtcgttcactgacctgcaacttggtgtgagccttgtaatcctgtgaacggatgatggatggatcaaacatcagtttagttgatagactttggtacaactatcaaatgaaaacttcagacatgttatgtagctaggaacacaaactgttatagttcgttagtcgtcgttatatgtcttataagtttccctttctgatattggcttgcgaaagattttgaactttgtataactatcatattaaaactgcaggcatgtttctgtgcctaagagcacaagctgttttagtttacctctcatcttctgtttaagctggatagccgaacttaatgtctctgttaaaaaggtgtttattgtttttacagaacgagaaaatgatcaaattggtccttaatgtg

SEQ ID NO: 2280 - DNA, 795 bp, Solanum lycopersicum
cgtctcactctcctcctcagttcgagtttcgagaactcctcgacgattttttttcgcaggttttagcatcagtttaccaagaagctgacaactaagtttctgctcactctgcaacatggcatctggacttgggcttgagtctcttgttgatcaaactatctcagttattacaaatgatggacggaatattgtgggagttctgagaggattcgaccaggctacaaacttgattcttgatgaatctcatgagagagtatattcaacaaaggaaggtgtacagcaacttgtgttaggtctttatatcataaggggagacaacataagcgtcgttggggaattagatgaagatcttgatagtaacttggatatgtcaaaactgagagcacatcctctaaagccagtcgttcactgacctgcaacttggtgtgagccttgtaatcctgtgaacggatgatggatggatcaaacatcagtttagttgatagactttggtacaactatcaaatgaaaacttcagacatgttatgtagctaggaacacaaactgttatagttcgttagtcgtcgttatatgtcttataagtttccctttctgatattggcttgcgaaagattttgaactttgtataactatcatattaaaactgcaggcatgtttctgtgcctaagagcacaagctgttttagtttacctctcatcttctgtttaagctggatagccgaacttaatgtctctgttaaaaaggtgtttattgtttttacagaacgagaaaatgatcaaattggtccttaatgtg

SEQ ID NO: 2281 - DNA, 579 bp, Amsonia hubrichtii
gcttctcctctaatcagaaaagcttggttagcaggttgcttgagagaggctgttggaaacgtgcagtaagacttgctaaagatagaagccatttcttaaagaatccattcattatttgtgttggagattcagatatggcaactggacctgggcttgagtctctcgtagaccagacaatttcagttatcacaaatgatggtcgtaatatagtgggcatattaaaaggttttgaccaagctacaaatattattcttgatgaatctcatgagcgggtgtattccaccaaggaaggtgttcagcaacttgtattaggcctttacatcataaggggtgacaacataagcattgtcggtgaattggatgaagagttggatgcaaatttggatttatcaaaactgagagctcatcctctgaaacctgttatccattgatttgggaacatctataagaatgggatttaagagctgccaaggttgttacagaacgaaggagctatgtattgcttgtacttatttagctaaaacttttgccttgttcatctgttttactagagctttgttcattataacagtcttccat

SEQ ID NO: 2282 - DNA, 794 bp, Gossypium hirsutum
ttatttgattaaaaatgattgaatatattaattatggaatcttggagcctgcacactaccaaatttcaatgcgttagtttctttatcatccttttcccctctcactaccctaacgcagccgacatactttggaaaacccgacccaacaaatattcggtccctaactcaactctgaagccgctccattcccagatattgtaattcactgctttcaaaagcatcgaaatgtcaactggccctgggctcgagtctcttgtagatcagactatctcggtcattaccaatgacggacgtaacatagtgggagttttaaaaggctttgatcaggctacaaatatcattctcgatgaatctcatgaacgcgtatactccaccaaggaaggtgttcagcaacttgtgttgggcttgtacataataagaggtgacaacataagtgttgttggtgaactggatgaagagctggattctgcactcgacttgtcgaacctgagagcacatcctttgaagccagttatccattgattgaactgctaaaagttgtagagttatttttaaggacagcttgttggattgaataccttaaaagaaccaaagtgtaatgaatgataatatcaatgtgtattaagttttggatgcatttctatgttatattttgtatgccaattgttttccttttaagccttctggtataagatgatgctaaaagaactcatcaccatcatcaatggcagccgcaatttgatgataacgaccagaatctgatgatcctcccccagtctccaatgaactgactg

SEQ ID NO: 2283 - DNA, 560 bp, Gossypium hirsutum
tttccccctctgccctaacccagccggcatactttggaaacccgacccgaaaaatattcgggttcctaactgatcccttcagcttctccatactcagagctttgaaatgtcaactggccctggacttgagtctcttgtagatcagacaatctcggtcatcacgaatgatgggcgcaacatagtaggagtcttaaaaggctttgaccaggccacaaatatcattctcgatgaatctcatgaacgtgtgtactccaccaaggaaggtgttcagcagcttgtattgggtttgtacataataagaggcgacaacataagtgttgttggtgaactagatgaagagcttgattctgctcttgacttgtcaaaccttagagcgcatcctctgaagcctgttatccattgattgaacaatgaaagctcatagagttgctatagacagcatgttggattaaattccttagacaacatgttaaaagaacctatcatgatgatgagaaacccaatatgtattaattttttgatgcatttttatgttatattttattggtagcaaaaaagaa

SEQ ID NO: 2284 - DNA, 595 bp, Gossypium hirsutum
cccctcctgccctaacccagccggcatactttggaaacccgacccgaaaaatattcgggttcctaactgatcccttcagcttctccatactcagaccttttagttcttccatgtgacatgcataattgatagtcacatttactgctttttcagagctttgaaatgtcaactggccctggacttgagtctcttgtagatcagacaatctcggtcatcacgaatgatgggcgcaacatagtaggagtcttaaaaggctttgaccaggccacaaatatcattctcgatgaatctcatgaacgtgtgtactccaccaaggaaggtgttcagcagcttgtattgggtttgtacataataagaggcgacaacataagtgttgttggtgaactagatgaagagcttgattctgctcttgacttgtcaaaccttagagcacatcctctgaagcctgttatccattgattgaacaatgaaagctcatagagttgctatagacagcatgttggattaaattccacaacatgttaaaaagaacaatatcatgatgatgagaaaccaatatgtattaatttttgatgcatttttatgttatatttta

SEQ ID NO: 2285 - DNA, 744 bp, Linum usitatissimum
gaaggagaaatagtttagtcgcttgttaaaactagtctcgctctccgctctccggccagcagtgggggcgctcctccacctcttctcctctcgagctcctctccggcttcgctgggaagtcacgtgctagttatagcagattcgtgtctcagccagcaattcttaagagtttccgaatggcttccggtcttggactcgaatctcttgttgaccaaaccatttctgtgatcacaaatgatggccgcaacatagtgggcaacttgaaaggcttcgatcaggccactaatatcatcctcgatgaatcccatgaacgtgtttactccaccaaggaaggcgtgcaacaactggttttgggcttgtacataataaggggtgataatataagcgtgattggggagcttgacgaggaacttgatgcgcagcttgatatgtcgaatctcagagcacatcccctcaaacctgtgattcattgatcactggctcttagcatttggagtttctctttttgtagaccaactgatggatggattagccagctattgttctaaggagtcgatgtatcgagtgagaacagtcgacagtgaattaccttgaatattgtttggttctggaacatgtttcaactggatatcgtcgttcaaggataatactctgattaggtttaaatacactcgttaaggtggttcacctaatgatcatgtgtcttggtttaaagaatagaggaaaggggtaggaagtggtgtc

SEQ ID NO: 2286 - DNA, 744 bp, Linum usitatissimum
ggaacgtcgttggttcaattccagtctcgctctccgctctccggccaccagtggtggcgctcctccacctcttctcctttcgagctcctctccggcttcccaggattgtcacgtactaggttttccgctttcctccttcgttttgtaactcgactcaggtacttcagtttgtcagctcagtcggacgaactcccgtaaggttctggaagattcgcaactgggttagcagattcgtgtctcaaccagcaattcttaagagtttcagaatggcttctggtcttggactcgaatctcttgttgaccaaaccatatctgtgatcacaaatgatggccgcaacatagtgggcaacttgaaaggcttcgatcaggccacaaatatcatcctcgatgaatcccatgaacgtgtttactccaccaaggaaggcgtgcaacaactggttttgggcttgtacataataaggggtgataacataagcgtgattggggagcttgacgaggaacttgatgcgcaccttgatatgtcgaatctcagagcacatcccctcaagcctgtgattcattgatcagtggctctttatcattcccagtttctctttttgtagacaaactgatggatggattagccagttattgttttaaggacacgatgtattgagttagaacggtcaccaggaaactataatcctaatggaaactgggaaacagaaacttaaatcaacggatatcaacaggcacaattctccc

SEQ ID NO: 2287 - DNA, 533 bp, Gossypium raimondii
ctctcactaccctaacgcagccgacatactttggaaaacccgacccaacaaaaatattcggtccctaactcacctctgaagccgctccattcccagatattgtaattcactgctttcaaaagcatcaaaatgtcaactggccctgggctcgagtctcttgtagatcagactatctcggtcattaccaatgatggacgtaacatagtgggagttttaaaaggctttgatcaggctacaaatatcattctcgatgaatctcatgaacgcgtatactccaccaaggaaggtgttcagcaacttgtgttgggcttgtacataataagaggtgacaacataagtgttgttggtgaactggatgaagagctggattctgcactcgacttgtcgaacctgagagcacatcctttgaagccagttatccattgattgaactgataaaagttgtagagttatttttaaggacagcttgttggattgaataccttaaaagaaccaaagtgtaatgaatgataatatcaatgtgtattaagttt

SEQ ID NO: 2288 - DNA, 747 bp, Gossypium raimondii
aaactaactattttcaatgctcttgtttgtttcccccttttcttttccccctctgccctaacccagccggcatactttggaaacccgacccgaaaaatattcgggttcctaactgatcccttcagcttctccatactcagaccttttagttcttccatgtgacatgcataattgatagtcacatttactgctttttcagagctttgaaatgtcaactggccctggacttgagtctcttgtagatcagacaatctcggtcatcacgaatgatgggcgcaacatagtaggagtcttaaaaggctttgaccaggccacaaatatcattctcgatgaatctcatgaacgtgtgtactccaccaaggaaggtgttcagcagcttgtattgggtttgtacataataagaggcgacaacataagtgttgttggtgaactagatgaagagcttgattctgctcttgacttgtcaaaccttagagcacatcctctgaagcctgttatccattgattgaacaatgaaagctcatggagttgctatagacaacatgtattaattttttgatgcattttttgttatattttattggtagctgtttaaatgcttcatttatattgatcatgagctagcataaaaggtgaaaattttgaatgctgatatctaatctaggactcaatgtaagggctgcaaattcaactgaaaataaatgaactttctgatttgcgaaaatccaatgtcatatgtacaaatta

SEQ ID NO: 2289 - DNA, 594 bp, Phalaenopsis aphrodite
caattttctatctcgcgtttacacttgcagcggccttgctgtcggtcgagccgttaagaaaagttgtcgaaactcacgccggaggacttcgccgtttcccgccgcagtcctcacactcgaaatctctttgggcttgtcattcacgtggtccagtgatagagctattccgttacaaagaattgtgcaaatctaactgaaacaggatgtcaactggtccaggccttgagtctcttgtagaccagacaatatcagtgataacaaatgatgggcgcaatatcgtgggaatcttgaaaggctttgatcaagcaacaaatatcattcttgatgaatcccatgaacgggtttactccactaaggaaggcgtccaacaacttgttctagggttgtatatcatcagaggagataacataagcgtggttggagaactagatgaagaactagacgctaatctggatttgtctaaactgagggctcaccctctcaagcctgtcattcattgaagccaaagccaagttagtaatggaatgtttgttggattcatttcttctttatatggatcaattatgtatttacaattaatccttgatgttttta

SEQ ID NO: 2290 - DNA, 661 bp, Amborella trichopoda
  misc_feature (552)..(552): n is a, c, g, or t
  misc_feature (586)..(586): n is a, c, g, or t
ggtttctggtgaaatggcgagcttcctgctgggttgataaatagagcaatggtaactgtgatttgtagagactgttgagtatttgcagatacagagtatttgcagagacagaaggctttctaattttccgagaagttttcgctctctaattaagacaagattgactacacgtgatttaaaatctactgaaaggacggcgttaagatttactcagaatgtcaagtggtcctgggcttgagtctcttgtggaccaaactatatcagttatcacaaatgatgggcggaacatagtgggcattttgaaaggttttgatcaggccacaaatatcatcctcgatgaatcacatgaacgagtttactccacaaaggaaggagttcagcagcttgttcttggcctgtacatcatccgtggagataacataagcgtaatcggagagttagacgaggaacttgattcaaatctcgacttgtcaaaactgagagcacatcccttgaaacctgtgatacactgagagttgtaagatattccagatttatagtgtaggattgtcntgtatgaagcagcatgtgcacctggatgtctttngattgattgatatatcatgcctgggcaagctttgagaatccctggagccttgagttatgaaatatcctcatgaat

SEQ ID NO: 2291 - DNA, 672 bp, Hordeum vulgare
cagcgagattcgattcgaccagcgccgccgccgccgccgccgccgccgtcgcccaatcccaatcctctcctctcaaccctagcgagagagatcagacagcacaaagggggatggcgacgctcgagtccctcgtcgaccaggtgatctccgtcatcaccaacgacggccgcaacatcgtggggactctgcgggggttcgaccaggccaccaacatcatcctcgacgagtcccacgagagggtctactccaccaaggagggagtacaacagcttgtcctcggactgtacatcatcaggggcgacaacataggcgtggtgggtgaggtggacgaggagcttgacgcggcgctggacatgtcgaagctcagagcgcagcccctcaagccggtcatccactgaagatgatggtatcttctatcgatctgatcctgattgtgcaagccaaagctgattttgctcagtcaatctgtactgtaggttaatcgattgatcgcttgctcatatctcatatctcataccatgcaccgagagcgtgcgtcttcttgtatgatgaaaacaacatggtttgctgtgtcgatcgaacggtcatgctcttgtatgtgagagagagatacatgtatctctgtaagcgtaagtaatgaatgaacgaatgaagcaggcaattaaatgttag

SEQ ID NO: 2292 - DNA, 835 bp, Phaseolus coccineus
attctcacaagaaatattcgtgttgtttgttgccaaagggaaactgcgaaaccaaaacccttcctaagaccctgccaccgtcacgcacgccgtccgccgccgtgctctttgtcgccaccgacgccgcgcgatttcaggtgtgagagtgtgttacctagccaaaaagcaagatgtcagctgggcctggacttgagtctcttgtagatcagacaatttcagtcattacaaatgatggacggaatatagtgggagtcctgaaaggttttgaccaggccacaaatataattcttgatgagtcccatgaacgagtttattctacaaaggaaggtgtacaacaacttgttcttggtttatacatcatcaggggtgacaacataagtgttgttggtgaactggatgaagatctggattctagtctggatttatcaaaacttagagctcatcccttgaaacctgtcatccattgagtggaaatactctgtttgggtttttaatgaatgcatgtctgctgggtggaaagggtgagttttgcggcactttatactcaagtgcgctgtgaaactctttaagaatatgcatatagcataacttttctgatattatgattccattagtatgtaagttttgtcaaaacaaattaatgaaacaaatttgtgactatctgacgtgaagaaactgtcttctatttggtcattaatacataatgaaaaatgtttctttcaatgcgagctatgtctaatggcgctaaacaaacgcatctatgaaaaaatgcatttactgttgtacctataaacaatgattatatttgtgaacaggtgtggtttcttataattgc

SEQ ID NO: 2293 - DNA, 785 bp, Phaseolus coccineus
tggccggggggaaagtaattcgtgttgtttgttgccaaagggaaactgcgaaaccaaaacccttcctaagaccctgccaccgtcactcacgccgtccgccgccgtgctctttgtcgccaccgacgccgcgcaatttcaggtgttagagtgtgttacctagccaaaaggcaagatgtcagctgggcctggacttgagtctcttgtagatcagacaatttcagtcattacaaatgatggacggaatatagtgggagtcctgaaaggttttgaccaggccacaaatataattcttgatgagtcccatgaacgagtttattctacaaaggaaggtgtacaacaacttgttcttggtttatacatcatcaggggtgacaacataagtgttgttggtgaactggatgaagatctggattctagtctggatttatcaaaacttagagctcatcccttgaaacctgtcatccattgagtggaaatactctgtttgggtttttaatgaatgcatgtctgctgggtggaaagggtgagttttgcggcactttatactaaagtgcgctgtgaaactctttaagaatatgcaaatagcataacttttctgatattatgattccattagtatgtaagttttgtcaaaacaaattaatgaaacaaatttgtgactatctgacgtgaagaaactgtcttctatttggtcattaatacatgatgaaaaatgtttctttcaatgcgagctatgtccaatggcgctaaacaaacgcatctatgaaaaaatgcatttactgttg

SEQ ID NO: 2294 - DNA, 1672 bp, Theobroma cacao
gtacagatgaaggtcccatgataaacactaaaccatgcaagaacttttgttaagattggcaattccttttccaatattgatcagtaaagttggtaccaatgctgaaaattggtgttgccacatgctttgggtacttgtttttaacaagaagagccaattctggggaaagaaaatgaagcttttgcctatcttgcaaagcctactgatagcctttcctagttgatccaatcttccaattttaacactttaggtcccatgacagatactaatcatcaaattttggttttttaatgagattatatttagatacttgccagcttactgactgcaaggtgaaaatgccacgtcattcttaaaataaatttaccaacagcaaagattaagccacgtcgtcaccttccaaagaagaagcccacactcccattaaatatcaatccttcgctcccccttcttccttttccgtctctctaccctaactcagccgacatactttaaaatcaagaccccgacaacccgacccgataaatattcggctcctaaaagctgctccatactcagagagtatggcgttggaacctatcgataactaagtcttagtagtggactgaaatcttgtgaggttttgaggagtcgtgatgtatttgcccgtgttacttgtcaatgaattatgtaggtggaacttctgttcttatctgttgaagtacagaattgatgaagatactatgcagggggttttattcctgtatttttgtcatatatcttatctacttttttcccatgcataaatctgtattcaggaacttatgtcttccatcttcccttgtgcagaaaattgtcatcctgtcttgctgatcaaatttactgcttttgaagcttcaaaatgtcaactggccctgggcttgagtcacttgtggatcagacaatctcagttattacaaatgatggacgcaacatagtgggaattttaaaaggctttgaccaggccacaaacatcattcttgatgaatctcatgagcgtgtgtactccactaaggaaggtgttcaacaacttgtgttgggtttgtacataataagaggtgacaacataagcgttgttggtgaactagatgaagagcttgattctgctcttgacttgtcaaacctgagagcacatcctctgaagcctgttatccattgattgaaatatggaaagttgtagagttgctatggacagcatgttggattaaatacctgataaaacgtggcaaagaacagaaatagaaagacgagaaacctaatgtgtagtaatttttcaatgcatttctatgtcatttgggtagttgttttcaagctccattcctattttggtcatgctttatgtttcataactctttgtgtgtggcatgttctgtatctgcatgtgcatatcctaagataatgttagatgaaaagcgcaaagcttctgatcaaaccgctactagagtgaaacttaatagtgtgaaaaaatcagttatgcgggaagtgaaatactatattcattcggtgaagaaaaatagctttaactatttgtcatacagagtggtacttgtatgcagttatgagcagcaaaatgtcaagatagtttgaagatcctggttgaggctggagagccaaaaacgtttgaatatgaaggcatgtaccattgacagactca

SEQ ID NO: 2295 - DNA, 870 bp, Citrus sinensis
gaaaaggaggaaagggttttaactttcaatcgttctacagtggctgaagctctgcgcatacgagctctctgtctctcttactaatttttgtttgctaccagtcttgtgaaggatttttcaattaaggggttcttaagttgcaaaatgtcaggcggccctgggcttgagtctcttgtagaacagcaaatatcagttatcacaaatgacggacgtaacatagtgggagtcttgaaaggatttgaccaggctacaaatataatccttgatgaatctcatgagcgtgtttactcgactaaggaaggtgttcagcaacttgtgttgggattgtacataataaggggtgacaacataagcatcgttggggaagttgatgaagagctggattctcatcttgacttgtccaatttgagagctcatcccctcaaaccagtgatccattaatggactgttaaaagatgtagagctgttgtggactcaatgaaggattagaacaaaaactgataaattttatgcattagatgtatttattacttctgaagtctttgttttgatgttactgaaatttgtatattattgatgttaaaggaccagttaccgaacgttggggcaagattgatatcagctaaatcatagtcgtctgcgcttaaaaaaaaaagcaaaaatatagcatcactctataaaacaaagattagaaaccaaactctccaataataaaataagatataaaaataaaacaaggggcggcgcctctaaagagacaaacttaggacagcggggtggcaaatacaaacctcttaaaagggacaccaatttcaattgcgggcccctttttatacacgccgggatggaaaaacccgcggttaccaaatt

SEQ ID NO: 2296 - DNA, 611 bp, Coffea canephora
cgaaaaaaattcgatactgagcacaagaattttgcagggcctcctctggaattcccgtggcttcttttctctactgcaaagacatcctcataaagttataaacatcagcattcaacaaaatccagtgttatttgtattggatttcccgaatgtctggggggccaggacttgagtctcttgtagaccaaacaatttctgttatcacaaatgatgggcgcaacatagttggaatattgaaaggttttgaccaggctaccaatataattcttgatgaatctcatgagcgtgtgtattctacaaaggaaggtgtccagcaacttgtattgggtctctacatcattaggggtgataatataagcatcgttggtgaattagatgaagagttagatgcaaacttggatttatccaaactgagagctcatcccttgaagccagtaattcattaacctagaagaaacatgtataagcatgcaaactaagaattcctagctttcaaaggaccaagattactatgtcttacttgtgtgtaacatgcaaggccaaacttgttgcctgaattgatatcgttacttgggtactgttcattcctgaattatctagtgcgatgagat

SEQ ID NO: 2297 - DNA, 912 bp, Gossypium hirsutum
acactaccaaatttcaatgcgttagtttctttatcatccttttcccctctcactaccctaacgcagccgacatactttggaaaacccgacccaacaaatattcggtccctaactcaactctgaagccgctccattcccagatattgtaattcactgctttcaaaagcatcgaaatgtcaactggccctgggctcgagtctcttgtagatcagactatctcggtcattaccaatgacggacgtaacatagtgggagttttaaaaggctttgatcaggctacaaatatcattctcgatgaatctcatgaacgcgtatactccaccaaggaaggtgttcagcaacttgtgttgggcttgtacataataagaggtgacaacataagtgttgttggtgaactggatgaagagctggattctgcactcgacttgtcgaacctgagagcacatcctttgaagccagttatccattgattgaactgctaaaagttgtagagttatttttaaggacagcttgttggattgaataccttaaaagaaccaaagtgtaatgaatgataatatcaatgtgtattaagttttggatgcatttctatgttatattttgtatgccatttgttttccttttaagccttcaggtataagatgatgctaaaagaactcatcaccatcatcaatggcagccgcaatttgatgataacgaccagaatctgatgatcctcccccagtctccaatgaactgactggagaatcagcatcattggttaacaacacaggcgctctgcaaatggggcattagagtagagtgagggtgaagccacatatcaatgcattcaatgtggaaaccatggccgcactcgggcgagttccttccaacatcattatactcgaacggacttaaacacgacctgcgcgg

SEQ ID NO: 2298 - DNA, 629 bp, Gossypium hirsutum
cctaacccagccggcatactttggaaacccgacccgaaaaatattcgggttcctaactgatcccttcagcttctccatactcagagctttgaaatgtcaactggccctggacttgagtctcttgtagatcagacaatctcggtcatcacgaatgatgggcgcaacatagtaggagtcttaaaaggctttgaccaggccacaaatatcattctcgatgaatctcatgaacgtgtgtactccaccaaggaaggtgttcagcagcttgtattgggtttgtacataataagaggcgacaacataagtgttgttggtgaactagatgaagagcttgattctgctcttgacttgtcaaaccttagagcacatcctctgaagcctgttatccattgattgaacaatgaaagctcatggagttgctatagacaacatgtattaattttttgatgcattttttgttatattttattggtagctgtttaaatgcttcatttatattgatcatgagctagcataaaaggtgaaattttgaatgctgatatctaatctgggactcaatgtaagggttgcaaattcaactgaaaataaatgaactctctgatttgacgaaaaaagaaaaagtaccgactgcg

SEQ ID NO: 2299 - DNA, 974 bp, Vigna unguiculata
caaactccattattatcgttgtcactttcatccaaattccaaaacccagacaaggcttaaaggtattagggttttctttctccattattatcgttgccactgccagacttattccttcattcctctcacactctcttctcctcctcctccaccacccgcgttttgggaaaccagaagagagcaccctcgtttctcctccacccacgtcaagaaacacgaaggcagagtgcaggccattcacggcgtctcctttctcctccaccgtgacatccaccacgtcgctggcaggggcagcagcgagagaacgcagcgccaccatcggactgcgattgacggacgattccgaccgccacgaccaccacgaacacaggggtgagattgttatctagctaaaaagcatgtcagctgggcctggacttgagtcccttgtagatcagacaatttcagtcattacaaatgatggacggaatatagtgggagtcctgaagggttttgaccaggccacaaatataattcttgatgagtcccatgaacgtgtttattctacaaaggaaggtgtacaacaacttgttcttggtttatacatcatcaggggtgacaacataagtgttgttggtgaactggatgaagatctggattctaatctggatttatcaaaacttagagctcatcccttgaaacctgtcatccattgagtgaaaagagtgggttttgcggcactttataccaagtacgctgtgaaactctctaagaatatgcagataacagaacttttctaatattctgattctattaagcatgtaagttttgtcaaacaaatgaatgcaacaaatttgtgactatctgacgtgaagaactgtcctctatttggttaaaattgatacggaagttatttacaagtgaaaaatgtgtatgattatagttattttaaaaaacttatattttacaaaaaggaaaaactctttcttttttca

SEQ ID NO: 2300 - DNA, 563 bp, Heritiera littoralis
ctctctctaccctagctcagccgacatactctgaaaaacccgacccgattcggttcctagctgacctcttaagctgctccattttcagaaaattgtcatcccgtcttgctaatcaaatttactgcttttcaaagcttcaaaatgtcaactggccctgggcttgagtctcttgtagatcaaacaatctcggtcattaccaatgatggacgcaacatagtgggagttttaaaaggctttgatcaggccacaaatatcattcttgatgaatctcatgaacgcgtgtactccaccaaggaaggtgtccagcaacttgtgttgggtttgtacataataagaggcgacaacataagtgttgttggtgaactggacgaagagcttgattctgcacttgacttgtcaaacctgagagcacatcctctgaagcctgttatccattgatcgagctatgaaagttgtagagttgctaaggacagcatgttggattaaatacctaagaaaacatgtcaaagaacagaagtataatgatgagaaactcaatgtgtactaattttggatgcatttct

SEQ ID NO: 2301 - DNA, 794 bp, Quercus alba
ttagctttaggctttagctgtaacaaaaatcgaaagggagagagagagagagtgttgagactgaggggaaactcggcgctgggcatttactgtagctttttgctcgcacgcaaaagcagaaaaaattggttcataacctatcttgtagaggagtctctcgtatagattttgggagcctcaaaatgtcaggtggccctggacttgaatctcttgtagatcaaacaatatcagttatcacaaatgatggacggaacatagtgggagtcttaaaaggctttgaccaggctacaaatattatccttgatgaatctcatgagcgtgtctactccacaaaggaaggtgttcaacagcttgtgttgggtttgtacataatcaggggtgacaacataagcgtagttggggagctcgatgaggagcttgatgctcatcttgatttgtcaaaactgagggctcaacctctcaagcctgttatccattaaaagactaagaaaggtgcaagttgttatgaccatgaccatgtgagtgattattacctacaaagaacatgcagggtagttttcggtcgttctgaatattctatatgcgcatatttgtaatattgataaaaaagagctttatgtcaatttctcctaatcaaatgaatcattttccaagccccaatcagttctctaacatgatctagcgataagcccatgttgtggatgctttggaatgcttttgttttattggtaaggccctatttgttttgggggaaaatgattgtgaaaaatatttttagtgaaaagtgcattttg

SEQ ID NO: 2302 - DNA, 701 bp, Citrus sinensis
gtatgacggaagtgaaaaggaggaaagggttttaactttcaatcgttctactacagtggctgaagctctgcgcatacgagctctctgtctctcttactaatttttgtttgctaccagtcttgtgaaggatttttcaattaaggggttcttaagttgcaaaatgtcaggcggccctgggcttgagtctcttgtagaacagcaaatatcagttatcacaaatgacggacgtaacatagtgggagtcttgaaaggatttgaccaggctacaaatataatccttgatgaatctcatgagcgtgtttactcgactaaggaaggtgttcagcaacttgtgttgggattgtacataataaggggtgacaacataagcatcgttggggaagttgatgaagagctggattctcatcttgacttgtccaatttgagagctcatcccctcaaaccagtgatccattaatggactgttaaaagatgtagagctgttgtggactcaatgaaggattagaacaaaaactgataaattttatgcattagatgtatttattacttctgaagtctttgttttgatgttactgaaatttgtatattattgatgttaaaggaccagttaccgaacgttggggcaagattgatatcagctaaatcatagtcgtctgcgcttattcatatttttaagcaacgcagattgcatgaagtataag

SEQ ID NO: 2303 - DNA, 852 bp, Cajanus cajan
acatctcgcgttttgttaaaagaagaattaggcattggtcctaaaccctcgaattactgaactgggttacgttcctcttcctcgttgcagcgtctaccctctgcgatccacccttgttcttcgaaaggtttgagaacaagtgtgttagctatctagagacgcaagatgtcagctggtcctggacttgagtctcttgtagatcagacaatttcagtcattacaaatgatggacgaaatatagtgggagtcctcaaaggttttgaccaggcgacaaatataattcttgatgagtcccatgaacgagtttattctacaaaggaaggtgtgcaacaactagttctaggtctgtacatcatcaggggcgacaacataagcgttgttggtgaacttgatgaagatctggattctagtctggatttgtcaaaactcagagctcatcccttgaaacctgtaatccattgagatgaaataccatgtattggcggaaacaatcttgagttttgcgacattatatactagaggacgctgtgaaactgtctaagaatatgcagacaccataatatttcaaatattctgatactgttagcatgcaagtcttgtcaaacaaatgaatgcaacaaattctgcgactatctgacgtgaagaaactatcttctatggccactattatacatatataaatgtttcttagtaggggtgcgtgctcatgggtaggttatttatttaaataatctaaccattaccatttaataactatatctataaatagttatgataacttaatcataaccagttatgatttagaataacctgttttaaatttttaataaccggttatataatcgattatta

SEQ ID NO: 2304 - DNA, 880 bp, Cajanus cajan
agtatagagacatctcgcgttttgttaaaagaagaattaggcattggtcctaaaccctcgaattactgaactgggttacgttcctcttcctcgttgcagcgtctaccctctgcgatccacccttgttcttcgaaagtttatacaggtttgagaacaagtgtgttagctatctagagacgcaagatgtcagctggtcctggacttgagtctcttgtagatcagacaatttcagtcattacaaatgatggacgaaatatagtgggagtcctcaaaggttttgaccaggcgacaaatataattcttgatgagtcccatgaacgagtttattctacaaaggaaggtgtgcaacaactagttctaggtctgtacatcatcaggggcgacaacataagcgttgttggtgaacttgatgaagatctggattctagtctggatttgtcaaaactcagagctcatcccttgaaacctgtaatccattgagatgaaataccatgtattggcggaaacaatcttgagttttgcgacattatatactagaggacgctgtgaaactgtctaagaatatgcagacaccataatatttcaaatattctgatactgttagcatgcaagtcttgtcaaacaaatgaatgcaacaaattctgcgactatctgacgtgaagaaactatcttctatggccactattatacatatataaatgtttcttagtaggggtgcgtgctcatgggtaggttatttatttaaataatctaaccattaccatttaataactatatctataaatagttatgataacttaatcataaccagttatgatttagaataacctgttttaaatttttaataaccggttatataatcgattatatttttaaaaca

SEQ ID NO: 2305 - DNA, 681 bp, Solanum phureja
gtctcactcttcccctcagttcgactttcgagaactcctcgacgattttttcgcaggtttaagcatcagtttaccaagaagctgacaactaagtttctgctcactctgcaacatggcaactggacttgggcttgagtctcttgttgatcaaactatctcagttattacaaatgatggacggaatattgtgggagttctgagaggattcgaccaggctacaaacttgattcttgatgaatctcatgagagagtatattcaacaaaggaaggtgtacagcaacttgtgttaggtctttatatcataaggggggacaacataagcgtcgttggggaattagatgaagatctggatagtaacttggatatgtcaaaactgagagcacatcctctaaagccagtcgttcactgacctgcaacttggtgtgagccttgtaatcctgagaacggatggatggatcaaacatgagtttagttgaaatactttggtacaactatcaaatgaaaacttcagacatgttatctagctaggaacacaaactgttttagttcgttagtcgtcgttatatgtcttatatgtttccctttctgatattggcttgcgaaagattttgaattttgtacaactatcaaattaaaactgcaggcatattctgtgtctaagagcacaaactgttttagttt

SEQ ID NO: 2306 - DNA, 551 bp, Fagus grandifolia
gttgccacataagcatctcaggagctaccatatcagcaaaacgcagagttttatggagtttaaacaatcggcggcgaaaaatagtcccagataaaactgtgcgttgcttccgaacaagtttctcgctttttcagtaaatttgattcataacctatttttgtagaggagtcactgatatattgattctgggagcttcaaaatgtcaagtggccctggacttgaatctcttgtagatcaaacaatatcaattatcacaaatgatggacggaatatagtgggagtcctaaaaggctttgaccaggctacaaatattatccttgatgaatctcatgagcgtgtctactccacaaaggaaggcgttcaacaacttgttttgggtttgtacataatcaggggtgacaacataagcattgttggggaactggatgaagagcttgattctcatcttgatttgtccaaactgagagctcatcccctcaagcctgtcatccattaactgactaggaaaggtgcaaagctgttacagacaatgtgtatgaatgaacaattaa

SEQ ID NO: 2307 - DNA, 626 bp, Bupleurum chinense
aaaatctgctgctgtgccggacctctcgcagtatacagtcaagtagcattaggcatcagtcattgctgaagtaaaggcagttattggattttggtggtctgtacagaatgtcgggtggggctggacttgaaaatcttgtagatcaaatcatttccgtgataacaaatgatgggcgcaatatattgggaattttaaaaggttttgatcaggccaccaatataattctcgatgaatcccatgaacgtgtttattccacaaaggaaggcgtccagcaacttgtgctaggtctgtacatcatcaggggggataacataagcattgttggggaggtagatgaagagctggacgcaagcctcgatctttcaaaattgagagcgcatcccctaaagcctgtcatccactgatctgcttaaattagaagagccaccgtccaagttgaatggaatagttcgttcatgaatcaagagttagaacctatttattgctcagtaagtaactacttttttgagacaagggttgaaattgtcattgtttttttgcaagtaaattaatggattgctatataaagttgcaccagcttagattatcaaattgagataccctactgtttgttgacttatattgac

SEQ ID NO: 2308 - DNA, 660 bp, Bupleurum chinense
aaattcatctctcaaaatctgctgctgtgccggacctcccgcaatatacagtcaagtagtattaggcatcagtcattgctgaagtaaaggcagctattggattttggtggtctgtacagaatgtcgggtggggctggacttgaaaatcttgtagatcaaatcatttccgtgataacaaatgatgggcgcaatatattgggaattttaaaaggttttgatcaggccaccaatataattctcgatgaatcccatgaacgtgtttattccacaaaggaaggcgtccagcaacttgtgctaggtctgtacatcatcaggggggataacataagcattgttggggaggtagatgaagagctggacgcaaacctcgatctttcaaaattgagagcgcatcccctaaagcctgtcatccactgatctgcttaaattagaagagccaccgtccaagttgattggaatagttcgttcatgaatcaagagttagaacctatttattgctcagtaagtaactacttttttgagacaagggttgaaatggtcattgtttttttaatggattgatatataaagttgcaccagcttagattatcaaattgagataccctactgttttgtgacttatattgactataatcagttgtcttgccatatataaaatcc

SEQ ID NO: 2309 - DNA, 606 bp, Cicer arietinum
ctctctcttctgtcactcacgcggtgctctctctctctttccctgttcgtatcatcgaaactttgagagtatcaatatgtcaaccggtcctggacttgagtctcttgtagatcagacaatttcagtcattacaaatgatggacgaaatatagtgggagtcctaaaaggttttgaccaggcaacaaatattattcttgatgagtcgcatgaacgagttttttctaccaaggaaggtgttcagcaacttgttctaggtttatacatcattaggggtgacaacataagtgttgtcggtgaactggatgaggaactagactctaacttagatttgtccaagcttagagctcatcccttaaaggctgtcatccactgaagtaaaactgttagagctgttaggagatggttgctttcttggtagaaaggattggagcattagtacattacatacgacattaagcaatgaaatgaaagtaaaagaatatgctgataaaacaatatgctaaataagtaaatatcttgattctgttgttgatgttggtatggaaatcatggctttctacatgttggattatgcaatgtaacaaactcctgagtcctgactatctg

SEQ ID NO: 2310 - DNA, 1516 bp, Eucalyptus grandis
ctcgagaaaatattgggtaccctaacagtgccacgcaatccgtgctctgaaccattcattgcgtgacacctgtccatttgtcagtccacgtcggctccctcggctccctcttctctccgacgtcgttccaggttaaaccaacgcgcggattgaaaaaagtgaaaaggacattctctctcctctgtcttctctctcctctttgctctcgcttcctcctccggcgcacgtcttcgtaaatcgagttctctcccgacggccgatttcgctcgccgcccatcgccgctccgccggtgacccgcgagtccgctccattccaccacagccgcgccgcgtccgacgccgttgcatcgcaaccgcagccgagccaaaatccagccgtcggagtccctccgcctgcaaatccgaggtcctcgcagcatctgtgacccaatcccctgcgctgccacgccgccctgctgccgatctgcagcactccaagtcgcgccgccccacggaggacaccgatcttgctgcacgatccgccgcaccggagttgccccgacggcgtcgctccagatctgccaccgtccgcgagccccgacgacccgcgctctgtcccgacacgtcgccgagccgcctgttgccgtcccccaactcgcaactgagaagcaatcgttccgccctgctcgaagtagtcgctccgccctgctcgaagcagtcgctcgagaagccctaaatctgcgagtcagaagccagtgtgcagaactagacctgcaagaggatctttgctagttttgggagttgtgaaatgtctactggccctggacttgattctctcgtagaccaaacaatatcggtcattacaaatgatgggcgtaacattgtgggggtcttaaagggctatgaccaagcaacaaatatcattcttgatgaatctcatgaacgtgtttactccacaaaggaaggcgtgcagcaacttgtgctcggtctttacataataaggggtgataacataagcgttgttggagaactagatgaggagcttgattccaatctggatttgtccaagctgagagctcatccccttaagcctgtaattcattaatcatgtaccatatacacatgatacggtagttttcatgcacttcattagctgtaatcatacatataggtcggttaatgatgtttgtggagaacttattactgtttgttcagaaaatgttgctgatggcttatctaaggcgtggtctcgatgcagtatcgccattggggaaatgagaggtgacctttctgttagtgaaggattatgctatcgtttatcaaatttagagcacgtgatgtttcgagtcacgatgtccaatatgtgctcggttctagttcttttgacattctattatgaggcagtacccacaactttagattttactcatttttgagacgttggattgtagaaattgaaatatccatgacgatggccttcacttgttgctctgatcctatcatcaatatagaagcttttagctttctaaggccaaga

SEQ ID NO: 2311 - DNA, 692 bp, Fagopyrum esculentum
cccgaactcagtcattgaaaataagaaacgaaaaggttttacgctgatacaaattttcctctcctcccactcccacttcccgactaaccctagcccatctctggctgccggcagcactcagcagaaatcgatcttcttcacttcttcttcttcggtcatcaagaaactcagaaaatcccaacaagttattgattttgaagaatggctactgggccagggctagagtcccttgttgatcaacaaatctctgtcattacgaatgatgggcgaaacatagtgggtgtgctgaaaggatttgatcaggccacaaacatcattcttgatgaatctcatgaacgtgtatattcgaccaaggaaggtgttcaacaactcgtgttgggtttgtacatcattaggggtgataacataagcgttattggtgagttagatgaagacttggatgcgaatctcgacttatcaaagcttagggcccatcccctgaagcctgttattcattgatcaattgtgtacgttactgcagcttgtctctgcaaaaccggtaaacagatttcaggtttaagaatgctagcaagaaatagttgtatgaattgatatggttgcgactttggagtgtaatttgcagatatgtttatgagaaacatagtagattttgtttgccgacaaagtgtgatgataataaagacggaccagat

SEQ ID NO: 2312 - DNA, 651 bp, Medicago truncatula
gctctattctctgttgtggaaattatcattatggcaaccggtggccctggactcgagtctctcgtagatcagcacatttcggtcattacacatgatggacgaaacatagtgggagttctaaaaggttttgaccaggcaacaaatataattcttgatgaatcccatgaacgagttttttctaccagggaaggtgttcagcagcttgttctgggtttatacatcattaggggtgacaacataagcgttgttggtgaattggatgaggaactagattctagcctagacttgtcccagcttagagctcatcccttaaagcctgtcattcactgaagtaaaacaatgttagaggtgttaggagatgcttgctttcttggtggaaaggattggaacattattagtacacctcatacggcattaagcaatgaatgaactatgagtatatgctgataacataatatgctaaataagtacatatcttgattatgtttttggtgttggcatgtgaatcatggttttctgcatgttggattatgcaatgcaacaactcctgactatcttatctgaacaaacttatttttcattcaaaaaaaaaaaaaaccactcgagggggggcccgacccccccttaccctataacgagtcttcttacatt

SEQ ID NO: 2313 - DNA, 743 bp, Sarracenia psittacina
gaagctaactaaacagaaattgaaagaaagaagaagtggctagggctcagcgcttctctcagagagagagagagagagagaccaggccgccgcacgtcgccggcgtcgatcttaacgccaccatcccgccgccaacgaactcatcgacgagaccgccgccaccggcgaccactacactggcgaatatcttgggtatcggatcgagaagactttgcaaaggtgtgaccatcagtcggttaaagaattgagcaagtaattcgtgttgagttcagaaaatgtcaagtgggcctgggcttgaatctcttgtagatcaaacaatttcagtcatcacgaatgatggacgcaatatagtgggagttttaaaaggttttgatcaggccacaaatataattctcgacgaatctcatgaacgtgtttactccaccaaggaaggtgtccaacaacttgtgttaggtctatacatcataagaggtgacaacataagcattgtgggtgaactagacgaagagctggatgccaacctagatttgtcaaaactgagagctcatccgctgaagcctgttatccattgatgagcaaaatggtatgagctgtttctttattgagtattgtaagggatgaatgaatctgcttggattgcatttaaggaatagaatgattggaatatcgaacattattctaagaaactgtaatatgtatttcactggttagtggctacaaattagattcactttcctgtctag

SEQ ID NO: 2314 - DNA, 551 bp, Utricularia gibba
gtttggcctgagtagcttggttaattgaaggagatggccagcggaattggattggagtctctcgttgatcaaacaatatcggtgatcacgaatgatggacggaatattgtgggagttcttaaaggtttcgatcaggctaccaacattatactggatgagtcccatgaaagggtttactccacgaaggaaggcgtacagcaacttgtgttgggcctctacatcattcgaggcgataacataagcgtagttggggaaatagatgaagaaatcgatgcagacttggacttgtcgaaagtcagagcccaccctttgaagccagtcattcactgagccctggaaactgttactgcgaatagccgtaagtatgaacatgtccagtatctgtaggagtcatgttcgttttgcagtcattgtgggttgattagtgatgacaagttctccctttcaccaatgttgcaacttttgaacctccatctttagaggtctgaatgagctgctttgcataaatattatatcattagattggaaacgtaaaaaaaaaaaaaacaacg

SEQ ID NO: 2315 - DNA, 727 bp, Antirrhinum majus
  misc_feature (648)..(648): n is a, c, g, or t
agtaaaccctaacccctctttctcctatcgcgaggttgcagaaactggttcaaattcgccaaaaataatcctcagtgctggtgacggagaatttgataaaggaaccggcatttgttgcttaactagtctgaaattaaggagatggcgagcgggatgggactcgagtctcttgttgatcagactatttcaataatcacaaatgatggccgcaacattgtgggagttctgagaggttttgaccaagccaccaatataattctggatgagtctcatgaacgggtgtactccactaaggaaggtgttcagcaacttgtgttgggtctctacatcatacggggtgataacataagcattgttggagagttagatgaagagctagatgagaagttggacttgtcagaactcagagctcatcctctgaagccagttatccattgatttttgttatgtgctatgcctaaaggcccttttgatagggtgattgaaggacaatgagagcagagtggtctgacgttttgtacctatcatgtaaaatcgagcattattaaaaatgttggattgatttctttgaaaagttcgaatgagtagatttagctgggccaacggcggagaacaaattgtgttgactttttactttaggcgtccgtngttgcctaaaaaaatgaaatctaagaattgctaatagatgtaacatgttcaacaccattatgttcaatcatcttgttcg

SEQ ID NO: 2316 - DNA, 314 bp, Aquilegia formosa
tttcacgatgtcaggtggcccaggacttgagtctcttgttgatcaacaaatatcagttattacaaatgatgggcgcaatatagtgggtgtgctgaaaggctttgaccaggccaccaatatcattcttgatgaatcgcatgaacgtgtttactctacaaaggaaggtgttcaacaacttgtattaggattgtacatcattaggggagataacataagcattgttggcgaagtggacgaagatcttgactcaaatctggacctatcagaactgagagcacatcctctcaaacctataattcactaattcaagggat

SEQ ID NO: 2317 - DNA, 314 bp, Manihot esculenta
atgtctactggccctggcctggagtctcttgtagatcaaacaatttcagttataaccaatgatggccgcaacatagtgggaatcttgaaaggctttgaccaggcaacaaatatcatccttgatgaatctcatgaacgggtttactctactaaggaaggtgttcaacagcttgtacttggtttgtacataataaggggtgacaacataagcattgttggggaactggatgaagagctcgattcgcatcttgacctgtcaaacctaagagctcatcctctcaagccagtcatccattgatcacctatgaatatttt

SEQ ID NO: 2318 - DNA, 703 bp, Solanum melongena
acgtctcactcactctcctcagttcgagtttcgagaactcctcggcgattcctttcggcaggtttaagcatcagtttactgtagaagctgacaactaggtttctgctaactctgcaacatgtcaactggacttgggctcgagtctcttgttgatcaaaccatctcagttattacaaatgatggacggaatattgtgggagttttgagaggattcgaccaggctacaaacttgattcttgatgaatcccatgaaagagtatattcgacaaaggaaggtgtacagcaacttgtgttgggtctttatatcataaggggggacaacataagcgtcgttggggaattagatgaagatctggatagtaacttggacatgtcaaaactgagagcacatcctctaaagccagtcgttcactgacctgcaacttggtgtgaacttgtaatcctgagaacggatggatggatcgaacatcagtttaattgaaagactttggtactactatcaaatgaaaacttcagacatgttctgtagctaagaacacaaaactgttttagttagtagtcattatatgtcttataagttttcctttctgatattgacttgtggatgattttgtacccgagtagatgaagcatcagtttagttgatgaacttttgtacaaccatcaaagtcaattgtgtctaagagcacaaactggtttactt

SEQ ID NO: 2319 - DNA, 1363 bp, Eucalyptus grandis
tcgtaaatcgagttctctcccgacggccgatttcgctcgccgcccatcgccgctccgccggtgacccgcgagtccgctccattccaccacagccgcgccgcgtccgacgccgttgcatcgcaaccgcagccgagccaaaatccagccgtcggagtccctccgcctgcaaatccgaggtcctcgcagcatctgtgacccaatcccctgcgctgccacgccgccctgctgccgatctgcagcactccaagtcgcgccgccccacggaggacaccgatcttgctgcacgatccgccgcaccggagttgccccgacggcgtcgctccagatctgccaccgtccgcgagccccgacgacccgcgctctgtcccgacacgtcgccgagccgcctgttgccgtcccccaactcgcaactgagaagcaatcgttccgccctgctcgaacagtcgctcgagaagccctaaatctgcgagtcagaagccagtgtgcagaactagacctgcaagaggatctttgctagttttgggagttgtgaaatgtctactggccctggacttgattctctcgtagaccaaacaatatcggtcattacaaatgatgggcgtaacattgtgggggtcttaaagggctatgaccaagcaacaaatatcattcttgatgaatctcatgaacgtgtttactccacaaaggaaggcgtgcagcaacttgtgctcggtctttacataataaggggtgataacataagcgttgttggagaactagatgaggagcttgattccaatctggatttgtccaagctgagagctcatccccttaagcctgtaattcattaatcatgtaccatatacacatgatacggtagttttcatgcacttcattagctgtaatcatacatataggtcggttaatgatgtttgtggagaacttattactgtttgttcagaaaatgttgctgatggcttatctaaggcgtggtctcgatgcagtatcgccattggggaaatgagaggtgacctttctgttagtgaaggattatgctatcgtttatcaaatttagagcacgtgatgttgcgagtcacgatgtccaatatgtgctcggttctagttcttttgacattctattatgaggcagtacccacaactttagattttactcatttttgagacgttggattgtagaaattgaaatatccatgacgatggccttcacttgttgctctgatcctatcatcaatatagaagcttttagctttctaaggccaagagcgattgagaagctcgtgacatgtcaaatgaggctgcaaggtaaacgatgaattgtacgtacgacttgtcaagcccgacgtgaggtggaaggttcattact

SEQ ID NO: 2320 - DNA, 841 bp, Vitis vinifera
cttttgtccatttggctagggttttgattttgggttttgggtttttggttgaagcgtctagggtttaaggagttacaggggggagatagatcaaagagagaagaagtgattttctctaccactattttctatggctaatgtgtgagcttcatcaggcaacaaccgctgccgttgcaggaaaatttgctagcaaccagttcttccaggggtttggctattatttatcagttaccaacttgcaacatgtcaactgggcctggacttgagtctcttgtagatcaaactatatcagtcatcacaaatgatggtcgaaatatagtgggagttctaaagggctttgaccaggctaccaatatcattcttgatgaatctcatgagcgtgtttactccacaaaggaaggcgttcaacagcttgtgttgggtttgtacataataaggggtgacaacataagcattgttggggaactagatgaagagctggattctagccttgatctatcgaaactgagagcacatcccctcaagcctgtcactcattgactgggaaaggtgttgaaactgagaaaggtgttgagaagttcctgactctataattagattggactgatgaaaaatgtatgctgatatatgtagttataacaaccagaagttatgatgttctaaagaagaggttgtttttcatgccaccctgagttgttatccttgatgctgttgatgctgaatgttttcttcgactcttatgttttgcattaataactcgacaattatatcatattatcaacttaattgtattgagagcatgacttatttggttaaattctttttcatggtttcctctgct

SEQ ID NO: 2321 - DNA, 756 bp, Vitis vinifera
tttggttgaagcgtctagggtttaaggagttacaggggggagatagatcaaagagagaagaagtgattttctctaccactattttctatggctaatgtgtgagcttcatcaggcaacaaccgctgccgttgcaggaaaatttgctagcaaccagttcttccaggggtttggctattatttatcagttaccaacttgcaacatgtcaactgggcctggacttgagtctcttgtagatcaaactatatcagtcatcacaaatgatggtcgaaatatagtgggagttctaaagggctttgaccaggctaccaatatcattcttgatgaatctcatgagcgtgtttactccacaaaggaaggcgtgcaacagcttgtgttgggtttgtacataataaggggtgacaacataagtattgttggggaactagatgaagagctggattctagccttgatctatcgaaactgagagcacatcccctcaagcctgtcactcattgactgggaaaggtgttgaaactgagaaaggtgttgagaagttcctgactctataattagattggactgatgaaaaatgtatgctgatatatgtagttataacaaccagaagttatgatgttctaaagaagaggttgtttttcatgccaccctgagttgttatccttgatgctgttgatgctgaatgttttcttcgactcttatgttttgcattaataactcgacaattatatcatattatcaacttaattgtattgagagc

SEQ ID NO: 2322 - DNA, 600 bp, Ipomoea nil
ggacctctgctttctctctctgcgttgcaggtgctaagctttcaaatacagggttcaaaggtgttttaaaataaagagtttgaaggagcaagagctaaagtactacattgcagcagaggtcttatcatgtcaggtggaccggggcttgagtctcttgttgatcaaactatatcagtaattaccaatgacggacgtaatatagtgggaattttgaaaggatttgaccaggccacaaacttaattcttgatgaatctcatgaaagggtgtattcaaccaaggaaggtgtacaacaacttgtcttaggcctttacatcataagaggggacaatattagcgttgtcggggaattagatgaagagctggatgcaaacttggatttgtcaaaactgagagctcatcctttaaaaccagttgtccactgatgttctcggagcttgggatcaaaacttgagttgcaatagaaatgagttggatatcaatgtagtatggtctaaattcacttgaatgttgtgctactgaaatactattgtaaactaaactcccttagccattttgggatgctgaatcttgcttttgaagatggtctataaaatcttctc

SEQ ID NO: 2323 - DNA, 493 bp, Jatropha curcas
attcatcccgtgcacttccttcgccttctcgcttccttacagagaaattgattgcgttgaaccaatctcacacaggagcttctcctccagctgattcagagcttgcaaaatgtcatctacaggccctggacttgagtctctcgtagatcaaacaatttcagttatcaccaatgatggccgcaatatagtgggaatcctgaaaggctttgatcaggccacaaatatcatcctcgatgaatctcatgaacgtgtttactccactaaggaaggtgttcaacaacttgttctgggtttgtacataataaggggtgacaacataagtattgtaggagaactagatgaggagcttgattcacatcttgacttgtcaaatgtaagagctcatcctctgaagcctgtcatccattgatcaactatgttattgtagagcagatgacagtacagaatcttacaactttgttaaaaaaatatatatattttgcccttatttttt

SEQ ID NO: 2324 - DNA, 940 bp, Ananas comosus
agactctccccgtccttttctctcgacctagggcatccatgccatgatcacctccaccatgcgagactctccccggcctcttctctcgacctagggcatccatgccatgatcacctccaccaatcgcagcggcatcgctcgccatttctgaggtttccttgctccaaaacaaggttcgtgagtactatactagaagggctggaaattttctatttgtgagctgtagtattttctatcatccacatcacaatgtctgatggtcctgggctcgaatcacttgtggatcagactatatctgttattacaaatgacgggcgtaatattgtgggcattttgaaaggttttgatcaagctactaatatcattctggacgagtcacatgagagggtatactccacaaaggaaggcgtacaacagcttgttttagggctgtatattataaggggagataacattagtgttgttggagagttggatgaagagctagatgcgaacctggacttgtcgaagcttagggcacacccctttaagcctgtgattcactgatctacaatgaagtacaacaacgtgctagctttttgtatgcataatagaagcatatttggtattgccaacaaaagcatcgcacgcaacagcttatctcggcagcctttggaattcaatgagcctgagtatcagatttttattacaaattagttttagaggcctttccatgttgaatgctgtgacatgggtatttttgctgtcttgtatctgacagattttggagcgcatctctgattagctacctgcgaactttgtagttacgattatagtagctgttagttccatttatttaatactaagaatgcatgttgtattagtgcagatttgttcttgtttaggtgtttatgaatcctgaagatactcgagttttgtttcttgtagaggatatgctgcg

SEQ ID NO: 2325 - DNA, 776 bp, Salvia sclarea
ggggatatataaacctaccacctcaccgtctccaccttcgcagaactcttgtccgctctccgccgcagccctcatctcttcgccgccgcctcgaagccccagtaagtggtggctcttgtcggtgctcgtacctccccctaccattccgtcgcctgctgccgatagtacttgtgctttcactagactttgattgtttcaggggctcgaggtcatttgctgcttgttgctcatttatatcgaggattagaagatggcaactggggctggactcgagactcttgttgatcaaacaatttcggttatcacaaatgatgggcggaatattgtgggaattctgaaaggtttcgatcaggctaccaacataattcttgacgagtctcatgaacgggtttattccacaaaggaaggcgtacaacaacttgtgttgggcctctacattattcggggtgataacataagcattgttggagagttagatgaagagctggatgcaagcttggacttatctaaacttagagctcatcctttgaagccagtcattcactgatgtgtgccattgaaaaaacgtatgtaatgcctaaagctgttgagctttgcttgtaagaatcaaactttagctagaagcaggagaggaaaatgaggatgcttgatcgacattttctgacaaatataacattgttccgattcatttttgcttgcagttgtatgtgatttaacctttcacaatttacgttgatttgcaatgatcgaaaggaatggagtaagtatcaaaaaac

SEQ ID NO: 2326 - DNA, 626 bp, Pisum sativum
atcccaattcaccactccatccccccccgccatctctcaatctcaattcaccactccatcccctcccgctattctaccatcgttatgtcaaccgggcctggacttagtctctcgtagatcagacaatttcagttattacaaatgatggacgaaatatagtgggagttctaaaaggttttgatcaggcaacgaatataattctcgatgaatcccatgaacgagttttctctaccaaggaaggtgttcagcaacttgttctgggtttatacatcattaggggtgacaacataagtgttgttggtgaactggatgaagaactagattctaaccttgatttgtccaagcttagagctcatcccttaaagcctgtcatccattgaagttaaactatgttaaattgttaggagatgcttggtctcttcgtggaaaggattggagcagcattaaaccgagaaatgaaattatatgaatatgctgataacataatatgctaaataactgactatcttgattctgttgttgttggcatggaaatcatgggtttttttacgtgctggattatgtaatgtaacaaactctgaactatctgatatggaaatacctgtttgttttaaaaaaaaaaaaaa

SEQ ID NO: 2327 - DNA, 1000 bp, Amorphophallus konjac
tttcgacttcgtacccgtcctccttccccaacccaccggcaaacccacgctccaccgacacctcctccgcctcgtccgcccccaccccgccggccgcaccctcgcctcctgcccccacgtgaccgccacctacaccttcccgttcaccctcctctttccctctctctgttttctctctcctcccacccgttctctctgcctctgtctgtacggtgccccctctcccagtacgctgcggcccagaagacaacatcccaccagcgcgcaggaaggcccagccaaccagacaaccggcccaatcgcgcccagtgattcctgagtgtgaagttaatatatttagaagcttgcaaaatgtctaccggtccgggacttgagtcacttgtagatcaaacgatatcagtcattacaaatgatggaagaaacattgtgggaattttgaaaggttttgaccaagctacgaacatcattctcgatgaatcacatgaacgagtttattccacaaaggagggtgttcagcaactcgtcttaggcttgtacattatcaggggcgacaacataagcgtaatcggagaactggatgaagagcttgatgcaaatctagacttgtcgaaattgagggctcaacctctgaagcctgtcatacactgattcgtttggcagacgcccaagctgttcgtatgttctgttgatgtgggtggttatgacctgtgggctctatggtcagtacaaacggcgggaaaagaaatctgaagcaaagcctttaatgtatcattaagagtgtctcatcgtctcttgcatccacttgatcgagaacataatcttttggcagatgaacgcgtcgctctgaacttaatgtatgtctaaatgttttgcttgttagtatggcttcaggtggaggcaagttcatgtcggtattgtctgcataggttgaagtaaaccccaggcagaggttctgccgtttgcatgagaactagactttatagtcacatctttaatatga

SEQ ID NO: 2328 - DNA, 800 bp, Catharanthus roseus
ttcctcttcctctctgcctcagactatcatctccctccctcccgacagcttcagcttcaagcttcaagcttcttcttcatcttcatctttggccgtctgttcacaatccaccgccgtcagctgctccaccggtccaccactaagctgtcatctctgcggcaacgtttcccagacttgataaagattgaaggttttgtcctttgaaagaatcccctgtttacgcgtgttggcgatatagaaatgtcgactggacctggacttgagtctcttgtagaccaaaatatttcagtcatcacaaatgatggccgtaacatagtgggaatattaaaaggttttgaccaagctacaaatttaattcttgatgaatctcatgagagggtgtattccaccaaggaaggcgttcagcaacttgttttgggcctttacatcataaggggcgataacataagcattgttggtgaattggatgaagagttggatgcaagtttggatctatctaaactgagagctcatcctctgaaacctgttattcattgatcttttgggaaatatgtataacaaagcgaatgatgaactgctgaggttgttacagaagaaccaaaatgctaatgcgttgcttgtacttaatttaagtgtaacttgttcgctttatccattctatgacatcctttatttaatataacattcttccatgcgacacaaaatgaagtagaaaatgtggcttcacgacaaatctgtgtgacagtcttcttagtgtatattattttgatggttaatttaaaaaacactcttctactttt

SEQ ID NO: 2329 - DNA, 1202 bp, Eucalyptus grandis
gttgcgcagcgccgatttcatcttcactctctaggtctcagcctgtccttcttcgtcttcgtcagcccctctctccctctctcgctcgctcgccggtggagcgtacggtcacgccctagccaagctctgctaagcggcttcacaggaagaagcaagtgtacagaaccagacctgcaagaaggcgtttgctagttttgggagttgtgaaatgtcaactggccctggactcgattctctcgtagaccaaacaatatcggtcattacaaatgatgggcgtaacattgtgggggtcttaaagggctatgaccaggcaacaaatatcattcttgatgaatctcatgaacgtgtttactccacaaaggaaggcgtgcagcaacttgtgctcggtctttacataataaggggtgataacataagcgttgtcggagaactagatgaggagcttgattccaatctggatttctccaagctgagagctcatccctttaagcctgtaattcattaatcatgtaccatatacatgtgatacagtagtgctcatgcacttcattagccgtaatcatacatataggtcggttaatgatgtttgtggagaacttattactgtttgttcagaaaatgttgctgatggcttatctaaggcgtggtctcgatgcagcattgccattggggaaatgagaggtgacctttttgttagtgaaggattatgctatcgtttatcaaatttagagcatgtgatgtttcgagtcacaatgtccaatatgtgctcggttctagttctttgacattctattatgaggcagtacccacaactttagattttactcatttttgagaccttggattggagaaattgaaatatccatgacgatggccttcgcttgttgctctgatcctatcatcaatatagaagcttttagctttctaaggccagagtgattgagaagctcgtgacatatcaattgaggctgcaaggtaaaacgatgaattgtacgtacgacttgtcaagcccgacgtgacgtgggaggctcattactcacagcacgagcgacacgggcctaacgacaaaagatgtgcttatacgtcggaaccaaacggactaccgtggaaaccaaaaagaactgtctagattggaccatactgcgtttcaaaatcccccctggcaaggctcctcttgtcactttcgacgagacgttagagcg

SEQ ID NO: 2330 - DNA, 720 bp, Euonymus alatus
ttgatagggttcgataaccctagataccgcgcagaaccagaaccaggaggagagacggagattcggagcagaaacctcatcactcgaattgaatctccttctgctaccgcattggaaaccgcattaatagaagcggaaaccggatcagtacgatcctgcatctgctgttgtttcaggaatcaggagtagcaaaatgtcaggcccaggacttgagagtcttgtggatcagacaatttcagttatcacaaatgatggtcgtaatatagtgggaatcttaaaaggctttgatcaggccacaaatatcattcttgatgaatctcatgaacgtgtttactccaccaaggaaggcgtgcagctgctcgtgttgggtttgtatataataaggggtgacaacataagtattgttggggaacttgatgaagaactcgattctcgtctcgacttgtcgagtttgagagctcatcccctcaagcctgtcattcattgacattgactgtgagggttgtaaactgtagagctatttataaaactctgaggaatttaaactgcaaaagtattggaatttttgtctctatcttcactgagattacgaggttttaggttcactcatgcttgtggactggaccatttactgtccatcttgaaacaagatcttattcaggatgaaactttagttgcgatgcattctatgtttagttttctattcttagcattgaatct

SEQ ID NO: 2331 - DNA, 705 bp, Euonymus alatus
tagtatttcactgttggcagtaacggtgttgcacggggtggttgtctccttcctcctttaacgcttgttataggtagtcgatcttcacttgagaaacaatctctgagatctggtgctgtttgctggtcgcttctcctgacgaggaggagtagcaaaatgtcaggcccaggacttgagtctctcgtggatcagacaatttcagttatcacaaacgatggtcgcaatatagtgggaatcttaaagggctttgatcaggccacaaatatcattcttgatgaatctcatgaacgtgtttactcaactaaggaaggagtgcagctgctcgtgttgggtttgtatataataaggggtgacaacataagtattgttggggaacttgatgaagaacttgattcgcgtctcgacttgtcgagtctgagagctcatcccctcaagcctgttattcattgatatttaccgggtgaggtgtagactgtagagctttttgtaaaactgcacgaggaatttaaactgctagagtagtgtaatttttatttttctttcacttttgagattattataaggttgtaggttcactcatgcttctttaccagttaccgcccgtcttgaaacatgatctattcaggctgaaatgttggttgcgatgcaagttatgtttagatttctatttgacattgaatctgaaaaaaccagcagcagacgttc

SEQ ID NO: 2332 - DNA, 704 bp, Euonymus alatus
gttcgataaccctagataccgcgcagaaccagaaccaggaggagagacggagattcggagcagaaacctgatcagtactcgaatttaatctccttctgctaccgcattcgaaaccgcattaatagaagcggaaaccggatcagtacggtcctgcatctgctgttgtttcaggaatcaggaggagcaaaatgtcaggcccaggacttgagagtcttgtggatcagacaatttcagttatcacaaatgatggtcgtaatatagtgggaatcttaaaaggctttgatcaggccacaaatatcattcttgatgaatctcatgaacgtgtttactccaccaaggaaggcgtgcagctgctggtgttgggtttgtatataataaggggtgacaacataagtattgttggggaacttgatgaagaacttgattctcgtctcgacctgtcgagtttgagagctcatcccctcaagcctgtcattcattgacattgactgtgaggcctgagggttgtaaactgtagagctatttataaaactctgaggaatttaaactgcaaaagtattggaatttttgtctctatcttcactgagattacaaggttgtaggttcagtcatgcttgtggactggaccatttactgtccatcttgaaacaagatcttattcaggatgaaactttagttgcaagaaaaaaaaaaaaaaaaggccg

SEQ ID NO: 2333 - DNA, 711 bp, Tropaeolum majus
cggccgggggttcactttgttctccatctcctcgggtcagcgccaaaaagctagggtttgaagtctctattcacaaatttacacagaagtccagtcgtaaccaagagcatatagttcatctcacacttcgagactgcaaaatgagtggccctggactcgagtctcttgttgaccagacaatatcagttatcacaaatgatggacggaacattgtgggaatactgaaaggttttgaccaagccacaaatatcatccttgatgaatctcatgaacgtgtttactcaactaaggaaggcgttcaacaactcgtgttgggtttgtacataataagaggcgataacataagcattgttggagaacttgatgaggaactcgattccgctctggatttatcaaacctaagagctcatcccctcaagccagtcattcattgattcggtaacatagtccgatggatgaaataaactcctcttaaggtaattaaaaaagacgcccagtctaggtgcttaatagcaaatacccgattttttcacaaaatcgagagacacacctcttatcgttttatgggttgtgttttttagataaaaatgtgtttgaatattctactactttgagcttacatatttgaacataatgatgtaagtaaatgttgtgattctgagatcttttaaattaagcacatatgagtaaattgaatttgaaatttcagaa

SEQ ID NO: 2334 - DNA, 628 bp, Tabernaemontana elegans
agtcaagagtgtacactgagctgtgaagagatttgaacccctcgcaaccaccaggagggagtagaagaatttgcaaagccctcctctttactttcttatgctttctcaactctgagggtatttgatttgctgctaagacaattcacatcccttctcaattagtcaagtaacttgataagacagaagcttttgtgctttgaaagaatccactgtttatccttgttggagagtcagaaatgtcaaccggacctgggcttgagtctcttgtagaccagacaatttcagttatcacaaatgatggccgtaatatagtgggaatattaaaaggttttgaccaagctacaaatataatacttgatgaatctcatgagcgggtttattccaccaaggaaggtgttcagcaacttgtgttgggcctttacatcataaggggtgacaatataagcattgtcggtgaattggatgaagagttggatgcaaatttggatttatcaaaactgagagctcagccgctgaaacctgttatccattgatttgggaacatgtacaagagtgtgatttaggaattgccctggttgttacagaacgaaattgttatgagttgcttgtacttagctaaacttgttgc

SEQ ID NO: 2335 - DNA, 648 bp, Acacia harpophylla
ggccgtcgcgctccaacaacttcagcgacgtatctccctattgccagcgagtgactcctcttcaaactctacaaggcctgaggagtcgtgtgccattaacctagccaataccgaagtgtgcaagatgtcaactgggcctggacttgagactcttgttgatcagaccatttcagtcattacaaatgatggacgaaatatagtgggaatcctgaaaggttttgaccaggcaacaaatataattcttgatgaatcccacgaacgagtttgttctaccaaggaaggggtgcagcaactcgttctaggtttgtacatcattaggggtgacaatataagtgttgtaggtgaactagacgaagatctggattcaagtttggatttgtccaagcttagggctcatcccttaaggcctgttatccattgaactaccttaccagttgtttgttaccttcccggtggaaaagtacgagtctctgactgtggagcgttgctagattttgtcttggaggtagcgagtgacatatccgagttttgtgttgagattaatgttctacatgccacacttgtgagatcttatgagacaaccttagactatccattttgtttgttcacgtgactaattctttaggtcgcttctcggtccatcatttg

SEQ ID NO: 2336 - DNA, 798 bp, Manihot esculenta
attgctctgcctcctagaagctacatccgccggttatttatctggaaactaatcggggattacataggcattgtctttctccacttacagagccttcatcaactatcttcagacagatcgattgtagcaaaggagtttctcacagctgcttcaggacttgcaaaatgtctactggccctggacttgagtctcttgtagatcaaacaatttcagttataaccaatgatggccgcaacatagtggggatcttgaaaggcttcgaccaggccacaaatatcatcctagatgaatctcatgaacgagtttattctactaaggaaggcgttcaacaacttgtcctgggtttgtacataataaggggtgacaacataagcattgttggggaactggatgaagagcttgattcacaccttgatttattaaacctaagagctcatcctctcaagccagtcattcattgatcaactatgaacatgtgggatgttgtagacctggtaatggacccagtacagaatgttagttgttacagtggtttaattcttgatgctgtagactgagacctaattttattgaaattctgctggtcttagtttctcttcaactttgttgacatcattttttttctcatctgtatacttgttaaatgttggtgctatttgtatttccaatttttatgtattttgcttcttaatgctggttatgagccactaaataattgataggcctattgggccaaaaaacctaattctttgcacttttttcataattttgtataagaaaagtatatcctttcaattt

SEQ ID NO: 2337 - DNA, 882 bp, Eucalyptus grandis
cagcgccgatttcatcttcactctctaggtctcagcctgtccttcttcgtcttcgtcagcctctctccctctctcgctcgctcgccggtggagcgtacggtcacgccctagccaagctctgctaagcggcttcacaggaagaagcaagtgtacagaacctgacctgcaagaaggcgtttgctagttttgggagttgtgaaatgtcaactggccctggactcgattctctcgtagaccaaacaatatcggtcattacaaatgatgggcgtaacattgtgggggtcttaaagggctatgaccaggcaacaaatatcattcttgatgaatctcatgaacgtgtttactccacaaaggaaggcgtgcagcaacttgtgctcggtctttacataataaggggtgataacataagcgttgtcggagaactagatgaggagcttgattccaatctggatttctccaagctgagagctcatccctttaagcctgtaattcattaatcatgtaccatatacatgtgatacagtagtgctcatgcacttcattagccgtaatcatacatataggtcggttaatgatgtttgtggagaacttattactgtttgttcagaaaatgttgctgatggcttatctaaggcgtggtctcgatgcagcattgccattggggaaatgagaggtgacctttttgttagtgaaggattatgctatcgtttatcaaatttagagcatgtgatgtttcgagtcacaatgtccaatatgtgctcggttctagttctttgacattctattatgaggcagtacccacaactttagattttactcatttttgagaccttggattggagaaattgaaatatccatgacgatggccttcgcttgttgctc

SEQ ID NO: 2338 - DNA, 774 bp, Arachis hypogaea
aaccctaaaccctcaacctccattctcccttcgcttccttctgtctctctgatcccgcgccatcgcgtttctgggttcacagcttcagtctctttccttcctcccgtcgtcgctcccgtcgcgcggtcttgtcccttgcttcggctgcgtcgttcttccgtcgtttccccagttcggacaataagtgtgactacaaattaaacaagttcttgcaagatgtcagatgggcctggacttgagtctcttgttgatcaaacaatttcagtcatcacaaatgacgggcggaatatagtgggaatcctgaagggttttgaccaggctacaaacattattctggatgagtctcacgaacgagtttattctaccaaggaaggtgtccagcaacttgttctaggcttgtacattattaggggtgacaacataagcgttgttggtgaactagatgaagatttggattcaaacctggacttgaaaaaccttagagcacatcccttaaagcctgttattcactgaagtgaagttgaatgccattggttgtgacttgcttggtatgagggcttcaaagaatttgtatgaatgaatatattgtttacaacataatgtctatccaaagaatttaaatctcttgtatcttgatgttcagaacacaaatatgagcttcttttttatttttatattttaaaaatagcaatatgaaataacgatacaagttatttaataattaaaatatatacaaataggataccataacttgccctagatttaccaaagttc

SEQ ID NO: 2339 - DNA, 615 bp, Cicer arietinum
acgcggggctctctcttctgtcactcacgcggtgctctctctctctttccctgttcgtatcatcgaaactttgagagtatcaatatgtcaaccggtcctggacttgagtcttttgtagatcagacaatttcagtcattacaaatgatggacgaaatatagtgggagtcctaaaaggttttgaccaggcaacaaatattatccttgatgagtcgcatgaacgagtttttttttaccaaggaaggtgttcagcaacttgttttaggtttatacatcattaggggtgacaacataagtgttgtcggtgaactggatgaggaactagactctaacttagatttgtccaagcttagagctcatcccttaaaggctgtcatccactgaagtaaaactgttagagctgttaggagatggttgcttttttggtagaaaggattggagcattagtacattacatacgacattaagcaatgaaatgaaagtaaaagaatatgctgataaaacaatatgctaaataagtaaatatcttgattctgttgttgatgttggtatggaaatcatggctttttacatgttggattatgcaatgtaacaaactcctgagtcctgactatttg

SEQ ID NO: 2340 - DNA, 813 bp, Tropaeolum majus
acggccgggggtagtatttgtcctttgtatactgcactttgttctccatctcctcgggtcagcgccaaaaagctagggtttgaagtctctattcacaaatttacacagaagtccagtcgtaaccaagagcatatagttcatctcacacttcgagactgcaaaatgagtggccctggactcgagtctcttgttgaccagacaatcagttatcacaaatgatggacggaacattgtgggaatactgaaaggttttgaccaagccacaaatatcatccttgatgaatctcatgaacgtgtttactcaactaaggaaggcgttcaacaactcgtgttgggtttgtacataataagaggcgataacataagcattgttggagaacttgatgaggaactcgattccgctctggatttatcaaacctaagagctcatcccctcaagccagtcattcattgattcggtaacatagtccgatggatgaaataaactcctcttaaggtaattaaaaaagacgcccagtctaggtgcttaatagcaaatacccgattttttcacaaaatcgagagacacacctcttatcgttttatgggttgtgttttttagataaaaatgtgtttgaatattctactactttgagcttacatatttgaacataatgatgtaagtaaatgttgtgattctgagatcttttaaattaagcacatatgagtaaattgaatttgaaatttcagcattagggtttattggaagaaactgtaagttactatgataatgtgacacttacggtggaaacgagttgtagttactcgtcagtt

SEQ ID NO: 2341 - DNA, 925 bp, Cirsium arvense
tgaaagactgcccatatcttcgcagttaacctccgtcgcctgagtaccaatccggaagagtagtaataagcggtttccttggcgtttcttctctcaacaacgactaacaaaggttgtgaagcacagacaagttcaggtaagctagtgttctagcggtgtcagaaaatgctgggtggtccagggcttgaatctgtcgttgatcagatcatttcagttatcacaaatgatgggcggaacatagtgggtgttctgaaaggtttcgaccaagctaccaatataattcttgatgaatctcatgaaagggtttattccaccaaggaaggcgttcagcaacttgtattaggtctctacatcataaggggtgataacataagcgtaattggggaattagatgaagaactggatgcaagcctggatttgtcagaactgagagctcatcctctgaagcctgttattcattaatatgctacaaggtattcttagtaaacatcgaatcttgtaacggtagtagatgctgaaaacggatttgttatgatattatttgattcagagttgcatcaaacttgagtgctattatatatatatggaatgtacacagacctctcctccactccaaggggtagagaggctgtttctatgaaaaaagaaaactgaccttggtgtctcctagtagaatgacataaggcaaaatatcatctcaatttatgcaaacaaaactaacgtcaaccgttggtgaaaaactacaaaaggaaatcaggtattactggtttttgaacatccacattcaagcccccatcctccgctctttgcctagctttatgcctgccatggcggctaccacttttcggcttattcgtttcaccattttcatcgttaactggaggacttggatgctttttgtctttaccatgagtactacgatgtt

SEQ ID NO: 2342 - DNA, 713 bp, Cirsium arvense
ggttgggaatgaaagactgcccatcttcgcagttaacctccgttgcctgagtacgactccggtgtaccagaagagcagtaagcggtttccttcacgtttcttctctcatcgactaacaagcagcaagcagtgtcatctgtagtagttagatacttagaccatagtttctcataaccgggttgtgaagcacagacaagttcaggtaagctagtgttctagcagtgtcagcaaaatgctgggtggtccagggcttgaatctgtcgttgatcagatcatttcggttatcacaaatgatgggcggaacatagtgggtgttctgaaaggtttcgaccaagctaccaatataattcttgatgaatctcatgaaagggtttattccaccaaggaaggcgttcagcaacttgtattaggtctctacatcataaggggtgataacataagcgtaattggggaattagatgaagaactggatgcaagcctggatttgtcagaactaagagctcatcctctgaagcctgttattcattaatatgctacaaggtattcttagtaaacatcgaatcttgtaatggtagtagatgctgaaaacgaatttgttatgatattttttgattcagaattgcatcaaactcgagtgctattatatatatctatggaatgtacacagacctatcctccaccccaaggggtagagcggctgtttctatgaaaaa

SEQ ID NO: 2343 - DNA, 673 bp, Cirsium arvense
ttaaaacaaacagaagctgaagctcctccctgaaccctggacgaacacaaactccactcgccggcggcaactgactaacgccgaacggttctccggcggtccggctggtcattctcaatctcacacacactcactaaagcatcctctgaatctctctttcaggagaagtgagctaaatcaagatagtgctttataaatatctgcaaaatgctgggtgggcctggacttgaatcggttgtcgatcaaatcatatctgttattacaaatgatggtcgtaacatagtgggaattttgaaagggttcgatcaagctacgaatataattctcgatgaatctcatgaaagagtttattccaccaaggaaggtgttcaacaacttgtattaggtctctacatcataaggggtgataacataagtgttattggggaattagatgaagagcttgatgcagggttggatttgtcggaactgagagctcatcctttgaagcctgttattcactaatgaatattacatggtatgcatagttaaaaaacatgaatagtttgcaaggaagttagaatttgatcttttattgactgatgtttggctgcatcttctggaattttggggttcatgttgcattcacatgtgcatgttgaatttaaagtttgcactcttgcatatattagat

SEQ ID NO: 2344 - DNA, 654 bp, Euonymus alatus
atagtatttcagtgtttgcagtaacggtgttgcacggggcggttgtctccttccgcctttaacgcttgttataggtagtcgatcttcacttgagaaacaatctctgagatctggtgctgtttgctggtcgcttctcctgacgaggagttttcgggagtagcaaaatgtcaggcccaggacttgagtctctcgtggatcagacaatttcagttatcacaaatgatggtcgcaatatagtgggaatcttaaagggctttgatcaggccacaaatatcattcttgatgaatctcatgaacgtgtttactcaactaaggaaggagtgcagctgctggtgttgggtttgtatataataaggggtgacaacataagtattgttggggaacttgatgaagaacttgattcgagtctcgacttgtcgagtctgagagctcatcccctcaagcctgttattcattgatatttaccgggtgaggtgtagactgtagagctttttgtaaaactgcacgtggaatttaaactgctagagtagtgtaatttttatttttctttcacttttgagattattataaggttgtaggttcactcatgcttctttaccggttaccgcccgtcttgaaacatgatctattcaggctgaaatgttggttgcgatg

SEQ ID NO: 2345 - DNA, 699 bp, Elaeis guineensis
atttcctcgtacgagccctagccgactcaaacgcaaagagggaaagcgtggtgacagacggtaggaaggagccaccatcgaagaataaataaaaaaaaaaaggtgcaaagaacaattgaaactattctgccagacaagtagatatccttcaatttattgaaatcctacaatgtcgtctggtcctgggcttcaatcgctagtagaccagaccatatcagtcattacaaatgatggacgacatattgtgggaattttgaaagggtttgatcaagctaccaatatcattcttgatgagtcacatgagcgtgtttactctacaaaggaaggtgttcagcaacttgttttggggctgtatattataaggggtgataacataagtattgtgggagaattagatgaagaactggatgcaaatctggatctgtcaaaactaagggcacatcctctcaagcctgtgatccattgatcaatttgatgtccagacctcttgatattttcctctctacaatagagttgtcttactgtgggatttgaggtatttagttgttcaaaacaagaatggacgtggtgtttgtctaatagaatacaatttgttcccacactgctataatttttgatgccaactaagcaacattatttccagcagacacattaaaaaaaaagggcaatgcatcagaactgaaaggatatatggatcct

SEQ ID NO: 2346 - DNA, 642 bp, Plantago ovata
cggccgggggttcttggctcattcagctggagtgaaaccctatttcttttcttcacagagaattctccccgagtgctattccagagcggatttggaattctagaggtgataacctatggcaactggggcaggacttgagtctcttgttgatcaaacaatttcgataattacaaatgacgggcgaaatattgtgggtgttctgaaaggtttcgatcaggccaccaacattatactcgatgagtctcatgaacgtgtttactccaccaaggaaggtgtgcagcaacttgtgttggggctctacatcatacgaggcgataacataagcattgttggagagatagatgaagagcgtgacgaacagctggatctgtccaaactcagggctcatcctttaaagccagtcatccattgatttgtaacgtccttgaaacatgtgtaatgtctatgaactgaaaagattggctgatagaaaacttcataaactggttatttatcaatagaacggtgaatagatactgtgtacctatcttgtattgtttgctgtactaagaatataattcagttggtgtgttggctgattatttgccagaatttgagcgttacaacagaaaagagataatgtgatcatgctcagcttgtcta

SEQ ID NO: 2347 - DNA, 597 bp, Tripterygium wilfordii
cctctcttctgttaatatttcaggagtagcaaaatgtcaggcccaggacttgagagtcttgtggatcagacaatttcagttatcacaaatgatggtcgtaatatagtgggaatcttaaaaggctttgatcaggccacaaatatcattcttgatgaatctcatgaacgtgtttactccactaaggaaggagtgcagctgctcgtgttgggtttgtatataataaggggtgacaacataagtattgttggggaacttgatgaagaacttgattctcatctcgacttgtcaagtttgagagcacatcccctcaagcctgtcattcattgacattgactgtgagagttgtagctggtagagctaaaactgtgcgaggaatttaaactgcaagtattgtaattttttctctctcttcactgagatttcaaggttgtaggttcactcatgcttgtggaccatttcctgtccagcctgggacaaaatcttattcaggctgaaacgttggttgggaagcacgaatgttgatatatggatcttcatgggccaggattatacaaaacaagcccaggctgttcattgattggattttatttttgagcc

SEQ ID NO: 2348 - DNA, 492 bp, Vinca minor
tcttatgctttttcaactttacgatttgataaagatagaagtttttgtgctttgaaagaatccactgtctgctcgtgttggagatacagaatgtcaactggacttggtcttgagtctcttgtagaccaaacaatttctgttatcacaaatgatggccgaaacatagtgggaatattaaaaggttttgatcaagctacaaacataatacttgatgaatctcatgagcgggtgtattccaccaaggaaggtgttcagcaacttgttttgggcctttacatcataaggggtgacaacataggcattgttggtgaattggatgaagagttggatgctaatttggatttatcaaagctgcgagctcatcctcttaaacctgttattcattgatttcggaacatgtacaacaatgcgaattatgaactgctgaggttgttacacaaccaaattgctaattgttgcctatactttgtttttgtataagtaattatgtac

SEQ ID NO: 2349 - DNA, 726 bp, Persea americana
tatcaacgcagagtgcattacgaccggggagaaagagaagtaggagggtttagcctctcacctgtttcgactcagagagagggaaaggccgaagctgctgttgttcgctgcttgcggaggtgaaggtgaggctcccggacgtcgacgaccgacggttcttcgctgcaaaatctcgccggtgccaggttcgacttcgattttccaaggacttgcctagtccgtggtcttgatagtccacaatgtcaagtagtattggacttgagtctctagtcgatcaaactatatctgttatcacaaacgatggacgcaatatagtgggagttttaaaaggtttcgaccaggccacaaatatcattctcgatgaatcccatgaaagggtttactccaccaaggaaggcgtccagcagcttgtgttaggcctgtatattataaggggcgataacataagcgttgttggagagttggatgaagagcttgactccaatttgaacttgtcggaactgagagcacatcctctcaaacctgtcatacattgatattcagaacaacagcttctttaggttgttgacatggattgaccaattcaatttctgttttgtattgtttacttctattggtatgaattgtgctactgtatgttcagaacagtgacttatcatgtatttaatctctggcgatcctgatttgcaaattaggattggcataatttcctagttctatctttgc

SEQ ID NO: 2350 - DNA, 641 bp, Centaurea maculosa
  misc_feature (221)..(221): n is a, c, g, or t
ggcgggggcgctgctttcgagagatttgtcctttttttcggtgcgattgatctccattgtcgcctcttcttggagctccttaacgtttttctttcacaaagcctaacaagggtttgaagaagtgatctgaatcaagatagtcatttatcaatatttgcaaaatgttgggtggacctggacttgaaacggttgttgatcaaatcatatctgttattacaaangatggtcgcaacatagtgggagttttgaaagggttcgatcaagctaccaacataattcttgatgaatctcatgaaagagtttattccaccaaggaaggtgttcaacagcttgtattaggtctctacatcataaggggtgacaacataagtgttattggggaattagatgaggagcttgatgcagggttggatttatcggaactgagagctcatcctctgaagcctgttattcactaatgaatattcatggtatgcatagttaatcttgaatattgtaagcaaatttagaatttggtttctgaaagaaaaagatgcatgaaaacataacttcttattgtgtattagcttaagagattcttaaggtgaaatcttttattgactgatgtttggatgctgaaaaaaacaaaggccgcctacgac

SEQ ID NO: 2351 - DNA, 633 bp, Centaurea maculosa
cggggggggaatgaagactgcccatatcttcgcagttaacctccatcgcctaactgtacgaatccggaagactagtaagcggtttccttcgacccttctgtacgtttcttgtctcaaaggttgtgaagcacagacaagttcaggtaagctagtgttctagtggtgtcagcaaaatgctgggtggtccagggcttgaatccgttgttgatcagatcatttcggttatcacaaatgatgggcggaacatagtgggtgttctgaaaggtttcgaccaagctaccaatataattcttgatgaatcccatgaaagggtttattctaccaaggaaggcgttcagcaacttgtattaggtctctacatcataaggggtgataacataagcgtaattggggaattagatgaagaactggatgcaagcctggatttgtcagaactgagagctcatcctctgaagcctgttattcattaatatgctacaaggtattcttagtaaacattgaatcttgtaatggtagtagatgctaaaaacgaatttgttatgatatttttgattcagaattgtatcaaacttgagtgctattatatatatctacggaacttccaccccaaggggtagagtggctgtttctatg

SEQ ID NO: 2352 - DNA, 800 bp, Cichorium intybus
ggcgggggttatgcattttgctttctttcatattggaacattttctttgtttttgcgtaccccctgccgccttgcttctcggcacacatttcaattttcagcaataagaagttcggggtttgtcctctcgttgcgattagccaccattatcgagcactagtaccagactctggaagcgtagcaagcgccgtagcgtttccctcgagcgtttcaaggttctctcttgtaaaacctaacaaggctttgaagcaaaagtaagctaaatcttaatcaagtagtatctgcaaaatgttgggtgggcccggacttgaaacggtagttgatcaaatcatttcggttattacaaatgatgggcgtaacatagtgggagttttgaaagggttcgatcaagctacaaatataattcttgatgaatctcatgaaagagtttattccaccaaggaaggtgttcaacaactggtattaggtctttacatcataaggggtgataacataagtgttattggggaattagatgaagagcttgatgccagcttggatttatcagaactgagagctcatcctctgaagcctgttattcattaattatctaacattatatgcatatttagacttgaatgttttaagaaaatttagaattttaaattttgaatgataatattattgggttcgatgacacatgaaactgaagtgcttattatctactctagaagtaaatagtttttcctttgcagtttattttggacaaaagaatataaggaaaaataagtgaggtaccagttgtaaaaaagttcgtggag

SEQ ID NO: 2353 - DNA, 751 bp, Cynara scolymus
  misc_feature (643)..(643): n is a, c, g, or t
gcggggagagttcactatttgaaacagacagaaagctcctcccctgttcggtctgagacctacacactcgactcgcaggccgcagcagacgcacgtcgcacggttctccggcggtccggccggtcactctcactctcactctcactctctcacactcactcaatcactctctcaatctctcgttcagggtttgaaggagaagtgagctaaatcaagatagtgctctattaatatctgcaaaatgctgggtggacctggacttgaatcggttgttgaccaaatcatatctgttattacgaatgatggtcgtaacatagtgggagttttgaaagggttcgatcaagctacgaatataattcttgatgaatctcatgaaagagtttattccaccaaggaaggtgttcaacaacttgtattaggtctctacatcataaggggtgataacataagtgttattggggaattagatgaagagcttgatgcagggttggatttgtcagaactgagagctcatcctctgaagcctgttattcactaatgaatcttacatggtatgcatagttaagcttgaatattttgcaaggaaattagaatttggtttctgaaagaaaaagatgcatgaaaacagaagtgcttattgttnttcattagcttctgtggttcttagggtgagatcttttattgactgatgtttggctgcatcttatgaaatttttggggttcatgttgcatttaacatgtgcatgttgag

SEQ ID NO: 2354 - DNA, 668 bp, Hevea brasiliensis
tgaactcctagaagctgtatccgcccgttttctatacggaaactctcggagattacaaagacattgtcttcatccacctccatcaactatcttcagacagattgattgtagttgtagacagtcttgcgaaggaatttctctctcagctgcttcaggacttgcaaaatgtctactggccttggacttgagtctcttgtagatcaaacaatttcagttataaccaatgatggccgcaacatagtgggaatcttgaaaggctttgaccaggccacaaatatcatcctcgatgaatctcatgaacgtgtttactctactaaggagggcgttcaacaacttgttctgggtttgtacataataaggggtgacaacataagcattgttggggaactggatgaagagcttgattcacatattgacttatcaaacctaagagctcatcctctcaagccagtcatccattgatcactatgaatatgtgggttgttgttgtagtgcagattatgggctaaatgcaaaatgttacattggtttaagtctcaatggttgtagaccgagacctaatttaatcgaaattctgctggtcttattttctcttttaactttgttggcatcattgtgctttgtatactttttaaatattggtgttagttgtctttccaattttaata

SEQ ID NO: 2355 - DNA, 570 bp, Mimulus guttatus
accaagtttcccgatccctccccctcagcggtagagaaacgcgccgccgcctcttgaaattcgcagcagcagcccgacatcaaattgcttaggttgcttgttgataagaagatggcaactgatgctggactcgagaatctcgttgatcaaataatttcagttatcacaaatgacgggcggaatattgtgggagttctgaaaggatttgaccaggctaccaacataatcctcgacgaatctcatgagcgggtttactccaccaaggaaggtgtgcagcaacttgtcttggggctttatatcatacgcggtgataacataagcatcgttggagaactagatgaagagctagatgcaagtttggacttgtcggcgcttagagctcatcctttgaagccggttatccactgatatctatcgtcttacgagcatattgtaatgaacacaaaatactgttaagaattgtatgttagctagagagagcaggagagagaagaaaatatgaggaagtgattctgacattttgtacttataattaaccactatgctatctatatttttgtgctttgcctt

SEQ ID NO: 2356 - DNA, 809 bp, Triphysaria pusilla
tctcattcagtcgagcagactagcagagtaaaatgaaaacctagcccagcccctcttacttttttcttcccagccctcaatcaaccatccggcgaccaagtctccgctatcactggattttaggtcttcctgcttttccgtcaaagtaatcagctagtatcaaaacatttcttctcagtagttacagaaccttaggagcgccccagcatcattttctaaattcagtttttactcacttgtattgaggataagaagatggcaactggaactggacttgagactcttgttgaccaaatgatctcgatcatcacaaatgacggacgaaatattgtgggtgtcctaaaaggtttcgatcaggccaccaacataattcttgatgaatctcatgaacgagtttactccaccaaggaaggtgtacagcaacttgtgttgggcctctacatcatacgtggtgataacataagcattgttggagaattagacgaagagctagatgcaagcttggacttatcgaaccttagagctcatcctttgaagccggtcatccactgatatatgtaatatcttgtaagcatatgaaccgttgagattggattttcagaaacaaacatagcaaatctagaaagatgtaagagagagtgaggcatttgtatctaacattttcatattttatgctatctattctgagctagtttacaatggccaaccgtagaaaggacaaggtttttgtatttcatgtgatctctaaagttaagactactcggatttataatatttttgcgtgagattttcagaaaaaaaaaaaaaaa

SEQ ID NO: 2357 - DNA, 1004 bp, Cannabis sativa
gacaaacctaatttctaaacctaaatataatccttccactttctcttctcctatacccagccgttctcttcactgaactcaaacctaaaccaaaattttcttctcttcatcactgtcaatctctgtcgccgttcaactcaccaccgaccaccgactagtctatctcttcagtcgacggtagactccactcgctgccctcgccgaccagtccagaacttcagtcgaggtctactccactccctgccctcgccgaccttagacaaagggttatcatttgaaagcagggcttgttattgaagaaggtgaattgtttccgaggtttggaatatgtctggtggccctggacttgagtctcttgtagatcaaacaatatcggttatcacaaacgatggacgcaatattgtgggagttttgaaaggcttcgaccaggctacaaatatcattctcgatgaatctcatgaacgggttttctccacaaaggaaggtgttcagcaactagtgctgggtttgtatataatcagaggcgacaacataagtattgtcggagaattagatgaagaaattgattcatctgttgactggtcggaaaaaagagctcatcctctaaagcctgtcattcattgagtggcttggaaggcaataaagcattagagctgttgtatgtagattgtctggttgattaccatcccgccaaagagtttccatggattatagtttgtttatcttgttcattgcttttttctatgagactgttctgattgggatcagaaataaggaaaaaagaaagagaagactgtcttcatcccaaattttaccaaatatttaaagctgttttgtgctacattttatattctattttcattggcattggtggtggtggtgtttattttctcatatcagaacaatcaaaattgtaaatgtataaagtacactattaattaattagtcagacaaagaagtgcatttggaaaacattttgctcatacatatatatatatatatat

SEQ ID NO: 2358 - DNA, 581 bp, Cirsium arvense
gttgggaaccaaagactcctccgtctcgcagttaacctccatcgcgtgagtacgaacaagtccggtgtaccggaagagaagtaagctgctacaacgtttccttcgagcctctatacgtttcttcacgcaacttctaagaaggttgtgaagcgcaggcaagttcaggtgagctagtgttctagtggtatcagcaaaatgctgggtggtccagggcttgaatctgtagttgatcagatcatttcagttatcacaaatgatggccggaacatagtgggtattttgaaaggtttcgatcaagctaccaatataattcttgatgaatctcatgaaagggtttattccaccaaggaaggtgttcaacaacttgtattaggtctctacatcataaggggtgataacataagcataattggggaattagatgaagaactggatgcaagcctggatttgtcagaactgagagctcatcctctgaagcctgttattcattaatgtgctacaaggtattcttagtaaaccttgaatcttgtaagggaggtagatgatgaaaatggatttattatgatatcattttattcaaa

SEQ ID NO: 2359 - DNA, 574 bp, Flaveria ramosissima
agaactgaaacaaatacacacacttggtgccccttttcctttttcagcaattagaaagatcgaggattcgggaagggttcaacgttttctctcgcaaaacctaagaaatcaggctttgaagcagtatcattaaaatgctgggtgggccaggacttgaatctgttgttgatcaatacatttcagttatcacgaatgatggacgcaacatagtgggagtgttaaaagggtttgatcaggctacaaatattattcttgatgaatctcatgaaagggtttattcgaccaaggagggtgttcaacaacttgtgttaggcctttacatcataaggggtgataacataagtgttattggggaactagatgaagagcttgatgcaagcttaaatttgtctgagcttagagctcatcctctgaagccggttattcactaatggtctcatgatattatgcatggttaaaccatgaatgtcttaaggtaattaaaattttgtttcagagagaatattatcttgttcaaagacacatgaagttgaagtgcttattatctaatgtttaggattcatattgcatttaa

SEQ ID NO: 2360 - DNA, 977 bp, Humulus lupulus
ctggcgctcagtgtctcattctcactctctcagacgctcacttcaccggctctccgtcacttttgagccgatactctccgtcagaaaaaccgccactgctactattctccgagcctttaaccaaaaattcaattagttttcatagctcactagccctcattcccgcgtaacagccattgagctctgaggttggcgctggtcactgactcactttcctcatctacggaagtactttccatcggtctgaagaagaggtccttgctttattcattccaagggttggaatatgtctggtggccctggacttgagtctctagtagatcaaacaatatcagttatcacaaatgatgggcgcaatattgtgggagttttaaaaggctttgaccaggctacaaatatcattctcgacgagtctcatgaacgtgttttctcgacaaaggaaggtgttcagcaactagtgttgggtttgtatataataagaggcgacaacataagtatcgtcggagaattagatgaagaaatcgattcgtctgttgactggtcggaaaaaagagctcatcctctaaagcctgtcattcattgagtggcttggaaggcaatagagctgttgtagattgtctggtcgattaccatccagcaagagttttcttggtttatagtttgttcatcttgttcattgctatcaaaatgagctttctctgagattgttctgatcccaatcagaaaaaaaggacaatatcttcaaacccaaattttaccaaatatttaaagactgttttgtgctactttaatattctatttcattggcattggtggtggttattttctcagaacaatcaaaattgtaaatgtataaagtacactattaattagacaaagaagtgctgttggataacactaagtgcagtggttctcatgctcgtgtgctgataaggtgcaaatacttactacaagaaaagtgatttttaaagtcacac

SEQ ID NO: 2361 - DNA, 477 bp, Olea europaea
ggtagaggtttcccagcgcacgaaccagtagtattgtaagggttcgcaaaggtccaagaatcagcgacttaaaaagaattgtcgcctatttgtattggagatcagaagatgtctagtgggcttgggcttgagaatcttgttgaccaaacaatttcagtgatcacaaatgatgggcgaaatatagtgggaatcctgaaaggttttgaccaagctactaatataattcttgatgagtctcacgaacgggtgtattccacggaggaaggtgtacaacaacttgtgctcggcctctacatcataaggggcgacaacataagcattgttggagaaatagacgaagagctagatgctagcttggacttgtcactactgagagctcatcctctgaagccagttatacattgatttgtaacatgacagtatctaaagattgcttaggtaggaatctagaaaacacacccaaaacgcaggggattg

SEQ ID NO: 2362 - DNA, 686 bp, Rosa hybrid cultivar
ttacaatcgccttcaaaatgcttgtcatatcgaggcatctagcactgtctgttttatttggtcaagattcactcttttactggatctgacttaaagacttcgaatatctccagtcctcacgcaccccagcccttaagttctaaacgggggatgatcaattctttgtggtattatgtgtctcccctaaacattctgaacagaggaatattaattctttgaaacttttgcttatcaagaagcctcagaattgaaatatgtccggtggccctggtcttgagtcacttgttgatcaaacaatttcagttatcacaaatgatggacgcaatattgtgggagtcttgaaaggctttgaccaggctactaatatcattcttgatgagtctcatgaacgtgtcttctctacaaaggagggtgttcagcaactcgtgttgggattgtatataatcaggggcgacaacataagcatcgttggggaactagatgcggatcttgattcaagccttgactggtcgaagatgagagcgtatcctctgaagcctgtcatccattgactgatcatgaaagccatagagatgttgtaggctcgatgagtagattatggcgaaccgaaacaaatgtgttacttataggtgtataatgataggaacaattacgggtttagtaatactgatttggtttctaaactg

SEQ ID NO: 2363 - DNA, 866 bp, Aristolochia fimbriata
agcttcttcttcagtctccccatccgcctcactgcgattcgagcttctacttccctcactttcccgcggtctgcattttttctaatctttccctcctccatcgggcaggtcgacgagtatcaagggataatctacgaggtagtgcgtgcgcgcttgtaccgaaggattagcatagtggtggccttcctcatttgtcaatgtcaactggaccaggacttgaatctcttgtagaccaacaaatatcggttatcaccaatgatgggcgtaatattgtgggaattttgaaaggttatgatcaagctacaaacatcattctggatgagtcacatgaacgggtatactccactaagcaaggagttcaacaacttgtattaggcctgtatataataaggggtgacaacataagcgtcgtcggagaactcgatgaggagcttgaagcaagtctggatttgtccaaattgagagcacaacccctcaagcctgtaatccactgattatgatagagcttgacttggactatatatgattgtatacatctacattgaaccgctctgactaaatttaggtgaaatgcataagagtggaatgtagcttatttcacattgagctgtgttgaaactctttttgacaatgaggtataacttaccagttgggaccatcaagtttttggaacccctgtgcatacttatctaatctcatgaatgaggtaacactgaaatgctgacttttgaatctgtgtttgcaaatattgggtgattttcagttttttcgatctgccttccatggttacctgttgcattccagggacatgaacactttgtcattgttatctatgtcagtctatacagatggattgcattcagtga

SEQ ID NO: 2364 - DNA, 996 bp, Artemisia annua
caataacaagtcggaagaccgtctttggtttcattcttccaaaacaaaacctagcagaacaggatttaacaagagaattaagttgaggtgtttctctagcagtatctgcaaaatgctgggtgggcctggacttgaatcggtcgttgatcaaatcatctctgttattacgaatgatggacgcaacatagtgggtctcttgaaagggtttgatcaagctacaaatattattcttgatgaatctcatgaaagagtttactcgaccaaggaaggtgttcaacaacttgtattgggtctctacatcataaggggtgataacataagtgttatcggagaattagatgaagagcttgatgcaagcttgaatatgtcagaactgagagctcatcctctgaagcctataattcactgatggtggcaagttatgcatatttaaaacggcatgaaaattgtagtggttattatctattcactagcaccttagagtgagatttttttgtccaactgatgtttggctttatcatctagctgcttttggtttattttgcatattaaatatgttcttgctgggattaatgattaatgtttgcactcttgtgcaaacatgaaactttattatgaggtgttccaaaagccaatttgttagggctctaatcatccagaccttttggtacatctttttggtaggaaaaaaaatgttttctttgtcaccaatagctctgcgttgtgaccatctaacagggtgccacactatattagcaactgctgtcagcgcttggtttggaccatgtcaccaatagctctgcgttgtaaccatcaccagatttgctgccgtcagacttcaaatgccttctaagtttagatcttgccggattgatttagaggttttttatgcttataaaatgttttgatgcgtaagattggtgttttatgtttttcaaactcatttttgttctgatttcatattggagaatgttatttgattttaatgatttagag

SEQ ID NO: 2365 - DNA, 569 bp, Cynara scolymus
cgggatttagttgggaatgcgttacatccatcgcgtgagtacgagtcctcggtgtaccggaagagaagtaagctgcgacaacgtttccttagagcctctacacgttttttctcgcaacgactaagaaggttgtgaagcacagacaagttcaggtgtgctagtgttctagtggtgtcagcgaaatgctgggtggtccagggcttgagtctgtcgttgatcaaatcatttcagttatcactaatgatgggcggaacatagtgggtgttttgaaaggttttgatcaagctaccaatataattcttgatgaatctcatgaaagggtttattctactaaggaaggtgttcagcaacttgtattaggtctctacatcataaggggtgataacataagcataattggggaattagatgaagaactggatgcaagcttggatttgtcagaactgagagctcatcctctgaagcctgttattcattaatgtgctacaaggtattcttagtaaaaccttgaatcttgtaagggaagtagatgatgaaatggatttattatgatattatttgatttaaac

SEQ ID NO: 2366 - DNA, 771 bp, Taraxacum officinale
aacggcagagtgtaaaccctaaatcgacctgtgaggcgccgatagcgacaaccgagttagaagcaccgacaggcgacaaccgagcttgaagcgccgcagcttctccgtctcctacaagccggcgtccctgagattgaagaggtcctgcctcgattttcattttgcaagttcgaagacccactgcttcgattcagcaactctcaggatttgaagcaaaatgctgggtgggcccggacttgaaacggtcgttgatcaaatcatatcggtcattacaaatgatggtcgcaacatagtgggagtattgaaagggttcgatcaagctacaaatataattcttgatgaatctcatgaaagagtttattccaccaaggaaggtgttcagcaactcgtattaggtctctacatcataaggggtgataacataagtgttattggggagttagatgaagagcttgatgccagcttggatttgtcacaactgaaagctcatcctctgaagcctgttattcattaatcttctatatcttatccatatgttatgtagactctctatgaaaaactagaatttggaattttgagttacaatattatctgtcgggtttaagaacacatgaaactcaagtgcttgcttgttatcttctgtagaagcaaaatagattcctttgtagttttcttgtttggatatttgaggtcatatttgtaaaaaaagttcagagacttaatagggaaagtcttttctttttgcattaagctaaaaaaaaaaaaaaaaaa

SEQ ID NO: 2367 - DNA, 916 bp, Lotus japonicus
atcccattctaaaacacccatttgaactcagcacccttccccggacaacgtccctcgacgctccggcgagctactgcagtccgaagaaggtatcatactctctccggcgacagttaccttctccgacgacacttctctccttccagctgcgtgaactgtgactataagtttgacaaccaaagcagccaataactaactcggctagatgtcgactgggcctggacttgagtctcttgtcgatcagcaaatttcagtaattacaaatgatggacgaaatatagtgggtgtcctaaaaggctttgaccaggcaactaatataattcttgatgagtcccatgaacgagttttttctaccaaggaaggcgtccagcaaatagttctcggtttatacatcattaggggtgacaacataagtgttgtcggtgaactggatttggatcttgataggagccttgatatgaccaagcttagagctcatccgttgaagcctgtcatccactgaagtaaacttatgttagttgttaggagatgattgcttggtggaaagggttggagcattacaatattatatacgattttaagaggtgaaatgaatgtgcaagaatattttgacaacataatatactcaattagtaatatttctcattctgttggttgttgatgttgcatggaaatcatggcttactatgtgctggactgtgctaaacaagtgttcattatgatggtgctggctagtattggtaacattctggtttggaccttcacttcttcaccttggtcacagtgcaaaccttcttttgctgccgttcaaaagaatcttaatacaccaatgtgctggaccatgtatttttcaatagtcttattatttttgcagtacaatattagcctagattggtttagagactatgaaatcatg

SEQ ID NO: 2368 - DNA, 791 bp, Populus trichocarpa
caaatcctcttaaaccatcaaaaccctctttctctgcctcttctgtgttagaaactcaaaggtgtggaggatctctcccgggtctctcaaacttcttccgcctcgtagtttagttaaaaacgctccttttctattgaaatccaaacagcaagaagcttacaaatcgagttgaacagagaaataaagttttcacaaccagtcttgcgagggagtcagcagtttttggacttgaaaaatgtctattggaacaggactcgagtctctcgtagatcaaacaatttcaattatcacaaatgacggccggaatatagtgggagtcttaaaaggcttcgaccaggccacaaatattatccttgatgaatctcacgagcgtgtttactccaccaaggaaggtgttcaacaactagtgttgggcttgtacataataaggggtgacaacataggcgttgttggggaacttgatgaagagcttgatgcgcaccttgacttgtctagtctgagagctcatccactcaagcctgtcattcattgatctgatataaggaagctgaattgtcgcagaacatatgatgggttaagtacttgcaaaagaaaatgtattggaagattggtgtgcggaatggccagtaatttattgctctaaatgttaccgtagcagaatatcatgttgttgtagagttgggatcaaatttattcagtttttactagtgcttattatttctcctttgactcttctgatataactattgaatctgaagcaatacagcgccggtcctttcttttttatatta

SEQ ID NO: 2369 - DNA, 686 bp, Fragaria vesca
gctgctccggtctctctacttccagccgcagccgcagccaccgtcaaaccgctcgagtccgatttggaaacttttgcttatcaagaagcttcagaattgaaatatgtccggtggccctggtcttgagtcacttgttgaccaaacaatttcagttatcacaaatgatggacgcaatattgtgggagtcttgaaaggctttgaccaggctactaatatcattcttgatgagtctcatgaacgggttttctctacaaaggagggtgttcagcaactcgtgctgggattgtatataatcaggggcgacaacataagcatagttggggaactagatgcagatcttgattcgagccttgattggtcgaagatgagagcgtatcctttgaagcctgtcatccattgactgatcgtgaaagccatagagatgttgtagactcgatgggtagattatggccatccaaacaaatgagttacttataggtgtataatgatggacatttgggtttgtaatactcagtcgggtttctaatctgttggactgtcattctacttatgcgctagacaatgaacaggttataatccttttcttgaatgctgatgtgacagagtagaacttaccagcaagaatatgagtgttattcaactacccccttttgaattcattctaaagcctatatgtttggatttct

SEQ ID NO: 2370 - DNA, 479 bp, Helianthus annuus
gttcaaattgtaatatcggcgacaggattcgtgaagtctttctctcgtgaaccctaagaaggcaggctttgaagcagtatcgttaaaatgttgggtgggccaggacttgaatctgtcgttgatcaatacatttcagttatcacgaatgatggacgcaacatagtgggagtattgaaagggttcgatcaagctacaaatattattcttgatgaatctcatgaaagagtctattcgaccaaggagggtgttcagcaacttgtgttaggtctttacatcataaggggtgataacataagtgttatcggggaactagatgaagagcttgatgcaagcttgaatttgtcggaactgagagctcatcctctgaagcctgtcattcactgatggttacattgtattacactattatgcatggttaaaatatgaatgtcgtaaggtaatcagatacccgtttcagtgaggaattattatcgggttta

SEQ ID NO: 2371 - DNA, 742 bp, Helianthus annuus
taagaagttcaaattgtaatatcggcgacaggattcgtgaagtctttctctcgtgaaccctaagaaggcaggctttgaagcagtatcgttaaaatgttgggtgggccaggacttgaatctgtcgttgatcaatacatttcagttatcacgaatgatggacgcaacatagtgggagtattgaaagggttcgatcaagctacaaatattattcttgatgaatctcatgaaagagtctattcgaccaaggagggtgttcagcaacttgtgttaggtctttacatcataaggggtgataacataagtgttatcggggaactagatgaagagcttgatgcaagcttgaatttgtcggaactgagagctcatcctctgaagcctgtcattcactgatggttacattgtattacactattatgcatggttaaaatatgaatgtcgtaaggaaaagatatctgtttgctagcagcatcctttttgcgtgtgcatgttgagttgtttaccatccaacgggttctggattttggctgtgtgacctcattacacattgtattacgtctgccaacacaagttcggttagtatcgtagtccatgtcaagattcgcgtcggatggactctatgatgattgaaatgtatcattcaacttcttcctttcttgtcttccttgctagaatagttttggtatattgaaatagttttaaaatggttaatactgtaaaagctattatgctatcttattttcac

SEQ ID NO: 2372 - DNA, 514 bp, Zinnia violacea
cgccccgtgcactcgccactttccctctctggcaccaagtagttgtaatctgggtgacagcacccgctgaaggaaagcagcgtctttaacattttgttggagctttcaacgtgtctctcctaaaccctaacagagaaatcaggctttgaagcagtcagcatcttgaaaatgctgggtgggccaggacttgaatctgttgtcgatcaatatatttcagttatcacgaatgatggacgcaacatagtgggagtattgaaagggtttgatcaagctacaaatattattcttgatgaatctcatgaaagagtttattcgaccaaggagggtgtgcaacaacttgtgttaggtctttacatcataaggggtgataacataagtgttattggggaactagacgaagagcttgatgcaaccttgaatttgtcggaactgagagctcatcctctgaagccagttattcactgatggttacatgctattatgcatggcttgaacattattgtcgtaaggtaat

SEQ ID NO: 2373 - DNA, 317 bp, Momordica charantia
acctgggcttgaatctctggttgatcaaacaatatcggttatcacaaatgacggccgcaatatagtgggggtgttgaaaggatttgaccaggctacaaatattatccttgatgaatctcatgagcgtgtttactcaaccaaggaaggcgttcagcaacttgtattgggtctatatataatccgaggcgacaatataagcattgttggggagctagatgaggaacttgattctaatctcgacttgtcaaaattgcgagctcatcctctgaagcctgtgtattctatttaatttggatctatttattctgagtcatgtt

SEQ ID NO: 2374 - DNA, 550 bp, Ambrosia trifida
ttttcttggggtttcaacgtctttctcgtgaccgtaaaaagctaggctttgaagcagtatctttaaaatgctggtgggccaggacttgaatctgttgttgatcagtacatttcagttatcacaaatgatggacgcagcatagtgggagtattgaaagggtttgatcaagctacaaatatcattcttgatgaatcccatgaaagggtgtattcgaccaaggagggcgtgcagcaacttgtgttaggtctttacatcataaggggtgataacataagcgttattggggaactagatgaagagctcgatgcaagcttgaatttgtcggaactgagagctcatcctctgaagcctgtcattcattgatggttacaaggtgtcatgcatggttaaaaacatgagtgtcgtaaggtaattagatacttgtttcagtgagaaagtattatctggtttaattagaaatgctaagccaattttgtagccgacattttgggacatgtttttggaagaaagagatttgttagcagcaaaaaaagaaaaagtaccgactgcg

SEQ ID NO: 2375 - DNA, 410 bp, Flaveria ramosissima
gttttaaccagtggattagggcagagaacccagcgcctctagtgtttcctcggagcctttctgtcgcaaaacccaagaaagcaggttttaaagaggaattgaggcggtattcgcaaaatgttgggcggtccaggacttgaatcagttgttgatcaatacatttcagttatcacaaatgatggacggaacatagtgggagttttaaaagggttgatcaagctacaaatattattcttgatgaatctcacgaaagagtatattcgaccaaggaaggtgttcaacaacttgtgttaggtctctacatcataaggggtgataacataagtgttataggggaactagacgaagagcttgatgcaagcttgaatttgtcagaactgagagctcatcctctgaagcctgttattcat

SEQ ID NO: 2376 - DNA, 614 bp, Ambrosia trifida
cacaagcaacaacaacgttgtcttcctgtctgtttgggtatcatctctgcacagttaacgaggtcaaaggcttgaatcacaactgatttgaagttggtgcttttgtgttattgcaaaaatgttgggtggccctgggcttgaatctgttgtcgatcaactcatttccgtcatcacaaacgatggacgaaacatagtgggaattctaaaagggtttgatcaagcgacaaacattatcctggatgaatctcatgaaagagtttattccaccaaggaaggagttcaacaacttgtgttgggtctttacatcataaggggtgataacataagcattattggggaactagatgaggaacttgatgcaagcttggatttgtcagaagtgagagctcatcctctgaagcctgttattcactagtgagctgcatggtatgctgcgtaattgcaattatgtttttttttaatgaaagtaaatgatttacttgagaaaatattattaagtgcttgctatatgtcttgaggtggattttttagcttgtaattgacaattgaaagtggaattgtatccttctagaacttcttttatgttccaaaaagaaaatactacttattattag

SEQ ID NO: 2377 - DNA, 729 bp, Brassica rapa
aatttttccggtttggttgctggtttgggttcaaaaacacaaagcaaaagacgcccgagttttcagaaaacagtgacgaggggggaggggatttggggtttagggctttaacactcagaagcaaaaggggtttacattcggaagcagcaaaggtcttttcaactgttcgcatggcaacaactactggacttgagtctcttgtcgatcagatcatttcggttattacaaacgatggacgcaacattgtgggagttctcaaaggttttgaccaggcgactaatataattctggatgaatctcatgaacgcgtcttttccacaaaggaaggagtacaacaacttgtgttgggtttgtacattatcagaggcgacaacataggtgttattggggagctagacgaagagctcgatgctagtctggacttttcgaaactaagagctcatcctttgaaacccgtcgtgcattgattgaaaatagtaatgatgtacgacaaagcctgaacaaagacaagattgtgaacaatttgaattagtttgtcttgctatctatctgttttgtgtatcccaaaccgcaaacgcaagctttcttttgcgatattctagtgttatgatcttttatttattaatcatgttttagtaagcttttgattccaatcctgtaagcgaatacaaaacttatgaggaaatttactactctcttcatttcatttttaagtgatgttttagaata

SEQ ID NO: 2378 - DNA, 639 bp, Euphorbia peplus
gcatagcagagattctccctaacgttttctccacctcatctgaacggcaaaagctaaaccaccacctctccgtcgcctgcctctctccaccggtttcaccgtctgccgcagttcgtttcaccaccattgctgctgatatcgcgacaaatcttgcagccttcatctttgacattcttgcaagggagctgcttcaggattgcgataatgtctaccggccctggacttgagtctcttgtagatcaaaatatttcagttatcaccaatgatgggcgcaatatagtgggaatcctgaaaggctttgaccaagcaacaaatatcatccttgatgaatctcacgaacgtgtatactccactaaggaaggtgttcaaaggcttgttctggggctatacattataaggggcgataacataagcattgttggggaagttgatgaagaactagatttgaaactcgacttgccaaacataaaagctcatcctctcaaacctgtcatccattgatcagattggtgaaatactacagagtgttaccattgtactgtactttcttattttttgcttttatctgtagttgatgtttgttattgaccaatgacttaaatacaattagcaattactgccaaaaaaaaaaaaaaattc

SEQ ID NO: 2379 - DNA, 632 bp, Euphorbia peplus
taccagattcccccaaacgtcacctgaacggcaaaagctcctcttcctccgtcgccggtgatatcgcgacaaatcttgcagcctctatctttctctgacattcgctgcttcgggattgccataatgtctaccggcggccctggacttgagtctcttgtagatcaaaatatttcagttatcaccaatgatggccgcaatatagtgggaatcctgaaaggctttgaccaagcaacaaatatcatccttgatgaatctcacgaacgtgtatactccactaaggaaggtgttcaactgattgttctggggctatacatcataaggggcgataacataagcattgttggggaacttgatgaagaactcgaattgaatctcgacctgaaagccttaagagctcatcctcttaaacctgtcatccactgatcagattggtgaagtacagagtgttacaactacagttaccattgtactgagctcggagtatatcattgttttgtttgtttcttttgcttttctgtacttgatgtttgttattgaccaatgacttaaatacaattagcaattaccgcccttcaatttattggcatgatttttagcgatggatacacaattcagagagattggttagtgtg

SEQ ID NO: 2380 - DNA, 533 bp, Flaveria ramosissima
atgggggctctcatttgccgaattcgttgcgaaaaacgtgaagtaaaacaagcagcaaagtcgtcttcttccagtctttttgggtcttctatcaacaattaagaggcttgagtctcgagtgatttgaagtaagttggtgcatttgtggtattgcaaaaatgctgggtggccctgggcttgaatctgttgtcgatcaactcatttcagttatcacaaatgatggacgaaacatagtgggaattctaaaaggttttgatcaagcgaccaacataattctggatgaatctcatgaaagagtttattccaccaaggaaggagttcaacaacttgtattgggtctttacattataaggggtgataacataagcattattggggaactagatgaggaacttgatgcaagcctggatctgtcagaagtgagagctcatcctctaaagcctgttattcactgatgagctacatggtatgctgcttaattgcaattatgtttttgaaagaaagtaaatgatttacttaagaaaacattatta

SEQ ID NO: 2381 - DNA, 596 bp, Flaveria ramosissima
ccgaattcgttgcgaaaaacgtgaagtaaaacaagcagcaaaatcgtcttcttccagtctttttgggccctgtataaacaattaaggaggcttgagtctcgagtgatttgaagtaagttggtgcttttgtggtattgcaaaaatgctgggtggccctgggcttgagtctgttgtcgatcaactcatttcagttatcacaaatgatggacgaaacatagtgggaattctaaaaggttttgatcaagcgaccaacataattctggatgaatctcatgaaagagtttattccaccaaggaaggagttcaacaacttgtattgggtctttacatcataaggggtgataacataagcattattggggaattagatgaggaacttgatgcaagcctggatttgtcagaagtgagagctcatcctctaaagcctgttattcactgatgagctacatggtatgctgcttaattgcaaatttgcaattatgtttttgaaagaagtaaatgatttacttaagaaaacattattagattcatagacttgaatagttaagtgcttgttatatgtctttgggtggaatcttttagcttttaactatatt

SEQ ID NO: 2382 - DNA, 677 bp, Helianthus annuus
caatgttcgtgcttaccttaaaacctccatacccgaattcaattcatagcgagacacctgaagaaagcaagcagaaacaacgttgtcttccagtctatttgggtattatccccacaattaacgaggctttaatcactagcgatttgaaggaagttggtgcttttgtgatactgcaaaaatgctgggtggccctgggcttgaatctgttgttgaccaactcatttcagttatcacaaatgatggacgaaacatagtgggtattctcaaaggttttgatcaggcaacgaacataattctggatgaatcgcatgaacgagtttattcgacaaaggaaggagttcaacaacttgtattgggtctttacatcataaggggtgataacataagcattattggggagctagatgaagaacttgatgcaagcttggatttgtcggaagtgagagctcatcctctgaagcctgttattcattaatgagctacatggtatgctgcgtaattgcaatggtgttttttaaagaaagtaaatgttttacttgagaaaacgttattggatttatcggcttgaaaacttaagtgtttgctatatgtcttggtgtggattcttttagcttttagttgaaattggactgtgtactacaactttatattttctaaggatgctaaagaattcatgt

SEQ ID NO: 2383 - DNA, 313 bp, Eutrema halophilum
ctttggactgttaatatggcggcaactactggactcgagtctcttgtcgatcagatgatttcggtaattacaaacgatggacgcaacattgtgggagttcttaaaggttttgaccaggctacaaatataatccttgatgaatctcatgaacgggtcttttccacaaaggaaggagtacaacaacttgtgttgggtttgtacattatcagaggcgacaacataggcgttatcggggagctcgacgaggagcttgatgctagtctggatttttcgaaactgagagctcatcctttgaaacccgtcgtgcattgaa

SEQ ID NO: 2384 - DNA, 691 bp, Artemisia annua
gaaaactaaaagcaaatgttccaggctttaaacccgtgaccttcctcctcagtaaaacatagtgcaattgtcgtttcggtacgattaaccctccgtagccgaccgaaccaaggggcaacaaccgctaacgaggcatcgaaccacgagtgaattccagtgaggagctagtgcttttgtggtattgtaaaaatgctgggtggccctgggcttgaatctgttgtggaccaatacatttcggttatcacaaatgatggaaggaatatagtgggaattctaaaagggtttgatcaagcgacaaacattattctggatgaatctcatgaaagagtttattccaccaaggaaggggttcaacagcttgtattgggtctctacattataaggggtgataacataagcgttattggggaattagacgaggagcttgatgcagggctgaatttgtcagaactacgagctcacccattgaagcctattattcactgatgaactgcatggtatgctgcttattggaaatgatgtgttttagagaatgtggataatctacttggggtgcattcttttagcttttcatcattctagaacttatatgtcctaagaatgtaagaactcaattgctgatctttatgtattcccctgttggattgttttgttgtatacatgaggatcatgtattcatattggttttgaa

SEQ ID NO: 2385 - DNA, 637 bp, Raphanus sativus
gggaaccaatcaattttatattcgtttcccttcgtgaatttttttctcattatcttatgtttttcttgtaatatgtccatgtaaacttaacagaaacttcatatccgggttcctatagattctgttgagatccgttatgcccaccaactgttcgatgaatttcttgctgaaacattttaagtaacccctttcaggtctttcccaactgttcgcatggcagcaactactggactcgagtctcttgtcgatcagatcatttcggttattacaaacgatggacgcaacattgtgggagttctcagaggttttgaccaggcgactaatataattctgaatgaatctcatgaacgcgtcttttccacaaaggaaggagtacaacaacttgttctgggtttgtacattatcagaggcgacaacataggtgttataggggagctggacgaggagctcgatgctagtctggacttatcgaaactgagagctcatcctttaaaacccgtcgtgcattgattgaaaatagtttcgatgtatgaaaaagccttaacaacgaaaagatcgtaaaactattttagttagttcatcttgatatctgtctgctttgtgcatcccaacccgcaaacgtaagcagcttctgatt

SEQ ID NO: 2386 - DNA, 699 bp, Euphorbia esula
  misc_feature (75)..(75): n is a, c, g, or t
caacggcgacagcaacggcgacagcaacggcgacagcaacggtgtcaaaaaaaaaaaaaaaaaaatccctagtancatagcagagattctccctaacgttttctccacctcatctgaacagcaaaagctaaaccaccacctcctccgtcgcctgcctctctccaccggtttcaccgtctgccgcagttcgtttcaccaccacactagctgctgatatcgcgacaaatcttgcagccttcatcttagacattcttgcaagggagctgcttcaggattgcgataatgtctaccggccctggacttgagtctcttgtagatcaaaatatttcagttatcaccaatgatgggcgcaatatagtgggaatcctgaaaggctttgaccaagcaacaaatatcatccttgatgaatctcacgaacgtgtatactccactaaggaaggtgttcaaaggcttgttctggggctatacattataaggggcgataacataagcattgttggggaagttgatgaagaactagatttgaaactcgacttgccaaacataaaagctcatcctctcaaacctgtcatccattgatcagattggtgaaatactacagagtgttaccattgtactgtactttcttattttttgcttttatctgtagttgatgtttgttattgaccaatgacttaaatacaattagcaattactgcc

SEQ ID NO: 2387 - DNA, 675 bp, Helianthus annuus
gcgaccaatgttcttgcttccacttaaaacctccatacccgaattcaattcatagcgagacacctgaagaaagcaagcagcaacaacgttgtcttccactctatttgggtattatccccacaattaacgaggctttaatcactagcgatttgaaggaagttggtgcttttgtgatactgcaaaaatgctgggtggccctgggcttgaatctgttgttgaccaactcatttcagtcatcacaaatgatggacgaaacatagtgggtattctcaaaggttttgatcaggcaacgaacataattctggatgaatcgcatgaacgagtttattcgacaaaggaaggagttcaacaacttgttttgggtctttacatcataaggggtgataacataagcattattggggagctagatgaagaacttgacgcaagcttggatttgtcggaagtgagagctcatcctctgaagcctgttattcattaatgagctacatggtatgctgctgcgtaattgcaatggtgttttttaaaggaagtaaatgatttacttgagaaaacgttattggatttatcggcttgaaaacttatatgtcttggtgtggattcttttagcttttagttgaaattggactgtgtactagaacttctttatatgttctaaggatgctaaagaattca

SEQ ID NO: 2388 - DNA, 734 bp, Helianthus annuus
tgcgaccaatgttcttgcttacacttaaaacctccatacccgaattcaattcatagcgagacacctgaagaaagcaagcagcaacaacgttgtcttccactctctttgggtattatccccacaattcacgaggctttaatcactagcgatttgaaggaagttagtgctttcgtgatactgcaaaaatgctgggtggccctgggcttgaatctgttgttgaccaactcatttcagtcatcacaaatgatggacgaaacatagtgggtattctcaaaggttttgatcaggcaacgaacataattctggatgaatcgcatgaacgagtttattcgacaaaggaaggagttcaacaacttgttttgggtctttacatcataaggggtgataacataagcattattggggagctagatgaagaacttgacgcaagcttggatttgtcggaagtgagagctcatcctctgaagcctgttattcattaatgagctacatggtatgctgcgtaattgcaatggtgttttttaaaggaagtaaatgatttacttgagaaaacgttattggatttatcggcttgaaaacttatatgtcttggtgtggattcttttagcttttagttgaaattggactgtgtactagaacttctttatatgttctaaggatgctaaagaattcatgtgctgatcttttgtcttcctttcttgttggttatgcattcctagggatagagaagatgt

SEQ ID NO: 2389 - DNA, 681 bp, Helianthus annuus
caatgttcttgcttacacttaaaacctccatacccgaattcaattcatagcgagacacctgaagaaagcaagcagcaacaacgttgtcttccactctatttgggtattatccccacaattaacgaggctttaatcactagcgatttgaaggaagttagtgcttttgtgatactgcaaaaatgctgggtggccctgggcttgaatctgttgttgaccaactcatttcagtcatcacaaatgatggacgaaacatagtgggtattctcaaaggttttgatcaggcaacgaacataattctggatgaatcgcatgaacgagtttattcgacaaaggaaggagttcaacaacttgttttgggtctttacatcataaggggtgataacataagcattattggggagctagatgaagaacttgatgcaagcttggatttgtcggaagtgagagctcatcctctgaagcctgttattcattaatgagctacatggtatgctgcgtaattgcaatggtgttttttaaagaaagtaaatgatttacttgagaaaacgttattggatttatcggcttgaaaacttaagtgcttgctatatgtcttggtgtggattcttttagcttttagttgaaattggactgtgtactagaacttctttatatgttctaagaatgctaaagaattcatgt

SEQ ID NO: 2390 - DNA, 710 bp, Helianthus annuus
cgggggacttcctgacataatagtgcgaccaatgttcttgcttacacttaaaacctccatacccgaattcaattcatagcgagacacctgaagaaagcaagcagcaacaacgttgtcttccactctatttgggtattatccccacaattaacgaggctttaatcactagcgatttgaaggaagttagtgcttttgtgatactgcaaaaatgctgggtggccctgggcttgaatctgttgttgaccaactcatttcagtcatcacaaatgatggacgaaacatagtgggtattctcaaaggttttgatcaggcaacgaacataattctggatgaatcgcatgaacgagtttattcgacaaaggaaggagttcaacaacttgttttgggtctttacatcataaggggtgataacataagcattattggggagctagatgaagaacttgatgcaagcttggatttgtcggaagtgagagctcatcctctgaagcctgttattcattaatgagctacatggtatgctgcgtaattgcaatggtgttttttaaagaaagtaaatgatttacttgagaaaacgttattggatttatcggcttgaaaacttaagtgcttgctatatgtcttggtgtggattcttttagcttttagttgaaattggactgtgtactagaacttctttatatgttctaagaatgctaaagaattcatgt

SEQ ID NO: 2391 - DNA, 654 bp, Zostera marina
ttgatccatccaagcccagacagcgctagtgatcagaagtcggatccggcgtgcacccttagttgaaagatagattttggaattactgtgttctgtgatatcggctgaataattcatttatggcagctgcctccacacttgaatcacttgtcgaccaaatgatatcagtcattacaaacgatggtcgcaatatcgtgggaatattgaaaggtttcgaccaagctacaaatatcattcttgatgaatcacatgaaagggtttattcaacaagggaaggtgttcaacaactcgttctaggtttgtacattataaggggtgataacataagcgttgttggagaattagacgaggatcttgattcaaatctggacttgtcgacagtaaaagcacatcccctgaagcctgtgatccattgatccgaatataattctcgattgcaaactctcgtataattctcgacgtcattgagtttgtttatcttatgggattaagttgtatttaatagcatgatgaatttaaactttgtccatgttatcttgattttccatcttctaaccggaagttgattcccattcttctagattatggttttgtaagaagtattagattgatctgaataaatccttattgaaaacatcattcacagaaactccc

SEQ ID NO: 2392 - DNA, 617 bp, Valeriana officinalis
cagagacgaacaaaatagaagatacctaccgacgccgcagcagtctagtcgacgggaagctggagaacatagtgactgtagttgtctagccaacacgacaacggagacggcaggagtatcaagtggaaataaagccagcaagtcatatagtcaaacagtcatcagagaatgtcaagtggaactggtggaactgggcttgaatctcttgttgaccagataatttcagtcataacaaatgacggccgaaatatagtgggagttttaaaaggatttgatcaggctacaaatataattcttgacgagtctcacgagcgagtttattccaccaaggaaggcgttcagcagcttgtgttgggtctctacatcatacgcggcgataatataagcatagttggagagctagatgaggaactggatgcgagcttggaattgtcgaaagtgagagctcaccctcttaaaccggttatccactaaatatattccatgccttcttgcggtacaaacacttgaacatgtcttctttttcattttacgatcgaattttctacctacatattgcgcttgattctgattttattaaatagtttcatcacttaatagagtaaaattcagacttt

SEQ ID NO: 2393 - DNA, 543 bp, Castanea mollissima
tactgtggacaaaaataacgaaagggaaggagagagagagagaaagagagagtgtgtgtgtgtgttgagactgaggggaaactcggcgctgggcaattactgtagctttttgctcgcacgcaaaagcaaaaaaaattggctcataacctatcttgtagaggagtctctcatatagattttgggagcctcaaaatgtcaggtggccctggacttgaatctcttgtagatcaaacaatttcagttatcacaaatgatggacggaacatagtgggagtcttaaaaggctttgaccaggctacaaatattatccttgatgaatctcatgagcgtgtctactccacaaaggaaggtgttcaacaacttgtgttgggtttgtacataatcaggggtgacaacataagcgtagtcggggagcttgacgaggaccttgatgctcatcttgtatttgtacaaaactggagggctcatcctctcaagcctgtcatccaattaaaagactaaaggaaaggtgactaaaagtttgttaaacgacccacggttagg

SEQ ID NO: 2394 - DNA, 304 bp, Setaria italica
gttcttctcctgctcctgcagaggtcatctccgtcatcaccaacgatggccgcaacatcgtgggcacgctcagaggatttgaccaggccaccaacattatcctcgacgagtcccacgagagggtctattcgacaaaggagggagtccagcaacttgtacattatcaggggtgacaacataagcgttgtgggtgaggtggatgaagacctggatgcaaggttggatctgtcgaagctacgagcgcacccactgaagccagtcatccactgaccgctgctgcgagatcagacacaccccgccgaga

SEQ ID NO: 2395 - DNA, 494 bp, Primula obconica
gcttataattaccggagagttttcagaatgtcggctggccctgggctcgagtctcttgttgatcaacaaatttctatcatcacaaatgatggacgcaatatagtgggaattttgaaaggcttcgaccaggctacaaatgtaattcttgatgaatcccatgaacgtgtttactctactagggaaggtgtacagcaagttgtgttaggcctctacatcataagaggagacaacataagcattgttggggaattggatgaagagctggatgcaagcctggatttgtcaaaagtgagagctcatcccctgaagcctgttatccattagtaagaaacacagtacgagcacatcttgtgtttttgaaggggtgaatctgctagaaatctattttaactgatgaaaacagtaacgttacctggtcatttgaaaacattttgtatcgtgctctttcttggtccataatgatgtagcttatatacaattagtttgattcctgt

SEQ ID NO: 2396 - DNA, 734 bp, Arabidopsis thaliana
acatccaaaagcaaaaacacacgccggagagttttctaagaacaacagtgacgaaaaggtttttagggtttctttaccaatcagaatctccgccaagtaacgattttcagattccgaagcagcaaagttcaaataatttccgaactgtaacatggcggcaactactggacttgagactctcgtcgatcagattatttcggtgattacaaatgacggacgcaacattgtgggagttcttaaaggttttgaccaggctacaaatataatccttgatgaatctcatgaacgtgtgttttccacaaaggaaggagtacaacaacatgtgttgggtttgtacatcatcagaggggacaacataggtgttatcggggagctggacgaggagcttgatgctagtctggatttttcgaagctgagagcccatccgttgaaacccgtagtgcattgattgaatatagttatggtgagaaaatctaattctctcattcaaagcctaaaaacaaagagaagatttgattgtaaacaatttggatagtttgttttgatgtctggagttgtcttatttgtgtatcctaaggacaaaagctatatgatattttatgtcttaaacgttttggtcggaaacttaaatcatacaatcttttggacggacctaggtttgctactagaccacaaattctttgattagaaaaaaaacttttattgttaaccaaaattttatagatattcaaatt

SEQ ID NO: 2397 - DNA, 632 bp, Brassica juncea
gggcttagttagattcagaagcagcaaaggactttcaactgtagcatggcgacaactactggacttgagtctcttgtcgatcagattatctccgtaattaccaatgatggacgcaacattgtgggagttctgaaaggttttgaccaggctactaatataatcctggatgaatctcatgaacgcgtcttctccactaaggaaggagtacaacaacatgtgttgggtttgtacattatcagaggcgacaacataggtgttattggggagctggacgaggagcttgatgctagtctggatttttcgaaactgagggctcatcctttgaaacccgtcgtgcattgattgaaaattagttatgatgagtgctaaacagaagagaaagattgcaaacagtttggattaagtttgtcttggagttgtgtgcttttgtctactatcctaaggttctttgtcaaacccttttgccctaaaagatcgttgtaattccaaaacgtaatatacacttcatttgcgatcttagtgtgagatgaattttatcttcaaaatcacgtatccttaatgttttttgggagctttttttattccaatccttgaagcgaatacaaaacttatttgaggaaacttactaatca

SEQ ID NO: 2398 - DNA, 673 bp, Brassica oleracea
ggagaaaagaaagtgacggcgaaaggggttttaattagggatttaaaacattgagaagaaaagggcttagattcagaagcagcaaaggactttcaactgtagcatggcgacaactactggacttgagtctcttgtcgatcagattatctccgtaattaccaacgatggacgcaacattgtgggagttctgaaaggttttgaccaggctactaatataatcctggatgaatctcatgaacgcgtcttctccactaaggaaggagtacaacaacatgtgttgggtttgtacattatcagaggcgacaacataggtgttattggggagctggacgaggagcttgatgctagcctggatttttcgaaactgagggctcatcctttgaaacccgtcgtgcattgattgaaaaatagttatgacgagtactaaacagaagagaaagattgcaaacagtttggattagtttgtcttggagtttgtgtgcttttgtctatcctaaggttctatgtcaaacgctttagacttcatttgcgatcctagtgagagataatttttatcttctaaaccaggtttccgtaatgtttttcggtagcttttttattccaatccttgaaggctgaagcgaataaaaaatttatttggggaaactcactaatcaaatgcaaatggaccgat

SEQ ID NO: 2399 - DNA, 729 bp, Brassica rapa
ggcgggtttaataatctaagaaaacacaaacccgagttttctgagaaaaaaagaagtgacggcgaaaggggttttaattagggatttaacattgagaagaaaagggcttagttagattcagaagcagcaaaggtctttcaactgtagcatggcgacaactactggacttgagtctcttgtcgatcagattatctccgtaattaccaacgatggacgcaacattgtgggagttctgaaaggttttgaccaggctactaatataatcctggatgaatctcatgaacgcgtcttctccactaaggaaggagtacaacaacatgtgttgggtttgtacattatcagaggcgacaacataggtgttattggggagctggacgaggagcttgatgctagtctggatttttcgaaactgagggctcatcctttgaaacccgtcgtgcattgattgaaaaatagttatgatgagtactaaacaaagagaaagattgcaaacagtttgtgttaagtttgtcttggagttgtgtgcttttgtctatcctaaggttctttgtcaaacccttttgccctcaaagatcgttgtaattccaaaacgtaatagacttcatttgcgatcccagtgagatgaattttatcttcaaaatcacgtatccttaatattttttgggagctttttttattccaatccttgaagcgaatacaaaacttatttgaggaaacttactaatcaca

SEQ ID NO: 2400 - DNA, 596 bp, Brassica rapa
  misc_feature (593)..(593): n is a, c, g, or t
  misc_feature (596)..(596): n is a, c, g, or t
ggagaaagaagaagtgacggcgaaaggggttttaattagggattgaacactgagaagaaaagggcttagttagattcagaagcagcaaaggtctttcaactgtagcatggcgacaactactggacttgagtctcttgtcgatcagattatctccgtaattaccaacgatggacgcaacattgtgggagttctgaaaggttttgaccaggctactaatataatcctggatgaatctcatgaacgcgtcttctccactaaggaaggagtacaacaacatgtgttgggtttgtacattatcagaggcgacaacataggtgttattggggagctggacgaggagcttgatgctagtctggatttttcgaaactgagggctcatcctttgaaacccgtcgtgcattgattgaaaaatagttatgatgagtactaaacaaagagaaagattgcaaacagtttgtgttaagtttgtcttggagttgtgtgcttttgtctatcctaaggttctttgtcaaacccttttgccctcaaagatcgttgtaattccaaaacgtaatagacttcatttgcgatcccagtgagatgaattttatctnccn

SEQ ID NO: 2401 - DNA, 559 bp, Brassica napus
ttagattcagaagcagcaaaggactttcaactgtagcatggcgacaactactggacttgagtctcttgtcgatcagattatttcggtgattaccaacgatggacgcaacattgtgggagttctgaaaggttttgaccaggctactaatataatcctggatgaatctcatgaacgcgtcttctccactaaggaaggagtacaacaacatgtgttgggtttgtacattatcagaggcgacaacataggtgttattggggagctggacgaggagcttgatgctagcctggatttttcgaaactgagggctcatcctttgaaacccgtcgtgcattgattgaaaaatagttatgacgagtactaaacagaagagaaagattgcaaacagtttggattagtttgtcttggagtttgtgtgcttttgtctatcctaaggttctatgtcaaacgctttagacttcatttgcgatcctagtgagagataatttttatcttctaaaccaggtttccgtaatgtttttcggtagcttttttattccaatccttgaaggctgaagtcaaa

SEQ ID NO: 2402 - DNA, 498 bp, Brassica napus
gggcttagttagattcagaagcagcaaaggtctttcaactgtagcatggcgacaactactggacttgagtctcttgtcgatcagattatctccgtaattaccaacgatggacgcaacattgtgggagttctgaaaggttttgaccaggctactaatataatcctggatgaatctcatgaacgcgtcttctccactaaggaaggagtacaacaacatgtgttgggtttgtacattatcagaggcgacaacataggtgttattggggagctggacgaggagcttgatgctagtctggatttttcgaaactgagggctcatcctttgaaacccgtcgtgcattgattgaaaattagttatgatgagtgctaaacagaagagaaagattgcaaacagtttggattaagtttgtcttggagttgtgtgcttttgtctactatcctaaggttctttgtcaaacccttttgccctaaaagatcgttgtaattccaaaacgtaata

SEQ ID NO: 2403 - DNA, 622 bp, Brassica napus
gggggtttaataatctaagaaaacacaaacccgagttttctgagaaagaagaagtgacggcgaaaggggttttaattagggattgaacactgagaagaaaagggcttagttagattcagaagcagcaaaggtctttcaactgtggcatggcgacaactactggacttgagtctcttgtcgatcagatcatctccgtaattaccaacgatggacgcaacattgtgggagttctgaaaggttttgaccaggctactaatataatcctggatgaatctcatgaacgcgtcttctccactaaggaaggagtacaacaacatgtgttgggtttgtacattatcagaggcgacaacataggtgtaattggggagctggacgaggagcttgatgctagtctggatttttccaaactgagggctcatcctttgaaacctgtcgtgcattgattgaaaaatagttatgatgagtactaaacaaagagagagattgcaaacagtttgtgttggagttatgtgctttgtctatcctaaggttctatgtcaaacgcttttgccctaaaagatcgttgtaattccaaaacgtaatagacttcatttgcgatcctagtgagagatgaattttatct

SEQ ID NO: 2404 - DNA, 787 bp, Ricinus communis
gaggtttctacacactgcccttgctgttgcccggaagcttattgtcgcctttcaaattgagcctctctctccatcagagaaatcgattgagatttataagcagtcttgcaaggaagtttctcacccaacttgtcgctaatgtctaccggccctggactcgagtcccttgtagatcaaaatatttcagttatcactaatgatggccgcaatatagtgggaatcctgaaaggctttgaccaggccacaaatattatccttgacgaatcgcatgaacgtgtttactccactaaggagggtgttcaactacatgttctgggactgtacataataaggggtgacaacataagcattgttggggaacttgatgaagaactggattcgaatcttgacttggcaagcctaagagctcatccactgaagccactcatcccttgatcaaatatgaattttttgggtggttgtggagcagataatggaccaagtatagtttgttacaaaaatatgatggccattgtactaagttggaaggaagtaatgatattattattattattatttcttttcttttctttccttttacttattttcacaatgatgtaaggcctgatgattgtgagccgagaactatgttagaaatagcaggtttcctctttaattttgtaggggatttgttctttcaggaaagttgtggccaagttcaaatctccttaacgaggaaaacaagttccatttcagcagaattatttttgcaacagtgcctgatgcatccatatacttaattgttttg

SEQ ID NO: 2405 - DNA, 3593 bp, Ricinus communis
aataaaacaatgagcttagactattattaaatgatactatcgcatcatattttctatcaacaaattgcagcaccgctcataaaatcagatgcgctttcctgatgaatgcattcagctgccttactagtctgtgttaaaagaaatcaggggaaagaaatatatgcatatattcctatcaaagatatatatctatctctgtgaatgggtttggacaccagaaaatggcaacccatcaatcaagcaagcacagttaccatgcaaaattacaacatcttccatgactttgcaagacaactccacattcaacctgcgaccatcaatttcaaacttaattcatctattcatatcacatatacccagccacttgataactcaattaaagtcgtagttggccttttcggattggtcgcggtttagtgcttcaaatcatcgccacatattgacttgaagaaagcttatcaagagagatggaaaatccacgacaaagaaataatggctcaaagtttcaattcttttcaacatttgcagcaattttaaggtgaatagatgcctcgggattgtgacataaagcaagaaggcagactcatctctagcagcctctaaaccaaacaaacaaagtttttactttggcatcataatgcactctttttttagtagcatttaaatatcttgtttttaaggtaatattctttttcgacgagcaacttctttgagaataacaacaagacattcctaatcgcagaaaatctcaaactaagaccttgtaaacacacagtgactcaatgatcaaccacttcttgcatcaggtacagaaggtgaagttggattacagcacttaaagaggagtcatcttttggggaaagaatagcaaccttactgcgagcaacaagtcaccacttacctcatgtagaaatcattggacagggccccatgctcgcaattacaccgactatacaaacccacaaactgagaaagagcatgtgaaggtccaataccataaattttcctcatagcacattatttactttggaataaatgagccagatcaggatcgtccaaggccacatctatccatccattcaagcgcatgtattcaatataatgatctggtggttccactgccctgcaatttctcggagtccagccatgaatcatctcaacatcccgagcaagccactgaatataagcacggtccacaggaggaataattttcagaagaatctcttccctttcttgctttacagtcacaggcttgtttcccatggtgcgcgaattttgcaagcttaaggaagagcataaagcaataaagcaaattagtgaatgaaccgagcaagataaataaatgtagaaacggcgtggtttatttcatcctatacttgcctgcttgctctaaaatgttaaaagtctcacaaagtagtgcctacgcagaaataaaagaaataacatacatcatagggagttcattaatttccttcaaaataatatattaacaataccacttctctgaatcatttactataactatagttgagaagtctagcataagaaatgctaataaatcatcacaatcacatcaaacgctaaaaacttgagccacattcaagacaagaaccagtgttatctcacatgctcaaaccaaaaagactcctgcagcataaagtataatgacttcagcattgtggtagggaggatccacacatccataagaaatttatttgtttccatcattccgtgcattggagtatttataaaagaaaaggtcaatatatcaaaatcccactcccaaaaaagacaatatatatatatatatataagtaagatggattaaaaagaaaacagcttgaagagagtcttgaaggaagcaactgaaatgtgatggacaaacaaagaaccttgcgggaaaaagcttgaactggcaataagttgctgaatgaaaaatgaacttcaccttatagtcataagcactaaagtgagccatgttgcacgaaaagagtggtgggataggtgtaacatagttttgaaaaagtaagcaggatttgtaattaagcgttaatgaaatgtatcaagcaaggatggcgttgacagtagcaggatttgcctagtatcaaatgcaagagaaatactagtaataaggcatcccaatcagattctaatatcgcaaagagttcaaagataaataagtttcctttaaaaccaacaaaaatttgaattttactttggtagataattttgagcaaggataccaggcacccataaaaagaataggtaatggctttggaaaaactttttatagattcagcaaacaaagtgaagaaactgagtatatatatatatatatatatatatatatatatatatatatatacccgaacagtgaaagaacaaagcaattaaaatgattacagacatctttacagcgtagggagatcaaaaccaaatcccaaagttcccaagcgtagaattctcaagagttcgaaacatagataaaaaggaaaaaaaagaaaagaaaaaaaaaggttaaccgatgataacaagtcaatgataatcaatatagattatcacgaattacaaattaaaagaattttgaaaaactgaccttgttgagcagagcagtcgaggattagagggtagagaagagatgaactgagagagagacagagaggcgcctgtaaaatttactaagattcttatttactaggatacccttgcagttctttggaattacaaaggtatccttgcagaagtagcgcatataaatattcttcaagacctaggccgggtttcgaggtttctacacactgcccttgctgttgcccggaagcttattgtcgcctttcaaattgagcctctctctccatcagagaaatcgattgagatttataagcagtcttgcaaggaagtttctcacccaacttgtcgctaatgtctaccggccctggactcgagtcccttgtagatcaaaatatttcagttatcactaatgatggccgcaatatagtgggaatcctgaaaggctttgaccaggccacaaatattatccttgacgaatcgcatgaacgtgtttactccactaaggagggtgttcaactacatgttctgggactgtacataataaggggtgacaacataagcattgttggggaacttgatgaagaactggattcgaatcttgacttggcaagcctaagagctcatccactgaagccactcatcccttgatcaaatatgaattttttgggtggttgtggagcagataatggaccaagtatagtttgttacaaaaatatgatggccattgtactaagttggaaggaagtaatgatattattattattattatttcttttcttttctttccttttacttattttcacaatgatgtaaggcctgatgattgtgagccgagaactatgttagaaatagcaggtttcctctttaattttgtaggggatttgttctttcaggaaagttgtggccaagttcaaatctccttaacgaggaaaacaagttccatttcagcagaattatttttgcaacagtgcctgatgcatccatatacttaattgttttgtcatttgtgggcttgatgcagc

SEQ ID NO: 2406 - DNA, 672 bp, Lactuca sativa
ctcgtgaccttgggcataggcagacttctcgagcaataagagtgcgacgatcgtcctttccttgcgattaacctccatctccaaattccagcacagaatacgtgaagtgtagcaagcgacaacaacaaatcttcgagtcgttttgcgttgtttctgtaaaattaacgaggtttcttcaattgaaggcattgaatcacaactggtattgtcaaaatgctaggtggccctggtcttgaatctgttgttgatcaaatcatttcagttatcacaaatgatggaagaaacatagtcggagttctaaaaggttttgaccaagcaacaaatataattctggatgaatctcatgaacgagtttattccaccaaggaaggagttcaacaacttgtattaggcctctacatcataaggggtgataacataagcataattggggaactggatgaggagcttgatgcaagcttggatttggctgaactgagagctcatcctctaaggcctgttattcattaatgttatgatgatcttattttattaaatcatgtgttttaggggaagtaaatgtgatgtacttttaaattctgatacatgaaaactgaagtggttgctatttgcgaatgctatgtatttgttttagcttttggttgaaacttgtttgaaacatgttaagtcgaa

SEQ ID NO: 2407 - DNA, 689 bp, Lotus japonicus
ttttgtggtcatagggtttgctttaaccggcaacatcccactcccttcgaagctaactgcatacctccggcgaaggttgctgcactctctccggcgacagttcccttctacgacgacacttctctccttcgaactccgtgaactgtgactataagtttgacaaccaaactagacaatagctagctcggcaagatgtcgaccgggcctggacttgagtctcttgtagatcagcaaatttcagtgattacaaatgatggacgaaatatagtgggtaccctaaaaggttttgaccaggcaacgaatataattcttgatgagtcccatgaacgagttttttctaccaaggaaggtgtacagctaattgctctcggtctatacatcattaggggtgacaacataagtgttgtcggtgaactggatgaggatctagataaaaaccttgataagtccaagattagagctcagcctttgaagcctgtcatccactgaagtaaacttatgttgttgttagcagatgattgcttgcttgcttggtggaaagggttgaagcgttactatattttatacaatattcagaggtgaaatgtgtgtgtaagaatatgctgacaacaacataatatactcaatgacaataagtaaatattctgattctgttggttgttgatgttgtatggaaatcatagcttact

SEQ ID NO: 2408 - DNA, 1014 bp, Carica papaya
ctcttctcgttgtctctctggttcgaaatttctacttctctctggtggaatctagcccgtagaagaacagcagcattaggcacgccacgttcagccatctcagttatctgtccgtcgtttcagctgccaggttccgcgtgaatcgagcaccctccgcgtgtcaagttgtcgatcggacgaaaaacccgtcggagtgggcgttctccatctccattttggccactgcctacagccaagctttgaaagtttgctctcactttgtttccctcttctgattgggaagactgttacctggttcctaatccgcaaaaatgtcaagtgggcttggactcgagtctcttgttgatcacacaatttcagttattacaaatgatgggcgcaatattgtgggaatcctgaaaggttttgaccaagctacaaatataatccttgatgaatctcatgaacgtgttttctccaccaaggaaggagtgcagcaacttgtgttgggtttgtacattataagaggcgacaacataagcgttataggggaattgaatgaggagctggatgcaagtttggatctctcgaaactgagagctcatcccctgaagcctgttgtccattgatgactggcccgctccatttgtgagttgcattgctaaactttctctgttggaaagtcttcgcacaattttaaatttaaaatgcttcttgcagtatatgagatatcgacaaagagccaacggtatatggattaattagtgttttaggcttatgtttttagtttaaatgttggtcggtggttcgttcaaagcagtctgtttgtgtgagcttgacaaaatgaggtagctcgaggaaaatacatattgaacaagtaactataatctggagttgggaacgctggttgtttttgtatggatgggaaatattactgctctgtcatttacagcatgaatgtggctatatatgtatgcgttgtaaatgcatgtgtttgtagtgtatgcatatgttgtatgttgtttgtcacagcga

SEQ ID NO: 2409 - DNA, 625 bp, Raphanus sativus
ggaaacccgagttttctggacgaaaggggctttaaattttaattagggctttaacattgagaaagcaaaaagggtttagatccagaagacagcagcagcaaaggtctttcaactaactgtagcatggcgacaactactggacttgagtctcttgtcgatcagatcatttcggtaatcaccaatgatggacgcaacattgtgggacttctcaaaggttttgaccaggctactaatataatcctcgatgaatctcatgaacgcgtcttctccaccaaggaaggagtacaacaacatgtgttgggtttgtacattatcagaggcgacaacataggtgttattggggagctggacgaggagcttgatgctagtctggatttttccaaactgagggctcatcctttgaaacccgtcgtgcattgattgaaaaaaaaatagttatgttgagtactaaacaaagagaaagattgcaaacagtttggattagtttgtctttggagttgtgtgctttgtctatcctaaggttctttctatgtcaaacgcttttgcccttaaagatcgttgtaattccaaatcgtaatagacttgaatcatttgcgatcctagtgagagatgaattttatcttca

SEQ ID NO: 2410 - DNA, 540 bp, Sequoia sempervirens
gttgtatagcattcataaataattctcattgttcctttcgtattgcttcttgtcttctttaaacgtcttccctccttcgtaggtattgccaaaccatatctctacagcaatgtcaatcgcaggattggattccatgatggaccaggtaatctccgtcattacgaacgatggacgtaacatagtgggtattttgaggggctttgatcaggccacaaatcttattcttgatgaatcacatgaacgagtttactccactacggcaggggtagagcaacttgtcctgggattgtacatcatccgaggagataatattagcgttgttggagagctggatgaagagcttgattcaaacctcgacttatcaaaactcagagcacatccactaaagcctgttgttcactaattaaggtgggatcaagatgtatattcatttgctgtgtcttcagcaattggaaacagagaatcaaattttgaattcaagctcatgaattaccatgatatggtttgactacaacaatgtttgaagctcagtgtacacta

SEQ ID NO: 2411 - DNA, 835 bp, Brassica napus
gggggtttaataatctaagaaaacacaaacccgagttttctgagaaagaagaagtgacggcgaaaggggttttaattagggattgaacactgagaagaaaagggcttagttagattcagaagcagcaaaggtctttcaactgtagcatggcgacaactactggacttgagtctcttgtcgatcagatcatttcggtaattaccaacgatggacgcaacattgtgggagttctgaaaggttttgaccaggctactaatataatcctggatgaatctcatgaacgcgtcttctccactaaggaaggagtacaacaacatgtgttgggtttgtacattatcagaggcgacaacataggtgttattggggagctggacgaggagcttgatgctagtctggatttttcgaaactgagggctcatcctttgaaacccgtcgtgcattgattgaaaaatagttatgatgagtactaaacagaagagaaagattgcaaacagtttggattagtttgtcttggagttgtgtgcttttgtctactatcctaaggttctatgtcaaacgctttagacttcatttgcgatcctagtgagagataatttttatcttctaaaccaggtttccgtaatgtttttcggtagcttttttattccaatccttgaaggctgaagcgaataaaaacttattgaggaaactcactaatcaaatgcaaatggaccgattaaagtgttcgtttttaatatgaaaaaagctacagtacagaatggaagatgtattttatttgttgtatgactatttttttttataatcgttcgaaaaaaaaaaaaaactaaagtgacgt

SEQ ID NO: 2412 - DNA, 2298 bp, Sorghum bicolor
cgccgctgcccactcccagatcccactgctccccagatccgcgcccgagccctagtccccagatccgccgcggcgccggagcactcctcctcgcattggcgtccgcggcgccatggcgtgcctcgcgatctccctgcagccggtgaacggcccggacatcctactgcaaacgcggtcctggttccccgtctcccgcgccctcgccgccgtctccgcctttcgcctcgcgcgcctccacctcgcgcgcggcaagcagcagtcctcctcatcctccgcctcctcggcctcgctcgacgccatcggcgacgacccgctcgccgccgcgtcggggcagctcgttgtcggcgtcgagtcacagtaccgcgtggtgtaccgcctcgtcaactccatctacgtgctgggggtcaccaccgctggctccgaccatgccgcccccgctgtcaacgccttcgccgtcgccgacgctgtcaaccaggccgtctccgtcgtcgtcgcagcctgccgtggcgtcgacgtcacccccgagaaggtgcaccgcaagtaccccgaggtctatctcgccctcgacctcgtcctccacggcgttggctccgtccgcctctcccagatcctcgccaccatccatggcgacaacctcgcgcgcatggtcaactcctcccctgacgccgaagcccgggcccgcggcgcggatccctggcccgccgtcgagcacctcgctcaggaccgccacgctgcgagggagggcttctcgggcgcctctttcgagcttccccaggagacgctcgcggctggtgacgaattctcgtctaacatcgcccctgcgaccactgttgctactggtgatgagccaccacctgaggaggcagcacctgtggagaaggatccttttgcagccagtgacctgattaacaacaagccggaggaggcattggtgggtggattcaagaagaacaaggagactgcccttgtggttgctgatcctgcagctgcgctagctggattggaggtcacgactttaccgccagctgaggcgactaagccgacatttattggagttgaagggtttgagggtgattatggtggcattgagtttggcaatgatgaggcgtcacttgctgaggcatttgaagggctcaatgcgccatttggtggtgggctggatgcttctgagtttgttacaacaacgaagaaggatcacaaggacagggccgtcactggtcttgagctgctagtatcaagtgggaagccaccgaatgcagctgctggtactccattggaaaatctgttggtgaccaagcgcacagaaatgactgctcctgagttgtttattgctgaggagatcaatgcagaattcaaggagtctattcttgtgcgtgttggcttgaagggtacaatcttcctgcgtaccttgccgctgaataaggcagcgggcaaggagacagagttctcatttcgtcttgagggcacatcaggaatgaagagggctgcattgcagagtaatgtgttgagcaacctacagaatggactgttccatgtcaggactgtgtcgaaagaggagcccattcccctcatgaagtacagcttcctaccaaagcactcgcctctccctttgaggatgcgcctagtgaagcgccacagtgggacgttactctcagtgatgatacagtacgcatccaatccaatgctaccccagcctctgagcaatgttacattcattgttaagcttcctgtggatcccactctgctcaatgtttcacccaaggctgtgctaaaccgggcagagagggagcttagatggcatatttcagaaattcccctgaaaggtccagccggaaggctcagggcacggatgcctgttgaccaagactccaaagatggtgagctagaggttgttgggatggtgaagtttgcttaccaaggtccattcacattgtctggcattaaactacgcccagccactgatggcattgcccaatttaatgaagttggccataccttctccagtgggagttacctgtgcatctgataggtatcttcttgtactgtaggtgcttcttcatctgtttttatgtttgtttctacagcagggtgtgaaaatcctattgtatgtagcaaagtgtgtttttttttctgtgaggctgaaattccatcgcgtttttgagttgtctgtttcatgatatgtcatttgtgattactcatgaaagctactttatacatcaccaagtttatcattcatatgaagaaacaatgtactgctatatgtaattactattttattgcttctctttcttcttagca

SEQ ID NO: 2413 - DNA, 3367 bp, Sorghum bicolor
gtgcccagcgcctcaggctctaccgtctctacaccgagtccacccatcgccccgtgcacccgtctccttccccttcgtacaccccgcacgccgctgcccactcccagatcccactgctccccagatccgcgcccgagccctagtccccagatccgccgcggcgccggagcactcctcctcgcattggcgtccgcggcgccatggcgtgcctcgcgatctccctgcagccggtgaacggcccggacatcctactgcaaacgcggtcctggttccccgtctcccgcgccctcgccgccgtctccgcctttcgcctcgcgcgcctccacctcgcgcgcggcaagcagcagtcctcctcatcctccgcctcctcggcctcgctcgacgccatcggcgacgacccgctcgccgccgcgtcggggcagctcgttgtcggcgtcgagtcacagtaccgcgtggtgtaccgcctcgtcaactccatctacgtgctgggggtcaccaccgctggctccgaccatgccgcccccgctgtcaacgccttcgccgtcgccgacgctgtcaaccaggccgtctccgtcgtcgtcgcagcctgccgtggcgtcgacgtcacccccgagaaggtgcaccgcaagtaccccgaggtctatctcgccctcgacctcgtcctccacggcgttggctccgtccgcctctcccagatcctcgccaccatccatggcgacaacctcgcgcgcatggtcaactcctcccctgacgccgaagcccgggcccgcggcgcggatccctggcccgccgtcgagcacctcgctcaggaccgccacgctgcgagggagggcttctcgggcgcctctttcgagcttccccaggagacgctcgcggctggtgacgaattctcgtctaacatcgcccctgcgaccactgttgctactggtgatgagccaccacctgaggaggcagcacctgtggagaaggatccttttgcagccagtgacctgattaacaacaagccggaggaggcattggtgggtggattcaagaagaacaaggagactgcccttgtggttgctgatcctgcagctgcgctagctggattggaggtcacgactttaccgccagctgaggcgactaagccgacatttattggagttgaagggtttgagggtgattatggtggcattgagtttggcaatgatgaggcgtcacttgctgaggcatttgaagggctcaatgcgccatttggtggtgggctggatgcttctgagtttgttacaacaacgaagaaggatcacaaggacagggccgtcactggtcttgagctgctagtatcaagtgggaagccaccgaatgcagctgctggtactccattggaaaatctgttggtgaccaagcgcacagaaatgactgctcctgagttgtttattgctgaggagatcaatgcagaattcaaggagtctattcttgtgcgtgttggcttgaagggtacaatcttcctgcgtaccttgccgctgaataaggcagcgggcaaggagacagagttctcatttcgtcttgagggcacatcaggaatgaagagggctgcattgcagagtaatgtgttgagcaacctacagaatggactgttccatgtcaggactgtgtcgaaagaggagcccattcccctcatgaagtacagcttcctaccaaagcactcgcctctccctttgaggatgcgcctagtgaagcgccacagtgggacgttactctcagtgatgatacagtacgcatccaatccaatgctaccccagcctctgagcaatgttacattcattgttaagcttcctgtggatcccactctgctcaatgtttcacccaaggctgtgctaaaccgggcagagagggagcttagatggcatatttcagaaattcccctgaaaggtccagccggaaggctcagggcacggatgcctgttgaccaagactccaaagatggtgagctagaggttgttgggatggtgaagtttgcttaccaaggtccattcacattgtctggcattaaactacgcccagccactgatggcattgcccaatttaatgaagttggccataccttctccagtgggagttacctgtgcatctgataggtatcttcttgtactgtaggtgcttcttcatctgtttttatgtttgtttctacagcagggtgtgaaaatcctattgtatgtagcaaagtgtgtttttttttctgtgaggctgaaattccatcgcgtttttgagttgtctgtttcatgatatgtcatttgtgattactcatgaaagctactttatacatcaccaagtttatcattcatatgaagaaacaatgtactgctatatgtaattactattttattgcttctctttcttcttagcatgcattacttagagatgtttttgcttctgttcaaaagagaatgccactgtaattagttactattagatgatatctagttattcatgcagggcaactgattgatttttattacgaaaagattcaagtgactgcattctctgtttttattgtatgatatccctgttcatcaatttaaagttaggaagatggcactaatgggttactccctcacttcctgctgatcgctaatgtaagatgcttagagatattgacatgttctacaaggtggaaattttattgccaatttctatgaaaaatatgtagctaaaataaaaaagaatcatgtcttgaaactattttttatgagataagtgtaccatcatcaatcttacattttcaacctatctaggtgttcttactgtgatgttcaaagttgaaaataggaatcctaaagtgacttgtatgacgaggaaatacctgtttagcaactaggatcaagtttgaagtttcaatttcagtttcatataaaatccactgtagagctttctctggacagaagaaatccatactgatgcaagttaacagtcttggcaaagatcaatatacttggctgtatgtatggcgcattgatatttctgcaaataaccaaagagatatgtcaggtgacaactgacaagattattggtcaacgtatgctcaagtgcaatcttgatgttgggtctaatctgattggcccaagtgaaggattagagttccctcataattgggctgacttatgcccaattagatttagtcaaactataacttaaaagtgataagaggtaattagattattcaaattaaaagtgataagaggtatgggggagttcccacttctcacttttgggccactcagattagatccaatacacaagattgagtttgtgcatatgtactcttatatgcaccttatattacctcataatgaaattactgatgagctgagcatgttcatgatttctg

SEQ ID NO: 2414 - DNA, 2343 bp, Setaria italica
tcgccccgtgcacccgtctccttcccttcctactccgccccgccgcaacggcaacccactccctcccagatcccactgctccccagatccgcgccgctgccctcgcccccagatccgccgccgcgccggagcgtcccactccgccgccggcgtccgcgcgccatggcgtgcctcgcgatctccctgcagccggttaacgggccggacatcctcctccagacgcgctcctggttccccgtctcccgcgccctcgccgccgtctccgccttccgcctcgcgcgcctccacctcgcccgcggcaagcagcagtccgccgccgccgccgcctccgcctcctcgtccgcctcgctcgacgccatcggcgacgacccgctcgccgccggatcgggccagctcgtcgtcggcgtcgagtcgcagtaccgcgtcgtgtaccgcctcgtcaactccatctacgtgctcggcgtcaccaccgcgggctccgaccacgccgcccccgccgtccacgccttcgccgtcgccgacgccgtcaaccaggccgtctccgtcgtcgtcgccgcatgccgcggcgtcgacgtcacccccgagaaggtgcaccgcaagtaccccgaggtgtacctcgcgctcgacctcgtcctccacggcgtgggatccgtccgcctctcccagatcctcgccaccatacatggcgacaacctcgcgcgcatggtcaactcctcccccgacgccgaggcccgcgcccgtggcgcggattcttggcccactgtcgagcacctcgcgcaggatcgccacgccgcgagggagggcttctccggcgcctcgttcgagcttccccaggaaacactcgctgctggtgacgagttctcctctaacattgctccggcgaccacggttgctactggggatgagcctccacctgaggaggcgcctcctgtggagaaggatcccttcgcagccagcgacctgattaacaacaagccggaggaggcattggttggtgggttcaagaagaacaaggagactgcccttgtggttgctgatcctgcagctgcacttgctgggttggaggtcacgactctgcctccagctgaggcaactaagccgacatttattggagttgaagggtttgagggtgactatggtggaattgagttcggcaacgaggaggcttcacttgctgaggcgtttgaagggttcaatgcgccatttggtggtgggctggatgcttctgagtttgttaccacgacgaagaaggatcataaggacagggctgtcactggtcttgagctgctagcaaccagtgggcagccaccaaatgcagctggtggtactccgttggagaatctattggtgaccaagcgcacagaaatgactgctcctgagttgttcattgcagaggagatcaacgcagaattcaaggagtctattcttgtgcgggttggtttgaagggtacaatcttccttcgaaccttgccattgaacaaggcagcggggaaggaaacagagttctccttccgtcttgagggcacatcaggaatgaagagggctgcattgcagagtaatgtgttgagtaacctccagaatgggctattccatgtcagaactgtgtcgaaggaggagcccattccccttctgaagtacagcttcctgccaaagcactcgcctctacctttgaggatgcgccttgtgaagcgccatagcgggacattgctctcagtgatgatacagtatgcatccaacccaatgctgccgcagcctctgagcaatgtgacattcattgttaagcttcctgtggaccccactctgctcaatgtttcacccaaggcagtgctgaaccgggcagagagggagctaagatggcacatttcagacattcccctgaaaggtccagctggaaggctcagagcacgaatgcctgttgaccaagactccaaggatggtgagctagaggttcttggcatggtgaaatttgcttaccaagggccatttacattgtctggcatcaaactacgtccagccactgatggcattgcccagtttaatgaagttggacataccttttccagtgggagttacctgtgcatctgataggtaccttcttgtactgtaggtgcttctttacatctttcattgtgtttgtttctgcagcagggtgtgaaaatcctattgtatgtagcaaagtgtgtttgtttttgtgaggctgaagttccaccatgtttttgagttttcttttgctcttgatatatcatctgtgattactcatgaaagctatctactgttcatgaagtttattcatgaaaaaataatgtgctatctttactcatgaagatacaatgtgctgctctc

SEQ ID NO: 2415 - DNA, 2337 bp, Oryza sativa
tctccacagtggctggacccggtccacgggtcggctcgtgcacccgtctccttcctctactccccctcgcgccccagatctcacccaaccacctcacctcactcccgatcagatccgagccctaaccctagcctctcgccggcggcggcggcggcggcgatggcgtgcctcgcgatctccctccagccggtgaacggcccggacatcctcctccagacccgatcctggttccccgtctcccgcgccctcgccgccgtctcctccttccgcctcgcccgcctccacctcgcccgcgggaagcagcagcagttgtcatcgtcgtcgtcggccgccgcggcggcggcgacgctcgaggccatcggcgacgacccgctcgccgccgggtcggggcagctcgtggtcggggtggagtcgcagtaccgcgtcgtgtaccgcctagtcaactccatctacgtgctcggcgtcaccacctcctccgaccacgcctcccccgccgtccacgccttcgccgtcgccgacgccgtcaaccaggccgtctccgtcgtcgtcgccgcgtgccgcggcgtcgacgtcacgccggagaaggtgcaccgcaagtacccggaggtctacctcgccctcgacctcgtcctccacggcgtcggctccgtccgcctctcccagatcctcgccaccatccatggcgacaacctcgctcgcatggtgaattcatcccctgacgccgaggcgaaagctcgtggcgctgatccctggcccgccgtcgagcacctcgcccacgatcgccatgccgctcgcgatggcttcacgggcgcctcgttcgagctcccccaggagacccttgctgccggtgacgagttctccgcgtctaacattgcgccggcggctgctgcggctactggggatgagcctccaccggaggaggcagctcccgtggagaaggacccgtttgcagccagtgaactggttaacaattctgaggaggcgttggttggtgggttcaagaagaacaaggagaccgccattgtggttgctgatcccgcggctgcgcttgctgggttggaggtcacgaccttgccaccagctgaggcgactaagccaacatttattggagttgaagggtttgagggtgactatggtggaattgagtttggcaatgaggaggcttcactggccgaggcatttgaagggttcaatgcgccgtttgggggtggattggatgcttcagagtttgttaccacaacaaagaaggaccataaggataagagcatcactggtcttgagctgctagccactagtgctggacagggaccaaatgcacctggtggtaccccgctggagaacttgttggtgacaaagagcacagagatgacagcccctgagctatacatcgtggaggaggtcaatgcagaatttaaggagtctattcttgcacgggttggtttgaagggtacaatctttctgcgaacgttgccaccaaagaaggcggctggtaaggagacagagttctcatttcgtcttgagggcacatctggaatgaagaaggccgcgttgcagagcactgtgttgagcaacctcgagaatgggatgttccatgtccggacgccatcgaaggaggaacccatccccatcatgaagtacagctttctgcccaagcactcacctctccctttgaggatgcgccttgtgaagcgacatagcggaacattgctctcagtgatgattcaatacgcatcaaacccaatgttgccacagccgctgagcaatgttacgttcattgttaagcttcctgtggacccaactctgctaaatgtttcacccaaggctgtgctgaatcgggcagagagggagctcaggtggcacatcccagacattcccctgaaaggacctgctggacgtttgagggctcggatgcctgtagatcaggactcaaaggatggtgagctagaggttgttgggatggtgaagtttgcttaccaagggccatttacattgtctggcatcaaactatgcccagccactgatggcacggctcagtttaatgaggctggccacaccttctccagtgggagttatctgtgcatctaattggtaccttctttgtattgtagttgttactttacccttgatttgttcggtttgcttctaaagcaggttgtgaaattcctattgtatgtagtgacgcttgtttgttttttgaggctggaaattacatcatgtttttgatttgtctattattacatattaccaggatatggtgtctgattttttaaaaaacttcatgcaacttgatacaaatttcatgacgtatacaatgaaacagtataatgttgtggctca

SEQ ID NO: 2416 - DNA, 2233 bp, Oryza sativa
tctccacagtggctggacccggtccacgggtcggctcgtgcacccgtctccttcctctactccccctcgcgccccagatctcacccaaccacctcacctcactcccgatcagatccgagccctaaccctagcctctcgccggcggcggcggcggcggcgatggcgtgcctcgcgatctccctccagccggtgaacggcccggacatcctcctccagacccgatcctggttccccgtctcccgcgccctcgccgccgtctcctccttccgcctcgcccgcctccacctcgcccgcgggaagcagcagcagttgtcatcgtcgtcgtcggccgccgcggcggcggcgacgctcgaggccatcggcgacgacccgctcgccgccgggtcggggcagctcgtggtcggggtggagtcgcagtaccgcgtcgtgtaccgcctagtcaactccatctacgtgctcggcgtcaccacctcctccgaccacgcctcccccgccgtccacgccttcgccgtcgccgacgccgtcaaccaggccgtctccgtcgtcgtcgccgcgtgccgcggcgtcgacgtcacgccggagaaggtgcaccgcaagtacccggaggtctacctcgccctcgacctcgtcctccacggcgtcggctccgtccgcctctcccagatcctcgccaccatccatggcgacaacctcgctcgcatggtgaattcatcccctgacgccgaggcgaaagctcgtggcgctgatccctggcccgccgtcgagcacctcgcccacgatcgccatgccgctcgcgatggcttcacgggcgcctcgttcgagctcccccaggagacccttgctgccggtgacgagttctccgcgtctaacattgcgccggcggctgctgcggctactggggatgagcctccaccggaggaggcagctcccgtggagaaggacccgtttgcagccagtgaactggttaacaattctgaggaggcgttggttggtgggttcaagaagaacaaggagaccgccattgtggttgctgatcccgcggctgcgcttgctgggttggaggtcacgaccttgccaccagctgaggcgactaagccaacatttattggagttgaagggtttgagggtgactatggtggaattgagtttggcaatgaggaggcttcactggccgaggcatttgaagggttcaatgcgccgtttgggggtggattggatgcttcagagtttgttaccacaacaaagaaggaccataaggataagagcatcactggtcttgagctgctagccactagtgctggacagggaccaaatgcacctggtggtaccccgctggagaacttgttggtgacaaagagcacagagatgacagcccctgagctatacatcgtggaggaggtcaatgcagaatttaaggagtctattcttgcacgggttggtttgaagggtacaatctttctgcgaacgttgccaccaaagaaggcggctggtaaggagacagagttctcatttcgtcttgagggcacatctggaatgaagaaggccgcgttgcagagcactgtgttgagcaacctcgagaatgggatgttccatgtccggacgccatcgaaggaggaacccatccccatcatgaagtacagctttctgcccaagcactcacctctccctttgaggatgcgccttgtgaagcgacatagcggaacattgctctcagtgatgattcaatacgcatcaaacccaatgttgccacagccgctgagcaatgttacgttcattgttaagcttcctgtggacccaactctgctaaatgtttcacccaaggctgtgctgaatcgggcagagagggagctcaggtggcacatcccagacattcccctgaaaggacctgctggacgtttgagggctcggatgcctgtagatcaggactcaaaggatggtgagctagaggttgttgggatggtgaagtttgcttaccaagggccatttacattgtctggcatcaaactatgcccagccactgatggcacggctcagtttaatgaggctggccacaccttctccagtgggagttatctgtgcatctaattggtaccttctttgtattgtagttgttactttacccttgatttgttcggtttgcttctaaagcaggttgtgaaattcctattgtatgtagtgacgcttgtttgttttttgaggctggaaattacatcatgtttttgatttgtctatt

SEQ ID NO: 2417 - DNA, 2252 bp, Brachypodium distachyon
cagatcctaaccctaaccgacagcccagatccgcctcgccggcggcggcccgcgatggcgtgcctcgccatctccctgcagccggtgaacgggcccgacatcctcctccagacgcgctcctggttccccgtctcccgcgcgctcgccgccgtctccgccttccgcctcgcgcgcctccacctcgcccgcgggaagcagcagccggcctcgcacgcctcgctcgacgccatcggcgacgacccgctcgcggccggttccgggcagctcgtcgtgggcgtcgagtcgcagtaccgcgtggtgtaccgcctcgtcaactccatctacgtgctcggcgtcaccaccgcctccgaccacgcctcccccgccgtccacgcgttcgccgtcgccgacgccgtcaaccaggccgtctccgtcgtcgtcgccgcctgccgcggcgtcgacgtcacccccgagaaggtgcaccgcaagtacccggaggtgtacctcgccctcgacctcgtcatccacggcgtcggctccgtacgcctctcccagatcctcgccaccatccatggcgacaacctcgcccgcatggtcaactcctcccctgacgcggaggcccgcgctcgtggcgctgattcctggcccaccgtagagcacctcgcccaggaccgccatgccgcccgtgatgccttcactggcgcttcattcgagctccccttggagaccctcgctgctggtgacgagttctccgcatccagccttgctcctgcagctgctgcgactactggggatgaggcgccacctgaggatgcgccacccgtggagaaggacccctttgcagctagtgacatggttagcaagccagaggaggcattggtaggtgggttcaagaagaacaaagagactgccctcgtggttgctgatcccgccgctgctcttgctgggttggaggtcacgactttgccaccagctgaggcaactaagcccacatttattggggttgagggatttgagggcgactacggtggaattgagttcggtaatgaggaagcttcactggctgaggcatttgaagggttcaatgcgccatttgggggtgggctagatgcttcggagtttgtcaccacaacaaagaaggatcataaggacaagagcatcactggtcttgagctgctagccatgggtggtgggcaggcactgaatgcagctgctggttcacctctggagaacttattggtgaccaagagcgcagagatgactgttcctgagttgtacattgtggaggagatcaacgcagaattcaaggagtctattcttgcacgggttggtttgaaaggcacaatctttctgcggactttaccaccaaagaaggcagcagggagggacacagagttctcattccggcttgagggtacttctggaatgaagagggctgccttgcagagtaccgtgttgagtaacctcgagaatggcctgttccatgtgaagacaccatcgaaggaggaacccatccccatcatgaaatacagcttccttcccaagcactcacctctacctttgaggatgcgccttgtaaagcgccatagtggaacattactctcagtgatgatacactatgcgtcgaacccaatactgccgcagccactgagcaatgttacattcattgttaagctccccgtggatccaactctgcttaatgtgtcgcccaaggctgtcttgaaccgcgcagagagggagctcaggtggcacatcgcagacattcccctgaaaggtcctgctggacggctgagagcacggatgcctgtagatcaggattccaaggatggtgaattagaggttgttggaatggtgaagtttacttaccaaggaccattcacattatctggcatcaaactttgtccagccatcaacagcacagcccaatttaaccaagttggtcacacattttccagtgggagttatcgttgcatctgagttggtactttctttgtatcgtagctgttactttgccccttttttttcagtttacttctacagcagggtgatattgtatctagtgaagcttatttgttttgtgaggctggaacttaaaacatgttttcgggttgtctattattatctggagatagtaactgtgatttagtttcatttcattattggatgcaaagaggaaaatatacttttgcacatcatggatgcaaagataaatgtacttagctacagtaattcgtcatgtaatgttgaaagaaatcattacctttttattagtc

SEQ ID NO: 2418 - DNA, 2401 bp, Brachypodium distachyon
agccagtaggcagtagtccctgcacccagtccacccacggccccgtgcacccttctccttcctctacttcccgcacccactccccagtccagatctcccgaaaccaactcacctcccccttcccagaccccagatcctaaccctaaccgacagcccagatccgcctcgccggcggcggcccgcgatggcgtgcctcgccatctccctgcagccggtgaacgggcccgacatcctcctccagacgcgctcctggttccccgtctcccgcgcgctcgccgccgtctccgccttccgcctcgcgcgcctccacctcgcccgcgggaagcagcagccggcctcgcacgcctcgctcgacgccatcggcgacgacccgctcgcggccggttccgggcagctcgtcgtgggcgtcgagtcgcagtaccgcgtggtgtaccgcctcgtcaactccatctacgtgctcggcgtcaccaccgcctccgaccacgcctcccccgccgtccacgcgttcgccgtcgccgacgccgtcaaccaggccgtctccgtcgtcgtcgccgcctgccgcggcgtcgacgtcacccccgagaaggtgcaccgcaagtacccggaggtgtacctcgccctcgacctcgtcatccacggcgtcggctccgtacgcctctcccagatcctcgccaccatccatggcgacaacctcgcccgcatggtcaactcctcccctgacgcggaggcccgcgctcgtggcgctgattcctggcccaccgtagagcacctcgcccaggaccgccatgccgcccgtgatgccttcactggcgcttcattcgagctccccttggagaccctcgctgctggtgacgagttctccgcatccagccttgctcctgcagctgctgcgactactggggatgaggcgccacctgaggatgcgccacccgtggagaaggacccctttgcagctagtgacatggttagcaagccagaggaggcattggtaggtgggttcaagaagaacaaagagactgccctcgtggttgctgatcccgccgctgctcttgctgggttggaggtcacgactttgccaccagctgaggcaactaagcccacatttattggggttgagggatttgagggcgactacggtggaattgagttcggtaatgaggaagcttcactggctgaggcatttgaagggttcaatgcgccatttgggggtgggctagatgcttcggagtttgtcaccacaacaaagaaggatcataaggacaagagcatcactggtcttgagctgctagccatgggtggtgggcaggcactgaatgcagctgctggttcacctctggagaacttattggtgaccaagagcgcagagatgactgttcctgagttgtacattgtggaggagatcaacgcagaattcaaggagtctattcttgcacgggttggtttgaaaggcacaatctttctgcggactttaccaccaaagaaggcagcagggagggacacagagttctcattccggcttgagggtacttctggaatgaagagggctgccttgcagagtaccgtgttgagtaacctcgagaatggcctgttccatgtgaagacaccatcgaaggaggaacccatccccatcatgaaatacagcttccttcccaagcactcacctctacctttgaggatgcgccttgtaaagcgccatagtggaacattactctcagtgatgatacactatgcgtcgaacccaatactgccgcagccactgagcaatgttacattcattgttaagctccccgtggatccaactctgcttaatgtgtcgcccaaggctgtcttgaaccgcgcagagagggagctcaggtggcacatcgcagacattcccctgaaaggtcctgctggacggctgagagcacggatgcctgtagatcaggattccaaggatggtgaattagaggttgttggaatggtgaagtttacttaccaaggaccattcacattatctggcatcaaactttgtccagccatcaacagcacagcccaatttaaccaagttggtcacacattttccagtgggagttatcgttgcatctgagttggtactttctttgtatcgtagctgttactttgccccttttttttcagtttacttctacagcagggtgatattgtatctagtgaagcttatttgttttgtgaggctggaacttaaaacatgttttcgggttgtctattattatctggagatagtaactgtgatttagtttcatttcattattggatgcaaagaggaaaatatacttttgcacatcatggatgcaaagataaatgtacttagctacagtaattcgtcatgtaatgttgaaagaaatcattacctttttattagtctatacaatcccttgctgaa

SEQ ID NO: 2419 - DNA, 2079 bp, Secale cereale
gcagccggtgaacggcccggacatcctcctccagacgcgctcctggttcccggtctcgcgcgccctcgccgccgtctccgccttccgcctcgcgcgcctcagcctcgcccgcggcaagcagcactcctccgccgccctcgacgccatcggcgacgacccgctcgccaccggctcgggccagctggtggtgggcgtcgagtcgcagtaccgcgtcgtgtaccgcctcgtcaactccatctacgtgctcggcgtcaccaccgcctccgaccacgcctcccccgccgtgcacgccttcgccgtcgccgacgccgtcaaccaggccgtctccgtcgtcgtcgccgcctgccgcggcgtcgacgtcacccccgacaaggtccaccgcaagtaccccgaggtctacctcgcgctcgacctcgtcctccacggcgtcggatccgtccgcctctcccagatcctcgccaccatccatggcgacaacctcgcccgcatggtcaactctcccccgacgccgaggcccgcgcccgcggcgccgactcctggaccgtcgtcgagcacctcgcgcaggaccgccacgccgcccgcgacgccttcaccggcgcctccttcgagctcccccaggagaccctctctgccggcgatgagttcgctgcttccagcctcgcgcctgcggctgctgcggctactggggatgagccgccgcctgaggaggcgccccccgttgagaaggacccctttgcagccagcgacatggttgttagcaagccagaggaggccttggtcggtgcgttcaagaagaacaaggagactgcacttgtggttgctgatcctgctgctgcgcttgctgggttggaggtcaccactctgcctccagctgaggcaacgaaaccaacgttcattggggtcgagggattcgagggtgactacggtggaattgagtttggtaatgaggaagcttcactggctgaggcatttgaaggcttcaatgcgccatttgggggtgggctagatgcttctgagtttgttaccaccaccaagaaggatcacaaggacaagaccctcactggtcttgagctgctagccatgagccaggcaccgaatgcagcttcttctggttcgcaacttgacagcttattggtgaccccgagcaaagagatgaccgtgcctgagttgtgcatcgtggaggagatcaatgctgaattcaacgagtctgttcttgcacgggttggtctcaagggtacaatctttttgcggacactaccaccaaagaaggcagcagggagggagacagagttctcattccgccttgagggtacttctgggatgaagcgcgctgccttgcagagtaccgtgttgagcagccttgagaatggcctgttccatgtgaagacaccatccaaggaggagcctatccccatcatgaaatacagcttcctgcccaagcactcacctctccctttgaggatgcggcttgtcaagcgccacagcggtacattgctctcgctgatgatacactatgcgtcgaacccaatgttgccgcagccactgagcaatgttacgttcattgttaagcttcctgtggatccgactctgcttaatgtttcacccaaggctgtgttgaaccgggcagagagggagctcaggtggcacatctctgacattcctctgaagggccctgctgggcggttgagagcacgaatgcctgttgatcaagactccaaagatggtgaactagaggtcgttggaatggtgaagtttgcttaccaagggccattcacattgtctggcatcaagctctgcccagccatcaatagcactgcccaatttaatgaagttggccacaccttctcaagcgggagctaccgctgcatctgagttgctggtaccttctttgtattgtagctgttactttaccttttttttttcagtttgcttctacaacagggtgtgaaatccatatttgtacgtatttcgtttgtgaggcttgaatttaaaccatgttttgagctgtgattattcatcaagggtacacaatcttttgcatgtttcgtaattgatgcatggaagaacatgtacttctgt

SEQ ID NO: 2420 - DNA, 2159 bp, Secale cereale
cccgaccgaccctcgccccacgatccggccgccgcgatggcgtgccctgcccatctccctgcagccggtgaacggcccggacatcctcctccagacgcgctcctggttcccggtctcgcgcgccctcgccgccgtctccgccttccgcctcgcgcgcctcagcctcgcccgcggcaagcagcactcctccgccgccctcgacgccatcggcgacgacccgctcgccaccggctcgggccagctggtggtgggcgtcgagtcgcagtaccgcgtcgtgtaccgcctcgtcaactccatctacgtgctcggcgtcaccaccgcctccgaccacgcctcccccgccgtccacgccttcgccgtcgccgacgccgtcaaccaggccgtctccgtcgtcgtcgccgcctgccgcggcgtcgacgtcacccccgacaaggtccaccgcaagtaccccgaggtctacctcgcgctcgacctcgtcctccacggcgtcggatccgtccgcctctcccagatcctcgccaccatccatggcgacaacctcgcccgcatggtcaactcctcccccgacgccgaggcccgcgcccgcggcgccgactcctggaccgtcgtcgagcacctcgcgcaggaccgccatgccgcccgcgacgccttcaccggcgcctccttcgagctcccccaggagaccctctctgccggcgacgagttcgctgcttccagcctcgcgcctgcggctaccggggatgagccgccgcctgaggaggcgccccccgttgagaaggacccctttgcagccagcgacatggttgttagcaagccagaggaggccttggtcggtgcgttcaagaagaacaaggagactgcacttgtggttgctgatcctgctgctgcgcttgctgggttggaggtcaccactctgcctccagctgaggcaacgaaaccaacgttcattggggtcgagggattcgagggtgactacggtggaattgagtttggtaacgaggaagcttcactggctgaggcatttgaaggcttcaatgcgccatttgggggtgggctagatgcttctgagtttgttaccactaccaagaaggatcacaaggacaagaccctcactggtcttgagctgctagccatgagccaggcaccgaatgcagcttcttctggttcgcaacttgacagcttattggtgaccccgagcaaagagatgaccgtgcctgagttgtgcatcgtggaggagatcaatgctgaattcaacgagtctgttcttgcacgggttggtctcaagggtacaatctttttgcggacactaccaccaaagaaggcagcagggagggagacagagttctcattccgccttgagggtacttctgggatgaagcgcgctgccttgcagagtaccgtgttgagcagccttgagaatggcctgttccatgtgaagacaccatctaaggaggagcctatccccatcatgaaatacagcttcctgcccaagcactcacctctccctttgaggatgcgccttgtaaagcgccacagcggtacattgctatcactgatgatacactatgcatcgaacccaatgttgccgcagccactgagcaatgttacattcattgttaagcttcctgtagatccgactctgcttaatgtttcacccaaggctgtgttgaaccgggcagagagggagctcaggtggcacatctctgacattcctctgaagggccctgctgggcggttgagagcacggatgcctgttgatcaagactccaaagatggtgagctagaggtcgttggaatggtgaagtttgcttaccaagggccattcacattgtctggcatcaaactctgcccagccatcaatagcactgcccaatttaatgaagttggccacaccttctcaagcgggagctaccgctgcatctgagttgctggtaccttctttgtattgtagctgttactttaccttttttttttccagtttgcttctacaacagggtgtgaaatccatatttgtacgtatttgttttgtgaggcttgaatttaaaccatgttttgagctgtgattattcatcaagggtacacaatcttttgcatgttttgtaattgatgcatggaagaacatgtacttctgttcattatggatgcaagcaaaagcaata

SEQ ID NO: 2421 - DNA, 1725 bp, Sorghum bicolor
ccccgcctccgctccgtccccaaatctgcgcaaggcctctaggcaaatcccatcgcggcgaccgacatggttgggagcgtgggcaacgggctggcggatctgggcgcagcaggggccgtctccatgaacggggtcgggaagccgctgcatcctgccgaggcggcggcggcggtggagacgctcccgatggagctggagccgccggaggccttagtggccgcggcggcggaggcgaagcgggaggaggctggtgcaaacgggaggaggagggagatcgtgatggggaggaacgtgcacacctcctgcttcgccgtcaaggagcccgacgcggacgacgaggagaccggcgagcgggaggcgaccatggccagcgtcctcgcgctctaccgccgctcgctcgtcgaacgcaccaagcaccacctcggttacccatacaatctggactttgattatggtgcactggcccagctacagcacttctccattaataaccttggtgaccccttcattgagagcaactacggtgtccactccaggcagtttgaggttggagtgttggattggttcgctcgcctctgggagttagaaaaggatgagtactggggatatattactaactgtggtacagaaggaaatctgcatgggattcttgttgggcgggaggtgtttcctgatggaatattgtatgcttctcgcgagtcccattattcagtattcaaagcagcaagaatgtacagaatggattgtgtcaaagttgacacccttatgtctggggaaatagattgtgctgatttccatagaaagttattgcagaaccgagacaaacctgccatcattaatgttaacattggaacaactgtgaagggggcagttgatgatctagacttggttatcaaaacccttgaggaaaatggctttaaagatcggttctatattcattgtgatggtgccctttttggattgatgataccatttgttaagaaggcacctcaagtgacatttaaaaagcctattgggagtgtcagcgtctctgggcacaagtttgttggatgccccatgccatgtggtgtccagataacaagattggagcacataaatgccctttctagcaatgtggaatatctggcgtcaagggatgcaacgatcatgggaagcaggaatggccatgcgcctatcttcctctggtacaccctcaacaggaagggctacagaggctttcagaaagaagtccagaagtgcttgagaaatgcacactacctaaaagatcgcctcaaggaagcaggagttggagcaatgcttaacgagctcagcagcacagttgtatttgaaaggccgaaggatgaagaatttgtccgaaggtggcagctcgcttgtgaaggcaatatagctcacgttgtggtgatgcccagtgtcaacattgacaagctagattatttcctgaatgaattagtggagaaacgagcgacttggtaccaggatggaataagtcaacccccctgcattgccagagacgtaggcgtcgagaactgtctgtgtggccttcacaagtagtgtgagccttttgcaaggggggttcattcgtgagtcgagttaaagtgttatgttgtactgtatccatgcgttctgtatgtgataataatgtgttccgcagtgtagcttatttgttgccatgagaataaaaatcaattaaatggatggatggaagttgcatcaccgttggctcat

SEQ ID NO: 2422 - DNA, 2066 bp, Sorghum bicolor
cgactcccgagtcgacccgtgcacacacccaagccaagagtcccagtcccagacacggacacggacggccctcccgccgagtggcgacccgtttctccgttctcgccgtccgattataaatgcgcccgcaaatcactccagtcccctccctcctccgagtccgagctctctctctcgctgcgcctcccccccgcctccgctccgtccccaaatctgcgcaaggcctctaggcaaatcccatcgcggcgaccgacatggttgggagcgtgggcaacgggctggcggatctgggcgcagcaggggccgtctccatgaacggggtcgggaagccgctgcatcctgccgaggcggcggcggcggtggagacgctcccgatggagctggagccgccggaggccttagtggccgcggcggcggaggcgaagcgggaggaggctggtgcaaacgggaggaggagggtgatcgtgatggggaggaacgtgcacacctcctgcttcgccgtcaaggagcccgacgcggacgacgaggagaccggcgagcgggaggcgaccatggccagcgtcctcgcgctctaccgccgctcgctcgtcgaacgcaccaagcaccacctcggttacccatacaatctggactttgattatggtgcactggcccagctacagcacttctccattaataaccttggtgaccccttcattgagagcaactacggtgtccactccaggcagtttgaggttggagtgttggattggttcgctcgcctctgggagttagaaaaggatgagtactggggatatattactaactgtggtacagaaggaaatctgcatgggattcttgttgggcgggaggtgtttcctgatggaatattgtatgcttctcgcgagtcccattattcagtattcaaagcagcaagaatgtacagaatggattgtgtcaaagttgacacccttatgtctggggaaatagattgtgctgatttccatagaaagttattgcagaaccgagacaaacctgccatcattaatgttaacattggaacaactgtgaagggggcagttgatgatctagacttggttatcaaaacccttgaggaaaatggctttaaagatcggttctatattcattgtgatggtgccctttttggattgatgataccatttgttaagaaggcacctcaagtgacatttaaaaagcctattgggagtgtcagcgtctctgggcacaagtttgttggatgccccatgccatgtggtgtccagataacaagattggagcacataaatgccctttctagcaatgtggaatatctggcgtcaagggatgcaacgatcatgggaagcaggaatggccatgcgcctatcttcctctggtacaccctcaacaggaagggctacagaggctttcagaaagaagtccagaagtgcttgagaaatgcacactacctaaaagatcgcctcaaggaagcaggagttggagcaatgcttaacgagctcagcagcacagttgtatttgaaaggccgaaggatgaagaatttgtccgaaggtggcagctcgcttgtgaaggcaatatagctcacgttgtggtgatgcccagtgtcaacattgacaagctagattatttcctgaatgaattagtggagaaacgagcgacttggtaccaggatggaataagtcaacccccctgcattgccagagacgtaggcgtcgagaactgtctgtgtggccttcacaagtagtgtgagccttttgcaaggggggttcattcgtgagtcgagttaaagtgttatgttgtactgtatccatgcgttctgtatgtgataataatgtgttccgcagtgtagcttatttgttgccatgagaataaaaatcaattaaatggatggatggaagttgcatcaccgttggctcatctgtactgtgctcaaacaattcactttgctttaccctctgccatgcttctgttgtctgtagaacaagaggcaactctgtcaagcttctgttatctgtaaaacaaggggcaactggggcagcattaatcacttattgatgagcacttcagatgc

SEQ ID NO: 2423 - DNA, 1728 bp, Panicum virgatum
cccgctgcccgtcccctgccggcttcgcccccaaatctgcgcagcgccttcgccagatttcccgcggcgacgaggatggttgggagcgtgggcaacgggctggcggatctaggcgcctccatgaacgggaacgggaaggcggcggcggagccgctcccgatggagatggacccgccggcggacgtgatggcggcggcggcggcggctgagggggaggcggcctcgaacgggaggagggagatcgtgatggggaggaacgtgcacacctcctgcttcgcggtcaaggagcccgacgcggacgacgaggagaccggcgagcgggaggccaccatggccagcgtcctcgcgctctaccgccgctcgctcgtcgagcgcaccaagcaccacctcggttacccatacaatctggacttcgattacggtgcattggggcagctgcagcacttctccattaacaaccttggagaccccttcattgagagcaactatggtgtccattccaggcagtttgaggttggagtgctggattggttcgctcgcctctgggatttagaaaaggataaatactggggatacattacaaactgtggtacagaaggaaatctgcatgggattcttgttggtagggaggtgttccctgatggaatcttgtatgcctctcgtgagtctcattattcagtattcaaagctgccagaatgtacaggatggattgtgtcaaagttgacactcttatgtctggggaaatagattgtgctgatttccagagaaagatattgcagaaccgagacaagcctgccatcattaatgttaacattggaacaactgttaagggggcagtcgatgatctagatttggttatcaaaactctcgaggaaagcggttttaaagaccggttttatattcattgtgatggcgccctttttggattgatgataccctttgttaagaaggcacctaaagtgacatttaaaaagcctattgggagtgtcagtgtctctgggcataaatttgttggatgccccatgccatgtggtgtgcagataacaagattgaagcacattaacgccctttctagcaatgtggagtatctggcgtcaagggacgccacgatcatgggaagcaggaatgggcatgctcctatcttcctctggtacacgctcaacaggaagggctacagaggctttcagaaggaagtccagaaatgcttgagaaacgcacactacctcaaagatcgcctcaaggaagcaggaatcggagcgatgcttaatgagctcagcagcacagttgtgtttgaaaggccaaaggatgaggagtttgtccgaaggtggcagctcgcctgcgaggggaatatagcccatgttgtggtaatgcccagtgtcaacattgacaagttggactatttcctgaatgaactagtggagaagcgggcaacctggtacaaggatggaataagtaaacccccctgcattgccagagacttgggcgtggagaactgcctctgtggccttcacaagtagtgtgatccttctatcaacaggggggcgttcattcctgagttgagttagtcctctataatgtgttgtactgtatccgtgcgttctgtatgtgataatgtggtctgctgtgtagcttatttgttgtcatgaataaattccttctattaaatttatggatggaagtagcttatttgttgtcatgataataaaattccttcaattaaattggta

SEQ ID NO: 2424 - DNA, 1819 bp, Setaria italica
tctctctctcccgctgctcgtcctcgtgccccctgccggtttccccccaaatctgcgcagcgcctagccagatttcccgcggcggccgagatggtggggagcgtgggcaacgggctggcggatctgggcgcctccatgaacggggtcgggaaggtggcggcggcggacccgctcccgatggagatggagccgccggcggacgtggtggtggtggcggcggcggcggctgcggcggccgaggggggtaaggcggaggggccgacctcgaacgggaggagggagatcgtgatggggaggaacgtgcacacctcctgcttcgcggtcaaggagcccgacgcggacgacgaggtcaccggcgagcgggaggccaccatggccagcgtcctcgcgctctaccgccgctcgctcgtcgagcgcaccaagcaccacctcggttacccatacaatttggactttgattacggtgcactggggcagctgcagcacttctccattaacaaccttggagatcccttcatcgagagcaattatggtgtccattccaggcagtttgaggttggagtgctggattggttcgctcgtctctgggaattagaaaaggatgagtactggggatacattactaactgtggcacagaaggaaatctgcatgggattcttgttgggagggaggtgttccctgatggaatcttgtatgcctctcgtgagtctcattattcagtattcaaagcagcaagaatgtacaggatggattgtgttaaggtcgacacacttatgtctggggaaatagattgtgctgatttccagagaaagatattgcagaaccgagacaagcctgccatcattaatgtcaacattggaacaactgtgaagggagcagttgatgatctagacctggttatcaaaacccttgaggaaagcggctttaaagaccggttttatattcattgtgatggcgccctttttggattgatgataccctttgttaagaaggcacctaaagtgacatttaaaaagcctattgggagtgtcagtgtctctgggcacaagtttgttggatgccccatgccatgtggtgtccagataacaagattggagcacattaacgtcctttctagcaatgtggagtatctggcgtcaagggatgcgacgatcatgggaagcaggaacggccatgctcctatcttcctctggtacaccctcaacaggaagggctacgtaggctttcagaaggaagtccagaagtgcttgagaaacgcacactacctgaaagatcgcctcaaggaagcaggaattggagcgatgcttaatgagctcagcagcacggttgtgtttgaaaggccaaaggatgaggagtttgtccgaaggtggcagctcgcctgcgaggggaatatagcccatgttgtggtgatgcccagtgtcaacattgacaagttggactatttcctgactgaactagtggagaagcgggcaacctggtaccaggatggaataagtaagccaccctgccttgccagagacttgggcgtggagaactgcctctgtggccttcacaagtagtgtgagccttttgtgacgggggtgttcagtcgcgagttgagttagtcctcgctaatgtgttatgttgtactgtatccatgcgttctgtatgtgataatgtggtatcctgtgtagcctatttgttgtcatgagaataaaattccttcagttaagttgatgggtggaagtcgtagcttatttggtgtcatgagaataaaattccttcaattaaattcataggtggaagttgcatcagagttgcctcatgtgttctgtgctc

SEQ ID NO: 2425 - DNA, 1707 bp, Setaria italica
atggtggggagcgtgggcaacgggctggcggatctgggcgcctccatgaacggggtcgggaaggtggcggcggcggacccgctcccgatggagatggagccgccggcggacgtggtggtggtggcggcggcggcggctgcggcggccgaggggggtaaggcggaggggccgacctcgaacgggaggagggagatcgtgatggggaggaacgtgcacacctcctgcttcgcggtcaaggagcccgacgcggacgacgaggtcaccggcgagcgggaggccaccatggccagcgtcctcgcgctctaccgccgctcgctcgtcgagcgcaccaagcaccacctcggttacccatacaatttggactttgattacggtgcactggggcagctgcagcacttctccattaacaaccttggagatcccttcatcgagagcaattatggtgtccattccaggcagtttgaggttggagtgctggattggttcgctcgtctctgggaattagaaaaggatgagtactggggatacattactaactgtggcacagaaggaaatctgcatgggattcttgttgggagggaggtgttccctgatggaatcttgtatgcctctcgtgagtctcattattcagtattcaaagcagcaagaatgtacaggatggattgtgttaaggtcgacacacttatgtctggggaaatagattgtgctgatttccagagaaagatattgcagaaccgagacaagcctgccatcattaatgtcaacattggaacaactgtgaagggagcagttgatgatctagacctggttatcaaaacccttgaggaaagcggctttaaagaccggttttatattcattgtgatggcgccctttttggattgatgataccctttgttaagaaggcacctaaagtgacatttaaaaagcctattgggagtgtcagtgtctctgggcacaagtttgttggatgccccatgccatgtggtgtccagataacaagattggagcacattaacgtcctttctagcaatgtggagtatctggcgtcaagggatgcgacgatcatgggaagcaggaacggccatgctcctatcttcctctggtacaccctcaacaggaagggctacgtaggctttcagaaggaagtccagaagtgcttgagaaacgcacactacctgaaagatcgcctcaaggaagcaggaattggagcgatgcttaatgagctcagcagcacggttgtgtttgaaaggccaaaggatgaggagtttgtccgaaggtggcagctcgcctgcgaggggaatatagcccatgttgtggtgatgcccagtgtcaacattgacaagttggactatttcctgactgaactagtggagaagcgggcaacctggtaccaggatggaataagtaagccaccctgccttgccagagacttgggcgtggagaactgcctctgtggccttcacaagtagtgtgagccttttgtgacgggggtgttcagtcgcgagttgagttagtcctcgctaatgtgttatgttgtactgtatccatgcgttctgtatgtgataatgtggtatcctgtgtagcctatttgttgtcatgagaataaaattccttcagttaagttgatgggtggaagtcgtagcttatttggtgtcatgagaataaaattccttcaattaaattcataggtggaagttgcatcagag

SEQ ID NO: 2426 - DNA, 1667 bp, Avena sativa
ctcccgtcccgtcctgtcctctgtctcctcctccccaaatctgccaaaaaatccccgaccatggtggggagcgtgggcaacgggacgctggatctggcgggcgcggcctccctcctcgcaaacggcaacgggaaggcgccgctgcacccggaggagcctacggcggcggcggcggcggcggcggaggcgctcccgatggaggtggacccggacatggtggaggggaagagggaggtcgtcatggggcggaacatgcacaccgcctgcttcgccgtcaaggagcccgacgcggacgacgaggagaccggcgagcgcgaggccaccatggccagcgtcctcgcgctctaccgcagatcgctcgtcgagcgcaccaagcatcacctcggttacccatacaatttggatttcgattatggtgcacttgcccagcttcagcacttctccatcaacaaccttggtgaccccttcatcgagagcaactatggtgtccattccaggcagtttgaggtgggagtattggattggtttgctcgcctctgggaattagagaaggatgagtactggggatacatcacaaactgtggaacagaaggaaacctgcatggtattcttgtcgggagagaggtattccctgagggaatcctgtacgcctctcgtgagtctcactattcagtattcaaagcagcaagaatgtacaggatggaatgtgtcaaggtggacacccatatttctggagaaataaattgttctgattttgagagaaagctaatgcaaaacaaagataaacctgccattataaatgtcaacattggaacaaccgtgaagggagcagttgatgatcttgacctggttattaaaacccttgaagaaagtggctttcgagaccggttttatattcattgtgatggcgctctttttggactgatgataccgtttgttaagaaggcagctaaagtgacatttaagaagcctattgggagtgtcagtgtctctgggcacaagttcgtcggatgccccatgccatgtggtgttcaaataacaagattggagcatataaatgctctttctagcaatgtggaatatcttgcatcaagggatgcaacaatcatgggaagcaggaatggccatgctccaatcttcctctggtacactctgaataggaaaggctacagaggctttcagaaggaagtccagaagtgcttgagaaacgcacactatctgaaagaccgtctcaacgcagcaggaattggagccatgcttaacgagctcagtagcacagtagtgtttgaaaggccaaaggacgaggaattcgtccgaaggtggcagctcgcttgcgagggaaacatagctcatgtcgtggttatgcccagtgtcaacattgataagctggactatttcctgcgcgagctagtggagaagcgggcggtctggtacaaggatgggatttgtcagcctccttgcattgcccgagacgtaggccaggagagctgcttctgtagccttcacaagaagtgagcttactacacggggagcttcttccgtgagttgagttagtatttctagcgtgttttgttgtaccgatgccgtctatatgtaataatgcgttatgcagtgtagcgtatctgttgttgtgaagaaactaagttattatattaatgggtggagtt

SEQ ID NO: 2427 - DNA, 1650 bp, Avena sativa
tcccgtcctgtcctctgtctcctcctccccaaatctgccaaaaaatccccgaccatggtggggagcgtgggcaacgggacgctggatctggcgggcgcggcctccctcctcgcaaacggcaacgggaaggcgccgctgcacccggaggagcctacggcggcggcggcggcggcggcggaggcgctcccgatggaggtggacccggacatggtggaggggaagagggaggtcgtcatggggcggaacatgcacaccgcctgcttcgccgtcaaggagcccgacgcggacgacgaggagaccggcgagcgcgaggccaccatggccagcgtcctcgcgctctaccgcagatcgctcgtcgagcgcaccaagcatcacctcggttacccatacaatttggatttcgattatggtgcacttgcccagcttcagcacttctccatcaacaaccttggtgaccccttcatcgagagcaactatggtgtccattccaggcagtttgaggtgggagtattggattggtttgctcgcctctgggaattagagaaggatgagtactggggatacatcacaaactgtggaacagaaggaaacctgcatggtattcttgtcgggagagaggtattccctgagggaatcctgtacgcctctcgtgagtctcactattcagtattcaaagcagcaagaatgtacaggatggaatgtgtcaaggtggacacccatatttctggagaaataaattgttctgattttgagagaaagctaatgcaaaacaaagataaacctgccattataaatgtcaacattggaacaaccgtgaagggagcagttgatgatcttgacctggttattaaaacccttgaagaaagtggctttcgagaccggttttatattcattgtgatggcgctctttttggactgatgataccgtttgttaagaaggcagctaaagtgacatttaagaagcctattgggagtgtcagtgtctccgggcacaagttcgtcggatgccccatgccatgtggtgttcaaataacaagattggagcatataaatgctctttctagcaatgtggaatatcttgcatcaagggatgcaacaatcatgggaagcaggaatggccatgctccaatcttcctctggtacactctgaataggaaaggctacagaggctttcagaaggaagtccagaagtgcttgagaaacgcacactatctgaaagaccgtctcaacgcagcaggaattggagccatgcttaacgagctcagtagcacagtagtgtttgaaaggccaaaggacgaggaattcgtccgaaggtggcagctcgcttgcgagggaaacatagctcatgtcgtggtgatgcccagtgtcaacattgataagctggactatttcctgcgcgagctagtggagaagcgggcggtctggtacaaggatgggatttgtcagcctccttgcattgccagagacgtaggccaggagagctgcttctgtagccttcacaagaagtgagcttactacacggggagcttcttccgtgagttgagttagtatttctagcgtgttttgttgtaccgatgccgtctatatgtaataatgcgttatgcagtgtagcgtatctgttgttgtgaagaaactaagttattatattaa

SEQ ID NO: 2428 - DNA, 2097 bp, Oryza sativa
aaataggcccccgcgaaaccctcgtaacccctcttctactatctctctctctcctccggccgcggctgctcccccctttcgtcccccaaaatctccgcgcctccgagaagattccaccggcggcggacgacgacgacgacgaggatggtggggagcgtcgggaacggcctggtcgacctgggtggcgcagccgtggccgtgaacggcgtcgggaaggggatgcgccccgaggcggtggcggtggcgatggaggtggagtcgccgccgaggcctgcggaggaggagggggaggggtcgccgacgaggagggagatcgtgctggggaggaacgtgcacacggcgtcgttcgcggtgaaggagcccgacgcggacgacgaggagaccggggagcgggaggccgccatggccagcgtcctcgcgctctaccgccgcaacctcgtcgagcgcaccaagcaccaccttggttacccgtataacctggacttcgactatggtgcacttggccagctgcaacacttctccatcaacaaccttggtgatcccttcatcgagagcaactatggtgtacattccaggcagtttgaggtgggagtattggattggtttgctcgcatctgggagttggaaaagaatgagtactgggggtacattacaaactgtggcacagaaggaaacctgcatggtattcttgttgggagagaggtattccctgatggaatcctgtatgcttcccgtgagtctcactattcagtattcaaggcagcaaggatgtataggatggattgtgttaaggtggacacccttatttctggggaaatagattgtgaagattttcagagaaagttattgctaaacagagacaaacctgccattattaatgttaacattggaacaactgttaagggggctgtcgatgatcttgacttggttattaaaacacttgaagaaggtggctttaaagatcggttttatatccattgtgacggtgctctttttggactgatgataccatttgtcaagaaggcacctaaggtatcatttaagaagcctatcgggagtgtgagcgtttccgggcacaagtttgtaggatgtcccatgccatgtggtgtccagataacaagactggagcacataaatcgtctttctagcaatgttgaatatctggcatcaagagatgcgacgatcatgggaagtaggaacggccatgctccgatcttcctctggtacaccctgaacaggaaaggctacaggggcttccagaaggaggtccagaagtgcctgaggaacgctcactacctgaaggaccgcctcaaggaagctggaatcggcgccatgctcaacgagctgagcagcaccgtggtgttcgaaaggcccaaggacgaggagttcgtccggaggtggcagctcgcctgcgagggcaacatcgctcatgtcgtggtgatgcccagtgtgaccatcgacaagctggactacttcctgaacgagctgacggagaagcgggcgacctggtaccaggacggatcatgccagcctccctgcctcgccaaagacgtaggcgaggagaactgcctctgcagcatccacaagaagtgaagaggagcttatatattataacaaggagccatgttgcagtgtagctttgtgttgttgtcgtggcctgaagttagtactcctaatgcgttgtgttgtaccccgatgccttctgtatgtaataatgcgttatgcagtcagtgcagcttataatgttgttatcgtcaggatattacagttaagttaaaattgatgggatgaaaattgcatcatctttacctcttctgttctctacctgatgtgatggttccatttgctatattcttcgatgcttctgcaaagactgtaaaatctgtagaacttcagatgctgctgaagaaactttttactgctcctgatgagtggctggcgccgtcatctggcgccgtcctcctgccaccgtggcgtacgcgaaccgacgtggcaggaggagggcgccagccatgctggcgccgccccagggaggagggcgccagcatggctggcgccgctgcctccattcctgtttctctgtatggagttgcaatg

SEQ ID NO: 2429 - DNA, 1788 bp, Oryza sativa
ctctctctctcctccggccgcggctgctcccccccccccctttcgtcccccaaaatctccgcgcctccgagaagattccaccggcggcggacgacgacgacgaagaggatggtggggagcgtcgggaacggcctggtcgacctgggtggcgcagccgtggccgtgaacggcgtcgggaaggggatgcgccccgaggcggtggcggtggcgatggaggtggagtcgccgccgaggcctgcggaggaggagggggaggggtcgccgacgaggagggagatcgtgctggggaggaacgtgcacacggcgtcgttcgcggtgaaggagcccgacgcggacgacgaggagaccggggagcgggaggccgccatggccagcgtcctcgcgctctaccgccgcaacctcgtcgagcgcaccaagcaccaccttggttacccgtataacctggacttcgactatggtgcacttggccagctgcaacacttctccatcaacaaccttggtgatcccttcatcgagagcaactatggtgtacattccaggcagtttgaggtgggagtattggattggtttgctcgcatctgggagttggaaaagaatgagtactgggggtacattacaaactgtggcacagaaggaaacctgcatggtattcttgttgggagagaggtattccctgatggaatcctgtatgcttcccgtgagtctcactattcagtattcaaggcagcaaggatgtataggatggattgtgttaaggtggacacccttatttctggggaaatagattgtgaagattttcagagaaagttattgctaaacagagacaaacctgccattattaatgttaacattggaacaactgttaagggggctgtcgatgatcttgacttggttattaaaacacttgaagaaggtggctttaaagatcggttttatatccattgtgacggtgctctttttggactgatgataccatttgtcaagaaggcacctaaggtatcatttaagaagcctatcgggagtgtgagcgtttccgggcacaagtttgtaggatgtcccatgccatgtggtgtccagataacaagactggagcacataaatcgtctttctagcaatgttgaatatctggcatcaagagatgcgacgatcatgggaagtaggaacggccatgctccgatcttcctctggtacaccctgaacaggaaaggctacaggggcttccagaaggaggtccagaagtgcctgaggaacgctcactacctgaaggaccgcctcaaggaagctggaatcggcgccatgctcaacgagctgagcagcaccgtggtgttcgaaaggcccaaggacgaggagttcgtccggaggtggcagctcgcctgcgagggcaacatcgctcatgtcgtggtgatgcccagtgtgaccatcgacaagctggactacttcctgaacgagctgacggagaagcgggcgacctggtaccaggacggatcatgccagcctccctgcctcgccaaagacgtaggcgaggagaactgcctctgcagcatccacaagaagtgaagaggagcttatatattataacaaggagccatgttgcagtgtagctttgtgttgttgtcgtggcctgaagttagtactcctaatgcgttgtgttgtaccccgatgccttctgtatgtaataatgcgttatgcagtcagtgcagcttataatgttgttatcgtcaggatattacagttaagttaaaattgatgggatgaaaattgcatcatctttacctcttctgttctcta

SEQ ID NO: 2430 - DNA, 1750 bp, Brachypodium distachyon
ggtgcgatctgcggcttctcgctcgctcgctcgactcgcggtagacacgggcggcgtggccagtataagtggagccccgcaggccgcccgcagagcactcctaacccctcttctctcttccgatcccccccacaaatctgcgcggcccttcgccaaattctcgcggacacgacgatggtggggagcgtgggcaacgggacggtggatctgcacgctgttaacggcaacgggaaggcactgcacctggagggggaagcggcggcggcggaggcgctcccgatggaggtggagccggggaagagggaggtcgtgctggggaggaacgtgcacatgacgtgtttcgaggtgaaggagcccgacgcggacgacgaggagaccggcgagcgggaggccaccatggccagcgtcctcgcgctctaccgccgatccctcgtcgagcgcaccaagcaccacctcggttacccatacaatcttgacttcgattatggtgcacttgcccagctgcagcacttctccatcaacaatctcggtgacccattcatcgagagcaactatggtgtccattccaggcagtttgaggtgggagtgttggattggtttgctcgcctctgggaattagagaaggatgagtattggggatacatcacaaactgtggaacagaaggaaacctgcatgggattcttgtcgggagagaagtttttcctgatggaatcttgtatgcctctcgtgagtctcactattcagtgttcaaggcagcaaggatgtacaggatggaatgtgtcaaggtggacacccatatttcgggggaaatagattgttctgattttgagagaaaactgctgcaaaacagagataaacctgccattattaatgtcaacattggaaccaccgtgaagggagcagttgatgatcttgacctggttattaaaacccttgaagagagtggtttccaaggtcgtttttatattcattgtgatggtgctcttttcgggctgatgataccgtttgttaagaaggcggctaaagtgacattcaagaagcctattgggagtgttagtgtctccggccacaagtttgtcggatgccccatgccgtgtggtgtccagataacaagattggagcacataaatgccctttctagcaatgtggaatatctagcttcaagggacgcaacaatcatgggaagcaggaatggacacgctcctatcttcctctggtacaccctgaataggaaaggatatagaggctttcagaaggaagtccaaaagtgcttgagaaatgctcactatttgaaagaccgtctcaatgcagcaggaattggagcgatgcttaacgagctcagtagcacagtagtgttcgaaaggccaaaggatgaggagtttgtccggaggtggcagcttgcttgcgagggaaacatagctcatgtcgtggtcatgcccagtgtcaccattgacaagcttgattatttcctgcgtgagctagtggagaagcgggccgtctggtacaaggatggaatttgtcagcctccctgcattgccagagatgtaggcgaaaagagctgcttctgtagccttcacaagaattgagcttgctacaagagggcttcatttgttagttgagtttgggtttctagtgtgttttgttgtactataatgcgttatgcactgtatgtaataatgcgttatgcactgtagcctatatgttgttacgaagatacttaagttaaatcaatggatggagtttgcatca

SEQ ID NO: 2431 - DNA, 1767 bp, Brachypodium distachyon
ggtgcgatctgcggcttctcgctcgctcgctcgactcgcggtagacacgggcggcgtggccagtataagtggagccccgcaggccgcccgcagagcactcctaacccctcttctctcttccgatcccccccacaaatctgcgcggcccttcgccaaattctcgcggacacgacgatggtggggagcgtgggcaacgggacggtggatctgcacgctgttaacggcaacgggaaggcactgcacctggagggggaagcggcggcggcggaggcgctcccgatggaggtggagccggggaagagggaggtcgtgctggggaggaacgtgcacatgacgtgtttcgaggtgaaggagcccgacgcggacgacgaggagaccggcgagcgggaggccaccatggccagcgtcctcgcgctctaccgccgatccctcgtcgagcgcaccaagcaccacctcggttacccatacaatcttgacttcgattatggtgcacttgcccagctgcagcacttctccatcaacaatctcggtgacccattcatcgagagcaactatggtgtccattccaggcagtttgaggtgggagtgttggattggtttgctcgcctctgggaattagagaaggatgagtattggggatacatcacaaactgtggaacagaaggaaacctgcatgggattcttgtcgggagagaagtttttcctgatggaatcttgtatgcctctcgtgagtctcactattcagtgttcaaggcagcaaggatgtacaggatggaatgtgtcaaggtggacacccatatttcgggggaaatagattgttctgattttgagagaaaactgctgcaaaacagagataaacctgccattattaatgtcaacattggaaccaccgtgaagggagcagttgatgatcttgacctggttattaaaacccttgaagagagtggtttccaaggtcgtttttatattcattgtgatggtgctcttttcgggctgatgataccgtttgttaagaaggcggctaaagtgacattcaagaagcctattgggagtgttagtgtctccggccacaagtttgtcggatgccccatgccgtgtggtgtccagataacaagattggagcacataaatgccctttctagcaatgtggaatatctagcttcaagggacgcaacaatcatgggaagcaggaatggacacgctcctatcttcctctggtacaccctgaataggaaaggatatagaggctttcagaaggaagtccaaaagtgcttgagaaatgctcactatttgaaagaccgtctcaatgcagcaggaattggagcgatgcttaacgagctcagtagcacagtagtgttcgaaaggccaaaggatgaggagtttgtccggaggtggcagcttgcttgcgagggaaacatagctcatgtcgtggtcatgcccagtgtcaccattgacaagcttgattatttcctgcgtgagctagtggagaagcgggccgtctggtacaaggatggaatttgtcagcctccctgcattgccagagatgtaggcgaaaagagctgcttctgtagccttcacaagaattgagcttgctacaagagggcttcatttgttagttgagtttgggtttctagtgtgttttgttgtactataatgcgttatgcactgtatgtaataatgcgttatgcactgtagcctatatgttgttacgaagatacttaagttaaatcaatggatggagtttgcatcaattttgctttatgttct

SEQ ID NO: 2432 - DNA, 1829 bp, Triticum aestivum
ccacgcgtccgcagcatttccgcaggatctcggcccctcctcctcctccgccttctccaatccacactcccactcccccattccaaccacccccgacgccggccatgacgggcaccatcgcgaatggcgtggcggcgccaactggcccggggctccgcgagaaggccgccgcggcgccgctgcccgaggagctgaccccggaggtggtggagggagagagggagatcgtgctggggaggaacatgcacgcctcctgcttcgcggtgaaggagcccgacgccgacgacgagttcaccggcgagcgcgaggccaccatggccggcgtcctcgcgcgctaccgccgctccctcgtcgagcgcaccaagcaccacctcggctatccatacaatctggactttgagtacggtgctctttcccagctgcagcacttctccattaacaacctaggcgacccattcatcgagagcaactatggcgtgcactccaggcagtttgaagtgggtgtgttggattggtttgctcgcctttgggacctcgaaaaggatgaatattggggatacattacgaactgtggcaccgaaggaaatctgcatgggatccttgtcggaagggaagttttccctgatgggatcttgtatgcctctcgtgattcacactactcggtgttcaaagcagcgagaatgtacaggatggattgcgttaaagtggatactcttgtctctggagaaatagattgtgcagattttggaagaaagctacttgaaaacaaagataaacctgctattattaatgtcaacattgggacaactgtcaagggagcagttgatgatcttgacttggttatcgaaacacttgaaaaaagtgggttcaaggatcggttttatatacactgtgatggtgctctgtttggtctgatgatgccatttgttaagcaggcacctagggtatcctttaagaagcccattgggagtgtgagcgtgtctggtcacaagtttgttggatgtcccatgccctgtggtgtccagataacaaggttgaatcacataaatgccctttctagcaatgttgagtatctagcttcacgagatgctacaatcatgggaagcaggaatggtcatgctcccatcttcctatggtacaccctgaacaggaaaggctatagaggttttcagaaggaagttcagaagtgcttgagaaatgcacattacctgaaagatcggctcaaggatgctggaattagtgcgatgcttaacgagctcagtagtacagtagtttttgagaggccaaaggacgaggagtttgtgcgacggtggcagcttgcttgtgagggaagtatatcacatgttgtggtaatgcccagcgtcaatgtcgataagctggatactttcttaaatgagttggtggagaagcgggtaacctggtaccaggaaggaaaatgccaatctccttgcattgcagctgatgtaggccaggagaactgtctttgtactctgcacaagacataagtttgtcaggagacactctctgtgagtggtacttgagtatttacattggttggtgccgtatttaccaccttccaatcgtgcatcctttattgttccttgttgtcatggactcatttaaatttagtcctcgctctatgtctttatgagaaagatcttagcacggtagcatgctgaacttcatgtgctgtattcatcgtctgtcttcatctattcttctaataaagctctgtgcaaatgatgtatccaaatgaagttactggtatcttgtcctgtatcggcatgccatatacgtaacatatctcgtgttgttctacaaaaaaaaaa

SEQ ID NO: 2433 - DNA, 1860 bp, Secale cereale
tcaaatccgaatcatttccacaggatctcggccttctccaacccacactcccactccccctttccgatcacccccgacgccgacgccggcgcggttcggccgccatgacgggcagcgtcgcgaatggcgtggcggcgccaggtggcccggggctcgccgagaagaaggccgccgcggcgcctctgcccgaggagctggcgccggaggtggtggagggggcgagggagatcgtgctggggaggaacatgcacgcttcctgcttcgcggtgaaggagcccgacgccgacgacgagttcacgggcgagcgcgaggccaccatggccggcgtcctcgcgcgctaccgccgctccctcgtcgagcgcaccaagcaccacctcggctacccatacaatctggactttgagtatggtgctctttcccagctgcagcacttctccattaacaacctgggggacccattcattgagagcaactatggcgtgcactccaggcagtttgaagtgggtgtgttggattggtttgctcgcctttgggacctcgaaaaggatgaatattggggatacattacaaactgtggtactgaaggaaatctgcatgggatccttgtcggaagggaagtttaccctgatgggatcttgtatgcctctcgcgactcccactactcagtgttcaaagcagccagaatgtacaggatggattgcgttaaagtggatactcttgtctctggagaaatagactgtacagattttggaaaaaagctacttgaaaacaaagataaacctgccattattaacgtcaacattgggacaactgtcaagggagcagttgatgatcttgacttggttattgaaacacttgaaaaaagtgggttcaaggatcgattttatatacactgtgatggtgctctgtttggtctgatgatgccatttgttaagcaggcacctagggtatcctttaagaagcccattgggagtgtgagcgtgtctggtcacaagtttgttggatgtcccatgccctgtggtgtccagataacaaggttgaatcacataaatgccctttctagtaatgttgagtatctagcttcacgagatgctacaatcatgggaagcaggaatggtcatgctcccatcttcctatggtacaccctcaacaggaaaggctatagaggttttcagaaggaagttcagaagtgcttgagaaatgcacattacctgaaagatcggctcaaggatgctggaattagtgcgatgcttaacgagctcagtagtacagtagtttttgagaggccaaaggacgaggagtttgtgcggcggtggcagcttgcttgtgagggaagtatatcacatgttgtggtaatgcccagcgtcactgtcgataagctggatactttcttaaatgagttggtggagaagcggataacctggtaccaggaaggaaaatgccaatctccttgcattgcagctgatgtaggccaggagaactgcctttgtactctgcacaagacataagtttgtcaggagacacgccccgtgagttcaaatgttggatacttgagtatttacattggttggtgtcgtatttaccaccttccaatcgtgcgtcctttattgttccttgttgtcatggactcatttaagtttagtccttgctttatgtctatatgagacagatcttagcacagtaacatgctgaactttatgtgttgtattcatcgtccgtcttcatctattcttccaataaatttctgtgcaaatgatgtatccaaatgaagttactggtatcttgtcattatgccatatccgtaacaaaaaaaaaaaaacaaatagagactcgacgaacggcaacaggagggtagagggg

SEQ ID NO: 2434 - DNA, 1636 bp, Secale cereale
agcgtcgcgaatggcgtggcggcgccaggtggcccggggctcgccgagaagaaggccgccgcggcgcctctgcccgaggagctggcgccggaggtggtggagggggcgagggagatcgtgctggggaggaacatgcacgcgtcctgctttgcggtgaaggagcccgacgccgacgacgagttcaccggcgagcgtgaggccaccatggccggcgtcctcgcgcgctaccgccgctccctcgtcgagcgcaccaagcaccacctcggctacccatacaatctggactttgagtatggtgctctttcccagctgcagcacttctccattaacaacctgggggacccattcattgagagcaactatggcgtgcactccaggcagtttgaagtgggtgtgttggattggtttgctcgcctttgggacctcgaaaaggatgaatattggggatacattacaaactgtggtactgaaggaaatctgcatgggatccttgtcggaagggaagtttaccctgatgggatcttgtatgcctctcgcgactcccactactcagtgttcaaagcagccagaatgtacaggatggattgcgttaaagtggatactcttgtctctggagaaatagactgtacagattttggaaaaaagctacttgaaaacaaagataaacctgccattattaacgtcaacattgggacaactgtcaagggagcagttgatgatcttgacttggttattgaaacacttgaaaaaagtgggttcaaggatcgattttatatacactgtgatggtgctctgtttggtctgatgatgccatttgttaagcaggcacctagggtatcctttaagaagcccattgggagtgtgagcgtgtctggtcacaagtttgttggatgtcccatgccctgtggtgtccagataacaaggttgaatcacataaatgccctttctagtaatgttgagtatctagcttcacgagatgctacaatcatgggaagcaggaatggtcatgctcccatcttcctatggtacaccctcaacaggaaaggctatagaggttttcagaaggaagttcagaagtgcttgagaaatgcacattacctgaaagatcggctcaaggatgctggaattagtgcgatgcttaacgagctcagtagtacagtagtttttgagaggccaaaggacgaggagtttgtgcggcggtggcagcttgcttgtgagggaagtatatcacatgttgtggtaatgcccagcgtcactgtcgataagctggatactttcttaaatgagttggtggagaagcgggtaacctggtaccaggaaggaaaatgccaatctccttgcattgcagctgatgtaggccaggagaactgcctttgtactctgcacaagacataagtttgtcaggagacacgctccgtgagttcaaatgttggatacttgagtatttacattggttggtgtcgtatttaccaccttccaatcgtacgtcctttattgttccttgttgtcatggactcatttaagtttagtccttgctttatgtctatatgagacagatcttagcacagtaacatgctgaactttatgtgttgtattcatcgtctgtcttcatctattcttccaataaagttctgtg

SEQ ID NO: 2435 - DNA, 753 bp, Saccharum officinarum
tttccaccgcaccccctcgtcgctccggtccggcgggtgagtcgtcgtaccgccggtatccatggcggcggtggtgcgcggcgtcttgaggggcatcaaggagaagggactcaccaacttcatccgcgacgtccgcgacgaaggatacttcaaatgccttctggatgggaaccttttgcaaacgaaaattcacaatattggcgctacacttgttggagttgacaagtttggaaacaaatactatgagaaactacatggcactcagtatggaaggcataggtgggtagaatatgcagagaaaggtcgttacaatgcatcccaagtgcctcctgaatggcatggatggctgcaccacatcacagatagcactggggataagctgctgaaccagaagactgctaggtaccttgtagagcacaagcagaactactctggcgagggtgaagagctgatctaccactccaaggggcatgctttgaatccggggcaaagggactggacgaggtatcagccctgggagccaaagaaagagcaagcctagctcctgagtacattgtggggaagctgctgaaatgtttgcgttttcttgcattgggtcaggtatcaccgagcttgaatagcctctgggttattgcttggactgggcccaaataatgttgttctgaataccaatactgtataattcgatcatcttttgacatcgaaatgttgttgttactgctgtaaaagcagctttggggaatatctcatgca

SEQ ID NO: 2436 - DNA, 595 bp, Sorghum bicolor
ggacggaccgaataggagaagcgaaggcaggcaggcaggacaggagccaccagtttccaccgcacccccctcttcgctccggtccggcgagtgagtcgtcgtgccgcaggtatccatggcggcggtggtgcgcggcgtcttgaggggcatcaaggagaagggactcaccaacttcatccgcgatgcccgcgacgaaggatacttcaaatgccttctggatgggaaccttttgcaaacgaaaattcacaatattggcgcaacacttgtaggagttgacaagtttggaaacaaatactatgagaaactacatgacactcagtatggaaggcataggtgggtagaatatgcagagaaaggtcgttacaatgcatcccaagtgcctcctgaatggcatggatggctgcaccacgtcacagatagcactggggataagctgctgaaccagaagactgctaggtaccttgtagagcacaagcagaactactccggtgagggtgaagagctgatctaccactccaaggggcatgctttgaatccggggcaaagggactggacgaggtatcagccctgggagccaaagaaagagcaagcctag

SEQ ID NO: 2437 - DNA, 1141 bp, Sorghum bicolor
ccagcccacgtatactaataggcaggccgcccgcgacgagccgagccggacggaccgaataggagaagcgaaggcaggcaggcaggacaggagccaccagtttccaccgcacccccctcttcgctccggtccggcgagtgagtcgtcgtgccgccggtatccatggcggcggtggtgcgcggcgtcttgaggggcatcaaggagaagggactcaccaacttcatccgcgatgcccgcgacgaaggatacttcaaatgccttctggatgggaaccttttgcaaacgaaaattcacaatattggcgcaacacttgtaggagttgacaagtttggaaacaaatactatgagaaactacatgacactcagtatggaaggcataggtgggtagaatatgcagagaaaggtcgttacaatgcatcccaagtgcctcctgaatggcatggatggctgcaccacgtcacagatagcactggggataagctgctgaaccagaagactgctaggtaccttgtagagcacaagcagaactactccggtgagggtgaagagctgatctaccactccaaggggcatgctttgaatccggggcaaagggactggacgaggtatcagccctgggagccaaagaaagagcaagcctagcttctgagtacattgtggggaagctgctgaaatgtttgtgttttcttacatttcgttgggtcaagtatcaccgagctggatagcctctgggttattgcttggactgggcccaaataatgatctgaataccaataatgtacaattggatcatcttttgacattgaagtgttgttgttactgctgtaaaagcagctttgaggaatatctcatgcagttgttactgccttcggttgtctctaaaattgtacgagagattatctgtcctgttgtctggttgggggagctgtctacccagctgttgggtggtgtttggagacctcacacttgaatttcatgaccatggatgaagatccagcgctctacggctttcttgtcatctctttacttattcgtaccacggaccatttctttttgggaggtatttgggtcgatattagttatttttccacagatattttaggacagtcttaatggcatttcatcaaagtttcatggatat

SEQ ID NO: 2438 - DNA, 788 bp, Setaria italica
gacggacacagagaatcgccaagtgaacagaccagattccaccacaccctcttccttcttcgctccggtccggcgggtgagtcgtcgcgtcgccggcatccatggcggcggtggtgcgcggcgtgctgaggggcatcaaggagaagggcctcaccaacttcctccgcgacgtccgcgaagaaggatacctgaattgccttctggatgggaaccttttgcaaacaaaaattcacaatattggcgcaacacttgtaggggtagacaagtttggaaacaagtactatgagaaactgcatgacactcagtatggaaggcacaggtgggtagaatatgcagagaaagggcgctacaatgcatcccaagtgcctgctgaatggcatggatggctgcatcacatcacagataacactggtgatcagctgctggcccagaagactgctaggtaccttgtggagcacaagcagaactactctggtgagggtgaggagctgatctaccactccaaggggcacgccctgaacccgggtcagagggactggacgaggtaccagccctgggagccaaagaaagagcaatcctagtaaaatgtctgtgtccaatcggggaggaccaccctgtttgtgttttcttgcttttattgccttgggttcttaacgatcctgaataatgttgtactggacaacaatactgtataattcgatcatctccgtttgatttttgaaaggtggtggttgttactgctgtaaaagcagatttgcggaatctcctgcgtctggctgcgatgctag

SEQ ID NO: 2439 - DNA, 785 bp, Setaria italica
cggacgcagagaatcgccaagtgaacagaccagattccaccacaccctcttccttcttcgctccggtccggcgggtgagtcgtcgcgtcgccggcatccatggcggcggtggtgcgcggcgtgctgaggggcatcaaggagaagggcctcaccaacttcctccgcgacgtccgcgaagaaggatacctgaattgccttctggatgggaaccttttgcaaacaaaaattcacaatattggcgcaacacttgtaggggtagacaagtttggaaacaagtactatgagaaactgcatgacactcagtatggaaggcacaggtgggtagaatatgcagagaaagggcgctacaatgcatcccaagtgcctgctgaatggcatggatggctgcatcacatcacagataacactggtgatcagctgctggcccagaagactgctaggtaccttgtggagcacaagcagaactactctggtgagggcgaggagctgatctaccactccaaggggcacgccctgaacccgggtcagagggactggacgaggtaccagccctgggagccaaagaaagagcaatcctagtaaaatgtcgtgtccaatcggggaggaccaccctgtttgtgttttcttgcttttattgccttgggttcttaacgatcctgaataatgttgtactggacaacaatactgtataattcgatcatctccgtttgatttttgaaaggtggtggttgttactgctgtaaaagcagatttgcggaatctcctgcgtctggctgcgatgctag

SEQ ID NO: 2440 - DNA, 808 bp, Pennisetum glaucum
gagattcgcaaagtgaacaggctagattccaccacacacaccctcttccttcttcgctccggtctctccggcgggtgagtgagtcctcgcgtcgccggcatccatggcggcggtggtgcgcggcgtgctgaggggaatcaaggagaagggcctcaccaacttcctccgcgacgtccgcgaagaaggatacctgaattgccttctggatgggaaccttttgcaaacaaaaatccacaatattggcgcaacacttgtaggggttgacaagttcggaaacaagtactatcagaaattgcatgacactcagtatggaaggcataggtgggtagaatatgcagagaaaggtcgctacaatgcatcccaagtgcctcctgaatggcatggatggctgcatcacatcacagataacaccggtgatcagctgctggcccggaagactgctaggtaccttgtggagcacaagcagaactactccggtgagggcgaggagctcatctaccactccaaggggcatgccctgaacccgggtcagagggactggacgaggtaccagccctgggaaccaaagaaagagcaagcctagtaaaatttgtgcgtgagtgatcggggaggaccaccctgtttgtgttttcttactttccttgcctcaggcccgccaagggttgcttagctgaatgaatcaatcagcaaaagtgactccggcagccttgggttttcctggagcgatcctgaataatgttgtactggacgacaatactgtgtaattcgatcatctttgttgatttcgaaaggagcctgttgttattgc

SEQ ID NO: 2441 - DNA, 874 bp, Cynodon dactylon
agacggaccttcctcgattcccttctctctccccgctgctccggcgagctacatcgtcgtcgtcgtcgtccatggctgcggtagtgcggggggtgctcaggggcatcaaggagaagggactctccaacttcatccgcgacgtccgtgaagaaggctacttcaaatgccttctggatgggaatctgttgcaaacaaaaattcacggcattggtgcaacacttgtgggtgttgacaagtttggcaacaagtactatgaaaaattacatgacactcagtatggaaggcataggtgggtagaatatgcagaaaaaggtaggtacaatgcatcccaagtccctcctgagtggcatggatggctgcaccacatcactgacagcactggggataagctgctggagcagaagaccgctaggtaccttgtggaacacaagcagaacttcacaggtgagggtgaggagttgatctaccactccaaggggcacgctctaaacccagggcagagggactggacaaggtaccaaccttgggagccaaagaaagtagaagcctcctcctgagtacgtcgggacaaagtgttgtatccaatccgatcttgtttgtctgttttttgtttgttgcttgtgttgtgttgggttcgtggacaaagcctgaataatgcacgccgttacctggcagcaatactcaccatataattggatcatctctatttggttttgaaagactggtactgctgttaaatcagctttctagtagcatattgttgcttcactatgttgctagttcttacatctccaaaaatgtaccagatatcagcggtatctgttctctgatacaatatatgtgattaatattaaattgagaggcagtttggcat

SEQ ID NO: 2442 - DNA, 870 bp, Panicum virgatum
accgaccagacccagtttccagtttccaccacaccccacctctctgcgctccggtccggcgggcgagttgtcgtgtcgccggcatcgatggcggcggtggtgcgcggcgtcctcaggggcatcaaggagaagggcctcgccaacttcctccgcgacgcccgcgaagaaggatacctgaattgccttctggatgggaaccttttgcaaacaaaaattcacaatattggcgcaacactcgtaggggttgacaagtttggaaacaagtactatgagaaactgcatgacactcagcatggaaggcataggtgggtagaatatgcagagaaagatcgttacaatgcatcccaagtgcctcctgaatggcatggatggctgcatcacatcacagatagcactggtgatcagctgctggcccagaagactgctaggtacctcgtggagcacaagcagaactactccggtgagggcgaggagctgatctaccactccaaggggcacgccctgaacccgggacagagggactggacgaggtaccagccctgggagccaaagaaagagcaagcctagtaaaatgtcgtgtctgatcggggaggaacgccctgtttgtgttttctcgctttcttgccttgggccaggtgttgctgagctgaataatcaatcaatcagcgagtgacttgttcggcctcgggtccttggagcgatcctgaataatgttgtactggacaacaatactgtataatccgatcatctttgtttgatttcaaaaggttgctgttgttactgctgtataaaagctgatttgctgaatctcttgcggtctggctgtgatgctagtacctcatttgattatctctggattgtactacgagg

SEQ ID NO: 2443 - DNA, 848 bp, Panicum virgatum
atggacaaaccgaccagacccacagtttcccagtttccaccacaccccctctcttgcgcttcggtccggcgggtgagtcgtcgtgtcgccggcatccatggcggcggtggtgcgcggcgtcctgaggggcatcaaggagaagggcctcgccaacttcctccgcgacgcccgcgaggaaggatacctgaattgcattctggatgggaaccttttgcaaacaaaaattcacaatattggcgcaacacttgtaggggttgacaagtttggaaacaagtactatgagaaactgcaagacactcagcatggaaggcataggtgggtggaatatgcagagaaagatcgttacaatgcatcccaagtgcctcctgaatggcatggatggctgcatcacatcacagataacactggcgatcagctgctggcccggaagactgctcggtaccttgtggagcacaagcagaactactccggtgagggcgaggagctgatctaccactccaaggggcatgcccttaacccggggcagagggactggacgaggtaccagccctgggagccaaagaaagagcaagcctagtaaaatgtcgtgtctgatcggggaggaccaccctgtgttgtgttttcctgctttcttgccttgggccaggtgttgctgagctgaataatcaatcaatcagcgagtgactcgttcggcctcgggtccttggagcgatcctgaataatgttgtactggacgacaatactgtataattcgatcatctttgtttgatttcgaaaggttgctgttgttactgttgtataaaagctgatttgctgaatctcttgcagtctggctgtgatgctagtac

SEQ ID NO: 2444 - DNA, 638 bp, Eragrostis curvula
  misc_feature (29)..(29): n is a, c, g, or t
  misc_feature (43)..(43): n is a, c, g, or t
  misc_feature (62)..(62): n is a, c, g, or t
  misc_feature (105)..(105): n is a, c, g, or t
  misc_feature (543)..(543): n is a, c, g, or t
  misc_feature (589)..(589): n is a, c, g, or t
  misc_feature (619)..(619): n is a, c, g, or t
aaaaaaaaaaaaaaacaaccgggtttcgngacatctctcttcncgcttccctcaaaaaaaanaaaaatcttctcctctccgctgctccggcaagttcgtcgtcgncgtcgtccatggctgcggtggtgcggggcgtgctcaggggcatcaaggagaagggcctctccaacttcatccgcgacgtccgcgacgaaggctatttcaaagcccttctggacggaaacctgatgcaaacaaaaattcacaatattggtgcaacacttgtggggactgacaagtttggaaacaagtactatgagaaactaaatgacgttcaatatggaaggcataggtgggtagaatatgcagataaaggccggtacaatgcatcacaagtgcctccggaatggcatggatggctccaccacatcacagataacactggggataagctgctggagatgaagactgctaggtaccttgtggaacacaagcagaactactctggtgagggtgaggaattgatctaccaatccaaggggcacgctctaaacccaggacaangggactggacaaggtaccagccttgggagccaaagaaagaagaagnctcctcctgagttcatctgggctacatgtngtatccaatcggatcttgt

SEQ ID NO: 2445 - DNA, 1103 bp, Oryza sativa
ggagcccatacagatgaagtctggtgggtggttggcccatccatgttcctcttcttcctcctccgactccgacccgcagccgcaggaacccaagaggagatcggaagaaagagagagagattgaggaggaggaggaggaggagccatggctgcggtggtgcgtggcgtgttgaacggcatccgggagaagggcctctccaacttcctccgccatgcccgcgacgaaggctacttcaaatgccttctggatggaaacctcttgcaaactaaaatccacaatatcggcgccacacttgtaggagtagacaagttcggcaacaaatattatgaaaaactacatgacactcagtatggaaggcacaggtgggtagaatatgcagagaaagggcgctacaatgcatcccaagtgccccctgaatggcatggatggctgcaccacatcaccgacagcactggggacgagctactggagcagaatgctaaagcgtacatcgtggatcacaaggagaacttctccggcgagggtgaggaactgatctaccactccaaggggcatgctctaaacccaggacaaagggactggacgaggtaccagccgtgggaaccaaagaaagaagaggcaacctaattaaggcactgatccagtgtgtcatttgatttggtgtctaaaacaacagtcagccggctcggtgggctgaatctgaataatgttgtcttgaggattgtttacctgagaatggaagaacatgatggagttttaattcccatatgatatgtttgtttatttttgatggagcggagcgtcgtccccattgaatggacgagggttgaatgctggtttgctgaaatgaaatattgtcgattgtctggatttgtgatgtgatagaacgtcggtatcgtccgtccttgactgggctggtagctgctggatctggatgtgagagagggctactggctacgtggttggcttcgtctcggtggaatgaaattggggcggaagcggctgccacgactcattgtgtagtgtctgcatgtgttgtttgtgaatattttctgctggctactcctaataataagatattttgattgaatatgacgtatcc

SEQ ID NO: 2446 - DNA, 871 bp, Oryza sativa
agcccatacagatgaagtctggtgggtggttggcccatccatgttcctcttcttcctcctccgactccgacccgcagccgcaggaacccaagaggagatcggaagaaagagagagagattgaggaggaggaggaggaggagccatggctgcggtggtgcgtggcgtgttgaacggcatccgggagaagggcctctccaacttcctccgccatgcccgcgacgaaggctacttcaaatgccttctggatggaaacctcttgcaaactaaaatccacaatatcggcgccacacttgtaggagtagacaagttcggcaacaaatattatgaaaaactacatgacactcagtatggaaggcacaggtgggtagaatatgcagagaaagggcgctacaatgcatcccaagtgccccctgaatggcatggatggctgcaccacatcaccgacagcactggggacgagctactggagcagaatgctaaagcgtacatcgtggatcacaaggagaacttctccggcgagggtgaggaactgatctaccactccaaggggcatgctctaaacccaggacaaagggactggacgaggtaccagccgtgggaaccaaagaaagaagaggcaacctaattaaggcactgatccagtgtgtcatttgatttggtgtctaaaacaacagtcagccggctcggtgggctgaatctgaataatgttgtcttgaggattgtttacctgagaatggaagaacatgatggagttttaattcccatatgatatgtttgtttatttttgatggagcggagcgtcgtccccattgaatggacgagggttgaatgctggtttgctgaaatgaaatattgtcgattgtctggatt

SEQ ID NO: 2447 - DNA, 737 bp, Hordeum vulgare
ttgagaggaatcagagggggagcggcgcaggaagcgaaggtatcatccatggccgcggtggttcggagcgtgtggcagggcatcaaggagaagggcctcgccaacttcctccgctacgcccgcgacgagggatacctaaaatgccttggggatggaaacctattgcaaaccaaaattcacaacattggtgcaacccttgtaggagttgacagttttggaaacaagtactatgagaaactacatgacactcagtatggaaggcataggtgggtagagtatgcagagaagggtcgctacaatgcgtcccaagtgcctgctgaatggcatggatggctgcaccacattacagacagcactggggacaagctgctggaggagaagactaaaaagttcattatggagcacagacagaactacactggacagggtgacgacttgatctaccactccaaggggcatgctctgaaccctgggcaaagggactggacaaggtaccagccttgggaaccaaagaaagaagaggccacctgatcggatctgaatggtacctgataatcatcctcttctatgtttcacatttggtttggtgtcgccgatctaaagctgccagccagcttggtttcatggactggacctgaataatgtactatatctgatactgaacacctgccaccgaacaattttaatctctgtctggatgtggcaatagagaaactggcgattgtcgctgtttgctt

SEQ ID NO: 2448 - DNA, 922 bp, Brachypodium distachyon
catcgtcaatcttcgcccaccttccaatcctggagagagacagagagggagaaagaaggggaggcatcgcgtcgtccatcgagagcgcggcggaggaggcggaggaggagcatccatggccgcggtggttcggagcgtgatgcagggcatcaaggagaagggcctcaccggcttcctccgttacgcccgcgacgagggatacctaaaatgccttggggatggaaacctattgcaaacaaaaattcacaacattggcgcaacccttgtaggagttgacagttttggaaacaaatactatgagaaaacacatgacactcagtatggaaggcataggtgggtagagtatgcggagaagggtcgctacaatgcatcccaagtgcctgctgaatggcatggatggctgcaccacattacagatagcactggggataagctcttggaggagaagactaaaaagtatattagggagcacagacagaactacactggacagggtgatgacttgatctaccactccaaggggcatgcgctaaacccaggacaaagggactggacaaggtaccagccttgggaaccaaagaaagaagaggcgtcctgaactgaatggtacccagtaatcctctttgtgttttgttgtcagcgattggtgctgcggatctgaatccgtcgctcagcttggtttcatgtactggatctaaataatgtatgcggtatagaatacctgtcctgagccctgaacagttttaatccttgcctggatatatgccaaaaaattaaaaactggcgatttgatcgtctgtgtttgaatttaaggattttgtgtggatattgagaccgaaaattgttgccgttgtgtagtttttatactccctccgaaccatgacaagtgtcttaaatttagtacaacttatttgattgggta

SEQ ID NO: 2449 - DNA, 983 bp, Brachypodium distachyon
atcgtcaatcttcgcccaccttccaatcctggagagagacagagagggagaaagaaggggaggcatcgcgtcgtccatcgagagcgcggcggaggaggcggaggaggagcatccatggccgcggtggttcggagcgtgatgcagggcatcaaggagaagggcctcaccggcttcctccgttacgcccgcgacgagggatacctaaaatgccttggggatggaaacctattgcaaacaaaaattcacaacattggcgcaacccttgtaggagttgacagttttggaaacaaatactatgagaaaacacatgacactcagtatggaaggcataggtgggtagagtatgcggagaagggtcgctacaatgcatcccaagtgcctgctgaatggcatggatggctgcaccacattacagatagcactggggataagctcttggaggagaagactaaaaagtatattagggagcacagacagaactacactggacagggtgatgacttgatctaccactccaaggggcatgcgctaaacccaggacaaagggactggacaaggtaccagccttgggaaccaaagaaagaagaggcgtcctgaactgaatggtacccagtaatcctctttgtgttttgttgtcagcgattggtgctgcggatctgaatccgtcgctcagcttggtttcatgtactggatctaaataatgtatgcggtatagaatacctgtcctgagccctgaacagttttaatccttgcctggatatatgccaaaaaattaaaaactggcgatttgatcgtctgtgtttgaatttaaggattttgtgtggatattgagaccgaaaattgttgccgttgtgtagtttttatactccctccgaaccatgacaagtgtcttaaatttagtacaacttatttgattgggtatgctgtgtgtctgtcttcgaatggtttcgggtatgttgttgctatatggtccagattatata

SEQ ID NO: 2450 - DNA, 792 bp, Pseudoroegneria spicata
  misc_feature (664)..(664): n is a, c, g, or t
cggcctaggaggcgaaggcatcatccatggccgcggtggtccggagcgtgtggcagggcatcagggagaagggcctcaccaacttcctccgctacgcccgcgacgagggatacctaaaatgccttggggacggaaacctattgcaaaccaaaattcacaacattggtgcaacccttgtaggagttgacacttttggaaacaagtactatgagaaactacatgacactcagtatggaaggcataggtgggtagagtatgcggacaagggtcgctacaatgcatcccaagtgcctgctgaatggcacggatggctgcaccacattacagacagcactggggataagctgctggaggagaagactaaaaagttcattatggagcacagacagaactacaccggacagggtgacgatttgatctaccactccaaggggcatgctctgaaccccgggcaaagggactggacaaggtaccagccttgggaaccaaagaaagaagaggccacctgatctgaatgaatggtacctgataatcctcttccatgtttcgcatttggtttggtgtcgcggatgtaaaaccgccagtcagcttgctttcatggactgaacctgaataatgtactctatctgatactgaatacctgccactgaacaattttaatctntgtgtggatgtggcaattgagaaactggcgattcggtcgtcggtgttttcattgaagagtttctttttctactgatgtcaatggtgcgtggatgttgagatgctgaaaggagataatattgtttggta

SEQ ID NO: 2451 - DNA, 728 bp, Zea mays
atgcctgatatgagttccccggttaggagacgttgctaaattctacaatgcatatgtaaatgtgtttttgccatattctaacatcttgttatttacagcaaatgccttctggacgggaaccttttgcaaacgaaaattcacaatattggagcaacacttgtaggagttgacaagtttggaaacaaatactatgagaaactacatgacactcagtacggaaggcataggtgggtagaatatgcagagaaaggtcgctacaatgcatcccaagtgcctcctgaatggcatggatggctgcaccacatcacagatagcactggggataagctgctgaaccagaagactgctaggtaccttgtagagcacaagcagaactactccggtgagggtgaagagctgatctaccactccaaggggcatgctttgaatccgggacaaagggactggacgaggtatcagccctgggagccaaagaaagagcaagcctagctattgagtacattgtggggaagctactgaaatgtttgcatggcgttgggtcaggtatcaccgagctgaatggactctgagttatgtttgaactgggcccaaataatgttgtcctgaatatcaatatcatctttggacatgaagtgttgttgttactgctgtaaaaacagctttggggaaaatctcatgcatttgttactaccttcggttatatttgaaagtatacgagagattatata

SEQ ID NO: 2452 - DNA, 870 bp, Secale cereale
agagagaggcatcgcatcggcggatcggccatcgagagaaaacgaagggagagcggcggaggaggcgaaggcatcatccatggccgcggtggtccggagcgtgtggcagggcatcagggagaagggcctcgcaaacttcctccgctacgcccgcgacgagggatacctaaaatgccttggggacggaaacctattgcaaaccaaaattcacaacattggtgcaacccttgtaggagttgacactttcggaaacaagtactatgagaaactacatgacactcagtatggaaggcataggtgggtagagtatgcggacaagggtcgctacaatgcatcccaagtgcccgctgaatggcatggatggttgcaccacattacagacagcactggggacaagctgctggaggagaagactaaaaagttcattagggagcacagacagaactacaccggacagggtgacgacttgatctaccactccaaggggcatgctctgaacccagggcaaagggactggacaaggtaccagccttgggaaccaaagaaagaagaggccacctgatctgtattaatggtacttgataatcctcttctatgtttcacatttggtttgggatcgccgatctaaaaccgccagtcagcttggtttcatggactggacctgaataatgtactctatctgatactgaatacctgccactgaacaattttaatctctgtgtggatgtggcaattgtgaaactggcgattcggtcgtcggtgttttgcattgaagagtttctttttctactgatgtcaatggtgcgtggatgttgagatgctgaaaggagataatattgtttggtaaattcggtggcgttgtaacatgtc

SEQ ID NO: 2453 - DNA, 623 bp, Festuca arundinacea
ggcacgaggccacctcctaccttcgattccagagagagatacagtgaggcatcgcatcgaccattgagggtaaacgaagggagagcggcggaggaggcgaaggtatcatccatggccgcggtcgttcggagcgtgtggcagggcatcagggagaagggcctcgtcaacttcttccgctacgcccgcgacgagggatacctaaaatgcattccggacggaaacttactgcaaaccaaaattcacaacattggcgcaacccttgtaggagttgacagtttcggaaacaagtactatgagaaactacatgacacgcagtatggaaggcacaggtgggtagagtatgcagacaagggtcgctacaatgcatcccaagtgcctgctgaatggcatggatggctgcaccacattacagacagcactggggataagctgttggaggagaagactaaaaagtacatcatggagcacagacaaaactacaccggacagggcgacgatctgatctaccactccaaggggcatgctctaaacccagggcaaagggactggacaaggtaccagccctgggaaccaaagaaagaggaggcctcctgatctctgtggtacccgataatcctcttttg

SEQ ID NO: 2454 - DNA, 747 bp, Avena sativa
cacatcggccattgggaggaaacgaagggagagcggcggaggaggcgaaggtatcatccatggccgcggtggttcggagcgtgtggcagggcatcagggagaagggcctcgtcaacttcttccgctacgcccgcgacgagggatacctaaaatgccttccggacggaaacttattgcaaaccaaaattcacaacattggcgcaacccttgtaggagttgacagttttggaaacaagtactatgagaaactacacgacactcagtatggaaggcacaggtgggtagagtatgcggacaagggtcgttacaatgcatcccaagtgcctgctgaatggcatggatggctgcaccacattacagacagcactggtgataagctgttggaggagaagaccaaaaagtacatcatggagcacagacagaactacaccggacagggtgatgatctgatctaccactccaaggggcacgctctaaacccggggcaaagggactggacaaggtaccagccttgggaaccaaagaaagaggagacctcctgatcggaatggtccccgaattaatcatcttctgtgtttctcatttgtttttgtgtcgcggagctgaaacagccaggtttcatggactggacctgaataatgtatctgatactgaatatgcctgtcctgggcactgaacaaattttaatccctgtgggaatgtgccaaaaaagtatcttgtggcgaatggatcgtctgtgtttgaatc

SEQ ID NO: 2455 - DNA, 754 bp, Avena sativa
gaggcatcacatcggccattgggaggaaacgaagggagagcggcggaggaggcgaaggtatcatccatggccgcggtggttcggagcgtgtggcagggcatcagggagaagggactcgtcaacttcttccgctacgcccgcgacgagggatacctaaaatgccttccggacggaaatttattgcaaaccaaaattcacaacattggcgcaacccttgtaggagttgacagttttggaaacaagtactatgagaaactacacgacactcagtatggaaggcacaggtgggtagagtatgcggacaagggtcgttacaatgcatcccaagtgcctgctgaatggcatggatggctgcaccacattacagacagcactggtgataagctgttggaggagaagaccaaaaagtacatcatggagcacagacagaactacaccggacagggtgatgatctgatctaccactccaaggggcatgctctaaacccagggcaaagggactggacaaggtaccagccttgggaaccaaagaaagaggagacctcctgatcggaatggtccccgaattaatcatcttctgtgtttctcatttgtttttgtgtcgcggagctgaaacagccaggtttcatggactggacctgaataatgtatctgatactgaatatgcctgtcctgggcactgaacaaattttaatccctgtgggaatgtgccaaaaaagtatcttgtggcgaatggatcgtctgtgtttgaatc

SEQ ID NO: 2456 - DNA, 809 bp, Avena sativa
cacatcggccattgggaggaaacgaagggagagcggcggaggaggcgaaggtatcatccatggccgcggtggttcggagcgtgtggcagggcatcagggagaagggcctcgtcaacttcttccgctacgcccgcgacgagggatacctaaaatgccttccggacggaaatttattgcaaaccaaaattcacaacattggcgcaacccttgtaggagttgacagttttggaaacaagtactatgagaaactacatgacactcagtatggaaggcacaggtgggtagagtatgcggacaagggtcgttacaatgcgtcccaagtgcctgctgaatggcatggatggctgcaccacattacagacagcactggtgataagctgttggaggagaagaccaaaaagtacatcatggagcacagacagaactacaccggacagggtgatgatctgatctaccactccaaggggcatgccctaaacccggggcaaagggactggacaaggtaccagccttgggaaccaaagaaagaggagacctcctgatctgaatggtccccaaattaatcatcttctgtgtttctcatttttttttgtgtcgcggagctgaaacagccaggtttcatggactgggcctgaataatgtatctgatactgaatatacctgtcctgggcactgaacaaattttaatccctgcgggaatgtgccaaaaaagaatgttgtggcgaatggatcgtctgtgtttgaatcgaatatttcttttcctgatgttaatgatgcattgatgttgaatgttgagaacttgaggtgct

SEQ ID NO: 2457 - DNA, 792 bp, Avena sativa
ggagagcggcggaggaggcgaaggtatcatccatggccgcggtggttcggagcgtgtggcagggcatcagggagaagggtctcgtaaactttctccgctacgcccgcgacgagggatacctaaaatgccttccggacgggaacttattgcaaaccaaaattcacaacattggcgcaacccttgtaggagttgacagttttggaaacaagtactatgagaaactacacgacactcagtatggaaggcacaggtgggtagagtatgcggacaagggtcgttacaatgcatcccaagtgcctgctgaatggcatggatggctgcaccacattacagacagcactggggataagctgttggaggagaagactaaaaagtacatcatggagcacagacagaactacaccggacagggtgatgatctgatctaccactccaaggggcatgctctgaacccagggcaaagggactggacaaggtaccagccttgggaaccgaagaaagaggagacctcctgatctgaatggtacccgaattaatcatcttttgcgtttcgcatttggtttggtgtcacggagctgaaacagctagccagccagctcggtttcatggaccggacctgaataatgtatctgatactgaatacctgtcctgggcactgaacaaatttcaatccctgtgggaatgtgccaaaaaagaatgttgtggcgaatggatcgtctgtgtttgaatcgaatatttcttttcctgatgttaatgatgcattgatgttgaatgttgagaacttgaggtgct

SEQ ID NO: 2458 - DNA, 696 bp, Secale cereale
  misc_feature (128)..(128): n is a, c, g, or t
ccacgcgtccgggcatcgcatcggcggatcggccatcgagagaaaacgaagggagagcggcggaggaggcgaaggcatcatccatggccgcggtggtccggagcgtgtggcagggcatcagggagaanggcctcgcaaacttcctccgctacgcccgcgacgagggatacctaaaatgccttggggacggaaacctattgcaaaccaaaattcacaacattggtgcaacccttgtaggagttgacactttcggaaacaagtactatgagaaactacatgacactcagtatggaaggcataggtgggtagagtatgcggacaagggtcgctacaatgcatcccaagtgcccgctgaatggcatggatggttgcaccacattacagacagcactggggacaagctgctggaggagaagactaaaaagttcattagggagcacagacagaactacaccggacagggtgacgacttgatctaccactccaaggggcatgctctgaacccagggcaaagggactggacaaggtaccagccttgggaaccaaagaaagaagaggccacctgatctgtattaatggtacttgataatcctcttctatgtttcacatttggtttgggatcgccgatctaaaaccgccagtcagcttggtttcatggactggacctgaataatgtactctatctgatactgaata

SEQ ID NO: 2459 - DNA, 936 bp, Secale cereale
gagagagagagagaggcatcgcatcggcggatcggccatcgagagaaaacgaagggagagcggcggaggaggcgaaggcatcatccatggccgcggtggtccggagcgtgtggcagggcatcagggagaagggcctcgcaaacttcctccgctacgcccgcgacgagggatacctaaaatgccttggggacggaaacctattgcaaaccaaattcacaacattggtgcaacccttgtaggagttgacactttcggaaacaagtactatgagaactacatgacactcagtatggaaggcataggtgggtagagtatgcggacaagggtcgctacaatgcatcccaagtgcccgctgaatggcatggatggttgcaccacattacagacagcactggggacaagctgctggaggagaagactaaaaagttcattagggagcacagacagaactacaccggacagggtgacgacttgatctaccactccaaggggcatgctctgaacccagggcaaagggactggacaaggtaccagccttgggaaccaaagaaagaagaggccacctgatctgtattaatggtacctgataatcctcttctatgtttcacatttggtttggaatcgccgatctaaaaccgccagtcagcttggtttcatggactggacctgaataatgtactctatctgatactgaatacctgccactgaacaattttaatctctgtgtggatgtggcaattgtgaaactggcgattcggtcgtcggtgttttgcattgaagagtttctttttctactgatgtcaatggtgcgtggatgttgagatgctgaaaggagataatattgtttggtaaattcggtggcgttgtaacatgtccgtgttgttttggtgttactacgtcacactgaagtgtagtactttatttgatttgatagtt

SEQ ID NO: 2460 - DNA, 782 bp, Elaeis guineensis
gcccagccgagagggggtgcgaccggcgcgcggtaccagtgcgagaaaaggggatttcctcacgccgtgaggagagcggaggagacgaatggcttcggtagtccggggcgtcttcaaggcgatcagagaaaaaggcattggaaatttcgtgaaggagcttcgagaagagggctatacgaagtgccttctggatgggaatctattgcaaacaaaaattcacaacataggtgcgacccttgttggagttgataaatttggaaacaagtattatgaaaaattgcaggacactcagtatgggcggcacaggtgggtggaatatgcagagaagggccgttataatgcatcccaagtgccccctgagtggcatggctggctgcaccatatcactgaccatacgggggatgaacttttgatgctgaaacctaaaagatatggagtagaacacaaggagaacttttcgggagagggtgatgagtacatctaccactcgaagggtcacgctctcaaccctggacagagggactggacccgataccaaccatggcaacccaccaaaaactaaataaagtcctttcccttattagactgaaggcttggaaaagaaaattcagtgcattgcttttcttgccatgtgatcatccgtgagcaatgtctactagatattttaactgaaattttaatgcaggctggatgaactttgtgcaaataaatgtaatgaacttgttcctttcgagagagcaacctgtgattatcgtattgaaactttggattatgaactttgg

SEQ ID NO: 2461 - DNA, 1555 bp, Sorghum bicolor
gtttatttatagctgccgctcaaagcgacagctggagatcagcgggaggaggagctgagctgaggatcgagctcagggaacaagcaaacagccatagctcatatccaggtcgtgagggcaggggctattagccggcagtgatcttcttgtatccgccgtagcctcgatcgatcggtttgagctcgtggatatgggggagcaggagaacaacaagatcggcggcggcggcggcaaccacgccatggcggtggacgaggcggccgcggcggccaaggggaagagccttggcgccgcggacccgcgcctgcagggcatttccgacgccatccgcgtcgtcccccacttccccaagccagggatcatgttcaacgacatcacggagctgctgctgcggccgggcgtgttcaaggacgccgtggacatgttcgtcgagcgctaccgcggcatgggcatcgccgccgtcgcaggcattgaagctagaggattcatctttggcccagccattgcgctagccataggagcaaagttcataccactacgcaaacctaagaagcttccaggtgaggtattttctgaaagttatgtacttgagtatggaatggattgtttggagatgcatgttggagctattgaacccggggagcgtgtagtggttgttgatgatttggttgcaactggaggaactctttctgctgcaataagacttcttgagcgcgcaggagctaacgtggttgagtgtgcatgcctcattgggcttcccaagtttaaggatttctacaagctcaacgggaaaccagtttacatcctggtggagtcccgcaaataggacgcagtaaatggtcaggcaaaaaagctttctatcttcccctccaaagaagctcacaacttcattcatttgcacgcgcaagcaaggtggaatgcgcaccgagaactccacagtaatctgtgttgaggccaaggccagatgtcatgtatcttcatggagagtgtgagatgcattgggtttgggtgaaacgtagtcactgtacttttgtagcacgtaacgtctagtagtatttttagtagccatggctgaagagagtttgtagctattcccgacttcctgccaggaacatcatcagtgttagccagagaaggaggaacttatgctgctgctcagttttctaccagaattgtcttttttttttctgtgcagattcaattctatggtaaactttactacacatccacgttcctgtgctgcttgttttgcctaaaagactgttcaatcctggaagaagagcaatcatacgtaatgccaaggacggaggacataagtttcccaatactactatatattggagctcccaaggaatatgctactgtgcagttgtactccacctgatcagatactagtagtacccaggaaagttttggccttgtttacttctctaaatattttgtaaaatgtttagattctccgtcacatcgaatcttacggcatatgcatgaaatattaaatattggtaaaaaagtaactaattatacagtttaaatgtaatttgagagacgaatc

SEQ ID NO: 2462 - DNA, 1853 bp, Sorghum bicolor
gctttgggctcgccttctctaatctctactagactagagtaaacacggcgcaatggtggtcccggcggccggtttccaatccaaggataacaagatggagtcttaaccctcgctctcactgtcacgtacacatcccttggtgcttgctacggccaccccgcggctgtacctgtggtcttggcttgccatgtttatttatagctgccgctcaaagcgacagctggagatcagcgggaggaggagctgagctgaggatcgagctcagggaacaagcaaacagccatagctcatatccaggtcgtgagggcaggggctattagccggcagtgatcttcttgtatccgccgtagcctcgatcgatcggtttgagctcgtggatatgggggagcaggagaacaacaagatcggcggcggcggcggcaaccacgccatggcggtggacgaggcggccgcggcggccaaggggaagagccttggcgccgcggacccgcgcctgcagggcatttccgacgccatccgcgtcgtcccccacttccccaagccagggatcatgttcaacgacatcacggagctgctgctgcggccgggcgtgttcaaggacgccgtggacatgttcgtcgagcgctaccgcggcatgggcatcgccgccgtcgcaggcattgaagctagaggattcatctttggcccagccattgcgctagccataggagcaaagttcataccactacgcaaacctaagaagcttccaggtgaggtattttctgaaagttatgtacttgagtatggaatggattgtttggagatgcatgttggagctattgaacccggggagcgtgtagtggttgttgatgatttggttgcaactggaggaactctttctgctgcaataagacttcttgagcgcgcaggagctaacgtggttgagtgtgcatgcctcattgggcttcccaagtttaaggatttctacaagctcaacgggaaaccagtttacatcctggtggagtcccgcaaataggacgcagtaaatggtcagaaaagctttctatcttcccctccaaagaagctcacaacttcattcatttgcacgcgcaagcaaggtggaatgcgcaccgagaactccacagtaatctgtgttgaggccaaggccagatgtcatgtatcttcatggagagtgtgagatgcattgggtttgggtgaaacgtagtcactgtacttttgtagcacgtaacgtctagtagtatttttagtagccatggctgaagagagtttgtagctattcccgacttcctgccaggaacatcatcagtgttagccagagaaggaggaacttatgctgctgctcagttttctaccagaattgtcttttttttttctgtgcagattcaattctatggtaaactttactacacatccacgttcctgtgctgcttgttttgcctaaaagactgttcaatcctggaagaagagcaatcatacgtaatgccaaggacggaggacataagtttcccaatactactatatattggagctcccaaggaatatgctactgtgcagttgtactccacctgatcagatactagtagtacccaggaaagttttggccttgtttacttctctaaatattttgtaaaatgtttagattctccgtcacatcgaatcttacggcatatgcatgaaatattaaatattggtaaaaaagtaactaattatacagtttaaatgtaatttgagagacgaatcttttaagtctatttagtctataattggacaaaatttatcaaatacaaacgaaagtattactgttcacatttgcaaaaaaatttgaggctctttgtttgagctcatcagccgga

SEQ ID NO: 2463 - DNA, 1124 bp, Saccharum officinarum
ggggaggagctgggctgaggatcgaggtcagggaacaagcaagcagccatagcccatagccaggtcgtgagggaagggctataagccggcagtgatcttcatccaagtgaggccggagcgtcgatcggtttgagctcgtggatatgggggagcaggagaacaacaagatcggcggcggcggcaacaacgccatggcggtggacgaggcggtcgcggcggccaaggggaagaagagccttggcgccgcggacccgcgcctgcagggcatttccgacgccatccgcgtcgtcccccacttccccaagccagggatcatgttcaacgacatcacggagctgctgctgcggccgggcgtgttcaaggacgccgtggacatgttcgtcgagcgctaccgcggcatgggcatcgccgccatcgcaggcattgaagctagaggattcatctttggaccagctattgcgctagccataggagcgaagttcataccactacgtaaacctaagaagcttccaggtgaggtattttctgagagttatgtacttgagtatgggatggattgtttggagatgcatgttggagctgttgaacctggggagcgtgtagtggttgttgatgatttggttgcaactggtggaactctttctgctgcaataagacttcttgagcgcgcaggagctaacgtggttgagtgtgcatgcctcattgggcttcccaagtttaaggatttctacaagctcaacgggaaaccagtttacatcctggtggagtcccgcaaataggacgcagtaaatggtcagaaaagctttctatcttcccctccaaagaagctcacaacttcatacatttgcacgcacaagcaaggtggaatggacactgagaactctgcagtaatctgtgttgaggccaaggccagatgttgtatcttcatggagagtgtgagatggattgggtgaaacgtagtcactgtacttttgtagcacgtcacgtctagtgtttttagtagccatggctgaagagagtttgtagctattcccgacttcctgccaggaacatcagtgttagccagagaaggaaaaggaacttattatgccgctgctcagttttctaccagaatcgtctttttt

SEQ ID NO: 2464 - DNA, 1160 bp, Panicum virgatum
gtcctttgagtaggctatggagagggaggagctgaggatcgagggagcaagcagccaggtccaggtgaaggtgaggcctcgagggggaagccaggaagggctactgcctactagtactagccggtggtgatcttcttgcctcgggggtgacgccggagagtttgggtctgccgggcgcgtgagatgggggagcaggagaacaacaagaccggcggcggcaacaacgccatggcggtggcggacgaggcctcggcggcggcggccaaggagaagggccgcggcgccgcggacccgcgcctccagggcatttccgacgccatccgcgtcgtcccccacttccccaagccagggatcatgttcaacgacatcacgccgctgctgctccggccggccgtgttcaaggacgccgtggacatgttcgtcgagcgctaccgcggcatgggcatcgcggccgtcgcaggtattgaagccagaggcttcatctttggaccagccattgctttagccattggagcaaagttcataccgctgcgtaaacctaagaagcttccaggtgatgtattctctgaaagttatgtgcttgagtatgggacggattgtttggagatgcatgttggagctattgaaccgggggagcgcgcagtggtggttgatgacctggttgcaactggtggaactctttctgctgcaatcagacttcttgaacgcgccggagctgacgtggttgagtgtgcatgcctcattgggcttcccaagtttaaggatttctacaagctcaacggaaaaccagtttacattctggtggagtcccgcaaataggacgtggtaaaagatcaggcagaaaagctttccagcttttcctcagaaaaacaagctcaaagcttcattgtttgcaagcagcgtgaggtggaagaatggacgccgagtactctccagtaaaccgtgttgaggccaggggccagagccagctgctatgtatctgcatgtagagggtgaggtggattgggtgaaacgttagtctctgtaccacgtcccgtctagtgtttttctagtagccgtgacaggggagagtttgtagctattcccgccgagaacatcagtgttggccagagaatggaaggggaaaaaagagaaccttgctgatgctgtccggtttttct

SEQ ID NO: 2465 - DNA, 1183 bp, Pennisetum glaucum
gtttatttatagactcccccagctgcctctcaaagcgacatctggaggaggaggagggagctgaggaagtgagcatcgagagggagcgagcaagctgcaagcagccaggtgaggggggaagggctacgagccggcggtgatcttcgttcttgcatcggagtgagggctggtctctgggcgcgtgagatgggggagcaggagaacaacaaggccgccggcggcaacaacgccatggcggtggtggacgaggcggcgccggcggcggacaaggagaaggcgggccgtgccgccgcggacccgcgcctccagggcatttccgacgccatccgcgtcgtcccccacttccccaagccagggatcatgttcaacgacatcacgccgctgctgctgcggccggccgtgttcaaggacgccgtggacatgttcgtcgagcgctaccgcggcatgggcatcgccgccgtcgcaggtattgaagccagaggcttcatctttgggccagccattgcactagctattggagcaaagtttataccgctgcgtaaacctaagaagcttccaggtgatgtattttctgaaagttatgtgcttgagtatgggacggattgtttggagatgcatgttggagctataaaaccgggggagcgtgcagtggttgttgatgatctggttgcaactggcggaactctttctgctgcaataagacttcttgaacgcgcaggagctgacgtggttgagtgtgcatgtctcattgggcttcccaagttcaaggatttttacgagctcaacggaaaaccagtttacattctggtggagtcccgcaaataggaacgtagaagctcagaaaagcttaccagcttttgcgccgaaaaggctcacagcttcattcgttcgatcgcaagcgctcaaggaggaatggccgcagaccgccgagtgagagcagtaaactgtgtggagcccaaggccaagcaagctgctatgtatctggatggagagggtgagatcgatggattgggtgaaacgttcgtgttagtccttgtagcacgtcccgtcgtctagtgtgtttttagtagccgtgactgggtagagtttgtagcagctattcccgccgggaacatcagtgttaattagccagaaaatcgaaggaaaaacgaaatgctgctcggttttttccagaaaaaaaaaa

SEQ ID NO: 2466 - DNA, 1255 bp, Setaria italica
catccactgagctacggccaccccgcggctgtacctggtcttggcttcccgtgtttatttatagacgcccccagctgccgctcaaagcgacagctggaggaggaggagctcaggaagtgaggatcgagggagggagcaagcagccagagccaggtgaggggaagggctactgcctactggccggtgtcgatcttcttgcatcgaagtgaggccggagacctggtctgggagcgtgagatgggggagcaggagaacaacaacgccggcggcggcaacaacgccatggcggtggtggacgaggcgccggcggcggccaaggagaaggcgggccgtgccgccggggacccacgcctccagggcatttccgacgccatccgcgtcgtcccccacttccccaagccagggatcatgttcaacgacatcacgccgctgctgctgcggccggccgtgttcaaggacgccgtggacatgttcgtcgagcgctaccgcggcatggacatcgccgccgtcgcaggtattgaagccagaggcttcatctttgggccagccattgcgctggccattggagcaaagttcataccgctgcgtaaacctaagaagcttccaggtgatgcattttctgaaagttatgtacttgagtatgggacggattgtttggagatgcatgttggagctattgaaccgggggagcgcgcagtggttgttgatgatctggttgcaactggtggaactctttctgctgcaataagacttcttgaacgcgcgggagctgacgtggttgagtgtgcatgcctcattgggcttcccaagtttaaggatttttacaagctcaacggaaaaccagtttacattctggtggagtcccgcaaataggaacgtagaagatcagaaaagctttccagcttttccaccaaaaaggctcacagcttcattcgttcgcaagcgcaaggatgaatggccgcagaccgccgagtgagagcagtgtaaaccgtgtggaggccaagcggctatgtatctgcatggagagggtgagatggattgggtgaaacgttagtccttgtagcacgtcccgtctagtgttttttaagtagccgtgactggggagagtttgtagctattcccgccgggaacatcagtgttagccagagaatcgaaggaaaaagaaccatgctgatgttgctcggttttttctacgagaatccgtacgttttctgtggtcaattcagctcgttctcgctaaaggctgttcaacaac

SEQ ID NO: 2467 - DNA, 1338 bp, Setaria italica
gaggaggaggagctcaggaagtgaggatcgagggagggagcaagcagccagagccaggtgaggggaagggctactgcctactggccggtgtcgatcttcttgcatcgaagtgaggccggagacctggtctgggagcgtgagatgggggagcaggagaacaacaacgccggcggcggcaacaacgccatggcggtggtggacgaggcgccggcggcggccaaggagaaggcgggccgtgccgccggggacccacgcctccagggcatttccgacgccatccgcgtcgtcccccacttccccaagccagggatcatgttcaacgacatcacgccgctgctgctgcggccggccgtgttcaaggacgccgtggacatgttcgtcgagcgctaccgcggcatggacatcgccgccgtcgcaggtattgaagccagaggcttcatctttgggccagccattgcgctggccattggagcaaagttcataccgctgcgtaaacctaagaagcttccaggtgatgcattttctgaaagttatgtacttgagtatgggacggattgtttggagatgcatgttggagctattgaaccgggggagcgcgcagtggttgttgatgatctggttgcaactggtggaactctttctgctgcaataagacttcttgaacgcgcgggagctgacgtggttgagtgtgcatgcctcattgggcttcccaagtttaaggatttttacaagctcaacggaaaaccagtttacattctggtggagtcccgcaaataggaacgtagaagatcagaaaagctttccagcttttccaccaaaaaggctcacagcttcattcgttcgcaagcgcaaggatgaatggccgcagaccgccgagtgagagcagtgtaaaccgtgtggaggccaagcggctatgtatctgcatggagagggtgagatggattgggtgaaacgttagtccttgtagcacgtcccgtctagtgttttttaagtagccgtgactggggagagtttgtagctattcccgccgggaacatcagtgttagccagagaatcgaaggaaaaagaaccatgctgatgttgctcggttttttctacgagaatccgtacgttttctgtggtcaattcagctcgttctcgctaaaggctgttcaacaacaatcatacgtaatgcccgaacaaaggacatgtcttttggaaaactagatggcagtgctagattgaagcttccaaagcgcttgtttaatcaagctcccaaagaatatgcttgggtgccgttgtactccacctccacctggctagatgcccaggagttccgatctttgctttcctccagcg

SEQ ID NO: 2468 - DNA, 1138 bp, Brachypodium distachyon
ctccctggctacgaactagtcgaagggatagctgaagaagaccacgatcgagagcgaagcaaagaagaggaaggaggagttaatttaagaagtgcatcaagacatcatatggggcagcaagagaagagcggcgagaccggcggcggcaacatggaggaggcggcggccaaggagaacggccgcgccgccgatccgcgcctccagggcatttccgacgccatccgcgtcgtcccccacttccccaagccagggatcatgttcaacgacatcacggcgctgctgctgcggcctggcgtgttcaaggacgccgtggacatgttcgtggagcgctaccgcggcatgggcatcgcggccgtcgcaggtattgaagccagaggattcgtatttggcccggcgatcgcattagccatcggagcgaaattcataccgttgcgcaaacctgggaaactcccaggcgaggtgatttccgagacttatgtgcttgagtatgggacggattgcttggagatgcatgtcggagccactgaacagggggagcgcgtagtggtcgttgatgatttggttgcaaccggtgggacactttctgcagctataagacttctcgaacgtgctggagctgacgttgttgagtgtgcatgcctcattggacttcctaaatttaaggatttctacaagctcaacggaaagccagtttatatactggtggagtcccgcaaataggaattaaaaagttgatgaccgaccagaaaaaaggatgacagcttcagtcatttgtaaccgcgttacaaatgatggatgtaactctggagtacactgtcaagggcagctgccaagtgtgtctcctcaagagggtgagatagtagatgagatgtagtcatgtagagccttattagcactagttttttcagtagtatgaaggagagcttgtagttatttctgtcaagaattatcactgttagcaggagaaagaaaagaaccaccctgttgttcagttgtccgtgaacgttcttctgtgtttttttgccgtgcagatcatgcttagcattagtttatctcatcttgtttagactatcctactactaagattacatcgtacaactatcttgaagccgaataaaggatgccgaatttcattttc

SEQ ID NO: 2469 - DNA, 1381 bp, Brachypodium distachyon
ccggcgcgcgttgcgtcatgcgtgttgcgtccccgtgtttatttatatgcactggttaccttcctccctggctacgaactagtcgaagggatagctgaagaagaccacgatcgagagcgaagcaaagaagaggaaggaggagttaatttaagaagtgcatcaagacatcatatggggcagcaagagaagagcggcgagaccggcggcggcaacatggaggaggcggcggccaaggagaacggccgcgccgccgatccgcgcctccagggcatttccgacgccatccgcgtcgtcccccacttccccaagccagggatcatgttcaacgacatcacggcgctgctgctgcggcctggcgtgttcaaggacgccgtggacatgttcgtggagcgctaccgcggcatgggcatcgcggccgtcgcaggtattgaagccagaggattcgtatttggcccggcgatcgcattagccatcggagcgaaattcataccgttgcgcaaacctgggaaactcccaggcgaggtgatttccgagacttatgtgcttgagtatgggacggattgcttggagatgcatgtcggagccactgaacagggggagcgcgtagtggtcgttgatgatttggttgcaaccggtgggacactttctgcagctataagacttctcgaacgtgctggagctgacgttgttgagtgtgcatgcctcattggacttcctaaatttaaggatttctacaagctcaacggaaagccagtttatatactggtggagtcccgcaaataggaattaaaaagttgatgaccgaccaggcaaaaaaaaggatgacagcttcagtcatttgtaaccgcgttacaaatgatggatgtaactctggagtacactgtcaagggcagctgccaagtgtgtctcctcaagagggtgagatagtagatgagatgtagtcatgtagagccttattagcactagttttttcagtagtatgaaggagagcttgtagttatttctgtcaagaattatcactgttagcaggagaaagaaaagaaccaccctgttgttcagttgtccgtgaacgttcttctgtgtttttttgccgtgcagatcatgcttagcattagtttatctcatcttgtttagactatcctactactaagattacatcgtacaactatcttgaagccgaataaaggatgccgaatttcattttccagctccaagttacaggcctagtgcctggagaaaaagaagtactactcgttagtttctgaactgaagctaaccaaaaagaacagcttggtttaggaatcaggaggctcgccgcaaattcccgtcgattactccttgtgaacgaaatctcacaacgactcaccggcagagtgcagga

SEQ ID NO: 2470 - DNA, 1128 bp, Triticum aestivum
gaattcggcacgagggctacgtccacccggcgcctccgcccgtctcctctgctcgtgtttatttatacacacacgcgcacacctttctccctagccaccactactcactactcagaggaaggaagatcaaacgacgaagcaaagcaagcagcgagcgagcgagcgtcggcatcacgggcatgggggagcagggcaccagcggcagcgagggaggcggcagcatggtggaggcacaggcgccggccaagaagggcgacggccgcgccgccgacccgcggctccagggcatttccgacgccatccgcgtcgtcccgcacttccccaagccagggatcatgttcaacgacatcacggcgctgctgctgcggccgggcgtgttcaaggacgccgtggacatgttcgtggagcgctaccgcggcatgggcatcgcggccgtcgcaggcattgaagcaagaggattcatatttggcccggcgatcgcgctagccatcggggccaaattcataccgctgcgcaaacccggcaaactcccaggtgaggtgatttccgagacttatacactcgagtatgggacggattgcttggagatgcatgttggagccgtcgagcccggcgatcgtgtggtggtggtggatgatctggttgcaaccggtgggacgctttctgcagctataaaacttcttgaacgtgccgcagctgacgttgttgagtgtgcatgcctcatcggactccctaagtttaaggatttctacaagctcgatggaaagccagtttacatactggtggagtcccgcaaataaaatgtaaaatgatgatgattgatcagaaaaaggatcacagcttcattcgtttgcaagcgcgcatggtggatgtgtattgataactctgcagtacactgttaggggcagctgctattgctaagtgtctttcttggtggagagggtgagatagatgagatgtagtcttcctagcactagttttccagtagtggagtatttgatgagagcttgtagttatttctgtcgggaatcatcaccgttagccgcaaagaaaagaaccatcctgttgttcaggttcttctacgagatttttcctgtgtatctcagcattagtttattccattgtctc

SEQ ID NO: 2471 - DNA, 1221 bp, Secale cereale
gactggataataaaactaccccctactctccctcgcactgccgctacgtccacccggcgcctccgcccgtctcctcgtgtttatttatacacacacacgcacacctttctccctagccaccactcactactcggagcaaggaagatcaaacgacgaagcaaagcaagcaaggagcgagcgagcgtcggcatcacgggcatgggcgagcaggaccccagcggcagcgagggcggcggcagcgtcgtggaggcgcaggcgccggccaagaagggcggcggcggccacggccgcgccgccgacccgcggctccagggcatttccgacgccatccgcgtcgtcccgcacttccccaagccagggatcatgttcaacgacatcacggcgctgctgctgcggccgggcgtgttcaaggacgccgtggacatgttcgtggagcgctaccgcggcatgggcatcgcggccgtcgcaggcattgaagcaaggggattcatatttggcccggcgatcgcgttggccatcggggccaaattcataccgctgcgcaaacccggcaaactcccaggtgaggtgatttccgagacttatacgctcgagtatgggacggattgcttggagatgcatgttggcgccgttgagcccggcgaccgtgtggtggtggtcgatgatctggttgcaaccggtgggacactttctgcggctataaaacttcttgaacgtgctgcagctgacgttgttgagtgtgcatgcctcattggactccccaagtttaaggatttctacaagctcgatggaaagccagtttacgtactggtggagtcccgcaaatagtcagtaaaatgatgatgattgatcagaaaaaggatcacagcttcattgctatgcaagcgtgcatggtggatgtgtattgataactctgcagtacactgccaggggcagctgctattgctaagtgtcttggtggagagggtgagatagatgagatgtagtcttcctagcactagttttccagtagtggagtatttgatgagagcttgtagctatttctgtcggaaatcatcactgttagccgcaaagagaagaaccatcctgttgtccaggttcttttatgagtattttttttgtgttgtgtctcagctattagtttactcccactgtctctaaattgctagttgtatcgtacctaagattacagtgctagttacaaacttacatcggtactta

SEQ ID NO: 2472 - DNA, 1037 bp, Pseudoroegneria spicata
  misc_feature (5)..(8): n is a, c, g, or t
  misc_feature (134)..(136): n is a, c, g, or t
gatcnnnnacgaagcaaagcaagcaagcaacgagccagcgggcgagcgtcagcatcacgggtatgggggagcaggacaccagcggcagcgagggcggcggcaacgtggtggaggcgcaggcgccggcgccttcnnngaagaacggcgacggccgcgccgccgacccgcgcctccagggcattttcgacgccatccgcgtcgtcccgcacttccccaagccagggatcatgttcaacgacatcacggcgctgctgctgcggccgggcgtgttcaaggacgccgtggacatgttcgtggagcggtaccgcggcatgggcatcgtggccgtcgcaggtattgaagcaagaggattcatatttggcccggcgatcgcgttggccatcggagccaaattcataccgctgcgcaaacccggcaaactcccaggtgaggtgatttccgagacttatacgcttgagtatgggacggattgcttggagatgcatgttggagccgtcgagccaggcgatcgtgtggtggtggtggatgatctggttgcaaccggtgggacactttgtgcagccataaaacttcttgaacgtgccgcggctgacgttgttgagtgtgcatgcctcatcggactccctaagtttaaggatttctacaagctcgatggaaagccagtttacatactggtggagtcccgcaaataataagtaaaatgatgatgattgatcagaaaaaggatcacagcttcattcctttgcaagcgcgcatggtggatgtgtattgataactctgcagtacactgttaggggcagctgctattgctaagtgtcttggtggagagggtgagatagatgagatgtagtcttcctagcactaattttccagtagtggagtatttgatgagagcttgtagttatgtctgtcgggaatcagcactgctagccgcaaagaaaagaaccatcctgttgtccaggttcttttatgagattttttttgtgtgtatctcatcattagttcatcccattttctcaaaaaaatttatcatccta

SEQ ID NO: 2473 - DNA, 1127 bp, Secale cereale
tttatttatacacacacacgcacacctttctccctagccaccactcactactcggagcaaggaagatcaaacgacgaagcaaagcaagcaacgagcgagcgagcgagcgtcagcatcacgggcatgggcgagcaggaccccagcggcagcgtcgtggaggcgcaggcgccggccaagaagggcggcggcggccacggccgcgccgccgacccgcggctccagggcatttccgacgccatccgcgtcgtcccgcacttccccaagccagggatcatgttcaacgacatcacggcgctgctgctgcggccgggcgtgttcaaggacgccgtggacatgttcgtggagcgctaccgcggcatgggcatcgcggccgtcgcaggcattgaagcaaggggattcatatttggcccggcgatcgcgttggccatcggggccaaattcataccgctgcgcaaacccggcaaactcccaggtgaggtgatttccgagacttatacgctcgagtatgggacggattgcttggagatgcatgttggtgccgtcgagcatggcgaccgtgtggtggtggtggatgatttggttgcaaccggtggaacgctttctgcggcaataaaacttcttgaacgtgctgcagctgacgttgttgagtgtgcatgcctcattggactccccaagtttaaggatttctacaagctcgatggaaagccagtttacgtactggtggagtcccgcaaatagtcagtaaaatgatgatgattgatcagaaaaaggatcacagcttcattgctatgcaagcgtgcatggtggatgtgtattgataactctgcagtacactgccaggggcagctgctattgctaagtgtcttggtggagagggcgagatagatgagatgtagtcttcctagcactagttttccagtagtggagtatttgatgagagcttgtagctatttctgtcggaaatcatcactgttagccgcaaagagaagaatcatcatgttgtccaggtttcttttatgtagatttttttgtgtgtgtctcagcattagtttatcccactgcctctaaattgcagttgtatcgtcctaagattacagtgctagttacaaacttacatcggtacttat

SEQ ID NO: 2474 - DNA, 3925 bp, Sorghum bicolor
cctcttttcgctgcaacttcccaccaccgccttcgtccctcccctatccgcgtcctcccccgggcgatcgatcgaacgcggctaacttcgccgccgccccatcgaggcagccatggcggagatcgccgagcgggccgtcgcgggcgagctgccggaggagccgcggccgccgcacggggaggaggaggacgaggaggaggaggaggagggggacgtgtgccggatctgccgcaaccgcggcgacgaggaccacccgctgcgctacccgtgcgcctgcagcggcagcatcaagttcgtgcaccaggactgcctcctccagtggctcgaccatagcaactcgcgccagtgcgaggtctgtaaacatgcattctccttctcacccgtgtacgctgagaatgctccgacaagacttcctttccaggaactgatagttggtgttggaatgaaagcatgccatgtgtttcaattcatccttcggcttgcctttgttctctcagtttggctcatgattatccctttcattacctattggatatggcggttaacatttgtgagaagtcttggtgaagcgcaaaggctgttcctcagtcacatcagtgctcagttgatccttagtgattgccttcatgggttccttctctcagctatcattgtccttatatttctcggagccacctcattacgggactacataaggcatttgcgtgaacttggtggacatgatgctgagagggatgatggaggacgtgaaaggcatggtgctcgggctgtcaggaggctagctggtcctaataatagggttcctggagatgcaaatattgatgaattagcagaagcccaaggaattggtcctggtgaacttctcaggagaaatgctgaaaatgttgctgctcgattagaacgacttgaggctcaggttgagcagatgcttgatggtctggatgacgcagatggtgcagaggatgttccttttgatgaacttgttggcatgcaaggccctgtcttccacttggttgagaatgcaataacagttttggccagcaatgctatattccttattgttgtgatctttgttccattctcattgggaaggattgtcctgtactatctatcatggtttttctcttcggcttctactcctatgctggcaaaaatgatgcccttcacagaaacagctatttctatagctaatgatacattgaagagcgcacttaatgttgtgaagaatttttcttccgacagtaataatgaaggtgttattgggcatgtgattgaggttgttactcaatccttgaagataaatgccactggtcttagtgtaattcaaggcactgggaagagcagtctgatgaaaggaacaacaattggctcatcttatctttcagatttgacaactcttgctgttggatacatgttcatcttctgtctggtatttttgtacattggatcactggccttacttcgatatgccaggggagaacgtttcaccattggaagactctatggtatagctactatattagaggccatcccttctctatgcaggcagttctttgctggaatgaagcaccttatgactatggtcaaagttgcattccttctggtcattgagcttggtgtatttcctcttatgtgtggttggtggcttgatgtttgcactctaaagatgctgggcacaacaattgcgcagagagttgaattctttacaatgtcacccttggcgagctcatctatccattggctagttgggattgtgtatatgcttcaaataagcatatttgtcagccttcttcgaggggtgctgcgcaatggagttctttattttctgcgggaccctgctgatccaaattacaatccatttagggatttgattgacgatcctgtgcataagcatgcccggcgtgttcttttgtcagttgcagtgtatggaagtttgattgtgatgctggtcttcttacctgtaaaactggccatgagagtagctccttcaatttttcctcttgacatcaccatatttgacccgtttactgagattccagttgatgtccttctgttccaaatatgcataccatttgctattgagcatttcaagcctcgtgcaaccattaaatctcttttacatcattggtttgctgcggttggttgggcccttggcttaaccgatttcttactgccaaaacctgaagaaaacggtgggcaggaaaattggaatggcagggcagaaagaagagacaggggacatggtggacgggaaatggttgccccacaggtcgaacaacgcatgatacagcatgttgccgcagaagataatggcaggggaaatgcaaatgaagcaaatgatgccactgaagaatctgatgtagatgatcaaggagactctgagtatggctttgtgcttcggatcgtgctcttgcttgtactggcatgggtgacactactgatattcaatgccggaatgatagttattcctatctcgcttggccgtttggtttttgaggctgttccccgtctgccaatcacacatggcatcaagtgcaatgatctgttctcctttagcattgggtgctatattctctggagtgcggcagctgggaccagatatgcgattgattacatcagatcacgacagctgggatttctggtacaacaaatctgcaagtggtgctcaattgttttgaagagctcttttctcttgtcaatatggatctttgttattcctgtgctgattggactcctttttgagctgctggtcatcgtaccaatgagggtgcctattgatgagagccctgtcttcctattgtaccaggattgggcactggggttaatattcttgaaaatatggactagactggttatgttggatcagatggcacctttggttgatgaaagctggaggtcaaagtttgagagagttagagatgatggcttctcccgtttaaggggtctgtgggtcctccatgaaattataatgccgattgtcaccaagctccttacagctctctgtgtcccatacgtccttgcaaggggcatcttcccggtgctgggttaccctctcatagtgaactcagcagtgtaccgctttgcctggcttggatgcctgatcttcagcgcactcttcttttgtggcaagagattccatgtctggttcaccaacctccacaactccatcagggatgaccgctatctgattggccggaggctgcacaactttggcgaggactcacactcacccgaaccaagtgaatctggagcaactatagggtcagatgaccaggaccgagcccttgtcctgcgagatcaggaagaggacgtggggttgaggatgaggcgcaataatatgcgtgcaaaccaacaacccaggctggctttataagcaggaagtagttttggataaagagctcataatcatggtataagctggtctgcagcttctgcttgtgctttgtaatgggtgttgtagagtgagtttgtgttagtgatagagaagagtctaaagactgttctacgacgaagcctgggagaaagataaagtggttggtgactataagactggtggcgaactccctttcctgtggtagtcttggctgactgtaaatatcgtttgatagagcattaccaggccaactcagtttgttgtgatcctcttgtaatgactaatgaattaagttgaactgttgggtagatacgagatactaggttatatcactttcaccttttttttttggtgccatctttgtttcttggcaactgcaatattgaaatttactaagctcggatgtgggctgctggctgcatcacggaacaaggacaagttgatctgggcactaattggttgggagtaattgaaagcatgaaaaggatttctgagttttttttttgacaattaaaaggatttctgagttagaagtttagggggtgtttagtt

SEQ ID NO: 2475 - DNA, 4029 bp, Sorghum bicolor
agccgaccgccatatccagcgcgtcattaacgaggctccgaaaaaaaccccacgttttttcttcctcttttcgctgcaacttcccaccaccgccttcgtccctcccctatccgcgtcctcccccgggcgatcgatcgaacgcggctaacttcgccgccgccccatcgaggcagccatggcggagatcgccgagcgggccgtcgcgggcgagctgccggaggagccgcggccgccgcacggggaggaggaggacgaggaggaggaggaggagggggacgtgtgccggatctgccgcaaccgcggcgacgaggaccacccgctgcgctacccgtgcgcctgcagcggcagcatcaagttcgtgcaccaggactgcctcctccagtggctcgaccatagcaactcgcgccagtgcgaggtctgtaaacatgcattctccttctcacccgtgtacgctgagaatgctccgacaagacttcctttccaggaactgatagttggtgttggaatgaaagcatgccatgtgtttcaattcatccttcggcttgcctttgttctctcagtttggctcatgattatccctttcattacctattggatatggcggttaacatttgtgagaagtcttggtgaagcgcaaaggctgttcctcagtcacatcagtgctcagttgatccttagtgattgccttcatgggttccttctctcagctatcattgtccttatatttctcggagccacctcattacgggactacataaggcatttgcgtgaacttggtggacatgatgctgagagggatgatggaggacgtgaaaggcatggtgctcgggctgtcaggaggctagctggtcctaataatagggttcctggagatgcaaatattgatgaattagcagaagcccaaggaattggtcctggtgaacttctcaggagaaatgctgaaaatgttgctgctcgattagaacgacttgaggctcaggttgagcagatgcttgatggtctggatgacgcagatggtgcagaggatgttccttttgatgaacttgttggcatgcaaggccctgtcttccacttggttgagaatgcaataacagttttggccagcaatgctatattccttattgttgtgatctttgttccattctcattgggaaggattgtcctgtactatctatcatggtttttctcttcggcttctactcctatgctggcaaaaatgatgcccttcacagaaacagctatttctatagctaatgatacattgaagagcgcacttaatgttgtgaagaatttttcttccgacagtaataatgaaggtgttattgggcatgtgattgaggttgttactcaatccttgaagataaatgccactggtcttagtgtaattcaaggcactgggaagagcagtctgatgaaaggaacaacaattggctcatcttatctttcagatttgacaactcttgctgttggatacatgttcatcttctgtctggtatttttgtacattggatcactggccttacttcgatatgccaggggagaacgtttcaccattggaagactctatggtatagctactatattagaggccatcccttctctatgcaggcagttctttgctggaatgaagcaccttatgactatggtcaaagttgcattccttctggtcattgagcttggtgtatttcctcttatgtgtggttggtggcttgatgtttgcactctaaagatgctgggcacaacaattgcgcagagagttgaattctttacaatgtcacccttggcgagctcatctatccattggctagttgggattgtgtatatgcttcaaataagcatatttgtcagccttcttcgaggggtgctgcgcaatggagttctttattttctgcgggaccctgctgatccaaattacaatccatttagggatttgattgacgatcctgtgcataagcatgcccggcgtgttcttttgtcagttgcagtgtatggaagtttgattgtgatgctggtcttcttacctgtaaaactggccatgagagtagctccttcaatttttcctcttgacatcaccatatttgacccgtttactgagattccagttgatgtccttctgttccaaatatgcataccatttgctattgagcatttcaagcctcgtgcaaccattaaatctcttttacatcattggtttgctgcggttggttgggcccttggcttaaccgatttcttactgccaaaacctgaagaaaacggtgggcaggaaaattggaatggcagggcagaaagaagagacaggggacatggtggacgggaaatggttgccccacaggtcgaacaacgcatgatacagcatgttgccgcagaagataatggcaggggaaatgcaaatgaagcaaatgatgccactgaagaatctgatgtagatgatcaaggagactctgagtatggctttgtgcttcggatcgtgctcttgcttgtactggcatgggtgacactactgatattcaatgccggaatgatagttattcctatctcgcttggccgtttggtttttgaggctgttccccgtctgccaatcacacatggcatcaagtgcaatgatctgttctcctttagcattgggtgctatattctctggagtgcggcagctgggaccagatatgcgattgattacatcagatcacgacagctgggatttctggtacaacaaatctgcaagtggtgctcaattgttttgaagagctcttttctcttgtcaatatggatctttgttattcctgtgctgattggactcctttttgagctgctggtcatcgtaccaatgagggtgcctattgatgagagccctgtcttcctattgtaccaggattgggcactggggttaatattcttgaaaatatggactagactggttatgttggatcagatggcacctttggttgatgaaagctggaggtcaaagtttgagagagttagagatgatggcttctcccgtttaaggggtctgtgggtcctccatgaaattataatgccgattgtcaccaagctccttacagctctctgtgtcccatacgtccttgcaaggggcatcttcccggtgctgggttaccctctcatagtgaactcagcagtgtaccgctttgcctggcttggatgcctgatcttcagcgcactcttcttttgtggcaagagattccatgtctggttcaccaacctccacaactccatcagggatgaccgctatctgattggccggaggctgcacaactttggcgaggactcacactcacccgaaccaagtgaatctggagcaactatagggtcagatgaccaggaccgagcccttgtcctgcgagatcaggaagaggacgtggggttgaggatgaggcgcaataatatgcgtgcaaaccaacaacccaggctggctttataagcaggaagtagttttggataaagagctcataatcatggtataagctggtctgcagcttctgcttgtgctttgtaatgggtgttgtagagtgagtttgtgttagtgatagagaagagtctaaagactgttctacgacgaagcctgggagaaagataaagtggttggtgactataagactggtggcgaactccctttcctgtggtagtcttggctgactgtaaatatcgtttgatagagcattaccaggccaactcagtttgttgtgatcctcttgtaatgactaatgaattaagttgaactgttgggtagatacgagatactaggttatatcactttcaccttttttttttggtgccatctttgtttcttggcaactgcaatattgaaatttactaagctcggatgtgggctgctggctgcatcacggaacaaggacaagttgatctgggcactaattggttgggagtaattgaaagcatgaaaaggatttctgagttttttttttgacaattaaaaggatttctgagttagaagtttagggggtgtttagttcctctttcatccaaaaaattctaggttttggtctattattt

SEQ ID NO: 2476 - DNA, 3640 bp, Zea mays
ccaccgcctatatccgcgttccccccgggcgatcgatcgatcgcggctaacctcgccgccgcccccatcgaggcagccatggcggagatggccgaacggtccgtcgcgggcgagctgccggaggagccgcggccgccgcacggggaggaggacgacgaggaggaagaggagggggacgtgtgccggatctgccgcaaccgcggcgacgaggaccacccgctgcgctacccgtgcgcctgcagcggaagcatcaaattcgtgcaccaggactgcctcctccagtggctcgaccatagcaactcgcgccagtgcgaggtctgtaaacatgcattctccttctcacccgtgtacgctgataatgctccgacaagactccctttccaggaactgattgttggtgttggaatgaaagcatgccatgtgtttcaattcatccttcggcttgcctttgttctctcagtttggctcatgattatcccattcattacctattggatttggcggttaacattggtgagaagtattggtgaagcgcaaaggctgttcctcagtcacatcagtgctcagttgattcttagcgattgccttcatgggttccttctctcagctatcattgtccttatatttcttggagccacctcattacgggactacataaggcatttgcgtgaacttggtggacatgatgctgagagggatgatggaggtcgtgaaaggcatggtgctcgggctgtcaggaggctagctggtcctaataatagggttcctgcagatggaaatattgatgaattagcagaagcccaaggaatcggtgctggtgaacttttgaggagaaatgcggaaaatgttgctgctcgattagaacgacttgaggctcaggtggagcagatgcttgatggtctggatgatgctgatggagcagaggacgttccttttgatgaacttgttggtatgcaaggccctgtcttccacttggttgagaatgcaataacagttttggccagcaatgctatattcctcattgttgtgatctttgttccattctcattgggaaggattgttctgtactacctatcatggtttttctcttcggcttctactcctatgctggcaaaaatgatgcccttcacagaaacagctatttctatagctaatgatacattaaagagcgcacttaatgttgtgaagaatttttcttctgacagtaataatgaaggtgttatcgggcatgtgattgaggttgtaactcaatccttgaagataaatgccactggtctgagtgtaattcaagtcactgggaagagcagtctgatgaaaggaacagcaattggctcatcttatctttcggatctgacaactcttgctgttggatacatgttcatcttctgtcttgtacttttgtacatcggatcactggctttacttcgatatgccaggggagaacgtttcaccatcggaagactctatggtatagctactatattagaggcaatcccttctctgtgcaggcagttctttgctggaatgaagcatattatgactatggtcaaagttgcattccttctggtcattgagcttggtgtatttcctctaatgtgtggttggtggcttgatgtttgcactctaaagatgctgggcacaacaattgcgcagaggattgaattctttacagtgtcacccttagcgagctcatctatccattggctagttgggattgtgtatatgctccaaataagcatatttgtcagccttcttcgaggggttctgcgcaatggagttctttattttctgcgggaccctgctgatccaaattacaatccatttagggatttgattgacgatcctgtgcataagcatgcccgacgagttcttttgtcagttgcagtgtatggaagtttgattgtgatgttggtcttcttacctgtaaaactggccatgagagtagctccttcaatttttcctctggacatcaccatatttgatccatttactgagattccagttgatgtccttctgttccaaatatgcatcccatttgctattgagcatttcaagcctcgtgcaaccattaaatctcttctgcatcattggtttgctgtggttggttggggccttggcttaaccgatttcttgctgccaaaacctgaagaaaacggtgggcaggaaaactggaatggcagggcagaaaggagagacaggggacatggtgggcaggaaatggttgccccacaggttgaacaacttatgatacaacatgttgccgcagaacataatgacaggggaaatgcaaatgaagccaatgatgtcactgaagaatctgatgtagatgatcagggagactctgagtatggctttgtgcttcgcatcgtgctcctgcttgtactggcatggatgacactactaatattcaatgctggaatgatagttattcctatctcgcttggccgtcttgtttttgagggtgttccgcgcctgccaatcacacatggcattaagtgcaatgatctgttctcctttagcattgggtgctatattctctggagtgttgcagctgggaccagatatgccattgattacatcagatcacgacagctgggatttctggttcaacagatctgcaagtggtgctcaattgttttgaagagctcttttctcttgtcaatatggatctttgttattcctgtgctgattggacttctttttgagctgctggtcattgtacccatgagggtgcctattgatgagagccctgtcttcttattgtaccaggattgggcactggggttaatattcttgaaaatatggactagactggttatgttggatcagatggcacctttggttgatgaaagctggaggtcaaagtttgagagagttagagacgatggcttctcccgtttaaggggtctgtgggtcctccatgaaattataatgccgattctcaccaaactccttaccgctctctgtgtcccatacgtccttgcaaggggcatcttcccggtgctgggttacccactcatcgtgaactcagcagtgtatcgctttgcctggcttggatgcctgatcttcagcgcactcttcttttgtggaaagaggttccatgtctggttcaccaacctccacaactccatcagggatgaccgctatctgattggccgaaggctgcacaactttggtgaggacacacccgagccgagtgaatctggagcaactatagggtcagatgaccaggaccaagctcttgtcctgcgagatcaggaagaggaagtggggttgaggatgaggcgcaataatatgcgtgcaaaccaacaacccaggctggctttttaagaaggagatagttttggatatagagctcataaccatggtataagctttggcctgcagcttctgcttgtgctttgtaatgggcgttgtagagggggtttatgtggttgcgataggaaagagtctaaggactgttctacgacaagtctgggagaaagctaaagtggttagtgattataagaactggtggcaactccctttcctgtggtagtcttggctgactgtaaatatcgtttgacagacactaccaggccaactcagtttgttgtttcttgtaatgactaatgaattaagttgaactgttgggtagata

SEQ ID NO: 2477 - DNA, 4206 bp, Setaria italica
atggtggcgtggccgatgatgcggccagccgagatcggattcggcgactggtgtagacgtgagccccgcgggtggccaagacctcgcagtgggcggccagctttgagtggtgaccagggagcggcggcggccttggggagcgatccgctcattgggagagagggagaaggaaggggtaaaaggcagtatgtatctaggcccaagcccaatgcgacacgacaaatcgagccctccagagaagtccggatcttcttcctcctctcgaaagaaaaaaaagggtccggactttttacccgacccacacccacggacccaccacagctgtcccatcgagaccccgcgtcattaacgaggctccgaaaatctccacgttttttccctcatcttttcgctgcaacttccccccaccgccttcgccccctatccgcgtcccccgcgcgatcgatcggccgccgccgccgccccagcgagccagccatggcggagatcgccgagcgggccgtcccgggggagctgccggaggagccgcggccgccgcccggggaggaggaggacgaggaggaggaggagggggacgtgtgccggatctgccgcaaccgcggcgacgaggaccacccgctccggtacccgtgcgcctgcagcggcagcatcaagttcgtgcaccaggactgcctcctccagtggctcgaccatagcaactcgcgccagtgcgaggtttgtaaacatgcattctccttctcacccgtgtacgctgataatgctccgacaagacttcctttccaagaattgatagttggcgttggaatgaaagcatgccatgtgtttcaattcatccttcggcttgcctttgttctctcagtttggctcatgattatcccattcattacttactggatatggaggttaacatttgtgagaagtcttggtgaagcacaaaggctgttcctgagtcacatcagtgctcagttgatccttagtgactgccttcacgggttccttctctcagctatcattgtccttatatttcttggagccacctcattacgggactacataaggcatttgcgtgagcttggtggacacgatgcggagagggatgatggaggccgtgaaaggcatggtgctcgggctgtcaggaggctagcgggtcctaataatagggttcctgcagatggaaatattgatgaattagcagaagcccaaggaattggtgctggtgaacttctgaggagaaatgctgaaaatgttgctgctcgactggaacgacttgaggctcaggttgagcagatgcttgatggtctggatgatgcagatggtgcggaggatgttccttttgacgaacttgttggtatgcaaggacctgtcttccacttggttgagaacgcaataacagttttagccagcaatgctatattcctcattgttgtgatctttgttccgttctcattgggaagaattgtcctgtactatttatcatggtttttctcttcggcctctactcctatgctggcaaaaatgatgcccttcacagaaacagctatttctatagctaatgatacattgaagagtgcacttaatgttgtgaagaatttttcttccgacactaacaatgaaggtgttattgggcatgtgattgaggttgttactcaatccttgaagataaatgccactggtcttagtgtaattcaagggagtgggaggggcagtctgataaaaggaacagctatcggctcgtcttatctttccgatttgacaactcttgctgttggatacatgttcatcttctgccttgtattcttgtacatcggatcactggctttacttcgatatgccaggggagaacgttttaccattggaagactctacggtatagctactatattagaggccattccatctctatgcaggcagttctttgctggaatgaagcatctcatgactatggtcaaagttgcattccttctggtgattgagcttggtgtattccctcttatgtgtggttggtggcttgatgtctgcactctaaagatgctcggcacaacaattgctcagagagttgaattctttacaatgtcacccttggcgagctcttctatccattggctagttgggatcgtgtatatgctccaaataagcatatttgtcagtcttcttcgaggggtactgcgcaatggagttctttattttctgcgggaccctgctgatccaaattacaatccattcagggacttgatcgacgatcctgtgcataaacatgctcgacgggttcttttgtctgttgcagtgtatggaagcttgattgtgatgttggtcttcttacccgttaaactggccatgcgagtagctccttcaatttttcctctggacatcacgatatttgacccattcactgagattccagttgatgtccttctgttccaaatatgcatcccatttgcaattgagcatttcaagcctcgtgcaactattaaatctcttttgcaccactggtttgctgcggttggttgggcccttggattaactgatttcctactgccaaaacctgaagaaaatggtgcgcaggaaaattggaatggcagggcagaaagaagagataggggccatgttgggcgggaattggttgctccacaggttgaacaacgcatgatacaacatgttgctgcagaagataatggcaggggaaatccaaatgaagccaatgatgttgctgaagaacctgatgtagatgatcagggagactcagagtatggttttgtgcttcggattgtgctcttgcttgtactggcatggatgacactactgatattcaatgctggaatgatagttattcctatctcacttggacgtcttgtttttgaggctgttccccgcctgccaatcacacacggcatcaagtgcaatgatctcttctcctttagcattgggtgctatattctctggagtgcagcagctggaaccagatatgcaattgattatatcagatcgcggcagctaggaatcctggtacaacagatctgcaagtggtgttctattgttttgaagagctctgttctgttgtcaatatggatctttgttattcctgttttgattggactcctttttgagctactggtcattgttccgatgagggtgcctatcgatgagagccctgtcttcctattataccaggattgggcgcttgggttaatattcttgaagatatggactcggctggttatgttggatcaaatggcacctttggttgatgagagctggaggtcaaagtttgagagagttagagatgatggattctcccgtttaaggggtttgtgggtcctccatgaaattataatgccgatagtcaccaagctccttactgctctctgtgtcccatacgtccttgcaaggggagtcttcccggtgctgggctacccactcatcgtgaactcggcagtgtaccgctttgcctggctaggctgcctgatcttcagcgcgctcttcttctgcggcaagagattccatgtgtggttcaccaacctccacaacaccatcagggatgaccgctatctgattggccggaggctgcacaattttggtgaggacacacctgagccaagcgaatccggagcaactatagggtcagatgaccaggacagggccctagtcctgcaagatcatgaagaggaaatgggattgaggctgaggcgcaataacatgcgtgcaaaccaacagcccaggctagcagcataaggaaggagttttcaatggagagtgcataaccgtggtataaaccttcagcctgcagcttgtgcttgcggtttgtcattgggttgtagaggggagtctgtgtgttagtgatagggatgagtttaagtactgttgtacaacaaaagcctgggagaaagctaaaatgatcggacagtaatacggaaggtaactccctttcctgtggtagtcttggctgactgtaaatatcgtttgacagagcactaccaggccaacgcagttttatgtgatcctgttgtaatggctaatgaatcaagtgaaaacaatctgttgggtagatacaagatagattataatagcactatcaccccctttttattgggattgtgtgccatatatttttttatttttttagcaatgtaatatcgcattctgtgaagcggtggtgccatataatgctataagccttggatggaatgttatcactgctattgtttgttt

SEQ ID NO: 2478 - DNA, 6155 bp, Oryza sativa
ccgcgacccgctaaggccgaccgcctcccccgcggggggccccacccatcagggactcctcctcgtcaccaacgcgttattaacgaggcgctaatccatccttctctccccctctttccccaccgcctcctccgccccaacgcggtctccctcccccccccctcccccgcgcgatcgctcgcacgcacggccgccgccgccgccgcgcccagccatggcggacgtcgccgcggaccggcctcccgcggccgagcaggaggaggcgcggccgccctcatccaccgcggcggtggcggaggaggacgaggaggaggaggaaggggacgtgtgccggatctgccggaacccgggggacgacgagcacccgctccggtacccgtgcgcctgcagcggcagcatcaagttcgtgcaccaggactgcctcctccagtggctcgaccacagcaactcccgccagtgcgaggtttgcaaacatgcattctctttctcgcccgtctatgctgacaatgctccgtcaagactccccttccaagaacttattgttggtgttgggatgaaagcgtgccatgtgcttcagtttgtcctccggcttgcctttgttctttcagtttggctcatgattatccccttcatcacttactggatatggaggttaacattcgtgagaagtcttggtgaagcacagaggctattcttgagtcatatcagcgctcagttgatcctaagtgactgtttacatggttttcttctctcagctattattgtccttatatttcttggagctacctctttaagggactatataagacacttgcgggaacttggagggcatgatgctgagagggatgatgggggccgtgaaaggcatggtgcacgagctgtcagaaggctacctggtcctaataacagggttcctgctgcagatggaaacgttgacgaattagcagaagcccaaggacttggtgctggtgaacttttgagaagaaatgcagaaaatgttgctgctcgattagaacgacttgaagctcaagtcgagcagatgctagatggtttggatgatgcagatggtgcagaggatgttccttttgatgaacttgtaggcatgcaaggccctgttttccacttggttgagaacgcaataacagttctggccagcaatgctatattcctcattgttgtgatcttcgtaccattctcattgggaaggattgtcctgtactatctatcatggttcttctcttcagcctctagtcctatgctggcaagaatgatgccgtttacggaaactgctatttcattggctaatgatacattgaagagtgcacttaatgccgtgaagaacttatctgctgacagccataatgaaggtgtcattggtcatgtcattgaggtggttactcaatcattgaagataaatgccactggtcttactgtaatgcaggcctctgggaagagtagtctgataaaaggaactgctattggctcatcctatctttctgatctgacaactcttgctgtgggatatatgtttatcttttgccttgtgtttttgtacattggatcattggctttactgcggtatgctaggggagaacgtttcaccattgggaggctctacggtatagctaccattttagaggctatcccatctctatgcaggcaattctttgctggaatgaagcatctcatgactatggtcaaagttgcattccttttggtgattgaacttggtgtatttccccttatgtgcggttggtggcttgatgtatgcaccttaaagatgctgggtgcaacaattgctcaaagagttgaattcttcacgatgtcacccttggcaagctcctctatccattggcttgttgggattatatatatgcttcaaataagcatatttgtcagccttcttcgaggggtactgcgcaatggtgttctttatttcttgcgggaccctgccgatccaaattacaatccgtttagggatttgattgatgatcctgtgcataaacatgcccggcgagttcttctgtctgttgctgtgtatggaagcttgattgtgatacttgttttcttacctgtcaaactggccatgcgagtagctccatcgatttttcctctggacatcaccatttttgacccatttacagagatcccagttgatgtgcttctgttccaaatatgcatcccgtttgcaattgagcacttcaagcctcgtgcaacaattaaagcacttctgcgtcattggtttgctgctgttggttgggcattaggcttaactgatttcttactgccaagacatgaagaaaatggtgggcaagagaactggaatggcagagcaggtagagatagggtacatggtggccgggaaatggttgccccacagctggagcagcgtatgatacaacatgttgctgataatctgaatggcaggggtaatgccaatgacagtaacgaggtcgctgaagaatctgatgttgatgaccagggagattcagagtatggtttcgtccttcggattgtgctcttgcttgtactggcatggatgactctgctgatattcaatgctggaatgattgttattccaatctcacttggtcgtttagtttttgaggctattccccgcctgccaatcacacatggcatcaagtgcaatgatttattctctttcagcattggatgttatattatctggagtgcagcagctggaaccagatatgcaattgattacattcgatcacgacgactggccttcctagtgcaacaaatctgcaagtggtgctctattgttgtgaagagttctgctctcctgtcaatatggatctttgttattcctgtgttgattggactcctgtttgagttactggtcattgtacccatgagggtgcctattgacgagagtccggttttcctgttgtatcaggattgggctcttggattaatattcttaaaaatatggactaggctggttatgttggatcaaatggcacctttggttgatgaaagctggaggacgaagtttgagagggttagagaggatggcttctcccgtttgagaggtctatgggtcctgcatgaaatcataatgcctattgtcaccaagctccttacagctctctgcgttccatatgttcttgcaaggggtgtcttcccagtgcttggttacccactcattgtgaactcagcggtctaccgtttcgcgtggcttggctgcctgatattcagcgcgctgttcttctgtggcaagagattccatgtttggttcaccaatctccacaattccattagggatgaccgttatctgattgggcggaggctgcacaactttggtgaggactcactccattcaagtgaacctggaacaactacagcgtctgacgatgatgaacacgagcaagcactcattcctcgcgatcaggaaggagagttggggctgaggttcaggcgccatatcatgcgtggaaaccaaccgagaatggctgcataagcagggacgagtttttggacaaagcaaggggcatatgcacgatctgacttctgccctggagcttctgcttgtgattagtaatccgcattgtagagtgaaatgagtccgtcagttagtgataggaaaagtaaggattgttgtacaacaaagtccaagggaagaacagctcaaaaaaaaaagaatacacaccagaaaactcatggtaagctcacttccctgtggctatgtgttgctgactgtaaatatagacgaactaccccacacaatttattgtggttctgatgtgtaatggacaatgaattactcctacagtagtacatcaagttggatagtagctagggttggtagacgatgttgtccacacttcatttcttttcatttcttgtgaactttttgtacctgttggtgttggatctttttttttttaccgcgtctctgctgacaaggaaggcacacagcagcggggaggggcaacttgtcggttgacttactcggtcggtacgtgcaaggaaacttcgcctgcatttgttcacatcgagatcgccaaggaacatataaaataaatgcttgctgtgtctttgtattttgatttcgccttaacgagggtcccgggatttgtttcacccgctacggtaccgcgggcgggattgaagacctgcctagatctttatagcagcagacacggaatgcctatatatgtgcagcacatgggatttcacaacccaaagacgggaaacctcttggcaattgaatggcacgtttgcagttgaggatgcacgcggctgaagatgagcacagcggagacttaacgcaatccctttagcaaagcattttttctgcgaatatgaatctattctttcagttcatcttataaatagacttgcctaactttgttatatgaatcacaagtgtcttggcatatccagattctagagtggttctcaaaaaaagcaaaattgtttaagttcgaacagggcaggctccaagcctacaatacgaacactactagcctagaggctctagcagagtcgtctcggttcatcgtcaactcagctcctctctttcttcccctcccccgctcctccgcgagacgacccgcgcccgtagccatccatgtcgatacaaggccagatcctcgaagtcagagtcactgggtgcaggaagctgagggacacggagttcttcacgcggcaggatccctacgtctgcatcgagtatgccaccaacaagttccgcacccgcacctgcaccgatgggggaaggaaccctacttttgacgagaagtttcatatacctctcattgaggggcttcgtgagctaaccgtcacagtgtggaacagcaacacgctcacccatgatgatttcattggcaatggcaggtttgtggacctcaattacgcccatttggtgattactgttcttaaataactgtccactgagcctttttgtagggtgcagctgcataaggtgcttacgcgtggctatgatgatgcctcatggcccctccagacacgccatatgaggtagtcgtatttcttttaccttgtgctcattgcacttgtgaacttcctgatagtagtgtatcttcaggtctgctggggaagtgacgctcattatgcattttgatgtttcagcaatgaagaacaagccgggaaaaatttctgccgcgtcaaccacacattctgttcttccagtgccggtaccagcagtaccatatgctgccccctcaccttcatacgcactaccccctgcaggataccctgcagtaccgccatatcaatcctatcctgctagccatgtcccggcgccatatcctacttcagcatacccacatccaccaccatctctgctagctcgcgatgttgagcatgcggcataccctcctacaagtacaacatatcctccacagccgtacccaccacagccgcagggacaaacatacccaccgcagccgcagggagaaacataccaaccgcagccgcagcgagaaacatacccaccgcagcctcaagtacaaccatacccaccaaagccacagggacaaccatacccaccgcagccgcagggacaaccatatccaccgcaaccatatggacaaacttacccaccacctccaaaaggacagcccacatatccacctgcgccctatccttcaacttatccaccagcaccatattgatatggcacacttggtggactgaagttgtccacatacaaaagcaagtaagcaacaagtgatgatcagttcttatatttatccagggtatccagccttcatcatccagttaattgaaacaaatgaaatcattcctgaagcgattcatgtcaacatcttagcaaccaatggtagtagttaccatctggtatgtatcatatatcatagcttgcagaatgtcacgaatggaatttgttcgattatgttgtatgttttgggcttgttgtaacagtgatccacctttgttctgttttgaggtcatgtttggctgttctgtgactgtaactactgctttttacaaaggggggaagcagtaattctagttctacctgcaactgcctgataagtgttaactgtgaaaagttgcagtagcttgtcgactttgtaccatgttgtttgagatgctcaataaatttgctttgtactcttgatgtgtggtgaatttaaatatgatcggtt

SEQ ID NO: 2479 - DNA, 4270 bp, Oryza sativa
ccccctctttccccaccgcctcctccgccccaacgcggtctccctcccccccccctcccccgcgcgatcgctcgcacgcacggccgccgccgccgccgcgcccagccatggcggacgtcgccgcggaccggcctcccgcggccgagcaggaggaggcgcggccgccctcatccaccgcggcggtggcggaggaggacgaggaggaggaggaaggggacgtgtgccggatctgccggaacccgggggacgacgagcacccgctccggtacccgtgcgcctgcagcggcagcatcaagttcgtgcaccaggactgcctcctccagtggctcgaccacagcaactcccgccagtgcgaggtttgcaaacatgcattctctttctcgcccgtctatgctgacaatgctccgtcaagactccccttccaagaacttattgttggtgttgggatgaaagcgtgccatgtgcttcagtttgtcctccggcttgcctttgttctttcagtttggctcatgattatccccttcatcacttactggatatggaggttaacattcgtgagaagtcttggtgaagcacagaggctattcttgagtcatatcagcgctcagttgatcctaagtgactgtttacatggttttcttctctcagctattattgtccttatatttcttggagctacctctttaagggactatataagacacttgcgggaacttggagggcatgatgctgagagggatgatgggggccgtgaaaggcatggtgcacgagctgtcagaaggctacctggtcctaataacagggttcctgctgcagatggaaacgttgacgaattagcagaagcccaaggacttggtgctggtgaacttttgagaagaaatgcagaaaatgttgctgctcgattagaacgacttgaagctcaagtcgagcagatgctagatggtttggatgatgcagatggtgcagaggatgttccttttgatgaacttgtaggcatgcaaggccctgttttccacttggttgagaacgcaataacagttctggccagcaatgctatattcctcattgttgtgatcttcgtaccattctcattgggaaggattgtcctgtactatctatcatggttcttctcttcagcctctagtcctatgctggcaagaatgatgccgtttacggaaactgctatttcattggctaatgatacattgaagagtgcacttaatgccgtgaagaacttatctgctgacagccataatgaaggtgtcattggtcatgtcattgaggtggttactcaatcattgaagataaatgccactggtcttactgtaatgcaggcctctgggaagagtagtctgataaaaggaactgctattggctcatcctatctttctgatctgacaactcttgctgtgggatatatgtttatcttttgccttgtgtttttgtacattggatcattggctttactgcggtatgctaggggagaacgtttcaccattgggaggctctacggtatagctaccattttagaggctatcccatctctatgcaggcaattctttgctggaatgaagcatctcatgactatggtcaaagttgcattccttttggtgattgaacttggtgtatttccccttatgtgcggttggtggcttgatgtatgcaccttaaagatgctgggtgcaacaattgctcaaagagttgaattcttcacgatgtcacccttggcaagctcctctatccattggcttgttgggattatatatatgcttcaaataagcatatttgtcagccttcttcgaggggtactgcgcaatggtgttctttatttcttgcgggaccctgccgatccaaattacaatccgtttagggatttgattgatgatcctgtgcataaacatgcccggcgagttcttctgtctgttgctgtgtatggaagcttgattgtgatacttgttttcttacctgtcaaactggccatgcgagtagctccatcgatttttcctctggacatcaccatttttgacccatttacagagatcccagttgatgtgcttctgttccaaatatgcatcccgtttgcaattgagcacttcaagcctcgtgcaacaattaaagcacttctgcgtcattggtttgctgctgttggttgggcattaggcttaactgatttcttactgccaagacatgaagaaaatggtgggcaagagaactggaatggcagagcaggtagagatagggtacatggtggccgggaaatggttgccccacagctggagcagcgtatgatacaacatgttgctgataatctgaatggcaggggtaatgccaatgacagtaacgaggtcgctgaagaatctgatgttgatgaccagggagattcagagtatggtttcgtccttcggattgtgctcttgcttgtactggcatggatgactctgctgatattcaatgctggaatgattgttattccaatctcacttggtcgtttagtttttgaggctattccccgcctgccaatcacacatggcatcaagtgcaatgatttattctctttcagcattggatgttatattatctggagtgcagcagctggaaccagatatgcaattgattacattcgatcacgacgactggccttcctagtgcaacaaatctgcaagtggtgctctattgttgtgaagagttctgctctcctgtcaatatggatctttgttattcctgtgttgattggactcctgtttgagttactggtcattgtacccatgagggtgcctattgacgagagtccggttttcctgttgtatcaggattgggctcttggattaatattcttaaaaatatggactaggctggttatgttggatcaaatggcacctttggttgatgaaagctggaggacgaagtttgagagggttagagaggatggcttctcccgtttgagaggtctatgggtcctgcatgaaatcataatgcctattgtcaccaagctccttacagctctctgcgttccatatgttcttgcaaggggtgtcttcccagtgcttggttacccactcattgtgaactcagcggtctaccgtttcgcgtggcttggctgcctgatattcagcgcgctgttcttctgtggcaagagattccatgtttggttcaccaatctccacaattccattagggatgaccgttatctgattgggcggaggctgcacaactttggtgaggactcactccattcaagtgaacctggaacaactacagcgtctgacgatgatgaacacgagcaagcactcattcctcgcgatcaggaaggagagttggggctgaggttcaggcgccatatcatgcgtggaaaccaaccgagaatggctgcataagcagggacgagtttttggacaaagcaaggggcatatgcacgatctgacttctgccctggagcttctgcttgtgattagtaatccgcattgtagagtgaaatgagtccgtcagttagtgataggaaaagtaaggattgttgtacaacaaagtccaagggaagaacagctcaaaaaaaaaagaatacacaccagaaaactcatggtaagctcacttccctgtggctatgtgttgctgactgtaaatatagacgaactaccccacacaatttattgtggttctgatgtgtaatggacaatgaattactcctacagtagtacatcaagttggatagtagctagggttggtagacgatgttgtccacacttcatttcttttcatttcttgtgaactttttgtacctgttggtgttggatcttttttttttaccgcgtctctgctgacaaggaaggcacacagcagcggggaggggcaacttgtcggttgacttactcggtcggtacgtgcaaggaaacttcgcctgcatttgttcacatcgagatcgccaaggaacatataaaataaatgcttgctgtgtctttgtatttgatttcaccaaacgaggtcccgggatttgtttcacccgctacggtaccgcgggcgggattgaagacctgcctagatctttatagcagcagacacggaatgcctatatatttgcaccacatgggatttcacaacccaaagacgggaaacctcttggcaattgaatggcacgtttgcagttgaggatgcacgcggctgaagatgagcacagcggagacttaacgcaatccctttagcaaagcattttttctgcgaatatgaatctattctttcagttcatcttataaataaacttccctaactttgttatatg

SEQ ID NO: 2480 - DNA, 3693 bp, Brachypodium distachyon
atggcggagatcgtggacccggccgtcgccgccgccgccgccgcgggcgggccggtggttgcggaggaggaggaggagccgcgtctgccgcccgcccccgccgggggagaggaggacgacgacgacgaggaggaaggggacgtgtgccggatctgccgcaaccgcggcgacgacgagcacccgctccgctacccgtgcgcctgcagcggcagcatcaagttcgtgcaccaggactgcctcctccagtggctcgaccacagcaactcgcgccagtgcgaggtctgtaaacatgcgttctctttctcgcctgtatatgctcagaatgctccaacgagacttcctttccaagagcttgtgtttggcgttggaatgaaagcatgccatgtgtttcagtttgtcctccgccttgcctttgttctttcagtttggctcatgattatccccttcattacctattggatctggaggttaacatttgtgagaagttttggtgaagcacaaaggctgttcttgagtcacatcagcgctcagttgatccttagtgattgcctacatggttttcttctctcggctattattgtccttatatttcttggagctacctctttaagggactatataaggcacttgagggaacttggaggacatgaagctgatagggatgacgcaggccgtgaaaggcatggtgctcgagctgtcagaaggctagctggtcctaataatagggttcctgctgcagatggaaacatggacgaattggcagaggcccaaggacttggtgctggtgaacttctgaggagaaatgcagaaaacgttgctgctcgattggaacgacttgaagctcaagttgagcagatgctagatggtttggatgatgccgatggtgcagaggatgttccttttgatgaactcgtaggcatgcaaggtccagtattccacttggttgagaacgcgataacagttttggccagcaatgctatattcctcattgtcgtgatctttgtaccattctcgttgggaaggattgtcctgtactatttatcatggttcttctcttcagcatctagccccatgctcgctaaaatgatgcccttcacagaatctgctatttccttggctaatgatacattaaataatgcatttaatgccatgaagaatttctcttccgacagtcataatgaaggtgtcattggacatgtgattgaggtggttactcaatccttgaagataaatgccactggtcttgctgtaatgcagggggctgcgaagaacagtgtgatgaaaggaactgctatgggctcatcttacctttctgatctgacaactcttgctgttggatacatgttcatcttctgccttgtgtttttgtacatcggatcattggctttacttcgatacgcccgcggagaacgttttaccattggaagactctatggtattgctgcaatactagaggccattccatctctatgcaggcagttcttttctggaatgaagcatctcatgactatggtcaaagttgcattccttctggtgattgaacttggtgtattcccccttatgtgtggttggtggcttgatgtctgcactctgaagatgttgggcacaacaattgctcaaagagttgaattctttacaatgtcaccctttgcgagctcctctatccattggcttgttgggattgtgtatatgctccaaataagcatatttgtcagtcttcttcgaggggtgctgcggaacggagtcctttatttcttacgggaccctgctgatccaaattacaatccgtttagagacttgattgatgatcctgtacacaaacatgctcgacgagttcttttatctgttgctgtgtatggaagcctgattgtgatgctggtcttcttacctgtcaaactggccatgcgagttgctccttcaactttccctctggacatcaccatttttgacccatttactgagattccagtcgacgtgcttctgttccaaatatgcatcccgtttgcgattgaacatttcaagcctcgtgcaacaattaaagctctgttgcatcattggtttgctgtgattggctgggcactaggcttaactgatttcttgctgccaaaaccagaagaaaatggtgggcaagagaactggaatgtcagggcagaaagaagagataggttacatggtgggagggaagcagtagcactacagcttgagcagcgtatgatacagcatgctgcattagataatgatggcaggggtaatgcaaacgaagctaatgatgttgctgaagaatctgaagcagatgatcaaggagattcagagtacggcttcgctctccggattgtactcttgcttgtactggcatggatgacactattaatattcaatgctggaatgattgttattcctatctcacttggccgtctggtttttgaggctgttccccgcctgccaatcacacatggcattaagtgtaatgatctgttctcttttagcatcggttgttatatcatctggagtgcagcagcgggaaccagatatgcaattgactacattagatcgcgacgtctggccttcctggtacaacaaatttgcaagtggtgctctattgttttgaagagttctgctctcctatcaatatggatctttgttattcctgtgttgattggactcctttttgagctactggtgattgtacccatgagagtgcctattgacgagagcccagtgtttctattgtatcaggattgggctctcggattaatattcttgaaaatatggactagactggttatgctggatcaaatggcacctttagtagatgaaagctggagaatgaagtttgagagagtaagagaggatggcttctcccgtttgaaaggtctatgggtcctgcatgaaatcataacgccgatcgtcaccaagctcctcactgcactgtgtgttccatatgtccttgcaaggggtgttttcccggtgctgggctacccattgattgtgaactcggcagtctaccgtttcgcctggcttggctgcctgatattcagcacactgttcttctgtggcaagcggttccatgtttggttcaccaacctccacaattccatcagggacgaccgctatctgattggccgcaggctgcacaactttggtgaggactcgctccgattgaacgaatctgatgaaactccagggccaggaggtgaggaccaggctctgattcctgtagatgacgatgatgtggggctgaggttcaggcgtatcaaccggaatgcgcatgaacatccgaggatggttcttgagtagcagaaggcatcatcatcatcttggcctacagttagtctcttgtggtttgtgcaaccggcattgtagagtgattagttgttcttctagtgttagggtaggcaagtattgttgtacaacaaagtattgggaataagctagaaagattcaagccgatagctctgatggtaaactccctttcctgtgtactggtagtcgttgctgaatgtatatatattgactgaagaacactcccaagccgacataaaatttgatgtttttttgctgatcaacggctaatgggtagcccatacatacaattcaatgtaattctgaatatatcacgcgatgtctagtggtagccaacaaaatttgacatgattctggtgcaatggatgatgaatcagttatacttcactg

SEQ ID NO: 2481 - DNA, 3779 bp, Brachypodium distachyon
aggcgagcgaaaaatctccgcctcttcgcccccctttctgcctccgcctcccccgcgcgatcgatcgccctcaccgcaccccagccatggcggagatcgtggacccggccgtcgccgccgccgccgccgcgggcgggccggtggttgcggaggaggaggaggagccgcgtctgccgcccgcccccgccgggggagaggaggacgacgacgacgaggaggaaggggacgtgtgccggatctgccgcaaccgcggcgacgacgagcacccgctccgctacccgtgcgcctgcagcggcagcatcaagttcgtgcaccaggactgcctcctccagtggctcgaccacagcaactcgcgccagtgcgaggtctgtaaacatgcgttctctttctcgcctgtatatgctcagaatgctccaacgagacttcctttccaagagcttgtgtttggcgttggaatgaaagcatgccatgtgtttcagtttgtcctccgccttgcctttgttctttcagtttggctcatgattatccccttcattacctattggatctggaggttaacatttgtgagaagttttggtgaagcacaaaggctgttcttgagtcacatcagcgctcagttgatccttagtgattgcctacatggttttcttctctcggctattattgtccttatatttcttggagctacctctttaagggactatataaggcacttgagggaacttggaggacatgaagctgatagggatgacgcaggccgtgaaaggcatggtgctcgagctgtcagaaggctagctggtcctaataatagggttcctgctgcagatggaaacatggacgaattggcagaggcccaaggacttggtgctggtgaacttctgaggagaaatgcagaaaacgttgctgctcgattggaacgacttgaagctcaagttgagcagatgctagatggtttggatgatgccgatggtgcagaggatgttccttttgatgaactcgtaggcatgcaaggtccagtattccacttggttgagaacgcgataacagttttggccagcaatgctatattcctcattgtcgtgatctttgtaccattctcgttgggaaggattgtcctgtactatttatcatggttcttctcttcagcatctagccccatgctcgctaaaatgatgcccttcacagaatctgctatttccttggctaatgatacattaaataatgcatttaatgccatgaagaatttctcttccgacagtcataatgaaggtgtcattggacatgtgattgaggtggttactcaatccttgaagataaatgccactggtcttgctgtaatgcagggggctgcgaagaacagtgtgatgaaaggaactgctatgggctcatcttacctttctgatctgacaactcttgctgttggatacatgttcatcttctgccttgtgtttttgtacatcggatcattggctttacttcgatacgcccgcggagaacgttttaccattggaagactctatggtattgctgcaatactagaggccattccatctctatgcaggcagttcttttctggaatgaagcatctcatgactatggtcaaagttgcattccttctggtgattgaacttggtgtattcccccttatgtgtggttggtggcttgatgtctgcactctgaagatgttgggcacaacaattgctcaaagagttgaattctttacaatgtcaccctttgcgagctcctctatccattggcttgttgggattgtgtatatgctccaaataagcatatttgtcagtcttcttcgaggggtgctgcggaacggagtcctttatttcttacgggaccctgctgatccaaattacaatccgtttagagacttgattgatgatcctgtacacaaacatgctcgacgagttcttttatctgttgctgtgtatggaagcctgattgtgatgctggtcttcttacctgtcaaactggccatgcgagttgctccttcaactttccctctggacatcaccatttttgacccatttactgagattccagtcgacgtgcttctgttccaaatatgcatcccgtttgcgattgaacatttcaagcctcgtgcaacaattaaagctctgttgcatcattggtttgctgtgattggctgggcactaggcttaactgatttcttgctgccaaaaccagaagaaaatggtgggcaagagaactggaatgtcagggcagaaagaagagataggttacatggtgggagggaagcagtagcactacagcttgagcagcgtatgatacagcatgctgcattagataatgatggcaggggtaatgcaaacgaagctaatgatgttgctgaagaatctgaagcagatgatcaaggagattcagagtacggcttcgctctccggattgtactcttgcttgtactggcatggatgacactattaatattcaatgctggaatgattgttattcctatctcacttggccgtctggtttttgaggctgttccccgcctgccaatcacacatggcattaagtgtaatgatctgttctcttttagcatcggttgttatatcatctggagtgcagcagcgggaaccagatatgcaattgactacattagatcgcgacgtctggccttcctggtacaacaaatttgcaagtggtgctctattgttttgaagagttctgctctcctatcaatatggatctttgttattcctgtgttgattggactcctttttgagctactggtgattgtacccatgagagtgcctattgacgagagcccagtgtttctattgtatcaggattgggctctcggattaatattcttgaaaatatggactagactggttatgctggatcaaatggcacctttagtagatgaaagctggagaatgaagtttgagagagtaagagaggatggcttctcccgtttgaaaggtctatgggtcctgcatgaaatcataacgccgatcgtcaccaagctcctcactgcactgtgtgttccatatgtccttgcaaggggtgttttcccggtgctgggctacccattgattgtgaactcggcagtctaccgtttcgcctggcttggctgcctgatattcagcacactgttcttctgtggcaagcggttccatgtttggttcaccaacctccacaattccatcagggacgaccgctatctgattggccgcaggctgcacaactttggtgaggactcgctccgattgaacgaatctgatgaaactccagggccaggaggtgaggaccaggctctgattcctgtagatgacgatgatgtggggctgaggttcaggcgtatcaaccggaatgcgcatgaacatccgaggatggttcttgagtagcagaaggcatcatcatcatcttggcctacagttagtctcttgtggtttgtgcaaccggcattgtagagtgattagttgttcttctagtgttagggtaggcaagtattgttgtacaacaaagtattgggaataagctagaaagattcaagccgatagctctgatggtaaactccctttcctgtgtactggtagtcgttgctgaatgtatatatattgactgaagaacactcccaagccgacataaaatttgatgtttttttgctgatcaacggctaatgggtagcccatacatacaattcaatgtaattctgaatatatcacgcgatgtctagtggtagccaacaaaatttgacatgattctggtgcaatggatgatgaatcagttatacttcactg

SEQ ID NO: 2482 - DNA, 3441 bp, Secale cereale
acgacgacgaggacgacgaggagagggggacggtctgccggatctgccgcaaccgcggcgacgacgaccacccgctgcgctacccctgcgcctgcagcggcagcatcaagttcgtccaccaggactgcctcctccagtggctcgaccacagcaactcccgccagtgcgaggtctgtaagcacgcgttctctttctcgcctgtctatgctcagaatgctccaaccagacttcctttccaagaacttgtgtttggcgttgggatgaaagcatgccatgtgtttcagtttgtcctccggcttgcctttgttctttcagtctggctcatgattatcccattcattacctactggatatggcggttaacattcgtgagaagtcttggggaagcacaaaggctgttcttgagtcacatcagcgctcagttgattctcagtgattgcctacatgggtttcttctctcagctatcattgtccttatatttcttggagctacctctttaagggactatataaggcacttgcgggaacttggaggacatgaagctgacagggacgatgcaggccgtgaaaggcatggtgcccgagctgtcagaaggctagctggtcctaataacagggttcctggtgcagatggaaatattgatgatctggctgaggcccaaggacttggtgctggggaacttctgaggagaaatgctgaaaatgttgctgctcgattggaaagactagaagcccaagttgagcagatgttagatggtctggatgatgcggatggtgcagaggacgttccttttgatgaacttgtcggcatgcaaggcccagtatttcacttggttgagaatgcaattacagttttggccagcaatgctatattcctcattgttgtgatctttgtaccattctcattgggaaggattgtcctgtattatctatcatggtttttctcttcagcctccagtcctatgctggctagggtgatgccatttacggaatctgctatttctttggctaatgaaacgttgaatagtgcttttaatgccatgaagaatttctcttccgacagtcacaatgaaggtgttattgggcatgtgattgaggtggttactcagtccttgaagataaatgccactggtcttgctgtaatgcagggcactgggaagagcagtttggtgaaaggaacagctattggctcgtcttatctttcagatctgacaactcttgctgttggatacatgtttatcttttgccttgtgtttttgtacattggatcactggctttacttcgatacgcccgtggagaacgttttactattggaagactctatggcatcgctgcaatactagaggccattccatctctatgcaggcagttcttttctggaatgaagcatctcatgaccatggtcaaagttgctttccttttggtgatagaactcggagtatttccccttatgtgtggttggtggcttgatgtctgcactcttaagatgttgggtaccacaattgctcaaagagttgaattctttacgatgtcacccttggcgagctcctcgatccattggcttgttgggattgtatatatgctccaaataagcatatttgtcagccttcttcgaggggtactgcggaatggagttctgtacttcttacgggaccctgctgatccaaattacaatccttttagggacctgatcgatgatcctgtgcataaacatgctcgacgagtccttttatctgtcgctgtgtatgggagcttgattgtgatgctggtcttcttacctgtcaaactggccatgcgagtagctcctaaaacttttcctctggacattaccatctttgacccttttaccgagattccagttgatgtgcttctgttccaaatatgcatcccatttgcgattgagcatttcaagcctcgggcaactattaaagctctgctgcatcattggttcgctgtgattggctgggcactaggcttaacagatttcttactgccaaaacctgaagaaaatgctgctgggcaagagaactggaatggcagggcagaaagaagagatagagtaaacggtgggatggaaatggtagccccacagcttgagcagcgtatgattcaacatgctgccatagataatgatggtaggggtaatgcaaatgaagccaatgacattgctgaagaatctgatgtagatgatcaaggagattcagagtacagttttgcactccgtatcatactcttgcttgtactagcatggatgacgctactcatattcaatgctggaatgattgttattcctatctcacttggccgtctagtttttgaggctgttccccgcctgccaatcacacatggcatcaagtgcaatgatctgttctcttttagcatcggttgctatattatctggagtgcagcagctggaaccagatatgcagttgattacattagatcacgacgtctgggcttcctggtacaacagatctgcaagtggtgctctattgtcctgaagagttccgctctcctgtcaatatggatcttcgttatccccgtgctgattggactcctttttgagctgctggtgattgtacccatgagggtgcctattgacgagagcccagtttttctgctgtatcaggattgggcacttggattaatattcttgaaaatttggactagactggtgatgctggatcaaatggcacctttggttgatgaaagctggaggatgaagtttgagagagtaagagaggatggcttctcccgtttgaaaggtctatgggtcctgcacgaaatcataacccccatcatcacaaagctccttacagctctctgtgttccatacgtccttgcaaggggcgtgttcccggtgctgggctacccactgattgtgaactcggcagtctaccgtttcgcctggctcgggtgcctgatattcagcacgctcttcttctgcggcaagagattccacgtctggttcaccaacctccacaactccatcagggacgaccgctatctcattggccggaggctgcacaactttggcgaagactcccgtcggtcgaacgtggctgatgagaacccaggttcaggagacgaggaccttgcgctgatccctatagatcatcaggaggacgacgacgtcgggctgaggttcaggggcaacaaccggcatgcgcatgaagacgcgggggtggttgtcgtcggttaagctttagtgcatgagtatgaaaccggcatccgcatgtgaccggcattgtagagtgaaggagttgccctgtagtgtttagggtagtaggcaagcattgttgtacaacacatagtagcagcaaggggaataataagctagatagaaggatttcgcgcggaaaggaaagctgatggtcaagtgcctcttttttgggttgctttggtagtcgttgctgaatgtatatatttgacagatctcc

SEQ ID NO: 2483 - DNA, 3532 bp, Secale cereale
aaccgcggcgacgacgaccacccgctgcgctacccctgcgcctgcagcggcagcatcaagttcgtccaccaggactgcctcctccagtggctcgaccacagcaactcccgccagtgcgaggtctgtaagcacgcgttctctttctcgcctgtctatgctcagaatgctccaaccagacttcctttccaagaacttgtgttcggcgttgggatgaaagcatgccatgtgtttcagtttgtgctccggcttgcctttgttctttcagtctggctcatgattatcccattcattacctactggatatggcggttaacatttgtgagaagtcttggggaagcacaaaggctgttcttgagtcacatcagtgctcagttgattctcagtgattgcctacatgggtttcttctctcagctatcattgtccttatatttcttggagctacctctttaagggactatataaggcacttgcgggaacttggaggacatgaagctgacagggacgatgcaggccgtgaaaggcatggtgcccgagctgtcagaaggctagctggtcctaataacagggttcctggtgcagatggagttattgatgacttggctgaggcccaaggacttggtgctggggaacttctgaggagaaatgctgaaaatgttgctgctcgattggaaagactagaagcccaagttgagcagatgttagatggtctggatgatgcggatggtgcagaggacgttccttttgatgaacttgtcggcatgcaaggcccagtatttcacttggttgagaatgcaattacagttttggccagcaatgctatattcctcattgttgtgatctttgtaccattctcattgggaaggattgtcctgtattatctgtcatggtttttctcttcagcctccagtcctatgctggctagagtgatgccatttacggaatctgctatttctttggctaatgaaacattgaatagtgcttttaatgccatgaagaatttctcttccgacagtcacaatgaaggtgttattgggcatgtgattgaggtggttactcagtccttgaagataaatgccactggtcttgctgtaatgcagggcactgggaagagcagtttggtgaaaggaacagctattggctcgtcttatctttcagatctgacaactcttgctgttggatacatgtttatcttttgccttgtgtttttgtacattggatcactggctttacttcgatatgcccgtggagaacgttttactattggaagactctatggcatcgctgcaatactagaggccattccatctctatgcaggcagttcttttctggaatgaagcatctcatgaccatggtcaaagttgctttccttttggtgatagaactcggagtatttccccttatgtgtggttggtggcttgatgtctgcactcttaagatgttgggtaccacaattgctcaaagagttgaattctttacgatgtcacccttggcgagctcctcgatccattggcttgttgggattgtatatatgctccaaataagcatatttgtcagccttcttcgaggggtactgcggaatggagttctgtacttcttacgggaccctgctgatccaaattacaatccttttagggacctgatcgatgatcctgtgcataaacatgctcgacgagtccttttatctgtcgctgtgtatgggagcttgattgtgatgctggtcttcttacctgtcaaactggccatgcgagtagctcctaaaacttttcctctggacattaccatctttgacccttttaccgagattccagttgatgtgcttctgttccaaatatgcatcccatttgcgattgagcatttcaagcctcgggcaactattaaagctctgctgcatcattggttcgctgtgattggctgggcactaggcttaacagatttcttactaccaaaacctgaagaaaatgctgctgggcaagagaactggaatggcagggcagaaagaagagatagagtaaacggtgggatggaaatggtagccccacagcttgagcagcgtatgattcaacatgctgccatagataatgatggtaggggtaatgcaaatgaagccaatgacattgctgaagaatctgatgtagatgatcaaggagattcagagtacagttttgcactccgtatcatactcttgcttgtactagcatggatgacgctactcatattcaatgctggaatgattgttattcctatctcacttggccgtctagtttttgaggctgttccccgcctgccaatcacacatggcatcaagtgcaatgatctgttctcttttagcatcggttgctatattatctggagtgcagcagctggaaccagatatgcagttgactacattagatcacgacgtctgggcttcctggtacaacagatctgcaagtggtgctctattgtcctgaagagttctgctctcctgtcaatatggatctttgttatccctgtgctgattggactcctttttgagctgcttgtgattgtacccatgagggtgcctattgacgagagcccagtttttctgctgtatcaggattgggcacttggattaatattcttgaaaatttggactagactggtgatgctggatcaaatggcacctttggttgatgaaagctggaggatgaagtttgagagagtaagagaggatggcttctcccgtttgaaaggcctatgggtcctgcacgaaatcataacccccatcatcacgaagctccttactgctctctgtgtcccatacgtcctcgcaaggggtgtgttcccggtgctgggctacccactgattgtgaactcggcagtctaccgtttcgcctggctcgggtgcctgatattcagcacgctcttcttctgcggcaagagattccacgtctggttcaccaacctccacaactccatcagggacgaccgctatctcattggccggaggctgcacaactttggcgaagactcccgtcggtcgaacgtggctgatgagaatccaggttcaggagacgaggaccttgcgctgatccctatagatcatcaggaggatgacgacgacgtcgggctgaggttcaggggcaataaccggcatgcgcatgaagacgcgggggtggttgtcgtcggttaagctttagtgcatgagtatgaaaccggcatccgcatgtgaccggcattgtagagtgaaggagttgccctgtagtagtgttagtagggtagtaggcaagcattgttgtacaacacatagtagcagcgaggggaataataagctagatagaaggatttcgcgcggaaaggaaagctgatggtcaagtgcctcttttttgggttgctgtggtagtcgttgctgaatgtatatattgatggaaacacctaagaagacatgatctgatgttgttctgatgtaatgtgcaaggataaatctgagtcgacactggtgtaatggctcatgtttcacgttggacctactcgttttaagttttcatctcgtggaatgatcagattgt

SEQ ID NO: 2484 - DNA, 3503 bp, Secale cereale
atcaagttcgtccaccaggactgcctcctccagtggctcgaccacagcaactcccgccagtgcgaggtctgtaagcacgcgttctctttctcgcccgtctacgctcagaatgctccaacaagacttcctttccaagaacttgtgtttggtgttgggatgaaagcatgccacgtgtttcagtttgtcctccggcttgcatttgttctttcagtctggctcatgattatccccttcattacctactggatatggcggttaacatttgtgagaagtctcggtgaagcacaaaggctgttcttgagtcacatcagcgctcagttgattcttagtgattgcctgcatggatttcttctctcagctatcattgtccttatatttcttggagctacctctttaagggactatataaggcacttgcgggaacttggaggacatgaagctgacagggacgatgcaggccgtgaaaggcatggtgcccgagctgtcagaaggctagctggtcctaataacagggttcctggtgcagatggagttattgatgacctggctgaggcccaaggacttggtgctggggaacttctgaggagaaatgctgaaaatgttgctgctcgattggaaagactagaagcccaagttgaacagatgttagatggtctggatgatgcggatggtgcagaggacgttccttttgatgaacttgtcggcatgcaaggcccagtatttcacttggttgagaatgcaattacagttttggccagcaatgctatattcctcattgttgtgatctttgtaccattctcattgggaaggattgtcctgtattatctgtcatggtttttctcttcagcctccagtcctatgctggctagagtgatgccatttacggaatctgctatttctttggctaatgaaacattgaatagtgcttttaatgccatgaagaatttctcttccgacagtcacaatgaaggtgttattgggcatgtgattgaggtggttactcagtccttgaagataaatgccactggtcttgctgtaatgcagggcactgggaagagcagtttggtgaaaggaacagctattggctcgtcttatctttcagatctgacaactcttgctgttggatacatgtttatcttttgccttgtgtttttgtacattggatcactggctttacttcgatacgcccgtggagaacgttttactattggaagactctatggcatcgctgcaatactagaggccattccatctctatgcaggcagttcttttctggaatgaagcatctcatgaccatggtcaaagttgctttccttttggtgatagaactcggagtatttccccttatgtgtggttggtggcttgatgtctgcactcttaagatgttgggtaccacaattgctcaaagagttgaattctttacgatgtcacccttggcaagctcctcgatccattggcttgttgggattgtatatatgctccaaataagcatatttgtcagccttcttcgaggggtactgaggaatggagttctttacttcttacgggaccctgctgatccaaattacaatccttttagggacctgatcgatgatcctgtgcataaacatgctcgacgagtccttttatctgtcgctgtgtatggaagcttgattgtgatgctggtcttcttacctgtcaaactcgccatgcgagtagctcctaaaacttttcctctggacattaccatctttgacccttttaccgagattccagttgatgtgcttctgttccaaatatgcatcccatttgcgattgagcatttcaagcctcgggcaactattaaagctctgctgcatcattggttcgctgtgattggctgggcactaggcttaacagatttcttactaccaaaacctgaagaaaatgctgctgggcaagagaactggaatggcagggcagaaagaagagatagagtaaacggtgggatggaaatggtagccccacagcttgagcagcgtatgattcaacatgctgccatagataatgatggtaggggtaatgcaaatgaagccaatgacattgctgaagaatctgatgtagatgatcaaggagattcagagtacagttttgcactccgtatcatactcttgcttgtactggcatggatgacgctactcatattcaatgctggaatgattgttattcctatctcacttggccgtctagtttttgaggctgttccccgcctgccaatcacacatggcatcaagtgcaatgatctgttctcttttagcatcggttgctatattatctggagtgcagcagctggaaccagatatgcagttgattacattagatcacgacgtctgggcttcctggtacaacagatctgcaagtggtgctctattgtcctgaagagttccgctctcctgtcaatatggatctttgttatccctgtgctgattggactcctttttgagctgcttgtgattgtacccatgagggtgcctattgacgagagcccagtttttctgctgtatcaggattgggcacttggattaatattcttgaaaatttggactagactggtgatgctggatcaaatggcacctttggttgatgaaagctggaggatgaagtttgagagagtaagagaggatggcttctcccgtttgaaaggtctatgggtcctgcacgaaatcataacccccatcatcacaaagctccttacagctctctgtgttccatacgtccttgcaaggggcgtgttcccggtgctgggctacccactgatcgtgaactcagcagtctaccgtttcgcctggctcgggtgcctgatattcagcacgctcttcttctgcggcaagagattccacgtctggttcaccaacctccacaactccatcagggatgaccgctatctgattggccggaggctgcacaactttggtgaggactcgcgtcggttgaacgtggctgatgagaatccaggttcaggagacgacgaccttgcgctgatccctatagatcatcaggatgatgacgacgtcgggctgaggttcaggggcaacaaccggcatgcgcatgaagacgcgggggtggttgtcgtcggttaagctttagtgcatgagtatgaaaccggcatccgcatgtgaccggcattgtagagtgaaggagttgccctgtagtagtgttagtagggtagtaggcaagcattgttgtacaacacatagtagcagcaaggggaataataagctagatagaaggatttcgcgcggaaaggaaagctgatggtcaagtgccttttttttttgggttgctgtggtagtcgttgctgaatgtatatattgatggaaacacctaagaagacatgatctgatgttgttgtgatgtaatgtgcaaggataaatctgagtcgacactggtgtaatggctcatgtttcacgttggacctactcgttttagttttcatctcgtggaatgatcagattgtggaagtagctgtttgtttcctcaaaat

SEQ ID NO: 2485 - DNA, 3355 bp, Secale cereale
agttcgtgcaccaggactgcctcctccagtggctcgaccacagcaactctcgccagtgcgaggtctgcaagcacgcgttctctttctcgcctgtctatgctcagaatgctccaaccagacttcctttccaagaactcgtgtttggcgttgggatgaaagcatgccatgtgtttcagtttgtcctccggcttgcctttgttctttcagtctggctcatgattatccccttcattacctattggatatggcggttaacattcgtgagaagtcttggggaagcacaaaggctgttcttgagtcacatcagcgctcagttgattctcagtgattgcctacatgggtttcttctctcagctatcattgtccttatatttcttggagctacctctttaagggactatataaggcacttgagggaacttggaggacatgaagctgacagggacgatgcaggccgtgaaaggcatggtgcccgagctgtcagaaggctagctggtcctaataacagggttcctggtgcagatggaaatattgatgatctggctgaggcccaaggacttggtgctggggaacttctgaggagaaatgctgaaaatgttgctgctcgattggaaagactagaagcccaagttgagcagatgttagatggtctggatgatgcggatggtgcagaggacgttccttttgatgaacttgtcggcatgcaaggcccagtatttcacttggttgagaatgcaattacagttttggccagcaatgctatattcctcattgttgtgatctttgtaccattctcattgggaaggattgtcctgtattatctgtcatggtttttctcttcagcctccagtcctatgctggctagggtgatgccatttacggaatctgctatttctttggctaatgaaacattgaatagtgcttttaatgccatgaagaatttctcttccgacagtcacaatgaaggtgttattgggcatgtgattgaggtggttactcagtccttgaagataaatgccactggtcttgctgtaatgcagggcactgggaagagcagtctggtgaaaggacagctattggctcatcttatctttcagatctgacaactcttgctgttggatacatgtttatcttttgccttgtgtttttgtacattggatcactggctttacttcgatacgcccgtggagaacgttttactattggaagactttatggcattgctgcaatactagaggccattccatctctatgcaggcagttcttttctggaatgaagcatctcatgactatggtcaaagttgcattccttttggtgatagaactcggagtatttccccttatgtgtggttggtggcttgatgtctgcactcttaagatgttgggtaccacaattgctcaaagagttgaattctttacgatgtcacccttggcgagctcctcaatccattggcttgttgggattgtatatatgctccaaataagcatatttgtcagccttcttcgaggggtactgaggaactggagttctttacttcttacgggaccctgctgatccaaattacaatccttttagggacctgatcgatgatcctgtgcataaacatgctcgacgagtccttttatctgtcgctgtgtatggaagcttgattgtgatgctggtcttcttacctgtcaaactcgccatgcgagtagctcctaaaacttttcctctggacattaccatctttgacccttttaccgagattccagttgatgtgcttctgttccaaatatgcatcccatttgcgattgagcatttcaagcctcgggcaactattaaagctctgttgcatcattggttcgctgtgattggctgggcactaggcttaacagatttcttactaccaaaacctgaagaaaatgctgctgggcaagagaactggaatggcagggcagaaagaagagatagagtaaacggtgggatggaaatggtagccccacagcttgagcagcgtatgattcaacatgctgccatagataatgatggtaggggtaatgcaaatgaagccaatgacattgctgaagaatccgatgtagatgatcaaggagattcagagtacagttttgcactccgtatcatactcttgcttgtactggcatggatgacgctactcatattcaatgctggaatgattgttattcctatctcacttggccgtctagtttttgaggctgttccccgcctgccaatcacacatggcatcaagtgcaatgatctgttctcttttagcatcggttgctatattatctggagtgcagcagctggaacccagatatgcagttgactacattagatctcgacgtctgggcttcctggtacaacagatctgcaagtggtgctctattgtcctgaagagttctgctctcctgtcaatatggatctttgttatccccgtgctgattgggctcctttttgagctgctggtgattgtacccatgagggtgcctattgacgagagcccagtttttctgctgtatcaggattgggcacttggattaatattcttgaaaatttggactagactggtgatgctggatcaaatggcacctttggttgatgaaagctggaggatgaagtttgagagagtaagagaggatggcttctcccgtttgaaaggtctatgggtcctgcacgaaatcactaacccccatcatcacaaagctccttacagctctctgtgttccatacgtccttgcaaggggcgtgttcccggtgctgggctacccactgatcgtgactcagcagtcctaccgtttcgcctgtctcgggtgcctgatattcagcacgctcttcttctgcggcaagagattccacgtttggttcaccaacctccacaactccatcagggacgaccgctatctgattggccggaggctgcacaactttggtgaggactcccgtcggtcgaacgtggctgatgagaatccaggttcaggagacgaggaccttgcgctgatccctatagatcatcaggaggacgacgacgtcgggctgaggttcaggggcaacaaccggcatgcgcatgaagacgcgggggtggttgtcgtcggttaagctttagtgcatgagtatgaaaccggcatccgcatgtgaccggcattgtagagtgaaggagttgccctgtagtagtgttagtagggtagtaggcaagcaatgttgtacaacacatagtagcagcaaggggaataataagctagatagaaggatttcgcgcggaaaggaaagctgatggtcaagtgcctcttttttgggttgctgtggtagtcgttgctgaatgtatatattgatggaaacacctaagcagacataatc

SEQ ID NO: 2486 - DNA, 2807 bp, Panicum virgatum
ggaggttaacatttgtgagaagtcttggtgaagcgcagaggctgttcctgagtcacatcagtgctcagttgatccttagtgattgccttcatggattccttctctcagctatcattgtccttatatttcttggagccacctcattacgggactacataaggcatttgcgcgagcttggtggacatgatgctgagagggatgatggagtccgtgaaaggcatggtgctcgggctgtcaggaggttggcgggtcctaataatagggttcctgcagatggaaatatcgatgaattagcagaagcccaaggaattggtgctggtgaacttctgaggagaaatgctgaaaatgttgctgctcgattggaacgacttgaggctcaggttgagcagatgcttgatggtctggatgatgcagatggtgcagaggatgttccttttgacgaacttgttggtatgcaaggccctgtcttccacttagttgagaacgcaataacagttttggccagcaatgctatattcctcattgttgtgatctttgttccattctcattgggaaggattgtcctgtactatctatcatggtttttctcttcggcctctactcctatgctagcaaaaatgatgcccttcacagaaacagctatttctatagctaatgatacattgaagagtgcacttaatgtcgtgaagaaattttcttccgatagtaacaatgaaggtgttattgggcatgtgattgaggttgttactcaatccttgaagataaatgccactggtcttagtgtaattcaaggcactggaaagagcagtttgataaaaggaacaaccattggctcatcttatctttccgatctgacaactcttgctgttggatacatgttcatcttctgccttgtatttttgtacatcggatcactggctttacttcgatatgctaggggagaacgttttaccattggaagactatatggtatagctactatattagaggccattccatctctttgcaggcagttctttgctggaatgaagcatctcatgactatggtcaaagtcgcattccttctggtgattgagcttggtgtctttcctcttatgtgtggttggtggcttgatgtttgtactctaaagatgctgggcacaacaatagctcagagagttgaattctttacgatgtcacccttggcgagctcttctatccattggctagttgggattgtgtatatgctccaaataagcatatttgtcagtcttcttcgaggggtactgcgcaatggagttctttattttctgagggatcctgctgatccaaattacaatccatttagggacttgattgacgatcctgtgcataaacatgctcgacgggttcttttgtctgttgccgtgtatggaagcttgattgtgatgttggtcttcttacctgtaaaactggccatgcgagtagcaccttcaatttttcctctggacatcacgatatttgacccattcactgagattccagttgatgtccttctgttccaaatatgcatcccattcgcaattgagcacttcaagcctcgtgcaactattaaatctcttttgcaccattggtttgctacggttggttgggcgcttggattaactgatttcttactgccaaaacctgaagaaaacggtgggcaggaaaattggaatggcagggcagaaagaagagataggggccatggtgggcgggaaatgattgccccacagattgaacaacgcatgatacaacatgttgctgcagaagataatggcaggggaaatgcaaatgaagccaatgatgtcgctgaagaacctgatgtagatgatcagggagactctgagtacggctttgtgcttcggattgtgctcttgcttgtactggcatggatgacactactaatattcaatgctggaatggtagttattcctatctcgcttggccgtctcgtttttgaagctgttccccgcctgccaatcacacatggcatcaagtgcaatgatctgttctcctttagcattgggtgctatattctctggagcgtagcagctggaaccagatatgcaattgattatatcagatcgcggcaactaggaatcctggtacaacagatctgcaagtggtgctctattgttttgaagagctctgttctcttgtcaatatggatctttgttattcctgtgttgattggactcctttttgagctactggtcattgtaccaatgagggtgcctatcgatgagagccctgtcttcctactataccaggattgggcccttgggttaatattcttgaaaatatggactaggctggttatgttggatcaaatggcacctttggttgatgaaagttggaggtcaaagtttgagagagttagagacgatggcttctcccgtttaaggggtctgtgggtcctccatgaaattataatgccgattgtcaccaagctccttactgctctctgtgtcccatacgtccttgcaaggggcatcttcccggtgcttggctaccctctcatcgtgaactcagcagtgtaccgctttgcctggctaggctgcctgatcttcagcgccctcttcttttgtggaaagagattccatgtctggttcaccaacctccacaactccatcaggatgaccgctatctgattggccggaagctgcacaactttggtgaggacacacctgaaccaagcgaatcagagcaactatgggtcagatgaccaggacagggcactagtcctgcaagatcaagaagaggaagtggggctgaggctgagcgcaataatgtgcgcgcaaaccaac

SEQ ID NO: 2487 - DNA, 1817 bp, Sorghum bicolor
atcatcagtagttagttgatgaatacccaaccacgtccacatgccctgacccccggtgcacggccaaagatcaacaagatgccggtcgccgcgcggcagcatccccgcgggagccgtgacacctgacgcgccaacagaccacccggtgggcggtggcacggcagcaagcactcatcagcctccacctccacctccacctccgcctccacgcgctggggcgggcggcgacctcccacccgtctcgcacgccgagaacctgtttgtttttcttttcttttccccgattcctttctcgcccgcccagtcgcccttccccgggtccacaacacttccactccctcaaccccaccagacccctcaactgccacatttccgtcgctaccggagccgccactcccacgaccacgaacgccggcgaccgagcggaaacgaaccagttatctagtggagctgcctcgtccaaggtactgtaatgtcctttctattcaagtctagcaatggtggtaccactgaaaaaaccatgcccctggaagaacagcaagaaaaaataaatgaactacgcaaggtgcttggtgaccactcatcaccagccattcaagacttcctttcagatgcctcattagcgagatttcttcgagcaaggaactggaatgtgcagaaagctagtaaaatgatgaaagcagctgtgaagtggcggcttgcattcaaacctgaaaacatctgttgggatgatatttcagaggaagcagagaccggaaagatatatagggcagactataaggacaaacatggcagaactgttcttgtattgaggcctggtttagagaacactacctcagcaacaggacagatcaaatatctagtctactctctggagaaagcaattatgaacctgacggaagatcaagagaagatggtatggctgacagatttccagtcctggacattgggaagcacaccactgaaggtgacccgtgagactgtcaatgtcttgcaagactgttatcctgagaggttggggcttgcaatcctttacaaccctcctaggatatttgaatcattctggaagatagtgaagccgttcctggaccaagagacccgcaagaaggtgaagtttgtgtactccaacgacaaggagagccagaagataatggcagaagtctttgacatggaggagctcgactcggcatttgggggaaagaacccagcgacatttgagtacaacagctacgcagagcgaatgcaggaggacgacaagaagatgggatcgttgcacagttcaaccaatagcttgcttgaatcagctgagaaggaggctaatggcgcagactcggacgcctcaagtgaggcctccttctacagtggaactgactctccgaaacatgaggacggtgaacacagcatcgcaaagaagagcggctgagctaaactgctttgattgctcaaattgagggagctgaggaatggaataggtcaacatatctagcttgaacgattgtcaggaccgatggcgatgagccgatgacagattacaagctggttagataacgttgccgggtctaggcggaatgtatatttgctgctcatgatattagagtatatgtaagagtttggaccatcaacgctgaattggtgatgcgttatacatctttggaataagtttaacttctccgcggtacatgtttggttactcgttgacgtcgcccaatgtatattccagttcccaatgtctctaacagcgtttatcaacttggaccattgtatgtcttggaaattaaaatgtactctatctattctaaattatttgatattttaac

SEQ ID NO: 2488 - DNA, 1582 bp, Sorghum bicolor
gcgctggggcgggcggcgacctcccacccgtctcgcacgccgagaacctgtttgtttttcttttcttttccccgattcctttctcgcccgcccagtcgcccttccccgggtccacaacacttccactccctcaaccccaccagacccctcaactgccacatttccgtcgctaccggagccgccactcccacgaccacgaacgccggcgaccgagcggaaacgaaccagttatctagtggagctgcctcgtccaaggtactgtaatgtcctttctattcaagtctagcaatggtggtaccactgaaaaaaccatgcccctggaagaacagcaagaaaaaataaatgaactacgcaaggtgcttggtgaccactcatcaccagccattcaagacttcctttcagatgcctcattagcgagatttcttcgagcaaggaactggaatgtgcagaaagctagtaaaatgatgaaagcagctgtgaagtggcggcttgcattcaaacctgaaaacatctgttgggatgatatttcagaggaagcagagaccggaaagatatatagggcagactataaggacaaacatggcagaactgttcttgtattgaggcctggtttagagaacactacctcagcaacaggacagatcaaatatctagtctactctctggagaaagcaattatgaacctgacggaagatcaagagaagatggtatggctgacagatttccagtcctggacattgggaagcacaccactgaaggtgacccgtgagactgtcaatgtcttgcaagactgttatcctgagaggttggggcttgcaatcctttacaaccctcctaggatatttgaatcattctggaagatagtgaagccgttcctggaccaagagacccgcaagaaggtgaagtttgtgtactccaacgacaaggagagccagaagataatggcagaagtctttgacatggaggagctcgactcggcatttgggggaaagaacccagcgacatttgagtacaacagctacgcagagcgaatgcaggaggacgacaagaagatgggatcgttgcacagttcaaccaatagcttgcttgaatcagctgagaaggaggctaatggcgcagactcggacgcctcaagtgaggcctccttctacagtggaactgactctccgaaacatgaggacggtgaacacagcatcgcaaagaagagcagctgagctgagctgctttgattgctcaaattgagggagctgaggaatggaataggtcaacatatctagcttgaacgattgtcaggaccgatggcgatgagccgatgacagattacaagctggttagataacgttgctgggtctaggcggaatgtatatttgctgctcatgatattagagtatatgtaagagtttggaccatcaacgctgaattggtgatgcgttatacatctttggaataagtttaacttctccgcggtacatgtttggttactcgttgacgtcgcccaatgtatattccagttcccaatgtctctaacagcgtttatcaacttggaccattgtatgtcttggaaattaaaatgtactctatc

SEQ ID NO: 2489 - DNA, 1393 bp, Panicum virgatum
gccccgcccgccccgttccacacttccattcccccagggtcccccgactgctcctccaccgtcctcctccgctctcccgcgggcgcgcgcggcgggggccgaaacgacccagctacgcatctatccgtgctgcttcaccaaggtgctgaaatgtcctttctgttcaagtcaagcaacagtggtacaactgagaaaggcttgtccctagaagaacagcaagaaaaaataaatgaattacgcaaggagcttggtgaatactcatcagcagccattcaggatttcctttcagatgcctcgttgtcgagatttcttcgagcaaggaactggaatgtgcagaaagctagtaagatgatgaaagcagctgtgaagtggcggctcgcgttcaagccagagaacatttgctgggcagatattgcacaggaagcagagactggaaagatatatagggcagattacaaggacaaacaagggagaactgttcttgtattgaggcctggcttagagaacactacctcagcaacagggcagatcaaatatctagtttactctctggagaaagcgattatgaacctaacagaagatcaagagaagatggtgtggctgacagatttccagtgctggacattgggaagcacaccactgaaggtaacccgtgagactgtcaatgtcttgcaagactgttatcctgagcggttggggctagcaatcctttacaatcctcctaggatatttgaatcattctggaagatagtgaagcctttcctggaccatgagacccgcaagaaggtgaagtttgtgtactcgaacgacaaggagagccagaagataatggcagaggtctttgacatggaggagctcgactcggcattcggggggaagaatccagctacattcgagtacaacagctatgcagagcgaatgcaggaggacgacaagaagatgggatctttgcacagctcaactgatagcttccttgaatcatctgagaaggaggctaatggcgcagactctgatgcctcgagcgaggcctccttctacagtggaactgactctccgagacatgacgatgaacacagcaccccgaagaagaacagctgagctggactgctttggctgctcgagctgagagatggtctaggtcgacaactcgacatacagttatctaactggagctattgtctggaccgatgggggcaccagtttacaagctggtcagatcacgctgtcgggtctagaagggatgtatgtttgctgcccatgataatatagagaatatggaagagtttggaccatcagtggcgttgtactagatgaatttctcaataagattggacttcttcgagccatttgtttggttactcctagcaggagacctatatgtgttgccctagcc

SEQ ID NO: 2490 - DNA, 1081 bp, Sorghum bicolor
cttcctttcccttggtgccttttgtccacagcccctagcgcctgcttcttagttcttccctctgcctcttgctgcggctgctgctgctgcttcctgtgccgatcacacgatggtgtccattgtcacggaggcatgggcgctcgccggatgcggcccggcgtccaaggctgcggcggtaccggcgcaggagttgccggtgcagcatcctcctgcagcagctgcagggaagaccaagaagagattcgtgtcgttcagatgcgtcagcagcggcggtggccaggaccaccggcgtgaggccaccgtcgtcgtcggccggcggcgcggccttgcgtcgtgcgcgctcgccgccctcgccgcctcgttctccccgctcgccgccgaccgcgccgcacgggccctcgtcctcgaggaagacgacgacatcgagctgctggagcgcgtgaaggaggacaggaagaagcggctgcagaagcaaggcgtcatcagctcctctggcaccgagaccggatatttgcaggacctcatctacaagctgagcaaagttgggcaggccattgacaaagatgatctcccagccgcaagcagcgtcctgggaccaagttcagatgcgaagtgggtgcagaacatcaatatggctttctccaagttcagctcaagcccagaggagaggaacgtggttgatagcttcaacagctcactggccacattgtttacatccgtgaacaagctcgacgctgaatcctccaagtcggcgttcgtgtcgtctgcgacggcgttggagaaatggattgcattagccggactgggtggtcagctcaaaggctactgatgtgacggaagcgttgtatgtatcatgtatggatccggcatttgtgaatctcctaaagagggtaccgtaaccgaggactgaattcagataagcgtgctagaataacacagcagcatcctcatcgatcaagaaactgggatcattttttgcgactgtgttattacagtaaatcagtaataggaaatgaagctgtattgttttttgttgtccggtgttacttttgaaattccaaacagctgatgggaagttttt

SEQ ID NO: 2491 - DNA, 1213 bp, Sorghum bicolor
ctgtgacggccgaaacgagatagtgaggataaggggctctttcgttgggccagcgctgcatgcttcctttcccttggtgccttttgtccacagcccctagcgcctgcttcttagttcttccctctgcctcttgctgcggctgctgctgctgcttcctgtgccgatcacacgatggtgtccattgtcacggaggcatgggcgctcgccggatgcggcccggcgtccaaggctgcggcggtaccggcgcaggagttgccggtgcagcatcctcctgcagcagctgcagggaagaccaagaagagattcgtgtcgttcagatgcgtcagcagcggcggtggccaggaccaccggcgtgaggccaccgtcgtcgtcggccggcggcgcggccttgcgtcgtgcgcgctcgccgccctcgccgcctcgttctccccgctcgccgccgaccgcgccgcacgggccctcgtcctcgaggaagacgacgacatcgagctgctggagcgcgtgaaggaggacaggaagaagcggctgcagaagcaaggcgtcatcagctcctctggcaccgagaccggatatttgcaggacctcatctacaagctgagcaaagttgggcaggccattgacaaagatgatctcccagccgcaagcagcgtcctgggaccaagttcagatgcgaagtgggtgcagaacatcaatatggctttctccaagttcagctcaagcccagaggagaggaacgtggttgatagcttcaacagctcactggccacattgtttacatccgtgaacaagctcgacgctgaatcctccaagtcggcgttcgtgtcgtctgcgacggcgttggagaaatggattgcattagccggactgggtggtcagctcaaaggctactgatgtgacggaagcgttgtatgtatcatgtatggatccggcatttgtgaatctcctaaagagggtaccgtaaccgaggactgaattcagataagcgtgctagaataacacagcagcatcctcatcgatcaagaaactgggatcattttttgcgactgtgttattacagtaaatcagtaataggaaatgaagctgtattgttttttgttgtccggtgttacttttgaaattccaaacagctgatgggaagtttttatccaaaacttgctgcatgccgtgtgaatgtaaaagggtcaagcagtgtcaactcttcaatcattctgcc

SEQ ID NO: 2492 - DNA, 1280 bp, Setaria italica
gtgcttaccactaggctaaccgagctaacacatgtgtggctgtgacggccgaaggaagatagtgaggataaggggactcttccattggcccagtcgtgcatgcttccttcgtgttctgtccacaacctctagtgcctgcttctttcctctccctcttgactcttgctgctgctgccgcttcctgggggagaacacgatcgccaatggtggccattgctaccgaggcatgggcgctcgccggatgtggcgcggcgtccaaggtggcggcgacggcggtgcaggagctgccagcgcagcagcatcccccagcggcagcatgcagggccaagttcagaggcgtcagcagcaacggaggccaggaccggcgtgaggccgccgtcgtcgtcggccgacggagcggcctggcgtcatgcgtgctcgccgccctggcggcgtcgttctccccgctcgccgccgaccgccccgcgcgggcccttgtgctcgaggaggacgacgacatcgagctgctggagcgcgtcaaggaggacaggaagaagcgcctggagaagcaagggatcatcagcgcgtcaggcaccgagactgggtacttgcaggacctcatctacaagttgagcaaagttgggcaggccattgacaaggacgatctcccagccgcgagcagcgtcctgggtccaagtacagatgcccagtgggtgcagaacatcaatgcagctttttccaagttcagctcgagcccagaggagaggagcacggttgatagcttcaacgcctccttggcctcattgttcacatcagtgaacaagcttgatgctgaatcctccaagtcggcgtttgtgtcgtcagccacagcgttggagaaatggatagcgttagccggactgagtggccagctcaaaggcttctaatatgccagtgaagtggcttgctgacaaatagctgggtgcttctcttactcgaagcactggctgtgatcgcaagacagtgtatgcatccggcacttgtgaatcttctaaagagggtaccgtaacagagaactgagctcacttggagaacggcaacattctcatcaagaaattggaattaatttgcgatgtattatcacagtaataggaaatgaagctaaaattgcttttgtttggttgtctagtctctgtctttcaaactccaagaagctcatgggcagtttctatcctcgaaattggggtatgtcaatagagattgaggtgtatgaaacatcagcaggtttttttattttcagttttcatcaatcatgccatgcc

SEQ ID NO: 2493 - DNA, 2229 bp, Sorghum bicolor
aagccgccgccgccgctagcttcaccactgcggactgctccgcttctcttgctggcctcctgggacattgctgcgtcgaaggcgagggccggcggactccgctcgcacgccatattcgtatcgccgcacggcgtctagtctgctgcctgcactgcagcgtgctccatcttgccgggtctagcagccaccctcttctcctctccgctcgctcccaaacgccgctgcctccacttcaccatggcgcttcacgccccggtcctcgtgctgaaggactcgctgaagcgggagtctggcgcgaaggttcaccaagccaacatccaggcggccaaggctgttgctgacatcatacgcactacattgggtcccagatccatgctgaaaatgcttctggatgctggtggaggtattgtggttactaatgatgggaatgctattttgagggaaatagacatcgcacaccctgctgccaagtctatgattgaactaagtcgtacacaggatgaagaagttggtgatggcactacatctgtcattgttctagctggagagatgctacacgttgcacaggcattcattgacaagaactaccatccaactgttatttgccgagcatacaccaaagcgcttgatgatgctattgctgtacttgacaaaattgcaatgcctgttgatgtgaatgaccgtggggcaatgctaggccttgtgaagagctctattggtacaaaattcactggccagtttggtgaccttattgctgaccttgctattgatgctactacaacagcaggtgttgaccttggtcagggtatgcgtgaagttgatatcaagaaatacattaaagttgaaaaggtacctggtggtcagttggaggattctagagtccttaaaggagttatgatcaataaggatgttgtagctcctggaaaaatgaggagaaagatagttaacccccgtatcatcctcttggactgccctgttgagtataagaaaggagaaaatcagaccaacgctgagttaatgaaggaagaagattggcaggttctgctagagatggaggaagaatacataaagaacctgtgcgctcaaattctaaaattcaagcctgatttagtcatcacagagaaagggctcagtgatctcgctatccattatttaagcaaagctggtgttagtgcaatccgtagacttaggaaaactgacaacaacaggattgctaaagcttgtggagcagttatagtgaacaggcctgaggagctccaagaatctgatgtgggaacaggagctggcctgtttgaggtcaagaagataggtgatgaattctttgcctttattgttgactgtaaagatcccaaggcatgtactgttctgttgaggggagcaagcaaggatgtattgaatgaagttgagagaaacctgcaggatgccatgtccgttgcaagaaacattttgaaaaatccaaaactccttcctggaggtggtgctacagagctgactgtatcagcgacactgaagcaaaagagttcttcagttgaaggcgtggaaaagtggccctatgaagctgctgctctagcatttgaggcaattccaaggactttggcccaaaattgtggtttgaatgttattaggataatgacacaacttcagggaaagcatgctaatggtgaaaatgcgtgggttggcattgatggaaggagtggtgatattgttgatatgaaagagcgaaagatctgggattcctacagcgttaaagcgcagacgttcaagacagcaattgaggccgcttgcatgcttttgagaatcgatgacattgttagcggtatcaagaagaagcaggctcctggagcctcagctccaaagcaaccccaaattgaaactgagggcgatgctgacaatgagcagatgatcccagagtagaggctgtgacgaacctgcactggcaaagttatttactagtaccagaatagcacgctgagcagagttatttgtttgagtgttggtggttagccttagcttaaagatgtacctagttttctatagtttgatgagtggtccgagggttttgggatccaggttttgaagtgttgttgctgctcattttgctttggactgatggacgacaaacaagcagtgaaactagtctttatggctaactacctttgcctgttgtatgccgcaaatctactttgtacttggtaatgctgtcgtttctcatgacctgaccagttcggc

SEQ ID NO: 2494 - DNA, 2360 bp, Sorghum bicolor
acgcaaggtgaattcaagcgaaggcccgtctaaggcccatctgcaaccggccctaaaatgtcttcacttcccaaccctaaacacacaagccgccgccgccgctagcttcaccactgcggactgctccgcttctcttgctggcctcctgggacattgctgcgtcgaaggcgagggccggcggactccgctcgcacgccatattcgtatcgccgcacggcgtctagtctgctgcctgcactgcagcgtgctccatcttgccgggtctagcagccaccctcttctcctctccgctcgctcccaaacgccgctgcctccacttcaccatggcgcttcacgccccggtcctcgtgctgaaggactcgctgaagcgggagtctggcgcgaaggttcaccaagccaacatccaggcggccaaggctgttgctgacatcatacgcactacattgggtcccagatccatgctgaaaatgcttctggatgctggtggaggtattgtggttactaatgatgggaatgctattttgagggaaatagacatcgcacaccctgctgccaagtctatgattgaactaagtcgtacacaggatgaagaagttggtgatggcactacatctgtcattgttctagctggagagatgctacacgttgcacaggcattcattgacaagaactaccatccaactgttatttgccgagcatacaccaaagcgcttgatgatgctattgctgtacttgacaaaattgcaatgcctgttgatgtgaatgaccgtggggcaatgctaggccttgtgaagagctctattggtacaaaattcactggccagtttggtgaccttattgctgaccttgctattgatgctactacaacagcaggtgttgaccttggtcagggtatgcgtgaagttgatatcaagaaatacattaaagttgaaaaggtacctggtggtcagttggaggattctagagtccttaaaggagttatgatcaataaggatgttgtagctcctggaaaaatgaggagaaagatagttaacccccgtatcatcctcttggactgccctgttgagtataagaaaggagaaaatcagaccaacgctgagttaatgaaggaagaagattggcaggttctgctagagatggaggaagaatacataaagaacctgtgcgctcaaattctaaaattcaagcctgatttagtcatcacagagaaagggctcagtgatctcgctatccattatttaagcaaagctggtgttagtgcaatccgtagacttaggaaaactgacaacaacaggattgctaaagcttgtggagcagttatagtgaacaggcctgaggagctccaagaatctgatgtgggaacaggagctggcctgtttgaggtcaagaagataggtgatgaattctttgcctttattgttgactgtaaagatcccaaggcatgtactgttctgttgaggggagcaagcaaggatgtattgaatgaagttgagagaaacctgcaggatgccatgtccgttgcaagaaacattttgaaaaatccaaaactccttcctggaggtggtgctacagagctgactgtatcagcgacactgaagcaaaagagttcttcagttgaaggcgtggaaaagtggccctatgaagctgctgctctagcatttgaggcaattccaaggactttggcccaaaattgtggtttgaatgttattaggataatgacacaacttcagggaaagcatgctaatggtgaaaatgcgtgggttggcattgatggaaggagtggtgatattgttgatatgaaagagcgaaagatctgggattcctacagcgttaaagcgcagacgttcaagacagcaattgaggccgcttgcatgcttttgagaatcgatgacattgttagcggtatcaagaagaagcaggcccctggagcctcagctccaaagcaaccccaaattgaaactgagggcgatgctgacaatgagcagatgatcccagagtagaggctgtgatgaacctgcactgtcaaagttatttactagtaccagaatagcacgcagagcagagttatttgtttgagtgttggtggttagccttaacttaaagatgtacctagttttctatagtttgatgagtggtccgagggttttgggatccaggttttgaagtgttgttgctgctcattttgctttggactgatggacgacagacaagcagtgaaactagtctttatggctaactacctttgcctgttgtatgccgcaaatctactttgtacttggtaatgctgtcgtttctcatgacctgaccagttcggcaaatcgtttttgcggctgatgcttatgccgatttgttatgagaga

SEQ ID NO: 2495 - DNA, 2246 bp, Saccharum officinarum
ttgaaacctgtcgcttgcacgcacctggccggacctcccgggccgacccacgcgtccgctcgaaagatcccgcggcgcagcagccaccctcttctcctctccgctcccaatattatcgtcgcctccctcgatcgccgctgcctctacttcaccatggcgcttcacgccccggtcctcgtgctgaaggactcgctgaagcgggagtctggcgcgaaggttcaccaagccaacatccaggcggccaaggctgttgctgacatcatacgcactacattgggtcccagatccatgctgaaaatgcttctggatgctggtggaggtattgtggttactaatgatggtaatgctattttgagggaaatagacatcgcacaccctgctgccaagtctatgattgaactaagtcgtacacaagatgaagaagttggtgatggcactacatctgtcattgttctagctggagagatgctacatgttgcacaggcattcattgacaagaattaccatcctactgttatttgccgagcatacaccaaagcacttgatgatgctattgctgtacttgacaaaattgcaatgcctgttgatgtgaatgatcgtggggcaatgctaggccttgtgaagagctccattggtacaaaattcactggccagtttggtgatcttattgctgaccttgctattgatgctactacaacagcaggcgttgaccttggtcagggtatgcgtgaagttgatatcaagaaatacattaaagttgaaaaggttcctggtggtcagttggaggattctagagtccttaaaggagttatgatcaataaggatgttgtagctcctggaaaaatgaggagaaagatagttaacccccgtatcatcctgttggactgccctgttgagtataagaaaggagaaaatcagaccaacgctgagttgatgaaggaagaagattggcaggttctgctagagatggaggaagaatacataaagaacctgtgcgctcaaattctaaaattcaagcctgatttagtcatcacagagaaagggctcagtgatctcgctatccattatttaagcaaagctggtgttagtgcaatccgtagacttaggaaaactgacaacaacaggattgctaaagcttgtggagcagttatagtgaacaggcctgaggagctccaagaatctgatgtgggaacaggagctggcctgtttgaggtcaagaagataggtgatgaattcttcgcctttattgttgactgtaaagatcccaaggcatgtactgttctgttgaggggagcaagcaaggatgtattgaatgaagttgagagaaacctgcaggatgccatgtccgttgcaagaaacattttgaaaaatccaaaactccttcctggaggtggtgctacagagctgactgtatcagcaacactgaagcaaaagagttcttcagttgaaggcgtggaaaagtggccctatgaagctgctgctctagcatttgaggcaattccaaggactttggcccaaaattgcggtttgaatgttattaggataatgacacaacttcagggaaagcatgctaatggtgaaaatgcgtgggtgggcattgatggaaggagtggtgatattgttgatatgaaagagcgaaagatctgggattcatacagcgttaaagcgcagacattcaagacagcaattgaggctgcttgcatgcttttgagaatcgatgacattgtcagcggtatcaagaagaagcaggctcctggagcctcagctccaaagcaaccccaaattgaaactgagggcgatgctgacaatgagcagatgatcccagagtagaggctgtgacgaacctgcactggcaaagttatttactagtgccagaatagcactttgggcagagttcattttgtttgagtgttggtggttagccttagcttaaagatgtgcctggttttatatagtgagtggtacgagggttttggatccacgttttgaagtgtggttgctgctcattttgctttggactgatggacaacaagcagtgaaactagtctcctgtaatcctgttgtatgccgcaaatctactttgtacttggtaatgctgtcgtttcttatgatccgaactgagtcttgttgctgtcctttctcatcacccgaacttcgggtgatcggatggacggcatttgatgactcattattgttaagcgctttgggtgactggatagacggtacttaatgactcattattatta

SEQ ID NO: 2496 - DNA, 2085 bp, Zea mays
ccggtaaccctactcccggcgacggggatcctgcactcttgggttcttgcatcccgcataccctcgaaagctcgaaagatcccgcggcgcagcagccacccttctctcctctccgctcccaatcttatcgtcgcctccctcgaagtcgccgctgccttcattccaccatggcgcttcacgccccggtccacgtgatgaaggactcgctgaagcgggagtctggcgcgaaggttcaccaagccaacatccaggcggccaaggctgttgctgacatcattcgcacgacattgggtcccagatccatgctgaaaatgcttctggacgctggtggaggtattgtggttactaatgatggtaattctattttgagggaaatagacatcgcacaccctgctgccaagtctatgattgaactaagtcgtacacaagatgaagaagttggtgatggcactacatctgtcattgttctagctggagagatgctacacgttgcacaggcattcattgacaagaactaccatcctactgttatttgtcgagcatacaccaaagcgcttgatgatgctattgctgtacttgacaaaattgcaatgccggttgatgtgaatgatcgcggggcaatgctaggcctcgtgaagagctccattggtacaaaattcactggccagtttggtgatcttattgctgaccttgctattgatgctacaacaacagcaggcgttgaccttggtcagggtatgcgtgaagttgatatcaagaaatacattaaagttgaaaaggttcctggtggtcagttagaggattctagagtccttaaaggagttatgatcaataaggatgttgtggctcctggaaaaatgaggagaaagatagttaacccccgtatcatcctgttggactgccctgttgagtataagaaaggagaaaatcagaccaacgctgaattgatgaaggaagaagattggcaggttctcctagagatggaggaagaatatataaagaacctttgcgctcaaattctaaaattcaagcctgatttagttatcacagagaaagggctcagtgatctcgctatccattatttgagcaaggctggtgttactgcaatccgtagacttaggaaaactgacaacaacaggattgctaaagcttgtggggcagttatagtgaacaggcctgaggagctccaagaatctgatgtgggaacaggagctggcctgtttgaggtcaagaagataggtgatgaattctttgcctttattgttgactgtaaagatcccaaggcatgtactgttctgttgaggggagcaagcaaggatgtattgaatgaagttgagagaaacctgcaggatgccatgtctgttgcaagaaacattttgaaaaatccgaaactccttcctggaggtggtgctacagagctgactgtatcagcaacactgaagcaaaagagttcttcagttgaaggcgtggaaaagtggccctatgaagctgctgctctagcatttgaggcaattccaaggactttggcccaaaattgtggtttgaatgttattaggataatgacacaacttcagggaaagcatgctaatggtgaaaatgcgtgggttggcattgatggaaggagtggcgatatcgttgatatgaaagagcgaaagatctgggattcctacagcgttaaagcgcagacgttcaagacagcgattgaggctgcttgcatgcttttgagaatagatgacattgtcagcggtatcaagaagaagcaggctcctggagcctcagctcccaagcaaccccaaattgaaactgagggtgatgccgacaatgagcagatgatcccagagtagaggctgtgaccaacctgcactgtcaaagttgtttactagtgccggaatagcactttgaatagagttcattttatttgagtgttggtggttagccttaggttttatatatagtttgatacactcgtccgagggttttttgtagtgtggttgctgcgcattttgctttggacagatggacgaactttgcctgttgtatgccgtaaatctacctaatacatggtaatgctgttgtttcccatga

SEQ ID NO: 2497 - DNA, 2087 bp, Panicum virgatum
ccgaaacaaaccctcgaaagctcggaagatcccgcggcacagcaccctcctctcctctcctctccactacccactcgtcgccgccgtcgcgagacctcgccatggcgctgcacgcccccgtccttgtgatgaaggactcgatgaagcgggagtcgggcgccaaggtgcaccaggccaatatccaggctgccaaggctgtggcagacatcatacgcactacactgggtcccagatccatgttgaagatgcttcttgatgctggcggaggtattgttgttactaatgacgggaatgctatattgagggaaatagacattgcacatcctgcagctaagtctatgattgaactaagccgtacacaggatgaggaagtgggcgatggcacaacctctgtgattgttctagctggtgagatgctccatgttgctcaagcattcattgacaagaactatcatccaaccgtcatttgccgagcatataccaaagcgcttgatgacgctatagctgttcttgacaagattgcaatgcctgtcgatgtgaatgatcgcacggcaatgctaggtcttgtgaagagctccatcggtacaaaattcactggtcagtttggcgaccttattgctgaccttgctatcgatgctactacaacagcaggtgttgacctaggtcagggtatgcgggaagttgatatcaagaagtatattaaagtagaaaaggttcctggtgggcagttagaggattctacggtcctcaaaggagttatgatcaataaggatgttgtggctcctggcaaaatgagaaggaagatagttaacccacgtataatcctgctggacagccctattgagtataagaagggagaaaatcagaccaatgctgagttgatgaaggaagaagattggcaggttctgctagagatggaggaagagtacataaagaacctatgtgcacaaattctaaaatttaagcctgatttggtcatcacagagaaagggcttagtgatcttgctatccattatttgagcaaggctggtgttagtgcaattcgtagacttcgaaaaactgacaacaacagaattgctaaggcttgtggagcagttatagtgaacaggcctgaggagctccaggaatctgatgtgggcacaggagctggcctatttgaggtcaagaagataggtgatgaattcttttccttcgttgttgattgtaaagatcctaaggcttgcactgttctgttgaggggagcaagcaaggatgtcttgaatgaagttgagaggaacctgcaggatgctatgtctgttgcgaggaacattttgaaaaacccaaaactcctacctggaggtggtgctactgaattgactgtatcggcaacactgaagcaaaagagttcttcagttgaaggtgttgaaaagtggccctatgaagctgctgctttggcatttgaagcaattccgagaacattggcccaaaattgtggtttgaatgttattaggacaatgactcaactccagggaaagcatgctaatggcgaaaatgcctgggttggccttgatggaagaagtggtgacattgttgatatgaaagagcgaaagatctgggactcctacagtgtcaaagcgcagacgttcaagacagctatcgaggctgcttgcatgcttttgagaatcgacgacattgtcagcggtatcaagaagaagcaggctcctggagcctcagctcccaagcagccccagattgaaacggaaggtgatgcggacaacgagcagatgatcccagagtagatgtagcgagtcatttcttaggccagaatagcacgatgagccgaattcattatttcagtgtttgtttgtggctggtcctggcttgaaaatgtacctgaattcttatggttgagtggttcgagggttttggggtccaggttttgaagtatggctgctgttcatcttgttttggacttgtgctgaacgacagtcagcagttagactagtagtttttgtggctaactgtctgttgtatgacacatgctatgtgtttggtaatgctatcgttcccatgcttgtaactgtgctcattacaacttcggatgcctg

SEQ ID NO: 2498 - DNA, 2149 bp, Setaria italica
cgagggtttcacttgaacccaccaaaactgaaacaaaccctcgaaagctaggaagatcccgcggcgcagcaccctcctctcctctccactccccctcccgtcgccgcctcccccgtcgccgccgtcgcgagaccgccatggcgctgcacgcccccgtcctcgtgctgaaggactcgctgaagcgagagtcgggagcgaaggtgcaccaggcgaacatccaggctgccaaggctgtggcagacatcattcgcactacactgggtcccagatctatgttgaagatgcttcttgatgccggtggaggtatcgtggttactaatgacgggaatgctatattgagggaaatagacattgcacatcctgctgctaagtctatgattgaactaagccgtacacaagatgaggaagtgggtgatggcacaacctctgtgattgttctagctggtgagatgctccatgttgctcaagcatttattgacaagaactatcatcctactgttatttgccgagcatacaccaaagcgcttgatgatgctatagctgttcttgacaagatagcaatgcctgtcgatgtgaatgatcgcgtgtcaatgctaggacttgtgaagagctccattggtacaaaattcactggccagtttggtgaccttattgctgaccttgctatcgatgctactacaacagcaggcgttgacctaggtcagggcatgcgtgaagttgatatcaagaagtatattaaagtagaaaaggttcctggtggtcagttagaggattctagggtcctcaaaggagttatgatcaataaggatgttgtggctcctggtaaaatgagaaggaagatagttaacccacgtataatccttctggacagccctattgagtataagaagggagaaaatcagactaatgctgagttgatgaaggaagaagattggcaggttctgctggagatggaggaagagtacataaagaacctctgtgcacaaattcttaaatttaagcctgatttggtcatcacagagaaagggctcagtgatcttgctattcattatttgagcaaggctggtgttagtgcaattcgtagacttcgaaaaactgacaacaacagaattgctaaggcttgtggagcagttatagtgaacaggcctgaggagcttcaagaatctgatgtgggcacaggagctggcctcttcgaggtcaagaagataggcgatgaattctttgccttcatcgttgattgtaaagatccaaaggcatgcactgttctgttgaggggagcaagcaaggatgtcttgaatgaagttgagaggaacctgcaggatgccatgtctgttgcgaggaacattttgaagaacccaaaactcctacctggaggtggtgctactgaattgactgtatcggcagcactgaagcaaaagagttcttcagttgaaggtgttgaaaagtggccctatgaagctgctgctttggcatttgaagcaattccgagaacattggcccaaaattgtggtttgaatattattaggacaatgactcaactccaaggaaagcatgctaatggtgaaaatgcctgggttggccttgatggaagaagtggtgaaattgttgacatgaaagagcgaaagatctgggactcctacagtgtcaaagcacagacgttcaagacagctattgaggctgcttgcatgctgttgagaatcgatgacattgtcagcggtatcaagaagaagcaggctcctggagcctcagctcccaagcagccccagattgaaacggaaggtgatgcggacaatgagcagatgatcccagagtagatgttttagcgaacccacactggcgaagttgtttactcaggccaggatagcacgttgagccaagtttattatttgagtgtttgttggtggctgggcctggcatgcaaatgtacctgatttcatacagttgagagtggttcgtgggttttgggatccaggttttgaagtgtggctgctgttcatcttgttttggacttagctggacgactatcaagcagcgaaactagtagtttttgtggctaactgtgtctgttgtaatgacacatgctttggtttggtaatgctatcgtttcccatgctggtaactctgatcattacagcttcgggtaacttga

SEQ ID NO: 2499 - DNA, 2221 bp, Oryza sativa
cccacaaaaccaaacaaacaaaccctcgtcgagctcgatcccccgcggcgcctcacccccttcctctcccttgccgcctctcgcccccactccgccgccgccgccgcctcgcctcccgcgggatcgcgccatggcattgaacgcccccgtcctcgtgctgaaggactcgctgaagcgggagtccggcacgaaggttcaccatgccaacatccaggccgccaaggctgtggcagacatcatccgtactacactcggtcctcggtccatgttgaagatgcttctggatgcttctggaggtattgtggttactaatgatggcaatgctatattgcgagaaatagatattgcacatcctgctgccaagtctatgattgagctaagccgtacacaggatgaagaagttggtgatggcacaacatctgtcattgttttagctggtgagatgctccatgttgcagaagcattcattgataagcactaccacccaactgttatttgccgagcatacaccaaagctcttgaggatgctttagctgtccttgacaaaattgcaatgcatgttgacgtgaatgaccgtgctgctatgctagggctagtgaagagctctattggtacaaaattcacgggtcagtttggtgaccttattgctgaccttgctattgatgctactacaacagcaggtgttgacctaggtcaaggtatgcgtgaagttgatatcaagaaatatatcaaagtggagaaggttcctggtggtcagttagaggattcacgggttcttaaaggagttatgttcaataaagatgttgtagctcctggaaaaatgagaaggaagatagtcaacccccgcattatccttctggattgccctgttgagtacaagaaaggagaaaaccagaccaatgctgaactgatgaaggaagaagattggcaggttctgctagagatggaggaagaatacataaagaacctctgtgcgcagattttaaaattcaagcctgatttagttgtcacagagaaaggtctcagtgatcttgctatccattacctaagcaaggctggtgttagtgcaattcgtaggctaaggaagactgataacaacaggattgctaaggcttgtggagcagtcatagtgaacaggccagaggagcttcaagaatcggatgttggaacaagagctggcctctttgaggtcaagaagataggtgatgaattctttaccttcattgtcgactgcaaagatcccaaggcatgcactgttcttttgaggggagcaagcaaggatgtcctgaatgaggttgagaggaaccttcaggatgccatgtctgttgcaaggaacattttgaaaaacccaaaacttttacctggaggtggtgctaccgagctgactgtatcagcagcactgaagcaaaagagttcttcagttgaaggtgtagaaaagtggccctatgaagctgctgctttagcatttgaagcaattccaagaactttggctcaaaattgtgggttgaatgtcatcaggataatgacacaactccagggaaagcatgcaaatggtgaaaatgcgtgggttggcattgacggaaggagcggtgacattgttgacatgaaagagcggaagatctgggattcttacagtgtcaaggcacaaacgttcaagacagctatcgaggcagcttgcatgcttcttaggatcgacgacatcgtcagcggtatcaagaagaagcaggctcctggagcctcagctcctaaacagcctcagatcgaacaggagggtgacgcggacaatgagcagatgatcccagagtagaacttgtgtgctgttggtgtgaggagcctgcactggcgatgttatgctctaaagccagagtaagcccatgaagggagaacggctagtttgacatgtgaagcttttgcgagttgtgtttcttgaatgtttgttcttggctaagcctccagggttttttctggttttagtttgaaaatgtgccgcttttatatgtttgatttaggggcacgatgaggtttctcgttctgtgtattgtatcagcattttgggatcccacgttctgcggggttagctgctgttcgttttattaatgtacctcgtactggacggctaccggaactttgattaagcagcaacactagtattagctttatgacttgcattccttaaatcggagaaagaaattcctgttagacttatgtttctgcttgatca

SEQ ID NO: 2500 - DNA, 2114 bp, Setaria italica
ggcgaggcgagggtttcacttgaacccaccaaaactgaaacaaaccctcgaaagctaggaagatcccgcggcgcagcaccctcctctcctctccactccccctcccgtcgccgcctcccccgtcgccgccgtcgcgagaccgccatggcgctgcacgcccccgtcctcgtgctgaaggactcgctgaagcgagagtcgggagcgaaggtgcaccaggcgaacatccaggctgccaaggctgtggcagacatcattcgcactacactgggtcccagatctatgttgaagatgcttcttgatgccggtggaggtatcgtggttactaatgacgggaatgctatattgagggaaatagacattgcacatcctgctgctaagtctatgattgaactaagccgtacacaagatgaggaaatggcacaacctctgtgattgttctagctggtgagatgctccatgttgctcaagcatttattgacaagaactatcatcctactgttatttgccgagcatacaccaaagcgcttgatgatgctatagctgttcttgacaagatagcaatgcctgtcgatgtgaatgatcgcgtgtcaatgctaggacttgtgaagagctccattggtacaaaattcactggccagtttggtgaccttattgctgaccttgctatcgatgctactacaacagcaggcgttgacctaggtcagggcatgcgtgaagttgatatcaagaagtatattaaagtagaaaaggttcctggtggtcagttagaggattctagggtcctcaaaggagttatgatcaataaggatgttgtggctcctggtaaaatgagaaggaagatagttaacccacgtataatccttctggacagccctattgagtataagaagggagaaaatcagactaatgctgagttgatgaaggaagaagattggcaggttctgctggagatggaggaagagtacataaagaacctctgtgcacaaattcttaaatttaagcctgatttggtcatcacagagaaagggctcagtgatcttgctattcattatttgagcaaggctggtgttagtgcaattcgtagacttcgaaaaactgacaacaacagaattgctaaggcttgtggagcagttatagtgaacaggcctgaggagcttcaagaatctgatgtgggcacaggagctggcctcttcgaggtcaagaagataggcgatgaattctttgccttcatcgttgattgtaaagatccaaaggcatgcactgttctgttgaggggagcaagcaaggatgtcttgaatgaagttgagaggaacctgcaggatgccatgtctgttgcgaggaacattttgaagaacccaaaactcctacctggaggtggtgctactgaattgactgtatcggcagcactgaagcaaaagagttcttcagttgaaggtgttgaaaagtggccctatgaagctgctgctttggcatttgaagcaattccgagaacattggcccaaaattgtggtttgaatattattaggacaatgactcaactccaaggaaagcatgctaatggtgaaaatgcctgggttggccttgatggaagaagtggtgaaattgttgacatgaaagagcgaaagatctgggactcctacagtgtcaaagcacagacgttcaagacagctattgaggctgcttgcatgctgttgagaatcgatgacattgtcagcggtatcaagaagaagcaggctcctggagcctcagctcccaagcagccccagattgaaacggaaggtgatgcggacaatgagcagatgatcccagagtagatgttttagcgaacccacactggcgaagttgtttactcaggccaggatagcacgttgagccaagtttattatttgagtgtttgttggtggctgggcctggcatgcaaatgtacctgatttcatacagttgagagtggttcgtgggttttgggatccaggttttgaagtgtggctgctgttcatcttgttttggacttagctggacgactatcaagcagcgaaactagtagtttttgtggctaactgtgtctgttgtaatgacacatgctttggtttggtaatgctatcgtttcccatgct

SEQ ID NO: 2501 - DNA, 2159 bp, Brachypodium distachyon
aaaacccaaaccgagaacaaaccctcgacctcgaaagatcgcgcggcccagcagcagccgccctctccagctctcctttcctcccccttcctttcccctcgccgccgcctcgcccactcgtctctctctagatcgccatggcattgcacgcccccgtactcgtgctcaaggactcattgaagagggaatccggcgccaaggttcaccatgccaacattcaggccgcaaaggccgtggcagatatcattcgcactactttgggtcctaggtcaatgttgaagatgcttctggatgctagtggaggtattgtggtcactaatgatggcaatgctatattgcgggaaatagacattgctcatcctgctgccaagtctatgattgagctaagccgcacacaagatgaagaagtgggtgatggcacaacatctgtcattgttctagctggtgagatgctccatgttgcagaagcgtttattgaaaagaactaccacccaactgttatttgccgagcctacaccaaagctctcgaggatgctttagctgtccttgacaaaattgcgatgcctgttgatgtgaatgaccgcggggcaatgctagggctggtgaagagttccattggtacaaaattcactggtcagttcggtgaccttattgctgaccttgctatagatgctactacaacagcaggtgttgacctaggtcaaggcatgcgtgaagtcgatatcaagaaatacatcaaagtagagaagattcctggtggccagttggaggattcaagggttcttaaaggagtcatgttcaataaagatgttgtggctcctggaaaaatgaaaaggaagatagttaatccgcgtatcattcttctggattgccctgttgagtacaagaaaggagaaaatcagacaaatgctgagttgatgaaggaagaagattggcaggttctgctagagctggaggaagaatacataaagaacctctgtgcgcaaattttaaaattcaagcctgatttggttgtcacagagaaaggtctcagtgatcttgctatccattatttaagcaaggccggtgttagtgcgatccgtcgacttaggaagactgacaacaacaggattgctaaggcttgtggtgcagttatagtgaacagaccagaggagcttcaagaatcagatgtgggaacacgggctggcctctttgaggtcaagaagattggtgatgaattcttttccttcattgtcgactgcaaagatcctaaggcatgcactgttttgttgaggggagcaagcaaggacgtcttgaacgaggtggagaggaaccttcaggatgccatgtctgttgcaaggaacattttgaaaaacccaaaacttctacctggaggtggtggtactgaattgactgtatcagcaacactgaagcaaaagagttcttcagttgaaggcgtggaaaagtggccgtacgaagctgctgcgttagcatttgaagcaatcccaagaactttgcttcaaaattgtggtttgaatgttattaggacaatgacacaactccagggaaagcatgcgaatggtgaaaacgcctgggttggcattgatggaaggagtggtgatattgtggacatgaaagagcggaagatctgggattcttacagtgtgaaggcacagacgttcaagacagctattgaggcagcttgcatgcttctacggattgacgacattgtcagtggtatcaagaagaagcaggctcctggagccggtgctcctaagcaacctcagatcgaacaggagggtgatgcagacactgaacaaatgatcccagagtagaactactatgctgttggagcgagcctgcacggtgtacgaaagccagagtagtgccaatggagcagaatgttttagtaacatgtgaattgatgtcgcctggttgcatctcttgaatgtttgttcgtggccaggccagctggattgcctagtattagcatgggtttgtagcttttctatatgttcggatgtggggcatgagtctgtgtattgtatcagcattttgggatccgaggttttgcaggattggctgctgttagttttgttttcgaacatcagaatttcgattaagctgaactttatgagttacgactagcttatacgctgacaaatactccgtatcatcca

SEQ ID NO: 2502 - DNA, 2899 bp, Brachypodium distachyon
gttgcgaccagggtttcgcttcaaaacccaaaccgagaacaaaccctcgacctcgaaagatcgcgcggcccagcagcagccgccctctccagctctcctttcctcccccttcctttcccctcgccgccgcctcgcccactcgtctctctctagatcgccatggcattgcacgcccccgtactcgtgctcaaggactcattgaagagggaatccggcgccaaggttcaccatgccaacattcaggccgcaaaggccgtggcagatatcattcgcactactttgggtcctaggtcaatgttgaagatgcttctggatgctagtggaggtattgtggtcactaatgatggcaatgctatattgcgggaaatagacattgctcatcctgctgccaagtctatgattgagctaagccgcacacaagatgaagaagtgggtgatggcacaacatctgtcattgttctagctggtgagatgctccatgttgcagaagcgtttattgaaaagaactaccacccaactgttatttgccgagcctacaccaaagctctcgaggatgctttagctgtccttgacaaaattgcgatgcctgttgatgtgaatgaccgcggggcaatgctagggctggtgaagagttccattggtacaaaattcactggtcagttcggtgaccttattgctgaccttgctatagatgctactacaacagcaggtgttgacctaggtcaaggcatgcgtgaagtcgatatcaagaaatacatcaaagtagagaagattcctggtggccagttggaggattcaagggttcttaaaggagtcatgttcaataaagatgttgtggctcctggaaaaatgaaaaggaagatagttaatccgcgtatcattcttctggattgccctgttgagtacaagaaaggagaaaatcagacaaatgctgagttgatgaaggaagaagattggcaggttctgctagagctggaggaagaatacataaagaacctctgtgcgcaaattttaaaattcaagcctgatttggttgtcacagagaaaggtctcagtgatcttgctatccattatttaagcaaggccggtgttagtgcgatccgtcgacttaggaagactgacaacaacaggattgctaaggcttgtggtgcagttatagtgaacagaccagaggagcttcaagaatcagatgtgggaacacgggctggcctctttgaggtcaagaagattggtgatgaattcttttccttcattgtcgactgcaaagatcctaaggcatgcactgttttgttgaggggagcaagcaaggacgtcttgaacgaggtggagaggaaccttcaggatgccatgtctgttgcaaggaacattttgaaaaacccaaaacttctacctggaggtggtggtactgaattgactgtatcagcaacactgaagcaaaagagttcttcagttgaaggcgtggaaaagtggccgtacgaagctgctgcgttagcatttgaagcaatcccaagaactttgcttcaaaattgtggtttgaatgttattaggacaatgacacaactccagggaaagcatgcgaatggtgaaaacgcctgggttggcattgatggaaggagtggtgatattgtggacatgaaagagcggaagatctgggattcttacagtgtgaaggcacagacgttcaagacagctattgaggcagcttgcatgcttctacggattgacgacattgtcagtggtatcaagaagaagcaggctcctggagccggtgctcctaagcaacctcagatcgaacaggagggtgatgcagacactgaacaaatgatcccagagtagaactactatgctgttggagcgagcctgcacggtgtacgaaagccagagtagtgccaatggagcagaatgttttagtaacatgtgaattgatgtcgcctggttgcatctcttgaatgtttgttcgtggccaggccagctggattgcctagtattagcatgggtttgtagcttttctatatgttcggatgtggggcatgagtctgtgtattgtatcagcattttgggatccgaggttttgcaggattggctgctgttagttttgttttcgaacatcagaatttcgattaagctgaactttatgagttacgactagcttatacgctgacaaatactccgtatcatccattcacttagccagaccatttctaagtgccgatccaggctggagctggaagaagctattttcttgctgaagctgaaaggctggagctaaatctgacttgctgttcgtttagtgtagcagtgaaattatggatgcagctggatgggaatggaatgtttgaaatgcccatgtttgtagcgatatttgatcaagcattgagttcgatgttggtagtgcaaatgatgagtttaagaaatattttgagcgttaaatacgtaatttgataggattcatctaaaatcgtttgtttggctagatttagaataacttgcttgatttcatatattatttaagcttgacaatgagtcaatgaattcatgtccctggtcatggcatgtaagagcaaacaatgaacatggatacaaacatacaaacacatctgcactggacattcaaccaataaaaaactaataaaatctcctgcaaactatgctatttccttcgtatctcctctagcagaggatgcacaatggagaccaggatctatcacatctccttcaaaattctcctgaacaattgcatgaactgaagatctccctgtctagaatgagaaggggagaggtggtcgacggggaggcgggccggtggcgcggtcacgtggacgacggggaggcgggccggcggcgctcggggagaggagggacgcgggccgccggtcggggagacgagaggcgcggggcg

SEQ ID NO: 2503 - DNA, 2069 bp, Brachypodium distachyon
gaaagatcgcgcggctcagcagcagagccctctccagctctcctttcctcccccttcctttcccctcgccgccgcctcgcccactcgtctctctctagatcgccatggcattgcacgcccccgtactcgtgctcaaggactcattgaagagggaatccggcgccaaggttcaccatgccaacattcgggccgcaaaggccgtggcagatatcattcgcactactttgggtcctaggtcaatgttgaagatgcttctggatgctagtggaggtattgtggtcactaatgatggcaatgctatattgcgggaaatagacagtgctcatcctgctgccaagtctatgattgagctaagccgcactcaagatgaagaagtaggtgatggcacaacatctgtcattgttctagctggtgagatgctccatgttgcagaagcgtttattgaaaagaactaccacccaactgttatttgacgagcctacaccaaagctctcgaggatgctttagctgtccttgacaaaattgcgatgcctgttgatgtgaatgaccgcggggcaatgctagggctggtgaagagttccattggtacaaaattcactggtcagttcggtgaccttattgctgaccttgctatagatgctactacaacagcaggtgttgacctaggtcaaggcatgtgtgaagtcgatatcaagaaatacatcaaagtagagaagattcctggtggccagttggaggattcaagggttcttaaaggagtcatgttcaataaagatgttgtggctcctggaaaaatgaaaaggaagatagttaatccgcgtatcattcttctggattgccctgttgagtacaagaaaggagaaaatcagacaaatgctgagttgatgaaggaagaagattggcaggttctgctagagctggaggaagaatacataaagaacctctgtgcgcaaattttaaaattcaagcctgatttggttgtcacagagaaaggtctcagtgatcttgctatccattatttaagcaaggcgggtgttagtgcgatccgtcgacttcggaagactgacaacaacaggattgctaaggcttgtggtgcagttatagtgaacagaccagaggagcttcaagaatcagatgtgggaacacgggctggcctctttgaggtcaagaagattggtgatgaattcttttccttcattgtcgactgcaaagatcctaaggcatgcactgttttgttgaggggagcaagcaaggacgtcttgaacgaggtggagaggaaccttcaggatgccatgtctgttgcaaggaacattctgaaaaacccaaaacttctacctggaggtggtggtactgaattgactgtatcagcaacactgaagcaaaagagttcttcagttgaaggcgtggaaaagtggccgtacgaagctgctgcgttagcatttgaagcaatcccaagaactttgcttcaaaattgtggtttgaatgttattaggacaatgacacaactccagggaaagcatgcgaatggtgaaaacgcctgggttggcattgatggaagttgtggtgatattgtggacatgaaagagcggaagatctgggtttcttacagtgtgaaggcacagacgttcaagacagctattgaggcagcttgcatgcttctacggattgatgacattgtcagtggtatcaagaagaagcaggctcctggagctggtgctcctaagcaacctcagatcgaacaggagggtgatgcagacactgaacaaatgttcccagagtagaactactatgctgttggagcgagcctgcacggtgaactaaagccagagtagtgccaatgcagcagaatgttttagtaacatgtgaattgatgtcgcctggttgcatctcttgaatgtttgttcgtggccaggccagctggattgtctagtattagcatgggtttgtagcttttctgtatgttcggatgaggggcatgagtctgtgtattgtatcagcattttgggatccgaggttttgcaggattggctgctgttcgttttgttttcgaacatcagaatttcgattaa

SEQ ID NO: 2504 - DNA, 2007 bp, Brachypodium distachyon
atcgccatggcattgcacgcccccgtactcgtgctcaaggactcattgaagagggaatccggcgccaaggttcaccatgccaacattcgggccgcaaaggccgtggcagatatcattcgcactactttgggtcctaggtcaatgttgaagatgcttctggatgctagtggaggtattgtggtcactaatgatggcaatgctatattgcgggaaatagacagtgctcatcctgctgccaagtctatgattgagctaagccgcactcaagatgaagaagtaggtgatggcacaacatctgtcattgttctagctggtgagatgctccatgttgcagaagcgtttattgaaaagaactaccacccaactgttatttgacgagcctacaccaaagctctcgaggatgctttagctgtccttgacaaaattgcgatgcctgttgatgtgaatgaccgcggggcaatgctagggctggtgaagagttccattggtacaaaattcactggtcagttcggtgaccttattgctgaccttgctatagatgctactacaacagcaggtgttgacctaggtcaaggcatgtgtgaagtcgatatcaagaaatacatcaaagtagagaagattcctggtggccagttggaggattcaagggttcttaaaggagtcatgttcaataaagatgttgtggctcctggaaaaatgaaaaggaagatagttaatccgcgtatcattcttctggattgccctgttgagtacaagaaaggagaaaatcagacaaatgctgagttgatgaaggaagaagattggcaggttctgctagagctggaggaagaatacataaagaacctctgtgcgcaaattttaaaattcaagcctgatttggttgtcacagagaaaggtctcagtgatcttgctatccattatttaagcaaggcgggtgttagtgcgatccgtcgacttcggaagactgacaacaacaggattgctaaggcttgtggtgcagttatagtgaacagaccagaggagcttcaagaatcagatgtgggaacacgggctggcctctttgaggtcaagaagattggtgatgaattcttttccttcattgtcgactgcaaagatcctaaggcatgcactgttttgttgaggggagcaagcaaggacgtcttgaacgaggtggagaggaaccttcaggatgccatgtctgttgcaaggaacattctgaaaaacccaaaacttctacctggaggtggtggtactgaattgactgtatcagcaacactgaagcaaaagagttcttcagttgaaggcgtggaaaagtggccgtacgaagctgctgcgttagcatttgaagcaatcccaagaactttgcttcaaaattgtggtttgaatgttattaggacaatgacacaactccagggaaagcatgcgaatggtgaaaacgcctgggttggcattgatggaagttgtggtgatattgtggacatgaaagagcggaagatctgggtttcttacagtgtgaaggcacagacgttcaagacagctattgaggcagcttgcatgcttctacggattgatgacattgtcagtggtatcaagaagaagcaggctcctggagctggtgctcctaagcaacctcagatcgaacaggagggtgatgcagacactgaacaaatgttcccagagtagaactactatgctgttggagcgagcctgcacggtgaactaaagccagagtagtgccaatgcagcagaatgttttagtaacatgtgaattgatgtcgcctggttgcatctcttgaatgtttgttcgtggccaggccagctggattgtctagtattagcatgggtttgtagcttttctgtatgttcggatgaggggcatgagtctgtgtattgtatcagcattttgggatccgaggttttgcaggattggctgctgttcgttttgttttcgaacatcagaatttcgattaagctgaactttatgagttacgactagcttatacgcag

SEQ ID NO: 2505 - DNA, 2235 bp, Avena sativa
acttcaaagcccaaaactgaacaaaccctcgagctcgcaagatcgcgcggcgcagcagcagccgacttctctcttctttcctctcccctccccctcgccgccgcctcccccacccgtctcgtctctcgctagcgccatggcattacacgcccccgtcctcgtgctgaaggactcgttgaagagggaatccggcgcgaaggttcaccatgccaacatccaggccgcgaaggctgtggcagacatcattcgcactacattgggtcctaggtccatgttgaagatgctcctggatgccagtggaggtattgtggttactaatgatggcaatgctatattgcgggaaatagacattgcacatcctgctgctaagtctatgattgagctgagccgcacacaggatgaagaagtgggggatggcacaacgtccgtcattgttcttgctggtgagatgctccatgttgcagaaacgtttattgaaaagaactaccaccccactgtaatttgccgagcgtacacaagagctctggaggatgctctagctgtccttgacaaaattgcaatgcctgttgatgtgaatgaccgtgttgcaatgctagggctggtgaagagctctattggtacaaaattcactggtcagtttggtgacctaattgctgaccttgctatagatgctactacaacagcaggtgttgacctaggtcaaggaatgcgtgaagttgatatcaagaaatatatcaaagtagagaagattcctggtggccagttggaggattcaaaggttcttaaaggagtcatgttcaataaagatgttgtggctcctggaaagatgagaaggaagatagtaaacccacgtatcatccttttggattgccctgttgagtacaagaaaggagaaaatcagacaaatgccgagttgatgaaggaagaagattggcagcttctcctagagttggaggaagaatacataaagaatctctgtgcgcaaattttgaaattcaagcctgacttggttgtcacagagaaaggtctcagtgaccttgctattcattatttaagcaaggctggtgttagtgcaatccgtagacttaggaagactgataacaacaggattgctaaggcttgtggcgcagttatagtgaacaggccagaggagcttcaagaatcggatgtgggaacacgagctggtctctttgaggttaagaagattggtgatgaattcttctccttcattattgactgccaagatcctaaagcatgcactgttctattgaggggagcaagcaaagacgtcttgaacgaagtggagagaaaccttcaggacgccatgtctgttgcaaggaacattttgaaaaacccaaaacttctacctggaggtggtgcttctgaattgactgtatcggcaactctaaagcaaaagagttcctcagttgaaggtgtagaaaagtggccttatgaagctgctgccttagcattcgaagcaatcccaagaactttacttcaaaattgtggtttgaatgttattaggacgatgacacaactccagggaaagcatgcgaatggtgaaaatccctgggttggcattgatggaaggactggtgatattgttgacatgaaagagcggaagatctgggattcttacagcgtaaaagcacagacgttcaagacagctattgagtcagcttgcatgcttctaaggattgacgacattgtcagtggaatcaagaagaagcaggctcctggaggcggtgctcccaagcaacctcagattgaaacagaaggcgatgcagacactgaacagatgatcccagagtagagctatttctgcttttggagtgggcctgcaatttcgatattgtgtactaaagccagaaaagcgcccgaggagcaggatgtttattagcacgtgaaatcactgtcgcctggttgcatttcttgaatgtttgttcctgtccaggcctccagggtggtcggtctagtattagcttgaattgtagcattttcatatgttcggataatgggtatgtgagtttcagttgtgtgcactgtatcagcgttttgggatctgaggttttgcaaggctggttgctgttcgttttgtttttggagatcgattgaacagctcaccgagtttggattgaacagctgactgaagtttttctttccccgtgattttgtaaacctctgttaaatctgaaaatttcaaggagaaagtttactttaatactcccaaaaaaa

SEQ ID NO: 2506 - DNA, 2225 bp, Avena sativa
acttcaaagcccaaaactgaacaaaccctcgagctcgcaagatcgcgcggcgcagcagcagccgacttctctcttctttcctctcccctccccctcgccgccgcctcccccacccgtctcgtctctcgctagcgccatggcattacacgcccccgtcctcgtgctgaaggactcgttgaagagggaatccggcgcgaaggttcaccatgccaacatccaggccgcgaaggctgtggcagacatcattcgcactacattgggtcctaggtccatgttgaagatgctcctggatgccagtggaggtattgtggttactaatgatggcaatgctatattgcgggaaatagacattgcacatcctgctgctaagtctatgattgagctgagccgcacacaggatgaagaagtgggggatggcacaacgtccgtcattgttcttgctggtgagatgctccatgttgcagaaacgtttattgaaaagaactaccaccccactgtaatttgccgagcgtacacaagagctctggaggatgctctagctgtccttgacaaaattgcaatgcctgttgatgtgaatgaccgtgttgcaatgctagggctggtgaagagctctattggtacaaaattcactggtcagtttggtgacctaattgctgaccttgctatagatgctactacaacagcaggtgttgacctaggtcaaggaatgcgtgaagttgatatcaagaaatatatcaaagtagagaagattcctggtggccagttggaggattcaaaggttcttaaaggagtcatgttcaataaagatgttgtggctcctggaaagatgagaaggaagatagtaaacccacgtatcatccttttggattgccctgttgagtacaagaaaggagaaaatcagacaaatgccgagttgatgaaggaagaagattggcagcttctcctagagttggaggaagaatacataaagaatctctgtgcgcaaattttgaaattcaagcctgacttggttgtcacagagaaaggtctcagtgaccttgctattcattatttaagcaaggctggtgttagtgcaatccgtagacttaggaagactgataacaacaggattgctaaggcttgtggcgcagttatagtgaacaggccagaggagcttcaagaatcggatgtgggaacacgagctggtctctttgaggttaagaagattggtgatgaattcttctccttcattattgactgccaagatcctaaagcatgcactgttctattgaggggagcaagcaaagacgtcttgaacgaagtggagagaaaccttcaggacgccatgtctgttgcaaggaacattttgaaaaacccaaaacttctacctggaggtggtgcttctgaattgactgtatcggcaactctaaagcaaaagagttcctcagttgaaggtgtagaaaagtggccttatgaagctgctgccttagcattcgaagcaatcccaagaactttacttcaaaattgtggtttgaatgttattaggacgatgacacaactccagggaaagcatgcgaatggtgaaaatccctgggttggcattgatggaaggactggtgatattgttgacatgaaagagcggaagatctgggattcttacagcgtaaaagcacagacgttcaagacagctattgagtcagcatgcatgcttctaaggattgacgacattgtcagtggaatcaagaagcagcaggctcctggaggcggtgctcccaagcaacctcagattgaaacagaaggcgatgcagacactgaacagatgatcccagagtagagctatttctgcttttggagtgggcctgcaatttcgatattgtgtactaaagccagaaaagcgcccgaggagcaggatgtttattagcacgtgaaatcactgtcgcctggttgcatttcttgaatgtttgttcctgtccaggcctccagggtggtcggtctagtattagcttgaattgtagcattttcatatgttcggataatgggtatgtgggtttcagttgtgtgcactgtatcagcgttttgggatctgaggttttgcaaggctggttgctgttcgttttgtttttggagatcgattgaacagctcaccgagtttggattgaacagctgactgtagtttttctttccccgtgattttgtaaacctctgttaaatctgaaaatttcaaggagaaagtttactttaatact

SEQ ID NO: 2507 - DNA, 2015 bp, Oryza sativa
gtttgcgcgaaccaacccccgccgccgccaccgccaccgccgccgccgccgcatcctcctcctcgcgcctctcgctatccatggcattgcacgcgccggtgctcgtgctcaaggattctttgaagcgggagtctggcaccaaggtgcatcatgccaacatccaggcagccaaggctgtggcggatatcatacgcacaacattgggccctcagtcaatgttgaagatgcttcttgatgctgcaggaggtattgttgtaactaatgatggcaattgtatattgcgggagctagaccttgcacacccagctgcaaagtctatgattgagctaagccgcacacaggatgaagaagtaggagatggcacgacatctgttattgttcttgctggtgaaatgctccatgttgcgcaagcattcatcgacaagaactaccatcccaccgttatttgtagagcatacaccaaagctcttgacgatgctctatctgttcttgataagattgctattcctgttgacgtggacgaccgtgttgcaatgcttggtctggtgaagagttccatcggtacaaaatttactggtcagtttggtgaccttattgcggatcttgctatcgatgctaccacaacagctggtgttgacctgggtcaaggcattcgtgaagttgatatcaagaagtacatcaaagtagagaaggttcctggaggccagctggaagattccaaggttcttaaaggagttatgatcaataaagatgttgttgctcctgggaaaatgagaagaaaaatagttaacccacgcatcattctcctggattgccctcttgaatacaagaaaggagaaaaccagaccaatgctgagttgatgaaagaagaagattggcaggtgatgctacagatggaagaggaatatatagagaacctgtgtgcacagattctgaaattcaagcctgatttggttataacagagaaagggttgagtgacctagcagtccattatttaggaaaggctggtgtaagtgcaattcgaaggctcaggaagacggacaacaacaggatcgcaaaggcttgtggagcagttatagtgaataggccagaggaacttcaagaatctgatgtaggaacaggagctggcctctttgaggtcaagaagtttggtgatgagttctttgccttcattgttgactgcaaagatcccaaagcatgtactgttttgttgaggggagcaagcaaggatgtcttgaatgaggttgagaggaacttgcaggatgctatgtctatggcaaggaacatttggaaaaaccctaaactgctacctggaggtggtgctactgaattaactgtatctgcaacattgaaacaaaagagttcttcagttgaaggtgtagagaagtggccctatgaagctgccgcattagcatttgaggcaattccaagaactcttttacagaattgtggcctgaacgttattaggacaatgacacaacttcagggaaagcatgcaaatggtgaaaatgcttgggttggcattgatggaagcagtggtgatattgtggatatgaaagagcggaagatctgggactcgtacagtgtcaaggcgcagacattcaagacagctattgaggctgcctgcatgctcctgaggatcgatgatattgtcagtggcatcaagaagaagcaagctcctggagccagttcagctccaaagcaacctcaaatagaacaagagggtgatgcagacaatgaacagatgatcccagagtagaatgtcacatgaatgcatcaatcacacttaacctaacatataaatcagtctgttgaaattctttaaatttttgtggtagcctttataatcatttcccaacacaacttttgtatctgtcagtttgtatggctgttagccatccatgtttatgttggtcacatagttgagtactcaatgagtttgcttctaattattattttctgtgttctaacacggtttgtgtttcaattgaaatttttacggctcttaattctc

SEQ ID NO: 2508 - DNA, 2130 bp, Triticum aestivum
cgccttcccattctcatctccctcccacccctcgccgccgcctccccgtcgtctcgcctctcgccagatcgccatggcattgcacgcccccgtcctcgtgctgaaggactctttgaagagggaatccggcgccaaggttcagcatggcaacatccaggccgcgaaggctgtgtcagacatcatccgcactacgctcggtcccaggtccatgttgaagatgcttctggatgccagtggaggtattgtggttaccaacgatggcaatgctatactgcgggaattagacattgcacatcctgctgctaagtctatgattgagctaagccgcacacaggatgaagaagtgggagatgggacaacgtccgtcattgttctagctggtgagatgctgcatgttgcagaaacatttattgaaaagaactaccatcccactgtcatttgccgagcatacagcagagctcttgaggatgccatagctgtccttgacaaaattgcaatgcctgttgatgttaatgaccgtgaggcgatgctagggctggtgaagagctccattggtacaaaattcactggccagtttggtgacctaattgctgaccttgccatagatgctaccacaacagcaggtgtagacctgggtcaaggaatgcgtgaagtcgatatcaagaaatatatcaaagtagagaagattcctggcggccagttggaggattcaaaggttcttaaaggggtcatgttcaataaagatgttgtggctcctggaaaaatgagaaggaagatagtaaatccacgcatcatccttttggattgccctgttgagtacaaaaagggagaaaatcagacaaatgctgagttgatgagtgaagaagattggaaggttctgctagatatggaggaagaatacataaagaacctctgtgtgcaaattttgaaattcaagcctgacctggttatcacagagaaaggactcagtgacatggctatgcattatttaagcaaggctggcgttagtgcaatccgtaggcttaggaagacagataacaacaggattgctaaagcctgtggtgcagttatagtgaacaggccagaggagcttcaagaatcagatgtgggaacacgagctggtctctttgaggttaagaagatcggtgatgaattcttttccttcattattgaatgcaaagatcctaaagcatgcactgttctattgaggggagcaagcaaggacatcttgaacgaggtggagaggaaccttcaggatgccatgtctgttgcaaggaacattttgaaaaacccaaaacttctacctggaggtggtgcttctgaattgactgtatcggcaacactaaagcaaaagagttcttcagttgaaggtgtagaaaagtggccttatgaagctgctgctttagcattcgaagcaatcccaagaactttgcttcaaaattgtggtttgaatgttatcaggacgatgacacagctccagggaaagcatgcgaacggtgaaaatccttgggttggcgttgatggaaggactggtgatattgttgacatgaaagagcggaagatctgggattcttacagcgtgaaggcacagaccttcaagacagctatcgagtcagcttgcatgcttctaaggattgacgacattgtcagtggaatcaagaagaagcaggctcctggctctggtgctcccaagcaaccccagattgaaacgggtgaagatgcagacactgaacagatgatcccggagtagaactattgtgctgttggagtgagcaagcaccggcgatgttgtgtgccaaagctagaaaaaagtgcccgcggagcagaatgttttattaacacgtgaaatggcgtcgcctggttgcatttcttgaatgtttgatggtggccgggccttcagggtcgtctagtattagtttggattgtagctttttcctatgttcggatggtgagcggtatgcgggtttcagttgtgtatttgtatcagcgttttgggatctgactgttgcatggatggttgctgttcggttttgtttttggactttgtactgaacggatatcagaacttgaatttaacagcaaaactagctttgtgacgacgccagttttgttttattattatagaaagac

SEQ ID NO: 2509 - DNA, 2249 bp, Triticum aestivum
ccacgcgtccgctaggtcacgcatcgctcaggcgcacgctggtcgcgacgagggtttcacttgaaagcccaaaccgagcaaaccgtcaagctcgaaagatcgcgcggcgcagcagcatccgccttccattctcctctccctcctcccacctcgccgccgcctccccgtggtcttgtctctcgccagatcgccatggcattgcacgcccccgtcctcgtgctgaaggactcgttgaagagggaatccggcgccaaggttcagcatggcaacatccaggccgcgaaggctgtgtcagacatcattcgcacaacgttgggtcctaggtccatgttgaagatgcttctggatgccagtggaggtatcgtggtcactaatgacggcaatgctatattacgggagctagacattgcacatcctgctgctaagtctatgattgagctaagccgcacacaggatgaagaagtgggagatgggacaacatctgtaattgttctagctggtgagatgctccatgttgcagaaacatttattgaaaagaactaccatcccactgtcatttgccgagcatacagcagagctcttgaggatgccatagctgtccttgacaaaattgcaatgcctgttgatgttaatgaccgcgaggcaatgctagggttggtgaagagctccattggtacaaaattcactggccagtttggcgacctaattgctgaccttgccatagatgctactacaacagcaggtgtagacctgggtcaaggaatgcgtgaagttgatatcaagaaatatatcaaagtagagaagattcctggcggccagttggaggactcaaaggttcttaaaggggtcatgttcaataaagatgttgtggctcctggaaaaatgaaaaggaagatagtaaatccacgcatcatccttttggattgccctgttgagtacaaaaagggggaaaatcagacaaatgccgagttgatgagtgaagaagattggaaggttctgctagatatggaggaagaatacatcaagaacctctgtgtgcaaattttgaaattcaagcctgacctggttatcacagagaaaggactcagtgacatggctatgcattatttaagcaaagctggtgttagtgcaatccgtagacttaggaagacagataacaacaggattgctaaagcctgtggtgcagttatagttaacaggccagaggagcttcaagaatcagatgtggggacacgagctggtctctttgaggttaagaagatcggtgatgaattcttttccttcattattgaatgcaaagatcctaaagcatgcactgttctattgaggggagcaagcaaggacatcttgaacgaggtggagaggaaccttcaggatgccatgtctgttgcaaggaacattttgaaaaacccgaaacttctacctggaggtggtgcttctgaattgactgtatcggcaacactaaagcaaaagagttcttcagttgaaggtgttgaaaagtggccttatgaagctgctgctttagcattcgaagcaatcccaagaactttgcttcaaaattgtggtttgaatgttattaggacgatgacacaactccagggaaagcatgcgaatggtgaaaatccttgggttggtgttgatggaaggactggtgatattgttgacatgaaagagcggaagatctgggattcttacagcgtgaaggcacagacgttcaagacagcaatcgagtctgcttgcatgcttctaaggattgacgacattgtcagtggaatcaagaagaagcaggctcctggctctggtgctcccaagcaaccccagattgaaacgggtgaagatgcggacactgaacagatgatcccggagtagaactacttgtgctgctggagtgagcctgcaccggcgatgttatctaccgaagctagaaaagtgcgcccgcggagcagaatgttttattaacacgtgaatggcgtcgcctggttgcatttcttgaatgtttgatggtggccaggcctccagggtcgtctagtattagtttggattgtagctttttcatatgttcttatgatgaggagtgtgcgggtttcagttgtgtatctgtatcagcgttttggaatctgactgttgcatggatggttgctgtccgtttttgtttttggactttgtactgaacggatatcagaacctgaatttaacagcaaaactagctttctgacgccgtcagttttgttttattattatagaaagac

SEQ ID NO: 2510 - DNA, 2202 bp, Secale cereale
gaaagcccaaaccgagcaaaccctcgagctcgaaagatcgcgcggcgcagcagcatccgccttcccattctcttctccctcctcccacctcgccgccgcctccccgtcgtctcgtctctcgccagatcgccatggcattgcacgcccccgtcctcgtgctgaaggactcgttgaagagggagtcgggcgcgaaggttcagcatggcaacatccaggccgcgaaggctgtgtcagacatcattcgcactacgctcggtcctaggtccatgttgaagatgcttctggatgccagtggaggtattgtggttactaacgatggcaatgctatattgcgggaactagacattgcacatcctgctgctaagtctatgattgagctaagtcgcacacaggatgaagaagtgggagatgggacaacgtctgtcattgttctagctggtgagatgctccatgttgcagaaacatttattgaaaagaactaccatcccaccgtcatttgcagagcatacagcagagctcttgaggatgcaatagctgtccttgacaaaattgcaatgcctgttgatgtcaatgaccgtgaggcgatgctagggctggtgaagagctccattggtacaaaattcactggccagtttggtgacctaattgctgaccttgccatagatgctactacaacagcaggcgtagacctgggtcaaggaatgcgtgaagttgatatcaagaaatatatcaaaatagagaagattcctggtggccagttggaggattcaaaggttcttaaaggggtcatgttcaataaagatgttgtggctcctggaaaaatgaaaaggaagatagtaaatccacgtatcatccttttggattgccctgttgagtacaaaaagggggagaatcagacaaatgctgagttgatgagtgaagaagattggaaggttctgctagatatggaggaagaatacataaagaacctctgtgtgcaaattttgaaattcaagcctgacctggttatcacagagaaaggactcagtgacatggctatgcactatttaagcaaggctggtgttagtgcaatccgtagacttaggaagacagataacaacaggattgctaaagcctgtggcgcagttatagttaacaggccagaggagcttcaagaatcagatgtggggacacgagctggtctctttgaggttaagaagatcggtgatgaattcttttccttcattattgaatgcaaagatcctaaagcatgcactgttctattgaggggagcaagcaaggacatcctgaacgaggtggagaggaaccttcaggatgccatgtctgttgcaaggaacattttgaaaaacccaaaacttctacctggaggtggtgcttctgaattgactgtatcagcaacactaaagcaaaagagttcttcagttgaaggtgtagaaaagtggccttatgaagctgctgctttagcattcgaagcaatcccaagaactttgcttcaaaattgtggtttgaatgttattaggacgatgacacagctccagggaaagcatgcgaacggtgaaaatccttgggttggcgttgatggaaggactggtgatattgttgacatgaaagagcggaagatctgggattcttacagcgtgaaggcacagaccttcaagacagctatcgagtcagcttgcatgcttctaaggattgacgatattgtcagtggaatcaagaagaagcaggctcctgggtctggtgctcccaagcaaccacagattgaaacgggagaagatgctgacactgagcagatgatcccggagtagaactatttgtgctgctggattgagcccgtaccggcgatgttatctaccgaagctagaacagtgcccctgcagagcagaatgttttatgaacacgtgaagtggcgtcgcctggttgcatttcttgaatgtttgatggtggccaggcctccagggtcgtctagtgttagttttggattgcactactagttttttcttatgttcggatgacgaggggtgtgtgtatttgtatcagcgttttggatctgactattgcatggatggttgctgttggtttttttgtttttggactttgtgctgagcggatatcagaacctggatttaacagcaaaactagctttgtgacgactttagttttttcttttatttaattaatatagcaagacgatgccagttt

SEQ ID NO: 2511 - DNA, 2201 bp, Secale cereale
gagggtttcacttgaaagcccaaaccgagcaaaccctcgagctcgaaagatcgcgcggcgcagcagcatccgccttcccattctcttctccctcctcccacctcgccgccgcctccccgtcgtctcgtctctcgccagatcgccatggcattgcacgcccccgtcctcgtgctgaaggactcgttgaagagggagtcgggcgcgaaggttcagcatggcaacatccaggcagcgaaggctgtgtcagacatcattcgcactacgctcggtcctaggtccatgttgaagatgcttctggatgccagtggaggtattgtggttactaacgatggcaatgctatattgcgggaactagacattgcacatcctgctgctaagtctatgattgagctaagtcgcacacaggatgaagaagtgggagatgggacaacatctgtcattgttctagctggtgagatgctccatgttgcagaaacatttattgaaaagaactaccatcccaccgtcatttgcagagcatacagcagagctcttgaggatgcaatagctgtccttgacaaaattgcaatgcctgttgatgtcaatgaccgtgaggcgatgctagggctggtgaagagctccattggtacaaaattcactggccagtttggtgacctaattgctgaccttgccatagatgctactacaacagcaggcgtagacctgggtcaaggaatgcgtgaagttgatatcaagaaatacatcaaaatagagaagattcctggtggccagttggaggattcaaaggttcttaaaggggtcatgttcaataaagatgttgtggctcctggaaaaatgaaaaggaagatagtaaatccacgtatcatccttttggattgccctgttgagtacaaaaagggggagaatcagacaaatgctgagttgatgagtgaagaagattggaaggttctgctagatatggaggaagaatacataaagaacctctgtgtgcaaattttgaaattcaagcctgacctggttatcacagagaaaggactcagtgacatggctatgcactatttaagcaaggctggtgttagtgcaatccgtagacttaggaagacagataacaacaggattgctaaagcctgtggcgcagttatagttaacaggccagaggagcttcaagaatcagatgtggggacacgagctggtctctttgaggttaagaagatcggtgatgaattcttttccttcattattgaatgcaaagatcctaaagcatgcactgttctattgaggggagcaagcaaggacatcctgaacgaggtggagaggaaccttcaggatgccatgtctgttgcaaggaacattttgaaaaacccaaaacttctacctggaggtggtgcttctgaattgactgtatcagcaacactaaagcaaaagagttcttcagttgaaggtgtagaaaagtggccttatgaagctgctgctttagcattcgaagcaatcccaagaactttgcttcaaaattgtggtttgaatgttattaggacgatgacacagctccagggaaagcatgcgaacggtgaaaatccttgggttggcgttgatggaaggactggtgatattgttgacatgaaagagcggaagatctgggattcttacagcgtgaaggcacagaccttcaagacagctatcgagtcagcgtgcatgcttctaaggattgacgacattgtcagtggaatcaagaagaagcaggctcctggctctggtgctcccaagcaaccccagattgaaacgggagaagatgctgacactgagcagatgatcccggagtagaactatttgtgctgctggagtgagcctgtaccggcgatgttatctaccgaagctagaacagtgcccccgcagagcagaatgttttatgaacacgtgaagtggcgtcgcctggttgcatttcttgaatgtttgatggtggccaggcctccagggtcgtctagtattagttttggattgcactactagctttttcttatgttcggatgacgaggggtgtgtgtatttgtatcagcgttttggatctgactattgcatggatggttgctgttggtttttttgtttttggactttgtgctgagcggatatcagaacctggatttaacagcaaaactagctttgtgacgactttagttttttcttttatttaattaatatagcaa

SEQ ID NO: 2512 - DNA, 2218 bp, Secale cereale
gagggtttcacttgaaagcccaaaccgagcaaaccctcgagctcgaaagatcgcgcggcgcagcagcatccgccttcccattctcttctccctcctcccacctcgccgccgcctccccgtcgtctcgtctctcgccagatcgccatggcattgcacgcccccgtcctcgtgctgaaggactcgttgaagagggagtccggcgcgaaggttcagcatggcaacatccaggccgcgaaggctgtgtcagacatcattcgcactacgctcggtcctaggtccatgttgaagatgcttctggatgccagtggaggtattgtggttactaacgatggcaatgctatattgcgggaactagacattgcacatcctgctgctaagtctatgattgagctaagtcgcacacaggatgaagaagtgggagatgggacaacgtctgtcattgttctagctggtgagatgctccatgttgcagaaacatttattgaaaagaactaccatcccaccgtcatttgcagagcatacagcagagctcttgaggatgcaatagctgtccttgacaaaattgcaatgcctgttgatgtcaatgaccgtgaggcgatgctagggctggtgaagagctccattggtacaaaattcactggccagtttggtgacctaattgctgaccttgccatagatgctactacaacagcaggcgtagacctgggtcaaggaatgcgtgaagttgatatcaagaaatacatcaaaatagagaagattcctggtggccagttggaggattcaaaggttcttaaaggggtcatgttcaataaagatgttgtggctcctggaaaaatgaaaaggaagatagtaaatccacgtatcatccttttggattgccctgttgagtacaaaaagggggagaatcagacaaatgctgagttgatgagtgaagaagattggaaggttctgctagatatggaggaagaatacataaagaacctctgtgtgcaaattttgaaattcaagcctgacctggttatcacagagaaaggactcagtgacatggctatgcactatttaagcaaggctggtgttagtgcaatccgtagacttaggaagacagataacaacaggattgctaaagcctgtggcgcagttatagttaacaggccagaggagcttcaagaatcagatgtggggacacgagctggtctctttgaggttaagaagatcggtgatgaattcttttccttcattattgaatgcaaagatcctaaagcatgcactgttctattgaggggagcaagcaaggacatcctgaacgaggtggaaaggaaccttcaggatgccatgtctgttgcaaggaacattttgaaaaacccaaaacttctacctggaggtggtgcttctgaattgactgtatcagcaacactaaagcaaaagagttcttcagttgaaggtgtagaaaagtggccttatgaagctgctgctttagcattcgaagcaatcccaagaactttgcttcaaaattgtggtttgaatgttattaggacgatgacacagctccagggaaagcatgcgaacggtgaaaatccttgggttggcgttgatggaaggactggtgatattgttgacatgaaagagcggaagatctgggattcttacagcgtgaaggcacagaccgtcaagacagctatcgagtcagcttgcatgcttctaaggattgacgatattgtcagtggaatcaagaagaagcaggctcctgggtctggtgctcccaagcaaccccagattgaaacgggagaagatgctgacactgagcagatgatcccggagtagaactatttgtgctgctggattgagcccgtaccggcgatgttatctaccgaagctagaacagtgcccctgcagagcagaatgttttatgaacacgtgaagtggcgtcgcctggttgcatttcttgaatgtttgatggtggccaggcctccagggtcgtctagtgttagttttggattgcactactagttttttcttatgttcggatgacgaggggtgtgtgtatttgtatcagcgttttggatctgactattgcatggatggttgctgttggtttttttgtttttggactttgtgctgagcggatatcagaacctggatttaacagcaaaactagctttgtgacgactttagtttttcttttatttaattaatatagcaagacgatgccagtttctcc

SEQ ID NO: 2513 - DNA, 2336 bp, Elaeis guineensis
ctttgtaaaggagtggagcataagggtatcaaggaactgggggcgagggtttttgttctctgtcgctccgaagaacgccaagaaccattgagactacccgggcgtcgccgtcccaagaacgaacgctgccattttaggcatcgcctcgcgaagaacgaccattctcggaatctatctctcttctctccagccatgcacgccccggtcctcgtcctcaaagattctttaaaacgggaatctggaagtaaggtgcatcatgccaacatccaagcttctaaggctgtggctgacataatccgtactactttgggtcctcggtctatgttgaagatgcttcttgatgctggtggaggtattgttgttactaatgatggaaatgctatcctacgtgagttggatcttgcccatccagctgctaagtcaatgattgaactaagccgcacacaagatgaagaagtgggagatggcacaacatccgtcattgttcttgctggtgagatgcttcatgttgcggaagctttcattgaaaaaaactatcatcctacagttatctgtcgagcttataataaagctcttgaggatgcaatatcagttattgacaagattgcaatgaccattgatgtgaatgaccgtgccacaatgctgggtctcgtaaaaagttgtataggtacaaaatttactggacaattcggggacctgattgctgatcttgctattgattcaaccacgacagttggtgtggaccttggccaaggtatgcgtgaggtggacatcaagaagtatataaaagttgagaaggttcctggtggccagttggaggactctaaggttcttaaaggagttatgattaacaaagatgttgttgcccctgggaaaatgagaagaaaaatattgaacccacgtatcattctccttgactgcccgcttgagtataagaagggagaaaatcaaactaatgctgagttggtaaaagaagaagattgggaagttttgctgaagatggaagaggaatatatagagaatctttgtatgcagatactgaagttcaaacctgacttggttataacggaaaaagggctcagtgatcttgcatgccattatttaagcaaggctggagtcagtgccatccggagattgaggaagacagacaacaataggattgctaaggcttgtggagcagttattgtaaataggccggaggagcttcaagaatctgatgttggaacaggagctgggctatttgaggtcaagaaatttggtgatgagttttttgcttttattgtggactgcaaagatccaaaagcatgtactgttcttttaagaggtgcaagtaaggatctcttaaatgaggttgagagaaacttgcaggatgccatgtcagtagcacggaatatattgaaaaacccaaaactccttcctggaggtggtgccacagagttaacagtatctgcagcattgaaacagaagagttcatcgattgaaggtattgagaagtggccctatgaagctgctgctgtagcttttgaggctatcccacgaaccttggctcaaaattgtggggtgaatgttattcggacaatgactgctctccaaggaagcatgctaatgaagaaaatgcatgggttggcattgatggaaacactggtgctattgttgatatgaaagagagaaagatatgggactcttacaatgttaaggcacaaacatttaagacagctattgaggctgcttgcatgcttttgaggattgatgatattgtgagtgggataaagaaaaagcaggctcctggagctggcccaaccccatcgaaacctaagatagaggaagaaggagatgcagacaatgagcagatacttccagagtagagttttgaaaggtgtttgtttatttgcttactggagtgtttgaatacctggatgtgcgtgcttgttctctcatcagcaaaaaggttttatcagggagcaaatggagcattcagttgggtgccattttgttgacaaatttgttttcttgggtcagtttcactccttgaggactaccgagattaattgtcatgtcttgttatttgggaaccagtgacagttcatctcgccatggtttgttcgcccatctgttggaaaccacctcaagcagtgcgttgcagtgcaagcgtagcagatgaacatgtggttatgtcttagtttcaattcacctgtgtagaatgagacttaaaaaattattcaactgccatcaaccgggttttagttgaggaaacgttttagttttaacaatgcttatctgaaaatgtgtgaaacattgtggtttctggcaggtatttgtgggctagctatttagtt

SEQ ID NO: 2514 - DNA, 2193 bp, Elaeis guineensis
ctcggtgtcgctcgcaggagcgccaggaaccttccagaccacgcgggcatcgccgccccaagaacgaaggaccatttagggcatcgcggccctagagcgaacgccattctgggggtctctctctctcttttctccagccatgcatgccccggtcctcgtcctcaaagattctttaaaacgggaatctggaagtaaggtgcaccatgccaacatccaagcttctaaggctgttgctgacataatccgtactactttgggtcctcgatcgatgttgaagatgctgcttgatgccggaggaggaatcgttgttactaatgatggaaatgctatcctacgtgagttggatcttgcccatccagctgctaagtcaatgattgaactaagccgcacacaagatgaagaagtgggagatggcacaacatctgtcatcgttcttgctggtgagatgcttcatgttgcggaagctttcattgaaaaaaactatcatcctacagttatctgtcgagcatataataaagccctagaggatgcaattgctgttctggacaagattgcgatgcctattgaggtgaatgaccgtgccacgatgctgggtctggtcaaaagttgtataggtacaaaatttaccggacaatttggggacctaattgctgatcttgccattgatgctaccacaacagttggtgtggaccttggccaaggtttgcgtgaggtagacatcaagaagtatataaaagttgagaaggttcctggtggccagttggaggactctaaggttcttaaaggagttatgattaacaaagatgttgttgcccctggaaaaatgagaagaaagatattgaacccgcgtatcattctcctcgactgcccccttgagtataagaaaggagaaaatcaaactaatgctgagttggtaaaagaagaagattgggaagttttgctgaagatggaggaggaatatatagagaatctctgtatgcagattctgaagttcaaacctgacttggttataacggaaaaagggcttagtgatcttgcatgccattatttaagcaaggctggagtcagtgctatccggagattgagaaaaacagacaacaataggattgccaaggcttgtggtgcagtaattgtaaataggcccgaggaacttcaagaatctgatgttggaacaggagctgggctatttgaggtcaagaaaataggcgacgagttttttgcatttattgtggactgcagagatccaaaagcatgtactgttctcttaagaggtgcgagtaaggatcttttaaatgaggttgaaagaaacttgcaggatgccatgtcggtagcacggaacatattgaaaaacccaaagcttcttcctggaggtggtgccacagagttgacagtgtctgcagcattgaaacagaagagttcattgattgaaggtattgaaaagtggccctatgaagctgctgctgtagcttttgaggctatcccacgaaccttggctcaaaattgtggggtgaacgttattcgaacaatgactgctctccaaggaaagcatgctaatgaggaaaatgcatgggttggcattgatggaaacacgggtgccattgtcgatatgaaagagagaaagatatgggactcttacaatgttaaggcacaaacatttaagacagccattgaggctgcttgcatgattttgaggattgatgatattgtgagtggaataaagaaaaagcaggctcctggagctggcccaaccccatcgagaccaaagatggaggaagaaggagatgcggacaatgagcagatgcttccagagtaaaattttgaaaggggttcgtttatttgcttactggagtgtttgaatacctggatgtgcattcttgttctcttgtcagcaagttttatcagggaatggtaacaaattttgttttcttaggtcatttttcactccttgaggactaccaggattagttttattccgtccttggtgcacgttttgttatctgggaaccaatgagggttcatgtatggtttgttttcaacagatggtttatcagctcttatattgtaaacgcgaaaggagtatgttaagatgtaagggtagcatatgaaaatgtgattcgttgtttttagttttgacctgatcttgtacagaaagagacaacaaatgatttgaggactggccatcaatttagttga

SEQ ID NO: 2515 - DNA, 2544 bp, Ricinus communis
agaattttaaaaaactttaggacttaatcgcaaaattcaaaaagtttttgtacccgtggaactatagattatttccgcaaacggtaccgtttaggaggctattatacctcgcctgaactcttaaaaccccagatccttcttcttcttctgcttcttataggttctctctccttctcttcactcaaaagtgcaatccctaacctagcttatttttctccgataaacgacgccgttagggcacctatattctatcttgtgtagtttaactatttcattatacaaatacaagaagaaggagaagaatgcaggctccggtgctcgttctcaaggattctttgaaacgtgagtccggtactaaagtacaccatgccaacattcaggcttccaaggctgttgctgacattatacgcacaacattgggtccccgatccatgctgaaaatgttacttgatgctgctggaggaattgttgttactaatgatgggaatgctattcttcgtgaactagatcttgctcacccagcagcaaagtcaatgattgaattgagccgtacacaagatgaagaagtaggagatgggacaacatcagtgattgttcttgctggagagatgctccatgttgctgaagcctttattgacaagagttatcatcctactgtcatttgccgagcctacattaaagctctagaagatgccattgctgtacttgataaaattgctatgtccattgatgtcaatgaccgtgcaacattgttaggtctggttaagagctgtataggcacaaagttcactagtcaatttggggacctaattgctgatctagcaattgatgccaccactacagttggggttgatcttggccaaggattgcgagtggatatcaagaagtatattaaggttgagaaggtacctggtgggcagttggaggattctaaagttcttaaaggagttatgttcaacaaagatgtagttgcccctggaaaaatgagaagaaagattgttaacccacgtattattcttcttgattgtccattagaatacaaaaagggtgagaaccaaacaaatgctgagttggttaaagaagaagactgggcagtcctactgaaaatggaagaggaatatattcagaacatgtgcatgcagatactgacatttaaaccagatctagtaatcacagagaaaggactcagtgatttggcatgccattatttgagcagggctggtgtcggtgcaatcaggaggctgaggaagacggacaataatagaattgctaaggcatgtggggctgttattgtgaacagaccggaggaattgcaagagtctgatgttggtactggagctgggctatttgaagttaagaaaattggggatgaattcttttctttcattgttgattgcaaagatccaaaggcttgcacagttctcttgagaggtgccagtaaggatctcctaaatgaagtggaaagaaatttgcaggatgccatgtctgtggccagaaacatactcaagaatcctaaacttcttcctggtggtggtgctacagagttaactgtctctgccactctcaagcaaaagagttcatctgtcgaaggaatagaaaagtggccatatgaagctgctgctttagcttttgaggctataccacgaactttggcccagaattgcggtgtcaatgtgattcgaacaatgactgccctccaaggaaaacatgcaaatggtgacaatgcatgggttggcatagatggcaacactggtgaaattactgatatgaaagagaggaagatatgggacgcctataatgtgaaagcacaaaccttcaagacagcaatagaagcagcttgtatgcttctgagaattgacgacattgtaagtgggatcaagaagaagcaggctccaggagcaggtccatccaagccaaagattgagactgaagcagatgcagatggtgagcagatacttcctgactgaggatatggagctagctggccttgaactattattcaaatgcgcagctgtttttttgggacggttaaacggttttttaggtgcgagttgagcatccttcaaaattttgagtgctactctgtggactcttgttttgcgttattgttctatctgaatttctacttaaatagagttgggatttcttccgtgtgcattagtgggacatagtattattatttattggcacctatccaaattgctagctggttgatatatgaatatggtcctttgtattgtaatgtccaactccaaagttgtgctagaagtcttatgttgaggatacctgtacttgaattttttgagaaaaaagaagaaaaattccagagatatttgagacaagatcgctttgggagtaacttgagaaatggaaaaagttgctatatatgcacataatcttgtcactttctcccttcaatgttgaaggttttgttgtcagatctgtcctttttccctttatatttgttgacacctttatttgtcaatgtacttaacatcatcttatgttgcaatcttaaatattagcaataattttgattgttca

SEQ ID NO: 2516 - DNA, 2066 bp, Citrullus lanatus
ctcagtccgaaccatcgaactttcttctttctcaacctgttttctagggttttggcgaagggttttcgacgtccgtatctccatccatccaagccactcaccatgcacgctccagttctcgttctcaaagattctctaaaacgcgagtctgggagcaaggttcaccatgctaacatccaggcttccaaggctgttgctgatattatccgtaccacgttgggcccaagatctatgttgaagatgttacttgatgctcaaggagggatcgttgtcaccaatgatggaaatgccattctccgggaattggatattgcacatccagcagcaaaatcgatgattgaacttagccgcacacaagatgaggaagtaggagatggaactacatcagttattgttcttgctggtgagatgctccatgttgctgaggccttcattgagaaaaattatcacccaacagtcatttgccgggcctatagtaaagctctcgaggatgcacttgctgtgcttgataagatagcaatggacatcgatgtgaaggatcgcactgctatgttagggctggtcaaaagctgcataggcaccaagttcactagtcaatttggagatttgattgctgatctagcaattgatgccactacaattgtgggtgttgatcttggccaaggcttacgtgaggtagacatcaagaagtacataaaggttgagaaggttccaggtggtcagctagaagattcaagggttcttaaaggagtaatgtttaacaaagatgttgttgcccctggaaaaatgcgaaggaagattgtcaatccacgtattattcttctcgactgccccctagaatacaagaaaggtgaaaaccagacaaatgctgagttggtcaaagaagaagattggggaatccttctgaaaatggaagaagaatacattgagaatatctgtgcacagataatcaaattcaaacctgacctggttatcacagagaagggcctcagtgatttggcttgccattatctaagtaaagctggtattagtgcaattagaaggttgaggaagactgacaataatagaatagcaaaggcatgtggtgccgttattgtgaatagacctgatgagttgcaggaatcagatgttggcactggtgctggattatttgaagttaagaagataggggatgaattctttgcgtttatagtggattgcaaggagccaaaagcttgtactgtgcttctgagaggtgctagtaaagatcttttgaatgaagtagaaagaaatttgcaggatgccatgtctgtagcaaggaacataataaaaaatccaaaacttgttcctgggggtggtgctactgagttgactgtatctgctacactgaagcagaagagttcttctgttgaaggcatagaaaagtggccttatgaagctgccgccttagcttttgaagccataccccgaactttggctcagaattgtggggtgaatgttataagaaccatgacagcattgcaaggaaagcatgccaatggtgaaaacgcatggacaggcatagatggaaacactggtgaaatcactgacatgaaagagcgtaagatttgggatgtgtataatgtaaaggcacaaacttttaagacagcgatagaagcttcctgcatgctgttgagaatcgacgacattgttagtggtattaagaagaaacaggcaccaggtgcaggtccatcaaagccacaaattgagacggaagctgatgcagataatgagcaaattcttccggagtaaattaatttttggttcagctgcactttaatttcaagagttcgttcttccttgtattttggcatcagttttcttagctctccagtggtgttatcgagctagcattagctatttgggtgggttcgattcttcacaactttgaaggctcttttgtgtttgcttaggttgggactttcaaaatatggttaccagatgaatacaattttgttaccaccgttttgatttcgggttgatgtttgagaacagtgatttaaatgttcaatacatgggttgatgattcctgagacctaacttttata

SEQ ID NO: 2517 - DNA, 2211 bp, Manihot esculenta
agttctaggtttctagttctttctcggccccgccatttattgtatgccgtctgagatctccaccgactgtgaccagaaccgaccatcttcgccgatccaccgctccggaagcctttaacaaactggtttttctacttggcattgatacaaagatccaccttgttagttgttaatacaagaagaagagtaggtaaaagatgaacgctcctgttctcgttctcaaggattctttgaaacgggagtctggaaccaaagtacatcatgccaacattcaggcttccaaggcggttgctgacattatccgcactactttgggtccacgatctatgctgaagatgttacttgatgctggtggaggaatagttgtcactaatgatgggaacgctatcctacgtgaattagatcttgcacacccggcagcaaagtcaatgattgaattgagccgcacacaagatgaagaagtaggagatgggactacatctgtcattgttcttgctggagagatgcttcatgttgctgaagccttcattgacaagaattatcatcctacggtcatttgccgagcctacaataaggctttggaggatgctgttgctgtgcttgacaaaattgctatgtccattgacgttaatgaccgtgcaatgatgttgggactggttaagagttgtataggcacaaagttcaccagtcaatttggggatttaattgctgatctggcaattgatgccacctccactgtagggattgatcttggtcaaggattgcgagaagtggatatcaagaaatacattaaggttgagaaggtacctggtggccagttggaagattctaaagttcttaaaggagttatgtttaacaaagatgtggttgcccctggcaaaatgaggagaaagattgtcaatccacgaataattcttcttgattgtccccttgagtacaagaagggtgagaaccaaacaaatgcagagttggttaaagaagaagactggggagtcctactgaaaatggaggaagaatatattgagagcatgtgtatgcagatactaaaatttaaaccagatctggttatcacagagaaagggctcagtgatttggcatgccattatctaagcaaggctggtgtcagtgcaatcaggaggttaaggaagacggacaataatagaattgcaaaggcatgtggggctgtcattgtgaacagaccagatgaattgcaagagtctgatgttggtactggggccgggctatttgaagttaagaaaattggggatgagttcttttcttttattgttgattgcaaagatccaaaagcttgtacagttctcttgcgaggtgccagtaaggatctcctgaatgaagtggaaaggaatttgcaggatgcaatgtctgtggccaggaatatacttaagaacccaaaacttgttcctggtggtggtgctacagagttaactgtctctgccactttgaagcaaaagagttcagctatagaaggaatagaaaagtggccctatgaagctgctgccatagcttttgaggccattccacgaactttggcacagaattgtggtgttaatgtgattcggacaatgactgcactccaaggaaaacatgcaaatggtgagaatgcatgggttggcatagatgggaacactggtgaaatcactgatatgaaagagaggaagatttgggacgcctataacgtgaaagcacaaaccttcaagacagcaatagaagcagcatgcatgcttttaaggattgatgacattgtaagtgggatcaagaagaaacaggccccaggagcaggccaagctccgtccaagcctcagattgagacagaaggagatgcagacggtgagcagatacttcctgactgaagttattgagctagctttccttgaagtatttgtaggggtgtatttcctccggcatttctggttggtaaaacaattgagtagctgtgatttttgtccatctctcatatcttgttttgaacaatggggggtatttcgcatgatgagtcaatcgttgggattcttttgggtgctaaccagtgtgttcgtacatgatattattaattggtcactagctgcctgtatggtgtctatttgatattgtggttttagggggaaaaaacttgcaggaaaaacatcattatagatgccgttgagacaaaacagttccataaaaaggttctattcttatagtgttctgact

SEQ ID NO: 2518 - DNA, 2224 bp, Tripterygium wilfordii
aaaaactctctcaaacactccacactttgacagagaagttgccattcttactttcttagtttttgtgctactctttgtcacttattggaacctcgtgttccgcccacgcttcgcttcttcgttcgatctccgcttcggcctatcggatttgttcgtctagtgtttccgctgcagagtttgtaagatcgcaaatatgcatgcgccagtacttgttctcaaggattctctgaaacgtgaatctggaagcaaggtacagcatgctaatatccaggcttcaaaggctgttgctgatataattcgtacaaccttgggtccacgatctatgttgaagatgctccttgatgctgctggagggattgtcgttactaatgatgggaatgctattttacgtgagctagatcttgcacacccggctgcaaagtcaatgatagaattaagtcgcacacaagatgaagaagttggagatggaacaacatctgtcattgttttagcgggtgaaatgcttcatgttgcggaagccttcattgacaagaactaccatcccacggtcatttgtcgagcctacaacaaagctctggaagatgctattgctgtgctcgacagaattgcaatgtccattgatgtaaacgatcgggcaacgatgttgggcctggtaaagagctgtattggcacaaagttcactagtcaatttggtgatttgattgcggatttagcaatcgatgccaccacgacggttggtgttgaccttggccaaggaatgcgagaagtggatattaagaagtacattaaggttgagaaggttcctggtggccagttggaagattcaagagttctcaaaggggttatgtttaacaaagatgtagttgcccctggaaaaatgaggagaaagatcgtcaacccacgtatcattcttctcgattgcccccttgagtacaagaaaggcgagaaccaaacaaatgcagaattagttaaagaggaagattggggaatccttttgaaaatggaagaagaatacattgagaatctctgtatacagatcttgaaattcaaaccggacttggtaattacagaaaagggtctcagtgatctggcctgccattatctgagcaaagcaggcgttagtgcaataaggaggttgaggaagacggacaataacagaattgccaaagcatgcggtgccgttatcgtgaacagaccagaagaactgcaggagtccgatgttggtactggggctgggttgtttgaagttaagaaaattggggatgaattttttgcttttattgttgattgcgtagatccaaaagcttgtaccatattattaagaggagcaagtaaggatctcctaaatgaagtagagagaaacttgcaggatgctatgtctgtggctaggaacatacttaagaatccaaaactacttccgggaggtggtggtacagagttaactgtatctgctactttgaagcaaaagagttcatctattgaaggcatagaaaagtggccttatgaagctgcggcaatagcttttgaggctataccacgaactttggcacaaaattgtggtgttaatgtgatccgaactatgactgccctacaaggacagcatgctaatggtgaaaacgcttggattggcattgatggaaatactggattgatcgctgacatgcaagagcggaagatatgggattcctataatgtgaaggcacaaaccttcaagacagcgatagaagctgcttgcatgattctcaggattgatgacattgttagtgggatcaagaagaagcaggcccctggagcgggccaagcaccaaagccgaaggttgaaacagaggcagatgctgatggcgagcaaatacttcccgactgaggataccattgcactcggactgactcggcattcagataactgccagaaaggttttgtttgcattgttggcttgttcatgtgttttgttgggcttttaattgcgcacacttcaaattttgggatcttggccagttcagagttttgttggttgcttagaaccacctttctataatggttgcagttgtatactatccgtaactttgtgcagttgggatgtttgaaagctctgttagttcatcaactctgaggaagaaatggcagtttctgttctcagcagtagaggcatccgcatctccacactaactgccgtttcatttgaatttctaatttttacagttaatctagtaatattctcacttg

SEQ ID NO: 2519 - DNA, 2385 bp, Citrus sinensis
aagccgtccgcgtttccaacccgtatttaaggtctattgctgataataaagggttttaaagagcatatttggtacaaaacatttaagaagaaaaaggagccaacgaggagggttcgaggaatttctttcaacaacagcaaagctaaacagtctcacttcactttttactttgaaagaaaaagatccctgagtttagttttgtagagttgagttggtatcagtagttagggttttatctattacttgatacaatcatgcactctccagttctcgttctcaaggattccttgaagcgtgaatccggaaccaaggttcaccatgccaatatccaggcttccaaggctgttgctgatatcattcgtacaacattgggtccccggtccatgttaaagatgctacttgatgctagcggagggattgtagtaactaatgatggaaatgctattcttcgtgagcttgatgttgcacatccagcagctaagtcaatgattgagttaagtcgaactcaagatgaagaagtaggggatggaacaacatctgtcattgtgctagctggcgagatgcttcatgttgcggaagagttcattgacaagaattatcatcctacagtcatctgccgagcttacaataaggctttggaggatgctgttgctgtgcttgataaaattgcaatgcccattgatacaaatgatcgtgcaacaatgttgggcctggtcaagagttgcattggaactaagttcacaagccaatttggggatctgatagctgatcttgcaattgatgccaccactactgttggtgttgaccttggccaagggttgcgagaggtggatattaagaagtacattaaagttgagaaggttcctggtggccagttggaagattctagggttctgaaaggagttatgttcaacaaagatgttgttgcccctgggaaaatgagaagaaaaattgtcaacccccgtattatccttcttgattctccccttgagtacaagaaaggagagaatcaaacaaatgctgagttggttaaggaagaagactgggaagtcctgttgaaaatggaagaggaatacattgaaaacctctgcatgcagattctgaagtttaaaccagacttggtaattacagagaaggggctaagtgatcttgcatgccattatctaagcaaggctggcgttagtgcaattaggaggctaaggaagacagacaataatagaattgccaaagcatgtggtgctgttattgtgaacagaccagatgaattgcaggaatctgatgttggtactggggctgggctgtttgaggttaagaaaattggtgatgaattctttgctttcattgttgattgcaaagatccaaaagcttgtactgtactcttaagaggtgctagtaaggatctcctgaatgaagtggaaagaaatttgcaggatgcaatgtctgtggcaagaaacataatcaagaatccaaaactagtacctggtggaggggctacagaattaacagtatctgccactctaaaacaaaagagttcctcaatcgaaggcatcgaaaagtggccttatgaagctgctgctatcgcttttgaggctataccaagaactttggctcagaattgtggggttaatgtaattcggaccatgactgccttgcaaggaaaacacgctaatggtgaaaatgcatggatcggcatagatggaaacactggtgcaatttctgacatgaaagagaggaagatctgggatgcatataatgtgaaagcacagacatttaagacagcaattgaagctgcttgcatgcttctgaggattgatgacattgtcagtggcattaagaagaaacaggcccctgggtcaggccaaactccatcgaagcctcagattgagacggaggcagatgcagacagtgagcaaatactccctgactagacaactttactgttaactgactatgcagttaaattatttgaaaaaatgttggcttcttgttctgctggcggtccaatgattttgctgagcttttcctccaaattttgtgcaattgcgccgatgttttagccattgtaggcaaactgggaagttgtgatatgctttgtatttttccccccttttggacatcctgtttttggataagttttttcctattactactctcaggtgttgtgtaggcacagcctaatttttgtttaaatttttcaagttgtgcgtttttctgtgcatgaatgccaatagatatgatcggttagaacaagagggagttgcagtagaacaaagagcagcgccatttttattcttccatcaaattatgtattttaatattttttatttatttgatttaattgtggatggtacttttgaaattacataatttcattggggacacttt

SEQ ID NO: 2520 - DNA, 2231 bp, Citrus clementina
atcagggttacgaatccagttacaggataccgaaaagcagtccgcgtttccaacccagatttaaggtctattgctgataataaagggttttaaagagcatattcggtacaaaacatttaagaagaaaaaggagccaacgaggagggttcgaggaatttctttcaacaacagcaaaagctaaacagtctcacttcacttttactttgaaagaaaaagatccctgagtttagttttgtagagttgagttggtatcagtagttagggttttatctattacttgatacaatcatgcactctccagttctcgttctcaaggattccttgaagcgtgaatccggaaccaaggttcaccatgccaatatccaggcttccaaggctgttgctgatatcattcgtacaacattgggtccccggtccatgttaaagatgctacttgatgctagcggagggattgtagtaactaatgatggaaatgctattcttcgtgagcttgatgttgcacatccagcagctaagtcaatgattgagttaagtcgaactcaagatgaagaagtaggggatggaacaacatctgtcattgtgctagctggcgagatgcttcatgttgcggaagagttcattgacaagaattatcatcctacagtcatctgccgagcttacaataaggctttggaggatgctgttgctgtgcttgataaaattgcaatgcccattgatacaaatgatcgtgcaacaatgttgggcctggtcaagagttgcattggaactaagttcacaagccaatttggggatctgatagctgatcttgcaattgatgccaccactactgttggtgttgaccttggccaagggttgcgagaggtggatattaagaagtacattaaagttgagaaggttcctggtggccagttggaagattctagggttctgaaaggagttatgttcaacaaagatgttgttgcccctgggaaaatgagaagaaaaattgtcaacccccgtattatccttcttgattctccccttgagtacaagaaaggagagaatcaaacaaatgctgagttggttaaggaagaagactgggaagtcctgttgaaaatggaagaggaatacattgaaaacctctgcatgcagattctgaagtttaaaccagacttggtaattacagagaaggggctaagtgatcttgcatgccattatctaagcaaggctggcgttagtgcaattaggaggctaaggaagacagacaataatagaattgccaaagcatgtggtgctgttattgtgaacagaccagatgaattgcaggaatctgatgttggtactggggctgggctgtttgaggttaagaaaattggtgatgaattctttgctttcattgttgattgcaaagatccaaaagcttgtactgtactcttaagaggtgctagtaaggatctcctgaatgaagtggaaagaaatttgcaggatgcaatgtctgtggcaagaaacataatcaagaatccaaaactagtacctggtggaggggctacagaattaacagtatctgccactctaaaacaaaagagttcctcaatcgaaggcatcgaaaagtggccttatgaagctgctgctatcgcttttgaggctataccaagaactttggctcagaattgtgggattaatgtaattcggaccatgactgccttgcaaggaaaacacgctaatggtgaaaatgcatggatcggcatagatggaaacactggtgcaatttctgacatgaaagagaggaagatctgggatgcatataatgtgaaagcacagacatttaagacagcaattgaagctgcttgcatgcttctgaggattgatgacattgtcagtggcattaagaagaaacaggcccctgggtcaggccaaactccatcgaagcctcagattgagacggaggcagatgcagacagtgagcaaatactcccggactagacaactttactgttaactgactatgcagttaaattatttgaaaaaatgttggcttcttgttctgctggcgcgccatttttattcttccatcaaattatgtattttaatattttttatttatttgatttaattgtggatggtacttttgaaattacataatttcattggggacacttttagtaatttatgttttagaatttgattggttgataatcaaattttgaaaagttattgtaggttacttttaaaagtcaatgcaaaacaatttt

SEQ ID NO: 2521 - DNA, 2231 bp, Citrus sinensis
atcagggttacgaatccagttacaggataccgaaaagcagtccgcgtttccaacccagatttaaggtctattgctgataataaagggttttaaagagcatatttggtacaaaacatttaagaagaaaaaggagccaacgaggagggttcgaggaatttctttcaacaacagcaaaagctaaacagtctcacttcacttttactttgaaagaaaaagatccctgagtttagttttgtagagttgagttggtatcagtagttagggttttatctattacttgatacaatcatgcactctccagttctcgttctcaaggattccttgaagcgtgaatccggaaccaaggttcaccatgccaatatccaggcttccaaggctgttgctgatatcattcgtacaacattgggtccccggtccatgttaaagatgctacttgatgctagcggagggattgtagtaactaatgatggaaatgctattcttcgtgagcttgatgttgcacatccagcagctaagtcaatgattgagttaagtcgaactcaagatgaagaagtaggggatggaacaacatctgtcattgtgctagctggcgagatgcttcatgttgcggaagagttcattgacaagaattatcatcctacagtcatctgccgagcttacaataaggctttggaggatgctgttgctgtgcttgataaaattgcaatgcccattgatacaaatgatcgtgcaacaatgttgggcctggtcaagagttgcattggaactaagttcacaagccaatttggggatctgatagctgatcttgcaattgatgccaccactactgttggtgttgaccttggccaagggttgcgagaggtggatattaagaagtacattaaagttgagaaggttcctggtggccagttggaagattctagggttctgaaaggagttatgttcaacaaagatgttgttgcccctgggaaaatgagaagaaaaattgtcaacccccgtattatccttcttgattctccccttgagtacaagaaaggagagaatcaaacaaatgctgagttggttaaggaagaagactgggaagtcctgttgaaaatggaagaggaatacattgaaaacctctgcatgcagattctgaagtttaaaccagacttggtaattacagagaaggggctaagtgatcttgcatgccattatctaagcaaggctggcgttagtgcaattaggaggctaaggaagacagacaataatagaattgccaaagcatgtggtgctgttattgtgaacagaccagatgaattgcaggaatctgatgttggtactggggctgggctgtttgaggttaagaaaattggtgatgaattctttgctttcattgtcgattgcaaagatccaaaagcttgtactgtactcttaagaggtgctagtaaggatctcctgaatgaagtggaaagaaatttgcaggatgcaatgtctgtggcaagaaacataatcaagaatccaaaactagtacctggtggaggggctacagaattaacagtatctgccactctaaaacaaaagagttcctcaatcgaaggcatcgaaaagtggccttatgaagctgctgctatcgcttttgaggctataccaagaactttggctcagaattgtgggattaatgtaattcggaccatgactgccttgcaaggaaaacacgctaatggtgaaaatgcatggatcggcatagatggaaacactggtgcaatttctgacatgaaagagaggaagatctgggatgcatataatgtgaaagcacagacatttaagacagcaattgaagctgcttgcatgcttctgaggattgatgacattgtcagtggcattaagaagaaacaggcccctgggtcaggccaaactccatcgaagcctcagattgagacggaggcagatgcagacagtgagcaaatactcccggactagacaactttactgttaactgactatgcagttaaattatttgaaaaaatgttggcttcttgttctgctggcgcgccatttttattcttccatcaaattatgtattttaatattttttatttatttgatttaattgtggatggtacttttgaaattacataatttcattggggacacttttagtaatttatgttttagaatttgattggttgataatcaaattttgaaaagttattgtaggttacttttaaaagtcaatgcaaaacaatttt

SEQ ID NO: 2522 - DNA, 1987 bp, Cucumis melo
agggttttcgacgttcgtacttcatcgaagccactcatcatgcacgctccggttctcgttctcaaagattctctaaaacgtgagtctgggagcaaggttcaccatgctaacatccaggcttccaaggctgttgctgatattattcgtaccacgttgggcccaagatctatgttgaagatgttacttgatgctcaaggagggatcgttgttaccaatgatggaaatgccattctccgagaattggatattgcacatccagcagcaaaatcgatgatcgaacttagccggacacaagacgaggaagtaggagatggaactacatcagttattgtgcttgctggtgagatgctccatgttgctgaggccttcattgagaaaaattatcacccaactgtcatttgtcgggcctataacaagctctagaggatgcactcgctgtgcttgataaaatagcaatggacatcgatgtgagagatcgcactgctatgttggggctggtcaaaagctgcataggcaccaagttcactagtcaatttggagatctgattgctgatttagcaattgatgctactacaattgtcggtgttgatcttggccaaggcgttcgtgaagtagacatcaagaagtacataaaagttgagaaggttccaggtggtcagttagaagattcaaaggttcttaaaggagtgatgtttaacaaagatgttatcgcccctggaaaaatgagaaggaagattgtcaatccacgcattattcttcttgactgccccctagaatacaagaaaggtgaaaaccagacaaatgctgagttggtcaaagaagaagattggggaatcctactgaaaatggaagaggaatacattgagaatatctgtgcacagataatcaaattcaaacctgacctggttatcacagagaagggcctcagcgatttggcttgccattatctgagtagagctggtatcagtgcaattaggcggttgaggaaaactgacaataatagaatagccaaggcttgtggtgctgtaattgtgaacagacctgatgagttgcaggaatcagatgttggaactggtgctggattatttgaagttaagaagataggggatgaattttttgcttttatagtggattgcaaggagccaaaagcttgtactgtgcttctgagaggcgctagtaaagatcttttgaatgaagtagagagaaatttgcaggatgcgatgtctgtagcaaggaacatattaaaaaatccaaaacttgttcctgggggaggtgctaccgagttgactgtatctgctacgcttaaacagaagagttcttctgttgaaggcatagaaaagtggccttatgaagctgctgcattagcttttgaagccatacctcgaactttggctcagaattgtggggtgaatgtaatacgaaccatgacagcattgcaaggaaagcatgccaatggtgaaaacgcctggacaggtatagatggaaacactggtgaaatcactgacatgaaagagcgtaagatttgggatgtgtataatgtaaaggcccaaacttttaagacagctatagaagcttcctgcatgctgctaagaatcgacgacattgttagcggtattaagaagaaacaggcaccaggggcaggaccaacaaagccacaaattgagacggaagcggatgcagataatgagcaaattcttccagagtaaattaattttggacttttaatttaagagttctttcttccttgtattttggtatcagttttcttgtctctccaatggtgttatcgtgctagagctagcgctagctatttaggtgggttcgtttctttacagctttatagctagggccctttgtgttctcttgggttgggacttccgaaatataatatggtcagcggatgaattcaattttgttaccagcggtttgatttcgggttgatgtttgagaatagtgatttaatttttcaatacattggctgatggtt

SEQ ID NO: 2523 - DNA, 2102 bp, Euonymus alatus
tcacttcggtctctaggagattcccccaacactgagaagtgagaagctcttttcgggtttttgcaactattcatcatttcccgatacctcgtgttccgcccacgcttcgcttcggcctttcggatttgttcgtttagggtttccattgcagagtttgtaagatcgcaaatatgcatgcgccggtacttgttctcaaggattcgctgaaacgggaatctggaagcaaggtacagcatgctaatatccaggcttcaaaggctgttgctgatataattcgtacaaccttgggtccacgatctatgttgaagatgctccttgatgctgctggagggattgtcgttactaatgatgggaatgctattttacgtgagctagatcttgcacacccagctgcaaagtcaatgattgaattaagtcgcacacaagatgaagaagttggagatggaacaacatctgtcattgttttagcgggtgaaatgctccatgttgcggaagccttcattgacaagaactatcatcccacggtcatttgtcgagcctacaacaaagctctggaagatgctattgctgtgcttgacagaattgcaatgtccattgatgtaaacgatcgggcaatgatgttgggcatggtaaagagctgtattggcacaaagttcacaagtcaatttggtgatttgattgctgatttagcaatcgatgccaccacgacgattggcgttgaccttggccaaggaatgcgcgaagtggatattaaaaagtacattaaggttgagaaggttcctggtggccagttggaagattcaagagttctcaaaggggttatgtttaacaaagacgtagttgcccctggaaaaatgaggagaaagattgtaaatccacgtatcattcttcttgattgcccccttgagtacaagaaaggtgagaaccaaacaaatgcagaattggttaaagaggaagattggggagtccttttgaaaatggaagaagaatacattgagaacctctgtgtgcagatcttgaaattcaaaccggatttggtaattacagaaaagggtctcagtgatctggcttgccattatctgagcaaagcaggcgtcagtgcaataaggaggttgaggaagacggacaataacagaattgccaaagcatgtggtgccgttatcgtgaacagaccagaagaactgcaggagtctgatgttggtactggggctgggctgttcgaggttaagaaaattggggatgaattttttgctttcattgttgattgcaaagatccaaaagcctgtaccatactattaagaggagccagtaaggatctcctaaatgaagtagagagaaacttgcaggatgctatgtctgtagcgaggaacatacttaagaatccaaagctagttccaggaggtggcggtacagagttaactgtatctgctactttgaagcaaaagagttcatctattgaaggcatagaaaagtggccttatgaagccgcggcaatagcttttgagtctataccacgaactttggcacaaaattgtggtgttaatgtgatccggactatgactgccctacaaggacagcatgccaatggtgaaaatgcatggattggcattgatggaaatactggattgatcgctgacatgcatgagcgacagatatgggatgcctataacgtaaaggcacaaaccttcaagaccgcaatagaagccgcttgcatgattctcaggattgatgacattgttagcgggatcaagaagaagcaggcccctggagcgggccaagcaccaaagcccaaggttgagacagaggcagatgctgatggcgagcaaatacttcccgactgaggatgttgttgaactcggacttactcggctttcgataatggccagaaatgttttgtttgcattctcggccagttcaagggttttgttgggcttttaatcgcacaatacttcaaattttggaatcctggccagttcacagttttgttgtttgcttagaactacctttctataatgttttcagttgtatactttgtgcagttgggatgcttgaaagctctgttagttcatggactccaaggaagaaatagcagcttttgttct

SEQ ID NO: 2524 - DNA, 1924 bp, Euphorbia peplus
ccgtcaccgatcacataagttgatatccaacgcaactgaaaaaatgcacgctccagttcttgttctcaaggattctttgaaacgggagtccggcactaaagttcatcatgccaacattcaggcttccaaggctgttgctgatattatccgcacaacattgggaccacggtccatgttgaagatgctacttgatgctagtggaggaattgttgttactaatgatgggaatgctatcctccgtgaattagatgttgcacaccctgcagcaaagtcgatgattgaattgagccgcacacaagatgaagaagttggagatggaacgacatctgtcatcattctagctggagaaatgctccatgtagcagaagccttcattgacaagagttatcatcccactgttatttgtcgagcctacaacaaggctttggaggatgctattgccgtgcttgataaaattgctatgaccattgatgtcaatgatagggcaacaatgttgggtctggttaagagctgcataggcacgaagttcacgagtcaatttggggacctaattgctgatctagcaattgatgccacttccacagttggggttgatcttggccaaggattgcgagaggtggatatcaaaaagtacattaaggttgagaaggttcctggtggccagttggaagattccaaagttcttaaaggagtcatgttcaataaagatgtggttgcccctggaaaaatgaggaggaagattgtgaacccacgtattattcttcttgattctccccttgaatacaagaaaggtgagaaccaaacaaatgctgagttggttaaggaagaagactgggcagtactattgaaaatggaggaggaatatatccagaacctgtgcatgcagatactgaaatttaaaccagatcttgttattacggagaagggacttagtgatttggcatgccattatttcagcaaggctggtgttagtgcaatcaggaggctgaggaagacggacaataataggattgccaaggcatgtggagctgttattgtgaacagaccagatgaattgcaagagtctgatgttggaactggagctgggttatttgaggttaagaaaattggagatgagttcttctcctttattgttgattgcaaagagccaaaagcttgcacagttcttttgagaggtgccagtaaggatctcttgaatgaagttgagagaaatctccaggatgccatgtctgtggctagaaacatactcaagaatccaaaactcgttcctggtggtggtgcgaccgagttaactgtctcagctactctgaagcaaaagagttcctccattgaaggaatagaaaagtggccctatgaagctgctgctatagcttttgaggctataccaagaactttggctcagaattgcggtgttaatgtgatccggacaatgacttccctccaaggaaaacatgcgaatggtgataatgcatggactggcatagatgggaatactggtgaaatctgtgatatgaaagagagaaagatatgggatgcatataatgtgaaagcccaaaccttcaagacagccatagaagcagcttccatgcttcttaggattgatgacattgttagtgggatcaagaagaaacaggctccaggagcgggtccttcaaagcccactgtcgaaacagaagcagatgcagatggtgagcagatacttccagactaagagggaggttggttgggtggctctctttgaagttttggtcaaaggtggcagcgttttttctcaggagggggtgctgctaaaacagttttgtttgaagtgttgagatgctgagcaccactgctgaagtatttgtatggtattgtgacctaatagaatatatatgaagtctgaatttcaacttaaacatgcactttcgaatttgtacttgtattt

SEQ ID NO: 2525 - DNA, 2053 bp, Gossypium hirsutum
tcaacgcagagtacatggggaagagagggttcattgttgtagtagggtttttcactgagaagaaactagaaacatagaaaccctttgcagatttgtttgttttcaacagttttaagctctaatactaacgaaatcgtaaatcatgcacgccccggttctcgttctaaaggattcgttgaaacgggagtctgggacgaaggttcaccatgctaacatccaagcctccaaggctgttgctgacattattcgaacaacattgggtcctcgatccatgttgaaaatgctccttgatgcttctggaggtattgttgttactaatgatggaaatgctatcctacgcgagttagatcttgcacatccagcagcaaagtcaatgattgaattgagccgtacccaagatgaagaagttggagatggaacaacatctgtcattgttcttgctggtgagatgcttcatgttgcagaagcctttattgagaaaaattatcatcctacggttatttgtcgagcatacaataaggctttggaggatgctattgccgtgcttgacaagattgcaatgtctattgatgtcaaagaccgtgccacaatgttgggacttgtgaagagctgtatagggacaaagttcactagccagtttggtgatctgattgccgatttggcaattgatgcaactcaaacagtcggagttgaccttgggcaagggctgcgagaagttgatattaagaagtacattaaagtagagaaagtaccaggtggtcagttggaagattctaaggtactcaagggagtgatgatcaataaagatgtagttgcgcctggcaaaatgaagcgaaagattgtcaacccacgtattattcttcttgactgtccccttgagtataagaaaggggagaaccaaacaaatgccgagttggttaaggaagaagattgggaagttcttttgaaaatggaagaagaatacattgagagcctttgcttgcagattctgaaattcaaaccagacttggtggttacagaaaaaggacttagtgacttggcatgccattatcttagcaaggctggtgtcagtgcaattaggagggtgagaaagactgacaacaacagaattgcaaaggcatctggagctgttattgtgaatcgtcctgacgaattgcaggaatccgatgttggtactggagctgggctatttgaggttaaaaaaatcggggatgagttctttgcattcattgttgattgcaaagatccaaaagcttgtacggttctcttaaggggtgctagcaaggatctcctgaacgaggttgaaagaaatttgcaggatgccatgtctgttgctagaaacataattaagaatccgaaacttgttcccggaggtggtgctacagaattaaccgtttctgccaccttgaagcagaagagttcatctgttgaaggcatagaaaagtggccgtatgaagctgctgctcttgcttttgaagccataccacgtactttggcacaaaattgtggagttaatgtgattcggaccatgactgctctgcaaggaaagcatgcaaatggtgaaaatgcatggattggcatagatggcaacactggtgccattgctgacatgaaggaaagaaagatttgggacgcatacaatgtgaaggcgcaaacatttaagacagcgatagaagcagcatgcatgcttctacgaattgatgacattgtaagtgggattaagaagaagcaggctcctggagctggccaaggtccaacgaaacccaaggtcgagactgaagcagatgcggatggtgagcaaattcttcctgattgaagatactgaatcacttaaacacacccttcgctttcaaactgtttgatgagatgatgggtctgttttgttgaagatgttttaagggatttgttgagcatctttttgcttgtatttttgagaattttaatctgtggttggtgtgagcttttaagtcgttatctttttactatttcatcctaatttaccttcaattccttaaatgcgtgaagttattaaatcagttattttaaagtatta

SEQ ID NO: 2526 - DNA, 2086 bp, Gossypium hirsutum
aatgtgatacgactacatatacggcggaagggggacactaacgctgtccacacacttcggcgcgaacagcactgggatctgttgtacgtgggtggttggagctggagaagaaactagaaacttagaaaccctttgcagatttgtttgttttcaacagttttaagctctaatactaacgaaatcgtaaatcatgcacgccccggttctcgttctaaaggattcgttgaaacgggagtctgggacgaaggttcaccatgctaacatccaagcctccaaggctgttgctgacattattcgaacaacattgggtcctcgatccatgttgaaaatgctccttgatgcttctggaggtattgttgtcactaatgatggaaatgctatcctacgcgagttagatcttgcacatccagcagcaaagtcaatgattgaattgagccgtacccaagatgaagaagttggagatggaacaacatctgtcattgttcttgctggtgagatgcttcatgttgcagaagcctttattgagaaaaattatcatcctacggttatttgtcgagcatacaataaggctttggaggatgctattgccgtgcttgacaagattgcaatgtctattgatgtcaaagaccgtgccacaatgttgggacttgtgaagagctgtatagggacaaagttcactagccagtttggtgatctgattgccgatttggcaattgatgcaactcaaacagtcggagttgaccttgggcaagggctgcgagaagttgatattaagaagtacattaaagtagagaaagtaccaggtggtcagttggaagattctaaggtactcaagggagtgatgatcaataaagatgtagttgcgcctggcaaaatgaagcgaaagattgtcaacccacgtattattcttcttgactgtccccttgagtataagaaaggggagaaccaaacaaatgccgagttggttaaggaagaagattgggaagttcttttgaaaatggaagaagaatacattgagagcctttgcttgcagattctgaaattcaaaccagacttggtggttacagaaaaaggacttagtgacttggcatgccattatcttagcaaggctggtgtcagtgcaattaggagggtgagaaagactgacaacaacagaattgcaaaggcatctggagctgttattgtgaatcgtcctgacgaattgcaggaatccgatgttggtactggagctgggctatttgaggttaaaaaaatcggggatgagttctttgcattcattgttgattgcaaagatccaaaagcttgtacggttctcttaaggggtgctagcaaggatctcctgaacgaggttgaaagaaatttgcaggatgccatgtctgttgctagaaacataattaagaatccgaaacttgttcccggaggtggtgctacagaattaaccgtttctgccaccttgaagcagaagagttcatctgttgaaggcatagaaaagtggccgtatgaagctgctgctcttgcttttgaagccataccacgtactttggcacaaaattgtggagttaatgtgattcggaccatgactgctctgcaaggaaagcatgcaaatggtgaaaatgcatggattggcatagatggcaacactggtgccattgctgacatgaaggaaagaaagatttgggacgcatacaatgtgaaggcgcaaacatttaagacagcgatagaagcagcatgcatgcttctacgaattgatgacattgtaagtgggattaagaagaagcaggctcctggagctggccaaggtccaacgaaacccaaggtcgagactgaagcagatgcggatggtgagcaaattcttcctgattgaagatactgaatcacttaaacacacccttcgctttcaaactgtttgatgagatgatgggtctgttttgttgaagatgttttaagggatttgttgagcatcttttgcttgtatttttgagaattttaatctgtggttggcgttagcttttaagtcgttatctttttactatttcatcctaatttaccttcaattccttaaatgcgtgaagttattaaatcagtt

SEQ ID NO: 2527 - DNA, 2125 bp, Euonymus alatus
gctctaggagattcaccccacactaacactcggcagagaagttgccactcttcgtttctctgcaactctcgtcattttggacacctcgtgttgcgcctacgcttcacttcttcgttcgatcctcgattcggcctttcggatttgttcgtttagggtttccattgcagagtttgtaagatcgcaaatatgcatgcgccagtacttgttctcaaggattctctgaagcgtgaatctggaagcaaggtgcagcatgctaatattcaggcttcaaaggctgttgctgatataattcgtacaaccttgggtccacgatctatgttgaagatgcttcttgatgctgctggagggattgttgttactaatgatgggaatgctattttacgtgagctagatcttgcacacccagctgcaaagtcaatgatagaattaagtcgcacacaagatgaagaagttggagatggaacaacatctgtcattgttttagcgggtgaaatgcttcatgttgcggaagccttcattgacaagaactatcatcccacagtcatttgtcgagcatacaacaaagctctggaggatgctattgctgtgcttgacaaaattgcaatgtccattgatgtaaacgatcgggcaacgatgttgggtctggtaaagagctgtattggtacaaagttcactagtcaatttggtgatttgattgccgatttagcaatcgatgccaccacgacggttggtgttgacctcggccaaggaattcgagaagtggatattaaaaagtacattaaggttgagaaggttcctggtggccagttggaagattcaagagttctcaaaggggttatgtttaacaaagatgtagttgcccctggaaaaatgaggagaaagattgtcaacccacgtatcattcttctcgattgcccccttgagtacaagaaaggtgagaaccaaacaaatgcagaattggttaatgaagaagattggggagtccttttgaaaatggaagaagaatatattgagaacctctgtgtgcagatcttgaaattcaaaccggacttggtgattacagagaagggtctcagtgatctggcttgccattatctgagcaaagcaggcgtcagtgcaataaggaggttgaggaagacggacaataacagaattgccaaagcatgcggtgccgttattgtgaacagaccagaagaactgcaggagtccgatgttggtactggggctgggctgtttgaggttaagaaaattggggatgaattttttgcttttattgttgattgcatagatccaaaagcttgtaccatactattaagaggggccagtaaggatctcctaaatgaagtagagagaaacttgcaggatgctatgtctgtagcgaggaacatacttaaaaatccaaagctagttccgggaggtgggggcacagagttaactgtatctgctactttgaagcaaaagagttcatccattgaaggcatagaaaagtggccttatgaagccgcggcaatagcttttgaggctataccacgaactttggcacaaaattgtggtgttaatgtgatccggactatgactgccctacagggacagcatgccaatggtgaaaatgcatggattggcatagatggaaatactggtttggttgctgacatgcaagagcggcagatatgggatgcctataatgttaaggcacaaaccttcaagacagcaatcgaagctgcttgcatgcttctcaggattgatgacattgttagtgggatcaagaagaagcaagcccctggagcggggcaagcaccaaagtccaaggttgagacagaggcagatgccgatggtgagcaaatacttcctgactgaggatactgttgctcccggactgactgcgcattcagataatagcgagaggttttgtttgcattctttgcctgttcaagggttttgttgagcttttaattgtacaatacttcaaattttgtgatcttggccagatcatagtttggttgcttgctttgaactacgtttctataatgtttgcagctgtatactctcggtaactctctgcagtttgtatttttgaaagctctgttagttcaacttcgaggatgaaagtgtagttcatgttctt

SEQ ID NO: 2528 - DNA, 2149 bp, Vitis vinifera
agggtttacgagacgcacttcagtacgacggaggctccagacttcactccattttccctcgcaaactattccgaagaccctttcacgcagaagctgtaaagcatcttctcgacgccattagggttttccacaatctccagtcatgcaagcgccagtgctggttctcaaggattctttgactcgcgaatcaggaagtaaggtccagcatgccaatatccaagcgtcaaaggctgtggctgacataatccgcacaaccttgggtccaagatccatgttgaagatgttacttgatgctggaggaggtattgtggtcactaatgatggaaattctattcttcgggagttagatcttgctcatccagctgctaagtccatgattgaattaagccgcacacaagatgaagaagttggtgatggaactacttcagtcattgttcttgctggtgagatgcttcatgtcgcggaagctttcatagacaaaaactttcaccctacagtcatatgtcgagcttataataaagctcttgaggatgctattgcggtgcttgacaagattgcagcccctgttgatgtgaatgaccgtgttgcaatgttgggaatggtgaagagttgtataggtacaaaatttactggtcaatttggggatctaattgctgatttagcacttgatgctaccacaactgttggtgtggaccttggtcaaggattgcgagaagtggacattaagaagtacataaaggttgagaaagtccctggtggccagttggaagattccaaggttcttaaaggagttatgattaacaaagatgttgtggcccctggaaaaatgagaagaaagattatcaaccctcgtattattcttcttgattgcccccttgaatataaaaaaggggagaaccaaacaaatgcagagttggttagagaagaagactggggaattctcctgaaaatggaggaagaatacattgagaatctgtgcatgcaaatactaaaattcaaacccgatttggtcataacagaaaaggggcttagtgacctggcatgccattacttgagtaaagctggagttagtgcaatcagaagattgaggaaaacagacaacaacaggattgctaaggcatgtggagctgttgttgtaaacagaccagatgaacttcaagaatctgatgtaggaactagggctggaatttttgaggtcaagaagattggagatgagttctttgctttcatagatgagtgcacagaccctaaagcatgcactgttcttcttagaggtgcgagcaaggatcttttgaatgaagtggaaagaaacttgcaggatgccatgtctgtggcaagaaacatgataaagaatccaaagcttgttcctggtgggggtgctacagagttaactgtttcagctaccctaaaacagaaaagttcatctgttgaaggcattgaaaagtggccttatgaagctgctgctatagcttttgaggctattccacgtactttggcacagaattgtggtgtgaatgtgattaggactatgactgctttgcagggaaagcatgcaaatggtgaaaatgcctggatcggaatagatggaagtactggtgcaattactgacatgaaggagcggaagatatgggatgcttataatgtgaaggcacagacctttaagaccgccatcgaggctgcttgcatgctgcttaggatcgacgacatcgtgagtggaataaaaaagaaacaagcccctggagcaggccaagctccatcaaagcctacaattgagcaagaaggagatgcagacaacgagcaaatgattccggagtaaagtatttgatgattcgaccacatgggatgtcgggcagagtttgttaaaggagttggtggaaatgtcggatccgattttgtcatttttcacagatttttttgccaagttctggtttaggtgtagttgtctgaaattttggctatatatttcatgatcagtcagaatcgttcctttgttttttctgtctgaaatggacttgctcactgtcagtctttaacaccttgatgtgctttccttgggcagcttttttatgcggggatttggttgtcttcttgaaatgaatgaatcgctagtgccttaaatggcatttcactcgaatttgatcctcttttg

SEQ ID NO: 2529 - DNA, 1998 bp, Pennisetum glaucum
atggcgctgcacgcccccgtgctcgtgttgaaggactcgctgaagcgtgagtcgggctcgaaggtgcatcaggccaacatccaggctgccaaggctgtggcgagacgatcatacgcactacactgggtcccagatccatgttaaagatgcttcttgatgctggaggaggtattgtggttactaatgatgggaatgctatattgagggagatagacgttgcacatcctgctgctaagtctatgattgaactaagccgtacacaagatgaggaagtgggtgatggcacaacctctgtgattgttctagctggtgagatgctccatgttgctcaggcatttatcgacaagaactatcatcctactgttatttgccgagcttacactaaagcacttgatgatgctatagctgttcttgacaagatagcaatgcctgttgatgttaatgatcgtgcatcaatgctaggtcttgtgaagagctccatcggtacaaaattcactggccagtttggcgaccttattgctgaccttgctattgatgctactacaacagcaggtgttgaccttggtcagggcatgcgtgaagttgatatcaagaagtatattaaagtagaaaaggttcctggtggtcagttagaggattctagggttcttaaaggagtgatgatcaataaggatgttgtggctcctggtaaaatgagaaggaagataattaacccacgtattatccttctggacagccccattgagtataagaagggagaaaatcagaccaatgctgagttgatgaaggaagaagattggcaagttctgctggagatggaggaagaatacataaaggacctttgtgcacaaattctaaaatttaagcctgatttggtcatcacagagaaagggctcagtgatcttgctattcattatttgagcaaggctggtgttagtgcaattcgtagacttcgaaaaactgacaacaacagaattgcaagggcttgtggagcagttatagtgaacaggcctgaggagcttcaagaatctgatgtgggcacaggagctggcctgtttgaggtcaagaagataggtgatgaattcttcgctttcatcgttgattgtaaagatcctaaggcatgcactgttctgttgaggggagcaagcaaagatgtcttgaatgaagttgagaggaacctgcaggatgccatgtatgttgcgaggaacattttgaagaaccctaaactcctaccaggaggtggtgctactgaattgactgtatcagcaacactgaagcaaaacagttcttcagttgaaggtgttgaaaagtggccctatgaagctgctgctttggcatttgaagcaattccgagaacattggcccaaaattgtggtttgaatgttattaggacaatgactcaactccaaggaaagcatgctaatggtgaaaatgcctgggttggccttgatggaagaagtggtgacattgttgatatgaaagagcgaaagatctgggactcatacagtgtcaaagcacagacattcaagacagctattgaggctgcttgcatgctgttgagaatcgacgacatcgtcagcggcatcaagaagaagcaggctcctggagcctccgctcccaagcaaccccagattgaaacggaaggtgatgtggacaacgagcagatgatcccagagtagatgttgtagcgactctagtgaaggtatttactgaggtcaggataggacattgaaccgagtttattatttgagtgttgttggtggctgggcctagcatgcaaatgtacctgatttcatacaactgagtggttcgtggatttggggatccaggtttttgaagtatggcttctgttcatcttgtcttggacttcgctggacgactaagcagtgaaactagtagtttttgtggctaactgtctgttgtattgtaatgacttgtttggttatgctattgttcccatgctagtaatatcattacagctaccgatagcttgactcg

SEQ ID NO: 2530 - DNA, 2213 bp, Eucalyptus grandis
acgccttttcagttttcccttcaattttcccttcactttcacttcaccgcctcttcactcctcgcgctctccctcccgccccgccgctctccgccgccggccgcctcgccggagctccccgccgccgcatccgaatctcccgcgttttggccggactcgactcttcgtcgcgcggcttgtgatccgcgagcgctcgtcgctggttgtttgcttctcgaagcaagagcaaaatgttgcactctccgatgctcgttctcaaggattccttgaaacgtgaatctggaagcaaggtacaacatgctaatatccaagcatccaaggctgttgctgatattatccgcaccaccttgggcccaaggtccatgttgaagatgctacttgatgctagtggaggaattgttgtgacaaatgacggaaatgctattcttcgtgaacttgatattgcacaccctgctgcaaagtcgatgattgagcttagccgcacccaagatgaagaagttggagatggaacaacttctgtcattgtccttgctggtgaaatgctccatgttgcagaagcgttcattgacaagaactatcatcctactgtcatttgtcgcgcctataacaaagctttggaggatgctattgctgtattggataaaattgcaatatcagttgacgttaatgatcgtgctagcatgcttggccttgttaaaagtagcattggtacaaagttcaccagtcagtttggggatctgattgctgatttagctattgaggctaccacaattgttggtgtggatcttggtcaagggctgagagaagtggatataaaaaagtacataaaggttgaaaaagtccctggtggacagttggaagattcgatggttcttaaaggagttatgttccaaaaggatgttgtcgctcctggaaaaatgagaaggaagattgtcaacccacgcgtcattcttcttgattgcccccttgagtacaagaaaggcgagaatcaaacaaatgccgagttggtcaaagaagaagattggagcattcttttaagaatggaggaagagtacgttgagaatatatgcatgcaaatactgaaattcaaaccagacttggtgataacggagaagggactgagtgacttggcatgccattattttagcaaggctggtgttagtgccattaggaggttgaggaagacggataataacagaattgcaaaggcttgtggggccacgattgttaatagaccagatgaactgcaggagtcagatgttggtactggggctggtttgtttgaggttaagaagattggggatgagttctttgcatttattgttgattgcaaagatccgaaagcttgtacagtactcttaaggggtgcaagtaaggatcttctgaatgaagttgaaagaaatttgcaggatgccatgtctgtagcaagaaacatcatcaagaatccgaaacttcttcctggtggtggagctacagagttgactgtttctgccatgttgaagcagaagagttcctcgattgaaggcatagaaaagtggccttatgaagctgcggctattgctttcgaggctattcctcggactttagcccagaattgtggagtaaatgtgataagaatcatgactgccttgcagggaaagcatgcaaatggagaaaatgcatggattggcattgacggaaacactggtgctattactgacatgaaagaacagaagatctgggattcctacaacgttaaggcgcagacattcaagacagccatcgaagcttcttgcatgcttcttaggattgatgacatcgtgagcggtatcaagaagaagcaggcgcccggagctggtgctgcgccgaagccgcaggtggagaccgaagccgatgccgacggcgagcaaatactccctgactagggacaccgcgggcgcatcccatgctcgttcgctttttgtatacctcggatcgtcctcttttcaagcgcttttgaaccgagcagttgccctcgagtttttgagttgctttaaatggcaactgaagctgattaggattgtgctagaatgtgtttattcaagaacctttctgaacctttcattttgatctgctgctctcctttttcctatgaagttttgtactgtcttcgatttagttggtgattcatttcgtaatatcccgaagaaattacaaaaagaagaagaagaagaagaagaaagctttaataaaag

SEQ ID NO: 2531 - DNA, 6212 bp, Vitis vinifera
tctagtttttcaatttcaattgtatttactgttttgttttattatttatttattaatcaatcttagggtttgaggatcttgaaaccaaaatccaaaatcatgcaggcaccagtactcgttctcaaagattctctgaaacgcgagtctggaagtaaggtgcagcatgctaatatccaagcctcaaaggctgttgctgacataatacgtactaccttgggtccacgatccatgttgaagatgctacttgatgctggtggaggaattgtagtgactaatgatggaaatgctattctccgggaattagatcttgcacaccctgcagcaaagtcaatgattgagctaagccgcacacaagatgaggaagtaggagatggaacaacatctgtaattgttcttgctggtgagatgctccatgttgctgaagctttcattgataagagttatcatcccacggtcatttgccgagcatacaataaagctctggaggatgctattgctgtgcttgacaaaattgcaatgtccatagatgtgaaggaccgttcaacggtgttggggttggtgaagagttgcataggcacaaagttcactagtcaatttggggatctaattgctgacttggcaatagatgccaccatgacagttggtgtggaccttggccaagggttacgagaagttgacattaagaagtacattaaggttgagaaggtccctggtggccaattagaagattcgaaggttcttaaaggagttatgatcaacaaagacgtaattgcccctggaaaaatgagaagaaagattgtcaacccacgaatcattcttcttgattgtccccttgagtacaagaagggcgagaaccaaacaaatgctgaattggttaaagaagaagactggggagtcctattaaaaatggaagaagaatatattgagagtatctgcatgcagatattgaagttcaaaccagacttggtgatcacagaaaaaggccttagcgaccttgcatgtcattatctgagcaaggctggggtcagtgcaataaggaggttgagaaagacagacaataatagaattgcaaaggcatgtggtgctgttatcgtgaacagacctgatgaattgcaggaatctgatgttggcactggggctggactatttgaggttaagaaaattggggatgagttctttgctttcattgttgattgcaaggacccaaaagcatgtactgtgctgttgagaggtcccagtaaagatcttttgaatgaagtggaaagaaatttgcaggatgccatgtgtgtagctagaaacataatcaagaatcctaaactagttccgggaggtggtgcaacagagttaactgtatctgctaccctgaagcagaagagttcatctattgaagggatagaaaagtggccttatgaagctgctgctgtggcttttgaggctataccacggacattggcacagaattgtggggttaatgtgatacggaccatgactgcactccagggaaagcatgcaaatggtgaaaatgcatggatgggcatagatgggaacacgggtgcaatcactgatatgaaagagcgcaagatttgggatgcttacaatgtaaaggcacagacctttaagacagccattgaagctgcttgcatgctgcttaggatcgatgacatagtgagcgggatcaagaaaaagcaggctcctggagcagggcaagcaccatcgaagcccaagatcgaggaagaaggagatgcagacaacgagcaaatacttcccgagtgatgatatcaactatatgataggcggcattatttgacaaaattgcaggttttgtttttaggggctatatatgagtttcagtgagctgttgattgtgggactttttttttttattcaaattttggtgctgttctgaattattagctcgacttttgttggtttaatggttgaaatgggatttgagggtctctctttcttattagtttttggtccaacatcttggtttcttgtttcttcttccttttttttttttttttttttttgtgtttttcgttttttcttgtatgatcatgagttcggtcgcattatcagcagaaactgtgatggatttattaaatgaggacaataagctctagcagaaggaaaccattttatcgaattattgaagaattggaggcaattagaagatggatggagaagggagttcgaaccatattggtggtatgaatgaccttgaaaatgagggattcctggatggcaaggagattgagaggtactggtcagagatatcggagaaaagcatgatcatgtataaagagccgcttctgacaaagaggatgaacactacctcccagattgccattgttggtgctaatgtctgctccattgagagccttgactatgagattgttgaaaatgaactatttaagcaagactggaggtcaaggaagaaggctcagatatttcagtatgtggtactcaagtgggcacttgcacttcttatagggcttggtactggacttgttggcttcttcaacaatattgcagttgagaatattgctggtttcaaactgctgctgactagtgatttcatgtctcagaaaaatgcagatatttcaaggcttttgcagcatatgctagctgcaatataggtttggcagctgctgcagcagccctttgtgctttcattgctccagcagcagcagggtctggtattcctgaagtgaaagcatatctcaatggtatagatgctcattcaatattggctccaagtaccctctttgtaaaggtatataagaagttccagtacgcccctcccgtctgtctatgcatgtgtgtgtctgagtgcatgcatacattcatgttcatgttctagaaattaggcatagtgttcataatctttcttcagacaatagaattttctcattaatattgcttttgcatcataagtcctaagaagctaagattgcatgcttacccctcaaacaaaaggatattgaaaatagagatggcaacgacttggatttgagaggctttaagtgagattattttttccaatctattctgtttatgagtatctagaaaatgttggatgtaagaattgttcattgggatgcaggtcaattgggtcctgttgccaaagccagagctggctagaccagacaggtttgcaaatttgcttaaattttgtcaactttaatgggaaaagttattggctttggtttttaggaaaatctaggcatgatcatgtagttgtctattactaccctatccacttaagcaaattgaatttgcattaccatttgctactaccacagtggaggctctccatgaaactttacaacaggttgttgtgggacatcttccatcaaatgaagtgaataagctttccttgatctatgttgtgtattttgcctaggtttcaaactcttgcctggttccattttctgttgtcagttatgaaccttccacactccctgttcctcaaactctaagttctctgttatctttatcgttttgggtttgtcagatttttggttccattcttggtgtttctgctggatttgtggtgggtaaggaagggccaatggtgcacacgggtgcttgcattgcctctcttcttgggcagggaggctctcgcaagtatcatttaacgtggagttggctaaaatacttcaaaaatgatcaggacagacgagacttgatcacttgcggggctgctgccggggtggctgctgccttccgtgctccagtgggtggtgtcctctttgcccttgaagaagcagcttcatggtacatctctttctctcatcactatcctagtttctttggatgcagtattaggcaaatctattttcacatccaatagttgaaatgatatcaactgtttacctcttgtgccatagatgaaaaacaaagaagaggtcacttaagttattagaatagcttagtttcttcttggacatgcttcaggtggcgaagtgctcttctttggaggacatttttcacaacagctgtggttgctattgttttgagagctttcatagaatattgctggactggaaaatgtgggctattcgggcaaggaggtctgataatgtatgatgtcagtgctgctacagaaacatacggtgtcccagatatactagcagtactatttctaggagtcattggcggcatttttggaagcctatacaattatcttgtggacaaggttcttcgaacttatagcatcatcaatgagtatgtcattgtatttcatcccagattgttgaatttctcacttataaacatcaaattagctcaactttccagcatcataggcatttgtgtttactgatcatccttgatgctcttatcacttagtttttgaataaagcactaaaacatgggaccacggatgtgatccatgtttagcatgtgcttttattcaggtcacagagcaatgtagatgagatggcagtaatcaatgatactggccggggttgttttttctttttctctgatactaaattctgctatatccactggttctatcgctgcagaaaaggtgcccgttccaaaatattacttgttgttactatctgcatcttgacaacctgttgctcctttggcctgccatggttttcaaagtgtatagcctgccctgctgatctggctgtgacctgctccacagaatctggcaactttaaacgcttccagtgccaatcaggttactacaatgacctcgcttccctcttcctgaatactaatgatgacgctattcgcaacctattcagcaccagcactaggcatgaatttcgtatttccagcctcttcatcttctttgctgccatctactgtcttggcattatcacgtatggtattgctgtcccctccggtctcttcattccagttatactagctggagcttgctatggtcgtcttgttgggagactctttgcatctatatctaaacttgatacgggactctttgccctccttggagctgcatccttcctcggtggcaccatgagaatgacagtttccctgtgtgtaatcctgctagagcttaccaatgatctactattgctgccccttgtcatgcttgttctccttgtctcaaaaacagtggctgatagcttcaacaaaggtgtctatgaccagatagtaaaactgaagggattgccttacatggaggcccatgcagagccctacatgaagcatttggctgcacgtgatgttgtttcaggtccattggttaccttctctggcattgaaaaggtggggaacataatgcatgctttgaggactacagggcataacgggttccctgtgattgacgagccgcctttcacagatgcaccagaactgtgtggacttgtgttgaggtctcatttgcttgttctactaaaggggaagagtttctctaggaatcaggtgcattgtggaggggagatcttgagaaagtatgcagcattggactttgccaaggcaggatcaggaaagggggtgaaactggaggatttgaatattgaagaggaagagatggaaatgtatgtcgatctccatcctataacaaatgcatctccatacaccgtggttgagacgatgtcgttagcaaaagctgcaattctctttcggcaagtgggccttaggcacatgtgtgtggtaccaaagagccaaggggtaacatctctttcgttttccctggaagttgcatacttttacatacacacacatgaagttatttgaggtgcatggttatcatttctgactcgtctgctcattgcagaggcctccaattgttggaatcctgacacggcacgacttcatgccagagcacatattgggactctaccctcatttgagtcctcacaagtaatttgcttccccagaactgcggatatgtttgtttcaagttgttgttttatatcagaatgtttgaattttcttctttttttttggggaggggttctgggtgtttgcaaactctttatggaacatatttaggtcaatttatagcaacaaattgatttcttctcccaaaatggccttttgcccaaaagcttaggcgatgtggatatgccctacatctcccccctttaaggcagcaaaatggttatggtttctctacaaaccacaacctgggtatcccttattttttattttatttgtgtacgtgcgtgttttttccacaaaaatactcccttttgaataaaaaattaggatgatgagtcgat

SEQ ID NO: 2532 - DNA, 1927 bp, Ambrosia trifida
ccgctgtaaccgcttcttctcgtgttttctctcatttcaaaagaaacacaaaccctagactcaacactctgacgtcatctcctacaactgatcgatccctagggttcttcttcgtacactcacatctttagctatgcagtcaccagttctcgttctcaaggattcgctcactcgtgaatctggaagtaaggtgcatcatgcaaatatccaagcttctaaggccgtggctgatattattcgcaccacattgggtccaaggtctatgttaaagatgatgcttgatgcttcaggaggaattgtggtcactaatgatgggaatgccattttgcgggagttggatattgctcacccagctgcaaagtccatgattgaacttagccgcacacaggatgaggaagttggtgatggaactacatcagtcattgttcttgctggtgagatgcttcatgttgcggaagctttcatagacaagaaatatcatcctacagttatttgccgagcttacaacaaggctcttgaagatgctcttgctgtgttggataagatctccatgtctattgatgtgaatgatcgttcaatgatgcttggattggtgaagagttgtattggcacaaagtttaccagtcaatttggggatttaatagcagatctagcacttgatgcaacaacaacagttggtgttgatctaggccaaggtttaagagaagtggatattaaaaagtatatcaaggttgaaaaaatccctggtggtcagttggaagattccaaagtactcaaaggtgttatgtttaacaaagacgttgtcgtccctggaaaaatgaaaagaaaaatcgtaaacccccgtatcattttactggattgccctctggagtacaaaaagggtgagaatcaaacaaatgcggaattggtcagagaagaagattgggcagtactcttgaaaatggaagaagagtacatagaaaacctgtgtgcacaaattcttaaattcaagcctgatttggtgatcactgaaaaagggcttagtgatttggcatgccattatttcagtaaagctggagttagtgctattaggagattaaggaaaacagataacaataggattgctaaggcatgcggagcggttattgtgaacaggcctgatgaacttcaagaatcagatgttgggactggagctgggcttttcgaggttaaaaaaattggtgatgagttttttgtcctacattgtggaatgtaaagacccgaaagcatgcacggttcttctcagaggtgccagcaaggatcttttgaatgaagttgagcggaacttgcaggatgctatgtcggtggctaggaatatactaaagcatccaaaacttgtccctggtggtggtggcactgagttgactgtttctgctacactgaagcagaagagctcatcaattgaaggcattgaaaagtggccttatgaagctgcagctgtagcatttgaggctataccaagaacattggcacaaaactgtggtgtcaatgtcattcgaaccatgactgctctacaggggaagcatgcaaatggtgagaatgcctggacaggaatagatgggaatacaggtgaaattgctgatatgaaagaattaaagatttgggatgcgtataacgtgaaagcgcagaccttcaagaccgccattgaggccgcttgtatgcttctaagaattgatgatattgtaagtggaataaaaaagaaacaggcccccggagctagccaacaatcaaaacccactatcgagacagaaggggacgctgataacgagcagatgattcccgagtgaagaaagcattaatttgagtatccatggaaagtttttcgctcggttcaatcacagtttctggtgtgttttattgttgccaaggcttaaactatttagtcaactaaaattttggtatgttacgc

SEQ ID NO: 2533 - DNA, 1759 bp, Catharanthus roseus
taagcggaaaagccctcgaaaaacactctccataacattttaactcccgcaacctctctacagcccttcgccggagatcctatcggaaaatgcaggctccagtcctcgttctcaaggattctttaaagcgtgaatcaggaaataaagtgcattatggaaacatccaagcatcaaaggctgttgcagacataattcggactactttgggtccacgatcaatgttgaagatgcttcttgatgctgctggtggaattgtagtgactaatgatggaaatgccatcctgcgagagttggatcttgctcatccagcagcaaagtccatgattgaacttagtcgtactcaagatgaggaggttggagatggaactacatccgtaattgtgcttgcgggtgagatgttgcatgttgctgaagctttcattggcaggaattatcatccgacagtcatttgtagagcttataataaggctctagaggatgctattgctgtgcttgacaagattgcaatgagcattgatgtgaaggatcgttcaacaatgttaagccttgttaagagctgtattggcacaaaatttacaagtcaatttggagaccttattgcggacttagccattgatgctacatcaacagttggtgtggaactgggccaaggcttgcgtgaggtagatatcaaaaagtacatcaaggttgagaaggttcctggtgggcagttggaagattccaaggtcctcaaaggagttatgattaacaaagatgttgtggctccaggtaaaatgaggagaaaaattgtgaatccacgtattattcttcttgattgtcctctggagtacaagaagggcgagaaccaaactaatgcggaattgatgagagaagaagattggagtgtactgctaaaaatggaagaagaatacattgagaacctctgctttcagatattgaagttcaaaccagatttagtgataacagaaaagggacttagtgaccttgcgtgtcactatctgagcaaagctggtgtctctgccatcagaaggctccgtaagacggataataacagaattgctaaggcatgtggggcagttattgttaacaggcctgatgaattgcaggaatctgatgttggtactggagctagtctattcgaagtccggaaaataggggatgagttcttctcgttcattgttgagtgcaaggatccaaaggcttgtacagtactcctgaggggtgcaagcaaagatttattaaatgaagtagagaggaatttacaggatgccatgtctgtagcaagaaacattatcaagaatccaaaacttgttcctggtggtggtgcgacagagttgactgtatctgcaatgttgaagcaaaagagttcatcaattgaaggcatagaaaagtggccttatgaagctgcagcaattgcttttgaggccatcccacgaactttagctcagaattgtggagtcaatgttattaggactatgacagccttgcaaggaaagcatgcaaatggagaaaatgcgtggattggcattgacgggaatactggagaaattactgatatgaaagagaggaagatatgggactcgtacactgtgaaggcacaggcgtttaagactgccatagaagctgcttgcatgcttctgaggattgatgacatcgtaagtggaataaagaagaagcaggctcctggagcaggatcagcacctaagtctaaagttgagggagaaggtgaagcagacaacgaagccctaattccagaatg

SEQ ID NO: 2534 - DNA, 2137 bp, Tabernaemontana elegans
ttttccaccgcttgctcaaaaacatcaaaaaagagttcaaaatacacacatttggaaagccctccaaaactcccaccaacgaaaaaaagccctccacctcttcacagtcgctctcgctgtcgccggagatcagatcggaaaatgcaggccccagtcctcgtcctcaaggattctttaaagcgtgaatcaggaaataaagtgcattatggaaacatccaggcatccaaggctgttgcagacattattcggactactttgggtccacgatcaatgttgaagatgcttcttgatgctactgggggaattgtagtgactaatgatggaaatgccatcctacgagagttagatcttgctcatccagcagcaaagtccatgattgagcttagtcgtactcaagatgaggaggttggagatggaactacatctgtcattgttcttgctggtgagatgctccatgtcgcagaagcgttcattggcaggaattatcatcctaccgtcatttgtagagcttacaataaagctctagaggatgctattgctgtgctggacaagattgcaatgagcattgatgtgaatgatcatgcaacaatgctaggccttgtaaagagctgtattggcacaaaatttacaagccaatttggagatcttattgctgatttagcaattgatgctacatcaacagttggagtggaattggggcaaggcttgcgtgaagtggatatcaaaaagtacatcaaggttgaaaaggttcctggtgggcagttagaagattcaaaggtccttaaaggagttatgattaacaaagatgtagtagctccaggtaaaatgaggagaaaaattgtgaacccacgtattattcttcttgattgtcccctggagtacaagaaaggcgagaaccaaactaatgcagaattgatgagggaagaagattggagtgtactgttgaaaatggaagaagaatacattgagaacctttgtatgcagatactgaagttcaaaccagatctagtaataacagaaaagggactcagcgaccttgcatgccattatctgagcaaagctggtgtctctgccatcagaaggctaaggaagacagacaataacagaattgctaaggcatgtggggcagttattgtcaacaggcctgatgaattacaggaatccgatgttggttctggggctggtctattcgaagtgagaaaaattggggatgagttcttctcattcattgttgattgcaaggatccaaaagcttgtacagtactcttgaggggtgccagcaaggatctattgaatgaagtagaaaggaatttacaggatgccatgtctgtggcaagaaacattatcaagaatccaaaacttgttcctggtggtggtgcaacagagttgactgtctctgcgatgctgaagcaaaagagctcatctattgaaggcatagaaaagtggccttatgaagctgcggcaattgcttttgaggccatcccacgaactttagcacagaactgtggagttaatgttattaggactatgacagccttgcagggaaagcatgcaaatggagaaaatgcatggattggcattgacgggaatacaggagaaattactgatacgaaagagaggaagatatgggattcatacactgtgaaggcacaggcattcaagactgccattgaagctgcctgcatgcttcttagaattgacgacattgtaagcggaataaagaagcagcaggctcctggagcaggatcggctccatcaaagcctaaagttgaggaagaaggtgaagcagacaatgaggccctaattcctgaatgagaaggaaaacagaaaattttaacgattgaatttgccttacagttgaaagttgtcttgcatttgtatgctgtaaaaaagagcttcattgtgctgattttgtagtttcgtttttggcgtaggctagtaagcgatccccgtaattctgtttctcattaaatctctttagctttgcctcttggggctgatctaagatgcctgcacaagattgtctttgtgtgagatcatttacctcaagtctgttatttatgtgctttttaagttttgttcgcgtacgaacaagtctaggcttaatttatgtacacttggctcccagtctgtgcat

SEQ ID NO: 2535 - DNA, 2134 bp, Populus trichocarpa
cttacccaacccaccgagggagggctggcagccatttttcgtttttaagaggattaaaagtttaaacatacaagcacacaaacagtccgtatcttcttctcctctcgtctccttttctagggttttctacctgtataacctaaacaagcgaaaaggaaggatgcacgctccagttctcgttctcagggattcgttgaaacgagaatcaggaacgaaggtacatcatgccaacatacaggctgcaaaggcagttgccgatatcatcaggaccaccttaggtccgcggtccatgttgaagatgcttctcgatgccagcggtggtattgttgttaccaacgacggcaatgcaatcctccgtgagttagatctggctcatcctgctgccaaatccatgattgaattgagtcgcactcaagacgaagaagtcggtgacggaacgacctctgtcattgttctcgggggagagatgcttcatgttgctgaagctttcatcgaaaagagctatcatcctactgtcatttgccgagcctacagtaaagctctggaggatgctattgccgtgcttgacaaaattgctgtgtccattgatgtcaacgatcgtccggcaatgttgggtctggtcaagagttgcataggcacaaagttcactagtcaatttggggacttaattgctgatctagcaattgatgccacctcaacagttggtgttgaccttggccaagggttgcgggaagttgacattaagaaatacattaaggttgagaaggtgcctggcagccagttggaagattcgaaggttcttaaaggggttatgtttaacaaagatgtggttgccccaggaaaaatgaaaagaaaaattcccaatccgcgcattattcttcttgattgccccgttgaatataagaaaggagagaaccagacaaatgccgagctggttagagaagaagactgggaagtcctgttgaaaatggaagaggaatacatagagaatatgtgtgtgcagatacttaagttcaaaccggatttggtaatcacagagaagggtctcagtgatttagcatgccactatctgagcaaagctggtgttagtgcaatcaggaggctgaggaagactgataataacagaattgccaaggcatgtggggccaccattgttaacaggccagatgagttgcaagagtctgatgttggtactggggctggcttatttgaggttaagaaaattggggatgaattctttgctttcattgttgattgcaaagatccaaaggcttgtactgttctcttgagaggtgccagcaaggatcttctgaatgaagtggaaagaaacttgcaggatgccatggctgtagcaagaaatatactcaagaatccaaaactccttcctggtgggggtgctacagaattaactgtatctgctgctctgaagcaaaaaagttcatccatcgaaggcatagaaaagtggccttatgaagctgctgctatagctttcgaggctataccaaggacattggctcagaattgtggtgttaatgtgatccgaaccatgactgctctgcaaggaaagcatgcgaatggtgaaaatgcatggattggcatagatgggaacactggtgaaattactgatatgaaagagaggaagatatgggatgcatacaatgtcaaagcacaaaccttcaaaacagcaatcgagtccgcttgcatgcttctgagaattgatgacattgtgagtggaatcaagaagaagcaggcccctggagcccagggtccatccaagcctaagattgagacagaagcagatgcagacagcgagcagatacttcccgactgaagatgttagttactatttgaactgactttcctcaaaagaaagccactttcttttcttcagctgttctattcaagttttgattagggagtgcgtttcttcaaagttttgggcctatttgtctgaatctgcctgccggtgttgtggagcatatagttattgtatgctactcttattagttagtggtagtgtccagtctgaatttcttcatctacataaactgtattgacgtggttctcttttctcttcttttttgccttcttgttgtcttacgcatctctttgaaagaaaatacttgctttggga

SEQ ID NO: 2536 - DNA, 2135 bp, Eucalyptus grandis
tcactcctcgcgctctccctcccgccccgccgctctccgccgccggccgcctcgccggagctccccgccgccgcatccgaatctcccgcgttttggccggactcgactcttcgtcgcgcggcttgtgatccgcgagcgctcgtcgctggttgtttgcttctcgaagcaagagcaaaatgttgcactctccgatgctcgttctcaaggattccttgaaacgtgaatctggaagcaaggtacaacatgctaatatccaagcatccaaggctgttgctgatattatccgcaccaccttgggcccaaggtccatgttgaagatgctacttgatgctagtggaggaattgttgtgacaaatgacggaaatgctattcttcgtgaacttgatattgcacaccctgctgcaaaggcattcgatgattgagcttagccgcacccaagatgaagaagttggagatggaacaacttctgtcattgtccttgctggtgaaatgctccatgttgcagaagcgttcattgacaagaactatcatcctactgtcatttgtcgcgcctataacaaagctttggaggatgctattgctgtattggataaaattgcaatatcagttgacgttaatgatcgtgctagcatgcttggccttgttaaaagtagcattggtacaaagttcaccagtcagtttggggatctgattgctgatttagctattgaggctaccacaattgttggtgtggatcttggtcaagggctgagagaagtggatataaaaaagtacataaaggttgaaaaagtccctggtggacagttggaagattcgatggttcttaaaggagttatgttccaaaaggatgttgtcgctcctggaaaaatgagaaggaagattgtcaacccacgcgtcattcttcttgattgcccccttgagtacaagaaaggcgagaatcaaacaaatgccgagttggtcaaagaagaagattggagcattcttttaagaatggaggaagagtacgttgagaatatatgcatgcaaatactgaaattcaaaccagacttggtgataacggagaagggactgagtgacttggcatgccattattttagcaaggctggtgttagtgccattaggaggttgaggaagacggataataacagaattgcaaaggcttgtggggccacgattgttaatagaccagatgaactgcaggagtcagatgttggtactggggctggtttgtttgaggttaagaagattggggatgagttctttgcatttattgttgattgcaaagatccgaaagcttgtacagtactcttaaggggtgcaagtaaggatcttctgaatgaagttgaaagaaatttgcaggatgccatgtctgtagcaagaaacatcatcaagaatccgaaacttcttcctggtggtggagctacagagttgactgtttctgccatgttgaagcagaagagttcctcgattgaaggcatagaaaagtggccttatgaagctgcggctattgctttcgaggctattcctcggactttagcccagaattgtggagtaaatgtgataagaatcatgactgccttgcagggaaagcatgcaaatggagaaaatgcatggattggcattgacggaaacactggtgctattactgacatgaaagaacagaagatctgggattcctacaacgttaaggcgcagacattcaagacagccatcgaagcttcttgcatgcttcttaggattgatgacatcgtgagcggtatcaagaagaagcaggcgcccggagctggtgctgcgccgaagccgcaggtggagaccgaagccgatgccgacggcgagcaaatactccctgactagggacaccgcgggcgcatcccatgctcgttcgctttttgtatacctcggatcgtcctcttttcaagcgcttttgaaccgagcagttgccctcgagtttttgagttgctttaaatggcaactgaagctgattaggattgtgctagaatgtgtttattcaagaacctttctgaacctttcattttgatctgctgctctcctttttcctatgaagttttgtactgtcttcgatttagttggtgattcatttcgtaatatcccgaagaaattcaaaagaagaagaa

SEQ ID NO: 2537 - DNA, 1982 bp, Ambrosia trifida
actcaaactctgacgtcatctcctacaactaattgatccctagcctccttcttcttcgtacactcacatctttagctatgcagtcacctgttctcgttctcaaggattcgctcactcgtgaatctggaagtaaggtgcatcatgcaaacatccaagcttctaaggccgtggctgatattattcgcaccacattgggtccaaggtcaatgttaaagatgttgcttgatgcttcaggaggaattgtggtcactaatgatgggaatgctattttgcgggagttggatattgctcacccagctgcaaagtcgatgattgaactaagccgcacacaggatgaggaagttggtgatggaactacatcagtcattgttcttgctggtgagatgcttcatgttgccgaagctttcatagacaagaaatatcatcctacagttatttgccgagcttacaacaaggcccttgaagatgctcttgctgtgttggacaaaatctccatgtctattgatgtgaacgatcgttcaatgatgctgggattggtgaagagttgtattggcacaaaatttaccagtcaatttggggatttaattgctgatctagcacttgatgcaacaacaacagttggtgttgatcttggccaaggtttgagagaagtggatatcaaaaatatattaaggttgaaaaatccctggcggccagttggaagattccaaagtcctcaagggtgttatgtttaacaaagacgttgtcgtccctggaaaaatgaaaagaaaaatcgtaaaccctcgtatcatattactagattgccctttggagtacaaaaaaggtgagaatcaaacaaatgcagaactgctcagagaagaagattgggcagtactcttgaaaatggaagaagaatacatagaaaacctttgtgcacaaatacttaaattcaagcctgatttagtgatcacagaaaaagggcttagtgatttggcatgccattatttcagtaaagctggagttagtgctattaggaggttaaggaaaacagataacaataggattgctaaggcatgtggagcggttattgtgaacaggcctgatgaacttcaagaatcagatgttgggactggagctgggcttttcgaggttaaaaaaattggtgatgagttttttgcctacattgtggattgtaaagacccgaaagcatgcacggttcttctcagaggtgccagcaaggatcttttgaatgaagttgagcggaacttgcaggatgctatgtcagtggctaggaatatcctaaagcatccaaaacttgtccctggtggtggtggcactgagctgactgtttctgctacactgaagcagaagagctcatcaattgaaggcattgaaaagtggccttatgaagctgcagctgtagcatttgaggctataccaagaacattggcacaaaactgtggtgtcaatgtcatccgaaccatgactgctcttcaagggaagcatgcaaatggtgagaatgcatggacaggaatagatgggaatacaggtgaaattgctgatatgaaagaattaaagatttgggatgcgtataacgtgaaagcgcagaccttcaagaccgccattgaggccgcttgtatgcttctaagaattgatgatattgtaagtggaataaaaagaaacaggcccccggagctagccaacaatcaaaacccactatcgagacagaaggggacgctgataacgagcagatgattcctgagtgaagaaaacattaatttgagtattcttggaaagtttttcgctcggttcaatcacagtttcttgtgtgtttcattgttgccaaggcctaaactacttagtcaactaaaattttggtatgttacgcttttggggtgcttcgctttttgtttcagttttcatgacccgtcttgaatcctagtatttgttgttcattttgacacgttgacattatatgatagttagcgatcgtaacgtggttt

SEQ ID NO: 2538 - DNA, 2051 bp, Flaveria ramosissima
gaatcacctctagcatctccgacaaccgatcgttagcgttcttacactcacatctacagctatgcagtcaccggttctcgttctcaaggattcgctcactcgtgaatctggaactaaggtgcatcatgcaaatattcaagcttctaaggccgtggctgatattattcgtaccacattgggtccaaggtccatgttaaagatgttgcttgatgctgcaggaggaattgtggttactaatgacgggaatgccattttacgggagttggatattgctcacccagctgcaaagtccatgatcgaactaagccgcacacaggatgaggaagttggtgatggaactacatcagtcattgttcttgctggtgagatgcttcatgttgcggaagctttcattgacaagaaatatcatcctacagttatttgccgagcttacaacaaggctctggaagatgctcttgctgtattggataaaatctccatgtctattgatgtgaatgatcgttccatgatgttgggattggtgaagagttgtattggcacaaaatttaccagtcaatttggggatctaattgcagatctagcacttgatgcaacaacaacagttggtgttgatctaggccaaggtataagagaagtggatattaaaaaatatatcaaggttgaaaaaattcctggtggccaattggaagattccaaagtcctgaaaggggttatgtttaacaaagacgttgtcgtacctggaaaaatgaaaagaaaaatcgtaaaccctcgtatcattttactagactgccctctggagtacaaaaagggtgagaatcaaacaaatgcagaattggtcagagaagaagattgggcagtactcttgaaaatggaagaagaatacatagaaaacttgtgtgtgcaaatacttaaattcaagcctgatctagtgatcacagaaaaagggcttagtgatttagcatgccattatttcagtaaagctggagtaagcgctattaggagactaagaaaaacagataacaataggattgctaaggcttgtggagcggttattgtgaataggcctgatgaacttcaagaatcagatgttggaactggtgctgggcttttcgaggttaaaaagattggtgatgagttttttgcatatattgtcgattgtaaagacccaaaagcgtgcacggttcttctccgaggtgccagcaaggatctcttgaatgaagttgagcggaacttgcaggatgcaatgtcagtggctaggaatatcctaaagcatccaaaacttgtccctggcggtggtgcaactgagttgactgtttctgctacactgaagcagaagagctcatcaattgaaggcattgaaaagtggccttatgaagctgcagctgtagcatttgaggctataccaagaacattggcacaaaattgtggtgtcaatgtcattagaaccatgactgctcttcaggggaagcatgcaaatggtgagaatgcctggacaggaatagatgggaattcaggtgaaattgctgatatgaaagaactaaagatttgggatgcttataacgtgaaggcacagaccttcaagactgccatcgaggctgcttgtatgcttctaagaatcgatgatatcgtaagtggaataaaaaagagacaagctcccggagctagccaaccatctaaacccaccatcgagactgaagtggatgctgacaacgagcagatgattcccgagtgaagaaaaacattaacctgagttttttgggtttgtttttgcctcggtttaattgcaatttcttgtgtttcattgttgctaaggcctagcttaagatgactaaaattttggtatgttatggttttggggtgctttgcttttgtttctatcttcatatgacccaccttgaatctgaacatttgctgttcgttataattgtgacattgtatgatagttaggttcgttctttgtttccatgtaacgtgggtttaacctaggggtctttattgtttcggaatgacttttaaagatttgactgttcgaaagtatacttgtggacgac

SEQ ID NO: 2539 - DNA, 2255 bp, Populus trichocarpa
gcgttgttcacgttaagtccgtgcagtgcaggcgcggcagcagtgtgtccctgtttcaagtctagaagaagaagcaccgcacccacagagaaaggggtttaaacgaagcacatcgagcagtccgtctcttcatcctcatctcctctcttctactagggtttatttatttatttatttataacgcttgctttctacttgtaactgaaaaggctgaaaggaaagatgcacgctccagttctcgttcttagggattcgttgaaacgggaatcaggaaggaaggtacatcatgccaacatacaggctgcaaaggcagttgccgatattatcaggaccaccttaggtcctcgttccatgttgaagatgcttctcgatgccagcggcggtattgttgtcacgaacgacggcaatgccatcctgcgtgagttagatctggctcatcctgctgctaaatccatgattgaattaagtcgcactcaagacgaagaagtcggtgacggaactacctccgtcattgttctcggaggagagatgcttcatgttgctgaagccttcatcgaaaagaactaccatcctactgtcatatgccgagcctacagtaaagctttggaggatgctattgcagtgattgacaaaattgctatgtccattgatgtcaacgatcgtcctacaatgttggggctggtcaagagttgcattggcacaaagttcactagtcaatttggggacttaattgctgatctagcaattgatgccacctcaatagttggtgtggaccttggtcaaggattgcgtgaagttgacatcaagaagtacattaaggttgagaaggtgcctggtggccagttggaagattcaaaggttcttaaaggggttatgtttaacaaagatgtagttgcccctggaaaaatgaagagaaaaattgtgaacccacgtgttattcttcttgattgccccgttgagtacaaaaaaggagagaaccagacaaacgcggagctggttagagaagaagactgggaagtcctgttgaaaatggaagaggaatacatagagaatatgtgtgcgcagatactgaagttgaaaccagatttggtaatcacagagaaaggtctcagtgatttggcatgccactatctgagcaaagctggtgttagtgcaatcaggaggctgcggaagactgataataacagaattgccaaggcatgtggggccactgttgtgaacagaccagatgagttgcaagagtctgatgttggtactggggctggtttatttgaggttaagaaaattggggatgaattctttgctttcattgttgattgcaaagatccaaaggcttgtactgttcttttgagaggtgccagcaaggaccttctgaatgaagtggaaagaaacttgcaggatgccatgtctgtagctagaaatatactcaagaatccaaaactccttcccggtgggggtgctacagaattaactgtatctgctgctctgaagcaaaaaagctcatctatcgaaggcatagaaaagtggccttatgaagctgctgctatagcttttgaggctataccaagaacattggctcagaattgtggtgttaatgtgatccgaaccatgactgctctgcaagggaagcatgcaaatggtgaaaacgcatggattggcatagatgggaacactggtgaaattaccgatatgaaagagaggaagatatgggatgcctacaatgtcaaggcacaaaccttcaaaacagcaatcgagtctgcttgcatgcttctgaggattgatgacattgtgagtggaatcaagaagaagcaggcccctggagcgcagggtccgtccaagcctaagattgagacagaagcagatgcagacagcgagcagatacttcctgactgaagattttagttgctgtttgaactgactttccatggaagaatctgacaaaagaagccagtttattttatcggctcttgagctgttttgtcccaagttttgattagagtgcctttgttcaaagttttgggcctatttgtctgtggcggcctgctggtggtgtgaaccatataggaattgtatggtactcgtattagttagtgtattgtccaatctgaattcctcctacacaaaacagtaaatcagtaatggtgtggttttttattttgaacttttttggtcctgtgcatttatttggacataattactttggagtttgtttcatgattgaaggagtgtttctgattgctgttgtattttgaaaa

SEQ ID NO: 2540 - DNA, 2047 bp, Helianthus annuus
agtactgtaaccgccccttctcgtattttctgcatttcaaaagaaatcaaacacagaaaccctagacttaactccgtcatctccgaccaccgatccctaccgttcttcttacactcacatctacagctatgcagtcgccggttctcgttctcaaggattcgctcactcgtgaatctggaagtaaggtgcatcatggaaatatccaagcttctaaggccgtggctgatattattcgcaccacattgggtccaaggtcaatgctaaagatgttgcttgatgctgcaggaggaattgtggtcactaatgacgggaacgccattttgcgggagttggatgtcgctcacccagctgcaaagtcgatgattgaactaagccgcacccaggatgaggaagttggtgatggaactacatcagtcattgttcttgctggtgagatgcttcatgttgcggaagctttcatagacaagaagtatcaccccacagttatttgccgagcttacaacaaggctcttgaagatgctcttgctgtgttggacaaaatctccatgtctattgatgtgaacgatcgttcgatgatgctgggattggtgaagagttgtattggcacaaagttcaccagtcaatttggagatttaattgcagatctagcacttgacgcaacgacaacggtcggtgtcgatctaggccagggcttacgagaagtggatatcaaaaaatacataaaagtcgaaaaaatccctggtggccagttagaagattccaaagtcctcaaaggcgttatgttcaacaaagacgtcgtcgtccccggaaaaatgaaacgaaaaatcgtaaaccctcgtatcatcttactcgattgccctcttgaatacaaaaagggcgagaatcaaacaaacgctgaattagtccgagaagaagattgggctgtactgttaaaaatggaagaagaatacatcgaaaacctgtgcgcgcaaatactcaaattcaaacccgatttagtgatcaccgagaaagggcttagtgatttggcgtgtcattattttagtaaagcgggagttagtgcaattaggaggttaaggaaaacggataataatcggattgctaaggcgtgtggagcggttattgtgaataggcccgatgaacttcaagaatcggatgttggaactggtgctgggctttttgaggttaagaaaatcggtgatgagttttttgcgtatattgtggattgtaaagatccgaaagcgtgtacggttcttctcagaggtgccagtaaggatcttttgaatgaagttgagcggaacttgcaggatgctatgtcagtggctaggaatattctaaagcatccaaaacttgtacccggtggtggtgcaactgagttgaccgtttccgctacactgaagcagaagagctcatcagttgaaggcattgaaaagtggccttatgaagctgcagctgtggcatttgaggctattccaagaacattggcacaaaactgtggtgtcaatgttattcgaaccatgaccgcacttcagggaaagcatgcaaatggagagaatgcatggacaggaatagatgggaattctggtgaaattgctgatatgaaagaactaaagatttgggatgcttataacgtgaaggctcagactttcaagaccgccattgaggccgcttgtatgcttttaagaatcgacgatattgtaagtggaataaaaaagagacaagcccccggagctagccaaccatcaaaacccactattgagacagaaggggacgctgataacgagcagatgattcccgagtgaagaaaaaacattaatttgagtgttcttgggaagtttttcactcgttttaatcacaatttcttgtgtgttttattgttgctaaggcctaaactatttagttaactaaaattttggtatgttatgcttttggggtgctttgcttttgtctttagttttcatgacccaccttgaatcttagtatttgatgttcattttgatctgttgacatgatatgatagttagcagttgtactcagtaacatgagtttt

SEQ ID NO: 2541 - DNA, 2084 bp, Helianthus annuus
cgggggctgcagtactgtaaccgccccttctcgtattttctgcatttcaaaagaaatcaaacacagaaaccctagacttaactccgtcatctccgaccaccgatccctaccgttcttcttacactcacatctacagctatgcagtcaccggttctcgttctcaaggattcgctcactcgtgaatctggaagtaaggtgcatcatggaaatatccaagcttctaaggccgtggctgatattattcgcaccacattgggtccaaggtcaatgctaaagatgttgcttgatgctgcaggaggaattgtggtcactaatgacgggaacgccattttgcgggagttggatgtcgctcacccagctgcaaagtcgatgattgaactaagccgcacccaggatgaggaagttggtgatggaactacatcagtcattgttcttgctggtgagatgcttcatgttgcggaagctttcatagacaagaagtatcaccccacagttatttgccgagcttacaacaaggctcttgaagatgctcttgctgtgttggacaaaatctccatgtctattgatgtgaacgatcgttcgatgatgctgggattggtgaagagttgtattggcacaaagttcaccagtcaatttggagatttaattgcagatctagcacttgacgcaacgacaacggtcggtgtcgatctaggccagggcttacgagaagtggatatcaaaaaatacataaaagtcgaaaaaatccccggtggccagttagaagattccaaagtcctcaaaggcgttatgttcaacaaagacgtcgtcgtccccggaaaaatgaaacgaaaaatcgtaaaccctcgtatcatcttactcgattgccctcttgaatacaagaagggcgagaatcaaacaaacgctgaattagtccgagaagaagattgggccgtactgttaaaaatggaagaagaatacatcgaaaacctgtgcgcgcaaatactcaaattcaaacccgatttagtgatcaccgagaaagggcttagtgatttggcgtgtcattattttagtaaagcgggagttagtgcaattaggaggttaaggaaaacggataataatcggattgctaaggcgtgtggagcggttattgtgaataggcccgatgaacttcaagaatcggatgttggaactggtgctgggctttttgaggttaagaaaatcggtgatgagttttttgcgtatattgtggattgtaaagatccgaaagcgtgtacggttcttctcagaggtgccagtaaggatcttttgaatgaagttgagcggaacttgcaggatgctatgtcagtggctaggaatattctaaagcatccaaaacttgtacccggtggtggtgcaactgagttgaccgtttccgctacactgaagcagaagagctcatcagttgaaggcattgaaaagtggccttatgaagctgcagctgtggcatttgaggctataccaagaacactggcacaaaactgcggtgtcaatgttattcgaaccatgaccgcacttcagggaaagcatgcaaatggagagaatgcatggacaggaatagatgggaattctggtgaaattgctgatatgaaagaactaaagatttgggatgcttataacgtgaaggctcagactttcaagaccgccattgaggccgcttgtatgcttttaagaatcgacgatattgtaagtggaataaaaaagagacaagcccccggagctagccaaccatcaaaacccactattgagacagaaggggacgctgataacgagcagatgattcccgagtgaagaaaaaacattaatttgagtgttcttgggaagtttttcactcgttttaatcacaatttcttgtgtgttttattgttgctatggcctaaactatttagttaactaaaattttggtatgttatgcttttggggtgctttgcttttgtcttagttttcatgacccacactgaatcttagtatttgatgttcattttgatctgttgacatgatatgatagttagcagttgtactcggtaacatgagttttgtttgatccgggaaagcggcttttggtc

SEQ ID NO: 2542 - DNA, 2174 bp, Triphysaria pusilla
ggttatgcagtgcgcatccaaaacatacatcactcacttattcatacactcactcagaaaccctcgtttgagttccagagaagcgcctttttttgttctctcatcgtaccaatctcgtaagttcaaatcggcaagccaagatgaattctcaagtgctcgtcctcaaagataatctgaagcgggaatctggaagcaaggttcaacatgccaatatccaggcatcaaaggctgttgcagatattatacgcactacattgggtccacgatcaatgttgaagatgatgcttgatcctgttggaggaattgtcgtgacaaacgatggaaatgcgattcttcgtgaattagatgtggcacaccctgcagccaagtccatgattgaactaagccgaactcaagatgaagaagtaggagatgggacaacatctgtgatcgtccttgctggtgaaatgctccatgttgctgaagctttcattgacaagaattatcatcccacagtcatttgtcgagcttataataaagctctagaggatgctgttgctgcgcttgacaaaattgcaatgactgtggatgttaaggatcgtgcgattatgttgggacttgtgaagagttgtatcgggacaaaattcactagtcaattcggggatttaattgccgacttagcaatagaagcaactaccacagctggtgtggatcttgggcaaggtctgcgtgaggtggatatcaagaaatacattaaagtcgagaaagttcctggtagtcagttggaggactctaaagtcttaaaaggagttatgttcaacaaggatgttgttgctcctggtaaaatgagaagaaagatagtgaacccgagaattattcttcttgattgtcctcttgagtacaagaaaggtgagaaccaaaccaatgccgaattgctgaaggaagaggattggagcgtgttgctaaaaatggaagaggagtacatagagaacctatgtgttgagattctaaagttcaagccagatttagtaataactgaaaagggtctcagtgatcttgcttgccattattttagcaaggccggtgtcagcgcaatcagaaggctcaggaagacggacaacaacagaattgccaaggcttgtggggcctaattgttaaccgacctgatgaattgcaggaatctgatgtaggtactggtgctggactgtttgaggtcaggaaaattggtgacgagttttttgcattcattgttgactgcaaggatcccaaggcatgcacagtccttttgaggggccccagcaaggacttgttgaatgaagttgagagaaatctgcaggatgctatgtctgtggctcggaacataattaaaaacccaaaacttgttccaggtggaggtgctacagagctgactgtatcagctatgttaaagcagaagagctcatctattgaaggcgtagaaaagtggccatatgaagctgctgcaatcgcatttgaggctataccaagaactttggctcagaactgtggtgttaatgtcattcggattatgactgccttacagggaaagcatgcaaatggtgagaatgcgtgggtcggcatcgacgggaataccggtgaaattgctgacatgaaggagcgtaagatatgggattcatatgctgtgaaggcccaggcatttaagacggccattgaagctgcttgcatgcttttgaggattgatgatatagtgagtgggatcaagaagaaacaggcccctggttcaggcgggccatcaaagcctcaaatcacgcaagaaggtgatgcggacaatgagagtatgattcctgagtaagagtaagtgcggttggctgggattgcacgtctgatctgtaaattgggctcgtcttgcgcttttgaatttgggctgattttttttctaaagttttacgcggtgccatcttttctgctgttttgattggatgcagaattcgttgcctcgtgtgttgttcgaattgcagtttgagtttagtagtttgtgtttttctctttcattcttattagtccaagaaactcctgccgctttttggtgacacttgagtttctactgaacttaggttttgtggtttttgttttattttctgattgtagtactccctatctttgattagacgtttatgaaattttgcagattattatcaaaaaaaaaaaaaaaaaaa

SEQ ID NO: 2543 - DNA, 1941 bp, Cichorium intybus
gcttcttctgtattttctttctcattttcaaagaaggcgaccactgaaaccctagagaaaaatctgccagctccagcaactgatccctagagttttacaattttcatctcgagctatgcaatcaccagttcttgttctcaaggattctctcacacgtgaatctggaagtaaggttcatcatgcaaatattcaagcttctaaggcagttgcagatattattcgcaccactttggggccaaggtccatgttgaagatgcttcttgatgctactggaggaattgtggtcactaatgatgggaatgccattttgagggaactagatattgctcaccctgctgcaaagtccatgattgaattaagtcgcacacaagatgaagaagttggtgatggaactacctcagtcattgttcttgctggtgagatgcttcatgtggctgaagctttcattgacaaaaaatatcatcctacagttatttgccgagcttacaacaaggctcttgaagatgctcttgctgtgttggacaagatctccatgtctattgatgtcaatgatcgatccatgatgctaggtttggtaaagagctgtattggtaccaaatttactagtcaatttggggatctcatagcagatctagcacttgatgcaacaacaatagttggagttgaccttggtcaaggactaagagaagtcgacataaaaaaatacataaaagtcgaaaaaatccctggtggccaattagaagactcgaaagtcctcaaaggagtcatgttcaacaaagacgtagtcgtccctggaaaaatgaaaagaaaaatcataaacccccgcatcattttactagattgccctttagaatacaaaaagggcgaaaaccaaacaaacgcagaattagtccgcgaagaagactgggcagttcttttaaaaatggaagaagaatacatcgaaaatctgtgtgtccaaattctaaaattcaagcccgatttggtcattacagaaaaaggacttagtgatttagcttgccattatttaagtaaggctggagttagtgctataaggagattaagaaagacggataataatcggattgctaaagcttgcggggccgttatcgtaaatagaccagatgaattgcaagaatctgatgtgggaacaggggcaggactttttgaagttaaaaaaattggggatgagttttttgcttatattgttgactgtaaagacccgaaagcatgcactgttttacttcgaggtgccagcaaggatcttttgaatgaagttgaacgcaacttacaggatgcgatgtcggtggctagaaatatcttgaagcatccgaaacttgttcctggtggtggggccactgagttgactgtttctgctactttgaagcagaagagctcgtcgattgaaggcattgaaaagtggccatatgaagctgcggctgtagcatttgaagctattccaagaacactggcacaaaactgtggtgtcaatgtcattagaaccatgactgctcttcaaggcaaacatgcgaatggtgagaatgcatggaccgggatcgatgggaattcgggtgaaattgctgacatgaaagaactaaagatttgggatgcgtataatgtgaaggcacaaacgtttaagacagccattgaagctgcttgtatgcttttaagaatcgatgatattgtgagtggaataaagaagaggcaagcacctggtgcaagtcaaccatcaaaacccactgttgagacagaaggtgatgctgacaacgagcagatgattcccgagtgagatttaaaaacattaatctactttttatggaatttaatcatgtgtttttgttttattagatgattttggatattcaaaattttggttattttcgggtgctatgatttgtttctaatttctattgaccaccggtattttctagaagaaaaaaaaga

SEQ ID NO: 2544 - DNA, 2308 bp, Quercus alba
aaaggtttaaaagagagcagagagaaagagagagggttcgagggttttccagttgtttaaagaaagagagaaagggttttaagttatataagggaaggcctcttgcttagctttgattccttctctcatatttttctcttctctacaactacaactacaacactctcagcctccatcgaagaacaacaacaactacaaaatgcacgccccagtactcgttctcaaggactctctgaaacgcgagtctggaagcaaggtccaacatgctaatatccaggcttctaaggctgttgctgacattattcgtacaacgttgggtccaagatccatgctgaagatgctccttgatgctactggtggaattgttgttactaatgatggaaatgctatattgcgtgagttagatcttgctcaccctgctgctaagtctatgatcgaacttagccgtacccaagatgaagaagtcggagatggaaccacttctgtcattgttcttgccggtgaaatgctccacgttgctgaagcattccttgacaaaagttatcaccctacagttatctgccgtgcctacaacaaagctttggaggatgctattgctgtgttggacagaattgccatgcccattgacgtcaaggatcgtgcaacaatgttggggttggtcaagagctgtataggcacaaaatttaccagccagtttggggatctcattgctgatctagctatagatgccaccacaacagttggtgttgatcttggccaaggcttgcgagaagtggatattaagaagtacattaagcttgagaagatccctggtggacagttggaggattcaagggttcttaaaggagttatgtttaacaaagatgtggttgcccctggaaaaatgagaagaaaaattgtaaacccacgtatcattcttcttgattgtcccctcgagtacaaaaagggtgagaaccaaacaaatgcagagctggttagagaagaagactgggaagtcctgttgagaatggaagaagaatacattaagaacctctgcgaccagatagtgatgttcaaaccagacctggtaatcacagagaagggccttagtgatttggcatgtcattatctgtgcaagcatggagttagtgcaatcaggaggttaagaaagacagataataatagaattgcaaaggcatgtggagctgttattgtgaacagaccagatgaactgcaggagtctgatgttggtactggggctgggttatttgaagttaagaaaattggggatgagttttttgctttcattgttgactgcaaagaaccaaaagcttgtactgtacttttaagaggtgccagtaaggatctcttgaacgaagtggaaagaaacttgcaggatgccatgtcggtagcgagaaacatactaaaaaatccaaaacttcttcctggaggtggtgctacagagttaactgtatcagctgctttgaagcagaagagttcatctattgaaggcatagaaaagtggccttatgaagctgctgccatagctttcgaggctataccccgtactttagcacaaaattgtggggtgaatgtgattcgaaccatgaccgcactacaagggaagcatgcaaatggtgaaaatgcatggattggcatagatggaaacactggtgtaattactgacatgaaagagcgcaagatttgggatgcctacaacgtgaaggcacaaacttttaagacagccatagaagctgctagcatgctccttaggatcgatgacattgtgagtgggattaagaagaagcaggcccctggagcaggagctccatcaaagcccacggttgagactgaagcagatgctgacagtgagcaaatacttcctgactgaagatatcagaacaattaaaggctttactttttgtggtgtttgaaggaagctgggtgtccaacagttttgttgaacttttgacttatgtactgtttgaaaatttcagatttttgccttgtgctgtcctgggaccacctagtctgttctgggagcaattgtaattacgttaaaaacgtttaatgggatgtcttttattagcagaatcaattattatgatgatttcttcttcccttgtgtttattgggggtaattccatttagtgacacaattgagaacattgcatagaggccttttaaaggatacctaggctgttacaattctgctcaattggcccaggctctctcaggttatttaacaaagttttggctttgctatgtttgagctttgcttcatatttaatgaaattccttgaatttttgtaagtaaaaaaaaaaaaaa

SEQ ID NO: 2545 - DNA, 1961 bp, Tragopogon dubius
ctgtagtgctttctcgtgatttctttctcattttcaaaagaaggcgaactgtgaaaccctagagaaaaaccagcttcagcaactgatcccaaaatcttacactttcatctcgagctatgcaatcaccggttcttgttctcaaggattctctcactcgtgaatctggaagtaaggtgcatcatggaaacatacaagcttctaaggccgttgctgatattatccgcaccactttgggtccaaggtccatgttgaagatgcttcttgatgcttctggaggaattgttgtcactaatgatggaaatgccattttgagggaactggatattgctcacccagctgcaaagtccatgattgaactaagtcgcacgcaagacgaggaagttggtgatggaaccacctcagtcattgttcttgctggggagatgcttcatgtggccgaagctttcattgacaaaaagtatcaccccacagttatttgccgagcttacaacaaggctcttgaagatgctcttgctgtactagacaaaatctccatgtccatcgatgtgaacgatcgctccatgatgcttggtttggtaaaaagttgcattgggaccaaattcactagtcaatttggagatctaatagcagatttagcacttgatgcaacaacaacagttggtgttgacctaggccaaggattaagagaagtggacatcaagaaatacataaaagttgaaaaaatcccaggtggacgattagaagattcacaagtcttgaaaggagtaatgttcaacaaagacgtagtcgtccccggaaaaatgaaaagaaaaatcataaacccacgtatcattttactagattgccctttagaatacaaaaaaggagagaatcaaacaaacgccgagttagtacgcgaagaagattggggtgtacttttaaaaatggaagaagaatacatagaaaatctttgtgtacagattcttaagtttaagcctgatttggtgattactgaaaaagggcttagtgacttggcgagtcattatttaagtaaagcgggagtgagtgcgattaggaggttgagaaaaacggataataatcggattgctaaagcttgtggggcggttattgtaaataggccagatgaacttcaagaatcggatgttggaactagggctggacttttcgaggttaagaaaattggggatgagttttttgcgtatattgtggagtgtaaagacccgaaagcatgcaccgttcttcttcgtggtgctagtaaggatcttttaaatgaagttgaacgcaacttgcaggacgctatgtcggtggctaggaatatcttaaagcatccaaaacttgttcctggtggtggggccactgagttgactgtttctgctacactgaagcagaagagctcatccattgaagggatcgaaaagtggccatatgaagctgcagctatagcattcgaggctattccaagaactttggcacaaaactgtggtgtcaatgtcattagaaccatgactgctcttcaaggcaaacatgcaaacggtgaaaatgcatggacaggcatcgacggaaattcaggtcaaatcgctgatatgaaagaattaaagatttgggatgcttataatgtgaaggcacagacatttaaaacagccattgaagcagcttgtatgctattaagaattgatgatattgtgagtggaataaagaagagacaagcacctggagcaagtcaaccctcaaaacctactattgaacaagaaggtgatgctgacaatgagcagatgattcccgagtgaaccgtaaaaaaacacattaatttactttcctggtaacttcttttttacttttacttttgttttgtgttttattgttgttaaggctactttagtagttatccaaaattttggtaattttgtgggtgttatgatttgtttttggacaaccttgaatctaagtatttgtttgttaag

SEQ ID NO: 2546 - DNA, 2155 bp, Amsonia hubrichtii
ctccaaaactcccaccaacaaaaaaagaacccgtaacctctatacatttactttcgtcgtcaccggagatcagatcggaaaatgcaggccccagtcctcgttctgaaggattctttaaagcgtgaaactgggaataaagtgcattatggaaacatccaagcatcaaaggctgttgcagacataattcgaactactttgggtccacggtcaatgttgaagatgcttcttgatgttgctggaggaattgtagtgactaatgatggaaatgccatcctgcgagaattggatcttgcacatccagcagcgaagtccatgattgagcttagccgtactcaagatgaggaagttggtgatggaactacatctgtcattgttcttgctggtgagatgctccatgttgctgaagccttcattggaaggaattatcaccctacagtcatttgtagagcttacaataaagctctagaggatgctattgctgtgttggacaatattgcaatgagcattgatgtgaaggatcgtgcatcaatgttgggccttgtaaagagctgtattggtactaaatttacaagtcagtttggagatcttattgctgatttagcaattgatgctacatcagcagttggtgtagacctgggacaaggcttgcgagaagtggatatcaagaagtacattaaggttgagaaggttcctggtgggcagctggaagattcaaaggtccttaagggagttatgtttaacaaagatgtagtagctccaggtaaaatgaggagaaagattgtgaacccacgtattattcttcttgattgtcccctggagtacaagaagggcgagaaccaaactaatgcagaattgatgagagaagaagattggggtgtattgttgaaaatggaagaagaatacattaagaacctatgtatgcagattttgaagttcaaaccagatctagtaataacagaaaagggacttagtgaccttgcatgccattatctgagccaagctggtgtctctgccatcagaaggctaaggaagacagacaataacagaattgctaaagcatgtggggcagtcattgtcaacaggcctgatgaattacaggaatctgacgttggtactggagctggtctatttgaagtgaggaaaattggggatgagttcttctcattcattgttgattgcaaggatccaaaagcttgtacagtactcctcagaggtgctagcaaagatctactgaatgaagtagaaaggaatttacaggatgccatgtctgtagcaagaaacattatcaagcatccaaaacttgttcctggtggtggcgcaacagagttgactgtgtctgcaatgttgaagcaaaagagctcatctattgaaggcatagagaagtggccttatgaagctgcagcaattgcttttgaggccatcccacgaactttagctcagaattgtggagttaatgttattaggactatgacagccttgcaaggaaagcatgcaaatggtgaaaatgcatggattggcattgacgggaatactggtgaaattactgacatgaaagagagaaagatatgggactcgtacactgtgaaggcacaagcatttaagaccgccatagaagctgcctgcatgcttctgagaattgacgacattgtaagtggaataaagaagaagcaggctcctggagcaggatcagctccatcaaagcctaaagttgaggaagaaggcgaagcagaaaacgaagccctaattcctgaataaggaggaaaagccagaagaaaacggaaaaatttaacagctgagttttagtggtatgcttagtttgccttacagttgaaagctgtcttgcttttgtaagctgtaaaaaagagttccattggtgttattttgtagcctagttgttagtgttcccttaattctctttctcactaaagctcttgagctttgtcccttttgagcttagtttatgatacctgtggcaagattatcactagtcttggtgttattcaagtactttttaagtttcatttgcgtgaacaagtctaagcttattgtgagtatattacttaaaacagttttggcgacatacatgtttgtatcaagtccagacacaattgtagaagtctttgctgttatgaggaaaaatacctgaagattcacc

SEQ ID NO: 2547 - DNA, 2096 bp, Citrus sinensis
gcgcagaaataattccctatactacaaagcatttacgaagaaaaaggggccaacggggagggtttgagggctttctttcaagtactcatcgtcaacagcaaagccaaacagtctcacttcgcttttactttatacgacaaagatcccggagtttagttttgttgagttgagttgagttgataccagtagttagggttttatccattacttgatacaatcatgcattctccagttctcgttctcaaggattccttgaagcgtgaatctggaaccaaggttcaccatgccaatatacaggcttccaaggctgttgccgatatcattcggacaacattgggtccccggtccatgttaaagatgctacttgatgctagtggagggattgtagttactaatgatggaaatgctattcttcgtgagcttgatgttgcacatccagcagctaagtcaatgattgagttaagtcgaactcaagatgaagaagtaggggatggaacaacatctgtcattgtgctagctggtgagatgcttcatgttgcggaagagttcatcaacaagaattatcatcctacggttatctgtcgagcttacaataaggctttggaggatgctgttgctgtgcttgatacaattgcaatgcccatcgatgcaaatgatcgtgcaacagtgttgggcctggtcaagagttgcattggaactaagttcacaagccaatttggggatctgctagctgatcttgcaattgatgccaccactactgttggtgttgaccttggccaagggttgcgagaggtggatattaagaagtacattaaagttgagaaggtccctggtggccagttggaagattctagggttctgaaaggagttatgttcaacaaagatgttgttgcccctgggaaaatgagaagaaaaattgtcaacccacgtattatccttcttgattctccccttgagtacaagaaaggagagaatcaaacaaatgctgagttggttaaggaagaagactggggagtcatgttgaaaatagaagaggattacatcgaaaacctctgcatgcagattgtgaagtttaaaccagacttggtaattacagagaaggggctaagtgatcttgcatgccattatttaagcaaggctggagttagtgcaattaggaggctaaggaagacagacaataatagaattgccaaagcatgtggcgctgttattgtgaacagaccagatgaattgcaggaatctgatgttggtactggggctgggctgtttgaggttaagaaaattggggatgaattctttgcattcattgttgattgcaaagatccaaaagcttgtactgtactcttaagaggtgctagtaaggatctcctgaatgaagtggaaaggaatttgcaggatgcaatgtctgtggcaagaaacataatcaagaatccaaaactagtacctggtggtggggctacagaattaacagtgtctgccactctaaaacaaaagagttcctcaatcgaaggcatcgaaaagtggccttacgaagctgctgctattgcttttgaggctattccaagaactttggctcagaattgtggcgttaatgtaattcggactatgactgctctgcaaggaaaacatgcaaatggtgaaaatgcatggattggcatagatggaaacactggtgcaatttctgacatgaaagaggggaagatctgggatgcatataatgtgaaagcacagacatttaagacagcaattgaagctgcttgcatgcttctgaggattgatgacattgtcagtggaattaagaagaaacaggcccctggctcaggccaagctccatcgaagccccagattgagacggaggcagatgcagatagtgagcaaatactccctgattagacaatgttattgtcaacgactatgcagtttaattatttgaaaaaatgttggtttattgttctgttggcggtctaatgattttgctgagcttttcctccaaattttgtgatattgcgccaatgttttagccattgtagacaaactgggaagctgtgatatgctctgcaatatatatatatattttaacatcctgtttttggata

SEQ ID NO: 2548 - DNA, 1985 bp, Triphysaria pusilla
ttttcttgttcactcaccgtacaactctcgtaagctcaaatcggaaagccaagatgaattcccaagtgctcgtcctcaaagataatctgaagcgtgagtctggaagtaaggtgcaacatgccaatatccaggcatcaaaggctgttgctgatattatacgcacgacattgggtccacgatcaatgttgaagatgatgcttgatgctgttggaggaattgtcgtgacaaatgatggaaatgcgattcttcgtgaattagatgttgcacaccctgcagcaaagtccatgattgaactaagccgaactcaagatgaggaagtaggagatgggacaacatctgtgatcatccttgctggtgaaatgcttcatgttgcggaagctttcattgacaagaactatcatcccacagtcatttgtcgagcttataataaagctctagaggatgctgtcgctgcgcttgacaaaattgcaatgactgtagatgttaaggatcgtgcaattatgttgggacttgtgaagagttgtataggaacaaaatttactagtcaatttggggatttgattgcggacttagcaatagacgccactaccacagctggtgtggaacttgggcaaggactacgtgaagtggatatcaagaaatacattaaagtcgagaaggttccaggtagtcagttggaggactccaaagtcttaaaaggagttatgtttaacaaggatgttgttgctcctggtaaaatgagaagaaagatagtaaacccgagaatcattcttcttgattgtcctcttgagtacaagaagggcgagaaccaaaccaacgccgaactgctgagggaagaggattggagcgtgttgctaaaaatggaagaggagtacatagagaacctatgtatggagattctaaaattcaagccagatttagtaataacggaaaaggggctaagtgatcttgcttgccattattttagcaaggccggtgtcagcgcaatcagaaggctcaggaagacagacaacaacaggatcgcgaaggcttgtggcgctgtaattgttaacagacctgatgaattgcaggaatctgatgtaggtactggtgctggactgtttgaggtgaagaaaattggtgacgagttttttgcgttcattgttgactgcaaggatcccaaggcatgcacagtccttctgaggggacccagcaaggacttgctgaatgaagttgagagaaatctgcaggatgctatgtctgtggcaagaaacataattaaaaacccaaaacttgttcctggtggaggtgctacagagctgactgtatcagctgtgctaaagcagaagagctcatctattgaaggcgtagaaaagtggccttatgaagctgctgcaattgcatttgaggctataccaagaactttggctcagaactgtggtgtaaacgtgattcggactatgactgccttacagggaaagcatgcaaatggtgaaaatgcttgggtaggcatagatgggaataccggtgaaattactgacatgaaggagcgtaagatatgggattcgtacgccgtgaaggcacaagcatttaagactgctatagaagctgcttgcatgcttttgagaattgatgatatagtgagtgggatcaagaagaaacaggccactggatcaggtgggccatcaaagcctcaaatcacgcaagaaggtgatgcggacaatgagagtatgattcctgagtaagaggaagtgcggttagctgggattgcacgtctgatctgtaaattgggcttgtcttgtgcttttcaattgggcctggtttcttgaaagttttatgcagtgccattttttctgctgttttgagtggatcctgattgctttgcctctttgttgcgctgatcgagttgcagtatgggtatctttagctgacgtttatgaaattttgcagattattattaactagaaatttacccaccaccgcgttgcggccggtggacatgcctc

SEQ ID NO: 2549 - DNA, 2224 bp, Ricinus communis
gcttcttataggttctctctccttctcttcactcaaaagtgcaatccctaacctagcttatttttctccgataaacgacgccgttagggcacctatattctatcttgtgtagtttaactatttcattatacaaatacaagaagaaggagaagaatgcaggctccggtgctcgttctcaaggattctttgaaacgtgagtccggtactaaagtacaccatgccaacattcaggcttccaaggctgttgctgacattatacgcacaacattgggtccccgatccatgctgaaaatgttacttgatgctgctggaggaattgttgttactaatgatgggaatgctattcttcgtgaactagatcttgctcacccagcagcaaaggcaatgctctctttctccatttcctaaattatcttcaatgattgaattgagccgtacacaagatgaagaagtaggagatgggacaacatcagtgattgttcttgctggagagatgctccatgttgctgaagcctttattgacaagagttatcatcctactgtcatttgccgagcctacattaaagctctagaagatgccattgctgtacttgataaaattgctatgtccattgatgtcaatgaccgtgcaacattgttaggtctggttaagagctgtataggcacaaagttcactagtcaatttggggacctaattgctgatctagcaattgatgccaccactacagttggggttgatcttggccaaggattgcaagtggatatcaagaagtatattaaggttgagaaggtacctggtgggcagttggaggattctaaagttcttaaaggagttatgttcaacaaagatgtagttgcccctggaaaaatgagaagaaagattgttaacccacgtattattcttcttgattgtccattagaatacaaaaagggtgagaaccaaacaaatgctgagttggttaaagaagaagactgggcagtcctactgaaaatggaagaggaatatattcagaacatgtgcatgcagatactgacatttaaaccagatctagtaatcacagagaaaggactcagtgatttggcatgccattatttgagcagggctggtgtcggtgcaatcaggaggctgaggaagacggacaataatagaattgctaaggcatgtggggctgttattgtgaacagaccggaggaattgcaagagtctgatgttggtactggagctgggctatttgaagttaagaaaattggggatgaattcttttctttcattgttgattgcaaagatccaaaggcttgcacagttctcttgagaggtgccagtaaggatctcctaaatgaagtggaaagaaatttgcaggatgccatgtctgtggccagaaacatactcaagaatcctaaacttcttcctggtggtggtgctacagagttaactgtctctgccactctcaagcaaaagagttcatctgtcgaaggaatagaaaagtggccatatgaagctgctgctttagcttttgaggctataccacgaactttggcccagaattgcggtgtcaatgtgattcgaacaatgactgccctccaaggaaaacatgcaaatggtgacaatgcatgggttggcatagatggcaacactggtgaaattactgatatgaaagagaggaagatatgggacgcctataatgtgaaagcacaaaccttcaagacagcaatagaagcagcttgtatgcttctgagaattgacgacattgtaagtgggatcaagaagaagcaggctccaggagcaggtccatccaagccaaagattgagactgaagcagatgcagatggtgagcagatacttcctgactgaggatatggagctagctggccttgaactattattcaaatgcgcagctgtttttttgggacggttaaacggttttttaggtgcgagttgagcatccttcaaaattttgagtgctactctgtggactcttgttttgcgttattgttctatctgaatttctacttaaatagagttgggatttcttccgtgtgcattagtgggacatagtattattatttattggcacctatccaaattgctagctggttgatatatgaatatggtcctttgtattgtaatgtccaactccaaagttgtgctagaagtcttatgttgaggatacctgtacttgaattttttgagaaaaaagaagaaaaattccagagatatttgaga

SEQ ID NO: 2550 - DNA, 2168 bp, Artemisia annua
ctttcactctcattttcaaaacaagtaacaaaccctagaaccatctcaaacaaactgatctccctacactcacacactcactcacaactatgcagtcaccagttctcgttctcaaggattctctcactcgtgaatctggaagtaaggtgcatcatgcaaatatccaagcttctaaggccgtagctgatatcatccgcaccacattgggtcccagatctatgttaaagatgcttcttgatgcttcaggaggaattgtggtcactaatgatgggaatgccattttgcgagagctggatattgctcaccctgctgcaaagtcaatgatcgagctaagccgcactcaggatgaggaagttggtgatggaactacatcagttattgttcttgctggtgagatgcttcatgttgcagaagctttcattgacaagaagtatcatcctactgttatttgcagagcttacgtcaaggctcttgaagatgctcttgctgttttggacaagatttctatgtctattgatgtgaatgatcgttctatgatgctgggtctggtgaagagttgtattggtacaaaatttaccagtcagtttggtgatctaattgcagatctagctcttgatgcaacaactacagttggtgtggatttaggtcagggaatcaaagaagttgatatcaagaagtacatcaaagttgaaaaaatccccggtggacaattagaagattccaaagtccttaaaggtgttatgttcaacaaagacgttgtcgtccctggaaaaatgaaacgaaaaatcataaaccctcgtgtcattttacttgattgcccgttggaatacaaaaagggagagaatcaaacaaatgcagaattagtcagagaagaggactgggcagtactgttaaaaatggaagaagaatacattgaaaacctctgtgtacaaatacttaaattcaaacccgatttggtgatcacagaaaaggggcttagtgacttagcctgccattatttcagtaaagctggagtcagtgccatcaggcgattaaggaaaacagacaacaataggattgctaaggcatgtggtgcggttattgtgaataggccagatgaactacaagagtcagatgtcgggactggagctggactctttgaagttaaaaagattggtgacgagttttttgcgtatattgtggattgtaaagacccaaaagcctgcactgttcttctacgcggtgccagcaaggatcttttgaatgaagttgaacgtaacttgcaggacgcgatgtcagtggctaggaacattctaaagcatccaaagcttgtgccagggggtggggccactgagttgaccgtttccgctacactgaagcagaagagctcatcagttgaaggaatcgaaaagtggccttatgaagctgcagctgtagcatttgaagctataccaagaacattggcacaaaactgtggtgtcaatgtcattagaacaatgactgctcttcaggggaagcatgcaaatggtgagaatgcatggacaggtattgatgggaattcaggtgaaattgctgatatgaaagaactaaagatctgggatgcttataacgtgaaggcacaaaccttcaagacagcaattgaagctgcttgtatgcttctaagaattgatgacattgtgagcggaattaaaaagagacaagctccaggatctagtcaaccttcaaaacctactattgagacaggtgatgatgctgacaatgaacagatgattcccgagtaaaaacattagttatgtttttgagaagaaagttcactcagatcaaccgcagttttatcttgtcttttattgttgtcaagggctggactacttggctatcaaaaattttggtcattatctttggttttcattttcttttgaccactttggattaggttatttggtgctagtggtagaatttgtatgtcatatgatggcttctatgttctgaaacgtggatggaaaacaatgttagcttcgtttagagtgtgtacgtcttgtttttggtttgggaatcaagtttatttgtgtgatcaatattagaagcttatcaatggtttaatgtagttaattctgttcatataattgctatcttaaatggatcttcaggtgtattgtttacatcttatgatatatgtatctttttcccaa

SEQ ID NO: 2551 - DNA, 2067 bp, Citrus sinensis
  misc_feature (1864)..(1864): n is a, c, g, or t
tacaaagcatttacgaagaaaaaggggccaacggggagggtttgagggctttctttcaagtactcatcgtcaacagcaaagccaaacagtctcacttcgcttttactttatacgacaaagatcccggagtttagttttgttgagttgagttgagttgataccagtagttagggttttatccattacttgatacaatcatgcattctccagttctcgttctcaaggattccttgaagcgtgaatctggaaccaaggttcaccatgccaatatacaggcttccaaggctgttgccgatatcattcggacaacattgggtccccggtccatgttaaagatgctacttgatgctagtggagggattgtagttactaatgatggaaatgctattcttcgtgagcttgatgttgcacatccagcagctaagtcaatgattgagttaagtcgaactcaagatgaagaagtaggggatggaacaacatctgtcattgtgctagctggtgagatgcttcatgttgcggaagagttcatcaacaagaattatcatcctacggttatctgtcgagcttacaataaggctttggaggatgctgttgctgtgcttgatacaattgcaatgcccatcgatgcaaatgatcgtgcaacagtgttgggcctggtcaagagttgcattggaactaagttcacaagccaatttggggatctgctagctgatcttgcaattgatgccaccactactgttggtgttgaccttggccaagggttgcgagaggtggatattaagaagtacattaaagttgagaaggtccctggtggccagttggaagattctagggttctgaaaggagttatgttcaacaaagatgttgttgcccctgggaaaatgagaagaaaaattgtcaacccacgtattatccttcttgattctccccttgagtacaagaaaggagagaatcaaacaaatgctgagttggttaaggaagaagactggggagtcatgttgaaaatagaagaggattacatcgaaaacctctgcatgcagattgtgaagtttaaaccagacttggtaattacagagaaggggctaagtgatcttgcatgccattatttaagcaaggctggagttagtgcaattaggaggctaaggaagacagacaataatagaattgccaaagcatgtggcgctgttattgtgaacagaccagatgaattgcaggaatctgatgttggtactggggctgggctgtttgaggttaagaaaattggggatgaattctttgcattcattgttgattgcaaagatccaaaagcttgtactgtactcttaagaggtgctagtaaggatctcctgaatgaagtggaaaggaatttgcaggatgcaatgtctgtggcaagaaacataatcaagaatccaaaactagtacctggtggtggggctacagaattaacagtgtctgccactctaaaacaaaagagttcctcaatcgaaggcatcgaaaagtggccttacgaagctgctgctattgcttttgaggctattccaagaactttggctcagaattgtggcgttaatgtaattcggactatgactgctctgcaaggaaaacatgcaaatggtgaaaatgcatggattggcatagatggaaacactggtgcaatttctgacatgaaagaggggaagatctgggatgcatataatgtgaaagcacagacatttaagacagcaattgaagctgcttgcatgcttctgaggattgatgacattgtcagtggaattaagaagaaacaggcccctggctcaggccaagctccatcgaagccccagattgagacggaggcagatgcagatagtgagcaaatactccntgattagacaatgttattgtcaacgactatgcagtttaattatttgaaaaaatgttggtttattgttctgttggcggtctaatgattttgctgagcttttcctccaaattttgtgatattgcgccaatgttttagccattgtagacaaactgggaagctgtgatatgctctgcaatatatatatatatttaacatcctgtttt

SEQ ID NO: 2552 - DNA, 2096 bp, Citrus clementina
gcgcagaaataattccctatactacaaagcatttacgaagaaaaaggggccaacggggagggtttgagggctttctttcaagtactcatcgtcaacagcaaagccaaacagtctcacttcgcttttactttatacgacaaagatcccggagtttagttttgttgagttgagttgagttgataccagtagttagggttttatccattacttgatacaatcatgcattctccagttctcgttctcaaggattccttgaagcgtgaatctggaaccaaggttcaccatgccaatatacaggcttccaaggctgttgccgatatcattcggacaacattgggtccccggtccatgttaaagatgctacttgatgctagtggagggattgtagttactaatgatggaaatgctattcttcgtgagcttgatgttgcacatccagcagctaagtcaatgattgagttaagtcgaactcaagatgaagaagtaggggatggaacaacatctgtcattgtgctagctggtgagatgcttcatgttgcggaagagttcatcaacaagaattatcatcctacggttatctgtcgagcttacaataaggctttggaggatgctgttgctgtgcttgatacaattgcaatgcccatcgatgcaaatgatcgtgcaacagtgttgggcctggtcaagagttgcattggaactaagttcacaagccaatttggggatctgctagctgatcttgcaattgatgccaccactactgttggtgttgaccttggccaagggttgcgagaggtggatattaagaagtacattaaagttgagaaggtccctggtggccagttggaagattctagggttctgaaaggagttatgttcaacaaagatgttgttgcccctgggaaaatgagaagaaaaattgtcaacccacgtattatccttcttgattctccccttgagtacaagaaaggagagaatcaaacaaatgctgagttggttaaggaagaagactggggagtcatgttgaaaatagaagaggattacatcgaaaacctctgcatgcagattgtgaagtttaaaccagacttggtaattacagagaaggggctaagtgatcttgcatgccattatttaagcaaggctggagttagtgcaattaggaggctaaggaagacagacaataatagaattgccaaagcatgtggcgctgttattgtgaacagaccagatgaattgcaggaatctgatgttggtactggggctgggctgtttgaggttaagaaaattggggatgaattctttgcattcattgttgattgcaaagatccaaaagcttgtactgtactcttaagaggtgctagtaaggatctcctgaatgaagtggaaaggaatttgcaggatgcaatgtctgtggcaagaaacataatcaagaatccaaaactagtacctggtggtggggctacagaattaacagtgtctgccactctaaaacaaaagagttcctcaatcgaaggcatcgaaaagtggccttacgaagctgctgctattgcttttgaggctattccaagaactttggctcagaattgtggcgttaatgtaattcggactatgactgctctgcaaggaaaacatgcaaatggtgaaaatgcatggattggcatagatggaaacactggtgcaatttctgacatgaaagaggggaagatctgggatgcatataatgtgaaagcacagacatttaagacagcaattgaagctgcttgcatgcttctgaggattgatgacattgtcagtggaattaagaagaaacaggcccctggctcaggccaagctccatcgaagccccagattgagacggaggcagatgcagatagtgagcaaatactccatgattagacaatgttattgtcaacgactatgcagtttaattatttgaaaaaatgttggtttattgttctgttggcggtctaatgattttgctgagcttttcctccaaattttgtgatattgcgccaatgttttagccattgtagacaaactgggaagctgtgatatgctctgcaatatatatatatattttaacatcctgtttttggata

SEQ ID NO: 2553 - DNA, 2069 bp, Coffea canephora
aacttccctcattgtcacacagcaaatcctctctatttctctgtcgattgaatcagaaaaatgcacgccccagttttagtcctcaaggatactttgaaacgagagtccggaaataaggtgcactatgctaacatccaagcatctaaggctgttgcagacattattcgcaccactttgggtcctcgatctatgttgaagatgcttcttgacgcagctggaggtattgtagtgaccaatgatggaaatgctattcttcgtgagttagatcttgcacacccagcagcaaagtccatgattgaactaagtcgcactcaagatgaggaggttggagatggaactacgtctgttattgtacttgctggtgagatgcttcatgttgctgaagccttcattgacaacaactatcatccaacagtaatttgccgagcttacaacaaagctctagaagatgccatagccgcgctggaaaagatagctatgactgttgacgttaaggatcgtgcaacaatgttaggccttgtaaagagctgtattggcacaaaatttactagtcaatttgggaatcttattgcggatttagcaattgatgctacaacaaccgtgggagtggaagttggacaaggcatccgtgaagtggatattaagaaatatgtcaaggttgagaaggttccgggtgggcaactggaagattcacaggtccttaagggagttatgtttaacaaggatgtggttgcccctggcaaaatgagaagaaagattgtaaatcctcgtatcatccttctagattgtcccctggagtacaagaaaggcgagaatcaaacaaatgcagaattactgagggaagaagattggagcgtgttattaaaaatggaagaggagtacattgagaacctttgcatgcagatactgaagtttaagcctgatttagtgataacagaaaaggggctgagtgatctagcatgccattatctgagcaaggctggcgtttctgcaattaggaggctgagaaagacggacaataacaggattgccaaggcatgtggggcagttattgtgaaccgacccgatgagttacaggaatctgatgttgggactggagctgggctatttgaggtgaggaaaattggggatgagttctttgcattcattgttgattgcaaggatccaaaagcatgtactgttcttttaaggggtgccagcaaagacctattgaatgaagtagaaagaaatttacaggatgcgatgtccgttgcaagaaacattgtcaagaatccaaaacttgttcctggtggtggtgcaactgagttgactgtatcagcgattttaaagcagaagagctcatctgttgaaggcattgaaaagtggccttatgaagctgctgcaattgcctttgaggcaataccacgaactttggctcagaattgtggtgtcaatgttattcgaacaatgacttccttgcgtgggacgcatgcaaatggtgaaaatgcttgggttggcatagatggtaatactggtgcaattgctgatatgaaggagaggaagatatgggattcctacactgtgaaggtgcaagcatttaaaacagccatcgaagctgcctgcatgcttctaagaattgacgacattgtaagtggaataaaaaagaagcaggcacctggagcgggggcttcatcaaagcccaaagttgaagaagaaggtgaagcagagaatgaagcactaattcctgaatgagaaacggcaaaaactttcggcacttaagcaccatctttgatgagtctatcttacagtttggagttgtttttggtttgtatgctgtaaaaagagtttaactgagctgattttttagtctaattattcgaactaaactttctctgctgctttggccgcatgtagtatcatggtcaagtgcaagctagtatccagtgatcttgcctcttgatagctcgatgaactttgagcatttttgagcagtttagtatacttctctcaagtcttgcaaatgacagtttgcgatcgtgtagtacaagcttttgtttctttgtatctcagtaagaattgatttcttccct

SEQ ID NO: 2554 - DNA, 2081 bp, Momordica charantia
ggggagttccagattttattttttggtcacagtcggaagtgtgaaagttttctcctttccatctttctctagggtttttgcttagggttttcgacaagcccacaacgatgcacgctccagttctcgttctcaaggattctttgaaacgcgagtctggaagcaaggttcaccatgccaacatccaggcttctaaggctgttgctgatattatccgtaccacgttggggccgagatctatgttgaagatgttacttgatgctagtggaggaatcgttgtcacaaatgatggaaatgccattctccgggaattggatattgcacatccagcagcaaaatcgatgattgaacttagccggacgcaagatgaggaagtaggagatggaactacatcagttattgtgcttgctggtgagatgctacatgttgccgaagccttcattgagaaaaactatcatccaactgtcatttgccgggcatataataaagctttggaggatgcacttgctgtccttgataaaattgcgatggacattgatgttgaagatcgcactgctatgttggggctggttaaaagctgcataggtaccaagttcactagtcaatttggagatttgattgctgatttagcaattgatgcaaccacaattgttggtgttgatcttggccaaggattacgcgaagtagacatcaagaagtacataaaggttgagaaggttccaggtggtcagttagaagattctagggttcttaaaggagtgatgttcaacaaagatgttgttgcccccggaaaaatgagaagaaagattgtcaatccacgtattattcttcttgactgcccccttgagtacaaaaaaggtgaaaaccagacaaatgctgagttggttaaagaagaagattggggaatcctgctgaaaatggaagaagagtacatagagaatatctgcgcacagataatcaaattcaaacctgacttggttatcacagagaagggcctcagtgacttggcatgccattatctgagtaaagctggaatcagtgcaattaggaggttgaggaagactgacaataatagaatagctaaggcatgtggtgctgtaattgtgaacagacctgacgagttacaggaatcagatgtcggcactggtgctggattatttgaagttaagaaaataggggacgagttcttttcgtttatagtggattgcaaggatccaaaagcctgtactatactcttgaggggtgccagtaaagatcttttgaatgaagtagaaagaaatttgcaggatgccatgtctgttgcaagaaacataataaagaatccaaaacttgttcctgggggtggtgctactgagttgaccgtatctgctacactgaagcagaagagttcttctattgaaggcatagagaagtggccttatgaagctgctgccttagcttttgaagccattccgcgaactttggctcagaattgtggggtgaatgtaatacgaacaatgacagcattgcaaggaaagcatgccaatggtgaaaatgcatggacaggcatagatggaaactctggtgaaatcactgacatgaaagaacgcaagatctgggacgtgtataatgtgaagtctcaaacttttaagacagccatagaagcttcctgcatgctgctgagaatagacgacattgttagcggtattaagaagaagcaggcaccggggcaaggtccatcgaagccaaaaatcgagacggaagctgatgcagacaatgagcaaattctcccagagttaaatttttggttgagtcagttttattagctctacaatggtgtttcttcaagcttgcgattcgggtgtgttcgattcttcagaactttggcttcttgtggtttttcgtaggttgggcttctgaaatatggtttagcggatgaatacaattttgttaccaccgttttgtttcagattagtgatctaaaatttcaattaatacctgggatgatgatgattcctgaaatcaaacttatcttaattttcttctttgttttaatatgttgagaaatgagtaacttttttagtacagaatagagttgagaactt

SEQ ID NO: 2555 - DNA, 2169 bp, Mimulus guttatus
acacacacacacacacacacacacaaacacaaacacaagtacactaaaaacccttgttcgagttcgagggttttccagaagaaaaatcaccttttcttcttcttcttcactgcatttcgctctcaaataccaaatctcgcgaatctggtaacttcagatcggaatccaatatgcatgccccagtcctcgtactgaaagatacattgaagcgggagtctggaagcaaggtgcaacatgccaatattcaagcatccaaggctgttgcagatattatacgtactactttaggtccgcggtcaatgttgaagatgctccttgatgcttctggagggattgtagtgacaaatgatggaaatgctattctacgtgagctagatgtcgcacacccagcagctaagtcaatgattgaactaagccgaactcaggatgaggaggtgggagatgggacaacatccgtgattgtcctcgctggtgaaatgctccatgttgctgaagccttcattgacaagaaatatcaccccacggtcatttgtcgagcttatggtaaagctctggaagatgcagtcgctgtacttgacaaaattgctatgactgtggatataaatgatcatgcaacaatgttagggcttgtcaagagttgtattggcacaaagtttaccagtcaatttggcgatttgattgctaacttggcaatagatgccacaaccacagcaggtgtcgatgttggccaaggattgcgtgaggtggatatcaagaagtacatcaaggtagagaagattcccggtggtcaattggaagactcgaaagtcttaaaaggagtcatgttcaacaaggacgttgttgcccctggcaaaatgaaaagaaaaatactaaatccaagaattatgcttcttgattgtcctctcgagtacaagaaaggtgagaaccaaaccaacgctgaattgttgagggaggaagactggagtgtcttactgaaaatggaagaggagtacatagagaacctatgtgcgcagatattgaagttcaaaccggatttagtgataactgaaaaggggctcagtgatctagcttgccattattttagcaaggctggtgtcagtgcaatcagaaggctgagaaagacggataataacagaattgccagagcttgtggggcagttattgttaataggcccgatgaattgcaggaatctgatattggtacaggcgctggactgtttgaggtgaggaaaattggtgatgagttctttgcattcattgtggactgtaaagatccaaaagcatgcactgtccttctaaggggtgccagcaaggacctgttgaatgaagtggagagaaatttgcaggatgcaatggctgtggcaagaaacataattaaaaacccgaaacttgttcctggtggtggtgcgacagaactgactgtatctgctatgttgaagcaaaagagctcatccattgaaggcgtagagaagtggccatatgaagctgctgcaatggcattcgaagctataccaagaactttggctcagaactgtggtgtcaatgtgattcggatcatgactgccttacaaggaaagcatgcaaacggtgagaatgcatggatcggaatcgacggtaacactggtgaaatcactgatatgaaagagcgcaagatatgggattcatacactgtgaaggcgcaagcattcaagacagccattgaagctgcgtgcatgctgttgagaatcgatgatatagtgagtgggataaagaagaagcaggctggagcaggtgggccatcgaagcctacaatcgaggaagaaggcaatgcagacaacgagaatatgattcccgagtgagagataccaagtggattattgcatgcaatctctgatctgtaaatgaaattaaaaattggttctttaaaaaaaacaagtttagcagtgttgtgctttttcggctggatgtgccgtttcatttcccctgatccgagttgcaggttgagttttgtagtctgttgtttcttccttccttaattaactagggtttcttgccacttgacgtaatttttgtggttttgttcgacttttttttgcgtgtctcttgtactaaactaagatttgtcaattttcccctttagaaccagatgcccaattttgacaatgatccccagaaaacataaaattctac

SEQ ID NO: 2556 - DNA, 2004 bp, Tropaeolum majus
tccatccttcccttcccgtcgctccgtgaagtttgtcgttttagggcattctcgttccagtactccataaccacgttaggctctctgtcaatctgtatctgcagcttttgtttcatttttgctgaaaggaggaagaagaagtgtgaaaatttgttgtagtcgaagatcttcaaagcgcagaaatgaatgcaccagtactcgttttaaaggattctttgaagcgagagtctggaagtaaggttcaacatgctaatatacaggcgtcaaaggctgtggctgacattattcgtacaactttgggtccgcggtctatgttaaagatgttacttgatgctagtggagggatagtggttactaatgatggtaatgcgattctacgtgagttggatattgcacatccagcggccaagtcgatgattgaattaagccgcactcaagatgaagaagttggtgatggaaccacatcggtcattgttcttgctggtgaaatgctccacgtagcagaagccttcattgacaagaattatcatcctacagtgatttgccgagcctacattaaagctctggaggatgcaattgctgtcattgacaaaattgctatgcccattgatgcaaaggatcgttcaacaatgttgtcactggtaaagagctgcataggcacaaagttcactagtcaatttggcgatttgattgctgatttggccattgatgccaccactactgttggtgttgacctaggccaagggttacgagaagtagatattaagaaatacatcaaggttgagaaggttcctggtggccagttggaagactctagtgttcttaaaggtgttatgtttagcaaagatgtcgttgcccctggaaaaatgagaagaaagatcatcaacccccgtattatacttcttgattgtcctcttgagtacaagaagggtgagaatcaaacaaatgctgagttggttagagaagaagactgggcagttctgttgaaattggaagaagaatatattgagaacatttgtatgcaaattataaagttcaagcctgatttagtaatcacagaaaaagggcttagtgatttggcatgccattacctaagcaaggctggtattactgcaattcgaaggttgaggaagacagacaacaacagaattgcgaaggcatgtggggctgtaattgtgaacagaccagacgagttgcaggagtcagatgttggtactggtgctgggctatttgaggttaaaaaaattggggacgagttctttgcatttattgttgactgtaaagatccaaaagcatgtactgttctcttaagaggtcctagcaaggatctattaaatgaagtggaaaggaatctgcaggatgccatgtctgttgcaagaaacataataaaaaatccaaaacttcttcctggaggcggagcaacagaattaactgtttctgctactttgaaggcaaaaagttcatctattgaaggcatagagaagtggccttacgaagcagctgccattgcgtttgaggctattccacgtactcttgcccagaattgtggtgtcaatgtcatccggacaatgactactctgcagggaaagcacgcgaatggcgagaatgcttggacaggcatagatgggaacaccggtgctattgttgacatgaaagaacgcaagatctgggacgcctacaacgtgaaagcgcaaacctttaagacagcaattgaagctgcctgcatgcttctgaggatagatgacattgttagtggcataaagaagaagcaagctcctggagcaggtcaatctcaaaagccaaagattgagacagaaaacgacgccgatggcgagcaaatacttcctgattaaaaaatcttgtactccgaaaactaacgaattttgctttgtttcgtttgtttgtcttcttaaagctttttattttcgcgtagtttatcgaattttggccctgttttgattcaatcctaaatttatcattgtgttagtgagtaaacttgtttgc

SEQ ID NO: 2557 - DNA, 2065 bp, Tropaeolum majus
tccatccttcccttcccgtcgctccgtgaagtttgtcgttttagggcattctcgttccagtactccataaccacgttaggctctctgtcaatctgtatctgcagcttttgtttcatttttgctgaaaggaggaagaagaagtgtgaaaatttgttgtagtcgaagatcttcaaagcgcagaaatgaatgcaccagtactcgttttaaaggattctttgaagcgagagtctggaagtaaggttcaacatgctaatatacaggcgtcaaaggctgtggctgacattattcgtacaactttgggtccgcggtctatgttaaagatgttacttgatgctagtggagggatagtggttactaatgatggtaatgcgattctacgtgagttggatattgcacatccagcggccaagtcgatgattgaattaagccgcactcaagatgaagaagttggtgatggaaccacatcggtcattgttcttgctggtgaaatgctccacgtagcagaagccttcattgacaagaattatcatcctacagtgatttgccgagcctacattaaagctctggaggatgcaattgctgtcattgacaaaattgctatgcccattgatgcaaaggatcgttcaacaatgttgtcactggtaaagagctgcataggcacaaagttcactagtcaatttggcgatttgattgctgatttggccattgatgccaccactactgttggtgttgacctaggccaagggttacgagaagtagatattaagaaatacatcaaggttgagaaggttcctggtggccagttggaagactctagtgttcttaaaggtgttatgtttagcaaagatgtcgttgcccctggaaaaatgagaagaaagatcatcaacccccgtattatacttcttgattgtcctcttgagtacaagaagggtgagaatcaaacaaatgctgagttggttagagaagaagactgggcagttctgttgaaattggaagaagaatatattgagaacatttgtatgcaaattataaagttcaagcctgatttagtaatcacagaaaaagggcttagtgatttggcatgccattacctaagcaaggctggtattactgcaattcgaaggttgaggaagacagacaacaacagaattgcgaaggcatgtggggctgtaattgtgaacagaccagacgagttgcaggagtcagatgttggtactggtgctgggctatttgaggttaaaaaaaattggggacgagttctttgcatttattgttgactgtaaagatccaaaagcatgtactgttctcttaagaggtcctagcaaggatctattaaatgaagtggaaaggaatctgcaggatgccatgtctgttgcaagaaacataataaaaaatccaaaacttcttcctggaggcggagcaacagaattaactgtttctgctactttgaaggcaaaaagttcatctattgaaggcatagagaagtggccttacgaagcagctgccattgcgtttgaggctattccacgtactcttgcccagaattgtggtgtcaatgtcatccggacaatgactactctgcagggaaagcacgcgaatggcgagaatgcttggacaggcatagatgggaacaccggtgctattgttgacatgaaagaacgcaagatctgggacgcctacaacgtgaaagcgcaaacctttaagacagcaattgaagctgcctgcatgcttctgaggatagatgacattgttagtggcataaagaagaagcaagctcctggagcaggtcaatctcaaaagccaaagattgagacagaaaacgacgccgatggcgagcaaatacttcctgattaaaaaatcttgtactccgaaaactaacgaatttttgctttgtttcgtttgttttgtcttcttaaagctttttattttcgcgtagtttatcgaattttggccctgttttgattcaatcctaaatttatcattgtgttagtgagtaaacttgtttgctttttttttccaattctaatagctctgtcgcggttaatgtatgcattatgccaactcg

SEQ ID NO: 2558 - DNA, 2015 bp, Prunus persica
aaaaacctctctcgagtgttctgaactcctcttcctcacacactcaacagtttcaaacagatctcaacatcaccatgcaagccccagtactcgtcctgaaagattcattgaagcgtgagtctgggactaaggtgcaccatggtaatatccaggcatcaaaggctgtcgctgacataatccgtacaaccttgggtcctcgatccatgctcaagatgctacttgatgctagtggaggaattgtggtgactaatgatggaaatgccattctgcgtgaattagatattgcacacccagcagcaaaggcatgccattttcaatgattgaactaagtcggacacaagatgaagaagtaggtgatggaactacatccgtcattgtccttgctggtgagatgctccatgttgcagaagcatttattgacaagcattatcatcctactgtcatttgccgagcatacaacaaagctctggaggatgctattgcggttcttgacaaaatagcaatgaccattgatgtgaaggatcgtgcaacaatgttggggctggtcaaaagttgtatcggtacaaagttcactagtcaatttggggatttaattgctgatttagcacttgacgctaccacaatagtaggggtggaccttggccagggtctgcgggaagtggatattaaaaagtacataaaggttgagaaggttcctggtggccagttggaagattcagtggttctcaaaggagtaatgattaacaaagatgttattgcacctggaaaaatgagaagaaagattttcaacccacgcatcattcttcttgattgtcctcttgaatataagaaaggtgagaaccaaacaaatgctgagttgcttaaagaagaagattggggagtcctgctaaaattggaagaagaatacatcgagagcctatgcgtgcaaatattgaagtttaaaccagatgtggttatcacagaaaaggggcttagtgacttggcatgccattattttagcaaggccggcgtcagtgcaatcaggaggttgcggaaaacagataataaccgaattgccaaggcttgtggggctgtaattgttaacagaccagatgaattgcaagagtctgatgttggtacaggcgctgggatatttgaggttaagaaaattggtgatgagttttttgcattcattgttgattgcaaagagcctaaagcatgtactgtactcttgagaggtcctagtaaggatctcttaaatgaagtggaaaggaatttgcaggatgccatgtctgtagcaagaaacatcctcaagaatccgaaacttgttcctggtggtggtgctacagagttaactgtatctgctacattgaagcaaaagagttcatctgtagaaggtatagaaaagtggccgtatgaagctgctgctatagcttttgaggctataccacgtactttggctcagaattgcggggtgaatgtgattagaacaatgacggcgctgcagggaaagcatgcaaatggtgaaaatgcatggattggcattgatggtaacactggtgtgataactgatgtgaaagagaaaaagatatgggatgcctacaacgtgaaggcccagacttttaaaacggccatagaagctgcttgcctacttctcagaatcgatgacattgtgagtgggatcaagaagaagcagcctcctggtgccaaagctccttcgaagcctcaagttgagacagaaggcgatgcagataatgagcaaataattcccgagtgatcatcgagagcacgtggttttctcagtttaaatgaagttttgctttaaagaagaaaaaaaggagcattataagtttgatgaggatattttgtaggtttataatgtcaccttaacttggtagtgtgtgttttgtccctcttctttctttctcaatccacgaggggtgggaaagaagagaagtcttcttattggagaatgctaatgttagtttgacatgtcatctgtgtatcgaacacaatttatttgttgaacttcttgg

SEQ ID NO: 2559 - DNA, 1740 bp, Cirsium arvense
gagaaaactctgcaacactctaccaactgatctctctacggtttttcacttccatctccagaagatatgcagtcacctgttcttgttctcaaggattccctcactcgtgaatctggaagcaaggtgcatcatgcaaatatccaagcttctaaggccgtggctgatattattcgcaccacattgggtccaaggtccatgttaaagatgcttctcgatgctcaaggaggtattgtggtcaccaatgatggaaatgccattttgcgggagttggatattgctcacccagctgcaaagtccatgattgaactaagccgcacacaggatgaggaagttggtgatggaactacatcagttatcgttcttgctggtgagatgcttcatgttgcagaagctttcattgacaagaagtatcatcctacagttatttgccgagcttacaacaaggctcttgaagatgctcttgctgtgttggacaagatttccatgtcgattgatgtgaatgaccgttccatgatgctgggtttggtgaagagttgtattggcacaaaatttaccagtcagtttggtgatctaatatcagatctcgcacttgatgcaactacgatagttggtgtcgatataggccagggacttagagaagtggatattaagaaatatattaaggtcgagaaaattcctggcggccaattggaagattctaaggtcctcaaaggtgttatgtttagcaaagatgtggtcgttcctggaaaaatgaaaaggaaaattgtaaatccccgcatcattttacttgattgccctctggagtataaaaagggagagaaccagacgaatgcagaattggtcagggaagaggattgggcagtactcttgaaaatggaagaagagtacattgaaaatctatgtgtacaaatactgaagttcaagcccgacttggtgatcacagagaaggggcttagtgacttagcctgccattacttcagtaaagctggagtcagtgccatcaggagattaaggaaaaccgacaacaataggattgctaaggcatgtggagctgtgattgtgaataggccagatgaacttcaagaatcagatgttggaaccggggctggactctttgaggttaaaaagatcggtgatgagttttttgcgtacattgttgattgtaaagatccaaaagcatgcactgttcttctccgaggtgctagcaaagatcttttaaacgaagtggagcgaaacttgcaggatgctatgtcggtggctaggaacatcctaaagcatccaaagcttgttcctggtggcggtgccactgagttgaccgtttctgctacactgaagcaaaagagctcatcgatagaaggcattgaaaagtggccttatgaagctgcagctgtagcattcgaggcgataccacgaacattggcacagaactgtggtgtcaatgtcattagaactatgactgcccttcagggaaagcatgcaaatggtgagaatgcatggacagggatcgatgggaatacgggtgaaatttctgatatgaaagaacttaagatctgggatgcttataatgtgaaggcacagaccttcaagacagccatcgaggctgcttgtatgcttctaaggattgacgatattgtgagcggaataaagaagaggcaagctccgggagccagtcaaccatcaaaacccactatcgagcaagaaggggaagccgacaacgagcagatgattcccgagtgaaga

SEQ ID NO: 2560 - DNA, 2241 bp, Cajanus cajan
agcacattttggcggaaaacctcagcgcagttgctagctctgttccgccgattttttctcgaaaccgatttcgcctctgtgccctagcgcctctccgccgccgtcaaccaccggctaccgttaccgatcggacattctcccaccaagttcagcgaaccttagattctctcgagcgtctcccggagcatctcctctgctactggatttagctcttgcgtgcgaaaattctcggaatattttgaatccaaggaatcatgcacgcgccagttctagttctcaaggactctttgaagcgagagtctggagctaaggtgcgctatgctgttattcaagcggccaaggctgttgctgatgtagtccgtacaacattgggacctaggtccatgctaaaaatgcttcttgatgctcaaggaggaattgtggttaccaatgatggaaatgctatcttacgtgaattagaccttgctcacccagctgcgaagtctatgattgaacttagtcgcacccaagacgaagaagtaggagatggaacaacatctgtcattattcttgctggtgagatgcttcatgttgctgatgcattcatcgacaaaattcaccctactgttatttgccgagcatataccaaagctttggaggatgctattgctgttcttgacaaaattgcaatgcctattgatgctcaggatcgaggtataatgctggggctagtaaaaagctgcataggtaccaaatttacaggtcaatttggggatttaattgctgatttagctattgatgccactacaacagttggtgttgacattggccatggtttgagagatgtagatattaaaaattatattaaggttgagaaagtcccaggtgggcagctggaggattcgagagttctcaagggagttatgataaacaaagatgtggttgcccctggaaaaatgaggagaaagattgttaacccacgtatcattcttctagatagtccccttgagtataaaaagggtgaaaaccagacaaatgctgaactcctcaaagaagaagattggagtctcttgttgaagatggaggaagaatacattgaggaactgtgcatgcagatattgaagtttaaaccggacttggtaatcacagagaagggtctgagtgatttggcttgccattatctgagcaagcatggagttagtgcaatcaggaggctgaggaaaactgataataatagaattgccaaggcatgtggtgctgttattgtgaacagacctgatgaattgcaggagtctgatgttggtactggtgctggattatttgaggttaagaaaattggagatgagtactttgcatttattgttgattgcaaagaccccaaggcttgtaccgtattactaagaggtgctagtaaggatctcttaaatgaagttgaaagaaacctacaggatgctatgtctgttgcaaggaacataataaaaaatccaaaacttgttcctggtggtggtgctacagagttgacagtatcggctgccttgaaacagaagtgttcatctattgagggcatagagaagtggccttatgaagccgctgccattgctttcgaagctataccacgaactttggcacaaaattgtggagtaaatgtcattcgaactatgactgctctacaaggaaaacatgcaaatggagaaaatgcatggattggtatagatggaaatactggtagcatcactgacatgaaagaggccaagatctgggatgcctacaatgtgaaggcacaagcttttaagactgccattgaagctgcttgcatgctcttaaggattgatgatatagtgagtgggatcaagaagaagcaagcacctggagcctcagctccttcaaaacccaaggttgagaccgaggcagatgctgatggcgagcaaatccttcctgactaagaattaggttcaactgacattgctttttgatagagtcgatgatgtgctaggttcttgatctgccttaaaccttatctttattcttagaagttttgggtccttgattgggctgttttgtgccttgttctgtttgcaagagtaaattataaacttttatgttatagacttgtagactatattgggtgttttgggtccattattttgagattttgtgcctgggtcaaaccgaccagtttctccgattctgttgagctgtttctggtttttcattcatgaaatattttttactcttaatatccaagcactcccttagaacttg

SEQ ID NO: 2561 - DNA, 1674 bp, Ambrosia trifida
cagtcaccggttctcgttctcaaggattcgcttactcgtgaatctggaagtaaggttcatcatgctaatatccaagcctcaaaggccgtggctgatatcattcgaaccactttgggtccaaggtccatgttaaagatgcttctagacgcgcaaggaggcattgtggtcactaatgatgggaatgccattttgcgggagttggatattgctcacccagctgcaaagtccatgattgaactgagccgcacacaggatgaggaagttggtgatggaactacatcagtcattgttcttgctggtgagatgcttcatgttgcagaagctttcattgacaagaagtatcatcctacagtaatttgcagagcttacagcaaggctcttgaagatgctcttgctgtgttggacaaaatctccatgtctattgatgtgaatgatcgttcaatgatgttgggtttggtgaagagttgtattggcacaaaattcaccagtcaatttggggatctgattgcagatctagcacttgatgcaacaaccacagttggtgtggatctaggccaaggtataagagaagtggatattaaaaaatatattaaggttgagaaaatccctggtggccagttggaagattctaaagtcctaaaaggtgttatgttcaacaaagacgttgtcgtccctggaaaaatgaaaagaaaaatcataaacccccgtatcattttactagattgccctttggagtacaaaaagggtgagaatcaacaaatgctgagttagttagagaagaagattgggcagtactcctaaaaatggaagaagaatacatgaaaacctctgtgtgcaaatacttaagttcaagccagatttggtgatcactgaaaaggggcttagtgacttagcatgccattatttcagtaaagctggagttagtgctattaggagattgaggaaaacagataataataggattgctaaagcatgtggggctgttattgtgaatcggcctgatgaacttcaagaatcagatgtcgggactggggctgggctttttggaggttaaaaaggttggtgatgtaatttttttcatttattgtggattgtaaagacccaaaagcgtgcacggttcttctccgaggtgccagcaaagatcttttgaatgaagttgaacggaacttgcaggatgcaatgtcagttgctaggaacatcctaaagcatccaaaactcgtcctggcggtggtgcaactgagttaactgtttctgctacactgaagcagaagagctcgtcaatagaaggcattgagaagtggccttatgaagccgcagctgtagcatttgaggctataccacgaacattggcacagaactgtggagtcaatgtcattagaactatgactgctcttcaggggaagcatgcaaacggtgagaatgcctggacaggtatagacgggaattcaggtgaaattgctgatatgaaagaactaaagatttgggatgcttataacgtgaaggcacagacctttaagacggccattgaggctgcttgtatgcttctaagaatcgatgatatcgtgagtggaatcaaaaagaggcaagctcctggatctaatcaaccatcaaaacccactattgagactgaaggggatgccgacaacgagcagatgattcctgagtgaaagaaaa

SEQ ID NO: 2562 - DNA, 1728 bp, Flaveria ramosissima
actctcgttatcagttatgcaatcaccggttctggtcctcaaggattctctcactcgtgaatctggaacgaaggtgcatcatgcaaatatccaagcttcaaaggccgtggctgatattattcgaaccactttgggtccaaggtctatgttaaagatgcttctagatgctcaaggaggaatcgtggtcactaatgatgggaatgctattttacgggagttggacattgctcacccagctgcaaagtctatgattgaactaagccgcacacaagatgaggaagttggtgatggaactacttctgtcattgttcttgccggagagatgcttcatgttgcagaagctttcattgacaagaagtatcatcctacggttatttgtcgagcttacaataaggctcttgaagacgctcttgctgtgttggacaaaatctccatgtctattgatgtgaatgaccgctcaatgatgctgggtttggtgaagagttgtattggcacaaaatttaccagtcaatttggggatcttattgcagatctagcacttgatgcaacaactacagttggtgtggatctaggccaaggaataagagaagttgatattaaaaaatatattaaggttgagaaaatccctggtggccagttagaagattctaaagtcctcaaaggtgtgatgttcaacaaagacgtagtcgttcctggaaaaatgaaaagaaaaatcataaacccccgcatcattttactagattgtcctttggagtacaaaaagggtgaaaatcaaacaaatgcagaattagttagagaagaagattgggcagtacttctaaaaatggaagaagaatacatcgaaaacatctgtgtacagatacttaaattcaagcctgatttggtgatcactgaaaaggggcttagtgacttagcatgccattatttcagtaaagctggagttagtgcaattagaagattaaggaaaacagataataacaggattgctaaagcatgtggggctgttattgtgaatagacctgatgaacttcaagaatcagatgtaggtactggggctgggctttttgaggttaaaagattggtgatgaattttttgcatttattgtggattgtaaagacccgaaagcgtgcaccattcttctccgaggtgctagcaaggatcttttgaatgaagttgaacgaaacttgcaggatgcaatgtcagttgctaggaacatcctaaagcatccaaaacttgtgccgggtggaggtgcaactgagttaactgtttctgctacacttaagcaaaagagctcatcaatagaaggcattgagaagtggccttatgaagctgcagctgtagcattcgaggctattccacgaacattggcacagaattgtggcgtcaatgtcattagaactatgactgctctgcaggggaagcatgcaaatggtgagaatgcctggacaggaatagatggaaattcaggtgaaattgctgatatgaaagaactaaagatttgggatgcttacaacgtgaaggcgcaaacctttaagacagccattgaggctgcttgtatgcttctaagaattgatgatatcgtgagtggaatcaaaaaaaggcaagcaccaggatctacccaaccatcgaaacccaccattgaaacagaaggggatgccgacaatgagcagatgattccggagtgaagaccagcgtaatttttgaaaaaaaaacactaatcttgtttc

SEQ ID NO: 2563 - DNA, 1752 bp, Cirsium arvense
gagaaaactctgcaactccaactactgatctctacggttttacacttccatctacagatatgcaatcaccggttctcgttctcaaggattctctcactcgtgaatctggaagcaaggtgcatcatgcaaatatccaagcctctaaggccgttgctgatattattcgcaccacattgggtccaaggtccatgttaaagatgcttcttgatgctcaaggaggtattgtggtcactaatgatggaaatgccattttgcgggagttggatattgctcacccagctgcgaagtccatgattgaactaagccgcacacaggatgaggaagttggtgatggaactacgtcagttattgttcttgctggtgagatgcttcatgttgcagaagctttcattgataagaagtaccatcctacagttatttgccgagcttacaacaaggctcttgaagatgctcttgctgtgttggacaagatctctatgtctattgatgtgaatgaccgttccatgatgctgggtttggtgaagagttgtattggcacaaaatttaccagtcagtttggggatctaatagcagatctagcgcttgaggctacgacaacagttggtgtagatataggccagggacttagagaagtggatattaagaaatatattaaggtcgagaaaattcctggcggtcaattagaagattctaaggtcctcaaaggtgttatgtttagcaaagatgtggtcgtccctggaaaaatgaaaaggaaaatcgtaaatccccgtatcattttacttgattgccctctggaatataagaagggagagaaccagacgaatgctgaattggtcagagaagaggattgggcagtactcttgaaaatggaagaagagtatattgaaaatctatgcgtacaaatactgaagtttaagcccgacttagtgatcacagaaaaggggcttagtgacttagcctgccattatttcagtaaagctggagtcagtgccatcaggagattaaggaaaactgataataataggattgctaaggcatgtggagctgtgattgtgaatcggccagatgaacttcaagaatcagacgttggaactggggctgggctctttgaggttaaaaagattggtgatgagttctttgcctacattgttgattgtaaagatccaaaagcgtgcactgttctcctccgaggtgctagcaaagatcttttaaatgaagtggagcggaacttgcaggatgctatgtcggtggctaggaacattctaaagcatccaaaacttgttcctggtggcggggccactgagttgaccgtttctgctactctgaagcagaagagttcatcaatagaaggcattgagaagtggccttatgaagctgcagccgtagcatttgaggcgataccacgaacattggcacagaactgtggtgtcaatgtcattagaactatgactgctcttcaggggaagcatgcaaatggtgagaatgcatggactgggatcgatggaaattctggtgaaattgctgatatgaaagaacttaagatctgggatgcttataacgtgaaggcacagaccttcaagacggccatcgaggcttcttgtatgcttctaaggattgacgatattgtgagtggaatcaagaagaggcaagctcctggagctagtcaaccatcaaaacccactattgaacaagaaggggaagctgacaacgagcagatgattcccgagtgaagataaatagtttcaccccaaa

SEQ ID NO: 2564 - DNA, 2015 bp, Helianthus annuus
ccgccccttctcgtattttctgcatttcaaaagaaatcaaacacagaaaccctagacttaactccgtcatctccgaccaccgatccctaccgttcttcttacactcacatctacagctatgcagtcgccggttctcgttctcaaggattcgctcactcgtgaatctggaagtaaggtgcatcatggaaatatccaagcttctaaggccgtggctgatattattcgtaccacattgggtccaaggtcaatgctaaagatgttgcttgatgctgcaggaggaattgtggtcactaatgacgggaacgccattttgcgggagttggatgtcgctcacccagctgcaaagtcgatgattgaactaagtcgcacccaggatgaggaagttggtgatggaactacatcagtcattgttcttgctggtgagatgcttcatgttgcggaagctttcatagacaagaagtatcaccccacagttatttgccgagcttacaacaaggctcttgaggatgctcttgctgtgttggacaaaatctccatgtctattgatgtgaacgatcgttcgatgatgctgggattggtgaagagttgtattggcacaaagttcaccagtcaatttggagatttaattgcagatctagcacttgacgcaacgacaacggtcggtgtcgatctaggccagggcttacgagaagtggatatcaaaaaatacataaaagtcgaaaaaatccctggtggccagttagaagattccaaagtcctcaaaggtgttatgttcaacaaagacgtcgtcgtgcccggaaaaatgaaacgaaaatcgtaaacctcgtatcatcttactcgattgccctctttgatacaaaaagggcgagaatcaaacaaacgccgaattagtccgggaagaagattgggccgtactgttaaaaatggaagaagaatacatcgaaaacctgtgcgcgcaaatactcaaattcaaacccgatttagtgatcaccgagaaagggcttagtgatttggcgtgtcattattttagtaaagcgggagttagtgcaattaggaggttaaggaaaacggataataatcggattgctaaggcgtgtggagcggttattgtgaataggcccgatgaacttcaagaatcagatgttggaactggtgctgggctttttgaggttaagaaaatcggtgatgagttttttgcgtatattgtggattgtaaagatccgaaagcgtgtacggttcttctcagaggtgccagtaaggatcttttgaatgaagttgagcggaacttgcaggatgttatgtcagtggctaggaatattctaaagcatccaaaacttgtacccggtggtggtgcaactgagttgaccgtttccgctacactgaagcagaagagctcatcagttgaaggcattgaaaagtggccttatgaagctgcagctgtggcatttgaggctattccaagaacattggcacaaaactgtggtgtcaatgttattcgaaccatgaccgcacttcagggaaagcatgcaaatggagagaatgcatggacaggaatagatgggaattctggtgaaattgctgatatgaaagaactaaagatttgggatgcttataacgtgaaggctcagactttcaagaccgccattgaggccgcttgtatgcttttaagaatcgacgatattgtaagtggaataaaaaagagacaagcccccggagctagccaaccatcaaaacccactgttgagacagaaggggacgctgataacgagcagatgattcccgagtgaagaataaacattaatttgagtgttcttgggaagtttttcactcgttttaatcacaatttcttgtgtgttttattgttgctaaggcctaaactatttagttaactaaaattttggtatgttatgcttttggggtgctttgcttttgtctttagttttcatgacccaccttgaatcttagtatttgatgttcattttgatatgttgacattatatgatagttagcagttg

SEQ ID NO: 2565 - DNA, 1950 bp, Valeriana officinalis
ttgcaactacacttccattctcaactccagatctccataaacctcacttcaccaccattttaccagcttctctcattgttttaggtttacatcatcatatcaccagtcatgcaatcacctgtactagttctcaaggattcgctgacccgtgaatctgggagcaaggttcatcatggtaatatccaagcctcaaaggctgttgctgatatcattcgtaccacacttggtccaagatctatgttaaagatgctcttagatgctagtggaggaatcgttgtaactaatgatggaaatgctattctccgtgaactggatgtagctcacccagcagccaagtccatgattgaactaagccgcacacaagatgaagaagtaggggatggaacaacttcggtcatagttctcgctggggagatgcttcacgtggctgaagcttttattgacaagagctatcatcctacagtgatctgccgagcttataataaagcacttgaggatgctctagcggtgctcgacaagatttctatgtcaattgatgtgaatgacagagacatgatgatggggctaatcaagagttgtataggcacaaaatttactagtcaattcggtgatctaattgctgaactggctcttgaggcaacaacaacaattggtgtagatattggccaaggagtgcgcgaagttgatatcaagaaatacataaaagttgaaaaaatccctggaggccagttagaagattctcacgttctgaaaggtgtcatgttcaacaaagatgtggttgtacctggaaaaatgagaagaaaaatcgtgaatccccgtatcattttactagattgccctctcgaatataaaaaaggtgagaatcaaacaaacgcagaactagtcagagaagaagactggggcgttctcttgaaaatggaggaagagtacattgaaaatctttgcgcgcaaatactcagattcgaaccagatcttgtaatcaccgagaaaggacttagtgacctggcgtgccattacttgagtaaagctggagttagtgcgattagaagattgaggaaaactgacaataacagaatcgctaaagcgtgtggggccgttattgtaaatagaccagatgaactccaagaatctgatgttggaactggtgctggacttttcgaggtcaagaaaattggagatgagtttttctcttacattgttgagtgcaaagaccctaaagcttgtaccgttcttttgcgaggagctagcaaggatcttttgaatgaagtcgaacgcaacttacaggacgcaatgtcagttgctagaaacattataaagaatccaaagcttgtccctggtggtggtgctactgagttaactgtatcagctacactgaaacagaagagctcatctgttgaaggcattgagaagtggccttatgaagcagctgcagtagcattcgaggctataccacgaacactggcacaaaattgcggtgtaaatgtgatcagaactatgactgctctgcaaggaaagcatgcaaatggtgaaaacgcttgggtgggaattgatggcaactctggtgtaatttctgacatgaaagagctaaagatatgggatgcttataatgtgaaagcacagacgttcaagacggcgatagaggcagcttgtatgcttttaaggatagatgatatagtgagcgggataaagaagaaggcagcaccgggcagccaagctccatcaaaaccgggcatcgaacaagaaggagatgccgacaatgagcagatgattcccgagtgatgatgaattattaaacatggtcttttttaaaacttctttttgtaggttgacagtgtttctgtggggtttatgttttttctcatctggatctgcttagttacggagtaaatcttaatttcgagaattttgactactcacttctcgacttcctactgtttgaatctattgtgg

SEQ ID NO: 2566 - DNA, 1784 bp, Vinca minor
acaccaaaaagccctccaaaactctctccaaacctaaaacttctgtaatctccttgaaataaattatctctcagtctcccccggagatcagatcggaaaaaatgcatgctcctgtcctcgttcttaaggattctttaaagcgtgaatcgggaaataaagtgcattatgggaacatccaagcatcaaaggctgttgcagacataattcggactacactgggtccacggtcaatgttgaagatgcttcttgatgctgctgggggaattgtagtaactaatgacggaaatgctatcctgcgggagttggatattgctcatccagcagctaagtccatgattgaacttagccgtactcaagatgaggaggttggagatggaaccacatctgtcattattcttgcgggtgagatgctccatgttgcagaagctttcattggcaggagttatcatcctacagtcatttgtagagcttacaataaggctctagaggatgctcttgcagtgctggacgagatttctatgagcattgatgtgaaggatcgtgcgtcaatgttgggcctcataaagagctgtattggcacaaaattcacaagtcaatttggagatcttattgctgatttagccattgatgctacatcaacagttgatgtggaactgggacaaggcttgcgtgaagtagatatcaagaagtacattaaggttgagaaggttcctggtgggcaattggaagattcaaaggttcttaaaggagttatgattaacaaagatgtagtagctccaggtaaaatgaggagaaagattgtaaatccacgtattattcttcttgattgtcccttggagtacaagaagggtgagaaccaaactaatgccgaattgatgagagaagaagattggagtgtactgttgaaaatggaagaagaatacattgacaatctttgtgcacagatattgaggttcaaaccagatttagtcataacagaaaaggggctaagcgaccttgcgtgtcattacttgagcaaagctggtgtctcggcaatcaggaggctacgaaagatggataacaacagaattgctaaggcatgtggggcagtcatcgtcaacaggcctgatgaattgcaggaatctgatgttggtactggagctggtctatttgaagtgaggaaaattggcgatgacttcttctcattcattgttgattgcaaggatccaaaagcttgcacagtactcttaaggggtgccagcaaagatctattgaatgaagtagagcgaaatttacaggatgccatgtctgtagcaagaaacattatcaagaatccaaaacttgttcctggtggtggcgcgacagaattgactgtatctgcaacgttgaagcaaaagagttcttctgttgaaggcatagaaaagtggccttatgaagcggcagcaattgcttttgaggctatccctcgaactttagctcagaattgtggagtcaatgttattagaactatgacagcattgcaaggaaagcatgcaaatggagaaaatgcatggattggcatcgatgggaatactggagaaattactgatatgaaagagaggaagatatgggactcatatactgtgaaggcacaggcattcaaaactgccatagaagctgcctgcatgcttctgagaattgacgacattgtaagtgggataaagaagcaggctcctggatccggatcagctccatcgaaacctaaagttgacgaagaaggtgaagctgacaatgaagccctaattccggaatgaggaggaaaacaa

SEQ ID NO: 2567 - DNA, 2119 bp, Arabidopsis lyrata
tctctctcagcttctctcttcactgtgaaaacctcagatcgcaaatatgcacgcaccggttctcgttctgagcgattcgttgaagcgtgaatctggaagtaaggttcatcatggtaatatccaagcttctaaggctgtggctgatatcattcgtacgacgttgggtcctcgttctatgttgaagatgcttcttgatgctagtggagggattgttgttactaatgatgggaatgctattcttcgtgagctagatgttgctcatcctgctgctaagtcaatgattgagttgagccgtacacaagacgaagaagttggtgatgggacaacgtctgttattgttctagctggagaaatgcttcatgtcgcagaagcatttattgagaagaattaccaccccacagtcatatgccgagcttacattaaggctctcgaagattcaattgctgttcttgacaaaattgctatgtcaattgatatcaatgaccgttcatcagtgctaggattagtcaaaagctgcatagggacaaagttcactagccaatttggagatctaattgctgatttggctattgatgccactactactgttggtgttgatcttgggcaaggtttgagggaggtagacattaaaaagtacatcaaggttgagaaggttcctggtggtcagtttgaggactcggaggttcttaaaggagttatgtttaataaagatgtcgttgctcctggtaaaatgaaaagaaagattgtcaacccacggattattcttcttgactgtccccttgagtacaagaaaggtgaaaatcaaaccaatgctgagttggtcagagaagaggactgggaagtgttgttgaagttggaagaggaatacatcgagaacatttgcgtccaaatacttaagttcaaacctgatttagttattacagaaaagggtcttagtgatttggcctgtcactatttcagtaaagctggggttagtgcaatccgtaggttgagaaaaactgacaacaacagaatcgccaaggcttgtggagcagtgattgtgaacaggcccgacgaactgcaggagtctgatatcggtactggggctggtttgtttgaggtcaagaaaataggagatgatttcttttctttcattgttgattgcaaagaacccaaagcctgtaccgtactcttaaggggaccaagtaaagatttcatcaatgaagtggaaagaaatttacaggatgccatgtctgttgcaagaaacattatcaaaaacccaaagctcgttcctggtggaggagccacagagttaaccgtttctgccacattaaaacagaagagtgcaacaatcgaaggcatagaaaagtggccttatgaagcagctgccattgctttcgaggctattccacgtaccctggctcagaactgtggggttaacgtgatccgtactatgactgcattgcaagggaagcacgcaaatggtgaaaacgcatggactggtattgatgggaacactggtgcaatagctgatatgaaagagagcaagatatgggattcgtacaatgtgaaggcgcaaactttcaagacggctatagaagctgcgtgtatgcttctaagaattgatgatatagtgagtggaatcaagaagaagcaagctcctggatcaggaccttcaaagcctaccattgagacagaaggagatgcagacaacgaacaaattcttcccgactaagcaaagagaaacactttggtctcagtgtgtaactcaatctctgttttcacttgttttatggttgcattctctttcggctagtatcgtccccttgacatatcttctaattttgcaatttgacttggtgagataagatttttgagggtggggttttagtgtcttgttctgaatgttaccttttttgaattttcgtagtcactttgttggttttaagagtgctagttgttattgtcttactgaaatttctggcactagagactttttttagtttgtgacgtttttgtttgaatatcatcaaagtacttcaacggtatcttaagttgaccgtttagtgtcaaaatgtgtttttgtttgaacaccattaattgcatttcagacgtacggatcggttttttagagtgttgg

SEQ ID NO: 2568 - DNA, 2186 bp, Aristolochia fimbriata
ggacagcagaagagtaagtggaaaggcaagggcgccctggctgcaggtcctataagtattccgaacactctagcgcgcgagtgccttgtctctcttcctgctgtcggaggttccttttgctaccaagcttgcattttcgatcttcagccatgcaaacgccagttcttgccctcaaagattcattgactcatgaatctggaactaaagtacaccatgcaaatatccaagctgcaaaggctgttgctgatataatccgcactacattgggtccacggtccatgttgaagatgcttcttgatgcagcaggaggtattgtggtcacaaacgatggaaattctatcctgcgtgagttggatattgctcatcctgctgcaaagtcaatgattgaactgagtcgaacacaagatgaagaagtaggtgatggaaccacatcagtcattgttctggctggtgaaatgctgcacgtagctgaagcttttattaacaagagctttcatcccacggttatttgtcgagcctacaatcaagctcttgaggatgcccttgcagtgcttgacaagattgctgtgtctattgatgttgatgatcgtacgacaatgctgggcctggttaaaacttgcattggcacaaagtttaccagtcaatttggaaatcttattgctgatctagcacttgatgccactacaatggttggtgtggaccttgggcaagggtataaagaagtggacatcaagaagtacgtcaaagttgagaaggttcctggtggccagttggaggactccaaggttcttaaaggagttatgtttaacaaagatgtggttgctcctggaaagatgagaagaaagattgtcaatccacgcattattctccttgactgcccacttgaatataagaaaggagaaaaccaaacaaatgcagagttggttaaagaagaagactgggctgttcttctaaaaatggaagaagaatacattgagaatgtgtgcatgcagatattgaagttcaaacctgatgtagtaatcacagagaagggccttagtgatcttgcttgccattacttgagtaaagctggtgtaagtgccatacgacgtctgagaaagactgacaacaatagaattgccaaagcttgtggggctgttatcgttaatagaccagaagagctgcaagagtcagatgttggaactggagctgggctttttgaggttaagaaaattggtgatgagttcttcacatttattgtggattgcaaaaacccaaaggcttgtactgttctactaagaggtgccagtaaggatctcttaaatgaagtagagaggaatttgcaggatgctacgtctgtggcaagaaatattataaaaaatccaaaactagttcctggtggtggtgctacagagttaactgtatctgcaacattgaagcaaaaaagttcatctgttgaagggattgagaagtggccgtatgaagctgctgccatagcttttgaggctattcctcgaaccttggcacagaattgtggtgttaatgttatcagaactatgacagctctgcaaggaaagcatgcaaatggtgaaaatgcttggactggtattgatggaaacactggtgagatcacagacatgaaagagcggaagatctgggattcatacgatgtgaaggctcagacattcaaaactgccattgaggctgcctgcatgcttctcaggattgatgatattgttagtggaattaaaaagaagcaggctcctggcgctgggcaagctccacagaagcctaagatcgaggaagaaggggatgctgacaatgaacaaacgatccctgaataggtaagagctggtagtagagaaattaaccaagacgcaattgccatggctaaatcttgggtctcgtttgtgtatttgtggaacttatgttgccgttctgctgttgtcctttagctgtttaatgagtcctggtacttgacatctcatgtgggaccttcagagttggtttcatttggaagccctcgtacgttttgtttttggcctagtcgttgtatttttgcatagatgctgttagaatgttttacaaggttgtggttgtaatcttaatggctcattgttttaaagtgttattgaggatttgattgcagaaactgttgctcacaaattgagctgtactattgctaaagactaacgataccaatctta

SEQ ID NO: 2569 - DNA, 2019 bp, Helianthus annuus
tctctctctcagctccaaaagaaggcgaaggagaaaccctagacaccttcgagaactgatccctagggttcttacactctcgtatcacagctatgcaatcacctgttctcgttctcaaggattcgctcactcgtgaatctggaagtaaggtgcatcatggaaatattcaagcttcaaaggccgtggctgatattattcgaaccactttgggtccaaggtcgatgctaaagatgcttctagacgctcaaggaggaattgtggtcactaatgatgggaatgccattttgcgggagttggatattgctcaccctgctgcaaagtccatgattgaactaagccgcacacaggatgaggaagttggtgatggaactacatcagtcattgttcttgctggtgagatgcttcacgttgcagaagctttcattgacaagaagtatcatcctacagttatttgccgagcttacatcaaggctcttgaggatgctcttgctgtgttggacaaaatctccatgtctattgatgtgaatgaccgttcaatgatgctgggtttggtgaagagttgtatcggcacaaaatttaccagtcaatttggggatctgattgcagatctagcactcgacgcaacaactacagtcggtgtggacctaggccaaggaatacgagaagtggatattaaaaaatacattaaagtcgagaaaatccccggtggccaattagaagattccaaagtcctcaaaggcgttatgttcaacaaagacgtcgtcgtccccggaaaaatgaaacgaaaaattataaacccgcgtatcatattactagattgccctttagaatacaaaaagggtgagaatcaaacaaacgccgaattagtacgagaagaagattgggccatactcttaaaaatggaagaagaatacatagaaaacatttgcgtacaaatacttaaattcaagcctgatttggtgataaccgaaaaggggcttagtgatttggcgtgtcattatttcagtaaagccggagttagcgcgattaggagattgaggaaaaccgataataaccggattgcgaaagcgtgtggggcggttattgtgaatcggcccgatgaacttcaagaatcggatgttgggactggtgctgggctttttgaggttaaaaagattggtgatgagtttttttcgtttattgtggattgtaaagacccgaaagcgtgcacgattcttcttcgaggtgccagcaaggatcttttgaatgaagttgaacggaacttgcaggatgcaatgtcagttgctaggaacatcctgaagcatccgaaacttgttcccggtggtggtgcaactgagttaactgtttccgctaccctgaagcagaagagctcgtcgatagaaggcattgagaagtggccttatgaagccgcagctgtagcgttttaagctataccacgaacgttggcacagaactgtggtgtcaatgtcattagaaccatgactgctcttcagggaaagcatgcaaatggtgagaatgcctggacaggtatagatggcaattcaggtgaaattgctgatatgaaagaactaaagatttgggatgcttataacgtgaaggcgcagacctttaagacagccatcgaagctgcttctatgcttttaagaatcgatgatatcgtgagtggaatcaaaaagaggcaagctcctggatctaaccaaccatcaaaacccactattgagaccgaaggggatgctgataacgagcagatgattcccgagtgatgaaacattttaatgtagtttcattaaacacgttttctcttgattcatttttaatttcttatgtgctttcattattaccactcgactgcccgaaattttggtccgttatgctaagttttgtttcttctcttttgaccattttttcattcctagtatgtgctgtttgttttgtactattgccattgtatattagtaaggaggtacgcggtgtgtctccaaagtaaatgtggctttctgcttaataaaaaagaaaaaa

SEQ ID NO: 2570 - DNA, 2318 bp, Amorphophallus konjac
ctcactcgtcgttgccgctcaccgccctcctcccgctcagcgcacagcgaacccgagacctctctggaagcagggcgcagccacccggagaagccaggcgccaggcacagggtagcccctctgggatcatctcccttcccagaagaaggaacggaggaggggccgtctcgagcgttctacttccgcctctctcgccctccgcagccatgcatgcccccgtcctcgtcctcaaagactcgttgaaacgggaatctggagctaaggtgcaccatgccaatatccaagcgtcaaaggcagtggctgatataatacgtactacactaggccctcggtctatgttgaagatgctacttgacactggtggaggaattgttgttactaatgatgggaatgccatcctacgtgacctagatttggcccatcctgctgctaagtcaatgattgaattgagtcgcactcaggatgaagaagtaggagatgggacgacttctgtcattattctcgctggtgagttgcttcatgttgcagaagcctttattgacaagaactatcatcccacagttgtttgtcgagcttacactaaagctcttgaggacgccatcgctgttcttgataaaattgcaatgcccattgatgtaaatgatcgtgccacaatgcttggcctggtcaaaagttctattggtacaaagtttactagtcagtttgggaacttaattgcggatcttgcaattgatgctactacaacagtaggagtggaccttggtcaaggactcagagaggtggacattaagaattacataaaagttgagaaggtacctggtggcccattggaggactccaaggttctaaagggagttatgattaacaaggatgttgtcgcccctgggaagatgagaagaaggatactgaaccctcgaatcatcctccttgattgtccccttgagtacaaaaagggggaaaccagacaaatgcagagttagttagagaagaagattgggcggttctcctgaagatggaggaagaatatatagaaaacctatgtgcgcagatactaaagttcaagcctgatttggttatcacagaaaagggacttagtgaccttgcttgccattatctgagcaaggctggagttagtgctatcaggagattgagaaagggtgacaacaacaggattgctaaggcttgtggagcagttgttgtaaacaggccagatgaactgcaagaatctgatgtgggaactggagcaggtctttttgaggtcaagaagattggggatgaattttttgcatttattgtggattgcaaaggccctaaagcatgtaccgttcttctgagaggtgctagtaaggatcttctgaatgaagttgaacggaacttgcaggatgccatggctgtagcacggaatatcttgaagaacccgaagcttcttcctggtggtggtgccacagaattgactgtgtctgctgccttaaagcagaagagttcatccatagaaggcattgaaaaatggccatatgaagctgctgccatggcctttgaggcgattccacgtaccttggcacaaaattgtggtgtaaatgtgattcggacaatgactgctctgcaaggaaagcacgcaagtggtgagaactcatggattggcattgatgggaacactggtgcaattgttgacatgagagaacggcagatttgggattcttacaatgtaaaggcacagacatttaagacatccattgaggctgcttgcatgattttgaggattgatgatatagttagtggagttaagaagaaacaatctccgggtgccggcccaacaccaacgaagcccaagatagaagaagaaggcgacgcagatggtgagcagatactacccgagtgaggtgttgggcaacatacccgtcaattcgttgcttacatgtgatggattctttagggttttcagagatgaagtcaggtggagagtaatggcttcaatcgagtgttcacagattttgaatgaggtgtctttatttgtgttttcgctgttgaaactgtccagaagtcagtcctatcctctcgtttgttcttttgggagcacggaaactagcatgctaggtgttgtttttggtgtactttttttgcatctcgtcatttcctggtggttccgattgcttaggagatgcataggaaggtgtgtttcacttcgaattccgaggcggaaaaggtcctcttatcggtgagatctaaggcttccttgggcctcttgcatgtaccctccttgaaaattttgtatatctgaaaaacaggctgtttttgaaagaaaactttttagttacttt

SEQ ID NO: 2571 - DNA, 2087 bp, Brassica rapa
gagccgcgaagcagtagtagtagcctccaccatcttccactcctttcgaatttgcaccgtcgccgtctctaagccttctgctcggaatctccgtcatacgcctagatcttcacagatatgaacgcccctgttctagttctcaaggattcgttgaagcgtgaatctggaacaaaggttcaccatggtaacatccaagcttccaaggctgttgctgatatcatccgtaccacattgggtcctcgctctatgttgaagatgcttcttgatgctggtggagggattgttgttactaatgatgggaatgctattttgcgtgagctggatgttgctcaccctgctgctaagtcgatgattgagttgagccgcacacaggacgaagaagttggtgatgggactacatctgttattgtacttgctggtgaaatgttacatgttgctgaagcatttattgagaagagttatcatcccacagtcatctgccgtgcttataataaggctcttgaggatgctatcgctgttcttgacaagattgccatgtcaatcgatgtcaatgaccgtgcaacagtactaggactagtcaaaagctgcataggcacaaaattcactagccagtttggtgatcttattgctgatttggctattgatgccaccactaccgttggtgttgatctcggacaaggactaagggaggtggatataaaaaaatacatcaaggttgagaaggtccccggtggtcaattggaagactccaaggttctcaaaggagtcatgttcaacaaagacgtagtcgctcccggtaaaatgaagagaaagatcgtcaacccacggatcattcttctcgactgtccccttgagtacaagaaaggtgaaaaccaaaccaacgctgagctggttagagaagaggactgggaagttctgctgaagcttgaagaggagtacattgagaacatctgcgtgcagatactaaagttcaaacctgatttggtcatcacagagaagggacttagcgacttagcctgtcactatttcagtaaagctggggttagtgcaataaggaggctgagaaagacggacaacaacaggattgctaaggcctgtggagctgtgattgtgaacaggcctgatgagcttcaggagtctgatgttggtactggcgctggcttgtttgaggttaagaagataggagacgacttcttcgccttcgttgttgattgcaaggaacctaaagcgtgtactgtgctcttaagaggaccaagtaaagatcttctcaatgaagtggagaggaatcttcaggatgccatgtctgtttcaagaaacatcatcaagaacccgaagcttgttcctggtggtggagccactgagttaaccgtctctgccactttaaaacagaaaagtgcaacaattgaaggaatcgaaaagtggccttatgaagcagctgctatagcttttgaggctattccacgtactttagctcagaactgtggagttaatgttatcagaactatgacagcactgcaaggaaagcatgcaaatggtgagaatgcttggactggaatcgatggaaacactggtgcaatagctgacatgaaagagagcaagatatgggatgcttacaatgtgaaagcgcaaacgtttaagacagcgatagaagcggcgtgtatgctactgaggattgatgatatagtgagtggtatcaagaagaagcaagctcctggagctggaccttcaaagcctaccattgagacagaaggagatgcagacaacgagcaaatacttcccgactagaaaattgtgctctcaccaacttaatcttgttcctttttttggtcttgttttgatattttagtttggaatgtttttggaacttgacagtctctttagtatcttgttgttttgcattttgacttggggagaaaagatcttgaagggagtgagtgttttgagtgatgaatcttttgtttatttctggaggcaaaggcgttggcattgcaagacgctgatttatttttagtctaacccggatttacttgtttggttttgctacgtatggtacagcgaatatttatttttatgaaatgaatttcatc

SEQ ID NO: 2572 - DNA, 2132 bp, Brassica napus
gaagcagtagcagagcctccaccatcttccactcctttcgaatttgcaccgtcgccgtctctaagccttctgctcggaatctccgtcatacgcctagatcttcacagatatgaacgcccctgttctagttctcaaggattcgttgaagcgtgaatctggaacaaaggttcaccatggtaacatccaagcttccaaggctgttgctgacatcatccgtacaacattgggtcctcgctctatgttgaagatgcttcttgatgctggtggagggattgttgttactaatgatgggaatgctattttgcgtgagctagatgttgctcaccctgctgctaagtcgatgattgagttgagccggacgcaggatgaagaagttggtgatgggactacatctgttattgtacttgctggtgaaatgttacatgttgccgaagcatttattgagaagagttaccatcccacagtcatctgccgtgcttataataaggctcttgaggatgctatcgctgttcttgacaagattgccatgtcaatcgatgtcaatgaccgtgcaacagtactaggattagtcaaaagctgcataggaacaaaattcactagccagtttggagatctgattgctgatttggctattgatgccaccaccactgttggtgttgatcttggacaaggactaagggaagtggatatcaaaaaatacatcaaggttgagaaggtccccggtggtcaattggaagactccaaggttctcaaaggagtcatgttcaacaaagacgtagtcgctcccggtaaaatgaagagaaagatcgtcaacccacggatcattcttctcgactgtccccttgagtacaagaaaggtgaaaaccaaaccaacgctgagttggtcagagaagaggattgggaagttctgctgaagcttgaagaggagtacatcgagaacatctgcgtgcagatactaaagttcaaacccgatttggtcatcacagagaagggacttagcgatttagcctgtcactatttcagtaaagctggggttagtgcaataaggaggctgagaaagacggacaacaacagaattgctaaggcgtgtggggctgtgattgtgaacaggcctgatgagcttcaggagtctgatgttggtactggcgctggcttgtttgaggttaagaagataggagacgacttcttcgccttcgttgttgattgcaaggaacctaaagcgtgtactgtgctcttaagaggaccaagtaaagatcttctcaatgaagtggagaggaatcttcaggatgccatgtctgtttcaagaaacatcatcaagaacccgaagcttgttcctggtggtggagccactgagttaaccgtctctgccactttaaaacagaaaagtgcaacaattgaaggaatcgaaaagtggccttatgaagcagctgctatagcttttgaggctattccacgtactttagctcagaactgtggagttaatgtgatcagaactatgacagcactgcaaggaaagcatgcaaatggtgagaatgcttggactggaatcgatggaaacactggtgcaatagctgacatgaaagagagcaagatatgggatgcttacaatgtgaaagcgcaaacgtttaagacagcgatagaagcggcgtgtatgctactgaggattgatgatatagtgagtggtatcaagaagaagcaagctcctggagctggaccttcaaagcctaccattgagacagaaggagatgcagacaacgagcaaatacttcccgactagaaaattgtgctctcaccaacttaatcttgttcctttctttggtcttgttttgctattttagtttggaatgtttttggaacttggcagtctctttagtatcttgttgttttgcattttgacttggggagaaaagatcttgaagggagtgagtgtttggagtgatgaatcttttgtttatttctgaaggcaaaggcgttggcattgcaaaaaaaaaaaactgatgaggcaaatcgaaagcaaagaagtagagcttaacagacacccaagctctgataaatctgctctgttccctcctcatgtacttgaaaatatcgacttttccatgcttcctcctgagaaacagaatgatagggac

SEQ ID NO: 2573 - DNA, 1909 bp, Brassica napus
cacatcatgaacgctccggttctcgtcctcaaggactctttgaagcgtgaatctggaacgaaggttcaccatgggaacattcaagcttccaaggctgtggctgatatcattcgcaccacgttgggtcctcgctctatgttgaagatgcttcttgatgctggtggagggattgttgttaccaatgatgggaatgctattttgcgagaacttgatgttgctcaccctgctgctaagtcgatgattgagctgagccgcacacaggacgaagaagtgggtgatgggacgacatctgttattgttcttgccggtgaaatgctgcatgttgccgaagcattcattgaaaagagttaccatcccacagtcatatgccgagcttataacaaggctctcgaggatgctatcgctgttcttgacaagatcgccatgtcaatcgacgtcaatgaccgcgcaacagtactaggactagtcaagagctgcataggaacaaaattcaccagccagtttggagatcttattgctgatttggctattgacgccaccactacggttggtgttgatctcggacaaggattaagggaagtggatatcaaaaaatacatcaaggttgagaaggttcctggcggccagttggaagactccaaagttctcaaaggagtcatgttcaacaaagacgtagtagctcccggtaaaatgaagagaaagatcgtcaacccacggataatccttctcgactgcccgctcgagtacaagaaaggtgaaaaccaaacaaacgccgagctggtcagagaagaggactgggaagttctgctgaaactcgaagaggagtacatcgagaacatctgcgtgcagatactcaagttcaaacccgatctggtcatcacagagaagggactcagcgacttggcgtgtcactacttcagtaaagctggagttagtgcgattagaaggctgaggaagacggataacaacagaatcgctaaggcgtgtggggctgtgattgtgaacaggcctgatgagcttcaggagtctgatgttggtactggcgctggtttgtttgaggtcaagaagataggagatgatttcttcgccttcgttgttgattgcaaagaacctaaagcgtgtactgtcctcttgagaggaccgagtaaagatcttctcaacgaagtggaaagaaaccttcaggatgctatgtctgtttcaagaaacatcatcaagaacccgaagcttgttcctggtggtggagccactgagttaaccgtttccgccactttgaaacagaagagtgcaacaattgaaggaatcgaaaagtggccttatgaagcagctgctatagcttttgaggctattccacgtactctagctcagaactgtggagttaacgtgatcagaactatgacagctttgcaaggaaagcacgcaaatggtgagaatgcctggactggaatcgatggaaacactggtgcaattgctgacatgaaagagagcaagatatgggatgcgtacaatgtgaaggctcaaacgtttaagacagcgattgaagcggcgtgtatgcttctgaggattgatgatatagtgagtggtatcaagaagaagcaagctccaggagctggaccttcaaagcctaccattgagacagaaggagatgcagacaacgagcaaattcttcctgactagaaaagttttgctcttcaccaacataatcttgttctttcttttgtcttgttttactattttttttttaatcatgcgtcttgtttttgatattttagtctgaaatgtttgtgaaacttgatgacagtccctttagtattttatgcttttgcatttaacttggtagtgagtgatgatgtaatcttcgtaccagcacagttacgatttcattgtttttacgtaaccctaattgcttgat

SEQ ID NO: 2574 - DNA, 1991 bp, Brassica napus
gcctccaccctcttccactcttttcgaatttgcaccgtcgccgtcgctaagctcggaatcgccgtcaaaacgcttagatcctcgcagatatgaacgcccctgttctcgttctcaaggattcgttgaagcgtgaatctggaacaaaggttcaccatggcaatatccaagcttccaaggctgtggctgacatcatccgtacaacattgggtcctcgctctatgttaaagatgcttcttgatgctggtggaggaattgttgttactaatgatgggaatgctattttgcgagagctagatgttgctcaccctgcagctaagtctatgattgagttgagtcgtactcaggacgaagaagttggtgatgggactacatctgttattgtacttgctggtgaaatgttacatgttgctgaagcatttattgagaagagctaccatcccacagtcatctgccgtgcttataacaaggctcttgaggatgctatcgctgttcttgacaagattgccatgtcaatcgatgtcaatgaccgtgcaacggtactaggattagtcaaaagctgcataggaacaaaattcactagccaatttggtgatctcattgctgatttggccattgatgccaccactactgttggtgttgatcttggacaaggcttgagagaggtggatataaaaaatacatcaaggttgagaaggtccccggtggtcaattggaagactccaaggttctcaaaggagtcatgttcaacaaagacgtagtcgctcccggtaaaatgaagagaaagattgtcaacccacggatcattcttctcgactgtccccttgagtacaagaaaggtgaaaaccaaaccaacgctgagctggtcagagaagaggactgggaagttctgctgaagcttgaagaggagtacatcgagaacatctgcgtgcagatactaaagttcaaacccgatttggtgatcacagagaagggacttagcgacttagcgtgtcactatttcagtaaagcgggggttagtgcaataaggaggctgagaaagacggacaacaacaggattgccaaggcctgtggagctgtgattgtgaacaggcctgatgagcttcaagagtctgatgttggtaccggcgctggcttgtttgaggttaagaagataggagacgatttctttgcctttgttgttgattgcaaagagcccaaagcgtgtactgttctcttgaggggaccaagtaaagatcttctcaatgaagtggagaggaatcttcaggatgccatgtctgtttcaagaaacatcatcaagaatccaaagcttgttcctggtggtggagccactgagttaaccgtctctgctactctaaaacagaagagtgcaaccattgaaggaatcgaaaagtggccttatgaagcagctgctatagcttttgaggctattccacgtactttagctcagaactgtggagttaacgtgatcagaactatgacagcactgcaaggaaagcatgcaaatggtgagaatgcttggactggaatcgatggaaacactggtgcaatagctgacatgaaagagagcaagatatgggatgcttacaatgtgaaggcgcaaacgtttaagacagcgattgaagcagcgtgtatgctactgaggattgatgatatagtgagtggtatcaagaagaagcaagctcctggagctggaccttcaaagcctaccattgagactgaaggagacgcagacaacgagcaaatacttcccgactagaaaattgtgctctcaccaacttaatcttgttcctttttttggtcttgttttgctattttagtttggaatgtttttggaacttgacagtctctttagtatcttgttgttttgcattttgatttggggagaaaagatcttgaagggagtgagtgtttcgagtgatgaatcttttgtttatttctgtaaggcaaaggcgttggcactgcaagacgctgatttatttttagtctaaccc

SEQ ID NO: 2575 - DNA, 2109 bp, Trigonella foenum-graecum
gcggaaaagagtgtagcctctgtttcttcactctctccttcataaccgatccttcttcttctgtgccctaacgccgcctcctcctccgttaaccacaaaacactctcttccatacttccgtgaagcttaaattttcagaagatcttcggaagaatttggtttttgttctgcaaataactaaggagatttattaaccttgaaatcatgcaatcgtcagtactagttctcaaggactctttgaaacgcgagtctggagctaaggtgcatcatgctaatattcaggcatcaaaggctgtcgctgatataattcgtacaaccttgggacccaggtccatgctaaagatgcttctcgatgcttctggaggaattgtggtgacaaatgatggaaatgctatcttacgtgaattagatattgctcatccagctgccaagtctatgattgaattaagccgcacacaagacgaagaagtaggagatggaactacatctgtcatcattcttgctggtgagatgctccatgttgccgaagcattcattgacaaaaactaccaccctacagttatttgccgagcatataacaaagctttggaggatgctattgcagctattgacaaaattgcgatgcctattgatgctcaggatcgtggtcaaatgctggggcttgtaaaaagctgcataggtaccaaattcaccagtcaatttggggatttaattgctgatctagctattgatgctaccacaacagtcggcgttgatattggccaaggtttaagagatgtagatattaaaaattatatcaaggttgagaaggttcctggcgcgcagcttgaggattcgagagttctgaaaggagttatgtttaacaaagatgtggttgcccctggcaagatgaggagaaagattgttaacccacgtatcattcttcttgattgtcctcttgagtataaaaagggtgaaaaccaaacaaatgctgaactgcttagagaagaagactggagtctcttgttgaaattggaggaagaatacatcgaggagctctgcatgcagatattgaagtttaaacctgacttggtagttacagagaagggtcttagtgatttggcatgccattatctgagcaagcatggagtcagtgcaatcagaagactgaggaaaactgataataatcgaattgccaaggcatgcggtgctgttatagtgaacagaccagatgagttgcaggagtctgatgttggtactggtgcagggttatttgaagttaagaaaattggagacgagtactttgcttttgttgttgattgcaaagaacccaaagcttgtactgtattattacggggtgccagtaaggatctcttgaatgaggttgaaagaaacctacaggatgccatgtctgttgcaaggaacattataaaaaatccaaaacttgttcctggaggtggtgctacagagatgactgtgtcagctactttgaagcagaagagttcttctattgaaggcatagagaagtggccatatgaagctgctgccattgcttttgagtctattccacgaactttggcacaaaattgtggagtaaacgtcatccggacaatgactgcactacaaggaaaacatgcaaatggagaaaatgcatggattggcattgatggaaatactggtgcaattgctgacatgaaagagcgcaagatctgggatgcctataatgtgaaggcacaaacttttaagactgccattgaagctgcatgcatgcttctgaggatcgatgatatagtaagtgggatcaagaagaagcaggcccctggagcaggcccttcaaagccaaagattgagaccgagggagatgctgacggcgagcaaatccttcccgactgaaaacacagtttccttgactttttttgacttgtagagttaaaaacctgctaggttatctgctaggttcttgttcctttttaaactatttaattattcttaagaaattttgggtccttgattgtgctgttttgtacttggtactgtttgttaaagtaacatgtgaacctctgatgatactttaaatgtcatgttttatggtgtggtttatgcgattacgcaggcctttctctgccatgt

SEQ ID NO: 2576 - DNA, 2276 bp, Arabidopsis thaliana
tcggagaaggcagtaggatcttccacttgccgctctttgaaaatcactcgccgtgtctctctaagcttcttcttcactgtgaaaacctcagatcgcaaatatgcacgcaccggtactcgttctgagcgattcgttgaagcgtgaatctggaagtaaggttcatcatggtaatatccaagcttccaaggctgttgctgatatcattcgtacaacattgggtcctcgttctatgttgaagatgcttcttgatgctggtggagggattgttgttactaatgatgggaatgctattcttcgtgagctagatgtcgctcatcctgcagctaagtcaatgattgagttgagccgtacgcaagatgaagaagttggtgatgggacaacgtctgttattgttctagctggtgaaatgcttcacgttgcagaagcgtttcttgagaagaattaccatcccacagtcatatgccgagcttacatcaaggctctcgaagattctattgctgttcttgacaaaattgctatgtcaattgatatcaatgaccgttcacaagtgctaggattagtcaagagctgcatagggacaaagttcactagccaatttggagatcttattgcggatttggctattgatgccactactactgttggtgttgatcttggacaaggtttgagggaggtagacattaaaaagtacatcaaggttgagaaagttcctggtggtcagttcgaggactctgaggttcttaaaggagttatgtttaacaaagatgttgttgctcctggtaaaatgaaaagaaagattgtcaacccacggattattcttcttgactgtcctcttgagtacaagaaaggtgaaaatcaaaccaatgctgagttggttagagaagaggactgggaagtgttgttgaagttggaagaggaatatatcgagaacatttgcgttcaaatactaaagttcaagcctgatttggttatcacagagaagggtcttagtgacttggcctgtcactatttcagtaaagctggggtaagtgcaatccgaaggttgagaaaaactgacaacaacagaatcgccaaggcttgtggagcagtaattgtgaacaggcccgacgaactgcaggagtctgatatcggtactggggctggcttgtttgaggtcaagaaaattggagatgatttcttttctttcattgttgattgcaaagaacccaaagcctgtactgtactcttaaggggaccaagtaaagatttcatcaatgaagtggaaagaaatttacaggatgccatgtctgttgcaagaaacattatcaaaaacccaaagctagttcctggtggaggagccacagagctaaccgtttctgccacattaaaacagaagagtgcaacaattgaaggcatagaaaagtggccttatgaagcagctgccattgctttcgaggctattccacgtaccctggctcaaaactgtggggttaacgtgatccgtactatgactgcattgcaagggaagcatgcaaatggtgaaaacgcatggactggtattgacgggaacactggtgcaatagctgatatgaaagagagcaagatatgggattcgtacaatgtgaaggcgcaaactttcaagacggctatagaagcagcgtgtatgcttctaaggatcgatgatatagtgagtggaatcaagaagaagcaagctcctggatctggaccttcaaagcctaccattgagacagaaggagatgcagacaacgaacaaattcttcccgactaagcgaagggagaaacactttggtctcagcataactcaatctctgttttcacttgtttaatggttgcactcttttggctattatcttcccttgacatatcttttaattctgcagtttgacttggtgagataagattttcgagggtggtttttttttgtttgttttggaatattagcttttttgaattttcgtagtcactttgttggtttttagagtgctagttgttattgtctttttgaaatttctggcactagagacttttttagtttgtgtcgtttttgtttgaatatcatcaagtatgtacttcaactggatctttagttgaccggttagtgtcaaattgtgtttttgtttgaacaccattaattgcatttcagacgtacggatctgttatttagagttttgggttattattcaggttgactcggtccgaatttatttatacgggttggttttgttactgaaaacctttaaacttcgctagttaaatgaaaattgaaagtttagtta

SEQ ID NO: 2577 - DNA, 1904 bp, Raphanus sativus
  misc_feature (405)..(405): n is a, c, g, or t
  misc_feature (708)..(709): n is a, c, g, or t
  misc_feature (885)..(885): n is a, c, g, or t
  misc_feature (1194)..(1194): n is a, c, g, or t
  misc_feature (1215)..(1215): n is a, c, g, or t
atgaacgcccctgttctcgttctcaaggattcgttgaagcgtgaatctggaacaaaggttcaccatggaaatatccaagcttccaaggctgtggctgatatcatccgcaccacattgggtcctcgctctatgttaaagatgcttctcgatgctggtggaggaattgttgttaccaatgatgggaatgctattttgcgtgaacttgatgttgctcaccctgctgctaagtctatgattgagttgagccgtacacaggacgaagaagttggtgatgggactacatctgttattgttcttgctggtgaaatgttacatgttgctgaagcatttattgagaagagttaccatcccacagtcatctgccgtgcttataacaaggctcttgaggatgctatcgctgttctngacaaaattgctatgccagtcgatgtcaatgaccgtgaaacagtactaggcttagtcaaaagctgcataggaacaaaattcactagccagtttggtgatcttattgctgatttggctattgatgccactactactgttggtgttgatcttggacaaggattaagggaggtggatatcaaaaaatacatcaaggttgagaaggtccccggtggtcaattggaagactccaaggttctcaaaggagtcatgttcaacaaagacgttgtcgctcccggtaaaatgaagagaaagattgtcaacccnnggattattcttctcgactgtccccttgagtacaagaaaggtgaaaaccaaaccaacgctgagttggtcagagaagaggattgggaagttctgctgaagcttgaagaggagtacatcgagaacatctgcgtgcagattctaaagttcaaacccgatttggtgatcacagagaagggncttagtgacttagcatgtcactatttcagcaaagccggggttagtgcaatccggaggctgagaaagacggacaacaacaggattgccaaggcgtgtggagctgtgattgtgaacaggcctgatgaacttcaagagtctgatgttggtacaggcgctggcttgtttgaggtcaagaagataggagacgacttctttgccttcgttgttgattgcaaagagcccaaagcatgtactgtgctcttaagaggaccaagtaaagatcttctcaatgaagtggagaggaatcttcaggatgccatgtctgtttcnagaaacatcatcaagaacccnaagcttgttcctggtggtggagccactgagttgaccgtttctgccactttgaaacagaagagtgcaacaattgaaggaattgagaagtggccttatgaagcagctgctatagcttttgaagctattccacgtacattagctcagaactgtggagttaacgtgatcagaactatgacagcattgcaaggaaagcatgcaaatggtgagaatgcttggactggaatcgatggaaacactggtgcgatagctgacatgaaagagagcaagatatgggatgcttacaatgtgaaggcgcaaacgtttaagacagctatagaagcggcgtgtatgcttctgaggattgatgatatagtgagtggtatcaagaagcagcaagctcctggagctggtggaccttcaaagcctaccattgagaccgaaggagatgcagacaacgagcaaattcttcctgattagaaaattttgctctctcaccaacgtaatcttgttctttctttttctttgtcttgttttgctatattagtttgaaatgtttttgaaactaggctctccctttaatttcttgttgttttgcattttgagttggcgacaaaagatctttaggggagtgagtgttttgagtgatgaatcttttgtttatcttctgaaaggagcatatgaggatgctggtttatgattcgccttaaaag

SEQ ID NO: 2578 - DNA, 2177 bp, Amborella trichopoda
gaaactattttcaattgcagaagaacccggaagaagtgagaaaatataagggtcggcttttctgaaactaccctctttccctctctttctccctcttcttctttgtcgatttttctctccctctaaaacccccaaaaccctagttggtctgctcttcactttctctatccacgatgcacgcaccagtacttgttctcaaagattctttgaaacgagagtctggaactaaagttcaccatgcaaacatccaggcatctaaggcagtggctgatatcatccgaacaactttgggtcctcgatccatgttgaagatgctactagatgctgcaggaggaattgttgtaacgaatgacggaaattgtattctgcgagaactagatttggcccacccagctgctaagtctatgattgaacttagtcgcacacaagatgaagaagtaggggatgggactacgtcagtgattgttcttgctggtgagatgcttcatgtggcagaagcttttattgacaagagctatcatcctacagtcatttgccgagcctacagtaaggcccttgaggattctattgcagtgcttgataagatcgctgtgcccattgatgtaaatgaccgagcgacaatgctgaaactagtcaaaagttgcatcggcacaaaattcactggccaatttggagacctcattgctgacttagccattggtgctactacaactattggtgtggatctcggccaaggcataaaagaagtcgacattaaaaagtacataaaagttgaaaagattcctggtggtcagttggaagactcaaaagttcttaagggagttatgataaacaaagatgtggtttctccaggcaaaatgaaaagaaagatactaaaccctcgcatcattcttctggattgccctcttgaatacaagaaaggggaaaatcaaacaaatgcagagttgttgaaagaagaagactggagtgtcctgctgaagatggaagaagagtatatcgagagtctctgtgctcagatattgaagttccagcctgacctagttatcacagagaaagggctcagcgatcttgcgtgccactatctcagcaaggctggtgttagtgccataaggaggctaaggaagactgacaataacaggattgccaaagcttgtggagccgtggttgtaaatcggccagatgagctacaagagtcagatgttggaacaggagctgggcttttcgaggtcaagaagattggggacgaattcttcgccttcatcactaattgcaaagacccaaaggcttgcactgttcttgtaagaggtgctagcaaggaccttttaaatgaagttgaaaggaatttacaggatgccatgtctgtagcacgaaatataataaagaacccaaagcttgttcctggtggtggggcttctgagctaactgtgtctgcaaccttgaagcagaagagttcgtccatcgaagggattgaaaagtggccatatgaagctgttgcagttgctttcgaggctatcccccgtactctggcacaaaactgtggagtaaatgtaatccggacgatgacagctttgcaaggaaagcatgcaaatggtgaaaatgcatggattggcatagacggaaacacaggcactatcgtggatatgaaagaaaaagggatttgggatgcatataatgtgaaggctcagacatttaagaccgccattgaggcagcttgcatgctcttgagaatagatgatattgttagtggtataaagaagaaacaaagtggaggggcaggatcagctcctaagcagcctcaagttgaccaagaagatgatgcagatggtgaacagattcttcctgaataaattttagagatgtttggtttgggttgaaatcgaaacatcaaaggtggtatcttgtgacaaaaaacgtgtgcatcctatttctttttctttttttttgtggagaggattaaaagggtcctttaatgtagatggttatggatcttttgatgatcctatttagtgggttggttatatttatgagagttcagttcgtttaagttgaacacacaagtcgtcacggtgggtgatagaaatgagattttggcagcttgctccgttttagttgtatgatgtgtaactcgtgcgatatttttctggtcaattagcttcaattcttccctcttcaatcga

SEQ ID NO: 2579 - DNA, 2010 bp, Castanea mollissima
agagaaagggttttaagttatataagggaaggcctcttgcgtagctttgattccttctctcatattattctcttttctctacaacactctcagcctccctcgaagaagaagaagaacaactacaaaatgcacgccccagtactcgttctcaaggactctctgaaacgcgagtctggaagcaaggtccaacatgctaatatccaggcttctaaggctgtcgctgacattattcgtacaacgttgggtccaagatccatgctgaagatgctccttgatggtggtggtaatattgttgttactaatgatggaaatgctatattgcgtgagttagatcttgctcaccctgctgctaagtctatgatcgaacttagccgtacccaagatgaagaagtcggagatggaaccacttctgtcattgttcttgccggtgaaatgctccacgttgccgaagcattccttgacaaaagttatcaccctacagttatctgccgtgcctacaacaaagctttggaggatgctattgctgtgcttgacaaaattgccatgcccattgatgtcaatgatcgtgcaacaatgttgagtttggtcaagagctgtataggcacaaaatttaccagccagtttggggatctcattgctgatctagctatagatgccaccacaacagttggtgttgatcttggccaaggcttgcgagaagtggatattaagaagtacattaaggttgagaagatccctggtggacagttggaggattcaaaggttcttaaaggagttatgtttaacaaagatgtggttgctcctggaaaaatgagaagaaaaattgtaaacccacgtatcattcttcttgattgtcccctcgagtacaaaaagggtgagaaccaaacaaacgcagagctggttagagaagaagactgggaagtcctgttgagaatggaagaagaatacattaagaacctctgcgaccagatagttatgttcaaaccagacctggtaatcacagagaagggccttagtgatttggcatgtcattatctgtgcaagcatggagtcagtgcaatcaggaggttaagaaagacagataataatagaattgctaaggcaagtggagctgttattgtgaacagaccagatgaactgcaggagtctgatgttggtactggggctgggttatttgaagttaagaaaattggggatgagttttttgctttcattgttgactgcaaagaaccaaaggcttgtactgtacttttaagaggtgccagtaaggaattcttgagcgaagtggatagaaacttgcaggatgccatgtcagtagcaagaaacataataaaaaatccaaaacttcttcctggaggtggtgctacagagttaactgtatcagctgctttgaagcagaagagttcatctattgaaggcatagaaaagtggccttatgaagctgctgccatggctttcgaggctataccccgtactctagcacaaaattgtggggtgaatgtgattcgaaccatgaccgcgctacaaggaaagcatgcaaattgtgaaaatgcatggattggcatagatggaaacactggtgtaattactgacatgaaagagcgcaagatttgggatgcctacaatgtgaaggcacaaacttttaagacagccatagaagctgctagcatgctccttaggattgatgacattgtgagtgggattaagaagaagcaagcccctggtgcaggagctccatcaaagcccacggttgagactgaagcagatgctgacagcgagcaaatacttcctgactgaagatatcagaaaaattaaaggctttactttttgtagtgtttgaaggaagctgggtgtccaacagttttgttgaacttttgacttctgtactgtttgaaaatttcagatttttgccttgtgctgtcctgggaccacctagtctgttctgggagcaattgtaattactttaaaaacgtttaatgggatgtcttttattagcagaatcaattattg

SEQ ID NO: 2580 - DNA, 2196 bp, Orobanche aegyptiaca
tctcgttcgagttccagggttttctgtaaggacaccgttttctctcactgtaaagagtcgtgatctgaaatcggaaaccgagatgcatgccccagtcctcgtcctcaacgatgctctgaagcgggagtctggaagcaaggtgcaccgtggcaatatccaggcatccaaggctgttgcggatattatacgcactactcttggtccacgatcaatgttaaagatgctgcttgatgctgctggaggtattgtggtgacaaatgatggaaatgctattcttcgtgaattagatgttgcacacccagcagcaaagtcaatgattgaactaagccgaactcaagatgaggaggtaggagatgggacaacatctgtgatcatccttgctggtgaaatgctccatgttgcggaagcctttatcgacaagaactaccatcccactgtcatttgtcgagcttataataaagctctggaggatgcaatctctgtgcttaacaaaattgcagttattatagatgttaaggatcgtgcaactatgttaggaattctaaagagttgtattgggacaaaatttactagtcaattcggcgatttgattgctgacttggcaatagatgccactaccacagcaggtgtggatcttggacaagggttacgtgaggtggacatcaagaagtacattaaagtagagaaggttcctggtggtcagttggaggactctgaagttttaaaaggagtcatgttgaacaaggatgttattgctcctggtaaaatgaggagaaaaatactgaatccgagaattatgcttctcgattgtcctcttgagtacaagaaaggtgagaaccaaaccaatgccgaattgcagagggaagaagattggagtgtcttactgaaaatggaagaggaatacatcgagaaggaatgcatgcagattctgaagttgaaacctgatgtagtaatgactgaaaaggggattagtgatctagcttgccattatctcagcaaggctggtgtcagtgcaatcagaaggctccggaagacggacaacaacagaattgccaaggcttgtggggcagtaatagttaatagacccgacgagttgcaggaatctgatataggtactggtgctggattgtttgaggtgagaaaaattggtgatgagttctttgcattcattgtcgactgcaaggaaccaaaagcatgcacagtccttttaaggggtgccagcaaggacctgctgaatgaagtggagagaaatctgcaggatgctatgtccgtggcacgaaatataataaaaaacccaaaacttgttcctggtggaggtgctacagagctgactgtatcggctacgttaaagcagaagagctcatctgttgaaggcatagaaaagtggccgtatgaagctgctgcaatagcatttgaggctataccaagaactttggctcagaactgcggggttaatgtgattcggactatgactgccttgcaggggaagcatgcaaatggtgagaatgcgtgggtcggcatagatgggaataccggtgaaattactgacatgaaagagcgtaagatatgggattcatacacagtgaaggcccaggcgttcaagacagccattgaagctgcttgtatgcttttgagaattgacgatatagtgagtgggatcaagaagaagcagtcccctggagcaagccaggttccatcaaaaccccaaattgagcaagaaggtgatgcagataatgagaatataattcccgagtaagcaggaagtgcagttggttggaattgctcttctgatcttgtaaatgtaattatctgctctttgctatggagctggttcccaaaatttttgatgttttttttttgttctggctggaggcagaatgcattgcctcttcatttcctttattgagttgcggtttttgttctgtttgcttcttaccgttattaccgagaactcgtcattgggccggcacttcagtttctattgaactcatttcctacttatgactggaatgacattaatgtattttttcctgaagaatcagagatctggaatttgtggatccagatcgatctcgctatttatttatttttatgttttgattaggtttcatcatctgaagtttggaatttggatatacttgttttgtagtggattttaaattcttgtaaattatttatgtggtgatatttgatgac

SEQ ID NO: 2581 - DNA, 2726 bp, Glycine max
agcgtagttcctaacactacactcttccgccgattattcttcctctgtgccctagcttctcttccgccgctgtcaacgaccgtctcccttgccgcttccggcaccgaacgaacagtctccggccaacttcagctcttgcgtgcgaaaattctcggaatattttgaatccaggaaatcatgcacgctccagttctagttctcaaggactctttgaaacgagagtctggatctaaggtccgctatgctattattcaggcggcaaaggctgttgctgatgtagtccgaacaacattgggacctaggtccatgctaaaaatgcttcttgatgctcaaggaggaattgtggttaccaatgatgggaatgctatcttacgtgaattagaccttgctcatcctgctgcaaagtctatgattgagttaagtcgcacccaagatgaagaagtcggagatggaacgacatctgtcatcattcttgctggtgagatgcttcatgtcgccgatgcattcattgacaaaattcaccctacagttatttgccgagcatataacaaagctttggaggatgctattgctgtccttgacaaaattgcaatgcctattgatgctcaggatcgaggtataatgctggggctagtaaaaagctgcataggtaccaaattcacaggtcaatttggggatttaattgctgacttagctattgatgctactacaacagtaggtgttgagattggccaaggtttgagagatgtagatattaaaaattatattaaagttgagaaggtcccaggtgggcagctggaggattcgagagttctcaagggagtcatgataaacaaagatgtggttgcccctggcaaaatgaggagaaggattgttaacccacacatcattcttcttgattctccccttgagtataaaaagggtgaaaaccaaacaaatgccgaactgctcaaagaagaagactggagtctcttattgaagatggaagaagaatatattgaggagctatgcatgcagatattgaagtttaaaccggacttggtaatcacagagaagggtctgagtgatttggcaacccattatctcagcaagcatggagttagtgcaatcaggaggctgaggaaaactgataataatagaattgcaaaggcttgtggtgctgttattgtgaacagaccagatgaattgcaggagtctgatgttggtactggtgctgggttatttgaggttaagaaaattggagatgagtactttgcatatattgttgattgcaaagaacccaaggcttgtactgttctactaaggggtgctagtaaggatctattaaatgaagttgaaagaaacctacaggatgccatgtctgttgcaaggaacattataaaaaatcctaaacttgttcctggaggcggtgctacagagttgacggtgtcggctgccttgaaacaaaagagttcatctattgagggcatagagaagtggccttatgaagctgctgccctagcttttgaagccataccacgaactttggctcaaaattgtggagtaaatgtcatccggactatgactgctctacaaggaaaacatgcaaatggagaaaatgcatggattggtatagatggaaatactggcagtatcactgacatgaaagagcgcaagatttgggatgcctacaatgtgaaggcacaagcatttaagactgccattgaagccgcttgtatgcttctgaggattgatgatatagtgagtgggatcaagaagaagcaagcccctggagctgctccttcaaaacccaaggttgagaccgaggcagatgctgacagtgagcaaatccttcctgactgagaatctcggttcaacagacattgttttttggtagagttgatgatgtgcaaggttctttatcttccttaaatcttatcactattcttaggagttttgagtcctttattgggatgctgttttttgtgccttctctactgtttgcaagagcaaattgtgtactttgttgatgttaaagacttaattaactggcgtatgctttattgggtgttctcggtccattatcttgagattttgtgccaggttcaaactgaccagtttcaccaattctgttacgctgtttctggtttttcatcctattcattcgtgaaatgttttcttcatcttaatatctaagtttccggtaaactatggtacaacagagacttttttgttggtaatagtgttcaatttagaaaagtactgatagtcttctagctcgctagtgattactgattagtcttttagaaaactaccaaggatttaagaaatgcttgagataatgagatgggtatttgatgtgcagcattagatgattcttatgcgaagaaacgttaactgacaagtagaaatagaagttcaaatttgttcagcaatatgttcttaaagccaaggccatcgttgtacttacgcaagtactcccaagaattttatacaattatttgagggatggcataaaataggcttttttttttattgtacattttatgtaaaatttaatgtaaatttggttaaatatattttagtaggaagttgtatttttttatatattattatataatgaattattttgtataccaaaattgttattaattattttaaaagtgatatctactatagatatttaatgtaaatttatattgatgggccatcgaaattaaagtcaataataacaattctgatatgca

SEQ ID NO: 2582 - DNA, 1955 bp, Phalaenopsis aphrodite
cgccaccgtctgccggtcactactgatcgaactaaactctcgagaaagcacgagcgtacccgagtaaaatccaaaagctgtgacgtttccggcgaattctccggccaaaagtgggcattcatccactcattcctcacgctttttttaaatatctgctgcaatgcacgcgccggttctcgttttaaaagactctttaaagagggagcagggaaataaggttcaacatgccaacatacatgcttcaaaggctgttgctgatataattcgcactaccttgggacctcggtcaatgctgaagatgctacttgatgctactggaggaattgtagtaaccaatgatggaaatgctatactacgtgaactggatctggcacacccagcagctaagtcaatgattgagctaagccgtacacaagatgaagaagtgggagatggtactacctctgttattgttctagctggtgagatgctccatgttgcggaagcgtttattgataagaattatcatccaacagtcattgtcgagcatacaacagagctttagaagatgctattgctgctctggacaagatagctgtgcaaatcgatgtaaatgaccgtgctgcaatgttaagccttgttaaaagctgcatcggcactaagtttacaggacaatttggcgatctaattgctgatcttgcaatcgatgctaccacaacagttggtgtggatcttgggcaaggtatgagggaggtcgacattaagaaatatataaaggttgagaaggttcctggtggccggttggaagattcaaaggttctcaaaggcgtcatgttcaataaggatgtcgttgctccaggtaaaatgaaacggaggattgtgaacccacgtattatactactcgactgcccgctcgaatataagaagggtgagaaccaaacgaatgctgagttggtgaaggaagatgattgggaggttcttctgaaattagaagaggaatatatacagaatctttgcgcacagattctaaaattcaagcccaacttggttataacggagaaggggctgagtgatcttgcttgccactatttaagcaaggctggagttagcgctatccgtaggctgaaaaagacggacaacaataggattgcgaaagcttctggtgctgtcattgttaacaggcctgatgagcttcaagaatctgatgtcggtgtcggagctggacttttcgaagtcagaaagattggagatgaattctttgcatttgttgttgattgcaaggagccgaaagcatgcactgttctgttgagaggtgctagcaaggatctcctgaatgaagttgaaagaaatttgcaggatgctatgtcagtagcacggaacattctgaaaaaccccaagcttgttcctggaggcggggctaccgaaatgactgtttctgcggcattgaaggagaagagctcatcaattgaggcattgagaagtggccctatgaagctgcagctgtggcttttgaggctatcccaaggacattagcgcaaaattgtggcgttaatgtgattagaacaatgacggcgcttcaaggaaagcatgcaaatggtgaaaatgcatgggttggcattgatgggaatagtggtgccattgttgacatgaaggagaggaagatctgggacgcttacaatgtgaaggcgcaaacatttaagactgccattgaggcagcttgcatgctgctgagaattgatgacatcgttagtgggatcaagaaaaagcaggctccaggtgctggccccactccttccaagcctaaggtggaggaagaaggagacgcagataacgagcagatacttccagagtagaatttatcctctttggcgtatcagctaattgtgagttttcattcagcgatatatatatgtttatgtaatgtgctgatacttcttgattgtaacactacggtgtttgctccattgactgatttt

SEQ ID NO: 2583 - DNA, 2199 bp, Beta vulgaris
tccagggttttcattctcactcatacactcactatagtttcgtagtctcttccctcccaaaaccctctgtttctccttcctctttgcatctttctctctcttcgaaactacacatcactattctccaatcatgcacgctccagtcctcgttctcaatgattctacaaaacgtgaatctgggagcaaggtccatcatgctaacatccgtgccgcaaaggctgttgctgaagtaattcgaacaacacttggtccacgctcaatgttaaagatgctccttgatgctgctggaggcatagtcgtgacgaatgatggtaatgccattttgcgtgaattagatcttgcacatccagctgctaagtcaatgatcgagcttagcaggacacaagatgaagaggttggagatggaacgacctctgtcattgttcttgctggagagatgctccatgtggctgaagaatttatcgataagagctatcatcctactgttatttgccgagcgtattcgaaagctctggaagatgcacttgctgttcttgacaagatcgcaatgtccattgatgtggaggatcgtgctactatgttgggcttggtcaagagctgtattggaaccaagtttaccagtcagtttggtgatctgattgccgatttagctattgatgccactgcaatggttggtgtggaccttggtcaagggctgcgagaggtggacattaagaagtacattaaagttgagaaggtacctggtggtcagttagaagattctcaggtgcttaaaggggtaatgatcaataaggacgtggttgcccctggaaagatgaggcggaagatcatcaacccgcgcattatgctacttgattgtcctcttgaatacaaaaaaggtgaaaatcaaacaaatgctgagatactgaaagatgaagactgggaagtcttgctacgaatggaggaagagttcattgagaatatgtgcgcacagatactgaaatttaagcccgatttagtgatcactgaaaaaggactaagtgacttggcatgccattatttgagcaaggctggtgttactgcaattcggagggtgaggaagacggataataacagaatcgccaaggcatgtggggctgtcattgtaaataggccagatgaactccaggaatcagatgtaggtactggtgctgggttgtttgaggtcaagaaaatcggtgatgagttttttgcatttattgttgattgcaaagagccaaaagcatgtactgtgctattaagaggcgctagcaaggatctcttaaacgaggtggaaagaaatcttcaggatgcaatgtgtgtggcaagaaatattatcaaaagtccaaaacttgttcctggagggggaggtacagaactgactgtatcagcaacgttgaagcaaaagagctcatctattgaaggcatagaaaagtggccatatgaagcagctgctttagcctttgaggctattccgcggacattggcccagaactgtggtgtaaatgttattaggactatgactgccttgcgtggaaagcatgcaaatggtgaaaatgcttggaccggcatagatggtaacactggtgaaattgcagatatgaaagaaaagaagatttgggactcatacgcagtaaaggctcagactttcaagactgcaatagaagcagcttgcatgcttctaaggatagatgatattgtaagtggcataaaaaagaagcaggctcctggagcacaagctccctcaaaaccttcggttgagcaggccgatgatgctgataatgaacaaatgattccggagtgataaatttgggagcctattgcctaacaaatcatcagttttatcatcactttgcatcttgaatcatgtcaacctgagtatgggctttccgaagcatataattttggtacaacactctctggaagatttctttaaccttgcagtgttgacttgtcccccccccccctccccccaagttttacttccatttttttcttccgttttgcgtgggcactctcttatcttcgacgtgtaacttagcggtagtagttcttttgttaactactgtaatttttgtagtggttttgttttcagaatcggtctctgcaaatcttttgtagatgaggtctcatatatggctatcatatttatatctgtatgcttactggacgaggtttttacaagtagtaggatggattttt

SEQ ID NO: 2584 - DNA, 2177 bp, Eutrema halophilum
gagaatcggaggatttttccagttgccgccctttgaatttactctgccgcgactcgccgtctctcagcttctcttcactgtgtgaacgcttagatcgcaaatatgcacgcaccggttcttgttctcaatgattcgttgaagcgtgaatctggaacgaaggttcatcataataatatccaggcttccaaggctgtggctgatatcatacgcacgacattgggtcctcgctctatgttgaagatgcttcttgatgctggaggagggattgttgttaccaatgatggaaatgctatccttcgtgaactcgatgttgcccatcctgcagctaagtcaatgattgagctgagccgtacacaagacgaagaagttggtgatgggacaacatcagttattgttctagctggtgaaatgcttcacgttgcagaagcatttattgagaagagttatcatcccacagtcatatgccgagcttacattaaggctcttgaagactctattgctgtccttgacaaaatcgcgatgacaattgatgtcaatgaccgtgcaacggtactaggactagtcaagagctgcatagggacaaagttcactagccaatttggcgatttaattgctgatttggctattgatgccactactactattggtgttgatcttgggcaaggtttgagggaggtagacattaaaaagtacattaaggttgagaaggttcctggtggtcagttggaggactcgaaggttcttacaggagttatgtttaacaaggatgttgttgctcctggtaaaatgaaaagaaagattgtcaacccacggattattcttcttgactgcccccttgagtacaagaaaggtgaaaatcaaaccaacgctgagttggttagagaagaggactgggaagtcctgttgaagttggaagaggaatacattgagaacatttgcgtgcaaattctaaagttcaaacctgatttagttattacagagaaggggcttagtgacttggcctgtcactattttagtaaagctggtgttagtgcaatccgaaggttgagaaagacagacaacaacagaattgccaaggcttgtggagcagtaattgtgaacaggcccgatgaactacaggagtctgatatcggtaccggagctggattgtttgaggtcaagaaaataggagatgatttctttgctttcatagttgattgcaaagagcccaaagcatgtactgtactcttaaggggaccaagtaaagatctcctcaatgaagtggaaagaaatttacaggatgccatgtctgttgcaagaaacattatcaaaaacccaaagctcgttcctggtggaggagccacagaattaaccgtttctgccacattgaaacagaacagtgcaacaatcgaaggcatagaaaagtggccttatgaagcagctgctatagcttttgaggctattccacgtactctggctcaaaactgtggtgttaatgtgatccgtactatgactgcattgcaagggaagcatgcgaatggcgaaaatgcatggacaggtattgacgggaactctggtgcaatagctgatatgaaagagagcaagatatgggatgcgtacaatgtgaaggcacaaactttcaagacggcgatagaagctgcgtgtatgcttctaaggatcgatgatatagtgagtggtatcaagaagaagcaagctcctggagctggaccttcaaagcctaccattgagacagaaggagatgcagacaacgagcaaattcttcccgactaagagatgagaaactctttggtcttggaaacctaatcgcaacatctttgttttcagggttagtttgtggctgcaatcttttcttcttttcttggcttttaactttccttttgacatacatcttctaattttgcaagtgacgtatgatttttgagggtggggttatttattttatttttttgcttttgtctttttcagtgtaagcttttttgaattttcatagtcacttgcttggtttgagagtgctagctgttatacctttttgaaatttcctctacaaagactttttaagatttgatttgttttttttttttttttttttggtaatatcaaatacttgcgatggaattttcagttgaccattgttagtgtcaatgtatcttagtctgaacaccattagctgcatttca

SEQ ID NO: 2585 - DNA, 2202 bp, Medicago truncatula
taaactctactagtattttacttactctcaaacttaaataaaagtaagtgcgacagtgttccattcatttccagggttttctagttcattttggcggaaaagagtgtagcctttctctctgttactcactcgcgacgctctgtgccctaacgccgcctcctccgttaagttaagtgaagctttaagaagaagatactttggttctggatttggtttttgttttgcaaaaatcgaagcaagtttttaaaccctagaaatcatgcagtcctcagttctagttctcaaggactctttgaaacgtgagtctggaccaaaggtgcatcatgctaatattcaggcatcaaaggctgttgctgatataattcgtacaacactgggacccaggtccatgctaaagatgcttcttgatgcttctggaggaattgtggtgacaaacgatggaaatgctatcttacgtgaattagatattgctcatccagctgccaagtctatgattgaattaagtcgcacccaagacgaagaagtcggagatggaaccacatctgtcatcattcttgctggtgagatgctccatgttgccgaagctttcattgacaagaattatcatcctacagttatttgccgagcatataacaaagctttggaggatgctattgctgctattgacaaaattgcgatgcctattgatgctcaagaccgaggtcaaatgctggggcttgtaaaaagctgcataggtaccaaattcactagtcaatttggggatttaattgctgatttagctattgatgctactacaacagtgggtgttgatattggccaaggtttaagagatgtagatattaaaaattatatcaaggttgagaaggtccctggcgcgcagcttgaggattcgagagttctcaagggagttatgtttaacaaagatgtggttgcccctggcaagatgaggagaaagattgttaacccacgtatcattcttcttgattgtcctcttgagtataaaaagggtgaaaaccaaacaaatgccgaactgcttagagaagaagactggagtctcttgctgaagttggaggaagaatacattgaggagctctgcatgcagatattgaagtttaaaccagacttggtagttacagagaagggtcttagtgatttggcatgccattatctgagcaagcatggagttagtgcaatcagaagactgaggaaaactgataataatcgaattgctaaggcatgcggtgctgttattgtgaacagaccagatgagttgcaggaatctgatgttggtactggtgcagggttatttgaagttaagaaaattggagacgagtacttcgcttttattgttgattgcaaagaacctaaagcttgtactgttttattaaggggtgctagtaaggatctcttgaacgaggttgaaagaaacctacaggatgccatgtctgttgctaggaatataataaaaaatccaaaacttgttcctggaggtggtgctacagagatgactgtgtcagctgctttgaaacagaagagttcttctattgaaggcatagagaagtggccatatgaagctgctgctattgcttttgaatctattccacgtactttggcacaaaattgtggagtaaacgtcatccggacaatgactgcactgcaaggaaaacatgcaaatggagaaaatgcatggattggcattgatggaaatactggtgtcattgctgacatgaaagagcgcaagatctgggatgcctataatgtgaaggcacaaacttttaagactgccattgaagctgcatgcatgcttctgagaattgatgatatagtgagtggaatcaagaaaaagcaggcccctggagcaggcccttcaaagcctaagattgatactgagggagatgccgacggcgagcaaatccttcctgactgaaaacacacttcccttgacgttgtttttttgacttgtagagttgaaaatctgctaggttcttcttcctctttaaaagtatttagttattcttatgaaattttgggtccttgatggtgctgttgttttatacttggtactgtttgtttaagcaacttgtgaactttaatgatgttcaagtgtcatatgctttatggagtgttctcgatctgttttgagaattgtgtcaggctgaaatgtttgttttctcctttttgagagttgcctgttttctacta

SEQ ID NO: 2586 - DNA, 2178 bp, Glycine max
aacctcagcgtagttcctaacactacactcttccgccgattatttctccaaaccgattattcttcttctgtgccctagcgccttttcctccgccgtcaaccaccgtatccctcccgcttccggcaccgatcgaacagtctccggccaagttcagttcttgcttgcgaaaattctcggaatattttgaatccaggaaatcatgcacgcgccagttctagttctcaaggactctttgaaacgggagtctggatctaaggtccgctatgctattattcaggcggcggaggctgttgctgatgtagtccgaacaacgttgggacctaggtccatgctaaaaatgcttcttgatgctcaaggaggaattgtggttacaaatgatgggaatgctatcttacgtgaattagaccttgctcaccctgctgcaaagtctatgattgaattaagtcgcacccaagacgaagaagttggagatggaacaacatctgtcatcattcttgctggtgagatgcttcatgtcgccgatgcattcattgacaaaattcaccctacagttatttgccgagcatatgccaaagctttggaggatgctattgctgttcttgacaaaattgcaatgcctatcaatgctcaggatcgaggtataatgctggggcttgtaaaaagctgcataggtaccaaattcacaggccgatttggggatttaattgctgacttggctattgatgctactacaacagtaggtgttgaggttggccaaggtttgagagatgtggatattaaaaattatatcaaagttgagaaggtcccaggtgggcagctagaagattcaagagttctcaagggagttatgataaacaaagatgtggttgcccctggcaaaatgaggagaaagattgttaatccacgtatcattcttcttgattgtccccttgagtataaaaagggtgaaaaccaaacaaatgctgaactgctcaaagaagaagactggagtctcttattgaagatggaagaagaatatattgaggagctatgcatgcagatattgaagtttaaaccagacttggtaatcacagagaagggtctgagtgatttggcttgccattatctcagcaagcatggagttagtgcaatcaggaggctgaggaaaactgataataatagaattgcaaaggcttgtggtgctgttattgtgaatagaccagatgaattgcaggagtctgatgttggtactggcgctgggttatttgaggttaagaaaattggagatgagtactttgcatttattgttgattgcaaagaacccaaggcttgtactgttctactaaggggtgctagtaaggatctattaaatgaagttgaaagaaacctacaggatgccatgtctgttgcaaggaacattataaaaaatccaaaacttgttcctggaggtggtgctacagagttgacagtgtcagctgccttgaaacagaagagttcatctattgagggcatagagaagtggccttatgaagctgctgccctagcttttgaagccataccacgaactttggcacaaaattgtggagtaaatgtgatccggactatgactgctctacaaggaaaacatgcaaatggagaaaatgcgtggattggtatagatggaaatactggtagtatcactgacatgaaagagtgcaagatctgggatgcctacaatgtgaaggcacaagcatttaagactgccattgaagctgcttgcatgcttctgaggattgatgatatagtgagtgggatcaagaagaaacaggcccctggagccactccttcaaaacccaaggttgagaccgaggcagatgctgacagtgagcaaatccttcccgattgagaatcttgtttcaactgacattgttttttggtagagttgatgatgtgttaggttcttaatcttccttaaattttatcactattcttagaagttgaatcctttattgggattttttttgtgtcttgtactgtttgcaagagctaattgtgtacttcgttgatgttaaagacttgattaactggcgtatgctttattgggtgttctcggttcattatcttgagattttgtgccagggtcaaactgaccagtttcaccaattctgttgagctgcttctggtttttcatcctattcattcgtgaaatgttttcttcat

SEQ ID NO: 2587 - DNA, 2104 bp, Solanum lycopersicum
gatagagatcatagtgaagtgttctctctgccctaacccacccccctcttgcgaaccccacaatctacgaagaacagaaatctcaacatttccattctaggtcaccattcaaattagcaagatgcatgctccagttcttgttatgcaggattctatgaaacgcgagcaaggtggcaaggttcagcgggcgaatattcaggcggcaaaggctgttgctgacattatccgtaccactttgggaccacgatccatgttaaaaatgctccttgatgctgctggaggaattgtagtaaccaatgatggaaatgcaattctccgtgagctagatcttgctcatcctgcagccaagtcaatgattgaactaagccgcacccaagatgaagaggtaggagacggaacaacatcagtaattgtccttgctggtgagatgctccatgttgcggaagcttttattgacaagaagtatcatcctacagtaatatgtagagcttatgctaaagctcttgaagatgctgttgccgtgcttgacaaaattgcaatgacagttgatgttgaagatcgtgaaacaatgttgggtctggttaagagttgcatcggcacaaaatttactagtcaatttggggatttaatttcagatttagcaattgatgccacaagaatggttggtgtggaacttggccaagggttacgcgaggtggacatcaagaagtacatcaagattgagaaggtgcctggtgggcagttggaagactctgtggtgcttaaaggagtaatgatgaacaaagatgtagttgcccctggcaaaatgaagagaaagattgtaaaccctcgcatcattctacttgattgtcccctagagtacaagaaaggtgagaaccaaacaaatgcagagctccttagagaggaggattggactgtcctcttgaaaatggaagaagagtacattgagaacatgtgcgcacagatacttaaattcaagccggatgtggttattactgaaaagggactcagtgatctggcatgccattatctgtgcaaggctggtgtcagtgcaatcagaaggctaaggaagacagacaataacagaattgctaaggcatgtggggcagttattgttaatagacctgatgagttgcaagaatctgatgttggtactggtgccggtctgtttgaagtgaaaaaaattggggatgagttctttacttttattgtcgattgcaaggatccgaaagcatgtactatacttttaaggggtgcgagcaaagatctactgaatgaagtagaaagaaatctacaggatgccatgtctgtcgctagaaacatcatcaagtgtcctaagctagttcccggtggtggtgcaacagagttaactgtatctgccatgttaaagcagaaaagttcatccgttgaaggcatagaaaagtggccgtatgaagctgctgcaattgcttttgaagctataccacgaactttggctcagaactgtggtgtaaatgtgattcgtactatgaccgctcttcaaggaaagcatgcaaatggcgagaatgcatggataggcattgatggaaacactggtgagattaccgacatgaaagagcggaagatatgggattcctatgctgtaaaagcacaggcttttaaaactgccattgaagctgcttgcctacttctgagaattgatgacattgtgagtggaataaagaagaagcaagcccctggagcaggacaaggtccatcaaaaccaaaaatagacgaagaaggtgatgcagacaatgaccagctaattccggaatgaacatgatatactatgctgcaatggaaatgcttatgcatttgataaccacttggaagttttcatctacttcagtatagtctgcccttgactgattgcttgaactttttgtgcttgacatgtaacttctgctgtttttgactgctggcagttgttggttgtatttgaaatagattttgtttcagtttttggttttaaattaaatttgatgttgcaagtacaatgactaatcaatgtaggggtatcatgtttttcaaggatccaacaaatttaaggccatacaaatcaaattcaggaaacttatgttgagtc

SEQ ID NO: 2588 - DNA, 2104 bp, Solanum lycopersicum
gatagagatcatagtgaagtgttctctctgccctaacccacccccctcttgcgaaccccacaatctacgaagaacagaaatctcaacatttccattctaggtcaccattcaaattagcaagatgcatgctccagttcttgttatgcaggattctatgaaacgcgagcaaggtggcaaggttcagcgggcgaatattcaggcggcaaaggctgttgctgacattatccgtaccactttgggaccacgatccatgttaaaaatgctccttgatgctgctggaggaattgtagtaaccaatgatggaaatgcaattctccgtgagctagatcttgctcatcctgcagccaagtcaatgattgaactaagccgcacccaagatgaagaggtaggagacggaacaacatcagtaattgtccttgctggtgagatgctccatgttgcggaagcttttattgacaagaagtatcatcctacagtaatatgtagagcttatgctaaagctcttgaagatgctgttgccgtgcttgacaaaattgcaatgacagttgatgttgaagatcgtgaaacaatgttgggtctggttaagagttgcatcggcacaaaatttactagtcaatttggggatttaatttcagatttagcaattgatgccacaagaatggttggtgtggaacttggccaagggttacgcgaggtggacatcaagaagtacatcaagattgagaaggtgcctggtgggcagttggaagactctgtggtgcttaaaggagtaatgatgaacaaagatgtagttgcccctggcaaaatgaagagaaagattgtaaaccctcgcatcattctacttgattgtcccctagagtacaagaaaggtgagaaccaaacaaatgcagagctccttagagaggaggattggactgtcctcttgaaaatggaagaagagtacattgagaacatgtgcgcacagatacttaaattcaagccggatgtggttattactgaaaagggactcagtgatctggcatgccattatctgtgcaaggctggtgtcagtgcaatcagaaggctaaggaagacagacaataacagaattgctaaggcatgtggggcagttattgttaatagacctgatgagttgcaagaatctgatgttggtactggtgccggtctgtttgaagtgaaaaaaattggggatgagttctttacttttattgtcgattgcaaggatccgaaagcatgtactatacttttaaggggtgcgagcaaagatctactgaatgaagtagaaagaaatctacaggatgccatgtctgtcgctagaaacatcatcaagtgtcctaagctagttcccggtggtggtgcaacagagttaactgtatctgccatgttaaagcagaaaagttcatccgttgaaggcatagaaaagtggccgtatgaagctgctgcaattgcttttgaagctataccacgaactttggctcagaactgcggtgtaaatgtgattcgtactatgaccgctcttcaaggaaagcatgcaaatggcgagaatgcatggataggcattgacggaaacactggtgagattaccgacatgaaagagcggaagatatgggattcctatgctgtaaaagcacaggcttttaaaactgccattgaagctgcttgcctacttctgagaattgatgacattgtgagtggaataaagaagaagcaagcccctggagcaggacaaggtccatcaaaaccaaaaatagacgaagaaggtgatgcagacaatgaccagctaattccggaatgaacatgatatactatgctgcaatggaaatgcttatgcatttgataaccacttggaagttttcatctacttcagtatagtctgcccttgactgattgcttgaactttttgtgcttgacatgtaacttctgctgtttttgactgctggcagttgttggttgtatttgaaatagattttgtttcagtttttggttttaaattaaatttgatgttgcaagtacaatgactaatcaatgtaggggtatcatgtttttcaaggatccaacaaatttaaggccatacaaatcaaattcaggaaacttatgttgagtc

SEQ ID NO: 2589 - DNA, 1745 bp, Taraxacum officinale
cacgaaaccctagagaaaatctgccagctccagcaactgatccctcagtctcgaccttcatctcgagatatgcagtcaccggttcttgttctcaaggattctctcacgcgtgaatctggaagtaaggttcatcatgcaaatatacaggcttctaaggccgttgctgatattattcgaaccaccttgggtccaaggtctatgctgaagatgcttctagatgctgctggaggaattgtggtaactaatgatggtaatgccattttgagggaattggatatcgctcacccagctgcaaagtccatgattgaactaagtcgcacacaagatgaggaggttggtgatggaaccacttcagtcattgttcttgctggtgagatgcttcatgttgctgaagctttcattgacaagaaatatcaccccacagttatttgccgagcttacaacaaggctcttgaagatgctcttgctgtgttggacaagatctccatgtctatcgatgtcaacgaccgttccatgatgttgggtttggtaaagagctgtattggtacaaaattcaccagccaattcggagacctgatagcagacctagcactagatgcaaccacaacagttggagttgacctaggtcaaggcataaaagaagtcgacattaaaaaatacataaaagtggaaaaaatccctggcggccaattagaagactccaaagtcctcaaaggagtcatgttcaacaaagacgtagtcgttcctggaaaaatgaaaagaaaaatcataaacccccgcatcattttactagattgccctctcgaatacaaaagggcgaaaaccaaacaaatgctgaattagtccgtgaagaagactgggcagttcttttaaaaatggaagaagaatacattgaaaatctgtgtgttcaaattctaaaattcaagcctgatttggtaataacagaaaagggacttagtgacctggcgtgtcattatttgagtaaagctggagtgagtgcgattaggagattgaggaaaacggataataatcgaattgctaaagcttcaggggctgttattgtaaattggccggatgagttgcaggaatcggatgtggggacaggggctgggctttttgaagtgaagaaaattggggatgagttttttgcgtatattgttgaatgtaaagattcgaaagcgtgtactgttcttcttagtggtgccagcaaggatcttttgaatgaagttgaacgtaacttacaggatgcgatgtcggtggccagaaacattttgaagcatccaaaacttgttcctggtggtggagctactgagttgactgtttctgctatgttgaagcagaagagctcatcaattgaaggcattgaaaagtggccatatgaagctgcggctgtagcatttgaggctattccacgaacattggcacaaaactgtggtgtgaatgtcattagaaccatgactgctcttcaaggcaaacatgcaaatggtgagaatgcatggacggggatcgatgggaatacgggtgcaattgctgacatgaaagaactaaagatttgggatgcgtataatgtgaaggcgcaaacattcaagacagcaattgaagcagcgtgtatgctattaagaattgatgatattgtgagtggaataaagaagaggcaagcccctggtgcaagccaaccacaaaaaccaactgttgagactgaagctgatgctgacaatgagggtatgattcccgagtgatcatct

SEQ ID NO: 2590 - DNA, 2354 bp, Phaseolus coccineus
aagggtttttctagcacattttggcggaaaacctcagcgcagttactaacacttcactcttccgctcgattatttatcgatcatttttgtgtgccctagcgcctcttctgcagccgctgccgccaaccaccgtttctcttgccgcttccggtaccgatcgaaccttctccggccaagttcagattctcgcgagcttcctcgggaggacatcctctgttgctggatttagttctcgcctgtgaaattttcggaatattttgaatctaagaaatcatgcacgcgccagttctcgttctccaggactctttgaaacgagagtctggatctaaagtgcggtatgctgttattcaggcagcaaaggctgttgctgatgtagtccgtacaacattgggacccaggtccatgctaaaaatgcttcttgatgctcaaggaggaattgttgttaccaatgatggaaatgctatcttacgtgaattagaccttgctcacccagctgcaaagtccatgattgaattaagtcgaacccaagaccaagaagttggagatggaacaacatctgtcatcattcttgctggtgagatgcttcatgttgccgatgcattcattaacaaaattcaccctacagttatttgccgagcatataccaaagctttggaggatgctctttctgttcttgacaaaattgcaatgcctatcgatgctcaggatcgaggtataatgctggggctagtaaaaagttgcataggtaccaaattcacaggtcaatttggggatttaattgctgatttagctattgatgctactacaacagtaggtgttgatattggccaaggtttgagagatgtagatattaaaaattatattaaggttgagaaggtccctggtgggcagctggaggattctagagtactcaagggagttatgataaacaaagatgtggttgcccctggcaaaatgaggagaaagattgtcaacccacgcatcattcttcttgattctccccttgagtataaaaagggtgaaaaccaaacaaatgctgaactgctcaaagaagaagactggagtcttttattgaagatggaagaagaatatattgaggagctatgcatgcagatattgaagtttaagcctgacttggtaatcacggagaagggtctgagtgatttggcttgccattatctgagcaagcatggagttagtgcaatcaggaggctgaggaaaactgataataatagaattgctaaggcatgtggtgctgttattgtgaacagaccagatgaattgcaggagtctgatgttggtactggtgctgggttatttgaggttaagaaaattggagatgagtacttttcatttattgttgattgcaaagaccccaaggcctgcactatactactgaggggagcaagtaaggatctcttaaatgaagttgaaagaaatctacaggatgccatgtctgttgcaaggaacataataaaaaatccaaaacttgttcctggaggtggtgcaacagagttgacagtgtcagctgccttgaaacagaagagttcttctatcgagggcattgaaaaatggccgtatgaagctgctgcgattgcttttgaatccatcccacgaactttggcacaaaattgtggagtaaatgtcatccggactatgacagctctacaaggaaaacatgcaaatggagaaaatacatggattggtatagatggaaatactggcagcatcactgacatgaaagagggcaagatctgggatgcctacaatgtgaaggcgcaagcttttaagactgccattgaagctgcttgcatgcttctgaggattgatgatatagtgagtgggatcaagaagaagcaggcccctggagcttcaggttcttcaaaacccaagattgagaccgaggcagatgctgacaatgagcaaatccttcccgactgagaatctaggttcaactgacattgctttttgatagagttgatgacgtactaggttcttggtctttcattaaatcttattaccattagaagttttgggtccttgactgggctgttgtttttttgtgccttgtactttttgcaagagcaaattgtgaactttgtttattttaaatactatattaactggtgtgtgatttattgggtgttttcggtccactgttgagattttgtgccggggtcaaacatgccagttttatcgattttgttgagctgtttctggtttctcttcctattcgtttttgaaatgttttttgcatattaatatccaagcacttccttagaactgtgtaaattatggtgaaattatgttttttttgtgtgccgataatagtgttctatttctgaaaaagcgat

SEQ ID NO: 2591 - DNA, 1870 bp, Helianthus annuus
gttcttacactctcgtatcacagctatgcaatcaccggttctcgttctcaaggattctctcactcgtgaatctggaaataaggtgcatcatgcaaatatccaagcttcaaaggctgtggctgatattattcgaaccactttgggtccaaggtcgatgttaaagatgcttctagacgctcaaggaggaattgttgtcactaatgatgggaatgccatattgcgggagttggatgttgctcacccagctgcgaagtccatgattgaactaatccgcacgcatgatgaggaagttggtgatggaactacatcaatcattgttcttgctggtgagatgcttcatgttgcaaaagctttcattgacaaaaaatatcatcctacagttatttgccgagcttacaccaaggctcttgaagatgctcttgctttgttggacaaaatctccatgtctattgatgtgaatgaccgttcaatgatgctgggattggtgaagagttgtattggcacaaaatttaccagtcaatttggggatctgattgcagatctagcactcgatgcaacaactacagttggtgttgaccttggtcaaggaatactagaagtggatattaaaaaatacattaaagtcgaaaaaatccccggtggccaattagaagattccaaagtcctcaaaggcgttatgttcaacaaagacgtcgtcgtccccggaaaaatgaaacgaaaaattataaacccgcgtatcatattactagattgccctttagaatacaaaaagggtgagaatcaaacaaacgccgaattagtacgagaagaagattgggccgtactcttaaaaatggaagaagaatacatagaaaacatttgcgtacagatacttaaatttaagcctgatttggtgataaccgaaaaggggcttagtgatttggcgtgtcattatttcagtaaagccggagttagcgcgcttaggagattgaggaaaaccgataataaccggattgcgaaagcgtgtggggctgttattgtgaatcggcccgatgaacttcaagaatcggatgttgggactggtgctgggctttttgaggttaaaaagattggtgatgagtttttttcgtttattgtggattgtaaagacccaaaagcatgcacgatttttctccgaggtgccagcaaggatcttttgaatgaagttgaacggaacttgcaggatgcaatgtcggttgctaggaacatcctgaagcatccgaaacttgttcctggtggtggtgcaactgaattaactgtttccgctacactgaagcagaagagctcgtcgatagaaggcattgagaagtggccttatgaagcagcagcagtagcattcgaggctatacctcgaacattggctcagaactgtggtgtcaatgtcattagaaccatgactgctcttcaggggaagcatgcaaatggtgagaatgcctggacaggtatagatggtaattcaggtgaaatcgctgatatgaaagaactaaagatttgggatgcttataacgtgaaggcgcagacctttaagacagccatcgaagctgcttctatgcttttaagaatcgatgatattgtgagtggaatcaaaaagaggcaagctcctggatctaaccaaccatcaaaacccactattgagaccgaaggggatgctgataacgagcagatgattcccgagtgatgaaacattttaatgtagtttcattaaacacgtttctcttgattcatttttaatttcttatgtgactgcccgaaattttggtccattacgctatgttttgtttctcctcttttgaccattttttgattcctagtatgtgctgtttgttttgtactgttgacattgtatattagt

SEQ ID NO: 2592 - DNA, 1975 bp, Eutrema halophilum
ttcctcttttcgaatttgctccgtcgccgtcgctaaacctctccgccgtttcgccgtctacgcttagatcgcagatatgaacgccccagttctcgttctcaaggattcgttgaagcgtgaatctggaacaaaggttcaccatggtaatattcaggcttccaaggctgtagctgatatcatccgcacgacattgggtcctcgctctatgttaaagatgcttcttgatgctgggggaggaattgttgttaccaatgatggaaatgctattttgcgtgaacttgatgttgctcaccctgcagctaaatcgatgattgagttgagccgcacacaggacgaagaagtcggtgatgggactacatctgttattgttcttgctggtgaaatgttacatgttgccgaagcatttattgaaaagagttaccatcccacagtgatatgccgagcttacaataaggctctcgaggatgcactcgctattcttgacaagattgccatgtcaatcgatatcaatgaccgtgcaacagtactaggattagtcaagagctgcataggaacaaaattcactagccagtttggagatctaattgctgatttggctattgacgccaccactactattggtgttgatcttggacaaggattgagggaggtggatattaaaaaatacattaaggttgagaaggttcctggtggccagttggaagactccaaggttctcaaaggagtcatgtttaacaaagacgtagttgctcctggtaaaatgaagagaaagattgtcaacccacggattattcttcttgactgcccccttgagtacaagaaaggtgaaaaccaaaccaatgctgagttggttagagaagaggattgggaagttctgctgaaactggaagaggagtacatcgagaacatctgcgtgcaaatactgaagttcaaacccgatttggtaattacagagaagggacttagcgacttggcctgtcactatttcagtaaagccggggttagtgcaatcagaaggttgagaaagacggacaacaacagaatcgctaaggcatgtggagctgtgattgtgaacaggcccgacgagcttcaagagtctgatgttggtaccggcgctggcttgtttgaggtcaagaaaataggagacgatttctttgctttcattgttgaatgcaaagaacccaaagcatgtactgtactcttaagaggaccaagtaaagatcttctcaacgaagtggaaagaaatcttcaggatgccatgtctgtttcaagaaacatcatcaagaacccaaagcttgttcctggcggtggggccacagaattaaccgtttctgctaccttaaaacagaagagtgcaacaattgaaggaatcgaaaagtggccttatgaagcagctgccatagcttttgaggctatcccgcgtactctagctcagaactgtggagttaacgtgatcagaactatgacagcattgcaaggaaagcacgcaaatggtgagaatgcctggactggaatcaatggaaacactggtgcaatagcggacatgaaagagagcaagatatgggatgcttacaatgtgaaggcgcaaacgttcaagacagcgattgaagcggcgtgtatgcttctgaggattgatgatatagtgagtggtatcaagaagaagcaagctcctggagctggaccttcaaagcctaccattgagactgaaggagatgcagacaatgagcaaatacttcccgactagaaatattgctctcatcaacataatctctctctctctctttttttttttttttctggctattttagtttgaaatgtttgttgaacttgacactcccttcagtatcttatgattttgcattttgactaggcgagaaaagatcttgaggggagtgagtgttgaatattttgttatcttttgaaagaaaggcattgaaagacgttgataatagctttggtttacgacgattcact

SEQ ID NO: 2593 - DNA, 1965 bp, Raphanus sativus
  misc_feature (559)..(559): n is a, c, g, or t
  misc_feature (644)..(644): n is a, c, g, or t
  misc_feature (650)..(650): n is a, c, g, or t
  misc_feature (899)..(899): n is a, c, g, or t
  misc_feature (1236)..(1236): n is a, c, g, or t
  misc_feature (1587)..(1587): n is a, c, g, or t
  misc_feature (1955)..(1955): n is a, c, g, or t
ggagcatccttcaaccttgttgttattgagagcttcgcttctgctccgtcgccgtcgctgcaaaactttctcctccgattccaattcttttcacttaacgcttagatcgcaaaaacatgaacgctccggttctcgttctcaaggactctttgaagcgtgaatctggaacgaaggttcaccatggtaacattcaagcttccaaggctgtggctgatatcatccgcacgacattgggtcctcgctctatgttgaagatgcttcttgatgctggtggaggaattgttgttaccaatgatgggaatgctattttgcgtgaacttgatgttgctcaccctgcagctaagtcgatgattgagctgagccgaacacaggacgaagaagtcggtgatgggactacatctgttattgttcttgctggtgaaatgttacatgttgccgaagctttcattgaaaagagttaccatcctacagtcatatgccgagcttacaataaggctctagaggatgctatcgctgttcttgacaagattgccatgacaatcgatgtgaatgaccgtgnaacagtactaggattagtcaagagctgcataggaacaaaattcaccagccagtttggagatctaattgctgatttggctattgangccacnactactgttggtgttgatcttggacaagattgagggagtggatatcaaaaaatacatcaaggttgagaaggttcctggtggccagttggaagactccaaagttctcaaaggagtcatgttcaacaaagacgtagttgctcctggtaaaatgaagagaaagatcgtcaacccacggattattcttctcgactgtcccctcgagtacaagaaaggtgaaaaccaaacaaatgccgagttggtcagagaagnggactgggaaattctgctgaaactcgaagaggagtacatcgagaacatctgcgtgcaaatactaaagttcaaaccggatctggtcatcacagagaagggactcagtgacttggcatgtcactacttcagtaaagctggagttagtgcgattcggaggctgagaaagacggataacaacagaatcgctaaggcgtgtggtgctgtgattgtgaacaggcctgacgaacttcaagagtctgatgttggtactggcgctggcttgtttgaggtcaagaaaataggagatgatttctttgccttcgttgttgattgcaaagaacccaaagcatgcactgtnctcttaagaggaccaagtaaagatcttctcaacgaagttgaaagaaatcttcaggatgccatgtctgtttcaagaaacatcatcaagaacccaaagcttgttcctggtggaggagccactgaattaaccgtttccgccactttaaaacagaagagtgcaacgattgaaggaatcgaaaagtggccttatgaagcagctgctatagcttttgaggctattccgcgtactctagcacagaactgtggagttaacgtgatcagaactatgacagcactgcaaggaaagcatgcaaatggtgagaatgcctggactggaatcgatggaaacactggtgcaatagctgacatgaangagagcaagatatgggatgcgtacaatgtgaaggctcaaacgtttaagacagcgattgaagcggcgtgtatgcttctgaggattgatgatatagtgagtggtatcaagaagaagcaagctccaggagctggaccttcaaagcctaccattgagacagaaggagatgcagacaacgagcaaatacttcctgactagaaaattttgctctccaccaacataaacttctttccttttttgttttttttgctattttagtttgaattttgaagtgtttgtgaaacttgacagtccctttagtattttatggctttgattggtaacttgatttactattgattaagtttgatttagactataattcaaaaatnttaccaacca

SEQ ID NO: 2594 - DNA, 2096 bp, Brassica rapa
gaagactaataaaaaggagagcgaggagagccgcgaagcagcactaataagcatctcttcaaccttctcattgagcttcttccgcttctcaaaatctactccctcgccgtcttcttctccgatccttcaacccacgcttagatcgcacacatcatgaacgctccggttctcgtcctcaaggactcgttgaagcgtgaatctggaacgaaggttcaccatgggaacatccaagcttccaaggttgtggctgatgtcatccggaccacattgggtccacgctctatgttgaagatgcttcttgatgctggtggagggattattgttaccaatgatgggaatgctattttgcgtgaacttgatgttgctcaccctgcagctaagtcgatgattgagttgagccgcacgcaggacgaagaagtgggtgatgggactacatctgttattgttcttgctggtgaaatgttacatgttgctgaagcattcattgaaaagagttaccatcccacagtcatatgccgagcttatatcaaggctctcgaggatgctatcgctgttcttgacaagatcgccatgtcaatcgacgtcaatgaccgtgaaaccgtactaggattagtcaagagctgcataggaacaaaattcaccagccagtttggagatcttattgctgatttggctattgacgccaccactatcgttggtgttgatctcgggcaaggattaagggaagtggatatcaaaaaatacatcaaggttgagaaggttcccggcggccagttggaggactccaaggttctcagaggagtcatgttcaacaaagacgtagtagctcccggcaaaatgaagagaaagatcgtcaacccacggatcatccttctcgactgcccactcgagtacaagaaaggcgaaaaccaaacgaacgccgagctggtcagagaagaggactgggaagtccttctcaaactcgaagaggagtacatcgagaacatctgcgtgcagatactcaagttcaagcccgatctggtcatcacagagaagggactcagtgacttggcatgtcactatttcagtaaagctggagttagtgcgattagaaggctgagaaagacggataacaacagaatcgctaaggcgtgtggggctgtgattgtcaacaggcctgatgagcttcaggagtctgatgttggtactggcgctggcttgtttgaggtcaagaagataggagatgatttcttcgccttcgttgttgattgcaaagaacctaaagcgtgtactgtcctcttgagaggaccgagtaaagatcttctcaacgaagtggaaagaaaccttcaggatgctatgtctgtttcaagaaacatcatcaagaacccaaagcttgtgcctggtggtggagccactgagttaaccgtttctgccactttaaaacagaagagtgcaacaattgaagggatcgaaaagtggccttatgaagcagctgctatagcttttgaggctattccgcgtactctagctcagaactgtggagttaacgtgatcagaacaatgacagctttgcaaggaaagcatgcaaatggtgagaatgcctggactggaatcgatggaaacactggtgcaatagctgacatgaaagagagcaagatatgggatgcgtacaatgtgaaggctcaaacgtttaagacagcgattgaagcggcgtgtatgcttctgaggattgatgatatagtgagtggtatcaagaagaagcaagctccaggagctggaccttcaaagcctaccattgagacagaaggagatgcagacaacgagcaaattcttcctgactagaaaagttttgctcctcaccaacataaacttctttttctcgtcttgttttgctatattttttcttttttgatcatgtgtcttgtgaaacttgatggcagtccctttagtattttatgcttttgcatttaacttggtagtgagtgatgaatcttggtatcagcacaagtttatgattcatgttttatgaccaacttgctgattcatgttagttattttatcaatgaaactctgtgaaaattttcctcacagtttataagttactcaatgaaactcca

SEQ ID NO: 2595 - DNA, 2279 bp, Cicer arietinum
cagggttttctagttctacattttggcggacaacctctctctctttacactacacactcacttctccaaaaacacaccgatcatttttctgtgccctaacgctccttccaccaccttcctccgccgcctctctccttaaccaccgaacattctcttctcaacttcagcgaagttcaaattttcggaaggatctttataaggttattgtttggtactggatttagagtttttggttgaaaaatcttaggacgttttttaaacctagaaatcatgcagtcgcctgttctagttctcaaggactctttgaaacgtgagtctggagcaaaggttcatcatgctaatattcaggcatcaaaggctgttgctgatataattcgtacgaccttgggtcccaggtccatgcttaaaatgcttcttgatgcttctggaggaattgtggtgacaaatgatggaaatgctatcttacgtgaattagatattgctcacccagctgccaagtctatgattgaattaagtcgcacccaagatgaagaagttggagatggaactacatcagtcatcattcttgctggtgagatgctccatgttgctgaagcattcattgaaaaaaactatcaccctacagttatttgccgagcatatatcaaagctttggaggatgctattgctgttattgacaaaattgcaatgcctattgatgctcaggatcgaggaacaatgctggggcttgtaaaaagctgcataggtaccaaattcacaagtcaatttggggatttaattgctgatctagctattgatgctactacaacagtaggagttgatattgggcaaggtttgagggatgttgatattaaaaattatatcaaggttgagaaggtccctggtgcacagctcgaggattcgagagttcttaatggagttatgataaacaaagatgtggttgcccctggcaagatgaggagaaagattgttaaccctcgtatcattcttcttgatagtcctcttgagtataaaaagggtgaaaaccaaactaatgctgaattgcttagagaagaagactggagtctcttattgaagttggaggaagaatacatcgaggagctctgcatgcagatattgaagtttaaaccagacttggtcattacagagaagggtcttagtgatttggcatgccattattttagcaagcatggagttactgcaatcagaagactgaggaaaactgataataatcgaattgccaaggcatgcggtgctgttattgtgaacagaccagatgagttgcaggagtctgatgttggtactggtgcagggttgtttgaagttaagaaagttggagatgagtactttgcttttattgttgattgcaaagaacccaaagcttgtactgttttattacggggtgctagtaaggatctcttgaatgaggttgaaagaaacctacaagatgccatgtctgttgctaggaacataataaaaaatccaaaacttgttcctggaggtggtgctactgagatgactgtgtcggctactttgaaacagaagagttcttctattgaaggcatagagaagtggccatatgaagctgctgccattgcttttgaatctattccacgtactttggcccaaaattgtggagtaaacgttatccggacaatgactgcactacaaggaaaacatgcaaatggagaaaatgcatggactggcatagatggaaatactggtgccatcgctgacatgcaagagcgcaagatctgggatgcctataatgtgaaggcacaagcgtttaagactgccattgaagctgcatgcatgcttctgaggattgatgatattgtgagtggaatcaagaagaagcaagcccctggtgctggcccctcaaagcctaagattgagactgagggagatgctgatggcgaccaaatccttcccgactgaaaactcaattcccctgacattgtttttttgacagatagagttgaaaatcttctaggttcttgttcctttttgaacttaaattactaatattcttaagaagttttggttccttggttgtgttgtttagtgccttgtactctttggaaaagccaatcgtgaactattaaatgatatttcaagtcacatctgctttatcgagtgttctcagtccattgttgaagattatgccaggcttaaatttgttgttttcaccacttcgaaggttttccttgttttcctataaattttagtacatatatatatataatttattgtgggtacgtgatgagattacagaggtc

SEQ ID NO: 2596 - DNA, 2035 bp, Eschscholzia californica
ctgaagcgtgaatctggaagtaaagtacagcatgcaaatattcaagcatcaaaggctgtagcagacatcatccgaactactctgggacctcgttccatgctgaagatgctcttggatgcgtcaggaggtattgtggtcacaaatgatggaaatgcaatactgcgtgagttggatgttgcccatccagctgctaagtccatgattgagctgagtcgcacccaagatgaagaagttggagatgggacaacatccgtaattgttctagctggtgagatgcttcatgtggcagaagcttttattgataaacgttaccacccaactgtcatttgcagagcttacaaccaagctctagaagacgccatcgccgtgcttgacaaaattgctgtgtccattgatgttgatgaccgtgcctcaatgttgagtttggttaagagttgtattggcacaaagtttaccagtcaatttggagatctgattgcggatttagcgctcgatgccactacaactgttggtgtagatcttggccagggattccgtgaagtggacgtcaaaaagtacataaaggtcgagaagattcctggtggacagttggaagattcacatgttttgaaaggagtgatgttcaacaaagatgtagttgctcctgggaagatgagaaggaagatagtaaatcctcgaattattcttcttgattgccctcttgagtacaagaaaggagagaaccagacaaatgctgagttgcttaaggaagaggattggggtgttatgctaaagatggaagaagaatacattgagaacatctgtgcacagattctgaaattcaagcctgacttggtaatcacagaaaagggacttagtgatctagcctgccatttcttcagcaaggcaggggtcagcgctatccgaaggttaaggaagactgacaacaacaggattgctaaatcttgtggagcagttattgtcaacagaccagatgaactccaagaatctgatgtggggactggagctggactctttgaggtgaagaagattggggatgagttctttgcattcgttgttgattgtaaagatcccaaagcctgtactattcttttaaggggtgcaagcaaggaccttctgaacgaagtggaaagaaatctacaggatgccatgtctgtagcaagaaacatattgaaaaatccaaagcttgttcctggtggtggtgcttctgagttaaccgtatctgccactttgaagcaaaagagttcatcagttgaaggcattgagaagtggccatatgaagctgctgcattagcattcgaagcaatccccagaactctggctcagaactgtggagttaatgtgatccgaacaatgacagctctacagggcaagcatgcaaatggtgagaacccatggattggtattgatgggaacactggtgctatcgttgatatgaaggagagaaagatctgggattcttataatgtgaaagcacaaacgttcaaaacggcaattgaagcttcttgtatgcttctaagaattgatgatatagttagtggcatcaagaagaagcaacctcaaggttccagccaagctccaaagccccaaatcgaaggagcagaagatgctgataatgagcagatgattccagagtaagaacatggtgatgtttttgtgtaaagttcttatctgatcatttctgaagaaaattcactactattgcggtggcatccgatgagtttcgtggttttctctactaatttatttcgtcgagtgggatttcttagtctcataatcttgttatgcttcaaattttgggtttgttatattctctctcgtaggtagtaccaaagtctgtgttctcgttggattttcaccaagtgccgaaatcgaaaagggtttgagatcatcagattatatagttttagactgttagaggatgtcatttctaaatgtacgtttggtataactactagtactgtttcctttttttgagtaaaatattcctgcagttattaaaacttgagttttgtcaattgagttgttagagatc

SEQ ID NO: 2597 - DNA, 2212 bp, Papaver somniferum
gtcgaagaaagattattcccagtatattactttgctctcgaagtctctctttctctttctcactgtaggggtaaatctccggcaataaacccccatcactcgactgaactccaacttcaaagatctcataggtttttgacaaaatacagcaatcatgcaagctcccgttctcgttctgaaggataacttaaagcgtgaatctggaaagaaggttcagcatcaaaatattgcagcatcaaaggctgtagcagacatcatccggacaacattgggtcctcgttccatgctgaagatgcttttggatgcttcaggaggtattgtggtgacgaatgatggaaatgctatattgcgtgagctggatctggctcacccagctgctaagtccatgattgaactaagtcgcactcaagatgaagaagttggggatggaactacatctgtcattgttctaactggtgagatgcttcatgtggcggaagcttttcttgataagggttaccatccaacagtcatttgccgagcttacaaccaagctcttgaagatgctattttggtgcttgaaaaaatttccatgccaattgatgtgaatgatcgcccctcaatgttgggattagttaaaagttgcattgggacaaagtttactagccaatttggagatcttatcgccgacttagcaattgatgctactaccattgttggtgtggatctcggtcaaggagtccgagaagtggacattaagaagtacataaaggtcgagaagatacctggtggccagctagaagactccaaggttctggaaggagttatgttcaacaaagatgttgttgctcctgggaaaatgaaaagaaagatcgtgaacccaagaatcattcttctcgactgtcctcttgagtacaaaaagggagagaatcaaaccaatgcggaattggtcaaggaagaggattggggaattatgctaaagatggaagaagagttcattgagggtctctgtgcacagattctgaaatttaagcccgacttggtaatcacagagaagggacttagtgatctagcttgccatttcttcagcaaggcaggagtcagtgctatcagaaggctaaggaagacagacaacaacaggattgccaaggcctgtggagctgttattgtcaacagaccagatgagctccaagaatctgatgttgggactggagcaggactttttgaagtgaagaagatcggagatgaattcttttctttcatagtagattgcaaagatcctaaagcctgtacagtacttctaaggggtgctagcaaggatctcctgaatgaagtggaaagaaatcttcaggatgcgatgggcgtagcacggaacatattgaaaaaccctaagcttgttcctggtggtggtgccactgagttaactgtgtctgctactttgaagcagaagagttcatctattgcaggcatggaaaagtggccatatgaagccgcagcaatagcatttgaagctatcccacgaactctagctcagaactgtggagttaacgtgatccgaacaatgacagctttacagggcaagcatgcaaatggtgaaaacccctgggttggtattgatgggaacactggtgcaattgttgatatgggagagaaaaagatctgggacgcttataacgtgaaagcacaaacatttaaaacagctattgaagctgcttgcatgcttcttaggattgatgacatagtcagtggtatcaagaagaaacaaccacctggtgctagccaagctccaagatctcaaattgaggatggagataatgcagataacgagcagatgattccagagtaagacctcggtgttggcactgagatgtagtttctgacattctctgaagaggcttttgcttccttttccatggatggagtgttgtggttttcttcactggtcagtgtatgtgggtggaattttatattagtcgcggtgggtttgcttcacattttggataacgagatttatttcctttttgtgagcttagtaatgaaaaagggttttagatggcaggttagaggatttctactatttttgtacaacaaacatgtaattttggggtagtctttagttgataaatttagtgtgttgcgtgaccttggtatcaaaaattcaaaatccttgctgcattctagaatatgtttaaaccaaggctttgtgttcagagtacagtatttcaaatcaagt

SEQ ID NO: 2598 - DNA, 2066 bp, Papaver somniferum
cccagtatttaattttgctctcgaagtctctctttctctttctcactgtaggggtaaatctccggcaataaaaccccatcactcgactgaactccaacttcaaagatcttatagggttttgacaaaatacagcaatcatgcaagctcccgttctcgttctgaaggataacttaaagcgtgaatctggaaagaaggttcagcatcaaaatattgcagcatcaaaggctgtagcagacatcatccggacaacattgggtcctcgttccatgctgaagatgcttttggatgcttcaggaggtattgtggtgacgaatgatggaaatgctatattgcgtgagctggatctggctcacccagctgctaagtccatgattgaactaagtcgcactcaagatgaagaagttggggatggaactacatctgtcattgttctaactggcgagatgcttcatgtggcggaagcttttcttgataagggttaccatccaacagtcatttgccgagcttacaaccaagctcttgaagatgctattttggtgcttgaaaaaatttccatgccaattgatgtgaatgatcgcccctcaatgttgggattagttaaaagttgcattgggacaaagtttactagccaatttggagatcttattgccgacttagcaattgatgctactaccactgttggtgtggatctcggtcaaggagtccgagaagtggacattaaaaagtacataaaggtcgagaagatacctggtggccagctagaagactccaaggttctggaaggagttatgttcaacaaagatgttgttgctcctgggaaaatgaaaagaaagatcgtgaacccaagaatcattcttctcgactgtcctcttgagtacaaaaagggagagaatcaaaccaatgctgaattggtcaaggaagaggattggggaattatgcttaagatggaagaagagttcattgaggggctctgtgcacagattctgaaatttaagcccgacttggtaatcacagagaagggacttagtgatctagcttgccatttcttcagcaaggcaggagtcagtgctatcagaaggctaaggaagacagacaacaacaggattgccaaggcctgtggagctgttattgtcaacagaccagatgagctccaagaatctgatgttgggactggagcaggactttttgaagtgaagaagatcggagatgaattcttttctttcgtagtagattgcaaagatcctaaagcctgtacagtacttctaaggggtgctagcaaggatctcctgaatgaagtggaaagaaatcttcaggatgccatgggcgtagcacggaacatattgaaaaaccccaagcttgttcctggtggtggtgccacggagttaactgtgtctgctactttgaagcagaagagttcatctatcgaaggcattgaaaagtggccatatgaagccgcagcaatagcatttgaagctatcccacgaactctagctcagaattgtggagttaacgtgatccgaacaatgacagctttacagggcaagcatgcaaatggtgaaaacccctggattggtattgatgggaacactggtgcaattgttgatatgggagagaaaaagatctgggacgcttataacgtgaaagcacagacatttaaaacagctattgaagcagcttgcatgcttcttaggattgatgacatagtcagtggtatcaagaagaaacaaccacctggtgctagccaagctccaagatctcaaattgaggatggcgataatgcagataacgagcagatgattccagagtaagacctcggtgttggcactaagatgtagtttctgacatattctgaagaggcttttgcttccttttccatggatggagtgttgtggttttcttcactggtcagtgtatgtggttggaattttatattttagtcgcggtgggtttgcttcacattttggataatgagttttatttcctttttgtgagcttagtaatgaaaaagggttttagatggcaggttagaggaattctactatttttgtacaacaaacatgtaattt

SEQ ID NO: 2599 - DNA, 2137 bp, Eutrema parvulum
aatcggaagattttccagttgccgccctttgaatttactctgccgcgactccgccgtctctcagcttctcttcactgtgaacgcttagatcgcgaatatgcacgcaccggttctcgttctaaacgattcgttgaagcgtgaatctggaactaaggttcatcatgctaatatccaggcttccaaggctgtggctgatatcctccgtacgacattgggtcctcgctctatgttgaagatgcttcttgacgctggaggagggattgttgttaccaatgatggaaatgctatccttcgtgaactagatgttgcccatcctgcagctaagtcaatgattgagctgagccgtacacaagacgaagaagttggtgatgggacaacctcagttattgttctagctggtgaaatgcttcacgttgcagaagcatttattgagaaaagttaccatcccacagtcatatgccgagcttacattaaggctcttgaagattctatagctgttcttgacaaaattgcgatgacaatcgatgtcaatgaccgtgcaacagtactaggactagtcaagagctgcgtagggacaaagttcactagccaatttggcgatttaattgctgatttggctattgatgccactactactgttggtgttgatcttggtcaaggtttgagggaggtagacattaaaaagtacatcaaggttgagaaggttcctggtggtcagttggaggactcgaaggttcttaaaggagttatgtttaacaaagatgttatcgctcctggtaaaatgaaaagaaagattgtcaacccacggattattcttcttgactgcccccttgagtataagaaaggtgaaaatcaaaccaatgctgagttggttagagaagaggactgggaagtgcttttgaagctggaagaggaatacattgagaacatttgcgtgcaaattctgaagttcaaacctgatttagttattacagagaaggggcttagtgacttggcttgtcactatttcagtaaagctggtgttagtgcaatccgaaggttgagaaagacagacaataacagaattgccaaggcttgtggagcagtaattgtgaacaggcccgatgaactacaggagtctgatattggtactggagctggcttgtttgaggtcaagaaaataggagatgatttctttgctttcgtagttgattgtaaagaaccgaaagcatgtactgtactcttaaggggaccaagtaaagatctcctcaatgaagtggaacgaaacttacaggatgccatgtctgttgcaagaaacattatcaaaaacccaaagctcgttcctggtggaggagccacagaattaaccgtttctgccacattgaaacagaagagtgcaacaattgaaggcatagaaaagtggccatatgaagcagctgctattgcttttgaggttattccacgtaccctggctcaaaactgtggtgttaatgtgatccgtactatgacagcattgcaagggaagcacgcaaacggtgaaaatgcatggaccggtattgatggtaactctggtgcaatagctgatatgaaagagagcaagatatgggacgcgtacaatgtgaaggcacaaactttcaagacggcaatagaagctgcgtgcatgcttctaaggatcgatgatatagtgagtggtatcaagaagaagcaagctcctggagctggaccttcaaagccgactattgagacagaaggagacgcagacaacgagcaaattcttccggactaagagatgataaactctttggtctcagaaacccaatcgttgatatctctgttctcacttggctacaatcttttctttctttttgggattttatcttctaattttgaaatgacttagtgagataagatttttcaggatgggtttatatttatttttgtctttttctaaaatgtaagcttcatttttgaattttcgttgccacttggtttttagagtgctagttgttatgtctttttgaaatttctgccacaaagacttttataagattgtgttgtttttcttctgtaatatcaaatacttactttcgatggaagttttagtttgaccttcagtgtcggtatatctttgtctgaacaccattaatttcatttcata

SEQ ID NO: 2600 - DNA, 2226 bp, Chelidonium majus
caacttcccccagtcgcccactcaaaaccagactcgcgccctccgcagctccgcttcactgcactttggaacttcaccaacgatctctctcccactgtctcagcgaaaagttgagaaggaacaaatctaaccatgcaatcacaagttctcgttctgaaggattctttgaagcgtgaatctggaagtaaagtgcagcatgcgaatattcaagcatcaaaggctgtagcagacatcattcggactactctgggtcctcgttccatgctaaaaatgctcctggatgcttcaggaggtatcgtcgtcacaaatgatggaaatgcaatactgcgtgagttggacattgcccatccggctgctaagtccatgattgaactaagtcgcacccaagatgaagaagttggggatgggactacatccgtaattgttctagctggtgagatgcttcatgtggctgaagcttttattgataagcactacaccccacagtcatttgccgagcttacagccaagctcttgaggatgctattgctgtgcttgacaaaaattgctgtgccgattgatgtggatgaccgcgcctcaatgttgggattggttaaaagttgcattggcactaagtttactagccaatttggagatcttattgctgatttggcgattgatgctactacaactgttggtgtggatcttggccacggagtccgggaagtggacataaaaaaatatataaaggttgagaagattcctggtggcccattagaagattctaaggttctgacaggagtgatgttcaacaaagatgttgttgcccctgggaagatgagaagaaagatactgaacccccgccattattcttcttgattgccctcttgaatacaagaagggtgagaatcagacaaacgctgagttggtcaaggaggaggattggggagttatgctcaagatggaagaagaatacattgagggcatttgtgcacagattttgagattcaaacctgacttggttatcacagagaagggacttagtgatctagcctgccacttcttgagcaaggcaggcgtaagtgctattagaaggttaaggaagactgataacaataggattgccaaggcctctggagcagttatcgtcaacagaccagatgagctccaagaatctgatgtagggactggagcaggactctttgaggtgaagaaaatcggggacgagttctttgccttcattgtagattgcaaagatcccaaagcatgtacagttcttttaaggggtgccagcaaggacctcttgaatgaagtggaaaggaatcttcaggatgcaatgtctgtagcccgaaacatattaaagaatcctaagcttgttcctggtggtggtgcttctgagttaactgtatctgccactttgaagcagaagagttcttctattgaaggcattgaaaagtggccatatgaagctgcagcaattgcgttcgaagcaatcccacgaactcttgcacagaactgcggagttaacgtgatccggacaatgacagcgttgcagggcaagcatgcaaatggtgaaaacccctggattggaattgatgggaacactggtgccattgttgatatgcaagagaaaaagatctgggattcgtataacgtgaaagcacaaacgtttaaaacggctattgaggctgcttgcatgcttcttaggatagatgacatagttagtggaatcaagaagaagcaacccgcaggtgctggccaagctccaaagacccaagttatcgaggagggagatgcagataatgagaacataattccagagtaagaccatcatgtagggtattataacgtcgatagtctgcagagagctttttgctaccatagccatgggcggccccgtgagcttaatgagtttcttcgctaaattatgtcttcgggttggattttcgttttgtaagaaggggtttgctttacattttggatttaatgttcgtttttttcttgtgagcatggctttctcatcccacatcaagttcaccaagaggcgtaatgaaaatttagatgtcaggttcgaggatttcaatgaccatatctacatttttgttaacagacaacttgtaatcttttttggcgaaagtatttgtgccaaggtgggtagaacttcagttattagagttagctcttttcttttagatgacagtccacgcatctgcttggaaatgtttcgttatcttaatggtaaattgt

SEQ ID NO: 2601 - DNA, 1843 bp, Eutrema parvulum
aggattccctgaagcgtgaatctggaacaaaggttcaccatggtaatattcaggcttcaaaggctgtagctgatattatccgcaccacattgggtcctcgctctatgttaaagatgcttcttgatgctggtggaggaattgttgttaccaatgatggaaatgctattttgcgtgaactagatgttgctcaccctgcagctaagtcgatgattgagttgagccgcacacaggacgaagaagtcggtgatgggactacatctgttattgttcttgctggtgaaatgttgcatgttgccgaagcatttattgagaagagttaccatcccacagtcatctgccgagcttataataaggccctcgaggatgctatcgctgttcttgacaagattgccatgtcaatcgatgtcaatgaccgtgcaacagtactaggactagtcaagagctgcataggaacaaaattcactagccagtttggagatctaattgctgatttggctattgacgccaccactactgttggtgttgatcttggacaaggattgagggaggtggatattaaaaaatacatcaaggttgagaaggttcctggtggtcaattggaggactccaaggttctcaaaggagtcatgtttaacaaagacgtagttgctcctggtaaaatgaagagaaagattgtcaacccacggattattcttcttgactgtcctcttgagtacaagaaaggtgaaaaccaaaccaatgctgagttggttagagaagaagactgggaagtgctgctgaaactggaagaggagtacatcgagaacatctgcgtgcaaatactaaagttcaaacccgatttggtaattacagagaagggacttagtgacttggcctgtcactatttcagcaaagctggagttagtgcaatccgaaggttgagaaagacggacaacaatagaattgctaaggcatgtggagctgtgattgtgaacaggcctgacgaacttcaagagtctgatgttggtactggcgctggcttgtttgaggttaagaaaataggagacgatttctttgccttcattgttgattgcaaagaacccaaagcatgtactgtgctcttaagaggaccaagtaaagatcttctcaacgaagtggaaagaaatcttcaggatgccatgtctgtttcaagaaacatcattaagaacccaaagctggttcctggtggcggagccactgaattaaccgtttctgccactttaaaacagaagagtgcaacaattgaaggaatcgaaaagtggccttatgaagcagctgctatagcttttgaggctattccgcgtactctagctcagaactgtggagttaacgtgatcagaactatgacagcattgcaaggaaagcacgcaaatggtgagaatgcttggactggaatcgatggaaacaccggtgcaatagctgacatgaaagagagcaagatatgggatgcttacaatgtgaaggcgcaaacatttaagacagcgattgaagcggcgtgtatgcttctgaggattgatgatatagtgagtggtattaagaagaagcaagctcctggagctggaccttcaaagcctactattgagacagaaggagatgcagacaacgagcaaatacttcccgattagagattttgctcctaccaacataatcttttttttgtcttatgttcctattttagtttgaaatgtttgtgaaatttgacactccctccctttaatatcgtatgattttgcattttgacttggcgagaaaagatatcgaggggattggaagtgatgaatcttttgtcctctttcgaaaggaaaagcattaaaagacactgaag

SEQ ID NO: 2602 - DNA, 2059 bp, Actinidia deliciosa
  misc_feature (779)..(779): n is a, c, g, or t
  misc_feature (1770)..(1770): n is a, c, g, or t
  misc_feature (1773)..(1773): n is a, c, g, or t
  misc_feature (1785)..(1785): n is a, c, g, or t
  misc_feature (1788)..(1788): n is a, c, g, or t
  misc_feature (1794)..(1794): n is a, c, g, or t
  misc_feature (1800)..(1800): n is a, c, g, or t
  misc_feature (1807)..(1807): n is a, c, g, or t
  misc_feature (1813)..(1813): n is a, c, g, or t
  misc_feature (1841)..(1841): n is a, c, g, or t
aaagaactgagagctagagaagcactcgcacattttcatttcccgctcggactactcaactcgagcaaaccctaagcgaccgatcggttccgggttagggtttatcttcatctctcagtcatgcacgcaccagtagtcgtcctcaaggattctttgaatcgtgaatctggaagcagggtgcatcatgccaatatccaggcttcaaaggctgtggctgacataattcgcactaccttgggtccacgatccatgttgaagatgctacttgatgcggcgggaggtattgttgtaactaatgatggcaatgctatcctgcgagagttagatcttgctcatcccgctgctaagtccatgattgaattgagccgtacacaagatgaagaagtaggtgatgggacgacttctgttatcgttcttgctggtgagatgctccatgttgctgaagctttcattgacaagaaatatcatcctactgtgatttgtcgagcatacaataaagctcttgaggatgctcttgcagtccttgacaagattgctatgcctattgatgtgactgatcgtgtcacaatgttggggttggtgaagagttgtataggcacaaaattcaccagtcagtttggggatctaattgctgatttggcaattgatgctaccacaacagttggtgtggatcttggtcaaggactccgagaagttgacattaaaaagtatataaaggttgagaaagttcctggtggccagttggaggattccaaggttcttaaaggtgttatgttcancaaagatgttgttgcccctggcaaaatgagaagaaaaattgtcaacccccgcattattttacttgattgccctcttgagtataagaaaggagagaatcaaacaaatgcagagttggtcaaagaagaagactggggagttctactgaaaatggaggaagagtacattgagaatctttgtatgcaaatactgaagttcaaacctgacttagtcataactgaaaaagggcttagtgatctagcttgccattatttcagtaaagctggagtaagtgcaataaggagattgaggaaaacagacaacaatagaattgctaaagcatgtggagcagtcattgtaaacagaccagatgaacttcaagaatcagatgtaggaactggggccggactttttgaggttaagaaaatcggagatgagttctttgcgtttattgttgagtgcaaagaccctaaagcatgcacagttcttttacgaggagcgagtaaggatcttttaaatgaagttgaaagaaatttacaggatgctatgtctgtggcgaggaacatcataaagaatccaaaactgctccctggtggtggggctacagagttaactgtgtctgctactctgaagcagaaaagtcaatctattgaaggcatcgaaaagtggccttatgaagctgctgcaatagcttttgaggctataccacgaactcttgcgcagaattgtggggtcaatgttattaggactatgactgcgctgcagggaaagcatgcaaatggagaaaatgcatggactggaatagatggtaacactggcaaaatttcagacatgaatgaggcgaagatctgggatgcgtataatgtgaaagcacaaaccttcaagaccgccattgaggctgcttccatgcttcttagaattgatgatattgttagcggaatcaagaagaagcaagctccaggggcaagtaaaggtccatcaaagcctacaatcgatcaagaaggagatgctganggngagcaaattatnccngagtgnaaaatnccaggtnaactanccaaccagcggagtctttaagttgtatncaaggagcttattatagtcttaaaagtttatagtttggtgaaattttgatatttcacaaaaaaggtgacaaaagtcaccttttttgttggagcttctctgttaagttttggcgtgcatgctggccttttgaagtgattgtgttcgataaaacctgatttctttttgcccttattcttgaagaaaaagtttgatggtttcgcattggtaggaaaaaaaa

SEQ ID NO: 2603 - DNA, 1890 bp, Solanum phureja
cagaggattctatgaaacgtgagcaaggtggcaaggtacagcgggctaatatccaagcggcaaaggctgttgctgacattatccgcaccactttgggaccacgatccatgttaaaaatgctccttgatgctgctggaggaattgtagtaaccaatgatggaaatgcaattctccgtgagctagatcttgctcaccctgcagccaagtcaatgattgaactaagccgcacccaagatgaagaggtaggagatggaacaacatcagtaattgtccttgctggtgagatgctccatgttgcggaagcttttattgacaagaagtatcatcctacagtaatatgtagagcttacgctaaagctcttgaggatgctgttgccgtgcttgacaaaattgcaatgacagttgatgttgaagatcgtgaaacaatgttgggtctggtgaagagttgcatcggcacaaaatttactagtcaatttggggatttaattgcagatttagcaattgatgccacaagaatggttggtgtggaacttggccaagggttacgcgaggtggatatcaagaagtacatcaaggttgagaaggtgcctggtgggcagttggaagactctgtagtgcttaaaggagtaatgatgaacaaagatgtagttgcccctggcaaaatgaagagaaagattgtaaaccctcgcatcattctgcttgattgtcctctagagtacaagaaaggtgagaaccaaaccaatgcagagatccttagagaggaggattggactgtcctcttgaaaatggaagaagagtacattgagaacatatgcgcacagatacttaaattcaagccggacgtggttattactgaaaagggacttagtgatctggcatgccattatctgtgcaaggctggtgtcagtgcaatcagaaggctaaggaagacagacaataacagaattgctaaggcatgtggggcagttattgttaatagacctgatgagttgcaagaatctgatgttggtactggtgctggtctgtttgaggtgaaaaaaattggggatgagttctttacttttattgtcgattgcaaggatccgaaagcatgtactatacttttaaggggtgcgagcaaagatctactgaatgaagtagaaagaaatctacaggatgccatgtctgtcgctagaaacatcatcaagtgtcctaaactagttcccggtggtggtgcaacagagttaactgtatctgccatgttaaagcagaaaagttcatccgttgaaggcatagaaaagtggccgtatgaagctgctgcaattgcttttgaagctataccacgaactttggctcagaactgcggtgtgaatgtgattcgtactatgaccgctcttcaaggaaagcatgcaaatggcgagaatgcatggataggcattgacggaaacactggtgagattaccgacatgaaagagcggaagatatgggattcctatgcagtaaaagcacaggcctttaaaactgccattgaagctgcttgcctacttctgagaattgatgacattgtgagtggaataaagaagaagcaagcccctggagcaggaccatcgaaaccaaaaatagacgaagaaggtgatgcagacaatgaccagctaattccagaatgaacatgatactatgctgcagtggaatgcttctgcaattcagactgcatttgataaccacttggaagttttcgtctatatgacttcagtataggactgattgcttgaaatttttgtgcttgacatgtaacttctgctgtttttgactgctggcagttgttggttgtcaatatgtttgcgttgtatttgatttagattctgtttcagtttttggttttaaattaattttgatattgcgagtacgatg

SEQ ID NO: 2604 - DNA, 1845 bp, Brassica oleracea
  misc_feature (319)..(319): n is a, c, g, or t
  misc_feature (363)..(363): n is a, c, g, or t
  misc_feature (450)..(450): n is a, c, g, or t
  misc_feature (458)..(460): n is a, c, g, or t
  misc_feature (463)..(463): n is a, c, g, or t
  misc_feature (482)..(482): n is a, c, g, or t
  misc_feature (660)..(660): n is a, c, g, or t
  misc_feature (917)..(917): n is a, c, g, or t
tggcaccgtcgccgtcgctaagctcggaatcgccgtcaaaacgcttagatcctcgcagatatgaacgcccctgttctcgttctctaggattcgttgaagcgtgaatctggaacaaaggttcaccatggcaatatccaagcttccaaggctgtggttgacatcatccgtacaacattgggtcctcgctctatgttaaagatgcttcttgatgctggtggaggaattgttgttactaatgatgggaatgctattttgcgagagctagatgttgctcaccctgcagctaagtctatgattgagttgagtcgtactcaggacnaagaagttggtgatgggactacatctgttattgttcttgctggngaaatgttacatgttgccgaggcatttattgagaagagttaccatcccacagtcatctgccgtgcttataacaaggctcttgaggangctatcgnnnttnttgacaagattgccatgtnagtcgatgtcaatgaccgtgcaacagtactaggactagtaaaaagctgcataggcacaaaattcacaagccagtttggtgatctgattgctgatttggccattgatgccaccactactgttggtgttgatcttggacaaggcttgagagaggtggatataaaaaaatacatcaaggtngagaaggtccccggtggtcaattggaagactccaaggttctcaaaggagtcatgttcaacaaagacgtagtcgctcccggtaaaatgaagagaaagattgtcaacccacggatcattcttctcgactgtccccttgagtacaagaaaggtgaaaaccaaaccaacgctgagctggtcagagaagaggactgggaagttctgctgaagcttgaagaggagtacatcgagaacatctgcgtgcagatactaaagttcanacccgatttggtgatcacagagaagggacttagcgacttagcgtgtcactatttcagtaaagcgggggttagtgcaataaggaggctgagaaagacggacaacaacaggattgccaaggcctgtggagctgtgattgtgaacaggcctgatgagcttcaagagtctgatgttggtaccggcgctggcttgtttgaggttaagaagataggagacgatttctttgcctttgttgttgattgcaaagagcccaaagcgtgtactgttctcttgaggggaccaagtaaagatcttctcaatgaagtggagaggaatcttcaggatgccatgtctgtttcaagaaacatcatcaagaatccaaagcttgttcctggtggtggagccactgagttaaccgtctctgctactctaaaacagaagagtgcaaccattgaaggaatcgaaaagtggccttatgaagcagctgctatagcttttgaggctattccacgtactttagctcagaactgtggagttaacgtgatcagaactatgacagcactgcaaggaaagcatgcaaatggtgagaatgcttggactggaatcgatggaaacactggtgcaatagctgacatgaaagagagcaagatatgggatgcttacaatgtgaaggcgcaaacgtttaagacagcgattgaagcagcgtgtatgctactgaggattgatgatatagtgagtggtatcaagaagaagcaagctcctggagctggaccttcaaagcctaccattgagactgaaggagacgcagacaacgagcaaatacttcccgactagaaaattgtgctctcaccaacttcatcttgttcctttttttggtcttgttttgctattttagtttggaatgtttttggaacttgacagtctctttagtatcttgttgttttgcatttt

SEQ ID NO: 2605 - DNA, 1870 bp, Vinca minor
acgattctttaaagcgtgaatccggaaataaagtgcattatggaaacattcaagcatcaaaggctgttgcagacattattcggactacactgggtccacgatcaatgttgaagatgcttcttgatgctgctgggggaattgtagtgactaatgacggaaatgctatcctgcgagagttggaccttgctcatccagcagcaaagtccatgattgaacttagtcgtactcaagatgaggaggttggagatggaactacatctgtcattattcttgcgggtgagatgctccatgttgcagaggccttcattggcaggaattatcatcccacagtaatttgtagagcttacaataaagctctagaggatgctattgcagtgctggacaagatttcaatgagcattgatgtgaaggatcgtgcggctacgttagaccttgtaaagagctgtataggcacaaaatttacaagtcaatttggagatcttattgctgatttagccattgatgctacatcaacagttggtgtggaactggaaccaagcttgcgtgaagtagatatcaagaagtacattaaggttgagaaggttcctggtggacaattggaagattcaaaggttcttaaaggagttatgattaacaaagatgtagtagctccaggtaaaatgaggagaaggatagtaaatccacgtattgttctccttgattgtcccctggagtacaagaagggtgagaaccagaccaatgcagaattgatgagagaagaagattggagtgtactgttgaaaatggaagaagaatacattgataacctttgtgctcagatattgaagttcaaaccagatttagtcataacagaaaagggactaagcgaccttgcgtgtcattacctgagcaaagctggtgtctctgccatcaggaggatacgaaagacggataacaacagagttgctaaggcatgtggggcagttattgtcaacaggcctgatgaattacaggaatctgatgttgggactagagctggtctatttgaagtgaggaaaattggcgatgagttcttttcattcattgttgattgcaatgatccaaaagcttgtacagtactcttgaggggtgccagcaaagatctattgaatgaagtagagcgaaatttacaggatgccatgtctgtagcaagaaacattatcaagaatccaaaacttgttcctggtggtggcgcaacagagttgacggtatctgcaatgttgaagcaaaagagctcttctgttgaaggcatagaaaagtggccttatgaagcggcagcaatcgcttttgaggctatcccgcgaactttagctcaaaattgtggagtcaatgttattaggactatgacagccttgcaaggaaagcacgcaaatggagaaaatgcatggattggcatcgatgggaatactggagaaattactgatatgaaagagagaaagatatgggactcatatactgtgaaggcacaggcattcaaaactgccatagaagctgcttgcatgcttctgagaattgatgacattgtaagtggaataaagaagaagcaggctcctggagccggatcagcttcatcgaagcctacagttaatgaagaaggtgaagcagataatgaagccttaattcctgaatgaggaggaaacacataaagtaaaactgaaatttttaacttgtcaagttttattggtatatggagttttgccgttgcagttttatttttctgcatttgtcctgtaattttttgagaacagtcattttgtgcatttctaggtccgtctcctattcacccctgcccataccctaattactgagagcttaatgtagttatgttattgtggttgtatttgtagaccgt

SEQ ID NO: 2606 - DNA, 2264 bp, Secale cereale
cacttgaaagcccaaaccgagcaaaccctcgagctcgaaagatcgcgcggcgcagcagcatccgccttcccattctcttctccctcctcccacctcgccgccgcctccccgtcgtctcgtctctcgccagatcgccatggcattgcacgccccgtcctcgtgctgaaggactcgttgaagagggagtcgggcgcgaaggttcagcatggcaacatccaggccgcgaaggctgtgtcagacatcattcgcactacgctcggtcctaggtccatgttgaagatgcttctggatgccagtggaggtattgtggttactaacgatggcaatgctatattgcgggaactagacattgcacatcctgctgctaagtctatgattgagctaagtcgcacacaggatgaagaagtgggagatgggacaacgtctgtcattgttctagctggtgagatgctccatgttgcagaaacatttattgaaaagaactaccatcccaccgtcatttgcagagcatacagcagagctcttgaggatgcaatagctgtccttgacaaaattgcaatgcctgttgatgtcaatgaccgtgaggcgatgctagggctggtgaagagctccattggtacaaaattcactggccagtttggtgacctaattgctgaccttgccatagatgctactacaacagcaggcgtagacctgggtcaaggaatgcgtgaagttgatatcaagaaatacatcaaaatagagaagattcctggtggccagttggaggattcaaaggttcttaaaggggtcatgttcaataaagatgttgtggctcctggaaaaatgaaaaggaagatagtaaatccacgtatcatccttttggattgccctgttgagtacaaaaagggggagaatcagacaaatgctgagttgatgagtgaagaagattggaaggttctgctagatatggaggaagaatacataaagaacctctgtgtgcaaattttgaaattcaagcctgacctggttatcacagagaaaggactcagtgacatggctatgcactatttaagcaaggctggtgttagtgcaatccgtagacttaggaagacagataacaacaggattgctaaagcctgtggcgcagttatagttaacaggccagaggagcttcaagaatcagatgtggggacacgagctggtctctttgaggttaagaagatcggtgatgaattcttttccttcattattgaatgcaaagatcctaaagcatgcactgttctattgaggggagcaagcaaggacatcctgaacgaggtggagaggaaccttcaggatgccatgtctgttgcaaggaacattttgaaaaacccaaaacttctacctggaggtggtgcttctgaattgactgtatcagcaacactaaagcaaaagagttcttcagttgaaggtgtagaaaagtggccttatgaagctgctgctttagcattcgaagcaatcccaagaactttgcttcaaaattgtggtttgaatgttattaggacgatgacacagctccagggaaagcatgcgaacggtgaaaatccttgggttggcgttgatggaaggactggtgatattgttgacatgaaagagcggaagatctgggattcttacagcgtgaaggcacagaccttcaagacagctatcgagtcagcttgcatgcttctaaggattgacgatattgtcagtggaatcaagaagaagcaggctcctgggtctggtgctcccaagcaaccccagattgaaacgggagaagatgctgacactgagcagatgatcccggagtagaactatttgtgctgctggattgagcccgtaccggcgatgttatctaccgaagctagaacagtgcccctgcagagcagaatgttttatgaacacgtgaagtggcgtcgcctggttgcatttcttgaatgtttgatggtggccaggcctccagggtcgtctagtgttagttttggattgcactactagttttttcttatgttcggatgacgaggggtgtgtgtatttgtatcagcgttttggatctgactattgcatggatggttgctgttggtttttttgtttttggactttgtgctgagcggatatcagaatctggatttaacagcaaaactagctttgtgacgtacttttagttttttcttttatttaattaatatagcaagacgatgccagtttactaaaaactaaaaaaaaaaaaaaaaaacaaaaaaaaaaaaaacaaaaaaaaaaaa

SEQ ID NO: 2607 - DNA, 1967 bp, Aquilegia formosa
aagattcattgacgcgggagtctggaagtaaagttcaccatggaaacattcaagcttcaaaggcagtggctgatattattcgtactactttgggacctcgttccatgttgaagatgcttcttgatgctgcaggaggaattgtggtcactaatgatggaaatgctatactgcgtgagttggatattgcacacccagcagccaaggcatgatttaattccatgattgagctaagccgtacacaagatgaagaagtaggagatggtacaacatccgtcatagttcttgctggtgagatgcttcatgtagcagaagccttcatcaacaagcgctatcatcctacagttatatgccgagcatatagtaaagctctggaggattccatagaagttcttgacaaaattgcaatgcccattaatgtgaaagaacgtgctgaaatgctaggattggttaaaagttgcataggcacaaagtttactagccaatttggagatttgattgctaatctggcactagatgctactacaatagttggtgtggaccatggtcatggattgcgagaagtcgacataaaaaagtatataaaagttgagaaagtcccaggcggtcagttggaggattcaaaagtgctaaaaggagttatgtttaacaaagatgttgtagcaccaggcaaaatgaggagaaagatacttaatccacgtattattcttcttgatagtcccatcgaatacaaaaagggagaaaaccaaacaaacgcagagttggttaaagaagaagattggggggttttgcttaaattggaagaagaatacattgaaaacctttgcgtgcagatcctaaagttcaaacctgatgtggtgattacagaaaaaggtcttagtgatctggcatgccactactttagtaaggctggagttagtgcaattagaaggttaaggaagacggataataatagaattgccagggcatgtggtgcagttgtggtgaacagacccgaggaactgcaagaaagtgatgttggaaaaggggctggactatttgaggtcaagaagattggagacgagttctttgcatttattgttgactgcgaagctccaaaagcatgtaccgttttgttaagaggtgccagcaaggatctcttaaatgaagtggaaagaaatttgcaggatgctatgtctgttgcaagaaacattattaagaatccaaaacttgttcctggtggtggtgctactgagttaactgtatctgcaacattgaagcagaagagttcatcaattgaaggaattgaaaagtggccatatgaagctgctgctttagcttttgaggctattccaaggacattggcacaaaactgtggtgtaaatgtaattcgaaccatgactgctttgcaaggaaagcatgcaaatggtgaaaatgcatgggtcggcattgatggaaacactggagtgatagctgatatgaaagaacggaagatttgggattcttatagtgttaaggcacagacatttaagacagctattgaagctgcttgcatgcttttaaggattgatgacattgtgagtggaataaaaaagaagcaagctccaggagctggtccatctaagcctcaaattgagacaggagaagatgcagacaatgaacaaatgatcccagaatgagtgttggctatgtgggcatcagtttgttgttttgcatcgagaagagtgcaggttggtacattttgtgtaccagcagcttagggcgtactgagtgatttggttccattttgcagttttgttcacttggctgatcttttttttcacctttgattgtttcagaaattactagtaccttttgatattagtttaacatgtagttaaaaagattatgcaatagactctagtatggtgattctttttcatttcagaactttagaattttgtaatgtacattgttttggccttccccatgtcaaatgcctgtataagaac

SEQ ID NO: 2608 - DNA, 2496 bp, Abies balsamea
cgagggttttagtggctctggttcgaatcgcgtatcgttgaagggttctgtcaagtacagttttgggttataacacccagctacccttgaagcttacattattctccgcttgttaacgggagcattttcaaatttgacggcgatttggcggttttttgtctagtctacctttttttccctcgacggactgttagcggccataacttgcagaaatgcatgctccagttctcgttctgaatgatgctgtaaagcgggagactggaaatagggtgcaccatgcaaatattcaagcatcaaaggctgttgcagatattattcgaaccacattaggtccccgatctatgttgaagatgctacttgatgcatcaggaggcattgtggttacaaatgatggtaatgctatcttgcgcgagttggatttggcacatccagctgcaaagtctatgatcgaattaagtcgcactcaggatgaggaagtaggtgatggaacaacatctgtgattgtgctagctggtgagatgctgcatgtagctgaagccttcatcgataaggcttttcatcctactgtaatttgtagagcctacagtaaagctcttgaggatgctattgctgttcttgacaagatcgcaattcctattgatgtgaatgaccgcccaacattgttgaaaatggttaaaagctgtattggcacaaaatttactggccaatttggagacctcattgcggatatggcaattgatgcaaccactactgtgggtgttgacattgggaatgggttgcgtgaagttgatataaagaagtatgttaaagttgagaaggttcctggaggccagttagaagattctaaggttctcaagggtgttatgtttaacaaagatgttgtagcacctggtaaaatgaggagaaaaattgtcaatcctcgaatcattcttttggactgcccgcttgagtacaaaaagggagagaacatgacaaatgcagaattaattagggaagaggactggggtcttcttttgaaaatggaagaagagtatattgaaaagatctgtatgcaaattttatgtttcaagccagatttagtaatcactgaaaaggggcttagtgatcttgctgctcactacttgagtaaagcaggagttagtgcaatcagaagactaaggaaaacagataacaatagaattgctaaagcttgtggagctacagttgtaaacagaccagaggaactgcaagaaagtgacgttggaaccggggcaggattgtttgaggtcaaaagattggggatgagtattttacttatattgttgagtgcaaggatccaaaagcttgcacagttcttctgagaggtgccagcaaagacctattgaatgaggttgaacggaatttgcaggatgccatgtctgtagcccgaaacatgatcaagaatccaaaacttgttccaggtggtggagcaacagaacttacagtatcggcgactttgaaacaaaagagttcatcagttgagggcatagacaagtggccttatgaagctgtggctttagcttttgaggcaattccaagaacactggcccagaattgtggcgtgaatgtcattagaaccatgaccgcattgcaagcaaagcatgccaatggggaaaatgtatggactgggatagatggcaacacaggagcaatcactgacatgaaagagcgtgggatatgggatgcttataatgtgaaggcccaaaccttcaaaacagccatcgaggcagcctgcatgcttcttagaatcgatgacattgtaagtggaataaagaagaaacaagctccaggtggttcagcgccagcaaaacctcaagtagaggatgaaaaggacgttgacagtgagcagatgattccagaataatgagttatctgtttacaattaagtcaagcttggtaattcaagtaatgttcattatgctttggatgatgctgcttctgtcgagagtagacacacttattaatgaatttaagtggcatatccaagaaattcgttttggaatgatgaatgccaatgaggggaaaggaggggttgggtgattttgtgagtacgttgcaatttttcaaggggttttgttctctaattttgacttgcagatgggcggtaagcatgcattcattttaaactgtaactcattatagtcgaaagaataattgcagtatctgggttattgctgctctcttttctcagaacatggattatttttgcactgcgtttaacatttttgcccatagaaaagccagaataaactctgaacaatctgtttctagttttttggaatgggtttatagaatctgatgtcaagaatttgaacgaaacaaaaaaaaaaaaaaaaaattacctgatgtgattgtattgaatcatttcttggatctcagcagaaatacggatggatagaaattgcaactgcaatggctgttccagtagaggagctatgcgaagagggtggaagagatgaccagattacattgatacag

SEQ ID NO: 2609 - DNA, 1743 bp, Ambrosia trifida
ggaacaaacactctgcaacaactgatccattacactctcatctctttcagctatgcagtcaccggttctcgttctcaaggattcgcttactcgtgaatctggaagtaaggttcatcatgctaatatccaagcttcaaaggccgtggctgatattattcgaaccactttgggtccaaggtccatgttaaagatgcttctagacgcgcaaggaggaattgtggtcactaatgatgggaatgccattttgcgggagttggatattgctcacccagctgcaaagtccatgattgaactaagccgcacacaggacgaggaagttggtgatggaaccacatcagtcattgttcttgctggtgagatgcttcatgttgcagaagctttcattgacaagaagtatcatcctacagttatttgccgagcttacaacaaggctcttgaagatgctcttgctgtgttggaccaaatctccatgtctattgatgtgaatgaccgttcaatgatgttgggtttggtgaagagttgtattggcacaaaatttaccagtcagtttggggatttgattgcagatctagcacttgatgcaacaactacagttggtgtggatctaggacaaggaataagagaagtggatattaaaaaatatattaaggttgagaaaatccctggtggccaattagaagattctaaagtcctaaaaggtgttatgttcaacaaagacgttgtcgtccctgggaaaatgaaacgaaaaatcataaacccccgtatcattttactagattgccctttggagtacaaaaagggtgagaatcaaacaaatgctgagttagttagagaagaagattgggcagtactcctaaaaatggaagaagaatacatagaaaacctctgtgtgcaaatacttaagttcaagccagatttggtgatcactgaaaaggggcttagtgacttagcatgccattatttcagtaaagctggagttagtgctattaggagattgaggaaaacagataataataggattgctaaagcatgtggggctgttattgtgaatcggcctgatgaacttcaagaatcagatatcgggactggggctgggctttttgaggtcaaaaagattggtgatgaatttttttcatttattgtggattgtaaagacccaaaagcgtgcacggttcttctccgaggtgccagcaaagatcttttgaatgaagttgaacggaacttgcaggatgcaatgtcagttgcaaggaacatcctaaagcatccaaaacttgttcctggtggtggtgcaactgagttaactgtttctgctacactgaagcagaagagctcatcaatagaaggcattgagaagtggccttatgaagccgcagctgtagcattcgaggctataccacgaacattggctcagaactgtggtgtcaatgtcattagaactatgactgctcttcaagggaagcatgcaaacggtgagaatgcctggacaggtatagatgggaattcaggtgaaattgctgatatgaaagaactgaagatttgggatgcttataacgtgaaggcacagacctttaagacagccattgaggctgcttgtatgcttctaagaatcgatgatatcgtgagtggaatcaaaaagaggcaagctcctggatctaatcaaccatcaaaacccactaattgaagactaggaagggatgaccgacaacgagcagatgattccggatgaaagaaagcaattaatac

SEQ ID NO: 2610 - DNA, 2271 bp, Pseudotsuga menziesii
cttctaatacctagctatgctgtgattattttcaacttgttgacggaagcattttcgaatccgcggtgatttagcggctttgggtacagtttactgtttctacctcgacggactgttagcggccgtcatttgcagccatgcatgctccggttctcgttctgaatgacgctgtaaagcgggagactggtaatagggtgcaccatggaaatattcaagcatcaaaggctgttgcagatattattcgaaccacgttaggcccccgttctatgttgaagatgctacttgatgcatcaggaggtattgtggttacaaatgatggtaatgctattttgcgagagttggatttggcacatccagctgcgaagtctatgattgaattaagtcgcactcaggatgaggaagtaggtgatggaacaacatctgtgattgtgctagctggtgagatgctgcatgtagctgaagccttcattgacaaggcttttcatcctactgtaatttgcagagcctacagtaaagctcttgaggatgctattgctgttcttgacaagattgctattcctattgatgtgaatgaccgcccaacaatgttgaaaatggttaaaagttgtattggcacaaaatttactggccaatttggagacctcattgcggatatggcaattgatgcaactactactgtgggtgttgatcttgggaatgggttacgtgaagttgatataaagaagtatattaaagttgagaaggttcctggaggacagttagaagattcaaaggttctcaggggtgttatgtttaacaaagatgtggtagcacctggtaaaatgagaagaaaaattgtcaatcctcgaatcattcttttggactgtccactggagtacaaaaagggagagaacatgacaaatgcagaattaattagagaagaggactggggtgttctattgaagatggaagaggattatattgaaaaaatatgtatgcaaattttatgttacaagccagatttagtaatcactgaaaaggggcttagtgatcttgctgctcactacttgagtaaagcaggagttagtgcaatcagaagactaaggaaaacggataacaatagaattgctaaagcttgtggagctacagttgtaaacagaccagaggaactgcaagaaagcgatgttggaactggggcaggattgtttgaggtccaaaagattggggatgagtattttacttatattgttgagtgtaaggatccaaaagcttgcacagttcttttgagaggtgccagcaaagacctattaaatgaggttgaacgaaatttgcaggatgccatgtctgtagcccgaaacatgatcaagaatccaaagcttgttccaggtggtggtgcaacagaacttactgtatcagcaactttgaaacaaaagagctcatccgttgagggcatagacaagtggccttatgaagctgtggccttagcttttgaggcaattccaagaactttggctcagaattgtggcgtgaatgtcattagaaccatgacagcattgcaagcaaagcacgccaatggggaaaatgtatggactgggatagacgggaacacaggagcaataaccgacatgaaagagcgtgggatatgggatgcttataatgttaaggcccaaaccttcaaaacagcaattgaggcagcgtgcatgcttcttagaattgatgacattgtaagtggaataaagaagaaacaagctccaggcggttcggcatcagcaaaacctcaagtggaggatgaaaaggacgttgacagtgagcagatgattccggaataatgggattatctttttacaattaagtcaagcttgtcaactccatcaatgttcattatgctttggatgatgatgcttctgttgaagagtaaccacacatattaatgaattcaagtggcatgttcaagtaattcgttttggaatgatgaatgcgatgaggggaaagggagagggggtgtgtgtgactttgtgagtacattgcaaattttcaaggggttttgttctctaattttgacttgaagatgggtggtaagcatgcatttattttagactacaacttattatagtcgatagaataattgcagtttctagcctactgctgctgtcatttcatagaacatgaattatttttgcacagcgtttacagttttgcccatggaaaaaccagaatacattttaaacaatgtacttctagttttttgcaatgagttatagaatccgatgacaagaacttgacaaacaaaaa

SEQ ID NO: 2611 - DNA, 2156 bp, Fragaria vesca
gagagagccaggtttcttttccctttcggcgtttccctcgcaaagcctctgaaacctaccttcctcactctcattaggtctacacagatctcactcccaccatgcaatcccaagttctcgttctcaaggactctgtgaagagggagactgggagtaaagtgcaccatgctaatatccaggcctcaaaggctgttgctgacatcatccgtacaacgttgggacctcgatccatgttgaagatgctgctagatgccagtggaggtattgtagtaaccaatgatgggaatgccattctgcgtgaattggatcttgcgcacccagcagccaagtcaatgattgaattaagccgcacacaagatgaagaagtaggtgatggaacaacatccgtcattattctcgctggtgagatgctacatgtcgctgaaacttttattgaccagcattttcatcctactgtcatttgccgagcctacaataaagctctggaagatgctattgctgtacttgacaaaatagccatgaccattgacgtgacagatcgtgcaacaatgttggggctgattaaaagttgtattggtacaaagttcaccagccaattcggggatttaattgctgatttagcccttgatgcaactcgaatagttggagtggaccttgggcagggtttgcgagaagtggatattaaaaagtacatcaaggttgagaaggttcctggtggccagttggaagattcagtggttctgaaaggagtaatgatcaacaaagatgtcattgctcctggaaaaatgagaagaaagattgtcaatccgcggatcatgcttcttgattgtcctctggaatataagaaaggagagaaccaaacaaatgccgagttgcttaaagaagaagattgggggctcctactaaagttagaagaagaatacattgagggcctttgtgtgcagatattgaagttcaaaccagatgttgtgattacagaaaaggggcttagtgacctggcatgccattatctgagcaaggccggtgttactgcaatcaggaggttgagaaaaacagataataacagaattgccaaggcttgtggggcagttattgtcaacagaccagatgaattgcaggactctgatattggtactggggctgggttatttgaggttaaaaaaattggagatgagtactttacattcattgttgattgcaaagatcccaaagcatgtactgtactgttaagaggtcctagcaaggatatgttaaatgaagtggagagaaatttgcaggatgccatgtcagtagcaagaaatatcctgaagaatccaaaacttgttcctggtggtggtgcttcggagttgactgtttctgctacattgaagcaaaagagctcatccattgaaggtatagaaaagtggccatatgaagctgctgccttagcctttgaggccataccacgaacactggctcagaactgtggggttaatgtcattagaacgatgaccgcactgcaaggaaagcatgcaaatggtgaaaatgcatggattggcattgatggtaacactggtgccatgacagatgtaaaagagaaaaagatctgggatgcctacaatgtgaaggcacagacctttaagactgccatagaaagtgcctgcctacttctcagaattgatgacattgtgagtgggattaagaagaagcagcctgctggaagcaaaactccttcaaagcctcaggttgagactgaaggagatgcagataacgagcaaatcattcctgagtgaggatttccaatgttcaagtcttagtgcatcttgagtcgcttctccattcgactcgagtgaacattacgagtttaagagagatgttatgtaggttttgtaatgccctattactcgggtgcttgtgtgtctgttttttccttcatctctctttctctcggcgagggtttgggaaaagaatagaggttttgatggaaatgctaggaagtttgccttctcatctagctatggagtactttctttttctttagcttagatggaatgaggcatttagaagactgagttaccccagttgtgtagacatcgacttcagttcacttcattcttaactcacttatccgaagtattttgtcattgtgccttaacagcttatgggtttagagtttt

SEQ ID NO: 2612 - DNA, 2564 bp, Pinus pinaster
gttacacgagtgacatgattgagatcgactttaccgagagcttaaatctccaaaggtctctactttctcatttctttagtcgctcgcgagggttttagtagctctggttcgattcgcgtatcattgaaaagggttactgccgagtgctgcttcggcttctaataaccagaaataaccttgtagctatcattaatctcagttttgtagacgggagcattttcgaattcagctgtgattcggtggtttttgtccagtctagcgtttgttccctcgacggactgctagccgccttcacttgcagccatgcatgctcctgttcttgttttgaatgacgctataaagcgggagtctggaaatagggtgcaccatgcaaatattcaggcatcaaaggctgttgcagatattattcgaaccacattaggtccccgttctatgatgaagatgctactcgatgcaggaggaggcatcgtggttacaaatgatggtaatgctatcttgcgggagttggatttggcacatccagctgcaaagtcgatgattgaattaagtcgcactcaggatgaggaagtaggtgatggcacaacatctgtgattgtgctagctggtgagatgctgcatgtagctgaagccttcattgacaaggcttatcaccctactgtaatttgcagagcttacagtaaagctcttgaggatgctattgctgttcttgacaagattgctattcctattgatgtaaatgaccgccctacaatgttgaaaatggttaagagctgtattggcacaaaatttactggtcaatttggagacctcatcgcggatatggcaattgatgcaacaactaccgtgggtgttgatcttggtaatgggttgcatgaagttgatataaagaaatatgttaaagtagagaaggttcctggaggccagttggaagattcaaaggttctcaggggtgttatgattaacaaagatgttgtcgcacctagtaaaatgaggagaaaaattgtcaatcctcgaatcattcttttggactgtccgcttgagtacaaaaagggagagaacatgacaaatgcagaattaattagagaagaggactggggtgttttattgaagatggaagaggagtatattgaaaagatttgtgtgcaaattttatctttcaagccagatttagtagtcactgaaaaggggcttagtgatcttgctgctcactactttagtaaagcaggagttagtgcaatcagaagactaaggaaaacggataacaatagaattgctaaagcttccggagctacagttgtaaacagaccggaggaactgcaggaaagtgatgttggaactggggcaggattgtttgaggtccaaaagattggggacgagtattttacttttatagttgactgcaaggatccaaaagcttgcacagtccttctgagaggtgccagcaaagacctattaaatgaggttgaacggaatttgcaggatgccatgtcagtagcccgaaatatgatcaagaatccaaagcttgttccaggtggtggtgcaactgaactcacagtatcagcaactttgaaacaaaagagttcaacggttgagggcatagagaagtggccttatgaagccgtggctttagcttttgaggcaataccaagaactttggcccaaaattgtggtgtgaatgtcattagaacgatgacagcattgcaagcaaagcatgccaatggggaaaatgtgtggactgggatagatggcaacacaggagcaatcactgacatgaaagaacgcgggatatgggatgcgtataatgtgaaagcccaaaccttcaaaacagccattgaggcagcctgtatgcttcttagaattgatgacgttgtaagtggaataaagaagaagcaagctccaggcagttcaggaccaacaaaacctcaagtagaggatgaaaaggacgttgacagtgagcagatgattccagaataatgagatacctgtttacaattaagtcgcgcttgtcaattccagcaatgtttattatgctttggatgataatgcttctgtcaagatttgccacagttattaatgaattcaagtgcaagtacaaggtattcgttttggagtgataaatgtcaatgaggagaaagtcgggggtgaggggggcgtgtgtgattttgtgagtacattataaatttttacggggttctctctctaattttaacttgcagatggacggtaggcatgcatttatttcagactctaacttgttagagtcgaaagaataatttcaatatatctggcctactgctgctgtcatttcatagaacatgaattatttttgcacagcgtcaacgtttttgcccatggaaaaagcagaatgcactttaatcaatgtatttctagttttttgaatgagtttatagaatccgatgtcaagaatttgacaaacagtatggggtataaattgatgttcagattgtcatcacataattccattccacttggatcagctgtggcaagcatacgcccgtttaatactgatgtttttgaatgaaacatttttacccttgcagcaa

SEQ ID NO: 2613 - DNA, 2843 bp, Pinus taeda
cggccggggaaattaacatgaaatgccaaagggaaaagttacgcgagtgacatgatcgagaccgactttaccgagagcttaaatcttcgaaggtctctactttttcgcttctttagtcgctcgcgagggttttggtagctctggttcgaatcgcgtatcattgagaagggttgctgccgagtacagcttcggcttctagtaatcagagataaccttgtagctatcattaatctcagttttgtcgacgggagcattttcgaattcagctgtgattcggcagtttttgtccagtctaccgtttgttccatcgacggactgctagccgccttcacttgcagccatgcatgctcctgttctcgttttgaatgacgctataaagcgggagactggaaatagggtgcgccatgcaaatattcaagcatcaaaggctgttgcagatattattcgaaccacattaggtccccgttctatgatgaagatgctacttgatgcaggaggaggcatcgtggttacaaatgatggtaatgctatcttgcgggagttggatttggcacatccagctgcaaagtcaatgattgaattaagtcgcactcaagatgaggaagtaggtgatggcacaacatctgtgattgtgctagctggtgagatgctgcatgtagctgaagccttcattgacaaggcttatcaccctactgtaatttgcagagcttacagtaaagctcttgaggatgctattgctgttcttgacaagattgctattcctattgatgtaaatgaccgccctacaatgttgaaaatggttaagagctgtattggcacaaaatttactggtcaatttggagacctcatcgcggatatggcaattgatgcaacaactaccgtgggtgttgatcttgggaatgggttgcatgaagttgatataaagaaatatattaaagtagagaaggttcctggaggccagttggaagattcaaaggttctcaggggtgttatgattaacaaagatgttgtcgcacctagtaaaatgaggagaaaaattgtcaatcctcgaatcattcttttggactgtccgcttgagtacaaaaagggagagaacatgacaaatgcagaattaattagagaggaggactggggtgttttattgaagatggaagaggagtatattgaaaagatttgtgtgcaaattttatctttcaagccagatttagtagtcactgaaaaggggcttagtgatcttgctgctcactactttagtaaagcaggagttagcgcaatcagaagactaaggaaaacggataacaatagaattgctaaagcttccggagctacagttgtaaacagaccggaggaactgcaggaaagtgatgttggaactggggcaggattgtttgaggtccaaaagattggtgacgagtattttacttttatagttgactgcaaggatccaaaagcttgcacagttcttctgagaggtgccagcaaagacctattaaatgaggttgaacggaatttgcaggatgccatgtctgtagcccgaaatatgatcaagaatccaaagcttgttccaggtggtggtgcaactgaactcacagtatcagcaactttgaaacagaagagttcaacggttgagggcatagagaagtggccttatgaagccgtggctttagcttttgaggcaattccaagaactttggcccaaaattgtggtgtgaatgtcattagaacgatgacagcgttgcaagcaaagcatgccaatggggaaaatgtgtggactgggatagatggcaacacaggagcaatcactgacatgaaagaacgcgggatatgggatgcgtataatgtgaaagcccaaaccttcaaaacagccattgaggcagcctgtatgcttcttagaattgatgacgttgtaagtggaataaagaagaagcaagctccaggcagttcaggaccaacaaaacctcaagtagaggatgaaaaggacgttgacagtgagcagatgattccagaataatgagatacctgtttacaattaagtcacgcttgtcaattacagcaatgtttattatgctttggatgataatgcttgtgtcaagatttgccacagttattaatgaattcaagtgcaagtacaaggtattcgttttggagtgataaatgtcaacgaggagaaagtcgggggtgaggggggcgtgtgtgattttgtgagtaccttataaatttttacggggttctctctctacttttaacttgcagatggacggtaggcatgcatttatttcagactgtaacttgttagagtcgaaagaataattgcagtatatctggccgactgctgctgtcatttcatagaacatgaattatttttgaacagcgtcaacgtttttgcccatggaaaaagcggaatgcactttaatcaatgtatttctagttttttgaatgagtttatagaattcgatgtcaagaatttgacaaacagtatgggttataaattgatgttcagatcgtcatcacataattccattccacttggatcagctgtggcaagcatacgcctgttttattactgatgtttttgaatgaacattttactcttgcagcatcatatttactgccaaagtgattccattgttggtcaatgtaaatacgcgagtgtattgctattgttttgtcacagtactgggtccaatcaaagcttctatcgaaaatcgttagtatcatggatggttgcaggaaggctgctttgtatggtcaatagttcatgcacgaatgccagtagtaggtcttataaattgatgttcagatcgtcatcacataattccattccacttgagatcagttgtggc

SEQ ID NO: 2614 - DNA, 2254 bp, Gossypium raimondii
catttttcaaatctccccttcccaatttccccttataatcaacgcagagtacatgggggaagagagggttcattgttgtagtagggtttttcactgagaagaaactagaaacatagaaaccctttgcagatttgtttgttttcaacagttttaagctctaatactaacgaaatcgtaaatcatgcacgccccggttctcgttctaaaggattcgttgaaacgggagtctgggacgaaggttcaccatgctaacatccaagcctccaaggctgttgctgacattattcgaacaacattgggtcctcgatccatgttgaaaatgctccttgatgcttctggaggtattgttgttactaatgatggaaatgctatcctacgcgagttagatcttgcacatccagcagcaaagtcaatgattgaattgagccgtacccaagatgaagaagttggagatggaacaacatctgtcattgttcttgctggtgagatgcttcatgttgcagaagcctttattgagaaaaattatcatcctacggttatttgtcgagcatacaataaggctttggaggatgctattgccgtgcttgacaagattgcaatgtctattgatgtcaaagaccgtgccacaatgttgggacttgtgaagagctgtatagggacaaagttcactagccagtttggtgatctgattgccgatttggcaattgatgcaactcaaacagttggagttgaccttgggcaagggctgcgagaagttgatattaagaagtacattaaagtagagaaagtaccaggtggtcagttggaagattctaaggtactcaagggagtgatgatcaataaagatgtagttgcgcctggcaaaatgaagcgaaagattgtcaacccacgtattattcttcttgactgtccccttgagtataagaaaggggagaaccaaacaaatgccgagttggttaaggaagaagattgggaagttcttttgaaaatggaagaagaatacattgagagcctttgcttgcagattctgaaattcaaaccagacttggtggttacagaaaaaggacttagtgacttggcatgccattatcttagcaaggctggtgtcagtgcaattaggagggtgagaaagactgacaacaacagaatcgcaaaggcatctggagctgttattgtgaatcgtcctgacgaattgcaggaatccgatgttggtactggagctgggctatttgaggttaaaaaaatcggggatgagttctttgcattcattgttgattgcaaagatccaaaagcttgtacggttctcttaaggggtgctagcaaggatctcctgaacgaggttgaaagaaatttgcaggatgccatgtctgttgctagaaacataattaagaatccgaaacttgttcccggaggtggtgctacagaattaaccgtttctgccaccttgaagcagaagagttcatctgttgaaggcatagaaaagtggccgtatgaagctgctgctcttgcttttgaagccataccacgtactttggcacaaaattgtggagttaatgtgattcggaccatgactgctctgcaaggaaaggtatggatgcttctagagtgctgttatacacttttcaccataccctttacaatttccatttactgaaactgtgattgtagcatgcaaatggtgaaaatgcatggattggcatagatggcaacactggtgccattgctgacatgaaggaaagaaagatttgggacgcatacaatgtgaaggcgcaaacatttaagacagcgatagaagcagcatgcatgcttctacgaattgatgacattgtaagtgggattaagaagaagcaggctcctggagctggccaaggtccatcgaaacccaaggtcgagactgaagcagatgcggatggtgagcaaattcttcctgattgaagatactgaatcacttaaacacacccttcgctttcaaactgtttgatgagatgatgggtctgttttgttgaagatgttttaagggatttgttgagcatctttttgcttgtatttttgagaattttaatctgtggttggtgttagcttttaagtcgttatctttttactatttcatcctaatttaccttcaattccttaaatgcgtgaagttattaaatccgttattttaaagtattaagcataattagtttgttatttaagtgcttttattctaatatattataaaccctgaaatatatcaaatctggtatttcaaaaa

SEQ ID NO: 2615 - DNA, 1996 bp, Silene vulgaris
atcgttctcactttctcctctctacaattcctcggcagccatgaattctcgcacgatcgttctcaacgattctactaaacgtgaatctggtaccaaggtccatcatgctaacattcgtgctggaaagtctgtcgctgacattattcgcacaacgttgggtccacgttcaatgttaaagatgcttcttgatgcagctggaggcatagtcgtcactaatgatgggaatgctatcttgcgtgagttggatcttgctcacccagctgctaagtcaatgattgaactcagtcggactcaagatgaagaagttggagatggaactacctctgtaattattcttgcgggggagatgcttcacgttgccgaagatttcattgacaagaattatcacccaactgtcatatgcagagcctacaccaaagcccttgaagatgcagtggcagctcttgacaagattgcgatgtccattgacattaaggaccgagacacgattttggggctggttaagagctgtatcggcacaaagtttacgagccagtttggagacttgattgctgatttggcaattgatgctactgcaatggttggtgtggacttgggtcaagggctacgagaggtggatatcaagaagtatattaaagtcgagaaaataccaggtggccagttagaggattcacaggtgcttaggggagtgatgatcaataaggatattgttactccggggaaaatgaggcggaggattgttaatccgcgaatcattctccttgattgtcctcttgagtacaagaaaggtgaaaaccaaacaaatgctgagatattaagagaagaagattgggaaaccctactaagagtggaagaagagtacattcaggagatatgtgctcagatattgaagtttaagccagatgtggttattactgagaaagggcttagtgatttggcttctcattattttagcaaagctggtgtcagcgcaatcaggagattgaggaagaccgacaataatagaatagccaaggcatctggggctgtcattgtaaataggcctgatgaacttcaagaatccgatgttggaactggtgctggcctttttgaggtcaagaaaattggtgatgatttttttacctttatcgtggactgcgaagatccgaaagcttgtactgtgttattgaggggtgctagcaaggatcttttgaatgaagtggaaagaaatcttcaggatgcaatgtgtgtggcaagaaatattataaaaaatccaaaacttgttcctggaggaggcgctactgagctgactgtatctgcaaccttgaagcaaaagagcggatccattgaaggcatagaaaagtggccgtatgaagcagctgctttagcttttgaagctataccacgtacattagctcagaactgtggtgtcaatgtgattagaactatgaccgctttgcgaggaaagcatgcaaatggtgaaaatgcttgggtcggcattgatggaaactctggtgaaattgccgacatgaaagaaaagaagatttgggattcatacactgtcaaggctcaaacattcaaaaccgccattgaatcagcctgcatgcttctcagaatagatgatattgtaagtggaataaaaaagaagcaggctccaggagcaggtcctcaaaagccgcagattgaacaagccgatgatgctgacaatgaacaaatgattccggaatgagaactgtgagttataaggactgtaactgctagtttgtgcgtcaggcaagtatttgttatgttgccatgatcgccgctgagtgtgggctttctgaagctataattttggggtgatgctcatagaagggtcttttaactatcgagttgtgtttggtgaccgaatattctcattttatttctgtttgcatttgcctttatgtagcttagaaccgttggtaatgggattatagatgtagtaggccgttgtacgattagaatggatttttgtgtgatccataacctatttcaa

SEQ ID NO: 2616 - DNA, 2006 bp, Zostera marina
aaggttttgctcctccctccaccgtcgagccatcgccatcgcttcgtttcctccgaaaaggtgtctgtcggtgatcttctccggtaaattcacatagccacaaccttaagaagaagaacattgggcgaagattacactgatcgaattctccattgcaacaatgaatgctccggttgtcgtcttaagtgattcggtgacacgtgaatctggaagtaaggtgcaccatgctaatattcaagcttcaaaggctgtggctgatgtaatccgtactacccttggcccacgttctatgttgaagatgttgttggatgcttctggagggattgttgtgaccaatgatggaaatgctatacttcgtgaattggatgttgcccatccagctgcaaagtcaatgattgaactaagccgaactcaggatgaagaagtcggagatggtactacatcagtcataatccttgccggtgaattccttcatgttgcggaggccttcattaataaaaagtatcatcccacaattatttgccgagcctatgttaatgctcttgaagattccatttctgcccttgataaaattgcgatgtctattgatgtcaacgatcgtgcaactatgctagatttggttaaaagctgcattggtacaaagtttactagtcagtttggagatctaattgctgatctcgcacttgatgccaccaagattgttggtgttgatcttggacaaggtttgcgagaggtggatattaaaaagtatataaaggtagagaaaattcctggtggtcagttagaagattcaaaggttctcagaggtgttatgttcaacaaagatgttgtcgcaccaggaaaaatgagaaggaaaatattaagtccacgtattattcttcttgattgtcctcttgagtataagaaaggagaaaaccaaaccaatgcagagttgctcagggaagaagattggggagttttgttaaaaatggaagaggaatatattgagaacctgtgcatgcagatattgaagtttaaacctgacatagtaatcactgagaaagggcttagtgatcttgcctgtcattactttagtaaggctggtgttagtgccattagaagactaagaaagacagataacaaccggatagccaaagcttgtggggcggttgtcgtaaataggccagatgaacttcaacaaagtgacgttggaactggttgtggactttttgaagtgaagaaaattgctgatgagttttttgcttttattgttgaatgtaaggatccaaaagcatgtacagttctgttaagaggtgctagcaaggatcttttgaatgaggttgaaaggaatttacaggatgcgatgtctgtgtcaaggaacatattaaaaaatccgaagcttgttccaggcggcggtgctgcagaattaactgtatcagcagctctgaagcaaaaaagttcatcgattgaaggcattgaaaagtggccttatgaagctgctgcacttgcttttgaggctattcctcggaccttagctcaaaactgtggtgttaatgtaatccgcacgatgactgctcttcaaggaaagcacgcgaatggtgaaaattcatggattggtatcgatggaagtactggcgacatcgttgatatgagggagcggaagatctgggatgcatacaatgtcaaggcacagacatttaagactgccatcgaagctgcctgtatgattcttaggattgacgacattgttagtggaataaagaagcgtcaagctccaggaagcggtccaccaagtcaatcaaaaccgaagctggaagatgaaggtgatgctgacaacgagcaaatgattcctgagtaaaagagaataccaaacaaatccaaagtttttgttgttttattttagttcgtccacgatattttatgtttcatgattgttgattgaactccagtacaaacctgcgtgtatgtgtgtgtgtttatttgctttaaaagactgtctcccagaattaattaattactaattatct

SEQ ID NO: 2617 - DNA, 1978 bp, Helianthus annuus
tctctctctcagctccaaaagaaggcgaaggagaaaccctagacaccttcgagaactgatccctagggttcttacactctcgtatcacagctatgcaatcaccggttctcgttctcaaggattctctcactcgtgaatctggaagtaaggtgcatcatgcaaatatccaagcttcaaaggccgtggctgatattattcgaaccactttgggtccaaggtcgatgttaaagatgcttctagacgctcaaggaggaattgttgtcactaatgacgggaatgccatattgcgggagttggatattgctcaccctgctgcaaagtccatgattgaactaagccgcacacaggatgaggaagttggtgatggaactacatcagtcattgttcttgctggtgagatgcttcacgttgcagaagctttcattgacaagaagtatcatcctacagttatttgccgagcttacatcaaggctcttgaggatgctcttgctgtgttggacaaaatctccatgtctattgatgtgaatgaccgttcaatgatgctgggtttggtgaagagttgtatcggcacaaaatttaccagtcaatttggggatctgattgcagatctagcactcgacgcaacaactacagtcggtgtggacctaggccaaggaatacgagaagtggatattaaaaaatacattaaagtcgagaaaatccccggtggccaattagaagattccaaagtcctcaaaggcgttatgttcaacaaagacgtcgtcgtccccggaaaaatgaaacgaaaaatcataaacccgcgtatcatattactagattgccctttagaatacaaaaagggtgagaatcaaacaaacgccgaattagtacgagaagaagattgggcaatactcttaaaaatggaagaagaatacatagaaaacatatgcgtacaaatacttaaattcaagcctgatttggtgataaccgaaaaggggcttagtgatttagcgtgtcattatttcagtaaagcgggagttagcgcgattaggagattgaggaaaacggataataaccggattgcgaaagcgtgtggggcggttattgtgaatcggcccgatgaacttcaagaatcggatgttgggactggtgctgggctttttgaggttaaaaagattggtgatgagtttttttcgtttattgtggattgtaaagacccgaaagcgtgcacgattcttcttcgaggtgccagcaaggatcttttgaatgaagttgaacggaacttgcaggatgcaatgtcagttgctaggaacatcctaaagcatccgaaacttgttcccggtggtggtgcaactgagttaactgtttccgctacactgaagcagaagagctcgtcgatagaaggcattgagaagtggccttatgaagccgcagctgtagcgtttgaagctataccacgaacgttggcacagaactgtggtgtcaatgtcattagaaccatgactgctcttcaggggaagcatgcaaatggtgagaatgcctggacgggtatagatggtaattcaggtgaaatcgctgatatgaaagaactaaagatttgggatgcttataacgtgaaggcgcagacctttaagaccgccatcgaggctgcttctatgcttttaagaatcgatgatattgtgagtggaatcaaaaagaaggcaagctcctggatctaaccaaccatcaaaacccactattgagaccgaaggggatgctgataacgagcagatgattcccgagtgatgaaacattttaatgtagtttcattaaacacgttttctcttgattcatttttaatttcttatgtgctttcattattaccactcgactgcccgaaattttggtccgttatgctatgttttgtttcttctcttttgaccattttttcattcctagtatgtgctgtttgttttgtactattgacattgtatattagttaagaggtagcagtgtgtat

SEQ ID NO: 2618 - DNA, 2032 bp, Zostera marina
aaggttttgctcctccctccaccgtcgagccatcgccatcgcttcgtttcctccgaaaaggtgtctgtcggtgatcttctccggtaaattcacatagccacaaccttaagaagaagaatatccatcgaaggtcacaccgatagacttttccattgcaaccatgcaagctccggttgtcgttctaagcgattcggtgacacgcgaatccggaagtaaggtgcatcatgctaatattcaagcttcgaaggctgtggctgatgtaatccgtactacccttggacctcgttctatgctgaaaatgttgttggatgcttctggagggattgttgtgaccaatgatgggaatgctatacttcgtgaattggatgttgctcatccagctgcaaagtcaatgatagaactaagccggactcaggatgaagaagtaggagatggtacaacatcagtcataattcttgctggtgaattccttcacgttgcagaagccttcataacaaaaagtatcaccccacattatttgccgagcctacattaatgctctgaggattctatttccgcccttgacaaaattgcgataaccattgatgtcaatgatcgcacaactatgctagatttggttaagagctgcattgggacaaagtttacaagtcagtttggaaacctaatcgcagatcttgcacttgatgctaccaagattgttggtgttgatcttgggcaaggtttgcgagaggtggatattaaaaagtacataaaggtagagaaaattcctggtggtcagttagaagattcaaaggttcttagaggagttatgtttaacaaagatgttgttgcaccagggaaaatgagaaggaagatattaaatccacgcattattctcctcgactgtcctcttgagtataagaaaggagaaaaccaaaccaatgcagaattgcttaaggaagaagattggggagttttattaaaaatggaagaggaatatatcgaaaacctatgcatgcagatattgaagtttaaacctgatattgtagtcactgaaaaagggctcagcgaccttgcttgtcattattttagcaaggctggtgttagtgccatcagaagattgagaaagacagataacaaccggattgccaaagcttgtggagcaattgttgtaaataggccagacgaacttcaagaaagtgatgttggaactggttgcggactttttgaagtgaagaaaattgccgatgagttttttgcttttatcgttgaatgtaaggatccaaaagcatgcacagttctgttaagaggtgcaagcaaagatcttttgaatgaggttgaaaggaatttacaggatgcaatgtctgtgtcaaggaacatattaaaaaatccaaagcttgttccaggcggtggtgctgcagaattaactgtgtcagcagcactgaagcaaaaaagttctttgattgagggcattgaaaagtggccttacgaagctgctgcacttgcttttgaggctattccccggaccttagctcaaaattgtggtgttaatgtcatccgtactatgactgctctgcaaggaaagcacgcaaatggtgaaaattcatgggttggtatcgatgggaatactggcgccattgttgatatgagggagcgcaagatttgggatgcatacaatgtgaaggtacagacatttaaaactgccatcgaagctgcatgtatgattcttaggattgacgacattgtgagtggaatcaagaagagacaagctccaggaagcgggccaccaagtcaatcaaaaccgaaggtggaggaagaaggtgatgctgacaatgagcaaatgattcctgagtagagagaaataaatctaaagtttttgtggttttattttattttgttcacgaagaagatatatatttcatgagtattgaagtttttctatgtttttttgttattgaactcccgtcggaattcgatctgtgtcgtgtcacgtggccttgtgtagttgcgtgtcctcgttaactctttttaataatatttattaataattttt

SEQ ID NO: 2619 - DNA, 1720 bp, Arabidopsis lyrata
atgaccgcaccagttcttgttctcaaggattcattgaagcgtgaatctggaacaaaggttcaccatgctaatattcaggcttccaagtctgtgtctgatatcctacgcaccacattgggtcctagctctatgttaaagatgattcttgatgctggtggagggattgttgttactaatgatggaaatgctattttgcgtgaaattgatgttgctcaccctgcagctaagtcgatgattgagttgagtcgcacacaggacgaagaagtcggtgatgggactacatctgttattgttcttgctggtgaactgttacatgttgctgaatcatttcttgagaagagttaccattccacagtcatttgccaagcttattataaggctctcgaggatgccatggctgttcttgaatagattgccatgccaatcaatgtcaatgaccgtgcaacagtactaggattagtcaagagctgcatagcaacaaaattcactagcaaatttggagatcttattgctgatttggctattgatgccaccactactattggtgttgatcttggacaaggattgagggaggtggatattaaaaagtacattaaggttgagaaggttcctggtgggcagttggaggactccaaggttctcaaaggagtcatgtttaacaaagacgtagttgctccaggtaaaatgaagagaaagattgtcaacccgcagattattcttcttgactgccccctggagtacaagaaaggtgaaaaccaaaccaatgccgagttggttagagaagaggactgggaagtgctgttgaaattggaagaggagtacatcgagaacatctgcctgcaaatactaaagttcaagcccgatttagtaattacagagaaggggcttagtgacttggcctgtcactatttcagtaaagctggggttagtgcaatcagaaggttgagaaaaacggacaacaacagaattgcaaaggcttgtggagctgtgattgtcaataggcctgatgaacttcaagagtctgatattggtaccaatgttggcttgtttgaggtcaagaaaataggagatgatttctttgcctttattgttgattgcaaagaacccaaagcatgtaccgtactcttaagaggaccaagtaaagatctcctcaacgaagtggaaagaaatcttcaggatgcaatgtctgtttcaagaaacatcatcaagaacccaaagcttgttcctggcggtggagccacagaactaactgtttctgccactttaaaacagaaaagtgcaacaattgaaggaatcgaaaagtggccttatgaagcagctgctatagcttttgaggtcattccacgtactctagctcagaactgtggagttaacgtgatcagaactatgacaacattgcaaggaaaacatgcaaatggtgagaatgcttggactggaatcgacggggttactggtgcaatagctgacatgaaagagaaaaagatatgggatgcgtacaatgtgaagtcgcaaacatatgctaataagcgattgaagctgcgtgtatgcttctcaggattgatgatatagtgagtggtatcaagaagaagcaagctcctggagctggaccgacaaagcctaccattgagacagaaggagatgcagagaacgagcaaatacttcccgactagaaatattggtctcaccaacataatcttctctctttttttttttttttttt

SEQ ID NO: 2620 - DNA, 2069 bp, Lippia dulcis
gggttttccggagaagtgctttctttccctctttcgcctttgaatcgatctgcactcagctctcgtctcgctgacctagacgaatctcgtagtttcaaatcgaaagcagagatgcacgctccagtcctcgtcctttaaagattacattggaagcggggatctggaagcaaggtgcatcattgccaatatacaagcatccaaggctgttgcagatattatacgaactactttgggtccgcgatcaatgttgaagatgctgcttgatgctgctggaggaattgtagtgaccaatgatggtaatgctattctccgagaactggacgttgcgcatcctgcggcaaagtccatgattgaactaagcaggacccaggatgaggaagtaggagatgggacaacatcggtcattgttcttgctggtgaaatgctccatgttgctgaagccttcattgacaagaactatcatcccaccgtcatctgtcgagcttataataaagctctagaggatgctgttgctgtgctcgacaaaattgcaatgtctgttgacgtaaacgaccgtgcatcaatgttgggacttgtcaagagctgcattgggacaaaatttacgagtcaatttggggatcttatagctgacttagcgattgacgctactaccactgtgggtgttgaccttggccatggcttgcgtgaggttgacatcaaaaagtacattaagatagagaaagttcctggtggtcagttggaggactcgaaagtcttaaaaggagtgatgtttaacaaggatgtggtagctcctggtaaaatgagaagaaaaatagtgaatcccagaattattcttctagattgtcctctcgagtacaagaaaggtgagaaccagaccaatgccgaactgatggaggaggaagattggagtgtcttactgaaaatggaagaggaatacatagagaacttatgtatgcagatactgaagttcaaacctgacttagttatcactgagaaggggctcagtgatctggcttgccattatttcagcaaggctggtgttagtgctatcagaaggctgaggaagactgacaataatagaattgccaaggcttgtggggcagtaattgctaacagacctgatgaattgcaagaatctgatgttggcgttggtgctggactgtttgaggtgagaaaaattggagatgagttttttgcattcattgttgaatgcaaggatccaaaagcatgcacggttcttttgaggggtgccagcaaagacctgctgaatgaagtagagagaaacttacaggatgcgatgtctgtggcaagaactattattaaaaatccaaaacttgttcctggtggaggggctactgagctgactgtatcagctatgttaaaacagaagagttcttctgttgaaggcgtagagaagtggccttatgaagctgctgcaattgcatttgaggctataccaagaacgttggctcagaactgtggtgtcaatgtgattcgaactatgactgccttacaaggaaagcacgggaatggtgagaatgcatggattggcatagatgggaatactggtgacataactgacatgaaagagcgtaagatatgggattcatacagtgtgaaagcacaggcatttaagacagctattgaagctgcttgcatgcttttgagaattgatgatatagtgagtgggatcaagaagaaacaggcccctggagcaagtgctccatcaaaaccaactatcgataaggaagacgatgctgacaatgagaacatgattcctgaatgagggaccaaatgccagttttctccgatctgtaaatgaaattatcttttgcttctcagcccatattgattcttaaaaaatgcggcattttttctgtctttgttgcggttttggatagatgggggaacacattgtgtttctttccccgatcgagttgcaggtcgagattagtagtttctttttattgttggagattagtagtttcttacttatttttggagactttagtgtttactgaactttgattgtgtttattgtgatcttcctgatgtttgtctcaaaaaaa

SEQ ID NO: 2621 - DNA, 1956 bp, Podocarpus macrophillus
gaacaagtgcagtggtagtaatcggaatctgcaacaatgcatgcgccggttcttgttttgaatgaaggggttaagcgggaaactggaaataaggttcatcatgcaaatatccaagcatcaaaggctgttgcagatattattcgaactactttaggtcctcgttccatgttgaaaatgctcctcaatgcagaaggaggcattgtggttacaaatgatggtaattctatcttgagagagttggatgtggcacatccagctgcaaagtctatgattgaattaagtcgcactcaagatgaggaagtaggtgatggaactacctctgttattgtgctagctggggagatgttgcacgtagcagaagcttttattgacaaagggtaccatcctacagtgatttgcagagcatacagtaaagctcttgaggatgctattgctgtgcttgacaagattgccattcctattgatgtgaatgaccgtgcatcactgttgaaaatggtcaaaagttgtattggtacaaaatttactggccagtttggcaatcttattgcggatctggcaattgatgcaacaacaactgtgagtattgatattggaaatggtttgcatgaggttgatattaagaaatatgtcaaggttgaaaaggttcctgggggcgagctggaagattgcaaggttctcaagggtgttatgattaacaaagatattgttgcacctggtaagatgaggaggaaaatcataaatcctcggattattcttctggattgccctcttgagtacaagaagggagagaacatgacaaatgcagagttgataaaagaagaggactggggtgtccttttgaaaatggaagaagagtacattgaaaagatgtgttctaccatattgagcttcaagccagatttagtcatcactgaaaaaggccttagtgatcttgctgctcattacttaagcaaaggaggagtcagtgcaatccgaaggctaaggaaaacagataataatagaattgccaaggcttgtggagcaacaattgtaaacagaccagatgaattgcaagagagtgatgttggaactggagcaggattgtttgaagttcaaaagattggggatgaatattttacttttattgtagagtgtaaggatccaaaagcttgcacagttcttttaagaggtgcaagcaaagatttgttgaatgaggttgagcgaaatctacaggatgcgatgtgtgttgcccgaaacatgattaagaatcctaagcttgttccaggaggtggtgcaactgaacttacagtatcggcaactttgaagcaaaagagttcatcggtagagggtatagaaaagtggccttacgaagctgtggcggtagcttttgaggcaattcctagaacattgactcagaattgtggtgtgaatgttgtcagaactatgacagcactacaagcaaaacatgctaatgcagaaaatgtatgggttggaattgatggtaacactggagaaattaccgacatgaaagaacgtgggatatgggatgcgtataatgttaaggcacagacttttaaaacagctattgaggcagcctgcatgctcctccgaattgatgacattgtgagtggaatcaagaacaaacaagctcaaggtggtcccaaaaaatcgaagcctcaagtagaggatggggaaaatgttgacagtgaacaaatgatcccagagtaatctttgaagatatctctgtatcgtttcttaaggtctgtacaatgataattcgtgaagtcccttggaaggcaataaatttagttggttttggaaggtcttagatttcatgttcaatatagagaatgaaaggttctgctgtgattttgcagcctaattttgaaatcgtctgataaatgtggtttatggtgattttgactttttccgacactctgtaggcattggtttctatttcactagtgtatgaaaaac

SEQ ID NO: 2622 - DNA, 2217 bp, Sciadopitys verticillata
gaaatctgcagccatgcatgccccggtcattgttcttaatgactctgtaaaacgagagactggaagtaaggtgcatcatgccaatattcaagcatcaaaggctgttgcagatattattcggaccactttaggtccccgatccatgttgaaaatgctccttgatgcgtcaggaggcattgtggttactaatgatggcaattcaattttgcgagagttggatgtggcgcatccagctgcaaagtctatgatcgaactaagtcgcactcaagacgaggaagtgggggatggaaccacatctgttattgtgttagctggcgagatgttgcatgtagctgaagctttcattgacaggggatatcatcctactgtgatttgcagagcctacagtaaagcacttgaggatgctattgctgtgctagacaagattgccattcctattgatgtgaatgaccgtccaacattgttgaaaatggttcgaagttgtattggcacaaaatttactggccagtttgggaatctcattgcggatatggcaattgatgcaactacaactgtgagtgttgaaatagggaatggtctgcgtgaggttgatataaagaactatgttaaagttgagaagattcctgggggccagttggaagattccaaggttcttaagggtgttatgtttaacaaggatgttgttgcacctggaaaaatgaagaggaaaatcatcaacccacgaatcattcttctggattgcccgcttgagtacaaaaagggagagaacatgacaaatgcagagttgataaaagaagacgactggagtatcctcttgaaaatggaagaggactatattgaaaatatttgttctcaaatattgagcctaaaaccagatctagtcatcactgaaaagggccttagtgatcttgcagctcactacttgagcaaagcaggagtcagtgcaattcgaaggctgaggaaaacagataacaatagaattgctagagcttgtggagcaacaattgtgaacagaccagaggaattgcaagaaagtgatgttggaactggagcaggattgtttgatgtccaaaagattggtgatgaatattttacttttattgttgactgcaaggaaccaaaagcttgcacagttcttttaagaggtgcaagcaaagatttactgaatgaggttgaacgaaatcttcaggatgctatgtcagtttcccggaatatgattaagaatcctaagcttgttccaggtggcggtgcaactgaacttacagtatcagcaactttgaagcaaaagagttcatcagttgagggtatagacaagtggccttatgaagccgttgcagtagcttttgaggcaattcctagaactttgactcagaattgtggtgtgaatgttgttagaaccatgacagcactgcaagcaaagcatgcaaatggggaaaacgtgtggactgggattgatggaaacactggagaaatcactgacatgaaagaacgcgggatatgggatgcttacaatgtgaaggcacagacttttaaaacagctattgaggcatcctgtatgcttcttaggattgatgacatcgtgagtggaataaagaagaaacaagctccaggtggtccaacaaaaacaaagcctcaaacagaggatggaaatgatgttgacagtgaacagatgattccagagtaattgtgtaggtgcttgcagtgatgtcaaatttattgatacgagcatttctgcttgagctggatataaatgatgcgtctgtcatgagcacagcctcactgacaagcaaattgaactggtgtgttgaaaggtcttgatgcaatgattaatattgagaacgagaggttctttgattttgcgggaaattccaaagtcatctattttacaagggcttgttctctctaattttgacttgcagatatgctgtaagcattcatatgtcttagactgtctgagagaaatatttttggagtatccggtttatttaatgcttacagtcatattggataacattgatgaaataatcagtgtactacttaaaaagctaaagtagcttagacactcttgttctagagttgattggattgtgcttgtagaaatctattttctagaatatctcttgtttaaacatatagttaaacccctttttagtaggttactagaaccacctattacatcattattggcatgaagagcactcacttgacttgtaaccg

SEQ ID NO: 2623 - DNA, 1798 bp, Euonymus alatus
atctatgttgaagatgctccttgatgctgctggagggattgtcgttactaatgatgggaatgctattttacgtgagctagatcttgcacaccccgctgcaaagtcaatgattgaattaagtcgcacacaagatgaagaagttggagatggaacaacatctgtcattgttttagcgggtgaaatgctccatgttgcggaagccttcattgacaagaactatcatcccacggtcatttgtcgagcctacaacaaagctctggaagatgctattgctgtgcttgacagaattgcaatgtccattgatgtaaacgatcgggcaatgatgttgggcatggtaaagagctgcattggcacaaagttcacaagtcaatttggtgatttgattgctgatttagcaatcgatgccaccacgacgattggcgttgacctaggccaaggaatgcgcgaagtggatattaaaaagtacattaaggttgagaaggttcctggtggccagttggaagattcaagagttctcaaaggggttatgtttaacaaagacgtagttgcccctggaaaaatgaggagaaagattgtaaatccacgtatcattcttcttgattgcccccttgagtacaagaaaggtgagaaccaaacaaatgcagaattggttaaagaggaagattggggagtccttttgaaaatggaagaagaatacattgagaacctctgtgtgcagatcttgaaattcaaaccggatttggtaattacagaaaagggtcttagtgatctggcttgccattatctgagcaaagcaggcgtcagtgcaataaggaggttgaggaagacggacaataacagaattgccaaagcatgtggtgccgttatcgtgaacagaccagaagaactgcaggagtccgatgttggtactggggctgggctgtttgaggttaagaaaattggggatgaattttttgctttcattgttgattgcaaagatccaaaagcctgtaccatactattaagaggagccagtaaggatctcctaaatgaagtagagagaaacttgcaggatgctatgtctgtagcgaggaacatacttaagaatccaaagctagttccaggaggtggcggtacagagttaactgtatctgctactttgaagcaaaagagttcatctattgaaggcatagaaaagtgccttatgaagccgcggcaatagcttttgagtctataccacgaactttggcacaaaattgtggtgttaatgtgatccggactatgactgccctacaaggacagcatgccaatggtgaaaatgcatggattggcattgatggaaatactggattgatcgctgacatgcatgagcgacagatatgggatgcctataacgtaaaggcacaaaccttcaagaccgcaatagaagccgcttgcatgattctcaggattgatgacattgttagcgggatcaagaagaagcaggcccctggagcgggccaagcaccaaagcccaaggttgagacagaggcagatgctgatggcgagcaaatacttcccgactgaggatgttgttgaactcggacttactcggctttcgataatggccagaaatgttttgtttgcattctcggctagttcaagggttttgttgggcttttaatcgcacaatacttcaaattttggccagttcacagttttgttgtttgcttagaactacctttctataatgttttcagttgtatactttgtgcagttgggatgcttgaaagctctgttagttcatggactccaaggaagaaatagcagcttttgttct

SEQ ID NO: 2624 - DNA, 1692 bp, Cynara scolymus
  misc_feature (759)..(759): n is a, c, g, or t
  misc_feature (1271)..(1271): n is a, c, g, or t
  misc_feature (1444)..(1444): n is a, c, g, or t
  misc_feature (1448)..(1448): n is a, c, g, or t
cggggttgccacgtttcttctcgtattttctttctcgtgtccaaagaaagcaaagagagaaaccctagagaaaactctgcaactccaacaactgatctctgcggtcttacacttccatctccaaacatgcagtcaccagttctcgttctcaaggattccctcactcgtgaatctggaagcaaggtgcatcatgcaaatattcaagcctctaaggcagttgctgatattattcgcaccacgttgggtccaaggtccatgttaaagatgcttctcgatgctcaaggaggtattgtggtcactaatgatggaaatgccatttggcgggagttggatattgctcacccagctgcaaagtccatgattgaactaagccggacacaggatgaggaagttggtgacggaactacatcagttattgttcttgctggtgagatgcttcatgttgcagaagctttcattgataagaagtatcatcctacagttatttgccgagcttacaacaaggctcttgaagatgctcttgctgtgttggacaagatctccatgtctattgatgtgaatgatcgttccatgatgctgggtttggtgaagagttgtatcggcacaaaatttaccagtcagtttggggatctaatagcagatctagcacttgatgcaacaacgacagttggtgtcgatataggccagggacttagagaagtggatattaagaaatacattaaggtcgagaaaattccaggtggccaattggaagattcnaaggtcctcaaaggtgttatgtttagcaaagatgtggtcgtcccgggaaaaatgagaaggaaaattgtaaatccccgtgtcattttgcttgattgccctctggaatataagaagggagagaaccagacaaatgcagaattggtcagagaagaggattgggcagtactcttgaaaatggaagaagagtacattgaaaatctatgcgtacaaatactgaagttcaagcccgacttggtgatcacagagaaggggcttagtgacttagcctgccattacttcagtaaagctggagtcagtgccattaggagattaaggaaaaccgacaataataggattgctaaggcatgtggagctgtgattgtgaatcggcccgatgaacttcaagaatcagatgttggaactggggctggactctttgaggtaaaaaagattggtgatgagttctttgcctacattgttgattgtaaagatccgaaagcatgcactgttcttctccgaggtgctagcaaagnccttttaaacgaagtggagcggaacttgcaggatgctatgtcggtggctaggaacatcctaaagcatccaaaacttgttcctggtgggggtgccactgagttgacttttctgcaactctgaagcagaagagctcatcgatagaaggcattgaaaagtggccttatgaagctgnagcngtagcatttgaggcgataccacgaacattggcacagaactgtggtgtcaatgtcattagaactatgactgctcttcaggggaagcatgcaaatggggagaatgcatggacagggattgatgggaattcgggtgaaattgctgatatgaaagaacttaagatctgggatgcttataacgtgaaggcacagacctttcagacatccatcgaggctgcttgtatgctttctaggattgacgacattt

SEQ ID NO: 2625 - DNA, 1608 bp, Flaveria ramosissima
ggtccaaggtcgatgttaaagatgcttctagacgctcaaggaggaattgtggtcactaatgatgggaatgctattttacgggagttggacattgctcatccagctgcaaagtccatgattgaactaagccgcacacaggatgaggaagttggtgatggaactacatcagtcattgttcttgccggtgagatgcttcatgttgcagaagcttacattgacaagaagtatcatcctacagttatttgccgagcttacaataaggctcttgaagatgctcttgctgtgttggacaaaatctccatgtctattgatgtgaatgaccgttcaatgatgctgggtttggtgaagagttgtattggcacaaaatttaccagtcaatttggggatcttattgcagatctagcacttgatgcaacaactacagttggtgtggacctaggccaaggaataagagaagtggatattaaaaaatatattaaggttgagaaaatccctggaggccaattagaagattccaaagtcctcaaaggtgttatgttcaacaaagatgtagtcgtccctggaaaaatgaaaagaaaaatcataaacccccgcatcattttactagattgccctttggagtacaaaaagggtgagaatcaaacaaatgctgagttagttagagaagaagattgggcagtacttctaaaaatggaagaagaatacatagaaaacatctgtgtacagatacttaaattcaagcctgatttggtgatcaccgaaaaggggcttagtgacttagcatgccattatttcagtaaagctggagttagtgcaattaggagattaaggaaaaccgataacaataggattgctaaagcatgcggggctgttattgtgaataggcctgatgaacttcaagaatcagatgtgggaactggggctgggctttttgagttaaaaagattggtgatgaattttttgcatttattgtggattgtaaagacccgaaagcgtgcaccattcttctccgaggtgccagcaaggatcttttgaatgaagttgaacgaaacttgcaggatgcaatgtcagttgctaggaacatcctaaagcatccaaaacttgttcctggtggaggtgcaactgagttaactgtttctgctacactgaagcaaaagagctcgtcaatagaaggcattgagaagtggccttatgaagctgcagccgtagcattcgaggctattccacgaacattggcacagaattgtggtgtcaatgtcattagaactatgactgctctgcaggggaagcatgcaaatggtgagaacgcctggacaggcatagatggaaattcaggtgaaattgctgatatgaaagagctaaagatttgggatgcttacaacgtgaaggcgcagacctttaagacagccattgaggctgcttgtatgcttctaagaatcgatgatattgttagcggaatacaaaagaggcaagcacctggatctacccaaccatcgaaacccaccattgagacagaaggggatgccgacaatgagcagatgattcccgagtgaagaacaaggtaatttatgaacaaaacattaaccttgtttcatgaaacatgttttc

SEQ ID NO: 2626 - DNA, 2154 bp, Cajanus cajan
gctgttgctgatataattcgtacaaccttgggacccaggtccatgttaaaaatgataattgatgctggaggaggaattgtggtgacaaatgatggaaatgctatcttgcgtgaagtagatgttgctcatcctgctgcaaagtctatgattgagttgagtcgcatccaagatgaagaagttggagatggaacaacatctgtcatcattcttgctggtgagatgcttcatgttgctgaagcactcatagataagaattatcatcctacagttatttgccgagcttataacaaagctttggaggatgccattgctgtccttgacaaaattgcaatgcctattgatgccaaggatcgaggtacaatgctggggcttgtcaaaagctgcataggtaccaaattcactagtcaatttggggatttagttgccgatttagctattgatgctactgccacagtagatattgatcttggccaaggtttgagagatgtagatattaaaaattatattaaggttgagaaggtccctggtgggcagctggaggattcaagagttcttaaaggagttatgataaacaaagatgtggttgcccctggcaaaatgaaaagaaagattgttaatccacgagtcattcttcttgattgtccccttgagtataaaaagggtgaaaatcaaacaaatgctgaaatgctcaaagaagacgactggagcctcttgttgaggatggaagaagaatacattgaggagctctgtatgcagatattgaagtttaaaccagatttggtgattacagagaaaggccttagtgatttggcgtgtcattttctgagtaagcatggagtaagtgcaatcagaaggctgagaaaaaccgacaacaatagaattgctaaagcatgtggtgctgttattgtgaacagaccagatgaattacaggagtctgatgttggtactggtgctgggttatttgaagttaagaagatcggagatgaattttttgcatttatagttgaatgcaaagaccctaaagcttgcactgtactattgaggggtgctagcaaggatctcttaaatgaagttgaaagaaacctccaggatgccatgtctgtagcaaggaacataataaaaaatccaaaacttgttcctgggggtggtgcttcagagttgactgtatcagcgacattgaagcagaacagttcatccgttcaaggtatagagaagtggccttatgaagctgctgccattgcttttgaggcgattcctcgaactttggcacaaaactgtggtgtaaatgtcatccgcactatgacttcactacaaggaaaacatgcaaatggtgaaaatgcatggatcggcataaatggaaatactggtgacatcgctgacatgaaagagtgcaagatctgggatgcatacaatgtaaaagcacaaacatttaagactgccattgaagctgcttgcatgcttctgcggattgatgatgtagtgagtgggataaagaagaggcaggcccctggagcaggccaggctccttcaaagcctaaggttgagaccgaggcagatgctgacagtgagcaaattctacctgattgagaacatagctgaactgactgatttttgacacgaagagtaagatgtgctagggtcttgttgggcatttataaactgtttgtggacggtaaatatagcatttgctttattgactgttcatctctcaagttgagattttgtacaaatgccacggtaaaattgttcggtttcacgaattggaaggttgcggggtttctgacttagttgtgaaatcagtttctatccgtgaacttgaagcacctaaagtctcggtattttattggttcaatgtgttcatgagctatgcaggctagcaataccgtgactcctttcactgaattggcacaaacccagggtccgcacaattatttaacaatcatatgtaagcagtaaacactccgacaaaattattttaaatgtttttttggttaggtacgtagtcagtactagttggaaaattttattaaatatattatcatgttgaaaggcaattacgaaatagttgttctcagcgcatggcgttgattcctgtaaaggacttggtgatacggagtaagattttccttaatgaaacatgctgatattccaatc

SEQ ID NO: 2627 - DNA, 1837 bp, Distylium racemosum
gcgggggtttactctttcgggtggaacctgcgaccagcaaaaggctgttcagcgctgtttgtgttcttagcttgttcttcgaagctagctaggcgcaaggcttgtttcattccgatcatatcaataggagttttttgaaatttggcggcgatttggtgatttcgagtcattttagctgatattgtttggcgaagtgcttagtagacaaaatctgcaaccatgcattcgccggtgctcgttctcaatgaatccgtaaagcgggagagtggaagtaaggttcatcatgcaaatattcaagcatcaaaggctgttgcagatattattcggaccactttaggtcctcgatccatgttgaagatgctccttgatgcagcaggaggcattgttgttacaaatgatgggaattctatcttgcgagaattggatgtggcacatccggctgcaaagtctatgattgaattaagtcgtacacaagatgaggaagtaggtgatggaactacctcggttattgtgttagctggtgagatgttgcatgtagctgaagcatttattgacaagggataccatcctacagtaatttgcagagcctatagtaaagctcttgaggatgctattgctgtgcttgacaagattgctattcctattgatgtgaatgatcgctcaacaatgttgaaaatggttaaaagctgtattggcacaaaatttactggccagtttgggaatctcattgcggatttggcaattgatgcaacaacaactgttagtattgatattgggaatggtctacatgaagttgatataaagaaatatgttaaagttgagaaggttcctgggggtgagttggaagattcgaaggtactcaagggtgttatgtttaacaaagatgtagttgcccctggtaaaatgaggaggagaatcatcaatcctcgaattattcttttggattgcccgcttgagtacaaaaagggagagaacatgacaaatgcagagttgttaagagaagaggactggagcgtccttttgaagatggaagaagagtttattgaaaagatatgttctcaaatattgagcttcaagccggatctagtcatcactgaaaagggtcttagtgatcttgcagctcactacttgagcaaaggaggagtgagtgcaattcgtagactgaggaaaacagataacaatagaattgctaaagcttgtggagcgacaattgtaaatagaccagaggaattgcaagaaagtgatgttggaactggagcagggctgtttgaggttcaaaagattggggatgaatatttcacatttattgttgaatgcaaggatccaaaagcttgcacggttcttttaaggggtgcaagcaaagatttgttgaatgaagtggaacgaaatctccaggatgccatgtgtgttgccagaaacatgatcaagaatcctaagctagttccaggaggtggtgcagctgaacttacagtatcagcgactctgaaacaaaagagctcatcagtagagggtatagagaagtggccttatgaagctgtggcagtggcttttgaggcaattcctagaactttgactcagaattgtggtgtgaatgttgtgagaaccatgacagcattgcaggcaaagcatgcaaacggtgaaaatgtatggattgggattgatggtaacactggagaaatcactgacatgaaagaacgagggatatgggatgcttataatgtgaaggcacaaacttttaaaactgctattgaggcatctagcatgcttcttaggattgatgatattgtgagtggaataaagaagaaacaagcccaaggtggtccaacaaaggcaaagc

SEQ ID NO: 2628 - DNA, 1440 bp, Sorghum bicolor
tagcaccaccactcctgtctctccctccaccacacagacacacgcacgcgcgcgccatcccccttccctcccgtcgcgcgccgtcgatccaatccacaaaaaccaaaaaatgccgccgccctccgccgccgccacttccaccaccgcagccgccagcgccgcgagggacgacatgtccccggcggaggcccggctggcgatgatggagctggcgaacatggtgtcggtcccgatggcgctgacggccgtaatccggctgggcgtccccgccgcaatatgggctggcggcgccaacgcgccgcggtcggcggccgagctcctcccggcgggccacccggacccgtcggtcctggagcggctgctccgcctgctggcgtcccgcggcgtcttctccgagtccacgtccacgtcggaggaccggacgacgacgacgcggcggttcgcgctcaccgcggtgggccgcacgctggtgccggagggcgcctcgggcgcgtcgtacgccgactacgtgctgcagcaccaccaggacgcgctggtggcggcgtggccgcggctgcacgaggccgtgctggacccgcgcgggcccgagccgttcgcgcgcgccaacgccggcgtccccgcctacgcctactacggcaaggacagggaagctaaccaggtgatgctccgcgccatgacgggggtctccgagcccttcatgcacgccctcctcgacggctacggcttcgacggcgggttccacggcgtcgccacgctcgtcgacgtcgggggaagctccggcgcctgcctcgagatgatcatgcgcagggtccccactatcaaggagggtatcaacttcgacctgcccgacgtcgtcgccgacgcgccggccatcgccggagtgaggcatgttggcggagacatgttcaagtccatcccctctggtgatgccatcttcatgaagtgggttctgacgacgtggaccaacgacgagtgcacggccatcctcaggaactgccacgccgcgctgccggacggcggcaagctggtcgcctgcgagccggtggtgccggaggagacggacagcagcaccaggacgagggcacttctggagaacgacatcttcgtcatgaccacctaccggacgcaggggagggagcgctccgaggaggagttccaccacctcggcatcgccgccggcttcaccggcttccgcgccatctacctcgaccccttctatgccgtcctcgagtacaccaagtgaatctctcaaatcatgttttctctagcatgtataataacgaacagatgtcaggcaaagttgagattcacgttccaactgcgcactgtactgtactctactctactgtggttagcttctgaatccagaatctctcttccaaacgagcttaaccatgatttccggctttttcaagcattctattctaagggaaaaagctt

SEQ ID NO: 2629 - DNA, 1433 bp, Sorghum bicolor
accaccactcctgtctctccctccaccacacagacacacgcacgcgcgcgccatcccccttccctcccgtcgcgcgccgtcgatccaatccacaaaaaccaaaaaatgccgccgccctccgccgccgccacttccaccaccgcagccgccagcgccgcgagggacgacatgtccccggcggaggcccggctggcgatgatggagctggcgaacatggtgtcggtcccgatggcgctgacggccgtaatccggctgggcgtccccgccgcaatatgggctggcggcgccaacgcgccgcggtcggcggccgagctcctcccggcgggccacccggacccgtcggtcctggagcggctgctccgcctgctggcgtcccgcggcgtcttctccgagtccacgtccacgtcggaggaccggacgacgacgacgcggcggttcgcgctcaccgcggtgggccgcacgctggtgccggagggcgcctcgggcgcgtcgtacgccgactacgtgctgcagcaccaccaggacgcgctggtggcggcgtggccgcggctgcacgaggccgtgctggacccgcgcgggcccgagccgttcgcgcgcgccaacgccggcgtccccgcctacgcctactacggcaaggacagggaagctaaccaggtgatgctccgcgccatgacgggggtctccgagcccttcatgcacgccctcctcgacggctacggcttcgacggcgggttccacggcgtcgccacgctcgtcgacgtcgggggaagctccggcgcctgcctcgagatgatcatgcgcagggtccccactatcaaggagggtatcaacttcgacctgcccgacgtcgtcgccgacgcgccggccatcgccggagtgaggcatgttggcggagacatgttcaagtccatcccctctggtgatgccatcttcatgaagtgggttctgacgacgtggaccaacgacgagtgcacggccatcctcaggaactgccacgccgcgctgccggacggcggcaagctggtcgcctgcgagccggtggtgccggaggagacggacagcagcaccaggacgagggcacttctggagaacgacatcttcgtcatgaccacctaccggacgcaggggagggagcgctccgaggaggagttccaccacctcggcatcgccgccggcttcaccggcttccgcgccatctacctcgaccccttctatgccgtcctcgagtacaccaagtgaatctctcaaatcatgttttctctagcatgtataataacgaacagatgtcaggcaaagttgagattcacgttccaactgcgcactgtactgtactctactctactgtggttagcttctgaatccagaatctctcttccaaacgagcttaaccatgatttccggctttttcaagcattctattctaagggaaaaag

SEQ ID NO: 2630 - DNA, 1492 bp, Saccharum officinarum
taaacaatttgtatctacagtactattcacgcactcctctgtttctgttcttaagaactcatccgaaattccccaattccccttgctttgctgttctgttccttgctccgattactcttgctaacacactagcaccaccactcctgtcgctcccttcaccacacagtacacgcgccatccccctcccctcccgtcgcgtgccgtcaatccaaaccaccaaaaccaaaaaatgccgccgccgtccgccgtcgacatgtccccggcggaggcccggctggcgatgatggagctggcgaacatggtgtcggtcccgatggcgctgacggccgtgatccgcctgggcgtccccgacgcgatatgggcgggcggcgccaacgcgccgcggtcggcggccgagctcctcccggtgggccacccggacccgtcggtcctggagcggctgctccgcctgctggcgtcccgcggcgtcttctccgagtccacgtccacgtcggaggacccgacgacgacgcggcggttcgcgctcaccgcggtgggccgcacgctggtgcccgagggcgcctcgggcgcgtcgtacgccgactacgtgctgcagcaccaccaggacgcgctggtggcggcgtggccgcggctgcacgaggccgtgctggacccgcgcgggcccgagccgttcgcgcgcgccaacgccggcgtccccgcctacgcctactacggcaaggacagggaagctaaccaggtgatgctccgcgccatgaccggggtctccgaacccttcatggaagccctcctcgaagggtacggggggttccgcggcgtcgccacgctcgtcgaagtcgggggaagctccggcgcctgcctcgagatgatcatgcgcagggtccccaacatcaaggaggggatcaacttcgacctgcccgacgtcgtcgccgacgcgccgcccatcgccggagtgaggcatgttggcggagatatgttcaagtccatcccctctggtgatgccatcttcatgaagtgggttctgacgacatggaccaacgacgagtgcacgaccatcctgaggaactgccacggcgcgctgcgggacggcggcaagctggtggcctgcgagccggtggtgccggagcagacggacaccagcaccaggacgagggcgctgctggagaacgacatcttcgtcatgaccacctaccggacgcaggggagggagcgctctgaggtggagttccgccacctcggagtcaccgctggcttcaccgccttccgcgccatctacctcgaccccttctatgccgtcctcgagtacaccaagtgatctcaatcaagccaaacatcatccatcgtcaatcatgttttctctagcgacatacagttgatgagttgaatagtagcataataacgaacagatcaaataatgtcaggcaaagttgagaacttcccactgtactgtactgtggttagcttctgaaaccagaatctctcttccaagcgttcc

SEQ ID NO: 2631 - DNA, 1335 bp, Triticum aestivum
acctcatcgagaatgtcgtcgccacaaccgccggcagccgagcccgccacccccaccgccgcggagatgtcgccgccggaggcgcggctggcgatgatggagctggcgaacatgatcgccgtcccgatggcgctgacggccgtcatccggctgggcgtgccggccgcggtgtgggcgggcggcgccaacgcgccgctctcggccgcggagctgctcccgccgggccacccggacccgtccgtcctcgagcggctcctccgcctgctcgcctcccgcggcgtcttctccgagcacgcagccgacggccgcccggagcgccggtacgcgctgaccgccgtggggcgcaccctggtgccctcgggcgcctccggcgcgtcgtacgccgactacgtgctgcagcaccaccaggacgcgctggtgctggcgtggccgcgcctccacgaggccgtgctcgaccccgccgggcccgagcccttcgcgcgcgcccacgccggcgtccccgcctacgcctactacggccaggaccgggcggccaacgaggtgatgctccgcgccatgaccggcgtgtcggagccgttcatggaggcgctgctggacgggtacgagggcgggttcgagggcgtggccacgctggtcgacgtcggcggcagctccggcgcctgcctggagatgatcatgcgccgggtgcccaccatccgcgagggcgtcaacttcgacctgcccgacgtcgtcgccgccgcgccccccatcgccggagtaaagcatgttggtggagacatgttcaaatccatcccctccggcgacgccatcttcatgaagtgggttctcacgacgtggaccaacgacgagtgcacggcgatcctcaagaaatgccacgaggcgctgccggagggcgggaagctgatcgcgtgcgagccggtggtgccggagacgacggacgccagcacgaggacgagggcgctgctggagaacgacatcttcgtcatgaccacctaccggacccaggggagggagcggtccgaggaggagttccggcagctcggcctcaccgccggcttcgccggcttccgggccctctacctcgaccctttctacgccgtccttgagtatgtcaagtgatcggtggcttattagatctcacctctccacccaattgttttctcccatgtaaaagaaattgaacaaggaggtcgggtgtatgactccctgttaggttggacatgcattttgagttctgagatgttatcttgagatagagtgaatcaagcgcatttgtcggaactcgaaaaaagttacacacatgttgaattaagggcatttgtattaccctaaagt

SEQ ID NO: 2632 - DNA, 1259 bp, Pseudoroegneria spicata
ctccaccaaccgaagatgtcgtcgccgccggcagccgagcccgccaccgccgccgccgcggagatgtcgccgccggaggcgcgtctggcgatgatggagctggccaacatgatcgcggtcccgatggcgctgacggccgtcatccggctgggcgtgccggccgcggtgtgggcgggcggcgccaacacgccgctctcggccgccgagctgctcccgccgggccacccggacccctccgtcctcgagcggctcctccgcctgctcacctcccgcggcgtcttctccgagcacgccgacgccgccgccggccggagacggtacgcgctgacggccgtggggcgcaccctggtcccctcggggccctccggcgcgtcgtacgccgactacgtgctgcagcaccaccaggacgcgctggtgctggcgtggccgcggctgcacgaggccgtgcgcgaccccgccggccccgagcccttcgcgcgcgcccacgccggcgtccccgcctacgcctactacggccaggaccggggggcgaatgaggtgatgctccgcgccatgaccggcgtgtcggagccgttcatggaggcgctgctggacgggtacgagggagggttcgagggcgtggccacgctcgtcgacgtcggcggcagctccggcgcctgcctggagatgatcatgcgccgggtgcccaccatccgcgagggcgtcaacttcgacctgccggacgtcgtcgccgccgcgccccccatcgccggggtaaagcatgttggaggagacatgttcaagtccatcccctcaggcgatgccatcttcatgaagtgggttctcacgacatggaccaacgacgagtgcacggcgatcctcaagaaatgccacgaggcgctgccggagggcgggaagctcatcgcgtgcgagccggtggtgccggagacgacggacgccagcacgaggacgagggcgctgctggagaacgacatcttcgtcatgaccacctaccggacccaggggagggagcggtccgaggaggagttccggcagctcggcctcaccgccggcttcgccggcttccgggccctctacctggaccctttctacgctgttctcgagtatgtcaagtgatcagtggcttagattacctcttcacccaattgtttctcccgtgtaacagaaagtcaaaaactgagcaaggaggtcggagtatgacgccctgttaggttggacatgcattttgagttctgcaataagaccatcttttcgaatca

SEQ ID NO: 2633 - DNA, 1923 bp, Setaria italica
tcccccctctcgctcgctggctcgctgcgcaccaccattccaattccaatttccatctcgtcccgtctcctcgctcgctcaccaaatgttgcccgccgccgccttcggccgaggcccgcctggccatgatggagctggccaacatgatctccgtccccatggcgctgacggccgtcatccggctcggcgtcccctccgccgtgtgggccggcggcgccaacgccccgctctctgccgcggagctcctcccggagggccacccggacccgtccgtcctggagcggctcctccggctgctggcctcccgcggcgtcttctcggagcacggcggagggtcagcagggtccccacggcggttcgcgctgacggcggtggggcgcaccctggtgccgtctggcccgtcgggcgcgtcctacgccgactacgtgctgcagcaccaccaggatgcgctggtgtcggcgtggccgcggctccacgaggcggtgctggaccccgcggggcccgagccgttcgcgcgcgccaacgccggcgtccccgcctacgcctactacggcagggacagggaggccaacgaggtgatgctccgggccatgaccggcgtgtcggagcccttcatggaggcgctgctggacggatacgccgccggattcgagggcgtggccacgctggtggacgtcgggggcagctccggggcgtgcctggagatgatcatgcgcagggtcgacaccatcagggaggggatcaacttcgacctgccagacgtcgtcgccgccgcgccgcccatcgtcggggtgcggcatgtgggtggagacatgttcaagtccatcccctccggcgatgccatcttcatgaagtgggtcctgacgacgtggaccaacgaggagtgcacggccatcctcggcaactgctacagcgcgctgccggacggcggcaaggtcatcgcctgcgagcctgtggtgccggaggagacggacggcagcaccaggaccagggcgctgctcgagaacgacatcttcgtcatgaccacctaccggacccaggggagggagcgctccgaggacgagttccgcaacctcggcatcgccgccggcttcaccggcttccgcgccatctacctcgaccccttatatgccgtcctagagtacaccaagaacaagtgatcaacttgcattcttctctcaacttcatcaaataaacaaacatgatcctcttcttttctttcttctcgtcacggttgagttgagtaacatgagaaataaaagtaagggcaggtgggagcagattacaattacatgcatcaaccaattatccgaatatatattcatcacaacaattatttcttagttaccaaatgttgacagatacagagggatgctctctatttaaggcagcatcagttaacatgacccgagcagaaagtgaatacacgcattattcctcttttttatcttctgcagcagcaccgtggggttcaaccaggggttttgattcactcgcaccctgcaaagacagagtgcacaataagcaattcagagctaaaccaagcagataatagatggtgactgattaaggttctcaagtcccttcagcagaatgatacgtgcaactcaaggataatacccatgggtctagtagtgatgtaacaagtaaattgtatgtctttgacgagaagcaataaatagcgaggtgtctgcgatagttgcgaaccagcatgcattttgcaacagctaatggtcagaagagtagcatgagcatgtagccttacttcatcgttcttctgagcagcaggtttgtaaggacaggcaggtggggctctctcaggtctcctgtattcccatccaaatagccgatacacctttctctggattataattcaaggcaacaaatcagtttccacgtgtgagcaacagaatattagtagag

SEQ ID NO: 2634 - DNA, 1182 bp, Panicum virgatum
ggccgaggcccgcctggccatgatggagctggccaacatgatctccgtcccgatggcgctcaccgccatcatccgcctgggcgttccctccgccgtctgggccggcggcgccaacgcccctctctccgccgccgagctcctcccggagggccacccggacccgtccgtcctggagcgcctcctccgcctgctagcctcccgcggcgtcttctcggagcacggcggctccccgcggcggttcgcgctcacggcggtggggcggaccctggtgccgggccccacgggcgcgtcctacgccgactacgtgctgcagcaccaccaggacgcgctggtggcggcctggccgcgcctccacgaggccgtgctcgaccccgccggccccgagcccttcgcgcgcgccaacgccggcgtgcccgcctacgcctactacggcaaggacagggaggccaatcaggtgatgctccgggccatgaccggcgtctccgagcccttcatggacgcgctgctcgacggctacgcccaaggcttccacggcgtggccacgctggtggacgtcgggggcagctccggggcctgcctccagatgatcatgcgcagggtcgccaccatcaccgagggcatcaacttcgacctgcccgacgtcgtcgccgcagcgccgcccatcgccggagtgcggcatgtgggtggagacatgttcaagtccatcccctccggcgacgccatattcatgaagtgggttctgacgacgtggaccaacgacgagtgcacagccatcctgaggaactgcacagcgcgctgccggccggcggcaaggtcatcgcctgcgagccggtggtgccggaagagacggacaccagcaccaggaccagggccctgctcgagaacgacatcttcgtcatgaccacctaccggacgcaggggagggagcgctccgaggacgagttccgccgcctcggcctcgccgccggcttcaccggattccgcgccatctacctcgacccattctatgccatcctcgagtacaacaagtgactcaacttgatccatcccttgtgttttcctttctttccactttaaattccttgtgacagttgagtcgaacagcatacttgtaataagaaataaggaatcatgctctttgaaccagagaaagaaagcatctcttttcaagcatcctttgac

SEQ ID NO: 2635 - DNA, 1251 bp, Secale cereale
cccctcctgaggcgcggctggcgatgatggagctcgccaacatgatcgccgtcccgatggcgctgacggccgtcatccggctgggcgtgccggccgcggtgtgggcgggcggcgccaacgcgccgctctcggccgccgagctgctcccgccgggccacccggacccgtccgtcctcgagcggctcctccgcctgctcgcctcccgcggcgtcttctccgagcacgccgccgacccgtccggcggccgcgagagacggtacgcgctgaccgcccgtggggcgcaccctggtgccctcgggcccctccggcgcgtcgtacgccgactacgtgctgcagcaccaccaggacgcgctggtgctggcgtggccgcgcctccacgaggccgtgctcgacccggccggcccggagcccttcgcgcgcgcccacgccggcgtgcccgcctacgcctactacggccaggaccgggacgccaacgaggtgatgctccgcgccatgaccggcgtgtcggagccgttcatggaggcgctgctggacgggtactgcccgggcggcgggttcgagggcgtggccacgctggtcgacgtcggcggcagctccggcgcctgcctggagatgatcatgcgccgggtgcccaccatccgcgagggcgtcaacttcgacctgcccgacgtcgtcgcggccgcgccccccatcgccggagtgaggcatgtgggtggagacatgttcaagtccatcccctccggcgacgccatcttcatgaagtgggttctcacgacgtggaccaacgacgagtgcacagcgatcctcaagaaatgccacgaggcgctgccggagggcgggaagctcatcgcgtgcgagccggtggtgccggagacgacggacgcctgcacgaggacgagggcgctgctggagaacgacatcttcgtcatgaccacctaccggacccaggggagggagcggtccgaggaggagttccggcagctcggcctcaccgccggcttcaccggcttccgggccctctacctcgaccctttctacgccgtcctcgagtatgtcaagtgaccggtgacttagatctcacctctccacccaattgctttctcccatgtatcagaaactgaacaaggtggtcggatgtatgacgccctgttaggttggacatgcattttgagttctgcagcatgatcatctcttcaaattattccaagtgcacctatacattttgcgagtactaacatagcatcatcatta

SEQ ID NO: 2636 - DNA, 1198 bp, Secale cereale
gaggcgcggctggcgatgatggagctcgccaacatgatcgccatcccgatggcgctgacggccgtcatccggctgggcgtgccggccgcggtgtgggcgggcggcgccaacgcgccgctctcggccgcggagctgctcccgccgggccacccggacccgtcagtcctcgagcggctcctccgcctgctcgcctcccgcggcgtcttctccgagcacgccgccgacccgtccggcggccgcgagagacggtacgcgctgaccgccgtggggcgcaccctggtgccctcgggcccctccggcgcgtcgtacgccgactacgtgctgcagcaccaccaggacgcgctggtgctggcgtggccgcgcctccacgaggccgtgctcgacccggccggcccggagcccttcgcgcgcgcccacgccggcgtgcccgcctacgcctactacggccaggaccgggacgccaacgaggtgatgctccgcgccatgaccggcgtgtcagagccgttcatggaggcgctgctggacgggtactgcccgggcggcgggttcgagggcgtggccacgctggtcgacgtcgggggcagctccggcgcctgcctggagatgatcatgcgccgggtgcccaccatccgggaaggggtcaacttcgacctgcccgacgtcgtcgcggccgcggcccccatcgccggagtgaagcatgtgggtggagacatgttcaagtccatcccctccggcgacgccatcttcatgaagtgggttctcacgacgtggaccaacgacgagtgcacggcgatcctcaagaaatgccacgaggcgctgccggagggcgggaagctcatcgcgtgcgagccggtggtgccggagacgacggacgccagcacgaggacgagggcgctgctggagaacgacatcttcgtcatgaccacctaccggacccaggggagggagcggtccgaggaggagttccggcagctcggcctcaccgccggcttcaccggcttccgggccctctacctcgaccctttctacgccgtcctcgagtatgtcaagtgaccggtgacttagatctcacctctccacccaattgctttctcccatgtaacagaaactgaacaaggtggacgcatgtatgacgctctgttaggttggacatgcattttgagttctgcagcatgatcatctcttcaaattattccaa

SEQ ID NO: 2637 - DNA, 2955 bp, Oryza sativa
cttgctgctggttatacacggtaatcgagcttatctaaccatcaggacccaaaaagaacccatcgcattgaaaagaaatttaaacaaagatttgaattgttgaccaattatcgctagagcccatgtggcattcgatcttggccaacgatagaatctgggcccacatgtcagcgagtacatatacagtatatagatagatagaagaaggaaacaactcaaccgcagcagttgtctcgtctcgtcagttgagttgagtagtgttgacttgagattcatcacatctgagtgagtaagagtttggaaaatgggcggcggaggagacggcgaactgtccccggcggaggccaggctggcgatgatggagctcgccaacatgatctccgtccccatggcgctcaccgccgtcatccgcctcggcgtccccgccaagctctgggcgggaggcgccaacgccccgctcgccgccgccgacctcctccccgcgggccacccggacccctccgtcctcgagcgcctcctccgcctcctcgcctcccgcggcgtcttctccgagcacaccggatcatcctccccctccccgcgccgcttctcgctcaccgccgtcggccgcaccctcgtccccggcggcggcggtagcccctccggctccggcgcgtcctacgccgactacgttctgcagcaccaccaggatgcgctcgtccgcgcctggcccctcctccacgaggccgtcctcgacccctccggccccgagcccttcgcccgcgccaacgccggcgtccccgcctacgcctactacggcaaggacagggaggcgaacgaggtgatgctccgggcgatgacgggggtgtcggagccgttcatggaggcgctgctggagggctacggcgacggcgggttcgagggggtgagcacgctggtggacgtgggaggcagctccggcgcgtgcctggagatgatcatgcggcgggtccgcaccatccgggacggcgtcaacttcgacctgcccgacgtcgtcgcggcggcgccgcccattcccggagtgaggcatgttggcggggacatgttcaagtccatcccctccggtgatgccatcttcatgaagtgggttctgacgacatggacgaacgaggagtgcacggcgatcctgagcaactgccacaaggcgctgccgggcggcgggaaggtgatcgcctgcgagccggtggtgccggacacgacggacggcagcacgaggacgagggcgctgctggagaacgacatcttcgtcatggccacctaccggactcagggcagggagcgatccgaggaggagttccgccacctcggcctcgccgccggcttcgcctccttccgggccatctacctcgaccctttctacgctgtcctcgagtacaccaagtagtagtcattcattcatgctgcatcaatttgctgctgaaatcaacaaccacgtttccttccttttctttttggtctcgtgacactgtcaaataagcagtatttcaattgtgcaatcagaccatgttcttttgagcattcacagcatcagagtaatggaaaggtgtagcagtttacgattgctagcatgcagttagcagtgtgcccactaccaccaacgttttggtacatgatggaagggggaatcaacaatcactgcccaaacatatgtggggagtatattcattcatataacaattatttcttaatagctacggtcacaaacattaacactgttgtttgaaacgttcgccgctgctcgacaacattaatcctctttcttatcttctgctgtggtagtagtagtactagcgctttggggttcaactagaggttttgattcacttgcaccctgtacagcaaaaggagtaaaccaatcacatcagaatggcctgttgcaaactgagttgctgcaaaattccctactggctctagtatgatgcagtaccatgcataaaagctagctgtctctatagagtttgtaaattatcagtgggggcatgctaagtgttaatatcttgcataatgaaatggtcgacttaaggcagaaataagtatagcaaatactagcatggaagcttacttcattgttctttgccgcaggcttaaacgggcaagcaggcggggctctttcaggcctcctgtattcccatccaaatagtcgataaatcttgctctggaatgtcattcagaacatgaatcaattttcagaatacagataacaggagaacctagaaacatatgcacattgcgtgctaaaacaccaataaggctacttcaggcagcgctaaactagaccgcgtacatcaagttttcattaagaaaagagattggcatagttcagggcatgtttgaaacatggacaaaattcttcatttgttccaacatttgacgcctttgctgccctcaaatagaaaacactcagcagctacagaacattattttatttctttcagcttgggattattataatccagattattgagagtaagcggaaagaaacagacaacttatttaagtagcttattataatctggagcccagcttattataatctgataagctcatttaggtgagctttttccagattatttggtgaaaaattacccaccatgccaccccactctctctttagacttgcaaacccaataatctaggctctaataatttaggaaagaaacaactaaccgcttattctactacatattataacaatctagcttatagtaatctgactcaataatctagattataataatccaaagctgagagaaacagggccttagttatttgttatccagagtaatatgaatagcaaaacatctttcagcattatttattgtcaagtcaagaaggggaaccttatgtagccttttgcctttcagttactatttatgctatatctttcggctctacgaggagtgtaactattatagtccctccgtttcacaatgtaag

SEQ ID NO: 2638 - DNA, 1638 bp, Oryza sativa
actcaaccgcagcagttgtctcgtctcgtcagttgagttgagtagtgttgacttgagattcatcacatctgagtgagtaagagtttggaaaatgggcggcggaggagacggcgaactgtccccggcggaggccaggctggcgatgatggagctcgccaacatgatctccgtccccatggcgctcaccgccgtcatccgcctcggcgtccccgccaagctctgggcgggaggcgccaacgccccgctcgccgccgccgacctcctccccgcgggccacccggacccctccgtcctcgagcgcctcctccgcctcctcgcctcccgcggcgtcttctccgagcacaccggatcatcctccccctccccgcgccgcttctcgctcaccgccgtcggccgcaccctcgtccccggcggcggcggtagcccctccggctccggcgcgtcctacgccgactacgttctgcagcaccaccaggatgcgctcgtccgcgcctggcccctcctccacgaggccgtcctcgacccctccggccccgagcccttcgcccgcgccaacgccggcgtccccgcctacgcctactacggcaaggacagggaggcgaacgaggtgatgctccgggcgatgacgggggtgtcggagccgttcatggaggcgctgctggagggctacggcgacggcgggttcgagggggtgagcacgctggtggacgtgggaggcagctccggcgcgtgcctggagatgatcatgcggcgggtccgcaccatccgggacggcgtcaacttcgacctgcccgacgtcgtcgcggcggcgccgcccattcccggagtgaggcatgttggcggggacatgttcaagtccatcccctccggtgatgccatcttcatgaagtgggttctgacgacatggacgaacgaggagtgcacggcgatcctgagcaactgccacaaggcgctgccgggcggcgggaaggtgatcgcctgcgagccggtggtgccggacacgacggacggcagcacgaggacgagggcgctgctggagaacgacatcttcgtcatggccacctaccggactcagggcagggagcgatccgaggaggagttccgccacctcggcctcgccgccggcttcgcctccttccgggccatctacctcgaccctttctacgctgtcctcgagtacaccaagtagtagtcattcattcatgctgcatcaatttgctgctgaaatcaacaaccacgtttccttccttttctttttggtctcgtgacactgtcaaataagcagtatttcaattgtgcaatcagaccatgttcttttgagcattcacagcatcagagtaatggaaaggtgtagcagtttacgattgctagcatgcagttagcagtgtgcccactaccaccaacgttttggtacatgatggaagggggaatcaacaatcactgcccaaacatatgtggggagtatattcattcatataacaattatttcttaatagctacggtcacaaacattaacactgttgtttgaaacgttcgccgctgctcgacaacattaatcctctttcttatcttctgctgtggtagtagtagtactagcgctttggggttcaactagaggttttgattcacttgcaccct

SEQ ID NO: 2639 - DNA, 2358 bp, Oryza sativa
aagaaaaagaaaataaatcgcagagaatatttggatcgtggtgtgtgagctttaactccccccctttccccgcggccactagggtttctcctcctctttcctctcctcctccgccccgacgcctcgctagggtttttgcctctccctccgccgccgccgctgccgcgaggagaggagggggggagagcacccagccggcgagccagccatgtcgctgcgcccgagcgagcgggtggaggtgcggcggaaccgctacaaggtggcggtggacgccgaggaggggaggcggcggcgcgaggacaacatggtggagatccgcaagagccgccgcgaggagagcctcctcaagaagcgccgcgaggggctccaggcccaggcccccgtccccgcctccgccgcaaccggcgtcgataagaagctcgaaagccttcctgctatgattggtggagtttattcggacgataacaaccttcagcttgaggccacaacacagttccgcaagttgctttctatagagaggagccctccaattgaagaggttattcaatcaggcgttgttcctagattcgtgcagtttcttaccagagaggatttcccccagctacagttcgaagctgcgtgggcacttacaaacattgcatctggcacttcggagaatacaaaggttgtcattgatcatggggctgtaccaatatttgtgaagcttcttggttcttctagtgatgatgttcgtgagcaggctgtatgggcattgggcaatgttgctggtgattcccctaagtgccgtgaccttgttcttgccaatggtgcattgctgcctctgctagcacagttgaatgagcacactaaactctctatgctaaggaatgcaacttggactttatcgaacttctgcagaggaaaaccacagccatcatttgaacagactaggcctgctcttccagcactggcacggcttattcactccaatgatgaggaagttctcactgatgcgtgctgggctctttcatatttatctgatggcactaatgacaagatccaagccgtgattgaagctggtgtttgcccccgtcttgtggagcttctcctccatccatcaccttcagtgcttatacccgcactacgaactgttggaaatattgtaactggagatgacgcgcaaactcagtgcatcattgatcatcaagccctcccttgcctcctaagtctgttgacacaaaatctcaagaaaagcatcaagaaagaggcttgctggactatttcaaatattactgctggtaacaaagatcagatacaggctgtcataaatgctggcattattggtcctctggtgaatctgctccaaacggcagagttcgatatcaagaaggaagctgcatgggccatctcaaatgctacttcaggcggtagccatgatcaaatcaagtatctggtgagcgagggctgcatcaagccattgtgtgatcttcttatttgcccagatataagaatcgttacagtttgtttggagggtctcgagaacattcttaaagtaggagaaaccgacaagaccttggctgcaggtgatgtgaatgtcttttcccagatgattgatgaagcggaaggtttggaaaagattgagaacttgcagagccatgataacaatgagatctatgaaaaagctgtgaagattcttgaggcctactggatggatgaggaggatgatacaatgggagctaccacggtagctgctccccaaggtgctacttttgactttggccaaggcggtggtgctgctcaattcaaataaatacagatttgaccagaggtggtaaattgtggccactgtgcggggtactgaattgttctggtggttcaataagctaaaggtttcaagggggccagtgttacattatttccctactggtcacggatatcatatcactacgtctgtaacagggattaaagctttgaagtctgcgtttttcatcaggctactactatgtagtgtttgcatcttttagtatggtgtgcaacattttgctacttgtatagcctgagtcgaagcttctgcaaagccgtcacaacacattcctgaacccgtctggttttgagtttcgtcaggagtgtgctgagttgcagtttgtccggacatgtaaaccattatgccttttaaattatatattgctagggtttgttcggttctactattctagtgatctctttgcatctgcgtttttagttaataccactgagtagggtttgcaaaaccgaaccactcttactgcaggggtacggtgaaaggaaaaccatggtaatctccttaaattcaaataaattttaaaaataatttgaaattttgataaatttcacggtaac

SEQ ID NO: 2640 - DNA, 2193 bp, Oryza sativa
agagaatatttggatcgtggtgtgtgagctttaactccccccctttccccgcggccactagggtttctcctcctctttcctctcctcctccgccccgacgcctcgctagggtttttgcctctccctccgccgccgccgctgccgcgaggagaggagggggggagagcacccagccggcgagccagccatgtcgctgcgcccgagcgagcgggtggaggtgcggcggaaccgctacaaggtggcggtggacgccgaggaggggaggcggcggcgcgaggacaacatggtggagatccgcaagagccgccgcgaggagagcctcctcaagaagcgccgcgaggggctccaggcccaggcccccgtccccgcctccgccgcaaccggcgtcgataagaagctcgaaagccttcctgctatgattggtggagtttattcggacgataacaaccttcagcttgaggccacaacacagttccgcaagttgctttctatagagaggagccctccaattgaagaggttattcaatcaggcgttgttcctagattcgtgcagtttcttaccagagaggatttcccccagctacagttcgaagctgcgtgggcacttacaaacattgcatctggcacttcggagaatacaaaggttgtcattgatcatggggctgtaccaatatttgtgaagcttcttggttcttctagtgatgatgttcgtgagcaggctgtatgggcattgggcaatgttgctggtgattcccctaagtgccgtgaccttgttcttgccaatggtgcattgctgcctctgctagcacagttgaatgagcacactaaactctctatgctaaggaatgcaacttggactttatcgaacttctgcagaggaaaaccacagccatcatttgaacagactaggcctgctcttccagcactggcacggcttattcactccaatgatgaggaagttctcactgatgcgtgctgggctctttcatatttatctgatggcactaatgacaagatccaagccgtgattgaagctggtgtttgcccccgtcttgtggagcttctcctccatccatcaccttcagtgcttatacccgcactacgaactgttggaaatattgtaactggagatgacgcgcaaactcagtgcatcattgatcatcaagccctcccttgcctcctaagtctgttgacacaaaatctcaagaaaagcatcaagaaagaggcttgctggactatttcaaatattactgctggtaacaaagatcagatacaggctgtcataaatgctggcattattggtcctctggtgaatctgctccaaacggcagagttcgatatcaagaaggaagctgcatgggccatctcaaatgctacttcaggcggtagccatgatcaaatcaagtatctggtgagcgagggctgcatcaagccattgtgtgatcttcttatttgcccagatataagaatcgttacagtttgtttggagggtctcgagaacattcttaaagtaggagaaaccgacaagaccttggctgcaggtgatgtgaatgtcttttcccagatgattgatgaagcggaaggtttggaaaagattgagaacttgcagagccatgataacaatgagatctatgaaaaagctgtgaagattcttgaggcctactggatggatgaggaggatgatacaatgggagctaccacggtagctgctccccaaggtgctacttttgactttggccaaggcggtggtgctgctcaattcaaataaatacagatttgaccagaggtggtaaattgtggccactgtgcggggtactgaattgttctggtggttcaataagctaaaggtttcaagggggccagtgttacattatttccctactggtcacggatatcatatcactacgtctgtaacagggattaaagctttgaagtctgcgtttttcatcaggctactactatgtagtgtttgcatcttttagtatggtgtgcaacattttgctacttgtatagcctgagtcgaagcttctgcaaagccgtcacaacacattcctgaacccgtctggttttgagtttcgtcaggagtgtgctgagttgcagtttgtccggacatgtaaaccattatgccttttaaattatatattgctagggtttgttcggttctactattctagtgatctctttgcatctgcg

SEQ ID NO: 2641 - DNA, 1953 bp, Helianthus annuus
cccccacattattactctcctatttagacaccatcactcactctgcaactcacaactcactcattctctcaacctccactccaatttctagggtttcctttaccaaaaatgtcgctgagacctagcgccaggacggaggttcgccggaaccgctacaaggtggcggtggacgccgatgaggggcgtcggaggagagaagacaacatggttgagatccgtaagagtaagagggaggagagtttgcagaagaagagacgtgaaggaattgctgctagccagttccctctacctgttcaatctgcttctgcttccgagaagaagttagaaaacttacctgcaatggttgcgggggttttgtcagatgataataatatgcagcttgaggccactacccagtttcgtaaactgttgtcgatagaacgcagtccacctattgaagaagttattcaatcaggtgttgttcctcgctttgttgagtttcttatgagggaggattttccccaactgcagtttgaggcagcttgggccttgactaatatcgcttcagggacatctgaacacacaaaagtggtgattgatcatggtgctgttccgatatttgtgaaacttcttgcatctcctagtgatgacgttcgggagcaggctgtatgggcactaggtaatgttgctggtgattcacctaaatgtcgtgaccttgtacttgcacaaggggctttgtcttctttgctggcccagttaaacgaacattctaaattatctatgttgagaaacgccacatggacgctttccaatttctgtagaggcaagccacaaccttcttttgatcagacaagacctgctctaccagcacttcaacaacttatacattcaaacgacgaagaagtcttgactgacgcttgctgggcactttcatatctttcagatggtacgaatgataaaatccaagctgtaatagaagcaaatgtatgtcccagattgattgagctactgaatcacccgtcaccttcagttctcatccctgctcttcgtacggttggcaacattgttactggcgatgatatgcaaactcagtatatcatcaatcatcaagccctgccttgtcttctgaacctgttgaccaataatcacaaaaaaagcattaagaaggaagcttgttggaccatatcaaacatcactgccggcaacaaggagcagattcagacggtgatcgaagcaagtatcattgggccccttgttcttttacttcagaatgcagaattcgacatcaagaaggaggctgcatgggctatctcaaacgctacttctggtggtagccatgaccaaattaagtatcttgttaatcagggatgcatcaaacctttatgtgatctacttgtgtgtccagaccctagaattgtgaccgtttgtctagaggggcttgagaacatactgaaggtgggtgaagcggacaagaatttgggacgatcaggagacgtgaatctttatgcacaaatgattgatgatgctgaaggattggagaaaattgagaatctacagagtcacgataacaatgagatatatgagaaagcggtgaagcttcttgaaacatattggttggaggaagaggaggatgatgcaatgccaactggtcagcctggtttccaacttggtggtgatgtttctgttcccaatggtggctttaacttcagttgattcaaggtctttcttgaagattacagggaggaagtagcgttggtggcatctatctgcttggtccaatattgtagtgtggttgaagttttgtgagtggttcaggtttcttacaatcactatcagtcaaatgttgatgaattgtgtaaaagtaatactttgtttttctttttggaggatttaaattgggatttatagaaattccattgttttgcaccatcggttatgtttttatagcaacaaaagcgagacgagttaatggtt

SEQ ID NO: 2642 - DNA, 2156 bp, Nicotiana benthamiana
  misc_feature (1699)..(1699): n is a, c, g, or t
  misc_feature (1705)..(1705): n is a, c, g, or t
  misc_feature (1720)..(1720): n is a, c, g, or t
  misc_feature (1743)..(1743): n is a, c, g, or t
  misc_feature (1752)..(1752): n is a, c, g, or t
  misc_feature (1775)..(1775): n is a, c, g, or t
  misc_feature (1783)..(1783): n is a, c, g, or t
  misc_feature (1791)..(1791): n is a, c, g, or t
  misc_feature (1904)..(1904): n is a, c, g, or t
  misc_feature (1918)..(1918): n is a, c, g, or t
  misc_feature (1921)..(1921): n is a, c, g, or t
  misc_feature (1926)..(1927): n is a, c, g, or t
  misc_feature (1935)..(1935): n is a, c, g, or t
  misc_feature (1968)..(1968): n is a, c, g, or t
  misc_feature (2005)..(2005): n is a, c, g, or t
  misc_feature (2019)..(2019): n is a, c, g, or t
  misc_feature (2027)..(2027): n is a, c, g, or t
  misc_feature (2029)..(2029): n is a, c, g, or t
  misc_feature (2037)..(2037): n is a, c, g, or t
  misc_feature (2041)..(2041): n is a, c, g, or t
  misc_feature (2054)..(2054): n is a, c, g, or t
  misc_feature (2085)..(2085): n is a, c, g, or t
  misc_feature (2090)..(2090): n is a, c, g, or t
tctcgattcatcatcgttgtccttcaagggttttctgtaataccctattcctatctcttttgcagttctcggtttttatacgaagatgtctctgagaccaagtgctaggacggaggttcgtcggaaccggtacaaggtcgccgtcgacgccgaggaaggccggcgccggcgagaggacaacatggttgagatccgaaagagcaagagagaagagagtttgctcaagaagcgtagggaaggccttcaaccgcaacaacaacccttcccggctaatctccatacatccaccgttgaaaaaaagttggaaagtcttccatcaatggttgctggtgtttggtcaaatgataacaatttgcagctggaggccaccacacaattccgtaaattgctctctattgaaaggagccctcctattgaggaagttatacaatctggtgttgttcctcgatttgttgagtttctaatgagggaagactttccgcagctccagtttgaagctgcttgggctctcacaaacattgcttctggtacctctgacaataccagagtggtgattgatcatggggcggtgccaatttttgtaaagcttctgggttctccaagtgatgatgtccgtgagcaggctgtgtgggcattgggaaatgttgctggcgattctccaagatgccgtgatcttgtgcttagtaatggggctttgattcctttgctggctcagttgaatgagcataccaagctttcaatgctgagaaatgccacgtggactttatcaaacttttgtagaggcaagccacaacctccatttgagcaggtgagaccagcactctcagctcttcagcgactcgttcattcgaatgatgaagaggtgctaacagatgcatgctgggcactttcttacctttctgatggtacaaacgacaaaattcaagccgtcattgaagcaggtgtttgtccacggctggttgagctcctcatgcatccgtctccttcagtactcatccctgctctccgtactgttggaaatattgttacaggagatgacctccagactcagtgcattattgaacatggagcccttacttgcctgctgagcttgttaacacacaatcacaaaaagagcatcaagaaagaggcatgctggaccatatccaatattactgctgggaacaaggagcagatacaggctgtaattgaggctggattaattgctcctctggtcaatctgcttcaaactgcagaatttgatatcaaaaaagaggctgcctgggctatttcaaatgctacttctggtgggactcatgagcagatcaagttcttggtgagtcagggttgcataaagcctctatgtgatttgcttgtgtgccctgatccaaggattgtcaccgtctgtctggaaggattagaaaacatattgaaggttggggaagcagagaaagcaaacactggaggcattaattactatgctcagctgaccgacgatgcagagggattggaaaagattgaaaaccttcagagtcatgataacaatgagatatatgagaaggctgttaagatactggaaacatactggttggaggaagaggacgaaacattgccagcaggtgatgaggcacaagctggattcaattttggcggaaatgacattcaacttccctctggtggattcaagtttggttgaaagttatgacatccatccaccaantttttntccttaacaggggcngagtatggtggatgagaaatgcngtttgaagntgacatgttggtgttggggtcangtcaagtngagtcagntcacctccctgagtctggtcagtccgggtcaagagtcagttgtggttgaggggaggtgccgggtggggtcactccatatgacagtggtaaataagacaagtggtaacagcagnggcatcttgggaanttnatacnngattcccntgcattgcttgtgttgttttggtgaaagtatgnaagttattattatcagtgaattagcttctcagagtgnggagtcccttttcnagttagcncntgagatgnatcngcagtctgtctgnaaagagtcggtctatagtatttcgagttgcngggtnaatgtctatacttacgagtcttttctataaatattgcaaaagtacatgtttgagcattttgattta

SEQ ID NO: 2643 - DNA, 2295 bp, Gossypium hirsutum
ttttctgttcctctgggatattcagtgaagaaggaaaatagtgttttgtattccgattctcttttaaattatagttttgttcctgaaaatcggagaagatgtcattgagaccaaactcgaggacggaggttcgaaggaacaggtacaaggtggcggtggacgctgaggaagggaggcggaggagagaggataacatggtggagattaggaagaatcgccgtgaagagagtttgcagaagaagcggcgtgaagggcttcaagcgcagccaatgcctgcttctcttcactcctctgccgttgagaaaaagttggaaaatttgccagccatggttgctggtgtctgggctgacgatagtaatatgcagcttgaggcaaccacacagtttaggaagttgctttcaattgaacgcagcccacctattgaccaagtgatacaagcaggagttgttcctcgcttcattgaattccttgcgagggatgatttcccacagcttcagtttgaggcagcttgggccctaactaatattgcttctgggacatctgagaacacaaaggtggtaattgatcatggggctgttcctatatttgtgaaattgcttgcttcaccaagtgatgatgttcgtgagcaggctgtctgggcactgggaaatgttgctggagattctcctagatgtcgtgacctggttcttagtcatggtgctttgcttcctttgttggcacagttaaatgagcatgttaaactttctatgctgaggaatgcaacatggactctctcaaacttttgtcggggaaagccccagcctccctttgatctggttaaacctgcacttcctgcattgacacaccttattcattcgaatgatgaagaagtcttaactgatgcatgttgggcgctctcatatctttctgatggtacaaatgacaaaatccaagctgttatagaagcaggtgtttgtgggcgtctggtggagctcttgatgcacccatctccttcagtgctaatacctgctcttcgcacagttggaaatattgtcacaggagatgatggtcaaacccagtgtattatcaatcatcaagtgttgccatgccttctaaacctcttgacaaataatttcaaaaagagcatcaagaaggaagcttgttggacaatctcaaatatcacagctggaaataaggagcagatacaggctgtaattgaagctaatattatatctccactggttcatctgcttcaaaatgctgaatttgatatcaagaaagaagcggcatgggccatctcaaatgccacatctggtggtactcatgatcagatcaaattccttgttagtcaaggttgtataaagccattgtgtgatcttcttaactgccctgatccaaggattgtaacagtctgtttagaagggcttgaaaacattttgaaggtaggagaagctgataagaacctgggcactaccggaggagtgaatctctatgcacaaatgattgatgatgctgagggtctggagaagatcgagaatttacagtcccacgataacactgagatttatgaaaaggctgtgaaagttctcgagacatattggttggaggaggaggatgagacaatgccgccaggtgatgcctctcaaacagggtttcattttggcgggggtgagcttcctgttccttcagggggattcaatttcagctagaggtatgtagtgctgctgtttgcatgcatttgtttttgtgttggtgcactagtgggagcgtgttatgtcgtttgagatgggactgcatatctgactaccatttgtatgcttttgagctataaaagctgttagtattccaggatttatctggtccagtattgaagtccttatggagatgatgggacaatagttttgggggggggggttccagttgaggcatctagtctttgggttgtgtccacagtcgggtatggtcgaaggtacagtgtgaatggtagtgggctggcgtgggttaacagcacagccaggttcatattatgcatgaagtgggaatggagacagaatagagcttggacagtaaattgaggaacccagactgagtctatatttaatggtcgtaaaacaaatatattgtgtctttgcaattgcaaaagcttggtttgatgattttggcatatgcccagagcagttatgattcacaggggaatatgcttttgtaactatgtaaatccgaacgactccagttagattgttttatatgttgctttgaagtggaaatagacatatataattgttggtttgaagaaagaaaaaagtaccgactgcg

SEQ ID NO: 2644 - DNA, 2410 bp, Euonymus alatus
ttacggccggggaaggctgagggcctgaggcagtaaattggtggcttcacatgaatctctttttactaaaacccactcatttttcaatcaaaagcataggccaagtgctctctaaaagcccctcttttgctagggtttcgaattcatcaaatcagtcaatcgattccctttcccgatctctcgtttttgttgaacagcgaataattttgcagcaaagatgtctctcaggccgaacgctaggaccgaggtgaggcggaaccggtacaaggtggcggtggatgcggaagaaggcaggaggaggcgcgaggacaacatggtcgagatccgcaagaatcgacgggaggagagtttgcagaagaagcgacgtgaggggctccaggcgcagcagatgcctgcctccatgcactcttcagctgtcgaaaagaagttggaaaatctaccagccatggttgctggagtttggtcagatgataagaacctacagcttgaggccaccacccagttcagaaaactgctatcgattgaacgcagccctccaatcgtggaagttattcaagctggtgttgttccacggtttgttgagtttcttatgagggaggactacccacagcttcagtttgaggctgcctgggttcttaccaatattgcctctgggacatcggaaaataccaaggttgtcattgaccatggtgctgtcccaatctttgtgaaacttcttggttctcctagtgatgatgttcgtgagcaggctgtgtgggcactgggaaatattgctggtgattctccgagatgtcgtgatttagtccttgggcatggagctttgcttcctttattgtcacagcttaatgagcactccaaactttccatgctgagaaatgctacctggactttgtcaaacttttgccgtggcaaacctcagccaccctttgatcaggttaagcctgcacttccagctctagcacgtcttattcattcaaatgatgaagaagtcttgacagatgcatgttgggcactttcttatctatctgatggtacgaatgacaaaattcaagctgttattgaagcaggggtgtgccccaggcttgttgagcttttaacgcacccatctccttctgtgcttgttcctgcccttcgtacggttggaaacattgttactggtgatgatttgcagactcagtgcatcatcaaccatcaagcattgccttgcctcctgacactattgaccaataactacaaaaagagcataaaaaaggaagcttgttggactatctcaaatatcacagctggtaacaaagagcaaattcagtctgtaattgaggctgttattattggtccacttgttcatctgcttcaaaatgctgagtttgacatcaagaaagaggccgcatgggcaatatcgaatgcaacatctgggggtacacgggaccagatcaagttacttgtaagccaaggttgcataaagcccttgtgtgaccttctcatctgccctgatccaagaattgtcaccgtctgtttagaaggtcttgagaacatcttgaaggcgggagaagctgacaagaatttgggtgataccggaggtgttaatttatatgctcaactgattgatgatgctgagggcttagagaagattgagaaccttcagtctcatgacaatactgagatatatgagaagtctgtaaagattcttgagacatattggttggaagaggaggatgaaactatgccacatggtgatgctcctcaagggtttcagtttggaggtagtgaagttcccacagtaccttctggtggattcaacttcagctaaagaaattgtagctggtctctatctaccatatattgtggtgtagtatggtcgggtgttgtttggaatcgagtacagttggacattgttggagtgaaggtcaggggtcttgtcatcgtgtcttggtcctttgtggtccagtgtccttgtatggtcgtgagggttgcttgacgggcttgggtttagcacgtgactggaaaatttcggagaggtaccggtgaattggctgttatgacaagcatcggcccattttcacaataagctgaggaatgatagttcttttctcatcaagcggttgttccaggaggttggcctcctcttgtgaagatgctgatgagtctttattcccttgtgtctcagttgtcctggttgtcatagtagtgtctttgtatgcattgtcttttctcgcagggtgatttttggcactccctaaatgattattcatatcgttcttattcttacttatgataagttttattctttagaatatagggtgtgttttattgtcatgatttcttgttttctcaagtctttttttgagtctgtatcctacaatatttaatggttctgatattgcagaagttccatgcgaaataagatacgttt

SEQ ID NO: 2645 - DNA, 2161 bp, Gossypium hirsutum
taaaataaataactcaaaaaccgaaaaactactctagggtttttcttgtttcgatccatttttataaaatctcaagtttcttcgagcattgttcttttccctggtttcttttttgaagagaagcagccgcccaatatgtcgttgagaccgagcaccagaaccgaggtccgccgcaaccgctacaaggtggcggttgacgcggaggaaggccgccgcaggagggaagacaacatggtggagatccgcaaaagcaagcgcgaagagagcttacagaagaagcgtcgcgaaggcctccaggctcaacagttgtccgcttctcttcaatcctccaacgtcgaaaaaaaattagagagtcttccttcgatggttgccggagtttggtccagtaacggctcagcgcagctagaagcgactactcagttccggaaattgctttcaattgagcgaagccccccgatcgacgaagtgatacaatctggcgtcgttcctcgctttgttgagtttcttatgagggaagattacccacagcttcagtttgaggctgcttgggcgcttacaaatattgcttctggaacctctgagcatactaaggtagttattgatcatggggccgttcctatatttgtaaagcttcttggttccccaagtgatgatgttcgcgagcaggctgtgtgggcactggggaatgttgctggcgattctcctagatgtcgtgatcttgttctcagtcatggagctttgatgccactcttagcacagttgaatgaacactcaaagttgtcaatgctgagaaatgcaacctggacattatcaaatttttgcaggggcaagccacagcctccatttgatcaggtaaggcctgcccttcctgcgcttgaacgtctcattcattcaaatgatgaggaagttctcactgatgcctgttgggctctatcgtacctgtctgatggtacaaatgacaaaattcaagctgtgattgaggcaggagtttgtccacgacttgttgagctcctacttaatccgtctccttcagtgctcattcctgctctccgtacggttggaaatattgtgacgggagatgatttacagactcagtgcattattgaccatggtgcattatcatgccttttgagtttgttgacgcataatcataaaaagagcattaaaaaagaagcttgctggactatctcaaacattacagctggaaacaaagaacaaattcaggctgtgatcaatgccggaataattggtcccctggtgagcttacttcaaaatgctgaatttgatataaaaaaagaagcagcatgggcaatttcaaatgctacctctggtggtactcatgagcaaatcaagtacctagtcagtgaaggatgcataaaacctttgtgtgatctccttgcatgccccgatccaagaattataacagtctgtctagaagggttggagaacattttgaaggttggtgaagctgagaaggcagctggtgctggagagtttaactattgtgcccagttaattgaagatgctgagggattagaaaagattgaaaatctacagagtcatgacaataatgagatctatgagaaggcagtcaagattctcgagacgtactggttggaggaggatgaagagacactacctcctggtgatggtactcagcaaaatttccattttggaggaaatgatgttaaggttccaactggtggattcaacttcagttgaaggtcttatagcttggttggataaagcaagcagttggtaacggggggttatgattgatacttggggtcgaagtttgtggtcggggcaccttgatgtgtccggttatacagtctgtcgagtttcaccgtggtgaatgaggtgccgaggtatgtctaactaaatatgattatagagggagtgggtactattgtgagaccaagacaattacatgtgaacctaatgccatgggaggtgcctttgggtttttatcatttgtataaaataggggccctttcacgtaaacgggtatgatggtaagggtttaccccgttgcggtagtttgccttgtgtttttttttttcagtcggaatttgtttcggtcctttagatggtcgttatttgctgtctcatgacattaaattaattagtgtttattatttgataaaacctcattttatgg

SEQ ID NO: 2646 - DNA, 2188 bp, Gossypium hirsutum
catttttataaaatctcaagtttcttcgagcattgttctttccctggtttctttttgaagaaaagcagccgcccaatatgtcgttgagaccgagcaccagaaccgaggtccgccgcaaccgctacaaggtggcggttgacgcggaggaaggccgccgcaggagggaagacaacatggtggagatccgcaaaagcaagcgcgaagagagcttacagaagaagcgtcgcgaaggcctccaggctcaacagttgtccgcttctcttcaatcctccaacgtcgaaaaaaaattagagagtcttccttcgatggttgccggagtttggtccagtaacggctcagcgcagctagaagcgactactcagttccggaaattgctttcaattgagcgaagccccccgatcgacgaagtgatacaatctggcgtcgttcctcgctttgttgagtttcttatgagggaagattacccacaacttcagtttgaggctgcttgggcgcttacaaatattgcttctggaacctctgagcatactaaggtagttattgatcatggggccgttcctatatttgtaaagcttcttggttccccaagtgatgatgttcgcgagcaggctgtgtgggcactggggaatgttgctggcgattctcctagatgtcgtgatcttgttctcagtcatggagctttgatgccactcttagcacagttgaatgaacactcaaagttgtcaatgctgagaaatgcaacctggacattatcaaatttttgcaggggcaagccacagcctccatttgatcaggtaaggcctgcccttcctgcgcttgaacgtctcattcattcaaatgatgaggaagttctcactgatgcctgttgggctctatcgtacctgtctgatggtacaaatgacaaaattcaagctgtgattgaggcaggagtttgtccacgacttgttgagctcctacttaatccgtctccttcagtgctcattcctgctctccgtacggttggaaatattgtgacgggagatgatttacagactcagtgcattattgaccatggtgcattatcatgccttttgagtttgttgacgcataatcataaaaagagcataaaaaaagaagcttgctggactatctcaaacattacagctggaaacaaagaacaaattcaggctgtgatcaatgccgggataattggtcccctggtgagcttacttcaaaatgctgaatttgatataaaaaaagaagcagcatgggcaatttcaaatgctacctctggtggtactcatgagcaaatcaagtacctagtcagtgaaggatgcataaaacctttgtgtgatctccttgcatgccctgatccaagaattataacagtctgtctagaagggttggagaacattttgaaggttggtgaagctgagaaggcagctggtgctggagagtttaactattgtgcccagttaattgaagatgctgagggattagaaaagattgaaaatctacagagtcacgacaataatgagatctatgagaaggcagtcaagattcttgagacgtactggttggaggaggatgaagagacactacctcctggtgatggtactcagcaaagtttccattttggaggaaatgatgttaaggttccaactggtggattcaacttcagttgaaggtcttatagcttggttggataaagcaagcagttggtaacgggggttatgattgatacttggggtcgaagtttgtggtcggggcaccttgatgtgtccggttatacagtctgtcgagtttcaccgtggtgaatgaggtgccgaggtatgtctaactaaatatgattatagagggagtgggtactattgtgagaccaagacaattacatgtgaacctaatgccatgggaggtgcctttgggtttttatcatttgtataaaataggggccctttcacgtaaacgggtatgatggtaagggtttaccccgttgcggtagtttgccttgtgtttgttttttcagtcggaatttgtttcggtcctttagatggtcgttatttgctgtctcatgacattaaattaattagtgttgggatatttgagtattatttgataaaacctcattttatggtctatttgcgagcagaattgaagatattaacggtgtgtttttttgctacctgtgggaaactaatttcatgtctgt

SEQ ID NO: 2647 - DNA, 2479 bp, Gossypium raimondii
aaagatttaaatttcatttcaaataaaataaataactcaaaaaccgaaaaactctctagggtttttcttgtttcgatccatttttataaaatctcaagtttcttcgagcattgttcttttccctggttttttttttgaagaaaagcagccgcccaatatgtcgttgagaccgagcaccagaaccgaggtccgccgtaaccgctacaaggtggcggttgacgcggaggaaggccgccgtaggagggaagacaacatggtggagatccgcaaaagcaagcgcgaagagagcttacagaagaagcgtcgcgaaggcctccaggctcaacagttgtccgcttctcttcaatcctccaacgtcgaaaaaaaattagagagtcttccttcgatggttgccggcgtttggtccagtaacggctcagcgcagctagaagcgactactcagttccggaaattgctttcaattgagcgaagccccccgatcgacgaagtgatacaatctggcgtcgttcctcgctttgttgagtttcttatgagggaagattacccacagcttcagtttgaggctgcttgggcgcttacaaatattgcttctggaacctctgagcatactaaggtagttattgatcatggggccgttcctatatttgtaaagcttcttggttccccaagtgatgatgttcgcgagcaggctgtgtgggcactggggaatgttgctggcgattctcctagatgtcgtgatcttgttctcagtcatggagctttgatgccactcttagcacagttgaatgaacactcaaagttgtcaatgctgagaaatgcaacctggacattatcaaatttttgcaggggcaagccccagcctccatttgatcaggtaaggcctgcccttcctgcgcttgaacgtctcattcattcaaatgatgaggaagttctcactgatgcctgttgggctctatcgtacctgtctgatggtacaaatgacaaaattcaagctgtgattgaggcaggagtttgtccacgacttgttgagctcctacttaatccgtctccttcagtgctcattcctgctctccgtacggttggaaatattgtgacgggagatgatttacagactcagtgcattattgaccatggtgcattatcatgccttttgagtttgttgacgcataatcataaaaagagcataaaaaaagaagcttgctggactatctcaaacattacagctggaaacaaagaacaaattcaggctgtgatcaatgccgggataattggtcccctggtgagcttacttcaaaatgctgaatttgatataaaaaaagaagcagcatgggcaatttcaaatgctacctctggtggtactcatgagcaaatcaagtacctggtcagtcaaggatgcataaaacctttgtgtgatctccttgcatgccctgatccaagaattataacagtctgtctagaagggttggagaacattttgaaggttggtgaagctgagaaggcagctggtgctggagagtttaactattgtgcccagttaattgaagatgctgagggattagaaaagattgaaaatctacagagtcacgacaataatgagatctatgagaaggcagtcaagattcttgagacgtactggttggaggaggatgaagagacactacctcctggtgatggtactcagcaaagtttccattttggaggaaatgatgttaaggttccatctggtggattcaacttcagttgaaggtcttatagcttggttggataaagcaagcagttggtaacgggggttatgattgatacttggggtcgaagtttgtggtcggggcaccttgatgtgtccggttatacagtctgtcgagtttcaccgtggtgaatgaggtgccgaggtatgtctaactaaatatgattatagagggagtgggtactattgtgagaccaagacaattacatgtgaacctaatgccatgggaggtgcctttgggtttttatcatttgtataaaataggggccctttcacgtaaacgggtatgatggtaagggtttaccccgttgcggtagtttgccttgtgttttttttttcagtcggaatttgtttcggtcctttagatggtcgttatttgctgtctcatgacattaaattaattagtgtttattatttgataaaacctcattttatggtctatttgcgagcagaattgaagatattaacggtgtgttttttggtatctgtggaactaagttcatgtctctctctttcagccatcttgtcactaagaaatgcgttttaccatcataaaatctgctagttaagtttggctgaaccggaatgagatagataggtttcacttttgctctgtttttatttctagaaaattgaatgtgtcaaaagttttaaatataagttaatttagatttgtggtagggatacattttattcagtcaaaattatcaaatataaattattggctcataaaaa

SEQ ID NO: 2648 - DNA, 2521 bp, Gossypium hirsutum
atctaaatagggttcttcggcgaaaagggtcagaatatataattgttggtatgaaagaattttttttgtaatgaaaaactcaactcttattacaagtgaatttctgaaaattcttttggatttctagaaattctagaaatcactttatttcttggtgtcaaaatcaaaacaaaataggatatgtggtataaaaacggggaatctattctcttctttttccaaaaaaatgctcttggagattgtgtaatgcttactcttaaactctttgtttacaccgtagtaatattctttgtttctctcttcatcttcggattcctatctaatgatccgggacgtaatcctggacgcgaagaataaaaaagggagagttccttgcttcatttttataaaatctcaactttcttcgagcattgttctttccctggtttctttttcgaagaaaagcagccgcccaatatgtcgttgagaccgagcaccagaaccgaggtccgccgtaaccgctacaaggtggcggttgacgcggaggaaggccgccgtaggagggaagacaacatggtggagatccgcaaaagcaagcgcgaagagagcttacagaagaagcgtcgcgaaggcctccaggctcaacagttgtccgcttctcttcaatcctccaacgtcgaaaaaaaattagagagtcttccttcgatggttgccggcgtttggtccagtaacggctcagcgcagctagaagcgactactcagttccggaaattgctttcaattgagcgaagccccccgatcgacgaagtgatacaatctggcgtcgttcctcgctttgttgagtttcttatgagggaagattacccacaacttcagtttgaggctgcttgggcgcttacaaatattgcttctggaacctctgagcatactaaggtagttattgatcatggggccgttcctatatttgtaaagcttcttggttccccaagtgatgatgttcgcgagcaggctgtgtgggcactggggaatgttgctggcgattctcctagatgtcgtgatcttgttctcagtcatggagctttgatgccactcttagcacagttgaatgaacactcaaagttgtcaatgctgagaaatgcaacctggacattatcaaatttttgcaggggcaagccccagcctccatttgatcaggtaaggcctgcccttcctgcgcttgaacgtctcattcattcaaatgatgaggaagttctcactgatgcctgttgggctctatcgtacctttctgatggtacaaatgacaaaattcaagctgtgattgaggcaggagtttgtccacgacttgttgagctcctacttaatccgtctccttcagtgctcattcctgctctccgtacggttggcaatattgtgacgggagatgatttacagactcagtgcattattgaccatggtgcattatcatgccttttgagtttgttgacgcataatcataaaaagagcataaaaaaagaagcttgctggactatctcaaacattacagctggaaacaaagaacaaattcaggctgtgatcaatgccgggataattggtcccctggtgagcttacttcaaaatgctgaatttgatataaaaaaagaagcagcatgggcaatttcaaatgctacctctggtggtactcatgagcaaatcaagtacctggtcagtcaaggatgcataaaacctttgtgtgatctccttgcatgccctgatccaagaattataacagtctgtctagaagggttggagaacattttgaaggttggtgaagctgagaaggcagctggtgctggagagtttaactattgtgcccagttaattgaagatgctgagggattagaaaagattgaaaatctacagagtcacgacaataatgagatctatgagaaggcagtcaagattcttgagacatactggttggaggaggatgaagagacactacctcctggtgatgggactcagcaaagtttccattttggaggaaatgatgttaaggttccatctggtggattcaacttcagttgaaggtcttatagcttggttggataaagcaagcagttggtaacgggggttatgattgatacttggggtcgaagtttgtggtcaggggcaccttgatgtgtccggttatacagtctgtcgagtttcaccgtggtgaatgaggtgccaggtatgtctaactaaatatgattatagagggagtgggtactattgtgagaccaagacaattacatgtgaacctaatgccatgggaggtgcctttgggtttttatcatttgtataaaataggggccctttcacgtaaatgggtatgatggtaagggtttaccccgttgcggtagtttgccttgttgttttttttttttcagtcggaatttgtttcggtcctttagatggtcgttatttgctgtctcatgacattaaattaattagtgttgggatatttgagtattatttgataaaacctcattttatggtctatttgcgagcagaattgaagata

SEQ ID NO: 2649 - DNA, 1824 bp, Ambrosia trifida
caacacaactcaactcaactcattctaatattattattaaccttcactccaattcctaggctttctttccttttttgtacctaaaaatgtctctgagacctaacgccaggacagaggtccgccggaaccggtacaaggtggccgtggacgccgacgaggggcggcgaaggagagaagacaacatggtcgagatccgtaagagcaaaagagaggagaatctacagaagaagagacgtgaaggccttgctgctacccagttccctgttccagttcagtctgtttctgcttctgaaaagaagttgaaaacttacctgcaatgttcgggggttttgtcagatgatagtaacatgcagcttgaggctactacccagtttcgcaaacttttatcaatagaacgcagtcctcctattgaagaagttattcaatcaggtgttgttcttcgctttgttgagtttcttatgagggaggattatccccaacttcagtttgaggcagcttgggctttgactaatatcgcttcagggacgtctgaacacaccaaagtggtgattgatcatggtgctgttcctatatttgtgaaacttctttcatcttctagtgacgatgttagggagcaggctgtatgggcactaggtaatgttgctggtgattcacctaaatgtcgtgacctagtacttgcacaaggggctttgccttcattgctggcccagttaaatgcacaatctaaattatctatgttgaggaacgccacatggacgctttccaatttctgtagaggcaagccacaaccttcctttgatcagacaagacctgctcttccagctcttcaacaacttatacattcaaacgacgaagaagttttgacggatgctttgctgggcactttcatatctttcagatggtacgaatgataaaatccaagctgttatagaagcaaatgtatgtcccagattgattgagttactgaatcacccgtctccttcagtgctcatccctgctcttcgtacagttggcaacattgttaccggtgatgatatgcaaacgcagtatattatcaatcatcaagccctgccttgtcttctgaacctattgacaaataatcacaaaaagagcattaagaaggaagcttgttggaccatatcaaacatcactgctggcaacaaggagcagattcagacggtgatcgaagcaaatatcattgggccccttgttcttttacttcagaacgcagagtttgacatcaagaaggaggctgcatgggctatctcaaatgctacttctggtggaagccatgaccaaattaagtatcttgttagtcagggatgcatcaaaccattatgtgacctacttgtgtgtccagaccctagaattgtgacggtttgtctagaggggctggagaacatactgaaagtgggtgaaggcgagaagaatttgggacgaacaggagatgtgaatctgtatgcacaaatgattgacgatgctgaaggattggagaaaatcgagaatctacagagtcacgataacaatgagatatacgagaaagcagtgaagcttcttgaaacatattggatggaggaagaggaggatgatggaatgccaccgggtcagtctggtttccaacttggtgatgcttctgttcccaatggtggctttaacttcagctgattcaaggtctgtcttgaagattgccgagagggagtagcggtggtgggatttatctgctttggtccaatattgtagtgtggttgaagttttgtgagtggttcaggtttcttacaatcaatagcagtcaaatgttgatgaattatgtaaaagtaatatttt

SEQ ID NO: 2650 - DNA, 1819 bp, Ambrosia trifida
caacacaactcaactcaactcattctaatattattattattaaccttcactccaatttctagggtttctttcttctttttgttacctaaaatagtctctgagacctaacgccaggacagaggttgccggaaccggtacaaggtggccgtggacgccgacgagggccggcggaggagagaagacaacatggttgagatccgtaagagcaaaagagaggagaatctgcagaagaagagacgtgaaggacttgctgctacccagttccctcttcctgttcagtctgttctgcttctgaaaagaagttagaaaacttacctgcaatggttgcggggttttgtcagatgatagtaacatgcagcttgaggctactacccagtttcgcaaactcttatcaatagaacgcagtcctcccattgaagaagttattcagtcaggtgttgttcctcgctttgttgagtttcttatgagagaggattatccccaacttcagtttgaggcagcttgggctttgactaatatcgcttcagggacatctgaacacaccaaagtggtgattgatcatggtgctgttcctatatttgtgaaacttcttgcatctaatagtgatgatgttagggagcaggctgtatgggcactaggtaatgttgctggtgattcacctaaatgtcgtgacctagtacttgcacaaggggctttgccttccttgctggcccagttaaatgcacaatctaaattatctatgttgagaaacgccacctggacgctttccaatttctgtagaggcaagccacaaccttcctttgatcagacaagacctgctcttccagctcttcaacaacttatacattcaaacgacgaagaagttttgactgatgcttgctgggcactttcatatctttcagatggtacgaatgataaaatacaagctgttatagaagcaaatgtatgtccccgattgattgagttactgaatcacccgtctccttcggtgctcatccctgctcttcgtacagttggcaacattgttactggtgatgatatgcaaactcagtatatcatcaatcatcaagccctgccttgtcttctgaatctgttgaccaataatcacaaaaagagcattaagaaggaagcttgttggaccatatccaacatcactgctgggaacaaggagcagattcagacggtgatcgaagcaaatatcattgggccccttgttcttttacttcagaatgcagagtttgacatcaagaaggaggctgcatgggctatctcaaatgccacttctggtggaagccatgaccaaattaagtatcttgttagtcaaggatgcatcaaacctttatgtgacctacttgtgtgtccagaccctagaattgtaaccgtttgtctagaggggctcgagaacatactgaaagtgggtgaagccgagaagaatttggggcgatcaggtgacgtgaatctgtatgcacaaatgattgatgatgctgaaggattggagaaaatcgagaatctacagagtcatgataacaatgagatatacgagaaagcagtgaagcttcttgaaacatattggatggaggaagaggaggatgatggaatgccaactggtcagtctggtttcccacttggtggtgatgtttctgttcccaatggtggctttaacttcagctgattcaaggtctttcttgaagattgccgagagggagtagcgctggtggcatctatctgcttggttcaatattgtagcgtggttgaagttttgtgagtggttcaggtttcttacaatcaatatcagtcaaatgttaatgaattatgtaaa

SEQ ID NO: 2651 - DNA, 1769 bp, Helianthus annuus
cccacattattactctcctatttagacaccatcactcactctgcaactcacaattcactcattctctcaacctccactccaatttctagggtttcctctacaaaaaatgtcgctaagacctagcgccaggacggaagttcgccggaaccgctacaaggtggcggtggacgccgatgaggggcgtcggaggagagaagacaatatggttgagatccgtaagagtaagagagaggagagtttgcagaagaagagacgtgaaggaattgctgctagccagttccctctacctgttcaatctgcttctgcttccgagaagaagttagaaaacttacctgcaatggttgcgggggttttgtcagatgataataatatgcagcttgaggccactacccagtttcgtaaactgttgtcgatagaacgcagtccacccattgaagaagttattcaatcaggtgttgttcctcgctttgttgagtttcttatgagggaggattttccccaactgcagtttgaggcagcttgggccttgactaatatcgcttcagggacatctgaacacacaaaagtggtgattgatcatggtgctgttccgatatttgtgaaacttcttgcatctcctagtgatgatgttcgggagcaggctgtatgggcactaggtaatgttgctggtgattcacctaaatgtcgtgaccttgtacttgcacaaggggctttgtcttctttgctggcccagttaaacgaacattctaaattatctatgttgagaaacgccacatggacgctttccaatttctgtagaggcaagccacaaccttcgtttgatcagacaagacctgctctaccagcacttcaacaacttatacattcaaacgacgaagaagtcttgactgacgcttgctgggcactttcatatctttcagatggtacgaatgataaaatccaagctgtaatagaagcaaatgtatgtcccagattgatcgagctactaaatcacccatcaccttcagtactcattcctgctcttcgtacagttggcaacattgttaccggtgatgatatgcaaactcagtatatcattaatcatcaagctctgccgtgtcttttgaatctgttgatcaataatcacaaaaagagtattaagaaagaagcgtgttggactatatcaaacataactgctggcaacaagaagcagattcagacggtgattgaagcaaatctcgttgcgcctcttgatcagtaacttcagcatgcagaattcgatattaaaaaagaagctgcatgggacatctcagatgctacttcaggagaaagtgatgaacaaattaagtatcttgttattcagggatgtatcacatctttatgtgagctacatgtgtgccccgactctacaaatgtgacagtttgtctagaggggcttgagaacattctgaaagtgggtgaagctgagaagaatttgggaaggaccgaggacacgaatctttatgcacaaatgattgatgatgctgaaggtttggagaaaattgagaacctacaaagtcatgataacaatgagatctatgagacagcagtgaagcttctggaaacgtattggttggaggaagaggatgacgtaatgccacctggcgaagttgctcagcccggttttaattttggtggtggtgatgttgctgttcctaatggtggctttaacttcaactgattcaaggtcggtcttgttgaagtagggggagatttatgtagtggtgcaggcatctatctgttttcatgag

SEQ ID NO: 2652 - DNA, 2224 bp, Triphysaria pusilla
gggagagggagaaaattctattctctctcttgcgaaaaagaacccaatctcgaaaaggttttcgtccatatccataatattcttccatactccattctcatctgacacaatagagaaccgctatcaattatctactgccatctaatttattttcagatttcgttttttatcctccttgttttttgatttgagatcgactcaacgatgtcgttgagaccgaacgccaagacggaggtccgccggagccggtacaaggttgcggttgacgcggatgagggacggcggcggagggaagataatatggtggagatccggaagaataaaagggaggagaacttgctgaagaagcgtcgcgaggggcttcaagctcagcaattccagcccgcagtcaacgctccactgctcgagaagaagctagaaacccttccatcgatggttgctggcatatggtcgaatgatagtgccctgcagctcgaggccacaactcagttccgtaaacttctttctatagaacgaaatcctccaattgaggaagtgatacagtctggagtcgttcctcgctttgttgagtttcttgcacgagatgattacccacagcttcagtttgaggcagcttgggctctcacaaacattgcttctggaacatctgacaacaccagggttgtgattgatcacggagctgttccaatatttgtgaggctgctaagttctccaagcgatgatgttcgtgagcaagcagtttgggctttgggcaatgttgctggtgactccccgaaatgtcgtgatcttgtccttggttatggagctttaatgccattattagctcaatttaatgaacatgtaaaactatccatgttgcgaaatgccacatggactctgtccaacttttgtcgaggaaagccgcaacctcagtttgaccaggtcaaacctgcccttcctgctcttgctctgcttattcgttcaaatgatgaagaggtcctaactgatgcctgctgggcactttcttatctatctgatggagtcaatgataaaattcaagctgtgattgagtctggtgtatgccctcgtctgattgagctattgcagcatacctcaccatctgttttgattcctgccttgcgtactgttggtaatattgtgactggtgatgatctccagactcaggctatcatcgattataggtctcttccttctctgcttaacttgttgacacaaaatcataagaaaagtatcaagaaggaagcttgttggactatctcaaacatcactgcagggaataaggatcagattcaggctgtgattgaggctggtattatttcccctcttgttctcctgcttcagaatgcagaatttgagataaagaaagaagctgcctgggctatttcaaacgccacttctggtggaaccaatgaccaaatcaagtttttggttcgcgagggatgtataaagccactgtgtgatcttctagtttgtccggaccccagaatcgtcacagtctgcttggaaggtcttgagaacattttaaaggtaggtgaagctgagaagaatcaaggtaccactggagaggtgaatgtcttcgcccaaatgatcgatgatgctgagggtctagagaagattgaaaatcttcagagtcatgataacaatgagatttatgagaaggctgtgaagattcttgaaatgtattggttggaagaggatgatgagcaacagctggtctctgatgatgctccacaatccggtttcaattttgggggtggtgaccttccagttccatctggaggtttcaaattcggttgaagaaattgttcgtgtcgttgtgggtttcatataatttgcaaactgaagaggtgaacaaaagttgatcctgtgtttgggggttgaaaaagtagaatggtcgtgtcgtatcgtccagccagttattgtgagtcttttgaagaaaatcaatcttcttcaatatttggagtcctctttttcgtgtttggtgtctgtactgtattgttggttatttattctattttgatggaaatatgacaaaattatatgtatatcacatcgaatatattaaagtgaaaacgggtcatatatgtaattttattttttattgtgagtaaactatttaatgctttgcgggttgtcaaaacagtctggtctcgtggagagtttcttttgagccgtattcacggatgcaatagaatattgtctggtaattaatgaaattgttgaa

SEQ ID NO: 2653 - DNA, 1419 bp, Sorghum bicolor
agacacagccgcacatcccccaccctccgcatttaaaatttccaactccgcctcatctcctttcattccccattctccacaagcatcaatctccgccgccgccgcccatcctcgagcaccattcccgcaaccgcctccgcctccgagtccgactccagcgagcgagcgcgaccagcgacagcgatccatggccctccgcgcgctcgacaacacgatgcccgccgccgtcgaggagcggcccaagaaggtggctaaggtgggcgtccccgccgccgccgccgccgtcaaggccacctcgcccgggagcggcgacaagaagaaaaagaaggggaacgacgagaactcggcgcccagggccacgaccgcggcggcggagcaggccgtggagtacatcccgtcggaggagctggcggcggcggccagccccaaggccaaggccgcggggctggtcgcggacctggactccaaggactgggtcaagacctgcgaggcgcttaacgacgcgcgccgcctcgcgatccaccaccccgcgctcctcaacccgatcctagagaaggtggtgctggcggtcgtgaagacgatgaagagcccccgcagcgcggtgctcaagacgtccatcatggcctgcgccgacatcttcagctccttcggcaacctcctctcctccgtctccgacgacgccttcgacaagctgctgctccagctcctgctgaaggcgtcccaggacaagcgattcgtgtgcgaggaggccgagaaggcgatgcgcgcgatggcggcgtcgatgccgccgctgccgctgctgaagaagctcaaggcgtacgtccaccacgccaaccttagggtcagggccaaggccgccgtcgccatctcccactgcgccgcccggatggacatcgaggcgatgaaggagttcgggatgtcagctctgctgcaggtggcggcggagctgctgaacgaccgtctaccggaggcgagggaggccgcccgcggcgtggtttcgtcgatgcacgcggcgttcgccaaggatgccgccgccagtggccaggaggacgacgcggccgcgtcctgggagagcctctgctcgctcagcctcccgcccatctccgcggtggccgtcgctaagatcaccgcctcctcctcctcgtagtagccacgcgtgctttgctgcgttgtttgagctcgtcgtccggttcggttcagaatcagaaaatgtagcgctgcgtgagtcagagtgagtgactgaactagcctagcctttttgctagtttgtcgctgctgctgctgctgtagcggccgagttctgttgtttgtttcattgctcatttgtttgtttctactccatgctatctcgcatggttacttctgtttatccatccctttgtgttacacaagtaataacatatcaattcacatggctta

SEQ ID NO: 2654 - DNA, 1449 bp, Sorghum bicolor
ccacgcgagtttgaacatttcatagccgttagacacagccgcacatcccccaccctccgcatttaaaatttccaactccgcctcatctcctttcattccccattctccacaagcatcaatctccgccgccgccgcccatcctcgagcaccattcccgcaaccgcctccgcctccgagtccgactccagcgagcgagcgcgaccagcgacagcgatccatggccctccgcgcgctcgacaacacgatgcccgccgccgtcgaggagcggcccaagaaggtggctaaggtgggcgtccccgccgccgccgccgccgtcaaggccacctcgcccgggagcggcgacaagaagaaaaagaaggggaacgacgagaactcggcgcccagggccacgaccgcggcggcggagcaggccgtggagtacatcccgtcggaggagctggcggcggcggccagccccaaggccaaggccgcggggctggtcgcggacctggactccaaggactgggtcaagacctgcgaggcgcttaacgacgcgcgccgcctcgcgatccaccaccccgcgctcctcaacccgatcctagagaaggtggtgctggcggtcgtgaagacgatgaagagcccccgcagcgcggtgctcaagacgtccatcatggcctgcgccgacatcttcagctccttcggcaacctcctctcctccgtctccgacgacgccttcgacaagctgctgctccagctcctgctgaaggcgtcccaggacaagcgattcgtgtgcgaggaggccgagaaggcgatgcgcgcgatggcggcgtcgatgccgccgctgccgctgctgaagaagctcaaggcgtacgtccaccacgccaaccttagggtcagggccaaggccgccgtcgccatctcccactgcgccgcccggatggacatcgaggcgatgaaggagttcgggatgtcagctctgctgcaggtggcggcggagctgctgaacgaccgtctaccggaggcgagggaggccgcccgcggcgtggtttcgtcgatgcacgcggcgttcgccaaggatgccgccgccagtggccaggaggacgacgcggccgcgtcctgggagagcctctgctcgctcagcctcccgcccatctccgcggtggccgtcgctaagatcaccgcctcctcctcctcgtagtagccacgcgtgctttgctgcgttgtttgagctcgtcgtccggttcggttcagaatcagaaaatgtagcgctgcgtgagtcagagtgagtgactgaactagcctagcctttttgctagtttgtcgctgctgctgctgctgtagcggccgagttctgttgtttgtttcattgctcatttgtttgtttctactccatgctatctcgcatggttacttctgtttatccatccctttgtgttacacaagtaataacatatcaattcacatggctta

SEQ ID NO: 2655 - DNA, 1370 bp, Setaria italica
gacacagccgtgcattccatcccccctctccccaccctccgcatttaaaattccaatccgtctcatcgacctttccatcccccaactctccacaagcatcaatcgccgccgccgccgccgccacctctccccgtctccatctccatccccgagaaccattccaagaatagcagcagcagcagcctccggtgagcttgaccagcaacaggaacccatggccctccgcgcgctcgacaacacgatgcccgccgtcgtcgaggagcggcccaagaaggtcgctaaggtggccgtccccgcccccgccgccgccgtcaaggccgcctcccccgggagcggcaagaagaagaagaagaacgacgagaactcggcgcccagggccacggccgcggcgggggagcaggctgtggagtacatcccgtcggcggagctggaggcggcggcccaccccaaggccaaggccgcggggcttgtcgcggagctggactccaaggactggatccgcgcgtgcgaggcgctcaacgacgcgcgccgcctcgcgatccaccactccgcgctcctgaacccgatcctggagaaagtgatgctggcgatcgtgaagacgatgaagaacccgcgcagcgcggtgctgaagacgtccatcatggcctgcaccgacatcttcaactcctgcggcaacctcctctcctccgtctccgacgacgccttcgacaagctgctgctgcagctcctgctgaaggcgtcccaggacaagcggttcgtgtgcgaggaggccgagaaggcgatgcgcgcgatggcggcgtcgatgccgccgctccccctgctgaagaagctcaaggcgtacgtccaccacgccaacctcagggtcagggccaaggccgccgtcgccatctcccactgcgccgccaggatggacatcgaggccatgaaggagttcgggatgtcggcgctcctccaggtggcagcggagctcctgaacgaccggctaccggaagccagggaggccgcccgcagcgtggtggggtcgatgcacggcgccttcgccaaggaggccgcggcgaggggggaggaggaggaggcggacgcgcccaccgtggccgcctcctgggagagcctctgctccctcagcctgccgcccatctccgcgcaggccgtcgtcaagatcgcctcgtcgtcgcagtagccacgcgtattgctgcgttgctagccttgggctcggctggttcagatcagaacccattttagccgtcgctttactagtttgttgctgattcgtttggtcgtttatacatgctatctcgcatgctttgttctgtttatcccgttgggttactgcaagtaatgaagtaataacatatcgatttcacatggct

SEQ ID NO: 2656 - DNA, 1350 bp, Panicum virgatum
  misc_feature (260)..(260): n is a, c, g, or t
  misc_feature (292)..(293): n is a, c, g, or t
  misc_feature (295)..(295): n is a, c, g, or t
  misc_feature (554)..(554): n is a, c, g, or t
  misc_feature (668)..(668): n is a, c, g, or t
cacccgtccgcatttaaaatttccaatccacctcttcggtccggcaattttcactctccactctcccaccagcatcacttgacaccgccgccgcctcatctccatctccatctgcatcctcgagcaccattccaagaacagcaaccgcatacgttgagcttggccggcgacggcaacccatggctctccgcgcgctcgacaacacgatgcccgctgccgtcgaggaacggcccaagaaggtcgctaaggtggccgccccnaccgaggccgcccccgtcaaggctgcctcccnngngagcggcaagaggaagaagaagaacgacgagaactcggcgcccagggccacggccgcggcaggggagcaggccgtggagtacatcccgtcggaggagctggaggcggcggcgcacccgaaggccaaggccgcggggctggtcgcggagctggactccaaggactggatccgggcgtgcgaggcgctcaacgacgcgcgccgcctcgcgatccaccactccgcgctcctgaacccgatcgtggagaaggtgatgctggcnatcgtgaagacgatgaagagcccgcgcagcgcggtgctgaagacatccatcatggcctgcaccgacatcttcaactccttcggcaacatcctctcctccgtctccgacgacgcnttcgacaagctgctgctccagctcctgctgaaggcgtcccaggacaagcggttcgtgtgcgaggaggccgagaaggcgatgcgcgccatggcggcgtcgatgcctccgctgctgctgctgaagaagctcaaggcgtacgtccaccacgccaacctcagggtcagggccaaggccgccgtcgccatctcccactgcgccgccaggatggacatcgcggcgatgaaggagttcgggatgtcggcgctcctccaggtggcggcggagctgctgaacgaccggctgccggaggccagggaggccgcccgcagcgtggtggggtcgatgcacggcgccttcgccaaggaggccgcagcgaaggggaaggaggaggaggacgcgccctccgtggccgcctcctgggagagcctctgctcgctcagcctgccgcccatctccgcgcaggccgtcgccaagatcgccgccacgcagtcgcagtgaccaatgcgctgctagtttgggcttcagctggttcactttagaaatcagaacccgctgcatggccccaccgtttactagttttttcttaaaaaaattattgctgcagcttaatgtttcgtttgtttatgcatgctatctcgcatggttttgttctgtttaatgttatccctttgagttactacaagtaataacatagtgttcacat

SEQ ID NO: 2657 - DNA, 2158 bp, Sorghum bicolor
tcattgcgccctgtcctcactagcttagctagctgctaccttcacctccatacccgtctgccgtctctctagtctctacacacacccacagacacaggtgagtgacactacagtgggagcgtgaacagaggaagcggctgagctctcgtcaagttgcggcgatgaagatgcatcgtttcgctctgcctggtctggggtttctcgtcctgtggatgctgctgcattgcggaagtgagctcgccgcggcggtgcctccagatggctggtacgattactctgcctacaccgactgcagaggccagccggaaccggcgctgtacaacggaggcattctcaagttcggcaacagcgacgactcggacgggtaccgcacgacggagaccggcgtcttctccccggcgttcgtggtgtacaacctcaacaaaaccaccatgtacaccttctcatgctgggtgaagctggaaggcgcgtactcggctttgatcactgcgaggctggcgccggacaacaccggcgcgaggtgcatcgccacggttcttgccaggagcgactgctgggccttcgtcaagggcggcttcgtcctggactggccaacgcagacctctgtcatcttcttccagaatgctgacaagacccccatgaagatcaccgtcgcgagcgggtcgctgcagccgttcacgacagaccagtgggcgatgcaccagcaggataccatccggaagaggaggaagcgcgtggcgaccatccacgtcgccgacccgcaaggcgcccgcgtggtgggcgcgtccgtgtcggtgcagcagacggccaaggatttcccgatcgggtcggcgatcgcctccaccatcctggggaaccaggcgtaccagcagtggttcgtggaccgcttcaacgcggcggtgttcgaggacgagctcaagtggtactccacggagcccatgtcgggtctgctccgcttcgacgtccccgaccagatgcttgcgttcgtgcggtcgcaccgcgtgatggtgcggggccacaacatcttctgggagaaccaggacgcgacgccccggtgggtgaagaacctgacggcggacgacctccggtccgccgtgaacacgcgcatccagagcctcatgacccggtaccgcggcgagttcgcgcactgggacgtcaacaacgagatgctgcactacaacttctacgagcagcgcctgggccccaacgcgtccatggacttcttcagcgtggcgcaggacgccgacccgctggccacgctcttcatgaacgagtacaacgtcatcgagacctgcgacgaccccttctccaccgtggacacgtacgtggccaagctcaaggagctccggtccggcggcgccatcctggaagggatcggcctggagggccacttctccaagcccaacatcccgctgatgcgagccatactggacaagctcgccaccctggggctgcccatctggttcaccgagatcgacatcagcaacaagttcgacgcgcagacgcaggcagcgtacctggagcaggtgctgcgggaggcctactcgcacccggccgtcagcggcgtcatgctgtggacggcgctgcaccccagcgggtgctaccagatgtgcctcacggactggaacctcgccaacctgcccacgggggacgtggtcgaccgcctgctgaacgagtggcggacgctgcaggcgggcgggcagaccgacgcgcacggcgcctacagcttcagcggatacctcggggagtacgtcctcacggtgagctacaacaacaggaccacgcagtccaccttctcgctgtcgccgggagacgagaccaggcacatcaacgttcagatgtgaccgagagtccgtgacgatcgatatgtggggtataaactaggtgctcttgtgttgttttgcattgcattgggctcctctcctgactcccttgtcatgtacgggtcgtaatgcttgctactgcttacccattatactattattactagctgatgtagtgactgcaagtgattgttgtggaagaagattgcacagtcaatctatgtgttcttactgtcctgcgtgaaatttactgtaaaatctggcatccaacagctggcatgtgtaatgtattgccatgtttaatgatccatcttagcgttactatcaagagattt

SEQ ID NO: 2658 - DNA, 2180 bp, Sorghum bicolor
ctgatcacgaccctctcttcattgcgccctgtcctcactagcttagctagctgctaccttcacctccatacccgtctgccgtctctctagtctctacacacacccacagacacaggtgagtgacactacagtgggagcgtgaacagaggaagcggctgagctctcgtcaagttgcggcgatgaagatgcatcgtttcgctctgcctggtctggggtttctcgtcctgtggatgctgctgcattgcggaagtgagctcgccgcggcggtgcctccagatggctggtacgattactctgcctacaccgactgcagaggccagccggaaccggcgctgtacaacggaggcattctcaagttcggcaacagcgacgactcggacgggtaccgcacgacggagaccggcgtcttctccccggcgttcgtggtgtacaacctcaacaaaaccaccatgtacaccttctcatgctgggtgaagctggaaggcgcgtactcggctttgatcactgcgaggctggcgccggacaacaccggcgcgaggtgcatcgccacggttcttgccaggagcgactgctgggccttcgtcaagggcggcttcgtcctggactggccaacgcagacctctgtcatcttcttccagaatgctgacaagacccccatgaagatcaccgtcgcgagcgggtcgctgcagccgttcacgacagaccagtgggcgatgcaccagcaggataccatccggaagaggaggaagcgcgtggcgaccatccacgtcgccgacccgcaaggcgcccgcgtggtgggcgcgtccgtgtcggtgcagcagacggccaaggatttcccgatcgggtcggcgatcgcctccaccatcctggggaaccaggcgtaccagcagtggttcgtggaccgcttcaacgcggcggtgttcgaggacgagctcaagtggtactccacggagcccatgtcgggtctgctccgcttcgacgtccccgaccagatgcttgcgttcgtgcggtcgcaccgcgtgatggtgcggggccacaacatcttctgggagaaccaggacgcgacgccccggtgggtgaagaacctgacggcggacgacctccggtccgccgtgaacacgcgcatccagagcctcatgacccggtaccgcggcgagttcgcgcactgggacgtcaacaacgagatgctgcactacaacttctacgagcagcgcctgggccccaacgcgtccatggacttcttcagcgtggcgcaggacgccgacccgctggccacgctcttcatgaacgagtacaacgtcatcgagacctgcgacgaccccttctccaccgtggacacgtacgtggccaagctcaaggagctccggtccggcggcgccatcctggaagggatcggcctggagggccacttctccaagcccaacatcccgctgatgcgagccatactggacaagctcgccaccctggggctgcccatctggttcaccgagatcgacatcagcaacaagttcgacgcgcagacgcaggcagcgtacctggagcaggtgctgcgggaggcctactcgcacccggccgtcagcggcgtcatgctgtggacggcgctgcaccccagcgggtgctaccagatgtgcctcacggactggaacctcgccaacctgcccacgggggacgtggtcgaccgcctgctgaacgagtggcggacgctgcaggcgggcgggcagaccgacgcgcacggcgcctacagcttcagcggatacctcggggagtacgtcctcacggtgagctacaacaacaggaccacgcagtccaccttctcgctgtcgccgggagacgagaccaggcacatcaacgttcagatgtgaccgagagtccgtgacgatcgatatgtggggtataaactaggtgctcttgtgttgttttgcattgcattgggctcctctcctgactcccttgtcatgtacgggtcgtaatgcttgctactgcttacccattatactattattactagctgatgtagtgactgcaagtgattgttgtggaagaagattgcacagtcaatctatgtgttcttactgtcctgcgtgaaatttactgtaaaatctggcatccaacagctggcatgtgtaatgtattgccatgtttaatgatccatcttagcgttactatcaagagatttaaaa

SEQ ID NO: 2659 - DNA, 1771 bp, Saccharum officinarum
ctcattagctagctgctagcttcccctccatacccgtctgccgtctctctagtctctacacacacaggtgacactatagtgaggagcaggagcttgaacagaggaagcggctgagctctcgtctagttgcgattgcggcgatgaagatgcatcgcttcgctctgcgtggcctggggtctctcgtgctgtggatgctgctgcattgcggaagtgagctcgccgcagcggtgcctccagatggctggtacgattactccgcctacaccgactgcagaggccagccggagccggcgctgtacaacggaggcattctcaagtacggcaacagcggcgacgacccggacgggtaccgcacgacggagaccggagtcttctcgccggcgttcgtggtgtacaacctcaacaagaccaccatgtacaccttctcatgctgggtgaagctggaaggcgcgtactcggctttgatcactgcgaggctggcgccagacaacaccggcgcgaggtgcatcgccacggttcttgccaggagcgactgctgggccttcgtcaagggcggcttcgtcctggactggccaacgcagacctcggtcatcttctttcagaatgctgacaagacccccatgaagatcaccgtcgcgagcgggtcgctgcagccgttcacgacagaccaatgggcgatgcaccagcaggataccatccggaagaggaggaagcgtgtggcgaccatccacgtcgccgacccgcaaggcgcccgcgtggtcggcgcgtccgtgtcggtgcagcagacggccaaggacttcccgatcgggtcggcgatcgcctccaccatcctggggaaccaggcgtaccagcagtggttcgtggaccggttcaacgcggcggtgttcgaggacgagctcaagtggtactccacggagcccatgtcggggctgctccgcttcgacgtccccgaccagatgctggcgttcgtgcggtcgcaccgcgtgatggtgcgcggccacaacatcttctgggagaaccaggacgcgacgccccggtgggtgaagaacctgacggcggacgacctccgcgccgccgtgaacacgcgcatccagagcctcatgacccgctaccgcggcgagttcgcgcactgggacgtcaacaacgagatgctgcactacaacttctacgagcagcgcctggggcccaacgcgtccatggagttcttcagcgtggcgcaggacgccgacccgctggccacgctcttcatgaacgagtacaacgtcatcgagacctgcgacgacccgttctccaccgtggacacgtacgtggacaagctcaaggagctccggtccggcggcgccatcctggaggggatcggcctggagggccacttctccaagcccaacatcccgctgatgcgggccatactcgacaagctcgccaccctggggctgcccatctggttcaccgagatcgacatcagcaacaagttcgacgcgcagacgcaggccacgtacctggagcaggtgctgcgggaggcctactcgcacccggccgtcagcggcgtcatgctgtggacggcgctgcaccccaacggctgctaccagatgtgcctcacggactggaacctcagcaacctgcccacgggggacgtggtcgaccgcctgctcaacgagtggcggacgctgcaagcgggcgggcagaccgacgcgcacggcgcctacaggttcagcggctacctgggggagtacgttctcaccgtgagctacaacaacaggacgacccaggc

SEQ ID NO: 2660 - DNA, 2073 bp, Setaria italica
gtgtgtttgtgcgggtactctcttcttcgctctccggtctccactgctcactagcactaggctagctgctatcttcctcctccatacccagtgtgtgagagcagcttgaagccttgagcagaggagaagttgttgagctcgttcggttgcggcgatgaggacgcctcgccaagctctgcatgccgcggggttcctcgcgctgtggatgctgctgcattgcggcattgagctcgtcgcggcggtgcctcctcctggctggtacgactacacctcctacactgactgcagaggccagccggagccggctctgtacaacgggggcatcctcaagttcggcaacagcgacgaccctgacggctatcgcacgacggagaccggcgtcttctccccggcgttcgtggtctacaacctcaacaagacaaccatgtacaccttctcatgctgggtgaagctggaaggcgcctccgcggctctgatcactgcgaggctggcgccggacaactccggcgcgaggtgcatcgccacggttctcgctaggagcgactgctgggccttcgtcaagggcggcttcgtcctcgactggccaacgcagacctctgtcatcttcttccagaacgctgacaagacgcccatgaagatcaccgtcgcgagtgggtcgctgcagccgttcacgacggaccagtgggcgatgcaccagcaggataccatccggaagaggaggaagcgcgtggcgacgatccacgtcgccgatccgcagggcgctcgcgtggtgggcgcgtccgtgtccgtgcagcagaccaccaaggacttcccgatcgggtcggcgatcgcctccaccatcctgggcaaccaggcgtaccagcagtggttcgtggaccggttcaacgcggcggtgttcgaggacgagctcaagtggtactcgacggagcccatgtcggggctcctccgcttcgacgtccccgaccagatgctggcgttcgtgcgttcccaccgcgtgatggtgcgcgggcacaacatcttctgggagaaccaggacgcgacgccccggtgggtgaagaacctgacggccgacgacctccggtccgccgtgaacacccgcatccagagcctcatgacccggtaccgcggcgagttcgcgcactgggacgtgaacaacgagatgctccactacaacttctacgagcagcggctggggcccaacgcgtccatggagttcttcagcgtggcgcaggacgcggacccgctggcgacgctcttcatgaacgagtacaacgtgatcgagacctgcgacgaccccttctccaccgtggacacgtacgtggccaagctcaaggagctccgcgccggcggcgccatcctggaggggatcggcctggagggacacttctccaagcccaacatcccgctgatgcgcgccatcctggacaagctcgccacgctggggctccccatctggttcaccgagatcgacatcagcaacaagttcgacgcgcagacgcaggcggcgtacctggagcaggtgatgcgggaggcctactcgcatccggcggtgagcggggtgatgctgtggacggcgctgcaccagagcgggtgttaccagatgtgcctcacggactggaacctgaacaacctgcccacgggggacgtcgtcgaccgcctcctcaacgagtggcggacgctgcaggccggagggcagaccgacgcgcacggcgcgtacagcttcagcggatacctcggggagtacaccctcacggtgagctataacaacaggacgacgcagtccaccttctcgctgtcgccgggagacgagaccaggcacatcaacgtccagatgtaactgtcaggctgcgcgcggtgaatacggccattcattcgggtggtgttactagccacgctgttactgcctaccagcccttgtgttggtttgggctcctctctcctgactcctcgtcgcatacgggtagtgtatgttactgcatactagtagtagctaatgttagtggttgtaagtgattgttgtggaagaaaattgcacgggcaaaactatttttgcgatcttttcgtggaatttag

SEQ ID NO: 2661 - DNA, 1813 bp, Setaria italica
tgcgggtactctcttcttcgctctccggtctccactgctcactagcactaggctagctgctatcttcctcctccatacccagtgtgtgagagcagcttgaagccttgagcagaggagaagttgttgagctcgttcggttgcggcgatgaggacgcctcgccaagctctgcatgccgcggggttcctcgcgctgtggatgctgctgcattgcggcattgagctcgtcgcggcggtgcctcctcctggctggtacgactacacctcctacactgactgcagaggccagccggagccggctctgtacaacgggggcatcctcaagttcggcaacagcgacgaccctgacggctatcgcacgacggagaccggcgtcttctccccggcgttcgtggtctacaacctcaacaagacaaccatgtacaccttctcatgctgggtgaagctggaaggcgcctccgcggctctgatcactgcgaggctggcgccggacaactccggcgcgaggtgcatcgccacggttctcgctaggagcgactgctgggccttcgtcaagggcggcttcgtcctcgactggccaacgcagacctctgtcatcttcttccagaacgctgacaagacgcccatgaagatcaccgtcgcgagtgggtcgctgcagccgttcacgacggaccagtgggcgatgcaccagcaggataccatccggaagaggaggaagcgcgtggcgacgatccacgtcgccgatccgcagggcgctcgcgtggtgggcgcgtccgtgtccgtgcagcagaccaccaaggacttcccgatcgggtcggcgatcgcctccaccatcctgggcaaccaggcgtaccagcagtggttcgtggaccggttcaacgcggcggtgttcgaggacgagctcaagtggtactcgacggagcccatgtcggggctcctccgcttcgacgtccccgaccagatgctggcgttcgtgcgttcccaccgcgtgatggtgcgcgggcacaacatcttctgggagaaccaggacgcgacgccccggtgggtgaagaacctgacggccgacgacctccggtccgccgtgaacacccgcatccagagcctcatgacccggtaccgcggcgagttcgcgcactgggacgtgaacaacgagatgctccactacaacttctacgagcagcggctggggcccaacgcgtccatggagttcttcagcgtggcgcaggacgcggacccgctggcgacgctcttcatgaacgagtacaacgtgatcgagacctgcgacgaccccttctccaccgtggacacgtacgtggccaagctcaaggagctccgcgccggcggcgccatcctggaggggatcggcctgacttctccaagcccaacatcccgctgatgcgcgccatcctggacaagctcgccacgctggggctccccatctggttcaccgagatcgacatcagcaacaagttcgacgcgcagacgcaggcggcgtacctggagcaggtgatgcgggaggcctactcgcatccggcggtgagcggggtgatgctgtggacggcgctgcaccagagcgggtgttaccagatgtgcctcacggactggaacctgaacaacctgcccacgggggacgtcgtcgaccgcctcctcaacgagtggcggacgctgcaggccggagggcagaccgacgcgcacggcgcgtacagcttcagcggatacctcggggagtagtgagctataacaacaggacgacgcagtccaccttctcgctgtcgccgggagacgagaccaggcacatcaacgtccagatgtaacc

SEQ ID NO: 2662 - DNA, 1941 bp, Panicum virgatum
gctgtctgctgtgtgtgtggcctcggttgctcgctatctgctgctagcttcctcttctcgctagctgctgcttctagcttcctcctccatagcccgcagcttgaagccttgccttgagcagaggaagaggttgagctcgctcgttcggtcgcggcgatgaggacgcctcgctccgctccgcgtgccgtggcggggttcgtcgtgctgtggatgctgctgcactgcggcagcgagctcgtcgcggcggtgcctcctgatggctggtacgactacgccgcctacacagactgcagagggcagccggagccggcgctgtacaacggcggcatcctcaagttcggcaacagcgacgacccggacggataccgcacgacggagaccggcgtcttctccccggcgttcgtggtctacaacctcaacaagaccaccatgtacacattctcatgctgggtgaagctggaaggcgcctccaacgctctgatcactgcgaggctggcgccggacaacaccggcgcgaggtgcatcgccacggttctcgccaggagcgactgctgggccttcgtcaagggcggcttcgtcctcgactggccaacgcagaccgccgtcatcttcttccagaacgctgacaagacgcccatgaagatcaccgtcgccagcgggtcgctgcagccgttcacgacggaccagtgggcgatgcaccagcaggacaccatccggaagaggaggaagcgcgtggcgaccatccacgtggccgacccgcagggcgcccgcgtggtgggcgcgtccgtgtccgtgcagcagaccgccaaggacttcccgatcgggtcggcgatcgcctccaccatcctgggcaaccaggcgtaccagaagtggttcgtggaccgcttcaacgcggcggtgttcgaggacgagctcaagtggtactcgacggagcccacgtcggggctcctccgcttcgacgtgccggaccagatgctggcgttcgtgcgctcccaccgcgtgatggtgcgcggccacaacatcttctgggagaaccaggacgcgacgccgcggtgggtcaagaacctgacctcgccggacgacctccgcgccgccgtgaacgcgcgcatccagggcctcatgacccgctaccgcggcgagttcgcgcactgggacgtcaacaacgagatgctccactacaacttctacgagcagcggctggggcccaacgcgtccatggagttcttcagcgtggcgcaggacgccgacccgctggcgacgctcttcatgaacgagtacaacgtgatcgagacctgcgacgaccccttctccaccgtggacacgtacgcggccaagctcagggagctccgcgccgggggcgccatcctggaggggatcgggctggagggccacttctccaggcccaacatcccgctgatgcgcgccatcctggacaagctcgccacgctggggctccccatctggttcaccgagatcgacatcagcagcaagttcgacgcgcagacgcaggcggcgtacctggagcaggtgctgcgggaggcgtacgcgcacccggcggtgagcggggtgatgctgtggacggcgctgcaccccagcgggtgctaccagatgtgcctcaccgactggggcctcaacaacctgcccacgggggacgtcgtcgaccgcctgctcaacgagtggcggacgctgcaggccggcggccagacggacgcgcacggcgcctacagcttcagcggattcctcggggagtacatcctcacggtcacctacaacaacaggacgacgcagtccaccttctcgctctcgccgggcgatgagaccaggcacatcaacgtccagatgtaactgcctaccaggcaccagccctcgtgctgttctgggagcgtctctcctgactccgtcgtcccatacgggtagtgtgatgtatgcaacggcttacta

SEQ ID NO: 2663 - DNA, 3659 bp, Oryza sativa
ggcgaacaggaggtgttggctaggcccggtgtttgagcaccacaagggcactgcaccaaaccgcttccttgaagaggcggccagcgccgaggaccaggtgcacgcgcatggtgggcgcccatgccatggcgcaggccagcccgtgaacccccgccacgccaatggcatcgcgccaagtgtggaaacaccggccacccgggcctcttctatatatacacacctctgcacacatctccttgcatcgctgtgatcacgacacagaacgtacatccttcagttcagctcgccattgctaagcctgaaagcttccttcgtagcgcacttgggagctggaagatgaggaggttttctctacatgccgtgagatatctcgtgctgtggatgctgctgcggtgtggccgtgagctcgttgcagcggtgcctcctgatggctggtacgattacactgcatacaccgactgcagagggcagccggagccggcgctgtacaacggagggattctgaggttcggcaacagcgacgacccgaccggctaccgcacgacggagaccggcgtcttctcgccggcgttcgtggtctacaacctcaacaagaccaccatgtacaccttctcaagctgggtcaagctggaaggcgcgtcctctgctctgatcacggcgaggcttgcgctggacaacgccggcgcgcggtgcatcggcacggttctcgcgaggaacgactgctgggccttcctcaagggcggcttcgtcctcgactggccaacacaaacctcagttatattttttcagaatgctgacaagacccctatgaagatcacggtcgcgagcggttcgcttcagccgttcacgtcggatcagtggtccatgcaccagaaagacacgatccggaagaggaggaagcggatggctaccatccacgttgccgatcagcaaggcggccgcgtggttggcgcgtccgtgtccgtgagacaaaccgccaaggacttcccgttcggctcggccatcgcctccaccatcttggggaaccaagcctatcagaaatggttcgtggatcggttcaacgcggcggtgttcgaggacgagctgaagtggtactctacggagcccatgtcggggcagctgcggttcgacgtgccggaccagatgctggcgttcgtgcggtcgcaccgcgtgatggtgcgagggcacaacatcttctgggagaaccaggacgcgacgccgagctgggtgaagggcctgtcaccggacgacctccgcgccgccgtcaacggccggatccagaacctgatgacccgctaccgcggcgagttcgcgcactgggacgtgaacaacgagatgctgcactacaacttctacgagcagcggctgggcgccaacgcgtcggtggagttcttcagcgtggcgcaggacgccgacccgctcgccacgctcttcatgaacgagttcaacgtgatcgagacctgcgacgacgtgtcctccaccgtggacacgtacgtggcgaagctcaaggacctccgcgcggggggcgccgtcctggagggcatcggcctggagggacacttcctcaagcccaacatcccgctcatgcgcgccgtgctcgacaagctcgccacgctcggcctgcccatctggttcaccgagatcgacatcagcaaccggtacgacgcgcagacgcaggccgtctacctggagcaggtgctcagggaggcgtactcccacccggccgtcaccggcgtcatgctgtggacggcgctgcaccccaacggatgctaccagatgtgcctcaccgactggaacctcaacaacctccccgtcggagacgtcgtcgaccgcctcctgcaggagtggcagacggggcaggccgccggcccgaccgacgcgcacggcgcctacagcttcagcggattcctcggggagtacatcgtctccgtcacctacgccaacagcacgtcgcaggccaccttctcgctctctcccggcgacgagaccaggcacatcaacatccagatatgaccatacgtatgtacacggtacacctcctcggtgtatatggcttcaagctctgctgacatcgtgacatactgacatgtcgtcacgtatgtgtaatgggtgacagtgtactgtcacgacttgtaggttgtaattgtggttacggaggtcagttaaccataaattggttcgattgaaccatgtacatgtacctggctcgggccggagactcgaacgaaccacgcaaaaacgacgacccgtgtgcaatcgaatcggtgttttccttggacggagccgcggccgaaacggaatcacccgagagatcacacatctcgggctcccgatggactccgcctcgccgccctccccgccgccggcgcaggcgtccgccgcagaagccagtggggcatccaatgccagcctgcggtggcgcatccttcgccgcgccctgctcgcgcgctccgcctccacctcccgcgcaccagaggaaacttctaacgatcagcaagataaaaatgatactaacaaaatttccagaaagacatcgcgtggctttgacctgattgagtgtcatatgctgcccatttcacagtcaactaaatcacatggggattcatcaagtagaaatgagaatattgtggaatgccataatgatgttcgtgtctgttacaagctaccttgtgaaggttcacctaaacttaacctagtatacagaagagaggattcccttgaactaaatgacattgtagcttctaacagatacaatattgacactactggacttgtgtgttgttggccgtcggaagaggtccttgcgtactactgtatcaaccattcggatatgttcaggtccaagaaggtgcttgagcttggatccggttatgggttagctggacttgctattgcagccagcacagatgctgatgaggtcgttatttctgatggaaatccacaagtagttggatatattcagcagaatatatccatcaatacagaaacttttggtcaaacaaaagttaaatctatggtacttcactgggatgctgggcaggcttcagaaattattagttccttcgatattattgttgcaagtgactgcacatttttcaagcaattccatcagagccttgcacgggttgtcaaatccttgttgaagcattcagaaacctcacaggccattttcctgagcccaaagagaggcgattcactcagcaaattcctagaagtaattaaaaagaatggtttgtcttgtgagttgatagagaagtatgatcccactgtatggaatatgcacaaaaaatatgtatcggatgataacagatcctggcccaactacaatgaagagcactgctaccctctattggttagaattaatagtcacagcaaatagttacctccagacatttcgtttgatctatgatgggttcatttgtgatgtaaaagctttagctagtctatgttgtaatttatacattacaatagaagtgggttatcggttgatatttttcttgatatcatcttttttttccccgagtgtgtcaaaagaaagatgattgacttgcaagttttcctttaatcacctatagtccttcataacattactgatgttttgtgcacatttgcacaaacacaagagcacctgtgcatataacaatgcatgatttcataag

SEQ ID NO: 2664 - DNA, 1961 bp, Oryza sativa
ctccttgcatcgctgtgatcacgacacagaacgtacatccttcagttcagctcgccattgctaagcctgaaagcttccttcgtagcgcacttgggagctggaagatgaggaggttttctctacatgccgtgagatatctcgtgctgtggatgctgctgcggtgtggccgtgagctcgttgcagcggtgcctcctgatggctggtacgattacactgcatacaccgactgcagagggcagccggagccggcgctgtacaacggagggattctgaggttcggcaacagcgacgacccgaccggctaccgcacgacggagaccggcgtcttctcgccggcgttcgtggtctacaacctcaacaagaccaccatgtacaccttctcaagctgggtcaagctggaaggcgcgtcctctgctctgatcacggcgaggcttgcgctggacaacgccggcgcgcggtgcatcggcacggttctcgcgaggaacgactgctgggccttcctcaagggcggcttcgtcctcgactggccaacacaaacctcagttatattttttcagaatgctgacaagacccctatgaagatcacggtcgcgagcggttcgcttcagccgttcacgtcggatcagtggtccatgcaccagaaagacacgatccggaagaggaggaagcggatggctaccatccacgttgccgatcagcaaggcggccgcgtggttggcgcgtccgtgtccgtgagacaaaccgccaaggacttcccgttcggctcggccatcgcctccaccatcttggggaaccaagcctatcagaaatggttcgtggatcggttcaacgcggcggtgttcgaggacgagctgaagtggtactctacggagcccatgtcggggcagctgcggttcgacgtgccggaccagatgctggcgttcgtgcggtcgcaccgcgtgatggtgcgagggcacaacatcttctgggagaaccaggacgcgacgccgagctgggtgaagggcctgtcaccggacgacctccgcgccgccgtcaacggccggatccagaacctgatgacccgctaccgcggcgagttcgcgcactgggacgtgaacaacgagatgctgcactacaacttctacgagcagcggctgggcgccaacgcgtcggtggagttcttcagcgtggcgcaggacgccgacccgctcgccacgctcttcatgaacgagttcaacgtgatcgagacctgcgacgacgtgtcctccaccgtggacacgtacgtggcgaagctcaaggacctccgcgcggggggcgccgtcctggagggcatcggcctggagggacacttcctcaagcccaacatcccgctcatgcgcgccgtgctcgacaagctcgccacgctcggcctgcccatctggttcaccgagatcgacatcagcaaccggtacgacgcgcagacgcaggccgtctacctggagcaggtgctcagggaggcgtactcccacccggccgtcaccggcgtcatgctgtggacggcgctgcaccccaacggatgctaccagatgtgcctcaccgactggaacctcaacaacctccccgtcggagacgtcgtcgaccgcctcctgcaggagtggcagacggggcaggccgccggcccgaccgacgcgcacggcgcctacagcttcagcggattcctcggggagtacatcgtctccgtcacctacgccaacagcacgtcgcaggccaccttctcgctctctcccggcgacgagaccaggcacatcaacatccagatatgaccatacgtatgtacacggtacacctcctcggtgtatatggcttcaagctctgctgacatcgtgacatactgacatgtcgtcacgtatgtgtaatgggtgacagtgtactgtcacgacttgtaggttgtaattgtggttacggaggtcagttaaccataaattggttcgattgaaccatgt

SEQ ID NO: 2665 - DNA, 2088 bp, Brachypodium distachyon
gcagtgatcataactggtacacatacattcttcagccttggtcactagcagactagctaggtagcttgagagcagtttagttgagcagacgaagaagccgagtggaagagaggaccgcgctgtaaaaagatgaggaggagtcatagcttcgtctccgctctgaaacatgtggtattgtttctcgtgtcgtggatggtgcattgcggcaacgagctagttgctgcggtgcctcctgatggctggtacgattactctgcctacacggattgcagaggccagccggaaccggcgctgtacaacggcgggattctgaagtacggcaacagtgacgacccgacaggctaccacacgacggagaccggcgtcttgtccccggcgtttgtggtatacaaccttaacaagaccactatgtacaccttctcaagttgggtcaggctggaagggtctgactcggctctgatcacagcgaggctggccccggacaactccggcacgaggtgcatcgggacagttcttgcgaggaatgactgctggtcgttcctcaagggcggcttcgttctggactggccgacgcagacctctgtcattttctttcagaatgctgacaagacgcctatgaagatcaccgtcgcgagaggctcgctgcagcccttcaccacggatcaatgggcgatgcaccaaaaagatacgatccggaagaggaggaagcggatggcgacgatccacgtggccgatccccaaggtagccgcgtggtgggggcatcagtctccgtgcagcagacggccaaggacttcccgttcgggtcggcgatcgcgtccaccatcctgggcaacgaggcctaccagaaatggttcgtggatcgcttcaacgcggcggtgttcgaggacgagctcaagtggtactcgacggagccggcgtcgggcctgctccggttcgacgtgccggaccagatgctggcgttcgtgcggtcgcacagggtcatggtgcgcgggcacaacatcttctgggagaaccaggaggcgacccctcgctgggtgaagggcctgtccccggaggacctccgctccgccgtcaacacccggatccagagcctcatgacgcggtaccgcggcgagttcgcgcactgggacgtcaacaacgagatgctgcactacaacttctacgagcagcggctgggccccaacgcgacggtggagttcttcagcgtggcgcaggacgccgacccgctggccacgctcttcatgaacgagtacaacgtcatcgagacctgcgacgacgtgtcgtccaccgtggacgcgtacgtggcaaggctcaaggacctcagggccgggggcgccgtgctcgaggggatcggactggagggccacttctccaagcccaacatcccctacatgagggccgtgctggataagctggccacgctgggcttgcccatctggttcacggagatcgacatcaacaacaagttcgacgcgcagacgcaggccgtgtacctggagcaggtgctgagggaggcctactcgcacccggccgtgagcggcgtgatgctgtggacggcgctgcaccagaacgggtgctaccagatgtgcctcacggactgggacctcaagaacctgcccgtgggggacgtcgtcgaccggctgctgcaggagtggcagacggggcaggccgccgggaacacggacgcccacggcgcctacagcttcagcgggtacctcggggagtacgtcgtcaccgtcagctccggcaacagctccgcgcagtccacgttctcgctgtctccaggggacgagaccaggcacatcacccttcacatatgagaccctctctagccggagccatgctgtttactttccgcgctcgttgttctgggcttgtagctcccctgacatttcgtcgcacgcgcgtgggcagtgttataaccgaactactagtgtagactgtgcagtagttgtattaccgggtaaagttgcatcaatttgtttgacatgctgttaagagtcccgtccccgccttcacatgctgttgggagttctcgagattttcagtttacgaaccatcactcgtgaacttgttttacactgtaa

SEQ ID NO: 2666 - DNA, 2139 bp, Brachypodium distachyon
gcagtgatcataactggtacacatacattcttcagccttggtcactagcagactagctaggtagcttgagagcagtttagttgagcagacgaagaagccgagtggaagagaggaccgcgctgtaaaaagatgaggaggagtcatagcttcgtctccgctctgaaacatgtggtattgtttctcgtgtcgtggatggtgcattgcggcaacgagctagttgctgcggtgcctcctgatggctggtacgattactctgcctacacggattgcagaggccagccggaaccggcgctgtacaacggcgggattctgaagtacggcaacagtgacgacccgacaggctaccacacgacggagaccggcgtcttgtccccggcgtttgtggtatacaaccttaacaagaccactatgtacaccttctcaagttgggtcaggctggaagggtctgactcggctctgatcacagcgaggctggccccggacaactccggcacgaggtgcatcgggacagttcttgcgaggaatgactgctggtcgttcctcaagggcggcttcgttctggactggccgacgcagacctctgtcattttctttcagaatgctgacaagacgcctatgaagatcaccgtcgcgagaggctcgctgcagcccttcaccacggatcaatgggcgatgcaccaaaaagatacgatccggaagaggaggaagcggatggcgacgatccacgtggccgatccccaaggtagccgcgtggtgggggcatcagtctccgtgcagcagacggccaaggacttcccgttcgggtcggcgatcgcgtccaccatcctgggcaacgaggcctaccagaaatggttcgtggatcgcttcaacgcggcggtgttcgaggacgagctcaagtggtactcgacggagccggcgtcgggcctgctccggttcgacgtgccggaccagatgctggcgttcgtgcggtcgcacagggtcatggtgcgcgggcacaacatcttctgggagaaccaggaggcgacccctcgctgggtgaagggcctgtccccggaggacctccgctccgccgtcaacacccggatccagagcctcatgacgcggtaccgcggcgagttcgcgcactgggacgtcaacaacgagatgctgcactacaacttctacgagcagcggctgggccccaacgcgacggtggagttcttcagcgtggcgcaggacgccgacccgctggccacgctcttcatgaacgagtacaacgtcatcgagacctgcgacgacgtgtcgtccaccgtggacgcgtacgtggcaaggctcaaggacctcagggccgggggcgccgtgctcgaggggatcggactggagggccacttctccaagcccaacatcccctacatgagggccgtgctggataagctggccacgctgggcttgcccatctggttcacggagatcgacatcaacaacaagttcgacgcgcagacgcaggccgtgtacctggagcaggtgctgagggaggcctactcgcacccggccgtgagcggcgtgatgctgtggacggcgctgcaccagaacgggtgctaccagatgtgcctcacggactgggacctcaagaacctgcccgtgggggacgtcgtcgaccggctgctgcaggagtggcagacggggcaggccgccgggaacacggacgcccacggcgcctacagcttcagcgggtacctcggggagtacgtcgtcaccgtcagctccggcaacagctccgcgcagtccacgttctcgctgtctccaggggacgagaccaggcacatcacccttcacatatgagaccctctctagccggagccatgctgtttactttccgcgctcgttgttctgggcttgtagctcccctgacatttcgtcgcacgcgcgtgggcagtgttataaccgaactactagtgtagactgtgcagtagttgtattaccgggtaaagttgcatcaatttgtttgacatgctgttaagagtcccgtccccgccttcacatgctgttgggagttctcgagattttcagtttacgaaccatcactcgtgaacttgttttacactgtaacttgttgtaaaaaagcaggttatcagtttcttaactcgttcttgatccttt

SEQ ID NO: 2667 - DNA, 2185 bp, Secale cereale
acacattcatacgcacattcattcttcttcagcgtccactcactgctagcttgtgaggggaggctctgtgcgcggcgtgtgagctgttagtttgagcgggcaagctgggtggacagagagcacagcgctagctatagcttgcccttggctggtgcaagatgaggagccgcagtagctttgctctgaaccatgcagtggtgttcctagtgtcgttgatggtgcattgcggcagtgagctcgttgccgccgtgcctcctgatggttggtacgattacaccgctcacacggactgcagaggacgcccggagccggcgcagtacaacggcgggattctcaagtacggcaacggcgacgacccgaacgggtacaagacgacggagaccggcgtcctgtccccggcgttcgtggtctacaacctcaacaagtccacgatgtacaccttctcaggctgggtgaagctggaaggctcttcctcggctctgatcaccgcgaggctggccccggacaactccggcacgaggtgcatcgggacggtcctcgccaggagcgactgctgggcgttcctcaagggcggcttcgtcctcgactggccaactcagacctccgtcatcttcttccagaatgctgataggacccctatgaagatcaccattgcgagcagctcgctccagccgttcacgacggatcaatggtcgatgcaccagaaagacatgatccggaagaggaggaagaggatggccaccatccacgtcgccgatccgcacggcacccgcgtggtcggcgcgtcggtgtccgtggagcagaccgccaaggacttcccgttcgggtcggcgatcgcctccaccatcctgggcaacgacgcgtaccagaagtggttcgtggaccggttcaacgcggcggtgttcgaggacgagctcaagtggtactcgacggagccggcgtcggggctgctccggttcgacgtgccggaccagatgctggcgttcgtgcggtcgcaccgggtgatggtgcgcgggcacaacatcttctgggagaaccaggacgcgacgccccggtgggtgaagggcctctcgccggacgacctccgctccgccgtgaacacgcgcatccagagcctcatgacccggtaccgcggcgagttcgcgcactgggacgtgaacaacgagatgctgcacttcaacttctacgagcagcggctgggccccaacgccaccatggagttcttcagcgtggcgcaggacgccgacccgctcgccacgctcttcatgaacgagtacaacgtggtggagacctgcgacgacgtctcctccaccgtggacgcgtacgtggcccggctcaaggacctccgggccggcggcgccgtgctggaggggatcggcctcgagggccacttctccaagcccaacatcccctacatgagggccgtgctcgacaagctggccacgctcaacctgcccatctggttcaccgagatcgacatcaacaacaagttcgacgcgcagacgcaggccgtgtacctggagcaggtgctgcgggaggcgtacgcgcacccggccgtgagcggcgtcatgctctggacagcgctccacgagaacgggtgctaccagatgtgcctcacggactggaacctcaagaacctgcccgtcggggacgtcgtcgaccgcctgctgcaggagtggcagacggggcaggccgccgggccgactgacgcgcacggcgcctacagcttcagcggctacctcggcgagtacgtggtcaccgtgagcgccggcaacacctcgaagcagtccaccttctcgctgtccccaggggacgagaccaggcacatcaccgttcagatatgacactggtactagtgtctatatgtgtggcacactgttactgcccgcacttgttggttcgggcttctacctccgctgacacgtatcgtcgcatgtgggtagtggttactaaattatactcctgctagtgtagcggttgttacgcgtaattacggcacgtctattcgagcaaatgattacggatttgctaaaaaaaaaaaaaaaaaaaaaaaaaaaaaaaaaagaaaaaaaaaaaaaaagaaaaaaaaaaaaaagaaaaaaaaaagaaaaaaaaagaaaaaagaaaagaaataatagactatagatacgtatacagtatagacgacacgacgacgagacgagag

SEQ ID NO: 2668 - DNA, 2033 bp, Hordeum vulgare
cggccctgatcataccagtagctggtacacacattcatacctacatacatccattcgtcatcagcatccgctcaccagcttgtgaggggaagacgaagctgggaagaaggtcgtgtttgagcacacgaagctggggagcagagctcggcgctagctagcttgccggtgcaagatgaggagccgtggctttgctctgagccatgccgcggtgtttctcgcgtggtggatggtgcattgcggcggcgggcttgtcgccgccgtgcctcctgatggttggtacgattacactgcccacacggactgcagaggtcacccggagccggcgcagtacaacggcgggattctgaagtacggcaacggcgaggacccgaacgggtacaagacgacggagaccggcgtcctgtccccggcgtttgtggtctacaacctcaacaagtccacaatgtacaccttctcgggttgggtgaagctggagggctcttcctcggctctgatcaccgcgaggctggccccggacaactccggcacacggtgcatcggcacggtcctcgccaggagcgactgctgggcgttcctaaagggtggcttcgtcctcgactggccaactcagacctccgtcatcttctttcagaatgctgataggacccccatgaagatcaccattgcgagcggctcgctccagccgttcacgacggatcaatggtcgatgcaccagaaagatacgatccggaagaggaggaagaggatggccaccatacacgtcgccgacccgcacggcacccgcgtggtgggcgcgtcggtgtccgtgcagcagaccgccaaggacttcccgttggggtcggcgatcgcctccaccatcctgggaaacgacgcgtaccagaaatggttcgtggagcgttcaacgcggcggtgttcgaggacgagctcaagtggtactcgacggagccggcgtcggggctgctccggttcgacgtgccggaccagatgctggcgttcgtgcggtcgcaccgggtgatggtgcgcgggcacaacatcttctgggagaaccaggacgcgacgccccgttgggtgaagggcctgtcgccggaggacctccggtcggccgtgaacacgcgcatccagagcctcatgacccggtaccgcggcgagttcgcgcactgggacgtgaacaacgagatgctgcacttcaacttctacgagcagcggctgggccccaacgcgaccatggacttcttcagcgtggcgcaggacgccgacccgctcgccacgctcttcatgaacgagtacaacgtcgtcgagacctgcgacgacgcctcctccaccgtcgacgcgtacgtggcccggctcaaggacctccgggccggcggcgccgtgctggaggggatcggcctcgagggacacttctccaagcccaacatcccctacatgagggccgtgctcgacaagctggccacgctcaacctgcccatctggttcaccgagatcgacatcaacaacaagttcgacgcgcagacgcaggccgtgtacctggagcaggtgctgcgggaggcgtacgcgcacccggcggtcagcggcgtcatgctctggacggcgctgcacgagaacgggtgctaccagatgtgcctcacggactggaacctcaagaacctgcccgtcggggacgtcgtcgaccgcctgctgcaggagtggcagacggggcaggccgccggcccgacggacgcgcacggcgcctacagcttcagcggctacctcggcgagtacgtcgtcaccgtcaacgccggcaacacctccaagcaggccaccttctcgctgtctccaggggacgagaccaggcacatcaccattcagatatgacactagtactagtgttccgatccatatgtgtggcacgctgttgctgcccgcacttgttgcctcgggcttctacctccgctgacacatatcgtcgcatgtgcgatgcgtggtgttactaaattatatactcctactactagtgtagcgattgttacgcgtaattacagtaatgtccattc

SEQ ID NO: 2669 - DNA, 2033 bp, Triticum aestivum
gcagcagccggtacacacattcatacatacattcttcttcagcatccactcgctactagcttgtgaggggagctctgtgtttgagcagacgaagctgggggagcagagcacggcgctagctagctagctggtgcgagatgaggagccgtggtagctttgctctaggccatgcggtggtgtttctcgcgtggttgatggtgcattgcggcggcgggcttgtcggcgccgtgcctcctgatggttggtacgattacactgcccacacggactgcagaggccgcccggagccggcgcagtacaacggcgggattctcaagtacggcaacggcgacgaccccaacgggtacaagacgacggagaccggcgtcctgtccccggcgttcgtggtctacaacctcaacaagtccacgatgtacaccttctcgggctgggtgaagctggagggctctccctcggctctcatcaccgcgaggctggccccggacaactccggcacgaggtgcatcgggacggtcctcgccaggagcaactgctgggcgttcctcaagggcggcttcgtcctcgactggccaactcagacctccgtcatcttcttccagaatgctgataggaccccgatgaagatcaccactgcgagcgcctcgctccagccgttcacgacggatcaatggtcgatgcaccagaaagatacgatccggaagaggaggaagaggatggccaccatccacgtcgccgacccgcacggcacgcgcgtggtcggcgcgtcggtgtctgtggagcagacgtccaaggacttcccgctggggtcggcgatcgcgtccaccatcctgggcaacgacgcgtaccagaagtggttcgtggagcggttcaacgcggcggtgttcgaggacgagctcaagtggtactcgacggagccggcgtcggggctgctccggttcgacgtgccggaccagatgctggcgttcgtgcggtcgcaccgggtgatggtgcgcgggcacaacatcttctgggagaaccaggacgccaccccccggtgggtgaagggcctgtcaccggaggacctccggtccgccgtgaacacgcgcatccagagcctcatgacccgctaccgcggcgagttcgcgcactgggacgtgaacaacgagatgctgcacttcaacttctacgagcagcggctgggcgccaacgccaccatggagttcttcagcgtggcgcaggacgccgacccgctcgccacgctcttcatgaacgagtacaacgtggtggagacctgcgacgacgcctcctccaccgtggacgcgtacgtggcgcggctcaaggacctccgcgccggcggcgccgtgctggaggggatcggcctcgagggccacttctccaggcccaacatcccctacatgagggccgtgctcgacaagctggccacgctcaacctgcccatctggttcaccgagatcgacatcaacaacaagttcgacgcgcagacgcaggccgtgtacctggagcaggtgctgcgggaggcgtacgcgcacccggccgtgagcggcgtcatgctctggacggcgctgcacgagggcgggtgctaccagatgtgcctcacggactggaacctcaagaacctgcccgtcggggacgtcgtcgaccggctgctccaggagtggcagacggggcaggtcgccgggccgacggacgcgcacggcgcatacagcttcagcggctacctcggcgagtacgtggtcaccgtgaacgccggcaactcctcgaagcagtccaccttctcgctgtccccaggggacgagaccaggcacatcaccgttcagatatgacactggtagtgtctgtatgtgagtggccggtggcacgctgtactgcccgcacttgttgtttcgggcttctacctccgctgacacatatcgtcgcatgtgggtagtggttactaaattatatactcctgctagtgtagcggttgtttcgcctaattacggtatgtctattcgagcaaacgactatgtcttcgaaaaaaaaaaaaaaaacga

SEQ ID NO: 2670 - DNA, 2041 bp, Sorghum bicolor
aattttcttccggcgttgggaagacgaaagagagctgcatctgatttccattctggaagcgcccgctccactccgcggcgccaccgcctcacgtcccacggtcccagacccggttccctcgccgtcgtctcttccgctccggtagatagaatctgatgggaagatgaatggtgtagaggagcagcagccgcctcaggtcagcagcatgtccaagacgttagatggtgttaccaagcctagtctggggaaagagcctattccagggagcgagctctggacggatgggctcatctgtgctttcgagctggtcaagagtcacaggaagcctgttcagcacaaatcatggccagcaatggagcagatgcaggagaaaggccccactatgtacacgaggaagcactcaagaaggaatggccaccagatcactgtgccgaaagcggatgagagcattgtgttagaaaacccccatcagactgatttcagtaatgatccttcagtgctcaaagataggccactgtatgctggggagattttggatcataaatgggtgcccattggatggagtaggatcgctgagttggtcctcagggttcaatcagactccagctgggagaatgaattgacagagatcagtgatagtgaggatgattacaccgtggctgatcttgctgctccatactggcagcgtccggtggggcctacttggtggtgtcatgtcgctgcaggccatccttcaatcgatgcatggttgaatagtgctcactggatgcatcctgccatcagaactgcactgagagatgagagcaaactgataagcgaccggatgaagtaccttctctacgaggtcccagttagagttgcaggagggctgttatttgagcttcttggtcagtcaatcggagatccaaatcatgaagaggaagatatacctattgtgcttaggtcttggcaagcacaaaattttcttgttacaacactgcatgtcaaaggcccttcatccaatttaaatgtgttaggagtgactgaagtgcaggagttgcttcttgctggtggaagccaaacacctagatcagtgcatgaagtaattgcacatttggtcagccgtctttcacgttgggatgacagattattccggaaatatgtatttggggaagcagatgaaattgaattgaaatttgtgaataggagaaatcgtgaagatcttaatcttatcagcatcatactaaatcaggaaatcagaaggttagcaacacaggtaatcagggttaaatggtcacttcatgcaagggaagagatattacttgagcttctcagacatttgaggggtaatgccacaagagctattttagagagtattagaaagtgtacaagggacatgttggaagagcaagaagctgtgcgcgggcgcttgttcactattcaggatgttatgcagagcactgttcgtgcgtggttacaggatagaagcctccgagttacacataatctggcaatttttggtggttgtggcatggttttgtccataatcactggcctttttggaatcaacgtcgatggcatacctggagcgcagaatactccctatgcttttggtttgtttgcaggacttctcttctttattgggatcgtcctaatcggcgtggggatgctgtatcttgggttacaaaatccagttaacagcgagaagatgaaggtgaggaagctggagctccagcagctggtttcaatgttccagcatgaagcagagcagcacggcaaggtcagggaaggccttagccggcatggctcctcaccaagctcatctgcggcctctgatgaagggtacattcttatctcctgagatgtgagatgggacattttatatttgctaatgtgcaaggtcttgtttcaaagaccggaactgaagagaagtcgggtacatggtatactgacacgggtctaagtaagaattgtaatcgaggaatttgacatcaaaacgttggatataactgtagtaccaggtcggttttcatgatttcaaatctgttgcttgagatctcgg

SEQ ID NO: 2671 - DNA, 2448 bp, Sorghum bicolor
aattttcttccggcgttgggaagacgaaagagagctgcatctgatttccattctggaagcgcccgctccactccgcggcgccaccgcctcacgtcccacggtcccagacccggttccctcgccgtcgtctcttccgctccggtagatagaatctgatgggaagatgaatggtgtagaggagcagcagccgcctcaggtcagcagcatgtccaagacgttagatggtgttaccaagcctagtctggggaaagagcctattccagggagcgagctctggacggatgggctcatctgtgctttcgagctggtcaagagtcacaggaagcctgttcagcacaaatcatggccagcaatggagcagatgcaggagaaaggccccactatgtacacgaggaagcactcaagaaggaatggccaccagatcactgtgccgaaagcggatgagagcattgtgttagaaaacccccatcagactgatttcagtaatgatccttcagtgctcaaagataggccactgtatgctggggagattttggatcataaatgggtgcccattggatggagtaggatcgctgagttggtcctcagggttcaatcagactccagctgggagaatgaattgacagagatcagtgatagtgaggatgattacaccgtggctgatcttgctgctccatactggcagcgtccggtggggcctacttggtggtgtcatgtcgctgcaggccatccttcaatcgatgcatggttgaatagtgctcactggatgcatcctgccatcagaactgcactgagagatgagagcaaactgataagcgaccggatgaagtaccttctctacgaggtcccagttagagttgcaggagggctgttatttgagcttcttggtcagtcaatcggagatccaaatcatgaagaggaagatatacctattgtgcttaggtcttggcaagcacaaaattttcttgttacaacactgcatgtcaaaggcccttcatccaatttaaatgtgttaggagtgactgaagtgcaggagttgcttcttgctggtggaagccaaacacctagatcagtgcatgaagtaattgcacatttggtcagccgtctttcacgttgggatgacagattattccggaaatatgtatttggggaagcagatgaaattgaattgaaatttgtgaataggagaaatcgtgaagatcttaatcttatcagcatcatactaaatcaggaaatcagaaggttagcaacacaggtaatcagggttaaatggtcacttcatgcaagggaagagatattacttgagcttctcagacatttgaggggtaatgccacaagagctattttagagagtattagaaagtgtacaagggacatgttggaagagcaagaagctgtgcgcgggcgcttgttcactattcaggatgttatgcagagcactgttcgtgcgtggttacaggatagaagcctccgagttacacataatctggcaatttttggtggttgtggcatggttttgtccataatcactggcctttttggaatcaacgtcgatggcatacctggagcgcagaatactccctatgcttttggtttgtttgcaggacttctcttctttattgggatcgtcctaatcggcgtggggatgctgtatcttgggttacaaaatccagttaacagcgagaagatgaaggtgaggaagctggagctccagcagctggtttcaatgttccagcatgaagcagagcagcacggcaaggtcagggaaggccttagccggcatggctcctcaccaagctcatctgcggcctctgatgaagggtacattcttatctcctgagatgtgagatgggacattttatatttgctaatgtgcaaggtcttgtttcaaagaccggaactgaagagaagtcgggtacatggtatactgacacgggtctaagtaagaattgtaatcgaggaatttgacatcaaaacgttggatataactgtagtaccaggtcggttttcatgatttcaaatctgttgcttgagatctcggctatagtagttattgaattttaagtaggagcaatggagtaagcggcgttgcatttaagcatccccacggtctagagcatagcgttcagcgctgtgccagtgaccgtcaaacgccagtggtagatcagatgtttctgaagattctgatggtagttgtcgattgggaaagcccaaagccctcgccactgggagctccgagctctgttggtttctgtcttcgggcggttgtgttgccatcgtccacgtctttcaggttgcctgttcgtcttgccggactggaaaacaaggggggatacttgttccagacaatagacacggcatgattagttggttagagaaagctggtgatcagggatcaaaacccaataagaggtttgtttggatcaattcacgtgtattggtatgaat

SEQ ID NO: 2672 - DNA, 2205 bp, Setaria italica
ctaaaacttccttttgctgttctagcctgcgaagcgagctcactgtactcgtgcgtgctcaggacgtagcgggcggtggctgggggtctgccggcgaaatttacgaaggtttggcccctgcttctggcgctacccggtgttgcgacagacagaattttgatgggaagatgaatggtgctgaggaggagcagccgcctcaggtcagcaacatgtccaagatgcaagacacagctcccaagcccagtttggggaaagagccaattccagggagtgagctctggacggatgggctcatctgcgcttttgagctggtcaagggtcacaggaagactgttcatcacaaatcatggccaacaattgatcagatgcaggagaaaggctccactatgtacacaaggaaacactctagaaggaatgggcaccatatcatagctccaaaaccggatgagagcattgtgttggagaatccccatcagactgaaatcagtaatgatccaaaagtgctcaaagataggccattgtatgccggggagattttggaccacaaatgggtacccattggatggaccaggatcgctgaactggtccagagggttcaatcagactccagctgggagaatgagttgacggagatcagtgatagtgaggatgattacaccgtggctgatcttgcagctccatactggcagcgtcctgtggggcctacgtggtggtgccatgtcactgcaggtcatccctttatcgatgcatggttgaatagtgctcactggatgcatcctgccatcagaactgcgctaagagatgagagcaaactgataagtgaccggatgaagtacctcctctacgaggttccagtaagagttgcaggaggactgttatttgagcttcttggtcagtcggtcggagatccaaatcatgaggaggaagatataccaattgtgcttcggtcttggcaagcacaaaattttcttgtaacagcaatgcatgtcaaaggtccttcatccaatataaatgtgttaggagtgactgaagtgcaggagttgcttcttgctggtggaagccaaacacctagatcagtgcacgaagtaattgcacatttggtcagccgtctttcacgttgggatgacagattattccggaaatatatctttggggaggcagatgaaattgaattgaaatttgtgaataggagaaatcgtgaagacctgaatcttctcagcataatactggatcaggaaatcagaaggttagcaacacaggtaatcagggtgaaatggtcacttcatgcaagggaagagatcttacatgagcttgtcagacatttgaggggtaataacacaagagttatcttggatagcgttagaaagtgtacaaggaacatgttggaagaacaggaagctgtgcgtggacgcttgttcactattcaggatgttatgcaaagcactgtccgtgcatggttacaggatagaagcctccgagtcacccacaatttggctattttcggaggtggtggcatggttttatccataatcacgggactcttcgggatcaacgtcgatggcataccaggagcacagaatacaccatatgcatttggtttgtttacgggccttctcttctttcttggaatcgtcctagtcgtcgtgggaatgttgtatcttgggttacaaaacccagttagcagtgagaaggtgaaggtgaggaagctggagctccagcagctggtttcgatgttccagcatgaagcagagcagcacggcaaggtcagggaaggtcttagccggcatggtttgtcgccgaggtcgtctgcagactcagatgaagggtacattctcatctcctgagattggagatcttcgttaacgtgcaaagtcatgtttgaaagtctggaactgaagagaagggggtacacggtggtggcagacttgtacacgttctaaaaactgtaatcgaggaatccgacataaaaaaaattagatgatataattctaacacaaggttggctctctgctgttgctagagttgctactttctagtatctgttgagcgagaaaactgtcttgaattagatgatacagtatttcttatcgaatttccagttggagtaatataagcgtcgatatacctcgaaccctgagcctcggcgcggtacatgacattatcggtgtttggtttgcgtcaccggaccttgcgcggacgtacgcc

SEQ ID NO: 2673 - DNA, 2436 bp, Oryza sativa
gctcagcgaggagtacgtgtgccggcgcatggggtagagaggctgagacatttgcaaagcgaggtgaccgaccgcgagaagcaaagcgagcatttgcctttgcatccccttcccttcccgtcttgaagcgcccgctccgctcccccacgattcctccttcctccacacttccacagtctccggcgcgctcccctcgcccactcttcttctctttctccctctcttcctcctccacctccagggctccaggctaaaacgtcttccccgcgggagtgctaggttggctctgcgcgtggggcccgcggggaaagctcagtggcgcgcggcgggtttttggcgggagcgggacttggtggccggtggcggcgctgcctgcgggtgtcgtgccgcgatctgggctccggacacgaattggagcggacatggctgatgtggagggccaacagcctcatcaggtcagtggtgtgtccagggcacaagacggggttgccaaggtgagtttggggaaagagcatgtgccaggaagcgagctctggaccgacgggctcatctgtgcttttgagctcataaagggtcacaagaagctggttcagcacaaatcatggccgacgattgatagcatgcaggagaaagaggtccctatgcatatgaagcggcacataagtaggaacgggcatcatgtcgcaaccatgaaaccagaagagtgcgatgtggtggagaatccccgccagacagagtttgctaatgatccttctctgttcaaagataggccggtgcatgtcagggcaatcctggatcacaaatgggtgcctatcggatggtctaggattgctgaactggtccagagggttcagtcagatgccagctgggatagtgagccggcggagatgaccgacagtgaggatgattacactgtagctgatgttgcagctccatactggcagcgtccggtaggacctacatggtggtgccatgtcactgcaggccatccctcagttgacgcatggctgaatagtgctcactggatgcatccggctataagaactgcattgagagatgaaagccggctgataagtgatcggatgaagtaccttctctatgaggtcccagttagagttgctgggggactgctatttgaacttcttggtcaatcagtcggagatccaaaccgtgaagaggaagacatacccattgtgcttcggtcttggcaagcacagaactttcttgtgaccgcaatgcatgtcaaaggcccttcatccaatataaatgttttaggagtgactgaagtgcaggagttgcttagtgctggtggaagtcaaacacctagatcagctcatgaagtaattgcacatttgatcggccgtctttcccgatgggatgacaggttattccggaaatatgtctttggtgaagcagatgaaattgaactgaagtttgtgaataggagaaatcatgaagatctaaatctagtcagcatcatattgaatcaagaaatcagaaggttagcaacacaggtaatcagagttaaatggtctctgcatgcaagggaagagatcataattgagctccttagacatttgaggggaaataccacaagagttatcttagatagcattagaaaggacacaagagaaatgttggaggagcaggaagctgtccgtggccgcttgttcactattcaggatgttatgcaaagcactgttcgagcatggttacaagatagaagccttcgtatcacccacaatttggctatttttgggggtggcggcatggttttatccataatcactggcctttttggaatcaatgttgatggcataccgggagcgcagaatactccatacgcttttggcttgtttgcaggacttctcttctttgtaggcttcgtccttattggggtaggaatactctatcttgggttacaaaatccagtgaccaatgagaaggtcaaggtgaggaagctcgagctccaggatcttgtttcagcgttccagcatgaagcagaacagcacggcaaggtgagggaaggtctcagccggcacagctcgtctcctaagtcatcatcggcctctaatgtagactacgttctaatttcttaaggctgtgaaattaatccccttgtgggagggattcactgaacaaggcctaaaagggattggaaaaagaataaagtacaaagagatttgacagaaaaaaaaaaggatttccggatagaagagttcttggtaaggactaaagtataagccatataagtatataactatgtttggtgatctgtatagaggtttagattagagtataatggttaacttgatatgctacggatatacttgtgactgggaaggattatcactgaggaaaatgtgatcgaaatgctaataaatatgagtaacgagttggcctccttttctgtataccaacctgaggtgttctgcc

SEQ ID NO: 2674 - DNA, 2335 bp, Oryza sativa
gcgagcatttgcctttgcatccccttcccttcccgtcttgaagcgcccgctccgctcccccacgattcctccttcctccacacttccacagtctccggcgcgctcccctcgcccactcttcttctctttctccctctcttcctcctccacctccagggctccaggctaaaacgtcttccccgcgggagtgctaggttggctctgcgcgtggggcccgcggggaaagctcagtggcgcgcggcgggtttttggcgggagcgggacttggtggccggtggcggcgctgcctgcgggtgtcgtgccgcgatctgggctccggacacgaattggagcggacatggctgatgtggagggccaacagcctcatcaggtcagtggtgtgtccagggcacaagacggggttgccaaggtgagtttggggaaagagcatgtgccaggaagcgagctctggaccgacgggctcatctgtgcttttgagctcataaagggtcacaagaagctggttcagcacaaatcatggccgacgattgatagcatgcaggagaaagaggtccctatgcatatgaagcggcacataagtaggaacgggcatcatgtcgcaaccatgaaaccagaagagtgcgatgtggtggagaatccccgccagacagagtttgctaatgatccttctctgttcaaagataggccggtgcatgtcagggcaatcctggatcacaaatgggtgcctatcggatggtctaggattgctgaactggtccagagggttcagtcagatgccagctgggatagtgagccggcggagatgaccgacagtgaggatgattacactgtagctgatgttgcagctccatactggcagcgtccggtaggacctacatggtggtgccatgtcactgcaggccatccctcagttgacgcatggctgaatagtgctcactggatgcatccggctataagaactgcattgagagatgaaagccggctgataagtgatcggatgaagtaccttctctatgaggtcccagttagagttgctgggggactgctatttgaacttcttggtcaatcagtcggagatccaaaccgtgaagaggaagacatacccattgtgcttcggtcttggcaagcacagaactttcttgtgaccgcaatgcatgtcaaaggcccttcatccaatataaatgttttaggagtgactgaagtgcaggagttgcttagtgctggtggaagtcaaacacctagatcagctcatgaagtaattgcacatttgatcggccgtctttcccgatgggatgacaggttattccggaaatatgtctttggtgaagcagatgaaattgaactgaagtttgtgaataggagaaatcatgaagatctaaatctagtcagcatcatattgaatcaagaaatcagaaggttagcaacacaggtaatcagagttaaatggtctctgcatgcaagggaagagatcataattgagctccttagacatttgaggggaaataccacaagagttatcttagatagcattagaaaggacacaagagaaatgttggaggagcaggaagctgtccgtggccgcttgttcactattcaggatgttatgcaaagcactgttcgagcatggttacaagatagaagccttcgtatcacccacaatttggctatttttgggggtggcggcatggttttatccataatcactggcctttttggaatcaatgttgatggcataccgggagcgcagaatactccatacgcttttggcttgtttgcaggacttctcttctttgtaggcttcgtccttattggggtaggaatactctatcttgggttacaaaatccagtgaccaatgagaaggtcaaggtgaggaagctcgagctccaggatcttgtttcagcgttccagcatgaagcagaacagcacggcaaggtgagggaaggtctcagccggcacagctcgtctcctaagtcatcatcggcctctaatgtagactacgttctaatttcttaaggctgtgaaattaatccccttgtgggagggattcactgaacaaggcctaaaagggattggaaaaagaataaagtacaaagagatttgacagaaaaaaaaaaggatttccggatagaagagttcttggtaaggactaaagtataagccatataagtatataactatgtttggtgatctgtatagaggtttagattagagtataatggttaacttgatatgctacggatatacttgtgactgggaaggattatcactgaggaaaatgtgatcgaaatgctaataaatatgagtaacgagttggcctccttttctgtataccaa

SEQ ID NO: 2675 - DNA, 2040 bp, Brachypodium distachyon
ctcgggccactgggccgttcctcccttcttccgcgattccctcaacaccttcttccgcgattccctcccccgcccggccgcccccctcgtgctcctcccatccgcggaaccggaagaagaacttaataagaagtgcctgagttgacataaagggggcggcagaagcttagaatgcgattatcgccggggcagttgtggcgcggaacttgaaaggcaggtagaattgaaaggaagatgactgatgtggaggggcagccgccgcctcagatcagcagcagcatgtctaaggtgcaagacggcagtggtggtaatccaaatcttgcgaaggaatgtcacattctggggagtgagctttggaccaacgggctcatctgtgctttcgagctcgtcaagggtcacaggaagatagttcatcacaaatcatggccagcaattgagctcgcgcaggagaaagttgtgcatatgaagaagcacagaggtagggatgggcatcatgtcgtgaacccaacaccagatgagagcaatgtagtagaaatccctggccagacggagttaggtaacgatccttctgtgctcaaagataggccaccatatcctgcggagattctcgatcacaaatgggtgccgattggatggtctaggattggcgagctgatccaaagggttcaatcagatgcaagctgggagaatgaacaggtgatgataagcgacagtgaggatgattacactgtagctgatgttgcggctccgtactggcagcgtcccggggggcctacatggtggttccatgtcactgcaggccatccttatgtcgacgcatggttgagtagtgctcactggatgcatccggctatcagaactgcactgagagatgaaagccgactgataagtgatcggatgaagtaccttctctatgaggtcccagttagagttgcaggaggactgttatttgagcttcttggacagtcagtcggagatccgaatcatgaagaggaagacatacccattgtacttcggtcttggcaggcccaaaattttcttctaactgcaatgcatgtcaaaggtcattcacccaacataaatgttttaggagtgactgaagtgcaggagttgcttatttctgacggaagtcagacgcctagatcagttcatgaagtaattgcacatttggtcagtcgtctttcacgatgggatgacagattattccgtaagtatatctttgggaaagcagatgaaattgaattaaagttcgtgaataggagaaatagtgaagatctgaacctagtcagcatcatattgaatcaagaaatcagaaggttagcaaaacaggtgatcagagttaaatggtcgctacacgcaagggaagagatcatacttgagcttctccgacatttaaggggaaatgccacaagagccattttagagagagagaggaaatctgcacgggagatgttggaggagcaggaagctgtccgcggtcgtctgttcactattcaggatgtcatgcagagcacagttcgtgcatggttgcaggatagaagccttcgtattacccacaatttggctgtttttggaggtggcggcatagttctatccataatcactggcctttttggaatcaatgttgatggcataccgggagctcagaatactccgtatgcttttggattgtttgctggacttcttttctttatcggagccgtccttgttggcgttggactgatgtatctcgggttgacaaaaccagtgaccagtgagaaggtaaacgtgaggaagctggagctccagcagctggtttcagtgttccagcgagaagcagaacagcatggcaaagtcagggaaggtctcagccgacatggcttgtcatcgggctcgtcttcagcctcccccggtgaaggctatattctgatttcctgaggggacagatgttgccaagggggaaatccatgcttgaaactttgaaagagaggcttaggccaccaccgtttgtaacctggcatttttttttcacttcttataaacatcatcgctgatttgttt

SEQ ID NO: 2676 - DNA, 2217 bp, Brachypodium distachyon
atcgtgctttcttccatctcccattctcgaagcacccactccagtcgtgtctcggtccagtcgagtctcgggccactgggccgttcctcccttcttccgcgattccctcaacaccttcttccgcgattccctcccccgcccggccgcccccctcgtgctcctcccatccgcggaaccggaagaagaacttaataagaagtgcctgagttgacataaagggggcggcagaagcttagaatgcgattatcgccggggcagttgtggcgcggaacttgaaaggcaggtagaattgaaaggaagatgactgatgtggaggggcagccgccgcctcagatcagcagcagcatgtctaaggtgcaagacggcagtggtggtaatccaaatcttgcgaaggaatgtcacattctggggagtgagctttggaccaacgggctcatctgtgctttcgagctcgtcaagggtcacaggaagatagttcatcacaaatcatggccagcaattgagctcgcgcaggagaaagttgtgcatatgaagaagcacagaggtagggatgggcatcatgtcgtgaacccaacaccagatgagagcaatgtagtagaaatccctggccagacggagttaggtaacgatccttctgtgctcaaagataggccaccatatcctgcggagattctcgatcacaaatgggtgccgattggatggtctaggattggcgagctgatccaaagggttcaatcagatgcaagctgggagaatgaacaggtgatgataagcgacagtgaggatgattacactgtagctgatgttgcggctccgtactggcagcgtcccggggggcctacatggtggttccatgtcactgcaggccatccttatgtcgacgcatggttgagtagtgctcactggatgcatccggctatcagaactgcactgagagatgaaagccgactgataagtgatcggatgaagtaccttctctatgaggtcccagttagagttgcaggaggactgttatttgagcttcttggacagtcagtcggagatccgaatcatgaagaggaagacatacccattgtacttcggtcttggcaggcccaaaattttcttctaactgcaatgcatgtcaaaggtcattcacccaacataaatgttttaggagtgactgaagtgcaggagttgcttatttctgacggaagtcagacgcctagatcagttcatgaagtaattgcacatttggtcagtcgtctttcacgatgggatgacagattattccgtaagtatatctttgggaaagcagatgaaattgaattaaagttcgtgaataggagaaatagtgaagatctgaacctagtcagcatcatattgaatcaagaaatcagaaggttagcaaaacaggtgatcagagttaaatggtcgctacacgcaagggaagagatcatacttgagcttctccgacatttaaggggaaatgccacaagagccattttagagagagagaggaaatctgcacgggagatgttggaggagcaggaagctgtccgcggtcgtctgttcactattcaggatgtcatgcagagcacagttcgtgcatggttgcaggatagaagccttcgtattacccacaatttggctgtttttggaggtggcggcatagttctatccataatcactggcctttttggaatcaatgttgatggcataccgggagctcagaatactccgtatgcttttggattgtttgctggacttcttttctttatcggagccgtccttgttggcgttggactgatgtatctcgggttgacaaaaccagtgaccagtgagaaggtaaacgtgaggaagctggagctccagcagctggtttcagtgttccagcgagaagcagaacagcatggcaaagtcagggaaggtctcagccgacatggcttgtcatcgggctcgtcttcagcctcccccggtgaaggctatattctgatttcctgaggggacagatgttgccaagggggaaatccatgcttgaaactttgaaagagaggcttaggccaccaccgtttgtaacctggcatttttttttcacttcttataaacatcatcgctgatttgttttacgtcctcattcgtttttgtggccgttgattctgttttctccgctcgaatcttgacaccccccctcggtggctgctgctttgtcggctctttgcatcggcctgttgccca

SEQ ID NO: 2677 - DNA, 888 bp, Zea mays
agtggctgggcggtgaggccgtgtctcccggtctgcagtatcgggcaagcctacgggcccaaacggaaaaagaggacctgagccgactccgccgaggtcggtggcggcggcggcggtgagcatggccgcgcagagggagaagtccgcggccgtcgcggtcggcccagcacacggcgctgcggtatcggggtctccttctccttcgtcctcatccggaggcccggcggcggcgtcctcgtcgggagagcggtggagcgccgcgatcgggaacctgggggagctcggcgccaacgtggacgcgctgcagaagatgctcgggcggaaggctgtcttcgtcgacgatgacatcttctccaaggcctccctcgccgccgaccaggcccgcaccattaaggttcttgaccagagggtgcagtctctggaacgcgaactcgatgccgccatttctgcagcagctcgagctcgtacagataaacgacaggccgaagctgcgcaacgagctgcagagttacgcacacaggaggtcaccaaggaactggagaacactgcgagagtgtttcagctgcacatggaggagttgcggctgaagcaagaggagattgcgaagaaagatagcgatatcaaggtgttggaagcgataatacgaaccctcggtagcaaagatgatgatggatccagcgaataattgtcatgaacagggagcgaggcttttatgttcaaatatctcacggcgtgtttatgattatgtatttccttttggggtttaatccctttgttactcagatggatgtaacttgtttcgacaagattgagcgtgtccgcactcatactactataaatttgtattctaaaacaaatattttatcatcgttagcaagattatctact

SEQ ID NO: 2678 - DNA, 851 bp, Sorghum bicolor
ctgcaatttcggggaagcctaggggcctaagcggaaaaagggaagctaagccgactgagactccgccgagatcggccggcggcgaccatggccgcgcagagggagaagtccgcggtcgccgcagcggcacacggcgctgcggtgtcggggtctccttctccttcgtcctcatccggaggtccggcggcggcgtcgtcgggagagcggtggagcgccgcgatcgggaacctgggggagctcggcgccaacgtggacgcgctgcagaagctgctcgggcggaaggccgtcttcgtcgacgacgacatcttctccaaggcctccctcgccgccgaccaggcccgcaccattaaggtccttgaccagagggtgcagtctctggaacgcgaactcgatgctgccatttctgcagcagctcgagctcgtacagagaaacgtcaggccgaagctgcacagcgagctgcagagttacgcacacaggaggtcacaaaggaactggagaacactgcgagagtgtttgagctgcacatggaggagttgcggctgaagcaagaggagattgcgaagaaagatagcgatatcaaggtgttagaagcgataatacgaacccttagtagcaaagatgacacccttagtagcaaagatgatgatggatccagcgaataattgccatgcacagggagcaaggcttttatatgattatgtattttcttttgggggtttaatccgttctattactcagatggatgtaaattgttgcgacaagattgaaattcagagagctttcagatgaacataagcactcttacgttgacctatttatgtcaatactaatgatatgttcacctccattt

SEQ ID NO: 2679 - DNA, 1021 bp, Sorghum bicolor
tcactgaggccgggccgggtcgccccgtccgctgcaatttcggggaagcctaggggcctaagcggaaaaagggaagctaagccgactgagactccgccgagatcggccggcggcgaccatggccgcgcagagggagaagtccgcggtcgccgcagcggcacacggcgctgcggtgtcggggtctccttctccttcgtcctcatccggaggtccggcggcggcgtcgtcgggagagcggtggagcgccgcgatcgggaacctgggggagctcggcgccaacgtggacgcgctgcagaagctgctcgggcggaaggccgtcttcgtcgacgacgacatcttctccaaggcctccctcgccgccgaccaggcccgcaccattaaggtccttgaccagagggtgcagtctctggaacgcgaactcgatgctgccatttctgcagcagctcgagctcgtacagagaaacgtcaggccgaagctgcacagcgagctgcagagttacgcacacaggaggtcacaaaggaactggagaacactgcgagagtgtttgagctgcacatggaggagttgcggctgaagcaagaggagattgcgaagaaagatagcgatatcaaggtgttagaagcgataatacgaacccttagtagcaaagatgacacccttagtagcaaagatgatgatggatccagcgaataattgccatgcacagggagcaaggcttttatatgattatgtattttcttttgggggtttaatccgttctattactcagatggatgtaaattgttgcgacaagattgaaattcagagagctttcagatgaacataagcactcttacgttgacctatttatgtcaatactaatgatatgttcacctccatttatttatctgtgcctaatagttgttcatctgtcggtcctcgatatggctatggccatgcccatacggggaagaggagagagagattggaggtttgttgtgcacctgtgtcgttacatttccttcagaaagagttgttctt

SEQ ID NO: 2680 - DNA, 705 bp, Saccharum officinarum
agctaagccgactgactccgccgagatcggcggcggcgatcatggccgcacatagggagaagtccgcggccgtcgcggtcgccccagtgtcggggtctccttctccttcgtcctcatccggaggtccggcggcggcggcggcgggagagcggtggagcgccgcgatcgggaacctcggggagctcggcgccaacgtggacgcgctgcagaagctgctcgggcggaaggccgtcttcgtcgacgacgacatcttctccaaggcctccctcgccgccgaccaggcccgcaccattaaggttcttgaccagagggtgcagtctctggaacgcgaactcgatgccgccatttctgcagcagctcgagctcgcacagagaaacgtcaggccgaagctgcacaacgagctgcagagttatgcacacaggaggtcacgaaggaactggagaacactgcaagagtgtttgagctgcacatggaggagctgcggctgaagcaagaggagattgcaaagaaagatagtgatatcaaggtgttagaagcgataatacgaacccttagtagcaaagatgacacccttagtagcaaagatgatgatggatccagcgaataattgccatgcagagggagcgaggcttttatgttcgagtatctcaaggcatggttatgaatatgtatttcctttttgggggttaatcccttctattact

SEQ ID NO: 2681 - DNA, 1079 bp, Setaria italica
atgagcaggggattcggggagaagggtttaggggaaggcggcggcgacagccgaatggaggaggaggaggccgcgggtggggggagcaaggcacatatagggctcgcgggagcggcctccgccgtcggatcggcacgagcggctgcggatcggaccgtccgatccgctcgtatattttccacgcccgcgggggccagagcgcaaaaacgggggaaggaagcgactccgccgagatcggcggcggcggcggggatcatcatggcggcgcagagggagaaggccgcggccgcggtcgcgcccgcccccggcgccgcggctgcttcgggatcgccgtctccttcgtcgtcgtccggagccccggcggcggcggcgtcgggggagcggtggagcgcggcgatcgggaacctcggggagctgggcgccaacgtggacgggctgcagaagctgctcgcgcggaaggccgtcttcgtcgacgacgacatcttctccaaggcctcgctcgccgccgaccaggcgcgcaccatcaaggttcttgaccagagggttcagtctcttgaacgcgaactcgatgctgccatttctgccgcagctcgagctcgtacagagaaacggcaggctgaagctggccaacgagccgcagagttacgtgcacaggaggtcacaaaggagctggagaacactgcaagagtgtttgagttacacatggaggagttgcggctgaagcaagaggagattgcgaagaaagatagtgatatcaaggtgctagaagcgataatacgaacccttagtagcaaagatgacacccttagtagcaaagatgatgatggatccagcgaataaataccatacacagggagcaggctaacatcaagtatctccccttgtgcttatgattatatttcctttctgggtttaagcccttctactcagatggctgtaaattgtgtttgacaagattgaaatccagggagctgtcggatgaacatatgcaccaatacgtttatgccctgtttatagcaataccaatgatatgtgcacctccacttttttacctgtgcataactgttcatctgtcgttg

SEQ ID NO: 2682 - DNA, 1666 bp, Zea mays
cgatctaggcccgacccgacccgatccggatccggactatggtctgtctatattgaataatcactcttctccgttcacaccctgtgcgcgcgggctctcttcgtcgtgcggcaactgcgcgaccgccgacgcccgacggcaggtgcaccaggtcttcgtcgaccccttcgcaaggcctcggttccatccttcgccggaggcgaccgcccgtcaacaggacttgatctactactcactagcggtgtagaggtgaagataagaacttgaccatgagcagcataggcacaggttatgatttgtctgtcacgaccttctccccagatggtcgtgtcttccaggtcgagtatgccaccaaggccgtcgacaacagcgggactattgttgggatcaagtgcaaagatggcattgtcctgggtgtcgagaagctggtaacctcaaagatgatgctggaaggatcaaaccgaaggatccattcggtgcaccgtcactctggcttggctgttgctggtttagcagcagatggcaggcaaattgtttcaaggaccaaatcagaagctgccagttatgaaaaggtctatggagaacccatttctgtgaaggaattggctgatcgtgtggcaagttatgttcatctttgcacgctgtactggtggctcaggccttttggttgtggtgttattcttggaggttatgatagggatgggccacagctctacatgatagaaccctcaggagtttcctacaaatacttcggtgctgcattggggaagggaagacaggctgcaaagactgagatagaaaagttgaaactttcggagcttacctgccgggaaggcattgttgaagttgcaaagataatttatggagtgcatgacgaagcgaaggacaaagcttttgagttggagttgagctggatctgtgatgaatcgaaccgccagcatcagaaggttccaaatgaactgttggagcaggccaaagctgctgctcaggcagctcttgaggagatggatgctgactaagaaacaggacgatttgcccagacttggtgtttttggtgctgttgaaatctccgatccctttggggtgtgacccactggacatggccaatttgtcacaatttattattttgacccatgtcatgtgaaactcctttcgttgaagtctggtatctagattgacttgtatcagagctgtggtttacgcagactggattctggagtactggactgtgtgtgtgtttttcggaactgtgcatctgacttttagctgttcgttgactttgtttttcttttttcagataaagagctgtttcttgatttgatgcaagtaggcttggtactcttcatgtttgtggcatatggttagcaggcatgaatgtgacatcaaacgaagtagtattattgatcaaccaatgcgaagagaaggcatgtaggttcgtgataaacagaggcgctctaacaaatcatgtagcacgcacacggcagcaaaaatggacgggcacatgttgctcacgttattccctcgcgtcatgtaccggacatatggtcatctaacacgtatcacattgaaatcaccatatcatatgctataatatgcgcacgtcacacactcaccatgtaacacatgcaaatcatctaaccacatcgacacacttgcaaatcacgtt

SEQ ID NO: 2683 - DNA, 1084 bp, Cynodon dactylon
ccggggacgcggccctatataccaagcagcagctgtggacgcacgccggaccaagcagcggcttctcgtcggcgtcgcctccacagtagcggcgtagagaaaacaacactcggtgacgatgagcagcataggcactggttacgatctgtctgttaccaccttctctccagatggccgtgtcttccaggtggagtatgccaccaaggccgttgacaacagtgggactgttgttggtattaagtgcaaagatggcattgtcctgggtgtggagaagctggtaacttcaaaaatgatgctggaggggtctaaccggaggatccattcagtccaccggcactctggcttggctgttgcaggtttagcagcagatgggaggcagattgtttcaagggccaaatcagaagctgccagttatgaaaaagtctatggggaacccatttccgtcaaggaattggcagatcgtgtggcaagttatgttcatctctgtacactatactggtggctcaggccatttggttgtggtgttattcttggaggttatgatagggacgggccacagctctacatgatagaaccctcaggagtctcctacaaatattttggtgctgcattgggcaagggaagacaggctgcaaaaactgagatagagaagttaaagctttcagagcttacctgccgtgaaggcattgttgaagtcgcaaagataatttatggagtgcatgatgaagcgaaggacaaagcttttgagttggagctgagctggatatgtgatgaatcgaaccgtcagcaccagaaggttccaaatgatctattggaacaggccaaggctgctgctcaggcagctcttgaggagatggatgctgactaagaagtcacctgtagaggagccaaacttatttcatatgtgggtgctggtgaaatctgcaatcctgtttgggtgataaactggagttttcagattttatttcaatgtactggaatatttcatagagatttgctaattctcagtcaacatgagattttgttttcagcccagtcacaatttgatcgtaaaaatcattttatgtgatcgataaatattacc

SEQ ID NO: 2684 - DNA, 1261 bp, Saccharum officinarum
cgagctctctttctcgtgcggcttactgcgcgaccgccgacgcccgacggcagggtgcccaggtcttcgtcagtcccttagccaggccctcgttgcatccttcgacggagacgaccccccaccaccaggactgatctactcacaagcggcgcagaggggaagagaagaacttgacaatgagcagcataggcacaggctacgatctgtctgtcaccaccttctccccagatggtcgtgtcttccaggtcgagtatgccaccaaggccgtcgacaatagcgggactgttgttgggatcaagtgcaaagatggcattgtcctgggtgtcgagaagctggtaacctcaaagatgatgctggaagggtcaaaccggaggatccattcagtgcaccggcattctggcttggctgtttctggtttagcagcagatggcaggcaaattgtttcaaggaccaaatcagaagctgccagttatgaaaaggtctatggagaagccatttctgtgaaggaattggcagatcgtgtggcaagttatgttcacctctgcacactgtactggtggctcaggccttttggttgtggtgttattcttggaggttatgatagggatgggccacagctctacatgatagaaccctcaggagtttcgtacaaatacttcggtgctgcattggggaagggaagacaggctgcaaagactgagatagaaaagttgaaactttcagagcttacctgccgggaaggcattgttgaagttgcaaagataatttatggagtgcatgacgaagcgaaggacaaagcttttgagttggagttgagctggatctgtgacgaatcaaaccgccagcatcagaaggttccgaatgaactgttggagcaggccaaagctgctgctcaggcagctcttgaggagatggatgctgactaagaaacacgatgatttgcccaaaagtgtttcggtgctgttgaaatctctgatccctttgtggtgacccataggatatggccaatttgtcacaatttatattttgatccatgtcttgtaaaactccgatcattgaagtctggaatctaggttgactaatatcagagctgtggtgtttacattcttaggtgatcttcaggaacttagcttttgttgtaccggttacgcagactggagtactggtctctgtgtgtttcggaatcgtgcatcagacttttagctgttccttgactctttttttctttcagataaagagctgttccctgacttatgcaagt

SEQ ID NO: 2685 - DNA, 1159 bp, Saccharum officinarum
atcttcttctccaagctgatttctgcttgttagctactcctgtctcgcgttctcctcctctccagtctctccgcctcccgcttacctctgtggctctagtctgtccctctctcgtttctttcctgtcggcgacggctgggggagctgcgccgctctcaccttcgccggcgacgagcatccacaagtagtcatctctttactagcggcgtagaggtgacgaaaaagccttgacaatgagcagcataggcacaggttatgatctgtctgtcaccaccttctctccagatggccgcgtcttccaggtcgagtatgccacgaaggctgtagacaacagcgggactgttgttgggatcaagtgcaaagatggcattgtcctgggtgtcgagaagctagtaacctcaaagatgattctggaggggtcaaaccggaggatccattcagtgcaccggcactcgggcttggctgttgctggtttggcagcagatggcagacaaattgtttcgaggaccaaatcagaagctgccagttacgaaaaggtctatggagaacccattcctgtgaaggaattggcagaccgtgtggcaagttatgttcatctttgcacgctgtactggtggctcagaccttttggttgtggcgttattcttggaggttatgatagggatgggccacagctctacatgatagagccctcaggagtttcctataaatacttcggtgctgcattggggaagggaagacaggctgcaaagactgagatagaaaagttgaaactttcagagcttacctgccgagaaggcattgttgaagttgcaaagattatttatggagtgcatgacgaagccaaggacaaagcttttgagttggagttgagctggatctgtgatgaatcgaagcgccagcatgagaaggttccaaacgaactgttggagcaggccaaagctgctgctcaggcagctcttgaggagatggatgctgactaagaaacacaatgatatgcccaaacttcatgttttggtgctgttgaaatctttgttcccttttggggtgacaaactggacatggccaatttgtctgattttattttgatgtcatgtaaaactccgttcatgtaagattgaatctggattgactgatatcatagccgtggtgttttaca

SEQ ID NO: 2686 - DNA, 1368 bp, Sorghum bicolor
ctgcatccttcgctcctcctctctctctctctctataccctctcgctcgcagatgactgttgggccgccgccgccctaggccaggtgctgaggcttttcttggtctcttcgccggcgacgaacacccaccaggactgatctacacacaagccgcgtagaggtgaagaaaaaacttgacaatgagcagcataggcacaggctacgatctgtcagtcaccaccttctcccctgatggtcgtgtcttccaggtcgagtatgccaccaaggccgtggacaacagcgggactgttgttgggatcaagtgcaaagatggcattgtcctgggtgtcgagaagctggtagcctcaaagatgatgctggaagggtcaaaccggaggatccattcagtgcaccgacactctggcttggctgttgctggtttagcagcagatggcaggcaaattgtttcaaggaccaaattagaagctgccagttatgaaaaggtctatggagaagccatttctgtgaaggaattggcagatcgtgtggcaagttatgttcacctttgcacactgtactggtggctcaggccttttggttgcggtgttattcttggaggttatgatagagatgggccacagctctacatgatagaaccctcgggagtttcctataaatacttcggtgctgcattggggaagggaagacaggctgcaaagactgagatagaaaaattgaaactttcagagcttacctgccgggaaggcattgttgaagttgcaaagataatttatggagtgcatgatgaagcgaaggacaaagcttttgagttggagttgagctggatctgtgatgaatcaaaccgccagcatcagaaggtcccaaatgaactgttggagcaggccaaagctgctgctcaggcagctcttgaggagatggatgccgactaagaaacacgatgatttgcccaaacttcgctgctgatccctttggagtgacccactggacatggccaatttgtcacatatattttgatccatgccatgtaaaactccgatcatggaagtctattgactgatatcagagctgtggtgtttacattctggtgaactcttggcgtgttcagacttttggcttctgctgtaccggttacgcagactgaagtactggattgtgtgtgtttcggaatcgtgctctagacttttagctgtgagagatttacatgtatggccctaaaaaaaaaatgcctattgtatggtttttttttgaacttcctcctgtggccctcaaaggaaatttcattggaaattttattccttctatggcctccggtgttaagtggagggtaaaaagactataatgcctctagcgtcaaattttctttcgcaa

SEQ ID NO: 2687 - DNA, 1890 bp, Sorghum bicolor
ccgtgcgttttacccttttttttccgccgtcgatacataacctgcttccccgtccgtccgctgcatccttcgctcctcctctctctctctctctataccctctcgctcgcagatgactgttgggccgccgccgccctaggccaggtgctgaggcttttcttggtctcttcgccggcgacgaacacccaccaggactgatctacacacaagccgcgtagaggtgaagaaaaaacttgacaatgagcagcataggcacaggctacgatctgtcagtcaccaccttctcccctgatggtcgtgtcttccaggtcgagtatgccaccaaggccgtggacaacagcgggactgttgttgggatcaagtgcaaagatggcattgtcctgggtgtcgagaagctggtagcctcaaagatgatgctggaagggtcaaaccggaggatccattcagtgcaccgacactctggcttggctgttgctggtttagcagcagatggcaggcaaattgtttcaaggaccaaattagaagctgccagttatgaaaaggtctatggagaagccatttctgtgaaggaattggcagatcgtgtggcaagttatgttcacctttgcacactgtactggtggctcaggccttttggttgcggtgttattcttggaggttatgatagagatgggccacagctctacatgatagaaccctcgggagtttcctataaatacttcggtgctgcattggggaagggaagacaggctgcaaagactgagatagaaaaattgaaactttcagagcttacctgccgggaaggcattgttgaagttgcaaagataatttatggagtgcatgatgaagcgaaggacaaagcttttgagttggagttgagctggatctgtgatgaatcaaaccgccagcatcagaaggtcccaaatgaactgttggagcaggccaaagctgctgctcaggcagctcttgaggagatggatgccgactaagaaacacgatgatttgcccaaacttcgctgctgatccctttggagtgacccactggacatggccaatttgtcacatatattttgatccatgccatgtaaaactccgatcatggaagtctattgactgatatcagagctgtggtgtttacattctggtgaactcttggcgtgttcagacttttggcttctgctgtaccggttacgcagactgaagtactggattgtgtgtgtttcggaatcgtgctctagacttttagctgtgagagatttacatgtatggccctaaaaaaaaaatgcctattgtatggtttttttttgaacttcctcctgtggccctcaaaggaaatttcattggaaattttattccttctatggcctccggtgttaagtggagggtaaaaagactataatgcctctagcgtcaaattttctttcgcaaacttttgtttgtttcttgtatattttgaataatagtaaacaaataaattgacaatttagacattataatagtacatatttggaccacaataaatatttaaacagcagtataatatatactaaaaagtttcatttatacaagaaacaaatcgaactttgtggaaaaaaattcatactaggggtattatagtcttttttctctccacttaacaccgttaaatactgaacagatggaaggtcatgaaagaaataaaaatttgtttgagggccatagaaagaagttttaaaaaaaaaaaccatacaaggaagaagtatttttgtaaaggccacacaagtaaatcagataaagagctgttccttggctttcttttcagataaagagctgttccttgacttgatgcaagtgtttggtactctttctgtttgtgccatatggttaacagacgtgaaagcatgaaatgca

SEQ ID NO: 2688 - DNA, 1068 bp, Cenchrus ciliaris
  misc_feature (94)..(94): n is a, c, g, or t
cgccctccctccccgccgcccactccggcgcttcccgaagctgcaccacccgacggccggtgcccaccctctctaggtactgaggtgacacaancaagtcgacaatgagcagcataggcacaggttacgatctgtccgttaccaccttctctccggacggtcgcgtcttccaggtcgagtacgccaccaaggctgtcgacaacagcggaactgttgttggaatcaagtgcaaagatggaattgtcctgggtgtcgagaagctggtaacttcaaagatgatgctggaggggtccaaccggaggatccattcagtgcaccggcacactggcttgtctgttgctggtttagcagcagatgggaggcaaattgtttcaagggctaaatcagaagctgccagttacgaaaaggtctatggggaacccattcctgtgaaggaattggcagatcgtgtagcaagttatgttcatctttgcacgctgtactggtggctgaggccatttggttgtggtgttattcttggaggttatgatagggatgggccacaactgtacatgatagagccctcgggagtctcctacaaatacttcggtgctgcattggggaagggaagacaggctgcaaaaactgagatagagaagttgaagctttcagagcttacctgccgggaaggcattgttgaagttgcaaagataatttatggagtgcatgacgaagcaaaggacaaagctttcgagttggaattgagctgggtctgcgacgaatcaaaccgccagcatcagaaggtgccaaatgatctgttggagcaagccaaggctgctgctcaggcagctctggaggaaatggacgctgactaagaaacaccgagcatacagtctgaacttatttcatcttctggtgctgttgaaatctttgatccctttggggtcacagactggacatggccaatttgtcggattttatttcagtgccctgtaaacttcatatgtacttaatggaaccatgcttttgtggaagtttaaagctcgacagtgagtgatatccaaagcagtggtatttgcattttggtga

SEQ ID NO: 2689 - DNA, 1958 bp, Zea mays
cctgcctctccctcccgccgccacagcgcgaagctctgtcggacaccgaccccgacgctgctctaccgctcgttgcgtcatccctccactggctcacacgtacaccttctcgaccgcgcgtcgtcactccactaccatatcccgaagattgcctcctccctgagactgccccctccacctcgcgtgcctcgcagacgggcgacctcgcatcgcgggctcggtgctcaaccgtggcccgaatttcgcttcgacgtcatcccgaacagctcgagaacaccatcctccatctcatcacagtataatacacatttgttcataagttatcgtggtattatatgattccgttgcaacgcacgggcactgacctagtcaaaatagaaaacagaaacaaaaatcatgagagtgagagttcatcttcttctccaagctgatttctgcttgttagctactcacgtcaacagaaaatctcgcgttcacctcctctccagtctctccgcctcccgcttacttctctgactctgtcctctttggtttctttcctgtcggcgacggctggggtgctgcgccgctctcaccttcaccgccgacgagcattcacaagtagtggtctcttactggtggcggcgtagaggtgacgaaaaaaccttgacaatgagcagcataggcacaggttatgatctgtctgtcaccaccttctctcccgatggccgcgtcttccaggtcgagtatgccacgaaggctgtcgacaacagcgggaccgttgttgggatcaagtgcaaagatggcattgttctgggtgtcgagaagctggtaacctcaaagatgatgctggagggatcaaaccgtaggatccattcagtgcacaggcactcgggcttggccgttgctggtttggcagcagatggcaggcaaattgtttcaaggaccaaatcagaagctgccagttatgaaaaggtctatggagaacccatttctgtgaaggaattggcagatcgtgtggcaagttatgttcatctttgcacgctgtactggtggctcagaccttttggttgtggtgttattcttggaggttatgatagggatggaccacagctttacatgatagagccctcaggagtttcgtataaatacttcggtgctgcattggggaagggaaggcaggctgcaaagactgagatagaaaagttgaaactttcagagcttacctgccgagaaggcattgttgaagttgcaaagataatttatgcagtgcatgatgaagctaaggacaaagcttttgagttggagttgagctggatctgtgaggaatcgaagcgccagcatcagaaggtcccaaatgacctgttggagcatgccaaagctgctgctcagacagctcttgaggagatggatgctgactaagaaacaagatgatatgcccaaacttcatgttttggcgctgttgaaatctctgatccctttggggtgacagactggatatggcaaatttgtcggattttattttgatgtcatgtaaaactcaattgatgtaagtttggatctgaattgattgatgtcatagctgtggctatttacattcaccgcagttgcgtcctttagaacttgctgttgttagactttataggaccttgcacacgaaccattgctactagacggcgattgttttgcgtgtcggacctctttctgtttttgtaggctatgtgaaagaggacggcagccataaggttgttgcgctctcgattagggcccgaacttgttccatcatctttcgttgcttttgaaatctttggtccctttgggctgccgggctgggctggacgtggcaaagaattgtcagattttactttcagttcgatgtaaaatctcatagatgtacctaacgaaactaggctccgttcatcggttcatggaagtttgaatctagacaggagatatcagggccgtgttgaaacagcggc

SEQ ID NO: 2690 - DNA, 1293 bp, Pennisetum glaucum
ggtcgccatcgtgttcagtccgtctcaccgtaggtctcggcttgggccggaagaaagaaaggggacgcacttactcacgcccctctctctccttcgatctcgtcttccccaaacccatcccaagccgccgagctcagcgaacccccctcgccactccaccttgctcgccggccggtccagatccaggagtgatctgtactagtggtgttggggcgacagaaacaagtcgacaatgagcagcataggcacaggttacgatctgtctgttaccaccttctctccggatggccgcgttttccaggtcgagtacgccaccaaggctgtcgacaacagcggaactgttgttggaatcaagtgcaaagatggaattgtcctgggtgttgagaagttggtaacttcaaagatgatgctggaggggtccaaccggaggatccattcagtgacgcggcactctggcttgtctgttgctggtttagcagcagatggaaggcagattgtttcaagggctaaatcagaagctgccagttacgagaaggtctatggggaacctattcctgtgaaggaattggcagatcgtgtagcaagttatgttcatctttgcacgctgtactggtggctgaggccttttggttgtggtgttattcttggaggttatgatagggatgggccccagctatacatgatagagccctcaggagtctcctacaaatacttcggtgctgcattggggaagggaagacaggctgcaaaaactgagatagagaagttgaagctttcagagcttacctgccgggaaggcattgttgaagttgcaaagataatttatggagtgcatgacgaagcaaaggacaaagctttcgagttggaattgagctgggtctgtgacgaatcaaaccgccagcatcagaaggtgccaaatgatctgttggagcaggccaaggctgctgctcaggcagctcttgaggaaatggacgctgattaagaaactccgagcacagtctgaacttattttatcttctggtggtgctgttgaaatctttgatccctttgggttgacagactggacatggccaatttgtcggattttatttcagtgtcctgtaaacttcatacgcacttaatggaaccatgctttcgtggaagtttaaatctcaacagcgagtgatatctgaccagtggcatttgcgttctggtgaaatcagaaatgaaagctcaactgttgatgttataaccacttcaaattacatatggttaatacttgtgcaacattttttttaagagtggtcacaaagc

SEQ ID NO: 2691 - DNA, 1134 bp, Panicum virgatum
ccccctccttccccatcgatctcgtcttccccaaacccatcacaagccgccgagtccacccgccgctccacccccagcgtcgcaggggctccgcctcgctcgccgccggtccagatccaggagtaacccatactagcggcttagaggtgacggaaacaagtcgacaatgagcagcataggtacaggctacgatctgtcggttaccaccttctctccggatggccgtgtcttccaggtcgagtacgccaccaaggctgtcgacaacagcgggactgttgtcgggatcaagtgcaaagatggcattgtcctgggtgttgagaagctggtaacttcgaagatgatgctggaggggtccaaccggaggatccattcagtgcaccgccactctggcttggctgttgctggtttagcggcagatggcaggcaaattgtttcaagggccaaatcagaagctgctagttatgaaaaggtctacggggaagccatttctgtgaaggaattggcagaccgtgtggcaagttatgttcatctttgcacgctgtactggtggctcaggccgtttggttgtggcgttattcttggaggttatgatagggatggaccacaactctacatgatagagccctcaggagtctcctacaaatactttggtgctgcattggggaagggaaggcaggccgcaaaaactgagatagagaagctgaagctttctgagcttacctgccgggaaggcattgttgaagttgcaaagataatttatggagtgcatgacgaagcgaaggacaaagctttcgagttggagttgagctgggtctgtgatgaatcaaaccgccagcatcagaaggtaccaaatgatctgttggagcaggccaaggctgctgctcaggcggctctggaggaaatggatgctgactaagaaacaccgacaatacgttcgaacttatttcatcttctggtgctgttgaaatctttgatccctttggggggacatactgaacatggccaatttgtcggtttctttaagtgtcatgtgaacttcatatgtacttaatggaactagcgagtgatatcagagctctggcgattactttctgcttgatgaaaggcactcgcgttctccaggaatttttcatt

SEQ ID NO: 2692 - DNA, 1372 bp, Setaria italica
tcgccttcgtgttctcggccccgcccgcccgtctcgtaggtctcggcttgggccggaagaaagaaaggggacgcacttactcacgcccctctctcatcgatctcgtcttccccaaacccatcccaagccgccgagctcagcgaaccccccgccgctccaccttgctcgccggccggtccagatccaggagtgatctgtactagcagtgttgaggtgacacaaacaagtcgacaatgagcagcataggcacaggttacgatctgtcagttaccaccttctctccggatggccgtgtcttccaggtcgagtacgccaccaaggctgtcgacaacagcgggactgttgttggaatcaagtgcaaagatggcattgtcctgggtgttgagaagctggtaacttcaaagatgatgctggaggggtccaaccagaggatccattcagtgcaccggcactctggcttgtctgttgctggtttggcagcagatggcaggcaaattgtttcaagggccaaatcagaagctgccagctacgaaaaggtctatggggaacccatttctgtgaaggaattggcagatcgtgtggcaagttatgttcatctttgcacgctgtactggtggctgaggccttttggttgtggtgttattcttggaggttatgatagggatgggccacagctgtacatgatagagccctcaggagtctcctacaaatacttcggtgctgcattggggaagggtagacaggctgcaaaaactgagatagagaagttgaagctttcagagcttacctgccgggaaggcattgttgaagttgcaaagataatttatggagtgcatgacgaagcaaaggacaaagctttcgagttggagttgagctgggtctgtgacgaatcaaaccgccagcatcagaaggtaccaaatgatctgttggagcaggccaaggctgctgctcaggcagctctggaggaaatggatgctgactaagaaacaccgaccatagtctgaacttatttcatcttctggtgctgttgaaatctttgatccctttggggtgacagactggacatggccaatttgtcggattttatttcagtgtcctgtaaacttcatacgtacttaatggaactatgctttcgtggaagtttgaagctctacagcgaatgatatccgagcagtggcatttgcattctggtgaaatcaaggcacttgcgttcttcaggaatttgcccatagacaatacttgttttcttcacttagcaccacgccgtctcttcaacctggatgagttgcttctgctgtacttttggtcgcaccagggcaaatgcgcatatgtcttccaactgttttcttgatgttataaccactcctttcct

SEQ ID NO: 2693 - DNA, 1161 bp, Setaria italica
gaagaaagaaaggggacgcacttactcacgcccctctctcatcgatctcgtcttccccaaacccatcccaagccgccgagctcagcgaaccccccgccgctccaccttgctcgccggccggtccagatccaggagtgatctgtactagcagtgttgaggtgacacaaacaagtcgacaatgagcagcataggcacaggttacgatctgtcagttaccaccttctctccggatggccgtgtcttccaggtcgagtacgccaccaaggctgtcgacaacagcgggactgttgttggaatcaagtgcaaagatggcattgtcctgggtgttgagaagctggtaacttcaaagatgatgctggaggggtccaaccagaggatccattcagtgcaccggcactctggcttgtctgttgctggtttggcagcagatggcaggcaaattgtttcaagggccaaatcagaagctgccagctacgaaaaggtctatggggaacccatttctgtgaaggaattggcagatcgtgtggcaagttatgttcatctttgcacgctgtactggtggctgaggccttttggttgtggtgttattcttggaggttatgatagggatgggccacagctgtacatgatagagccctcaggagtctcctacaaatacttcggtgctgcattggggaagggtagacaggctgcaaaaactgagatagagaagttgaagctttcagagcttacctgccgggaaggcattgttgaagttgcaaagataatttatggagtgcatgacgaagcaaaggacaaagctttcgagttggagttgagctgggtctgtgacgaatcaaaccgccagcatcagaaggtaccaaatgatctgttggagcaggccaaggctgctgctcaggcagctctggaggaaatggatgctgactaagaaacaccgaccatagtctgaacttatttcatcttctggtgctgttgaaatctttgatccctttggggtgacagactggacatggccaatttgtcggattttatttcagtgtcctgtaaacttcatacgtacttaatggaactatgctttcgtggaagtttgaagctctacagcgaatgatatccgagcagtggcatttgcattctggtgaaatcaaggcacttgcgttcttc

SEQ ID NO: 2694 - DNA, 1369 bp, Oryza sativa
cgcatcgcgccgcttttgctcctccgtctctctctcggcttggaccgtaagaaaaagcaaaaaaaggaaaaaaatagggagtgaaaaaaaaaaaccccaaaagaaagaaatctccttctctctctcgatcccgtctcgtctcgtcagtctgcacccggttgcctccccgccgctctcctctccggtctactcctccgccgtcgccgtcggcaccgccgccggagctcctccctgctccctctactgggttggcggggagtggatcggggatctgcacgcaggggccgatttcttctcttcgtaaggagtagataacacagaatagttgaagatgagcagcataggcacaggatacgatctgtccgttaccaccttctctccggatggtcgcgtcttccaggttgagtatgccacgaaggctgtcgacaacagcgggactgttgttggaatcaaatgcaaagatggaatcgtcctgggtgtggagaagctagtaacttcgaagatgatgctggagggatctaataggaggatccattcagtgcactggcactctggcttggctgttgctggtttagctgcagatggcaggcaaattgtttcaagagcaaaatcggaagcggccagttatgagaaggtctatggtgaacccatttctgtaaaagaattggctgatcgtgtggctagctacgttcatctttgtacactctactggtggctcaggccttttggttgtggagttattcttggaggttatgatagggatgggccacagctctacatgatcgaaccctcaggagtctcatacaaatactttggtgctgctctgggtaaaggaagacaggctgcaaaaactgaaatagagaagttgaagctttccgagcttacctgccgggaaggcattgtggaggttgcaaagatcatttatggagtacatgatgaagctaaggacaaagcttttgagttggaattaagctggatatgtgatgaatcaaatcgccagcatcagaaggttcctgctgatcttttggagcaggccaaggttgcagctcaggcagcgcttgaggagatggatgctgattaagaggagacccgactatgttctacgtttggccactgatgaaatctttgatgtcattactggcacacagggacatggccattctgtcggattttaaaacttcgcatgtacttatggtactaaattcatggaaagtttgatgctggacagtgaatggatatctgacttttgactgaacttgtcccttaaatcttgatgaattgctcgtttcgcgtttgccttttttggtgttcacccaagattgaacgactcaatgatgtttttcctgcagtatcttgacatttgaatcgc

SEQ ID NO: 2695 - DNA, 1312 bp, Oryza sativa
ggcttggaccgtaagaaaaagcaaaaaaaggaaaaaaatagggagtgaaaaaaaaaaaccccaaaagaaagaaatctccttctctctctcgatcccgtctcgtctcgtcagtctgcacccggttgcctccccgccgctctcctctccggtctactcctccgccgtcgccgtcggcaccgccgccggagctcctccctgctccctctactgggttggcggggagtggatcggggatctgcacgcaggggccgatttcttctcttcgtaaggagtagataacacagaatagttgaagatgagcagcataggcacaggatacgatctgtccgttaccaccttctctccggatggtcgcgtcttccaggttgagtatgccacgaaggctgtcgacaacagcgggactgttgttggaatcaaatgcaaagatggaatcgtcctgggtgtggagaagctagtaacttcgaagatgatgctggagggatctaataggaggatccattcagtgcactggcactctggcttggctgttgctggtttagctgcagatggcaggcaaattgtttcaagagcaaaatcggaagcggccagttatgagaaggtctatggtgaacccatttctgtaaaagaattggctgatcgtgtggctagctacgttcatctttgtacactctactggtggctcaggccttttggttgtggagttattcttggaggttatgatagggatgggccacagctctacatgatcgaaccctcaggagtctcatacaaatactttggtgctgctctgggtaaaggaagacaggctgcaaaaactgaaatagagaagttgaagctttccgagcttacctgccgggaaggcattgtggaggttgcaaagatcatttatggagtacatgatgaagctaaggacaaagcttttgagttggaattaagctggatatgtgatgaatcaaatcgccagcatcagaaggttcctgctgatcttttggagcaggccaaggttgcagctcaggcagcgcttgaggagatggatgctgattaagaggagacccgactatgttctacgtttggccactgatgaaatctttgatgtcattactggcacacagggacatggccattctgtcggattttaaaacttcgcatgtacttatggtactaaattcatggaaagtttgatgctggacagtgaatggatatctgacttttgactgaacttgtcccttaaatcttgatgaattgctcgtttcgcgtttgccttttttggtgttcacccaagattgaacgactcaatgatgtttttcctgca

SEQ ID NO: 2696 - DNA, 1557 bp, Sorghum bicolor
tagcccaacagagaacctttcacggccctgctagagtagtttaacaatcgaaatagaaacagaaacagagtgtagagttcatcttcttctccaagctgatttctgcttgttagctggtatagatctacataggtactcacgtcaacggaaaatctcgcgttcacctcctctccagtcgctccgcctcccgcagtcccgcctacctctgtccctctccctctcttgtttctttcctgtcggcggcggccgggggtgctgcgccgctctcaccttcgccggcgacgagcatccacaagtagcgatctctttactagcggcgtagaggtaacgaagaagccctgacaatgagcagcatcggcacaggttatgatttgtctgtcaccaccttctctccggatggccgcgtcttccaggtcgagtatgccacgaaggctgtcgataacagcgggactattgttgggatcaagtgcaaagatggcattgtcctgggtgttgagaagctagtaacctcaaagatgattctggaggggtcgaaccggaggatccattcagtgcaccaccactcgggcttggctgttgctggtttggcagcagatggcaggcaaattgtttcaaggaccaaatcagaagctgccagttatgaaaaggtctatggagaacccattcctgtgaaggaattggcagaccgtgtggcaagttatgttcatctttgcacgctgtactggtggctcagaccttttggttgcggtgttattcttggaggttatgatagggatgggccacagctctacatgatagagccctcaggggtttcctataaatacttcggtgctgcattggggaagggaaggcaggctgcaaagactgagatagaaaagttgaaactttcagagcttacctgccgagaaggcattgttgaagttgcaaagataatttatggagtgcatgacgaagccaaggacaaagcttttgagttggagttgagctggatctgtgatgaatcgaagcgccagcatgagaaggttccaaatgacctgttggagcaggccaaagctgctgctcaggcagctcttgaggagatggatgctgactaagaaacaagatgatatgcccaaacttaattgtttggtgctgttgaaatctttgatccctttgcgggtgacagtctggacatggccaatttgtctgattttattttgatgtcatgtaaaactcgggtcatgtaagtttgaatctggattgattgatatcatagctgtggtgttttaacattctggtttagtcatggcacttgcgttctttaggaagcttgttcacttgaacttatctatcgaatctgtcagttatttagcagtgtttttctcatataacaaatcagcaaacaatgctttcagtcatgatttttcagccaagtgaatagcagaataggacccacatgtagactgaactgcgtctttgttcgcaccaggagcacggcagctacatccgagttgtagctgtttcttgatgcgctaggtactcttctgtgtttgccaaatggtaagcagatttgcaact

SEQ ID NO: 2697 - DNA, 1805 bp, Sorghum bicolor
ttgatgtcataaatttttatatttttctctataactttaatcaaacttaagatgttttgactctctaaaattcttagaacggatgaagtacctttgtatcagtaggatactttattatggaaagttagagtgagtcggctcggatatagcaatgggcctggcgaagggcgcctcccttcttagttgcatttgtaggccgggaggcctctttagcttaggggcccaggtcgacctttctttttcactagcccaacagagaacctttcacggccctgctagagtagtttaacaatcgaaatagaaacagaaacagagtgtagagttcatcttcttctccaagctgatttctgcttgttagctggtatagatctacataggtactcacgtcaacggaaaatctcgcgttcacctcctctccagtcgctccgcctcccgcagtcccgcctacctctgtccctctccctctcttgtttctttcctgtcggcggcggccgggggtgctgcgccgctctcaccttcgccggcgacgagcatccacaagtagcgatctctttactagcggcgtagaggtaacgaagaagccctgacaatgagcagcatcggcacaggttatgatttgtctgtcaccaccttctctccggatggccgcgtcttccaggtcgagtatgccacgaaggctgtcgataacagcgggactattgttgggatcaagtgcaaagatggcattgtcctgggtgttgagaagctagtaacctcaaagatgattctggaggggtcaaaccggaggatccattcagtgcaccaccactcgggcttggctgttgctggtttggcagcagatggcaggcaaattgtttcaaggaccaaatcagaagctgccagttatgaaaaggtctatggagaacccattcctgtgaaggaattggcagaccgtgtggcaagttatgttcatctttgcacgctgtactggtggctcagaccttttggttgcggtgttattcttggaggttatgatagggatgggccacagctctacatgatagagccctcaggggtttcctataaatacttcggtgctgcattggggaagggaaggcaggctgcaaagactgagatagaaaagttgaaactttcagagcttacctgccgagaaggcattgttgaagttgcaaagataatttatggagtgcatgacgaagccaaggacaaagcttttgagttggagttgagctggatctgtgatgaatcgaagcgccagcatgagaaggttccaaatgacctgttggagcaggccaaagctgctgctcaggcagctcttgaggagatggatgctgactaagaaacaagatgatatgcccaaacttaattgtttggtgctgttgaaatctttgatccctttgcgggtgacagtctggacatggccaatttgtctgattttattttgatgtcatgtaaaactcgggtcatgtaagtttgaatctggattgattgatatcatagctgtggtgttttaacattctggtttagtcatggcacttgcgttctttaggaagcttgttcacttgaacttatctatcgaatctgtcagttatttagcagtgtttttctcatataacaaatcagcaaacaatgctttcagtcatgatttttcagccaagtgaatagcagaataggacccacatgtagactgaactgcgtctttgttcgcaccaggagcacggcagctacatccgagttgtagctgtttcttgatgcgctaggtactcttctgtgtttgccaaatggtaagcagatttgcaactgtg

SEQ ID NO: 2698 - DNA, 1171 bp, Panicum virgatum
aaagaaggcaagaaagaaaaggggggcgacgcactgactcaggcccttctcgtcccctcttcttccccatcgatctcgtccttccccaaacccatcccaagccgccgagctcagaacaccccgccgctccaccccagctccgccgggctccgcctcgctcgccgccggtccagatccaggagtgatctccataatagcagcttagaggtgacgcaaacaagtcgacaatgagcagcataggcacaggttacgatctgtcggttaccaccttctctccggatggccgtgtcttccaggtcgagtacgccaccaaggctgtcgacaacagcgggactgttgtcgggatcaagtgcaaagatggcattgtcctgggtgttgagaagctggtaacttcaaagatgatgctggaggggtccaaccggaggatccattcagtgcaccgccactctggcttggctgttgctggcttagcggcagatggcaggcaaattgtttcaagggccaaatcagaagctgctagttatgaaaaggtctacggggaagccatttctgtgaaggaattggcagatcgtgtggcaagttatgttcatctttgcacgttgtactggtggctcaggccgtttggttgtggcgttattcttggaggttatgatacggatgggccacaactctacatgattgagccctcaggagtctcctacaaatactttggtgctgcattggggaagggaagacaggctgcaaaaactgagatagagaagctgaagctttcggagcttacctgccgggaaggcattgttgaagttgcaaagataatttatggagtgcatgacgaagctaaggacaaagctttcgagttggagttgagctgggtctgtgatgaatcaaaccgccagcatcagaaggtaccaaatgatctgttggaacaggccaaggctgctgctcaggcggctctggaggaaatggatgccgactaagaaacaccgacaatacgttcgaaattcgtcttctggtgctgtttaaatctttgatccctttggggtgacatactggacatggccaatttgtcggtttgtttcagtgtaatgtgaacttcatatgtacttaatggaactagtctttcatggaagtttacatggtagacgagctatggcgattactttctgctata

SEQ ID NO: 2699 - DNA, 1021 bp, Saccharum officinarum
gtctttcctggcggcgacgatctgggctacggcgccgccctcttcgtcaggcccttcgccggcgacgagcatccaccaggattgatctccatactaacggcgtagaggtaacgaacaaagcttgacaatgagcagcataggcacaggttacgacctgtctgttaccaccttctctccggatggccgtgtcttccaggttgagtacgccaccaaggctgtcgacaacagcgggactgttgttgggatcaagtgcaaagatggcattgtcctgggtgtagagaagctggtgacttcaaagatgatactggagggttccaaccggaggatccattcagtgtaccaccactctggcttggctgttgctggtttagcagcagatggaaggcaaattgtttcaagggccaaatcagaagctgccagttacgaaaaggtctacggggaacccatttctgtgaaggatttggcagatcgtgtggcaagttatgttcatctttgcacgctgtactggtggctcaggccttttggttgtggtgttattcttggaggctatgatagggatgggccacagctctacatgattgagccctcaggagtctcctataaatactttggtgctgcattggggaagggaagacaggctgcaaagactgagatagagaagttgaagctttctgagcttacatgccgagaaggcatcgttgaagttgcaaagataatttatggagtgcatgacgaagcgaaggacaaagcttttgagttggagttgagctggatctgtgatgaatcgaagcgccagcatcagaaggttccaaatgaactgttggagcaggccaaggccgctgctcaggcagctcttgaggagatggatgctgactaagaaacaccattgctaggccccaacttgtttcatctttcggtgcttttgaaacctttgatcccttttgggctgacgggctggacgtggcaaaaaattgtcagattttttttaagggagaattgtcagattttactttcagtgcga

SEQ ID NO: 2700 - DNA, 1385 bp, Brachypodium distachyon
accgatgcctttgcccgcaaatacaactcgccccctcctattctcacaaaccccacactccgcaccttcttgcgcgacaagccggagccgacgagacgaccgcgccgccgtcgacgcgacctcctccgcccgccgggatcggagagaactcttgaaccagtttaaaggttgaagcaacttaacgatgagtagcataggaactggttatgatctgtccgtcaccacgttctccccagatggccgtgtcttccaggttgagtatgctggcaaggctgtcgacaacagcgggactatcgttgggatcaaatgcaaagatggaattgtccttggtgtggagaagctgattacatcaaagatgatacttgagggatcgaatcggagacttcactctgtgcaccggaactctggcttggctgtggctgggttagcagcggacggtaggcagatagtctcgagagcgaagtcagaggcagccaattatgaaaaggtttacggagaacccatgcctgttaaggagttggctgaccgtgtagctagctatgttcatctgtgtacactgtactggtggctcaggccctttggctgtggagttattcttggaggttatgatagggatgggccacagctctacatgattgaaccttcaggcctctcctacaaatattttggtgctgcactgggtaaaggaagacaagctgcaaaaaccgaaatagagaaattgaagctttctgagctaacgtgccgggaaggcatcgttgaggtcgccaagataatttatggtgtacacgatgaagcgaaagacaagtctttcgagttggaactgagctgggtatgtgatgaatcgaaccgtcagcatgagaaggttccaaacgatcttctggagcaggccaaagcagcagcgcaagcagcgcttgaggagatggatgctgactaagaaaagaaccccgcgaatattctcttcccatttactttgaggggtgtaatagatacatgatcctcagaatgttgctttcggttccatcccagtcgaggtagcaggctcgtgttgtttgggttctgacgaattgcattctgcttgctctggatcttaatttattcagttctgaacgacctggaaatttgatgagtacaactagcttttcattctaaaccattacagccctgacctcagatttgttcgccgctgtgtcccgcctcagggtgctggcgaacttgtcctaaattcctaatcagtataacaacatacggagattcttagggttgagtatagtgaagaacagtatacgagtgaagacgcaagtagtgtcctgactcctgaaaatactactcccactgagggtaaaatgcattttgtatgtatcaaaatagtctattttgcacagagc

SEQ ID NO: 2701 - DNA, 1405 bp, Brachypodium distachyon
cgagcccgacaccgatgcctttgcccgcaaatacaactcgccccctcctattctcacaaaccccacactccgcaccttcttgcgcgacaagccggagccgacgagacgaccgcgccgccgtcgacgcgacctcctccgcccgccgggatcggagagaactcttgaaccagtttaaaggttgaagcaacttaacgatgagtagcataggaactggttatgatctgtccgtcaccacgttctccccagatggccgtgtcttccaggttgagtatgctggcaaggctgtcgacaacagcgggactatcgttgggatcaaatgcaaagatggaattgtccttggtgtggagaagctgattacatcaaagatgatacttgagggatcgaatcggagacttcactctgtgcaccggaactctggcttggctgtggctgggttagcagcggacggtaggcagatagtctcgagagcgaagtcagaggcagccaattatgaaaaggtttacggagaacccatgcctgttaaggagttggctgaccgtgtagctagctatgttcatctgtgtacactgtactggtggctcaggccctttggctgtggagttattcttggaggttatgatagggatgggccacagctctacatgattgaaccttcaggcctctcctacaaatattttggtgctgcactgggtaaaggaagacaagctgcaaaaaccgaaatagagaaattgaagctttctgagctaacgtgccgggaaggcatcgttgaggtcgccaagataatttatggtgtacacgatgaagcgaaagacaagtctttcgagttggaactgagctgggtatgtgatgaatcgaaccgtcagcatgagaaggttccaaacgatcttctggagcaggccaaagcagcagcgcaagcagcgcttgaggagatggatgctgactaagaaaagaaccccgcgaatattctcttcccatttactttgaggggtgtaatagatacatgatcctcagaatgttgctttcggttccatcccagtcgaggtagcaggctcgtgttgtttgggttctgacgaattgcattctgcttgctctggatcttaatttattcagttctgaacgacctggaaatttgatgagtacaactagcttttcattctaaaccattacagccctgacctcagatttgttcgccgctgtgtcccgcctcagggtgctggcgaacttgtcctaaattcctaatcagtataacaacatacggagattcttagggttgagtatagtgaagaacagtatacgagtgaagacgcaagtagtgtcctgactcctgaaaatactactcccactgagggtaaaatgcattttgtatgtatcaaaatagtctattttgcacagagcgtaaaaaaaa

SEQ ID NO: 2702 - DNA, 1323 bp, Oryza sativa
cgcgggccgcctccctcctcccaacttaaaccgcaccacgactcgtctcctcctctctcttctcccccaagccaagacgacacactccccccaccttcttgcgccacaagccgaagccgccggaatcctcgacgagacgccccgccgccgccgccgccgccggcgacgccccccctcaccccccgcaggcatcggagaaatataatataaatacagttaaggggttgaagcaacttcacaatgagtagcatagggactggttatgatctttccgtcaccaccttctccccagatggccgtgtcttccaggttgagtatgctggcaaggccgtcgacaacagcgggactgttgttggcatcaaatgcaaagatgggattgtccttggtgtggagaagctggtaacatcaaagatgattttgaaggggtcgaatcggagactccactctgtgcaccgacactctggcttggctgttgctggtttagctgcggatggtaggcagatagtctctagggcaaagtcagaggcagccagttatgaaaaggtgtatggagaacccatgcctgtaaaggaattggctgatcgtgtagctagctatgtacatttatgtaccctctactggtggctcaggccttttggctgtggagttattcttggaggttatgatagggatgggccacaactctacatgatcgaaccttcggggctctcctataaatacttcggtgctgccctggggaaaggaagacaggctgcaaaaacggagatagagaaactgaatctttctgagcttacatgcagagaaggcattgttgaggttgcaaagataatctatggagtgcatgacgaagctaaagacaaagactttgaactggagctgagctgggtatgcgatgaatcaaagcgccagcatgagaaggttccagacgacctcgtggagcaggcgaaggcagccgcccaggcagcgctcgaggagatggacgcagactagaaaccgccgatcatgatgctctagaatcatatctccattactcgatgctagaccgatcgatcatctataaccatatcactacattgtgtaacagacttgaggcagctcgtcagtttcatttcaacgtagaaccacctcaagaaaagaatgttgtactatgcagctcgatcgctttcacatattgtttgctcctgatttatgacgaaccacactccttgctgtttgctcaacctttatacttgatatagatagttatatactgcccccgttttcaaataatctgtgagcgttgatcattaccgtctcatctttgataaccaatttatattttag

SEQ ID NO: 2703 - DNA, 1233 bp, Oryza sativa
ctctcttctcccccaagccaagacgacacactccccccaccttcttgcgccacaagccgaagccgccggaatcctcgacgagacgccccgccgccgccgccgccgccggcgacgccccccctcaccccccgcaggcatcggagaaatataatataaatacagttaaggggttgaagcaacttcacaatgagtagcatagggactggttatgatctttccgtcaccaccttctccccagatggccgtgtcttccaggttgagtatgctggcaaggccgtcgacaacagcgggactgttgttggcatcaaatgcaaagatgggattgtccttggtgtggagaagctggtaacatcaaagatgattttgaaggggtcgaatcggagactccactctgtgcaccgacactctggcttggctgttgctggtttagctgcggatggtaggcagatagtctctagggcaaagtcagaggcagccagttatgaaaaggtgtatggagaacccatgcctgtaaaggaattggctgatcgtgtagctagctatgtacatttatgtaccctctactggtggctcaggccttttggctgtggagttattcttggaggttatgatagggatgggccacaactctacatgatcgaaccttcggggctctcctataaatacttcggtgctgccctggggaaaggaagacaggctgcaaaaacggagatagagaaactgaatctttctgagcttacatgcagagaaggcattgttgaggttgcaaagataatctatggagtgcatgacgaagctaaagacaaagactttgaactggagctgagctgggtatgcgatgaatcaaagcgccagcatgagaaggttccagacgacctcgtggagcaggcgaaggcagccgcccaggcagcgctcgaggagatggacgcagactagaaaccgccgatcatgatgctctagaatcatatctccattactcgatgctagaccgatcgatcatctataaccatatcactacattgtgtaacagacttgaggcagctcgtcagtttcatttcaacgtagaaccacctcaagaaaagaatgttgtactatgcagctcgatcgctttcacatattgtttgctcctgatttatgacgaaccacactccttgctgtttgctcaacctttatacttgatatagatagttatatactgcccccgttttcaaataatctgtgagcgttgatcat

SEQ ID NO: 2704 - DNA, 1022 bp, Secale cereale
tccgcccgccgggatcggagagaactgtataaacggtttagcggttgaagcgacttaaccatgagtagcataggaaccgggtatgatctgtccgtcaccactttctccccggacggccgtgtcttccaggtcgagtatgctggcaaggccgtcgacaacagcgggacgattgttgggatcaagtgcaaagatggaattgtccttggcgtggagaagctgataacatcgaagatgatactggccgggtcgaatcggagacttcactctgttcaccggaattctggcttggctgtggctgggttagcagcagatggtaggcaggtggtctcaagagcaaagtcagaagcagccaattatgaaaaggtatacggagaacccatgcctgtgaaggaattagctgatcgtgtagctagctacgttcatctgtgtacactctactggtggctcaggccttttggctgtggagttattcttggaggttatgatagggatgggccacagctctacatgatcgaaccttcagggctctcatataaatattttggtgctgctctgggtaaaggaagacaggctgcaaaaacggagatagagaaattaaagctttctgagctaacctgcagggaaggcattgttgaggttgccaagataatttatggtgtacacgatgaagcgaaagacaaatcttttgagctggaactgagctgggtgtgcgatgaatctaaccgtcagcatgagaaggttccaaatgatcttctggagcaggccaaggcagcagcgcaggcagcgttggaagagatggatgccgactaagaagagaccatgagctctccttcccatttactttcacgttcggcgtaacagattcagggctggagcggttcgttttcagtggcgttgttgctttcggttccatgattccatcccagtcgaggtagcaagcaggttctcgtgtttttggggggttgtagcgaatagtattctgcttgctgttggtcacagactgaatcttaatctattgaaat

SEQ ID NO: 2705 - DNA, 1162 bp, Secale cereale
gcccgtccgtcccggcggctctctcaacccacactcccacctctgcggcacaagccgagccgacgatcccccgcccgcgccgccgtcgacgcggcctcctccgcccgccgggatcggagagaactgtataaacggtttagtggttgaagcgacttaagtcttaaccatgagtagcataggaaccgggtatgatctgtcggtcaccactttctccccggacggccgtgtcttccaggtcgagtatgctggcaaggccgtcgacaacagcgggacgattgttgggatcaagtgcaaagatggaattgtcctcggtgtggagaagctgataacatcgaagatgatacttgccgggtcgaatcggagacttcactctgttcaccggaactctggcttggctgtggctgggttagcagcagacggtcggcaggtggtctcaagagcaaagtcagaagcagccaattatgaaaaggtatacggagaacccatgcctgtgaaggaattagctgatcgtgtagctagctacgttcatctgtgtacactctactggtggctcaggccttttggctgtggagttattcttggaggttatgatagggacgggccacagctctacatgatcgaaccttcagggctctcatataaatattttggtgctgctctgggtaaaggaagacaggctgcaaaaacggagatagagaaattgaagctttctgagctaacctgcagggaaggcattgttgaggttgccaagataatttatggtgtacacgacgaagcgaaagacaaatcgtttgagctggagctgagctgggtgtgcgatgaatctaaccgtcagcatgagaaggttccgaatgatcttctggagcaggccaaggcagcagcgcaggcagcgctggaagagatggatgccgactaagaagagaccatgagctctgcttcccatttactttcacgagcggcgtaacagattcagggctggagcggttcgtttttcagtgcaaaaaactacctcaagggcgttgttgcctccggttccatgattccatcccagtcgaggtagcaagcaggttctcgtgtttttgtgggttgtagcgaatcgtattctgcttgctgttggtcacacactgaatcttaatctattgaaatccgatcatgattgtca

SEQ ID NO: 2706 - DNA, 1168 bp, Triticum aestivum
cccacgcgtccgacaactcgtgcccgtgcccgtccgtcccggcggctctctcaaacccacactccccaccttcttgcggcacaagccggagccgacgatcccctcgcccgcgccgccgtcgacgcggcctcctccgcccgccgggatcggagagaactgtataaacggttcagtggttgaagcgacttaagtcttaaccatgagtagcataggaaccgggtatgatctgtccgtcaccactttctccccggacggccgtgtcttccaggtcgagtatgctggcaaggccgtcgacaacagcgggacgattgttgggatcaagtgcaaagatggaattgtcctcggtgtggagaagctgataacatcgaagatgatacttgccgggtcgaatcggagacttcactctgttcaccggaactctggcttggctgtggctgggttagcagcagacggtaggcaggtggtctcaagagcaaagtcagaagcagccaattatgaaaaggtatacggagaacccatgcctgtgaaggaattagctgatcgtgtagctagctacgttcatctgtgtacactctactggtggctcaggccttttggctgtggagttattcttggaggttatgatagggatgggccacagctctacatgatcgaaccttcagggctctcatataaatattttggtgctgctctgggtaaaggaagacaggctgcaaaaacggagatagagaaattgaagctttctgagctaacctgcagggaaggcattgttgaggttgccaagataatttatggtgtacacgacgaagcgaaagacaaatcttttgagctggaactgagctgggtgtgcgatgaatctaaccgtcagcatgagaaggttccaaatgatcttctggagcaggccaaggcagcagcgcaggcagcgttggaagagatggatgccgactaagaagagaccatgagctctgcttcccatttactttcacgtgcggcgtaacagattcagggctggagcggttcgttttcagtgcaaaaaactaccttcagggcgttgttgcttccggttccatgattccatcccagtcgaggtagcaatcaggttctgtgtttttggggtttgtagcgaatcgtattctgcttgctgttggtcacacactgaatcttaatc

SEQ ID NO: 2707 - DNA, 891 bp, Avena sativa
gacatacctcactccccaccttcttgcgccacaagccggagccgacgatccgcctgcccgcgccgccgtcgacgtgccctcctccgccctccgggatcggagagaactctatattggtttagaggttgaagcagcttaacaatgagtagcatcggaactgggtatgatctgtccgttaccactttctccccggatggccgtgtcttccaggtcgagtatgctggcaaggccgtcgacaacagtgggacgatcgttggcatcaaatgtaaagatggaattgtccttggtgtggagaagctgataacatctaagatgatacttgccgggtcgaatcggagacttcactctgtgcaccacaactctggcttggctgtggctgggctagcagcagatggtaggcagatagtctcaagggcaaagtcagaggcagctaattatgagaaggtttacggagaacccatgcctgtgaaagaattagctgatcgtgtagctagctatgttcatctttgtacactctactggtggctcaggccttttggctgtggagttattcttggaggttatgatagggatgggccacagctctacatgatcgaaccttcaggtctctcctataaatattttggtgctgctctgggcaaaggaagacaagctgcaaaaaccgagattgagaaattgaagctttctgagctgacatgcagggaaggcatcgttgaggttgccaagataatttatggtgtgcacgacgaagcgaaagacaaatcttttgagctggaactgagctgggtatgcgatgaatctaaccgtcagcacgagaaggttccaagtgatcttctggagcaggctaaggcagcagcacaggcagcgctggaggagatggatgccgactaa

SEQ ID NO: 2708 - DNA, 1266 bp, Secale cereale
gcaggcctccgcgaatacaactagtttcgtgcccgtccggtccctgccccccctctcaaaccacactccccaccttcttgcgccacaagccggagccgacgatccgccgtcgacgcgacctcctccgcccgccggaatcggagacgactatataggtggtctagaggttgaagcaacttaacaatgagtagcataggaactgggtatgatctgtccgtcaccactttctccccggacggacgtgtcttccaggtcgagtatgctggcaaggccgtcgacaacagcgggacgatcgttgggatcaaatgcaaagatggaattgtccttggtgtggagaagctgataacctcaaagatgatacttgctgggtcgaaccggagacttcattccgtgcaccggaactctggcttggctgtggctgggttagcagcagacggtaggcagatagtctcaagagcaaagtcagaagcagccaattatgaaaaggtatacggagaacccatgcctgtaaaggaattagctgaccgtgttgctagctatgttcatctgtgtacactctactggtggctcaggccttttggctgtggagttattcttggaggctatgacagggatgggccacagctctacatgatcgaaccttcaggcctctcctataaatattttggtgctgctctgggtaaaggaagacaagctgcaaaaacggagattgagaaattgaagctttctgagctaacctgcagggaaggcatcgttgaggttgccaagataatttatggtgtacacgacgaagcgaaagacaaatcttttgagctggaactgagctgggtgtgtgaggaatctaaccgtcagcacgagaaggttccgagtgatcttctggagcaggccaaggcagcagcgcaggcagcgttggaagagatggatgccgactaagaagagaccctggtcccgttttctttcacgcgtggtgtaatagagatacaggaccggttgacgaatttcatttcagttccaaaaactagctcaggttgttgttgctttcgattccatcccggtcgaggtagcaagcagtctctcatgttgtttgggtggggttctagtgaattgaatcgtattaagcttgctgtgttggtcgcacttaatcttctattgaatcctgaatgacctgaaaatctgtcttgatttatctgcctcttcgttgccattactccaaccttggggcttgtgcaatgcgagaaaaaggacatagaacatgtgtttacctga

SEQ ID NO: 2709 - DNA, 1179 bp, Secale cereale
agccgacgatccgccgtcgacgcgacctcctccgcccgccggaatcggagacgactatatagacggtctagaggttgaagcaacttaacaatgagtagcataggaactgggtatgatctgtccgtcaccactttctccccggacggacgtgtcttccaggtcgagtatgctggcaaggccgtcgacaacagcgggacgatcgttgggatcaaatgcaaagatggaattgtccttggtgtggagaagctgataacctcaaagatgatacttgccgggtcgaaccggagacttcattccgtgcaccggaactctggcttggctgtggctgggttagcagcagacggtaggcagatagtctcaagagcaaagtcagaagcagccaattatgaaaaggtatacggagaacccatgcctgtaaaggaattagctgatcgtgttgctagctatgttcatctgtgtacactctactggtggctcaggccttttggctgtggagttattcttggaggctatgatagggatgggccacagctctacatgatcgaaccttcaggcctctcctataaatattttggtgctgctctgggtaaaggaagacaagctgcaaaaacggagattgagaagttgaagctttctgagctaacctgcagggaaggcatcgttgaggttgccaagataatttatggtgtacacgatgaagcgaaagacaaatcttttgagctggaactgagctgggtatgtgaggaatctaaccgtcagcacgagaaggttccgagtgatcttctggagcaggccaaggcagcagcgcaggcagcgttggaagagatggatgctgactaagaagagaccatggttctgtttactttcacgcgtggtgtaatagagatacaggaccggttgacgaatttcatttcagttccaaaaactagctcaggttgttgttgctttcgattccatcccggtcgaggtagcaagcagtctctcatgttgtttgggtggggttctagtgaattgaatcgtattaagcttgctgtgttggtcgcacttaatcttctattgaatcctgaatgacctgaaaatctgtcttgatttatctgcctcttcgttgccattactccaaccttggggcttgtgcaatgcgagaaaaaggacatagaacatgtgtttacctgaaatttt

SEQ ID NO: 2710 - DNA, 1193 bp, Hordeum vulgare
aaaccacactccccaccttcttgcgccacaagccggagccgacgatccgccgtccacgcgacctcctctgcccgccgggatcggagacgactggatagacggtctagggcttgaagcaacttaacaatgagtagcataggaactgggtatgatctgtccgtcaccactttctccccggacggacgtgtcttccaggtcgagtatgctggcaaggccgtcgacaacagcgggacgatcgttgggatcaaatgcaaagatggaattgtccttggtgtggagaagctgataacctcaaagatgatacttgccgggtcgaaccggagacttcattccgtgcaccggaactctggcttggctgtggctgggttagcagcagacggtaggcagatagtctcaagagcaaagtcagaagcagccaattatgaaaaggtatacggagaacccatgcctgtaaaggaattagctgatcgtgttgctagctatgttcatctgtgtacactctactggtggctcaggccttttggctgtggagttattcttggaggttatgatagggatgggccacagctctacatgatcgaaccttcaggcctctcctataaatattttggtgctgctctgggtaaaggtagacaagctgcaaaaacggagattgagaaattgaagctttctgagctaacctgcagggaaggcatcgttgaggttgccaagataatttatggtgtgcacgacgaagcgaaagacaaatcttttgagctggaactgagctgggtatgtgaggaatctaaccgtcagcacgagaaggttccgagtgatcttctggagcaggccaaggcagcagcgcaggcagcgttggaagagatggatgctgactaagaagagacactcgccccgtttactttcacgcgtggtgtaatagagatacaggaccggttgacgaatatcatttgagttccaaaaactagctcaggttgttgttgctttcgatccatcccggtcgaggttctagcgaatcgatccgtattaagcttgctgtgttggttgcacttaatcttctattaaatcctgagtgacctgaaaaatctgtctttgatttatctgtctcttcgttgccattactccaaccttagggctcgtggaatgcgagaaaatagacatagaacatgtgtttacccgaaattttcaattcaacc

SEQ ID NO: 2711 - DNA, 1197 bp, Avena sativa
tcttgcgccacaagccggagccgacgatccgcctgcccgcgccgccgttgacgtgccctcctccgccctccgggatcggagagaactctatattggtttagaggttgaagcagcttaacaatgagtagcatcggaactgggtatgatctgtccgttaccactttctccccggatggccgtgtcttccaggtcgagtatgctggcaaggccgtcgacaacagtgggacgatcgttgggatcaaatgcaaagatggaattgtccttggtgtggagaagctgataacatctaagatgatccttgccgggtcgaatcggagacttcactccgtgcaccacaactctggcttggctgtggctgggctagcagcagatggtaggcagatagtctcaagggctaagtcagaggcagctaactacgagaaggtttacggagaacccatgcctgtgaaagaattagctgatcgtgtagctagctacgttcatctgtgtacactctactggtggctcaggccttttggctgcggagttattcttggaggttatgatagggatgggccacagctctacatgatcgaaccttcaggtctctcctataaatattttggtgctgctctgggtaaaggaagacaagctgcaaaaacggagattgagaaattgaagctttctgagctgacctgcagggaaggcattgttgaggttgccaagataatttatggtgtgcacgacgaagcgaaagacaaatcttttgagctggaactgagctgggtatgcgatgaatctaaccgtcagcacgagaaggttccaagcgttcttctggagcaggccaaggcagcagcgcaggcagcgcttgaggagatggatgccgactaaagacgaggccaccgagcatgctctgaaggcttcacatttcttcctttcacgcgtggtgtaatagatacaggacctggttgatgaatttattttcagcgctaaaaactacaatcaggatgttgttgcttccggtcgagttagtaagcagggcttctcaagtgctgtctggggtgttctagcagatcgtactctgcatgttgtttggtcgcacattgattctgaatctattgaactctgaatgaccttgaaatctcactgagtgcaaatcctgtatccgatgccattactactacttgaaagatttgttgcggacgtgcacgagacacg

SEQ ID NO: 2712 - DNA, 1107 bp, Avena sativa
caccttcttgcgccacaagccggagccgacgatccgcctgcccgcgccgccgtcgacgtgccctcctccgccctccgggatcggagagaactctatattggtttagaggttgaagcagcttaacaatgagtagcatcggaactgggtatgatctgtccgttaccactttctccccggatggccgtgtcttccaggtcgagtatgctggcaaggccgtcgacaacagtgggacgatcgttggcatcaaatgtaaagatggaattgtccttggtgtggagaagctgataacatctaagatgatacttgccgggtcgaatcggagacttcactctgtgcaccacaactctggcttggctgtggctgggctagcagcagatggtaggcagatagtctcaagggcaaagtcagaggcagctaattatgagaaggtttacggagaacccatgcctgtgaaagaattagctgatcgtgtagctagctatgttcatctttgtacactctactggtggctcaggccttttggctgtggagttattcttggaggttatgatagggatgggccacagctctacatgatcgaaccttcaggtctctcctataaatattttggtgctgctctgggcaaaggaagacaagctgcaaaaaccgagattgagaaattgaagctttctgagctgacatgcagggaaggcatcgttgaggttgccaagataatttatggtgtgcacgacgaagcgaaagacaaatcttttgagctggaactgagctgggtatgcgatgaatctaaccgtcagcacgagaaggttccgagcgatcttctggagcaggccaaggcagcagcgcaggcagccctcgaggagatggacgccgactaagacgagaccactgaccatgctccgaaggcttcacatttcctttcacgggtgtaatagatacaggacctggttgatgaatttattttcagcgcttgcttccggtcgagttagcaagcagggcttctcaagtgctgtctcgggtgttgtagcggatcgtactctgcatgttgtttggtcgcacattgattctgaatctattgaactctgaatgaccttgaaatctcactgagtg

SEQ ID NO: 2713 - DNA, 1168 bp, Avena sativa
tagccccgctcctcacatacacgttcttgcgccacaagccgtagaagagtaccatccgccgcgcgcccgccgcccgcccgcgccgccgtcgacgttgcctcctccgcccgccaggatcggagagaactatatattggtttagaggttgaagcaaattaacgatgagtagcatcggaactgggtatgatctgtccgttaccactttctccccggatggtcgtgtcttccaggtcgagtatgctggcaaggctgtcgacaacagcgggacgatcgttgggatcaaatgcaaagatggaattgtccttggtgtggagaagctgataacatctaagatgatccttgccgggtcgaatcggagacttcactccgtgcaccacaactctggcttggctgtggctgggctagcagcagatggtaggcagatagtctcaagagctaagtcagaggcagctaactacgagaaggtttacggagaacccatgcctgtgaaagaattagctgatcgtgtagctagctacgttcatctgtgtacactctactggtggctcaggccttttggctgcggggttattcttggaggttatgatagggacgggccacagctctacatgatcgaaccttcaggtctctcctataaatattttggtgctgctctgggtaaaggaagacaagctgcaaaaacggagattgagaaattgaagctttctgagctgacctgcagggaaggcatcgttgaggttgccaagataatttatggtgtgcacgacgaagcgaaagacaaatcttttgagctggaactgagctgggtatgcgatgaatctaaccgtcagcacgagaaggttccgagcgatcttctggagcaggccaaggcagcagcgcaggcagcccttgaggagatggacgccgactaagacgagaccaccgaccatgctctgaaggcttcacatttcctttcacgcgtggtgtaatagatacaggacctggttgatgaatttattttcagcgctaaaaactacaatcaggatgttgttgcttccggtcgagttagcaagcagggcttctcaagtgctgtctggggtgttctagcagatcgtactctgcatgttgtttggtcgcacattgattctgaatctattgaactctgaatgaccttgaaatctcactgagt

SEQ ID NO: 2714 - DNA, 1129 bp, Triticum aestivum
cctcaaaccacactccccaccttcttgcgccacaagccggagcagacgatccgccgtcgacgcgacctcctccgcccgccgggatcggagacgactatatagacggtctagaggttgaagcaacttaacaatgagtagcataggaactgggtatgatctgtccgtcaccactttctccccggacggacgtgtcttccaggtcgagtatgctggcaaggccgtcgacaacagcgggacgatcgttgggatcaaatgcaaagatggaattgtccttggtgtggagaagctgataacatcaaagatgatacttgctgggtcgaaccggagacttcattccgtgcaccggaactctggcttggctgtggctgggttagcagcagacggtaggcagatagtctcaagagcaaagtcagaagcagccaattatgaaaaggtatacggagaacccatgcctgtaaaggaattagctgatcgtgttgctagctatgttcatctgtgtacactctactggtggctcaggccttttggctgtggagttattcttggaggctatgatagggatgggccacagctctacatgatcgaaccttcaggcctctcctataaatattttggtgctgctctgggtaaaggaagacaagctgcaaaaacggagattgagaaattgaagctttctgagctaacctgcagggaaggcatcgttgaggttgccaagataatttatggtgtacacgacgaagcgaaagacaaatcttttgagctggaactgagctgggtatgtgaggaatctaaccgtcagcacgagaaggttccgagtgatcttctggagcaggccaaggcagcagcgcaggcagcgttggaagagatggatgctgactaagaagagaccctggtcccgtttgctttcacgtgtggtgtaatagagatacaggaccagttgacgaatttcatttcagttccaaaaactagctcaggttgttgttgcttccgattccatcccggtcgaggtagcaagcagtctgtcgtgttgtttgggtggggttctagcgaattgaatcgtattaagcttgctgtgttggtcgcacttaatcttctattgaatcctgaatgatctgagaatctgtcttga

SEQ ID NO: 2715 - DNA, 1075 bp, Platanus occidentalis
agcttaggttttgctgaattctgagttcggagaagaacaataagaagaagaaaaagaagggaaaagagaagagattgaaagaatagagaaatatgagtagcattggaactggttatgatctttccgtcaccactttctctcccgatggccgcgtttttcagatcgaatacgcagccaaagccgtcgataacagtggtactgttattggcatcaaatgcaaagatgggatagttatgggtgtagagaagctaatagcctcaaagatgatgttaccgggctcaaatcggaggatccactccgtccatcgtcattccggcatggctgtggctggattagcggcagatgggaggcaaattgttgcacgaaccaagtctgaggcaaatagctatgaaagtgtctatggtgagcccatacctgtgaaggaacttgccgaacgtgttgctagttatgtgcatttgtgtacactctattggtggctgaggccttttggatgcggagtaatccttggtggttatgacagagatggaccacagctatacatggttgaaccttctggtgtttcctataggtattttggagctgcaattgggaaaggaaggcaggccgctaaaacagagatagaaaagttgaagctttctgaaatgacctgcagggaaggggtcattgaagttgcaaagatcatctatggtgtacatgatgaggcaaaggacaaggcattcgaattggaaatgagctgggtctgtgacgaatctaatcgtcaacatcagaaggttccagatgagctcttagaggcagcaaaggcagcagccaaagcagcactggaagagatggatgctgattgatagatccgaagaatgttttattttaattcgacacagtgccatttatcatcaacgcattttatccaacatgatttttcattacagactggtgctttgggtgccattaacttatgtcgttgcactaaattagttttgtaaaattataattttgagtctcaaaattacattgagatcttatccttacttttttgggctgatggaaaatatgtttgaagcggtggccggatttaggg

SEQ ID NO: 2716 - DNA, 1003 bp, Tripterygium wilfordii
atgcttgatataatggaaaaaaataccgcctgcttatatggtttctcccgcaatcggaaaagaagaaagaagaatgagcagcatcggaactggttacgatctctccgtcacaacattttcccccgatggccgtgttttccaggtcgagtacgcttccaaagccgtcgacaacagcgggactgttgttgggatcaagtgcaaagatgggatagttatgggtgtggagaagcttatacaatcaaagatgatgctacccgattccaatagaagaatacactctgttcatcgccactctggcatggctgtggcaggattagcagcagatggtaggcaaatagtcgcaagggccaagtctgaggctacaaactatgagaaggtatatggtgaaccgattccagtgaaagagcttgccgacagagtcgcaagttatgttcatctatgtactctatattggtggctcagaccgtttggatgtggagtaattcttggaggttatgacagagatggaccgcaattatacatggttgaaccttctggtgtttcatatagatattttggtgctgccattggcaagggcaggcaggctgctaaaacagaggtcgagaagttgaagctttctgaattgacctgccgccaaggagttattgaagttgccaagataatttatggtgtacatgatgaggcaaaggacaaggcatttgaattggaaatgagctggatttgtgatgaatcaaaccgccagcatcaaaagatcccagatgaccttttagaggaagccaaggcagcagctaaagcagcactcgaggaaatggatgccgattagagagaagcttttatcatattttgccccttccaacagttgtatttctttgatgatcagaggattttccaaataattaagacttacggtatagattggcaggttttcttacactattattttactgttcattttgagcggaggtactttctgtttcaagtaatttatgtttgcttatgtagt

SEQ ID NO: 2717 - DNA, 1084 bp, Solanum phureja
gtgtgtcttgagaacaaagaaaactccgagagctgcaaaacacaaaactttgagctcaactgaagctgtagtagagaagaataaaggcaaatatgagtagcataggaaccggatatgatctatcggtgacgacattctcgccggacggcagagtatttcagatcgaatacgccggaaaagcagtcgataacagtggtactgttgttggaatcaaatgcaaggatggaatcgtcttgggagtggagaagctaatagcctccaaaatgatgttgccgggatcaaatcgtcgaattcattctgttcatcgccattctggcatggctgttgcaggtttggctgcagatgggaggcagattgtttcccgagccaagtctgaagcaaccagctttgaaagtgtatatggtgagccaattccagtgaaagaacttgcagagcgtgttgctagttatgtgcatttatgcacactgtattggtggctcaggccttttggatgtggggtgattcttggagggtatgatagagatggacctcaactatacgtggttgagccttctggtgtctcctataggtacttcggtgctgctattggaaagggaaggcaagctgctaaaacagaaattgagaagttaaagttatctgaaatgacctgtcgacaagggattattgaggtagctaaaataatttacggagtacatgatgaggcaaaggacaaggcatttgaacttgaaatgagctgggtatgtgatgagtctaaccgccaacatcagaaggttcctgataatcttttagaggaagcaaaggctgcagctaaagctgcacttgaggagatggatgccgattaagggttcagataagatttggttatttcgttcttattgaatgatctatctctaccatgttaacgggatttttccaccactgtgatgatgaaagcgatttatagtatcttgtaattctgaactgtaagctttacaactcccaagtttgaaaatccagagtaatagtttgcattttaaaacgatgaatctgatttttgttgttaattttcttgtagtaatctttggtctataaagaatgttaaacg

SEQ ID NO: 2718 - DNA, 950 bp, Euonymus alatus
tttgtctcgcaatcggacaagaagaaagaagaatgagcagcatcggaactggttacgatctctccgtcaccacattctcccccgatggccgtgttttccaggtcgagtacgcttcaaaagccgtcgacaacagcgggactgttgttgggatcaagtgcaaagatgggatagttatgggtgtggagaagctcatacaatcgaagatgatgctacccgattccaatagaagaatacattctgtccatcgccactctggcatggctgtggcaggattagcagcagatggtaggcaaatagtcgcaagggccaagtctgaagctacaaactatgagaagacatatggtgaaccgattcctgtgaaagagcttgcggacagagtcgcaagttatgttcatctatgtactctatattggtggctcagaccgtttggatgtggagtaattcttggaggttatgacagagatggaccgcaattgtacatggttgaaccttctggtgtttcatataggtattttggtgctgctattggcaagggcagacaggctgctaaaacagaggttgagaagttgaagctttctgaattgacctgccaccaaggagttattgaagttgccaagataatttatggagtacatgatgaggcaaaggacaaggcatttgaattggaaatgagctgggtgtgtgacgaatcaaaccgccagcatcagaaggtcccagatgaactcttagaggaagccaaggcagcagctaaagcggcactagaggaaatggatgcagattagaaactgtcatattttccccctcacaacatttgtatttctttgatgatcaggggatctgtccaaacatttaaaacttatgttaaggaatagactggcagattttcttacaagttacaccctgtattatttgactgttcattttgaactgagcttctttttacttcaaag

SEQ ID NO: 2719 - DNA, 1067 bp, Platanus occidentalis
aaaggggggtaatacaatgctgctctcgtttcttgagatagaagaaaggtcagattttggtgaattctgagttgaaggaagtacaaggaggaaaaccataacgaaaagcgaaaaaattgaaaggagagaaatatgagtagcattggaactggttatgatctctccgtcaccactttctctcctgatggccgcgtctttcagatcgaatacgcagccaaagccgttgataacagtggaactgttgtcggcatcaaatgcaaagatggaattgtcatgggtgtagagaagctcatagcatcgaagatgatgttaccgggttcaaaccggagaatccactccgttcatcgtcattctggcatggctgtggctggattagcagcagatgggagacaaattgttgcacgagccaaatccgaggcaactaactatgaaagtgtttatggtgaactcatacctgtgaaggaactggccgaacgagttgctagttatgtgcatttgtgtacactctattggtggctcagaccttttggatgtggagtaatccttggaggttatgatagagatgggccacagctatacatggttgaaccttctggtgtttcctataggtattttggcgccgcaattgggaagggcaggcaggcagctaaaacagagatcgaaaagttgaagctttctgaaatgacctgcagggaagggctcattgaagttgcgaagatcatatatggggtacatgatgaggcaaaagacaaggccttcgaattggaaatgagctgggtttgtgatgagtcaaaccgccaacatcagaaggttccagatgagctcttagaggaagcaaaggcagcagccaaagcagcattagaagagatggatgctgattgatggtgctaaacaatgtcatgttttgattatttcactttctggtaagtgtcaactttgagataatcatcatccacacgacctgtcttggcaaagactggtgcattttacatgcatttaacttgtaatgttgcactaaattggtattataaaattataatcccagtttttaagctatatcaagatct

SEQ ID NO: 2720 - DNA, 928 bp, Ananas comosus
aagttaaaaaccccgacctctgcgctttctctttcctacaatcgattcgatccgatcccatcgccgcgaagaagaagaagaagaggaagaggaaagaagagggcgatagccatgagcagcatcggcaccggctacgacctctccgtcaccaccttctcccccgatggccgcgtcttccagatcgagtacgccgccaaagccgtcgacaacagcgggaccgtgattgggatcaaatgcaaggatggggtagttttgggcgtggagaagctgatctcttcgaagatgatgctggaggggtcgaatcggaggatccattcggttcaccggcactctggaatggctgtggcaggcttagcagcagatgggaggcaaattgttgcacgagcaaaatcagaagcggcaagttacgaaagagtatatggagagccaatacctgtaaaagaacttgcagatcgtgtcgctagttatgtccatctttgcacactatattggtggctaagaccttttggttgtggagtacttcttggaggttatgacagagacgggccacagctttacatggttgaatcttcaggtgtatcttataggtactttggtgctgcaatggggaaggggaggcaagcggccaaaacagagatagagaagctgaagctttctgaactaacatgcagggaaggagttattgaagttgctaagataatttatgggctgcatgatgaagcaaaagacaaggcttttgagttggaaatgagctgggtctgtgatgagtcaaatcgcctgcatcagaaggttccagataatcttttggaggaagctaaagccgcagcaaaagccgcactggaggaaatggacgctgattaagaacgcatgaattatacttgttcctttcttacatctcccatgatctgggacatgatgaaatttgttt

SEQ ID NO: 2721 - DNA, 1085 bp, Solanum tuberosum
tctacactagtgtgtgtcttgagaacaaagaaaactctattagagagctgcaaagcacaaaactttgagctcaactgaagctgtagtagagaagaagaaaggcaaatatgagtagcataggaaccggatatgatctatcggtgacgacattctcgccggacggcagagtatttcagatcgaatacgccggaaaagcagtcgataacagtggtactgttgttggaatcaaatgcaaggatggaatcgtcttgggagtggagaagctaatagcctccaaaatgatgttgccaggatcaaatcgtcgaattcattctgttcatcgccattccgggatggctgttgcaggtttggctgcagatgggaggcagattgttgcccgagccaagtctgaagcaaccagctttgaaagtgtatatggtgagccaattccagtgaaagaacttgcagagcgtgttgctagttatgtgcatttatgcacactgtattggtggctcaggccttttggatgtggggtgattcttggagggtatgatagagatggacctcaactatacctggttgagccttctggtgtctcctataggtacttcggcgctgctattggaaagggaaggcaagctgctaaaacagaaattgagaagttaaagttatctgaaatgacctgtcgacaagggattattgaggtagctaaaataatttatggagtacatgatgaggcaaaggacaaggcatttgaacttgaaatgagctgggtatgtgatgagtctaaccgccaacatcagaaggttcctgataatcttttagaggaagcaaaggctgcagctaaagctgcacttgaggagatggatgccgattaagggttcagataagattggttgttaacgggatttgccaccactatgatgatcaatgttgatgatgaaagcgatttatagtatcttgtaattctgaactgtaagctttacaactccctagtttgaaatccagagtattagtttgcattttaaaacgatgaatctgatttttgttgttaattttcttgtagtaatctttggtctataaagaatgttaaacgttctcccctt

SEQ ID NO: 2722 - DNA, 1233 bp, Solanum lycopersicum
ggaaaataattaagctatatttgtgcgaaagttgctcttaagaaaatgaaataatattgtgaataatttggtcatttttgcttttttgatcaaggctaaaactagtgtgtgtcttgagaacaaagaaaactccttatttgtatatttgagagagctgcaaagcacaaaactttgagctcaactgaagctgtacaagagaagaagaagaagaaaggcaaatatgagtagcataggaaccggatatgatctatcggtgacgacattctcgccggacggcagagtatttcagatcgaatacgccggaaaagcagtcgataacagtggtactgttgttggaatcaaatgcaaggatggaatcgtcttgggagtggagaagctaatagcctccaaaatgatgttgccgggatcaaatcgtcgaattcattctgttcatcgtcattccggcatggctgttgcaggtttggctgcagatgggaggcagattgttgcccgagccaagtctgaagcaaccagctttgaaagtgtatatggtgagccaattccagtgaaagaacttgcagagcgtgttgctagttatgtgcatttatgcacgctgtattggtggctcaggccttttggatgtggggtgattcttggagggtatgatagagatggacctcaactatacctggttgagccttctggtgtctcctataggtacttcggtgctgctatcggaaagggaaggcaagctgctaaaacagaaattgagaagttaaagttatctgaaatgacctgtcgacaagggattattgaggtagcaaaaataatttacggagtacatgatgaggcaaaagacaaggcatttgaacttgaaatgagctgggtatgtgatgagtctaaccgccaacatcagaaggttcctgataatcttttagaggaagcaaaggctgcagctaaagctgcacttgaggagatggatgccgattaagggtccagatatgttggttatttcgttcttatttaacgatctatctctaccatgtttacaggattttgccaccactacgatgatcaatgttgatgatgaaagcgatttatagtttcttgtaattctgaactgtaagcttacaactcccaagtttgaaaatccagagtattattttgcattttaaaaacgatgaatctgattttggttgtcaattttcttgtagtaatctttggtctataaagaatgttaaacagttggattat

SEQ ID NO: 2723 - DNA, 1233 bp, Solanum lycopersicum
ggaaaataattaagctatatttgtgcgaaagttgctcttaagaaaatgaaataatattgtgaataatttggtcatttttgcttttttgatcaaggctaaaactagtgtgtgtcttgagaacaaagaaaactccttatttgtatatttgagagagctgcaaagcacaaaactttgagctcaactgaagctgtacaagagaagaagaagaagaaaggcaaatatgagtagcataggaaccggatatgatctatcggtgacgacattctcgccggacggcagagtatttcagatcgaatacgccggaaaagcagtcgataacagtggtactgttgttggaatcaaatgcaaggatggaatcgtcttgggagtggagaagctaatagcctccaaaatgatgttgccgggatcaaatcgtcgaattcattctgttcatcgtcattccggcatggctgttgcaggtttggctgcagatgggaggcagattgttgcccgagccaagtctgaagcaaccagctttgaaagtgtatatggtgagccaattccagtgaaagaacttgcagagcgtgttgctagttatgtgcatttatgcacgctgtattggtggctcaggccttttggatgtggggtgattcttggagggtatgatagagatggacctcaactatacctggttgagccttctggtgtctcctataggtacttcggtgctgctattggaaagggaaggcaagctgctaaaacagaaattgagaagttaaagttatctgaaatgacctgtcgacaagggattattgaggtagcaaaaataatttacggagtacatgatgaggcaaaagacaaggcatttgaacttgaaatgagctgggtatgtgatgagtctaaccgccaacatcagaaggttcctgataatcttttagaggaagcaaaggctgcagctaaagctgcacttgaggagatggatgccgattaagggtccagatatgttggttatttcgttcttatttaacgatctatctctaccatgtttacaggattttgccaccactacgatgatcaatgttgatgatgaaagcgatttatagtttcttgtaattctgaactgtaagcttacaactcccaagtttgaaaatccagagtattattttgcattttaaaaacgatgaatctgattttggttgtcaattttcttgtagtaatctttggtctataaagaatgttaaacagttggattat

SEQ ID NO: 2724 - DNA, 833 bp, Juglans hindsii x Juglans regia
  misc_feature (16)..(17): n is a, c, g, or t
ggggggacacgcagannaagcagaggacgaagaagaaaagaaatcggaacaaggatcggacagtatgagtagcataggaacggggtacgatctttcagtgaccacgttttccccagatggccgcgtcttccagatcgagtacgccgccaaagctgtcgacaacagcgggactgtcattggcatcaaatgcaaagacgggattgtactgggtgtggagaagctaataacatcgaagatgatgctacccggttccaatagaagaattcattccgttcatcgccactccggcatggctgtggcaggattagcggcagatgggaggcaaattgttgcccgtgccaagtctgaagcgactaattatgaaagtgtctatggggaaccaatacctgtcaaggaacttgctgatcgtgttgctagttatgtgcatctgtgtacactttactggtggctgagaccttttggatgtggagttattcttggaggatatgacagagatggaccacagctgtacatggttgagccatctggtgtttcatataggtactttggagctgcaattggcaagggcaggcaggcagctaaaacagagatcgaaaagttgaggctctcagagttgacttgccgtcaaggggttattgaagtagccaaaatcatttatggagtacatgatgaggcgaaggacaaagagtttgaattggaaatgagctgggtgtgtgatgagtcaaaccgtcaacatcagaaggttccggatgagcttttacatgaagctaaagcagcggctaaagcggcactggaagaaatggatgctgattaatgggaggagccatatccct

SEQ ID NO: 2725 - DNA, 1112 bp, Elaeis guineensis
taaccaaaaccctcgctgtcggtctcgctcttgctcaccctccattcgatttgattcgaagaaagacggaggaaaaaaaaggtggaagcgaggaggcatcatgagcagcatcggcacgggttacgatctttcggtcaccactttctcccccgatggaagagtcttccaaatcgagtacgccgccaaggccgtcgacaacagcgggactgtaattgggatcaaatgcaaggacgggatcgttatgggtgtggagaagctcatttcatcgaagatgatgttagcagggtcgaatcggaggatccactccgttcatcggcattctggcatggctgtggcaggcttggcagcagatggtagacaaatcgttgcacgagctaagtcagaagcaactagttatgaaagagtctatggtgagccaatacccgtgaaagaacttgcggaacgagttgccggttatgttcatctgtgcacactttactggtggctgaggccatttggctgtggagttcttcttggaggttatgacagagatggaccgcagttgtacatgatcgaaccatcaggagtctcatataggtactttggtgctgcaattggaaagggaagacaggctgcgaaaacagagatagagaagctgaagttatctgaattaacttgcagggaaggggttattgaagttgccaagataatttatggggtacatgacgaggccaaggacaaagcctttgagttggaaatgagctgggtctgtgatgagtccaatcgccagcagcagaaggtgccagatgatctcttggaggaagccaaggcagctgcaaaagctgcattagaggaaatggatgcagattaagtacggtttgaccgatgcttcattttatattcattttctacttctcacactccgccgatgtattcagtttgcacatttttctgtcgttgatgaaactcaccattcccatggggttctgctcaagaagatcaggttaagtgtttttggttgtattgttaaaatgaacattattgcggtgtcagatagtgaaaaactgacattttcatgggttacttgcatcgaactgttgaatcttctatcacaaatgcaaatgaaacctttt

SEQ ID NO: 2726 - DNA, 1022 bp, Phalaenopsis aphrodite
cccttctcaaatccctcgcattagattgctttcttcttcctcctctcacaggattgagctccaagaaacccagaaacgattcgaattagctgactgcgatgagcagcataggcacgggttacgatctatccgtcaccaccttctcccccgacggtagggtttttcagatcgagtacgcggccaaagcagtcgacaacagtgggactgttgttggtatcaggtgcaaggatggtattgttttgggtgtggagaagctgatttcttcgaagatgatgctggcgggatcaaatcggagaatccactccgttcaccggcattctggaatggctgtgtctggattagcagcagatggtagacaaattgttgcaagggctaagtctgaagcaacaaactatgaaagaacatatggcgagcctatccctgtgaaggaacttgcagatcgagttgccagctatgttcatctttgtacgctttattggtggttgagaccatttggctgtggtgttatccttggaggttatgatagagatggacctcagctgtatattgttgaaccttcaggagtttcctatagatattttggtgctgcaattgggaagggcaggcaagctgctaagacggaaattgaaaagttgaagctttctgaactaacatgcaggcaaggcgtcgttgaggttgccaagataatttatggtgttcatgatgaggccaaggataaagcctttgaattggaattgagctgggtctgtgaagaatcaaacaggcagcaccaaaaggtgccggaggatctcctggaggaagccaaagcagccgccattgctgcactggaagagatggatgcagactaagcgttcaaaactaacctctctctaaactgacggctcttctctatctctgcatagaggtttattggaggacatatcatttagtgattgcattcagctgctattttcaatattatgctgcacagtaatgaagatttaattttatgaattaatcaaattattgttttggattataac

SEQ ID NO: 2727 - DNA, 1021 bp, Phalaenopsis aphrodite
cctcgcattagattgctttcttcttcctcttctcactggattgagctccaagaaacccagaaacgattcgaattagctgactgcgatgagcagcataggcacgggttacgatctatccgtcaccaccttctcccccgacggtagggtttttcagatcgagtacgcggccaaagcagtcgacaacagtgggactgttgttggtatcaggtgcaaggatggtattgttttgggtgtggagaagctgatttcttcgaagatgatgctggcgggatcaaatcggagaatccactccgttcaccggcattctggaatggctgtttctggattagcagcagatggtagacaaattgttgcaagggctaagtctgaagcaacaaactatgaaagaacatatggcgagcctatccctgtgaaggaacttgcagatcgagttgccagctatgttcatctttgtacgctttattggtggttgagaccatttggctgtggtgttatccttggaggttatgatagagatggacctcagctgtatattgttgaaccttcaggagtttcctatagatattttggtgctgcaattgggaagggcaggcaagctgctaagacggaaattgaaaagttgaagctttctgaactaacatgcaggcaaggcgtcgttgaggttgccaagataatttatggtgttcatgatgaggccaaggataaagcctttgaattggaattgagctgggtctgtgaagaatcaaacaggcagcaccaaaaggtgccggaggatctcctggaggaagccaaagcagccgccattgctgcactggaagagatggatgcagactaagcgttcaaaactaacatctctctctctctctaaactgacggctcttctctctctatctctgcatagaggtttattggaggacatatcatttagtgattgcattcagctgctattttcaatattatgctgcacagataatgaagatttaattttatgaattaatcaaattattgttttggattataa

SEQ ID NO: 2728 - DNA, 1126 bp, Citrus sinensis
gcgtctatatctcacagaacttcgctttctcagtagaagggaaagaggatcgaattgactcacaaatcgaaaaagaaagaagagagcaagaatgagcagcataggcacaggctacgatctgtcggtgaccacattctctcccgacggtcgcgttttccagatcgaatacgccgccaaagccgtcgacaacagcgggactgtgattggaattaaatgcaaagatggcatcgttatgggagtggagaagctaatagcgtcgaagatgatgttgcctggttccaatagaagaatccattccgttcatcgtcactccggcatggctgttgcaggattagcagcagatgggagacaaattgttaccagggccaagtctgaagctacaaactatgaaagtgtatatggcgaaccaattcctgttaaagaacttgctcaacgagttgctagctatgtgcatctatgtactctatattggtggctcagaccttttggatgtggtgtaattcttggaggttatgacagagatggaccgcaattgtatatgattgaaccttctggtatctcctataggtattttggagctgcaattggaaagggcaggcaggctgctaaaacagagattgaaaagttgaagctttctgaaatgacctgccgacaaggggtcattgaagtagccaagatcatttatggagtgcacgatgaggctaaggacaaggcctttgaactggaaatgagctgggtctgtgatgaatcaaaccgccagcatcagaaggtaccagatgagcttcttgaggaagctaaggcagccgccagagcagcgttggaagagatggatgcagattagtgtagcagagttgataatatttggttactagtttgatgccatttcagggcttgtcttggaatacttttcgaaacattttcaaaatatttaatagattggtggattctcttgatggttgatgtcttaccgctgataattgcatctatactgttaaagttcttaaattatcatttgctggtctatgagctagcgccaaatattttggtgttgaaacttgaatttatgcttttgcttaatgtgttggcatctggtctaaaatttagatagcacgaaatgtatggttag

SEQ ID NO: 2729 - DNA, 1192 bp, Citrus clementina
cgtctatatttcacagaactttgctttctcagtagaagggaaagaggatcgaattgactcacaaatcgaaaaagaaagaagagagcaagaatgagcagcataggcacaggctacgatctgtcggtgaccacattctctcccgacggtcgcgttttccagatcgaatacgccgccaaagccgtcgacaacagcgggactgtgattggaattaaatgcaaagatggcatcgttatgggagtggagaagctaatagcgtcgaagatgatgttgcctggttccaatagaagaatccattccgttcatcgtcactccggcatggctgttgcaggattagcagcagatgggagacaaattgttaccagggccaagtctgaagctacaaactatgaaagtgtatatggcgaaccaattcctgttaaagaacttgctcaacgagttgctagctatgtgcatctatgtactctatattggtggctcagaccttttggatgtggtgtaattcttggaggttatgacagagatggaccgcaattgtatatgattgaaccttctggtatctcctataggtattttggagctgcaattggaaagggcaggcaggctgctaaaacagagattgaaaagttgaagctttctgaaatgacctgccgacaaggggtcattgaagtagccaagatcatttatggagtgcacgatgaggctaaggacaaggcctttgaactggaaatgagctgggtctgtgatgaatcaaaccgccagcatcagaaggtaccagatgagcttcttgaggaagctaaggcagccgccagagcagcgttggaagagatggatgcagattagtgtagcagagttgataatatttggttactagtttgatgccatttcagggcttgtcttggaatacttttcggaacattttcaaaatatttaatagattggtggattctcttgatggttgatggcttaccgctgataattgcatctatactgttaaagttcttaaattatcatttgctggtctatgagctatagcgccaaattttttggtgttgaaacttgaatttacgcttttgcttaatgtgttggcatctggtctaaaatttagatagcacgaaatgtatggttaggaatgggatggaaggttagtctgttatatctctcatttatttttatttttaccacgtatatttac

SEQ ID NO: 2730 - DNA, 1303 bp, Solanum melongena
caatattcttgggtctttcttttccactctatactgtttcttgagacgaaagagaactctttgtataattgggtgaatacagagctcgatagctcaaaactgaagctgtagtagatttagagaagaagaaagacaaatatgagtagcataggaaccggatatgacctgtcggtgacgacattctcgccggacggcagagtatttcagatcgaatacgccggaaaagcagtcgataacagtggtactgttgttggaatcaaatgcaaggatggaatcgtcttgggagtggagaagctaatagcctccaagatgatgttgccgggatcaaatcgtcgaattcactccgttcatcgccattccggcatggctgttgcaggtttggctgcagatgggaggcagattgttgcaagagccaaatctgaagcaaccagctttgaaagtgtatatggtgagccaattccagtgaaagaacttgcagaacgtgttgctagctatgtgcatttatgcacactctattggtggctcaggccttttggatgtggggtgattcttggagggtatgatagagatggacctcaactatacatggttgagccttctggtgtctcctacaggtacttcggtgctgctatcggaaagggcaggcaagctgctaaaacagaaattgagaagttgaagttatctgaaatgagctgtcgacaaggggttattgaggtagctaaaataatttacggggtacatgatgaggcaaaagataaggcatttgaacttgaaatgagctgggtatgtgacgagtctaaccgccaacatcagaaggttcctgataatcttctagaggaagcaaaggctgcagctaaagctgcacttgaagagatggatgctgattaatagacaagttctttcattcttattgaatgatatgtctcttccatgttaactggattttgccagcacgtcgatgatcaaaactgataacgaaagcgatttatagtttctcgtaattctgaactgtaagctttacaactcgaagtttgaaaatccagagtatcagtttgcattttaaaacaatgaaatctggtttttgttgaatttcttgtagtagtctttggtctataaaggttaatcggtcttctcttctcagttggattataagcttaatgcttcatgataagtcgacagattgcaagccattagtaaacgaatgtgatgagcataagattaactttctatgagcagattagtacagtatgtcttcaatatgaaattaatatttgagtaaatgaatttgtatgtttttagctgt

SEQ ID NO: 2731 - DNA, 1076 bp, Elaeis guineensis
atgtattcgatttgattcgaagaaagacggaggaaaaaaaaggtggaagcgaggaggcatcatgagcagcatcggcacgggttacgatctttcggtcaccactttctcccccgatggaagagtcttccaaatcgagtacgccgccaaggccgtcgacaacagcgggactgtaattgggatcaaatgcaaggacgggatcgttatgggtgtggagaagctcatttcatcgaagatgatgttagcagggtcgaatcggaggatccactccgttcatcggcattctggcatggctgtggcaggcttggcagcagatggtagacaaatcgttgcacgagctaagtcagaagcaactagttatgaaagagtctatggtgagccaatacccgtgaaagaacttgcggaacgagttgccggttatgttcatctgtgcacactttactggtggctgaggccatttggctgtggagttcttcttggaggttatgacagagatggaccgcagttgtacatgatcgaaccatcaggagtctcatataggtactttggtgctgcaattggaaagggaagacaggctgcgaaaacagagatagagaagctgaagttatctgaattaacttgcagggaaggggttattgaagttgccaagataatttatggggtacatgacgaggccaaggacaaagcctttgagttggaaatgagctgggtctgtgatgagtccaatcgccagcagcagaaggtgccagatgatctcttggaggaagccaaggcagctgcaaaagctgcattagaggaaatggatgcagattaagtacggtttgaccgatgcttcattttatattcattttctacttctcacactccgccgatgtattcagtttgcacatttttctgtcgttgatgaaactcaccattcccatggggttctgctcaagaagatcaggttaagtgtttttggttgtattgttaaaatgaacattattgcggtgtcagatagtgaaaaactgacattttcatgggttacttgcatcgaactgttgaatcttctatcacaaatgcaaatgaaaccttttttc

SEQ ID NO: 2732 - DNA, 1190 bp, Citrus sinensis
cgtctatatctcacagaacttcgctttctcagtagaagggaaagaggatcgaattgactcacaaatcgaaaaagaaagaagagagcaagcatgagcagcataggcacaggctacgatctgtcggtgaccacattctctcccgacggtcgcgttttccagatcgaatacgccgccaaagccgtcgacaacagcgggactgtgattggaattaaatgcaaagatggcatcgttatgggagtggagaagctaatagcgtcgaagatgatgttgcctggttccaatagaagaatccattccgttcatcgtcactccggcatggctgttgcaggattagcagcagatgggagacaaattgttaccagggccaagtctgaagctacaaactatgaaagtgtatatggcgaaccaattcctgttaaagaacttgctcaacgagttgctagctatgtgcatctatgtactctatattggtggctcagaccttttggatgtggtgtaattcttggaggttatgacagagatggaccgcaattgtatatgattgaaccttctggtatctcctataggtattttggagctgcaattggaaagggcaggcaggctgctaaaacagagattgaaaagttgaagctttctgaaatgacctgccgacaaggggtcattgaagtagccaagatcatttatggagtgcacgatgaggctaaggacaaggcctttgaactggaaatgagctgggtctgtgatgaatcaaaccgccagcatcagaaggtaccagatgagcttcttgaggaagctaaggcagccgccagagcagcgttggaagagatggatgcagattagtgtagcagagttgataatatttggttactagtttgatgccatttcagggcttgtcttggaatacttttcgaaacattttcaaaatatttaatagattggtggattctcttgatggttgatggcgtaccgctgataattgcatctatactgttaaagttcttaaattatcatttgctggtctatgagctagcgccaaattttttggtgttgaaacttgaattttcgcttttgcttaatgtgttggcatctggtctaaaatttagattgcacgaaatgtatggttaggaatgggatgaaaggttagtctgttatatctctcatttatttttatttttaccgcgtatatttac

SEQ ID NO: 2733 - DNA, 1023 bp, Solanum tuberosum
ctcaaaattgaaaatctatagtggaaacagcgaagaggatcgaaacgtagaaaatgagcagcattgggactggatatgacctatcggtgacgacattctcgccggacggcagagtttttcagatcgagtatgccggaaaagctgttgataatagtggtactgttgttggaatcaagtgcaaggatggaatcgtattgggagttgagaagctgattgcgtcgaaaatgatgttgccgggatctaatcgtcggattcactctgttcatcgtcattctggcatggctgttgcagggctggctgctgatgggaggcaaattgttgcccgtgcaaagtctgaagcaaccagctttgaaagtgtatatggtgaaccgattccggtgaaagaacttgcagaacgtgttgctagttatgtacatttatgcacactttactggtggctcaggccttttggatctggggtaatccttggaggctatgatagagatggacctcaactctacatggttgagccatctggtgtttcctataggtacttcggtgctgctattgggaagggcagacaggctgctaaaactgaaattgagaagttgaagctctctgaaatgacgtgtcggcaaggggttattgaggtagccaaaataatttacggagttcatgatgaggcaaaggacaaggcatttgaactggaaatgagttgggtgtgtgatgagtctaaccggcagcaccagaaggttcccgctgatctgttagaggaagccaaggctgcagctaaagctgcacttgaagagatggacgcagactaatgacgcaaatacaactccgctctctctatttacttcttttatcaactgaatcaaatagtctgctctggctgtcatgtttggaatttggcacctgtatgccgattgttttaagtgatgaaagagatcttatattgttttcactgttgactgtaatctgtacacgtaactttcttagatcaagaggatatgttgcagtcttatatggggaattctcggtatt

SEQ ID NO: 2734 - DNA, 1093 bp, Solanum phureja
ttcttcttctgtatattccgtcgtttcattcttcagaaagctttgaactcaaaattgaaaatctatagtggaaacagcgaagaggatcgaaacgtagaaaatgagcagcattggaaccggttatgacctatcggtgacgacattctcgccggacggcagagtttttcagatcgagtacgccggaaaagctgttgataatagtggtactgttgttggaatcaagtgcaaggatggaatcgtattgggagttgagaagctgattgcgtcgaaaatgatgttaccgggatctaatcgtcggattcactctgttcatcgtcattctggcatggctgttgcagggctggctgctgatgggaggcaaattgttgcccgtgcaaagtctgaagcaaccagctttgaaagtgtatatggtgaaccgattccagtgaaagaacttgcagaacgtgttgctagttatgtacatttatgcacactttactggtggctcaggcctttcggatctggggtaatccttggaggctatgatagagatggacctcaactctacatggttgagccatctggtgtctcctataggtacttcggtgctgctattgggaagggcagacaggctgctaaaactgaaattgagaagttgaagctctctgaaatgacgtgccggcaaggggttattgaggtagccaaaataatttacggagttcatgatgaggcaaaggacaaggcatttgaactggaaatgagttgggtgtgtgatgagtctaaccggcagcaccagaaggttcccgcagatctgttagaggaagccaaggctgcagctaaagctgcacttgaagagatggacgcagactaatgacgcaaatacaactccgctctctctatttacttcttttatcaactgaatcaaatagtctgctctggctgtcatgtttggaatttggcacctgtatgccgattgttttaagtgatgaaagagatcttatattgttttcactgttgactgtaatctgtacacgtaactttcttagatcaagaggatatgttgcagtcttatatggggaattctcggtatttagcaatttgtatctttgacata

SEQ ID NO: 2735 - DNA, 1221 bp, Nicotiana tabacum
  misc_feature (35)..(35): n is a, c, g, or t
  misc_feature (37)..(37): n is a, c, g, or t
  misc_feature (60)..(60): n is a, c, g, or t
agaatttaaacaaagcacttcccctttccttccancncttcttctgtcttgacacaaaanaaaactccttttcctcttcctctgtatgttccgtcgttcatagttccagaacaaaagatcttcgaactcaaaactgaataagtaaaatcagttaaaaatgagcagcataggaacaggttatgacttatccgtgacgacattctcgccggacggcagagtatttcagatcgaatatgccggcaaagccgtcgataacagtggtactgttgtcggaattaaatgcaaggacggaatcgttttgggagttgagaagctgattgcgtctaaaatgatgttaccgggatctaatcgtcggattcactccgttcatcgccattctggcatggctgttgcagggctggctgcagatgggaggcaaattgttgcccgcacgaagtctgaagcaaccaactatgaaagtacatatggtgaaccaattctggtaaaagagcttgcagaacgtgttgctagttatgtacatttatgcacactttattggtggctcaggcctttcggatgtggggtgatccttggaggctatgatagagatggacctcaactctacatggttgagccgtctggtgtctcctataggtactttggtgctgctattgggaagggcagacaagctgctaagacagaaattgaaaagttgaagctctctgaaatgacgtgtcggcaaggggtaattgaggtagccaaaataatatacggagtacatgatgaggcaaaggacaaggcgtttgaactggaaatgagttgggtgtgtgatgagtctaatcgacagcatcagaaggttcctgccgatttgttagaggaagccaaggctgcggctaaagctgcacttgaagagatggatgcagattagtggcacaaagacactttgttccttgtttattcatgcacctatcttttatcagctgagtcaaatagtcttgctctgccatgtttgaaatttggcacctgtatgatgattacttttagtgatgaaagtgattgttattcccttaaactgtaatcgttacacataattttctaagatcaagaggataggttgcattctcaaaagagagagagaggggaagcgggaaagagagggaggagagagaagagaaagcggcggcaccggggttggaactccatccgcctaaatgagtcgaatacacgcgctaatgggcctcc

SEQ ID NO: 2736 - DNA, 1037 bp, Linum usitatissimum
ccacgcgtccgagaaatcactagcagagccacctgaaaaaccttacgaactagcaaggatgagcagcatcggcactggttacgatctctccgtgaccactttctcccccgatggacgcgtattccagattgagtacgccgctaaggccgtcgacaacagcgggactgttgtggggatcaagtgcaaagatggaattgtcatgggtgtggagaagctcatagcttccaagatgatgcttcccggttccaataggaggatacattcagttcatcggcactctgggatggctgtggctggcttagctgctgacggtagacaaattgttgcacgagcaaagtctgaggcagctaactatgacaatgtttacggtgaacctatccctgtgaaagaacttgcagatcgtgttgctagctatgttcatttgtgtaccctctattggtggctgaggccctttggttgtggtgttattcttggtggttatgacagagatggaccacagttgtacatgattgaaccatctggtatctcctatagatacttcggtgctgcaataggaaaggggaagcaagctgctaaaactgaaattgagaagttaaagctatcggaaatgacatgccgtgaaggaattcttgaagttgccaaaatcatttacaaggtacatgatgaagcaaaggataaggccttcgaattggaactgagctgggtttgtgaagagtcaaagagacaacatcagaaggttcctgaagaactattggaggaggccaagtctgctgctaggaccgcactcgaagaaatggatgctgattagacgtttggtcgacatggcatcaaggatccctgggcgctcacgatccttccttgttagaacgcaacttaacttatgtgtcctgatgatatggaattaagccgtgtatttcagtcacttattacctgagaagttttcatccgatccttcgcaaaactcgtatcaatgtgattggcttgtttgttgcatctggacaattgcatgggaagtatgatgatggtcagaacttgca

SEQ ID NO: 2737 - DNA, 1282 bp, Elaeis guineensis
ccagctaaaagccggtttcggtacataatgcgtcaatttgcgactaaattagaccgcttccgtctcctttcgttaattttttttgcttccaagaaatccttcctttctatttataaccaaaactctctccctctcattccctccctctctatctccattcgatttgattcgaagaaacggggggaaaaaaaaaaagcgatatgagcagtatcgggaccggttacgatctctcagtgaccaccttctcccccgatggaagagtcttccagatcgagtacgcagccaaagccgtcgacaacagcgggactgttatcgggatcaaatgtaaggatgggattgttatgggcgtggagaagctgatttcgtcaaagatgatgttagcggggtcgaatcggaggatccactccgttcatcggcattccggcatggctgtggcaggcttggcagcagatggtaggcaaatcgttacacgagctaagtctgaagcaaccagttatgaaagagtctatggtgagcccatacctgtgaaagaacttgcagaacgtgtggctggttatgttcatctttgcacactttattggtggctgaggccttttggctgtggagttcttcttggaggttatgacagagatggaccccagctgtacatgattgagccctcaggagtctcatataggtactttggtactgcaatcggaaagggaagacaggctgccaaaacagagatagagaagttgaagttgtctgaattaacttgcagggaaggggttattgaagttgctaagataatatatgcggtacatgacgaggcaaaagacaaagcttttgagttggaaatgagctgggtctgtgatgagtctaatcgccaacaccagaaggtgccagatgatctcctggaggaagccaaggctgctgcaaaagctgcattagaggaaatggatgcagattaagtgcagttgccggatgcttcatgttatatttgttttctatttcttacactccaatatattcagtttccatgttttgtctgttcgcaatgcaagtggctcttcacattgggaattgccctggaaatcaggttgagtgtaatcttcttgatgtgttagaatgaacattattttgtggtgactgaaagttataaacttaaatgatgttttcatcggttgctttctgcatcaaactgttgggtcctagtacaaatgcaaatgaaatctctacctattttagtcgcttggacgttgagatgttgtccaaggctttcaaggaaaaaaaaaaactaagc

SEQ ID NO: 2738 - DNA, 872 bp, Olea europaea
tacgtcggggacccaaaagaaaacccactctgattcaaaacccaatcgcaaatacatttatatagagagtatcagtgaatagcagaagaagagaaagcttgaaaattgtagagagagaaagatgagcagcattggcacaggttacgatctttctgtgaccacattttcgccggacggtcgagttttccagatcgagtatgctgcaaaagccgtcgacaacagcggcaccgtcgtcggtatcaaatgcaaagacggaatcgtcttgggagtggagaagctgattacttcgaagatgatgttgcccgggtccaacagaagaatccatgccgtccaccgccattccggcatggctgttgcgggattagctgcagatggcaggcaaattgttgcacgagcaaaatctgaagcaactaactatgagagtgtgtacggagaaccaattccagttaaagaacttgcagaacgtgttgcaagttacgtgcatctatgcacactatattggtggctcaggccttttggaagtggagtaattctgggaggttatgacagggatggaccacagctgtacatggttgaaccttcgggggtttcctatagatactttggtgctgcaattgggaagggcaggcaggctgctaaaactgagattgaaaaattgaagctttctgaaatgacctgccgacaaggggttattgaggtggccaagataatttacggagttcatgacgaggcaaaggacaaggcctttgaattggaaatgagttgggtctgtgatgagtctaaccgccagcatcaaaaggttccagatgatatattggaggaagcaaaggcagccgctaaggctgctctcgaagaaatggatgcggattagt

SEQ ID NO: 2739 - DNA, 1244 bp, Citrullus lanatus
aaaacattaaaaccaaaacaaaaggactagaatggtaatttgattgggggaaaagaaaaggcaaagcaaaaaaaattttcttgagaagaaagaaattgaagagtagagatacagagcttcttcttcgtcttcttctttttcataagctgctctcttctttcattttgtgttcttcaactcaaagctccctctcctttagggcaaacaaccaccaacaatgagtagcattggcaccggttacgatctttccgtcaccacattttcccccgatggccgcgttttccagatcgaatacgccgctaaggccgtcgacaacagcgggactgttattggaatcaaatgtaaagacggagtcgttatgggcgtggaaaagcttattacctctaagatgatgcttccaggctctaatagaagaattcacgctgttcatcgtcattctggcatggctgtggccggattagcagcagatggaagacaaatagttgctcgagctaagtctgaagcaaccaactacgaaagtgtttatggtgaaccaattcctgttaaggaactagctgatcgtgtggctagttatgttcatctctgtacactttactggtggctcagaccttttggatgtggtgtaattcttggaggttatgatagagatggaccacaattgtacatggttgaaccatctggtgtttcctacagatactatggtgctgcaattggaaagggtaggcaagctgcaaaaacggaaattgaaaagttgaagctctctgaattgacttgtcggcaaggggttattgaagtagccaagatcatttatggagtgcatgatgaggcaaaggataaggatttcgagttggaaatgagttggatctgtgatgaatcaaaccgccaacatcagaaggtcccagaggatctcctagaggaagcaaaggcagctgctaaagctgccctggaagaaatggatgctgattaaagaagttggaaatttataggtgttcttactgtgctgcaattgctttatttagtttctaagtgtctgatttgagcatcatgtaagaatttttaaggattcaggaagtgataaactaaatgtgatcttcatactgctttgttgtacttttcttaatcaaattgaggtttttttctctcctgaagccagtttgaagatctcccatccaactgctcccttgaaaattttaatacgatcaagagccgtggattatttgcaaatgcagctatttgatttacag

SEQ ID NO: 2740 - DNA, 1093 bp, Cucumis sativus
gaacgaagccaaaagattttcttgagaagaaagaaattgaagagtagagaagtacagagcttcttcttctccttcttcataagctgctgctttcttccttcatttcgtgttccacaaatttccaatcgaacctccttcttcgttaggacaaacaaccatcaacaatgagtagcattggcacaggttacgatctttccgtcaccacattctcccccgatgggcgcgttttccagatcgagtacgccgctaaggccgtcgacaacagcgggactgttattggaatcaaatgcaaagacggagttgttatgggcgtggaaaagcttattacctctaagatgatgcttcctggttctaatagaagaattcatgctattcatcgtcattctggcatggctgtggccgggttagcagcagatggaagacagatagtggctcgagctaagtctgaagcaagcaactacgaaagtgtatatggtgaaccaatccctgttaaggaactagctgaccgtgttgctagttatgtgcatctctgcacactttactggtggctcagaccttttggatgtggtgtaattcttggaggttatgacagagatggaccacaattgtacatggttgaaccatctggtgtttcgtacagatactatggtgctgcaattgggaagggtaggcaagctgcgaaaacggaaattgaaaagttgaagctctctgaattgacctgtcggcaaggggttattgaagtagccaagattatttatggagtacatgatgaggcaaaggacaaggacttcgagttggaaatgagttggatctgtgatgaatcaaaccaccaacatcagaaggtcccggaggatctcctagaggaagcaaaggcagctgctaaagctgccctggaagaaatggatgctgattaaggaaatttgtaggtgttcttattgtgttgcaattgcttaatttagtttccaagtgtttgatttgagcatcctgtaagaatttttcaaggattcaggaagtggataaactcaatgtgattttcatactgctttgttatgttgtactgttcttaatcaaattgagatttttctctcctgaa

SEQ ID NO: 2741 - DNA, 1102 bp, Ipomoea nil
gggtttgatttttttccccaacagttgcactggcctgttgtcttgagctcaaagaaaactctcttcgccttcgtctgcactatatttgcttgttcagagctcggagcacactcgaatcaaggggaatacctctagcagaagaaacggaagagaaaagatgagcagcataggcactggctacgatctctcggtgacaaccttctctccggacggcagagttttccagatcgagtacgccgccaaggccgttgacaacagcggcactgtaatcggcatcaaatgcaaggatggaatcgtcatgggtgtggagaagctgattgctttgaagatgatgttgccaggatctaatcggcgaattcactccgttcatcgccattccggcatggctgtcgctgggttagctgctgatgggaggcaaattgttgcacgaactaaatctgaagcaaccagctatgcgaatgtctatggtgaacctattccagtgaaagaacttgctgaaagggttgctagttatgtacatttatgtacactttattggtggctcaggccttttggttgtggggtgattcttggaggatatgatagagatggaccacagttgtacatggttgaaccttctggtgtctcttataggtactttggtgctgccattggaaagggcaggcaagctgctaaaactgaaattgagaaattgaagctctctgaaatgacatgtcggcaaggagttattgaagtagccaaaattatttatggtgtacatgatgaggccaaggacaaggcttttgaattggaaatgagttgggtatgtgacgagtctaaccgccaacaccagaaggttccggaagatctgttagaggaagccaaggcagccgccaaagctgcacttgaagaaatggatgcagattagttgctataacatgataaattgttattgtactgttgctttattgaagcagatttttcaattttcaatgtactttagctaaggtgtttcttatttaagtgttagtggatttggaacctttatgcgttctattctggtgtttcattaaactgtatacctccgttgctttatggtttattgttttatgttaacaaacct

SEQ ID NO: 2742 - DNA, 1180 bp, Cucumis melo
aacgaagacaaaagaatttcttgagaagaaagaaattgaagagtagagaagtgcagagcttcttcttctccttcttcttaagctgcttgcattcttctttcatttcgtgttccacaaatttccaatcgaacctccttttccgttaggacaaacaaccatctacaatgagtagcattggcacaggttacgatctttccgtcaccacattctcccccgatggacgcgtttttcagatcgagtacgcagctaaggccgtcgacaacagcgggactgttattggaatcaaatgcaaagacggagttgttatgggcgtggaaaagcttattacctctaagatgatgcttcctggttctaatagaagaattcacgctattcatcgtcattctggcatggctgtggccgggttagctgcagatggaagacagatagtggctcgagctaagtctgaagcaaccaactacgaaagtgtatatggggaaccaatccctgttaaggaactagctgaccgtgttgctagttatgtgcatctctgcacactttactggtggctcaggccttttggatgtggtgtaattcttggaggttatgacagagatggaccacaattgtacatggttgaaccatctggtgtttcgtacagatactatggtgctgcaattgggaagggtaggcaagctgcaaaaacggaaattgaaaagttgaagctctctgaattgacttgtcggcaaggggttattgaagtagccaagatcatttatggagtacatgatgaggcaaaggacaaggacttcgagttggaaatgagttggatctgtgatgaatcaaaccaccaacatcagaaggtcccggaggatctcctagaggaagcaaaggcagctgctaaagctgccctggaagaaatggatgctgattaaggaaatttataggcgttcttactgtgttgcaattgcttaatttagtttctaagtttttgatttgagcatcctgtaagaatttttcaaggattcaggaagtggataaacttaatgtgattttcgtactgctttgttttgttgtactgttctttaatcaaattgaggtttttctcccctgaagactgtgaagatatcacatcctatgaccagtcctcccttgaaaattttaatacaatcaagagtcgtggatgatttgcaaaaaaaaa

SEQ ID NO: 2743 - DNA, 1036 bp, Helianthus annuus
gggttttttcttgaaggaagacaccagtccgcttataacttttccccctttcttcttcttcttcttcttcactttcaaaatcaataaaccaaaatcagcagccctaaaacaacaacaacaacaagatgagtagcataggaaccggttacgatctttccgtcacgaccttctcgccggacggtagggttttccagatcgagtacgctgctaaagccgtcgacaacagcggcactgtcgtcggcatcaaatgcaaagacggcattgttatcggagtagagaagctgattgcgtccaagatgatgttgcctggatctaaccgtagaatccactccgtacatcgtcattctggaatgggtgtagcaggattagctgctgatgggaggcagattgtagcaagagccaaatctgaagctcacaattatgaaagcacttatggtgaacctattccgattaaagaacttgctgatcgtgttgctagttatgtgcatttgtgcacactttattggtggctcagaccttttggttccggtgtgattcttggaggttatgatcgtgatggcccacaattatatatggttgaaccttctggtgtttcctatagatattttggtgctgcaattgggaagggcaggcaggctgccaaaactgagattgaaaagttgaaactttctgagttgacttgccgggaaggtgttattgaggtggcgaaaataatctatggagtacatgacgaggcgaaggacaaaacctttgagttggagatgagctgggtttgtgatgaatcaaaccgccagcaccagaaggttccagaagcacttttggaggaagcgaaagctgcagctcaagcagcgttggaagaaatggatgctgattaatgataatagatcttttctccctttgtgtttgtctgaattttcgttttcgaatttgttcgcagaactaaacatgttaatcatcgaagattgtaacgttttccgtaaaatttaatgtatgttgcatcaaacctgtaagcgttaggtatcaaaatgttccaagt

SEQ ID NO: 2744 - DNA, 1066 bp, Helianthus annuus
ttcttcttcttcacttccaaaatcaataaaccaaaatcagcagccctaaaacaacaacaacaagatgagtagcataggaaccggttacgatctttccgtcacgaccttctcgccggacggtagggttttccagatcgagtacgctgctaaagccgtcgacaacagcggcactgtcgtcggcatcaaatgcaaagacggcattgttatcggagtagagaagctgattgcgtccaagatgatgttgcctggatctaaccgtagaatccactccgtacatcgtcattctggaatgggtgtagcaggattagctgctgatgggaggcagattgtagcaagagccaaatctgaagctcacaattatgaaagcacttatggtgaacctattccaattaaagaacttgctgaccgtgttgctagttatgtgcatttgtgcacactttattggtggctcagaccttttggttccggtgtgattcttggaggttatgatcgtgatggcccacaattatatatggttgaaccttctggtgtttcctatagatattttggtgctgcaattgggaagggcaggcaggctgccaaaactgagattgaaaagttgaaactttctgagttgacttgccgggaaggtgttattgaggtggcgaaaataatctatggagtacatgacgaggcgaaggacaaaacctttgagttggagatgagctgggtttgtgatgaatcaaaccgccagcaccagaaggttccagaagcacttttggaggaagcgaaagctgcagctcaagcagcgttggaagaaatggatgctgattaatgataatagatcttttctccctttgtgtttgtctgaattttcgttttcgaatttgttcgcagaactaaacatgttaatcatcgaagattgtaacgttttccgtaaaatttaatgtatgttgcatcaaacctgtaagcgttaggtatcaaaatgttccaagttcatgtgtgttttgttatgataaaccaccaaaatcacaaatggagtttctttctattaaagtattaatcaagagaaagatttcagttttag

SEQ ID NO: 2745 - DNA, 843 bp, Ambrosia trifida
aattaataaacataaaaatcagccctagaagaagaagaagaagaagatgagtagcataggaacaggttacgatctgtcggtgacgaccttctctcccgacggtagggttttccagatcgagtacgccgctaaagccgtcgacaacagcggcaccgtcgttggcatcaaatgcaaagatggcatcgttattggtgttgagaagctgattgcctccaagatgatgttgcctggatccaatcgtagaatccactctgtacaccgtcattctggaatgggtgtagcaggattagctgctgatggcagacagattgttgcaagagctaaatctgaagctcacaattacgaaagtacttatggtgaacctattccaattaaagaacttgctgaccgtgttgctagttatgtgcacttatgcacactttattggtggctcagaccttttggttccggtgtgattcttggaggttatgaccgtgatggcccacaattatatatggttgaaccttctggtgtttcctatagatattttggtgctgcaattgggaagggcagacaggctgccaaaactgagattgaaaagttgaaactttctgagttgacctgccgggaaggtgttattgaggtggcaaaaataatctatggagtacatgatgaggcaaaggacaaaacctttgagttggagatgagctgggtttgtgacgaatcaaaccgtcagcaccagaaggttccagaagcacttttggaggaagcgaaagctgcagctaaagcagcattggaagaaatggatgctgattaatgataatctccctttgtgtttgtcttgaatttttcgttttcaaattt

SEQ ID NO: 2746 - DNA, 1153 bp, Aquilegia formosa
tgagatctaagaaagctttctaggttttaagcagcagaacccaaatctctttcagctgcagaacaagaagaagaagaaataagttaatcacaagaaagatggctagtataggcactggatacgatctatcggttacaaccttctcaccagatggtcgtgtttttcagatcgaatacgcttccaaagctgttgataacagtggaactgttattgggatcaaatgcaaagatggtattgttctgggtgtggagaagcttatagcttctaagatgatgttacctggttccaataggagaatccatgctgttgaccgtcattctgggatggctgtggctggattagcagctgatggaagacaaattgttgcaagaacaaagtcggaagcaactaattatgaaaggacctatggggagcccatacctgtgaaggagcttgctgaccgtgttgctagttatgtgcatttgtgcacgctttattggtggctaagaccttttggatgtggagtaattcttggaggctatgacagagatgggcctcagttatacatggtcgaaccttccggtgtatcttatcggtattttggtgctgcgattggaaagggaagacaggctgctaaaacggaaattgaaaagttgaatctctctgaaatgacctgcagacaaggtgttgttgaagttgccaaaataatatatggagtacatgatgaggcaaaggacaaggcctttgaattagaaatgagctgggtttgtgacgaatccaaccgcctacatcagaaggttccagatgagctcttagagggtgcaaaagcagcagccaaagcagctttggaagaaatggatgcagattaagattagtgcaaatgcttggaacacatttgttttagaaatgagacatgtcacattggatatcagaagggaatatgatctgtcaatgaatattgtatgtttgagatttggaaatattggaatggcattgacccatgtccatagaaaatgtatgtttgagtttggtaggtgtacggaaaaatttatatgaatttggtatcgtaaaaagggtcaccatctacacttctgcaattagcttaggagtgaaatggtgcagaaccataactactttgtctgttatatacagatcctggtccatggtcgggcaa

SEQ ID NO: 2747 - DNA, 963 bp, Cucurbita pepo
ctcctcaaattagcaatcgaaactcgctttccactactccaaagaaccacaagcaatgagtagcattggaactggttatgatctttccgtcaccacattctcccccgatggccgcgttttccagatcgagtacgccgctaaggccgtcgacaacagcgggactgttattggaatcaaatgcaaagacggagtcgttatgggcgtggaaaagctaattacctctaagatgatgcttcctggttctaatagaagaattcacgctgttcatcgtcattctggcatggcggtggcaggattagcagcagatggaagacaaatagttgctcgagccaagtcggaagcaaccaattacgaaagtatttatggtgaaccaattcctgttaaggaattagctgatcgtgttgccagttatgtgcatctctgtacactttactggtggctcagaccttttggatgtggcgtaattcttggaggctatgacagagatggaccacaattgtacatggttgaaccatccggtgtttcctataggtactatggtgctgcaattgggaagggtaggcaagctgcaaaaacggaaattgagaagttgaaactctctgaattgacatgtcggcaaggtgttattgaagtagccaagattatttatggagtacatgatgaggcaaaggacaaggacttcgagttggaaatgagttggatctgtgatgaatcaaaccgccaacatcagaaggttccagaggatcttctagaggaagcaaaggcagctgctaaagctgccctggaagagatggatgctgattaaggaagttgaaaacttcataggtgtgttcttactgtgctgctgctattgctttatttagtttaaagggtctgatttgagcatgtcgttagaattttcgaaggattcaggaagtgatgaacttaatgtgattttcatactgctttgttgtactgttctta

SEQ ID NO: 2748 - DNA, 1056 bp, Euonymus alatus
cggccggggcaggcgatttcttgatagaaaagaaactctgtatttgttaagcacacccctaaaccaacccaacaacgcttcctttcccttggtatcgcaatcggagaagaagaaagaagaatgagcagcatcggaactggttacgatctctccgtcaccacattctcccccgatggccgtgttttccaggtcgagtacgcttccaaagctgtcgacaacagcgggactgttattgggatcaagtgcaaagatgggatagttatgggtgtggagaagctcatacaatcgaagatgatgctacccgattgcaatagaagaatacattctgttcatcgccactctggcatggctgtggcgggattagcagcagatggtaggcaaatagttgcaagggccaagtctgaagctacaaactatgagaagacatatggtgaaccaattcctgtgaaagagcttgctgacagagtcgcaagttatgttcatctatgtactctatattggtggctcagaccatttggatgtggagtaattcttggaggttatgacagagatggaccgcaattgtacatggttgaaccttctggtgtttcatataggtattttggtgctgccattggcaagggaagacaggctgctaaaacagaggtcgagaaattgaagctttccgaattgacctgtcgtcaaggagttattgaagttgccaaaataatttatggagtacatgatgaggcaaaggacaaggcatttgaattggaaatgagttgggtgtgtgatgaatcaaaccgcctgcatcagaaggtaccggatgaccttttagaggaagccaaggcagcagccaaagcggcactcgaggaaatggatgcagattaggagaacctttcatatttggccccgcccaactgttgtatttctttgatgatctgggtatttttccaaatcttaaagactttttaaggtatagactggcacgtttgttttcttacactctgtatcattttactgttcattttgaactgaggtactttttgtttcaagtaatttatttttgcttgtgta

SEQ ID NO: 2749 - DNA, 1075 bp, Castanea mollissima
ctcccttgtgttttacttttagcactgtttttaaaaacacacacatagtagtacagaagaagaagaagaacaagaagaatcgaaagacaaagacaaagaatatgagcagcataggaacaggatacgatcttgcggtcaccactttctctccagatggtcgtgttttccagatcgagtacgctgccaaagccgtcgacaacagcgggactgttattggaatcaaatgcaaagatgggattgttatgggtgtggagaagctaatagcgtcgaagatgatgttgcctggttccaatagaagaattcattctgttcaccgccactccggaatggcagtggcaggactagcagcagatggaaggcaaattgttgcccgggctaagtctgaagctagtaattatgaaagtacatatggcgaaccaattcctatcaaggaacttgccgaccgtgttgctagttacgtgcatctgtgtacactttattggtggctgagaccttttggatgtggagttattcttggaggctatgacagagatggaccacaactgtacatggttgaaccatctggtgtctcatataggtactttggtgctgcaattggcaagggcagacaggcagctaaaacagagatcgaaaagttgaagctttcagaattgacttgccgccaaggggttattgaagtagccaaaatcatttatggggtacatgatgaggcgaaggacaaggacttcgaattggaattgagttgggtctgtgacgagtcaaaccgtcagcatcagaaggtaccagatgagcttctgcaggaagctaaggcagcggccaaagcagccttggaagaaatggatgcagattagtagagcattgccattgttaacttatttttacatggttgcatctcaaattgtcattatatcactccagaacatcctcaaaatgtgttatggcatagactggtgctttttatcttttagacattgatctttattatgttgcagtatgtgtgataaaatctttattcctatcaattgacagtaggaaaccatctttttctgtttttgttagaactgtacgtgctagt

SEQ ID NO: 2750 - DNA, 1068 bp, Gerbera hybrid cultivar
ggcttcttccgataccccgaccaatcaagaagcccgtaaacgaaaatcagtagtagcaaattcgccctagaaaaagatgagcagcataggaacaggctatgatctatcggttacaaccttctcgccggacggtagggtttttcagatcgagtacgcggctaaagccgtcgataatagcggcaccgtcgtcggcatcaaatgcaaagatggcattgttattggagtagagaagctgattgcgtcgaagatgatgttgcctggatctaatcgtagaatccattccgttcatcgtcattctggcatgggtgtagcaggattagctgcagatgggagacagattgttgcaagagccaaatcagaagcccaaaactatgaaagtgtttatggtgaaccaattccagttaaagaactcgctgagcgtgttgctagttacgtgcatctatgcacgctttattggtggctcagaccttttggatctggggtaattcttggaggttatgaccgtgacggtccacaattatatatggttgaaccttccggtgtttcctatagatactttggcgctgcaattgggaagggcaggcaggctgctaaaactgagattgaaaagttgaagctctctgagatgacctgtcgtcaaggggttattgaagtagcaaaaataatctacggagtacatgatgaggcaaaggacaagtcgtttgaattggagatgagttgggtttgtgatgaatcaaaccaccaacaccagaaggtgccggaaggacttttggaggaggccaaggcagcggccaaagcagcattggaagaaatggacgctgattaataataataataatacatctttcctccctttttcttgtgtttgtctgactcttcggttccgtatgtgtttactcgtatgacatatttaaatttggccacctattaatcgtataacattttatctcaacatttaaagtttcatgtggtgttgctagatttttggtggttgtggactttgcttaagattgttatttcaaaactattggttgtactacagaattgaagaaaatatttcttgtatta

SEQ ID NO: 2751 - DNA, 1414 bp, Arachis hypogaea
ggggttttgccatctttaacatcgtgttttggctgtgtttaactgcaccagggcattactcatttactgtgaaatattcaagcctaaaacacaattttgctttgtgcgcaggccaactccgagaagcaaagaaaacatctcaaaaagcaaatttcaaagaagaagaaggaggaggaggagaagaagaagaatatcaaaatcaagtaagcgatgagcagcatcggaacaggttacgacctatcggtcactactttctcaccagatggccgcgttttccagatcgagtacgccgccaaggccgtcgacaatagcgggactgttatagggatcaaatgcaaggatggcattgtgttgggcgtggagaaacttattgcttcaaaaatgatgttaccgggttctaatcggagaatacactcggttcatcgccactctggcatggccgtggcagggttagcagctgatggtaggcaaattgttgcgaggaccaagtctgaagcaactaactatgacagtgtgtatggagaacctattcctgttaaggaacttgctgaacgcgtggctagttatgtgcacctttgcacactatactggtggctcagaccttttggatgtggcgtcatactaggaggttatgatagagatggaccacaattgtacatggttgaaccttctggcgtttcctatagatattttggtgctgcaattgggaaaggcaggcaggctgcaaaaacagagatcgagaagttaaagcttactgacatgacttgccgtcaaggggttattgaagtagccaagattatttatggagttcatgatgaggcaaaggataaagactttgaacttgaaatgagttgggtatgtgatgaatcaaatcgccaacatcaaaaggtccccgatgagcttctagaagaagctaaggcagcagccaaagctgctcttgaagaaatggatgcagattagtcagattgaaatagttatttagttctagagatgtatttctataactggctatttcagcatttggaacttttaaaggaaatgtaatgtgggattttctatgcttgattattaaacgtcgagttcctatggataaatcttctgaaggaagtactttagattctggccttcggttattgattttatgtttgcattgtgtcttccttgcccatgtttactcaacttaccatcaagtttgttttctatatgttggaaacttggaatgcattttcttctggacagttcttgggtagggcgaagaaatttggattggaaaaggttttccgttgcaggacactggcttgcctagggtggagcttattatatacaggtgaaaagaagggggaaagaaatgggtgtgtactgtgttgaaattacacttgagggttacaacttcatcgaatttcatgtacgagaa

SEQ ID NO: 2752 - DNA, 1140 bp, Arachis hypogaea
gaggaagtctaaaacacaattttgctttgcgcgcaagacaagcccgagaagcaaagaaaacatctgaaaaagcgaatttcgaagaagaagatcaaaatcaagtaagcgatgagcagcatcggaacaggttacgatctatcggtcactactttctcacctgatggccgcgttttccagatcgagtacgccgccaaggccgtcgacaatagcgggactgttatagggatcaaatgcaaggatggcattgtgttgggcgtggagaaacttattgcttcgaaaatgatgttaccgggttctaatcggagaatacactcggttcatcgccactctggcatggctgtggcagggttagcagctgacggtaggcaaattgttgcgaggaccaagtctgaagcaactaactatgacagtgtgtatggagaacctattcctgttaaggaacttgctgaacgcgtggctagttatgtgcacctttgcacactgtactggtggctcagaccttttggatgtggcgtcatactaggaggttatgacagagatggaccacaattgtacatggttgaaccttctggtgtttcctatagatattttggtgctgcaattgggaaaggcaggcaggctgcaaaaacagagattgagaagctaaagcttactgatatgacttgccgtcaaggggttattgaagtagccaagattatttatggagttcatgatgaggcaaaggataaagactttgaacttgaaatgagttgggtgtgtgatgaatcaaatcgccaacatcaaaaggtccccgatgagcttctagaagaagctaaggcagcagccaaagctgctcttgaagaaatggatgctgattagtccgattaaaatatttatttagttcgacagatgtatttcggtaacttactatttgagcagttggaacttttaaaggaaatgtaatgccttcaaccgttggattttgtatgcttgatgccttgattatgattattaaacgaccagttcctagagataaatcttctgaagaagtgctttagattgtggtcttcggttgttgatttgttgtttgtattgtgtcttcctcgcccatgtttactcaacttaccatcaggtttctcttttatatatgttggaatgaac

SEQ ID NO: 2753 - DNA, 1148 bp, Capsicum annuum
gcacgagggacaaaagaaaactctgtatatattttgggtctcagaggcacaaaacattgagctcaagtagtagagaagaagaagaagaaagggtgacaaggcaaatatgagtagcataggtacaggatatgacttgtcggtgacgacattttcaccggacggcagagtatttcagatcgaatacgccgccaaagctgttgataacagcggtactgttgttggaatcaaatgcaaagatggaatcgttttgggagtggagaagttgattgcgtctaagatgatgttgcctggatccaaccgtcgaattcactccgttcatcgccattccggcatggctgttgcaggtttggctgcagatggtaggcaaattgttgcccgagccaagtctgaagcaaccagctttgaaagtgtatatggtgagccaattccagtgaaagaacttgcagaacgtgttgctagttatgtgcatttatgcacactgtactggtggctcaggcctttcggatgtggggtgattcttggaggatatgatagagacggacctcaactatacctggttgagccttctggtgtctcctataggtacttcggcgctgctattgggaagggcaggcaagctgctaaaacagaaattgagaagttgaagttatctgaaatgacctgtagacaaggggttattgaagtagccaaaataatttacggagtacatgatgaggcaaaggacaaggactttgaacttgaaatgagttgggtatgtgatgagtctaaccgccaacatcagaaggttcctgataatcttttagaggaagcaaagactgcagctaaagctgcacttgaagagatggatgcagattaagggtgcagataagactagttccttctttcttcatgcatctacttattcgatgatctatctctgccatgctagccgaattttggcaccactgtgatgatctgctactgctgatagctatttatagtttcttgtaattctgaactccaagtttgaaaatccagagcattagtttgtgttttataagacactatgaaatctgatttttgttggtctataaagcatgttaaacgggctttcccgattctcatattgcaagagagtgctatgtcatttcactttcataaaaaaaaaa

SEQ ID NO: 2754 - DNA, 1191 bp, Solanum lycopersicum
gtcttgtcaaaaaagaaaactccattttcttcttctgtatattccgtcgtttcattctccagaaatctttgaactcaaaattgaaatctatagaggaaacagcgaagaggatcgaaacgtagaaaatgagcagcattggaactggttatgacctatcggtgacgacattctcgccggacggcagagtttttcagatcgagtacgccggaaaagctgttgataatagtggtactgttgttggaatcaaatgcaaggatggaatcgtattgggagttgagaagctgattgcgtcgaaaatgatgttgccgggatctaatcgtcggattcactctgttcatcgtcattctggcatggctgttgcagggctggctgctgatgggaggcaaattgttgcccgtgcaaagtctgaagcaaccagctttgaaagtgtatatggtgaaccgattccagtgaaagaacttgcagaacgtgttgctagttatgtacatttatgcacactttactggtggctcaggcctttcggatctggggtaatccttggaggctatgatagagatggacctcaactctatatggttgagccatctggtgtctcccataggtacttcggtgctgctattgggaagggcagacaggctgctaaaactgaaattgagaagttgaagctctctgaaatgacgtgtcggcaaggggttattgaggtagccaaaataatttacggagttcatgatgaggcaaaggacaaggcatttgaactggaaatgagttgggtgtgtgatgagtctaaccggcagcaccagaaggttcccgctgatctgttagaggaagccaaggatgcagctaaagctgcacttgaagagatggacgcagactagtggcgcaaatacaactctgcttgctctctctatttactacttttatcaactgaatcaaatagtctgctgtggctctgtcatgtttggaatttggcacctgtatgacaattgtttttagtgatgaaagagatctgatattgttttcactgttgactgtaatctgtacgcgtaaatttcgtagatcaaagaggataggttgctttcttatatggggaattctcggtatttagcaatttttatctttgacatatgctgctgttttttccctcaattgtgggggatccttatctctcgtcattttgctatatatttgctt

SEQ ID NO: 2755 - DNA, 1191 bp, Solanum lycopersicum
gtcttgtcaaaaaagaaaactccattttcttcttctgtatattccgtcgtttcattctccagaaatctttgaactcaaaattgaaatctatagaggaaacagcgaagaggatcgaaacgtagaaaatgagcagcattggaactggttatgacctatcggtgacgacattctcgccggacggcagagtttttcagatcgagtacgccggaaaagctgttgataatagtggtactgttgttggaatcaaatgcaaggatggaatcgtattgggagttgagaagctgattgcgtcgaaaatgatgttgccgggatctaatcgtcggattcactctgttcatcgtcattctggcatggctgttgcagggctggctgctgatgggaggcaaattgttgcccgtgcaaagtctgaagcaaccagctttgaaagtgtatatggtgaaccgattccagtgaaagaacttgcagaacgtgttgctagttatgtacatttatgcacactttactggtggctcaggcctttcggatctggggtaatccttggaggctatgatagagatggacctcaactctatatggttgagccatctggtgtctcccataggtacttcggtgctgctattgggaagggcagacaggctgctaaaactgaaattgagaagttgaagctctctgaaatgacgtgtcggcaaggggttattgaggtagccaaaataatttacggagttcatgatgaggcaaaggacaaggcatttgaactggaaatgagttgggtgtgtgatgagtctaaccggcagcaccagaaggttcccgctgatctgttagaggaagccaaggatgcagctaaagctgcacttgaagagatggacgcagactagtggcgcaaatacaactctgcttgctctctctatttactacttttatcaactgaatcaaatagtctgctgtggctctgtcatgtttggaatttggcatctgtatgacaattgtttttagtgatgaaagagatctgatattgttttcactgttgactgtaatctgtacgcgtaaatttcgtagatcaaagaggataggttgctttcttatatggggaattctcggtatttagcaatttttatctttgacatatgctgctgttttttccctcaattgtgggggatccttatctctcgtcattttgctatatatttgctt

SEQ ID NO: 2756 - DNA, 997 bp, Tragopogon dubius
ccctcaatcaacgagaagccagtaaaccaaaatcagtagtaacaaattagccctagaaaaagatgagtagcataggaacaggttacgatctatcggttacaaccttctcgccggacggtagggtttttcagatcgagtacgctgctaaagccgtcgacaatagcggcaccgtcgtcggcatcaaatgcaaagatggcattgttattggagtagagaagctgattgcgtcgaagatgatgttgcctggatctaatcgtagaatccactcagtacatcgtcattctgggatgggtgtagctggattagctgcagatgggagacagattgttgcaagagccaaatctgaagcccaaagctatgaaagtgtttatggggaaccgattccagttaaagaacttgctgagcgtgttgctagctatgttcatctatgcacactttattggtggctcagaccttttggctctggggtgattcttggaggttatgaccgtgatggcccacagttatacatggttgaaccttctggtgtttcttacagatattttggcgctgcaattggaaagggcaggcaggctgctaaaactgagattgaaaagttgaagctttctgagatgacatgtcgtcaaggagttattgaagtagcaaaaataatctatggagtacatgacgaggcaaaggacaagacatttgaattggagatgagctgggtgtgtgatgaatctaaccgccagcaccagaaggtaccagaagcacttttggaggaggcaaaagcagcagctaaagcagcattggaagaaatggatgctgattaattgttatatttccttcctttgtggttcactttcaagtttgttaatcgtatgacgtcttcatcagcgtattttttaagtttccatctaagattgtgtaacatttcagtcctatcagaacaaattttcatctgttgccagctcaccagacttttttttacatgtgaatggatcaaagtttctaaact

SEQ ID NO: 2757 - DNA, 956 bp, Zostera marina
ttccattggaacagggtacgatctgtccgtcaccactttctctcctgacggtagggttttccaggtcgagtattccggcaaagctgttgataacagtgggactgtagttgggatcaagtgtaaggatggagttgtcatgggcgtggagaaattaatatcgtccaagatgatgcttgagggatcgaatcggaggattcatgctgttcatcgtcatgctggaatgtccgttgcaggattagcagcagatggaagacaaattgtttcacgtgccaagtctgaagcaatcagctacgaaagagtgtatggtgaacctattcccatcaaggaacttgtagatcgggttgccagttatgttcatctctgtactctctattggtggctgagaccttttggatgtggagttattcttggaggttttgacagagatggtccacagctatacatgatcgaaccttctggtgtttcttataaatattttggcgcagctattgggaagggaaggcaagctgcaaaaacggagatagagaagctaaaactatcggagatgacttgcagggagggaattattgaagttgctaaaattatatatggagtacatgatgaagcaaaggacaaggcttttgagttagaactcagctggatttgcgaagaatcaaaccacaaacatcaaaagattccagatgagcttatagagcatgcaaaagaagccgcaaaaacggcattggaagaaatggatgcagattaatttcatccatttaaactggatgtataatttcgaatttctaacaaagaaacatttttctaataattatttaaatttgagatcccctctccctctccctccacattcaatttctatgttatatttgattaaatgtttagctgtttgctcatatactgtacaatgaggcattggaatatgttgttttgattatcgtgtgttaattcatcatttt

SEQ ID NO: 2758 - DNA, 1067 bp, Chelidonium majus
ccggcgattcggatcggttttattaaagtctcactcgttcagtcgtttcttgagatcaaagaaacactttttattagtttggacttgagagagagagtagaaagaaggtcgaagaacaaacaacaccaacactcggagttcagaggaaagagaaaaaatcaaaaaaacaaaaagatgagcagcattggaactggttacgatctctcagtcactactttctctccagatggtcgtgtcttccagatcgagtacgccgccaaagcagtcgacaacagcgggactgttattgggatcaaatgcaaggatgggattgtgttgggtgttgaaaaactcattgcatcaaagatgatgttacctggttctaatcggagaatccactccgtccatcgtcactctggcatggctgttgctggattagctgctgatgggagacagattgttgctagaacaaaggccgaagctgttaaccatgaaaagacttatggtgaacccatacctgttaaggaacttgctgagcgtgttgctagttatgtgcatctatgcacactctactggtggctaagaccttttggctgcggagttattcttggaggatatgacagagatggaccacaattgtacatggttgaaccttctggcatttcccacaggtattttggcgccgcaatcggaaaggggaggcaggctgctaaaacagagatcgaaaagttgaagctttctgagatgacatgtagggaagggggttattgaagttgctaagatcatttacggagtgcatgatgaggcaaaggacaaggcatttgaattggaaatgagctgggtatgtgatgagtcgaaccgcctacatcagaaggttccagatgagcttttagaagccgccaaagcagcagctaaagcagccttggaagaaatggatgccgactaattccccatttgagcagagcattatcgttacttatttctttttgttttcttgatttttatgtactttttcgggatattgcatcttcctgggcaacaactcggacatgaatcaaatattgagaacaagccaaactagtgtaaaa

SEQ ID NO: 2759 - DNA, 1055 bp, Amborella trichopoda
catttatcggtctctctttcctctctctctttctctctctctaaaatttcatttcttgagatccaagggaaaaggagaaaaatcggaaaatatgagcagcatcggcactggttatgatctttcagtgaccactttttcaccagatggtcgcgtttttcaaattgaatatgctgctaaagcagttgataatagcgggactgttattggaattaaatgcaaggatggcattgttctgggtgtcgagaaacttgtagcttcgaagatgatgttggcgggttccaatcgaagaattcattcagttcatcgacattctggcatggctgttgctggtttagctgcagatggcaggcaaattgttgcacgtgccaaatccgaagcaatcaactacgaaagtgtttatggtgagccgatccccgtaaaggaacttgctgagcgtgttgctagctatgtacatctttgcacactatattggtggttaagaccttttggttgtggagttattcttggaggttatgacagagaaggaccacagctatacatggttgaaccttccggagtttcctataggtactttggggccgcaattgggaaaggcagacagggtgctaaaactgagattgagaagctgaagctatctgaaatgagctgcagggaaggtgttattgaagttgcaaagataatctatggagtacatgatgaggcaaaggacaaggcctttgaattggagatgagctggatctgtgatgagtccaaccgccagcaccagaagattcctgatgatttattggaggcagcaaaggcggctgccaaggcagcacaagacgaaatggatgctgattaattgcattgatttcatttcctttaatttttgttttaagtcggaattttcagctttgttcaatgtctcttgtgaggattttatagttcttcagagattggagaaaagaaaaaaaagaaatattgtggacaatggggaagtagatatttatgaaaagaattgagaaaatggctatgaatttagtcctttgtgtttaaggtgagaaatttgttggaac

SEQ ID NO: 2760 - DNA, 1090 bp, Amorphophallus konjac
aaaagccctggaactgggaaggaggagccgaaggagagggacgcagaaggcgcgggcagggaagggtagagagagagaagatgagcagcatcggcacggggtacgacctgtcggtgacgaccttctcccccgacggccggctcttccagatcgagtacgccgccaaggccgtcgacaacagcgggactgtcgtcggcatcaagtgcaaggatgggatcgtcatgggtgtggagaaattgatctcatctaagatgatgctggctgggtccaacaggaggattcattctgtgcaccgtcactccggcatggctgttgctggacttgctgcagatggtaggcaaattgttacacgggccaaaggtgaagcaaccaactatgaaagggtttatggtgagcccatacctgtgaaagaactggcagaacgtgttgctagctatgttcacctgtgcactctttattggtggctaagaccctttggttgtggtgttattcttggtggttatgacagagatggacctcagctatatatggttgaaccttctggtgtttcacataggtattttggggctgcgattgggaaagggagacaggctgcaaaaacggagattgagaagctgaagctgtctgagttgacctgccgggaaggtgttattgaagttgctaaaataatatatggtgtacatgatgaggcaaaggataaagcatttgagttggaaatgagctgggtttgcgatgagtcgaaccgccaacatcagaaggtaccggatgatctcttggaacaggcgaaagaagccgccaaagtagcactggaggaaatggatgcggactaagaagtgtgagggattttccatgtaaaccctacagactgacagggaaatctcccaatcctcgttgtccaaatgcgaaaaactcattgcgcagagtacttgaattcaagtggaggatgataaatgttggaacattcacttgttctattttccaacaaaagtcggtcatgctccattataagtatgttgatctttgcttttgatttcttagattctcgatgtgtttttgcaaccggggaatttgacgtccattattttgcatg

SEQ ID NO: 2761 - DNA, 1129 bp, Cucurbita pepo
gcgggggacgcgaaggcaaaagattttcttgtgaagaaagaaattgaagagtagagagaagtacaaagctcggtcgtcttcttcataagctccactttttcatttcctgctccacagatcaccaatcgaaactcgctctcggttagggcaaagaaccagaaacaatgagcagcataggcactggttacgatctttcggtcaccacattctcccccgatggccgtgttttccagatcgagtacgccgcaaaggccgtcgacaacagtgggactgttattggaatcaaatgcaaagatggagtcgttatgggcgtggaaaagctaattacctcgaagatgatgcttcctggttctaatagaagaattcacgccgttcatcgtcattctggcatggctgtggcaggattagcagcagatggaaggcaaatagttgctcgagcgaagtctgaagcaaccaactatgaaagtgtttatggtgaaccaatccctgtaaaggaactagctgatcgtgttgccagttatgtgcatctctgtacactctactggtggctcagaccttttggatgtggcgttattcttggaggttatgatagagatggaccacaattgtacatggttgaaccatccggtgtttcttataggtactatggcgctgcaattggaaagggcaggcaggctgcaaaaacggaaattgaaaagttgaagctctctgaaatgacatgtcggcaaggggtcattgaagtagccaagattatttatggagtacatgatgaggcaaaggacaaggacttcgagttggaaatgagttggatctgtgatgaatccaaccgccaacatcagaaggtcccggaggatcttctaggggaagcaaaggcagcagctaaagctgccctggaagagatggatgctgattaagttagatatttttaggtgttcttactgtactgcaattgctttatttagtttcaagcgtctggttagagcaccctgtaagaattttccaaggattcaggaacagataaacttattgtgatttccatactgctttattgtactgttcttaatcaaattgggaattttctcctgtaagccagtagaagatcttgctcttaagaacacagcatgttcat

SEQ ID NO: 2762 - DNA, 991 bp, Lippia dulcis
gaaagaaaattaaaagcaggaagagagtgaaaataccacagcagtcgagagagggggaaaatgagcagcattggcacaggatacgatctatcggtgacgacattctcaccggacggccgcgttttccagatcgaatatgccgccaaagccgtcgacaacagcggcaccgtcgttgccatcagatgcaaagacggaatcgtcatgggagtggagaagctgattgcttccaagatgctgcttccaggctccaatcgaagaatccactccgttcatcgccactccggcatggctgttgccggattagctgcagatggcaggcagattgttacacgagcaaagtctgaagcaactaattatgaaaaggtttatggtgaagcaattcctgttaaagaactcgcggaacgagtggctagttatgtgcatttgtgcacactctattggtggctcaggccttttggttgtggagtgatcgtgggaggttatgatagggatggaccacagttgtacatgattgaaccttctggcatatcatacagatacttcggtgcagccattggaaagggaagacaggctgctaaaacagaaattgaaaagttaaagctttcagagatgacatgccgacaaggtatcattgaggtggccaagatcatttatggggtgcacgacgaggccaaggacaaggcctttgaactggaaatgagctgggtctgtgatgagtcgaaccgccagcatcaaaaggtaccggaaaatctgctagaggaagccaaggcagcagctaaagccgcccttgaagaaatggatgcagattagatttagctgttggcttttgctgagacccttattcaggccttttctaatccgtttatctgcttcccatcagttacattggttttgttttataaacatgaaaaaaatttctgaagacaacaacgatatgacattattgttaggttgtattaaaccttatgatcatttagtagacttcatttat

SEQ ID NO: 2763 - DNA, 1184 bp, Aquilegia formosa
tgagatctaagaaagctttctaggttttaagcagcagaaacccacatctcgaagaagaaagaagttaatcacaagaagaagaagaagaagaaataagttaatcagatggctagtataggcactggatacgatctatcggttacaaccttctcaccagatggtcgtgtttttcagatcgaatacgcttccaaagctgttgataacagtggaactgttattgggatcaaatgcaaagatggtattgttatgggtgtggagaagcttatagcttcgaagatgatgttacctggttccaataggagaatccatgctgttgaccgtcattctgggatggctgtggctggattagcagctgatggaagacaaattgttgcaagaacaaagtcagaagcaactaattatgaaaggacctatggggagcccatacctgtgaaggagcttgctgaccgtgttgctagttatgtgcatttgtgcacgctttattggtggctaagaccttttggatgtggagtaattcttggaggctatgacagagatgggcctcagttatacatggtcgaaccttctggtgtatcttatcggtattttggtgctgcgattggaaagggaagacaggctgctaaaacggaaattgaaaagttgaatctctctgaaatgacctgcagacaaggtgttgttgaagttgccaaaataatatatggagtacatgatgaggcaaaggacaaggcctttgaattagaaatgagctgggtttgtgacgaatccaaccgcctacatcagaaggttccagatgagctcttagagggtgcaaaagcagcagccaaagcagctttggaagaaatggatgcagattaagattagtgcaaatgcttggaacgcatttgttttagaaatgagacatgtcacattggatatcagaagggaatatgatctgtcaatgaatattgtatgtttgagatttggaaatattggaatggcattgacccatgtccatagaaaatgtatgtttgagtttggtaggtgtacggaaaaatttatatgaatttggtatcgtaaaaagggtctccatctacacttctgcaattagcttaggagtgaaatggtgcagaaccataactactttgtgcgcaactttgttgtgtgtcctctctgttatatacagatcctggtccatggtcgggcaa

SEQ ID NO: 2764 - DNA, 935 bp, Cichorium intybus
caccagtccgcttataactttgcccttttcttcacttattccgaaaccccaatcgaacgagaagccagtaaaccaaaatcagtagcagcaaatttgccctagaagaaaatgagtagcataggaacaggttacgatctatcggttacaaccttctcgccggacggcagggtttttcagatcgagtacgctgctaaagctgtcgataatagcggcacggtcgtcggcatcaaatgcaaagatggcattgttattggagtagagaagctgattgggtcgaagatgatgttgcctggatctaatcgtcgaatccactccgtacatcgtcattctgggatgggtgtagctggattagctgcagacgggagacagattgttgcaagagccaaatctgaagcccaaaactatgaaagtacttatggtgaaccaattccagttaaagaacttgctgagcgtgttgctagttatgtgcatctatgcacactttattggtggctcagaccttttggatctggggtgattcttggaggttatgaccgcgatggcccacagctatacatggttgaaccttctggtgtttcttatagatattttggtgctgcaatagggaagggcaggcaggctgctaaaactgagattgaaaagttgaagctttctgagttgacctgtcgtcaaggggttattgaagtcgcaaaaataatctatggagtacatgacgaggcaaaggacaagacctttgaattggagatgagctgggtctgtgatgaatcaaaccgccagcaccagaaggtaccagaagcacttttggaggaagcaaaagccgcagctaaagcagcattggaagaaatggatgctgattaattaatatatgtacttcctcccttttgtggttgtctgactcttccatttcaaatatgttgaagtttggttgctattaa

SEQ ID NO: 2765 - DNA, 1038 bp, Capsicum annuum
ctcctctcagcaaaaagcatttgaagtgaaaagtgaatcagtataaatagcgaaaaggagaaaaaatgagcagtattggaactggatatgacttgtcggtaacgacattctcgccggacggcagagtatttcagatcgagtacgccggaaaagctgttgataatagtggtaccgttgttggaattaagtgcaaggatggaatcgtactgggagttgagaagctgattgcatcgtcaatgatgttgccgggatcgaatcgtcggattcattcagttcatcgtcattctggaatggctgttgcagggctcgctgcagatgggaggcaaattgttgcccgggcaaagtctgaagcaaccaactttgaaagtacatatggtgaaccaattccagtgaaagagcttgcaggacgtgttgctagttatgtacatttgtgcacactttattggtggctcaggccttttggatgtggggtaattcttggaggctatgatagagatggacctcaactctacatgattgagccgtctggtgtctcctataggtactttggtgcggctattgggaagggcagacaagctgctaaaacagaaattgaaaagttgaagctctctgaaatgacgtgccggcaaggggtaattgagatagccaaaataatttatggagtacacgacgaggcaaaggacaaggcatttgaactggaaatgagttgggtgtgtgatgagtctaaccgacagcatcagaaggttcccgctgatctgttagaggaagccaaggctgcagctaaatctgcacttgaagagatggatgcagactaagtggcacagagacactttgtttcttcatttattcatgaacctaccttttatgagctgattcaaatagcttgctctgccatgtttggaatttggttcctgtatgacgaacgctgttaacgatgaaagagctttgctattgctttttaactgttgaaactgtaatctgttcaagtaattttctaagatcaagaggataggttgcattatcctaaatgcctcgtgc

SEQ ID NO: 2766 - DNA, 848 bp, Carthamus tinctorius
  misc_feature (8)..(8): n is a, c, g, or t
  misc_feature (833)..(833): n is a, c, g, or t
  misc_feature (838)..(838): n is a, c, g, or t
cggggacngaagccattaaacaaaatccaatttcgacctagaaaaccatgagtagcataggaacaggttacgatctctcagttaccaccttctcgccggacggtagggtttttcagatcgagtacgctgctaaagccgtcgacaatagcggaaccgtcgtcggcatcaaatgcaaagatggcattgttattggagtagagaagctgattgcgtcaaagatgatgttgcctggatctaatcgtagaatccactccgtacatcgtcattctggaatgggtgtagcaggattagctgcagatgggagacagattgttgcgagagccaaatctgaagcccataactatgaaagtgtttatggtgaaccaattccagtcaaagaacttgctgagcgagtcgctagttatgtgcatctatgcacactttattggtggctgagaccttttggatctggggtgattcttggaggttacgaccgcgatggcccacagttgtatatggttgaaccttctggtgtttcctatagatattttggtgctgcaattgggaagggaaggcaggctgctaaaaccgagattgaaaagttgaagctttctgagatgacatgtcgtcaaggagttattgaagtagcaaaaataatctatggagtacatgatgaggcaaaggacaagacattcgaattggagatgagttgggtttgtgacgaatcaaaccgccagcaccagaaggtaccagaagcacttttggaggaggcaaaggcagcagctaaagcagcattggaagaaatggatgccgattaacgtaatagataggtctttcttccctttgtgtttgtncgaanctttgatttc

SEQ ID NO: 2767 - DNA, 1039 bp, Helianthus annuus
aaggggttgaattgcaaatacaaataacaagtctcatttcttttcttgagactcaagacacccaaccccctttcttcacttcacttgtttcaacccccaatcgagccacaaatcagtaacctaaaaacaccagtaaccaccaatttagccctaaacgagcacgatgagcagcataggaaccggttacgatctatcggtcacaaccttctcgccggacggtagggttttccagatcgagtacgccgctaaagccgtcgataacagcgggaccgtcgtcggtatcaaatgcaaagacggcattgttattggagtagagaagctgattgcgtcgaagatgatgttgcctggatctaatcgtagaattcattcggtgcatcgtcattctgggatgggtgtagctggattagctgcagatgggagacagattgttgcaagagccaaatctgaagcccacaactatgaaagtacctatggtgaacctattcccatcaaagaacttgctgagcgtgttgctagttatgtgcatctttgcacactttattggtggctcagaccttttggatccggtgtgattcttggaggttacgaccgtgatggcccgcaattatatatggttgaaccttctggtgtttcctatagatattttggtgctgcaattgggaagggcaggcaggctgcaaaaaccgagattgaaaagttgaagctttctgagctgacatgtcgccagggtgttattgaagtagcaaaaataatctatggagtacatgatgaggcgaaggacaaaacatttgaattggagatgagttgggtttgtgacgaatcaaaccgccagcaccagaaggttccggaagcactgttggaggaagcaaaagcagctgctcaagcagcattggaagaaatggatgctgattaataataatattaaaatcccttcacattgtgtttcagcttaagataattatctaagattgtaacatttctgttttatcataacacgattcagattttcattatgctgactgccttgtcgacttttgct

SEQ ID NO: 2768 - DNA, 5553 bp, Aristolochia fimbriata
ctctctcttacatatttccaaatgcttcttgggagaaaaggagattgtgatttttctactgtataatttttctgtctggttctgcatgtatggattgtctattgtttcgtctcaatgcttcattagttaccagagatgtttggatatgaggatataaatggagacaattcaggagaaggaacatattatgttggtttaaaaagtaggtaagaagcactaaacagtggctaaaatgtagaagacagcaaattgtttgacaaattaccaacttatcattttaggtttctgatgcttcatttaatgaagatctggttaagatgaataggtgagtgtcataaactgtgagatattgtggcagtgtaaaggaagatataggaaaatggagaggtaggagatctcaaagtagggactctttgcctgatacaaccttcttgtatatgagaagcttagtggcataatttttggttcttataacgtaaacttttcgacattaaatcttttacgttacatgttctgaaactgaaccctgcactagtctttctattacttttatttttatttttatttttttaatttttttttaatgttgatatgccttcctaagtccctgcattaaatgtttcttgttttagcatgtgtacttttttagcctccaaggttccaatataaatgcagaagcctttatctgccgctgatgcatctttatttgcaggtggttcaccagatcgtgtatcagtggaatctggggcaaaaaggtctagtatctcatctggagggaggccccatgtttcttcaggtcgtaaagagttcttcaggaaatttatggatagtgaaatgctaacagataagcttcaagattggttttcagaattatctgataaatcggcaagtagaaaacctgcatttgatgtgccttttgagctgacagaattacaaaaatttgattatgctttagaaggcgtgacttttcaacagcttgttagaatgccaagtgctgtttatgcttcaacatctgatgctgttgaggcaagtgcttaccttgcaattgaggattttctgcatggtagtgccaagggcttgtgggacacattttggggtcaggaggagccaatgcctttctcagttgcatgtctatacagttcagggacaggttcaaaattttatccagcagagaaagcaatcgcgagtggaaagcttggaggcctttgtgccactgccatcatgataaataaaggtcgtcactcacatgcaaagtgggatcagatacttgaactagcactattaagacctgatgtcggtacacaatccttagagagcgatcggcgaccttctctctctgttctgggtcaggcccttttctttgctgttcgtatactattgtctagaagccttaacaaatctaatgttctttataattccaattgtgtatttgtgcttcttgttgattctcagtatggcgggattgtgaaagttgaaggagatgtgaataagctgaacctggatgtgagtaatgtgtatgactgtgctgcagaatggattaagcgctattcgaaaatttccatttcacctgtggatcgaatctggaacaaacttgggaatgcaaattggggagatattggagctctccaggctcttctggcaactttccattgtatttcacaatattctgggtttccaaagctatcaatagaagatttagcttcggaacatgctactcgtctccaaaatcgaagatctgagaggcaattggtagatactcgagtaaatggaaatggttttttcaggtttcagcaaaagagcttttccccagaaatagtcgaagttcaggaggaattcgccaaaattgagtcggaaccaatgcccaaactggatgtaggatctgttttgtggttggaggatttggatgggcagaagggttttgagattaatgaaatactgagtaatggggagatcccaacctatagtgccacgtctgtggaaggaggaaatgctttattactgtatgttggttctccaccttctcaaattgaacctgcttgggaggatatgagcttatggtatcaggttcagaggcaaaccaaagtattgaatgtgatgaaacaaagagaaatttcaagcaagtatctcccacagctggttgcttcaggcaggatgattcacccaggtcaatgccagaagcctagtgctggaggaaattgtgatcacccatggtgcgggacccccatccttgttacttatccgataggagaatccatggctgatatggtaagaaatggttcttttggtcatgatgaggctttgaggtgcttccatgattgtctatctgccctttcagtggccgcttctgctgggattcggcatggtgacatccgacctgaaaatgttatccatgtcactttgagtgtgaacgacccttatttcgttcttgtaggatggggccatgccatcttggaagacagggacaggccgacaatgaatcttctattttcttcttcatatgctcttcaggaagggaagttgtgctcagcttctgacgcagagagtctgatttatttactgtattttgcatgtggaggagctgtgcctgatttggactcagtagagggagcattggagtggagagtggctgtttggtcaagacggttgatccaacaaaagcttggggagatttctgctgtgctaaaagcttttgctgattacgtggatagtctctgtggaaccccttacccgttggattatgatatatggttgaagaggttgagaacaacgattaattacgaggaccatgggaaggatgtaggtccttcaggctagtgattctttgcgagagcagaatcttttgcatatcaggcagcaatgctgatgggagtgatggcatttttgttctcctcccttgactgtccaaaggtctgtgcagatcttcgaatggtgcttaaagttgaaattccttttaatcaggctggcaagacttttttgaactgacctgtggagaaataagctggctactgggtaatcttatgcagaaaattttcaaaccattgtgaaggtaaatcaacgattggaatctcttgtgagcttcttgttagcagcccttttttgtatgaacctgttcaggcattttttggattcaggaggtggaccaattcagatacttgtacaaagttgatggagtttttcctgcttttaagcggcatgacactgtttgtgggagattttaaatgagagattcctggtgtttcatatcccataaaaacaggacccgagcatggtttcctttcccctgttctatagctttttcggatgttaaaggggggataactgatgggtttcttgcaggtcacctcttttgaaatacttatactgtttgatctttgtcaatgttccccttacatttgcaaattattgttattattgatgctcttcgttgtaaatcatgcttgcaatcaacttggaaattcttggtgggttcgtttgaattgaaactatggacagggaagggtgaatttctacacccatatttcttatcatctaatatatttttagattttagacaatctatgtatttcttatgatattatatacctctcaagtatttatttaatatatgacagctttgaatattttaaaataattaatgatttaaaatttgtattaacccataaaattatagagaataacattatcatggacataaaagcataagaacaatgtttagggttcaccaaacgcaacaaaatcagtacaacatgcagtatcttgaatcatattttgactctagtaccatggcaccaggtgatccagacccatgttcagtctaataaaattttcccaaattacccataagtatgctcgactaatcagctaatcagacatcatctgttctctttaatacttgataattgataatcaagtgaaatcagtgtttccgaagctatgtgcaaactagaggagttaccggttcggtttgacttagttgaaccgggttcaaccagtgacaagattgtggttttctatcatcatattttcttgtgatacatgcgatttggttcatggccatctattagccctaggttagataaaaaaataaaatctattagccataagttcaccttagccctattggaccggcatgcctcaaaaggatttgggtcagaactgcaatttcctgtacggttcaacccggagacaagaagagatgtggagaatttaaggaaggtgtttatgtaatctctccttgtatttaacacctcgctctccggtagaagttttgcgccccctcttggcttgtgatcgaagaaatccttctcgttcgaagtagtcccgattttgagcatttctcgaacgctgagagccgggaaatatgagtagcataggaacgggttatgatctctcggtcaccactttctcccccgacgggcgcgttttccagatcgagtatgcagcaaaagcagtcgataacagcgggaccgttgttggtatcaagtgcaaggatggggttgtcttgggagtggagaagctcgttgcttccaagatgatgttgcctgggtctaatcggagaatccactcagttcaccgtcattctggaatggctgttgctgggctagctgctgatggaaggcaaattgttgcaagagccaagtctgaagcaactaactatgaaagtgtttatggtgaggccataccaattaaggagcttgcagaccgtgttgctagttatgtgcacctgtgcacattatactggtggctgaggcctttcgggtcaggtgtaattcttggaggctatgatagagatggtccacaactgtatatggtcgaaccctctggagtttcttacaggtattttggaacggcaattggaaaagggagacaggctgccaagacagagattgagaagctgaagctgtcagaaatgacctgtaggcaaggagtaattgaagttgctaaaatcatttatggagttcacgatgaggcaaaggacaaagcttttgagttggaattgagctgggtttgtgatgagtctaaccgtcagcacgaaaaggttcccgatgatcttttagaagcagccaaagcagccgctgaagcagcactcagggaaatggatgcagactaatttcagacgattcctttgtatttttctagtgaatgatgaatacttataccccctctaaacattatatctgaaacactttactcgccagagatcaaaattttggggaaaaatagtggtgaagtcttgacttgaaagaaatgatgaatgtcgcattactgcttatgggatgcccaaaagccccaaaaacttcctcactctgtatgtggtgatccagttcaatctagatatatttctgatgagggttacaaatacaatcaccctactcgctactcacaggctccttggtgactgccaattagtaaatattcaagagaaaaagatcaattcatgtctgttccctctgttccagtcctaactccctttttctccatgttaaaatccaaacttgggtcggccaaaagaaccgacgaatatttcagatctttggaactgtcatgaaggca

SEQ ID NO: 2769 - DNA, 958 bp, Amsonia hubrichtii
gagtctctctcaaacttgaacagtattgcattcagacaaccatagtccttgtagcaagttagattccaaagaagaagaagaagagtaaagagaaaaacgatgagcagcataggtactggctacgatctctcagtcactacgttctccccagatggccgagtttttcagatcgagtacgctgccaaggccgttgacaacagtggcaccgtcatcggcatcaagtgcaaggatggcatcgttttgggagtggagaagctcatagcatccaaaatgatgttgcccgggtccaatcgaagaatccatgccgttcatcgccattccggcatggctgttgctggattagctgctgatgggcgtcagattgttgcgagagcaaaggctgaagctaccaattatgaaagtacatatggagaaccaattcctgtgaaagagcttgcggaacgtgtcgccagttatgtgcatctatgtacgctttattggtggctcaggccctttggatgtggggtaatactaggaggttatgacagagatggaccacaactatacatggttgaaccttctggtgtttcttataggtacttcggtgctgcaattgggaagggtagacaggctgctaaaacagagattgaaaagttgaatctttccgggatgacttgccgtcaaggggttgttgaggtggccaagataatatatggaatacacgatgaggcaaaggacaaggcctttgaattggaaatgagttgggtttgtgatgaatcaaaccgccagcatcagaaggttccagatgaacttctagaggaagccaaagcagcagcaagggctgcacttgaggaaatggatgctgattagtaatctcaaaacaaatccaattatctttcaagtttcatttgttcagagatgggtgttttctgccgggctaaatgatgtcgcatggatttgtcattaacatattatttat

SEQ ID NO: 2770 - DNA, 1111 bp, Malus domestica
cttgagtgggaagccggtgtctctttattttgtagctgtttgtttctcagtcgagcactcaacaaacaacaataaacagcagaaaaataaaaaagaagaagaagaagatgagcagcatcggaacaggttacgatctctccgtcaccacattctcccccgacggccgcgtcttccagatcgagtacgccgccaaagccgtcgacaactccgggactgttattgggatcaaatgtaaggacggcgttgttatgggtgtggaaaagctcatagcgtcgaagatgatgctgcccggttccaatagaaggattcattcagtccatcgccactccgggatggcagtggcaggattagctgcggatggtaggcaaattgttgctaggaccaagtctgaagctaccaactatgaaagtgtgtatggtgaacagattcctgttaaggaacttgctgaacgtgttgctagttatgtgcatttgtgtacactatattggtggctcagaccttttggatgtgggataatccttggtggttatgacagagatgggccgcaattatacatggttgaaccatctggtgtttcttataggtattttggtgctgcaattggaaaaggcaggcaggctgctaagacagagattgaaaagttgaagctttcggagttgacttgtcggcaaggcgttattgaagtagccaagatcatttatggaattcatgatgaggcaaaggacaaggagtttgagttagaaatgagctgggtctgtgatgaatcaaaccgtctgcatcagaaggttccggatgagcttctagaggaagcaaaggcagcggctaaagcagcattggaagaaatggatgcagattaagaagccgatgaaataatgtgttggtattctgaaaccctactagaagaacatcaacagaaaagggttaatgagataagattgatggattttcattagccaacttgggctgctgcagtatttcttgtacgttaaaatgttcaatttaccgacgttgtggtgcaaaccacatctgtaggatgcttgagaaacagagtctcacttacattattatgcacattctccttttgaactgctgaagtaattctgttatttca

SEQ ID NO: 2771 - DNA, 977 bp, Arnica chamissonis
ttcttccgatacgacaatcgaacgagaaatcaataaaccaaaatcagtggtaccaaattcgctctagaagaagatgagtagcataggtacaggttacgatctatcggttacaaccttctcgccggacggtagggttttccagatcgagtacgcagctaaagccgtcgataacagcggcaccgtcgtcggcatcaaatgcaaagatggcattgttattggagtagagaagctgattgcgtcgaagatgatgttatctggatctaatcgtagaatccactccgtacatcgtcattctggaatgggtgtagcaggactagctgcagatgggagacagattgttgcaagagccaaatctgaagctcacaattatgaaagtacttatggtgaacctattccaattaaagaacttgctgaccgtgttgctagttatgtgcatttgtgcacactttattggtggctcagaccttttggatccggtgtgcttcttggaggttatgaccgtgatggcccacagttatacatggttgaaccttctggtgtttcttatagatactttggagctgcaattgggaaggggaggcaggctgctaaaactgagattgagaagttgaagctttctgagctgacctgtcggcaaggtgttattgaagtagcaaaaataatctatggagtgcatgacgaggcaaaggacaaaacatttgaattggagatgagttgggtttgtgatgaatcaaaccgtcagcaccagaaggttccagaagcacttttggaggaagccaaagcagcagctaaagcagcattggaagaaatggatgctgattaatgataataaatctttgtgtttgtctcaaatttcaatttcgaatttgttactagtaagagacatttaagtttggttttatccttaaaattttcatgtatgttgcatcaggtaagcgttatatacccaaatgctccaaattcaggtttctttctat

SEQ ID NO: 2772 - DNA, 915 bp, Arnica chamissonis
gatgagtagcataggaacaggttacgatctatcggttaccaccttctctccggacggtagggtttttcagatcgagtacgcagctaaagccgtcgataacagcggcaccgtcgtcggaatcaaatgcaaagatggcattgtcattggagtagagaagctgattgcgtcgaagatgatgttgcctggatctaatcgtagaatccactcggtgcatcgtcattctgggatgggtgtagctggattagctgcagatgggagacagattgttgcaagagccaaatctgaagcccacaactatgaaagcacgtacggtgaacctattccaattaaagaacttgctgaccgtgttgctagttatgtgcatctatgcacactttattggtggctcagaccttttggatccggtgtgattcttggaggttatgaccgtgatggcccacagttatatatgattgaaccttctggtgtttcctatagatattttggtgctgcaatcggtaagggcaggcaggctgcaaaaaccgagattgaaaagttgaagctttctgagctgacatgtcgtcagggtgttattgaagtagcaaaaataatctatggagtacatgacgaggcaaaggacaaaacatttgaactggagatgagttgggtttgtgatgaatcaaaccgcctgcaccaaaaggttccagaagcactcttggaggaagcaaaaactgctgctaaagctgcattggaagaaatggatgctgattaataataataaatttcttcacattgtgtttatctgaagtttcaatttaagatgattctctaagattgtaacatttctgttttatcatgacacagttcaaattttcttgtatgttgactttaggtgagccttgttgacttttgtttatacacagatgttctaaattc

SEQ ID NO: 2773 - DNA, 1072 bp, Catharanthus roseus
gctgtagtgaactcgggcgagcaacctttggaaaagtcggaacaagataacaaaggagaagtttaaaaccaaagaggaaaaccatgagcagcatcggcactggctacgatctctcagtcactacgttctccccggatggccgagttttccagatcgagtacgcggccaaggccgtcgacaacagtggcactgttatcggtatcaagtgcaaggatggcatcgttctgggcgtagagaagcttatatcttccaagatgatgttgcctgggtctaataggagaatccacgctgttcatcaccattctggaatggctgttgctggattagctgctgatgggcgacagattgttgccagagcaaaggctgaagcaactaactatgaaagtacatatggggaaccaattcccgtgaaagagcttgccgaacgtgttgccagttacgtgcatctatgtacactttattggtggctcaggccttttggatgcggagtaatactaggaggttacgacagagatggaccacaactatacatgattgaaccttctggtgtttcttataggtactttggtgctgcaattgggaagggcaggcaggctgctaagacagagattgaaaaattgagcctctccgggatgacttgccgtcaaggggttgttgaggtggcaaagataatatatggaatacatgatgaggcaaaggacaaggcttttgaattggaaatgagttgggtttgtgatgagtcaaaccgccagcatcagaaggttccagatgagcttttagaggaagccaaagctgcagccagggctgcacttgaggaaatggatgctgattagcgctgagtaacatagccatttgtctttgaagtttcatttatttagggatgtatttttatggatttgtccatttatctattgtacgaactcagctgtttggtactcttgttggaccagagagtaatttctgttttttctccttcacatctaactttacttgaacacaaaagtgattaacattgaaaagacatggacaagttaagttacaccggaaaaaaaactagaggcgtggtcggcgt

SEQ ID NO: 2774 - DNA, 958 bp, Eschscholzia californica
agcattggaacaggttacgacttatcagtcacaactttctcaccggacggtcgtgtctttcagatcgagtacgccgccaaagccgtcgataacagcggaactgttattgggatcaaatgcaaggatgggattgttttgggtgttgagaagttgatacaatcaaagatgatgttacctggttctaatcggagaattcattccgtccatcgtcactctggcatggctgtggctggattagctgctgatgggaggcaaattgtcgcacggacaaaatccgaagccattaattatgagaagacatatggagaacctatacctgtaaaggagcttgctgaacgtgttgctagttacgtgcatctatgcacactctattggtggctcagaccttttggatgtggagtaattcttggaggttatgatagagatggaccacaattgtacatggtagaaccttctggcatttcctataggtattatggtgctgcaattggaaaggggagacaggctgctaagacggagatcgaaaagttgaagctttctgaaatgacctgtaggcaaggggttattgaagttgctaagatcatttatggagtacatgatgaggcaaaggacaaggcttttgaattggaaatgagttgggtatgtgacgagtcaaaccgacagcatcagaaggttccagatgagctgctagaagaagctaaaactgcggcaaaactggctttggaagaaatggacgctgactgaatctgataaaataggagaaccttgttttcttataatttatttctcgaaatctttttatttggggtggataattcagtctagtatcaaaatgttatggagtcctccctcgtcgattcagtaatgtcattttatcttaaatggcagagacttaagcaaatgtgtaactctgagaccctttcttcttaaatgcagtgagaattttcataacaatgtt

SEQ ID NO: 2775 - DNA, 946 bp, Eschscholzia californica
aaatcagataagttagagagagaaagatgagtagcataggaacaggttatgatctatcagtcactactttctccccagacggtcgtgtctttcagatcgaatacgccgccaaagccgtcgataacagcggaactgttattgggatcaaatgcaaagatgggattgttttgggggtagagaagttaatacagtcaaagatgatgttacctggttctaatcggagaattcattctgtccatcgtcactccggcatggcagtggctggattagctgctgatggaaggcaaattgttgcacgaacaaaatctgaagcaattaattacgaaaagacatatggggagccgatacctgtaaaggagctagccgagcgtgttgcgagttacgttcatctgtgcacactctattggtggctaagaccttttggatgtggagtaattcttggaggttatgacagagatggaccacaactctacatggttgaaccttctggcatttcctataggtattatggtgctgcaattgggaaggggagacaggctgctaaaacagagattgaaaaattgaagctttctgaaatgacatgtaggcaaggggttattgaagttgctaagataatttacggagtgcatgatgaggcaaaagataaggcctttgaattggaaatgagctgggtatgtgatgaatcaaaccgcctccatcagaaggttccagatgacttgctagaagaagccaaaacagcagcaaaattggcattggaagaaatggatgccgactgatgatcaaaacgaacttatttccttgtagtgaaacatttaattcttaaatctctctatgtatttggagttgtcctgtgggttgagaatcaaatagtgttgggttatcattcctctcatttatgcacttacaatcctttagccaacaacatgcagggactacattttcttac

SEQ ID NO: 2776 - DNA, 1040 bp, Helianthus annuus
agtctcatttcttttcttgagactcaagacacccaaccccctttcttcacttcacttgtttcaacccccaatcgagccacaaatcagtaacctaaaaacaccagtaaccaccaatttagccctaaacgagcacgatgagcagcataggaaccggttacgatctatcggtcacaaccttctcgccggacggtagggttttccagatcgagtacgccgctaaagccgtcgataacagcggcaccgtcgtcggtatcaaatgcaaagacggcattgttattggagtagagaagctgattgcgtcgaagatgatgttgcctggatctaatcgtagaattcattcggtgcatcgtcattctgggatgggtgtagctggattagctgcagatgggagacagattgttgcaagagccaaatctgaagcccacaactatgaaagtacctatggtgaacctattcccatcaaagaacttgctgagcgtgttgctagttatgtgcatctttgcacactttattggtggctcagaccttttggatccggtgtgattcttggaggttacgaccgtgatggcccgcaattatatatggttgaaccttctggtgtttcctatagatattttggtgctgcaattgggaagggcaggcaggctgcaaaaaccgagattgaaaagttgaagctttctgagatgacatgtcgccagggtgttattgaagtagcaaaaataatctatggagtacatgatgaggcaaaggacaaaacatttgaattggagatgagttgggtttgtgacgaatcaaaccgccagcaccagaaggttccagaagcactgttggaggaagcaaaagcagctgctcaagcagcattggaagaaatggatgctgattaataataatattaaaatcccttcacattgtgtttcagcttaagataattatctaagattgtaacatttctgttttatcataacacgattcagattttcattatgctgactgccttgtcgacttttgcttatacccaaaattcaggtttgttttctttg

SEQ ID NO: 2777 - DNA, 1084 bp, Malus domestica
ttgtagctgtttgtttctcagtcgagcactcaacaaacaacaataaacagcagaaaaataaaaaagaagaagaagatgagcagcatcggaacaggttacgatctctccgtcaccacattctcccccgacggccgcgtcttccagatcgagtacgccgccaaagccgtcgacaactccgggactgttattgggatcaaatgtaaggacggcgttgttatgggtgtggaaaagctcatagcgtcgaagatgatgctgcccggttccaatagaaggattcattcagtccatcgccactccgggatggcagtggcaggattagctgcggatggtaggcaaattgttgctaggaccaagtctgaagccaccaactatgaaagtgtgtatggtgaacagattcctgttaaggaacttgctgaacgtgttgctagttatgtgcatttgtgtacactatattggtggctgagaccttttggatgtgggataatccttggtggttatgacagagatgggccgcaattatacatggttgaaccatctggtgtttcttataggtattttggtgctgcaattggaaaaggcaggcaggctgctaagacagagattgaaaagttgaagctttcggagttgacttgtcggcaaggcgttattgaagtagccaagatcatttatggaattcatgatgaggcaaaggacaaggagtttgagttagaaatgagctgggtctgtgatgaatcaaaccgtctgcatcagaaggttccggatgagcttctagaggaagcaaaggcagcggctaaagcagcattggaagaaatggatgcagattaagaagccgatgaaataatgtgttggtattctgaaaccctactagaagaacatcaacagaaaagggttaatgagataagattgatggattttcattagccaacttgggctgctgcagtatttcttgtacgttaaaatgttcaatttaccgacgttgtggtgcaaaccacatctgtaggatgcttgagaaacagtctcacttacattattatgcacattctccttttgaactgttgaagtaattctgttatttcaaaaaaaa

SEQ ID NO: 2778 - DNA, 902 bp, Ocimum basilicum
atttatgagcagcatcggcacgggatacgatctatcggtgaccactttctcgccggacggccgcgttttccagatcgagtatgccgccaaagccgtcgacaatagcggcaccgtcgtcgccatcagatgcaaggacggcgttgtcatgggagtggagaagctgattgcctcgaagatgatgttgcctggctccaatcgaagaatccacgccgttcatcgccactccggcatggctgttgctggattagctgcagatggcaggcagattgtgactcgagcaaagtctgaagcaaataactatgagagtgtttatggtgaacaaattccagttaaagaacttgcagaccgtgttgctagttacgtgcatttgtgcacactctattggtggctcaggccttttggttgtggggtaattctgggaggttatgacagggacggaccacagttgtacatgattgaaccatctgggatatcctatagatactttggtgcagccattggaaaggggagacaggctgctaaaacagagatcgaaaaattaaagctttcagaaatgacatgtcgacaaggtgtcatcgaggtggccaagattatttacggggtgcacgacgaggccaaggacaaagcctttgaactagaactgagctgggtatgcgatgagtcgaaccgccagcatcaaaaggtacccgacgtcttactcgaggaagccaaggaagcagctaaagctgcccttgaagaaatggatgcagattaggtttattcatagctcagctcctgtttctgctgcttccagttacgtcgatcatggtttttaaaatcagaaattcgaaggcgaaaacgacatcattgtcagattgtactaagcccttttggtcatttattcagtagactatatttgtggt

SEQ ID NO: 2779 - DNA, 1061 bp, Manihot esculenta
gagatcgaagaaaactcgccgagctctatttctactactgttattaggaagctaaagaacctaacaaaaatcacacagaggcaaagcgaaggctagaagatgagcagcattggaacaggttacgatctctcagtcaccactttctctcccgatggccgcgttttccagatcgaatacgctgccaaagccgtcgataacagcggtactgttattggaatcaagtgcaaggacggagttgttatggctgtagagaagctcattgcatctaagatgatgttgccgggttccaataggagaattcactctgttcatcgtcattctggcatggctgttgctggtttagcagctgatgggagacaaattgttgcacgagcaaagtctgaggcaaccaattatgaaagtgtttatggtgaacctattcctgtgaaggaacttgctgaacgcgttgctagttatgtgcatttgtgcactctctactggtggcttaggccatttggttgtggagtaattcttggtggttatgacagagatggaccccaattgtacatgattgagccatctggcatatcatataaatattttggtgctgctattgggaagggaaaacaagcagctaaaacagaaattgaaaagttgaagctttctgaaatgacttgccgagaaggtgttattgaagtagctaaaatcatttacaaggtgcatgatgaagcaaaggacaaggcctttgaattggaaatgagttgggtttgtgatgaatcaaatagacagcatcagaaggttcccgatgaactcttagaggaagccaagtctgctgctaggactgctcttgaagaaatggatgctgattaaagttaaaagtaacctgtttccctggatttcccttgtcattatccgagtccgttgggttcgtatttggagaactccatgtacaagtaatgtctgcaatccttttttccccttgttcttgtatggttaacatgtgcttaattggagcaggactattttaatatctctaggcaaaatcaatgaaattatttttgatactaatatttttgctttat

SEQ ID NO: 2780 - DNA, 829 bp, Centaurea maculosa
tcaaatcataaacaaaatcagcagccctaaaacaacaacaacaagatgagtaggataggaaccggttacgatctttccgtcacgaccttctcgccggacggtagggttttccagatcgagtacgctgctaaagccgtcgacaacagcggtaccgtcgtcggcatcaaatgcaaagacggcattgttatcggagtagagaagctgattgcgtccaagatgatgttgcctggatctaaccgtagaatccactccgtacatcgtcattctggaatgggtgtagcaggattagctgctgatgggaggcagattgtagcaagagccaaatctgaagctcacaattacgaaagcacttatggtgaacctattccaattaaagaacttgctgaccgtgttgctggttatgtgcatttgtgtacactatattggtggctaagaccttttggttctggtgtgattcttggaggttatgatcgtgatggcccacaattatatatggttgaaccttctggtgtttcctatagatattttggtgttgcaattgggaagggcaggcaggctgccaaaactgagattgaaaagttgaaactttctgagttgacttgtcgggaaggtgttattgaggtggcgaaaataatctatggagtacatgacgaggcgaaggacaaaacctttgagttggagatgagctgggtttgtgatgaatcaaaccgccagcaccagaaggttccagaagcacttttggaggaagcgaaagctgcagctcaagcagcattggaagaaatggatgctgattaatgataatagatcttttctccctttgtgtttgcct

SEQ ID NO: 2781 - DNA, 1004 bp, Centaurea maculosa
ggcgggggctataactttgccccctttctttctttctttcttccaaatcagaagccattaaccaaaatcagtagcaccaaatttcgacctagaaaaacaatgagtagcataggaacaggttacgatctctcagttacgaccttctcgccggacggtagggtttttcagatcgagtacgctgctaaagccgtcgacaatagcggaaccgtcgtcggaatcaaatgcaaagatggcattgttattggagtagagaagctgattgcatccaagatgatgttgcctggatctaatcgtagaatccactccgtacatcgtcattctggaatgggtgtagcaggattagctgcagatgggagacagattgttgcaagagccaaatctgaagcccataactacgaaagtgtttatggtgaaccaattccagttaaagaacttgctgagcgagtagctagttatgtgcatctatgcacactttattggtggctcagaccttttggatctggggtgattcttggaggttacgaccgcgatggcccacagttgtatatggttgaaccttctggtgtttcctatagatattttggtgctgcaattggaaagggcaggcaggctgctaaaactgagattgaaaagttgaagctttctgagatgacatgtcgccaaggagttattgaagtagcaaaaataatctatggagtacatgatgaggcaaaggacaagacatttgaattggagatgagttgggtttgtgacgaatcaaaccgcctgcaccagaaggtaccagaagcacttttggaggaggcaaaggcagcagctaaagcagcattggaagaaatggatgctgattaatatgatagatagatagatgtgatgtctcctccctttgtgtttgtttgaaccttcgatttgaaatgttactcgtaagacctcggcatatttaagtttgcttgttattagcggctatgatttgtaacattttggttttattggaacactttgcatca

SEQ ID NO: 2782 - DNA, 1134 bp, Coffea canephora
aacccccataggaattaggatcctctcaataagaggagaacccacacaaacactaaccaagaagaacgaagcaatttttattgttaaagagttaaatctgcaaaaacagtaagcggaatcagaatccggccagcaatcaaaaagaatactcgcaaaagtagaatgagcagcataggcaccggctacgacctatcagtcaccaccttctcccctgatggccgggtttttcagatcgagtacgccgccaaggccgtcgacaacagcggcaccgttgtcggcatcaagtgcaaggacggcgttgtcctgggagtggagaagctcattgcgtcaaaaatgatgctgcccgggtccaatcggagaatccatgctgttcaccgccactccggcatggccgttgctggattggccgcagacgggaggcaaattgttgcacgagctaaatctgaggcaaccaattacgaaagtgtgtatggagagcaaattcctgtgaaagagcttgcagaccgtgttgctagttatgttcatctatgtacactgtattggtggctcaggccctttggatgtggagtaatattaggagggtatgacagagatggaccacagctatacatggttgaaccttctggtgtttctcataggtactttggcacgtcaattgggaaaggcaggcaggctgctaagacagagattgaaaaactgaagctttctgaaatgacatgccgtcaaggggttattgaggtagcaaaaataatttatggagtgcacgatgaggcaaaggacaaggcctttgaattggaaatgagttgggtgtgcgatgagtcaaatcgtcagcatcagaaggttcccgatgatcttttagaagaagccaaagcagcagctaaagccgcacttgaggaaatggatgctgattaggagctcaaagcatatgcttcctgctcttttagtctttcacttttttgagagcatatactcatctcgaaaaaccctattctaatgcattaacagatgccaaacaaaaaccgcatgtttttgtaccctgaattttttgggttatttgggtggcttctctcaatgaggatttcaaattgttgattgcctgctgattagttagtgatttctaacgagcatccttct

SEQ ID NO: 2783 - DNA, 930 bp, Taraxacum officinale
ggccgggggaaacccaatcgaacgagaagtcactaaaccaaaatcagtagtagcaaattcgccctaaaagaaaatgagcagcataggaacaggttacgatctatcggttacaaccttctcgccggacggtagggtttttcagatcgagtacgctgctaaagctgttgataatagcggcacagtcgtcggcatcaaatgcaaagatggcattgttattggagtagagaagctgattgcgtcgaagatgatgttgcctggatctaatcgtagaatccactccgtgcatcgtcattctgggatgggtgtagctggattagctgcagacggcagacagattgttgcaagagccaaatccgaagcgcaaaactatgaaagtacttatggtgaaccaattccagttaaagaacttgctgaccgtgtcgcaagttatgtgcatttgtgcacactttattggtggctcagaccttttggatctggagtgattcttggaggttatgaccgtgatggcccacagttgtacatggttgaaccttctggtgtttcctatagatattttggggctgcaattgggaagggcaggcaggctgctaaaacggagattgaaaagttgaagctttcggagatgagctgtcgtcaaggggttattgaagtagcaaaaataatctatggagtacatgacgaggcaaaggacaagacttttgaactggagatgagctgggtctgtgatgaatcaaaccgtcagcaccagaaggtaccggaaacacttttggaggaggcaaaagctgcagctaaagcagccttggaagaaatggatgctgattaataaatatacatattacatatgtttgttgttatcagacactcttggatttcaaattcttagacatggtgatgggcatattttaagtttggttttatcatcccaagata

SEQ ID NO: 2784 - DNA, 1397 bp, Vitis vinifera
aaaaaccccaaattggaagagaggtagggatcaagtgtagtcgacccaacatctgccctgccctatttcttgagaacgaagccacctcagtctacatagaaaaagaaccggagagattgggaagagaaaaggaggaagaaggagagtggaaagatgagcagcataggaactggatacgatctctctgtcaccacattctctcctgatggccgcgttttccagatcgaatacgccgccaaagctgtcgataacagcgggactgtcattgggattaaatgcaaagatgggattgtcttgggagtagagaagcttatagcgtccaagatgatgttgccgggttccaatagaagaattcattctgtgcatcgccattctggcatggctgtagccggactagctgcagatgggaggcaaattgttgcacgagccaaggctgaagccaccaattatcaaagtgtgtatggtgaagcaattcctgtgaaggaacttgccgaacgagtggctagttatgtgcatttatgtaccctatactggtggctcagaccttttggatgtggagtaattcttggaggttatgacagagatggaccacaattgtacatggttgaaccttctggtgtttcctataggtactttggtgctgcaattggaaaaggcagacaggctgctaaaacagagattgagaagttgaagctttctgaattgtcttgtcggcaaggggttattgaagtagccaagatcatttatggggtacacgatgaggccaaggacaaggcatttgagttggaaatgagctgggtttgtgaggagtcaaaccgccagcatcagaaggttcctgatgaccttttagaggaagccaaggcagcagctaaagcagctctggaagaaatggatgcagattagttggacggacctaagcattcatgggtccacctctactctgctctttaaacttttttatttggcttgcccaaatggtttgttgtgacaaattaatgcttaatttctagtgaaatttgcaaaatgtagtgtggctcagattggtggatttttttgttacaatgggtattctactgatgtatcagtattattaccagttaaaatattttctatttttcctccaaggttcatttggcacttgtccggtttagccagagaggatgctcatatggttcgtaagagagggtgcagggtctacggcatcaggtagactctacgttatcttgggaattcaagtgaaacatactattaatagtcctcacttttcacaaataaagtacattacagatctactatgcaagggaaaaatgcaatatgctagtggtattagtgctcctacgatgagtggcaaagacttgtagcctgtggcaatgatcctattgaaactgctcaactat

SEQ ID NO: 2785 - DNA, 1002 bp, Vitis vinifera
gaggtagggatcaagtgtagtcgacccaacatctgccctgccctatttcttgagaacgaagccacctcagtctacatagaaaaagaaccggagagattgggaagagaaaaggaggaagaaggagagtggaaagatgagcagcataggaactggatacgatctctctgtcaccacattctctcctgatggccgcgttttccagatcgaatacgccgccaaagctgtcgataacagcgggactgtcattgggattaaatgcaaagatgggattgtcttgggagtagagaagcttatagcgtccaagatgatgttgccgggttccaatagaagaattcattctgtgcatcgccattctggcatggctgtagccggactagctgcagatgggaggcaaattgttgcacgagccaaggctgaagccaccaattatcaaagtgtgtatggtgaagcaattcctgtgaaggaacttgccgaacgagtggctagttatgtgcatttatgtaccctatactggtggctcagaccttttggatgtggagtaattcttggaggttatgacagagatggaccacaattgtacatggttgaaccttctggtgtttcctataggtactttggtgctgcaattggaaaaggcagacaggctgctaaaacagagattgagaagttgaagctttctgaattgtcttgtcgacaaggggttattgaagtagccaagatcatttatggggtacacgatgaggccaaggacaaggcatttgagttggaaatgagctgggtttgtgaggagtcaaaccgccagcatcagaaggttcctgatgaccttttagaggaagccaaggcagcagctaaagcagctctggaagaaatggatgcagattagttggacggacctaagcattcatgggtccacctctactctgctctttaaacttttttatttggcttgcccaaatggtttgttgtgacaaattaatgcttaatttctagtgaaattaaatg

SEQ ID NO: 2786 - DNA, 953 bp, Lactuca sativa
aaacgagaagccagtaaacaaaatcagtagtagcaaaatcgccctagaagaagatgagtagcataggaacaggttacgatctatcggttacaaccttctcaccggacggtagggtttttcagatcgagtacgctgctaaagctgtcgataacagcggcaccgtcgtcggcatcaaatgcaaagatggcattgttattggagtagagaagctgattgcgtcgaagatgatgttgcctggatctaatcgtagaatccactccgtgcatcgtcattctgggatgggtgtagccggattagctgcagacgggagacagattgttgcaagagccaaatctgaagcccaaaactatgaaagtacttatggcgaaccaattccagttaaagaacttgctgagcgtgttgctagctatgtgcatctatgcacactttattggtggctcagaccttttggatctggggtgattcttggaggttatgaccgtgatggcccacagttatatatggttgaaccttccggtgtttcctatagatattttggagctgcaattgggaagggaaggcaggctgctaaaacggagattgaaaagttgaagctttctgagatgacctgtcgtcaaggggttattgaagtagcaaaaataatctatggagtacatgatgaggcaaaggacaagacctttgaattggagatgagttgggtctgtgatgaatcaaaccgccagcaccagaaggtacccgaagcacttttggaggaggcaaaagcagcagctaaagcagcattggaagaaatggatgctgattaagatcccttaataatatattactccccctttgtgtttgtggttgtcttactcttggatttaaatttgttagacaccttgatccagcatattttaagtttggttgctattaatcatcaaagattgtagtatttcacaacactttaaaatttt

SEQ ID NO: 2787 - DNA, 854 bp, Liriodendron tulipifera
  misc_feature (557)..(557): n is a, c, g, or t
  misc_feature (740)..(740): n is a, c, g, or t
  misc_feature (817)..(818): n is a, c, g, or t
  misc_feature (829)..(829): n is a, c, g, or t
aagaaatctctctccctcgccttcgatcttgaagacttcggtaaaaatcgagaaaaatgtctagtataggaactggttatgatctctctgtcaccacattttcgcccgatgggagagttttccagattgaatacgccgcgaaggccgtcgataacagcgggactgttatcggcatcaagtgcaaagatggtatagttatgggtgtggagaagctcattgcttcaaaaatgatgttaccagggtcgaaccggagaatccactccgttcatcgtcattctggcatggctgtggctggattagcagccgatggcaggcagattgttgcacgcgccaagtctgaagcaactagctatgagagtgtctatggtgagcccataccagtgaaagaacttgccgaccgcgttgctagctatgtgcatctgtgcacgctctattggtggctaagaccgttcggatgtggagtaattcttggagggtatgatagagatggacctcagctatacatggtcgagccatctggagtttcctataggtattttggtgctgcaatcgggaanggaaggcagggtgcaaaaacggatattgaaaagctgaagctttcagaaatgacctgcagggaaggtgttattgaagttgcaaagatcatttacaaactacacgacgaggcaaaggacaaagcctttgaattggaaatgagttgggtctgtgatgagtcaaaacgcctacatcagaaggtcccngatgatcttttggaggaagccaaggcagcagccaaagcagcactggaggaaatggatgcagattaatcaaatgacanncaaaacttccntatcttctacatcacgtggttttta

SEQ ID NO: 2788 - DNA, 1604 bp, Quercus alba
ttcggggtataataataaacatttgccatatttcttgagaagaaagaaatatcggtagacaaaaagcaaaaggccccttctcccactggtctttttagcactgtttttataaacacacacatatagtacagaagaagaagaagagcaagaagaatcgaaagacaaagataagaatatgagtagcataggaacaggatacgaccttgcggtcaccactttctctccagatggtcgtgttttccagatcgaatacgctgccaaagccgtcgacaacagcgggactgttattggaatcaaatgcaaagatgggattgttatgggtgtggagaagctaatagcatcgaagatgatgttgcctggttccaatagaagaattcatgctgttcatcgccactccggaatggctgtggcaggactagcagcagacggaaggcaaattgttgcccgggccaagtctgaagctagtaattatgaaagtacgtatggcgaaccaattcctatcaaggaacttgctgaccgtgttgctagttacgtgcatctgtgtacgctttattggtggctgagaccttttggatgtggagttattcttggaggctatgacagagatggaccacagctgtacatggttgaaccatctggtgtctcatataggtactttggtgctgcaattggcaagggcagacaggcagctaaaacagagatcgaaaagttgaagctttcagaattgacttgccgccaaggggttattgaagtagccaaaatcatttatggagtacatgatgaggcaaaggacaaggacttcgaattggaattgagttgggtctgtgacgagtcaaaccgtctgcatcagaaggtaccagatgagcttctacaggaagctaaggcagcggccaaagcagccttggaagaaatggatgcagattagtagagcattgccattgttaacttatttttacatggttgcatctgaaattgtctttatatcattccagaacatcctcaaaatgtgttatggcatagactggtgctttttatcttttagacattgatctttattatgttacagtatttgagataaatgtttattcctatcaattggcagtaggaaaccatctttttctgtttttgatagaactgtacgtgctagtctaattgtgtctctaatcttcttttgttctaattgtgtctctaatcttcttatgttgccctgttaagtatcgattttttttccctcatcctttttatttatttattttatagttttgaaagtttatttccagaacttctatagtttatttatttcaaagcgatttgaaaagaaaataattataatattttggaaatattattcttatgttattttataaatgtcatgcattatccagatttaaaatattcaatttgcttcatgagcacaaacctttttccaaaactaatttgtggtcagtttaattgccacaattcagttcgatagtggcaattatatatgcacaattgtctgtctggtagtaaatagtagatggataatagcaagagatggagaaggaatcagaagaagactcagagatgcaggaaaactttcaatctttggtaagcgtgaatat

SEQ ID NO: 2789 - DNA, 953 bp, Petunia hybrida
cagcataggaacaggatatgacttatcggtgacgactttctcaccggacggtagagtttttcagatcgaatacgccgccaaagctgtcgataacagcggtactgttatcggtatcaaatgcaaagacggcatcgttttgggagtggagaagctaatagcttccaagatgatgctccccggatccaatcgtcgtattcactccattcatcgccactccggcatggctgttgcaggtttggctgcagatgggaggcaaattgttgcccgggctaagtctgaagcaaccaactttgagagtgtatatggtgaaccaattccggtaaaagagcttgcagaacgtgttgctagttatgttcatctatgcacactttactggtggctcaggccttttggatgtggggtgatccttggaggttacgacagagatggacctcaactttacatggttgagccgtctggtgtctcctataggtactttggtgctgctattggtaagggtagacaagctgctaagacagaaattgaaaagttgaagctctctgaaatgacgtgtcggcaaggggtaattgaggtagccaaaataatttatggagtgcatgatgaggcaaaggacaaggcatttgaactggaaatgagttgggtatgtgatgagtctaaccggcagcatcagaaggttcctgaagatcttttagaggaagctaaggctgcagctaaagctgctcttgaagagatggatgcagattaattgcgcaaatacacttcttcatttattcatgcatctacttttcgacaaccgatatgtttggaatttggcacctgtatgattattaattctagtgatgaaagagttgctatttattccttttcaactgttgaactgtaatctttacactaaatttgctaagatcaccaagaggatagttatgttctcatttgaggaattctcattttaa

SEQ ID NO: 2790 - DNA, 1196 bp, Prunus persica
atggacgagccctgtacggcctgtttattaaatagttggactctaaacgagctgaaacggccgtctaacacctctaagaatggcaaaaaaagccagtgtctctctatttgtagctttctcagtcgagctctcaacaacactcgacccaaaagaagaaagatgagcagcattggaacaggttacgatctctccgtcaccacattttctcctgatggccgcgtcttccagatcgagtacgccgccaaagccgttgacaactccgggactgttattgggatcaaatgtaaggacggcgttgttatgggtgttgaaaagcttatagcgtcgaagatgatgttgccaggttccaatagaaggattcattctgttcatcgccactccggcatggcagttgctggattagcagcagatggaaggcaaattgttgccaggaccaagtctgaagctaacaactatgaaagtgtgtatggtgaacagattcctgttaaggaacttgccgaacgtgttgctagctatgtgcatttgtgtacgctatattggtggctcagaccttttggatgtgggataatccttggaggttatgacagagatgggccacaactgtacatggttgaaccttccggcatttcttataggtattttggtgctgcaattggaaagggcaggcaggctgctaagactgagattgaaaagttgaagctctcggaattgacttgtcggcaaggtgttattgaagtagccaagatcatttatggaatccatgatgaggcaaaggacaaggactttgaattagaaatgagctgggtctgtgatgaatcaaaccgtcagcatcagaaggttccagatgagcttctagaggaagcaaaggcagcagctagagcagcattggaagaaatggatgcagattagaaagctaatgataatatgttattattctgatggttttatttcagtgagtccttgtgcctactcaaacaagtatgtctagaaagaaaaaaaaaaaaaaaaaaaggggttaatgggataagattgatggattttcattagccaatttgactgctgtagtagtcttgtaccttatgctgttcaatttaccaagattgcggtgcaaactgtatctgtaggatgtttgagaaacagagtttcactttcattacgcacgtttgcccttttactgctaatggtaattctgttat

SEQ ID NO: 2791 - DNA, 1163 bp, Glycine max
atattcttcattcctctggggtgctgcacaacgaaactcacagaagaaagaagaaaaagaagcgaaactaaagtcagcattcgaaaaagatgagtagcatcggtacaggttacgatctatcggtcaccactttctcccctgatggccgcgttttccagatcgagtatgccgctaaagccgtcgacaacagcgggactgttattgggatcaagtgcaaagatggggttgtgttgggcgttgagaagcttattccgtcgaaaatgatgcttccgggttccaatagaagaatacactccgttcatcgtcactctgggatggctgtagcaggattagcagctgatggcagacaaattgttgccagggctaagtctgaagctactaactatgacagcgtatatggcgaaccaattcctgttaaggaacttgctgaccgtgtggctagttatgtgcacctctgtacgctatattggtggctcagaccttttggatgtggtgtcatactaggaggttatgacagggatggaccacagttgtacatggttgaaccttccggtgtttcctatagatatttcggtgctgcaattgggaagggcaggcaggctgctaaaacagagattgaaaagttaaagcttgctgatatgacatgtcgacaaggggttattgaagtggctaaaattatatatggagttcatgatgaggcaaaggacaaagattttgagctagaaatgagctgggtgtgtgatgagtcaaaccgccaacatgagaaggtcccggatgagcttctagaagaagcaaaggcagctgccaaagcagctcttgaagaaatggatgcagattaatagactagaaatgtttatttcaaagttgcatttcataacttgtaattgagcatttggaacatctataggaaatacaaggcttcgatagtcggattttgtatgcttcttgatgaattaatgcccttgttgatttcctgttactgggagaattgttttgaagttctttagattctgacctttattgatttgtgttgaattctctgtcaaatcctttatgctaatgtgcacatcattgagtttcctttattttactcgtcatttgtgcgcattcctttttgcttgcataggatttgaaccatcaaatattcaggaacactttcaaca

SEQ ID NO: 2792 - DNA, 1420 bp, Fragaria vesca
aatttactgaattctcttcctcactagttttcttcttctctacgacgcctcacaatcgtccgcctccggccacaaaccaagttgcccgccgcctccgttttgtagttgacaaacacccagaagaagatggctagcataggaacaggctacgatctctcagtcaccacattttctcctgatggccgtgtcttccagattgaatacgctaccaaagccgttgacaactctgggactgtaattgggatcaaatgcaaggatggagttgttatgggtgtggaaaagctcatagcatcaaagatgatgctgcctggttccaacaggagaatccattctgttgatcgccactctggcatggcagtggcaggattagcagctgatggcaggcagattgttgccaggacaaagtctgaagctaccaactatgaaaatgtctatggtgaacagattcctatcaaggaacttgctgatcgtgttgccagttatgtgcatctgtgcacactatattggtggctcagaccttttggatgcgggatcatccttggaggttatgacagagatgggccgcaattgtacatggttgaaccttctggtgtttcttacaagtattttggtgcagcaattgggaagggaaggcaatctgctaaaactgagattgaaaagttgaagctttcagaattgacttgtcggcaaggtgttattgaagtagccaagatcatttatggaatacatgatgaggcgaaggacaaggactttgaattggaaatgagctgggtatgtgatgaatcgaaccatcagcatcagaaggttccagatgcacttctagaggaagcaaaggcagcggcaagagcagcattggaagaaatggatgcagattaattgaagctggaggatatttgggagaacagagtttaccttccaaaataaacaaatcttcgtcgtgttttctttgttctgatgaacttggctttgctgttcctttctatttactttcaggttatcgggcttttagatacttatgcaccattaagtagtttcgtttagtttcatctatgaaattgttatcgacacagtgaaaatgtcatccggcactttttctatttgtgatttaatcgttttatggcatactgaaactagcccttgattgaatgacagaagtttctcctcaacgtttgctcgagacttggtgacttccaaccaactggtttgtgcagtcgatggaagaaaatatgatagtagatctgcttgatatatttgcatatcccatttttggtgggaaatgatatctgtagtccaagttcaggagggaagatggtacgttttgtggtgggaattgatatctgtagtgcacgttcaggagggaaatggctacttcagtcccttgatggcggagctccgccggtcacaaacgaggtcagtaaca

SEQ ID NO: 2793 - DNA, 990 bp, Nicotiana tabacum
gaactcaactgaatcagtagaagctctagtagagaagaaaagaagggagaaatggccagcataggaacaggttatgacttatcggtgacgacattctcgccggacggcagagtatttcagatcgaatacgccggcaaagctgtcgataacagcggcactgttgtcggcatcaaatgcaaggacggaatcgtcttgggagtggagaagctaatagcatccaagatgatgttgcctggatcaaatcggagaattcactctgttcatcgccattccggcatggctgttgcaggcttggctgcagatgggaggcaaattgttgcccgggctaaatctgaagcaaccaatttcgaaagtacatatggtgagccaattccagtgaaagaacttgcggaacgcgttgctagttatgtgcatttatgcacactgtattggtggctcaggcctttcggatgtggggtgattcttggagggtatgatagagatggacctcaactatacctggttgagccttctggtgtctcatacaggtactttggtgctgctattggaaagggaagacaagctgctaaaacagaaattgaaaaattgaagttatcggagatgacctgtcgacaaggggtgattgaggtggccaaaataatttatggagtacatgatgaggcaaaggacaaggcatttgaacttgaaatgagttggatatgtgacgagtccaaccgccaacatcagaaggttcctgatgatattttagaggaagcgaagactgcagctaaagctgcccttgaagagatggatgcagattagtgatcctaatacactaagtactttctttcttcttgcatctgtttctcatgtccttattgaatggtccctctctgccatgttattactgttggtgatgaaagcgatttacaatttattttaactttgaattggaagcttacaactgaagttcaaaaaatcgagagtattagtttggatttacaaactatg

SEQ ID NO: 2794 - DNA, 870 bp, Ambrosia trifida
ctagaagaagaagaagaagaatgagtagcataggaacaggttacgatctatccgtcacaacgttctcgccggaccggagggttttccagatcgagtacgcagctaaagccgtcgacaacagcggtaccgtcgtcggtatcaaatgcaaagacggcattgttattggagtagaaaagctgattgcgtcgaagatgatgttgcctggatcaaatcgtagaattcattcagtccatcgtcattctgggatgggggtagctgggttagctgcagacgggaggcagattgttgcaagagccaaatctgaagcccacaactatgaaagtacctatggcgaacctattccaattaaagaacttgctgaccgtgttgctagctatgtgcatctttgcacactttattggtggctcagaccttttggatccggtgtgattcttggaggttacgaccgtgatggcccacaattatatatggttgaaccttctggtgtttcctatagatattttggtgctgcaattgggaagggcaggcaggctgcaaaaaccgagattgaaaagttgaagctttctgagctgacatgtcgtcagggtgttattgaagtagcaaaaataatctatggagtacacgacgaggcaaaggacaaaacatttgaattggagatgagttgggtctgtgacgaatcaaaccgccagcaccagaaggttccagaagcactttggaggaagcaaaagcagctgctcaagcagcattggaagaaatggatgctgattaagaataataatgttaaaatctctttacattgtgtttcaatttaagatgagtatctaagattgtaacatttctgttttatcataacaacattcagattttcaa

SEQ ID NO: 2795 - DNA, 1070 bp, Fagus grandifolia
aaccactctttaaagcacaaaacacagactcacagaaacaacaatcagaaacaatatgagcagcataggaacaggctacgatctcgccgttaccacttttctcccccgatggccgcgtcttccagatcgagtacgccgccaaagctgtagacaatagcgggactgttattggcattaaatgcaaagatgggattgtaatgggtgtggagaagctaattgcatcgaaaatgatgctacctggttccaatagaagaattcattctgttcatcgccactctggaatggcagtggcaggactagcagcagatgggagcaaattgttgcccgggcaagtctgaagctaatagttatgaaagtgtgtatggcgaaccagtccctatcaaggaacttgctgaccgtgttgctagttacgtgcatctgtgtacactatattggtggctgagaccttttgggtgtggagttattcttggaggctatgacagagatggaccacaactttacatggttgaaccatctggtgtctcttataggtactttggtgctgcaattggcaagggaagacaggcagctaaaacagagatcgaaaagttgaagctttcagatatgacttgccgtcaaggggttattgaagtagccaaaatcatttatggagtgcatgatgaggcgaaggacaaggagttcgaattggaattgagttgggtttgtgatgagtcaaaccgtcagcatcagaaggtaccagatgagcttttacaggaagctaaggcagcggccaaagcagctttggaagaaatggatgcagattagtagatcatcaccattgttaacttctgttttttatttaaatggttgcatctcaagttgattagatcatttgagaacatccacaaaatattttatggtgtagactggagcttttttttcttcttctttcttttagacattgatctttattgccgttacagtattgcagataaatgtttaatcttcctatctcttgacaacagcaagctatcttttactgtttttgatagaactttacttgccagtctaattttctcccaagattcact

SEQ ID NO: 2796 - DNA, 958 bp, Cirsium arvense
tcagaagccattaaaccaaaatcagtagcaccaatttcgacctagaaaaaccatgagtagcataggaacaggttacgatctatcggttacaaccttctcgccggacggtagggttttcagatcgagtacgctgctaaagccgtcgacaatagcggcaccgtcgtcggcatcaaatgcaaagatggcattgttattggagtagagaagctgattgcgtcaaagatgatgttgcctggatctaatcgtagaatccactccgtgcatcgtcattctggaatgggtgtagcaggattagctgctgatgggagacagattgttgcaagagccaaatctgaagccaataactatgaaagtacttatggtgaaccaattccagttaaagaacttgctgagcgagtcgctagttatgtgcatctatgcacactttattggtggctcagaccttttggatctggggtgattcttggaggttacgaccgcgatggcccacagttgtatatggttgaaccttctggtgtttcctatagatattttggtgctgcaattggaaagggcaggcaggctgctaaaactgagattgaaaagttgaagctttctgagatgacatgtcgccaaggagttattgaagtagcaaaaataatctatggagtacatgatgaggcaaaggacaagacatttgaattggagatgagttgggtttgtgacgaatcaaaccgccagcaccagaaggtaccagaagcacttttggaggaggcaaaggcagcagctaaagcagcattggaagaaatggatgctgattaatatgatagatagatagatgtgatgtctcctccctttgtgtttgtttgaaccttcgattttaaatgttactcgtaagaccttggcatatttaagtttgcttgttattagcggctatgatttgtaacattttggttttattggaacactttgcatcaaa

SEQ ID NO: 2797 - DNA, 1090 bp, Malus domestica
aagccaatgtctctttaattgtagctgtttgcttctctcagtcgaacactctccaaacaacaataaacagcagaaaaaaggaagaagatgagcagcatcggaacaggttacgatctctccgtcaccacattctcccccgacggccgcgtcttccagatcgagtacgccgccaaagccgtcgacaactccgggactgtcattgggatcaaatgtaaggacggcgttgttatgggtgtggaaaagctcatagcgtcgaagatgatgctgcccggttctaatagaaggattcattcagttcatcgccactccgggatggcagtggcaggattagctgcagatggtaggcaaattgttgctaggaccaagtctgaagccaccaactatgaaagtgtgtatggtgaacagattcctgttaaggaacttgctgaacgtgttgctagttatgtgcatttgtgtacactatattggtggctcagaccttttggatgtgggataatccttggtggttatgacagagatgggccacaattgtacatggttgaaccttctggtgtttcttataggtattttggtgctgcaattggaaagggcaggcaggctgccaagacagagattgaaaagttgaagctttcggagttgacttgtcggcaaggagttattgaagtagccaagatcatttatggaattcatgatgaggcaaaggacaaggaatttgagttagaaatgagctgggtctgtgacgaatcaaaccgtctgcatcagaaggttccagatgagcttctagaggaagcaaaggcagcggctaaagcagcattggaagatatggatgcagattaagaagctgatgaaataatgtgttaatattctgaaaccctactagaagaacatcaacagaaaagggttaatgagataagattgatggattttcattagccaatttgagctgctgtagtatttcttgtacgttaaaatgttcaatttaccgaagacgtggtgcaaaccgcatctgtaggatgtttgagaaacagagtttcacttacattattatgcactctccttattaactgctgaagtatttctgtttttttca

SEQ ID NO: 2798 - DNA, 981 bp, Rosa hybrid cultivar
tcactagttttcttcctctctacgacgcctacgcttcctctttccctcaccaccgtccggctccgaccagaaaccaagacgcccaccgcctccgctttgtagcacaagaaaacccagaacaagaagatgagtagcataggaacaggctacgatctctcagtcaccacattttctcctgatggccgtgtattccagattgagtatgcaaccaaagctgttgacaactccgggactgttattgggatcaaatgcaaggatggagttgttatgggtgtggaaaagctcattgcatcaaagatgatgctgcctggttccaacagaagaattcattctgttcatcgccactctggcatggccgtggcaggattagcagctgatggcaggcagattgttgccaggacaaagtcggaagctaccaactatgaaaatgtgtatggtgatcagattcctatcaaggaacttgctgaacgtgttgccagttatgtgcatctgtgcacactatattggtggctcagaccttttggatgtgggatcatccttggaggttatgacagagatgggccacaattgtacatggttgaaccttctggtgtttcttacaggtattttggtgcagcaattgggaagggaaggcaggctgctaaaacagagattgaaaagttgaagctttcagaattgacttgtcggcaaggtgttattgaagtagccaagatcatttatggaatacacgatgaggcgaaggacaaagactttgaattggaaatgagctgggtctgcgatgaatcgaaccgtctgcatcagaaggttccagatgagcttctagaggaagcaaaggcagcggcaagagcagcattggaagaaatggatgcagactaattgaagctggaggatgtttgggagaacagagtttcacttccaaaataaacaaaactttggcgtgttttctttgtcctgatgaacttggctttactgttcctttct

SEQ ID NO: 2799 - DNA, 1028 bp, Helianthus annuus
cccctctcttcagttcacttctttcaacccctaatcgagccacaaatcagtaacctaaaaacaccagtaaccaccaatttagccctagaacgagcacgatgagcagcataggaaccggttacgatctatcggtcacaaccttctcgccggacggtagggttttccagatcgagtacgccgctaaagccgttgataacagcggcaccgtcgtcggaattaaatgcaaggacggcattgttattggagtagagaagctgattgcgtcgaagatgatgttgcctggatctaatcgtagaattcattcggtgcatcgtcattctgggatgggtgtagctggattagctgcagatgggagacagattgttgcaagagccaaatctgaagcccacaactatgaaagtacctatggtgaacctattccaatcaaagaacttgctgagcgtgttgctagttatgtgcatctttgcacactttattggtggctcagaccttttggatccggtgtgattcttggaggttacgaccgtgatggcccgcaattatatatggttgaaccttctggtgtttcctatagatattatggtgctgcaattgggaagggcaggcaggctgcaaaaaccgagattgaaaagttgaagctttctgagatgacatgtcgccagggtgttattgaagtagcaaaaataatctatggagtacatgatgaggcaaaggacaaaacatttgaattggagatgagttgggtttgtgacgaatcaaaccgccagcaccagaaggttccagaagcactgttggaggaagcaaaagcagctgctcaagcagcattggaagaaatggatgctgattaataataataataaaatcccttcacattgtgtttcagcttaagataattatctaagattgtaacatttctgttttatcataacacaattcagattttcattatgctgactgccttgtcgacttttgcttatacccaaaattcaggtttgttttctttgatgaactaagaccaaaattggttt

SEQ ID NO: 2800 - DNA, 960 bp, Tabernaemontana elegans
ccctcaaacgaatacataatcactcgccgaactttgggtagcaaaagaggatttcaaagaacaagagtaaagagaaaaacgatgagcagcataggcactggctacgatctctcagtgacaacgttctccccggatggccgagtttttcaaatcgagtacgccgccaaggctgttgacaatagtggcaccgtcatcggtatcaagtgcaaggatggaattgttttgggagtggagaaactcatagcttctaagatgatgctgcccgggtccaatcggagaatccatgctgttcatcgccattccgggatggctgttgctggattagctgctgatgggcgtcagattgttgcccgagcaaaggctgaagcaaccaattatgaaagtacatacggagaaccaattcctgttaaagagcttgcagaacgtgttgccagttatgtgcatctatgtacactttactggtggctcaggccttttggatgcggggtaatactaggaggttatgacagagatggaccacaactgtacgtggttgaaccttctggtgtttcttatagatacttcggtgctgcaattgggaagggcaggcaggctgctaaaacagagattgaaaaattgaatctttcggagatgacttgccgtcaaggggttgttgaggtggccaagataatatatggaattcacgacgaggcaaaggataaggcctttgaattggaaatgagttgggtttgtgatgagtcaaaccaccagcatcagaaggttccagataagctttcagaggaagccaaagctgcagccagggctgcacttgaggaaatggatgcggattagtagctcaaaacacatgcccatttctgttgcaagtttcatttattcagcgatgtgtcctgaaatggatttgtcattaggatataatttattggtacgaactgcagtttggtacttttgttcttcttcttc

SEQ ID NO: 2801 - DNA, 1014 bp, Tabernaemontana elegans
tcttgacaacaaagaaactctctcccgattctaattacatcaacggagggtctccctctcaaaatagaattgagacaaccattagaaggaactgttggtagcaaaagaagattccagaagaagagcaaagaggaaaacaatgagcagcataggcactggatacgatctctcagtcaccacgttctcccccgatggccgagtttttcagatcgagtacgccgccaaggccgttgacaacagtggcaccgtcattggtatcaagtgcaaggatggcgtcgttttgggggtggagaagctgatagcttctaagatgatgttgccggggtccaatcggagaattcatgccgttcatcgccattctggcacggctgttgctggattagctgctgatgggcggcagattgtggcccgagcaaaggctgaagcaaccagctatgaaagtacatacggagaaccaattcctgtgaaagagctcgcagaacgtgttgccagttatgtgcatttatgtacactttattggtggctcaggccttttggatgtggggtaatactaggaggttatgacagagatggaccacaactgtacatgattgaaccttctggtgtttcgtataggtacttcggcgctgcaattgggaagggcaggcaggctgctaaaacagagattgaaaaattgaatcttccggagatgacttgccgtcaaggggttgttgaggtggccaagataatatatggaatacacgacgaagcgaaggataaggcctttgaattggaaatgagttgggtttgtgatgagtcaaaccgccagcagcagaaggttccagataagcttttggaggaagccaaagcggcagccagggctgcactcgaggaaatggatgccgattagtagctcaaaagacataacccatttctctttcaagtttcatttattcagtgatgtgttctgatgtcgatttgtcattagcatattatttttggtgggaactggagtttggcacttttgctcttctt

SEQ ID NO: 2802 - DNA, 1128 bp, Vinca minor
gggctttttctcctataaaaagagaaataataaggggacacacaaacagtggtgagaattgggaggaacaaccaaccagagccggaagaatcatcggaagagattagtagtagcagtaaagaagaagaagaatgagtagtatcgggacagggtacgatctgtcggtgacaacattctcaccagatggaagagtttttcagatcgagtacgctgccaaggccgttgacaacagtggtaccgttatcggtatcaagtgcaaggacggcgtcgttctgggagttgagaagctcattgcttccaagatgatgttgcccggttccaatcgcagaatccatgccgttcatcgccattccggcatggctgttgctggattagctgctgatggccgacagattgtagcccgagcaaaatctgaagcaactaactatgaaagtacgtatggagaaccaattcctgtgaaagagcttgcagaacgtgttgccagttatgtgcatttatgtacactttattggtggctcaggccttttggatgcggagtaatactaggaggttatgacagagatggaccacaattgtacatggttgaaccttctggtgtttcttatagatactttggtgctgcaattgggaagggcaggcaggctgccaaaacggagattgaaaaattgaatctttccgggatgacttgtcgtcaaggggttgttgaggtggcaaagataatatatggaatacacgatgaggcaaaggacaaggcctttgagttggagatgagttgggtttgtgatgagtcaaatcgccagcatcagaaggttccagataagcttttagaggaagccaaagctgcagccagggctgcactcgaggaaatggatgctgattagtggctgaaaaacatacttatttgtctttggtgttgtttttatgtttggataaatattgctacttgaatttttctcattatgtattgtacgactgcagtttggtgcttttgctggccccgagtaatttctttcatctctacctcatccacttttacttgaaccgaaaagataattaaactggaaagaacacctgcacagggcaagtattgtgacaaggttaaaaatgtatttctctattggaaatagt

SEQ ID NO: 2803 - DNA, 1086 bp, Malus domestica
ggccaagccaatatctctttaattgtagctgtttgcttctctcagtcgaacactctccaaacaacaataaacagcagaaaaaaggaagaagatgagcagcatcggaacaggttacgatctctccgtcaccacattctcccccgacggccgcgtcttccagatcgagtacgccgccaaagccgtcgacaactccgggactgtcattgggatcaaatgtaaggacggcgttgttatgggtgtggaaaagctcatagcgtcgaagatgatgctgcccggttctaatagaaggattcattcagttcatcgccactccgggatggcagtggcaggattagctgcagatggtaggcaaattgttgctaggaccaagtctgaagccaccaactatgaaagtgtgtatggtgaacagattcctgttaaggaacttgctgaacgtgttgctagttatgtgcatttgtgtacactatattggtggctcagaccttttggatgtgggataatccttggtggttatgacagagatgggccacaattgtacatggttgaaccttctggtgtttcttataggtattttggtgctgcaattggaaagggcaggcaggctgccaagacagagattgaaaagttgaagctttcggagttgacttgtcggcaaggagttattgaagtagccaagatcatttatggaattcatgatgaggcaaaggacaaggaatttgagttagaaatgagctgggtctgtgacgaatcaaaccgtctgcatcagaaggttccagatgagcttctagaggaagcaaaggcagcggctaaagcagcattggaagatatggatgcagattaagaagctgatgaaataatgtgttaatattctgaaaccctactagaagaacatcaacagaaaagggttaatgagataagattgatggattttcattagccaatttgagctgctgtagtatttcttgtacgttaaaatgttcaatttaccgcatctgtaggatgtttgagaaacagagtttcacttacattattatgcactctccttattaactgctgaagtatttctgttttttcaaaaaaaaaaaa

SEQ ID NO: 2804 - DNA, 842 bp, Cleome spinosa
ttatttctctggcttgagaccaaagacaaccttactccgatcttgtgctttaagaccccgaagaagaaggagaagaagaagtaagatcaacgaaatgagcagcattggtactggatacgatctctccgtcacgaccttctctcccgatggtcgtgttttccagatcgagtacgccgccaaagccgtcgacaacagtggaactgttgttgggatcaagtgcaaggacggaattgtcatgggtgtggagaagcttattgcatcaaagatgatgctaccgggttccaaccgaagaatccactcagttcatcgtcatgctggcatggctgttgccggattagcagctgatggaaggcaaattgttgcacgggctaaatctgaagcgacaaattacgagagtgtctatggtgaagccatacccttgaaggaactttctgatcgagttgcgagttatgtacatttatgcaccctatattggtggctcaggccctttggctgtggggtcattcttggaggttatgatagagatggacctcaattgtacatggttgagccatcaggcgtctcatatagatattttggcgcggcaatcgggaaaggaaagcaagctgctaagacggaaatagagaagttgaagctttccgagatgacgtgcagggaaggcgtagttgaggtggccaaaataatatacaagctgcacgatgaagccaaggataaagcttttgaattggagatgagttggatatgtgacgagtcaaaacgagaacatcagaaggttccagaagagctcctagaagaagctaaggctgcagccaaaaccgcacttgaagagatggatgctgact

SEQ ID NO: 2805 - DNA, 1114 bp, Mimulus guttatus
ggggtttgtgaaataaaaacaaaatccctaaattaaacagaaagaaagtaagaacacagtgacacagagttaagcggaatccggcagcaagaaactataagcaacagctttagagagagaaagtagagagagagaaaggaaaaaatgagcagcataggaacaggctacgatctatcggtgacaacattctcgccggacggccgcgttttccagatcgagtacgccgccaaagctgttgataacagcggcactgtggttgccatcaaatgcaaggacggcgttgttatgggagtggaaaaattgattgcctcgaagatgatgttgcccggttctaacaggagaatccacgccgttcaccgccattccggcatggctgttgctgggcttgctgcagatggcaggcaaattgtgacacgagcaaaatctgaagcaactaactatgagagtgtgtacggcgaaccaattcccgtaaaagaacttgcggcacgtgtagccagttatgtgcatttgtgcacactctattggtggctcaggccgtttggatgtggagtgattttgggaggttatgatagagatgggccgcagttgtacatggttgaaccatctggaatttcccatagatacttcggtgctgccattgggaagggcaggcaggctgctaaaacagagattgaaaaactaaagctttctgaaatgacatgccgacaaggagttgttgaggttgccaagattatttatggagtacatgacgaggcaaaggacaaggcctttgaattggaaatgagttgggtttgtgatgagtcaaaccgtcagcatcaaaaggttccggaggatctactagaggaagccaaatctgcagctaaagctgcactcgaagaaatggatgcagattagtggctgcgatcccctcttgctatttttgcttttatttctcctccgaacaattttcttaaaactggcaatgttatgctatggggttacgttaattgttgtcgttttacctgtatgaatttcgatcctgcattaatttgcaacgcagcttgaaaatccatgttaaaaagattattgaacttttatatactataaacaatccattttcgttatcttcccgctg

SEQ ID NO: 2806 - DNA, 1004 bp, Nicotiana benthamiana
  misc_feature (541)..(541): n is a, c, g, or t
gcacgaggcacagctccaaattgaactcaactgaatcagtagaagctctactagagaagaaaagaagggagaaatggccagcataggaacaggttatgacttatcggtgacgacattctcgccggacggcagagtatttcagatcgaatacgccggcaaagctgttgataacagcggcactgttgtcggcatcaaatgcaaggacggaatcgtcttgggggtggagaagctaatagcatccaagatgatgttgcctggatcaaatcggagaattcactccgttcatcgccattccggcatggctgttgcaggcttggctgcagacgggaggcaaattgttgcccgggctaagtctgaagcaaccaatttcgaaagtacatatggtgagccaattccagtgaaagaacttgcggaacgcgttgctagttatgtgcatttatgcacactgtattggtggctcaggcctttcggatgtggggtgattcttggagggtatgatagagatggccctcaactatacctggttgaaccttctggtgtntcatacaggtactttggtgctgctattggaaagggcagacaagctgctaaaacagaaattgaaaaattgaagttatcggagatgacctgtcgacaaggggtgattgaggtggccaaaataatttatggagtacatgatgaggcaaaggacaaggcatttgaacttgaaatgagttggatatgtgacgagtccaaccaccaacatcagaaggttcctgatgatattttagaggaagcgaagactgcagctaaagctgcccttgaagaaatggatacaaaatagtgatcctactactaagtactttctttcttcttgcatctgtttctcatctccttattgaatggtccctctctgccatgttattactgctggtgatgaaagcgatttacaatttattttaactttgaattggaagcttacaactgaagttaaaaaaaatcgagagtattagtttggattaaga

SEQ ID NO: 2807 - DNA, 937 bp, Cajanus cajan
aaacagcgaaagtaaaaatcagcactcgacaaagatgagtagcatcggaactggttacgatctctccgtcaccactttctcccccgatggccgcgtttttcagatcgaatatgccgctaaagccgtcgacaacagcgggactgttattgggatcaaatgcaaagacggggttgtgttgggtgttgagaagcttattccgtcgaagatgatgcttccgggttccaatagaagaatacactccgttcaccgtcactctgggatggctgtagcaggattagcagctgatggcaggcaaattgttgccagggccaagtctgaggcaactaactatgacagtgtatatggcgaaccaattcctgttaaggaacttgctgaacgtgtggctagttatgtccacctttgtacgctatattggtggctcagaccttttggatgtggtgtgatactaggaggttatgacagggatggaccacagttgtacatggttgaaccttccggtgtttcttatagatattttggtgctgcaattgggaagggcaggcaagctgctaaaacagagattgaaaagttaaagcttgctgatatgacttgtcgacaaggggttattgaagtagctaaaattatatatggagttcatgatgaagcaaaggacaaagattttgaactagaaatgagctgggtgtgtgatgaatctaaccgccaacatgaaaaggtcccagatgagcttctagaagaagcaaaagcagcagccaaagcagctcttgaggaaatggatgcagattaatagattaaaaatgtttatttcaaagttgtatttcttaacttgtaattgagcatttggaacatctataggaaatgcaaaggcttcattagttggattttgtatgtttcttgatgatttaatggccttgttgatttcctgtttcaggggagaatt

SEQ ID NO: 2808 - DNA, 1176 bp, Cajanus cajan
cagttaactcttgagcaagcaagaccccctttatattcatttccctgcgctgcactgcgagaaagtcgcagaagacagaagaagaaacagcgaaagtaaaaatcagcactcgacaaagatgagtagcatcggaactggttacgatctctccgtcaccactttctcccccgatggccgcgtttttcagatcgaatatgccgctaaagccgtcgacaacagcgggactgttattgggatcaaatgcaaagacggggttgtgttgggtgttgagaagcttattccgtcgaagatgatgcttccgggttccaatagaagaatacactccgttcaccgtcactctgggatggctgtagcaggattagcagctgatggcaggcaaattgttgccagggccaagtctgaggcaactaactatgacagtgtatatggcgaaccaattcctgttaaggaacttgctgaacgtgtggctagttatgtccacctttgtacgctatattggtggctcagaccttttggatgtggtgtgatactaggaggttatgacagggatggaccacagttgtacatggttgaaccttccggtgtttcttatagatattttggtgctgcaattgggaagggcaggcaagctgctaaaacagagattgaaaagttaaagcttgctgatatgacttgtcgacaaggggttattgaagtagctaaaattatatatggagttcatgatgaagcaaaggacaaagattttgaactagaaatgagctgggtgtgtgatgaatctaaccgccaacatgaaaaggtcccagatgagcttctagaagaagcaaaagcagcagccaaagcagctcttgaggaaatggatgcagattaatagattaaaaatgtttatttcaaagttgtatttcttaacttgtaattgagcatttggaacatctataggaaatgcaaaggcttcattagttggattttgtatgtttcttgatgatttaatggccttgttgatttcctgtttcaggggagaattgttttaaagtgctttagatgctgacctttatttattgattgtagtgttgaattctatccgtcaaaccagcatgtgcacacaattgactctcttatttagcacattatttgttggcattcccttttgcttgcatcggattagaaccatcgaatttt

SEQ ID NO: 2809 - DNA, 813 bp, Senecio madagascariensis
caaaatcaaaatcaaaatcaaaatcaatttagccctagaaaaccaccaaccatgagcagcataggaacaggttacgatctatcagtcacaactttctcaccggacggcagggttttccagatcgaatacgccgctaaagccgtcgataacagcggcaccgtcgtcggtattaaatgcaaagacggcattgttatcggtgtagagaagctaattgcttccaaaatgatgttgcctggatctaaccgtagaattcattcggttcatcgtcattccggaatgggagtagctggattagctgcagatgggagacagattgttgcgagagcgaaatctgaagctcataactatgaaagtacttatggtgaacctattccagttaaagaacttgctgaccgtgtcgccagctatgtgcacctatgcacactttattggtggctcagaccatttggatctggggtgattcttggaggttatgaccgtgatggcccacaattatatatgattgaaccttctggtgtctcctatagatattttggtgctgcaattggaaagggcaggcaggctgctaaaaccgagattgaaaagttgaagctttctgagatgacatgtcgtcaaggtgttattgaagtagcaaaaataatctatggagtacatgatgaggccaaggacaagacatttgaattggagatgagctgggtttgtgatgaatcaaaccgtcttcatcagaaggtacccgaagcacttttggaagaagcaaaatctgcagctaaactggcactggaagaaatggatgctgattaatagatcttttct

SEQ ID NO: 2810 - DNA, 1175 bp, Glycine max
actcttcacattcctctgtggttgagcacagccaaactcaaagaagaaagaagaaaatccagcgaaagtaaaaccagcatccgaaaaagatgagcagcatcggaacaggttacgatctctccgtcaccactttctcccccgatggccgtgttttccagatcgagtatgctgccaaagccgtcgataacagcgggactgttattgggatcaagtgcaaagatggggttgtgttgggcgttgagaagcttattccgtcgaaaatgatgcttccgggttccaatagaagaatacactccgttcatcgtcactctgggatggctgtagcaggattagcagctgatggcaggcaaattgttgctagggccaagtctgaagcaactaactatgacagtgtatatggcgaaccaattcctgttaaggaacttgctgaccgtgtggctagttatgtgcacctctgtacgctatattggtggctcagaccttttggatgtggtgtcatactaggaggttatgacagggatgaaccacagttgtacatggtcgaaccttctggtgtttcttatagatatttcggtgctgcaattggcaagggcaggcaggctgctaaaacagagattgaaaagttaaagcttgctgatatgacatgtcgacaagggcttattgaagtggctaaaattatatatggagttcatgacgaggccaaggacaaagatttcgaattagaaatgagctgggtgtgtgatgaatcaaaccgccaacatgagaaggtaccagatgagcttcttgaattagcaaaggcagcggccaaagcagctcttgaagaaatggatgcagattaatggactagaaatgtttatttcaaagttgtatttcataactttgtaattgagcatttgaaacatctataggaaacacaaggcttcgatagttggatattgtattcttcttgatgatttaatgcccttattgatttcctgtttcttggacaattgttttgaagttctatagaagctgacctttattgatttgtgttgaattctctgtcaaatccttgtgcttatgtgcacagcattgaatttcctttattcaacacgtcatttgttaagcgaattgtttttagcaatgtcgggaacactttcaacattattacataaatttatatgggtctcattaat

SEQ ID NO: 2811 - DNA, 1066 bp, Nicotiana tabacum
  misc_feature (989)..(989): n is a, c, g, or t
ctctactctgtcttgagaccaaagaaaactcctttatttatttgggtcactacactactcctaattgaactcaactgaatcagtagaagctctactttgagaagaaaagaagtgaaaaatggccagcataggaacgggatatgacctatcggtgacgacattctcgccggacggcagagtatttcagatcgaatacgccggcaaagcagtcgataacagcggcactgtcgtcggcatcaaatgcaaggatggaatcatcttgggagtggagaagctaatagcatccaagatgatgttgcctggatcaaatcggagaattcactccgttcatcgccattccggcatggctgttgcaggtttggctgcagatgggaggcaaattgttgcccgggctaagtctgaagcaaccaacttcgaaagtgcatatggtgagccaattccggtgaaagaacttgcggaacgcgttgctagttatgtgcatttatgcacactgtattggtggctcaggcctttcggatgtggggtgattcttggaggttatgatagagatggacctcaactatacctggttgagccttctggtgtctcatacaggtactttggtgctgctattggaaagggcagacaagctgctaaaacagaaattgaaaaattgaagttatcggagatgacctgtcgacaaggggtgattgaggtggccaaaataatttatggagtacatgatgaggcaaaggacaaggcatttgaacttgaaatgagttggatatgtgacgagtccaaccgccaacatcagaaggttcctgatgatattttagaggaagcgaagactgcagctaaagctgcccttgaagagatggatgcagattagtgatctaaatagacttggtgctttctttcttgcatacatttctcttctccttattgaatggtccctctgtgccgtgttaacttgatttggcacctgtgcgttgattactgttggtgatganagcgatttacaatttattgtaactttgtactggaagctttacaactgaagttcaaaaaaatcgagagtattagtttg

SEQ ID NO: 2812 - DNA, 804 bp, Juglans hindsii x Juglans regia
gggggacacagagaagtagaagaagcaagaagaatcgaaaagaggatcaggcgacagtatgagcagcataggaacagggtatgatctttcagtgactacattctcccccgatggccgcgtcttccagatcgagtacgccgccaaagcagtcgacaacagcgggactgtgattggcatcaaatgcaaagatgggattgtaatgggtgtggagaaactgatagcttcgaagatgatgctacctggttccaatcgaagaattcattctgttcatcgccactcgggcatggctgtggcaggactggcagcagatgggaggcaaattgttgcccgtgccaaatctgaagctactaattacgaaagtgtatatggtgaaccaattcctgtcaaggagcttgctgatcgtgtagctagttatgttcatctgtgtacactctattggtggctaagaccttttggatgcggagttattcttggtggctatgacagagatggaccacaactttacatggttgaaccctccggtatttcatataggtacttcggtgctgcaattggaaagggcaggcaggcagctaaaacagagatcgaaaagttgaggctttcagacttgacttgccgtcaaggggttattgaagttgccaaaatcatttatggagtacatgatgaggcgaaggacaaggacttcgaattggaaatgagcggggtctgtgatgagtcaaaccgtcagcatcagaaggttccagaggagcttctccatgaagctaaggcagcggctaaagcagctctggaagaaatggatgctga

SEQ ID NO: 2813 - DNA, 1414 bp, Cannabis sativa
tgaaaagtgaagctagtttctcattctgagttgtataattctttcttgagggaaaagaaaagaaagagagtgtggagtctataggagttgctgcttcagctttctcttcctctatttcaacctcttcttcagtccaacaaactcgaccgacttaactcaccaatccaaacggtaaacatgagcagcataggcacaggttacgatctttccgtcactacattctctcctgatggccgcgtttttcagatcgagtacgccgccaaagctgttgacaacagtgggactgttattggaatcaaatgcaaagatggcgtcgttatgggtgtggagaagctcgtagcgtcaaaaatgatgttgcctggttccaatagaagaatacattcggttcatcgacactctggcatggctgttgcaggcttagcagctgatggcaggcaaattgttgcccgggccaagtctgaagctactaactatgaaagtttgtatggtgaggccatccctgttaaggaactggctgaacgtgttgccagctatgtgcatctttgtacactatattggtggctcagaccttttgggtgtggaataatccttggtggctatgacagagatggacctcaattatacatgattgaaccatctggagtttcttataggtactttggagctgcgattgggaagggcaggcaggctgctaaaacagagattgaaaagttgaatctttctgaaatgacttgtcgacaagggattgttgaagtagcgaaaattatttatggaatacatgacgaggccaaagacaagggctttgaactagaaatgagctgggtctgtgaagaatcaaaccgacaacatcagaaggttccagaagatcttttagaagaggcgaaatcagcggctaaagcggctttggaagaaatggatgcagattaagttgaatgcatttaagccttggtgtaagtgaacccaatagaacacaaattgaaagaatgtacgaagggggggacatatgatttggtgggttttgatatcctcatagatgtttgctggtccaactattgcccattacaaatatttaaaacctctattgtgtgaggtgctgcagaccttaggataagctttttgctttacgtcaaatttgctctttttcttcacttgcttttgttgttttacttctttttcttatgaaaaatgggagagagctaccagtgtggctaccttcctgggcataatcctgaccctttatggctaccagtgtgcactctttttatgccacataagtgacaacatagttgtagaagtagctccacccaatttacaaagtgagaaataaatataatatggtaaattgattaaaggaaaacattcaaaaaaaaaaaaaaaagaaaagaaaagaaaaatagtgttgttcatgaaagag

SEQ ID NO: 2814 - DNA, 994 bp, Gossypium hirsutum
cgagcaatatagaagaagaagaaacagaaaggaagaataacaaccaagtgtgagaagtaggaaaagcaagtgcagagaagagaagaaagatgagcagcattggaactggttacgatctctcagtcaccactttctctcccgacggccgcgtttttcagatcgagtacgcctccaaggccgtcgataacagtggaactgtaattggaataaaatgcaaagatgggatcgttatgggagtggagaagctgatagcatcaaaaatgatgttacctggctctaatcgtagaatcctttccgttcatcgtcattccggcatggcagtagctggattagcagctgacggcagacaaattgtggcccgtgctaaatctgaagctactagttatcaaagtgtgtatggtgaacccattcctgtcaaagaacttgctgaacgcgttgcaagttatgtccatttatgcactctttactggtggctcaggccttttggctgtggggtaattctaggaggttatgatagagatggaccccaattatacatggttgaaccgtctggcatctcctatagatactttggtgctgcagttgggaagggaaaacaagctgccaaaacggaaattgaaaagttgaagctgtctgaaatgacatgcagagaaggggtcattgaagtagccaaaatcatatacaaggtacatgacgaagcaaaggataaggcctttgaacttgagatgagttgggtctgtgacgagtccaagcaacaacatcaaaaggttcccgatgaccttttggaggaggctaaggctgcggctagggttgccctagaagagatggatgccgattaaacatgagtggagccagaatactgttgcaatggtattttgatcttcactaatttctcatctgtcataaacttgatgtttgatttatgatctaagtcattgactggttaaacatgtttccttgtattatttcatcaagaagatctgccggctttttt

SEQ ID NO: 2815 - DNA, 1227 bp, Fagopyrum esculentum
acttttacagtttactcccttcacgacgacagagattgagaatcaatccaatttgtagaagaatgagtagcatcggaactggttatgatctctctgtcactactttctcccccgatggccgtgttttccagatcgagtatgctgccaaagcggtcgacaatagcgggactgttgtcggaatcaagtgcaaggatggcgtcgttctgggcgttgagaagctgattcagtctaagatgatgttacctggttctaatcgtcgtattcactccgttcaccggcactctggcgtggctgttgctggattagctgcagatgggaggcagatagttgttcgtgctaagtcagaagcctccaactatgagagtctttatggtgaacctatccctactaaggaacttgctcaacgagtagctagctatgtacatcttagcacgctctattggtggctcagaccttttggaagtggagttattctgggaggctatgacaaagatggaccagagctatatatggttgagccatctgggatctcttataaatatttcggtgctgctattggaaagggaaaacaagctgccaaaacagagatcgagaagttgaagctttctgaaatgacctgcagagaaggaatcattgaagtagcaaagatcatctacaaggtgcatgatgaggcaaaggacaaggcgtttgagctagagatgagttgggtttgtgacgaatcaaaccgtcagcatcagaaggtccctgaagaccttctggagactgctaaggctgctgccactgctgctttggaagaaatggacgcagactaaactgggactttcttttcttcccctgtacctgctactactcttacaagcagttgctgtttctatgaatagagccgtgttatttcttcctcgttgtaataggtaaccctctatctaaactccaatcatttgattttaaaagatggatcctttaaacgttattcacaatcttctcattagttgtaataggtaaccctctatctaaactcgaatcacttgaacagttgaacttgaccccaataatgggttcggtctcgatcttgccggtttatcttatattttcatttagctagccctgcatggccgtcagtggtttaggccaggtatatctttcattttcagcccactagaacctgaaccgaaaggtgcaatttggatggacctggaccgttgacccggttagtatcggaccggatgg

SEQ ID NO: 2816 - DNA, 904 bp, Flaveria ramosissima
aaaacacattagtagcaatttcgccctagaagaagatgagtagcataggcacaggttacgatctatcggtcacaaccttctcgccggacggtagggtttttcagatcgagtatgcagctaaagccgtcgacaacagcggcaccgtcgtcggcatcaaatgcaaagacggcattgttattggtgtagagaagctgattgcgtcgaagatgatgttgcctggatctaatcggagaatccactcggtgcatcgtcatgctgggatgggtgtagctggattagctgcagatgggagacagattgttgcaagagccaaatctgaagcccacaactatgaaagtacctatggtgaacctattccaattaaagaacttgctgatcgtgttgctagttatgtgcatctatgcacactttattggtggctcagaccttttggatccggtgtgattcttggaggttatgaccgcgatggaccacaattatatatggttgaaccttctggtgtttcctatagatattttggtactgcaatcgggaagggcagacaggctgcaaagaccgagattgaaaagctgaagctttctgagcttacctgtcgtcagggtgttattgaagtagcgaaaataatctatggagtacatgacgaggcaaaggacaaaacatttgaattggagatgagctgggtttgtgatgaatcgaaccgccagcaccagaaggttccagaagcacttttggaggaagcaaaagaagctgctaaagctgcattggaagaaatggatgctgattaataataattaatttcttcacattgtgtttatctgaagttccaatttaagatgactatctaagattgtagcatttctgttttatcataacaccatacaaattttcatgtatgtttactttt

SEQ ID NO: 2817 - DNA, 879 bp, Flaveria ramosissima
ggctataaccttgctccgatcgcaggagaaaccagtaacccaaaatacagtagcaccaatttcgccctagaagaagatgagtagcataggcacaggatacgatctatcggtcacaaccttctcgccggacggtagggttttccagatcgagtatgcagctaaagccgtcgacaacagcggcaccgtcgtcggcatcaaatgcaaagacggcattgttattggcgtagagaagctgattgcgtcgaagatgatgttgcctggatctaatcggagaatccactcggtgcatcgtcatgctgggatgggtgtagctggattagctgcagatgggaggcagattgttgctagagccaaatctgaagcccacaactatgaaagtacctatggtgaacctattccaattaaagaacttgctgatcgtgttgctagttatgtgcatctatgcacactttattggtggctcagaccttttggatccggtgtgattcttggaggttatgaccgtgatggaccacaattatatatggttgaaccttctggtgtttcctatagatattttggtactgcaattgggaagggcagacaggctgcaaagactgagattgaaaagctgaagctttctgagcttacctgtcgtcagggtgttattgaagtagcgaaaataatctatggagtacatgacgaggcaaaggacaaaacatttgaattggagatgagttgggtttgtgatgaatcgaaccgccagcaccagaaggttccagaagcacttttggaggaagcaaaagaagctgctaaagctgcattggaagaaatggatgctgattaataataatcaatttcttcacattgtgttgatctgaagtttcaatttaaaatgac

SEQ ID NO: 2818 - DNA, 1088 bp, Flaveria ramosissima
agaggaaagacatgaaaacaggagggcagtagagtcgaaggagaaatcaaaagcagtgccctagtcgtagaagaagatgagtagcataggaacaggttatgatctatccgtcacaaccttttcgccggacggtagggtttttcagatcgagtacgctgctaaagccgtcgacaacagcggcaccgtcctcggcatcaagtgtaaagatggcattgtcattggtgtagagaagctgattgcgtccaagatgatgttacctgggtttaatcgtagaatccattccgtgcatcgtcattctggaatgggtgtagcaggattagctgcagacgggagacagattgttgcaagagccaaatctgaagctcacaattatgaaagtacttatggtgaacctattccaattaaagaacttgctgaccgtgttgctagttatgtgcatctatgtacactttattggtggctcagaccttttggatctggtgtgattctcggaggttacgaccgtgatggcccacagttatacatggttgaaccttctggtgtttcctatagatattttggtgctgccattgggaagggcagacaggctgctaaaactgagattgaaaagttgaagctttctgagctaacctgtcggcaaggtgttattgaagtagcaaaaataatctatggagtacatgatgacgcaaaggacaaaacatttgaattggagatgagctgggtttgtgatgaatcaaatcgtcagcaccagaaggttccagaagcacttttggaggaagccaaagcagcagctaaagcagcattggaagaaatggatgctgattaatgataataaatctttccttccttcgtgtgttttgattccgaattgttacctgtaagaaacatttaagtttggaccttgatctttaaaaaaatcatgtgttttgcgtcaaactagggtaagcgtgatatacccaaatcctctaaattcaggtcacccttgtaccattcatgtattggtagtattaaccatgttttagaaggcacgcttcccttgttaacatttgcagtaggaactagcactacgttcttttatttgcataaaa

SEQ ID NO: 2819 - DNA, 1640 bp, Gossypium raimondii
tgctatttttgtttgaaatttaaaaataaaatttgagtataacgttatattcttttttggtacattaaaaattggagaagacatcaacagtgattatccgattaggatactgttttattataataaaagcatttttcatgtctattttactacatcttcaatgtttgtagccgagtagtatacaacaaaagatgattattaactcaacagtgttggactacatttttgtacccttagcattgcgagttgtgaggccggtactaagggcctgaagcgaggagtaattagagttgggctggtccggcaaaatactgaaatggagttggaacttcatcggccgtaaaaggcccatcagggtgaaaggtcttgacttgagaagaaagaaaactgggaacacaacacagagaaaattatatttaactaaggccgagcaacgtagaagaagaagaaacagaaaggaagaacaacaaccaagtgtgagaagtaggaaaagcaagtgcaaggaagagaagaaagatgagcagcattggaactggttacgatctctcagtcaccactttctctcccgacggccgcgtttttcagatcgagtacgcctccaaggccgtcgataacagtggaactgtaattggaataaaatgcaaagatgggatcgttatgggagtggagaagctgatagcatcaaaaatgatgttacctggctctaatcgtagaatcctttccgttcatcgtcattccggcatggcagtagctggattagcagctgacggcagacaaattgtggcccgtgctaaatctgaagctactagttatcaaagtgtgtatggtgaacccattcctgtcaaagaacttgctgaacgcgttgcaagttatgtccatttatgcactctttactggtggctcaggccttttggctgtggggtaattctaggaggttatgatagagatggaccccaattatacatggttgaaccgtctggcatctcctatagatactttggtgctgcagttgggaagggaaaacaagctgccaaaacggaaattgaaaagttgaagctgtctgaaatgacatgcagagaaggggtcattgaagtagccaaaatcatatacaaggtacatgacgaagcaaaggataaggcctttgaacttgagatgagttgggtctgtgacgagtccaagcaacaacatcaaaaggttcccgatgaccttttggaggaggctaaggctgcggctagggttgccctagaagagatggatgccgattaaacatgagtggagccagaatactgttgcaatggtattttgatcttcactaatttctcatctgtcataaacttgatgtttgatttatgatctaagtcattgactggttaaacatgtttccttgtattatttcatcaagaagatctgccggcttttttattagggcctttgatttcgaacaactacgaaatccgtaactgcctttgttaaggcatcaactgtgcatgccggggatttaatataaatatgttcatatgaaaatataaatattaaaagatgaaaaaatggaaaaaaacacaaaaaatattgatttaaaaatgtcagaaaatttttattaatactgtagacctgtacggatagttaccaaagcccaaggg

SEQ ID NO: 2820 - DNA, 1012 bp, Sarracenia psittacina
agaatgagcagcatagggacgggttatgatctatcagtcaccactttctctcccgacggccgcgttttccagatcgaatacgccgccaaagctgtcgacaacagtgggactgttgtcggaataacatgcaaagatgggattgtcatgggtgttgagaagcttattgcttcaaagatgatgttacccggttccaatcggagaattcattccgttcatcgacattctggcgttgcggttgctggattagcagcagatggcaggcaaattgttgcgagaaccaagtccgaagcaacaaattatgaaagtgtctatggtgaacttattcctgtgaaagaacttgctgaacgtgttgctagttatgtgcatctttgcacactctattggtggctcagaccttttggatgtggagtgattcttggaggttatgacagagagggaccacagttatacatgattgaaccttctggcatagcatataggtactttggtgctgcaattgggaaaggaaagcaggctgctaaaacagaaattgaaaagttgaagctttctgaaatgacctgccgggaaggagttattgaaatagccaagattatttacaaggtgcatgatgaggctaaagataaggcctttgaattggaaatgagctggatctgtgacgagtcaaagcgccaacatgagaaggtaccagtagaacttttagaggaagccaaggctgccgggaaggctgcattggaagaaatggatgctgattgatgaagcttcctcacttgtttatgttggaaatttagcaacttaaaatccgtttaaatgaagagatgtttcttttagggtaaacaatttaaatggaaacttatttgaagagatatgttctttataaaaaaactcgcttggaattttagaaataataaaacctcccaacttacatttgtgtcttaaatgtattgtgtaatcagcatatttaaagttgtaacacacctgtaagcaatgagatgtggtgaatgggatatagtag

SEQ ID NO: 2821 - DNA, 917 bp, Antirrhinum majus
cggcacgagaaactctttcaatcttgttcctccaaaaaacaaaaacaagaaaaaagagaaaactccattctattttcaaaagccatagattggtaagagtagcaaaactagagcaaatctgaggtaaaataaaaatataaaaaaaaaggaggaaaaaatggcgagcataggcactggatacgatctctcagtgaccacattctcgccggacggtcgagtttttcagatcgaatacgccgctaaagctgtcgacaacagcggcaccgttgttgctatcaaatgcaaagacggcgtcgtcatgggagtggagaagctgattgcttcgaagatgatgttgcccggatctaatcggagaatccacgccgttcatcgccactccggcatggctgttgctggtctggctgcagacggcaggcaaatcgttgcaagagctaaatcggaagcttctaactatgagagtgtctatggtgagcaagtccctgtgaaagaacttgcagaacgtgttgcaagttacgtgcatttgtgtactctctattggtggctcaggcctttcggatgtggggtcattctaggaggttatgatagagatgggccacaattatacatgattgaaccatctggaatttcctatagatactttggtgctgccattggaaagggcaggcaggctgccaaaactgagattgaaaaattgaagctttcggatatgacgtgtcgtcagggcgttattgaggtggccaagattatttatggagtacacgatgaggcaaaggataaggcctttgaactggaactaagttgggtatgcgatgaatcaaaccgcgagcatcaaaaggttccaaatgatctactagaggaagcaaaggcagcagctaaagctgcacttgaagaaatggatgcagattaattagtattgg

SEQ ID NO: 2822 - DNA, 1085 bp, Phaseolus coccineus
catttgagtcacccagttaaactcttgagcaagtaaagccctctttatattcgttggcgagttcctctggggtgtgcagcactgagagaagaatcacagaaaaagtaaaatcagctcttgaaaaagatgagtagcatcggaaccggttacgatctatcggtcaccactttctcccctgatggccgcgttttccagatcgagtacgctgccaaagccgtcgacaacagcggaactgtcattggtatcaaatgcaaagacggagttgtgttgggtgtagagaagcttattccgtcgaaaatgatgcttccgggttcaaacagaagaatacactcggttcatcgtcactctgggatggctgtagcaggattagcagctgatggcaggcaaattgttgcccgggccaagtctgaagcaactaactatgacagcgtttatggtgaaccaattcctgttaaggaacttgctgaccgtgtggctagttatgtgcacctatgtacactatattggtggctcagaccttttggatgtggtgtcatactaggaggttatgacagggatgggccacagttgtacatggttgaaccttccggtgtttcctatagatattttggtgctgcaatcggaaagggcaggcaagctgctaaaacagagattgagaagttgaaggttgctgatatgacttgtcgacaaggggttattgaagtggctaagattatatatggagttcatgatgacgcaaaggacaaagattttgaactagaaatgagctgggtatgcgatgaatcaaaccgtcaacatgaaaaggtcccagacgagcttctagaagaggctaaagcagccgccaaagcagctcttgaagaaatggatgcagattaatagactataaatgtttattccaaagttgtatgacgtaactttgtaattgagcatttggaacatctataggaaatgcaaaggcttcactacttggattttgtatgcttccttaatgcccttgatttcatgtttctggataatttgagaattgaagttcaaagtgttgaattttatctatcaaattcgatttctccacaccattgacttta

SEQ ID NO: 2823 - DNA, 1061 bp, Phaseolus coccineus
gacccagttaaactcttgagcaagtaaagccctctttatattcgttggcgagttcctctggggtgtgcagcactgagagaagaatcacagaaaaagtaaaatcagctcttgaaaaagatgagtagcatcggaaccggttacgatctatcggtcaccactttctcccctgatggccgcgttttccagatcgagtacgctgccaaagccgtcgacaacagcggaactgtcattggtatcaaatgcaaagacggagttgtgttgggtgtagagaagcttattccgtcgaaaatgatgcttccgggttcaaacagaagaatacactcggttcatcgtcactctgggatggctgtagcaggattagcagctgatggcaggcaaattgttgcccgggccaagtctgaagcaactaactatgacagcgtttatggtgaaccaattcctgttaaggaacttgctgaccgtgtggctagttatgtgcacctatgtacactatattggtggctcagaccttttggatgtggtgtcatactaggaggttatgacagggatgggccacagttgtacatggttgaaccttccggtgtttcctatagatattttggtgctgcaatcggaaagggcaggcaagctgctaaaacagagattgagaagttgaaggttgctgatatgacttgtcgacaaggggttattgaagtggctaagattatatatggagttcatgatgacgcaaaggacaaagattttgaactagaaatgagctgggtatgcgatgaatcaaaccgtcaacatgaaaaggtcccagacgagcttctagaagaggctaaagcagccgccaaagcagctcttgaagaaatggatgcagattaatagactataaatgtttattccaaagttgtatgacgtaactttgtaattgagcatttggaacatctataggaaatgcaaaggcttcactacttggattttgtatgcttccttaatgcccttgatttcatgtttctggataatttgagaattgaagttcaaagtgttgaattttatctatcaaattcgatttctcc

SEQ ID NO: 2824 - DNA, 992 bp, Theobroma cacao
ggcgtgaagtcttgagaagaaagaaaactcgatatatcaaggggagaagaagaacagaagagcaaagagcaaagtaggaaaaagcagagaagaaagatgagcagcatcggaacaggttacgatctatcagtcaccactttctctcccgacggccgcgtttttcagattgaatacgccgccaaagccgtcgataacagtggaactgtaattggaataaaatgcaaagatgggatcgttatgggagtggagaagctgatagcatcgaagatgatgttacctggttccaatcgaagaatccactccgttcatcgtcattccggcatggcagtggcaggattagcagctgatggtagacagattgtggcacgtgctaaatctgaagctactaattatgaaagtgtttatggtgaacccattcctgtcaaagaacttgctgaacgcgtcgcaagttatgtgcatttatgcaccctctactggtggctcaggcccttcgggtgtggggttatactcggaggttatgatagagatggaccccaattgtatgtggttgaaccatctggcatctcctatagatattttggtgctgccattgggaaaggaaagcaggctgccaaaacagaaattgaaaagttgaagctgtcggagatgacatgcagggaaggggttattgaagttgccaagatcatatacaaggtacatgatgaagcaaaagataaggcctttgaactggagatgagttgggtctgtgatgagtcgaagcaacaacatcaaaaggttccagatgaccttttagaggaagccaaggctgcggctaggactgcactagaagagatggatgctgattaattggtggagccagaatactctttttatgatattttgatcttcactattttcccattgttatgaacctgatgtttaatgtatgatgaagtcattgactgatcaaacgtgtttcctaaagattatatcataatctcttgacctttcca

SEQ ID NO: 2825 - DNA, 1224 bp, Trifolium pratense
ttttcttcttctccaaagtttctcacacataagtttcaaaatcaaaatcttcaaattcttcaaaatcattcaacaatatgagtagcatcggaacaggttacgatctatccgtcactactttctctcctgatggtcgcgttttccagatcgaatacgctgccaaagctgtcgataatagcgggactgttattggtatcaaatgcaaagatgggattgtgttgggtgttgagaagcttatcccttcgaaaatgatgcttccgggttccaatagaagaatacacgctgttcatcgacactctggaatggctgtagcaggattagcagctgacggcaggcaaattgttgccagggctaagtctgaagcaactaactatgacagcgtgtatggtgacccaattcctgtcaaggaacttgctgatcgcgtggctagctatgtgcacctttgtactttatattggtggctcagaccttttggatgtggtgtcatactaggcggttatgacagagatggaccacagttgtacatggtcgaaccttctggtgtctcctataggtattttggcgctgcaattgggaagggaagacaggctgcaaaaacagaaattgaaaagttgaagcttcaagatttgacctgccgcaaagcagtcattgaagtagctaagattatatatggagttcatgacgaggcaaaggataaagatttcgaacttgaaatgagctgggtgtgtgacgaatcaaaccgtcaacatgaaaaggttccagaggagctcctagaagaagccaaagcagcagcgaaattagctcttgaagaaatggatgcagattaattaacagattaaaaatgtttatctcaaaaagatgtattacattaacttctatgagagcattgggaacatctatagaaagttcataggcttcaaaagtgcttcttgatgattcaatgcccttgttggtttctgtttctgtggagaactgtttcaaagtgctttagatatttttcttatcaattgatttagtgctgaattttattccttcgccgccatatttggtttgagaaaatgttttatgaaaccaaacatatcttaatcttctattactctaaatatcatttccatttttcattcataggattagaagattaagttgtaacctttttctttccattaatcctagtttttagatgtttgtgattgtcatgtgccattccagaaaataaggtcgttg

SEQ ID NO: 2826 - DNA, 1068 bp, Vigna unguiculata
  misc_feature (13)..(13): n is a, c, g, or t
agttaagaccccnttatattcgttggttcgttcctctggggtgcgcagcactgagaatcacagaagaacgaaaaagaaaagccagagcttgaaaaagatgagtagcatcggaaccggttacgatctatcggtcaccacgttctcccctgatggccgcgttttccagatcgagtacgctgccaaagccgtcgacaacagcggaactgttattgggatcaaatgcaaagacggagttgtgttgggtgtagagaagcttattccgtcgaaaatgatgcttccgggttcaaacagaagaatacactcggttcatcgtcactctgggatggctgtagcaggattagcagctgatggcaggcaaattgttgcccgggccaagtctgaagcaactaactatgacagcgtttatggtgaaccaattcctgttaaggaactcgctgaccgtgtggctagttatgtgcacctttgtactctatattggtggctcagaccttttggatgcggtgtcatacttggaggttatgacagggatgggccccagttgtatatggttgaaccttccggtgtttcctatagatattttggtgctgcaattgggaagggcaggcaggctgctaaaacagagattgagaagttgaagcttgctgatatgacttgtcgacaaggggttattgaagtggctaagattatatatggagttcatgatgaggcaaaggacaaagattttgaactagaaatgagctgggtatgtgatgattcaaatcgacaacatgtaaaggtcccagacgatcttctagaagaggctaaagcagccgccaaagcagctcttgaagaaatggatgcagattaatagactagacatatttattccaaagttgtattacgtaactttgtaattgagcatttggaacatctataggaaatgcaaaggcttcactagttggattttgtatgcttcctgatgatttaatgcccttgatttcgtgtttttggatgatttgaggtttgaagttcaaagtgttgaattttatcaatgattgtagtttatgtagccaataatttctcatgtca

SEQ ID NO: 2827 - DNA, 1057 bp, Actinidia deliciosa
ctgttgttctacatatacaaaaaccacggagagagagagagagagagcgcgcggacagcagaatcagtaagaaaacaagcagcagcagcagcagcagcagaagaagaagaagaagaaaggaagaatgagcagcataggaacaggttacgatctctccgtcactaccttctcccccgatggccgcgtattccagatcgaatacgctgctaaagctgtcgacaacagcgggacagttgtcggcataaaatgcacggatggaattgtcatgggtgtggagaagctcatagcatcaaagatgatgctacccggctccaatcgcagaattcactccgttcaccgtcattctggcatggctgttgccggattagctgcagatgggaggcaaattgttgcacgggcaaaggccgaggcaacaaattatgaaagtgtctatggtgaacccattcctgtgaaggaacttgctgaacgtgttgctagttatgttcatctatgcacactctattggtggctcaggccttttggatgtggaataatccttggaggttatgacagaggaggaccacagttatacatggttgagccctctggcatttcttataggtactttggtgctgcgattgggaaaggaaagcaggctgctaaaacagaaattgagaagttgaagctttcagaaatgacctgccgggaaggcattattgaaatagccaagatcatttacaaggtacacgatgaggctaaggacaaggcctttgaattagaaatgagctggatctgtgatgagtcaaagcgccaacatgagaaggtaccagaagagcttttggaagaagccaaggctgcagcaaaggcggcattagaggaaatggatgctgattaatgaacccatttccctttctcacgctttcgtgatgattctcagaacgtaattgacttggatttatttgtataccatttacgtctttttaactgttttcttaagaaactttatattctctgttctgcggacagattatatctaatagtatcataagatgcatgcttagacaacaaaaaaaaaaaa

SEQ ID NO: 2828 - DNA, 1133 bp, Mimulus guttatus
atttctctttttattttcaaaattaaaaggaagagagagagagagagagagagagaggcatatagcacagtgtacaaagaagatcagcggaaagtagcgtagtagagagagagagaggggtgaaaatgagcagcataggcacaggctacgatctgtcagtaacgacattctcgccggacggccgcgttttccagatcgagtacgccgccaaagccgtcgacaacagcggtacggtcgtcgcaatcaaatgcaaagacggtgtcgtaatgggagtggagaagttgattgcttcaaaaatgatgttgcccgggtccaatagaagaatccacgccgcccatcgccactccggcatggctgttgctggattagctgcagatggcaggcagattgtgacaagagcaaaatctgaagcaactaactatgagagtgtgtatggagaaccaattcctgtaaaggaacttgcagaacgtgtcgccagttatgtgcatctgtgcacactatattggtggctaaggccttttggttgtggtgtaattctgggaggttatgatagggatgggccacagttatacatgattgaaccatctggcatatcctatcgatactttggagcatccattggaaaaggaaggcaggctgcgaaaacggagatcgaaaaattaaagctttcagatatgacatgtcgacaaggtgttattgaggtggccaaaattatttatggggtgcatgatgaggccaaggacaaagcctttgaattggaaatgagttgggtctgtgatgagtcgaatcgccaacatcaaaaggttccagacaatctattagaggaagctaaggcagcagctaaagctgcacttgaagaaatggatgcagattagttttcactcatttgctttgatcattttatttttttctgcttcgaattatgttggtcatggtgtggaaatacgcgaaacggcaccaaagatgatgttaagtcaatcggattttattaaacctatgatcatgtatactctacacttgcgatgatatgcacatcaccgtgaagtttgatcgaccgattcgtaattcatatataagagaacatcttcagttccatatgattaagtggctaaaaatatagattttattttttg

SEQ ID NO: 2829 - DNA, 1592 bp, Populus trichocarpa
gaggcagccatgttcgatctgtgctgtcttgagatcgaagaaaacatttcttcttaaaacaacaccaaaaccactggatagatagaaagaagttaaagaaaattatctaaaaagaaagcttgagcgatgagcagcataggaacaggctacgatctgtccgtcactactttctcgccggatggccgtgtttttcagatcgaatacgctgctaaagccgtcgataacagcggtactgttattggcatcaagtgcaaagatgggattgttatgggtgtggagaagctaatagcgtcgaagatgatgttacccggttccaataggagaattcacaccgttcatcgtcattccggcatggctgttgctggtttagcggctgatggtagacaaatcgttgcacgtgccaaaagtgaggcgtccaattatcagagtgtttatggtgaacccattcctgtcaaggagctcgctgatcgtgttgctagttatgtgcatttgtgcactctctattggtggcttaggccatttggttgtggggtgattctcggtggttatgacagagatggaccacaattatacatggttgaaccatctggcatctcctatagatattttggcgctgctatagggaaagggaagcaggctgctaaaacagaaattgaaaagttgaagctgtctgaaatgacatgccgagaaggggtccttgaagtagccaaaatcatttacaagttacatgatgaagcaaaggacaaggccttcgaacttgaaatgagttgggtttgtgatgagtcaaagagacagcatcaaaaggttcctgatgagctcttagagggagccaaggctgcagctaggattgcacttgaagaaatggatgctgattaaaaagcttaattgagctaggccaggcgatcgataagatgattttattttgattgggttctcattgttacattcgaaatcttttttgtgaatggccacaatatcatcctggagcttattacgaattcttgtcatgcatttaattggtattttcttataaccaatttggtccctcataaactctgctcatgtccaaagattggagtcattgttttctcattatcctttctttttcttgtgagctcacttcttttaacaaatgaggggaaaatattgaaaataagttttgatttctgtttgttatagggaaagtctcatctaagggtgtgtttgtcagagaaaggatggattgtgaaaagtggaaggagaggagaaatggttaacttatcatccatctagatgtttgatcaacaaaaatggggaaggataataaatagttaatttatccaaactagaagcgcattgaaacttataaatgaatggaagtatatgatctaatctgtccaaattgagaggtttgaagtactttcatattgattcatatgatcgcatgtaaatgttaatcataatcttcttctgacagattgataaacactctcacacacacacacacctgtatatttctcagtaaaagtatcccagatagcaggtcctcttccatgtttgtttgtttcaccttcatactgtataccataaatgaaagaacatgagatttgata

SEQ ID NO: 2830 - DNA, 1052 bp, Zostera marina
ggggccccaaagcccgacgaaggcactaatttcaaacgacaatgagttccattggaacagggtacgatctgtccgtcaccactttctctcctgacggtagggtcttccaggtcgagtattccggcaaagctgttgataacagtgggactgtagttggaatcaagtgtaaggatggagttgtcatgggcgtggagaaattaatatcgtccaagatgatgcttgagggatcgaatcggaggattcatgctgttcatcgtcatgctggaatgtccgtagcaggattagcagcagatggaagacaaattgtttcacgtgccaagtctgaagcaatcagctacgaaagagtgtatggtgaacctattcccatcaaggaacttgcagatcgggttgccagttatgttcatctctgtactctctattggtggctgagaccttttggatgtggagttattcttggaggttttgacagagatggtccacagctatacatgatcgaaccttctggtgtttcttataaatactttggcgcagctattgggaagggaaggcaagctgcaaaaacggagatagagaagctaaatttatcggagatgacttgcagggaaggaattcttgaagttgctaaaattatatatggagtacatgatgaagcaaaggacaaatcttttgaattagaactcagctgggtttgtgaagaatcaaaccgccaacatcaaaatattccagatgaccttatggaggatgcaaaagaagcagcaataatggcaatggaggaaatggatgcagattaatttcaaccatttaaactggatgattaatttcgaatttccgacaaagaagcatttttctaacaatggctattagattgctggagattttttctctctttcaattcgatgtgttgtatttgattaaatgtttggctgtttgcaaccatacactgtacaatgaggcattgcaatatgttgttttgattattgtgtgttaattcatcattttaggtgtttaaagtttatatgattaggttaaccacttatattaactattattct

SEQ ID NO: 2831 - DNA, 1076 bp, Beta vulgaris
attgaaaaaggaaaaacagtgctcttgctctgtcttgctgttcacgaaatcatctgcctttaaaagttcgtagacaaccaaaagtggatcgcaaacactgaaaacagagtgaaagaagggagagcgcaaaacgcaaattaattagaatgagtagcatcggaactggctacgacctatcggtcaccactttctcgcctgacggtcgcgttttccagatcgagtatgctgctaaggctgtcgacaacagcgggactgttgtaggcatcaaatgcaaggatggaatagttctgggcgtcgagaagcttatacaatcgaagatgatgttaccggggtccaatcgacgaatccattccgttcatcgacactctggcatggcagttgctggtttagcagcagatggaaggcaagtggttgctcgtgcaaagtcggaagctactaactatgagagtacatatggggaagctattccagtgaaggaacttgctgatcgtgttgctagttacgtgcatctctgcacactctattggtggctcagaccttttggttgtggagtcattcttggaggttatgacagagatggaccacaattatatatggttgagccttctggaatttcatataggtattttggcgctgctattggaaagggaaaacaggctgctaaaacggaaatcgagaagttgaagctttctgaaatgtcgtgtagagaaggggtcattgaagtagccaagatcatatacaaggttcatgatgaagcaaaggataaggcttttgaattggagatgagttgggtttgtgaggagtcaaaacgcgagcatcaaaaggttcctgataatcttctagaacaagccaaagccgctgcaactgctgctctggaagagatggatgctgactgatgcttatagagggttggaactagaaatttatgctttaagtgaagaatttctggaggttcgctaatggctgagggagcgggctcttactgccatacttttgaccttttagaaacttctttcagcttaactgccaaattgttcatcttggatttgtttagtttttgtagtagtgataatgtt

SEQ ID NO: 2832 - DNA, 1205 bp, Fagopyrum esculentum
ctcctttattttctggcttgacccatacgaaatcttcgttttcttcttcttccgatctccattcctcacatacctgtaacctaaagagtgagagaggacacagcctcaagagagtgagaaagagaggttaatcaatcgaagttgaaggatgagcagcatcggaaccggttacgatctttccgtcaccaccttctcccctgacggacgagtttttcagatcgagtacgccgctaaagctgtcgacaatagcgggactgttgttggaatcaagtgcaaggatggcatcgttctgggcgtggagaagcttatacagtctaagatgatgctgcctgattcaaatcgccgaattcactcggttcaccggcattccggcatggctgttgctggattagctgcagatggcagacaaatagttgcacgtgctaaatcagaagccatgaattatgaaagtacatatggtgaacctattccaacaagtgaactggcacaacgtgtggctagctatgtccatctctgcacactctattggtggctcagaccttttggatctggagttattctaggcggctatgatagagatggaccacagctgtacatggttgagccatctgggatatcatataggtattccggagctgctattggaaagggaagacaagctgctaagacggagattgaaaagttgaagctttctgaaatgacctgcagagaaggagtcatcgaagtagctaaaatcatctacaaggtgcatgatgaagcaaaggacaaggcctttgagctggagctgagttgggtttgtgatgagtcaaaccgtgagcatcagaaggttccagtagacgttctagagactgctaaggccgctgctactgcagcattggaagaaatggacgcggactaaatcttctttttccctacatgatcatgttggttggggttcgagttgcttgtagcattgtactgagcgagctcaggttcagtttatttgagagatggatcttttatgactattgactatcttcagtgctctaagatatgcttctttgctagagtttttaagttatttgagcaaccagcatgtgtcttaacttgtggagatcatgggttagggtccatggttccatccagtcttccaggtgaccaaatcatgtgttaagtcctatctatttatgacgagctcgatatcttggaaaaaaaaagaaaaacta

SEQ ID NO: 2833 - DNA, 1133 bp, Fagopyrum esculentum
aagagagaaggagaggttaatcaatcgaagtggaaggatgagcagcatcggtaccggttacgatctttccgtcaccaccttctcccctgacggacgggtttttcagatcgagtacgccgctaaagctgtcgacaatagcgggactgttgttggaatcaagtgtaaggatggcatcgttctgggcgtggagaagcttatacagtctaagatgatgctgccagattcgaatcgccgaattcactcggttcaccggcattccggcatggctgttgctggattagctgcagacggcagacaaattgttgcacgtgctaaatcagaagccatgaattatgaaagtacatatggtgaacctattccaacaagtgaactggcacaacgtgtggctagctatgtccatctctgcacactctattggtggctcagaccttttggatctggagttattctaggtggctatgatagagatggaccacagctgtacatggttgagccatctgggatatcatataggtattccggagctgctattggaaagggaagacaagctgctaagacggagattgaaaagttgaagctttctgaaatgacctgcagagaaggagtcatcgaagtagctaaaatcatctacaaggtgcatgatgaagcaaaggacaaggcctttgagctggagctgagttgggtttgtgatgagtcaaaccgtgagcatcagaaggttccagtagacgttctagagactgctaaggccgctgctactgcagcattggaagaaatggacgcggactaaatcttctttttccctacatgatcatgttggttggggttcgagttgcttgtagcattgtactgagcgagctcaggttcagtttatttgagagatggatcttttatgactattgactatcttcagtgctctaagatgcttctttgctagaatttttttttaaagtaatttgagcaaccagcatgtatcttaactcgtggagatcatgggttagggtccatggttccatccagccttccaggtgaccaaatcatgtgtcaagtcctttttattcacgacgagctcaatatcttggaaactccttttgcgattaaatttggatgatagcaaattgtggttatgattccgt

SEQ ID NO: 2834 - DNA, 958 bp, Silene vulgaris
aagatgagtagcatcggaactggttacgatctctccgtcaccactttctctcctgacggtcgtgttttccagatcgaatatgctgctaaagctctcgataactccggtactgttgttggtattagatgcaaggatggaatcgttatgggtgtggagaagttgattcagtcgaagatgatgttaccgggttcgaatcggaggattcattctgttcatcggcattctggcatggctgttgccggtctagctgcagacggaaggcaggttgttgctcgtgcaaagtcagaagcttcaaactatgagagtacttatggtgaaccaattccagtgaaggaacttgctgaccgagttgctagctatgttcatctctgtacactctattggtggctcagaccctttggttgtggagttattcttggtggttatgatagagatggacctcaattgtacatggtcgagccttctggtatttcatacagatattttggtgctgcaattgggaaggggaagcaggctgccaaaacagaaattgagaagttgaaactctctgaaatgacctgtagagaagggatcatcgaagttgcaaagatcatatacaaggttcatgatgaagcaaaggacaaagcattcgaattggagctgagttggatctgtgaggagtccaaaagagagcatcaaaaggttcccagtgaccttttagaagcagccaagaccgctgctactaccgcattggaagaaatggatgctgattaattatatgctctattgtaccttgttgcttttgatgcaatggttgttctttatgatcgtttttatagatggatatgctgtgtaccaagtgctcccagatttcgattgtactagtattggatggttgtgatgaacatgtccatctatcggatcatggaattttatttcttgcatttgagccttggaaagttagattcagattgctaat

SEQ ID NO: 2835 - DNA, 861 bp, Vinca minor
attagtaagtaacagagtagcaaggagaagaaggattctgaaacacaaaagagaatgagtagtatcggaactgggtacgatctatcggtcacaacattctcgccggatggaagagttttccagatcgagtacgctgccaaggccgtcgacaactctggtaccgttatcggtatcaagtgcaaggacggcgtcgttctgggagttgagaagctcattgcttcaaagatgatgttgcctggatccaatcgaagaatccatgccgttcatcgccattccggcatggctgttgctggattagctgctgatgggcgacagattgttgcccgagcaaaagctgaagccactaactatcaaagtacgtatggagaaccaattcctgtgaaagagcttgcagaacgtgttgccagttatgtgcatttatgtacactttattggtggctcaggccttttggatgcggggtaatactaggaggttatgatagagatggaccacaattgtacatggttgaaccttctggtgtttcgtatagatactttggtgctgcaattgggaagggcaggcaggctgccaaaacggaaattgaaaaattgaatctttctgggatgacttgtcgtcaaggggttgtcgaggtggccaagataatatatggaatacacgatgaggcaaaggacaaggcctttgagttggagatgagttgggtttgtgatgagtcaaatcgccagcatcagaaggttccagatgagctactagcggaagccaaagctgcagccagggctgcacttgaggaaatggatgctgattagtggctgagaaacgtactctttttgtctttggcgattcatttctacgtcgtttttttt

SEQ ID NO: 2836 - DNA, 1298 bp, Theobroma cacao
agcgggcaacgggaaaggtttgagcccaacccgagaccacaacttacttgatgttgaaatgcccaataggcccattggcttgaagtcttgagaggaaagaaactcaacaaaaattacatcgacgtttagaggggaagaagagcaaagtagaaaaaagcagagaagaaagatgagcagcatcggaacaggttacgatctatcagtcaccactttctcacccgacggccgcgtttttcagatcgagtacgccgccaaagccgtcgataacagtggaactgtaattggaataaaatgcaaagatgggatcgttatgggagtggagaagctgatagcatcgaagatgatgttacctggttccaatcgaagaatccactccgttcatcgtcattccggcatggcagtggcaggattagctgctgacggtagacaaattgtggcacgtgctaaatctgaagctaataattatgaaagtgtttatggtgaatccattcctgtcaaggaacttgctgcgcgtgtcgcaagttatgtacatctatgcactctctactggtggctcaggccctttgggtgtggggtaatacttggaggttatgatagagatgggccccaattatatatggttgaaccatctggtatctcctatagatattttggtgctgcaattgggaaaggaaagcaagctgccaaaacggaaattgaaaagttgaagctgtcagaaatgacatgcagggaaggggttattgaagtagccaaaatcatctacaaggtacatgatgaagcaaaggacaaggcctttgaactggagatgagctgggtctgtgatgagtcaaagcaacagcatcaaaaggtgcctgatgaccttttagaggaagccaaggttgcagctagggttgcattagaagaaatggatgctgattaaatattattggagccggaatccccttgttatcatattgagatcttcccaaaattcccgttgttatggaccttctggttttatttatgaagtcatttgctgattaaacgaggccgttccaaatatcatatcatataagaacagctgacgtttggacgggactgtggattccaaaaactgttaactcggctttttaactgtacttttttaggcttctttaagacatcaacatagtgttcgtcagtggcattttgcgataaaggttgagaaacatctttctgttgtctgctgtgtgtatacattgaagcaatatatttgcagcttaatgattttttttttcatatatatttctatgatacttaactaaatcagccatgcattt

SEQ ID NO: 2837 - DNA, 1278 bp, Gossypium hirsutum
ccgcgcaggtaaagatgattattaactcaacagtgttggactacatttttgtacccttagcattgcgagttgtgaggccggtactaagggcctgaagcgaggagtaattagcgttgggctggtccggtaaaatactgaaatggagttggaacttcatcggccgtaaaaggcccatcagggtgaaaggtcttgacttgagaagaaagaaaactaagtgtgagaagtaggaaaagcaagtgcaaggaagagaagaaagatgagcagcattggaactggttacgatctctcagtcaccactttctctcccgacggccgcgtttttcagatcgagtacgcctccaaggccgtcgataacagtggaactgtaattggaataaaatgcaaagatgggatcgttatgggagtggagaagctgatagcatcaaaaatgatgttacctggctctaatcgtagaatcctttccgttcatcgtcattccggcatggcagtagctggattagcagctgacggcagacaaattgtggcccgtgctaaatctgaagctactagttatcaaagtgtgtatggtgaacccattcctgtcaaagaacttgctgaacgcgttgcaagttatgtccatttatgcactctttactggtggctcaggccttttggctgtggggtaattctaggaggttatgatagagatggaccccaattatacatggttgaaccgtctggcatctcctatagatactttggtgctgcagttgggaagggaaaacaagctgccaaaacggaaattgaaaagttgaagctgtctgaaatgacatgcagagaaggggtcattgaagtagccaaaatcatatataagttacatgacgaagcaaaggataaggcctttgaacttgagatgagttgggtctgtgacgagtccaagcaacaacatcaaaaggttcccgatgaccttttggaggaggctaaggctgcggctaggattgccctagaagagatggatgccgattaaacatgagtggagccagaatactgttgcaatggtattttgatcttcactaatttctcatctgtcataaacttgatgtttgatttatgatctaagtcattgactggttaaacatgtttccttgtattatttcatcaagaagatctgccggcttttttattagggcctttgatttcgaacaactacgaaatccgtaactgcctttgttaaggcatcaactatgcagtatgcacggggatttaatataaatatgttcatatgaaaatataaatatt

SEQ ID NO: 2838 - DNA, 1020 bp, Panax ginseng
cttgttaccaaagaaaagcaaagacgagtagcttgaaaaaacactcgacagtatacaatcgaacgagtgagagagagagagaagtagaagaaaaagatgagtagcatcggaacaggttacgacctatcggtcaccactttctcgcctgacggtcgagtttttcagattgagtacgccgccaaagctgtcgataatagcggcaccgtcgtcgccatcaaatgcaaagatggcattgttatgggagttgagaagctgatcgcatccaagatgatgttgcctggatctaatcgtacaatccactctgttcaccgccattccggcatggctgttgcaggtttagctgcagacggaagacagattgttgcgcgagctaaatccgaggcgaataactaccaaagcctttatggtgaccaaattccggtgaaagaactttgcgaacgtgtcgctagttatgtgcatctatgcacactttattggtggctcaggccttttgggtgtggagtaattcttggaggttatgatagagagggaccacaactatacatgattgaaccttcaggagtttcctataaatactttggtgctgctattgggaagggcaggcaggctgccaagacagagattgaaaaattgaagctgtcagagatgacttgccggcaaggtgttattgaagtagccaagataatttatggagtacatgatgaggccaaggacaaggcctttgaattggaaatgagttgggtttgtgacgagtcaaagcgtcagcatcagaaggttccagatgaggttttagaagaagctaaggcagcagcaaaagcagcccttgaagaaatggatgcagattagttgtcggaaacattacaattttctttttttctaattctgttcaaatgtttccgtcaactttctaaaatgatgtattacgaagctgaatactggttcttaaagttaaattgattgggcttatcacctctggcttgagttaacctaagggtgtttgaagctttgattttcttcgtg

SEQ ID NO: 2839 - DNA, 1132 bp, Lotus japonicus
atatttacacagaaaagcaagagcgagacactccgtgaagcaaaaaagcacagtaagaagaagaaagagaactcgaaaacatgagcagcattggaactggttacgatctatcggtcactactttctctccagatggacgcgtcttccagattgagtacgccgctaaagccgtcgacaacagcgggactgtgattgggatcaaatgcaaagatgggattgtgttgggtgtggagaagcttattccgtcgaaaatgatgctaccgggttccaatagaagaatacactctgtccatcgccactctgggatggctgtagcaggattagcagcagatggcaggcaaattgttgctagggctaaggctgaagcaaataactatgacagcacgtacggtgaacctattcctgttaaggaacttgctgatcgtgtggctagttatgtgcacctctgtacgttatattggtggctcagaccttttggatgtggtgtcatcctaggaggttatgacagagatggaccacagttgtacatggtcgaaccttccggtgtttcctataggtattttggtgctgcaattgggaagggcagacaggctgctaaaacagagattgaaaagttaaagcttgctgatatgacttgccgacaaggagttattgaagtagctaagattatctatggagttcatgatgaggccaaggataaagacttcgaactagaaatgagctgggtgtgcgatgaatctaagcgtcaacatgaaaaggtcccagatgatcttctagaagctgccaaggcagcagccaaagcagctcttgaagaaatggatgctgattaaactattaaatgtagtatttgttccaaagatgtatttcatgactttgtaattgagcattatctagaggaaattcaaaggcttgaacggttggattttgtatgcttattgatgattcaatgcccttgttgttttcctgtttatgcggacaaatgtttttagtactttaaatacttccctttatccattagcttcattttgaagttaactctcatccccgattctgcacctaataccttaatgtatggaaggtggaaatttcattaacagtggtcacttgtgttaaaattgtgaatccatcttcg

SEQ ID NO: 2840 - DNA, 1105 bp, Tropaeolum majus
atcgatgaattaagtggaaccaaaatttcaccttgtcttgtgggaaaagaaaattgctcccagattattattatcgaacttaagatcgaaggttctactggaagaacagaaaccagaaattttttcatataaggaaggagtgtgaaagtgagaaagaaagagaaggaaatcaaagatgagtagtatcggaacaggctacgatctatccgtcactactttctctccagatggtcgtgttttccagatcgagtacgccgcgaaagcggtcgataacagtggcactgttatcggcatcaaatgcaaagacgggatagttatgggtgtggagaagctcatagcgtcaaagatgatgttacctggttctaatcggagaattcactcagttcatcgtcatgctggcatggctgttgcgggattagctgctgatggcagacaaattgtggcaagggctaaatcggaagcagctagttatgaaagtgtctacggcgaaccaattcctgtgaaggagctctcagagcgagttgcaagttatgttcatttatgcactctctactggtggctcagaccctttggttgtggggtaattcttggaggttacgatagagatggaccgcaattatacatgattgaaccatccggcatatcatatagatattttggtgctgctattgggaaaggaaagcaagctgctaaaacggaaatcgagaaattaaacctttctcagatgacatgcagagaaggagtaattgaagtagccaaactcatatacaaggtccatgatgaagccaaagacaaggccttcgaattggaaatgagttggatttgtgacgagtcaaagcgacaacatcaaaaggttcctgaagatctgctggaggaagccaagaatgcggctagagttgcacttgaagaaatggatgctgattaatacttggacttaaattcaggcattatatagggatgaacaagtgcaccccactttcattacaatttacggcatttggaacttatggacttgtgtagtgatgaaatcatacaattatttttattaatccaacgtttattttaagaagctcaagcttaatactttaattaattaagaggcttc

SEQ ID NO: 2841 - DNA, 1156 bp, Tropaeolum majus
gttatcactgtttttattctagcccatgaacagaactgcatctccatcgatgaattaagtggaaccaaaatttcaccttgtcttgtgggaaaagaaaattgctcccagattattattatcgaacttaagatcgaaggttctactggaagaacagaaaccagaaattttttcatataaggaaggagtgtgaaagtgagaaagaaagagaaggaaatcaaagatgagtagtatcggaacaggctacgatctatccgtcactactttctctccagatggtcgtgttttccagatcgagtacgccgcgaaagcggtcgataacagtggcactgttatcggcatcaaatgcaaagacgggatagttatgggtgtggagaagctcatagcgtcaaagatgatgttacctggttctaatcggagaattcactcagttcatcgtcatgctggcatggctgttgcgggattagctgctgatggcagacaaattgtggcaagggctaaatcggaagcagctagttatgaaagtgtctacggcgaaccaattcctgtgaaggagctctcagagcgagttgcaagttatgttcatttatgcactctctactggtggctcagaccctttggttgtggggtaattcttggaggttacgatagagatggaccgcaattatacatgattgaaccatccggcatatcatatagatattttggtgctgctattgggaaaggaaagcaagctgctaaaacggaaatcgagaaattaaacctttctcagatgacatgcagagaaggagtaattgaagtagccaaactcatatacaaggtccatgatgaagccaaagacaaggccttcgaattggaaatgagttggatttgtgacgagtcaaagcgacaacatcaaaaggttcctgaagatctgctggaggaagccaagaatgcggctagagttgcacttgaagaaatggatgctgattaatacttggacttaaattcaggcattatatagggatgaacaagtgcaccccactttcattacaatttacggcatttggaacttatggacttgtgtagtgatgaaatcatacaattatttttattaatccaacgtttattttaagaagctcaagcttaatactttaattaattaagaggcttctttggt

SEQ ID NO: 2842 - DNA, 1093 bp, Orobanche aegyptiaca
aattattttgtttttcctctgtatcttgtcagcaaagaaaactctcttcgtagaaaagtgaaaaccaataaaacccctttaaattgaactcaaagaaacaaaagtgagagcataagagtagagagaacgaatagcagaaaatagttgaaaagggaaaatgagcagcataggcactggctacgatctatcggtgacgacattctcgccggacggccgtgttttccagatcgaatacgccgccaaagccgtcgacaacagcggcactgtggttgccatcagatgcaaagacggcatggttatgggagtggagaaactgattgcttcgaagatggtgttgccgggttccaaccgaagaatccacgccgttcatcgccactccggcatggctgttgcgggactagctgctgatgggaggcaaattgtggcaagagcaaaatctgaagcaaatagttatgagagtgtgtatggtgaaccaattcctgtacaagaacttgcacaacgagtagcaagctatgtgcatttgtgcacactctattggtggctcaggccctttggatctggagtgattttgggaggttatgatagagatggcccgcagttgtatgtggttgaaccatctggagtttcttatagatactttggtgctgccattgggaagggaagacaggctgctaaaacagagattgaaaagctaaagctttctgaaatgacatgccggcaaggggttgttgaggtggccaagattatttacggggtacacgatgaggcaaaagacaaggcctttgaactggaaatgagctgggtttgtgatgagtcgaaccgtcagcatcaaaaggtgccggatgatctattagaggaagccaagtcagccgcgaaagctgcgcttgaagaaatggatgcagattagtggatgtgattctctgctattttatgtctctcttttttcgtgtaacatgtttcttgaaactggtcatgtcgaccctgtctgctaacttgatacgaacgagtattatgcccagttgagatttgctcttacatttacaaacttattcatggttcggagttaaatcagtttgaaatttatttaaaggaa

SEQ ID NO: 2843 - DNA, 1163 bp, Taxus baccata
gaagcagctaacaagcacctgcttccaaagttgcaaacgatatatatatatttagacttgttttactacccagacttcacttttgctttgagagctggtttacttgagggaacaactcagaatctatgagcccaaggacggcggcttaacagcaactcatttctcgtttttattatttaacctgagcggatcgctgggtcaaaatgggaagcattggaaccgggtatgatttgtcagttacaactttctctccagatgggcgagtctttcaaattgagtatgcaacaaaggccgttgataacagcggaactgtgattggcataaagtgcaaggatgggattgttttgggggtagagaagctcattgcttctaaaatgcttctagaaggatctaatcgtagaattcatgctgtccatcgtcatgctggcatgggtgttgctgggttagcagcagatggtcggcaaattgtggctcgtgcaaaatcagaggcaactagttatgaaagcatgtatggtgaaccaatccctgtgaaggaactttgtgaacgagttgctagctatgtgcatttgtgcacactttattggtggttaaggccttttggatctggagttatccttggaggttatgatagggatgggcctcaactgtatatgatagagccatcaggagtggcctatcgatactttggggcagcaataggaaagggaaggcaggctgctaaaactgaaattgagaagttgaagctctctgaaatgacttgcagagaaggaatagtagaagtcgcaaaaatcatatatggtgtgcatgatgaagcaaaagacaaagcatttgagctggaaatgagctggatttgtgacgaatcaaataggcaacatgaaaagattccgacagatcttctagaggaagttaaggcactagctaaggcagcacacgaagacatggatgctgattagtgagaaaagggaaggggctgtttataaatttcagagaattgaccactgatgtaatgatgcatggacaaaatcatttgatgttaaccttcagaagctttcaatttttgaatctatatttggtttttatatgcaaaacagtaaaaacatcgtatttgtccatgttttttgtttcctgtgttttcgcaagtgaccataaattatgaaatttaa

SEQ ID NO: 2844 - DNA, 891 bp, Flaveria ramosissima
aaaaccactccgcctataaggctataaccttgctccgatcgcaggagaaaccagtaacccaaaacacagtagcaccaatttagccctagaagaagatgagtagcataggcacaggttacgatctttccgtcacaaccttctcgccggacggtagggtttttcagatcgaatacgcagctaaagccgtcgacaacagcggcaccgtcgtcggcatcaaatgcaaagacggcattgttattggcgtggagaagctgattgcgtcgaagatgatgttgcctggatctaatcggagaatccactcggtgcatcgtcatgctgggatgggtgtagctggattagctgcagatgggaggcagattgttgctagagccaaatctgaagcccacaactatgaaagtacctatggtgaacctattccaattaaagaacttgctgatcgtgttgctagttatgtgcatctatgcacactttattggtggctcagaccttttggatccggtgtgattcttggaggttatgaccgtgatggaccacaattatatatggttgaaccttctggtgtttcctatagatattttggtactgcaatcgggaagggcagacaggctgcaaagactgagattgaaaagctgaagctttctgagcttacttgtcgtcagggtgttattgaagtagcgaaaataatctatggagtacatgacgaggcaaaggaacaaaacgttcgaattggagatgagttgggtttgtgatgaatcaaaccgccagcaccagaaggttccagaagcacttttggaggaagcaaaagaagctgctaaagctgcattggaagaaatggatgctgaattaataataatcaatttcttcacattgtgtttatctggagtttcaatt

SEQ ID NO: 2845 - DNA, 1441 bp, Cephalotaxus harringtonia
atgctgtagctgggcatttttttagggcctgtaatctcttcttatttgttttctcttgcacgaaatctcgctggtcacattgaggagtgattttcatacaggttaggggtgtttggaagggatcgaacgagattcaaaatgcaatattaacacggcgttttcagctgagagcttcagtttaaaattttgtcttcatcacttctatgtaacggctggggttttatcggtgtaaagttttggttttatcacttcatcgttattattattcagtctgagcggatcgcagggtcgaaatggggagtattggaaccgggtatgatttgtcagttacaactttctccccagatgggcgagtcttccaaatagagtatgcaacaaaggctgttgataacagcggaactgtgattggcataaagtgcaaggacgggattgttttgggggtagagaagctcattgcttctaaaatgcttctagaaggatctaatcgaagaattcatgctgtccatcgccatgctggcatgggtgttgctgggttagcagcagatggtaggcaaattgtggctcgtgcaaaatcagaggcaactagttatgaaagcatgtatggtgaaccaattcctgtgaaggaactttgtgaacgagttgctagctatgtgcatttgtgcacactatattggtggttaaggccttttggatctggagttatccttggaggttatgatagagacgggcctcaactgtatatgattgagtcatcaggagtagcctatcgatactttggggcagcaattggcaagggcaggcaggctgctaaaactgaaattgagaagttgaagctctctgaaatgacttgcagagaaggaatagtagaagttgcaaaaatcatatatggagtgcatgatgaagcaaaagataaagcgtttgagctggaaatgagctgggtttgtgatgaatctaataggcaacatgaaaagattccgacagatcttctagaggaggccaaggcactagctaaggcagcacacgaagatatggatgctgattagtaacaaaacgaaagggtccactcacaagttccagagaattgacaactggtataagtgacgcttgggacaaaagtcatttattgtagtcccttcagaagctttcaatttttgtctgaaatttgtatggtgacattgaattgcaggcagaactgatttacttttgaagggaatttttaggtgtagtgaatttggaatctgtcgtaattgggttttatatgtccaaacatcttatccctgttcattttttcgctatgttttggctagagaccataaattttgaaatttgatccagagcgatgcctggctcaatattttccagcttatagaacaataatgttttttctaagaactcactagttaaaagaaaacaatatatagaatttgaaaattctggtacc

SEQ ID NO: 2846 - DNA, 1042 bp, Cicer arietinum
aaatgagtagcatcggaacaggatacgatctatcagtcaccactttctctcccgacggtcgcgtttttcagatcgaatatgctgccaaagctgttgacaatagcgggactgttattggaatcaaatgcaaagatgggattgttttgggtgttgagaagcttattccttcgaaaatgatgcttccgggttccaatagaagaatacacgccgttcatcgccacgctggaatggctgtagcgggattagctgcagatggcaggcaaattgttgctagggctaagtcggaagcaactaattacgacagcgtgtacggtgacccaattcccgtcaaggaacttgctgatcgagtggctagttatgtgcacctttgtacattatattggtggctcagaccttttggatgtggtgtcatactaggtggctacgacagagacggaccacagttgtacatggtcgaaccttctggtgtctcctacaggtattttggtgctgcaattgggaagggcaggcaggctgctaaaacagagattgaaaagttaaagcttgccgatatgacctgccgacaaggagttattgaagtagctaagattatatatggagttcatgacgaggcaaaggataaagatttcgaactcgaaatgagctgggtgtgtgaggaatcaaaccgccaacacgaaaaggtcccagaagagcttctacaagaagctaaggcagccgcaaaagcagctcttgaagaaatggatgcagattaaaaatgtttatcccaaagagatgtatttcataaacttgtaatagagagcattttggaacatctatagaaaatattcataggcttcaaaaattggatttttgtatgtttcttgatgattcaatgctgccccttgttgatttctgttgctgtactatggagaactgagctgtttcaaagtgtttttaaatactgctcttatcagttgatttagtgttgaattctagctgccttcgccaattgtccgcaccatataaggcatctcttgtttgagatattattttatgaaagcaa

SEQ ID NO: 2847 - DNA, 1337 bp, Eucalyptus grandis
gttcctccgcactgtcttgagattcaagtaagagagagagcttcataaacagctgctgctccttctgcctcctcctcctcctccaaagctccgcgaagaagcgaacgaggatcgaaacggaagaaatcgcagaggttgaactccggcgggaagaagcatgagcagcatcggaacgggctacgacctctcggtcaccactttctcccccgatggccgcgtcttccagatcgagtacgccgccaaggccgtcgacaacagcggtactgtgattggcatcaagtgcaaggacgggattgtcttgggcgtcgagaagctgataacgtcgaaaatgatgctgcccggttccaatcggcgaatccactccgtccatcgtcattccggcatggctgtggccggattagcagcagatgggagacagattgttgcccgagcaaaggctgaggcaactcaatatgatggtgtttatggtgaagccattcctttaaaggagcttgctggacgtgttgctaattatgtgcatctgtgcaccctctattggtggctcaggccttttggttgtggagttattctcggaggttatgacagagatggacctcaattatacatgattgaaccatctggtatttcctatagatacttcggggctgcaattggcaagggaaagcaagctgcaaagacagaaattgaaaagttaaagctctcagagatgacgtgcagggaaggagttattgaagtagctaagatcatctacaaggtgcatgatgaggcaaaggacaaggcatttgaactagaaatgagctgggtctgcgatgagtcaaagaggcagcatgagaaggttcctgacaacctcctagaggaagcgaaggctgcagctcgattggcattggaagagatggatgctgattaaatattcgataggatgaacaacgcccctttgatgcatgatttcactgttgtgatattgacggtacgagggatggtcttttaaggaattctttgggtggtttcctgcaatggacagtcagagatcgatctacgtctaagtgaatatctcgtccgagatgcctatggttttctgttcctcttcgatttgcattgcggtctctttttctcgctgtttcttctttcggggccctaaattcgctaagtcatttgttactgcaaacgattagctaaatgttcctgtgtttcttgtgttctctaggtgtacgtgccgactaatagtttctaactattagttttcaaaaataatttgaaattcccaaaagtgcaaatagcttgcaaaatcttctatctaaatttttataaaaatttaatgttgccaagtttaattttaa

SEQ ID NO: 2848 - DNA, 763 bp, Euphorbia peplus
caaagttcaagaggatgagcagcataggaactggttacgatctctctgtcaccactttctcccccgatggccgcgttttccagatcgaatacgctgccaaagccgtcgacaacagcggtaccgttattggcattaagtgcaaggacgggattgttatgggcgtggagaagctcatagcgtccaagatgatgttgcctggctccaacaggagaatccactctgttcatcgtcattcaggaatggctgttgctggtttagctgcggatgggagacagattgttgcgcgagcaaagtcagaagcaaccaattatgaaagtgtttatggtgaacccatccctgtgaaagaactagctgaacgtgttgctagttatgtgcatttatgtaccctctattggtggcttaggccatttggttgtggggtaattcttggcggttatgacagagaaggaccacaattatacatggtcgagccatctggcatatcatatagatattttggggctgcaattgggaagggaaagcaagcggctaaaacagaaattgaaaagttgaagctttctgaaatgacatgccgagaaggggttattgaggtagccaaaatcatctacaaggtgcatgatgaagcaaaggacaaggcctttgaactagaaatgagttgggtttgcgatgaatcaaagagattgcatcagaaggtacctgatgatctcttagaggaagccaagactgcagctaggactgcacttgaagaaatggatgctgatta

SEQ ID NO: 2849 - DNA, 1719 bp, Gossypium raimondii
cttttcttaatttagccaggggatggggaggtgaaggttctagcccgacccaatacttagggcttctgtgtggcgatggggagaggttcagtggatggattaggcccattcccatcggtaatgatgtcttgagaagaaagaaaagctccaatatttatataaaaaaacaaaagcagcaaaaagagcaaagtattcaagtgtgggggaaaaaagcagagaagaagaaacaaagatgagcagcatcggaactggttacgatctctcagtcaccactttctctcccgacggacgcgttttccagatcgagtacgccgccaaagccgtcgataacagcggaactgtgattggaattaaatgcaaagatgggatcgttatgggagtggagaagctgatagcatcaaagatgatgttacctggttctaatcgtagaatccactcggttcatcgtcattccggcatggcagtggctggattagcagctgacgggagacaaattgtggcccgtgctaaatctgaagctactaattaccaaagtgtctatggtgaacccattcctgtcaaagaacttgctgaacgcgttgcaagttatgtgcatttatgcaccctttactggtggctcaggccctttggctgtgggataattctcggaggttatgacagagatggtccccaattatatatggttgaaccatctggcatctcctatagatattttggtgctgcaattgggaagggaaagcaagctgccaaaacggaaattgaaaagttgaagctgtcagaaatgacctgcagggaaggggttattgaagtagccaaaatcatctacaaagtacatgatgaagcgaaggacaaggcctttgaactggagatgagttgggtctgtgatgagtcaaagcaacaacatcaaaaggttcctgatgaccttttagaggaagccaaggttgcagctaggactgcattggaagaaatggatgctgactaatgattaccggagacagaatcatcttgttatcttatgtatttcgatcttcaccaagttcccaatgttatggaccgtcaaaaaaggagtgagtgcctgattaaacagggtctttctaagatcatatgagcagcaggcttttggatgagatcatggattcaaaaaaccttggaactgtactgtagattttttaggcatcacgtagactttgccagtggcaactactgtgaaggttgtcgagaaacatctttctaggtttggtgtgtataccgctaaacaatatattggttttacaggggctatattttcgaagtcaatttgaatggtgtggtactaagacttaggaatgagcattcgattgattcagttttgaaaattgaacaaatttgacgaacttgaaccaactgaaatatgaacttgaaaatggaataattgaacaatctcgaaccaattgagaccaaaatctgatcaatggccaggtgagaaattggactaatcgaattgaaattgattgtttggtcctaggtatattgatagttaattattggtaactttacaattattctttcactaccattaatgagtaatcgcaaaattatgtggctgtgaattcatgattatgatgattatgatatgcatgacaaagttctaataacaaagcgactaaagtgatttgaattcaagtcacacttgaagtggtgaatacctaacacaagggattaaaaaaaagagaggacaag

SEQ ID NO: 2850 - DNA, 1233 bp, Lippia dulcis
agaacgagtgctatacgaaccaaatccctaaatcaaactcagcgcagaggtttagattatagggaaatcagcagctcaaatcggagcaagtatttagagagcgggagaagcaacaatgagcagcatagggactgggtatgatctatcggtgacaacattctcgccggacggccgcgttttccagatcgaatacgctgctaaagctgtcgacaacagtggtactgtggttgcaatcagatgcaaagacggcgttgttatgggagtggagaaattgattgcttcgaagatgatgttacccgggtccaacagaagaatccatgccgttcatcgccactccggcatggcagttgcaggactagctgcagatggaaggcaaattgtgactagagcaaaatctgaagcaactaattatgagaatgtgtatggcgaaccaattcctgtacaagaacttgcagcacgtgtagcaagttatgttcatttgtgcacgctctattggtggctcaggccatttggttgtggagtgattctgggaggttatgatagagatggcccacagttatacatggttgaaccttctggaatttcctataggtactttggtgctgccattgggaagggcaggcaggctgctaaaactgagatagagaaattgaagctttctgatatgacatgccgacaaggggttattgaggttgcaaagattatttatggagtacatgatgaggcaaaggacaaggcttttgaattggaaatgagttgggtttgcgatgagtcaaaccgtcagcatcagaaggttccagatgatttattagaggcggccaaaacagcagccaaagctgctcttgaagaaatggatgcagattaatctctgatactgcaattatattttcagttttcctgtgaacatttttctcgaaccaatgcgattaacttgttataaacatatgtatggttgatttctgttgctggatttatgttatttctatgaacatgttactgctttagttcagggtttaaatcaacttgacaaatccaagccacatgattgatggatgttcgatctgctattcatctcaagttctccttcctgtttatccaataacattgtacttatggtggaattaagaagaaaactaatgatgctagatttggagtgggtactgcattgagtgtacgtatacatcagaaaatattatttttcatattgtgtgagatatttatgatataaatttc

SEQ ID NO: 2851 - DNA, 1030 bp, Plantago ovata
ctgagagagagcaaagagctacacaaatcttcaatacaacaataatcgatttgattcaccaagatgagcagcataggaacaggttacgatctctccgtcaccacattctcaccggacggtcgtgttttccagatcgaatacgccgccaaggccgtcgacaacagcggcaccgtcgtcgctatccgttgcaaggatggcgtcgtaatgggagttgagaagctgattgcttcgaagatgatgttgcctggatccaatcggagaatccactccgtccatcgccactctggaatggctgttgccggactagctgcagacggtagacaaattgtggcaagagcaaaatctgaggcatctaactatgaaagtacatatggagaccaaattccagtaaaagaacttgctgaacgtgttgctagctatgtacatttgtgcactctctattggtggctcagaccttttggatgtggaattatcctcggaggttatgatagggatgggccacaattgtacatggttgaaccctcaggagtatcatatagatactttggcgctgccattggaaagggcaggcaggccgccaagactgagatcgaaaaattgaagctttcagaaataacatgccgtcaaggtgctattgaggtcgccaagattatatatggagtacacgatgaggcaaaggacaaggccttcgaattggaattgagctgggtatgtgacgagtcaaaccgccttcaccaaaaggttccggaggatctgttagaggaagccaaggatgctgctaaagccgcactggaagaaatggatgctgattaagggccgctgtccctctaccttgttgtgttgatcaattctcgtgaaatggtcaaaatggattatgtttgtctttggttatggaaaatgttaaacgttcggacatcgatggaaattatttgtaatctacaaaagatccttttaattttataatttagatatcaaccctgaactttgcctgttgtttgttcatcagtctagagttctttctttttgcttc

SEQ ID NO: 2852 - DNA, 1462 bp, Papaver somniferum
gaaatggatgcggactaattcagcttttgccatcgttattgcttgttcgagaagctcctctggaaccttctgatgtaggcggttcgactcatcacatacccagctcatttccaactcaaaagctttattttgactactcgaacagcactagagagaaactgaggaaataatacccccaaaaaaatacgaagaagaagtagaagagaagatgagtagcataggaactggttacgatctatcagttacaacattctctcctgatggtcgcgttttccagatcgaatacgcatccaaagctgttgataacagcggtactgtaattggaattaaatgcaaagatggcatagttttgggtgtagagaaattggttgcatcgaagatgatgttgcctggttcaaatcgcagaatacacgctgttcatcgtcattctggcatggctgtggctggattagctgctgatgggaggcaaattgttgctaggacaaaggctgaagcaatcaactatgaaaagacgtacggggaagctataccagtgaaggaacttgctgagcgtgttgctagttacgtccatctttgcacactttactggtggatgagaccttttgggtgtggagttatccttggaggttatgacagagacggtccacagttatacatggttgaaccatctggcatttcccacaggtattatggagctgcaatcggaaagggtaggcaggctgctaagacggagattgaaaagttgaacctttctgaaatgtcatgtagggaggggattgttgaagttgctaagattatctacagcgtgcatgatgaagcaaaggataaggcttttgagttggaaatgagctgggtatgtgatgagtcgaaccgcctacatcagaaggttccagaggagcttctcgaacaagcaataacgatggcaaaagcagctttggaagaaatggatgcggactaattcagctttggaagaaatggatgctgactaattcaacatcttagtctcaatgtttctttttctgttgtctcttgaattatatgtagtggttattggggtcgtttcaggtaatgactagagtcgaatattgtggatgagtcttcatctgctgttatttttttctgtcaatgactccatccaaaccttgtgtaaagcacgagcgggtctccccgattcttctttatgcagtaacacttgtactagtatccattctgatcaaggcttgaacataccttttccatgagtctggctttagatattactggagtgcagtaagtaaaaatttccatgaatctggcttatatattactggagtgatttttttttgtttaaaaatgcaaacaagagtattattaaatcaacgctgagttcttatccaacaatagttgagactcttaacatatatgttatgcttcctactgtatttggttagtatttctattacaactcctttttatcaaaaaa

SEQ ID NO: 2853 - DNA, 1302 bp, Papaver somniferum
tttttgactactcgaacagcactagagagaaactgaggaaataatacccccaaaaaaatacgaagaagaagtagaagagaagatgagtagcataggaactggttacgatctatcagttacaacattctctcctgatggtcgcgtattccagatcgaatacgcatccaaagctgttgataacagcggtactgtaattggaattaaatgcaaagatggcatagttttgggtgtagagaaattggttgcatcgaagatgatgttgcctggttcaaatcgtagaatacacgctgttcatcgtcattctggcatggctgtggctggattagctgctgatgggaggcaaattgttgctaggacaaaggctgaagcaatcaactatgaaaagacatacggggaagctataccagtgaaggaacttgctgagcgtgttgctagttacgtccatctttgcacactttactggtggatgagaccttttgggtgtggagttatccttggaggttatgacagagacggtccacagttatacatggttgaaccatctggcatttcccacaggtattatggagctgcaatcggaaagggtaggcaggctgctaagacggagattgaaaagttgaacctttctgagatgtcttgtagggaggggattgtagaagttgctaagattatctacagcgtgcatgatgaagcaaaggataaggcttttgagttggaaatgagctgggtatgtgatgagtcgaaccgcctacatcagaaggttccagaggagcttctcgaacaagcaataacgatggcaaaagcagctttggaagaaatggatgctgactaattcagctttggaagaaatggatgctgactaattcaacatcttagtctcaatgtttctttttctgttgtctcttggattttatgtagtggttattggggtcgtttcaggtaatgactagagtcatattgtggatgagtcttcatctgctgttttttatgtcaattgactccatccaaaccttgtgtaaagctcgagcgggtctccccgattcttctttatgcagtatcacttgtactagtatccattctgatcaaggcttgaactggagtgcagtaagtaaaaatttccatgaatctggcttatatattactggagtgatttttttttgtttaaaaatgcaaacaagagtattattaaatcaacgctgagttcttatccaacaatagttgagactcttaacatatatgttatgcttcctactgtatttggttagtatttctattacaactcctttttatcaaaactcaaaa

SEQ ID NO: 2854 - DNA, 1230 bp, Trigonella foenum-graecum
aacaaacccttcatattttcttttccaaactttcacacacaaaactcacttcagaatcgaaatctacaatcgatcaagatgagtagcattggaacaggatacgatctttccgtcaccaccttctctcccgatggccgtgttttccagatcgagtatgctggcaaagctgtcgacaatagtgggactgttattgggatcagatgtaaagatggagttgttttgggtgtcgagaagctcatcccttcaaaaatgatgctttcgggttccaatagaagaatacacgcggttcatcgccactctggaatggctgtagcaggattagctgcagatggaaggcaaattgttgccagggctaagtctgaagcaactaactatgacagcgtgtatggtgatccaattcctgtcaaggaacttgctgatcgcgttgctagttatgtgcacctctgcacattatactggtggctcagaccttttggatgtggtgtcatactaggtggttacgacagagatggaccacagttgtacatggtcgaaccttctggtgtctcctataggtattttggtgctgcaatcgggaagggcaggcaggctgcaaaaacggagattgaaaagttgaagcttgcggatatgacctgccgacaaggagttattgaagtagctaagattatatatggagttcatgatgaggcaaaggataaagatttcgaacttgaaatgagctgggtgtgtgacgaatcaaaccgtcaacatgaaaaggttccagaggagcttctagaagaagctaaggcagcagctaaactagctcttgaagaaatggatgcagattaacatattaaaaatattcatccgaaagatgtttttcataacctgtaatagagagcattgggaacatctatagaaatttcataggcttcaaaatttggattttgtatgcttcttgatgattccatgcccttgttgatttctgttgctgtggagaactgattcaatgcccttgtggacttctattttcgaagatgttgacaattgtttaagagtttcaagtgaaatttatttggaatttataaggttactagtagttgttagagtaactaaataaatatatttgaattgtatcttttagggtacatcttttacaataacaataaccaagccttatccctccaagtggggtgtcggttacatggatcaaattacgctatagtgttctatcataaatcatatttgaat

SEQ ID NO: 2855 - DNA, 1077 bp, Gossypium hirsutum
agaagaaacaaagatgagcagcatcggaactggttacgatctctcagtcaccactttctctcccgacggacgcgttttccagatcgagtacgccgccaaagccgtcgataacagcggaactgtgattggaattaaatgcaaagatgggatcgttatgggagtggagaagctgatagcatcaaagatgatgttacctggttctaatcgtagaatccactcggttcatcgtcattccggcatggcagtggctggattagcagctgacgggagacaaattgtggcccgtgctaaatctgaagctactaattaccaaagtgtctatggtgaacccattcctgtcaaagaacttgctgaacgcgttgcaagttatgtgcatttatgcaccctttactggtggctcaggcccttcggctgtgggataattctcggaggttatgacagagatggtccccaattatatatggttgaaccatctggcatctcctatagatattttggtgctgcaattgggaagggaaagcaagctgccaaaacggaaattgaaaagttgaagctgtcagaaatgacctgcagggaaggggttattgaagtagccaaaatcatctacaaagtacatgatgaagcgaaggacaaggcctttgaactggagatgagttgggtctgtgatgagtcaaagcaacaacatcaaaaggttcctgatgaccttttagaggaagccaaggttgcagctaggactgcattggaagaaatggatgctgactaatgattaccggagacagaatcatcttgttatcttatgtatttcgatcttcaccaagttcccaatgttatggaccgtcaaaaaaggagtgagtgcctgattaaacagggtctttctaagatcatatgagcagcaggcttttggatgagatcatggattcaaaaaaccttggaactgtactgtagattttttaggcatcacgtagactttgccagtggcaactactgtgaaggttgtcgagaaacatctttctaggtttggtgtgtataccgctaaacaatatattgcttttacaggggctatattttcgaagtcaa

SEQ ID NO: 2856 - DNA, 1322 bp, Gossypium hirsutum
gtggatggattaggcccattcccatcggtatgatgtcttgagaagaaagaaaagctccaatatttaatataaaaaacaaaagcagcaaaaagagcaaagtattcaagtgtgggggaaaaaagcagagaagaagaaacaaagatgagcagcatcggaactggttacgatctctcagtcaccactttctctcccgacggacgcgttttccagatcgagtacgccgccaaagccgtcgataacagcggaactgtgattggaattaaatgcaaagatgggatcgttatgggagtggagaagctgatagcatcaaagatgatgttacctggttctaatcgtagaatccactcggttcatcgtcattccggcatggcagtggctggattagcagctgacgggagacaaattgtggcccgtgctaaatctgaagctactaattaccaaagtgtctatggtgaacccattcctgtcaaagaacttgctgaacgcgttgcaagttatgtgcatttatgcaccctttactggtggctcaggcccttcggctgtgggataattctcggaggttatgacagagatggtccccaattatatatggttgaaccatctggcatctcctatagatattttggtgctgcaattgggaagggaaagcaagctgccaaaacggaaattgaaaagttgaagctgtcagaaatgacctgcagggaaggggttattgaagtagccaaaatcatctacaaagtacatgatgaagcgaaggacaaggcctttgaactggagatgagttgggtctgtgatgagtcaaagcaacaacatcaaaaggttcctgatgaccttttagaggaagccaaggttgcagctaggactgcattggaagaaatggatgctgactaatgattaccggagacagaatcatcttgttatcttatgtatttcgatcttcaccaagttcccaatgttatggaccgtcaaaaaaggagtgagtgcctgattaaacagggtctttctaagatcatatgagcagcaggcttttggatgagatcatggattcaaaaaaccttggaactgtactgtagattttttaggcatcacgtagactttgccagtggcaactactgtgaaggttgtcgagaaacatctttctaggtttggtgtgtataccgctaaacaatatattgattttacagtggctatattttcgaagtcaatttgaatggtgtggtactaggacttaggaatgagcattcgattgattcagttttgaaaattgaacaaatttgacgaacttgaaccaactgaaatatgaactttgaaatggaataatt

SEQ ID NO: 2857 - DNA, 1278 bp, Eucalyptus grandis
gttcctccgcactgtcttgagattcaagtaagagagagagcttcataaacagctgctgctccttctgcctcctcctcctcctccaaagctccgcgaagaagcgaacgaggatcgaaacggaagaaatcgcagaggttgaactccggcgggaagaagcatgagcagcatcggaacgggctacgacctctcggtcaccactttctcccccgatggccgcgtcttccagatcgagtacgccgccaaggccgtcgacaacagcggtactgtgattggcatcaagtgcaaggacgggattgtcttgggcgtcgagaagctgataacgtcgaaaatgatgctgcccggttccaatcggcgaatccactccgtccatcgtcattccggcatggctgtggccggattagcagcagatgggagacagattgttgcccgagcaaaggctgaggcaactcaatatgatggtgtttatggtgaagccattcctttaaaggagcttgctggacgtgttgctaattatgtgcatctgtgcaccctctattggtggctcaggccttttggttgtggagttattctcggaggttatgacagagatggacctcaattatacatgattgaaccatctggtatttcctatagatacttcggggctgcaattggcaagggaaagcaagctgcaaagacagaaattgaaaagttaaagctctcagagatgacgtgcagggaaggagttattgaagtagctaagatcatctacaaggtgcatgatgaggcaaaggacaaggcatttgaactagaaatgagctgggtctgcgatgagtcaaagaggcagcatgagaaggttcctgacaacctcctagaggaagcgaaggctgcagctcgattggcattggaagagatggatgctgattaaatattcgataggatgaacaacgcccctttgatgcatgatttcactgttgtgatattgacggtacgagggatggtcttttaaggaattctttgggtggtttcctgcaatggacagtcagagatcgatctacgtctaagtgaatatctcgtccgagatgcctatggttttctgttcctcttcgatttgcattgcggtctctctttctcgctgtttcttctttcggggccctaaattcgcgaagtcatttgttactgcaaacgattagctaaatattcctgtgtttcttgtgctctctaggtgtacgtgccgactaatagtttctaatagttttcaaaaataatttgaaattcccaaaagtgcaaatagcttgc

SEQ ID NO: 2858 - DNA, 1142 bp, Medicago truncatula
aagcagtggtatcaacgcagagtggccattacggccgggacaacttcttcactcacgaaaccaaaaaaaactcaaaatcaatcgaaatcgaagaaatcaaattcagcaatcatgagtagcattggaacaggctacgatctatccgtcactaccttctctcccgatggtcgcgttttccagatcgaatatgctgccaaagctgtcgacaatagtgggactgttattggaatcagatgcaaggatggaattgtgttgggtgttgagaagcttatcccttcgaaaatgatgctttcgggttccaatagaagaattcacgcggttcatcgccactctggaatggctgtagcgggactagctgcagatggaaggcaaattgttgctagggctaagtctgaagcaactaactacgacagcgtgtacggtgatccaattcctgtcaaggaacttgctgaccgtgtggctagttacgtgcacctctgcacattatactggtggctcagaccttttggatgtggtgtcatactaggtggttatgacagagatggaccacagttgtacatggtcgaaccttctggtgtctcttataggtattttggtgctgcaatcgggaagggcagacaggctgcgaaaacggagattgaaaagttgaagcttgcagatatgacctgccgacaaggagttattgaagtagctaagattatatatggagttcacgacgaggcaaaggataaagatttcgaactcgaaatgagctgggtgtgcgatgaatcaaaccgtcaacatgaaaaggttccagaggagcttctagaagaagccaagacagcagctaaattagctcttgaagaaatggatgcagattaagatattgaaaatattcatcccaaagatgcatttcataacttgtaacagagagcattgggaacatctatagaaatttcataggcttcaaaatttggattttgtatgcttcttgatgattcaatgcccttgttgatttctgttactgtggagaactgtttcaaagtgctttaactacttccctcatcaattgatttagtgtttcatttattttatcagtcttctccacttgtccatgccattattatggcaacatttggtttgagtaaatgttttatgaaacc

SEQ ID NO: 2859 - DNA, 1092 bp, Medicago truncatula
actcacgaaaccaaaaaaaactcaaaatcaatcgaaatcgaagaaatcaaattcagcaatcatgagtagcattggaacaggctacgatctatccgtcactaccttctctcccgatggtcgcgttttccagatcgaatatgctgccaaagctgtcgacaatagtgggactgttattggaatcagatgcaaggatggaattgtgttgggtgttgagaagcttatcccttcgaaaatgatgctttcgggttccaatagaagaattcacgcggttcatcgccactctggaatggctgtagcgggactagctgcagatggaaggcaaattgttgctagggctaagtctgaagcaactaactacgacagcgtgtacggtgatccaattcctgtcaaggaacttgctgaccgtgtggctagttacgtgcacctctgcacattatactggtggctcagaccttttggatgtggtgtcatactaggtggttatgacagagatggaccacagttgtacatggtcgaaccttctggtgtctcttataggtattttggtgctgcaatcgggaagggcagacaggctgcgaaaacggagattgaaaagttgaagcttgcagatatgacctgccgacaaggagttattgaagtagctaagattatatatggagttcacgacgaggcaaaggataaagatttcgaactcgaaatgagctgggtgtgcgatgaatcaaaccgtcaacatgaaaaggttccagaggagcttctagaagaagccaagacagcagctaaattagctcttgaagaaatggatgcagattaagatattgaaaatattcatcccaaagatgcatttcataacttgtaacagagagcattgggaacatctatagaaatttcataggcttcaaaatttggattttgtatgcttcttgatgattcaatgcccttgttgatttctgttactgtggagaactgtttcaaagtgctttaactacttccctcatcaattgatttagtgtttcatttattttatcagtcttctccacttgtccatgccattattatggcaacatttggtttgagtaaatgttttatgaaccc

SEQ ID NO: 2860 - DNA, 1110 bp, Tropaeolum majus
cggccgggggttatgctctgctgcttcttcaaagtttaaatcgaaggcttggaaaatcggagagaagtaaaaactgaaggaaatctaaaatgagcagcatcggaacaggttacgatctatccgtcaccactttctcacctgatggccgcgtttttcagatcgaatacgccgccaaggccgtcgacaacagtggaactgttattggaatcaaatgcaaggacgggatagttatgggtgtggagaagctcattgcatccaagatgatgttaccaggttcaaataggagaatccacgctgttcatcgtcatgctggcatggctgtagccggattagctgctgatggtagacaaatcgtggcaagggctaaatcagaagctgcttcttatgaaagtgtctatggcgaacccattcctgtgaaggaactctccgagcgtgttgcaagctatgtgcacttatgcactctctactggtggctcaggccttttggctgtggggtaattcttggaggttatgatagagatgggccacaattatacatgattgaaccatctggcatctcttacaggtattttggtgctgctatcgggaagggaaagcaagcggctaaaacggaaatcgaaaagttaaacctttcggaaatgacatgcagagaaggagtgatcgaagtagccaaactcatatacaaggtccatgatgaagccaaggacaaggcttttgaattggaaatgagttgggtctgtgatgagtccaagcgacagcatcagaaggttccagacgatcttttggaggaagctaagaacgcggctagagttgcattggaagaaatggatgctgattaatactttcttctaggatttgtaagcattgattggctcatcgtcccccacatttcatcagtgttttttttatgtgccctcgaaaccttgtggactggtgtaatcatgaagaaatatttggcttctaattttcttattgtgattgtatttgtttttaattcgataggttgagataaaaaatatcacataaaaccgattcaaagtcttttttatcttgttccgttctgttaaaagtttttacttcaaaaatcaaacgaggccgggaaatgcttct

SEQ ID NO: 2861 - DNA, 1088 bp, Tropaeolum majus
gcttcttcaaagtttaaatcgaaggcttggaaaatcggagagaagtaaaaactgaaggaaatctaaaatgagcagcatcggaacaggttacgatctatccgtcaccactttctcacctgatggccgcgtttttcagatcgaatacgccgccaaggccgtcgacaacagtggaactgttattggaatcaaatgcaaggacgggatagttatgggtgtggagaagctcattgcatccaagatgatgttaccaggttcaaataggagaatccacgctgttcatcgtcatgctggcatggctgtagccggattagctgctgatggtagacaaatcgtggcaagggctaaatcagaagctgcttcttatgaaagtgtctatggcgaacccattcctgtgaaggaactctccgagcgtgttgcaagctatgtgcacttatgcactctctactggtggctcaggccttttggctgtggggtaattcttggaggttatgatagagatgggccacaattatacatgattgaaccatctggcatctcttacaggtattttggtgctgctatcgggaagggaaagcaagcggctaaaacggaaatcgaaaagttaaacctttcggaaatgacatgcagagaaggagtgatcgaagtagccaaactcatatacaaggtccatgatgaagccaaggacaaggcttttgaattggaaatgagttgggtctgtgatgagtccaagcgacagcatcagaaggttccagacgatcttttggaggaagctaagaacgcggctagagttgcattggaagaaatggatgctgattaatactttcttctaggatttgtaagcattgattggctcatcgtcccccacatttcatcagtgttttttttatgtgccctcgaaaccttgtggactggtgtaatcatgaagaaatatttggcttctaattttcttattgtgattgtatttgtttttaattcgataggttgagataaaaaatatcacataaaaccgattcaaagtcttttttatcttgttccgttctgttaaaagtttttacttcaaaaatcaaacgaggccgggaaatgcttct

SEQ ID NO: 2862 - DNA, 1080 bp, Sciadopitys verticillata
gcagcgactctgcagagttggtactcttactatttgagctagtggtgttatagcatctgaggaggaggaacatctgtgacaccaaggctggctgcttaacagcataattcttattattattctgtctgaacaaatagcaagatcaatatgggcagcattggaaccgggtatgatttatcagttacaactttctctccagatgggcgagtctttcagatagagtacgcaacaaaggctgttgataacagcggaactgtgattggcataaggtgcaaggatggcattgttttgggggtagagaagctcattgcgtcaaaaatgcttctagaaggatctaatcgaagaattcatgctgtccatcgtcatgctggcatggctgtcgctgggttagcagcagatggcaggcaaattgtggctcgtgccaaatcagaggcaactagttatgaaggcctttatggtgaaccgatccctgtgaaggaactttgtgaacgagttgccagctacgtgcacttgtgcacactttattggtggctaaggccttttggatccggagttatccttggaggttatgatagagatggacctcaactgtatatgattgagccatcaggagtagcctatcgatactttggagcagcaattggcaagggtaggcaggctgcgaaaactgaaattgagaagttgaagctttctgaattgacttgcagacaaggtgtagtagaagttgcaaaaatcatatatggagtgcatgatgaagcaaaagacaaagcatttgagctggaaatgagctggatttgtgacgagtcaaataggcaacatgagaagattccagcagatcttctagaagaagccaaggtgctagctaaggctgcacatgaagatatggatgcagattagctagaaaaggaaacaggttgctcacaaattttcaagaattaactgtcagtgtaactgccatgtaggacaaaagcatctgataatgcggtcctcccttaagaaacactacaatttaatctgaaattacatggtgacattgacttgcaggaaaaatattattttgtcagaaattctgatgtaaac

SEQ ID NO: 2863 - DNA, 1044 bp, Tamarix hispida
  misc_feature (91)..(91): n is a, c, g, or t
  misc_feature (116)..(116): n is a, c, g, or t
  misc_feature (210)..(210): n is a, c, g, or t
  misc_feature (695)..(695): n is a, c, g, or t
gggggtcagtcttgatgactacgaaacaccgcctctgaagtcatctaatattaggcttagatctcccctctatggtctgagtcagcaggangaggaacagtgaaagaagagaaagnttgtgtaacgaaatcgccattgaaagatgagcagcataggaactggctatgatctctctgtcactactttctctcccgacggccgtgtttttcngatcgaatatgccgctaaagccgtcgacaacagcgggactgtagtggccatcaaatgtaaggatggagttgtgatgggcgtggaaaagctgatacaatcaaagatgatgctaccgggctctaatcggcgaatccactccgttcatcgccactctggcatggccgttgctggattagctgcagatggaaggcagatagttgctcgtgcaaaggcagaagccacaaattatgagagtctttatggtgaacctattcctgtgaaggaacttgctggacgtgttgccagctatgtgcatttatgtacgctttactggtggctcagaccttttggatgtggagtcattcttggaggatacgacagagatggaccgcaattgtatatggttgaaccttcaggaatttcttataaatactttggggctgcaattgggaagggaaaacaggctgctaaaacggaaattgaaaagatgaaactttctgaaatgncctgtcgagaaggggcaattgaagtggctaagatcatttacaaggtgcatgatgaggcaaaagataaggcatttgaattggagctaagctgggtttgtgatgaatcaaaccgtcagcatcaaaaggtgcctgcagagcttctggaggaagccaaatctgctgctgctgtagcattggaagaaatggatgctgactgaggctttgaggcattgacttagttattgtgaccttttgaccttgtttatgaattggacgtctggaggtctactgccaaagctggctagtctgcagaccagtatcttagcgattgcattgtgacttgtgagggaccttgtattgaatttgtagt

SEQ ID NO: 2864 - DNA, 1156 bp, Cedrus atlantica
gcccttgttggtcggtgtgattaaagcttgaaggacaagtaagccgtgaaagctgggagagcaggtctgaatcttgggagctgaaggccgggagctcaacaatactaactccaattttttttcttcacgggctgagcagatcgcaggaccaatatgggcagcattggaactgggtatgatttgtcagttacaacattctccccagatgggcgagtctttcaaatagagtatgcaacaaaagctgttgataacagcggaactgtgattggcataaagtgcaaagatgggattgttttgggggtggagaagctcattgcttctaaaatgcttctagaaggatccaatcgaagaattcatgctgttcacaatcatgctggcatggctgtggcgggattagcagcagatgggaggcaaattgtggcccgtgctaaatcagaggcaactagttatgaaaacacttatggcgaaccaatccctattaaggaactttgtgaacgcgttgcgagttatgtgcatttgtgcacactatattggtggctaaggccttttggatctggagttatccttggaggttatgatagagatgggccccaactatatatgattgagccatcaggagtagcctaccgatactttgggacagcaattggcaaaggcaggcaggctgctaaaactgaaattgagaagttgaagctctctgaaatgacttgcagagaaggagtaatagaagttgcaaaaatcatatatggagtacatgatgaggcaaaggataaagcatttgagttggaaatgagctggatttgcgatgaatcaaaaaggcaacatcaaaaggttccagcagatcttctagaagaagctaaggaagcagctaaggcagcacaagaagacatggatgcagactaaattggaaaagcgtttcctcattttctgcatttgagtaaagtgccatgtagtctaaagaattaacacatgggatgaaagcaatctcaaattgtttatctttttcagaagcttcattgtactccaaaatgaatggtgacattttcttgcggggcaaaaatgatttattttccttgggagttatttgcaacgtgatgaagtttgtagtttggagtttttattttatattccgttgaaacttacattatgcatgctc

SEQ ID NO: 2865 - DNA, 764 bp, Euphorbia peplus
gcaaaggtcaagaagatgagcagcataggaactggctacgatctttccgtcactactttctccccagatggccgcgttttccagatcgaatacgctgctaaagctgtcgacaacagcggtactgttattggaatcaagtgcaaggacgggattgtcatgggcgtggagaagctcatagcatcaaagatgatgttgcctggttccaaccggaggatccactctgttcatcgccactcgggcatggctgttgctggtttagctgctgatgggagacagattgttgcacgggcaaagtcagaggcaaccaattatgaaagtacttatggtgaaccggtccctgtgaaggaactcgctgaacgtgttgctagttatgtgcacttatgcaccctttattggtggcttaggccatttggttgtggggtaattcttggtggttatgacagagaaggaccacaattatacatggttgagccatcaggcatatcatatagatacttcggtgctgcaattggaaagggaaagcaagctgcgaaaacagaaattgaaaagttgaagctttctgaaatgacatgccgtgaaggggttattgaggtagccaaaatcatctacaaggtccatgacgaagcaaaagacaaggcctttgaactagaactcagttgggtttgcgatgaatcaaagagattgcatcagaaggtacctgatgatatcttagaggaagccaaggctgcagctaggactgcacttgaagaaatggatgctgatta

SEQ ID NO: 2866 - DNA, 1351 bp, Gossypium raimondii
ccagtatcaacgcagaggaataagaccaaacacaccgaacatcctagtaggggaaggcagagagaagaaacaaagatgagcagcataggtactggctacgatctctccgtcaccactttctctcccgacggccgcgttttccagatcgagtacgccgccaaagccgtcgataacagcggaactgtgattggaattaaatgcaaagatgggatcgttatgggagtggagaagctgatagcatcaaagatgatgttgcctggttctaatcgaagaatccactcagtccatcgtcattccggcatggcagttgctggattagcagctgacggtagacaaattgtggctcgtgctaaatctgaagctaccaattaccaaagtgtgtatggtgaacccatccctgtcaaagaacttgctgaacgtgtagcaagttatgtgcatttatgtaccctttactggtggctccggccctttggctgtggcataattctcggtggttatgatagagatggtcctcaattatacatggttgaaccatctggcatctcttatagatactttggtgctgcaattgggaagggaaaacaagctgccaaaacagaaattgaaaagttgaatctgtccgaaatgacatgcagagaaggggttattgaagtagccaaaatcatctacaaggtacatgatgaagcaaaggataaggcctttgaacttgagatgagttgggtctgcgatgaatcaaagcaacaacatcaaaaggttcctgatgacctgttagaggaagcgaaggttgctgctaggactgcactagaagagatggatgctgattaaattgttagtgaagccagaatagtctttgttattgatattttcatctacatgaatccccattgttatggtttaaactgtcctcgtatcatttttcatataagatccctgctgacaaatttttttaggaacatggatttcaaacagaacaactataaactatgcctttgtcactttttatttaggcttcaacagtgcaaactaagaatttacaaaaatcttctcggttccaagaatcttggaatttattttgttcgaaattcatatgaagaattgggatgtttgataaatttatagaaggtatagatttgttgcttgtaggttcaacaaatttggacataaggtctaaatgtaatatggcaaataaggtaattgatttagctttagttcaggtatcattgttgttgttgcaacatataggaagatgatgcgagttttaacgtgttcacatataatgtatttgttgtctttggtaattaacgtgttcacatattatctaaaaacttaaaatttttatatgcttttgaga

SEQ ID NO: 2867 - DNA, 1044 bp, Gossypium hirsutum
aagaccaaacacaccgaacatcctagtaggggaaggcagagagaagaaacaaagatgagcagcataggtactggctacgatctctccgtcaccactttctctcccgacggccgcgttttccagatcgagtacgccgccaaagccgtcgataacagcggaactgtgattggaattaaatgcaaagatgggatcgttatgggagtggagaagctgatagcatcaaagatgatgttgcctggttctaatcgaagaatccactcagtccatcgtcattccggcatggcagttgctggattagcagctgacggtagacaaattgtggctcgtgctaaatctgaagctaccaattaccaaagtgtgtatggtgaacccatccctgtcaaagaacttgctgaacgtgtagcaagttatgtgcatttatgtaccctttactggtggctccggccctttggctgtggcataattctcggtggttatgatagagatggtcctcaattatacatggttgaaccatctggcatctcttatagatactttggtgctgcaattgggaagggaaaacaagctgccaaaacagaaattgaaaagttgaatctgtccgaaatgacatgcagagaaggggttattgaagtagccaaaatcatctacaaggtacatgatgaagcaaaggataaggcctttgaacttgagatgagttgggtctgcgatgaatcaaagcaacaacatcaaaaggttcctgatgacctattagaggaagccaaggttgctgctaggactgcactagaagagatggatgctgattaaattgtcagtgaagccagaatagtctttgctattgatattctcatctacatgaatccccattgttatggtttaaactgtcctcgtatcatttttcatataagatccctgctgacaaattttatttggaacatggatttcaaacagaacaactataaactatgcctttgtcactttttatttaggcttcaacagtgcaaactaagaatttacaaaaaagaaaaagtaccgacacctgcgcgg

SEQ ID NO: 2868 - DNA, 1134 bp, Gossypium hirsutum
gaagtccaaacgcaccgaacatcctagtaggggaaggcagagagaagaaacaaagatgagcagcataggtactggctacgatctctccgtcaccactttctctcccgacggccgcgttttccagatcgagtacgccgccaaagccgtcgataacagcggaactgtgattggaattaaatgcaaagatgggatcgttatgggagtggagaagctgatagcatcaaagatgatgttgcctggttctaatcgaagaatccactcagtccatcgtcattccggcatggcagttgctggattagcagctgacggtagacaaattgtggctcgtgctaaatctgaagctaccaattaccaaagtgtgtatggtgaacccatccctgtcaaagaacttgctgaacgtgtagcaagttatgtgcatttatgtaccctttactggtggctccggccctttggctgtggcataattctcggtggttatgatagagatggtcctcaattatacatggttgaaccatctggcatctcttatagatactttggtgctgcaattgggaagggaaaacaagctgccaaaacagaaattgaaaagttgaatctgtccgaaatgacatgcagagaaggggttattgaagtagccaaaatcatctacaaggtacatgatgaagcaaaggataaggcctttgaacttgagatgagttgggtctgcgatgaatcaaagcaacaacatcaaaaggttcctgatgacctattagaggaagccaaggttgctgctaggactgcactagaagagatggatgctgattaaattgtcagtgaagccagaatagtctttgctattgatattctcatctacatgaatccccattgttatggtttaaactgtcctcgtatcatttttcatataagatccctgctgacaaattttatttggaacatggatttcaaacagaacaactataaactatgcctttgtcactttttatttaggcttcaacagtgcaaactaagaatttacaaaaatcttctcggttccaagaatcttggaatttattttgttcgaaattcatatgaagaattgggatgtttgataaatttatagaaggtatagatttgttgcttgtaggttcaacaaat

SEQ ID NO: 2869 - DNA, 1087 bp, Podocarpus macrophillus
aaaaataccactcttttcgctatcgttcttattgtgatcggatcgcaagagcagcatggggagcattggaaccgggtatgatttgtcagttacaaccttctctccagatggacgtgtctttcaaatagaatatgcaacaaaagctgttgataacagcggtactgtgattggcataaagtgcaaggatgggattgttttgggggtagagaagcttattgcgtcaaaaatgcttcttgaaggatctaatcgaagaattcacgctgtacatcgtcatgctggcatgggtgttgctgggctagcagcagatggtaggcaaattgtggctcgtgcaaagtcagaggcaagtaattatgaaaacctatatggtgaaccaattccagtgaaagaactttgtgaacgagttgccagctatgtgcatttgtgcacactttattggtggctaaggccttttggctctggagttatccttggaggttatgacagagatggtcctcaattgtatatgattgagccatcaggagtagcctatcggtactttggggcagccattggcaagggcaggcaggctgctaaaacagaaattgagaagttgaagctttctgagatgacttgcagacaaggagtggttgaagttgcaaaaatcatatatggagtgcatgatgaagcaaaggataaagcgtttgaactggaaatgagttggatttgtgatgaatcaaataagcaacatgaaaagattccatcaggtcttctggaggaagccaaggcattggctaaggcagcacatgaagacatggacgccgactagtcagaaatataagcgtcaccaatcttagagaattaactgccatataacctatgaagtcgacaaaatcatctgaaaatgcagtcccaactttcaattttctttggctctggtctgaaattacttggtaacattgccttgcaggtgaaatgatttatttttatcaaaaattctgttacgttgagaatttaagattgctatttgctttaccattatagatgtgacaaatatcatatttttcttcttttcatattttggcaagggactgcaaattttaaaattcaa

SEQ ID NO: 2870 - DNA, 1195 bp, Populus trichocarpa
caactaaacccaaaaacccactgtgtcagctgactctctgaggcagccagtcctgttctcttctgtcttgagatcgaagaaaacttttcttcttaaaccacagtctctctgtctctctctctaacccctgcaaaaagaaaaagcacagagatagaagctgaagaagacagaagcataaaacgatgagcagcataggaacaggctacgatctgtcggtcactactttctcgccggatggccgtgtttttcagatcgaatacgctgctaaagccgtcgataacagtggtactgttattggaatcaagtgcaaagacgggattgttatgggtgtggagaagctaatagcttcgaagatgatgttacccggttccaataggagaatccacgccgttcatcgtcattccggcatggctgttgctggtctagcggctgatgggagacaaattgttgcacgagccaaaagtgaggcaaccaattatcagagtgtttatggtgaacctgttcctatcaaggagcttgcagatcgtgttgctagttatgtgcatttgtgcactctctattggtggcttaggccatttggttgtggggtgattcttggtggttatgacagagatgggcctcaattatacatggtcgaaccatctggcatctcctatagatattttggcgctgcaatagggaaagggaagcaggctgctaaaacagaaattgaaaagttgaagctatctgaaatgacatgccgagaaggggttattgaagtagcgaaaatcatttacaaggtacatgatgaagcaaaggacaaggcctttgaactggaaatgagctgggtttgtgacgaatcaaagagacagcatgaaaaggttcctgatgacctcttagaggaagccaaggcagcagctcggaatgctctggaagaaatggatgctgattaaaaagcttattagagctgggaattcactccttggagattactgttgtcttcctgtaatcggttcccacttttcccttgtcagataccaagtgggtttatgttttttttttttttctttgaacatgggaaaattcaagtgggtttatgctagtgtattgctgcggttgcaagtaatttatcctcaactcttaaagtctagtatgtcctgtggtttttccttttcttataattcagtcttcatgcactttaaaaaagcacatgctt

SEQ ID NO: 2871 - DNA, 1118 bp, Euphorbia esula
  misc_feature (9)..(10): n is a, c, g, or t
  misc_feature (128)..(128): n is a, c, g, or t
cacaaaatnnaaatcaagcaaactcaaacccattcgcaaaggtcaagaagatgagcagcataggaactggctacgatctttccgtcactactttctccccagatggccgcgttttccagatcgaatangctgctaaagctgtcgacaacagcggtactgttattggaatcaagtgcaaggacgggattgtcatgggcgtggagaagctcatagcatcaaagatgatgttgcctggttccaacaggaggatccactctgttcatcgtcattcgggcatggctgttgctgggttagctgctgatgggagacagattgttgcacgggcaaagtcagaggcaaccaattatgaaagtacttatggtgaaccggtccctgtgaaggaactcgctgaacgtgttgctagttatgtgcacttatgcaccctctattggtggcttaggccatttgggtgtggggtaattcttggtggttatgacagagaaggaccacaattatacatggttgagccatctggcatatcatatagatacttcggtgctgcaattggaaagggaaagcaagctgcgaaaacagaaattgaaaagttgaagctttctgaaatgacatgccgtgaaggggttattgaggtagccaaaatcatctacaaggtccatgacgaagcaaaagacaaggcctttgaactagaactcagttgggtttgcgatgaatcaaagagattgcatcagaaggtacctgatgatatcttagaggaagccaaggctgcagctaggactgcacttgaagaaatggatgctgattaaagcttcaaatttatggaaatcatttggagatgggctctctttttctccttcccggaatttccgctgtcaaaaatcgattgggattcctccctaatatggttaaacatgtgcttaatcaaaccgggttttgtggcatcttaagtcaaaacttgttagcttccaaatttcttgtgaacatgtttctataggaattagtgttgttcatttatagccctttctagttgcttgtctctttttttttgctacttgaatttcatgttgcaatgtgtggctttattgatatttaatgaatccctaggcattttcaagcgtttcacc

SEQ ID NO: 2872 - DNA, 1013 bp, Abies balsamea
cgaaggcggggaactacaacaatacatacacagtttttttctcacgggctgagcagatcgcaggaccaatatgggcagcattggaacagggtatgatttgtcagttacaacattctccccagatggacgagtctttcaaatagagtatgcaacaaaagctgttgataacagcggaactgtgattggcataaagtgcaaagacgggattgttttgggggtggagaagctcattgcttctaaaatgcttttggaaggatccaatcgaagaattcatgccgttcacaatcatgctggcatggctgtggctggattagcggcagatggtaggcaaattgtggctcgtgctaaatcagaggcaactagttatgaaaacacttatggcgaaccgattcctattaaggaactctgtgaacgtgtcgccagctatgtgcatttgtgcacactatattggtggctaaggccttttggatccggagttatccttggaggttatgatagagatgggccccaactatatatgatcgagccatcaggagtagcctatcgatactttgggacagcaattggcaaaggcaggcaggctgctaaaactgaaattgagaagttgaagctctctgaaatgacttgcagacaaggagtaatagaagttgcaaaaatcatatatggagtacatgatgaagcgaaggataaagcatttgagttggaaatgagctggatttgtgatgaatcaaaaaagcaacatcaaaaggttccagcagatcttctagaagaagccaaggaagcagctaaggcggcacaagaagacatggatgcagactaaaccagaaaaccttttcctcgttttcttcattgagcaaaatgccattagcccaaagaattaacacatgggatgaaagcatctcaaaatgataatatttttcagaagctccattgtactccaaaatgaatggcgacattttcttgcgggacaaaaatgatttattttctttggaattatcccaacgtgaggaaag

SEQ ID NO: 2873 - DNA, 1001 bp, Brassica napus
gtaaggttctttcgtcgtcgtcgtacacaacaacaccctccccccccccccacttctccttcgctcaaatcaaaagatgagtagcattggcactggatacgatctctcagtaacgaccttctcccccgatggccgtgttttccagatcgagtacgccgccaaagccgtcgacaacagtggaactgttgttggaatcaagtgcaaggacgggattgtcatgggtgtagagaaacttattgcttcgaagatgatgctaccaggatctaaccgcagaatccattctgttcatcgtcatgctggcatggccgttgctgggcttgcagctgacggcaggcaaattgttgcaagggccaaatccgaagccagaagttatgagagtgtttatggggacgctgtgccagtgaaggaactttcggagcgtgttgcaagctacgtgcatttgtgtaccctttattggtggctcaggccttttggatgtggggtcattctcgggggttatgatagagatggacctcagctgtacatgattgagccatcggggatatcatacagatattttggtgctgccattggcaaaggcaagcaagctgctaaaacggaaattgagaaactgaagttatctgagatgacatgcagagaaggcgttattgaagtggcgaaaatcatttacaagctacacgatgaagccaaagacaaggcgtttgaattggagatgagctggatatgtgaggagtcaaaacgagagcatcagaaggtccctgatgatcttctggaagaagcaaagacggcagctaaaactgcactggaggagatggatgctgactaaattgagaaaatgggttaaatttgtttttgttcaatgcatcgtttggtggtgttctgttggaagactttgaatttttgtctctaggggcaattgttgcattgcagtttctcatgaacctttgggactctttcgtcattattgatatcgacagtttcttctacgacttctaataacg

SEQ ID NO: 2874 - DNA, 936 bp, Distylium racemosum
gttttgtagcatctcagaaggactaacaacaggcaaagaaagcggaaaatctgtgaatcttggagaccaacgcagggagcccagctatacgattcttcatattgttattaatatcattattttgcctgagcaaaatagcaagatcaatatgggaagcattggaaccgggtatgatttgtctgttacaactttctctccagatggacgagtctttcaaatagaatatgcaacaaaggctgttgataacagtggaacggtgattggcataaagtgcaaggatgggattgttttgggagtagagaagctcattgcatctaaaatgcttttggaaggatctaatcgaagaattcatgctgttcatcgtcatgctgggatggctgttgctgggttagcagcagatggtaggcaaattgtggctcgtgcaaaatcagaggctactaattatgaaggcctttatggtgaaccaatccctgtgaaggaactttgtgaacgagttgccagctatgtgcatttgtgcacactttattggtggctaaggccttttggttctggtgtaatccttggaggctatgacagagaggggcctcaactatatatgatagaaccatcaggagtagcgtatcgatactttggagcagccattgggaagggcaggcaggctgctaaaacagaaattgagaagttgaagctttctgaaatgacttgcagacaaggagtagtagaagtggcaaaaatcatatacggagtgcatgatgaagcaaaagataaagcatttgagctagaaatgagctggatttgtgatgaatcaaacagacaacatgaaaagattccatcagatcttctagaggaagcgaaagtattagcgaaggcagctcatgaagacatggatgcagactaatcagaaacggaggggcggacggtggtggcgagacgaca

SEQ ID NO: 2875 - DNA, 1087 bp, Euphorbia peplus
tcagcacacatatatctgtatctatgagctgaaaaacacacactgaaagcaaaaatcgaactcagaagacattgagattggttaacaaaggacaagaagatgagcagcataggaaccggatacgatctctcagtcactactttctccccagatggccgcgttttccagatcgaatacgctgccaaagccgtcgacaacagcggtactgttattggcattaagtgcaaggacgggattgtcatgggtgtggagaagcttatagcatcaaagatgatgttgcctggttccaaccggaggatccactctgttcatcgccactccggcatggctgttgctggtttagctgctgatgggagacagattgttgcacgggcaaagtcagaggcaaccaattatgaaagtacttatggtgaaccggtccctgtgaaggaactcgctgaacgtgttgctagttatgtgcacttatgcaccctttattggtggcttaggccatttggttgtggggtaattcttggtggttatgacagagaaggaccacaattatacatggttgagccatcaggcatatcatatagatacttcggtgctgcaattggaaagggaaagcaagctgctaaaacagaaattgaaaagttgaagctttctgaaatgacatgccgagaaggggttcttgaggtagcgaaaatcatctacaaggtgcatgatgaagcaaaggacaaagcctttgaactagaactcagttgggtttgcgaagaatcaaagagattgcatcagaaggtacctgatgacatcttagaggaagccaaggctgcagctaggaccgcacttgaagaaatggatgccgattaaagcttcagattcatggaaatcatttggagatggttgctgccgtgcactctctttttctccttcccagaatccgctgccaaaaaccgattgggttggatttatatttggtgaacgctatgagctagtttcccccctatatggttaaatatgtgcttaatcagaccaggttttgtggcatcttaagacaaaattgttagcttccaagtttcttgtgaacatgttactagaggaatcagcg

SEQ ID NO: 2876 - DNA, 794 bp, Eutrema parvulum
aagaagaagaaaagaaaaaacagaaggaaggagagatgagtagcattggaactggatatgatctctccgtcaccactttctctcccgatggccgcgtcttccagatcgagtacgccgccaaagctgtcgacaatagtggaactgttgttggaatcaagtgcaaggacgggattgtaatgggtgtggagaagcttattacgtccaagatgatgctaccaggttcaaaccggagaatccactccgttcatcatcatgctggcatggctgttgctggactagccgctgatgggaggcaaattgttgcacgggctaaatccgaggcgagaagttatgagagtgtctatggtgaagctgtacctgtgaaggaactttccgaacgcgttgcgagttatgtgcatttgtgtaccctctattggtggctcaggccctttggctgtggggtcattcttggaggttatgatagagatggccctcaattatacatgattgagccgtcaggcatatctcatagatattttggtgcagcaattgggaaaggaaagcaagctgctaaaacggaaatagagaagttgaaactttctgagatgacatgcagagaaggcgtaattgaggtggctaaaatcatttacaagctacacgatgaagcgaaagacaaggccttcgagttggagatgagttggatatgtgaggagtcaaaacgagagcatcagaaggtccctgaggatctcctagaagaagcaaagtccgcagctaaaacggcacttgaggagatggatgcagactaaaagctttat

SEQ ID NO: 2877 - DNA, 843 bp, Valeriana officinalis
aacaaacagccagtccagaaattcacaggtagaaaatcatcatgagcagcataggtactggatatgatctctcagttaccactttctctcccgacggccgtgttttccagatcgaatacgctgctaaagccgtcgataacagcggaactgttgtcggtataagatgcaaagatggaattgttatgggcgtggagaagctcataacatcgaagatgatgctgcctggatctaatcgtaggatccactcggttcatcgtcattctggcatggctgttgctggactagcagcggatgggagacaaatagttgcacgcgcaaaaggtgaagcgtcaagttatgaaagtacttatggtgaccaaatacctgtaaaggaactaactgatcgtgttgcaagctatgtgcacttatgtacgctctactggtggctcagaccgtttggctgtggagttattctcggaggttatgacagagatggaccacaactatatatgattgaaccttctggtatttcatataggtacttgggtgctgctataggaaaaggaaagcaggctgctaagacagaaattgaaaagttgaatctttctgagatgacctgcagagaaggagttcttgaagtagccaaaatcatctacagggtacacgatgaggcgaaggacaaagcctttgagttggagatgagctgggtttgcgacgagtcaaatcgccaacatgtcaaggtaccagaagatcttttaggacaagcaacggatgctgctaaggctgctttggaagaaatggatgctgattaattattattgtcagtaacaaactcaaaatcacccatttcattttttatttttc

SEQ ID NO: 2878 - DNA, 1104 bp, Sequoia sempervirens
gaatctttgagaccaaggacggcagcttaacaactcaatattcttcttatttgtaacattttaattactcagtctgagaagatcgtagaattacaatgggcagcattggaaccgggtatgatttgtcagtgacaactttctctccagacgggcgagtctttcaaattgagtatgctacaaaggctgtcgataacagcggaactgtgattggcataaagtgcaaggatggaattgttttgggggtagagaagctcattgcttctaagatgcttttagaaggatctaaccgaagaattcatgctgtccatcgtcatgctggcatgggtgttgctgggttagcagcagatggtaggcaaattgtggctcgtgcaaaatcagaggcaactagttatgaaagcatgtatggtgaaccaatccctgtaaaggaactctgtgaacgagttgctagctatgtgcatttgtgtacgctttattggtggttaaggccttttggatctggagttatccttggaggttatgatagagacggtcctcaactgtatatgattgagccatcaggagtagcctatcgatactttggggcagcaattggcaagggcaggcaggctgccaaaactgaaattgagaagttgaagctctctgaaatgacttgccgagaaggagtagtggaagtcgcaaaaatcatatatggagtgcatgatgaagcaaaagataaagcatttgagctggaaatgagctggatttgtgatgaatcaaagaggcaacatgaaaagattcccacagatcttttagaggaagccaagaagttagctaaggaagcacatgaagacatggatgctgactagtgagaaaagggggattgcttataaattttagagatttgtccacctatctaattatggggaaaaatcatttatgtacccttcagaagcattcaaattcagtctgaaattatatggtgacattgaattacaagtagaaatgatttgctgattgggggaattctaacatgcagagagttgggaatcaatatttgatttttatatgcgaaaaccttgtatctgctcatgttccttattttccctcaaaagaccatatatctgg

SEQ ID NO: 2879 - DNA, 1462 bp, Picea glauca
gactaaatatttagtacgttcagagatgaaaatgaaaattacacatttattttaaattcagtgtcaggactccactggtcttcttcacttttgcttttgcctgttggtgggtgttatgaaaccttgaggaacaagtaagccgtgaaagctgagaggagcacgtttgaatctcggagccaaaggccaggagctcgacaatactaagacctatttttttcttcacgcgctgagcagatcgcaggaccaatatgggcagcataggaaccgggtatgatttatcggttacaacattctccccagatggacgagtctttcaaatagagtatgcaacaaaagctgttgataacagcggaaccgtgattggcataaagtgcaaagacgggattgttttgggggtggaaaagctcattgcttctaaaatgcttctagaaggatccaatcgaagaattcatgctgttcacaatcatgctggcatggctgtggctggattagcggcagatggtagacaaattgtggctcgtgctaaatcagaggcaactagttatgaaaacacttatggtgaaccaatccctattaaggaactttgtgaacgtgttgccagttatgtgcatttgtgcacactatattggtggctaaggccttttggatctggagttatccttggaggttatgatagagatgggccccaactatatatggttgagccatcaggagtagcctatcgatactttgggacagcaattggcaaaggcaggcaggctgctaaaactgaaattgagaagttgaagctctctgaaatgacttgcagagaaggagtaatagaagttgcaaaaatcatatatggagtacacgatgaagcgaaggataaagcatttgagttggaaatgagctggatttgtgatgaatcaaaaaagcaacatcaaaaggttccagcagatcttttagaagaagccaaggaagcagctaaggcagcacaagaagacatggatgcagactaaactagaaaagctttttctcattttcttcattgagtaaagtgccatgtagtccaaagcattaacacgtgggatgaaagcatctcaaaattacaatctttttcagaagctccattgtaccccaaaatgaatggagacattttcttgcgggacaaaaatgatttattttccttagaattattcccaacgtgaggaaagtagtaatttttatttggtttttcattctatattccgttgaaacatcacattatgcatgctctttttttccaagatattaaactaaggatttgaaaatgtggctgagaggcgcctaccccagaatttggcaatttagacaagaaatatttgcgtgctagaccagaagcaaggttaactactctttcggaagaccaattattatccaagtatggtgtcttatgacagtaatgtttttaccaagacaagtgatatctaagctgatttatttt

SEQ ID NO: 2880 - DNA, 1502 bp, Picea glauca
agttgactaaatatttagtacgttcagagatgaaaatgaaaattacacatttattttaaattcagtgtcaggactccactggtcttcttcacttttgcttttgcctgttggtgggtgttatgaaaccttgaggaacaagtaagccgtgaaagctgagaggagcacgtttgaatctcggagccaaaggccaggagctcgacaatactaagacctatttttttcttcacgcgctgagcagatcgcaggaccaatatgggcagcataggaaccgggtatgatttatcggttacaacattctccccagatggacgagtctttcaaatagagtatgcaacaaaagctgttgataacagcggaaccgtgattggcataaagtgcaaagacgggattgttttgggggtggaaaagctcattgcttctaaaatgcttctagaaggatccaatcgaagaattcatgctgttcacaatcatgctggcatggctgtggctggattagcggcagatggtagacaaattgtggctcgtgctaaatcagaggcaactagttatgaaaacacttatggtgaaccaatccctattaaggaactttgtgaacgtgttgccagttatgtgcatttgtgcacactatattggtggctaaggccttttggatctggagttatccttggaggttatgatagagatgggccccaactatatatggttgagccatcaggagtagcctatcgatactttgggacagcaattggcaaaggcaggcaggctgctaaaactgaaattgagaagttgaagctctctgaaatgacttgcagagaaggagtaatagaagttgcaaaaatcatatatggagtacacgatgaagcgaaggataaagcatttgagttggaaatgagctggatttgtgatgaatcaaaaaagcaacatcaaaaggttccagcagatcttttagaagaagccaaggaagcagctaaggcagcacaagaagacatggatgcagactaaactagaaaagctttttctcattttcttcattgagtaaagtgccatgtagtccaaagcattaacacgtgggatgaaagcatctcaaaattacaatctttttcagaagctccattgtaccccaaaatgaatggagacattttcttgcgggacaaaaatgatttattttccttagaattattcccaacgtgaggaaagtagtaatttttatttggtttttcattctatattccgttgaaacatcacattatgcatgctctttttttccaagatattaaactaaggatttgaaaatgtggctgagaggcgcctaccccagaatttggcaatttagacaagaaatatttgcgtgctagaccagaagcaaggttaactactctttcggaagaccaattattatccaagtatggtgtcttatgacagtaatgtttttaccaagacaagtgatatctaagctgatttattttctagatatttctaatgcttgggactccttcaaaaaa

SEQ ID NO: 2881 - DNA, 1076 bp, Triphysaria pusilla
gtcttgttcacaaagaaaacccttatattacccgaacttaaataaaagaccaaaaatccctaaattgagctcaaagtaacaatagcgagactaacaaagagcatcacagtaaagaaaaacgtccagctgaaactagttaaaatcgaaaaatgagcagcataggcacaggctacgatctatcagtgacgacattttcgccggatggccgcgttttccagatcgaatacgccgccaaggccgtcgataacagcggcaccgtggttgcgatcagatgcaaggacggtgttgttatgggagtggagaaactaattgcatcgaagatgatgttaccgggatccaacagaagaatccacgccgttcatcgccactccagcatggctgttgctggactagctgcagatggcaggcagattgtggcaagagcaaaatccgaagcaactaattatgagagtgtgtatggtgaacaaattcctgtgcaagaacttgctcaacgtgtagctagctatgtgcatttgtgcacactctactggtggctcaggccttttggatgtggagtgattttgggaggctatgatagagatgggccacagttgtacatggttgaaccatctggtgtttcctataggtactttggtgctgccatcggaaagggaaggcaggctgctaaaacggagattgagaaattgaagctttctgaaatgacatgccgacaaggggttattgaggtggcaaaaattatttatggggtacatgacgaggcaaaagacaaagcatttgagttggaaatgagttgggtgtgtgatgagtccaaccgtcagcagcagaaggtccctgaggatttattagaggaagccaagactgccgctaaagttgcacttgaagaaatggatgcagattaacttttctctattttcatattgatttcctatgtgtaacatttttcttgaaactggtcataatgtgctctccgcggaacacattatgatcgattcatatttgctcttacatgtatgaacttttcttgctttaactaaggggattcaaacaacaaacaggttgaatatcaatgttaaatg

SEQ ID NO: 2882 - DNA, 882 bp, Ambrosia trifida
agagccctctttcttcacttgtttcaaataaccacgaaccagtaacctaaaaacacacacacacacactactagcaaccaacctagaagacaggaagaagaagaagaaagaagatgagtagcataggaacaggttacgatctatccgtcacaacgttctcaccggacggtagggttttccagatcgagtacgccgctaaagccgtcgacaacagcggcaccgtcgtcggtatcaaatgcaaagacggcattgttattggagtagagaagctgattgcgtcaaagatgatgctgcctggatctaatcgtagaattcattcagtgcatcgtcattctgggatgggtgtagctgggttagctgcagatgggagacagattgttgcaagagccaaatctgaagcccacaactatgaaagtacctatggcgaacctattccaattaaagaacttgctgaccgtgttgctagctatgtgcatctttgcacactttattggtggctcagaccattcggatccggtgtgattcttggaggttatgatcgtgatgggccacaattatatatggttgaaccttctggtgtttcctatagatattttggtgctgcaattgggaagggcaggcaggctgcaaaaaccgagattgaaaagttaaagctttctgagctgacatgtcgtcagggtgttattgaagtagcaaaaataatctatggagtacacgacgaggcaaaggacaaaacatttgaactggaaatgagttgggtctgtgacgaatcaaaccgccagcatcagaaggttccggaaacacttttggaggaagcgaaagcagcagctcaagcagcattggaagaatggatgctgattaagaataataatagttaaaatc

SEQ ID NO: 2883 - DNA, 1049 bp, Cephalotaxus harringtonia
ggaaccgggtatgatttgtcagttacaactttctccccagatgggcgagtcttccaaatagagtatgcaacaaaggctgttgataacagcggaactgtgattggcattaagtgcaaggacgggattgttttgggggtagagaagctcattgcttcaaaaatgcttctagaaggatctaatcgaagaattcatgctgtccatcatcatgctggcatgggtgttgctggattagcagcagatggtaggcaaattgtggctcgtgcaaaatcagaggcaactagttatgaaagcatgtacggtgaaccaattcctgtgaaggaactttgtgaacgagttgctagctatgtgcatttgtgcacactatattggtggttaaggccttttggatctggagttatccttggaggttacgatagagatgggcctcaactgtatatgattgagccatcaggagtagcctatcgatactttggggcagcaattggcaagggcaggcaggctgctaaaactgaaattgagaagttgaagctctctgaaatgacttgcagagaaggaatagtagaagttgcaaaaatcatatatggagtgcatgatgaagcaaaagataaagcgtttgagctggaaatgagctgggtttgtgatgaatctaataggcaacatgaaaagattccgacagatcttctagaggaagccaaggcactagctaaggcagcacatgaagacatggatgctgattagtaacaaaaggaaagggtccacttacaagtttcagagatttgacaactggtgtaattgagatgcttgggacaaagtcatttattgtagtcccttaagaagctttcaatttgtctgaaattatatggtgacattgaattgcaggcagaattgatttacttttaacaggaattttaacgtgtggtgaatttggaatctgtcgtaatttggttttatatgttttatcttatccctgttcattttttccctatgttttggctagagatcataaattttgaaattcaatcctgagccatatctggctcaatattttc

SEQ ID NO: 2884 - DNA, 1017 bp, Arabidopsis lyrata
tctggcttgagaacaaagaaaacccctttcttcgatctctgcttaaatcactcgaagaagaagaaatcactaagagtcacaaaaaaaaaaagatcgacgaagatgagtagcattggaactgggtacgatctctccgtcaccactttctctcccgatggccgtgttttccagatcgagtacgccgctaaagctgtcgacaacagtgggactgttgttggaatcaagtgcaaagacgggattgttatgggtgtggagaaacttattgcatcaaagatgatgttaccaggttccaacaggaggatccattctgttcatcgtcatgctggcatggctgttgctgggcttgcagctgatgggaggcaaattgttgcgcgtgccaagtctgaagcacgaagctatgagagtgtttatggcgatgctgtacctgtgaaggaactttcagagcgtgttgcaagttatgtacatttgtgtaccctgtattggtggctgaggccttttggctgtggagtcattcttggaggttatgatagagatggacctcaattgtacatgattgaaccatcaggcatatcatataggtattttggtgcggccattggcaaaggaaagcaagcggctaaaacggaaattgagaagttgaatttatctgagatgacatgcaaagaaggcgttatcgaggtggcgaaaatcatctacaagctacacgatgaagccaaggacaaggcctttgaattggagatgagttggatatgcgacgagtcaaaacgagaacatcagaaggtccctgatgatcttctggaagaagcaaagacagcagctaaaactgcgctcgaggagatggatgctgactaaaactgaggagtgtgttgaatttagacctgttgtaatgcgtcgttttgtgtttcttatgtactctgaattgaattttgtcttggagggacagttgttgcagtgtcttatgaaccattggagtcttttatctttattgctatcaacagttgctacgataactccttt

SEQ ID NO: 2885 - DNA, 914 bp, Zea mays
ttctatgattcttattgatcaagccacggtgtttgtgaaaaggactgttgttgggatcaagtgcaaagatggcattgttctgggtgtcgagaagctggtaacctcaaagatgatgctggaggggtcaaatcggaggatccattcagtgcaccggcattcgggcttggttgttgctggtttggcagcagatggcagacaaattgtttcaagggccaaatcagaagctgccagttatgaaaaggtctatggagaacccattcctgtgaaggatttggcagatcgtgtagcaagttatgttcatctttgcacgctgtactggtggctcagaccttttggttgcggtgttattcttggaggttatgatagggatgggccacagctttacatgatagagccctcaggagtttcctataaatactttggtgctgcattggggaagggaaggcaggccgcaaagactgagatagaaaagttgaaactttcggagcttacctgccgagaaggcattgttgaagttgcaaagataatttatggagtgcatgacgaatccaaggacaaagcttttgagttggagttgagctggatctgtgatgaatcgaaccgccagcatcagaaggttccgaatgaattgttggagcaggccaaagctgctgctcaggcagctcttgaggagatggatgctgactaagaaacatgacaaatatgcccatgcttcatgtttttgtgctgttgatatctttgatccctttggggtgacaccgtgacagactggacattgccaatttgttggattttatttggatgtcatgtaaaactccattcatggaagtttgaatctggattgactgatataagagctgtggtgttttttacattctggtttagtcacgggctcacggcgctcgcgttcttta

SEQ ID NO: 2886 - DNA, 1550 bp, Pinus taeda
aatacaccttaaatcaaaacacttcgtttataatttgtaccttttattattaaatttttaggtacgctcagaaataaaaagtagaaaattacatgtttaattttaaattcagagtgtcaggacgctactggtcttcttcgcttttgctttttgcctgttgttggtgggtgttatgaaagcttgatgaacaagtaagtcgtgaaatctcagagtatctcgtctgaatctcggagccgaagcctaggagctcgacatcactaagaactatttttgccttcacgtgctgagcagatcgcaggaccaatatgggtagcattggaaccgggtatgatttgtcagttacaacattctccccagatggacgagtctttcaaatagagtatgcaacaaaagctgtcgataatagcggaactgtgattggcataaagtgcaaagatgggattgttttgggggtggagaagctcattgcttctaaaatgcttctagaaggatccaatcgaagaattcatgctgttcacaatcatgctggcatgggtgtggctggattggcagcagatggtaggcaaattgtggctcgtgctaaatcagaagcaacgagttatgaaaacacttatggtgagccgatccctattaaggaactttgtgaacgtgttgccagttatgtgcatttgtgcacactatattggtggttaaggccttttggatctggagttatccttggaggttatgatagagatgggccccaactatatatgattgagccatcgggagtagcctatcgatactttgggacagcaattggcaaaggcaggcaggctgcaaaaactgaaattgagaagttgaagctctctgaaatgacttgcagagaaggagtaatagaagttgcaaaaatcatatatggagtacatgatgaagcgaaagataaagcatttgagttggaaatgagctggatttgtgatgaatcaaaaaggcgacatcaaaaggttccagcagatcttttagaagaagccaaggaagcagcgaaggcagcacaagaagacatggatgcagactaaaccagaaaagctttttcccattttcttcgttgagtaaagtgcgatgtagtccaaagcattaacacatggattgaaaacatctcaaaatgatcatctttttcagacggtgcattgtaccccaaaatgaataggaacatttttcttgtggggcaagaataatttattttcctagaattattcccaacgtgaggaagtaatttttatttggcttttcattctatattccgttgagacatcacattatgcatgctcttttcttttccgagatattaaaccaaggatttgaatattgtgactgaaaggtgcctaccccataatttggcaatttaggcaagagatatttgcgttctaagctagaagcaaggttaactactcttttcgaaaggccaattatttaccaagcctggtgtcgcctggtgtcttctgacagtattcttttaaccaagacatgatacctaagctgatttattttctaatgctggtgactgcttcaaa

SEQ ID NO: 2887 - DNA, 1346 bp, Pseudotsuga menziesii
cttcttcttctccttttgctttttacctgttgttggttgttgttatttaagcttgaagaacaagtaagccgtgaaagctcggaggaactggtctgaatctcggagacgaagtccaggagctgaagaataccaacatctattttttttctttacgtactgatctaatcgcaggaccaatatgggcagcattggaacagggtatgatttgtcagttacgacattctccccagatggacgggtctttcaaatagagtatgcaacaaaagctgttgataacagcggaactgtaattggcataaagtgcaaagacgggattgttttgggggtggagaagctcattgcttctaaaatgcttctagaaggatccaatcgaagaattcatgctgttcacaatcatgctggcatggccgtggctggattagcggcagatggtaggcaaattgttgctcgtgctaaatcagaggcaactagttatcaaaacacttatggcgaaccaatccctatcaaggaactttgtgaacgcgtcgccagttatgtgcatttgtgcacactatattggtggctaaggccttttggatctggagttatccttggaggttatgatagagatgggccccaactatatatgattgagccatcaggagtagcttatcgatactttgggacagcaattggcaaaggcaggcaggctgctaaaactgaaatcgagaagttgaagctctctgaaatgacttgcagagaaggagtaatagaagttgcaaaaatcatatatggagtacatgatgaagcaaaggataaagcatttgagttggaaatgagctgggtttgtgatgaatcaaaaaagcagcatcaaaaggtgccagcagatcttttagaagaagccaaggaagcagctaaggcagcacaagaagacatggatgcagactaaaccagaaaagtttttctcatttttttcattgagtaaagtgccgtgtagtccaaagcattaacacatgggatgaaagcatctcaaaatgataatcttttccagaagcttcattgtactccaaatgcatggcggcattttcttgcgggacaaaaatgatttattttccttagaattattcccaacgtgaggaaacgaatttttatttggttctacattttatattttgttgaaacatcacattatgcatgctctttttttccaagatattaaactaaggacaagtgaaaataggtgcacacccgaggatttggctatttagaaaaaaactatttgcgtgctagactagaagcaaaggtttactttttcgaaagacgaattattatccaaatatggtgtgttatgacagtatatttgtttt

SEQ ID NO: 2888 - DNA, 1354 bp, Pteridium aquilinum
ccataatgccctaagactacgcactcggttgcgtattactgactgacttgcgtcgaaagttttcctctgcgatcgtcggagctcagcagaaacccgccaagatgagcagtatcgggactgggtatgacctatcagtaacaacattttcacctgatggtcgagtatttcaaattgagtatgcaaccaaggctgtggataatagcggaacttcggtgggcataaagtgcaaggatggagttgttctgggtgtagagaagttgattgcttcaaaaatgcttttggagggatctaatcgccgaatacattctgttcatcggcatgctggaatggcaatggcaggcttagcagctgacggcagacaaatcgtatcacgtgctcgatcagaagcaaacagctatcaagttaactacggggaagaaattcctattaaggagctttgtgaccgcgtggccagctatgtgcatctctgtactctctactggtggttaagaccattcggaaccgcagctcttcttggtggttatgatcgggatggcccacaactctacatgattgagccgtcgggtgttgcttataggtattttggggcagcagttggaaaaggaagacaggctgcaaagacggagattgagaaacttaagctatcagaaatgacgtgtagagaaggtgttattgaagtagccaaaattatttatagtgttcacgatgaagcaaaagacaaggcttttgagctggagatgagctggatatgtgatgaatcaaagcgcgaacatcaacgggtgccagctgacctccttgaacaagccaaggcagctgcgaaggctgctctagaggaagacatggatgcggactagctgggattttgaacgagtaaatctattggctggatgggttttggactttgaacgccgaaagatttgtttgcgcaatttgtcaaacaagacataattataccccattcgacacggtgagttaggtatataccttatgattgggcatggtgtacgacagtacaggacatttggcagtaaagcgtggaatctacgtcgtttctacagcttgtctgggggaatagaaagatttttgagtgctaaattttgtttgcaagttccttccatttctcaagatcatgattctgaaatcttatctctagcaaacacttcaaattaaaactgaaaatgaacgccattaagtttttgcatagcttctaactaatgggagccggcgtaggggttcgagtgggggcgtgtgtgtttgaacccttcctggctcgctccatacggtcacttatgggtggtgggccccactgtacacagttgctcccgttcgggtgggtgcgtttgcatgaaatttc

SEQ ID NO: 2889 - DNA, 1068 bp, Pinus pinaster
actggtcttcttcgcttttgctttttccctgttgttggtgggtgttatgaaagcttggtgaacaagtaagtcgtgaaatctcagagtatctcgtctgaatctcggagccgaagcctaggagctcgacatcactaagaactatttttgccttcacgtgctgagcagatcgcaggaccaatatgggtagcattggaaccgggtatgatttgtcagttacaacattctccccagatggacgagtctttcaaatagagtatgcaacaaaagctgtcgataatagcggaactgtgattggcataaagtgcaaagatgggattgtttgggggtggagaagctcattgcttctaaaatgcttctagaaggatccaatcgaagaattcatgctgttcacaatcatgctggcatgggtgtggctggattggcagcagatggtaggcaaattgtggctcgtgctaaatcagaagcaacgagttatgaaaacacttatggtgagccgatccctattaaggaactttgtgaacgtgttgccagttatgtgcatttgtgcacactatattggtggttaaggccttttggatctggagttatccttggaggttatgatagagatgggccccaactatatatgattgagccatcaggagtagcctatcgatactttgggacagctattggcaaaggcaggcaggctgcaaaaactgaaattgagaagttgaagctctctgaaatgacttgcagagaaggagtaatagaagttgcaaaaatcatatatggagtacatgatgaagcgaaggataaagcatttgagttggaaatgagctggatttgtgatgaatcaaaaaggcgacatcaaaaggttccagcagatcttttagaagaagccaaggaagcagcaaaggcagcacaagaagacatggatgcagactaaaccagaaaagctttttcccattttcttcgttgagtaaagtaccatgtagtccaaagcattaacacatggaatgaaaacatctcaaaatgataatctttttcagacgctgcattgtaccccaaaatgaataggaacatttt

SEQ ID NO: 2890 - DNA, 927 bp, Brassica napus
tcgaagaagatgagtagcattggaacaggatacgatctctcagtcacaaccttctctcccgatggccgtgttttccagatcgaatacgccgccaaagctgtcgacaacagtggaactgtcgttggaatcaagtgcaaggacgggattgtaatgggtgtggagaagcttatcgcatctaagatgatgctacccggatccaaccggaggatccattctgttcatcgtcatgctggcatggctgttgctgggcttgctgctgatgggaggcaaattgttgcacgtgctaaatctgaagccagaagctatgagagcgtttatggagacgctgtaccggtgaaggaactctcagagcgtgttgcaagttatgttcatttgtgtactctctattggtggcttaggccttttggttgtggagtcattcttggaggttatgataaagatggaccccaattgtacatgattgagccatccggcatttcatatagatattttggtgctgcaattggcaaaggcaaacaagctgctaaaacggaaatcgagaaattgaagttgtctgagatgacatgcaaagaaggcgttattgaagttgctaaaatcatttacaagttacacgatgaagccaaagacaaggcctttgaattggagatgagctggatctgcgaggagtcaaaacgagagcaccagaaggtccctgatgatcttctagaagaagcaaagacggcagccaaaactgcacttgaggagatggatgctgactaaactgagaaaatgggtcaaattagatatgtgttatgcatcgtttggtgtttctgttgtaaaacttttaaatttggccgagaggggcaaatcgctacagtttctcatgaacctttggactctttcatcttgttgctatcgacagtttctttgaactctggagtgactgtt

SEQ ID NO: 2891 - DNA, 1084 bp, Eutrema halophilum
gaaagcttttggcttctcttctggcttgagaacaaagaaaaccccattctccgatcctgcttaaaacgctgctctaggacgaagaaagaggaggaagaagaagtaagagtcaacaaaaatgagtagcattggaactggatacgatctctctgtcacgaccttctctcccgatggccgtgttttccagatcgagtacgccgcaaaagctgtcgacaacagtggaactgttgttggaatcaagtgcaaggacgggattgtaatgggtgtggagaaacttattgcgtcgaagatgatgctacctggatccaaccgtagaatccattctgttcatcgtcacgctggcatggctgttgctgggcttgcagctgatgggaggcaaattgttgcacgtgctaaatctgaagcgagaagttatgagagtgtatatggtgatgctgtacctgtgaaggagctttcagaacgtgttgcaagttacgtacatctatgtaccctgtattggtggctcaggccttttggctgtggggtcattcttggaggttatgataaagatggaccccagttgtacatgattgaaccatcaggcatatcatacagatacttcggtgcggccattggcaaaggaaaacaagctgctaaaacggaaattgagaagttgaaattatctgagatgacatgcaaagaaggtgttattgaagtggcgaaaatcatttacaagctacacgatgaagccaaagacaaggcctttgaattggaaatgagctggatatgtgaggagtcaaaacgagagcatcagaaggtccctgatgatcttctggaagaagctaagactgctgcgaaaactgcgctcgaggagatggatgctgactaaaactgagaggaagtgtgttaaattagatctgtctaaggcatcgtttggtgtttcttttgtaaactttgaatgtttctttatgatttttgtctcgagggacagttgttgcagtatctcatgaaccttttgggctcttttttatcttattgctatcaacagtggcttcaataactctcaagggacaaatattgcagtttcttataaatctcttttcat

SEQ ID NO: 2892 - DNA, 1035 bp, Arabidopsis thaliana
aaagatttggcttgtctctggcttgagaacaaagaaaacccctttcttcgatctcagcttaaatcactcgacgaagaagaaatcagaaaagagtcagagaaaaaaaaaatcaaggaagatgagtagcattggaactgggtacgatctctccgtcaccactttctctcccgatggccgtgttttccagatcgagtacgccgctaaagctgtcgacaacagtgggactgttgttggaatcaagtgcaaagatgggattgttatgggagttgagaaacttattgcatcaaagatgatgctaccaggttccaacaggagaatccattctgttcatcgtcatgctggcatggctgttgctgggcttgcagctgatgggaggcaaattgttgcgcgtgctaagtctgaagcacgaagctatgagagtgtttatggcgatgctgtacctgtgaaggaactttctgagcgtgttgcaagttatgtacatctgtgtaccctgtattggtggctcaggccttttggctgtggggttattcttggaggttatgatagagatggacctcaattgtacatgattgaaccatcaggcatatcatatagatactttggtgcggccattggcaaaggaaagcaagctgccaaaacggaaattgagaaattaaatttatctgagatgacatgcaaagaaggcgttatcgaggtggcgaaaatcatctacaagctacacgatgaagccaaggacaaggcttttgaattggagatgagctggatatgcgaggagtcaaaacgagagcatcagaaggtccctgatgatcttctggaagaagcaaagacggcagctaaaactgcgctcgaggagatggatgctgactaaaactgaggagtgtgttgaatttagatccgtcttattgcgtcgtttgatgtttcttatgtactctgaattgaattttgtctggagggacagttgttgcagtttcgcatgaaccattggagtcttttatcttattgctatcaacagttgctacgatgactccttcacta

SEQ ID NO: 2893 - DNA, 1214 bp, Brassica rapa
aaaaaagcccgataagaacagaatcgaggacccatcggccagagacaaaggtgttcttctggcttgacaacaaagaaatcctccccccattcttcttctatccttcctttgctcaaatcaaaagatgagtagcattggaactggatacgatctctcagtaacgaccttctcccccgatggccgtgttttccagatcgagtacgccgccaaagccgtcgacaacagtggaactgttgttggaatcaagtgcaaggacgggatcgtaatgggtgtggagaaacttattgcatctaagatgatgctaccaggatctaaccggagaatccattctgttcaccgtcatgctggcatggccgttgctgggcttgcagctgacggcaggcaaattgttgcaagggccaaatccgaagccagaagttatgagagtgtttatggggacgctgtaccagtgaaggaactttcagagcgtgttgcaagctacgtgcatttgtgtaccctttattggtggctcaggccttttggatgtggggttatccttgggggttatgataaagatggacctcagctgtacatgattgagccatcggggatatcatacagatattttggtgctgccattggcaaagggaaacaagctgctaaaacggaaattgagaaactgaaattatctgagatgacatgcaaggaaggcgttattgaagttgcgaaaatcatttacaagctacatgacgaagccaaagacaaggcatttgaattggagatgagctggatatgtgaggagtcaaaacgagagcatcagaaggtccctgatgatcttctggaggaagcaaagacggcagctaaaactgcactcgaggagatggatgctgactaaactgagaaaatgggttaaatttagtttttttttattgcatcgtttggtggtgttctgttgtaagactttgaatttttgtctctaggggcaattgttgcagtttctcatgaacttttgggactttcgtcactattgatatcgacagtttcttctacgacttcttataactctcgagggattgttgctgcaagttccttatgaacgttttatgggataggctcggaggtttacatcgatggaaacaaatattgcatcaaactctgtctcccacgaaaagacaacaatcacctggctgatttgttcactaaagatctacctcccaagacgttcaagttgttaa

SEQ ID NO: 2894 - DNA, 992 bp, Brassica rapa
atcggccagagacaaaggtgttcttctggcttgacaacaaagaaatcctccccccattcttcttctatccttcctttgctcaaatcaaaagatgagtagcattggaactggatacgatctctcagtaacgaccttctcccccgatggccgtgttttccagatcgagtacgccgccaaagccgtcgacaacagtggaactgttgttggaatcaagtgcaaggacgggatcgtaatgggtgtggagaaacttattgcatctaagatgatgctaccaggatctaaccggagaatccattctgttcaccgtcatgctggcatggccgttgctgggcttgcagctgacggcaggcaaattgttgcaagggccaaatccgaagccagaagttatgagagtgtttatggggacgctgtaccagtgaaggaactttcagagcgtgttgcaagctacgtgcatttgtgtaccctttattggtggctcaggccttttggatgtggggttatccttgggggttatgataaagatggacctcagctgtacatgattgagccatcggggatatcatacagatattttggtgctgccattggcaaagggaaacaagctgctaaaacggaaattgagaaactgaaattatctgagatgacatgcaaggaaggcgttattgaagttgcgaaaatcatttacaagctacatgacgaagccaaagacaaggcatttgaattggagatgagctggatatgtgaggagtcaaaacgagagcatcagaaggtccctgatgatcttctggaggaagcaaagacggcagctaaaactgcactcgaggagatggatgctgactaaactgagaaaatgggttaaatttagtttttttttattgcatcgtttggtggtgttctgttgtaagactttgaatttttgtctctaggggcaattgttgcagtttctcatgaacttttgggactttcgtcactattgatatcgacagtttctt

SEQ ID NO: 2895 - DNA, 1163 bp, Brassica rapa
ctattctggcttgagaagaaagaaaaacccaattccccgatccttgttaaatcgctagagaggagagaaagagagtaaacaacagtcgaagaagatgagcagcattggaacaggatacgatctctcagtcacgaccttctctcccgatggccgtgttttccagatggagtacgccgccaaagctgtcgacaacagcggaactgttgttggaatcaagtgcaaggacgggattgtaatgggtgtggagaagcttattgcatctaagatgatgctacccggatccaaccggaggatccattctgttcatcgtcacgctggcatggctgttgctgggcttgctgctgatgggaggcaaattgttgcacgtgctaaatctgaagccagaagctatgagagtgtttatggagacgctgtacctgtgaaggagctttcagagcgtgttgcaagttatgttcatttgtgtactctctattggtggcttaggccttttggttgtggagtcattcttggaggttatgataaagatggaccccagttgtacatgattgagccttccggcatttcatatagatattttggggctgcaattggcaaaggcaaacaagctgctaaaacggaaattgagaagttgaagttgtctgagatgacatgcaaagaaggcgttattgaagttgcaaaaatcatttacaagctacacgatgaagccaaagacaaggcctttgaattggagatgagctggatctgcgaggagtcaaaacgagagcaccagaaggtccctgatgatcttctggaagaagcaaagacggcagccaaaactgcacttgaggagatggatgctgactaaactgagaaaatgggtcaagttagataatatgtgttatgcatcgtttggtgtttctgttgtaaaactttaaaatttgcctcgaggggtaatcgctgcattttctcatgaatctttggactctttcgtttattgctatcgacagtttcttagactggagtgactgttgttgcagttttttctcaaacgttctagtttttcaccaatgcactaccgtcgttgctttccccttgtcatctcgtttagctcttcatatttgctgtttttgtctcattccaatagatatggtttgcttaataaagtgtcttaatttttataagca

SEQ ID NO: 2896 - DNA, 997 bp, Brassica rapa
ggagaagaaagaaaaacccaattccccgatccttgttaaatcgctagagaggagagaaagagagtaaacaacagtcgaagaagatgagcagcattggaacaggatacgatctctcagtcacgaccttctctcccgatggccgtgttttccagatcgagtacgccgccaaagctgtcgacaacagcggaactgttgttggaatcaagtgcaaggacgggattgtaatgggtgtggagaagcttattgcatctaagatgatgctacccggatccaaccggaggatccattctgttcatcgtcacgctggcatggctgttgctgggcttgctgctgatgggaggcaaattgttgcacgtgctaaatctgaagccagaagctatgagagtgtttatggagacgctgtacctgtgaaggagctttcagagcgtgttgcaagttatgttcatttgtgtactctctattggtggcttaggccttttggttgtggagtcattcttggaggttatgataaagatggaccccagttgtacatgattgagccttccggcatttcatatagatattttggggctgcaattggcaaaggcaaacaagctgctaaaacggaaattgagaagttgaagttgtctgagatgacatgcaaagaaggcgttattgaagttgcaaaaatcatttacaagctacacgatgaagccaaagacaaggcctttgaattggagatgagctggatctgcgaggagtcaaaacgagagcaccagaaggtccctgatgatcttctggaagaagcaaagacggcagccaaaactgcacttgaggagatggatgctgactaaactgagaaaatgggtcaagttagataatatgtgttatgcatcgtttggtgtttctgttgtaaaactttaaaatttgcctcgaggggtaatcgctgcattttctcatgaatctttggactctttcgtttattgctatcgacagtttcttagactggagtgactgt

SEQ ID NO: 2897 - DNA, 976 bp, Brassica napus
aaaggtgttcttctggctggacaacaaagaaatcctcccccccccccattcttcttcgatccttccttcgcaagatgagtagcattggcactggatacgatctctcagtaacgaccttctcccccgatggccgtgttttccagatcgagtacgccgccaaagccgtcgacaacagtggaactgttgttggaatcaagtgcaaggacgggattgtcatgggtgtagagaaacttattgcttcgaagatgatgctaccaggatctaaccgcagaatccattctgttcatcgtcatgctggcatggccgttgctgggcttgcagctgacggcaggcaaattgttgcaagggccaaatccgaagccagaagttatgagagtgtttatggggacgctgtaccagtgaaggaactttcagagcgtgttgcaagctacgtgcatttgtgtaccctttattggtggctcaggccttttggatgtggggttatccttgggggttatgataaagatggacctcagctgtacatgattgagccatcggggatatcatacagatattttggtgctgccattggcaaagggaaacaagctgctaaaacggaaattgagaaactgaaattatctgagatgacatgcaaggaaggcgttattgaagttgcgaaaatcatttacaagctacatgacgaagccaaagacaaggcatttgaattggagatgagctggatatgtgaggagtcaaaacgagagcatcagaaggtccctgatgatcttctggaggaagcaaagacggcagctaaaactgcactcgaggagatggatgctgactaaactgagaaaatgggttaaatttagtttttttttattgcatcgtttggtggtgttctgttgtaagactttgaatttttgtctctaggggcaattgttgcagtttctcatgaacttttgggactttcgtcactattgatatcgacagtttcttc

SEQ ID NO: 2898 - DNA, 1158 bp, Brassica napus
gggcttgagaagaaagaaaaacccaattctccgatccttgttaaatcgctagagaggagagaaagagagtaaacaacagtcgaagaagatgagcagcattggaacaggatacgatctctcagtcacaaccttctctcccgatggccgtgttttccagatcgagtacgccgccaaagctgtcgacaacagcggaactgttgttggaatcaagtgcaaggacgggattgtaatgggtgtggagaagcttattgcatctaagatgatgctacccggatccaaccggaggatccattctgttcatcgtcacgctggcatggctgttgctgggcttgctgctgatgggaggcaaattgttgcacgtgctaaatctgaagccagaagctatgagagtgtttatggagacgctgtacctgtgaaggagctttcagagcgtgttgcaagttatgttcatttgtgtactctctattggtggcttaggccttttggttgtggagtcattcttggaggttatgataaagatggaccccagttgtacatgattgagccttccggcatttcatatagatattttggggctgcaattggcaaaggcaaacaagctgccaaaacggaaatcgagaaattgaagttgtctgagatgacatgcaaagaaggcgttattgaagttgcaaaaatcatttacaagttacacgatgaagccaaagacaaggcctttgaattggagatgagctggatctgcgaggagtcaaaacgagagcaccagaaggtccctgatgatcttctggaagaagcaaagacggcagccaaaactgcacttgaggagatggatgctgactaaactgagaaaatgggtcaagttagataatatgtgttatgcatcgtttggtgtttctgttgtaaaactttaaaatttgcctcgaggggtaatcgctgcattttctcatgaatctttggactctttcgtttattgctatcgacagtttcttagactggagtgactgttgttgcagttttttctcaaacgttctagtttttcaccaatgcactaccgtcgttgatttccccttgtcatctcgtttagctcttcatatttgctgtttttgtctcattccaatagatatggtttgcttaataaagtgtcttaatttttaaaaaaaa

SEQ ID NO: 2899 - DNA, 846 bp, Pseudoroegneria spicata
cgtccgtcccggcggctctctcaaacccacactccccaccttcttgcggcacaagccggagccgacgatcccacctcccgccccgccccgcccgcgccgccgtcgacgtgacctcctccgcccgccgggatcggagacaactatatacaagatttagaggttgaagcaacttaacaatgagtagcataggaactgggtatgatctgtccgtcaccactttctccccagacggacgtgtcttccaggtcgagtatgctggcaaggccgtcgacaacagcgggacgattgttgggatcaaatgcaaagatggaattgtccttggtgtggagaagctgataacatcaaagatgatacttgccgggtcgaatcggagacttcattcagttcaccggaactctggcttggctgtggctgggttagcagcagacggtaggcagatagtctcaagagcaaagtcagaagcagccaattatgaaaaggtatacggagaacccatgcctgtaaaggaattagctgatcgtgtagctagctatgttcatctgtgtacactctactggtggctcaggccttttggctgtggagttattcttggaggttatgatagggatgggccacagctctacatgatcgaaccttcaggcctctcatataaatattttggtgctgctctgggtaaaggaagacaagctgcaaaaacggagatagagaaattgaagctttctgagctaacctgcagggaaggcattgttgaggttgccaagataatttatggtgtacacgacgaagcgaaagacaaatcttttgagctggaactgagctgggtgtgcgatgaatctaaccatcagc

SEQ ID NO: 2900 - DNA, 1073 bp, Raphanus sativus
gggaactttagaagctattctggcttgagaagaaagaaaacccccattctccgatccttcttaaatcgcgagagagagaagaggagcaaacaacagttgaagaagaagaagatgagtagcattggaactggatacgatctctcagtcacgaccttctctcccgatggccgtgttttccagatcgagtacgccgccaaagctgtcgacaacagtggaactgttgttggaatcaagtgcaaggacgggattgtaatgggtgtggagaagctcattgcatctaagatgatgctaccgggttccaaccggaggatccattctgttcatcgtcatgctggcatggctgttgctgggcttgctgctgatgggaggcaaattgttgcacgtgctaaatctgaagccagaagctatgagagtgtttatggcgacgctgtacctgtgaaggaactttcggagcgtgttgcaagttatgttcatttatgcactctctattggtggcttaggccttttggttgtggagtcattcttggaggttatgataaagatggaccccaattgtacatgattgagccatccggtatttcatatagatactttggtgctgcaattggcaaaggaaaacaagctgctaaaacggaaattgagaaattgaagttatctgagatgacatgcaaagaaggcgttattgaagttgcaaaaatcatttacaagctacacgatgaagccaaagacaaggcttttgaattggagatgagctggatttgcgaggagtcaaaaagagagcaccagaaggtccctgatgatcttctagaagaagcaaagacggcagccaaaactgcgcttgaggagatggatgctgactaaactgataaaaatgggtcaaaattagatattgtgtaatgatgcatcgtttggtgtttctgttgtaaaactttaaaatttgcctcgagaggggcaaatcgctgcattttctcatgaaccttttggactccttcgtcttgtttctatcgacagtttctttgaactctcgagttattgttgttgcagttttttctcaaacgttctagtttccacca

SEQ ID NO: 2901 - DNA, 948 bp, Raphanus sativus
  misc_feature (28)..(29): n is a, c, g, or t
  misc_feature (34)..(34): n is a, c, g, or t
  misc_feature (36)..(36): n is a, c, g, or t
aaatcgagttcgctcaaatcaaactaannaaaananaggatgagtagcattggaactggatacgatctgtcggtgacgactttctcacccgatgggcgggttttccagatcgagtacgccgccaaagctgtcgacaacagtggaaccgttgttggaatcaagtgcaaggacgggattgttatgggtgtggagaaacttatagcatcaaagatgatgctaccaggatccaacaggagaatccattctgttcatcgtcatgctggcatggctgttgctgggcttgctgctgacggcaggcaaattgttgcaagggccaaatctgaagccagaagttacgaaagtgtttatggggacgctgtaccagtgaaggaactttcagagcgtgttgcaagctacgttcatttgtgtaccctttattggtggctcaggccttttggatgtggggtcattcttggtggttatgataaagatggacctcaattgtacatgattgagccttccgggatatcatacagatattttggtgctgcgattggcaaaggcaaacaagctgctaaaacggaaattgagaaactgaaattatctgagatgacatgcaaagaaggcgttattgaagtggcgaaaatcatttacaagctacatgatgaagccaaagacaaggcatttgaattggagatgagctggatatgtgaggagtctaaacgagagcatcagaaggtccctgatgatcttctggaagaagcaaagacggcagctaaaactgcactcgaggagatggatgctgactaaactgaggaaaaatgggtcaaattagttttttttttgtttaatgcaacgtttggtcgtgttctgttgtaagaccttgaattgtgtctctaggggcaatttgttgcagtttctcatgaaacctttggactctttcgtcattattgatatcgacagtttctt

SEQ ID NO: 2902 - DNA, 929 bp, Raphanus sativus
gctcaaatcaaactaaagaaaagagaagatgagtagcattggaactggatacgatctgtcggtgacgacattctcaccggatgggcgtgttttccagatcgagtacgctgccaaagctgtcgacaacagtggaaccgttgttggaatcaagtgcaaggacgggattgttatgggtgtggagaaactaatagcatcaaagatgatgctaccaggatctaacaggagaatccattctgttcatcgtcatgctggcatggctgttgctgggcttgcagctgatggcaggcaaattgttgcaagggccaaatctgaagccagaagttacgaaagtgtttatggggacgctgtaccagtgaaggaactttcagagcgtgttgcaagctacgttcatctgtgtaccctttattggtggctcaggccttttggatgtggggtcattcttggtggttatgataaagatggacctcaattgtacatgatcgagccatcgggcatatcatacagatattttggtgccgccattggcaaaggcaaacaagctgctaaaacggaaattgagaaactgaaattatctgagatgacatgcaaagaaggcgttattgaagtggccaaaatcatttacaagctacatgatgaagccaaagacaaggcatttgaattggagatgagctggatatgtgaggagtctaaacgagagcatcagaaggtccctgatgatcttctggaagaagcaaagacggcagctaaaactgcactcgaggagatggatgctgactaaactgagaaaaaatgggtttaaattagttttttgttttgtttaatgcaacgtttggtggtgttctgttgtaagactttgaattttgtctctaaggggcaactgttgcagtttctcatgaacctttcgtcattattgatatcgacagtttctt

SEQ ID NO: 2903 - DNA, 973 bp, Thellungiella halophila
ggaagaagtaagagtcaacaaaaatgagtagcattggaactggatacgatctctctgtcacgaccttctctcccgatggccgtgttttccagatcgagtacgccgcaaaagctgtcgacaacagtggaactgttgttggaatcaagtgcaaggacgggattgtaatgggtgtggagaaacttattgcgtcgaagatgatgctacctggatccaaccgtagaatccattctgttcatcgtcacgctggcatggctgttgctgggcttgcagctgatgggaggcaaattgttgcacgtgctaaatctgaagcgagaagttatgagagtgtatatggtgatgctgtacctgtgaaggagctttcagaacgtgttgcaagttacgtacatctatgtaccctgtattggtggctcaggccttttggctgtggggtcattcttggaggttatgataaagatggaccccagttgtacatgattgaaccatcaggcatatcatacagatacttcggtgcggccattggcaaaggaaaacaagctgctaaaacggaaattgagaagttgaaattatctgagatgacatgcaaagaaggtgttattgaagtggcgaaaatcatttacaagctacacgatgaagccaaagacaaggcctttgaattggaaatgagctggatatgtgaggagtcaaaacgagagcatcagaaggtccctgatgatcttctggaagaagctaagactgctgcgaaaactgcgctcgaggagatggatgctgactaaaactgagaggaagtgtgttaaattagatctgtctaaggcatcgtttggtgtttcttttgtaaactttgaatgtttctttatgatttttgtctcgagggacagttgttgcagtatctcatgaaccttttgggctcttttttatcttattgctatcaacagtggcttcaataactctcaaagggacaatattgcagtttctt

SEQ ID NO: 2904 - DNA, 1004 bp, Brassica napus
tgttaaatcgctagagaggagagaaagagagtaaacaacagtcgaagaagatgagcagcattggaacaggatacgatctctcagtcacgaccttctctcccgatggccgtgttttccagatcgagtacgccgccaaagctgtcgacaacagcggaactgttgttggaatcaagtgcaaggacgggattgtaatgggtgtggagaagcttattgcatctaagatgatgctacccggatccaaccggaggatccattctgttcatcgtcacgctggcatggctgttgctgggcttgctgctgatgggaggcaaattgttgcacgtgctaaatctgaagccagaagctatgagagtgtttatggagacgctgtacctgtgaaggagctttcagagcgtgttgcaagttatgttcatttgtgtactctctattggtggcttaggccttttggttgtggagtcattcttggaggttatgataaagatggaccccagttgtacatgattgagccttccggcatttcatatagatattttggggctgcaattggcaaaggcaaacaagctgctaaaacggaaatcgagaaattgaagttgtctgagatgacatgcaaagaaggcgttattgaagttgcaaaaatcatttacaagctacacgatgaagccaaagacaaggcctttgaattggagatgagctggatctgcgaggagtcaaaacgagagcaccagaaggtccctgatgatcttctggaagaagcaaagacggcagccaaaactgcacttgaggagatggatgctgactaaactgagaaaatgggtcaagttagataatatgtgttatgcatcgtttggtgtttctgttgtaaaactttaaaatttgcctcgaggggtaatcgctgcattttctcatgaatctttggactctttcgtttattgctatcgacagtttcttagactggagtgactgttgttgcagttttttctcaaacgttctagtttttcaccaat

SEQ ID NO: 2905 - DNA, 1859 bp, Eragrostis curvula
  misc_feature (41)..(41): n is a, c, g, or t
  misc_feature (51)..(51): n is a, c, g, or t
  misc_feature (102)..(102): n is a, c, g, or t
  misc_feature (210)..(210): n is a, c, g, or t
  misc_feature (340)..(340): n is a, c, g, or t
  misc_feature (359)..(359): n is a, c, g, or t
  misc_feature (367)..(367): n is a, c, g, or t
  misc_feature (373)..(373): n is a, c, g, or t
  misc_feature (392)..(392): n is a, c, g, or t
  misc_feature (399)..(400): n is a, c, g, or t
  misc_feature (406)..(406): n is a, c, g, or t
  misc_feature (410)..(411): n is a, c, g, or t
  misc_feature (414)..(414): n is a, c, g, or t
  misc_feature (416)..(417): n is a, c, g, or t
  misc_feature (426)..(426): n is a, c, g, or t
  misc_feature (430)..(430): n is a, c, g, or t
  misc_feature (434)..(434): n is a, c, g, or t
  misc_feature (439)..(439): n is a, c, g, or t
  misc_feature (441)..(441): n is a, c, g, or t
  misc_feature (443)..(445): n is a, c, g, or t
  misc_feature (448)..(448): n is a, c, g, or t
  misc_feature (453)..(455): n is a, c, g, or t
  misc_feature (501)..(502): n is a, c, g, or t
  misc_feature (505)..(505): n is a, c, g, or t
  misc_feature (507)..(507): n is a, c, g, or t
  misc_feature (511)..(512): n is a, c, g, or t
  misc_feature (525)..(525): n is a, c, g, or t
  misc_feature (532)..(532): n is a, c, g, or t
  misc_feature (543)..(543): n is a, c, g, or t
  misc_feature (563)..(563): n is a, c, g, or t
  misc_feature (566)..(566): n is a, c, g, or t
  misc_feature (569)..(569): n is a, c, g, or t
  misc_feature (571)..(571): n is a, c, g, or t
  misc_feature (585)..(585): n is a, c, g, or t
  misc_feature (604)..(604): n is a, c, g, or t
  misc_feature (606)..(607): n is a, c, g, or t
  misc_feature (707)..(707): n is a, c, g, or t
  misc_feature (832)..(832): n is a, c, g, or t
  misc_feature (835)..(835): n is a, c, g, or t
  misc_feature (847)..(847): n is a, c, g, or t
  misc_feature (862)..(862): n is a, c, g, or t
  misc_feature (865)..(866): n is a, c, g, or t
  misc_feature (877)..(879): n is a, c, g, or t
  misc_feature (881)..(881): n is a, c, g, or t
cagggttgaagcgctaatcgcgatgcctccccagttcgcanggtctccacngccgttcgcgccggcggaacgcgccccgttccagatccagttgcggggtanataagacaatactagttgacaatgagcagcataggcacaggttacgatctgtccgttaccaccttctctccagatggccgtgtcttccaggtcgagtacgccaccaangctgtcgacaacagcgggactgttgttggcattaagtgcaaagacggcattgtcctgggtgtagagaagctggtaacttcaaagatgatgctggagggatctaaccggaggatccattcagtgcaccggnactctggattggctgttgncggtttancagcanatgggaggcaaattgtctnaagggcnnaatcanaagnngcnanntatgaaaangtcnatgnggaancnannncgntgaannnattggcagaccgtgtggcaagttatgttcatctctgtacactatannggngnctcnngccttttggttgnggtgtcnttcttggcggntatgatagggatgggccacnctntananggtagaaccttcangagtctcctacaaatactntnnagctgcattggggaagggaagacaggctgcaaaaactgagatagagaagttaaagctttcagagcttacctgccgtgaaggcattgttgaagttgctaanataatttatggagtgcatgatgaagcgaaggacaaagcttttgagctggagctgagctggatatgtgatgaatcgaaccgtcagcatcagaagatcccaaatgatctgttggagcaggccaaggntgntgctcaggcagntcttgaggagatggntgnngactagaaagnnncnataataacagaacttatttcatctggcgctagtgaaatcttatatcccttatgggtgatggactggaatgtggcgagttgtcagattttatttcattgtgctggaatacttcacatgtacttaatggatgttccttcatggaagtttgaagctagacagtgaacgatatcagggttgtgttgtttgtattcagatgaaatcatgtcacttatgttctcttaggacttgagctaatgactgttttcctctcttcaaccctgatgaactgcttgcattttcaggagtatatagtaatctgaaatacgcttgtgcttgaaaaaaaaataaaacattaatatattaattctatcttccttttatatcatctttcgccccccgcactatcgccaacttacctataatataatatcaatatatacattactcaacaccaccccgccctttccaacctcttctacctcttccaccaacccttcccatttttttaataaaatgatcacacctcccctgaggttacagagcctcgtcctacgagtgccccccgcacacatgccgggcacaatctctcaaatctttttatatgaatttaattaagtttattgctattgtctaacaagaaaaggaatcaatatcacgatatacttatgagttttcacacatgactcacatctgtattacctatacgctctctatcatccaacctgcaatgaattatcgccctcattattcaccatatataatcgacactcatcgcgtaagtacagatgttattatttccaccatcctttcccgtctgttctctttctatatatacagctccatcctacgtctcaaagcagtgccgtcctgtcactcctcacttctctcccggaagtatcctgaccatctcccccttctccccatcgaaaatcattaacgtgaagactggtaaccaatctcttacagtctactattgttatattctgttatatgttccga

SEQ ID NO: 2906 - DNA, 1100 bp, Eutrema parvulum
ggagcacttagaagcgttggcttctcttctggcttgagaacaaagaaaaccccttttctccgatcctgcttaaaacactcttccaggaagaagaaagaggaaggagaagaaacagtcgactaaaccaacaagatgagtagcattggaactggatacgatctctccgtcacgactttctcgcccgatggccgtgttttccagatcgagtacgccgcgaaagctgtcgacaacagtggaactgttgttggaatcaagtgcaaggacgggattgtaatgggtgttgagaaacttattgcatctaagatgatgctaccgggatccaaccggagaatccactctgttcatcgtcacgctggcatggctgttgctgggcttgcagctgatgggagacaaattgttgcacgggctaaatctgaagcgagaagttatgagagtgtttatggcgacgctgtacctgtgaaggaactttcagagcgtgttgcaagttacgtacatttatgtaccctttattggtggctcaggccttttggctgtggggtcattcttggaggttatgataaagatggaccccaattgtacatgattgagccatcgggcatatcacatagatattttggtgctgcaattggcaaaggaaaacaagctgctaaaacggaaattgagaagttgaaattatctgagatgacatgcaaagaaggcgttattgaggtggcgaaaatcatttacaagctacacgatgaagccaaagacaaggcctttgaattggagatgagttggatatgtgaggagtcaaaacgagagcatcagaaggtccctgatgatcttttggaagaagcaaagacagcagctaaaactgccctcgaggagatggatgctgactaaactgtggaagcgggttaaattagatttgtctaatgcatcgtttggtgttttctcttgtaaaactgtcgagtgtttcttatgaattttgtctccagggacagttgttacagtttctcatgaacctttggactatttttttatcttatttgctatcaacagttgcttcaataactctcgagggataaggtcttgcagtttctcatgaacttcttttggga

SEQ ID NO: 2907 - DNA, 982 bp, Brassica napus
gggcttgagaagaaagaaaaacccattctccgatccttgttaaatcgagagagagagaggaagagtaaacaacagtcgaagaagatgagtagcattggaacaggatacgatctctcagtcacaaccttctctcccgatggccgtgttttccagatcgaatacgccgccaaagctgtcgacaatagtggaactgtcgttggaatcaagtgcaaggacgggattgtaatgggtgtggagaagcttatcgcatctaagatgatgctacccggatccaaccggaggatccattctgttcatcatcatgctggcatggctgttgctgggcttgctgctgatgggaggcaaattgttgcacgtgctaaatctgaagccagaagctatgagagtgtttatggagacgctgtaccggtgaaggaactatcagagcgtgttgcaagttatgttcatttgtgtactctctattggtggcttaggccttttggttgtggagtcattcttggaggttatgataaagatggaccccaattgtacatgattgagccatccggcatttcatatagatattttggtgctgcaattggcaaaggcaaacaagctgctaaaacggaaatcgagaaattgaagttgtctgagatgacatgcaaagaaggcgttattgaagttgctaaaatcatttacaagttacacgatgaagccaaagacaaggcctttgaattggagatgagctggatctgcgaggagtcaaaacgagagcaccagaaggtccctgatgatcttctagaagaagcaaagacggcagccaaaactgcacttgaggagatggatgctgactaaactgagaaaatgggtcaaattagatatgtgttatgcatcgtttggtgtttctgttgtaaaacttttaaatttggccgagaggggcaaatcgctacagtttctcatgaacctttggactctttcatcttgttgctatcgacagtttctt

SEQ ID NO: 2908 - DNA, 966 bp, Raphanus sativus
gattcgatccttgctcaaatcgagttcgctcaaatcaaactaaaaaaaaaaagaaaagatgagtagcattggaactggatacgatctgtcggtgacgactttctcacccgatgggcgggttttccagatcgagtacgccgccaaagctgtcgacaacagtggaaccgttgttggaatcaagtgcaaggacgggattgttatgggtgtggagaaacttatagcatcaaagatgatgctaccaggatccaacaggagaatccattctgttcatcgtcatgctggcatggctgttgctgggcttgctgctgatggcaggcaaattgttgcaagggccaaatctgaagccagaagttacgaaagtgtttatggggacgctgtaccagtgaaggaactttcagagcgtgttgcaagctacgttcatttgtgtaccctttattggtggctcaggccttttggatgtggggtcattcttggtggttatgataaagatggtcctcaattgtacatgatcgagccatcgggcatatcacacagatattttggtgctgccattggtaaaggcaaacaagctgctaaaacggaaattgagaaactgaaattatctgagatgacatgcaaagaaggcgttattgaagtggcgaaaatcatttacaagctacatgatgaagccaaagacaaggcatttgaattggagatgagctggatatgtgaggagtctaaacgagagcatcagaaggtccctgatgatcttctggaagaagcaaagacggcagctaaaactgcactcgaggagatggatgctgactaaactgagaaaaaatgggtcaaattagtttttttttgtttaatgcaacgtttggtcgtgttctgttgtaagaccttgaattgtgtctctaggggcaatttgttgcagtttctcatgaaacctttggactctttcgtcattattgatatcgacagtttctt

SEQ ID NO: 2909 - DNA, 986 bp, Catharanthus roseus
  misc_feature (7)..(9): n is a, c, g, or t
  misc_feature (12)..(15): n is a, c, g, or t
  misc_feature (800)..(800): n is a, c, g, or t
agaagannnaannnnttcggcacgagggctgtagtgaactcgggcgagcaacctttggaaaagtcggaacaagataacaaaggagaagtttaaaaccaaagaggaaaaccatgagcagcatcggcactggctacgatctctcagtcactacgttctccccggatggccgagttttccagatcgagtacgcggccaaggccgtcgacaacagtggcactgttatcggtatcaagtgcaaggatggcatcgttctgggcgtagagaagcttatatcttccaagatgatgttgcctgggtctaataggagaatccacgctgttcatcaccattctggaatggctgttgctggattagctgctgatgggcgacagattgttgccagagcaaaggctgaagcaactaactatgaaagtacatatggggaaccaattcccgtgaaagagcttgccgaacgtgttgccagttacgtgcatctatgtacactttattggtggctcaggccttttggatgcggagtaatactaggaggttacgacagagatggaccacaactatacatgattgaaccttctggtgtttcttataggtactttggtgctgcaattgggaagggcaggcaggctgctaagacagagattgaaaaattgagcctctccgggatgacttgccgtcaaggggttgttgaggtggcaaagataatatatggaatacatgatgaggcaaaggacaaggcttttgaattggaaatgagttgggtttgtgatgagtcaaaccgccagcatcagaaggttccagatgancttttagaggaagcccaaagctgcagccccgggctgcacttgagggaaatggaagcttgatttagcgcctgaataacatagcccattttgtctttgaattttctatttattttagggaatggaattttttagggattttgtcccatttttcctaggggacagaactccacgcggtttgggatcatt

SEQ ID NO: 2910 - DNA, 987 bp, Brassica napus
gttactcctcctatggtaccggccggtttgccgaatcgaccacgcgtccgattcattcttcttcgacccttccttttgaaagatgagtagcattggaactggatacgatctctcagtgacgactttctcccccgatggccgtgttttccagatcgagtacgccgccaaagccgtcgacaacagtggaaccgttgttggaatcaagtgcaaggacgggatcgtaatgggtgtggagaaacttattgcttcgaagatgatgctaccacgatctaaccgcagaatccattctgttcaccgtcatgctggcatggctgttgctgggcttgcagctgatggcaggcaaattgttgcaagggccaaatctgaagccagaagttatgagagtgtttatggggacgctgtgccagtgaaggaactttcagagcgtgttgcaagctacgtgcatttgtgtaccctttattggtggctcaggccttttggatgcggggtcattctcgggggttatgataaagatggacctcagttgtacatgattgagccatcggggatatcatacaggtattttggtgctgccattggcaaaggcaaacaagctgctaaaacggaaattgagaaactgaaattatctgagatgacatgcaaggaaggcgttattgaagtggcgaaaatcatttacaagctacatgacgaagccaaagacaaggcatttgaattggagatgagctggatatgtgaggactcaaaacgagagcatcagaaggtccctgatgatcttctggaagaagcaaagacggcagctaaaactgcactcgaggagatggatgctgactaaactgagaaaatgggttaaatttagtttttgttcaatgcatcgtttggtggtgttctgttgtaagactttgaatttttgtctcgaggggcaattgttgcattgcagtttctcatgaacctttgggactctttcgtcattattgatatcgacagttt

SEQ ID NO: 2911 - DNA, 1061 bp, Brassica napus
gttactcctcctatggtaccggccggtttgccgaatcgaccacgcgtccgattcattcttcttcgacccttccttttgatcaaatcaaaagatgagtagcattggaactggatacgatctctcagtgacgactttctcccccgatggccgtgttttccagatcgagtacgccgccaaagccgtcgacaacagtggaaccgttgttggaatcaagtgcaaggacgggatcgtaatgggtgtggagaaacttattgcttcgaagatgatgctaccacgatctaaccgcagaatccattctgttcaccgtcatgctggcatggctgttgctgggcttgcagctgatggcaggcaaattgttgcaagggccaaatctgaagccagaagttatgagagtgtttatggggacgctgtgccagtgaaggaactttcagagcgtgttgcaagctacgtgcatttgtgtaccctttattggtggctcaggccttttggatgcggggtcattctcgggggttatgataaagatggacctcagttgtacatgattgagccatcggggatatcatacaggtattttggtgctgccattggcaaaggcaaacaagctgctaaaacggaaattgagaaactgaaattatctgagatgacatgcaaggaaggcgttattgaagtggcgaaaatcatttacaagctacatgacgaagccaaagacaaggcatttgaattggagatgagctggatatgtgaggactcaaaacgagagcatcagaaggtccctgatgatcttctggaagaagcaaagacggcagctaaaactgcactcgaggagatggatgctgactaaactgagaaaatgggttaaatttagtttttgttcaatgcatcgtttggtggtgttctgttgtaagactttgaatttttgtctcgaggggcaattgttgcattgcagtttctcatgaacctttgggactctttcgtcattattgatatcgacagtttttctacgacttctaataacgctcgagggactgttgctgcagttccttatgaacgttttatgggac

SEQ ID NO: 2912 - DNA, 1013 bp, Raphanus sativus
ggagaaaaaaggtttggcttcggttctgacttgaaaacaaagaaatcacccattctaagttcgattcgatccttgctcaaatcgagttcgctcaaatcaaactaagaaaaaaaaaggatgagtagcattggaactggatacgatctgtcggtgacgactttctcacccgatgggcgtgttttccagatcgagtacgccgccaaagctgtcgacaacagtggaaccgttgttggaatcaagtgcaaggacgggattgttatgggtgtggagaaactaatagcatcaaagatgatgctaccaggatccaacaggagaatccattctgttcatcgtcatgctggcatggctgttgctgggcttgctgctgacggcaggcaaattgttgcaagggccaaatctgaagccagaagttacgaaagtgtttatggggacgctgtaccagtgaaggaactttcagagcgtgttgcaagctacgttcatttgtgtaccctttattggtggctcaggccttttggatgtggggtcattcttggtggttatgataaagatggacctcaattgtacatgattgagccttccgggatatcatacagatattttggtgctgcgattggcaaaggcaaacaagctgctaaaacggaaattgagaaactgaaattatctgagatgacatgcaaagaaggcgtcattgaagtggcgaaaatcatttacaagctacatgacgaagccaaagacaagcatttgaattggagatgagctggatatgtgaggagtctaaacgagagcatcagaaggtccctgatgattttttgaaagaagcaaagacggcagctaaaactgcactcgaggagatggatgctgactaaactgagaaaatgggtttaaattagttttttttgtttaatgcaacgtttgggggtgttttgttgtaagactttgaattttgtttttaagggggcaactgttgcagtttttcatgaaccttttgtcattattgatatcgacagtttttt

SEQ ID NO: 2913 - DNA, 833 bp, Momordica charantia
gaagagcggaagagtagaaagaaggagcttctcttgtgttcttcataagctgctccatttcctgctccacagagaagcaatcgaatccgctctccgttagggcaaagaatcagaaatcagaatgagtagcatagggactggttacgatctttccgtcaccacattctccccagatggccgcgttttccagatcgagtacgccgctaaggccgtcgacaacagcgggactgtaattggaatcaaatgcaaggatggagtcgttatgggcgtggaaaagctaattacctctaagatgatgcttcccggttctaatagaagaattcacgcagttcatcgtcattctggcatggctgtggcaggattggcagcagatggaagacaaatagttgctcgagccaaatctgaagcaaccaactacgaaagtgtttacggtgaaccaatccctgtaaaggaactagctgatcgtgttgctagttatgtgcatctctgtacactttactggtggctcagacctttcggatgcggggtaattctcggaggttatgatagggatggaccacaactgtacatggttgaaccatccggtgtttcctataggtactatggtgctgcaatcggcaagggtaggcaagctgcaaaaacggaaattgagaagttgaacctctctgaactgtcttgtcggcaaggggtcattgaagtagccaagattatatatggagtacatgatgaggcgaaggataaggacttcgaattggaaatgagttggatctgtgatgaatcaaaacgccaacatcagaaggttccggatgatcttcttgaggaagcaaaggcag

SEQ ID NO: 2914 - DNA, 1014 bp, Triphysaria pusilla
aattgaactcaaagaaacaacagtgagacttagaaagagcatcaaggaaaagagaaacgagcagcggaaaccagtgaaaagctaaaaatgagcagcataggcacaggctacgatctatcggtgaccacattctcgccggatggccgcgttttccagatcgaatacgccgccaaggccgtcgataacagcggcactgtggttgctatccgatgtaaagacggtgttgttatgggagtggagaaactgatttcatcgaagatgatgttacccggctccaacagaagaatccatgctgttcatcgccactccagcatggctgttgctggactagctgcagatggcaggcagattgtggcaagagcaaaatctgaagcaaccaattatgagagtgtgtatggtgatcaaattcctgtacaagagctcgctcaacgtgtagctagttatgtgcatttgtgcacactctactggtggctcaggccttttggttgtggagtgattttgggaggttatgatagagatgggccgcagttgtacatggttgaaccatctggagtttcctataggtattttggtgctgccattgggaagggaaggcaggctgctaaaacggagattgaaaaattgaagctttctgaaatgacatgccgacaaggggttattgaggtggccaaaattatttatggggtacatgacgaggcaaaagacaaggcctttgagttggaaatgagttgggtgtgtgatgagtccaaccgtcagcagcaaaaggtcccggaggatctattagaggaagcgaagacagccgctaaagctgcacttgaagaaatggatgcagattattcgtatttatttcctgtgtaacgtttttctcgaaactggccatttcaacttgcagtgtgctgtgatgaacacattatgatcgattcagatttgttcttacatgtacgaagctttttcctgctttaaactcagggattaaatcagcagctttaaaatctatgttaaatgacttgagct

SEQ ID NO: 2915 - DNA, 1224 bp, Brassica napus
acgagcgtaaccctcggcggcgaagactcctccttgttcgtgacgggggaggacgttacggatggtggaggagcgagtcaaggcttggtggatctccatggaggcacctccgggataagcgaagacggtttcgacgccttgacgctcgagggcttccacgaggatatcagcacccttgcggggctcgtcgggagcgtagcgggagatgaaagtcttgatcttgcgggtttttcaggtgcgacattgacgggtgagttgagaacggcggagatggcgagaggacggtggagacgggaggagggtttctgtggggttaaggagaagggaagggagaatctggaactggatacgatctctcagtaacgaccttctcccccgatggccgtgttttccagatcgagtacgccgccaaagccgtcgacaacagtggaactgttgttggaatcaagtgcaaggacgggatcgtaatgggtgtggagaaacttattgcatctaagatgatgctaccaggatctaaccggagaatccattctgttcaccgtcatgctggcatggccgttgctgggcttgcagctgacggcaggcaaattgttgcaagggccaaatccgaagccagaagttatgagagtgtttatggggacgctgtaccagtgaaggaactttcagagcgtgttgcaagctacgtgcatttgtgtaccctttattggtggctcaggccttttggatgtggggttatccttgggggttatgataaagatggacctcagctgtacatgattgagccatcggggatatcatacagatattttggtgctgccattggcaaagggaaacaagctgctaaaacggaaattgagaaactgaaattatctgagatgacatgcaaggaaggcgttattgaagttgcgaaaatcatttacaagctacatgacgaagccaaagacaaggcatttgaattggagatgagctggatatgtgaggagtcaaaacgagagcatcagaaggtccctgatgatcttctggaggaagcaaagacggcagctaaaactgcactcgaggagatggatgctgactaaccgagaaatgggttaaatttagtttttttatgctatcgttggtgtgttctgttgtagtactttgtaattttgtctgtaggggctaagttgttgctagtttctcatgaacttttgggactttcgcatattgataccgaactatttaact

SEQ ID NO: 2916 - DNA, 1045 bp, Ambrosia trifida
gttgctcaattgttttcttgagaggaaagcaaagaagtccgctttttatttattataaactctttctttctgttatccccctttgttaacactagagtgtaaaaaaagagaaatcaagaaggaaggaagatgagtagcataggaacaggttacgatctgtcagtgacgaccttctctcccgacggtagggttttccagatcgagtacgccgctaaagccgtcgacaacagcggcaccgtcgtcggcatcaaatgcaaagatggcatcgttattggtgtagagaagctgattgcctccaagatgatgttgcctggatccaatcgtagaatccactctgttcaccgtcattctggcatgggtgtagcaggattagctgctgatggcagacagattgttgcaagagctaaatctgaagctcacaattatgaaagtacttatggtgaacctattccaattaaagaacttgctgaccgcgttgctagttatgtgcacttatgcacactttattggtggctcagaccttttggttccggtgtgattcttggaggttatgatcgtgatggcccacaattatatatggttgaaccttctggtgtttcctatagatattttggtgctgcaattgggaagggcagacaagctgccaaaactgagattgaaaagttgaaactttctgagttgacctgccgggaaggtgttattgaggtggcaaaaataatctatggagtacatgacgaggcaaaggacaaaacctttgagttggagatgagctgggtttgtgacgaatcaaaccgtcagcaccagaaggttccagaagcactttttggaggaagcgaaagctgcagctaaagcagcactggaagaaatggatgctgattaatgataatctccctttgtgtttgtctgaattttcgttttcaaatttgtttgcagaaccaaacgcgtaacgtattaatcatcaaagattgtatcattttggttttatccttgaaattcatgtatgttgcatcaaacctgtaaggtagtgtcgtttcattgaattgaa

SEQ ID NO: 2917 - DNA, 736 bp, Acacia harpophylla
cacgacgaagatttggtgcaaattgatcgtgcggaagaatgagtagcataggaacaggatatgatctttcagtcactactttctccccggatggccgagttttccagatcgagtatgccgctaaagccgtcgacaacagcgggactgttatcggtatcaaatgcaaggacgggattgtgatgggggttgagaaacttgttccatccaagatgatgctgcctggttccaatagaagaatacactctgttcatcgccactcgggcatggcggtggcaggattagcagctgatgggaggcaaattgttgccagggctaagtcagaagcaactaactatgaaagtgtttatggtgaacaaattcccgtcaaggaactcgctgatcgtgtggctagttatgtgcacctttgcacgctatattggtggctcagaccttttggatgtggtgtcatactaggaggttatgacagagatggaccgcaattgtacatggtcgaaccatctggtgtttcctataggtattttggtgcagcaattgggaagggcaggcaggctgctaaaacagagattgagaagttgaagctttctgacatgagttgccgccagggagttattgaggtagccaagattatttatggagttcatgatgaggccaaggataaagactttgaacttgaaatgagctgggtgtgtgatgaatcaaaccgccaacatgtgaaggtcccagatgaacttttgga

SEQ ID NO: 2918 - DNA, 857 bp, Allium cepa
  misc_feature (701)..(701): n is a, c, g, or t
  misc_feature (706)..(706): n is a, c, g, or t
  misc_feature (800)..(800): n is a, c, g, or t
catcaactaaccttcgttcttgctaataaacttaacctccaagaataaaacccaactatacatttgatttttgaaacgcctccaactcaagcgaaattcgcctccaactcaagcgaaattcaccgaccaagtccaaagaatgagcagcatcggaacgggatacgatctgtccgtcaccaccttttctcccgatggtcgcgtcttccagatcgagtatgctgctaaggccgtcgataacagcgggactgtcgtgggcatcaaatgcaaagatgggatagttctgggagtggagaagctgattacttcaaagatgatgttgcctggatctaatcggaggattcactcggttcaccgtgaatcgggcatggcggtagctggcctagccgcagatggtaggcaaattgttgcacgtgcaaagtctgaagcaactgactatgaaagagtttatggtgagcccatgcctgtgaaagaacttgctgacagagtagctagttatgttcatctatgtacactttattggtggatgagaccctttggatgtggagttatactaggagggtatgacagggatggtccccaactctacatggtggaaccctctggagtttcatttagatactttggtgctgcaattgggaagggccgacaagctgccaagacggaaatagagaagctaaaactctctgaaatgacatgcaggnaaggngttatagaagttgcaaagtttatatacagtgttcacgatgaggcgaaggataaagattttgagttggaactgagctgggtatgcgatgaatctnaacgtctacatcaaaaggttccagatgatatcctcgaagaagcaagactgctggcaa

SEQ ID NO: 2919 - DNA, 891 bp, Cynara scolymus
  misc_feature (37)..(37): n is a, c, g, or t
  misc_feature (862)..(863): n is a, c, g, or t
cgcggggcctttcttacttattcgatcccccttcgancagaagccattaaccaaaatcagcagtaccaatttcgccctagaagaacatgagtagcataggaacaggttacgatctgtcggttacaaccttctcgccggacggtagggtttttcagatcgagtacgctgctaaagccgtcgacaatagcgggaccgtcgtcggcatcaaatgcaaagatggcattgttattggagtagagaagctgattgcgtcaaagatgatgttgcctggatctaatcgtagaatccactccgtgcatcgtcattctggaatgggtgtagcaggattagctgcagatgggagacagattgttgcaagagccaaatctgaagcccataactatgaaagtgtttatggtgaaccaattccagttaaagaacttgctgagcgagtcgctagttatgtgcatctatgcacactttattggtggctcagaccttttggatccggggtgattcttggaggttatgaccgtgatggcccacagttatatatggttgaaccttctggtgtttcctatagatattttggtgctgcaattgggaagggcaggcaggctgctaaaaccgagattgaaaagttgaagctttctgagatgacatgtcgtcaaggggttattgaagtagcaaaaataatctatggagtacatgatgaggcaaaggacaagacattcgaattggagatgagttgggtttgtgatgaatcaaaccgccagcaccagaaggtaccagaagcacttttggaggaagcaaaggcagcagctaaagctgcattggaagaaatggatgctgataaatacatagatattgtttgtgtttgtcnnaatctctgtttcaaacttgtactcgtaa

SEQ ID NO: 2920 - DNA, 779 bp, Fraxinus spp
gacggtcgagttttccagatcgagtatgctgcaaaagcagtcgacaatagcggcaccgtcgtcggtatcaaatgcaaagacggaatctttttgggtgtggagaagttgattacttcgaagatgatgttccccgggtccaacagaagaatccatgccgtccatcgccattcgggcatggctgttgcaggattagctgcagatggcaggcaaattgtcgcacgagcaaaatctgaagcaactaactatgagagtgtgtacggagaaccaattccagtaaaagaacttgcagaacgtgttgcaagttacgtgcatctatgtacactatattggtggctcaggccttttggaagcggagtaattctgggaggttatgacagggatgggccacagctgtacatggttgaaccttctggagtttcctatagatactttggtgccgcaattgggaagggcaggcaggctgctaaaactgagattgaaaaattgaagctttctgaaatgacctgccgacaaggggttattgaggtggccaagataatttacggagttcatgatgaggcaaaggacaaggccttcgaattggaaatgagttgggtctgtgacgagtctaaccaccagcatcaaaaggttccggatgatatcttggaggaagccaaggcagcagctaaggccgccctcgaagaaatggatgcggattagtgtttctggtttttgcaattttcatttgaaactttggctatatttttctcctctgtcaaactctacagttatgtcagtaa

SEQ ID NO: 2921 - DNA, 1306 bp, Marchantia polymorpha
  misc_feature (1036)..(1036): n is a, c, g, or t
  misc_feature (1219)..(1219): n is a, c, g, or t
  misc_feature (1227)..(1227): n is a, c, g, or t
  misc_feature (1256)..(1256): n is a, c, g, or t
  misc_feature (1263)..(1264): n is a, c, g, or t
ctcgacgggacttctgtctagtggagctctgtcgctgcgatcgcgcgtctcgaagttggacgtagagcatctcgagcgcaagctgacacgagtgcatcaagatgagtagcattggaaccgggtatgatttgtcggtcaccacattttcacccgatgggcgagtttttcaaatagaatatgctactaaggccatcgacaacagcggaacggtcgtgggtatcaagtgcaaggatgggattgttttgggagtggagaagcttattgcatcgaaaatgcttctggagggatccaacaggagaatccactcagtaaaccgtcactcggggatggctattgctgggttggctgccgatggcaggcaaattgttactcgtgcaagagcagaagctggaaattacttgggcttttacggtgaagaaatccccaccaaagagctttgcgacagagtcgcttactacgtgcatctatgcaccctttactggtggctccggccatatggttcggccgccatactaggtggttatgatcgggatggtcctcagttgtacatgattgagccctcaggtgttgcttatcggtactttggtgctgcagtaggaaaagggagacaagctgccaaaacagagattgaaaagctaaagttgtcccaaatgacatgtcgagagggtgtcattgctgttgcaaagattatttacaatgtacacgatgaagctaaggacaaagcttttgagctagaaatgagctggatctgcgatgaatcaaagcgtgagcaccaacgggtccctgctgatcttctggcggaagccaaggccattgcgaaagcggcccaagaagaagacatggatgccgactaaagtaatgtggaatctgggtggtgttgagaagaagaatgtctcgcggctcctgattcagatcagagggaaatatggtcctgccgaccagtggatagctaattacgtctgggatctgcactctgattcgaaataagatggtggcatccaattgtgagttactcttagtttgtgtgctgactgantcgaatgcatagcaagtggtaggattatgtcgacatggtgacccgagcattccaaagatatgacgcttaccttcccataggtagaagctgctctcagagggtgccgtttcttatgtaccatttcgttgacatccttatcctcggcattttcaggagttgccatcactgccctcctctgtgganttgtccancacaagatgtaactgtatcagaggccacnttctcannattaatgcattttgtatagcaaactaggaattaaaaaaaaaa

SEQ ID NO: 2922 - DNA, 906 bp, Antirrhinum majus
  misc_feature (1)..(1): n is a, c, g, or t
  misc_feature (242)..(242): n is a, c, g, or t
  misc_feature (496)..(496): n is a, c, g, or t
  misc_feature (577)..(577): n is a, c, g, or t
  misc_feature (589)..(589): n is a, c, g, or t
  misc_feature (683)..(683): n is a, c, g, or t
  misc_feature (692)..(692): n is a, c, g, or t
naaaactctccaacaaatataagcaacaaacccatcatcagctcaacacacacacacacacacacacacacacacagtagaaaaatcaagagagaatagagtaaaagatggcgagcataggcacggggtacgatctctcagtgaccacattctcgccggacggtcgcgttttccagatcgaatacgccgccaaagccgtcgacaacagcggcaccgtcgtcgccatcaaatgcaaagacggnatcgtcatgggagtggagaagctcattgcctcgaagatgatgttgccagggtctaatcggagaatccacgccgttcatcaccactccggcatggctgtagctggactggctgcagatggcaggcaaattgtggcacgagcaaaatctgaagcaactaattatgagaatgtttatggtgaaccgattcctgtaaaagaacttgcagaccgtgttgctagttacgtccacttatgcacactctattggtggctcangccttttggatgtggagtaattctaggaggttatgacagggatgggccgcaattatacatgattgaaccttctggaatttnctatagatactntggtgctgccattggaaagggcaggcaggctgccaaaacagaaattgaaaagttgaagctttcagaaatgacgtgccgtcagggtgttgttgangtggccaanattatttatggggtacatgatgaggcaaagaaaggcatttgcactggatatgagttgggtctgtgacgagtcaaaccgtaagcatcaaaggtccagatgatctgttaaaggaagctcgacaatgctaaagcggcgcttagacgaatggatgctcattatgggctctgatactttgaatttctgggtttaattgtggatcttttccttgaacagg

SEQ ID NO: 2923 - DNA, 1050 bp, Musa acuminata
agacccttcatcccccaactttgctatatggtattactgaacccccctcttctgtgcttccctctcgctctctcgctgtgttgattccatccgattcgaggacctaacgatcggaggaggagcgaagcacgatgagcagcatcggcaccggctacgatctctccgtcaccaccttttcccccgatgggagggtcttccagatcgagtacgcagccaaggctgtcgacaacagcgggaccgtcattgggatcaaatgcaaggacgggatcgtgatgggtgtggagaagctgatctcgtcgaagatgatgttggcgggatctaaccggagaatacatgctgttcaccgccattctggcatggctgtagcaggcttagctgctgatggcagacaaatcgttgcacgagcaaagtccgaagcaaccagttatgagagagtatatggtgaacccatacctgtcaaggaacttgcagatcgtgttgccagttatgttcatctttgtacactctattggtggctcaggccttttggcagtgggattattcttggtggttatgacagagatggacctcagctttacatgattgagccatctggagtatcatataggtattttggtgctgcaattgggaagggaagacaagctgccaagacggagatagagaagctgaagctgtctgagatgacctgtaaggagggaatcattgaagttgccaagataatttatggagtgcatgatgaggcaaaagataaagcatttgagttagaaatgagctggatctgtgatgaatctaaccgccaacatcagaagttccagatgatctattggaggaagccaagacagccgcgaaagctgcactggaggagatggatgcagattagaggcactaaataaactttcagtattttataggttgaatttaaatgatgtctcaccctatttttccgacattgagtgatcctagttgttgcagagggtcgatggggaaagctgtgttctttgtaagtgaatacattttgcattgacagaaaaatctcaaccttgttctttg

SEQ ID NO: 2924 - DNA, 916 bp, Utricularia gibba
gccggatggacgagtttttctagatcgagtatgcggcgaaggcggtggacaatagtggaacggtcgttgcaatacgatgcaaggacggcgtggttatgggagtggagaaattgatagcatcgaagatgatgctgcctggctccaatcgacgaatccacgccgtccatcgtcactccggcatggcggttgctggtttggctgctgatggtaggcagattgttgcaagagcaaaagctgaggcgactaattacgaaagcgcatatggtgaaccaattcctgtgaaggagcttgctgaacgtgttgctagttatgtgcatttatgcacactctattggtggctccggccttttggttgtggagtcattttgggaggttacgatagagatggcccacagttatacatgattgagccatccggagtttcttataggtactttggtgctgccatggggaagggtagacaagctgccaaaacggagatcgagaagttaaagctttcagaaatgacatgccgacaaggggttattgaagtagctaaaattatatatggggtacatgatgaggccaaggataaggcttttgagttggaactgagttgggtgtgtgatgagtctaaccgtcagcatcagaaggtacctgatgatctcctagaggaagccaaggaagcggccaaagcagcactggaagaaatggatgcagattaggcattttgattattccgaattgcgcatcattttcattacagcaactttctttcgcaataccatcatgtaaacgatccagcacggcacataccacatggtatgacagacacttggtactaggttttcatgtgtgttgcttgtaagaacctttttctctcccttgttctgcgtctgtgggattgaaaatcttcgcctaggtattctgattctgt

SEQ ID NO: 2925 - DNA, 1635 bp, Sorghum bicolor
ccacacgcctccgatccctccctctgcccacacctatagctagctagccaaggcctcatcaatcatggcggctactactacttctcgtcctgccgctgctgctctgccgctggcggtactggcagcagccatggtggtggccctggcggcggccggcgacgtcgtcgagcagcagctcgaggtcgttggcagcaggtacccgccgctggcgccgggcctgtcgttcgacttctacaagaagagctgcccgaaggcggagtcgatcgtgaaggagttcctgtcgtcggcggtgcggcagaacgtggggctcgccgccgcgctgatccgggtccacttccacgactgcttcgtgcagggctgcgacgcctccgtcctgctcgactccacgcccacccagcccagcgagcagctgtcgccgcccaaccttacgcttcggccggcggcgttcaaggccatcaacgacatccgcgcccgcctcgagcaggcctgcggccgcgtcgtctcctgcgccgacatcaccgccctcgccgcccgtgaatccgttgccctgggtggcggtccggcgtacaaggttccactaggccggcgagacggcctagcagcggcgtcgaacgccgccgtcctggcggcgctcccgtcgccgacgtcgacggtgccaacactgctctccttcctgtcgaagatcaacctggacgtgacggacctggtggcgctgtccggcggccacacggtgggcgtcgcgcactgcagctccttcagcaaccgtctgttcccgacgcaggacccgacgctgaacaagttcttcgcggggcagctgtacgggacgtgcccgaccgacaccacggtgaacacgacggtgaacgacatccggacgcccaacacgttcgacaacaagtactacgtggacctgctgaaccggcagggcctcttcacgtcggaccaggacctgctcaccaacgctacgaccaggcctatcgtcaccaagttcgctgttgaccagaacgccttcttcgagcagttcgtctactcgtacgtcaagatggggcagatcaatgtgctcacggggtcccagggacaggttcgcgccaactgctccgcgcgcaacgctggtgctgcaggtaacggtggcgaggaccagctgccgtggtccgacgtcgtcgagaccgtcgtcgacgccaccggcagcctcgtgctctagatcgtatcgtgaaacaacaaccacaccaccggccgggagtgcgcgtatgtacgtgtgtagcagtttgttggcagcaagttgttagcaatttgaagcttgcttgttttttcttatataagtctcgatctctccatcgagtccatatatatgtgggggcatatgcatgcatgttgtaacaaaataagcaggcagctaagctagctagtgatccattggaaataaaaagctcgtgtgttcttgccttcttggggatcagatgatgtcatgacgacgatcattacaaacgacgacgtcgatggcattggcatgccctgcagggcagttcaggccgggcaccagcagatcgacgaactaattaagggggtgtttagttctcctttttttttcccaaaagaattttaggttttggtctatcattttgcaaaataaaactaatc

SEQ ID NO: 2926 - DNA, 1814 bp, Sorghum bicolor
tgctgtttccaggatccatcatcgtcttgagaggtttgaccagcagccacaaattagcgttctctcatccatcgtctctacatctccggatctcccacctaaacccacggccaacttgcagctaggacgcatgtctgcaaccatggctataaatggaagcagccgatcgcgcaaggcctccacacgcctccgatccctccctctgcccacacctatagctagctagccaaggcctcatcaatcatggcggctactactacttctcgtcctgccgctgctgctctgccgctggcggtactggcagcagccatggtggtggccctggcggcggccggcgacgtcgtcgagcagcagctcgaggtcgttggcagcaggtacccgccgctggcgccgggcctgtcgttcgacttctacaagaagagctgcccgaaggcggagtcgatcgtgaaggagttcctgtcgtcggcggtgcggcagaacgtggggctcgccgccgcgctgatccgggtccacttccacgactgcttcgtgcagggctgcgacgcctccgtcctgctcgactccacgcccacccagcccagcgagcagctgtcgccgcccaaccttacgcttcggccggcggcgttcaaggccatcaacgacatccgcgcccgcctcgagcaggcctgcggccgcgtcgtctcctgcgccgacatcaccgccctcgccgcccgtgaatccgttgccctgggtggcggtccggcgtacaaggttccactaggccggcgagacggcctagcagcggcgtcgaacgccgccgtcctggcggcgctcccgtcgccgacgtcgacggtgccaacactgctctccttcctgtcgaagatcaacctggacgtgacggacctggtggcgctgtccggcggccacacggtgggcgtcgcgcactgcagctccttcagcaaccgtctgttcccgacgcaggacccgacgctgaacaagttcttcgcggggcagctgtacgggacgtgcccgaccgacaccacggtgaacacgacggtgaacgacatccggacgcccaacacgttcgacaacaagtactacgtggacctgctgaaccggcagggcctcttcacgtcggaccaggacctgctcaccaacgctacgaccaggcctatcgtcaccaagttcgctgttgaccagaacgccttcttcgagcagttcgtctactcgtacgtcaagatggggcagatcaatgtgctcacggggtcccagggacaggttcgcgccaactgctccgcgcgcaacgctggtgctgcaggtaacggtggcgaggaccagctgccgtggtccgacgtcgtcgagaccgtcgtcgacgccaccggcagcctcgtgctctagatcgtatcgtgaaacaacaaccgcaccaccggccgggagtgcgcgtatgtacgtgtgtagcagtttgttggcagcaagttgttagcaatttgaagcttgcttgttttttcttatataagtctcgatctctccatcgagtccatatatatgtgggggcatatgcatgcatgttgtaacaaaataagcaggcagctaagctagctagtgatccattggaaataaaaagctcgtgtgttcttgccttcttggggatcagatgatgtcatgacgacgatcattacaaacgacgacgtcgatggcattggcatgccctgcagggcagttcaggccgggcaccagcagatcgacgaactaattaagggggtgtttagttctcctttttttttcccaaaagaattttaggttttggtctatcattttgcaaaataaaactaatc

SEQ ID NO: 2927 - DNA, 293 bp, Zea mays
gcaggtgccgcccagccagattcgacccgagttcacgacgagagcacgagatggcgatgcgaaccgcgctgacctccctccctgcgcgcctgcacgcccctgcgccccccgcggcgatgggcggccggcgcctcctcagtgatgggaaggggcgcgtgctcagcgaggaggagcgcgccaaggagagcgtctacatccagaagatggagagggagcgacaggagaagctcaagaagaggctcgagcaggagaaggccgactccgaaaaggtgaagtccgccgacgccgacaag

SEQ ID NO: 2928 - DNA, 684 bp, Sorghum bicolor
gccggcagggcaagtcagtacttcagtccacccacccatctcccatttctcaacccaaccagcaaagagcaaaccagacaagcagcccaacccccgcacctcaggcccaggcagactcgtcgatcgcggcgagagcacgagatggcgatgcggaccgcgctgacctccctccccgcgcgcctgcgcgcccccgcggccccctcctcggcggcggcgaccggcggcggcctgcgcctcctcagcgacgggaagggccgcgtgctcagcgaggaggagcgcgccaaggagaccgtctacatccagaagatggagaaggagcggcaggagaagctcaagaagcagctcgagcaggagaagcccggcgccgacaaggccaagcccgccgacgccgacaagaaggccgagggatctacctaggattgaaatggcgctgatggaaggcaatcctgtttcgcatgcatccgatggacagctttgtttgtacatgtccagcgatggaagaataaattctgtaaaacgttaatggcactggatatgctgtgttttcggttggttgcatgttgaagacgacattcatattttgagactgctgctgttgaaccttgcacctttgtgcctcctttgcgtttgctacctcgtggtggatcggtctttgtggtgttacctgctctttactagttcctg

SEQ ID NO: 2929 - DNA, 768 bp, Sorghum bicolor
aaaaaatcaagagccaacctgaattttctgaaggcttcttcccctttctcgtgcaccctagtaatgccggcagggcaagtcagtacttcagtccacccacccatctcccatttctcaacccaaccagcaaagagcaaaccagacaagcagcccaacccccgcacctcaggcccaggcagactcgtcgatcgcggcgagagcacgagatggcgatgcggaccgcgctgacctccctccccgcgcgcctgcgcgcccccgcggccccctcctcggcggcggcgaccggcggcggcctgcgcctcctcagcgacgggaagggccgcgtgctcagcgaggaggagcgcgccaaggagaccgtctacatccagaagatggagaaggagcggcaggagaagctcaagaagcagctcgagcaggagaagcccggcgccgacaaggccaagcccgccgacgccgacaagaaggccgagggatctacctaggattgaaatggcgctgatggaaggcaatcctgtttcgcatgcatccgatggacagctttgtttgtacatgtccagcgatggaagaataaattctgtaaaacgttaatggcactggatatgctgtgttttcggttggttgcatgttgaagacgacattcatattttgagactgctgctgttgaaccttgcacctttgtgcctcctttgcgtttgctacctcgtggtggatcggtctttgtggtgttacctgctctttactagttcctgagaccaactccagcccaag

SEQ ID NO: 2930 - DNA, 526 bp, Triticum aestivum
acaagcagcccaacccccgcacctcaggcccaggcagactcgtcgatcgcggcgagagcacgagatggcgatgcggaccgcgctgacctccctccccgcgcgcctgcgcgcccccgcggccccctcctcggcggcggcgaccggcggcggcctgcgcctcctcagcgacgggaagggccgcgtgctcagcgaggaggagcgcgccaaggagaccgtctacatccagaagatggagaaggagcggcaggagaagctcaagaagcagctcgagcaggagaagcccggcgccgacaaggccaagcccgccgacgccgacaagaaggccgagggatctacctaggattgaaatggcgctgatggaaggcaatcctgtttcgcatgcatccgatggacagctttgtttgtacatgtccagcgatggaagaataaattctgtaaaacgttaatggcactggatatgctgtgttttcggttggttgcatgttgaagacgacattcatattttgagactgctgctgttgaacct

SEQ ID NO: 2931 - DNA, 894 bp, Pennisetum glaucum
atttgagcccaggcgagcccaccacccaccaggccaccacagaggcagattcgatcgcgacgacatggcgatgcggtccgcgctgacctccctccccgcgcgcctccgcgccccctcggcggcggcggcggacggcggacggcgcctccttagcgacggcaagggccgcttgttaagcgaggaggagcgcgccaaggagagcgtctacatccagaagatggagagggaacggcaggagaagctcaagaagaagctcgagcaggagaaggccaacgccgacaagaccaagcccgccgacgccgacaagaagcctgagggatctaactagggatcggcacggtgctgcctgaagacaatccagcttcacctgtctccaatggacaagctttgtggttacatgtccagctatggaggaataaattatgtaaaacgttaatggctcaaccgcactggatatgttgtgttgcatccgtattttgagactctattttgtttgctctcttgtggtaaatcagtgttgtggcgttgccttctgttcacttattttggatgctggtggcacctagttcccgactctgagaagctcgagcaaggtgtggtaaccatttcctgatcgaatggctgtgaaagaactgcgttgttgtgagcagctgttatgctctcatggcatgcttgaaaccctggtacttgacaggtgaacttcaagagtagccacttctgtgtttcggtgtgcgcaacatgtatagtgttttgaaacttcttgatagctgcagctaataggttatggttccaggagtaaaagagttgtttcatgccttctatacggaattttatcgggctagaaccagttactaatgcttgaacttttccaagtcagtattttccatgtaaaaa

SEQ ID NO: 2932 - DNA, 735 bp, Saccharum officinarum
tgatgtcgacgcctgcagtacgcaccggtattcactggtccggtcgacccacgcgtccgatacgagcagcccaacccccgccctcaggcccaggcagattcgatcgcgacgagacgagagcacgagatggcgatgcggaccgcgctgacctccctccccgcgcgcctgcgcgacccctcctcggcggcggcgaccggcggcctgcgcctcctcagcgacgggaagggccgcgtgctcagcgaggaggagcgcgccaaggagagcgtctacatccagaagatggagaaggagcggctggagaagctcaagaagcggctcgagcaggagaagtccggcgccgaccagggaaagcccgccgacgccgacaagaaggccgagggatctaactaggactggcatggcgccgtcggaaggcaatcccgtttcgcatgcatccgatggacagctttgtctgtacatgtccagggatggaagaataaattctgtaaaacgttaatggcactggatatgctgtgctttcggttgcttgcatgctgaagacgacgttcatattttgagactgctgctgttgaaccttccatctttgtgcctgtttgtgtttggtatctcgtgggagatccgtccttgtggtgttacctgctgttttctggttgctgctcggaagaacttctgaacaaggacaaaaagttaggtgggttttcctatggatataaaaggcaaaagggactactttgg

SEQ ID NO: 2933 - DNA, 691 bp, Panicum virgatum
  misc_feature (590)..(590): n is a, c, g, or t
  misc_feature (659)..(659): n is a, c, g, or t
actagagccgccgccgcgaccattcgagtcgaggcgagtccacgcacccttccaagagcccaacgccccccatccccactgcaggcagattacatcgcggcgagagagcacgagatggcgatgcggtccgcgctgagctccctccccgcgcgcctccgcgtcccctcggcggcggcagcggcggcgcccggcgcccggcgcctcctcagcgacggcaagggccgcgtgctcagcgaggaggagcgcgccaaggagagcgtctacatccagaagatggagagggagcggcaggagaagctcaagaagaagctcgagcaggagaaggccgacgccgacaagaccaagcccgccgactccgacaagaagccagagggatctaactagaattggcatggtgctgtttgaaggcgtgcctcggatggatagctgtgtttctacgtgtccatcgatgaaagaaaataaaatcctgtcaaacgttaactgcatcagtgtttccagatcatataatatcgatgttgaaccttatgtcactgtgcttcatatatgtttgctttcttccggtaaattggtcttgtggtgctttcttgccnttctgtgataaactggccttgtgagaaccagtttctggtcgaattttggtgatgaaatgtgttgccgcngacattgtgtgacaagtacgtgcaaggttctt

SEQ ID NO: 2934 - DNA, 648 bp, Eragrostis curvula
ggggaattccaacccgacgcatccatcccccgagcccttgaatccgaccaagcccacacacatccatggcgatgcgatccgcgctgacctccctccccgcgcgcctccgcggcccctctgcgcccgcggcgacggcgaccaccggccggcgcctcctcagcgacggcaagggccgcgtgctcagcgaggaggagcgcgccaaggagagcgtctacatccagaagatggagagggagcggcaggagaagctcaagaagaagctcgagcaggagaagaccgacgccgacaagaacaagcctccagagtccgacaagaagcccgaggggtctaactaggattcctgtgctgcttgaatacaaccttcgcagtatcgtttggagatggaagaataaataaatttctgtagagcgttaaccatgtttctgtcttcagtgctttgcacatgttcaagacagcatcctttgggattcaatcattagttggcatctgatttctgtgtggccctttttgtgccgagtaagacagtcatgtttttccttaacttgaaatctggtatgttggcttgtgttctgacatgctgccaactgtgttactacgtgttattgtcctgcttatgaaacaggataaaatgatgatttgcacatgtca

SEQ ID NO: 2935 - DNA, 445 bp, Cynodon dactylon
ggcgatgcgatccgcgttgacctccctcccggcgcgcctccgcaaccccgctgcccccgcggcggcgaccaccggccggcgcctcctcagcgacggcaagggccgcgtcctcaacgaggaggagcgcgccaaggagaccgtctacatccagaagatggagagggagcgccaggagaagctccggaagaggatggagcaggagaagcccgacgcggacaagaacaagcccgccgactccgacaagaagccagagggttctagctaggattgacttcatgcgcctgaaggcaacctttgcaacatcatttccgatgcaccccgtgcacagccatgtaatgtttacacatgtctgcagatgtacgaataaataaattctgtaaaacattaacactcctgtattatcggtgcattggatatgtttgagaccgcatcatttgctttttgg

SEQ ID NO: 2936 - DNA, 1512 bp, Saccharum officinarum
ccccaccgtgtcccttcgccgaagctccagcagctgcagcaaaacccaaggggaagccatagccacatacattaggttagggtagggtcctagtgaattgtgagttgaagaggagggagagcaaagatgcggcgcgtcgcgctgtcgttgctcctcgtatgcgcggtggcgcgtgctgccgcggccgtcaccgacggtcttcttccgaacggcaacttcgaggatggcccgcccaagtcggcgctggtgaacggcacggtggtgtcgggcgccaacgccatccctcgctgggagacgtcgggcttcgtggagtacatcgagtcggggcacaagcagggcgacatgctgctggtggtgccgcagggcgcgcacgccgttcgcctgggcaacgaggcctccatccgtcagcgcctggccgtgacgcgcggcgcctactacgccatcaccttcagcgcggcgcggacgtgcgcgcaggcggagacgctcaacgtgtcggtgagccccgagtggggcgtgctcccgatgcagaccatctacggcagcaacggctgggactcgtacgcctgggccttcaaggccaagttcgacgccgtgacgctcgtcatccacaaccccggcgtggaggaggaccccgcctgcggcccgctcatcgacggcgtcgccatccgggcgctgtacccgccgactctcgccaagggcaacatgctcaagaacggcggcttcgaggaggggccctacttcctgcccaacgcgtcgtggggcgtcctcgtgccgcccaacatcgaggacgaccactcgccgctgcccgcctggatgatcgtctcgtccaaggccgtcaagtacgtggacgccgcgcacttcgccgtgccccagggcgcgcgcgccgtcgagctggtgggcggcagggagagcgcgctggtgcaggaggtgcgcaccgtgccggggtggaactaccgcctcgccttcgccgtgggggactccggcgacggctgcacgggatccatggtcgccgaggcctacgcggcgcgcgccaccgtcaaggtgccgtacgagtccaagggcaccggagggtacaagcgcgccgtgctcgacttcatggccatcgccaaccgcacccgcgtcgtgttccagagcaccttctaccacatgaaggccgacggcacgctctgcggcccgcttgtcgacgacgcatcgctcgtcggcctgcgcaagaagcccgccgccggacgccgcctgctgcagttcctgtaagcagctagcttccacgtgcgatgcgcaggcgcagcgatgatgtaatattggtaggcgttttggtttggtgtgtgcgtggtatatgcgtgccgtgcgcgccctgtggctgcagctgcagctgcagtggcgtcgcgttgggtgtttggtgtggtctggcgcaccgggacaggtttaatcaacttatgatgataacctgatgaggtgccagactgaagatgacacgggatcaatggcaaatgctgctagtactatttttgttcc

SEQ ID NO: 2937 - DNA, 1641 bp, Sorghum bicolor
gctcatctcgtcctcactcccctccactccactcctcccgtgtcccttcgtcgcgaagctccagcagctgctgctgcaaaaccccaaagagggaaggacgaagccacagacattagaggtccttgtgaatggaagaggagggagggagagcaaagatgcggcgcgtcgcgctgttgctgctcctcgtatgcgcgctggcgcgggctgccgcggtcgtcaccgacggtcttctcccgaacggcaacttcgaggatggcccgcccaagtcggcgctggtgaacggcacggtggtgtcgggcgccaacgccatcccgcgctgggagacctccggcttcgtggagtacatcgagtcgggccacaagcagggcgacatgctgctggtggtgccgcagggcgcccacgccgtgcgcctgggcaacgaggcctccatccggcagcgcctcgccgtggcgcgcggcgcctactacgccatcaccttcagcgcggcgcggacgtgcgcgcaggcggaggcgctcaacgtgtcggtgagccccgagtggggtgtgctcccgatgcagaccatctacggcagcaacggctgggactcgtacgcctgggccttcaaggcgaagctgagcaccgtgacgctcgtcatccacaaccccggcgtggaggaggaccccgcctgcggcccgctcatcgacggcgtcgccatccgggcgctgtacccgccgacgctcgccagggggaacatgctcaagaacggcgggttcgaggagggcccctacttcctgcccaacgcgtcgtggggcgtgctggtgccgccaaacatcgaggacgaccactcgccgctccccggctggatgatcgcctcctccaaggccgtcaagtacgtggacgccgcgcacttcgccgtgccccagggcgcgcgcgccgtcgagctggtgggcgggcgggagagcgcgctggtccaggaggtgcgcaccgtgcccgggtggagctaccgcctcgccttcgccgtgggggactccggcgacggctgcacggggtccatggtcgccgaggcctacgcggcgcgcgccaccgtcaaggtgccgtacgagtccaagggcaccggagggtacaagcgcgccgtgctcgacttcacggccgtcgccaaccgcacacgcgtcgtgttccagagcaccttctaccacatgaaggccgacggcacgctctgcggcccgctcgtcgacgacgcctccgtcgtcggcctgcgcaagaagcctgccgccgccggccgccgcctcctgcagttcctgtaaggtgcttaacgccgcgctcggtggcgtggcgcaggcgcaggcgcagcgatggtgtaatattggtaggcgttttggtttggtgtgtgcgtggtatatgcgtgccgtgcgcgccctgtggctgcagcggcagtggcgtcgcgttgggtgttttcttgttgtgacgaacaaaggggtcttctggcgcaccgggagaggttaatcaacttatgataacctgatgaggtgccagactgaagatgacacgggattaatggcaaatgctgctagtactatttttgttccagacttagattgagcctattaaactttaacaaccttaaccaaacaccctgaaatgtgtgcgattgaagtgtgctgc

SEQ ID NO: 2938 - DNA, 1875 bp, Sorghum bicolor
tctcgctattgaacggcagtctcgtgggcgttttgccgaggggtcgctctataagagcggccgcgacccccgcctgctctgctcatctcgtcctcactcccctccactccactcctcccgtgtcccttcgtcgcgaagctccagcagctgctgctgcaaaaccccaaagagggaaggacgaagccacagacattagaggtccttgtgaatggaagaggagggagggagagcaaagatgcggcgcgtcgcgctgttgctgctcctcgtatgcgcgctggcgcgggctgccgcggtcgtcaccgacggtcttctcccgaacggcaacttcgaggatggcccgcccaagtcggcgctggtgaacggcacggtggtgtcgggcgccaacgccatcccgcgctgggagacctccggcttcgtggagtacatcgagtcgggccacaagcagggcgacatgctgctggtggtgccgcagggcgcccacgccgtgcgcctgggcaacgaggcctccatccggcagcgcctcgccgtggcgcgcggcgcctactacgccatcaccttcagcgcggcgcggacgtgcgcgcaggcggaggcgctcaacgtgtcggtgagccccgagtggggtgtgctcccgatgcagaccatctacggcagcaacggctgggactcgtacgcctgggccttcaaggcgaagctgagcaccgtgacgctcgtcatccacaaccccggcgtggaggaggaccccgcctgcggcccgctcatcgacggcgtcgccatccgggcgctgtacccgccgacgctcgccagggggaacatgctcaagaacggcgggttcgaggagggcccctacttcctgcccaacgcgtcgtggggcgtgctggtgccgccaaacatcgaggacgaccactcgccgctccccggctggatgatcgcctcctccaaggccgtcaagtacgtggacgccgcgcacttcgccgtgccccagggcgcgcgcgccgtcgagctggtgggcgggcgggagagcgcgctggtccaggaggtgcgcaccgtgcccgggtggagctaccgcctcgccttcgccgtgggggactccggcgacggctgcacggggtccatggtcgccgaggcctacgcggcgcgcgccaccgtcaaggtgccgtacgagtccaagggcaccggagggtacaagcgcgccgtgctcgacttcacggccgtcgccaaccgcacacgcgtcgtgttccagagcaccttctaccacatgaaggccgacggcacgctctgcggcccgctcgtcgacgacgcctccgtcgtcggcctgcgcaagaagcctgccgccgccggccgccgcctcctgcagttcctgtaaggtgcttaacgccgcgctcggtggcgtggcgcaggcgcaggcgcagcgatggtgtaatattggtaggcgttttggtttggtgtgtgcgtggtatatgcgtgccgtgcgcgccctgtggctgcagctgcagtggcgtcgcgttgggtgttttcttgttgtgacgaacaaaggggtcttctggcgcaccgggagaggttaatcaacttatgataacctgatgaggtgccagactgaagatgacacgggattaatggcaaatgctgctagtactatttttgttccagacttagactgagcctattaaactttaacaaccttaaccaaacaccctgaaatgtgtgcgattgaagtgtgctgcttttagacgacatgtacctcaaacggagctcatggtctctccacgtttgcatgatttcaaccaatatatcttgaccatccatcatcgaagctcatagtttcacatgtgccccgacgccactaattgacgaacgatcactcaaactaaatcaaac

SEQ ID NO: 2939 - DNA, 1534 bp, Panicum virgatum
cctccggctcgcaaccgcaaagcagcaggcaggggagaggagtccttgcgaaaagaggaagagaagcaccggcggaagaggaggagagcacgatgcgccgcgtcgcgctgttgctgctcgtctgcgcggcggcgcgcgccgccgcggtcgtcaccgacgggctcctcccgaacggcaacttcgaggagggcccgcccaagtcggcgctggtgaacggcacggtggtgaagggcgccaacgcgatcccgcgctgggagacgtcgggcttcgtggagtacatcgagtccgggcacaagcagggcgacatgctcctggtggtcccgcagggtgcccacgccgtgcgcctgggcaacgaggcctccatccgccagcgcctcgccgtcacccgcggcgcctactacgccatcaccttcagcgcggcgcgcacctgcgcgcaggccgagcgcctcaacatctcggtgagccccgagtggggcgtgctcccgatgcagaccatctacggcagcaacggctgggactcgtacgcctgggccttcaaggccaagctcgacgccgtcacgctcgtcatccacaaccccggcgtcgaggaggaccccgcctgcggcccgctcatcgacggcgtcgccatccgcgcgctctatccgcccaggctcgcccgcggcaacatgctcaagaacggcggcttcgaggagggcccctacttcctgcccagcacgtcctggggcgtgctcgtgccgcccaacatcgaggacgaccactcgccgctccccgcctggatgatcgcctcctccaaggccgtcaagtacgtggacgccgcgcacttcagggtgccccagggcgcgcgcgccgtcgagctggtgggcggccgggagagcgcgctcgtgcaggaggtgcgcaccgtgcccgggtggagctaccgcctcgccttcgccgtgggcgacgccggcgacggctgcgcggggcccatggtcgccgaggccttcgcggcgcgcgccaccgtcaaggtgccctacgagtccaagggcaccggcgggtacaagcgcgccgtgctggacttcacggccatcgccaaccgcacccgcgtcgtgttccagagcaccttctaccacatgaaggccgacggcacgctctgcgggcccctcgtcgacgacgcctcgctcgtcgggctgcgcaagaagcccgccgccggcagccgccgcctgctgctgtgactgaggcctcttcgatatgattttcacgcgcggtcagtgatgatgtaatatggtggggtagtactagcaggtgttttggtttggtgtgcgcttggtatatgcgtggcgtgccgtgccctgttgcagctgcagcggcgcgcgcatgggtggagtttttcttgtgaagaagaaaggggtggtggcctggctcgagggtccaaaagacttttgagttgtaaaattaacctgagaagccaggctgaagtcgacaagggattaatggctaatgttactactaattttcttgttggcaccatatcctgtgcaaaccaatgattttgtgg

SEQ ID NO: 2940 - DNA, 1556 bp, Panicum virgatum
cgcctcgcaaccgcaaagcaggcacgcacgcaggggagaagagctagtggttgcgaaagaggaagagaagcaccggcagaggaggagggagagcacgatgcgccgcgtcgcgctgttgctgctcgtctgcgcggcggcgcgcgccgccgcggtcgtcactgacgggctgctcccgaacggcaacttcgaggagggcccgccgaggtcggcgctggtgaacggcacggtggtgaggggcgccaacgccatcccgagctgggagacctcaggcttcgtcgagtacatcgagtcggggcacaagcagggcgacatgctcctggtcgtgccgcagggcgcccacgccgtgcgcctgggcaacgaggcctccatccgccagcgcctcgccgtcgcccgcggcgcctactacgccatcaccttcagcgcggcgcgcacctgcgcgcaggcggagcgcctcaacgtgtcggtgagccccgagtggggcgtgctcccgatgcagaccatctacggcagcaacggctgggactcgtacgcctgggccttcaaggccaagctcgacgccgtcacgctcgtcatccacaaccccggcgtcgaggaggaccccgcctgcggcccgctcatcgacggcgtcgccatccgcgcgctctacccgcccaggcttgcccgcggcaacatgctcaagaacggcggcttcgaggaggggccctacttcctgcccggcgcgtcctggggcgtgctcgtgccgcccaacatcgaggacgaccactcgccgctccccgcctggatgatcgcctcctccaaggccgtcaagtacgtggacgccgcgcacttcaaggtgccccagggcgcgcgcgccgtcgagttggtgggcggccgggagagcgcgctcgtgcaggaggtgcgcaccgtgcccgggtggagctaccgcctcgccttcgccgtgggcgacgccggcgacggctgcgcggggcccatggtcgccgaggccttcgcggcgcgcgccaccgtcaaggtgccctacgagtccaagggggccggggggtacaagcgcgccgtgctggacttcacggccatcgccaaccgcacccgcgtcgtgttccagagcaccttctaccacatgaaggccgacggcacgctgtgcgggcccctcgtcgacgatgcgtcgctcgtcgggctgcgcaagaagcccgccgccgccgggcgccgcctgctgctctgaaggccggccgccttcgattttcaccgccgccggcgagtatcgttcgtgcgtcgctgatgtaatatggtgggcgtgtggctagttctggcaggcgttttggtttggcgtgcgcttggtatatgcgtggcgtgccctgcgtgccctgtggttgcagctgcagaggcgcgcacatgggcggtgtttttcttgtgaagaagaaaggggtggtggcctggctcgagggtccaagactttggagtgtaacataacctgaggagccaggctgaagtcgacaagggattaatggctactaatgttactactccttccgtcccaaaataaatataattttaagaccaaa

SEQ ID NO: 2941 - DNA, 1967 bp, Setaria italica
atgtcgagccagctagtgctagcgatcgaagcgcatgcgagcctgtgggtgaaaaatagagatggcacgtccaggagcatgaggccgagaccccggcggcctcgacgcacagatccgccgatctcgcgtgtccgtgtcctgggccccgtcactgcatgccgctcctgctggcttatctcgctgttgagtgcaagcgagctcggatccttggttagttcgtacagtttctcaagcgacaagcaaggggcgcatgaattacggcgcacgtacacatggcgccatgtgcccaaccccaagaccggccaggccgtcgtggttgacggtatcttggccgatgttccagatcgacgaggctcctgtcccgcaaagcaggggagagggagtccttgtgaacagaagagaagcaccccggcagcaggaggaaggaggagaggcatgatgcgccgcgtcgcgctgttgctgctcgtctgcgcggcggcgcgcgccgccgccgtcgtcaccgacgggcttcttccgaacggcaacttcgaggagggcccgcccaagtcggcgctggtgaacggcacggtggtgcgcggcgcgaacgccatcccgctctgggagacgtcgggcttcgtggagtacatcgagtccgggcacaagcagggcgacatgctcctggttgtgccccagggcgcccacgccgtgcgcctgggcaacgaggcctccatccgccagcgcctcgccgtcacccggggcgcctactacgccatcaccttcagcgcggcgcgcacctgcgcgcaggccgagcgcctcaacgtctcggtgagccccgagtggggcgtgctcccgatgcagaccatctacggcagcaacggctgggactcctacgcctgggcgttcaaggccaagttcgacaccgtcacgctcgtcatccacaaccccggcgtcgaggaggacccggcctgcggcccgctcatcgacggcgtcgccatccgcgccctgtacccgcccacgctcgtccgcgggaacatgctcaagaacggcgggttcgaggaggggccctacttccttcccaacgcgtcgtggggcgtgctcgtgccgcccaacatcgaggacgaccactcgccgctcccggcgtggatgatcgtgtcgtccaaggccgtcaagtacgtggacgccgcgcacttcaaggtgccccagggcgcgcgcgccgtggagctggtgggcgggagggagagcgcgctggtgcaggaggtgcgcaccgtgcctgggtggagctaccgcctctccttcgccgtcggggacgccggcgacggctgcaccgggtccatggtcgccgaggccttcgcggcgcgcgccaccgtgaaggtgccgtacgagtccaaggggacgggagggtacaagcgcgccgtgctggacttcaccgctatcgccaaccgcacccgcgtcgtgttccagagcacgttctaccacatgaaggccgacggcacgctctgcgggccacttgtcgacgatgcctcgctcgtcgggctgcgcaagaagcccgccgccggccgccgcctgctgctgtaaggcctttgttgatttgcacgcgcctcggtcgcgcgcggtgatgtaatatggtgggcgtgtggtgggtctagtactggtaggcgttttggtttggtgtgcgcttggtatatgagatgtgtgccgtgccgtgcgcgccctgtggttgcggttgcagtggcgcgtgcatggagtttttcttgtgaagaagaagggaggcggtggcctggctcgagggtttataagacttttgagtaactttaacgacacgggattaatggcaaatgttactagtatttttgttccaaactctgatagatcgacagatcgagaaccatcaccttggccgtcaagaggattgaaacggggcttgggagactgagaccaagatgcaattgcatgattgcatctgttactactcgcagacgaccgacgac

SEQ ID NO: 2942 - DNA, 1514 bp, Setaria italica
gtgagtgcctcccgctcgttagcttccttgcgcatcccaggtcccgtgtccttcgactcgcagccgcaaagcaggggagagggagtccttgtgaacagaagagaagcaccccggcagcaggaggaaggaggagaggcatgatgcgccgcgtcgcgctgttgctgctcgtctgcgcggcggcgcgcgccgccgccgtcgtcaccgacgggcttcttccgaacggcaacttcgaggagggcccgcccaagtcggcgctggtgaacggcacggtggtgcgcggcgcgaacgccatcccgctctgggagacgtcgggcttcgtggagtacatcgagtccgggcacaagcagggcgacatgctcctggttgtgccccagggcgcccacgccgtgcgcctgggcaacgaggcctccatccgccagcgcctcgccgtcacccggggcgcctactacgccatcaccttcagcgcggcgcgcacctgcgcgcaggccgagcgcctcaacgtctcggtgagccccgagtggggcgtgctcccgatgcagaccatctacggcagcaacggctgggactcctacgcctgggcgttcaaggccaagttcgacaccgtcacgctcgtcatccacaaccccggcgtcgaggaggacccggcctgcggcccgctcatcgacggcgtcgccatccgcgccctgtacccgcccacgctcgtccgcgggaacatgctcaagaacggcgggttcgaggaggggccctacttccttcccaacgcgtcgtggggcgtgctcgtgccgcccaacatcgaggacgaccactcgccgctcccggcgtggatgatcgtgtcgtccaaggccgtcaagtacgtggacgccgcgcacttcaaggtgccccagggcgcgcgcgccgtggagctggtgggcgggagggagagcgcgctggtgcaggaggtgcgcaccgtgcctgggtggagctaccgcctctccttcgccgtcggggacgccggcgacggctgcaccgggtccatggtcgccgaggccttcgcggcgcgcgccaccgtgaaggtgccgtacgagtccaaggggacgggagggtacaagcgcgccgtgctggacttcaccgctatcgccaaccgcacccgcgtcgtgttccagagcacgttctaccacatgaaggccgacggcacgctctgcgggccacttgtcgacgatgcctcgctcgtcgggctgcgcaagaagcccgccgccggccgccgcctgctgctgtaaggcctttgttgatttgcacgcgcctcggtcgcgcgcggtgatgtaatatggtgggcgtgtggtgggtctagtactggtaggcgttttggtttggtgtgcgcttggtatatgagatgtgtgccgtgccgtgcgcgccctgtggttgcggttgcagtggcgcgtgcatggagtttttcttgtgaagaagaagggaggcggtggcctggctcgagggtttataagacttttgagtaactttaacgacacgggattaatggc

SEQ ID NO: 2943 - DNA, 1879 bp, Oryza sativa
atcatcccaagcggcacagcagcctcgagctgaactgaagcaggggaggggaggagaggagaggagagagcaacgcgttcaccgttgagagaagagaaggaagtaagacgagcgcaatgcgtcgcgtcacggtgctcgttctgctcctcgcctgcgcggcggcgcgcgccgccgccgccgtcgtcaccgacgggctgttgccgaacggcaacttcgaggagggcccacccaagtcggacctggtgaacggcacggtggtgcgcggcgcgaacgccatcccgcggtgggagacgtccgggttcgtggagtacatcgagtccgggcacaagcagggggacatgctgctggtggtgccgcagggcgcgcacgccgtgcgcctcggcaacgaggcgtccatccggcagcggctcgccgtgaccaggggcgcctactacgccgtcacgtttagcgcggcgcgcacctgcgcccaggcggagcagctcaacgtgtcggtgagccccgagtggggggtgctccccatgcagaccatctacggcagcaacgggtgggactcgtacgcgtgggcgttcaaggcgaagatggacgaggtggcgctcgtcatccacaacccgggcgtggaggaggacccggcgtgcggcccgctcatcgacggcgtcgccatcagggcgctgtacccgccgacgctggccaaggggaacatgctcaagaacggcgggttcgaggagggcccctacttcctccccaacgcgtcgtggggggtgctcgtcccgcccaacatcgaggacgaccactcgccgctcccggcgtggatgatcatgtcgtccaaggccgtcaagtacgtcgacgccgcgcacttcgccgtgccgcagggcgcccgcgccgtggagctggtggggggcaaggagtcggcgctggtgcaggaggtgcgcaccgtgcccgggtggacgtaccgcctgtcgttcgccgtgggcgacgcgcgcgacgggtgcgcgggctccatggtcgccgaggcgtacgcggcgagggcctccatcaaggtgccgtacgagtccaagggcaccggcgggtacaagcgcgccgtcctcgagttcgccgccatcgccaaccgcacccgcgtcgtgttccagagcacgttctaccacaccatgaccgacggctcgctctgcgggccggtcatcgacgacgcctccctcgtcggcctccgcaagaagacggccggccggcggctgctcctgtaagacgaacggccgcgtggcatcgaacgccgtcgcattccctccattctatgaatatatgaatacaaggcgcggttaaacttgggggcagttggcacgaccaaagttgggtgctaaaatgggtagtattgctaggctcgtttttttggttttggtgtgtactctggtatatgtacgcgtgtgcgcgcgttgcatggttatactttggagctgcgctcgtttggtgttttgttgtgaagaggagaggtgatacgtggtgcaaggtctgtcacaaggggtttggttgatcaacttaaccggaggtgccaacctaaacgcaccatcagacattatgaatgggaagcattactagtgctcacttttttataagtcaattgtgtatttttaattctgttctaaaaagccagatcctttttgaaagttgagtcatacatttgagctatgctcgaaaatcaatcggaaacgaacttaaacatgtgtaaatgatgtatgaaagtaagagtaagttttatatttagccacattttcttattagaaaagttttaatttggatcgcttgtttagctatacttttacttcggaccagataacattttctttgtttgcatcttggaccaccttcactatacatctatttcatcccc

SEQ ID NO: 2944 - DNA, 1060 bp, Setaria italica
gatgatgcagggcttcttccgaacggcaacttcgaggagggcccgcccaagtcggcgctggtgaacggcacggtggtgcgcggcgcgaacgccatcccgctctgggagacgtcgggcttcgtggagtacatcgagtccgggcacaagcagggcgacatgctcctggttgtgccccagggcgcccacgccgtgcgcctgggcaacgaggcctccatccgccagcgcctcgccgtcacccggggcgcctactacgccatcaccttcagcgcggcgcgcacctgcgcgcaggccgagcgcctcaacgtctcggtgagccccgagtggggcgtgctcccgatgcagaccatctacggcagcaacggctgggactcctacgcctgggcgttcaaggccaagttcgacaccgtcacgctcgtcatccacaaccccggcgtcgaggaggacccggcctgcggcccgctcatcgacggcgtcgccatccgcgccctgtacccgcccacgctcgtccgcgggaacatgctcaagaacggcgggttcgaggaggggccctacttccttcccaacgcgtcgtggggcgtgctcgtgccgcccaacatcgaggacgaccactcgccgctcccggcgtggatgatcgtgtcgtccaaggccgtcaagtacgtggacgccgcgcacttcaaggtgccccagggcgcgcgcgccgtggagctggtgggcgggagggagagcgcgctggtgcaggaggtgcgcaccgtgcctgggtggagctaccgcctctccttcgccgtcggggacgccggcgacggctgcaccgggtccatggtcgccgaggccttcgcggcgcgcgccaccgtgaaggtgccgtacgagtccaaggggacgggagggtacaagcgcgccgtgctggacttcaccgctatcgccaaccgcacccgcgtcgtgttccagagcacgttctaccacatgaaggccgacggcacgctctgcgggccacttgtcgacgatgcctcgctcgtcgggctgcgcaagaagcccgccgccggccgccgcctgctgctgtaag

SEQ ID NO: 2945 - DNA, 1033 bp, Sorghum bicolor
atgcaacaatgcaggtcttctcccgaacggcaacttcgaggatggcccgcccaagtcggcgctggtgaacggcacggtggtgtcgggcgccaacgccatcccgcgctgggagacctccggcttcgtggagtacatcgagtcgggccacaagcagggcgacatgctgctggtggtgccgcagggcgcccacgccgtgcgcctgggcaacgaggcctccatccggcagcgcctcgccgtggcgcgcggcgcctactacgccatcaccttcagcgcggcgcggacgtgcgcgcaggcggaggcgctcaacgtgtcggtgagccccgagtggggtgtgctcccgatgcagaccatctacggcagcaacggctgggactcgtacgcctgggccttcaaggcgaagctgagcaccgtgacgctcgtcatccacaaccccggcgtggaggaggaccccgcctgcggcccgctcatcgacggcgtcgccatccgggcgctgtacccgccgacgctcgccagggggaacatgctcaagaacggcgggttcgaggagggcccctacttcctgcccaacgcgtcgtggggcgtgctggtgccgccaaacatcgaggacgaccactcgccgctccccggctggatgatcgcctcctccaaggccgtcaagtacgtggacgccgcgcacttcgccgtgccccagggcgcgcgcgccgtcgagctggtgggcgggcgggagagcgcgctggtccaggaggtgcgcaccgtgcccgggtggagctaccgcctcgccttcgccgtgggggactccggcgacggctgcacggggtccatggtcgccgaggcctacgcggcgcgcgccaccgtcaaggtgccgtacgagtccaagggcaccggagggtacaagcgcgccgtgctcgacttcacggccgtcgccaaccgcacacgcgtcgtgttccagagcaccttctaccacatgaaggccgacggcacgctctgcggcccgctcgtcgacgacgcctccgtcgtcggcctgcgcaagaag

SEQ ID NO: 2946 - DNA, 1477 bp, Oryza sativa
agtggattaatctgattaaattaatggtgactaaaaaaattaacgacgtgtgttgtgcagggctgttgccgaacggcaacttcgaggagggcccacccaagtcggacctggtgaacggcacggtggtgcgcggcgcgaacgccatcccgcggtgggagacgtccgggttcgtggagtacatcgagtccgggcacaagcagggggacatgctgctggtggtgccgcagggcgcgcacgccgtgcgcctcggcaacgaggcgtccatccggcagcggctcgccgtgaccaggggcgcctactacgccgtcacgtttagcgcggcgcgcacctgcgcccaggcggagcagctcaacgtgtcggtgagccccgagtggggggtgctccccatgcagaccatctacggcagcaacgggtgggactcgtacgcgtgggcgttcaaggcgaagatggacgaggtggcgctcgtcatccacaacccgggcgtggaggaggacccggcgtgcggcccgctcatcgacggcgtcgccatcagggcgctgtacccgccgacgctggccaaggggaacatgctcaagaacggcgggttcgaggagggcccctacttcctccccaacgcgtcgtggggggtgctcgtcccgcccaacatcgaggacgaccactcgccgctcccggcgtggatgatcatgtcgtccaaggccgtcaagtacgtcgacgccgcgcacttcgccgtgccgcagggcgcccgcgccgtggagctggtggggggcaaggagtcggcgctggtgcaggaggtgcgcaccgtgcccgggtggacgtaccgcctgtcgttcgccgtgggcgacgcgcgcgacgggtgcgcgggctccatggtcgccgaggcgtacgcggcgagggcctccatcaaggtgccgtacgagtccaagggcaccggcgggtacaagcgcgccgtcctcgagttcgccgccatcgccaaccgcacccgcgtcgtgttccagagcacgttctaccacaccatgaccgacggctcgctctgcgggccggtcatcgacgacgcctccctcgtcggcctccgcaagaagacggccggccggcggctgctcctgtaagacgaacggccgcgtggcatcgaacgccgtcgcattccctccattctatgaatatatgaatacaaggcgcggttaaacttgggggcagttggcacgaccaaagttgggtgctaaaatgggtagtattgctaggctcgtttttttggttttggtgtgtactctggtatatgtacgcgtgtgcgcgcgttgcatggttatactttggagctgcgctcgtttggtgttttgttgtgaagaggagaggtgatacgtggtgcaaggtctgtcacaaggggtttggttgatcaacttaaccggaggtgccaacctaaacgcaccatcagacattatgaatgggaagcattactagtgctcacttttttataaataaa

SEQ ID NO: 2947 - DNA, 1512 bp, Leymus cinereus x Leymus triticoides
gctagtagtaagcttgaaccagctcgaagcggaaaactaaagggtgagagagagagagacgaagacgaaggacgacgcgatgcgttgtgccgtgctgctgctgctcgtcttcgcggcggcgcgcgccgccgcggtcgtcaccgacgggcttctgccgaatggcaacttcgagttgggtccggccaagtcggagctggtgaacggcacggtggtgaagggcggcaaggcgatccccaagtgggagacgtcgggcttcgtggagtacatcgagtccgggcacaagcagggcgacatgctgctggtggtgccgcagggcgcgtacgccgtgcgcctcggcaacgacgcctccatcctccagcgcatccccgtcgcccggggctcctactacgccatcaccttcagcgccgcccgcacctgcgcgcaggccgagcgcctcaacgtctccgtcagcccagagtccggcgtgctccccatgcagaccatctacggcagcaacggctgggactcgtatgcctgggccttcaaggccaagctcgacgtcgtcgacctcgtcatccacaacccgggcgtcgaggaggacccggcctgcggcccgctcatcgacgccgtcgccatccggacgctctacccgcccacgctctccaagggcaacatgctcaagaacggcggcttcgaggagggcccctacttcctgcctaacacctcctggggggtgctcgtgccgcccaacatcgaggacgaccactcgccgctccccgcctggatgatcatgtcttcgaaggccgtcaagtacgtcgacgccgcgcacttcaaggtgcccgagggcgcgcgcgccgtcgagctcgtgggcggcaaggagagcgcgctcgtgcaggaggtgcgcaccgtgcccggctgggcctaccgcctctccttcgccgtcggcgactccggcgacgactgcaagggctccatggtggccgaggcctacgcggcgcgcgccaccctcaaggtgccgtacgactccaagggcgccggcgggtacaagcgcgccgtgctggacttcgtggccgtcagggaccgcacgcgggtcgtgttccagagcgccttctaccacatgaaggccgacggcacgctctgcggccccgtcatcgacgacgctaagctcgtcggcctgcgcaagaagccggccgcccgccggctcatgctgtaagctggcccggccgctaagtcttaccacaatatatgcaagcacggcgcggcaccgccggatccggatccggatcggagtgagtagtatttattgctaggcttttggtgtgccgggtatatgtgtgtgagttcgccgttgtccgccgtgcttatacttgcggtggctcggcgcttgttatttttgtttctttcatgtcaatcaacaaagaaaagggtcatgctgtggcttggcccgacggagggtcacgttatcatcacataggccaaaaccacatgatacaaggcgcaattcaatggcaaatgcatcttactatttctcat

SEQ ID NO: 2948 - DNA, 1444 bp, Triticum aestivum
gcttgaaggagctcggagcggcaaatcaaagaagaagaagagtgagagagagaccaggaaggaggacgacgcgatgcgctgtgccgtggtgctgctgctcgtcttcgcggcggcgcgcgccgccgcggtcgtcaccgacgggctcctcccgaatggcaacttcgagtcgggtccggccaagtcggagctggtgaacggcacggtggtgaagggcggcaaggcgatccccaagtgggagacgtcgggcttcgtggagtacatcgagtccgggcacaagcagggcgacatgctgctggtggtgccgcagggcgcctacgccgtccgcctcggcaacgacgcctccatcctccagcgcatccccgtcgcccggggctcctactacgccatcaccttcagcgccgcccgcacctgcgcgcaggccgagcgcctcaacgtctccgtcagccccgagtccggcgtgctccccatgcagaccatctacggcagcaacggctgggactcctacgcctgggccttcaaggccaagctcgacgtcgtggagctcgtcatccacaacccgggcgtcgaggaggaccccgcctgcggcccgctcatcgacgccgtcgccatccgcacgctctacccgcccacgctctccaagggcaacatgctcaagaacggcggcttcgaggagggcccctacttcctccccaacgcctcctggggcgtgctcgtgccgcccaacatcgaggacgaccactccccgctccccgcctggatgatcatgtcctccaaggccgtcaagtacgtcgacgccgcgcacttcaaggtgcccgagggcgcgcgcgccgtcgagctcgttggcggcaaggagagcgcgctcgtccaggaggtgcgcaccgtgcccggctgggcataccgcctctccttcgccgtcggcgactctgccgacggctgcaagggctccatggtggccgaggcctacgccgcgcgctccaccctcaaggtgccgtacgagtccaatggcgccggcggctacaagcgcgccgtgctggacttcgtcgccgtcagggaccgcacccgggtggtcttccagagcgccttctaccacatgaaggccgacggcaccctctgcgggcccgtcatcgacgacgccaagctcgtcggcctgcgcaagaagccatccgcacgtcgcctcatgctctaattaagctagccccgctgccacgtcttactacaaacaatatatgcaagcacacggcgccggatcggagtgagtagtatttattgctaggcttttggtgtgccaaccgggtgagtatatgtgtgtgagtttgccgttgtccgccgtgcttatacttgcggttgcccggcgcttgttatttttgtttctttcatgccaatcaacaaagaaaagggtcatgctatggcttggcctgacggagggtcacattatcatcacatc

SEQ ID NO: 2949 - DNA, 1458 bp, Leymus cinereus x Leymus triticoides
gctggctagtaataagcttgaacaagctcgaagcggcaaagtaaagaagagagagagagagagagacgaagaaggacgacgcgatgcgttgtgccgtgctgctgctgctcgtcttcgcggcggcgcgcgccgccgcggtcgtcaccgacgggctcctgccgaacggcaacttcgaggccggcccggccaagtcggagctggtgaacggcacggtggtgaagggcggcaaggcgatccccaagtgggacacgtcggggttcgtggagtacatcgagtccgggcacaagcagggcgacatgctgctggtggtgccgcagggcgcgcacgcggtgcgcctcggcaacgacgcctccatcctgcagcgcatccccgtcgcccggggcgcctactacgccatcaccttcagcgcggcgcgcacctgcgcgcaggccgagcgcctcaacgtctccgtcagccccgagtccggcgtgctccccatgcagaccatctacggcagcaacggctgggactcctacgcctgggcattcaaggccaagctcgacctcgtggacctcgtcctccacaaccccggcgtcgaggaggaccccgcgtgcggcccgctcatcgacgccgtcgccatccggacgctctacccgcccacgctctccaagggcaacatgctcaagaacggcggcttcgaggagggcccctacttcctccccaacgcctcatggggggtgctcgtgccgcccaacatcgaggacgaccactcgccgctccccgcctggatggtcatgtcctccaaggccgtcaagtacgtcgacgccgcgcacttcaaggtgcccgagggcgcgcgcgccgtcgagctcgtgggcggcaaggagagcgcgctcgtgcaggaggtgcgcaccgtgcccggctgggcctaccgcctctccttcgccgtcggcgactccggcgacgactgcaagggctccatggtggccgaggcctacgcggcgcgcgccaccctcaaggtgccgtacgagtccaagggcgccggcgggtacaagcgcgccgtgctggacttcgtcgccgtcagggaccgcacgcgggtcgtattccagagcgccttctaccacatgaaggccgacggcacgctctgcgggcccgtcatcgacgacgccaagctcgtcggccagcgcaagaagcccgccgcacgtcgcctcatgctctaagctggcccggccaccgtcgtctacgtcttaccacaaacaatatatgcaagcacggcacggcaccgccggatccggatcggagtgagtagtatttattgctaggcttttggcgtgccgggtatatgtgtgtgagttcgccgttgtccgccgtgcttatacttgcggtggcagggcgcttgatcattttgtttctttcatgtcatcaacaaagaaaagggtcatgctgtggcttggcccgacggagggacacattatcatcaca

SEQ ID NO: 2950 - DNA, 1388 bp, Triticum aestivum
aggacgccgcgatgcgttgcgccgtgctgctcctgctcgtcttcgcggcggcgcgcgccgccgcggtcgtcaccgacgggctcctgccgaatggcaacttcgagttgggtccggccaagtcggagctggtgaacggcacggtggtgaagggcggcaaggcgatccccaggtgggagacgtcgggcttcgtggagtacatcgagtccggccacaagcagggcgacatgctgctggtggtgccgcagggcgcctacgccgtccgcctcggcaacgacgcctccatcctccagcgcatccccgtcgcccggggctcctactacgccatcaccttcagcgccgcccgcacctgcgcgcaggccgagcgcctcaacgtctccgtcagccccgagtccggcgtgctccccatgcagaccatctacggcagcaacggctgggactcctacgcctgggccttcaaggccaagctcgacgtcgtcgagctcgtcctccacaaccccggcgtcgaggaggaccccgcctgcggcccgctcgttgacgccgtcgccatccgcacgctctacccgcccacgctctccaagggcaacatgctcaagaacggcggcttcgaggagggcccctacttcctccccaacgcctcctggggcgtgctcgtgccgcccaacatcgaggacgaccactccccgctccccgcctggatgatcatgtcctccaaggccgtcaagtacgtcgacgccgcgcacttcaaggtgcccgagggcgcccgtgccgtcgagctcgttggcggcaaggagagcgcgctcgtgcaggaggtccgcaccgtgcctggatgggcctaccgtctctccttcgccgtcggcgactccgccgacggctgcatgggatccatggtggccgaggcctatgccgcgcgctccaccctcaaggtgccctacgagtccaagggcgccggcggttacaagcgcgccgtgctggacttcgtcgccgtcagggaccgcacccgggtcgtcttccagagcgccttctaccacatgaaggccgacggcacgctctgcgggcccgtcatcgacgacgccaagctcgtcggcctgcgcaagaagcccgccgcacgtcgcctcatgctctaattaagctagccctgccacgacgtcttactacaaagaatgtacgcaagcacggcgccggatcggagtgagtagtatttattgctaggcttttggtgtgccaaccgggtgggtttatgtgtgagagttcgccgttgtccgccgtgcttatatttgcggtggcccggtgcttgttatttttgtttctttcatcatgctaatcaacaaagaaaagggtcatgctgtggcttggcccgacggagggccacgttatcatcacatcacata

SEQ ID NO: 2951 - DNA, 1595 bp, Leymus cinereus x Leymus triticoides
tgaaccagctcgaagcggaaaaccaaaagggagagaaacaaggacgagcgccgcgatgcgttgtgccgtgctgctgctgctcgtcttcgcggcggcgcgcgccgccgcggtcgtcaccgacgggcttctgccgaatggcaacttcgagttaggtccggccaagtcggagctggtgaacgggacggtggtgaagggcggcaaggcgatccccaagtgggacacgtcggggttcgtggagtacatcgagtccgggcacaagcagggcgacatgctgctggtggtgccgcagggcgcgcacgcggtgcgcctcggcaacgacgcctccatcctccagcgcatccccgtcgcccggggcgcctactacgccatcaccttcagcgcggcgcgcacctgcgcgcaggccgagcgcctcaacgtctccgtcagccccgagtacggcgtgctccccatgcagaccatctacggcagcaacggctgggactcgtacgcctgggcattcaaggccaagctcgacctcgtggacctcgtcctccacaaccccggcgtcgaggaggaccccgcgtgcggcccgctcatcgacgccgtcgccatccggacgctctacccgcccacgctctccaagggcaacatgctcaagaacggcggcttcgaggagggcccctacttcctccccaacgcctcctggggggtgctcgtgccgcccaacatcgaggacgaccactcgccgctccccgcctggatggtcatgtcctccaaggccgtcaagtacgtcgacgccgcgcacttcaaggtgcccgagggcgcgcgcgccgtcgagctcgtgggcggcaaggagagcgcgctggtgcaggaggtgcgcaccgtgccgggatgggcctaccgcctctccttcgccgtcggcgactccggccacgactgcaagggctccatggtcgccgaggcctacgcggcgcgtaccaccctcaaggtgccgtacgagtccaagggcgtcggcgggtacaagcgcgccgtgctggacttcgtcgccgtcagggaccgcacgcgggtcgtgttccagagcgccttctaccacatgaaggccgacggcacgctctgcgggcccgtcatcgacgacgccaagctcgtcggcctgcgcaagaagccggccgcacgtcggctcatgctctaagctactccggccacaggtcttatcttactacaatatgtgcaaaaagcacggcgcggcaccgccggatccggatcggagtgagtagtatttattgctaggctccgggtgtgcctaccgggtgggtatatgcgtgtgagttcgccgtccgttgtccgccgtggttatactcgcggtggcagggcgctggttcattttgtttctttcatgtcatcaatcaacaaagaaagggtcatgctgtggctcggcccgagcgagggtcacattatcatcacataggccaaaccagatgatactacaaggcacaattcaatggcaaatgcatgttacaatttctcatgaaatagtaacaaactcttgatgcaagcatagtttcgtactactagctttctgcctcttttggcttagttaaataaattattttgatgga

SEQ ID NO: 2952 - DNA, 1468 bp, Secale cereale
ggcaaatcaaaggagatagagatatatagagagagacgaagaagaaggacgacgcgatgcgctgtgccgtggtgctgctgctcgtcttcgcggcggcccgcgccgccgcggtcgtcaccgacgggctcctgccgaatggcaactttgagttgggtccggccaagtcggagctggtgaacgggacggtggtgaagggcggcaaggcgatccccaagtgggagacgtcggggttcgtggagtacatcgagtccgggcacaagcagggcgacatgctgctggtggtgccgcagggcgcctacgccgtccgcctcggcaacgacgcctccatcctccagcgcatccccgtcgcccggggctcctactacgccatcaccttcagcgccgcccgcacctgcgcgcaggccgagcgcctcaacgtctccgtcagccccgagtccggcgtgctccccatgcagaccatctacggcagcaacggatgggactcctacgcctgggccttcaaggccaagctcgacgtggtcgagctcgtcctccacaaccccggcgccgaggaggaccccgcatgcggcccgctcgtcgacgccgtcgccatccgcacgctctacccgcccacgctctccaagggcaacatgctcaagaacggcggcttcgaggagggcccctacttcctccccaacgcctcctggggcgtgctcgtgccgcccaacatcgaggacgaccactccccgctccccgcctggatgatcatgtcctccaaggcagtcaagtacgtcgacgccgcgcacttcaaggtgcccgagggcgcgcgcgccgtcgagctcgtcggcggcaaggagagcgcgctcgtgcaggaggtgcgcaccgtgcccggatgggcctaccgcctctccttcgccgttggcgactccgccgacggctgcaagggctccatggtggccgaggcctacgccgcgcgctccaccctcaaggtgccctacgagtccaatggcgccggcgggtacaagcgtgccgtgctggacttcgtggccgtcagggaccgcacccgggttgtcttccagagcgccttctaccacatgaaggccgacggcacgctctgcgggcccgtcatcgacgatgccaagctcgtcggcctgcgcaagaagcccgccgcacgtcgcctcatgctctaattaagctagccccgccactaagtcttaccacaatactctatatgcaagcacggcgccggatcgagagtgagtagtatttattgctaggcttttggcgtgccgacccggtgagtacgtatgtgtgtgtgagttcgccgttgtccgccatgcttatatttgcggtggctcggcgcttgttatttttgtttctttcatgccaaccaacaaagaaaagggtcgtgctgggtcacgttatcttcacatcggccaaaaccacatgatacaaggagcaattcaatgacgaatgcatgttactattt

SEQ ID NO: 2953 - DNA, 1602 bp, Secale cereale
tgggtattcctaaaccttgtagggtcctagtcgtagtctttgtaaggagctcgaagcggcaaatcaaaggagatagagatatatagagagagacgaagaagaaggacgacgcgatgcgctgtgccgtggtgctgctgctcgtcttcgcggcggcccgcgccgccgcggtcgtcaccgacgggctcctgccgaatggcaacttcgagttgggtccggccaagtcggagctggtgaacgggacggtggtgaagggcgggaaggcgatccccaagtgggagacgtcggggttcgtggagtacatcgagtccgggcacaagcagggcgacatgctgctggtggtgccgcagggcgcctacgccgtccgcctcggcaacgacgcctccatcctccagcgcatccccgtcgcccggggctcctactacgccatcaccttcagcgccgcccgcacctgcgcgcaggccgagcgcctcaacgtctccgtcagccccgagtccggcgtgctccccatgcagaccatctacggcagcaacggctgggactcctacgcctgggccttcaaggccaagctcgacgtggtggagctcgtcctccacaaccccggcgccgaggaggaccccgcatgcggcccgctcgtcgacgccgtcgccatccgcacgctctacccgcccacgctctccaagggcaacatgctcaagaacggcggcttcgaggagggcccctacttcctccccaacgcctcctggggcgtgctcgtgccgcccaacatcgaggacgaccactccccgctccccgcctggatgatcatgtcctccaaggccgtcaagtacgtcgacgccgcgcacttcaaggtgcccgagggcgcgcgcgccgtcgagctcgtcggcggcaaggagagcgcgctcgtgcaggaggtgcgcaccgtgcccggctgggcctaccgcctctccttcgctgtcggcgactccgctgacggctgcaagggctccatggtggccgaggcctacgccgcgcgctccaccctcaaggtgccctacgagtccaatggcgccggcgggtacaagcgcgccgtgctggactttgtcgccgtcagggaccgcacccgggtcgtcttccagagcgccttctaccacatgaaggccgacggcacgctctgtgggcccgtcatcgacgacgccaagctcgtcggcctgcgcaagaagccggccgcacgtcgcctcatgctctaattaagctagccccgccactaagtcttaccacaatactcaatatgcaagcacggcgccggatcgagagtgagtagtatttattgctaggcttttggtgtgccgacccggtgagtacgtatatgtgtgtgagtccgccgttgtccgccgtgcttatatttgcggtggctcggcgcttgttatttttgtttctttcatgccgaccaacaaagaaaagggtcatgctgttgcttggcccgacgaagggtcacgttatcttcacatcggccaaaaccacatgatacaaggagcaattcaatggcgaatgcatgttattattactaacaaaaaaaaaactagaagactgaccaacggacacacgaagggagtaaggcccccc

SEQ ID NO: 2954 - DNA, 1528 bp, Secale cereale
gcttgaaggagctcgaagcggcaaatcaaaggagatagagatatagagagagagagacgaagaagaaggacgacgcgatgcgctgtgccgtggtgctgctgctcgtcttcgcggcggcccgcgccgccgcggtcgtcaccgacgggctcctgccgaatggcaacttcgagttgggtccggccaagtcggagctggtgaacgggacggtggtgaagggcggcaaggcgatccccaagtgggagacgtcggggttcgtggagtacatcgagtccgggcacaagcagggcgacatgctgctggtggtgccgcagggcgcctacgccgtccgcctcggcaacgacgcctccatcctccagcgcatccccgtcgcccggggctcctactacgccatcaccttcagcgccgcccgcacctgcgcgcaggccgagcgcctcaacgtctccgtcagccccgagtccggcgtgctccccatgcagaccatctacggcagcaacggctgggactcctacgcctgggccttcaaggccaagctcgacgtcgtcgagctcgtcctccacaaccccggcgccgaggaggaccccgcctgcggcccgctcgtcgacgccgtcgccatccggaccctgtaccctcccacgctctccaagggcaacatgctcaagaacggcggcttcgaggagggcccctacttcctccccaacgcctcctggggcgtgctcgtgccgcccaacatcgaggacgaccactccccgctccccgcctggatgatcatgtcctccaaggccgtcaagtacgtcgacgccgcgcacttcaaggtgcccgagggcgcgcgcgccgtcgagctcgtcggcggcaaggagagcgcgctcgtgcaggaggtgcgcaccgtgcccggctgggcctaccgcctctccttcgccgtcggcgactccgccgacggctgcaagggctccatggtggccgaggcctacgcggcgcgctccaccctcaaggtgccgtacgagtccaatggcgccggcgggtacaagcgcgccgtgctggacttcgtcgccgtcagggaccgcacccgggtcgtcttccagagcgccttctaccacatgaaggccgacggcacgctctgcgggcccgtcatcgacgacgcaaagctcgtcggcctgcgcaagaagccgaccgcacgtcgcctcatgctctaattaagctagccccgccactaagtcttaccacaatactctatatgcaatgcaagcacggcgccggatcggagtgagtagtatttattgctaggcttttggtgtgccgacccggtgagtacgtatatgtgtgtgtgtgagttcgccgttgtccgccgtgcttatatttgcggtggcccggtgcttgttatttttgtttctttcatgccaatcaacaaagaaaagggtcatgcctgttgcttggcccgaaacgaaaaaaaaaaaaaaaacaaaaaaaaaaaaacaaaaaaaaaaaactaaaacgaagaactacacaacgacgacacaggagtagacccccc

SEQ ID NO: 2955 - DNA, 1473 bp, Secale cereale
aggagctcgaagcggcaaatcaaaggagatagagatatatagagagagacgaagaagaaggacgacgcgatgcgctgtgccgtggtgctgctgctcgtcttcgcggcggcccgcgccaccgcggtcgtcaccgacgggctcctgccgaatggcaactttgagttgggtccggccaagtcggagctggtgaacgggacggtggtgaagggcggcaaggcgatccccaagtgggagacgtcgggcttcgtggagtacatcgagtccgggcacaagcagggcgacatgctgctggtggtgccgcagggcgcctacgctgtccgcctcggcaacgatgcctccatcctccagcgcatccccgtcgcccggggctcctactacgccatcaccttcagcgccgcccgcacctgcgcgcaggccgagcgcctcaacgtctccgtcagccccgaatccggcgtgctccccatgcaaaccatctacggcagcaacggctgggactcctacgcctgggccttcaaggccaagctcgacgtggtggagctcgtcctccacaaccccggcgccgaggaggaccccgcatgcggcccgctcgtcgacgccgtcgccatccgcacgctctacccgcccacgctctccaagggcaacatgctcaagaacggcggcttcgaggagggcccctacttcctccccaacgcctcctggggcgtgctcgtgccgcccaacatcgaggacgaccactccccgctccccgcctggatgatcatgtcctccaaggccgtcaagtacgtcgacgccgcgcacttcaaggtgcccgagggcgcgcgcgccgtcgagctcgtcggcggcaaggagagcgcgctcgtgcaggaggtgcgcaccgtgcccggctgggcctaccgcctctccttcgccgtcggtgactccgccgacggctgcaagggctccatggtggccgaggcctacgccgcgcgctccaccctcaaggtgccttatgagtccaatggcgccggcgggtacaagcgtgccgtgctcgacttcgtcgccgtcagggaccgcacccgggtcgtcttccagagcgccttctaccacatgaaggccgacggcacgctctgcgggcccgtcatcgacgatgccaagctcgtcggcctgcgcaagaagcccgccgcacgtcgcctcatgctctaattaagctagacccgccactaagtcttaccacaaaatatatgcaagcacggcgccggatcgagagtgagtagtatttattgctaggcttttggtgtgccgacccggtgagtacgtatatgtgtgtgaggtcgccgttgtccgccgtgcttatatttgcggtggctcggcgcttgttatttttgtttctttcatgccaaccaacaaagaaaagggtcatgccgttatcctcacatcggccaaaaccacatgatacaaggagcaattcaatggcgaatgcatgttactatttta

SEQ ID NO: 2956 - DNA, 1398 bp, Secale cereale
ctcgaagcggcaaatcaaaggagagagatagatagagagagagacgaagaagaaggacgacgccatgcgctgtgccgtgctgctgctgctcatcttcgcggcggcccgcgccgccgcggtcgtcaccgacgggctcctgccgaatggcaacttcgagttgggtccggccaagtcggagctggtgaacgggacggtggtgaagggcggcaaggcgatccccaagtgggagacgtcggggttcgtggagtacatcgagtccgggcacaagcagggcgacatgctgctggtggtgccgcagggcgcctacgccgtccgcctcggcaacgacgcctccatcctccagcgcatccccgtcgcccggggctcctactacgccatcaccttcagcgccgcccgcacctgcgcgcaggccgagcgcctcaacgtctccgtcagccccgagtccggcgtgctccccatgcagaccatctacggcagcaacggctgggactcctacgcctgggccttcaaggccaagctcgacgtcgtcgagctcgtcctccacaaccccggcgccgaggaggaccccgcatgcggcccgctcgtcgacgccgtcgccatccgcacgctctacccgcccacgctctccaagggcaacatgctcaagaacggcggcttcgaggagggcccctacttcctccccaacgcctcctggggcgtgctcgtgccgcccaacatcgaggacgaccactccccgctccccgcctggatgatcatgtcctccaaggccgtcaagtacgtcgacgccgcgcacttcaaggtgcccgagggcgcgcgcgccgtcgagctcgtcggcggcaaggagagcgcgctcgtgcaggaggtgcgcaccgtgcccggctgggcctaccgcctctccttcgctgtcggcgactccgctgacggctgcaagggctccatggtggccgaggcctacgccgcgcgctccaccctcaaggtgccctacgagtccaatggcgccggcgggtacaagcgcgccgtgctggacttcgtcgccgtcagggaccgcacccgggtcgtcttccagagcgccttctaccacatgaaggccgacggcacgctctgcgggcccgtcatcgacgatgccaagctcgtcggcctgcgcaagaagccgaccgcacgtcgcctcatgctctaattaagctagccccgccactaagtcttaccacaatactctatatgcaagcacggcgccggccggaccggagtgagtagtatttattgctaggcttttggtgtgccgacccggtgagtacgtatatgtgtgtgagagttcgccgttgtccgccgtgcttatatttgcggtgcttgttatttttgtttctttcatgccaaccaacaaagaaaagggtcatgccg

SEQ ID NO: 2957 - DNA, 1526 bp, Brachypodium distachyon
atccatcctgagctagtgaagctcgacttcaaagcgggagagtgagaaagagagagagagaggttcagggaagaagaagggcgcaatgcgtttcgccgtgctgctgctgctcgtctgcacggcggcccgcgccgccgcggtcgtcaccgacgggcttctgccgaatggcaacttcgaggccggccccccgaagacggacctggtgaacggcacggtggtgaagggcggcaacgcgatccccaactgggagacgtcgggcttcgtggagtacatcgagtccgggcacaagcaaggcgacatgctgcttgtggtgccgcagggcgcgcacgccgtgcgcctgggcaacgaggcctccatccggcagaagctcgccgtggcccgcggctcctactacgccatcaccttcagcgcggcgcgcacctgcgcgcaggcggagcggatcaacatctccgtgagcccggagtccggcgtgctcccgatgcagaccatctacggcagcaacggctgggactcgtacgcgtgggcgttcaaggccaagctggacgtcgtccagctcgtcctccacaacgtggggatcgaggaggacccggcgtgcggcccgctggtggacgccgtggccatcaggacgctgtacccgccgacgctctccaaggggaacatgctcaagaacggcggcttcgaggaagggccttacttcctgcccaacgcgtcgtggggcgtgctggtgccgcccaacatcgaggacgaccactcgccgctcccggcgtggatgatcatgtcgtccaaggccgtcaagtacgtggacagcgcgcacttcagggtgcccgaggggacacgcgccgtggagctcgtgggcggcaaggagagcgcgctggtgcaggaggtgcgcaccgtgcccgggtggacctaccgcctgacgttcgccgtgggcgacgccgccgacgggtgcaccgggtccatggtcgccgaggcctacgcggcgcgcgccatcgtcaaggtgccgtacgattccaagggcgccgggggtttcaagcgcgccgtgctggacttcgcggccgttgggaaccgcaccaggatcgtgttccagagcacgttctaccacatgaaggctgatggcaccctctgcgggccggtcatcgacgacgccaagctcgtcggcctcaaaaagaagcctgccgcccgccggctcatgctgtgattaactagtgagagcctgcacaagaaccgccggatcggagtgagtagtatttattggtagcctttttcttggtttggtgtgtcggctgtgtgtgtgtgtgtatgtgtgagctgggggtgtccggttcgtgtgcgccccgtggttatacttgcagggggtggttgttaattttgctttcttcatactatgtcaacaagatgaggtgatgcttaatttggcttggcccgggggttaacgtaggccagaccaaagataaggcacacgatcaatcaatggcaaatgttactatctcttttaagcatttaggttaggccctttttcagataaa

SEQ ID NO: 2958 - DNA, 1653 bp, Brachypodium distachyon
cgtctcatccatcctgagctagtgaagctcgacttcaaagcgggagagtgagaaagagagagagagaggttcagggaagaagaagggcgcaatgcgtttcgccgtgctgctgctgctcgtctgcacggcggcccgcgccgccgcggtcgtcaccgacgggcttctgccgaatggcaacttcgaggccggccccccgaagacggacctggtgaacggcacggtggtgaagggcggcaacgcgatccccaactgggagacgtcgggcttcgtggagtacatcgagtccgggcacaagcaaggcgacatgctgcttgtggtgccgcagggcgcgcacgccgtgcgcctgggcaacgaggcctccatccggcagaagctcgccgtggcccgcggctcctactacgccatcaccttcagcgcggcgcgcacctgcgcgcaggcggagcggatcaacatctccgtgagcccggagtccggcgtgctcccgatgcagaccatctacggcagcaacggctgggactcgtacgcgtgggcgttcaaggccaagctggacgtcgtccagctcgtcctccacaacgtggggatcgaggaggacccggcgtgcggcccgctggtggacgccgtggccatcaggacgctgtacccgccgacgctctccaaggggaacatgctcaagaacggcggcttcgaggaagggccttacttcctgcccaacgcgtcgtggggcgtgctggtgccgcccaacatcgaggacgaccactcgccgctcccggcgtggatgatcatgtcgtccaaggccgtcaagtacgtggacagcgcgcacttcagggtgcccgaggggacacgcgccgtggagctcgtgggcggcaaggagagcgcgctggtgcaggaggtgcgcaccgtgcccgggtggacctaccgcctgacgttcgccgtgggcgacgccgccgacgggtgcaccgggtccatggtcgccgaggcctacgcggcgcgcgccatcgtcaaggtgccgtacgattccaagggcgccgggggtttcaagcgcgccgtgctggacttcgcggccgttgggaaccgcaccaggatcgtgttccagagcacgttctaccacatgaaggctgatggcaccctctgcgggccggtcatcgacgacgccaagctcgtcggcctcaaaaagaagcctgccgcccgccggctcatgctgtgattaactagtgagagcctgcacaagaaccgccggatcggagtgagtagtatttattggtagcctttttcttggtttggtgtgtcggctgtgtgtgtgtgtgtatgtgtgagctgggggtgtccggttcgtgtgcgccccgtggttatacttgcagggggtggttgttaattttgctttcttcatactatgtcaacaagatgaggtgatgcttaatttggcttggcccgggggttaacgtaggccagaccaaagataaggcacacgatcaatcaatggcaaatgttactatctcttttaagcatttaggttaggccctttttcagataaaccacaaccactgtccgctacaattcgacatatattatggctcagtttttgtcatcgtgcattataacttgataatcagatatgaaaaaatagaaacatgaatggaccttttctttttggaa

SEQ ID NO: 2959 - DNA, 1508 bp, Secale cereale
tcaggcttgaaggagctcgaagcggcaaatcaaaggagatagagatatatatatagagaaagagagacgaagaagaaggacgacgcgatgcgctgtgccgtggtgctgctgctcgtcttcgcggcggcccgcgccaccgcggtcgtcaccgacgggctcctgccgaacggcaacttcgagctcggcccggccaagtcggagctggtgaacgggacggtggtgaagggcggcaaggcgatccccaagtgggagacgtcggggttcgtggagtacatcgagtccgggcacaagcagggcgacatgctgctggtggtgccgcagggcgcctacgccgtccgcctcggcaacgacgcctccatcctccagcgcatcccggtcacccggggctcctactacgccatcaccttcagcgccgcccgcacctgcgcgcaggccgagcgcctcaacgtctccgtcagccccgagtccggcgtgctccccatgcagaccatctacggcagcaacggctgggactcctacgcctgggccttcaaggccaagctcgacgtcgtcgagctcgtcctccacaaccccggcgccgaggaggaccccgcctgcggccccctcgtcgacgccgtcgccatccgcacgctctacccgcccacgctctccaagggcaacatgctcaagaacggcggcttcgaggagggcccctacttcctccccaacgcctcctggggcgtgctcgtgccgcccaacatcgaggacgaccactccccgctccccgcctggatgatcatgtcctccaaggccgtcaagtacgtcgacgccgcgcacttcaaggtgcccgagggcgcccgcgcagtcgagctcgtcggcggcaaggagagcgcgctcgtgcaggaggtgcgcaccgtgcccggatgggcctaccgcctctccttcgccgtcggcgactccgccgacggctgcaagggctccatggtggccgaggcctacgccgcgcgctccaccctcaaggtgccctacgagtccaatggcgccggcgggtacaagcgcgccgtgctggacttcgtcgccgtcagggaccgcacccgggtcgtcttccagagcgccttctaccacatgaaggccgacggcacgctctgcgggcccgtcatcgacgacgccaagctcgtcggcctgcgcaagaagccggccgcacgtcgcctcatgctctaattaagctagccccgccactaagtcttaccacaatactctatatgcaagcaaggcgccggatcggagtgagtagtatttattgctaggcttttggcgtgccgacccggtgagtacgtatgtgtgtgtgtgagttcgccgttgtccgccatgcttatatttgcggtggctcggcgcttgttatttttgtttctttcatgccaaccaacaaagaaaagggtcatcctgttgcttggcccgacgaagggtcacgttatcttcacatcggccaaaaccacatgatacaaggagcaattctatggcgaaaagtc

SEQ ID NO: 2960 - DNA, 1484 bp, Secale cereale
gagcttgaaggagctcgaagcggcaaatcaaaggagatagagatatatagagagagacgaagaagaaggacgacgccatgcgctgtgccgtgctgctgctgctcatcttcgcggcggcccgcgccgccgcggtcgtcaccgacgggctcctgccgaatggcaacttcgagttgggtccggccaagtcggagctggtgaacgggacggtggtgaagggcggcaaggcgatccccaagtgggagacgtcggggttcgtggagtacatcgagtccgggcacaagcagggcgacatgctgctggtggtgccgcagggcgcctacgccgtccgcctcggcaacgacgcctccatcctccagcgcatccccgtcgcccggggctcctactacgccatcaccttcagcgccgcccgcacctgcgcgcaggccgagcgcctcaacgtctccgtcagccccgagtccggcgtgctccccatgcagaccatctacggcagcaacggctgggactcctatgcctgggccttcaaggccaagctcgacgtcgtcgagctcgtcctccacaaccccggcgccgaggaggatcccgcctgcggcccgctcgtcgacgccgtcgccatccgcacgctctacccgcccacgctctccaagggcaacatgctcaagaacggcggcttcgaggagggcccctacttcctccccaacgcctcctggggcgtgctcgtgccgcccaacatcgaggacgaccactccccgctccccgcctggatgatcatgtcctccaaggccgtcaagtacgtcgacgccgcgcacttcaaggtgcccgagggcgcgcgcgccgtcgagctcgtcggcggcaaggagagcgcgctcgtgcaggaggtgcgcaccgtgcccggctgggcctaccgcctctccttcgccgtcggagactccgccgacggctgcaagggctccatggtggccgaggcctacgccgcgcgctccaccctcaaggtgccgtacgagtccaatggcgtcggcgggtacaagcccgccgtgctggacttcgtcgccgtcagggaccgcacccgggtcgtcttccagagcgccttctaccacatgaaggccgacggcacgctctgcgggcccgtcatcgacgatgccaagctcgtcggcctgcgcaagaaaccgaccgcacgtcgcctcatgctctaattaagctagacccgccactaagtcttaccacaaaatatatgcaagcacggcgccggatcgagagtgagtagtatttattgctaggcttttggtatgccgacccggtgagtacgtatatgtgtgtgaggtcgccgttgtccgccgtgcttatatttgcggtggctcggcgcttgttatttttgtttctttcatgccaaccaacaaagaaaagggtcatgccgttatcctcacatcggccaaaaccacatgatacaaggagcaattcaatggcgaatgcatgttactattttctca

SEQ ID NO: 2961 - DNA, 1478 bp, Secale cereale
tgagcttgaaggagctcgaagcggcaaatcaaaggagagagatagatagagagagagacgaagaagaaggacgacgccatgcgctgtgccgtgctgctgctgctcatcttcgcggcggcccgcgccgccgcggtcgtcaccgacgggctcctgccgaatggcaacttcgagttgggtccggccaagtcggagctggtgaacgggacggtggtgaagggcggcaaggcgatccccaagtgggagacgtcggggttcgtggagtacatcgagtccgggcacaagcagggcgacatgctgctggtggtgccgcagggcgcctacgccgtccgcctcggcaacgacgcctccatcctccagcgcatccccgtcgcccggggctcctactacgccatcaccttcagcgccgcccgcacctgcgcgcaggccgagcgcctcaacgtctccgtcagccccgagtccggcgtgctcccatgcagaccatctacggcagcaacggctgggactcctacgcctgggccgttccaaggccaagctcgacgtcggtggagctcgtcctccacaaccccggcgccgacggaggaccccgccatgcggcccgctcgtcgacgccgtcgccatccgcacgctctacccgcccacgctctccaagggcaacatgctcaagaacggcggcttcgaggagggcccctactcctccccaacgcctcctggggcgtgctcgtgccgcccaacatcgaggacgaccactccccgctccccgcctggatgatcatgtcctccaaggccgtcaagtacgtcgacgccgcgcacttcaaggtgcccgagggcgcgcgcgccgtcgagctcgtcggcggcaaggagagcgcgctcgtgcaggaggtgcgcaccgtgcccggctgggcctaccgcctctccttcgccgtcggtgactccgccgacggctgcaagggctccatggtggccgaggcctacgccgcgcgctccaccctcaaggtgccttatgagtccaatggcgccggcgggtacaagcgtgccgtgctggacttcgtggccgtcagggaccgcacccgggttgtcttccagagcgccttctaccacatgaaggccgacggcacgctctgcgggcccgtcatcgacgatgccaagctcgtcggcctgcgcaagaagcccgccgcacgtcgcctcatgctctaattaagctagccccgccactaagtcttaccacaatactctatatgcaagcacggcgccggatcgagagtgagtagtatttattgctaggcttttggtgtgccgacccggtgagggtacgtatatgtgtgtgagtccgccgttgtctgccgtgcttatatttgcggtggctcggcgcttgttatttttgtttctttcatgctgttgcttggcccgacgaagggtcacgttatcttcacatcggccaaaaccacatgatacaaggagcaattcaatggcgaaaagtc

SEQ ID NO: 2962 - DNA, 1514 bp, Hordeum vulgare
cggcacgaggctcggcttcagcttgtaaaagcttcaaccagcctcaagcggaaaactacagagggagagagggagggaggaagacggaggacgccgcgatgcgttgtgcagtgctgccgctgctgctcgtcttcgtggcggcgcgcgccgccgcggtcgtcaccgacggtctcctgccgaacggcaacttcgagctgggtccggccaagtcggagctggtgaacggtactgtggtgaagggcgggaaggcgatccccaagtgggagacgtcgggtttcgtggagtacatcgagtcggggcacaagcagggcgacatgctgcttgtggtgccgcagggcgcctacgccgtccgcctcggcaacgacgcctccatcctccaacgcatccccgtcgcccgtggctcctactacgccgtcaccttcagcgccgcccgcacctgcgcgcaggccgagcgcctcaacgtctccgtcagccccgagtcgggcgtgctccccatgcagaccatctacggcagcaacggctgggactcgtacgcctgggccttcaaggccaagctcgacgtcgtggagctcgtcatccacaaccccggcgtcgaggaggaccccgcctgcggcccgctcatcgacgccgtcgccatccgcaccctctacccgcccacgctctccaagggcaacatgctcaagaacggcggattcgaggagggcccctacttcctccccaacgcctcctggggcgtcctcatcccgccaaacatcgaggacgaccactccccgctccccgcctggatgatcatgtcctccaaggccgtcaagtacgtcgacgccgcccacttcagcgtccccgagggcgcccgcgccgtcgagctcgtcggcggcaaggagagcgcgctcgtgcaggaggtgcgcaccgtgcccggctgggcgtaccgcctctccttcgccgtcggagactccggacacgactgcaagggatccatggtcgccgaggcctacgccgcgcgatccacgctcaaggtgccgtacgagtccaagggcgccggcgggtacaagcgcgccgtgctggacttcgtcgccgtcagggaccgcacgagggtcgtcttccagagcgccttctaccacatgaaggccgacggcacgctctgcgggcccgtcatcgacgacgccaagctcgtcggactgcgcaagaagcccgccgcacgtcgcctcatgctctgattaattcagatagccccgccgccgcacgtcgccttacaacaaacaatatacttcatatatgcgcgcatgcacgacgcggtaactcccggtcaggatcagtgactacgtagtatctattgctaggcttttggtgtgccaatcgatcggatgggtatatgtgtgtatgtgagttcgccgttgcctgccgtgcttatacttgcggtggctcggcgcttgttgttttttgcttctttcatgtcaatcaacaaagaaaagagtcatgttatggcttggcccgagggttggtcacattatattatc

SEQ ID NO: 2963 - DNA, 1412 bp, Sorghum bicolor
tccagccccgccttcaggtgagcgtctgagccccgacccgcgcagccgcaccgcacccctactctgacgccgcccatgtccgccgcaccggcggccgcggccgcggccccgccccgccgcgtggtcatctgcggcggcggcgtggtgggcgcgtgcacggcctacttcctctccacccacgccgggtcccccaccgtcccgacgctcatcgaaaagtgcgccccggcgtgcgccgcctcggggaaagccggcgggttcctggcgctcgactggtgcgactccacccaggcgctgtccagcctcgcgcgggcctccttcgcgctccaccgccgcctcgccgacgccctcggcggcgccgacgcctacggcttccgccccgtccacaccctctccgtcctgctgcccacgcaccccgggcccgcccccgctagttcgccgcacccgcggctcccgccctgggtcgacccctccgcgtccgcggccccgccgagggagctcgggaccccggacaccaccgcgcaggtccacccgggcctcttcaccaaggccgtcctcgccgcgtcgggcgccgaggtcgtcatcggcgaggtggagcgcgtcgtggcccgggacggccgcgtcgccggcgtcgtggtcaaggggcgcgacgccgtggtggacgccgacgccgtcgtgctcgcgctcggcccctggtccggccgcctcgaggtcgtccgcgaggtgttcgacgtgtccgggctcaaggcgcacagcatcgtgctccggccgcgcgagcccgacaagatcacgccgcactgcgtcttcctcagctaccagccggagcccggcgccaagatgctcaaccctgaggtgtacccgcggcccaccggggaggtgtacatttgtggaatgagcaaggacgagaacccgccagatgacccagcaacaataacaggcgaaccagactcgattgcaatgctgcataagattgcagggaaggtgtccagccagctgaagaaggaagaaggcgctgaggtggtcgtggagcaggcgtgctacctgccgtgcaccaccgacgggctgccggtcatcggggagatgccaggcgtgaaggggtgctatgtggccaccgggcacagctgctggggcatcctcaatggtccggccaccggcgcggccctcgcggagctcatcctcgacggtaaggccaagatcgttgaccttgagcctttcagcccggcaaggtttctcaagagaaggagcaggcgtggagcctgaccgtgtgatgtgcttcgtgagttcgtgtgaatgttcagattcaagtttgttactgaatcaaacactctgactctccctttgcctattcctcagtgatgagagttgcaaaacatgaatgagttaataaatcatggatatatagtcttgattttgcg

SEQ ID NO: 2964 - DNA, 1694 bp, Sorghum bicolor
ctgacacagatcagcatttgtgaagcacaactggggttaaactagcaaattggatccatccgagccatgagtgtagtagcgtgcacaatcactactcttccccctgcttccatacacttccagttccagccccgccttcaggtgagcgtctgagccccgacccgcgcagccgcaccgcacccctactctgacgccgcccatgtccgccgcaccggcggccgcggccgcggccccgccccgccgcgtggtcatctgcggcggcggcgtggtgggcgcgtgcacggcctacttcctctccacccacgccgggtcccccaccgtcccgacgctcatcgaaaagtgcgccccggcgtgcgccgcctcggggaaagccggcgggttcctggcgctcgactggtgcgactccacccaggcgctgtccagcctcgcgcgggcctccttcgcgctccaccgccgcctcgccgacgccctcggcggcgccgacgcctacggcttccgccccgtccacaccctctccgtcctgctgcccacgcaccccgggcccgcccccgctagttcgccgcacccgcggctcccgccctgggtcgacccctccgcgtccgcggccccgccgagggagctcgggaccccggacaccaccgcgcaggtccacccgggcctcttcaccaaggccgtcctcgccgcgtcgggcgccgaggtcgtcatcggcgaggtggagcgcgtcgtggcccgggacggccgcgtcgccggcgtcgtggtcaaggggcgcgacgccgtggtggacgccgacgccgtcgtgctcgcgctcggcccctggtccggccgcctcgaggtcgtccgcgaggtgttcgacgtgtccgggctcaaggcgcacagcatcgtgctccggccgcgcgagcccgacaagatcacgccgcactgcgtcttcctcagctaccagccggagcccggcgccaagatgctcaaccctgaggtgtacccgcggcccaccggggaggtgtacatttgtggaatgagcaaggacgagaacccgccagatgacccagcaacaataacaggcgaaccagactcgattgcaatgctgcataagattgcagggaaggtgtccagccagctgaagaaggaagaaggcgctgaggtggtcgtggagcaggcgtgctacctgccgtgcaccaccgacgggctgccggtcatcggggagatgccaggcgtgaaggggtgctatgtggccaccgggcacagctgctggggcatcctcaatggtccggccaccggcgcggccctcgcggagctcatcctcgacggtaaggccaagatcgttgaccttgagcctttcagcccggcaaggtttctcaagagaaggagcaggcgtggagcctgaccgtgtgatgtgcttcgtgagttcgtgtgaatgttcagattcaagtttgttactgaatcaaacactctgactctccctttgcctattcctcagtgatgagagttgcaaaacatgaatgagttaataaatcatggatatatagtcttgattttgcgtatctgttgtacacacatcacaaaaggtccaacttgccaacatcatgatcagatgttcatttagctgagcttgagctcaacaagctgttgcatctgcagctattcgacttgcacaatgtttccttgtggtcaagtgacactctactacctaataataa

SEQ ID NO: 2965 - DNA, 2947 bp, Setaria italica
atggatccaccttggagttttgtatccttcttctcttctgcgaaagggaggaagtccttcccatcccttagtgaatttgcttcctgtgctgctgatttcgtcagcggcgctggtgctgtgcctcgtcgaggagtcaaggatgacggtcgatgtgcgctagaggggagaagatttgtgactagtcaaagtttgtctccttggattcctcaatggtggctttcgttctctgggttgggttcttcgtcttcttctccatcgagcagaggagcgacgagcacactaggagcgctgcagcggatcttgagaagcaagaaaccaccgtgcacaaaccaaacacccgctcccacaccacaatccacttccgcatccggcatcccgacgccgcccatgtccgccgcgccagccgccgccgccgccgccgccccgccccgccgcgtgatcatctgcggcggcggcgtggtgggcgcgtgcacggcctacttcctctccacccaccccgcgtccccgaccgtcccgaccgtcccgaccctcatcgagcggtgcgccccggcgtgcgccgcctcggggaaagccggcggcttcctcgccctcgactggtgcgactccaccccggcgctctccgcgctcgcgcgggcctccttcgcgctccaccgccgcctcgccgccgacctcggcggcgccgacgcctacggcttccgccccgtccacaccctcagcgtctgcgtcccctccgttcccaagcccacctcgccaccgccgcacccgctgctcccgccctgggtggacccgtcggcctccgcggcgccgccgcaggagctcgggaccccggacaccaccgcgcaggtccacccgggcctcttcacaagggccgtcctcgccgcgtccggcgccgaggtcgtcaccggcgaggtggagcgcgtcgtggtacgggacggccgcgccgccggcgtcgtggtgaaggggcgcgagcgcgacggcgtggtggacgccgacgccgtggtgctcgcactcggcccctggtccgggcggctcgaggtggtcagcgaggtgttcgacgtgtccgggctcaaggcgcacagcatcgtgctgcggccgcccgagccggagaaggtcacgccgcactgcctcttcctcagctaccagccggagcccggcgccaagatgctcgacccggaggtgtacccgcggcccaccggggaggtgtacatatgtggaatgaccaaggatgagaacccgccggatgatccggcgacgatcacaggcgaacccgactcaattgcaatgctgcacaagatcgctgggagggtgtccagccaactgaagaaggaagagggtgcggaggtggtggtggagcaggcttgctacctgccgtgcaccaccgacgggctgccggtcatcggggagatgccgggggtgaaggggtgctatgtggccaccgggcacagctgctggggcatcctcaatgctccggccactggagcggccttagcggagctcatcctcgatggcaaggccaagatcgtggatcttgcgccgttcagcccggcaaggtttctagggaggaggagccggtgtggagcctgactgtgtaaggtgcttggtgtcaattgtgaaggttcagacttggaactgaataagaacacacactcgtgatgggagttgcaaaacatgtatgagtgaagtagtgaataaataatggatacttgctgttctgtacttgttttacattacaagttattccaatttggcagcaacaagatgcaatgtttacctgttgccaagtgatctgcattcatgttcctctgctgcatgaattcccaatccaatttcctatgacacaaccttctaaaggaaacgagcattctgattctggatgatctgtatgcttcagacactggaaaaacatgactccaagcttttttctaagaatgctaatatggcgactaagtgatgtatagcaaatgatctgccattcttgtacataatcaagcatgagaactgaaacggtatgcacaaaacatcagggctgcaagcaatgcagacttcggatcaacccaagttaatctcagtagatgagactgtgatccagtacaaggtaacctgcctctacaaaaaatatgccacgctattctgacgcagccagcgggcaactcttagactaaatagataatgctgctctttcttaactctgaagagtaagaacgagtctgactaggatagttcttggaagtcttaacatttctaactacaggcattactagttggagtccaagtacagagtcaccttcttcaccgacgtgaacgaagtttgcagcctccagtctttctgcttcctgttcaatggccttcctttccccgcttccgctctgttctccttgacatctgccagcttccagatgcagtgctcagcctgagtgtcaaccgactcgagcaagaagatgccatccttcagaaggttctgctttgagacaaggtcgttgtcgccttcagcaaggtattgcaccctcatagccatgtccttgaagcgatccaaatccccaggcaccttcagaagcctctctgcacctggtgacgatacctcaagtgccaggtccaggggtatttcgcctctttcaattatttcatccaatttctgcttgtagagcctattgaaactctctatttcctcaatatcagggcacccatatatgttggtgagcttgtccaggcgcacgtagacgtatcccttgggcgacaccttgaatgcgaacatggcgacgtcatccccgaagtggccggcgaggacctcctgggccgccgcgagggcgcgctccccccacttgacgtcccgcagcgcgacgccgccgccgtccccgccgtcgccgatctcgggctcgtacccgtcgtcctcgctgtcctcccactccaccgcccactcctcgtcgtcctccgagcccgcctcgcgccc

SEQ ID NO: 2966 - DNA, 1393 bp, Panicum virgatum
ccgcctcgaggcttccactgagtccgcccccaccccacgccgccgccgccgccgccgccccgccccgccgcgtggtcatctgcggcggcggcgtggtgggcgcgtgcacggcctacttcctctcgacccacgccgcgtcgcccaccgtcccgaccctcgtcgagaggtgcgccccggcgtgcgccgcctcggggaaagccggcggcttcctcgccctcgactggtgcgactccaccccggggttctccgcgctcgcgcgggcctcctacgcgctccaccgccgcctcgccgccgacctcggcggcgccgacgcctacggctaccgccccgtccacaccctctccgtccgcgtcccctccgttcccaagcccgcctcgccgtatcctatgctcccggcctgggtcgacccgtcggcgtccgcagccccgccgcgggagctcggcaccccggacaccaccgcgcatgtccacccgggcctcttcaccagggccgttctcgccgcgtccagcgctaaggtcgtcatcggcgaggtggagcgcgtcgtggtgcgggacggccgcgccgccggcgtcgccgtgaaggggcgcgatggcgtggtggacgccgacgccgtggtgctcgcgctcggcccgtggtccgggcggctcgaggtagtcagcgaggtgttcgacgtgtccgggctcaaggcgcacagcatcgtgctgcgcccgcgcgagcccgagaacatcacgccgcactgcctcttcctcagctaccagccagagcctggcgccaagatgctcgaccccgaggtgtacccacggccgacgggggaggtatacatatgtggaatgaccaaggatgagaacccgcccgacgatccggcaacgatcacgggtgaacccaactcaattgcaatgctgcacaagattgccgggaaggtgtccagccagctgaagaaggaagagggggcagaggtagtggcagagcaggcgtgctacctgccgtgcaccactgacgggatgccggtcatcggggagatgccgggggtgaaggggtgctatgtggccaccgggcacagctgctggggcatcctcaacggtccagccaccggcgcggccctggcagagctcatcctcgatggtaaggctaagatcgtcgaccttgcgccgttcagtccggcaaggtttctcaagaggagccggcgtggagcctgactgtgtaaggtgcttgatgtcaattgtgaaagttcagacttgcagcagaataaaaagacacttgtgatgagagttgcaaaacatgtacgactgaaatagtgaataagaatggatacttgttctgtacttgttacagttagaacacactcattccaatttgcaagcaataagagttggaggatgttcatttagctaac

SEQ ID NO: 2967 - DNA, 1306 bp, Brachypodium distachyon
gaacacccatggccacggcgccagccgccgctccgccccgccgcgtggtcgtctgcgggggcggcgtcgtgggcgcttgcacggcctacttcctctccacccacgcggcctccccgaccgtcccgaccctcatcgagaagtcctccccggcctgcgccgcctcgggcaaggccggcggcttcctcgccctcgactggtccgattccaccccgtccctctccgccctcgcgcgcgcctccttcgcgctccacggccgcctcgccgccgccctcgacggcgccgacgcctacggcttccgccccgtccacaccctctccgtatccctcccctcccatcccatctcgccctcctcgccgcctcacccgctcctccctccctgggtcgacccctccgcctccgccgccccgccgcgggagctcgggaccccggccaccacggcgcaggtccacccgggcctcttcaccaaggccgtcctcgcggcctccggtgccgaggtcgtcataggcgaggtggagcgcgtggtgctcggcccagacgaccgcgtcgccggcgtccaggtcaagggccgcggcgtggtggaagccgacgccgtcgtgctcgcgctcgggccctggtccggccggttcgagatggtcagggaggtgttcgacgtctccgggctcaaggcgcacagcatcgtgctccggccgcgtgaccccgacaagatcacgccgcactgcctgttcctcagctaccagccggagcccggcgccaagatgctcgaccccgaggtctacccgcggcccaccggggaggtgtacatttgtggaatgaccaaggatgaggatgtcccagatgacccagcgacgattgtcggcgagcccgactcgattgcgatgcttcacaagatcgccgggagggtgtccagccagttgaagacagaggagggggcagaggtggtcgctgagcaggcgtgctacctgccgtgcaccaatgacgggctaccggtcatcggggagatgcctggggtgaaaggatgctacgtagccaccgggcacagctgctggggcatcctgaatgctccggccaccggtgcagctctagcggagctcatcctcgatggacaggccaagactgttgatctcacgctgttcagcccggcgagatttctcaagaaaaggaggcgctgagtgtaatcagatgagtgtttgtatgatctggggtccaaacttggcaactgaataaaaagctacacagttgtaatctttgtgaagagagagcaaaggatgtactgatgaataaaccttgaacacttgttgtttgcttt

SEQ ID NO: 2968 - DNA, 2550 bp, Brachypodium distachyon
ccaagtcgaagtcgaagccgtcttcagcttccccacacttccgcttccaccgcgaaatcccgagctcgacgaacgaacacccatggccacggcgccagccgccgctccgccccgccgcgtggtcgtctgcgggggcggcgtcgtgggcgcttgcacggcctacttcctctccacccacgcggcctccccgaccgtcccgaccctcatcgagaagtcctccccggcctgcgccgcctcgggcaaggccggcggcttcctcgccctcgactggtccgattccaccccgtccctctccgccctcgcgcgcgcctccttcgcgctccacggccgcctcgccgccgccctcgacggcgccgacgcctacggcttccgccccgtccacaccctctccgtatccctcccctcccatcccatctcgccctcctcgccgcctcacccgctcctccctccctgggtcgacccctccgcctccgccgccccgccgcgggagctcgggaccccggccaccacggcgcaggtccacccgggcctcttcaccaaggccgtcctcgcggcctccggtgccgaggtcgtcataggcgaggtggagcgcgtggtgctcggcccagacgaccgcgtcgccggcgtccaggtcaagggccgcggcgtggtggaagccgacgccgtcgtgctcgcgctcgggccctggtccggccggttcgagatggtcagggaggtgttcgacgtctccgggctcaaggcgcacagcatcgtgctccggccgcgtgaccccgacaagatcacgccgcactgcctgttcctcagctaccagccggagcccggcgccaagatgctcgaccccgaggtctacccgcggcccaccggggaggtgtacatttgtggaatgaccaaggatgaggatgtcccagatgacccagcgacgattgtcggcgagcccgactcgattgcgatgcttcacaagatcgccgggagggtgtccagccagttgaagacagaggagggggcagaggtggtcgctgagcaggcgtgctacctgccgtgcaccaatgacgggctaccggtcatcggggagatgcctggggtgaaaggatgctacgtagccaccgggcacagctgctggggcatcctgaatgctccggccaccggtgcagctctagcggagctcatcctcgatggacaggccaagactgttgatctcacgctgttcagcccggcgagatttctcaagaaaaggaggcgctgagtgtaatcagatgagtgtttgtatgatctggggtccaaacttggcaactgaataaaaagctacacagttgtaatctttgtgaagagagagcaaaggatgtactgatgaataaaccttgaacacttgttgtttgctttcatgggtagatctcgtttaagcctactatgcctggggcctgtgtgttctacaagttgttacttgctgttctactggagtctatagtagcagacatgatgacaaatgttttccatgaaagcatctttgaatgcagacatgaactgcaaatacactaccaaagtttacagccgaagtttaacatttgaatcataactgtcgcactgttctgtgtcgtacaatgtaacttatctccagaaatcccaaactaatagacactactcttaactcccaaaatgaatggctttttccatttttacattaagtttaccacaggttttaaagttctagccgtggttattttccgaggtgttgaatctatccaagatggccttttaatgttttcagtccaagtacagggtcaccttcctcaccgattgaaaggaagtttgcagcctccaatctctctgtttcctgctcaatggcctccctttcccagctcggttctctgtgacgttggcaagcttccacacacaatgttctgcctgaatgtcaaccgactcgagcaaaaagataccatccgcctgatctgaaacaaggtcatcaccttcagcaaagtactgtaccttcattgccatatctttgaagcgatccagatcctcaggcaccttcagaagtctctctgctccaggtgacgaaatctgaaccatcaaatttagttgtttgtaagtggctgtgaaatgcaggagcattgagtatgaaatttgatgacttgcaggatgacttgcctcaacagccaggtccagtggtatttcgcctctttcgatcatctcatccaatttctgcttgtagattctattgaaattctctatttcctctataccaggacacccatacctgtagagattctcagacaataaagcgaatgggatagaactgtcatatgtgcatataattttttttagtagaaacaacctaacaggatcaggttagaggatcaatattattcaatatattccagtggtattgatatactcaatatcctagatcaataatgcaggcatggcacaaagctaaagatatggctcaatcaaggtactacgaaccagcaggtgataggtgctgtaataatgaaaaccatgatgggcatcttgacatgtcagtttttggaggctcttcttttcttatcttga

SEQ ID NO: 2969 - DNA, 1401 bp, Triticum aestivum
ccgacgacatcatggccagcgcgccagccccgccgccccgccgcgtggtcgtctgcggcggtggcgttgtcggcgcttgcacggcctatttcctctccacccaccccgcctcccccaccgtgccgaccctcatcgagaagtcctcccccgcttgcgctgcctcaggcaaggcgggcggcttcctcgccctcgactggagcgactccacccccgcactctcggcgctggcgcgcgcatccttcggtctccaccaccgcctcgccgctgccctcgacggcgccaacgcgtacggcttccgccccgtccacaccctctccatctgcctcccctctcagcccgccgagcccctctcaccccacccgctcctcccttcctgggtcgacccctccgcctccgccgcgccgccgcgccagctcggaactccggacaccaccgcgcaggtccatccgggcctcttcaccaaggccgtcctcgccgcgtccggcgccgaggtggtcatcggcgaggtggagcgcgtggtggtcggcgaagggtgtgtcgttggcgtcgcggtgaaggggcgcggcgtggtggacgcggatgccgtggtgctcgcgctcggcccttggtctgggcgtttcgagatggtcatagaggtgttcgacgtgtccgggctcaaggcgcacagcatcgtgctccggccgcgcaaccccgacaagatcacgccgcactgcctgttcctgagctaccagccggagcccggcgccaagatgctcgacccggaggtctacccgcgccccacgggggaggtgtacatttgcggaatgagcaaggacgaggatgttccagatgatccggcagcgattgacggggagccggactccattgcaatgcttcacaagatcgctgggagggtgtccagccaactgaagacagaggagggcgcagaggtagtcgcggaacaggcctgctacctcccgtgcaccaatgacgggctgccggtcatcggggagatgcctggggtgaagggatgctacgttgcaaccgggcacagctgctggggcatcctcaatgctcctgctaccggtgcagcactcgccgagctcatccttgatgggcaggccaagattgttgatcttgtgcccttcagcccggcaagatttctcaagaagaagagcaggcgcggagtgtaatggcatgcgcggtttgtttcgatctgatgttccaaacttggcaaccgaataaaaagctatcctctcttgcctgtccgaggggataggcaaataatgtacggataaataaaaccttcaacacttgctgtcgagtgttgtggagatggatagatcctgttttacttttatctgatgctgtagtgatctaaatgctcttatatttatatatggagggagtaccaaatgtacc

SEQ ID NO: 2970 - DNA, 2000 bp, Secale cereale
tgagttttcgcgactcccgttcaacacacccgcagctccaaatccggagaccgacgacatcatggccagcgcgccagccccgccgccccgccgcgtggtcgtctgcggcggtggcgttgtcggcgcttgcacggcctatttcctctccacccaccccgcctcccccaccgtgccgaccctcgtcgagaaatactcccccgcttgcgctgcctcaggcaaggcgggcggcttcctcgccctcgactggagcgactccacccccgcactctcggcgctggcgcgcgcatccttcggcctccaccgccgcctcgctgctgccctcgacggcgccaacgcgtacggcttccgccccgtccacaccctctccatctgcctaccctctcaacccgccgagcccctctcaccccacccgctcctcccttcctgggtcgacccctccgcctccgccgcgccgccgcgccagctcggaactccggacaccaccgcgcaggtccatccgggcctcttcaccaaggccgtcctcgccgcgtccggcgccgaggtggtcgtcggcgaggtggaacgcgtggtggtccgcgaagggcgtgtcgtcggcgttgcggtgaaagggcgcggcgtggtgaacgctgatgccgtggtgctcgcgctcggcccttggtctgggcgtttcgagatggtcaaagaggtgttcgacgtgtccgggctcaaggcgcacagcatcgtgctccggccacgcgaccccgacaagatcacgccgcactgcctgttcctgagctaccagccggagcccggcgccaagatgctcgacccggaggtctacccgcgccccacgggggaggtgtacatttgcggaattagcaaggacgaggaagttccagatgatccagcagcgattgccggggagcctgactccattgcaatgcttcataagatcgctgggagggtgtccagtcagctcaagacagaggagggtgcagaggtagtcgcggagcaggcctgctacctcccgtgcaccaatgacgggctgccggtcatcggggagatgcctggggtgaagggatgctacgttgcaaccgggcacagctgctggggcatcctcaatgcccctgctaccggcgcagcactcgccgagctcatcctcgatggacagaccaagattgttgatcttgcgcccttcagcccggcaagatttctcaagaagaagagcaggcgcggagtgtaatggcatgcgcggtttgtttcgatctgaggttccaaacatggcaactcaataaaaagctatccttgcttgtaacctgtccgagctgataacaaagaatgtacggataaataacacctttaacacttgctgtcgagtgttgtggagatggatagatcctgttttatttgatgctgtctgacgacacggtagtgatctaaatgctcttatatttgtgtatggagggagtaccaaatgtacaaacgaatgttttgcatgagaacatctttgaatgcagacgtgaactgccagtacactccctccactactgcatgatcatgagaagaatgatactgtgaagttactatcaaacaactcagggcgtccttcggtaaattttacgtaggaattaaaattaccttccggtaagtttttaccttattgtttttgttttgtattctataggattgtaatcctatttagtaaacttttttaccctaactttgtttttttttctttaccttccctataggtatttcttagcattcaatcaaaccctcttacgaaaaaattacttttgtttttccttatgatgacaataccaaaaaccaaaccccaaaaatctagtggtaaggtattgactgactacttaccaactacgtacgtttttagaagaaactacctacgacgaagtacaaacggaaggaccgtaacttaacttaatttagtttggtttttggttacgtacggtttaagttactaagagttaattcgttacggttaacgtaattaactaggtaaa

SEQ ID NO: 2971 - DNA, 2138 bp, Oryza sativa
gtacagtcatttcataattataatatcccccccattatttgacactcgccttccttcaccacattccactccaaacacacacacgcttccatcccatggcgacctcgccggcggcggcgccgccgcggcgcgtggtgatttgcggcggcggggtcgtcggagcgtgcacggcctacttcctctccacccacgcggcctccccgactgtcccgaccctcgtcgagaagtcgtccccggcctgcgccgcctcgggcaaggccggcggcttcctcgcgctcgactggtgcgacaaaaccccggccctctccgcgctcgctcgcgcctccttcgcgctccaccgccgcctcgccgccacgctcgacggcggctccgcctacggcttccgccccgtccacaccctctccatctgcctccccaccgacccggaccccgccgccgccgccgccgccgcggcgtccccgctgctccccgcctgggtcgaccccgccgcgtccgccgcgccgccgagggagctcgggacgacggacaccaccgcgcaggtccacccgggcttcttcaccaaggccgtcctcgccgcgtccggcgccgaggtggtcatcggcgaggcggagcgcgtcgtcgtccgggacggccgcgtcgccggggttgtggtcaggggccgcggcgaggtggacgccgacgccgtggtgctcgcgctcgtcccctggtcggggaggttcgagatggtcagggaggtgttcgacgtgtccggcctcaaggcgcacagcatcgtgctccggccgcgtgagcccgaaaacatcacgccgcacgccctgttcctcagctaccagccagagcccggcgccaagatgctcgacccggaggtctacccgcggcccaccggggaggtgtacatttgtggaatgaccaaggatgaggaggtgcccgatgacccggagacgatcaccggtgagccggactcaattgcgatgctgcacaagatcgccgggagggtttccggccagctgaagagggaggaaggcgcggaggtggtggcggagcaggcttgctacctgccgtgcaccgatgacggtttgccggtgatcggggagatgcctggagtgaagggttgctatgtcgccaccgggcacagctgctgggggatcctcaatgctccagccaccggtgccgctctcgcagagctcatcctcgacggcgatgccaagatcgtcgatctcgcgccgttcagcccagcaaggtttctcaagaagaagagtaagcgtggagtttagtgtagattgtgatgagtttgcttccttgatgccatgtctggatgaataaatttgttctctgtctgctggtatccttcattcctttgtgaggactgagagaacaaatatgtacaacaatgtactgtactgatgaataataagtaaaccatgaacacttgcatgagaacagctttcagatgctgtcaactgcagagaattcatcacactctgtacgatcatgagcatgaaacaatagagaatacacagaaaaattcagtacccaaaatgagtgattccatataatgtattgcttcccagatacatttgccatgctattctgtgttctactcagcatgtaattcagagataataactgtgtcttgcaatgaattttgcctccagaaaattcattcagttccacaaataaagtagacgctaatctaactgcagaactgaacatcctttgccagtattgcaagtattacagagagtatgcgagattccgttccaatttaaactaatactggatttggttctaaatcagttctgtccaaacatatgccatcatggtttagtccaagtatagtgttgccttcttcactgcttggaacgaagtttgcagcctccagtccctttttttcctgttcaatggccttcctttcccagctgcagctcggttctccttgacatctgccagcttccagatgcaatgttctgcctgaatgtcaacagactcgagcaagaagattccatccttctgcaggatctgcttcgggacgacatcatcgccttcaacaaggtattgcaccctcatggccatatctttaaaacgatccagatccttgggcaccttgagaagtcgttcggctcctggtgatgagacctgca

SEQ ID NO: 2972 - DNA, 1368 bp, Oryza sativa
actccaaacacacacacgcttccatcccatggcgacctcgccggcggcggcgccgccgcggcgcgtggtgatttgcggcggcggggtcgtcggagcgtgcacggcctacttcctctccacccacgcggcctccccgactgtcccgaccctcgtcgagaagtcgtccccggcctgcgccgcctcgggcaaggccggcggcttcctcgcgctcgactggtgcgacaaaaccccggccctctccgcgctcgctcgcgcctccttcgcgctccaccgccgcctcgccgccacgctcgacggcggctccgcctacggcttccgccccgtccacaccctctccatctgcctccccaccgacccggaccccgccgccgccgccgccgccgcggcgtccccgctgctccccgcctgggtcgaccccgccgcgtccgccgcgccgccgagggagctcgggacgacggacaccaccgcgcaggtccacccgggcttcttcaccaaggccgtcctcgccgcgtccggcgccgaggtggtcatcggcgaggcggagcgcgtcgtcgtccgggacggccgcgtcgccggggttgtggtcaggggccgcggcgaggtggacgccgacgccgtggtgctcgcgctcgtcccctggtcggggaggttcgagatggtcagggaggtgttcgacgtgtccggcctcaaggcgcacagcatcgtgctccggccgcgtgagcccgaaaacatcacgccgcacgccctgttcctcagctaccagccagagcccggcgccaagatgctcgacccggaggtctacccgcggcccaccggggaggtgtacatttgtggaatgaccaaggatgaggaggtgcccgatgacccggagacgatcaccggtgagccggactcaattgcgatgctgcacaagatcgccgggagggtttccggccagctgaagagggaggaaggcgcggaggtggtggcggagcaggcttgctacctgccgtgcaccgatgacggtttgccggtgatcggggagatgcctggagtgaagggttgctatgtcgccaccgggcacagctgctgggggatcctcaatgctccagccaccggtgccgctctcgcagagctcatcctcgacggcgatgccaagatcgtcgatctcgcgccgttcagcccagcaaggtttctcaagaagaagagtaagcgtggagtttagtgtagattgtgatgagtttgcttccttgatgccatgtctggatgaataaatttgttctctgtctgctggtatccttcattcctttgtgaggactgagagaacaaatatgtacaacaatgtactgtactgatgaataataagtaaaccatgaacacttgcatgag

SEQ ID NO: 2973 - DNA, 1444 bp, Hordeum vulgare
ggtttgtgaacacgcccgcaggcccaaatccggagacatggcaagcgcgccccccgccgcgccgccccgccgcgtggtggtctgcggcggtggcgttgtcggcgcttgcacggcgtatttcctctccacccaccccgccttccccaccgtgccgacgcttgtcgagaagtcctcccccgcttgcgctgcctcaggcaaggcgggcggcttcctggccctcgactggagcgactccaaccccgcactctcggcgctggcgcgcgcatccttcggcctccaccaccgcctcgctgctgccctcgacggcgccaacgcgtacggtttccgccctgtccacaccctctccatctgcctcccctctcagccggaggagcccctctcaccgcacccactcctcccttcctgggtcgacccctctgcctccgccgcgccaccacgccagctcggaactccggacaccaccgcgcaggtccatccgggcctcttcaccaaggccgtcctcgccgcgtccggcgccgaggtggtcatcggcgaggtggagcgcgtggtggtccgccaaggggaagggcgtgtggtcggcgttgcggtgaaagggcgcggtgtggtggacgcggatgccgtggtgctcgccctcggcccttggtctgggcgtttcgagatggtcaaagaggtgttggacgtgtccgggctcaaggcgcacagcatcgtgctccggccgcgcaaccccgacaagataacaccgcactgcctgttcctgagctaccagccggagcccggcgccaagatgctcgacccggaggtctacccgcgccccacgggggaggtgtacatctgcggaatgagcaaggacgagcaagttccagatgatccggcaacgattgccggggagcctgactccattgcaatgcttcataagattgctgggagggtgtccagccagctcaagacagaggagggcgcagaggtagtcgcggaacaggcctgctacctcccgtgcaccgatgacgggctgccggtcattggggaaatgcccggggtgaagggatgctacgttgcaaccgggcacagctgctgggggatcctcaatgctccagttaccggtgcagcactcgccgagctcatcctcgatgggcaggccaagatcgttgatcttgcgcccttcagcccggcaagatttctcaacaacaagaagagcaggcgcggagtgtaatgtgatccgaggttcctgccaaacttggcaaccgaataaaaagatactcctacgtatcctcgcttgtaacctgtccgaggaggggacaccaaatcaaataatgtacggataaataaacctacaccaaatcaaataatgtacggataaataaaccttcaacacttactgtcgagtgttgtagagatggatagatcctgttttatctgatgatgtgtgttctattcaaaaaaaaaa

SEQ ID NO: 2974 - DNA, 1185 bp, Leymus cinereus x Leymus triticoides
ccgccccgccgcgtggtcgtctgcggcggtggcgttgtcggcgcttgcacggcctatttcctctccacccaccccgcctcccccaccgtgccgaccctcgtcgagaagtcctcccccgcttgcgctgcctcagtcaaggcgggcggcttcctcgccctcgactggagcgactccacccccgcactctcggcgttagcgcgcgcatccttcggcctccaccgccgcctcgccactgacctcgacggcgccaacgcgtacggcttccgccccgtccacaccctctccatctgcctcccttcttagcccgccgagcccccctcaccccacccgctcctcccttcctgggtcgacccctccgcctccgccgcgccgccacgccagctcggaactccggacaccaccgcgcaggtccatccgggcctcttcaccaaggccgtcctcgacgcgtccggcgcctaggtggtcatcggcgaggtggagcgcgtggtggtccgcgaagggcgtgtcgtcggcgttgcggtgaaagggcgcggcgtggtggacgcggatgtcgtggtgctcgcgctcggcccttggtctgggcgtttcgacatggtcgtgctccggccgcgcaaccccgacaagatcacgccgcactgcctgttcctgagctaccagccggagcccggcgccaagatgctcgacccggaggtctacccgcgccccacgggggaagtgtacatttgtggaatgagcaaggaggaggatgttccagatgatccggcagcgattgccggggagcctgactccattgcaatgcttcataagatcgctgggagggtgtccagtcagctgaagagagaggagggcgcagaggtagtcgcggaacaggcctgctacctcccgtgcaccaatgacgggctgccggtcatttgggagatgcctggggtgaagggatgcttacgttgcaaccgggcacagctgctggggcatcctcaatgctccagctaccggtgcagcactcgccgagctcatcctcgatggacaggccaagattgttgatcttgcgcccttcagcccggcaagatttctcaagaagaagagcaggcgcggagtgtaatggcatgcggtttgttttgatgtgagcttccaaacttggcaaccgaataaaaggctaccctcccttgtaaccaaaacaaaaaaaaa

SEQ ID NO: 2975 - DNA, 1902 bp, Setaria italica
gccacgccgcgtcgtcctcgcatcgcaatcgccgtcgcccccgcctcactccctcccatcctccgccgaccgccgcactccacctccccatccccgccctccccaccgcgcggccggccccatgtgggagcgcggcaggccgccccgcaagccgcgcccgtccccgattatcgtgccgccgccaccgccttcgccgcctccccgcctgaacctcctcctccccagatccctcctcgcgctcgccgcgcgcgccatgccgtcgcgccgcccctccccggtcctcctactcctcctcgcgctcgcgctcgcgctcctcttcgtcatactctccccgtcgtccccctccgcctcccgcctctcccggtccctcgcctccggctccgcttccgcctcctcatctccggcgacacccgccgctccgccgccccccgtcaagatctacatgtacgacctgccgcccaagttcacgtacggcgtcgtgcgcagctacatggccgcgcgcgcgccctcgggctcggcggacgcagccgcggtgctccccgacgagcagctgcggtacccggggcaccagcactcggcggagtggtggctcttcaaggacctgctccgccgcgggccgcgcgaccgccccgtagcacgcgtggacgaaccgagcaacgccgaccttttctacgtgcctttcttctcctccctcagcctcgttgtcaaccccatccgacccccggcggcggccaacgcctctggggtggcggcagcgtacagtgacgaggccatgcaggaggagctgctggcgtggctggagctgcagccgtactggcagcagcacagggggagggatcatattttcatctgccaggatcccaacgcgctgtacaaggtgatcgaccggattagcaatgctgtactcctggtctctgattttggccggttgcgcagcgaccaggcgtccctcgtcaaggatgtcatcctgccctactcacaccgaatcaactccttcaagggtgatgtcggggtagatggtcggccctcattgctgttcttcatgggcaatcgctaccgcaaggagggtgggaaggtccgtgatgcacttttccaaattcttgagaaagaggaagatgtaaccataaaacatggcgcacaatcaagggagagtcggcgtgcagctacacgaggaatgcactcatcaaaattttgcctccatcctgctggagacaccccctcagcgtgcagattgtttgatgcacttgtcagtttatgcattcctgttatagtgagtgatcacatcgagctaccatttgaagatgttatagactacagtaacatagcaatatttgttgagacaagcaaggccgtacaacctggatacttaacttcaatgctacgaagagtaagttcagagaggattctggagtaccagagagaaataaaaaaggtaaaacaattctttgagtatgaagatccgaatggaccagtcaatgagatatggcgccaagtatccctaaaagcaccactgataaagttgttgactaaccgtaacaaacgcctgtttgaaagaggcaccaatggaacagattgctcgtgcatgtgctctacaaccccctattgagatgaccacagccgggtaaagaaggtggaacccctatgaagctttttgcctcatttccaagtgatcacattgcctgagagagacgatagaggctgtgcagctctatgtacagcgagatttccagtaactactttgaacactaaaattactaactgccacgatcctacaattttcagtagatatgtataggagggggcgaatagtcaaagaaccttaaagtgatgcctctggcgtcaatacaaggccacaatattttttgtatgatgtgtaagttatattatttcatttttttcagc

SEQ ID NO: 2976 - DNA, 1908 bp, Sorghum bicolor
gccaccacgtcgtactcgcatcccaatctccgtcgtcccccgcctcactccctccgccgcactccacctccccatccccgcccaccccaccgcgttgccggccccatgtgggagcgcggaaggccgccccgcaagccgcgcccgtccccgatcctcgtgccaccgccaccgtcgtcgccgcctccccgcctgaacctcctccttccgagatccctcctcgcgctcgccgcgcgcgccatgccgtcgcgccgctcctccccggtcctcctcctactcctcgcgctctcgctcgccctcctcttccttctcctctccccttcctccccctccgcctcccgcttttcccactccctcagttcgggctccgttatcgcttactcatctccggcatcaacctccgccccgcctgctcccgtcaagatctacctgtacgacctgccggccaagtttacctacggcgttgtccggagctacacggctacgcgtgctccatcgggctccgcggatgccgccgcagctctgcctgacgagcagctgcggtacccgggacaccagcactcggcggagtggtggctcttcaaggacctgctccgacgcggcccgcgggaccgccccgtggcacgcgtggacgacccgagcgacgccgacctcttctacgtgcccttcttctcctccctcagccttgttgtgaaccccatccgctctccgccggcagcaaacgcctctggggcagcggcagcgtacagcgacgacgccatgcaagaggagctcctagagtggttggagcggcagccttactggcggcgccacatggggagggatcacgttttcatctgccaggatcccaatgccctgtacagggtgatcgaccggatcagcaatgccgtactcctggtctctgatttcggcaggttgcgtagcgaccaggcatctctcgtcaaggatgtcatcctgccctactcacaccgaatcaactccttcaagggtgaggtcggggtggatggccggcccttattgctgttcttcatgggcaataggtaccgcaaggagggagggaaggtccgtgatgcacttttccagattcttgaaaacgaggatgatgtaaccataaaacatggaactcaatcgagggagagtcggcgtgcagctagacaaggaatgcactcatctaaattttgcctccatcctgccggagatactccctcagcgtgcagattatttgatgcacttgtcagtctgtgtgttcctgttatagtcagtgattacattgaacttccattcgaagatattatagactacaacaaaatatcaatatttgtcgggacaagcaaagcagtacaacctggatacttaacttcaatgcttcgaagaatcagttcagagaggattctggagtaccagagggaaacaaaaaaggtgaaacgttactttgagtatgaggatccgaatggaccagtgaatgagatttggcgccaagtatcccttaaagcaccactgataaagttgttgattaatcgcaacaaacggttgcttgaaagaggcaccaatggaacagattgctcgtgcatctgctctacaactccaactgagataactgcagccagttaaacaagatggaagctttgtgcctattttcagtgatcacattgcctggatttttgaggctgtacagttttatgtaaagagagattaccagccactattttgaacattaaatttactaattgccataattcttaagttttcactagatttgtataggatcggatagtcaggatagtcaggaaccttgtacagtaccctttttgtatgtgtaagttacattagctcatttttgtcagcagtttgctgccccagttttctgacctacataagcatcagtccccgtgccagtgcatggacaaagtt

SEQ ID NO: 2977 - DNA, 1987 bp, Sorghum bicolor
gcaggacccacagtcagtcacccagtgggcggccaccacgtcgtactcgcatcccaatctccgtcgtcccccgcctcactccctccgccgcactccacctccccatccccgcccaccccaccgcgttgccggccccatgtgggagcgcggaaggccgccccgcaagccgcgcccgtccccgatcctcgtgccaccgccaccgtcgtcgccgcctccccgcctgaacctcctccttccgagatccctcctcgcgctcgccgcgcgcgccatgccgtcgcgccgctcctccccggtcctcctcctactcctcgcgctctcgctcgccctcctcttccttctcctctccccttcctccccctccgcctcccgcttttcccactccctcagttcgggctccgttatcgcttactcatctccggcatcaacctccgccccgcctgctcccgtcaagatctacctgtacgacctgccggccaagtttacctacggcgttgtccggagctacacggctacgcgtgctccatcgggctccgcggatgccgccgcagctctgcctgacgagcagctgcggtacccgggacaccagcactcggcggagtggtggctcttcaaggacctgctccgacgcggcccgcgggaccgccccgtggcacgcgtggacgacccgagcgacgccgacctcttctacgtgcccttcttctcctccctcagccttgttgtgaaccccatccgctctccgccggcagcaaacgcctctggggcagcggcagcgtacagcgacgacgccatgcaagaggagctcctagagtggttggagcggcagccttactggcggcgccacatggggagggatcacgttttcatctgccaggatcccaatgccctgtacagggtgatcgaccggatcagcaatgccgtactcctggtctctgatttcggcaggttgcgtagcgaccaggcatctctcgtcaaggatgtcatcctgccctactcacaccgaatcaactccttcaagggtgaggtcggggtggatggccggcccttattgctgttcttcatgggcaataggtaccgcaaggagggagggaaggtccgtgatgcacttttccagattcttgaaaacgaggatgatgtaaccataaaacatggaactcaatcgagggagagtcggcgtgcagctagacaaggaatgcactcatctaaattttgcctccatcctgccggagatactccctcagcgtgcagattatttgatgcacttgtcagtctgtgtgttcctgttatagtcagtgattacattgaacttccattcgaagatattatagactacaacaaaatatcaatatttgtcgggacaagcaaagcagtacaacctggatacttaacttcaatgcttcgaagaatcagttcagagaggattctggagtaccagagggaaacaaaaaaggtgaaacgttactttgagtatgaggatccgaatggaccagtgaatgagatttggcgccaagtatcccttaaagcaccactgataaagttgttgattaatcgcaacaaacggttgcttgaaagaggcaccaatggaacagattgctcgtgcatctgctctacaactccaactgagataactgcagccagttaaacaagatggaagctttgtgcctattttcagtgatcacattgcctggatttttgaggctgtacagttttatgtaaagagagattaccagccactattttgaacattaaatttactaattgccataattcttaagttttcactagatttgtataggatcggatagtcaggatagtcaggaaccttgttgtgatgcctgtccttgatacaaggtacagtaccctttttgtatgtgtaagttacattagctcatttttgtcagcagtttgctgccccagttttctgacctacataagcatcagtccccgtgccagtgcatggacaaagttatttgtgtcgattgattctttg

SEQ ID NO: 2978 - DNA, 1928 bp, Oryza sativa
gcccggcacgtcggaaggccactaccgcagtgtgcgccccaaaatcgccgccgtcccccgtctcactccccgccgttctcctcctcctccgccgccgccgccgtcccgcccgcccgccgccaccgcccacatgtgggagcgcggcaggctaccccgcaagccgcgaccgtcccctatcctcgtgccgccgccgccggcgtccccgccgcccccgccccgcctcctcgccttcctcctccctagatccctcctctcgctcgccgcccgcgccatgccgtcgcgccgcccgtctcccctgctcctcctcctcctcgcgctcgcgctcgccttcctcttcctcctcctctccccatccgcgccctccgcctcccacctctccagctccctcgcctccgccgccgccgccgtttccactcccgcgtcctcccctcccgcccccgtcaagatctacatgtacgacctccccgccaagttcacctacggcgtcgtccgcagctacatggcggcgcgcgcccgggcgggggcggcgggcgcggcatcggcgattcccgacgacgagctgcggtacccggggcaccagcactcggcggagtggtggctcttcaaggacctcaggcgccgcgggccactcgaccgccccgtcgcccgcgtcgacgacccggccgacgccgacctcttctacgtgccgttcttctcctccctcagcctcgtcgtcaacccgatccgcccatcggcggccgccgccaatgcgtccgacgcggcggagcccgcgtacagcgacgagtccacgcaggaggagctgctggtgtggctggagcggcagccgtactggcgacggcaccaggggagggatcacgtgttcatctgccaggatccgaacgcgctctacagggtggtggatcggatcagcaatgctgtgctcctgatctccgacttcgggcggttgcgtagtgagcaggcatctctcgtcaaggatgttatcctgccctacgcgcaccgaatcaactccttccaaggcgatgtgggagtcgaaagccggccttcattgctattcttcatgggcaaccggtatcgaaaggagggtgggaaggtgcgtgatacgctgtttcaagttcttgaaaatgaggcagatgtaatcataaaacatggagcccagtcaagggagagtaggcgtatggctacacgaggaatgcactcatccaaattctgcctccatcctgctggagatactccctcggcatgcagattgtttgatgcgcttgtcagtttatgtgttcctgttatagtcagcgattacattgaattaccatttgaagatgttatagattacagaaacatatcaatatttgttgagacaagcaaggctgtacagcctggatttttaacatcaacacttcgaggaatcagttcacagaggattctagagtaccagagagaaataaaaaaggtaaaacattattttgagtatgaagatccaaacggaccagtgaatcagatatggcaccaagtttcttcaaaggcaccattgatcaagctgttgattaaccgcgataaacgcctagttgaaagaggtaccaatggaacagattgctcgtgcatctgttcgaccacgaaggaacttctacgtaaataagatggttctcatctcctggacgaacccaagttttgtggacgacccttctgattgagtacagtacctgaattttggctgacgctgagctctgtaactatgtgcagcgaggatcctaacaatttgttttgattgctaagcgcccatttcctgctgatttttcttcaattttcagtagatattagaatgttgtgaacaatataacaccactggtgcccctggctaaagcagaagtatatcattgttttcttttgtacgtgtgacttatatacatcctacattcctttttctcccaagg

SEQ ID NO: 2979 - DNA, 1777 bp, Oryza sativa
atgtgggagcgcggcaggctaccccgcaagccgcgaccgtcccctatcctcgtgccgccgccgccggcgtccccgccgcccccgccccgcctcctcgccttcctcctccctagatccctcctctcgctcgccgcccgcgccatgccgtcgcgccgcccgtctcccctgctcctcctcctcctcgcgctcgcgctcgccttcctcttcctcctcctctccccatccgcgccctccgcctcccacctctccagctccctcgcctccgccgccgccgccgtttccactcccgcgtcctcccctcccgcccccgtcaagatctacatgtacgacctccccgccaagttcacctacggcgtcgtccgcagctacatggcggcgcgcgcccgggcgggggcggcgggcgcggcatcggcgattcccgacgacgagctgcggtacccggggcaccagcactcggcggagtggtggctcttcaaggacctcaggcgccgcgggccactcgaccgccccgtcgcccgcgtcgacgacccggccgacgccgacctcttctacgtgccgttcttctcctccctcagcctcgtcgtcaacccgatccgcccatcggcggccgccgccaatgcgtccgacgcggcggagcccgcgtacagcgacgagtccacgcaggaggagctgctggtgtggctggagcggcagccgtactggcgacggcaccaggggagggatcacgtgttcatctgccaggatccgaacgcgctctacagggtggtggatcggatcagcaatgctgtgctcctgatctccgacttcgggcggttgcgtagtgagcaggcatctctcgtcaaggatgttatcctgccctacgcgcaccgaatcaactccttccaaggcgatgtgggagtcgaaagccggccttcattgctattcttcatgggcaaccggtatcgaaaggagggtgggaaggtgcgtgatacgctgtttcaagttcttgaaaatgaggcagatgtaatcataaaacatggagcccagtcaagggagagtaggcgtatggctacacgaggaatgcactcatccaaattctgcctccatcctgctggagatactccctcggcatgcagattgtttgatgcgcttgtcagtttatgtgttcctgttatagtcagcgattacattgaattaccatttgaagatgttatagattacagaaacatatcaatatttgttgagacaagcaaggctgtacagcctggatttttaacatcaacacttcgaggaatcagttcacagaggattctagagtaccagagagaaataaaaaaggtaaaacattattttgagtatgaagatccaaacggaccagtgaatcagatatggcaccaagtttcttcaaaggcaccattgatcaagctgttgattaaccgcgataaacgcctagttgaaagaggtaccaatggaacagattgctcgtgcatctgttcgaccacgaaggaacttctacgtaaataagatggttctcatctcctggacgaacccaagttttgtggacgacccttctgattgagtacagtacctgaattttggctgacgctgagctctgtaactatgtgcagcgaggatcctaacaatttgttttgattgctaagcgcccatttcctgctgatttttcttcaattttcagtagatattagaatgttgtgaacaatataacaccactggtgcccctggctaaagcagaagtatatcattgttttcttttgtacgtgtgacttatatacatcct

SEQ ID NO: 2980 - DNA, 1830 bp, Brachypodium distachyon
atgtgggagcgcggcaggccaccgccccgcaagccgcgaccgtcgcctctcatcctgccggcgtcggcgctggtctcgcctcctccccctcgattcgtattccccagatccctcttcgcgctcgccgcccgggccatgccgtcgcgccgcccctcccctgcgctcctcctcctcctcgcgctggcgctcgccctactcttcctcctcttatccccctccggcccctccgcctcccgcctctcccactctttcgcctccgcctcctcttcctatcctgcctcctccccccttccctcgccagtcaagatctacctgtacgacctgccatccaagttcacctacggcgtcgtccgtagctacatgtccgcgcgggctcccccggggtcggcggatgcggccgcgacgctgcccgacgaggagctgcgatatccagggcaccaacactcggcggagtggtggctcttcaaggatctccgccgccgggggccgcgcgaacgccctgtggcccgcgtggacgacccggccgaggctgacctcttttacgtgcccttcttctcctccctcagcctcgttgtcaaccccatccgtcccctggcggccgccaatgcctccgtggcggcggcggaacctgcatacagcgacgaggccatgcaggacgagctggtggagtggctggagcggcagccttactggaggcggcaccgggggagagaccacgtcttcatctgccaggaccccaacgcgctctaccgggtggtggaccggatcagcaatgccgtactcctggtctctgacttcggccggttgcgtggtgatcaggcctctcttgttaaggatgtcatcctgccttactcgcaccgcatcaaccccttccagggcgacgtcagtatcgaagcccgacctgcactgcttttcttcatgggcaaccggtaccgtaaggagggcgggaaggtccgtgatacactcttccaagtccttgaaaatgagggagatgtaatcataaaacatggaacccaatcaagggtgagtcggcgtatggccacacaaggaatgcactcatccaaattttgcctccatcctgctggagatactccatcagcgtgcagattgtttgatgcacttgtcagtttatgtgttcctgttataatcagtgatcatattgagttaccatttgaagatgttatagactacagtaatatatcaatttttgttgacacaagcaaggctgtacagcctggattcttaacttcgatgcttcgaagagtcagttcagaacggattctggagtaccaaagagaaataaaaagggtaaagcattactttgagtatgaagatccaaatggtccagtcaatcaaatatggcaccaagtttccatgaaggcaccgttgattaaactgttgattaaccgtgacaaacggctggttgaaagagccactaacgaaactgactgctcgtgcatctgttcaacaccgagcgagatatctactggtaactaagtaaagaagatagttttcacggactgaaggaaaccaagctttgtggccacatcgcccgaattctgaaggctgcaccgctacatatatgtacagcacggatcctgttggttctttttaatccctgattgcccataacctgctaacgtccttcaatttttcagtaggtattagagagtcagcagcaaatgatggcgctttgatcggtagttttatgtttgtttgttttatgttattagcttccctttgttaggatgtcatgtcgaatcagaatcttgtgttgacactactgttcaaagtgtttcttttggtagtaacaacaaatttttggagtat

SEQ ID NO: 2981 - DNA, 2042 bp, Brachypodium distachyon
aagctcagtagcacagcaccccgatcgccgtcgtccccgccctgtcttcccacggtccctcccacgcagggcgccgctcgttgtcccggccggccacatgtgggagcgcggcaggccaccgccccgcaagccgcgaccgtcgcctctcatcctgccggcgtcggcgctggtctcgcctcctccccctcgattcgtattccccagatccctcttcgcgctcgccgcccgggccatgccgtcgcgccgcccctcccctgcgctcctcctcctcctcgcgctggcgctcgccctactcttcctcctcttatccccctccggcccctccgcctcccgcctctcccactctttcgcctccgcctcctcttcctatcctgcctcctccccccttccctcgccagtcaagatctacctgtacgacctgccatccaagttcacctacggcgtcgtccgtagctacatgtccgcgcgggctcccccggggtcggcggatgcggccgcgacgctgcccgacgaggagctgcgatatccagggcaccaacactcggcggagtggtggctcttcaaggatctccgccgccgggggccgcgcgaacgccctgtggcccgcgtggacgacccggccgaggctgacctcttttacgtgcccttcttctcctccctcagcctcgttgtcaaccccatccgtcccctggcggccgccaatgcctccgtggcggcggcggaacctgcatacagcgacgaggccatgcaggacgagctggtggagtggctggagcggcagccttactggaggcggcaccgggggagagaccacgtcttcatctgccaggaccccaacgcgctctaccgggtggtggaccggatcagcaatgccgtactcctggtctctgacttcggccggttgcgtggtgatcaggcctctcttgttaaggatgtcatcctgccttactcgcaccgcatcaaccccttccagggcgacgtcagtatcgaagcccgacctgcactgcttttcttcatgggcaaccggtaccgtaaggagggcgggaaggtccgtgatacactcttccaagtccttgaaaatgagggagatgtaatcataaaacatggaacccaatcaagggtgagtcggcgtatggccacacaaggaatgcactcatccaaattttgcctccatcctgctggagatactccatcagcgtgcagattgtttgatgcacttgtcagtttatgtgttcctgttataatcagtgatcatattgagttaccatttgaagatgttatagactacagtaatatatcaatttttgttgacacaagcaaggctgtacagcctggattcttaacttcgatgcttcgaagagtcagttcagaacggattctggagtaccaaagagaaataaaaagggtaaagcattactttgagtatgaagatccaaatggtccagtcaatcaaatatggcaccaagtttccatgaaggcaccgttgattaaactgttgattaaccgtgacaaacggctggttgaaagagccactaacgaaactgactgctcgtgcatctgttcaacaccgagcgagatatctactggtaactaagtaaagaagatagttttcacggactgaaggaaaccaagctttgtggccacatcgcccgaattctgaaggctgcaccgctacatatatgtacagcacggatcctgttggttctttttaatccctgattgcccataacctgctaacgtccttcaatttttcagtaggtattagagagtcagcagcaaatgatggcgctttgatcggtagttttatgtttgtttgttttatgttattagcttccctttgttaggatgtcatgtcgaatcagaatcttgtgttgacactactgttcaaagtgtttcttttggtagtaacaacaaatttttggagtatcaatgatctgacggtagcaattttgctgattgattatcgcgtctgaaccatgtttgtttgtgcttctgaaccttggcacaaagaatcaagcactgatagtacattgaacattgaa

SEQ ID NO: 2982 - DNA, 2026 bp, Sorghum bicolor
cgagcggcggctataaaaccttcccctgcgctcccagtcgcgaagctctactcaacttctccttttccaccggcgattattccggccactcgccttcgttgcgtgcgcctcgagaacccggttctagaatcggcggcgggcggctaaaggagagggtgctaaattttcgatagaaggacgagcacgacttcttaatttttttttggggggtggcggttgatgttgaagaggattgcgctggcgagaatccatttttagggcggtgccggcgcgaccgttccgggatcgggagctttatctggaggcgagaggggtcagggcagcggcgacgatcgaccaacccaacccaccagttcccgcgtcgaggaagaagaagggataggagacggagccggtggtggtcgcaaggatggccgggagcatgcaggcggcggacgcggcgggccggctaagcgcgctgctgtcgctgctcgcgctgcgccggctcctcgccgtgctccagccgctggccctgctcctgctcctgcccttcaggtggcgcccaaggccgggggccgtgcccacggccgtggcgtccgatgccgcgccctccgcgtcgtcgggggctagcgggaagaaggggaaggcgtcgtcgtcggtggttctaagggtgccggccggctcgcccatggtcgccgcgcggaggcaggcgtccgcaaggagggagatagccatgcgccgggcgcgggaggccgggcgggagtacgagctcatccccaccgctcgcggcgagacgctcttcacgcagtgctggtggccgcacccgccttcctccaccgttaaaccaagggcgctggttgttgtcatgcacgggctaaacgagcacagtgggaggtatgatcatttagcgaggcgattgaatgacatcggcatcaaggtgtacggaatggactggactggtcatggtggaagtgatggtctccatggatatgtgcaatctcttgattatgctgtcaatgatttgaaaatgtacctcaagaaagtattagccgagaaccctggtcttccatgcttctgcttcggccattcgactggtggaggtatcattctgaaggctgcgcttgatccagaggtaaaaactctcattagcggtattgtcctgacatcaccagctgtccgtgttcagcctgcccacccagtcatagcggtcatggcaccgattttcgccctcatcgcaccgaggtatcagttcacggcgtcgcacaggaacggcccaccggtgtcgcgcgacccggaggccctgcgtgccaaatacacggaccagctggtgttcacgggcgccatccgcgtgaggacgggctacgagatcctccgcctgacgtcgtacctgcagcagcacctgcaccgcatcgacgtcccgctgctggtgatgcacggcgccgacgacctggtgaccgaccccaagggctcgcgggcgctgtacgagcaggcctcctccgcggacaagtccctcaagctctacgacgggctgctgcacgacctcctgatcgagcccgagaaggacaaggtgatggacgacatcgtggcgtggctgagccccaaggtctaacgccggcatgcagatgcccgtaggacgcgcgcgcgggcttcgatcgtctgctgagcgcggaggacctgcaggcggaagacgtacgcctcgcctccggacggtgatgacgcgggtctggtcggccgcggagcaagggagagcgggtgtgcctcctcgcccccttgccgtggtgattatccgagagcaggactacaggagtacggcatactactactacctacgctacggcgatggctttactcgtgcctcccattgtatcccgataatttttgtcaggggtacttacgaattatgtaaaacatgctcgtttcgccctgtacgtgtggctgcacgagcggtgtccgatactgtagaagacgcccgccctcttgtgaattgtgaatgcattaacgcaattccatatcagagttgcaagttgcaacaggctctcggtctcct

SEQ ID NO: 2983 - DNA, 2195 bp, Sorghum bicolor
ttcatactcccggtcccggtgctctccctcccttgccgcctccgcctgcccctcccccgtagcgagcggcggctataaaaccttcccctgcgctcccagtcgcgaagctctactcaacttctccttttccaccggcgattattccggccactcgccttcgttgcgtgcgcctcgagaacccggttctagaatcggcggcgggcggctaaaggagagggtgctaaattttcgatagaaggacgagcacgacttcttaatttttttttggggggtggcggttgatgttgaagaggattgcgctggcgagaatccatttttagggcggtgccggcgcgaccgttccgggatcgggagctttatctggaggcgagaggggtcagggcagcggcgacgatcgaccaacccaacccaccagttcccgcgtcgaggaagaagaagggataggagacggagccggtggtggtcgcaaggatggccgggagcatgcaggcggcggacgcggcgggccggctaagcgcgctgctgtcgctgctcgcgctgcgccggctcctcgccgtgctccagccgctggccctgctcctgctcctgcccttcaggtggcgcccaaggccgggggccgtgcccacggccgtggcgtccgatgccgcgccctccgcgtcgtcgggggctagcgggaagaaggggaaggcgtcgtcgtcggtggttctaagggtgccggccggctcgcccatggtcgccgcgcggaggcaggcgtccgcaaggagggagatagccatgcgccgggcgcgggaggccgggcgggagtacgagctcatccccaccgctcgcggcgagacgctcttcacgcagtgctggtggccgcacccgccttcctccaccgttaaaccaagggcgctggttgttgtcatgcacgggctaaacgagcacagtgggaggtatgatcatttagcgaggcgattgaatgacatcggcatcaaggtgtacggaatggactggactggtcatggtggaagtgatggtctccatggatatgtgcaatctcttgattatgctgtcaatgatttgaaaatgtacctcaagaaagtattagccgagaaccctggtcttccatgcttctgcttcggccattcgactggtggaggtatcattctgaaggctgcgcttgatccagaggtaaaaactctcattagcggtattgtcctgacatcaccagctgtccgtgttcagcctgcccacccagtcatagcggtcatggcaccgattttcgccctcatcgcaccgaggtatcagttcacggcgtcgcacaggaacggcccaccggtgtcgcgcgacccggaggccctgcgtgccaaatacacggaccagctggtgttcacgggcgccatccgcgtgaggacgggctacgagatcctccgcctgacgtcgtacctgcagcagcacctgcaccgcatcgacgtcccgctgctggtgatgcacggcgccgacgacctggtgaccgaccccaagggctcgcgggcgctgtacgagcaggcctcctccgcggacaagtccctcaagctctacgacgggctgctgcacgacctcctgatcgagcccgagaaggacaaggtgatggacgacatcgtggcgtggctgagccccaaggtctaacgccggcatgcagatgcccgtaggacgcgcgcgcgggcttcgatcgtctgctgagcgcggaggacctgcaggcggaagacgtacgcctcgcctccggacggtgatgacgcgggtctggtcggccgcggagcaagggagagcgggtgtgcctcctcgcccccttgccgtggtgattatccgagagcaggactacaggagtacggcatactactactacctacgctacggcgatggctttactcgtgcctcccattgtatcccgataatttttgtcaggggtacttacgaattatgtaaaacatgctcgtttcgccctgtacgtgtggctgcacgagcggtgtccgatactgtagaagacgcccgccctcttgtgaattgtgaatgcattaacgcaattccatatcagagttgcaagttgcaacaggctctcggtctcctcgtctgtctgctctgttcatagtacttcctatcagcaccctagccagcagttgttgctgcttgcaattgcaaccttgaatccttggtgctgcgtaagaagtcccaag

SEQ ID NO: 2984 - DNA, 1909 bp, Pennisetum glaucum
ccggcggcggcggcggcggcaacgtcaatcggaaaaaagcgagcgctccttatttttgggcggcggcggtggaggatcgcgctggcctggcggtggcgggaatccatttttagggcggtgccggcgcgatcggtccgggatcggggagctttttctgggggggcgagagaggtcagagcagcggcgacgcccagacccgacccaactcaaacccaaccaaccaacacacccccgcgcggcccgcgtcgaggagggggataggagacggcgacggtggtcgcgaggatggccgggagcatgcaggcggcggaggccgcggggcggctgagcgcgctgctctcgctgctcgcgctgcgccgcctcctcgccgtgctccagccactggccctgctcctgctcctgcccttccgctggcgcgcgcggccgggggccgtggtcgccgccgtggcgtcgtccgacgccgcgcagtcctccgcgtcgggctccagcggcaagaccaaggggaaggcgtcggcgtcggtggtgctgcgggtgccggcggggtcgcccatggtcgccgcgcgcaggcaggcgtcggcgcggagggagatagccatccgccgggcgcgggagggcggcagggagtacgatctcattccaactccccgcggcgagacgctcttcacgcagtgctggtggccgcacccgccctcctccaccattaaaccaagggcactagttgttgtcatgcacgggctaaacgagcacagtgggagatatgaccatttagcgaggcggttgaatgagatcggcatcaaggtgtacgggatggactggaccggccatggtggaagcgatggtcttcatggatatgttcagtctcttgatcatgctgtcaatgatttgaaaatgtacctcaagaaactctcagctgagaaccctggtcttccatgcttctgctttggccattccactggcggaggcattattctgaaggctgcacttgatccagaggttgaaactcttattagtggtgttgtcctgacatcgccagctgttcgtgtacagcctgcccacccaatcataagggtgatggcgccagttttcgcgctcctcgcaccgaggtaccagttcacggcgtcccacaggaacggccctccggtgtcgcgcgacccggaggccctgcgcgccaaatacacggacccgctcgtgttcacgggcgccatccgcgtgaggacgggctacgagatcctccgcctgacgtcctacctgcagcagcacctgcaccgcatcaccgtccccatcctggtgctccacggcgccgacgacatggtgacggaccccgacggctcgcgggcgctctacgaactgtcctcgtccgcggacaagtccctgaagctctactccggcctgctgcacgacctcctgatcgagcctgagaaggacatgatcatggacgacatcgtggcgtggctgagccccagggtctgacgctgccgccgccaccgccaaactgaccagccgtaggacgcagctcgattgccagccgcagagcgcggaggaggaccaagcaggcgagcaagccgcctcgcctcacctccggcggtgatgacacggcgtgatcagcggctgcggagcaggggagagcgggagacggtgagatcttcttcgcccccctgccgcggtgacgatgcgagagcaggacaggaatactacccgagttacctacggtgatggcttttactcacggcctcccggtgtgtgttgtatcccgagatttttggtcagggatacgtatggtatggatctgtaaagattgttcgtttcgccctgtgtggccgcactgcacgagtggtgcccggcccgatgctactataaaatttagacgcctgtattcccctatgggcgatgcatcaaatgcaattccaaa

SEQ ID NO: 2985 - DNA, 2157 bp, Setaria italica
gcggccacgacgcccgcccgccgcggctcggcgcgaggcgttcgattcggttgcggcctccctgccttgccgctcccgcctctcggacggagcgagcgagcgagcggcggctataaacctttgcctccactcgcccccactcgcgaagacctactcaaacttctccttcccttcctcaccggcggttaatccggcaccgtttgttcgtgcactctctcctccgtccgttgcgtgcgcgtcgggcatctggttcgggaatcggcggcggggggcggcggcggtggcgtgaatcgataaaagcgagcgctccttatttttgggcggcggtggaggaggatcgcgctggtcttggggtcggggaatccatttttagggcggtgccggcgcgatcggtctgggatcgggagctttttcttggggcgagaggtcagaacagcggcgacgcgcaaccgaccgacccaccgacccaacccaaccaaccaaccccccgtggcccgcgtcgaggagggagaagaagggataggagacggcgacggtggtcgcgaggatggccgggagcatgcaggcggcggaggccgcggggcggctcagcgcgctgctctcgctgctcgcgctgcgccggctcctcgccgtgctccagccgctggccctgctccttctcctgcccttccgctggcgcgcgcggccgggggccgtcgccgccgccgtggcgtccgacgccgcgccctcctccgcgtcggggcccagcgggaagaaggggaaggcgtcggtggtgctgcgggtgccggcggggtcgcccatggtcgccgcgcgtaggcaggcgtcggcgcggagggagatagccatccgccgggcgcgggagggcggcagggagtacgacctcatccccacgccccgcggcgagacgctcttcacgcagtgctggtggccgtacccgccctcctccaccattaaaccaagggcgctagttgttgtcatgcacgggctaaacgagcacagtgggagatatgatcatttagcgaggcggttgaatgagatcggcatcaaggtgtacgggatggactggaccggccatggtggaagcgatggtcttcatggatatgtgcagtctcttgatcatgctgtcaatgatttgaaaatgtacctcaaaaaagtctcagctgagaaccctggtcttccatgcttctgctttggccattccactggcggaggcatcattctgaaggctgcacttgatccagaggtagaaactcttattagtggtgttgtcctgacatcaccagctgttcgtgtacagcctgcccacccaatcataagggtgatggcgccagttttcgccctcctcgcgccgaggtaccagttcacggcgtcccacaggaacgggccaccggtgtcgcgcgacccggaggccctgcgcgccaaatacacggaccagctcgtgttcacgggcgccatccgcgtgaggacgggctacgagatcctccgcctgacgtcctacctgcagcagcacctgcaccggatcaccgtccccatcctggtgctgcacggcgccgacgacatggtgaccgaccccgacggctcgcgggcgctctacgagcagtcctcgtccgcggacaagtccctcaatctctaccccggcctgctgcacgacctcctgatcgagcccgagaaggacaagatcatggacgacatcgtggcgtggctgagcctcagggtctgacgctgccgccggcatcgctagctggccggccgtaggacacagctcgatcgccagccgcagagcgcggaggaggaccagcaggcgagcaagccgcctcgcctcgcctccggacggtgatgacgcggcgtgatcagcggctgcggagcagggagagcgggagacagtgagatcttcttcgccccctgccgcggtggcgatgcgagagcaggacaggaatacccgagtacctacggtgatggcttttactcgcggcctcccggtgtgttgcatcccgagatttttggtcagggatacgtatggatctgtaaagattgttcgtttcgccctgtgtggccgcacgagtggtgcccgatactactataatttagacgcctattcccctcggggtgatgcatccatgcaattccaaatcagagttgcaacaggctcggtctcct

SEQ ID NO: 2986 - DNA, 1924 bp, Zea mays
attcgcgaagccctgctcagcttctcctccttttctcaccaccggccccactcgtcttcgttgcgtacgacaccagaacccggttcgagaatcgccggcggccggctaaaggagagagggtgataataaatcgataaaaggacgggcacgactttttttttcggagggtgtcgttgaacaggactgcgctgggcctgggacgaatccatttttagggcggtgccggcgcgatcgttccgggatcggcagctttatcggggggcgagggatcacggcagcggcggcggcgacgaccgaccgaccgacccaacccgccaccagtgccccgcggcccgcgccgaggaagaaggaagggataaggagacggagccggtggtcgcagtcgcagggatggccgggagcatgcaggcggcggacgcggcgggccggctgagcgcgctgctctcgctgctcgcgctgcgccggctcctcgccgtgctgcagccgctggccctgctcctgctcctgcccttccggtggcgctcgcgcccgggggccggggccgcggcctccgcgccgggggctagcgggaagaaggggaagtcggcgtcgtcgtcgtcgtcgtcgtcgtcggtggttctgcgggtgccggccgggtcgcccatggtcgccgcgcggaggcaggcttccgcgcggagggaggtagccatgcgccgggcgcgggaggccgggcgggagtacgagctcatccccaccgctcgcggcgagacgctcttcacgcagtgctggtggccgcgcccgtcctccaccgttaaaccaagggcgctagttgttgtcatgcacgggctaaacgagcacagtgggaggtacgatcatttagcgaggcgattgaatgatatcggcatcaaggtgtacgggatggactggactggtcatggtggaagtgatggtctacatggatatgtgcaatctcttgaccacgctgtcaatgacttgaaaatgtacctcaagaaagtgtcagccgagaaccctggtcttccatgcttctgcttcggccattcgacgggtgggggtatcattctgaaggctgcacttgatccagacgtagaaacgctcatcagcggtgttgtcctgacatcaccagctgtccgtgttcagcctgcccacccaatcatagcggccatggcaccgatttttgccctgatcgcgccaaggtaccagttgacggcgtcgcacaggaacggcccgccggtgtcgcgcgacccggaagccctgcgggccaaatacgcggaccagctggtgttcacgggcgccatccgcgtgaggacgggctacgagatcctccgcctgacgtcgtacctgcagccgcacctgcagcgggtcgcggtgccgctgctggtgatgcacggcgccgacgacctggtgacggaccccgagggctcgagggcgctgtacgagcgggcctcgtccgcggacaagtccctcaggctctaccacgggctgctgcacgacctcctgatcgagcccgagaaggacagggtgatggacgacatcgtggcgtggctgagccgcagggtgtgatgcgttgcggtgctggccgtaggtttcgcgcggcttcgatcgtctgctgagcgcggaggacctgcaggcggaagacgaagacgcctcgcctctggacggtgatgacgcggtctggtcggctgcggaggtagggagggagagccggtgtgcgtccttgctgccttagcgcggtgatgatccgagagcggcacaggagtatggagtactagtactacctacggtgatggcttcactcgcgcctcccgggtgtatcctgagatttttgtcggggatacgtacgaattttgtaaaaatccgacgactgaacgaagatgagagcatctccaacaacgtgacctataaaaatgccttataatttaaaaat

SEQ ID NO: 2987 - DNA, 1984 bp, Panicum virgatum
tgccgcgcctcctcttggtactcggagcggcggctattcttcacctccactcccactcgcgaagacttgctcaacttctccttccctttctcgccgccgaataatccggccctcgtctacgagaagctagcccccgttgcgtgcgcctcgagcatctggcggttcgagaatcggcggcggcataattcgatacagccgtgcgctcctttttttgggcggcggtggaggaggatcgcgctggttgggggtgagggtggtgggggaatccatttttagggcggtgccggcgcgatcggtccgggatcgggagctttttgttgttgggggcgagagaggccacgagagcggcgacgcccggggacccgacccgacccagcccagcaccgcgccgaggagggagaagaagggataggagacggcgacggtggtcgcgaggatggccggcagcatgcaggcggcggaggccgcggggcggctcagcgcgctgctctcgctgctcgcgctgcgccgcctcctcgccgtgctccagccgctggccctgctcctgctcctgcccttccgctggcgcgcgcgcccgggggccgccgtcgcggaagccgcgtccgacgccgcgccgtccgcgtcgggcgccaccgtgaagaaggggaaagcgtcggcgtcggtggtgctgcgggtgccggccggctcgcccatggtcgccgcgcgcaggcaggcgtcggcgcggagggagatagccatccgccgggcgcgggagggcggacgggagtatgagctcatccccaccgcccgcggagagacgctcttcacgcagtgctggtggccgtacccgcccacctccaccattaaaccaagggcgctagttgttgtcatgcacgggctaaacgagcacagtgggagatatgatcatttagcgaggcgtttgaatgagatcggcatcaaggtgtacgggatggactggactggccatggtggaagtgatggtcttcatggatatgtgcagtcacttgatcatgccgtcagtgacttgaaaatgtacctcaagaaagtcttagctgagaaccctggtcttccatgcttctgctttggccattcaactggcggtggcatcattttgaaggctgcacttgatccagaggtagatattcttattaacggtattatcctgacatcaccagctgttcgtgtacagcctgcccacccaatcgtaagggtcatggcgccacttttcgccctcatcgcgccgaggtaccagttcacggcgtcccaccggaacggcccgccggtgtcgcgcgacccggaggccctgcgcgccaagtacacggaccctctcgtgttcacgggcgccatccgcgtcaggaccggctacgagatcctccgcctgacgtccttcctgcagcagcacctgcaccgcatcaccgtccccgtcctggtgatgcacggcgccgacgacatggtgaccgaccccgagggctcgcgggcgctctacgagcggtcctcgtccgcggacaagtccctcaggctctacggcggcctgctgcacgacctcctgatcgagcccgagaaggaggcggtgatcgaggacatcgtagcgtggctgcgccccagggtctgacgcccgccgccgccgcttccggcaagcgccggccgtaggacacgcagctcgatcgccagccgcggagcgcggaggaccagcaggcgggccgccgcctcgcctccggacggtgatgacgcggtgacgatgcgggagcagaggacaggagtacccgagtacctacggtgatggcgctttactcacgcctccccccggtgtgttgtatccctagattttttggtcagggatacgtatggatttgtaaaattgttgttcgtttcgccctgtgtggccgcacgagtggtgtccgacactatataatttagacgcccattccggcattcccctcggggtgatgcattaaagattgcaattccaaatcagagttgcaac

SEQ ID NO: 2988 - DNA, 2143 bp, Oryza sativa
ataaagcggccgcctccacctcacctacacctacgcctacgcctacgaggattttatttaattctctttgtgtttgtgtgttatttttttctcattttcgagcggccgattaatgcgcggagtttcgaatttttctacgtcctcgttgttgcgcgagacgaggcgatatacggcaccgagcatctggttccaggataattcgaccgattgatcggcgcgaggcagcgagagaatcatccgccttttttttgtttggttttgcggattgagtgattcgcttttctcttcgttggtcgcgggaggttggattggagaggaggtccatttttagggcggtggcggcgcgatcgatccgggattgggagaggcatttctagggcggggggagcggcagcgggcgagacccaccaccaacgacctcgcgaccgcgcctgcgtcgccgcgcgcgcgtgtggaggaggaggaggaggaggatggcggggagcatgcaggccgcggaggcggcggggcggatcagcgcgctgctgtcgctgctcgcgctgcggcggctcatcgccttgctccagccgctcgccctgctcctgctcctgcccttccggtggcgcggcgcgcgccccggcgccgccgccgcggcggcggcggcggcggcggacgccgtggccgcctcggtcgcgtcgggcgggaagaaggggaaggccgccgtcgtgctgcgggtccccgccgggtcgccgatcgtcgccgcgaggcgccaggcgtcggcccgccgggagatcgccgcgcggcgggcgcgcgaggccggccgcgagtacgagctcatccccacccaccgcggcgagacgctgttcacgcagtgctggtggcctcacggatcctcctccgccattaagccgagggcgctcgtcgtagtcatgcacgggttgaacgagcacagtgggagatacgatcatctagctaggaggttgaacgacatcggtgttaaggtttatgggatggactggactggtcatggtggaagtgatggtcttcatggttacgtgcaatctcttgaccatgctgtcagtgacttgaaaatgtatctcaagaaaattttagctgaaaaccctggtcttccatgcttctgttttggccactcaactggtggaggcatcattttgaaggctatgcttgatccagaggtagattcttgtgttgagggcatcttcctgacatcaccagctgttcgtgttcagcctgcccatccaatcataaaggtcatggcccctgtgtttgccctcatagccccaagataccagttcacggcttcacacaggaacgggccaccggtatcacgtgacccggaagccctgaaggctaaatattcagaccagcttgtgttcaccggttccatccgagttagaacagggtacgagatcctacgcctgacgtcgtatttgcaacagcacttgcacagaatcactgtcccgatgctggtgatgcatggtgccgatgatatggtgaccgatccccaaggatcacagaaactgtacgaagaagcttcatcctcggacaagtccctcaatctgtacaacggtctgcttcatgatctgctcatcgagcccgagaaggagaagatcatggacaacattgtggattggctgagcccgaggatttgacagctgatatccattcataggacgcagtctgatcgtccgcggagcgcgggggcaggatgagcatcccggcctcccgatggtgatgacgcggtctttgatcatctgcagagccgaggagggcgagcgttgctgcaagcctgcgatgctgctggcctcccggcgttggtaacatcataccacgagcattgcttctatctatattacgtgttgctgtagtaccaggcgatgatgggtcggcttactactgtcgcctccccttggtatcccggaatcctttttgtttgcagggatacgcctatgtaagattgttcgtttcgccctgtgtggctgcatgtgtggtgtccaataatttagatgccttttaccctccgatgagaggagacgttttctgcgttgcaatgtaatcagattttgcagcagaatatatttgcctggattgtctgatgtgtaaatatgttctcctgcgtcatatcgtgttatttttgcctgga

SEQ ID NO: 2989 - DNA, 1864 bp, Oryza sativa
ttttttttgtttggttttgcggattgagtgattcgcttttctcttcgttggtcgcgggaggttggattggagaggaggtccatttttagggcggtggcggcgcgatcgatccgggattgggagaggcatttctagggcggggggagcggcagcgggcgagacccaccaccaacgacctcgcgaccgcgcctgcgtcgccgcgcgcgcgtgtggaggaggaggaggaggaggatggcggggagcatgcaggccgcggaggcggcggggcggatcagcgcgctgctgtcgctgctcgcgctgcggcggctcatcgccttgctccagccgctcgccctgctcctgctcctgcccttccggtggcgcggcgcgcgccccggcgccgccgccgcggcggcggcggcggcggcggacgccgtggccgcctcggtcgcgtcgggcgggaagaaggggaaggccgccgtcgtgctgcgggtccccgccgggtcgccgatcgtcgccgcgaggcgccaggcgtcggcccgccgggagatcgccgcgcggcgggcgcgcgaggccggccgcgagtacgagctcatccccacccaccgcggcgagacgctgttcacgcagtgctggtggcctcacggatcctcctccgccattaagccgagggcgctcgtcgtagtcatgcacgggttgaacgagcacagtgggagatacgatcatctagctaggaggttgaacgacatcggtgttaaggtttatgggatggactggactggtcatggtggaagtgatggtcttcatggttacgtgcaatctcttgaccatgctgtcagtgacttgaaaatgtatctcaagaaaattttagctgaaaaccctggtcttccatgcttctgttttggccactcaactggtggaggcatcattttgaaggctatgcttgatccagaggtagattcttgtgttgagggcatcttcctgacatcaccagctgttcgtgttcagcctgcccatccaatcataaaggtcatggcccctgtgtttgccctcatagccccaagataccagttcacggcttcacacaggaacgggccaccggtatcacgtgacccggaagccctgaaggctaaatattcagaccagcttgtgttcaccggttccatccgagttagaacagggtacgagatcctacgcctgacgtcgtatttgcaacagcacttgcacagaatcactgtcccgatgctggtgatgcatggtgccgatgatatggtgaccgatccccaaggatcacagaaactgtacgaagaagcttcatcctcggacaagtccctcaatctgtacaacggtctgcttcatgatctgctcatcgagcccgagaaggagaagatcatggacaacattgtggattggctgagcccgaggatttgacagctgatatccattcataggacgcagtctgatcgtccgcggagcgcgggggcaggatgagcatcccggcctcccgatggtgatgacgcggtctttgatcatctgcagagccgaggagggcgagcgttgctgcaagcctgcgatgctgctggcctcccggcgttggtaacatcataccacgagcattgcttctatctatattacgtgttgctgtagtaccaggcgatgatgggtcggcttactactgtcgcctccccttggtatcccggaatcctttttgtttgcagggatacgcctatgtaagattgttcgtttcgccctgtgtggctgcatgtgtggtgtccaataatttagatgccttttaccctccgatgagaggagacgttttctgcgttgcaatgtaatcagattttgcagcagaatatatttgcctggattgtctgatgtgtaaata

SEQ ID NO: 2990 - DNA, 2148 bp, Sorghum bicolor
atggatgcagtggccagcgacgccgtactcttcctccttgccgtcactatctccctgctcatcaccactgccactgtctggaacaggcgtcgtgaggggcacgacgatggcgcgccaagcccgccgtcgctaccgctgctcggccacctccacctgctcagcaagccgctacaccactcgctggccgcgctcgccgccgcgcacggcactgggactgggtccggggccacggccaccccggcgccgctcctgtcgctgcgcctgggcgcgcggcgcgcgctgctggtgtccgggcacgccgcggccgaggagtgcttcacggcgcacgacgccgcgctggcgggcaggccgcggctgctggtcggcgacaggctcaactacgggtacaccacggtggggtggtcctcccacggcgaccactggcgcgccctccgccggttcctcgccgtcgagctcttcacggcgtcccgcctcgccgcgcgcgccgccgaccgccgcgccgaggtcgccgcgctcgtcgccaccctgctccgtgacgccgccgccgacgccgccgcggtgacgctccggcccaggctcttcgagctggtgctgaacgtgatgctgcgcgcgctcaccggcgcgccgccgcccgggcacggcggcggcgacgtgcgcggtctccaggagatcatagaggagaccttcgcggtgaccggcgtcatgagcgtcggggactactacccggcgctgcggtggatcgaccgtctgcgcggggtcgatgccgctctgatccgtctccaggcgagacgcgacgcgttcgtcgccggcctcgttcacgacaaacgccaaagtcgcacagccggtggccgagacgcggagaagaagagcaccattgatgagctcctgtcgctgcaagaaactgatcctgagtactacactgacactgtcatcaaaggcatcgtctcgatactgctcagtgccggcacagacacatcggcactgacccttgagtgggcaatggcgcagctgctgacgcacccggaagcgatgctgaaggcgagagctgagattgacgccaacgtcggcagatcccggctggtggaggagtcagatatgacgaacctcccatatctgcaatgtgtgatcaaggagactctccggctctgtcctgtcggcccggtaatcccagcgcatgaagctatggaggactgcagcgtcggtgggttccatgtccggcgcggcaccatgatcctcgtgaacgcttgggtgatccatcgggaccccaaattgtgggaggcgcctgaggtgttcaggccggagcggttcttggacactgccatggtgaccatggtcaccgcaccgttgctgccgttcgggcttggacggagacgctgccctggggaggggatggcaatgcgtctcatgggcttgacactggcagcgctcgtgcaatgcttcgactgggatgtcggtgaatctggtgctgttgacatgactgaaggtgccgggctgtcaatgccgatgaccaagccattggcagcaatctgtcgtcccagggagattgtcaagagtgtgttatctgcttcaacatgaattgccgaatgcaggtttctgaagagtaaacagaattgggtcacaatgaacttaagctattcagttacctatgtggaagaatacttgcagctagatgtgcatgatcaacgttgtagattattccatctccactatgcatttgttcatgaagtgaaactgaatgaagatacaaaagggcgagacaagggaaatttgatggtttcatgatatattgttggtggaatgtgtgcaaagaaaagcaatagaagaacattccaacaggtgaactgcaaccaagacaatttgctttcttgagcaaagcagatgttgatcaatatcaactggcctttaatagtcgcgacatcaacaatgaattgaagctctctccagcttgtgacatggttcaaggcaggatgtttcttcttcatctgcagtgggttgcggttgcgggtgatcttagttgagtccttgtttccttgttgcttcggttcctctgttagccctttggctgttgccgtatgcaggtgtttcagctgctgtattgtttggttgctggctgttctttattcttggttttctgggcctccttttaac

SEQ ID NO: 2991 - DNA, 2825 bp, Sorghum bicolor
aaaactttaacatcatgttgctctcgaccaaatataacacacatacacagacatatagtcataggtgtagcgattggtatttcgcctttgaaagttggccctagtcatgactaaatcctgggtccgccactggattcgaagaaaacaactaaacaagagaaaaggtgccggatttcgtaaatgctgatagagacgacgtgttccttgtcccttttttcctcacctacctccccctcccaggtacggcgccaccctcgggccgtcggcggccacggcgccaccgccacgaccctggtgtagtctgttgcatacgtggcgcctgcaaaagcctcgctgctgccagccatggatgcagtggccagcgacgccgtactcttcctccttgccgtcactatctccctgctcatcaccactgccactgtctggaacaggcgtcgtgaggggcacgacgatggcgcgccaagcccgccgtcgctaccgctgctcggccacctccacctgctcagcaagccgctacaccactcgctggccgcgctcgccgccgcgcacggcactgggactgggtccggggccacggccaccccggcgccgctcctgtcgctgcgcctgggcgcgcggcgcgcgctgctggtgtccgggcacgccgcggccgaggagtgcttcacggcgcacgacgccgcgctggcgggcaggccgcggctgctggtcggcgacaggctcaactacgggtacaccacggtggggtggtcctcccacggcgaccactggcgcgccctccgccggttcctcgccgtcgagctcttcacggcgtcccgcctcgccgcgcgcgccgccgaccgccgcgccgaggtcgccgcgctcgtcgccaccctgctccgtgacgccgccgccgacgccgccgcggtgacgctccggcccaggctcttcgagctggtgctgaacgtgatgctgcgcgcgctcaccggcgcgccgccgcccgggcacggcggcggcgacgtgcgcggtctccaggagatcatagaggagaccttcgcggtgaccggcgtcatgagcgtcggggactactacccggcgctgcggtggatcgaccgtctgcgcggggtcgatgccgctctgatccgtctccaggcgagacgcgacgcgttcgtcgccggcctcgttcacgacaaacgccaaagtcgcacagccggtggccgagacgcggagaagaagagcaccattgatgagctcctgtcgctgcaagaaactgatcctgagtactacactgacactgtcatcaaaggcatcgtctcgatactgctcagtgccggcacagacacatcggcactgacccttgagtgggcaatggcgcagctgctgacgcacccggaagcgatgctgaaggcgagagctgagattgacgccaacgtcggcagatcccggctggtggaggagtcagatatgacgaacctcccatatctgcaatgtgtgatcaaggagactctccggctctgtcctgtcggcccggtaatcccagcgcatgaagctatggaggactgcagcgtcggtgggttccatgtccggcgcggcaccatgatcctcgtgaacgcttgggtgatccatcgggaccccaaattgtgggaggcgcctgaggtgttcaggccggagcggttcttggacactgccatggtgaccatggtcaccgcaccgttgctgccgttcgggcttggacggagacgctgccctggggaggggatggcaatgcgtctcatgggcttgacactggcagcgctcgtgcaatgcttcgactgggatgtcggtgaatctggtgctgttgacatgactgaaggtgccgggctgtcaatgccgatgaccaagccattggcagcaatctgtcgtcccagggagattgtcaagagtgtgttatctgcttcaacatgaattgccgaatgcaggtttctgaagagtaaacagaattgggtcacaatgaacttaagctattcagttacctatgtggaagaatacttgcagctagatgtgcatgatcaacgttgtagattattccatctccactatgcatttgttcatgaagtgaaactgaatgaagatacaaaagggcgagacaagggaaatttgatggtttcatgatatattgttggtggaatgtgtgcaaagaaaagcaatagaagaacattccaacaggtgaactgcaaccaagacaatttgctttcttgagcaaagcagatgttgatcaatatcaactggcctttaatagtcgcgacatcaacaatgaattgaagctctctccagcttgtgacatggttcaaggcaggatgtttcttcttcatctgcagtgggttgcggttgcgggtgatcttagttgagtccttgtttccttgttgcttcggttcctctgttagccctttggctgttgccgtatgcaggtgtttcagctgctgtattgtttggttgctggctgttctttattcttggttttctgggcctccttttaacattttgggatgtacatgttgttctctcttctaataataatataacacggcaaatcacttgccgtattttcaaaatacatgaaaatttgtgcagtggcttcacagaacaaaccgcctgaaaaaatgccagttggaattagcgatgatgtatgcccgctgaaactggtttcagatctcaaaccagcagtgccctctgatcagagattgaatcatttaggaatgcctctgcatttctgatggttcaaattagctttctgattcagagatccatttgatggttaacccttctttcttctgacaatctgaaaaattaatattagctgtctgattcag

SEQ ID NO: 2992 - DNA, 1470 bp, Saccharum officinarum
cgcccaaacagtgacgactagacggatcaatcggtacaccgtttctcttcctgcttgctactcgcagcgcagccgcacactgccaccaccatcccatcccaccaccttttaaaagcccccaccacatcctgcgctgcacgcgaagctcgcctagctcagctctgttcagctcgcggtggaagaggaggcgacagcacacgagagggagcagaagcgcgcgaggaggtcaggcagccacgcgcccacgcccagcagcagcagcaccgcgcgagatggcgtgcatcaacatgtacaacccagacggcgcggcggggttcggcgccggcccgcaggcgccggccgcgctgggcccgcgcatctccttctccagcgacttcgcggtggagccgccgccgccggtgcagaaccgggcgatgagcctgcggtgccaggaggaggacctcaacttcgagttctcggtggggagccaccccatgatggcggccgaccagctcttctccaagggcaggatccttcccctcaaggacaacggcggcgccagctgcttcgctaacgcggcccggccgcccaccacgctgcgagacgagctccgtggcggcggcgacgacgagagggcctcggcctccgccagcagcaaggggtcgtcgtccagccggtggaaggagatgctcggcctgcggaaggcgctctgcgtcggcggcggcggcaacggaccggcggccaagaaggctagcagtagcgacaagcagggcgtcgccgccgacattatggtcaccgacgacgacatggccgcgtccaatcagcatcaggagctatgatgatgaggtgaccgtactaccgatgggagagacgagacaggcatgggggcacaaagccactccacatgcatgaagcaattatttttgtcctccctccttcagggtgatgctgttgatcgatcaacctcttgaatcgtgcttgtccatgggctataggttttgtagattgttgtgagcgatcgagtctgcttattgtgtgctaggtggcccggccggcccgttgaaaagatcccaaaaaaaaagtgtgtattttcactctctctagcaaactgtccactcactagcagatccatggccagtcttgcttcttttcttcctttctttctttcacttgttctcggctttctcctcctaaactccaccctgtacaaagtggctgtgtagtcgtcgtagatgggaaatttatggtgcaatgattagatttgccaggtggccagatctgtgaggtgcagtgatggagcctcactggccgcccctgtccctgtggggatcaacagtgctcttctttgtctcgttgctccgctggatgagtatataaagacagacaagagcctcagagcgagcatgtgtgaggcggcagcgagagctagtggaggaaggattccgctgccccagtccccgccccgtggcctgcaggcctgcataatcatca

SEQ ID NO: 2993 - DNA, 1968 bp, Sorghum bicolor
gcgcagagtgagtgctgctgcaggccgaccagtctcctccccgcccgcttcccaccgagctcacactgcacactcccactcccactcccactccccgctgcaggttcacgggaggcgaggtccctgcgcccctgcattcttcccgtattcgcggaccggtcctcgccgcgggagggcgagccgccagaagtgcgttcctgcgatttcggagagagtggagggggcgagtagaaaagaagaggcgttgctatctccttgctgactgctgagctagtgagctgaactgagctgagctgtggaagcacagcggcgccgcggcggtgtggcgactggggaagagcatggcgagggcgcgcggtggcgccgcgtgggtgctgctggcggcggcgtgggtgctgtgggcggcggcggcggcggaggccaggtcgccgtccgggaggagggtgcaccggcacctcaagcgcctcaacaagccggccgtcaagagcatcgagagtccagatggagacatcatcgactgcgtgcatatctcccaccagccagcctttgatcatcctctcctcaagaaccacacaatacagtttaggccggcgtaccaccctgaaggtctatacgaagatgccaagagcagcataggctcaaacaatgccggtgagaagccgatgctccagatgtggcatcgaaatggcaggtgtccggagggcacggtcccaatcaggagaaccaagaaggatgacctgctccgagctagctccatgaggcggtatggcaggaagcggcatactgctccaaacccgctgtctgttgatcctaacatgctcagtgagggtggtcaccaacacgccatagcgtacgttgagggtgataagtactatggtgcaaaggccaccattaatgtgtgggagcccaagattcagcaggctaacgaatttagcctgtcccagctctggatcttggggggttcatttggggaggatctcaacagcatagaggctggttggcaggttagccctgacctctatggtgacaacaacaccaggttgttcacatactggactagtgatgcataccaggccacagggtgctacaacatgttgtgctccggtttcattcagataaacagcgagatcgccatgggggctagcattttccccatctcgaactacgcaggctcccaatatgatatcagcatcctgatctggaaggaccccaaggaaggcaactggtggatgcagtttggcaaggaatacgtcctgggctactggccatccttcctcttctcctacctcgccgacagcgcatcaatgatcgaatggggcggggaggtggtgaactcggagcccgacggcacgcacacgtcgacgcagatgggcagtgggcacttccccgaggaagggttcggcaaggcgagctacttcaagaacattcaggtggtggacagcagcaaccagctcagcgcccccaagggcgtgggcaccttcaccgagcaatccaactgctacgacgtgcagaacggcaacaatggcgattggggcacctatttctactatggcggccccggcaagaactcgaattgcccatgactgatgcttctagtgtgcagtgtgaagtgctttcaccatgaacagaaatgtaaccaagcattcaggttcgctatacagcgtcagcctgcatctccttgttcagtcagtcctaggtagttgtaacatgtgcatgtgatttctagatcttggtgtttttttcttcttttttgctgttgtattttcttcttcatttgccatgtaaagtttctgaagagaagaagcatggcttgaggctgcagtggtggtttggctggtcagtggtgacctttacggattttttgcaagtctgctaattggtcaccttcgccagttattttgaaagtgtgctatagcagcttattggttgatgggtgatgataatgatattgagtttattggttattgc

SEQ ID NO: 2994 - DNA, 2037 bp, Sorghum bicolor
gtttcgtcaatggaacaaaacaaaagctcggaaacggcaaaagccatggcgagaagcgcagagtgagtgctgctgcaggccgaccagtctcctccccgcccgcttcccaccgagctcacactgcacactcccactcccactcccactccccgctgcaggttcacgggaggcgaggtccctgcgcccctgcattcttcccgtattcgcggaccggtcctcgccgcgggagggcgagccgccagaagtgcgttcctgcgatttcggagagagtggagggggcgagtagaaaagaagaggcgttgctatctccttgctgactgctgagctagtgagctgaactgagctgagctgtggaagcacagcggcgccgcggcggtgtggcgactggggaagagcatggcgagggcgcgcggtggcgccgcgtgggtgctgctggcggcggcgtgggtgctgtgggcggcggcggcggcggaggccaggtcgccgtccgggaggagggtgcaccggcacctcaagcgcctcaacaagccggccgtcaagagcatcgagagtccagatggagacatcatcgactgcgtgcatatctcccaccagccagcctttgatcatcctctcctcaagaaccacacaatacagtttaggccggcgtaccaccctgaaggtctatacgaagatgccaagagcagcataggctcaaacaatgccggtgagaagccgatgctccagatgtggcatcgaaatggcaggtgtccggagggcacggtcccaatcaggagaaccaagaaggatgacctgctccgagctagctccatgaggcggtatggcaggaagcggcatactgctccaaacccgctgtctgttgatcctaacatgctcagtgagggtggtcaccaacacgccatagcgtacgttgagggtgataagtactatggtgcaaaggccaccattaatgtgtgggagcccaagattcagcaggctaacgaatttagcctgtcccagctctggatcttggggggttcatttggggaggatctcaacagcatagaggctggttggcaggttagccctgacctctatggtgacaacaacaccaggttgttcacatactggactagtgatgcataccaggccacagggtgctacaacatgttgtgctccggtttcattcagataaacagcgagatcgccatgggggctagcattttccccatctcgaactacgcaggctcccaatatgatatcagcatcctgatctggaaggaccccaaggaaggcaactggtggatgcagtttggcaaggaatacgtcctgggctactggccatccttcctcttctcctacctcgccgacagcgcatcaatgatcgaatggggcggggaggtggtgaactcggagcccgacggcacgcacacgtcgacgcagatgggcagtgggcacttccccgaggaagggttcggcaaggcgagctacttcaagaacattcaggtggtggacagcagcaaccagctcagcgcccccaagggcgtgggcaccttcaccgagcaatccaactgctacgacgtgcagaacggcaacaatggcgattggggcacctatttctactatggcggccccggcaagaactcgaattgcccatgactgatgcttctagtgtgcagtgtgaagtgctttcaccatgaacagaaatgtaaccaagcattcaggttcgctatacagcgtcagcctgcatctccttgttcagtcagtcctaggtagttgtaacatgtgcatgtgatttctagatcttggtgtttttttcttcttttttgctgttgtattttcttcttcatttgccatgtaaagtttctgaagagaagaagcatggcttgaggctgcagtggtggtttggctggtcagtggtgacctttacggattttttgcaagtctgctaattggtcaccttcgccagttattttgaaagtgtgctatagcagcttattggttgatgggtgatgataatgatattgagtttattggttattgcatccagtactctac

SEQ ID NO: 2995 - DNA, 1672 bp, Saccharum officinarum
gctgaggggcggaagcacagcggcgccgcggcggtgtggcgactggcgactggcgaagcgcatggcgagggcgcgcggtggcgccgcgtgggtgctgctggcggcggcgtgggtgctgtgggcggcggcggcggcggaggccaggtcgacgccggggaggagggtgcaccggcacctcaagcgcctcaacaagccggccgtcaagagcatcgagagcccagatggagacatcatcgactgcgtgcatatctcccaccagccagcttttgatcatcctctcctcaagaaccacacaatacagtttaggccagcgtaccaccctgaaggtctatacgatgatgccaagagcagcataggctcaaacaatgccggtgagaagccgatgctccagatgtggcatcgaaatggcaggtgtccggagggcacggtcccaatcaggagaaccaagaaggatgacctgctccgagccagctccatgaggcggtatggcaggaagcggcacactgctccgaacccgttgtctgtcgatcctaacatgctcagtgagggtggtcaccaacacgccatagcgtacgtcgagggtgataagtactatggcgcaaaggctaccattaatgtgtgggagcccaagattcagcaggttaacgaatttagcctgtcccagctctggatcttggggggttcatttggggaggatctcaacagcatagaggctggctggcaggttagccctgacctctatggagacaacaacactagattgttcacatactggactagtgatgcataccaggcgacagggtgctacaacatgttgtgctctggtttcattcagatcaacagcgagatcgccatgggggctagcattttccccatctcgaactacgcaggctcccaatatgatatcagcatcctgatctggaaggaccccaaggaaggcaactggtggatgcagtttggcaaggaatacgtcctcggttactggccatccttcctcttctcctacctcgccgacagcgcatcgatgatcgaatggggtggggaggtggtgaactcggagcccgacggcacgcacacgtcgacgcagatgggcagcgggcacttcccggaggaagggttcggcaaggcgagctacttcaagaacattcaggtggtggacagcagcaaccagctcagcgcccccaagggcgtgggcaccttcaccgagcagtcgaactgctacgacgtgcagaacggtaacaatggcgactggggcacctacttctactacggtggccctggcaagaactcgaattgcccgtgactgctgcttctagtgtgtagcgtgaagtgctgttgtcaccgtgaaaaaaatgtaaccaagcgttcaggttctgctatacagtgtcaatatgcatgtccttgttcagtcagtcctaggtagtagtaacatgtgcatgtgctctctagaccctagtgttttcttcttgttctttttgttgtattttcttcctcatttgccatgtaaagtttctgaagagaagaagcatggcttgaggctgcggtggtggttgggctggtcagtggtgagctttacggatttttgcaagtctgcttattggtcaccttcggcagttgttttgagagtgtgctataggccctattggctgatggtaatgatattgagcttatt

SEQ ID NO: 2996 - DNA, 1610 bp, Panicum virgatum
gcgtggctgagctgagcggtgggactgtgagagggaggaagtgtgccgcggctgcgagtggtgggggaagcgcatggcgagggcgcgcggcggcggcctcgccgcgtgggcggtggccgtggcggcggcgtgggtgctgtgggcggcggcggcggcgggggccaggtcgccggcggggagggcgcaccggcacctcaagcggctcaacaagccggccgtgaagagcatcgagagcccagatggagacatcatcgactgcgtgcatatctcccaccaaccagccttcgaccatcctctcctcaagaaccatacaatacagtttaggccagcctaccaccccgaaggtctatatgatgatgccaagagcagcataggctccgacagtgccggcgagaagccgatgctccagatgtggcatcggaatggcagatgtccggcgggcacggttccaatcaggagaaccaagaaggatgacctgctccgagccagctccatgaggcggtatggcaggaagcgtcatactgttccaaacccactgtctgttgatcctaacatgctcagtgagggtggtcaccaacacgcgatagcgtatgtccaaggtgataagtactatggtgcaaaggctaccattaatgtgtgggagcccaagattcagcaggctaacgagtttagtctgtcccagctctggatcttggggggttcatttggggaggatctcaacagcatagaggctggttggcaggttagccctgacctctatggagacaacaacactaggttgttcacatactggactagtgatgcatatcaggcaacagggtgctataacatgttgtgctcaggattcattcagatcaacagtgagatcgccatgggggcgagcatcttccccatctcgaactacgcgggctcccagtatgatatcagcatcctgatctggaaggacccaaaggaaggcaactggtggatgcagtttggcaaggagtatgtcttaggctactggccgtccttcctcttctcctacctcgccgacagcgcatcgatgattgagtggggtggtgaggtggtgaattcagagccggatggcacgcacacgtcgacgcagatgggcagcgggcacttccccgaggaagggttcagcaaggcaagctacttcaagaacattcaggtggtggacagcagcaaccagctgagcgccccaaagggggtgggtaccttcactgagcagtccaactgctacgacgtgcagaacggtaacaatggtgactggggcacctatttctactacggtggccctggcaagaattcaaattgcccatgactactttctagtgtgtagtagaagtgctgtcaccatggaaaaaatgtaaccaagcattcaagtgtgcaatacagctttgatctgcatcttattcagtcctaggtagtgtgtaacatgtgtatgtgctctagagcctagagttttttttcttcctcttttcatatatttttttccatgtgccatgtaaagtttctgaagagaagaagcatggcttgaggtggtggtgctgggctggtgagtgacctctacggatttttgcaagtctgcttattggtcatcttgcccaagt

SEQ ID NO: 2997 - DNA, 1989 bp, Setaria italica
gtttcgtccatgcacccaaaattgaagctcggaaacggcaaaagccatggcgagtagcgcaggcttgcaggccgaccagtctctcctccgcccgcttcccaccgagctcgccactgcacactcccccactcggccactacccagcagtagcagcagccttgcgagctcacgggaggccgcgaggccccctgcaccccctgcattctccccgtattcgcggatcgcccctcgccgcagcaggcgtgtgggggcatttctgttagggaaaagggcgctcttgaatttttcgagagaggggagggggcgagaggaaaaagaaggcgccgttgctgtcttcactttgctgggcgtggctgagctgagcgcctgagcggtgggaggagacagcgtgctgcggccgcgagtgtggggagcgcatggcgagggcgcgcggcggcggccccgcgtcgtgggtggtggctgttgcggcggcgtgggtgctgtggatggccacggcggcggaggccaggtcgccggcggggagggtgcaccggcacctcaagcggctcaacaagccggccgtcaagagcatcgagagcccagatggagacatcatcgactgcgtgcccatctcccaccaaccagccttcgaccatcctctcctcaagaaccacacaatacagtttaggccggcctaccaccctgaaggtctatatgatgatgtcaagagcagcataggctcgaacaatgccagagagaagccaatgctccaaatgtggcatcgaaatggcagatgtccagagggcacggttccaatcaggagaaccaagaaggatgacctgctccgagcgagctccatgaagcgctatggcaggaagcggcatactgctccgaacccactgtctgttgatcctaacatgctcagtgagggtggtcaccaacacgcgatagcgtacgttgagggtgacaagtactacggtgcgaaggccacaattaatgtgtgggagcccaagattcagcaggctaacgaatttagcctgtcccagctctggatcttggggggttcatttggggaggatctcaacagcatagaggctggttggcaggttagccctgacctctatggagacaacaacactaggctgttcacatactggactagcgatgcataccaggcaacagggtgctacaacatcttgtgctcggggttcattcagatcaacagcgagatcgccatgggggcgagcatcttccccatctcgaactacgctggctcccagtacgatatcagcatcctgatctggaaggacccaaaggaaggcaactggtggatgcagtttggcaaggagtatgtcctcggctactggccatccttcctcttctcctaccttgccgacagtgcttcgatgatcgagtggggtggtgaggtggtgaactcggagcctgatggtgcgcacacaacgacccagatgggcagcgggcacttccccgaggaagggttcagcaaggcgagctacttcaagaacattcaggtggtggacagcagcaaccagctgagtgccccaaagggggtgggcaccttcaccgagcagtccaactgctatgacgttcagaacggtaacaatggcgactggggcacctatttctactacggtggccctggcaagaattcaaattgcccatgactacttctagtgtgtagtgtgagtgctgtcaccatgaaaaaaatgtaaccaagcattcaagtgtgcaatacagcgttgatctgcatcttgttccctcctaggtagtgtgtaacatgtgcatgtgccttagaccctagtgatttttttttccatcttttttttctcccatgtgccatgtaaagtttctgaagagaagaagcatgggctggtgagtgacctctcggattttgcactgtcaccttcaccaagtattttgaatgtgtgctatatagcttattggctgatggtaatggtattgagcttattgcatccagtaccctacacc

SEQ ID NO: 2998 - DNA, 1672 bp, Setaria italica
tcggccactacccagcagtagcagcagccttgcgagctcacgggaggccgcgaggccccctgcaccccctgcattctccccgtattcgcggatcgcccctcgccgcagcaggcgtgtgggggcatttctgttagggaaaagggcgctcttgaatttttcgagagaggggagggggcgagaggaaaaagaaggcgccgttgctgtcttcactttgctgggcgtggctgagctgagcgcctgagcggtgggaggagacagcgtgctgcggccgcgagtgtggggagcgcatggcgagggcgcgcggcggcggccccgcgtcgtgggtggtggctgttgcggcggcgtgggtgctgtggatggccacggcggcggaggccaggtcgccggcggggagggtgcaccggcacctcaagcggctcaacaagccggccgtcaagagcatcgagagcccagatggagacatcatcgactgcgtgcccatctcccaccaaccagccttcgaccatcctctcctcaagaaccacacaatacagtttaggccggcctaccaccctgaaggtctatatgatgatgtcaagagcagcataggctcgaacaatgccagagagaagccaatgctccaaatgtggcatcgaaatggcagatgtccagagggcacggttccaatcaggagaaccaagaaggatgacctgctccgagcgagctccatgaagcgctatggcaggaagcggcatactgctccgaacccactgtctgttgatcctaacatgctcagtgagggtggtcaccaacacgcgatagcgtacgttgagggtgacaagtactacggtgcgaaggccacaattaatgtgtgggagcccaagattcagcaggctaacgaatttagcctgtcccagctctggatcttggggggttcatttggggaggatctcaacagcatagaggctggttggcaggttagccctgacctctatggagacaacaacactaggctgttcacatactggactagcgatgcataccaggcaacagggtgctacaacatcttgtgctcggggttcattcagatcaacagcgagatcgccatgggggcgagcatcttccccatctcgaactacgctggctcccagtacgatatcagcatcctgatctggaaggacccaaaggaaggcaactggtggatgcagtttggcaaggagtatgtcctcggctactggccatccttcctcttctcctaccttgccgacagtgcttcgatgatcgagtggggtggtgaggtggtgaactcggagcctgatggtgcgcacacaacgacccagatgggcagcgggcacttccccgaggaagggttcagcaaggcgagctacttcaagaacattcaggtggtggacagcagcaaccagctgagtgccccaaagggggtgggcaccttcaccgagcagtccaactgctatgacgttcagaacggtaacaatggcgactggggcacctatttctactacggtggccctggcaagaattcaaattgcccatgactacttctagtgtgtagtgtgagtgctgtcaccatgaaaaaaatgtaaccaagcattcaagtgtgcaatacagcgttgatctgcatcttgttccctcctaggtagtgtgtaacatgtgcatgtgccttagaccctag

SEQ ID NO: 2999 - DNA, 1652 bp, Pennisetum glaucum
gagcggtgggaggagccacagttgctgtcttctcgttgctgtcttctctttgctgggcgagaggaaaaaggaggcgccgttgctgtcttctctttgctgggcgtggctgaggtgaggtggtgagcgcctgagcggtgggaggaggcagtgtgctgcggccgcgagcgtgggggagcgcatggcgatggcgcgcggcggcggcagccccgcggcgtgggtggtggcggtgtgggtgctgtgggcggccgcggcggcggaggccaggtcgccggcggggagggtgcaccggcacctcaagcggctcaacaagccggctgtcaagagcatcgagagcccagatggagacatcatcgactgcgttcatatctcccaccaaccagccttcgaccatcctctcctcaagaaccacacaatacagtttaggccggcctaccaccctgaaggtctgtatgatgatgtcaagagcagcataggctcgaacaatgctggtgacaagccgatgctccaaatgtggcatcgaaatggcaggtgtccagcgggcacggttccaatcaggagaaccaagaaggatgacctgctccgagctagctccatgaggcgctatggcaggaagcggcatactgctccgaacccactgtctgttgatcctaacatgctcagtgagggtggtcaccaacacgcaatagcgtacgttgagggtgacaagtactacggtgcgaaggccaccattaatgtgtgggagcccaagattcagcaggctaacgaatttagcctgtcccagctctggatcttggggggttcatttggggaggatctcaacagcattgaggctggttggcaggttagcccggacctctatggagacaacaacactaggctgttcacatactggactagcgatgcataccaggcaacagggtgctacaacatcttgtgctcggggttcattcagatcaacagcgagattgccatgggggcgagcattttccccatctcgaactacgctggctcccagtatgatatcagcatcttgatctggaaggacccaaaggaaggcaactggtggatgcagtttggcaaggagtacgtcctcggctactggccatccttcctcttctcctaccttgccgacagcgcttcgatgattgagtggggtggtgaggtggtgaactcacagcctggtggtgcgcacacatcaacgcaaatgggcagcggacacttccccgaggaagggttcagcaaggcgagctacttcaagaacattcaggtggtggacagcagcaaccagctgagtgccccaaagggggtgggcactttcacggagcagtccaactgctatgacgttcagaacggtaacaatggcgactggggcacctatttctactatggtggccctggcaagaattcaaattgcccatgactactttcaggtgtgtagtgagtactgtcaccatgcaaaaaatgtaacccaagcattcaaatgtgcaatacagcattgatctgcatcttgttccctcctaggtagtgtgtaacatgtgtatgtgaattagaccctagtgttttttctttctttttcatcttttttcttctctcccatgtgccatgtaaagtttctgaagagaagaagcatggcttgaggtggtggtgctggg

SEQ ID NO: 3000 - DNA, 1628 bp, Brachypodium distachyon
cgctcatggcggcggcgcgcggtgggctggcgcggttgctggcagcggcggctgtctgcgttctgtgggcggccgccgcggaggctaggtcgccggcggcgagggtgcaccggcacctgaagcggctcaacaagccggccgttaagagcatcgagagcccagactgggacatcatcgactgcgtgcacatctcacatcaaccggccttcgatcaccctctcctcaagaatcacactctccagttgagaccggccttccacccagaaggcttgtatgatgatactaagagcagcctggcctcaggcgaagctggtgagaagccgatgctccagctgtggcatcagaatgggagatgccaggagggcacggtcccaatcaggagaactaagaaggatgacctgctccgggcgagctcgatgcggcggtatggcaggaaacagcatacaaccccgaacccgttgtccgtggatcttagcatgctcaacgagggtggccaccaacatgcaatagcgtacgtcgagggggaaaagtactatggtgcgagggccaccattaatgtctgggagcccaaaatccagcagccaaacgagttcagtttatcccagctatggatcctggggggatcattcggagcggatctgaacagcatcgaggctgggtggcaggttagcccagacctctacggagacaataacactaggctcttcacatactggaccagtgatgcataccaagcaacagggtgctacaacatactgtgctcagggttcattcagatcaacagcgagatcgcaatgggggcgagcatcttcccgatctcgaacctagctggttcccagtatgatatcagtattcttatctggaaggacccaaaagaagggaactggtggatgcagttcggcaaggaatatgtcctcggctactggccatccttcctcttctcctacctcgctgacagcgcgtcgatgatcgagtggggcggggaggtagtgaactcagagcccaacggcgcgcacacgtcgacgcagatgggcagcgggcggtttccagaggaagggttcggtaaggcgagctacttcaagaacatccaggtggtggacagcaccaaccagctcaaggcccccaagggggtcggcacgttcaccgagcagtccaattgttacgatgtgcaggacggcaacaatggcgactggggcacatacttctactatggtggccctggcaaaaactcgaactgcccatgacctgttaactgctatcagcatgagcagatttcatgtgaccaaccattcatgtgtgcaatatagcttctacttctcctttagccctaactaggtagtttgtaacatgtgcatgtgtgatgtcctagtgttctcattttcgccccttatcttcctctctaatatgccatgtaagtttctgaagagaagcatggcgttgggtggtgagtctgaaatgcagttagccaattatccgtagccggatcccaggattatctaccactcgtgttgattttagactccattataagaacgggattcaagagaggttgacatggcagccctgagataaatttgttgaaaatatgggctattgatgcagaaattgcaattaatagcaggttgtcc

SEQ ID NO: 3001 - DNA, 2123 bp, Brachypodium distachyon
gtcagtgtggcaccggtcggcactgatacacggcccaataattcaggaatcatggaagcaacacaagggcaatacggtccagaaatccaaaattaaagctcggaaatggcaaaagccatggcaggcaggcaggcagcagcgaccagtctcatcccacttcccacttcccacttcccagtgagctcactgtacgctccccattggctctagcagcagcggcatccaattccgaggaaagcgaagccgcgcagactccaccagcattgtcgctgtattctcacagcagccctcgccgtggctgccctggaccttcctgcgcgagagaagggcgttcttgcgatttaggttcaggaggaagtgggtaagaggaaaagaagaaggaggctgggagcttcagagcttcagagcttgggcctaaggcgtaggcgctcatggcggcggcgcgcggtgggctggcgcggttgctggcagcggcggctgtctgcgttctgtgggcggccgccgcggaggctaggtcgccggcggcgagggtgcaccggcacctgaagcggctcaacaagccggccgttaagagcatcgagagcccagactgggacatcatcgactgcgtgcacatctcacatcaaccggccttcgatcaccctctcctcaagaatcacactctccagttgagaccggccttccacccagaaggcttgtatgatgatactaagagcagcctggcctcaggcgaagctggtgagaagccgatgctccagctgtggcatcagaatgggagatgccaggagggcacggtcccaatcaggagaactaagaaggatgacctgctccgggcgagctcgatgcggcggtatggcaggaaacagcatacaaccccgaacccgttgtccgtggatcttagcatgctcaacgagggtggccaccaacatgcaatagcgtacgtcgagggggaaaagtactatggtgcgagggccaccattaatgtctgggagcccaaaatccagcagccaaacgagttcagtttatcccagctatggatcctggggggatcattcggagcggatctgaacagcatcgaggctgggtggcaggttagcccagacctctacggagacaataacactaggctcttcacatactggaccagtgatgcataccaagcaacagggtgctacaacatactgtgctcagggttcattcagatcaacagcgagatcgcaatgggggcgagcatcttcccgatctcgaacctagctggttcccagtatgatatcagtattcttatctggaaggacccaaaagaagggaactggtggatgcagttcggcaaggaatatgtcctcggctactggccatccttcctcttctcctacctcgctgacagcgcgtcgatgatcgagtggggcggggaggtagtgaactcagagcccaacggcgcgcacacgtcgacgcagatgggcagcgggcggtttccagaggaagggttcggtaaggcgagctacttcaagaacatccaggtggtggacagcaccaaccagctcaaggcccccaagggggtcggcacgttcaccgagcagtccaattgttacgatgtgcaggacggcaacaatggcgactggggcacatacttctactatggtggccctggcaaaaactcgaactgcccatgacctgttaactgctatcagcatgagcagatttcatgtgaccaaccattcatgtgtgcaatatagcttctacttctcctttagccctaactaggtagtttgtaacatgtgcatgtgtgatgtcctagtgttctcattttcgccccttatcttcctctctaatatgccatgtaagtttctgaagagaagcatggcgttgggtggtgagtctgaaatgcagttagccaattatccgtagccggatcccaggattatctaccactcgtgttgattttagactccattataagaacgggattcaagagaggttgacatggcagccctgagataaatttgttgaaaatatgggctattgatgcagaaattgcaattaatagcaggttgtccaatactacagcagcattttgttcccggaatgtctgggagaaaataaaataaaatgtaccctgaaataac

SEQ ID NO: 3002 - DNA, 2175 bp, Oryza sativa
cttaaataattaacgaaaatcatcgaggtaggcgagggcagtttggtcagaacacacacaaaaaaaaaagttaaagctcggaaacggcaaaagctatggcgaccgaccggtcacttcccactccccagttcccagtgaacagagcaggagcagcctccactcctcctctgccactccactccccaccaccactcgcatcaccatccatccatccatctccaacccaagccgaatcacaccaatcgccatcgccatcgccatcgccgtgcgtggtcgccggtgccggcggcggagggggagggggaccaagggaaaagagagaaggtgagctgagctgagctgaggtgaagtggtgctgaggcgagtgactggggggcaatggcagcggcgtgggtgctggccgcggcggcggcgttggcgctgtgggcggcggcggcggagggggcaaggtcgccggcggcgagggtgcaccggcacctcaagaggctcaacaagccggccgtcaagagcatcgagagcccagatggagacatcatcgactgcgtgcatctctctcaccaaccagcatttgatcatcccctactcaagaaccatactctccagatgaggccggcctaccaccctgaaggcttgtatgatgatgacaagagaagcgtggcctctgacaatgccggcgagaagccgatgctccagctatggcatcaaaaggggaggtgcccggagggcaccgtcccgatcaggagaacgaagaaggatgatctgctcagagcgagctcgttgcggcggtatggcaggaaacggcataccgccgtgaacccgctgtccattgatcccaacatgctcaatgagggtggtcaccaacatgccatagcgtatgtggagggggataagtactatggtgccaaggccaccattaatgtgtgggagcccaagattcagcagcctaacgagttcagcctgtcccagctctggatcttggggggttcatttggtgaggatctcaacagcatcgaggccgggtggcaggtcagcccagacctctatggagataataacactaggctgttcacatactggactagtgatgcttaccaagcaacagggtgctacaacatattgtgctccggattcattcagatcaacagcgagatcgccatgggcgcgagcatcttccccatctcgaacatcgccggctcacagtatgatatcagtattctgatctggaaggacccaaaggaaggaaactggtggatgcagttcggcagggagtatgtcctcggctactggccgtccttcctcttctcctacctcgtcgacagtgcgtcgatggtcgagtggggcggggaggtggtgaactcggagcccgacggcacgcacacgtcgacgcagatggggagcgggcggttcccggaggaagggttcggcaaggcgagctacttcaagaacatccaggtggtggacagcagcaaccagctgaaggcccccaagggggtgggcacctacaccgagcagtccaattgctacgatgttcagaacggcaacaatggcgactggggcacctacttctactatggcggcccggggaagaactcgaattgcccatgaatttggtgatgaagaagctgatgatatatatatatttatatatatatatataatatatggtgaagtgtgcaagtgtaaccaagcattaatcatgtgtggaatacagattgatctgcatctgtttcttaatttagccctaggtagtatatgtgtatctttcctactgattttctttttcttctcttcattagttttttcttcttctttttctgatgtgccatgtaaaagtttctgaagagaagcatggcgtgaggtggtggtgcaggggtgatgatgacaattgatttgtgggtaatttgcaagtcaaacggcttgtgatcagtactacaaatttattagctgttgtgttagctgataaaatgacttggtagtagacagtagttctgtagaaacgtgagaaaatttgacagattcgaaatacaaattcaaagcaacgaggaagggagctgggctagactgtcagaaatccaatgtacacgaagagaaaataataaattcttgaggtggcctaccttctcggggaacatgtttgttctcagaagagtgttggtagctgagaaactctgaatc

SEQ ID NO: 3003 - DNA, 1845 bp, Oryza sativa
gcgaccgaccggtcacttcccactccccagttcccagtgaacagagcaggagcagcctccactcctcctctgccactccactccccaccaccactcgcatcaccatccatccatccatctccaacccaagccgaatcacaccaatcgccatcgccatcgccatcgccgtgcgtggtcgccggtgccggcggcggagggggagggggaccaagggaaaagagagaaggtgagctgagctgagctgaggtgaagtggtgctgaggcgagtgactggggggcaatggcagcggcgtgggtgctggccgcggcggcggcgttggcgctgtgggcggcggcggcggagggggcaaggtcgccggcggcgagggtgcaccggcacctcaagaggctcaacaagccggccgtcaagagcatcgagagcccagatggagacatcatcgactgcgtgcatctctctcaccaaccagcatttgatcatcccctactcaagaaccatactctccagatgaggccggcctaccaccctgaaggcttgtatgatgatgacaagagaagcgtggcctctgacaatgccggcgagaagccgatgctccagctatggcatcaaaaggggaggtgcccggagggcaccgtcccgatcaggagaacgaagaaggatgatctgctcagagcgagctcgttgcggcggtatggcaggaaacggcataccgccgtgaacccgctgtccattgatcccaacatgctcaatgagggtggtcaccaacatgccatagcgtatgtggagggggataagtactatggtgccaaggccaccattaatgtgtgggagcccaagattcagcagcctaacgagttcagcctgtcccagctctggatcttggggggttcatttggtgaggatctcaacagcatcgaggccgggtggcaggtcagcccagacctctatggagataataacactaggctgttcacatactggactagtgatgcttaccaagcaacagggtgctacaacatattgtgctccggattcattcagatcaacagcgagatcgccatgggcgcgagcatcttccccatctcgaacatcgccggctcacagtatgatatcagtattctgatctggaaggacccaaaggaaggaaactggtggatgcagttcggcagggagtatgtcctcggctactggccgtccttcctcttctcctacctcgtcgacagtgcgtcgatggtcgagtggggcggggaggtggtgaactcggagcccgacggcacgcacacgtcgacgcagatggggagcgggcggttcccggaggaagggttcggcaaggcgagctacttcaagaacatccaggtggtggacagcagcaaccagctgaaggcccccaagggggtgggcacctacaccgagcagtccaattgctacgatgttcagaacggcaacaatggcgactggggcacctacttctactatggcggcccggggaagaactcgaattgcccatgaatttggtgatgaagaagctgatgatatatatatatttatatatatatatataatatatggtgaagtgtgcaagtgtaaccaagcattaatcatgtgtggaatacagattgatctgcatctgtttcttaatttagccctaggtagtatatgtgtatctttcctactgattttctttttcttctcttcattagttttttcttcttctttttctgatgtgccatgtaaaagtttctgaagagaagcatggcgtgaggtggtggtgcaggggtgatgatgacaattgatttgtgggtaatttgcaagtcaaacggcttgtgatcagtactacaaatttatta

SEQ ID NO: 3004 - DNA, 1962 bp, Saccharum officinarum
ccgccggcgagggggctctttgggggtaaagcgaggcgaggcgaggcctgctttgcaagctcgccggaggaggcgagcggaaggggaaaggaggcgcggcagcggtggaggcgccaagagtgaggaggaggcgccgcccatggacaccgcgcggggggtcgcgtgcctgctcgtggcggtgatctgcttgtcgtgcgccgccgccgccgccgcgaggtcgccggccgcgaggctgcaccgccacctcaagcggctcaacaagccggccgtgaagagtatcgagagtccagacggggacatgatagactgcgtgcacatctcgcaccagccagcgtttgatcacccttacctcaagaaccacacaatccagatgaggccgaactaccaccccgaaggcctgtacgacgaatccaagacctccagcagcagtggggagaggcctatggttcagctctggcatcagaatgggaggtgtcctgaaggtacggtccccatcaggagaacgaagaaggacgacctgctcagggcaagctcaatgcggcggtacggcaggaagcggcacaccaccccgaacccaatgtccgtcaaccccaccatgctaaacgagggtggccatcagcatgccatagcgtatgttcagggcgacaagtactacggcgccaaggcgactatcaatgtgtgggagcccaagatcgagcagcctaacgagttcagcttgtcccagctctggatcttggggggctcattcggggaggatctgaacagcatcgaggctgggtggcaggttagtccggacctctatggggataacaacacaaggctgttcacgtactggactagtgatgcataccaggcaacagggtgctacaacatgctgtgctcagggttcattcaggttaacaaccagattgccatgggagccagcatcttcccaacctcaagctactctggctcccaatatgatatcagtatactgatctggaaggacccaaaggagggcaactggtggatgcaattcggcaaggactacgtgctcgggtactggccgtccttcctcttctcgtacctggccgacagcgcttcgatgatcgagtggggcggggaggtggtgaactcgcagccagacggcgtgcacacctcgacgcagatgggcagcgggcacttcccggaggaagggttcagcaaagcaagctacttcaagaacatccaggtggtggacagcaccaacaacctcaagtcccccaaggggctgggcaccttcacggagcagtccaactgctacgatgtgcagaacggcaacaacggcgactggggcacgtacttctactacggtggccctgggaggagctccaactgccagtaactttcaaggcgtgacagccatccgatccgagtggtaatacacggtcctcatcagttttcaggtagctctaggtagtagtatgtgatgtgaatgggtcttctttttgtgctgctgccttcacttgtagtagtttcttcttgagtctcttcttgttctttttttcttcccttgttgattagtgccaggatggcttctgaagagaagcatggcatgtggtggtgatgccctacccttatggtggcctacctccttttcctatatggtagattcacttgtccttgtggttatgggctgtgcttgttttcctgtcactttttttcacctttgatggatgtcagtgcgccgaaccgaaaggtggaatgggcagaattcagatttaggccagcagctttgtgtgccaccgatggatgggtgggtaactgcctaactggtgctggttgagtacaagaataagaacaagaaaaggggggaaaaaagagaggaaatgtccatgccattgcattgttgattgttatggatagagcacatctgtgagattatgaaatgttatgtactccagatcttagtggagatatagtgcaccaaaacccacgcgtccg

SEQ ID NO: 3005 - DNA, 2008 bp, Setaria italica
ctcggaaatgggaaaagtagcagcgagagtgctcgtcagtcttcactgtccacttgtttgcaagcgctagtagtgcggctccgctcccaaccgagacgacgagccgcccaagacgaggagccatttactcccactcccaatcccaccacgcacccgcattgtttcaaaaattctcgaatcggcccttggtggcagccccctggccgccggcgactgcggcgaggggctcttctggtgaagggggccgctttgcttcgctgcaagctcgccgtagggagggggaggaggagggtgtgacgaggaggagggcaaggcaggcggggcagcggtggaggtgcgaagactgaagaggcgccgcccatggacaccgcgcggggggtcgcgtgccttctcgtggcggtgatctgtttgtcgtgcgccgccgccgccgctgcgaggacgccggcggcgaggatgcatcgccacctcaagcggctcaataagccggccgtgaagagtatcgagagcccagatggggacatcatagactgcgtgcacatctcccaccagccagcgtttgatcacccgtacctcaagaatcacactgtacagatgaggccgaactaccatccggagggcctgtacgacgaatccaagaccaatgtggcctccaccagcaatggcgagaggcctatggtacagctctggcatcagaatgggaggtgcccggtaggcaccgtccccattaggcgaacgaagaaggacgacctgctcagggcaagctcaatgcggcggtatggcaggaagaggcacacaacagcaaacccaatgtcggtcaatcccaccatgctgaacgagggtggccatcagcatgcgatagcgtatgttcaaggtgacaagtactatggcgccaaggcgaccatcaatgtgtgggaacccaagatcgagcagcctaacgagttcagcttgtcccagctctggatcttggggggatcattcggggaggatcttaacagcattgaggctggatggcaggttagcccggacctctatggggacaacaacacaaggctgttcacctactggaccagtgatgcataccaagcaacagggtgctacaacatattgtgctcagggttcgttcagattaacagcgagattgccatgggcgccagcatcttcccaacctcaagctactctggctcccaatatgatatcagtatactgatctggaaggacccaaaggagggcaactggtggatgcagttcggcaaggactacgtgctgggctactggccgtcgttcctcttctcgtacctggcggacagcgcgtcgatgattgaatggggcggggaggtggtgaactcacagcccgacggtgtgcacacctcgacgcagatgggcagcgggcacttcccggaggaagggttcagcaagtcgagctacttcaagaacatccaggtggtggacagcaccaacaacctgaaagccccaaaggggctgggcaccttcaccgagcagtccaactgctacgacgtgcagaacggcaacaatggcgactggggcacctacttctactacggcggccctgggaggagctccaactgccagtagcaactctgaaagtgtagccgcgattcagagtgtaatacaccgtcgcaagcatcagttttctcgtagccctagatcaatagtgtgtcatgtgaatggggttcttttgttgctggtgtgtagtagtttctctctctgctgagtttcttctcttctctttcttttttttttcttgttagtgccaagatggcttctgaagagaagcatggcatgtggtggtgatgtgttgcccttatggtggcctacctccttttcctatatggtagattcacttgtccttgtggttatgggctgtgctccttttttccacccttgtcacctttttttcacctttgatgaatgtcagtgtggcgcaccgaaaggtggaatgggcagaattcagatttaggtcagcagctttgtgtgccatctgatgctg

SEQ ID NO: 3006 - DNA, 2187 bp, Sorghum bicolor
gcttcacaacagtcttcactgatgagtgcccacttgtttgtggtctgcagcaagcgctagtggacgcacgcgccgctcccaaccgaggcgacgagccgcccaaggcgacgagcctgccattactcccgttcccaatcccactctctcaccacgcaggcaggcacccgcattgtttcaaaattctcgaatcggccccctggtgtgtggtggcagccgcgccggcggcggcgagggggctctgtgtctggggggtaaagcgaggcgaggccctgctttgcgagctcgccggaggaggcgagcggaaggggaaaaggaggcgcggcagcggtggaggtgtctcaagactgaggaggaggcgccgcccatggacacctcgcggggggtcgcgtgcctgctcgtggcggtcatctgcttgtcgtgcgccgccgccgccgccgcgaggtcgccggccgcgaggctgcaccgccacctcaagcggctcaacaaaccggccgtgaagagtatcgagagtccagacggggacatgatagactgcgtgcacatctcacatcagccagcgtttgatcacccctacctcaagaatcacacaatccagatgaggccgaactaccaccccgaaggcctgttcgacgaatccaagacctccagcagcagtggggagaggcctatggttcagctctggcatcagaatgggatgtgtcctgaaggtacagtccccatcaggagaacgaagaaggacgacctgctcagggcaagctcaatgcggcggtacggcaggaagcggcacaccaccgcgaacccaatgtccgtcaaccccaccatgctcaacgagggtggccatcagcatgccatagcgtatgttcagggagacaagtactatggcgccaaggcgactatcaatgtgtgggagcccaagatcgagcagcctaacgagttcagcttgtcccagctctggatcttggggggctcatttggggaggatctgaacagcatcgaggctggatggcaggttagtccagacctctatggggataacaacacaaggctgttcacgtactggactagtgatgcataccaggcaacagggtgctacaacatgctgtgctcagggttcattcaggttaacaaccagattgccatgggagccagcatcttcccaacctcaagctactctggttcccaatatgatatcagtatactgatctggaaggacccaaaggagggcaactggtggatgcaattcggcaaggattacgtgctcggctactggccgtcctttctcttctcgtacctggcggacagcgcttcgatgatcgagtggggtggggaggtggtgaactcgcagccagacggcgtgcacacctcgacgcagatgggcagcgggcacttcccggaggaagggttcagcaaggcgagctacttcaagaacatccaggtggtggacagcaccaacaacctcaaggcccccaaggggctgggcaccttcactgagcagtcaaactgctacgacgtgcagaacggcaacaacggcgactggggcacctacttctactacggcggccctgggaggagctccaactgccagtaactttcaaggtgtgacagccatcggagtggtaatacatcagttttctggtagctctaggtagtagtatgtgatgtgaatgggtgggtctgtcttttgtttgtgctggtggcttcacttgtagtagtttctctcttgagtttcttcttgttctcttttcattagtgccaggatagcttctgaagagaagcatggcacccttatggtggcctacctccttttcctatatggtagattcacttgtccttgtggttatgggctgtgcctctttttttccctgtcaccctttttttcacctttgatggatgtcagtgtggcgcaccgaaaggtggaatgggcagaattcagatctaggccagcagctttgtgtgccactgatggatggtgggtaactgcctaactgtgctggttgggtacaagaacaagaacaagaacaaaagggtgaaaaaaagaagaggaaatgtccatgccattgcattgttaatagttttggatagagcacatcttggagatcataaaatgttctgtactcgggtagtgaaggtataaatagtgcaccaatgacatgtacatcagtcagatgttttcgttggcttttcctg

SEQ ID NO: 3007 - DNA, 2545 bp, Sorghum bicolor
aataattcccgaatcatagaggggcatttccgtccagaagcacaagctggggaaacggcaaaagtggccgcgagagtgcagagcgctgctcgcttcacaacagtcttcactgatgagtgcccacttgtttgtggtctgcagcaagcgctagtggacgcacgcgccgctcccaaccgaggcgacgagccgcccaaggcgacgagcctgccattactcccgttcccaatcccactctctcaccacgcaggcaggcacccgcattgtttcaaaattctcgaatcggccccctggtgtgtggtggcagccgcgccggcggcggcgagggggctctgtgtctggggggtaaagcgaggcgaggccctgctttgcgagctcgccggaggaggcgagcggaaggggaaaaggaggcgcggcagcggtggaggtgtctcaagactgaggaggaggcgccgcccatggacacctcgcggggggtcgcgtgcctgctcgtggcggtcatctgcttgtcgtgcgccgccgccgccgccgcgaggtcgccggccgcgaggctgcaccgccacctcaagcggctcaacaaaccggccgtgaagagtatcgagagtccagacggggacatgatagactgcgtgcacatctcacatcagccagcgtttgatcacccctacctcaagaatcacacaatccagatgaggccgaactaccaccccgaaggcctgttcgacgaatccaagacctccagcagcagtggggagaggcctatggttcagctctggcatcagaatgggatgtgtcctgaaggtacagtccccatcaggagaacgaagaaggacgacctgctcagggcaagctcaatgcggcggtacggcaggaagcggcacaccaccgcgaacccaatgtccgtcaaccccaccatgctcaacgagggtggccatcagcatgccatagcgtatgttcagggagacaagtactatggcgccaaggcgactatcaatgtgtgggagcccaagatcgagcagcctaacgagttcagcttgtcccagctctggatcttggggggctcatttggggaggatctgaacagcatcgaggctggatggcaggttagtccagacctctatggggataacaacacaaggctgttcacgtactggactagtgatgcataccaggcaacagggtgctacaacatgctgtgctcagggttcattcaggttaacaaccagattgccatgggagccagcatcttcccaacctcaagctactctggttcccaatatgatatcagtatactgatctggaaggacccaaaggagggcaactggtggatgcaattcggcaaggattacgtgctcggctactggccgtcctttctcttctcgtacctggcggacagcgcttcgatgatcgagtggggtggggaggtggtgaactcgcagccagacggcgtgcacacctcgacgcagatgggcagcgggcacttcccggaggaagggttcagcaaggcgagctacttcaagaacatccaggtggtggacagcaccaacaacctcaaggcccccaaggggctgggcaccttcactgagcagtcaaactgctacgacgtgcagaacggcaacaacggcgactggggcacctacttctactacggcggccctgggaggagctccaactgccagtaactttcaaggtgtgacagccatcggagtggtaatacatcagttttctggtagctctaggtagtagtatgtgatgtgaatgggtgggtctgtcttttgtttgtgctggtggcttcacttgtagtagtttctctcttgagtttcttcttgttctcttttcattagtgccaggatagcttctgaagagaagcatggcacccttatggtggcctacctccttttcctatatggtagattcacttgtccttgtggttatgggctgtgcctctttttttccctgtcaccctttttttcacctttgatggatgtcagtgtggcgcaccgaaaggtggaatgggcagaattcagatctaggccagcagctttgtgtgccactgatggatggtgggtaactgcctaactgtgctggttgggtacaagaacaagaacaagaacaaaagggtgaaaaaaagaagaggaaatgtccatgccattgcattgttaatagttttggatagagcacatcttggagatcataaaatgttctgtactcgggtagtgaaggtataaatagtgcaccaatgacatgtacatcagtcagatgttttcgttggcttttcctggtaatctcttgtgagagacggtttgttttgggggcgggggcagaacagcagcagcttaattttcaattctgtgcgtgtcgacgctggaaaaatttgtgccgttgtgaaaacatgacagggtccatgtgacgcaatttcccaggccaaccaaacattggcccgcaggactgtaaacggaaaaaggaagatcctgtttaccggcaatcaaaacattcgtcttggtaagtaggactaggtctcccatcgttcagtgttttgttcccaaaa

SEQ ID NO: 3008 - DNA, 2086 bp, Panicum virgatum
cttgtttgcaacagagacgacgagccgcccaagacgacgagccatttatccccactcccaatcccaccacgcccccgcattgtttcaaaattctcgattcggtccgtggtggcagccgcgcggcggccggcgaggcgggggggctctctgggtaggaggggagggccttgccgcgctgcaaggtcgccggcggcggcggagggcgtcggaggagaggaggagaggggggaagggagggggagcagcggtggaggtgtgaagaggcgccgcacatgggcaccacgcggggggtcgcgtgcctgctcgtggcggtgatctgcctgtcgtgtgctgccgccgccgccgccgccgccgcgaggtcgccggcggcgaggctgcaccgccacctcaagcggttcaacaagccggccgtgaagagcatcgagagcccagatggggacatcatagactgcgtgcccatcacccaccagccagcgtttgatcatccttacctcaagaaccacactgtccagatgagaccgaactatcaccccgaaggcctgtatgacgaatccaagaccaatgtggcctccaccagcagtggcgacaagcctaaggttcagctctggcatcagaatggcaggtgtccggaaggcaccgtccccatcaggagaacgaagaaggacgacctgctcagggcaagctcaatgcggaggtacggcaggaaacggcacaccaccgcgaacccaatgtcggtcaatcccaccatgctcaatgagggtggccatcagcatgccatagcgtacgttcaaggcgacaagtactacggcgccaaggcgaccatcaatgtctgggagcccaagatcgagcagcctaatgagttcagcttgtcccagctctggatcttaggggggtcatttggggaggatcttaacagcatcgaggctggatggcaggttagtccggacctgtatggggacaacaacacaaggctgttcacctactggaccagtgatgcataccaagcaacagggtgctacaacatgttgtgctctgggttcgttcagattaacagcgagattgccatgggtgccagcatcttcccaacctcaagctactctggctcccaatatgatatcagtatactgatctggaaggacccaaaggagggcaactggtggatgcagttcggcaaggactacgtgctgggctactggccgtcgttcctcttctcatacctggcggacagcgcgtcaatgatcgaatggggtggggaggtggtgaactcgcagccggacggcgtgcacacgtcgacgcagatgggcagcgggcacttcccggaggaagggttcagcaaggcgagctacttcaagaacatccaggtggtggatagcaccaacaacctcaaggcccccaaggggctgggcaccttcaccgagcagtccaactgctacgacgtgcagaacggcaacaatggcgactggggcacctacttctactatggcggccctgggaggagctccaactgccagtaactccgaaagcgtaacaaccattggaatgtaatacaccgtatgcaagcctcagttttctcgtagccctagatcaatagtgtgtcatgtgaatggggttgttttgtggtggtttgtagtagtttctctctgttgagtttcttccctcttttttttttccttgttactgccaggaaggcttctgaagagaagcatggcatgtggtggtgatgcgttgcccttatggtggcctacctccttttcctatatggtagattcacttgtccttgtggtttatgggctgtgttttttttttcaacttatcacctttttttttcaccttttctgagtgtcagtgtggcacaccgaaaggtggaatgggcagaattcagatttaggtcagcagctttgtgcgccgttgatggatgtgggcacctgaagctggtacaaggaaaagcatgagctgttctgcaaattgctattagatctttggccacagcaatttggtgaccaatttgtctaacaatcaatcctattctcgtgtgcttgctttgtccggtgggttacgacttatgagaatgtaaggagtaacttat

SEQ ID NO: 3009 - DNA, 2368 bp, Oryza sativa
caaaaataaagctcgtaatctgcgaaagctgatgaagctgagagagagagagatagagagagtgtgtgtgtgtgtgtgtcttcgcttcactgcccacttggatcctcgtggctgctgctgctgtagcggaagacgacgagccgcccaagaatccagcacccacccatccactgctgctgctgctcctgctgctgcaccccccgcattgtttcgaatttctcaaatcggccctcgggctgcggcggcgcggtcaccggcggcgaggtgagttcgtcggtgaagaggaaggggggggggggggtgtgaagtgaagtgcgatttgaggagggagcggtggcggcgtgaggaggcgagagccgcacatggccaccgcgcgcggcggtggcggcgtggggtggctggtggtggtggtggcggtggtctgcctgtcgtgcgcggcggcggcggcgaggtctccggcggggagggcgcaccggcacctgaagcggctcaacaagccggcggtgaagagcatcgagagcccagatggggacatcatagattgcgtgcacatctcacaccagccagctttcgatcatcccttcctcaagaaccacaccatccagatgaggccgaactaccatcccgatggcctgtacgacgaatccaagagcggcggcggcggcgagaagcccatggtccagctctggcaccagggcggcaggtgcccggaggacaccgtcccaatccggcgtacgaagcgggacgacctgctccgggcgagctccatgcgccgctacggcaagaagcggcacccggcgcccaaccccatgtccgtcgaccccaacctgctcaacgagggcggccaccagcatgccatcgcgtacgtccagggcgacaagtactacggcgccaaggcaaccatcaatgtctgggcgcccaagatcgagcagcccaacgagttcagcttgtcccagctctggatcttgggtggctccttcggcgaggacctcaacagcatcgaggctggatggcaggttagccccgacctctacggcgacaacaacacgaggctgttcacttactggactagcgatgcataccaggcaacagggtgctacaacgtattgtgtgcaggattcgtgcagataaacagtgagatcgccatgggagccagcatcttccccatctcaagctactctggctcccaatacgatatcagtataatgatttggaaggatccaaaggaggggaactggtggatgcagtttggcaaggattatgttcttggctattggccatccttcctattctcctaccttggcgacagcgcgtcgatgatcgagtggggcggggaggtggtaaactcgcagctcgatggcgtgcacacgtcgacgcagatgggcagcggtcacttcccggaggaagggttcagcaagtcaagctacttcaagaacatacaggtggtggacagcaccaacaacctgaaagcccccaagggggtgggcacattcactgagcaatcgaactgctacgacgtgcaaaacggtaacaatgccgactggggcacatacttctactatggaggccctggaaggagctcaaactgcccatgacaactgaaaactgaactgaacaccctgagcaagtgtttaaccattcaagtgtaatacaccatctgctccagttttttagccctagatagtgtgtgtcatgtgaatgggtccccggtgttgctttctaatctctctctgccttgagctttctttcttccttttttgtaatgccaagtcttctgaagagaagcaatggcatctggtggtggttgtggtgatggcctacctcctttttcctatatggtagattcacttgtctttctggttatggagcttctctcttgggcttaactaaagggtcagagggccatgctttatttttctcatgtcacctttacctcctttgaatgtcagtggtgtataggaaagaggaattggtaggattcagttactcagcaacttgtatgccattcccatggaggagtatctggtagtaggctataaaaagcacaaaaaataactaaaatgttgtgccatttatctcttctgccaaccatgaaagcatcagacctaaatagtagtatgttgaatattgtgagtactagtattcatggggagcataaatgtcaggtatatttttgtcaattgcagatgaagaaggatttgtaagaggtactgtacattgcattgaccatcttaatgccatcaacagtcatgtgcagatgaacaaaattggttgaggagtgtttctagaggtctggtttgtttgcccttgtttcatagtatatgctccagtttggtgggttggaagagaacccatgctgtttgacagg

SEQ ID NO: 3010 - DNA, 2061 bp, Oryza sativa
agctgagagagagagagatagagagagtgtgtgtgtgtgtgtgtcttcgcttcactgcccacttggatcctcgtggctgctgctgctgtagcggaagacgacgagccgcccaagaatccagcacccacccatccactgctgctgctgctcctgctgctgcaccccccgcattgtttcgaatttctcaaatcggccctcgggctgcggcggcgcggtcaccggcggcgaggtgagttcgtcggtgaagaggaaggggggggggggggtgtgaagtgaagtgcgatttgaggagggagcggtggcggcgtgaggaggcgagagccgcacatggccaccgcgcgcggcggtggcggcgtggggtggctggtggtggtggtggcggtggtctgcctgtcgtgcgcggcggcggcggcgaggtctccggcggggagggcgcaccggcacctgaagcggctcaacaagccggcggtgaagagcatcgagagcccagatggggacatcatagattgcgtgcacatctcacaccagccagctttcgatcatcccttcctcaagaaccacaccatccagatgaggccgaactaccatcccgatggcctgtacgacgaatccaagagcggcggcggcggcgagaagcccatggtccagctctggcaccagggcggcaggtgcccggaggacaccgtcccaatccggcgtacgaagcgggacgacctgctccgggcgagctccatgcgccgctacggcaagaagcggcacccggcgcccaaccccatgtccgtcgaccccaacctgctcaacgagggcggccaccagcatgccatcgcgtacgtccagggcgacaagtactacggcgccaaggcaaccatcaatgtctgggcgcccaagatcgagcagcccaacgagttcagcttgtcccagctctggatcttgggtggctccttcggcgaggacctcaacagcatcgaggctggatggcaggttagccccgacctctacggcgacaacaacacgaggctgttcacttactggactagcgatgcataccaggcaacagggtgctacaacgtattgtgtgcaggattcgtgcagataaacagtgagatcgccatgggagccagcatcttccccatctcaagctactctggctcccaatacgatatcagtataatgatttggaaggatccaaaggaggggaactggtggatgcagtttggcaaggattatgttcttggctattggccatccttcctattctcctaccttggcgacagcgcgtcgatgatcgagtggggcggggaggtggtaaactcgcagctcgatggcgtgcacacgtcgacgcagatgggcagcggtcacttcccggaggaagggttcagcaagtcaagctacttcaagaacatacaggtggtggacagcaccaacaacctgaaagcccccaagggggtgggcacattcactgagcaatcgaactgctacgacgtgcaaaacggtaacaatgccgactggggcacatacttctactatggaggccctggaaggagctcaaactgcccatgacaactgaaaactgaactgaacaccctgagcaagtgtttaaccattcaagtgtaatacaccatctgctccagttttttagccctagatagtgtgtgtcatgtgaatgggtccccggtgttgctttctaatctctctctgccttgagctttctttcttccttttttgtaatgccaagtcttctgaagagaagcaatggcatctggtggtggttgtggtgatggcctacctcctttttcctatatggtagattcacttgtctttctggttatggagcttctctcttgggcttaactaaagggtcagagggccatgctttatttttctcatgtcacctttacctcctttgaatgtcagtggtgtataggaaagaggaattggtaggattcagttactcagcaacttgtatgccattcccatggaggagtatctggtagtaggctataaaaagcacaaaaaataactaaaatgttgtgccatttatctcttctgccaaccatgaaa

SEQ ID NO: 3011 - DNA, 1947 bp, Triticum aestivum
cgctagtccccaggcgagacggcgtggcgcccgagagtgtgccaccgctccgctccactccgcacccccacccccgcattgtttcaaaatccgcaggccggtccccggaggcggcgcggcggtgggtcgccggcgggcaggggcgtctctggtgcggcaggaggagggggttctttcttcttgaagcttcggccggagcgcggaggcgggcggaggagcggtggaggagagagggagagagaggagaggagctatggccgctgcgcgcgtcgtcgcgtgcctgctggcggcggtgatgtgcctctcgtgtggggcggcggccgccgccaggtcgccggaggcccggatgcaccgccacctcaagcgcctcaacaagccggccgtcaagagcatcgagagccctgacggggacatcatagactgcgtgcacatctcgcaccagccggccttcgaccacccgttcctcaagaaccacaccatccagatgaggccgagctatcacccggagggcctgtacgacgagtccaaggccaatgtggcctcctccggcgacggcgagcggccgatggttcagctctggcaccgcaacggcaggtgcgcaccgggcaccgtcccggtccggaggaccaagaaggacgacctgatgcgcgcgagctcgatgcggcgctacggcaggaagcacaagcccacggtggcgaacccgatgtcggtcgatctcgccatgctcaacgagggcggccatcaacacgcgatatcatacgttcagggcgagaagtactacggcgccaaggcgacgatcaacgtgtgggagcccaagatcgagcagcccaacgagttcagcctgtcccagctgtggatcttggggggctccttcggcgaggacctcaacagcatcgaggctggctggcaggttagcccggacctctatggggacaacaacacaagactgttcacctactggactagtgacgcgtaccaggcaacagggtgctacaacatactgtgctcagggttcgtccagatcaacaacgaggtggccatgggggccagcatcttccccatctcgggctactccggctcgcagtacgacatcagcatactcatctggaaggatccgaaggagggtcactggtggatgcagtttggcaaggagtacgtgctgggttactggccgtcgttcctgttctcgtacctggcggacagcgcgtcgatgatcgagtggggcggggaggtggtgaactcgcaggcggagggggtgcacacgtcgacgcagatgggcagcgggcacttcccggaggaggggttcggcaaggcgagctacttcaagaacatccaggtggtggacagcaccaacaacctcaaggcgccccatgggatgggcaccttcacggagcagtccaactgctacgacgtgcagaacggcaacaacgccgactggggctcctacttctactacggcggccccggccggagcgccaactgccagtgatgacaagaacaccaccatgactgacgagtgagtgaagtgtagtgtggtgcaccatctgcattgttaggcctagatgatgataggtgtcatgtgaatgggtcctggtgttgtctcctgatttttttcttttttgattttctcccgtgtgtcaatcaagccttctgaagagaagcatggcatgtggtgtggtctgtggtggtgcaccagttgcgtgatggcctaccaaaggctcctttttcatactgtggtagtagattcattcacctgtctgtctttgttcgtggctattattggatggggggctctcttctttttctctcctggccggcttgggttcatgcatggcatggccccatgcatggggaagggcaacaatacaatggcttttgtttctcttggtcttgggagggactttctctcctttggatgccaccatctatgtatggcgaattgcaagc

SEQ ID NO: 3012 - DNA, 1571 bp, Brachypodium distachyon
atggccaccgcgcgtgtgcgtgtcgtcgcgcgcctgatggtggcggcggccgcggcggcagtgatgtgcctctcgtgcgccgccgcggcgaggtcgcccgaagccaggatgcaccggcacctcaagcgcctcaacaagcccgcggtcaagagcatcgagagccctgatggggacatcatagactgcgtgcacatctcacaccagccggctttcgaccaccctttcctcaagaaccacactatccagatgaggccgaactaccacccggaaggcctgttcgacgaatccaaggccaatgtggcctcctccggcgacggcgagaggcctatggttcagctgtggcaccagaagggcaggtgcccggaaggcaccgtgccggtccggaggaccaagaaggacgacctgctccgggcgagctcgatccggcggtacggcaggaagcggcacacggtggcgaaccccatgtctgtcgatctttccatgctcaacgagggtggccatcaacacgcgatatcgtacgtgcaaggcgagaagtactatggcgccaaggcgacgatcaacgtgtgggagcccaagatagagcagcccaacgagttcagtctgtcccagctgtggatcttgggtggcacattcggcgaagacctcaacagcatcgaggctggctggcaggttagtccggacctctacggggacaaccacacaaggctgttcacctactggacaagcgacgcgtaccaggcaacagggtgctacaacatactatgtgcagggttcgttcagatcaacagtgaggtcgccatgggagccagcatcttccccatctcaggctactccggatcccaatatgacatcagcatactcatctggaaggacccgaaagaggggcactggtggatgcagtttggcaaggagtacgtcctcggctactggccgtccttcctcttctcctacctcgcggacagtgcgtcgatgatcgagtggggcggggaggtggtgaactcgcagcccggcggcgtgcacacgtcgacacagatgggtagcgggcacttcccagaggaagggttcagcaagtcgagctacttcaaaaacatacaagtggtggacaacaccaacaacctcaaggcccccaagggggtgggcacattcaccgagcagtcgaactgctacgacgtgcagaacggcaacaatggcgactggggatcatacttctactatggaggccccggcaggagcgcaagctgccagtgaccagaagacaccctgactgagtgatccattcaagtgtaatacaccatctgcacaagtttttcttagccctagattagcgtgtgtcatgtgaatggggtcccagtgttgctttcctagtttttctctcgagctttttttcccctccctctttctgtgccagtcttctgaagagaagcatgggcatgttgttggtgcgcctgtggctgtggcctaccaccctcttcctcctttcacctatatggttgattcacttggctcttgtttctggtcatggagtatgctctctcttgggcttaaccaaagggggccttagtgccttgctt

SEQ ID NO: 3013 - DNA, 2086 bp, Brachypodium distachyon
tctagccctctctcttgccaccaactagtacagccgggtctccctacactgcccactactaccactaggcgctagcggccgctccccatccctcccaacccgagacggcgaggcgcccaagaagcggcgagagagcgtgccactgctgatcccatcccatccccaccccccgcattgtttcgaaattcgcaggcaggccctcggagccggccttgcggcggcggcggtccccggcggcgtgggtcgtctttggtagagagagaagggattttctgtcttcagagttttagccggagccgggagcgagagggggcaggggaggcggcggaggagcggagcgccgcccatggccaccgcgcgtgtgcgtgtcgtcgcgcgcctgatggtggcggcggccgcggcggcagtgatgtgcctctcgtgcgccgccgcggcgaggtcgcccgaagccaggatgcaccggcacctcaagcgcctcaacaagcccgcggtcaagagcatcgagagccctgatggggacatcatagactgcgtgcacatctcacaccagccggctttcgaccaccctttcctcaagaaccacactatccagatgaggccgaactaccacccggaaggcctgttcgacgaatccaaggccaatgtggcctcctccggcgacggcgagaggcctatggttcagctgtggcaccagaagggcaggtgcccggaaggcaccgtgccggtccggaggaccaagaaggacgacctgctccgggcgagctcgatccggcggtacggcaggaagcggcacacggtggcgaaccccatgtctgtcgatctttccatgctcaacgagggtggccatcaacacgcgatatcgtacgtgcaaggcgagaagtactatggcgccaaggcgacgatcaacgtgtgggagcccaagatagagcagcccaacgagttcagtctgtcccagctgtggatcttgggtggcacattcggcgaagacctcaacagcatcgaggctggctggcaggttagtccggacctctacggggacaaccacacaaggctgttcacctactggacaagcgacgcgtaccaggcaacagggtgctacaacatactatgtgcagggttcgttcagatcaacagtgaggtcgccatgggagccagcatcttccccatctcaggctactccggatcccaatatgacatcagcatactcatctggaaggacccgaaagaggggcactggtggatgcagtttggcaaggagtacgtcctcggctactggccgtccttcctcttctcctacctcgcggacagtgcgtcgatgatcgagtggggcggggaggtggtgaactcgcagcccggcggcgtgcacacgtcgacacagatgggtagcgggcacttcccagaggaagggttcagcaagtcgagctacttcaaaaacatacaagtggtggacaacaccaacaacctcaaggcccccaagggggtgggcacattcaccgagcagtcgaactgctacgacgtgcagaacggcaacaatggcgactggggatcatacttctactatggaggccccggcaggagcgcaagctgccagtgaccagaagacaccctgactgagtgatccattcaagtgtaatacaccatctgcacaagtttttcttagccctagattagcgtgtgtcatgtgaatggggtcccagtgttgctttcctagtttttctctcgagctttttttcccctccctctttctgtgccagtcttctgaagagaagcatgggcatgttgttggtgcgcctgtggctgtggcctaccaccctcttcctcctttcacctatatggttgattcacttggctcttgtttctggtcatggagtatgctctctcttgggcttaaccaaagggggccttagtgccttgcttttattatttctcttgacgactttctctcctttggatgccactatggcgcatcgaaaggagcaatgcgtccgggagagattcagtataattaccggtgaaccttgaactggtcgtgttgtggtgctgtggaagccttgcgtgcttttaaactttgcccgttagttcagca

SEQ ID NO: 3014 - DNA, 1719 bp, Triticum aestivum
ccaccccgcaccccccgcattgtttcaaaatccgcaggccggtccccggaggcggcgccgcggtgggtcgccggcgggcaggggcgtctctggtgcggcagggggagggggttcttccttcttgaagtccttgccggagcgcggaggcgggcgaaataggggctgcggaggagcggtggagttgtgagagagagagggagaggaaaggaaccatggccgctgcgcgcgtcgtcgcgtgcctgctggcggcggtgatgtgcctctcgtgcggggccgcgaggtcgccggaggcccggatgcaccgccacctcaagcgcctcaacaagccggccgtcaagagcatcgagagccccgacggggacatcatagactgcgtgcacatctcgcaccagccggccttcgaccacccgttcctcaagaaccacaccatccagatgaggccgagctatcacccggagggcctgtacgacgagtccaaggccaatgtggcgtcctccggcgacggcgagaggccgatggttcagctctggcaccggaacggcaggtgcgcaccgggcaccgtcccggttcggaggaccaagaaggacgacttgatgcgcgcgacctcaatgcggcgctacggcaggaagcacaaggccaaggcggcgaacccgatgtcggtcgatctcgccatgctcaacgagggcggccatcaacacgcgatatcgtacgttcagggcgagaagtactacggcgccaaggcgacgatcaacgtgtgggagcccaagatcgagcagcccaacgagttcagcctctcccagctgtggatcttggggggctccttcggcgaggacctcaacagcatcgaggctggctggcaggttagcccggacctctatggggacaacaacacaagactgttcacctactggactagtgatgcgtaccaggcaaccgggtgctacaacatgctgtgctcagggttcgtccagatcaacaacgaggtggccatgggggccagcatcttccccctctcgggctactccggctcgcagtatgacatcagtatactcatctggaaggatccgaaggagggtcactggtggatgcagtttggcaaggagtacgtgctgggttactggccgtcgttcctgttctcgtacctggcggacagcgcgtcgatgatcgagtggggcggggaggtggtgaactcgcaggcggagggggtgcacacgtcgacgcagatgggcagcgggcacttcccggaggaagggttcggcaaggcgagctacttcaagaacatccaggtggtggacagcaccaacaacctcaaggcgccgcatggaatgggcaccttcacggagcagtccaactgctacgacgtgcagaacggcaacaacgccgactggggctcctacttctactacggcggccccggccggagcgccaactgccagtgacctgagactgaaaccacccaccctagtgagtgagtgagtgagtgagagcaccattggaagtgtagtgtggtgcatctgcattataagtcagtcttgttaggcctagatgatgataggtgtcatgtgaatgggtcctggtgttggctcctgatttatttttgggttctttcttctttcttttccgtgtgtcaatcaagccttctgaagagaagcatggcatgtggtgtggtctggtggtgcaccagttgtgtgatggcctaccaaggggtcctttttcata

SEQ ID NO: 3015 - DNA, 2886 bp, Zea mays
cgagctgcggaaacggcaaaagtggccgcgagacatcgctgtgcagtgcagtgcagcaagcggctagtggacgcacgcgccgctcccaaccgagacgacgagccgcccaaggcgacgagccattactcccgtttccccaaatcccaccacgcaggcagtcaggcacccgcattgtttcaaaaatctcgaatcggcccctggttctggcagcgcagccgccgccggcggacggagggccctctttccgggtgaggcaagtcgaggcctgctttgcctcgctgtaagctcgccggaagagggaaccggggaggggaaaagacgcgcggcagtggtggagtggaggtgccaaggctgagggaggcgcgccgccgcccatggacgccgcgcggtgggtcgtgtgcctgctcgtgacggtcatctgcttgtcgtgcgccgccgccgctaccgccgccgtgaggtcgccggcggcgaggctgcaccgccacctcaagcggctcaacaagccggccgtgaagagtatcgagagtccagacggggacatgatagactgcgtgcacatctcacaccagccagcgtttgatcacccatacctcaagaaccacacgatccagatgaggccgaactaccacccggaagggctgtacgaggaatccaaggcctccagcagcggtggcgagaggcctatggctcagctctggcatcagaacgggaggtgtcccgaaggtacggtccccatcaggagaacgaggaaggacgacctgctgagggcaagctcgatgcgtcggtacggcaggaagcgccgcgccgccgcgaacccgatgtccgtcagtcccaccatgctcaacgagggtgggcatcagcatgccatagcgtacgtccagggcgacaagtactacggcgccaaggcgactatcaatgtgtgggcgcccaagatcgaacagcccaacgagttcagcttgtcccagctctggatcttgggcggctcattcggggaggatctgaacagcatcgaggctggatggcaggttagccctgacctctacggggataacaacacgaggctcttcacgtactggacaagtgatgcgtaccaggcgacagggtgctacaacatgctgtgctcagggttcatccagatcaacaaccagatcgccatgggcgccagcatcttcccgacctcgagctactccggctcccagtatgatatcagcatactgatctggaaggaccccaaggagggcaactggtggatgcagttcggcaaggactacgtgctgggttactggccgtcgttcctcttctcgtacctggcggacagcgcgtcgatggtggagtggggcggggaggtggtgaactcgcaggcggacggcgtgcacacgtcgacgcagatgggcagcgggcacttccccgaggaagggttcggcagggcgagctacttcaagggggtgcaggtggtggacagcagcaacaacctcggggcgcccaggggcggcctgggcaccttcacggagcagtccagctgctacgacgtgcagagcggcagcaacgccgactggggcacctacttctactacggcgggcccgggaggagctccagctgccagtaactggtgggctctctagctaggtagtgatgtgcgtgctgctggcttcacctttgtttgtggtagtttcttcttcttcttccgattagtcattagtgccgccgtgccgggatggcttctgaagagaagcatggcatgtggtggtggtggtgccctaccctacccttgttgtggtggcctgcctccttttcctatatggtagattcacttgttcgtccttgtggttaggactgggcatttttaacccgaaaaccgaacccgaaccgaacccgaacccgaatagaccgaataggtcggttttcggttttcgggttcgggtttcggttcatagatctcttctgttcgggtatcggtttagggttcggtttccagccagccaaacccgattagactcaaagaaccgaactatagtgatcctccctctgtccctcagcccaaaccgcgaaacctagtaacgggctaacggcccaactcaggcacaggcactccgcggtgacataggcgcagtccagtccgcacccgcaccgcacgcagcacgcacccgcaggccgcattgccgcaaccctagccgcatggcgcacgctggtccgccgccgcgccgtcgatccaccgctgctctgccgcacggagtcgcactggtcagccaccgcgccgtcgatccaccgctctgccgcctctgcgcgtcagccgcgctaggcgccaaccttccactccataccggtccaccggcgtcgatccaccgacgactccgtactcggtacttccaccgcatcgcggcaccggtccaccgctctggcgactcggtgttctgcacttctgctccgatttcggcgtcctgctccacggtgcccacgactcgctgcagaccgacccagcacgtaaggtgccgcggatcctggttgcgtccgaggagaggctgcgccggaacgcggagttcctgctcaacgaggtcgggctgccgccgcagtacatcgtccgccgttcggtgcttctcatgtacagcctcgagaggcggatagtgccccggcacctcgtgctgatggttctcaaagagaaggggttggttgagcaggaccggtgcttcttcaacgtggttctcaacgaggctgcacttctgtttgtgaattgtgatggattgatgatgaacctgttaagttatttcctgtggtgtatgaacttgcatgtagttggcattttctaagtcaatttgtcatgtatttgtatgcacttctatgcaattttgtgtgaactgtgaaccactaaacctatttatcaattatca

SEQ ID NO: 3016 - DNA, 1873 bp, Hordeum vulgare
gttgcccacttgtaaacaaacctcagtccccctagccgcactagcgccagcgtcccgagtccccaagcccagacggcgagccgccccaggagcggaggagagcgtgccacccccctccccctccccgcattgtttcaaaatcctcaggccggtccccggaggcggcgcggcggtaggtcgccggcggcgaggggtgtctctggtgcagaagggcgcctgttcgttcttcaagttgtagccggagcaaggtgctgggcgacagaagggctggggcggaggagtgagtgagcgagggggagccatgtccgctgcgcgcgtcgtcgcatgcctgctggcggcggtgatgtgcctctcgtgcgaggggcggtggccgcggcgaggtcgccggaggccaggatgcaccgccacctcaagcggctcaacaagccggccgtcaagagcatagagagccctgacggggacatcatagactgcgtgcacatctcgcaccagccggccttcgaccaccctttcctcaagaaccacaccatccagatgagaccgagctatcacccggagggcctgtacgacgagtccaaggccaatgtggcctcctccggcgacggcgagaggccgatggttcagctgtggcaccggaacggcaggtgcgcgccgggcaccgtcccggtccggaggaccaagaaggacgacctgatgcgcgcgagctcgatgcggcgctacggcaggaagcacaagcccacggtggcgaacccgatgtcggtcgatctcgccatgctcaacgagggcggccatcaacacgcgatatcgtacgttcagggcgagaagtactacggcgccaaggcgacgatcaacgtttgggagcccaagatcgagcagcccaacgagttcagcctgtcccagctgtggatcttggggggctccttcggcgaggacctcaacagcatcgaggctggctggcaggttagccctgacctctatggggacaacaacacaagactgttcacatactggactagtgatgcgtaccaggcaacagggtgctacaacatactctgctcagggttcgtccagatcaacaacgaggtcgccatgggggccagcatcttccccatctcgggatactccggctcgcagtacgacatcagcatactcatctggaaggatccgaaggagggtcactggtggatgcagtttggtaaggagtacgtgctggggtactggccgtcgttcctcttctcgtacctggcggacagcgcgtcgatgatcgagtggggcggggaggtggtgaactcgcaggcggagggggtgcacacgtcgacgcagatgggcagcgggcacttcccggaggaagggttcggcaagtcgagctacttcaagaacatccaggtggtggacagcaccaacaacctcaaggcgccccatgggctgggcaccttcacagagcagtccaactgctacgacgtgcagaacggcaacaacggcgactggggcacctacttctactatggcggccccggccggagcgccaactgccagtgatcaggaagaccaccctctaccctagtgactgagtgagagcgagtgtgcaccattggaagtgtagtgtggtgcaccatccatccatccatccatctgcattataagtcagtcagtctcgttaggcctagatgatgatgataggtgtcatgtgaatgggtcctgcctcctgatttttcttttcttttcttcttcctgtttccctgtgtcaatcaaggcttctgaagagaagcatggcatgtggatgtggtggtgcaccagttgtgtgatggcctaccaaagggtcctttttcatactgtggtagtggtagattcattcacctgtctgtctttcttc

SEQ ID NO: 3017 - DNA, 526 bp, Sorghum bicolor
gaaaagaggcctcgctactgccgtccgtcgctccacctgaacacggacgtcccctgaacacaccggcgaacgggcgaagagaaggcgaagaagcgatgggcgtcaccaaggaggacgtcgaggcggccatcacctccgctctcagcccttccaatctcgtggtcacggacacatccggagggtgtggtgcgagctacgagatcgaggtggtctcggagaagttcgaggggaagcggctgctggagaggcaccggatggtgaacaccgcgctggcgcctcacatggcggagatccacgccgtctccatcaagaaggcgctcaccccggcgcaggcccagccccagccggagcccgccgccgataagccccaggcctaagtgcttaattaaaaccccccaaaacggtttgatcacatatgctgatgcagcattagtccctgagtcaagctatgcataacgcatctgtgtaatatgtggtatgtgctacattgactgtctgcttgaataatgtggcggatgaaatttct

SEQ ID NO: 3018 - DNA, 2124 bp, Sorghum bicolor
ggaaaattgtgaaaaatcctgaaacccgaaacatcagctagttggacttctcatcttcacgactgtttcgaattcataaaatttcccaaccatagatatcttccaattattcgattcccaagccaccagggctctggaggaacaacagaatccggcaactctctgctcagccagaatagagaataccgaagaaaagaggcctcgctactgccgtccgtcgctccacctgaacacggacgtcccctgaacacaccggcgaacgggcgaagagaaggcgaagaagcgatgggcgtcaccaaggaggacgtcgaggcggccatcacctccgctctcagcccttccaatctcgtggtcacggacacatccggagggtgtggtgcgagctacgagatcgaggtggtctcggagaagttcgaggggaagcggctgctggagaggcaccggatggtgaacaccgcgctggcgcctcacatggcggagatccacgccgtctccatcaagaaggcgctcaccccggcgcaggcccagccccagccggagcccgccgccgataagccccaggcctaagtgcttaattaaaaccccccaaaacggtttgatcacatatgctgatgcagcattagtccctgagtcaagctatgcataacgcatctgtgtaatatgtggtatgtgctacattgactgtctgcttgaataatgtggcggatgaaatttctaaattgcaggatgttatccttgactcattagaaacttctgcactatgcatttaacttctcacttctgtgttgctctgggtgcttctgcccagattgtctgctttagagccgagactgtgttgcagcaatgttgttaatgttccgcgaggatgtttttttcagtcctcagaattgtgatatttgattgtaggggttaattctttaaccttgtgggttactgtagtcatctggtcgcatcatggtccgtagtggggagtggggtgtgatgactacatcttttacatatcattttcttttcctgattcatgatgccacaatcaagatgaatgtgttatccttgctgatataaaactggatacaagtatttagtgctggaactgcaatagtttacagtttaagctgagaaaataatttatataactatgcttacagtttagtgctggaattgcaatagtttacagtttaagctgcgaaaataatttatacagctatgtttaatctaaaaaaaaagcttctatgttatatcgtgtttgtagcattgcattgaattatagtacctgatgattatcttttagtgcatatgggggtgctggagttctcgtggagtaaccgaatagtggtgttagaatttctttttgtcataaacattccagtgtgtttgtgcacgtttgcatggacacatgaacagcagcacattgatcgcggcaccatagctcacttctatttgcaagtgttgctagcatctttgaatacacacagttttgtctgaacgcgatagaaatgtggactagcatgccttgcttgtattgatatacttggagaccatactttgaagacaggaccttctgagttctgagcgactacttccgcctatggtccctaattgctgatagtgatttctcggctgacgatctggaggaagacatgatcatttggaccctggaaccttcagagtttggacagggtgctgcttgttgatcagagaatgggtgaacgactacttcttccatctctgtgaaagaagcttagaagcggcacgccttctcatcttggaagttggaatgcttctccagatgtgtttggaagcgaatcagtgtttggaacagctcaccaaacctgaaccttgagttgtggtgcggtggtgcctacaacataacctgtagttctggacatctggaccttgtggaaacagaggaatgagaattttcgatcgcaaggaaaagtcagtgcactcaatctgatttaaaatcctcgatgagcatccttttggtcaacttctggtagatatgcatagaacgaataatctctaatatctgctttcctacaccttactggcagtctgcgtacactacttttctcttatattaatatataagacggataacaaccggatctttcaggaaaaaaa

SEQ ID NO: 3019 - DNA, 480 bp, Saccharum officinarum
gcgaagagaaggcgaagaagcgatgggcgtcaccaaggaggacgtcgaggcggccatcacctccgctctcagcccttccaatctcgtggtgaccgacacatccggagggtgtggtgcgagctacgagatcgaggtggtttcggagaagttcgaggggaagcggctgctggagaggcaccggatggtgaacaccgcgctggcgcctcacatggcggagatccacgccgtctccatcaagaaggcgctcaccccggctcaggcccagccccagccggagcccgccgccgataagccccaggcttaagtgcttaattaacaccccaaaactgtttgatcacatatgctgatgcactattagtccctgagtcaagctatgcataacgcatctgtgtaatatgtggtctctgctacattgactatctgcttgaataatgtggctgatgcaattgctaaattgcaggatattatccttgactgatt

SEQ ID NO: 3020 - DNA, 614 bp, Panicum virgatum
aaagaagtaaataaagaggctcgccgccagacgccaggccatgtcgtcttcttgcttgcccatcccgtcgctccacctgagcccaccggcgaagaggaggcgaagaagcgatgggcgtcaccaaggaggacgtcgaggcggccatcacctccgccctcagcccttcccatctcgtggtgacggacacatctggagggtgcggcgcgagctatgagatcgaggtggtgtcggagaagttcgaggggaagcggctgctggagcggcaccggatggtgaacacggcgctggcgccgcacatggcggagatccacgccgtctccatcaagaaggcgctcactccggcgcaggcccagccccagccccagccggagccggccgccgataagccccaggcttaagtgctcaactcgctccaaacggattgatcacatatgcgcatgagtcaagctcatccgtgttgtactagtatgtggtctctgatacattaactgctggttgaataatgtagcaaacgcaattgcagaattgcaggatgttatgcttgactgcttagaaatttctgtgctgtgcatttaacttcgcaattgcaaaattgcagggtgcttctgctctga

SEQ ID NO: 3021 - DNA, 669 bp, Setaria italica
caagagccagctttcgaaaagccaccttctggtaagcaaaagccgaaagacacagctttctgaaataaacagggcctcggtcgccagggcaaagccgtcgtctttgcttgccaatccgtcgcaccacctgaacacaccggcgaagaggaggcgaagaagcgatgggcgtcaccaaggaggacgtcgaggcggccatcacctccgctctgagcccttcccatctcgtggtgacggatacatctggagggtgtggtgcgagctacgagatcgaggtggtgtcggagaagttcgaggggaagcggctgctggagcggcaccggatggtgaacacggcgctggcgccgcacatggcggagatccacgccgtctccatcaagaaggcgctcactccggcgcaggcccagccccagccggagccggccgccgataagccccaggcttgagtgctcaactcgctccaaaacagttcgatcacatatccaccatgagtcaagctatgcataacgcatctatgtggttactgatacattaactatctggttgaataatgtagcagatgcaatttcaaaattgcaggatgttatgcttgactgcttagaaatttctgcactgtgcatttaacttctgagttgctctggatgcttctgctctgatcgtttgctggagact

SEQ ID NO: 3022 - DNA, 703 bp, Setaria italica
agctttctgaaataaacagggcctcggtcgccagggcaaagccgtcgtctttgcttgccaatccgtcgcaccacctgaacacaccggcgaagaggaggcgaagaagcgatgggcgtcaccaaggaggacgtcgaggcggccatcacctccgctctgagcccttcccatctcgtggtgacggatacatctggagggtgtggtgcgagctacgagatcgaggtggtgtcggagaagttcgaggggaagcggctgctggagcggcaccggatggtgaacacggcgctggcgccgcacatggcggagatccacgccgtctccatcaagaaggcgctcactccggcgcaggcccagccccagccggagccggccgccgataagccccaggcttgagtgctcaactcgctccaaaacagttcgatcacatatccaccatgagtcaagctatgcataacgcatctatgtggttactgatacattaactatctggttgaataatgtagcagatgcaatttcaaaattgcaggatgttatgcttgactgcttagaaatttctgcactgtgcatttaacttctgagttgctctggatgcttctgctctgatcgtttgctggagacttacactgttgtcacttttcagtgttccacgatggttggttttgagtcttcgaattatgttccctgatagtaggcttgcgaatttgtc

SEQ ID NO: 3023 - DNA, 439 bp, Pennisetum glaucum
agagaatatgaatattgcagctgtgctccggaagaatattttccagaaaccgaaaagaagtaaataaggaggctcaagtcgcggtcgtcttcttgccaatccgtcgcaccacctgaaacgcaccggcgaagaggagaggaagcgatgggcgtcaccaaggaggacgtcgaggcggccatcacctccgctctgagcccttcccatctcgttgtcacggatacatctggagggtgtggcgcgagctacgagatcgaggtggtgtcggataagttcgaggggaagcggctgctggagcggcaccggatggtgaacacggcgctggcgccgcacatggcggagatccacgccgtctccatcaagaaggcgctcaccccggcgcaggcccagcctcagccggagcccgccgccgataagccccaggcttgagtgctcaactcgc

SEQ ID NO: 3024 - DNA, 785 bp, Panicum virgatum
ggtcctagtcctgccgtcctccgccttcttcctcgcgtactgaataccggcaccttccaagcgccgccggaacggggatctgctctggagctcgcccctaaggacctagggcggccgccgtagctcgccccagtggtggctccgccactgaactgtgctcagcaggaataatttctggaaaccaaaaagaataaaaataaagaggctcgcagacgccagggccaaatcgtcttcttgcttgccaatccgtcgcaccacctgagcacatcggcggcgaagaggaggcgaagaagcgatgggcgtcaccaaggaggacgtcgaggcggccatcacctccgctctcagcccttcccatctcgtggtgacggatacatctggagggtgtggcgcgagctatgagatcgaggtggtgtcggagaagttcgaggggaagcggctgctggagcggcaccggttggtgaacacggcgctggcgccgcacatggcggagatccacgccgtctccatcaagaaggcgctcactccggcgcaggcccaaccccagccggagccggccgccgataagccccaggcttaagtgcttaactcgcttcaaacagtttgatcacatatgcaccatgagtcaagctcatctctgttgtagtatgtggtctctgatacattaactactggttgaataatgtagcagacgcaattgcaaaattgcaggatgttatgcttgactgcttagaaatttctgtgctgtgcatttaacttcagagatgttctgggtgcttctgctgtga

SEQ ID NO: 3025 - DNA, 892 bp, Oryza sativa
aaaaagtacgacacaaagtattagccaaaaatattcgaatttcttcgggaaacatgaatggatttaactaaatttcaccacatagaaaagaatgaatttagcgaaaattcaccaccatagaaaagagaatgcccgggatcaaaccgaagattcgattcccaatccagcggagagattgggaagaacaaaaaaccttttcatgattcccaatccacatcaagtaggaatatttctggtaactgaaagaggtcaaataaaggagagggtgaaacggccggcgccatcccaagtcgtcttcctccttcgctcaacccgcagaagaacacagattcgaagaggcagaggcggcgaagagacgcgcgagccatgggcgtcaccaaggaggatgtcgaggccgccatcacctcctccctcagcccttccagcctcgtggtgacggatacttccggcgggtgcggcgcgagctacgagattgaggtggtgtcggagaagttcgaggggaagcggctgctggagcggcaccggatggtgaacaccgcgctggcgccgcacatggcggagatccacgccgtctccatcaagaaggcgctcacccctgctcaggcgcagccccagccggagccggccgccgataaggcgccccaggcttaagtagttcttgaactcacacctccaaactgttcgatcacatatgcaccacgagtgaaccgatgcacttggtgtagcgtttgtcatgggtgtttgagatgtgcgtcagctctctctgcttgaataatgtgcatacaatggcagaattggaatgatactatgcttgactgcttagaaatttcagtaactttgcgtgcttcccgcgtcatgtgcttggcagttgatcctatttcacaattttgcc

SEQ ID NO: 3026 - DNA, 2111 bp, Oryza sativa
aagtctcaatttgtgcaaattaggcctattaataaagcccattgggcttccaggcgattgtcgcgtgggcgccgcaaccgagacacagcaaaaggccttaaggccgcatctcaccaccaggaaaaaacgcgagcgcatctgaagccgaagcgacaccagcggtgttagcctacccgcagcttggcgagttcagttgggtaagctagggtttaggtctcggcgcgcggcggaggggaggaggaggcgatggcggcggcggcggcggcagcggcggctgaggaggagatcgcggtgaaggagccgctggatctgatcaggctcagcctcgacgagcgcatctacgtcaagctcaggtccgaccgcgagctccgcggcaagctccatgcatacgatcaacatttaaacatgattcttggagatgttgaggagatcgtgacaacagttgagattgacgatgagacatatgaagaaattgtgcgcaccacaaaacgcactatccccttcctttttgttcgaggtgatggtgtcattttggtttctccacccctccgaacggcatgaagtatgaaggaagctcctgccgattgtcaaccatgagtaatgtgtattttttaatcaatggcatgtgttatgtgctgaagtgctactatttctgatggattctagttttagcatatgatacaattgtgtaacaatttctgatcgaggtgctagtttctactgtcatgttgaatcaaccttttgttaccagattaatcaactcaatcccgaagcactaatatttgttgtggtgatgtcttgcgtaatttttgtagatccacatgccaagaacaccctgttccaatctctattaaaaaagagccagcaagttgtaacatttttacagcgtatatgattcacatcacaacacccagccaaacagggaacgtatcaccgtcccaagacttatcacagccaaacagccaaacagccacacggcagcggtgtctccagggcttgcagaaaagacacattttacatgatcatttcattagctacaaaaagagatctataaactattcactgaccagcaaagtcaatcttcattccagccatgcttgaattcgccccaaatcctcacgcccggtcatgaaattgtatccatctaaagttctaaacagcaagccaacaacacaaaaagtacgacacaaagtattagccaaaaatattcgaatttcttcgggaaacatgaatggatttaactaaatttcaccacatagaaaagaatgaatttagcgaaaattcaccaccatagaaaagagaatgcccgggatcaaaccgaagattcgattcccaatccagcggagagattgggaagaacaaaaaaccttttcatgattcccaatccacatcaagtaggaatatttctggtaactgaaagaggtcaaataaaggagagggtgaaacggccggcgccatcccaagtcgtcttcctccttcgctcaacccgcagaagaacacagattcgaagaggcagaggcggcgaagagacgcgcgagccatgggcgtcaccaaggaggatgtcgaggccgccatcacctcctccctcagcccttccagcctcgtggtgacggatacttccggcgggtgcggcgcgagctacgagattgaggtggtgtcggagaagttcgaggggaagcggctgctggagcggcaccggatggtgaacaccgcgctggcgccgcacatggcggagatccacgccgtctccatcaagaaggcgctcacccctgctcaggcgcagccccagccggagccggccgccgataaggcgccccaggcttaagtagttcttgaactcacacctccaaactgttcgatcacatatgcaccacgagtgaaccgatgcacttggtgtagcgtttgtcatgggtgtttgagatgtgcgtcagctctctctgcttgaataatgtgcatacaatggcagaattggaatgatactatgcttgactgcttagaaatttcagtaactttgcgtgcttcccgcgtcatgtgcttggcagttgatcctatttcacaattttgccaataaattgccgtctagataatgatcctatttcgcaactttgccg

SEQ ID NO: 3027 - DNA, 464 bp, Triticum aestivum
cgtcaccaaggaggacgtcgaggcggccatcacctccgctctcagcccttccaatctcgtggtcacggacacatccggagggtgtggtgcgagctacgagatcgaggtggtctcggagaagttcgaggggaagcggctgctggagaggcaccggatggtgaacaccgcgctggcgcctcacatggcggagattcacgccgtctccatcaagaaggcgctcaccccggctcaggcccagccccagccggagtccgccgccgataagccccaggcttaagtgcttaattaaaacccccaaaacggtttgatcaaatatgctgaggcagcattaatccttgagtcaagctatgcataacgcatctgtgcaatatgtgctctgtgctacattgactgtctgcttgaataatgtgcctgatgaaatttctaaattgcccgatgctatccttgactgattataaacttct

SEQ ID NO: 3028 - DNA, 684 bp, Brachypodium distachyon
ggagtcagcccacttgctctttcgccttttgccttctctccactggaacgacgagaagagaggggcgtggaggaggtaatcgccagccatgggcgtcacaaaggaggacgtggagtccgccatcgccgccgctctcagcccttcccatctcgtggtcaccgatacatctggcgggtgcggcgcgagctatgagatcgaggtggtgtcggaaaagttcgaggggaagcgtctgctggagcgacaccggctggtgaacaccgcgctggcgccgcacatggcggagatccacgccgtctccatcaagaaggcgctcaccccggcgcaggcgcagccccagccggagcccgccgccgataagccacaggcttgagctcgctccaagcactctgatcatacaggcaccgttagatgttgaaacgcgcatcaaactctctgcttgaataatgtagtagcagatggattcccagaattgagactttgcagcgatgctgtgcttgaatgattatgttttaagtactgaattgtgtggttagtgcttctgctcaaatcgttggcttgactgcttgagaccggcttgcaacatgtccacgaactgcaacttcgatgtaggcagtttgcagttcagtttcttaggtgcattggttttgttaatctgatggcgtttgctgcaatttggttgtattg

SEQ ID NO: 3029 - DNA, 2725 bp, Brachypodium distachyon
caagattcgattcccagtccaccaggaggaagaacagaatattacgacaggccaattcatgctttcaaatccacatcaagaattcttcttcttttttgagaaacatcaagaattcttctatgcggtaaacattagataagacacaaaagagaggcaccagccggagtcagcccacttgctctttcgccttttgccttctctccactggaacgacgagaagagaggggcgtggaggaggtaatcgccagccatgggcgtcacaaaggaggacgtggagtccgccatcgccgccgctctcagcccttcccatctcgtggtcaccgatacatctggcgggtgcggcgcgagctatgagatcgaggtggtgtcggaaaagttcgaggggaagcgtctgctggagcgacaccggctggtgaacaccgcgctggcgccgcacatggcggagatccacgccgtctccatcaagaaggcgctcaccccggcgcaggcgcagccccagccggagcccgccgccgataagccacaggcttgagctcgctccaagcactctgatcatacaggcaccgttagatgttgaaacgcgcatcaaactctctgcttgaataatgtagtagcagatggattcccagaattgagactttgcagcgatgctgtgcttgaatgattatgttttaagtactgaattgtgtggttagtgcttctgctcaaatcgttggcttgactgcttgagaccggcttgcaacatgtccacgaactgcaacttcgatgtaggcagtttgcagttcagtttcttaggtgcattggttttgttaatctgatggcgtttgctgcaatttggttgtattgcatccattctcttttctgttatagagctaaatgctagggtatttcgatgttggagctgtcgttttcagctagttttatgttacagtacgtataattccatcacaaaggctggtgctccgttggtgtagagcagtattaagtttccatttgaaattaagttagacagatgggtccctttaattttcttcacatacgcataaagcctacaatacaaatattccggtaggattaccatgtcttaatctgtttccaaggcatctgaaaccaaaataggctgattcagtcattggacttggaatagcatgtctaacatgtattgatctgggaagagacccttgccggaggtggccttctggtggcggtagatgtcaatgccagagctttcaagctgttttgtagccaaacttagtttggaatcgctcggcggtctcattttcagcgaacagtttccatggcaacgaaacaagatatgtcgaattgtagcctattcccaattcaactctgaaattgcattggaccaactttttgtttgtttggtggtgccactgccaacagcagtatccagcatttagattaggttctcaatttccacatcagactgtacccacgttgccttgcgtcagtcaccagtctcatttatcatgattactcacatcatagatcacacattgggccttactgaactctcgaaaagagaatcatgatttttctacggagtagaaagaaatacaataccacttccattttctcgaaatttctcgcttccatctgaagggagaccgatctcttccttcttttctttttcttcttgagacaatcgacgatttacagatcccaaaattattcgtataactaaggagcttaattagtcagtggtgggccgggttactgatgaggtggttgcggatcggcacttcggagcaaggaaaggtagccaccttccaggttcttcacattcttgaatccctgcttaatacaggccagccggcaccatatcaaacttggcttaatagccgatagtaagtagtggtactagcagaatttgatcgagatggttacttaccgcgttaacaaggtctgcggtggcgagcttggatcttactcccgaccggcaaccctttagacagacacaagacatctcttacacactgccggagatcaagccaacaccgtccgggcgttggaaaaatggaaaggaagaactaaaccaaaagcactcacgtaccacgaggaagaggtcgtccttggcgtggagcgcggcgacctgggcgacgaagtccgggttcttctccttgccatggggagtcacggagaggtagtaggggacgttgcgggcgccggcgacgtggcccttgtcgaagtcctcccacatcctcacgtccacgtactggtactgcccggagctcagcaaggcgcacgcttcctccgcgtccacgctctccatcttcttcttctcgcctccgctgctgctgcttctcaatgaacccataaattaactatcgatgagttcagggaaaggaagatgctccagtcgatccaggggctgtggagtggattgatgggataagtgctactgcctacctgacgtatttatagtgtggctcacggttagccgcatccaccaccactctggcctccgtctctttccttgtcgaacctatcttctggagtacacgtacatatatggcattgtcaactgctgtattattttccgtgaatagacaagtagtaccagtttctctcgttttgcatcctcgtaagtggtcatgttggacattatcaccttccatgatttaatagaacgtcttccatgatcaagctacccagtataaacaaagggtggatggttaagcttggaagggtaagagggcaagtccaa

SEQ ID NO: 3030 - DNA, 560 bp, Secale cereale
ttgcctctgccagaacagataggagagaccgagaagggagggcgaagaggagagcagggagcaatctcaaacagccatgggcgtgaccaaggaggacgtgcaggccgccgtcgccgccgcgctcagccccacccacctcgtggtcaccgatacatccggcgggtgcggcgcgagctacgagatcgaggtggtgtcggacaagttcgaggggaagcggctgctggagcgccaccggatggtcaacaccgcgctggcgccgctcatggcggagatccacgccgtctccatcaagaaggcgctcaccccggcccaggcccagccccagccccagccggagccggccgccgccgccgccaagccgcaggcctgattcgcccctgaatcactaccggaaccacagcacatgcgccgttggatgttgggaactctgcatcacacagtactctctgcttgaatgaatgaataatgtagcaagatgcgcctgcaaaactgaaacttggctgattggagtctgctgcattttgtccatgagattgtgttgcaacatgttcctgagttct

SEQ ID NO: 3031 - DNA, 595 bp, Avena sativa
ttgcctgccttcgctccgccggaacagacagaggagagagggcgaaaggggagggaggaggcaaccgccggttcgctagctagccatgggcgtcaccaaggaggacgtggaggccgccgtcgccgccgcgctcagccccacccatctcgtggtcaccgatacatctggcgggtgcggcgcgagctacgagatcgaggtggtgtcggacaagttcgaggggaagcggctgctggagcggcaccggatggtcaacaccgcgctggcgccgcacatggccgagatccacgccgtctccatcaagaaggcgctcaccccggcccaggcccagccccagccccagccggccgccgccgccgctgacgacaaggcgcaggcttgatttcgctcgctccaatccaagcacatcgtctccgcttgaataatgtactgtattagcagatgcattcgcagaattgaaacttcggtactgatgctatatgtgctgcttaactggttactagatttcactgcaccgtatgcgcctatgtggttactgcgtctgcttgctgtaatctgtttcactgtgaccctgctgcaacatgtccctgaattatgt

SEQ ID NO: 3032 - DNA, 639 bp, Secale cereale
tgcttaccttggcagaacagacagagagaccgagaagagagggcgaagaggaggcaatcgcgaacagaccagccatgggcgtcaccaaggaggacgtggaggccgccgtcgccgccgcgctcagccccacccacctcgtggtcaccgacacatccggcgggtgcggcgcgagctacgagatcgaggtggtgtcggacaagttcgaggggaagcggctgctggagcgccaccggatggtcaacaccgcgctggcgccgctcatggcggagatccacgccgtctccattaagaaggcgctcaccccggcccaggcccagccccagcccgagccggccgccgccgccgccgccgacaagccgcaggcctgactcgctccgaaggaagcactagtactgaaatcacagcacatgcgccgttggatgttgggaactctgcatcacacagtactctctgctttgaatgaatgaataatgtagcaagatgcgcctgcaaaactgaggcttggctgattggagtctgctgcattttgtccatgagattgtgttgcaacatgtttctgagttctgtcttgtatgcggcggttgcgtttcttttttggtggactggttctgttgaatctgatggctttttttgctgcaa

SEQ ID NO: 3033 - DNA, 596 bp, Secale cereale
tgtttgccttgcctctgccagaacagacaggagagaccgagaagagagggcgaagaggaggcaatcgcgaacagaccagccatgggcgtgaccaaggaggacgtgcaggccgccgtcgccgccgcgctcagccccacccacctcgtggtcaccgatacatccggcgggtgcggcgcgagctacgagatcgaggtggtgtcgggcaagttcgaggggaagcggctgctggagcgccaccggatggtcaacaccgcgctggcgccgctcatggcggagatccacgccgtctccatcaagaaggcgctcaccccggcccaggcccagccccagcccgagccggccgccgccgccgccgacaagccgcaggcctgactagctctgaaggaagcactagtactcaaatcacagcatatgcgccgttggatgttgggaactctgcatcacacagtactctctgcttgaatgaatgaataatttagtaagatgcgcctgcaaaactgaggcttggctgattggattctgctgctatttttgtccatgtgattcagtgcgtctgctctagttgcgctggcatgagattgtgttgcaacaaaaaa

SEQ ID NO: 3034 - DNA, 563 bp, Avena sativa
agaggagagagggcgaaaggggagggaggaggcaaccgccggttcgctagctagccatgggcgtcaccaaggaggacgtggaggccgccgtcgccgccgcgctcagccccacccatctcgtggtcaccgatacatctggcgggtgcggcgcgagctacgagatcgaggtggtgtcggacaagttcgaggggaagcggctgctggagcggcaccggatggtcaacaccgcgctggcgccgcacatggccgagatccacgccgtctccatcaagaaggcgctcaccccggcccaggcccagccccagccggccggcgccgccgccgctgacgacaaggcgcaggcttgatttcgctcgctccaatccaagcacatcgtctccgcttgaataatgtactgtattagcagatgcattcgcagaattgaaacttcggtactgatgctatatgtgctgcttaactggttactagatttcactgcaccgtatgcgcctatgtggttactgcgtctgcttgctgtaatctgtttcactgtgaccctgctgcaacatgtccctgaattatgt

SEQ ID NO: 3035 - DNA, 524 bp, Secale cereale
tgccttggctccgctggagagaccgaccgaaaggagagggcgaagaacgaagcaggaggagggaatcgcgaacagaccagccatgggcgtgaccaaggaggacgtggaggccgccgtcgccgccgcgctcagccccgcccacctcgtggtcaccgacacatccggcgggtgcggcgcgagctacgagatcgaggtggtgtcggacaagttcgaggggaagcggctgctggagcgccaccggatggtcaacaccgcgctggcgccgctcatggcggagatccacgccgtctccatcaagaaggcgctcaccccggcccaggcccagcccgagccggccgccgccaccgacaagccgcaggcctgactagctccgaaggaagcactagtactgaaatcacagcacatgcgccgttggatgttgggaactctgcatcacacagtactctctgcttgaattgaatgaataatgtagcaagatgcacctgcaaaactgaaacttggctgattggattctgctgcatttt

SEQ ID NO: 3036 - DNA, 722 bp, Triticum aestivum
ggggcgagtgggataagttgataggaggaagacacgggcaatcgggaagtcttccttgtttgccttggctccgccggaacagagagaccgagaagagagggcgaagaggaggcaatcgcgaacagaccagccatgggcgtgaccaaggaggacgtggaggccgccgtcgccgccgcgctcagccccacccacctcgtggtcaccgatacatccggcgggtgcggcgcgagctacgagatcgaggtggtgtcggacaagttcgaggggaagcggctgctggagcgccaccggatggtcaacaccgcgctggcgccgctcatggccgagatccacgccgtctccatcaaggcgctcacccccgcgcaggcccagcccaagccccagccggagccggccgccgccgccgacaagtcgcagcaggcctgattcgtcgctgaatgaagcactagtactgaaaccacaacacatgcgctgttggatgttgggaactcgcattatacactactctgcttgaatgaataatgtagcaagatgcgtctgcggaatcgagactttgcagtggtgctatgcctgggtgataagattttgctgcgttttgtccatgtgattgtgatgattcagcgcttctgctctaactgtgttggcctgagattgtgtggcgacatgttcctgagtttctgtcatagactaagctgtttgcagtttagtttcttctttggtcg

SEQ ID NO: 3037 - DNA, 646 bp, Hordeum vulgare
aaagtctccttctccgccggcccggaacagacagagagaccaagaggagggggaggcaatcgtcagcagccatgggcgtgaccaaggaggacgtcgaggccgccgtcgccgccgcgctcagccccacccacctcgtggtcaccgatacatccggcgggtgcggcgcgagctacgagatcgaggtggtgtcgggcaagttcgaggggaagcggctgctggagcgccaccggatggtcaacaccgcgctggcgccgctcatggccgagatccacgccgtctccatcaaggcgctcacccccgagcaggcccagccccagccgtcgccgcccgccgtcaccgccgacaaggcctgactcgctcccaaggaagcattggttggatgctgggaaactcgcatcatacagtactctctgcttgaatgaatgaatgaataatgtagcaatgccgcgcctgcggaatcgagactctgcagtggtggcatacgttatgtccatgtgattgcgatgatttagtgcttctgctctaactgcgtttggcctgagattgtgtggcgacatgttcctgagttgtgtcatataatctctttgcagtttagtttcttctttccctagttgcttctgttgaatgtgattgcttttttgttgcc

SEQ ID NO: 3038 - DNA, 1353 bp, Sorghum bicolor
cagtccacgcatcccactgaaatggggaggctgctccctcgccacccttcccccctcctcctcctcgccgccgccgctgccgcggcgatctgcatctccagcagcagcatcgctgccgtccggggcgcgccagtgtaccgcgcggactacctggtggacgggaaccagctggtggacatgcagtaccacatgggccccgtcgtgtccgggtcgccgaccaacctctacctcatctggtacgggcggtgggagcccacggcgcaggccgtgctccgggacttcctcgcctcgctctctgcgccggcgccgttcccggccgtctccgactggtgggcgcgcacgccgcggatgtacgcggaccagacgggcgccaacgtgacgggaaccttcgccgtcgccggggagcactccgacgcgggctactcccacggcgcgtcgctccggcgcatcgacgtgcagtccgtgatccggtcggcggtgtacgcgtacccggacccgctgccgctggacccctacagcggcgcgtacctggtgctgacgtccccggacgtgaaggtggacgagttctgccgcgccgtctgcggcttccactacttcaccttcgcgtccgtggtcggggtcacggtgccctacgcctgggtcgggaacagcggcacgcagtgcccgggcaagtgcgcgtacccgttcgccgccgccgccgagtacggcgggggcgggggagcccaggcggtgctgcggccccccaacggcgacgccggggtggacgggatggtgatcgtgctggggcacgagctggcggagatgtctacgaacccactggtgaacgcgtggtacgccggggacacgcccacggcgccgaccgagatcgcggacctgtgcctcggcgtctacggcgacggcggcggcccgggcggcctggtcgggaacgtgtcccgcgcgcccgatggcagcgcctacaacgtcaacggcgtcaacggccggcggttcctcgtgcagtggctctggaaccccgtccgcggcgcctgctacggccccaactccagcaactgacccgaccgaatcctcgctgggggcgagggcgagcggagcagttcttcttcctcatgccattctgctcgatggcattgcagaaatccatggcggtttcaatggatggagacagcgttcattcacttccctgttcgttggggaatggtccacaggagactgagacgaggatcagatgaaccgaacccagtaattttgaagctgcactgtatgagaaacatgggtaggaaacaatgaggaaaatgccaatttgttgttcgatttctttttgattttgcagcataaatatatggtcaatttgctttc

SEQ ID NO: 3039 - DNA, 1787 bp, Sorghum bicolor
aacccagctgggcagttcggtgactcactttcagccttcacaccagtccacgcatcccactgaaatggggaggctgctccctcgccacccttcccccctcctcctcctcgccgccgccgctgccgcggcgatctgcatctccagcagcagcatcgctgccgtccggggcgcgccagtgtaccgcgcggactacctggtggacgggaaccagctggtggacatgcagtaccacatgggccccgtcgtgtccgggtcgccgaccaacctctacctcatctggtacgggcggtgggagcccacggcgcaggccgtgctccgggacttcctcgcctcgctctctgcgccggcgccgttcccggccgtctccgactggtgggcgcgcacgccgcggatgtacgcggaccagacgggcgccaacgtgacgggaaccttcgccgtcgccggggagcactccgacgcgggctactcccacggcgcgtcgctccggcgcatcgacgtgcagtccgtgatccggtcggcggtgtacgcgtacccggacccgctgccgctggacccctacagcggcgcgtacctggtgctgacgtccccggacgtgaaggtggacgagttctgccgcgccgtctgcggcttccactacttcaccttcgcgtccgtggtcggggtcacggtgccctacgcctgggtcgggaacagcggcacgcagtgcccgggcaagtgcgcgtacccgttcgccgccgccgccgagtacggcgggggcgggggagcccaggcggtgctgcggccccccaacggcgacgccggggtggacgggatggtgatcgtgctggggcacgagctggcggagatgtctacgaacccactggtgaacgcgtggtacgccggggacacgcccacggcgccgaccgagatcgcggacctgtgcctcggcgtctacggcgacggcggcggcccgggcggcctggtcgggaacgtgtcccgcgcgcccgatggcagcgcctacaacgtcaacggcgtcaacggccggcggttcctcgtgcagtggctctggaaccccgtccgcggcgcctgctacggccccaactccagcaactgacccgaccgaatcctcgctgggggcgagggcgagcggagcagttcttcttcctcatgccattctgctcgatggcattgcagaaatccatggcggtttcaatggatggagacagcgttcattcacttccctgttcgttggggaatggtccacaggagactgagacgaggatcagatgaaccgaacccagtaattttgaagctgcactgtatgagaaacatgggtaggaaacaatgaggaaaatgccaatttgttgttcgatttctttttgattttgcagcataaatatatggtcaatttgctttctgggagtggtcgactgattgattgctttcaccttttgactctgcattctttagtctggtgatcatggtaactctgcagcttggtctccttgcctccgtctctgatgacctctctttcctatctttttattctgagaacttgttcccctattttagtcttgtacactagcagttacagtcttattacagtggacaacgaattaggaagtgtagtactcctgttttggttaaaatgtgccttcagagggtgtttaaagagctgctacatgcggcattgtgtttaaagagctgctacatgctgcacttttgctattctttctgaatactgttgcagttacatgcggcattgaattagggagtggagagatgtctttactgttgtaattatactg

SEQ ID NO: 3040 - DNA, 1457 bp, Setaria italica
ctcactcgctccctgaagcctccactccactccactccactccacacatcgacacatcccaccagaatggggaggttgctcccccaccacccctccctcctcctcctcgccgcggcggcggcggcgatctgcatctccagcagcaacctcgccgccgtccggtgcacgccggtgtaccgccccgactacctggtggacgggaaccagctggtggacatgcagtaccacatggggcccgtcgtgtccgggtcgccgaccaacctctacctcatctggtacgggcggtgggagccggcggcgcaggccgtgctccgggacttcctcgcctccctctcggcgtcggccccgttcccggctgtctccgactggtgggcgcgcacgccgcggatgtacacggaccagacgggcgccaacgtgacgggcgcgttcgccgtcgccggcgagcactccgacgccggctactcccacggcgcctcgctccggcgcgccgacatgcagtcggtgatccggtcggcggtgtacgcgtacccggacccgctgccgctggacccctacagcggcgcgtacctggtgctgacctcccccgacgtgcaggtcgacgagttctgccgcgccgtgtgcggcttccactacttcaccttcgcctccgtggtcggggtcaccgtgccgtacttgtgggtggggaacagcgccacgcagtgccccggcaagtgcgcgtacccgttcgccgccgccgagtacggagccggcgccggcgccgggggaggaggagggggagggggagggcaggcggtgctgcggccgccgaacggcgacgccggggtggacgggatggtgatcgtgctggggcacgagctggcggagatgtcgaccaacccgctggtgaacgcgtggtacgccggggacacgccgacggcgcccacggagatcgcggacctgtgcctgggcgtgtacggcgacggcggcggcgcggggggcatggtcgggaacgtgtcccgcgcgcccgacggcagcgcctacaacgtgaatggcgtgaacgggcggcggttcctcgtgcagtggctctggaaccccgtccgcgccgcctgctacggccccaactccagcaactgaccggcgccccctgtttccttcctcttcgttgcagggaatggtcagttcagttcttcatgccattatgctcaatgacattgaagaaatcgatggcagtcccatgaatgaatgaatgaatcaatggataagaaagataagagcgttggatatctgagatgaggacaagagaccagatgaggcaagaaattctgaagcaacactttatgggatcctgaatggttacatgaactgtgtgggttctgaatttctgttcgatctgcacctcagcaggaaacaatgagaaattgccgatttgttcttcgatttgtttgaattttgcagcataaaagtgtgatcgatttgcc

SEQ ID NO: 3041 - DNA, 1825 bp, Oryza sativa
caaaaaccaccaaaaactccacttcacttcccccacgctctcactcctccactccactcgtcgagaaaaatggggaggcttccactcctcctcctcctcgccgccgccgccgtctccaccgccggcggcgcgccggtgtaccgggctgactacctggtggacggcaaccagctggtggacatgcagtaccacatgggccccgtcgtgtcggggtcgccgacgaacctctacctcatctggtacggccggtgggaggccgcggcgcaggcggtgctccgagacttcctcgcctcgctctcggccccggcggcgccgtccccggcggtgtccgactggtgggcgcgcgcgccgcggctgtacgcggaccagacgggcgccaacgtgacgggcgcgttcgccgtcgccggcgagcgctccgacgccgggtactcgcacggcgcgtcgctgcggcggatcgacatgcagtccgtcatccgctccgccgtgtacgcctacccggacccgctcccgctcgacccctacagcggcgtctacctggtgctcacctcgccggacgtccaggtggaggagttctgccgcgccgtctgcggcttccactacttcaccttcgcctccgtcgtcggcgtcaccgtgccgtacgcgtgggtcgggaacagcgccacgcagtgcccgggcaagtgcgcgtacccgttcgccgcgccggactacggcggcggcgccggtgggcagcaggtgctgcggccgccgaacggcgacgtcggggtggacgggatggtgatcgtgctcgggcacgagctggcggagctggcgacgaacccgctggtgaacgcgtggtacgccggagacacgcccacggcgccgacggagatcgccgacctctgcctcggcgtgtacggcgacggcggcggcgcgggcgggctcgtcgggaacgtgtcgcgcgccgccgacggcgcctcctacaacgtcaacggcgtcaacggccggcggttcatggtgcagtggctctggaaccccgtccgcggcgcgtgctacggccccaactccagcagctgaccgccgccgccatggccgccgggattcttgcgaggatggatcactcgatgccattgcgctcaatggctagtagaaacggaagactccatgggcagattcagagctcgacacctgaaaacgtcgcaccaatttgatctgatccctttcttgatcagagattcggggtgggttttgttcagatcgggagaaattctttgggttctgaattctgatcgatctgtaggagtgagaagcatgcaatttttttcatttcaatttattttatttgcagcataaattatgatcgatttaggggaatagaattgcattagtagaattccagcttgtttcaagcttcctcttgcttgctcaagcacagttgctgctttttttttttcactcctctcttttgactctgctttttcatcatggtaatctctgcagtttggtctccttgtctctcactctgtgacgctggtaagctttctgatagcagtttggttgaatggcttttgtttcttttgcagacatttttctttctttttttttcctgttgcttctgtatcacaattgacattcaggatgatcttgaatattgatgagaacttgagtgatgatgctaaagagatgctttgctctgcagaaacaacacgagtttttagataaatagaaagaacacaagtgacggcagaagcctttggtaggttggtcagacgtgtaaggatgtctccacccaagtacaaattggcccatcagaaaactgaaattctgaaagcttgtgtaaggggagatg

SEQ ID NO: 3042 - DNA, 1583 bp, Oryza sativa
ccactccactcgtcgagaaaaatggggaggcttccactcctcctcctcctcgccgccgccgccgtctccaccgccggcggcgcgccggtgtaccgggctgactacctggtggacggcaaccagctggtggacatgcagtaccacatgggccccgtcgtgtcggggtcgccgacgaacctctacctcatctggtacggccggtgggaggccgcggcgcaggcggtgctccgagacttcctcgcctcgctctcggccccggcggcgccgtccccggcggtgtccgactggtgggcgcgcgcgccgcggctgtacgcggaccagacgggcgccaacgtgacgggcgcgttcgccgtcgccggcgagcgctccgacgccgggtactcgcacggcgcgtcgctgcggcggatcgacatgcagtccgtcatccgctccgccgtgtacgcctacccggacccgctcccgctcgacccctacagcggcgtctacctggtgctcacctcgccggacgtccaggtggaggagttctgccgcgccgtctgcggcttccactacttcaccttcgcctccgtcgtcggcgtcaccgtgccgtacgcgtgggtcgggaacagcgccacgcagtgcccgggcaagtgcgcgtacccgttcgccgcgccggactacggcggcggcgccggtgggcagcaggtgctgcggccgccgaacggcgacgtcggggtggacgggatggtgatcgtgctcgggcacgagctggcggagctggcgacgaacccgctggtgaacgcgtggtacgccggagacacgcccacggcgccgacggagatcgccgacctctgcctcggcgtgtacggcgacggcggcggcgcgggcgggctcgtcgggaacgtgtcgcgcgccgccgacggcgcctcctacaacgtcaacggcgtcaacggccggcggttcatggtgcagtggctctggaaccccgtccgcggcgcgtgctacggccccaactccagcagctgaccgccgccgccatggccgccgggattcttgcgaggatggatcactcgatgccattgcgctcaatggctagtagaaacggaagactccatgggcagattcagagctcgacacctgaaaacgtcgcaccaatttgatctgatccctttcttgatcagagattcggggtgggttttgttcagatcgggagaaattctttgggttctgaattctgatcgatctgtaggagtgagaagcatgcaatttttttcatttcaatttattttatttgcagcataaattatgatcgatttaggggaatagaattgcattagtagaattccagcttgtttcaagcttcctcttgcttgctcaagcacagttgctgctttttttttttcactcctctcttttgactctgctttttcatcatggtaatctctgcagtttggtctccttgtctctcactctgtgacgctggtaagctttctgatagcagtttggttgaatggcttttgtttcttttgcagacatttttctttctttttttttcctgttgcttctgtatcacaattgacattcaggatgatcttgaatattga

SEQ ID NO: 3043 - DNA, 1502 bp, Brachypodium distachyon
ccccgtgttcccttctcattctagctctgccacttcactccacacatccccaaaaatggagaggctgctcccatgcccccctacccttcttccccttctcctcctcgtcctcctgctcgccgccgccatggccgccgtgcggagcgcgccggtgtacagggcggactacctggtggacggcaaccagctggtaaacatgcagtaccacatgggccccgtggtgtcgggttcccccacgaacctgtacctcatctggtacgggcggtgggatcccgcggcgcaggcggtgctccgcgacttcctggcctccctctcgtcccccgcggccccctccccctccgtctccgactggtgggcccgcgcgccgcgcctctacgcggaccagacgggcgccaacgtcaccgcggccttcgccgtcgccggggagcactccgactccggctactcgcacggcacctccctgcggcggatcgacgtgcagtccatcatccgcgccgccgtggtggcctacccggacccgctcccgctcgacccctacagcggcgcctacctggtgctctcctccccggacgtgcagatggaggagttctgccgcgccatgtgcggcttccactacttcaccttcgcctccgtcgtcggggtcacggtgccctacgcctgggtcgggaacagcggcacgcagtgccccgggaggtgcgcgtacccgttcgcccccgcgactgactacggcggcggctccggcggtggcgggcaggtgctgcggccgcccaacggggaccccggggtggacgggatggtgatcgtgctggggcacgagctggcggagctggccaccaacccgctggtgaacgcgtggtacgcgggggacacgcccacggcgcccacggagatcgccgacctctgcctcggcgtctacggcgacgggggcggcgccggcgggttcgtcgggaacgtgtcccgggcggccgacgggagcgcctacaacgtcaacggcgtcaacggccggcggttcctggtgcagtggctctggaaccccgtcctcggcaagtgctacggggccaatgccagcaactgacgcggccgccgctcgtttttccccccctcgcatccgcggagttctctctcgcagcaacggatcagtttatgccattgcgctcgatggcattgcggcagcaacaatggcgattccatggatggatggatgggtaattgggtatggcatgatacagaactcgaatgtctgaaacatgattcagactcgatctgtttctttattgttcggaggctcggatgggtctgtgcctctgtggatttttgttgatctgtaggaaggaaacgatgcaattttttctgcaggaggagaacaaatttagtctgtttctaatgtaatccagtaattgcagcataaaataagatcgatttgcaggggacacactttttgtgttcaatcttatactgcatgcttcattcatcatacagactcacaaaagtgtttcttgctt

SEQ ID NO: 3044 - DNA, 1628 bp, Brachypodium distachyon
ctctgccacttcactccacacatccccaaaaatggagaggctgctcccatgcccccctacccttcttccccttctcctcctcgtcctcctgctcgccgccgccatggccgccgtgcggagcgcgccggtgtacagggcggactacctggtggacggcaaccagctggtaaacatgcagtaccacatgggccccgtggtgtcgggttcccccacgaacctgtacctcatctggtacgggcggtgggatcccgcggcgcaggcggtgctccgcgacttcctggcctccctctcgtcccccgcggccccctccccctccgtctccgactggtgggcccgcgcgccgcgcctctacgcggaccagacgggcgccaacgtcaccgcggccttcgccgtcgccggggagcactccgactccggctactcgcacggcacctccctgcggcggatcgacgtgcagtccatcatccgcgccgccgtggtggcctacccggacccgctcccgctcgacccctacagcggcgcctacctggtgctctcctccccggacgtgcagatggaggagttctgccgcgccatgtgcggcttccactacttcaccttcgcctccgtcgtcggggtcacggtgccctacgcctgggtcgggaacagcggcacgcagtgccccgggaggtgcgcgtacccgttcgcccccgcgactgactacggcggcggctccggcggtggcgggcaggtgctgcggccgcccaacggggaccccggggtggacgggatggtgatcgtgctggggcacgagctggcggagctggccaccaacccgctggtgaacgcgtggtacgcgggggacacgcccacggcgcccacggagatcgccgacctctgcctcggcgtctacggcgacgggggcggcgccggcgggttcgtcgggaacgtgtcccgggcggccgacgggagcgcctacaacgtcaacggcgtcaacggccggcggttcctggtgcagtggctctggaaccccgtcctcggcaagtgctacggggccaatgccagcaactgacgcggccgccatggccgccgggattcttgcgaggatggatcactcgatgccattgcgctcaatggctagtagaaacggaagactccatgggcagattcagagctcgacacctgaaaacgtcgcaccaatttgatctgatccctttcttgatcagagattcggggtgggttttgttcagatcgggagaaattctttgggttctgaattctgatcgatctgtaggagtgagaagcatgcaatttttttcatttcaatttattttatttgcagcataaattatgatcgatttaggggaatagaattgcattagtagaattccagcttgtttcaagcttcctcttgcttgctcaagcacagttgctgctttttttttttcactcctctcttttgactctgctttttcatcatggtaatctctgcagtttggtctccttgtctctcactctgtgacgctggtaagctttctgatagcagtttggttgaatggcttttgtttcttttgcagacatttttctttctttttttttcctgttgcttctgtatcacaattgacattcaggatgatcttgaatattga

SEQ ID NO: 3045 - DNA, 12897 bp, Sorghum bicolor
gtcccatcgagaaagagaattaacgaatcctaaggcaaaggggcgagaaacgcaaggccaggccactcttcctccgggctttctttccgcactattatggacagtcaaataatgggaaaaattggattcaattgtcaaccggtcctatcgaaaataggattgactatggattcgagccatagcacatggtttcataaaatctgtacgattttcccgatctaaatcgagtgggtttccatgaagaagatcttgttcagcatgttctattcgatactggtaggagaagaaccgactcggtatcttaaaaaaagaggggaagcagaaccaagtcaagatgatatggatcgccccttcttcttgcgccaaagatcttaccatttctgaaggaactggggctacatttcttttcaatttccattcaagagtttctatctgtttccacgccctttttttgagacctcgaaacatgaaatggacaaattccttctcttaggaacacatacaagaaaaaggataatggtagccctcccattaactaatttaagaatggtagccctcccattaactaatttaagaatttcatagtaatagaaatccatgtcctaccgagacagaatttcgaacttgctatcctcttgcctaataggcaaagattgacctctgtagaaagactgattcattcggatcgatatgaggacccaactccgttgcattgccagaatccatgttccatatttgaagcgggttgacctctgtgcttctctcatggtacaatcctcttcctgctgagccccctttctcctcggtccacagagaaaaaatgtaggactggtgccgacagttcatcacggaagaaagaactcacagagccgggatcgctaactaatagaatagtactactaactaatactaatatatagataactaatactaatatatagatattaatactaatatatagatatatagaaatagatatctagaaatagaaacgaactaatatatagataatcgaaattgaaaagaactgtcttttctgtatactttccccgttctattgctaccgcgggtcttatgcaatcgatcggatcatatagatatcccttcaacacaacataggtcatcgaaaggatctcggacgactcaccaaagcacgaaagccagttagaaaatggattcctatttgaagagtgcctaaccgcatggataagctcacattaacccgtcaattttggatccaattcgggatttttcttgggaagtttcgggaagaaattggaatggaataatatcgattcatacagaggaaaaagttctctattgatgcaaacgctgtacctagaggatagggatagaggaagagggaaaaatcgaaatgaaataaataaagaataaagccaaaaaaataagtcgaagatagaagagcccagattcaaaatgaagaaatggaaactcgaaaaggatccttctgattctcaaagaatgaggggcaaggggattgataccgagaaagatttcttcttattataagacgtgatttgatccgcatatgtttggtaaaagaacaatcttctcctttaatcataaatggaaagtgttcaattagaacatgaaaacgtgactcaattggtcttagttagtcttcgggacggagtggaagaagggcggagactcccgaacgaggaaaaggatcccttcgaaagaattgaacgaggagccgtatgaggtgaaaatctcatgtacggttctgtagagggacagtaaggatgacttatctgtcgacttttccactatcaaccccaaaaaacccaactctgccttacgtaaagttgccagagtacgattaacctctggatttgaaatcactgcttatatacctggtattggccataatttacaagaacattctgtagtattagtaagaggaggaagggttaaggatttacccggtgtgagatatcgcattattcgaggaaccttagatgctgtcgcagtaaagaatcgtcaacaagggcgttctagtgcgttgtagattcttatccaagacttgtatcatttgatgatgccatgtgaatcgctagaaacatgtgaagtgtatggctaacccaataacgaaagtttcgtaaggggactggagcaggctaccatgagacaaaagatcttctttctaaagagattcgattcggaactcttatatgtccaaggttaatatggaaattctttcagaggttttcccttactttgtccgtgtcaacaaacaattcgaaatacctcgactttttcagaacaggtccgagtcaaatagcaatgattcgaagcacttctttttccattacactatttcggaaacctaaggactcgatcgtatggatatggaaaatacaggatttccggtcctagcgggaaaaggagggaaacggatactcaatttaaagtgagtaaacagaattccatactcgatctcatagatccctatagaattctgtggaaagccgtattcgatgaaagtcgtatgtacggcttggagggagatctttcctatctttcgagatccaccctacaatatggggccaaaaagccaaaaaaataagtgattcgtttttagcccttataaaaagaaaacggattcttgaacctctttcacgctcatgtcacgtcgaggtactgcagaaaaaagaaccgcaaaatccgatccaatttttcgtaatcgattagttaacatggtggttaaccgtattatgaaagacggaaaaaaatcattggcttatcaaattctctatcgagccgtgaaaaagattcaacaaaagacagaaacaaatccactattggttttacgtcaagcaatacgtagagtaactcccaatataggagtaaaaacaagacgtaataaaaaaggatcgacgcggaaagttccgattgaaataggatctaaacaaggaagagcacttgccattcgttggttattagaagcatcccaaaagcgtccgggtcgaaatatggctttcaaattaagttccgaattagtagatgctgccaaagggagtgggggtgccatacgcaaaaaggaagcgactcatagaatggcagaggcaaatagagctcttgcacattttcgttaatccatgaacagaatctaggtatgtagacacatggatccatacatctcgatcggaaaagaatcaatagaaggagaatcggacgatatctttttcgaaacaaataaaaaggaaaaaaaaaaagagaaaacagaaatcatgatcaactaagccctctcgggggcttgcttaagaataagaaagaggaatcttatggaaatagcatggaataaggtttgatcctattcatggggattccgtaaatatcccattccaaaaatcgaaacaatcgggacttttcggagattggctgcagttactaattcatgatctggcatgtacagaatgaaaacttcattctcgattctacgagaatttttatgaaagcgtttcatttgcttctcttcaatggaagtttcattttcccagaatgtatcctaatttttggcctaattcttcttctgatgatcgatttaacctctgatcaaaaagatagaccttggttctatttcatctcttcaacaagtttagtaataagcataacggccctattgttccgatggagagaagaacctataattagcttttcgggaaatttccaaacgaacaatttcaacgaaatctttcaatttcttattttattatgttcaactttatgtattcctctatccgtagagtacattgaatgtacagaaatggctataacagagtttctgttattcgtattaacagctactctagggggaatgtttttatgtggtgctaacgatttaataactatctttgtagctccagaatgtttcagtttatgttcctacctattgtctggatataccaagagagatctacggtctaatgaggctactatgaaatatttactcatgggtggggcaagctcttctattctggttcatggtttctcttggctatatggttcatctgggggggagatcgagcttcaagaaattgtgaatggtcttatcaatacacaaatgtataactccccaggaatttcaattgcgcttatattcatcactgtaggacttgggttcaagctttccccagccccttttcatcaatggactcctgacgtctacgaaggaaaagaagcgaggaatcctcttttcgactctgactcccccactccagtcgttgcttttctttctgttacttcgaaagtagctgcttcagctttagccacgcgaattctcgatattcctttttatttctcatcaaacgaatggcatcttcttctggaaatcctagctattcttagcatgatattggggaatctccttgctattactcaaacaagcatgaaacgtatgcttgcatattcgtccatagggcaaatcggatatgtaattattggaataattgttggagactcaaatgatggatatgcaagcatgataacttatatgctgttctatatctccatgaatctaggaacttttgcttgcattgtattatttggtctacgtaccggaactgataacattcgagattatgcaggattatacacgaaagatccttttttggctctctctttagccctatgtctcttatccctaggaggccttcctccactagcaggtttcttcggaaaactctatctattctggtgtggatggcaagcaggcctatatttcttggtttcaataggactccttacgagcgttctttctatctactattatctaaaaataatcaagttattaatgactggacgaaaccaagaaataaccccttatgtgcgaaattatagaagatcccctttaagatcaaacaattccatcgaattgagtatgactgtatgtgtgatagcatctactataccaggaatatcaatgaaccccattcttgcaattgctcaggataccctcttttagctgctaggtctatttcttagttcaagatccctcttactaactggaataaaagaattagtagatctgttccgcccaaaatgggaatgggtgctagggttatgaacttataatcatggaatcgactcgatcatcagattataagttcattccataccggaccagatcgtgcacattcttattatgagaaggggtcattcgagcctatggaaataggatactctgtttacatagaaatccctacgtccttacattctatttaggattaggaataggtgtaatcagacctgcttttgacatatctatcctatccttatttgttgggtaccatatgcacctctttgggcttctattgaatcgagaaattggattgtacatctttttgattttgatatcgattttgatacatataaggtgtcctacggataatgcaaatcgaagctatttgatgtctgactcaggcctatatgtatatgagcgatcgatcgaaatactccaagactccacctttgtcatatattccatatatcacattcgatagatatcatattcatggaatacgattcactttcaagatgccttgatggtgaaatggtagacacgcgagactcaaaatctcgtgctaaagagcgtggaggttcgagtcctcttcaaggcataatacggagaatgctcattgaatgagcattccccgtagaagtattccggaaatctgcgcctggcgctctcctctatcttctgaggtccttaaccatctccctgagaaaagtagacagtaaaagccaaaatagactaaatatagcctgaatgatcctaaaaacccctcgaaggagataataaagaacctaaagcagacggtatcctactgcaagggtggtcttaagaatccaaaagaggttgctcagaagagatagatgtatcccaacctctattgctctcgcgtaaagccttttttttacgcgacaggaaaaagtgactacgaattcccctttttgtttgcgaatccctgtttgtatcctttgagcgcacgcccataagtagcgatcaaggaaatcgatcaaacgatcccaataccgtgaaagagaaacttcccagatccagggaagcttatcataaagggcttcaacaaggggttttattcgttctttgagcaaaaagataaagatcggatagattcgaaccgcaattgcaaaggtaataactactatgccagcccaaatcatgatcttcaccaacttggatttggttctctcgcgaaaatcgcgagttgcagagatgagaaccctgaaaagcaagatcccgaataagaaaatagaaaccgaggaaaccacaagagtgaagactagtagagtctcatcttttgtcattctttgctcctttttcactcaatgattcattcgaatttcccaaccaaaaattctatatgtctattctatgatatttctatatatatagaatatgatatctaatatgacacccgatttgtcaaagggattggattggtgacttacccattcagtgactttggcactggacgttccaaaaacgggtactatcggatcgggtgaattagagaatagacagaggtccgttggcatttcagcttctcttctcctttcagggcctatccgaaagagaatccaggacctcttggtcctgaatatcagaataggacgaacgaaccggcctccgcggatatctttgcttcggaacaaaacaattagcattaggctcggtcaactggaatgtgtattatccatatgggagatcttccaatcgagaagatccatcgatctgagacgaagagaaagggcccattttctttacttattcagttaaaccaaggattcgttatggaaacagatagcaacaaccatttcatcagacatgcgtatttttgattatccggtggatttacacagtttcattaatgcaaattgtttgatgtagttagtactcaggttattcgacgctcaagaattcttatttaggcagttcatatcatcccatacatagtgttttgatctaagattgcaattcttccatgtttccgcagtagcatattgttccatggagctagggtccaaaataggaatcaacaagtgtttccacgactctaccgcccggccaatcctgttccactgaatcccctccctttttcatggccacatatctttacggctaaggagtgggaaatctttctcctgttacacaaatgaaatgtttcatttcatccgggaaaagccacctctttctccacaaacaatgtctttgtcatttgatccaggagccttccgttagataggaacagctttgctaaatactgagaactctcggatagagtattagaatgaaaagaccattaattatataaggaagaacccagggttctagcccattcccattcctaaatcactaattcgtagtgcttttgcctttcttgcgtactcctgatgaaccagttgctagccatatgtttaggaggcttttttctccaggtactggtactaagccgctttgccatctcttcatcttcatctgcaaagaattctcgacgtgaaaacacagagacaaaggcctgatctttgaataggaaaaagaatggatccgaaggtcccaaatcaattggcttattcgaaaaaagccttcttctttgaaagatatatctcgtgtctggtactgcattgttccactctgcaagaagtccgaatcagtctcttgcacctccccctttttatgataaatataccagaaataattcgaataaatagcagtctctgacaactcatcctctttaatctgcttggacccgctccaatacccataggaaaatccccagtcatattcagcgtacctgtccctgcaatcaaatagattgtcccaagggccccatattctaggagcccaagttatgctattgaaaattcgttcctctagcagttccggtttgaccattccgttccctttttcaaactccacttcttttcatatagcatccctaatcaaagagagaacaatatccatttcaaaacatttctaacggattccttggttcggaccgacgaagtaatggcactcgattattatcaacccgactgcaatctttttctgtcggtaaggattgcaccagagcaccttctacttctaataggccatgaactatagatagagaagaatcattctgagcgagtccataagaagcgacccactttttcatcggttccgggggaagaccaaagatcttgcgcgaccggtccgccagaaaaactcaaaagagaaagaagtctcgttaatctcttcatgctcgttccaagttcgaagtaccgtttggccaaagaaaaagccgcttcctgacacgattgcctctttatatagatagatataggatctatggggttattacttagaagtctattttgtacaagatcccctcctatctgatagaaaagggtcccatgatcccgagccggtcttatcttggctcgcaaaccccaagtttgtctatgaagagctaatctaattgtattagtttctataatggatttcttatgtggaatactaatggatagggcctcgttgctaagtgctacaagatctagtgcactggaactcgtggttatggacccgaatcctttagtatggaacattgtcttttccaagtaaaaacccctagtatatgaaagaatgaaaaggtgctttcgttcttgtggaataagaagccctcgtaccttaatgaaaggaaaataggaatttttcgttaggtatttgaccaaataggatcgtccagttcctatagaacctatcactaaaatacccgatagggctaagcggaacgaaaagggttttccatgagatggtaaatgaaaacgattagccccacacgaggtttgggaataagtgattgtctgataatgagcaaggaatatacgtctttctgctaaagaggatctattaaactcataattcattagatccttgttagcaatgtcaactaggtatcataagtaaatggatctcggttgttcaatcctttgataaccaaggtcattctttgctaaagagaaatgatcactatgggtcagactcaatagaattggatccattccaaatagcgagaattaggattcttgatccctctcaatctctctttcaattcgaggatccagagaggttttttcatagtcatctccgaatatttgccatctccgaatattttcgatttcatttttctatgatatgtctttctatatgaaaattggttatttacgatgtacgatgatccctgttaagcatccatggctgaatggttaaagcgcccaactcataattggtaaatttgcgggttcaattcctgctggatgcacgcgaacgggaacggtctattggaactggctctctatccatggaatctcatccatcatccatacataacgaattggtatggtatattcataccataacataagaacaataagaactcgaattcttatcgatactggaactcagagcataggagggaaagtcgatttatggatggaatcaaatacgcagtatttacagaaaagagtcttcgtttattgggaaagaatcaatatacttttaatgtcgaatcgggattcactaagacagaaataaagcattgggtcgaactcttctttggtgttaaggtagtagctgtgaatagccatcgactacccggaaagggtagaagaatgggacctattctgggacatacaatgcattacagacgtatgatcattacccttcaaccgggttattctattccacttctagatagagaaacgaactaaaggagaatacttaataatacggcgaaacatttatacaaaacacctatcccgagcacacgcaagggaaccgtagacaggcaagtgaaatccaatccacgaaataaattgatccatggacggcaccgttgtggtaaaggtcgtaatgccagaggaatcattaccgcaaggcatagagggggaggtcataagcgcctataccgtaaaatcgattttcgacggaatcaaaaagacatatctggtagaatcgtaaccatagaatacgaccctaatcgaaatgcatacatttgtctcatacactatggggatggtgagaagagatatattttacatcccagaggggctataattggagatactattgtttctggtacaaaagttcctatatcaatgggaaatgccctacctttgagtgcggtttgaactattgatttacgtaattggaagtaaccaattaggtttacgacgaaacctagaaatcgatcactgatccaatttgactacctctacgggatagacctcaacagaaaactgttgagtaacggcagcaagtgattgagttcagtagttcctcatagaaaattattgactctagagatatggtaatatggagaagacaaaattgtttgaagcacgcacagaaccggaagcgccccttgtttcaaagagaggaggacgggttattcacatttaatttgatggtcagaggcgaattgaaagctaagcagtggtaattaagaaccccgggtgaaaatagggatgtctcctacgttacccataatatgtggaagtatcgacgtaatttcatagagtcattcgatctgaatgctacatgaagaacataagccagatgacggaacgcggagacctaggatgtagaagatcataacatgagcgattcggcggatttggattccttttctatatatccactcatgtggtacttcatcatacgattcatataagatccatctgtctagagatcgtcatatacatctagaaagccgtatgctttggaagaagcttgtacagtttgggaaggggttttttgataaaaaagaagaatctacttcaaccgatatgcccttaggcacggccatacataacatagaaatcacacgtggaaggggtgggcaattagctagagcagcaggtgctgtagcgaaactgattgcaaaagagggtaaattggccactttaagattaccatctggggaggtccgtttggtatcccaaaactgcttagcaacagtcggacaagtgggtaatgttggggtgaaccaaaaaagtttgggtagagccggatctaagtgttggttaggtaaacgccccgtagtaagaggggtagttatgaaccctgtggaccacccccatgggggtggtgaagggaaagcccccattggtagaaaaaaacccacaaccccttggggttatcctgcgcttggaagaagaactaggaaaaggaaaaaatatagtgatagttttattcttcgtcgccgtaagtaaatacgtaactaggaatatggaaaattgcatttttggaaattgcaataatgcgatgggcgaacgacgggaattgaacccgcgcatggtggattcacaatccactgccttgatccacttggctacatccgccccttatccagctaaaggattttctcttttttccattcattattattctatttattctgacctacatacctcgatcgagatagtggacataggatgccactctttaaaatgaaaaaaaggagtaatcagctgtgacacgaaaaaaaacgaatccttttgtagctcgtcatttattggcaaaaatcgaaaaggtcaatatgaaggaggagaaagaaataatagtaacgtggtcccgggcatctagcattctacccgcaatggttggccatacaatcgcgattcataatggaaaagaacatatacctatttacataacaaatcctatggtaggtcgcaaattgggggaattcgtgcctactcggcatttcacgagttatgaaagtacaagaaaggatactaaatctcgtcgttaattgaattcagaatagaaagattcagaataaacaaagaaatacccaatatcctgttggaacaagatattgggtatttccggctttccttccttcaaaaattcctatatgtttaggagaaaaaccttatccattaagagatggaacttcaagagcagctaggtctagagggaagttgtgagcattacgttcgtgcattacctccataccaagattagcacggttaatgatatcagcccaagtattaataacgcgaccttggctatcaactacagattggttgaaattgaaaccatttaggttgaatgccatagtactaatacctaaagcagtgaaccagatccctactacaggccaagcagccaagaagaagtgtaaagaacgagagttgttgaaactagcatattggaagattaatcgaccgaaataaccgtgagcagccacaatattataagtctcttcttcctgaccaaatttgtaaccctcattagcagactcattttcagtggtttccctgatcaaactagaggttaccaaggaaccatgcatagcactgaatagggaaccgccgaatacaccagctacacctaacatgtgaaatggatgcataaggatgttgtgctctgcctggaatacaatcataaagttgaaagtaccagatattcctaaaggcataccatcagagaaacttccttgaccaatagggtaaatcaagaaaacagcagtagcagctgcaacaggagctgaatatgcaacagcaatccaagggcgcatacccagacggaaactaagttcccactcacgacccatataacaagctacaccaagtaagaagtgtagaacaattagctcataaggaccgccattgtataaccattcatcaacagatgcagcttcccaaattgggtaaaaatgcaatccgatcgccgcagaagtaggaataatagcaccagagataatattgtttccataaagtaaagaaccagaaacaggctcacgaataccatcaatatctactggaggagcagcgatgaaggcgataataaatacggaagttgcg

SEQ ID NO: 3046 - DNA, 3608 bp, Brachypodium distachyon
aaatagagctcttgcacattttcgttaatccatgaacagaatctaggtatgtagacacatggatccatacatctcgatcggaaaacagtagtttagaaggagaatcggacgatatctttctcgaaacaaacaaaaaggaaaagaaagagaaaacaaaaatcatgatcaactaagccctctcgagggcttgcttaagaataagaaagaagaatcttatggaaatggaataaggtttgatcctattcatggggattctgtaaatatgccattccaaaaatagaaacaatcaggacttttgggagattggatgcagttactaattcatgatctggcatgtacagaatgaaaacttcattctcgattctacgagaatttttatgaaagcgcttcatttgcttctcttccatggaagtttcattttcccagaatgtatcctaatttttggcctaattcttcttctgatgatcaattcaacctctgatcaaaaagatagaccttggttctatttcatctcttcaacaagtttagtaataagcataacggccctattgttccgatggagagaagaacctataattagcttttcgggaaatttccaaacgaacaatttcaacgaaatctttcaatttctcattttattatgttcaactttatgtattcctctatccgtagagtacattgaatgtacagaaatggctataacagagtttctgttattcgtattaacagctactctagggggaatgtttttattcggtgctaacgatttaataactatctttgtagcttcagaatgtttcagtttatgttcctacctattgtctggatataccaagagagatctacggtctaatgaggctactatgaaatatttactcatgggtggggcaagcttttctattctggttcatggtttctcttggctatatggttcatctggggggggagatcgagcttcaagaaattgtgaacggtcttatcaatacacaaatgtataactccctaggaatttcaattgcgcttatatccatcactgtaggacttgggttcaagctttccccagccccttttcatcaatggactcctgacatctaagaaggagtaaagaagcgaggaatcctctttccgactctgactcccccactccagtcgttgcttttctttctgttacttcgaaagtagctgcttcagcttcagccacgcgaattctcgatattcctttttatttctcatcaaacgaatggcatcttcttctggaaatcctagctattcttagcatgattttggggaatctccttgctattactcaaacaagcatgaaacatatgcttgcatattcgtccatagggcaaatcggatatgtaattattggaataattgttggagactcaaatgatggatatgcaagcatgataacttatatgctgttctatatctccatgaatctaggaacttttgcttgcattgtattatttggtctccgtaccagaactgataacattcgagattatgcaggattatacacgaaagatccttttttggctctctctttagccctatgtctcttatccctaggagccttcctccactagcaggtttcttcagaaaactctatctattctggtgtggatggcaagcaggcctatatttcttggtttcaataggactccttacgagcgttctttctatctactattatctaaaaataataaagttattaatgactagacgaaaccaagaaataaccccttatgtgagaaattatagaagatcccctttaagatcaaacaattccatcgaattgagtatgactgtatgtgtgatagcatctactataccaggaatatcaatgaaccccattcttgcaattgctcaggataccctcttttagctgctaggtctatttcttagttcaagatccctcttactaactggaataaaagaattagtagatctgttccgccaaaaatgggaatgggcgctagggttatgaacttataatcatggaatcgacttgatcatcagattataagttcattccataccggactagaccgtgcacattcttattatgagaagggggattcgagcctatggaaataggatactctatttacatagaaatccctacgtccttacattctatttaggattaggaataggtgtaagcagacctgcttttgacatatctatcctatttttatttgggtaccatatgcacctctttgggcttctattgaatcgagaaattggattgtacatctttcatctttttgattttgatatcgattttgatacatataaggtgtcctacggataatgcaaatcgaagctatttgatgtctgactcaggcctatatgaccgatcgatcgaaatactccaagactccacctttgtcatatattccatatatcgcattagatagatatcatattcatggaatacgattcactttcaagatgccttgatggtgaaatggtagacacgcgagactcaaaatctcgtgctgaagagcgtggaggttcgagtcctcttcaaggcataatatggagaatgctcattcaatgagcattccccgtagaagtattccggaaatctgcgcctggcgctctcctctatcttctgaggtccttaaccatctctctgaaaaaagtagacagtaaaagccaaaatagactaaatatagcctgaacgatcctaaaaatccctcgaaggagataataaagaacccaaagcggatggtatcctactgcaagggtggtcttaagaatccaaaagaggttgctcagaagagatagatgtatcccaacctctattgctctcgcgtaaagacttttttttacgcgacaagaaaaagtgactacgaattcccctttttgtttgtgaatccctatttgtatcctttgagcgcacgcccataagtagcgatcaaatcaaggaaatcgagcaaacgatcccaataccgtgaaagagaaacttcccagatccagggaagcttatcataaagggcttcgacaaggggttttattcgttctttgagcaaaaagataaagatcggatagattcgaaccgcaattgcaaaggtaataactactatgccagcccaaatcatgatcttcaccaacttggatttggttctctcgctaaaatcgcgagttgcagagatgagaatcatgaaaagcaagatcccgaataagaaaacagaaaccgaggaaaccacaagagtgaagactagtagagtctcgtcttttgtcattctttgctcctttttcactcaatgattctttctaatttccagaccaaaaattctatatgtctattctatgatatttctatatatatagaatatgatatctaatatgacacccgatttgtcaaaggggttggattggtgacttacccattcagtgactttggcactggacgttccaaaaacgggtactatcggctcgggtgaattagagaatagacagaggtccgttggcatttcagcctttcttctcctttcagggcctatccgaaagagaatccagtacctcttggtcctgaatatcagaataggacgaccgaactggcctccgcggatatctttgcttcggaacaaaac

SEQ ID NO: 3047 - DNA, 1573 bp, Brachypodium distachyon
ttactaattcatgatctggcatgtacagaatgaaaacttcattctcgattctacgagaatttttatgaaagcgcttcatttgcttctcttccatggaagtttcattttcccagaatgtatcctaatttttggcctaattcttcttctgatgatcaattcaacctctgatcaaaaagatagaccttggttctatttcatctcttcaacaagtttagtaataagcataacggccctattgttccgatggagagaagaacctataattagcttttcgggaaatttccaaacgaacaatttcaacgaaatctttcaatttctcattttattatgttcaactttatgtattcctctatccgtagagtacattgaatgtacagaaatggctataacagagtttctgttattcgtattaacagctactctagggggaatgtttttattcggtgctaacgatttaataactatctttgtagcttcagaatgtttcagtttatgttcctacctattgtctggatataccaagagagatctacggtctaatgaggctactatgaaatatttactcatgggtggggcaagcttttctattctggttcatggtttctcttggctatatggttcatctggggggggagatcgagcttcaagaaattgtgaacggtcttatcaatacacaaatgtataactccctaggaatttcaattgcgcttatatccatcactgtaggacttgggttcaagctttccccagccccttttcatcaatggactcctgacatctaagaaggacgaggaatcctctttccgactctgactcccccactccagtcgttgcttttctttctgttacttcgaaagtagctgcttcagcttcagccacgcgaattctcgatattcctttttatttctcatcaaacgaatggcatcttcttctggaaatcctagctattcttagcatgattttggggaatctccttgctattactcaaacaagcatgaaacatatgcttgcatattcgtccatagggcaaatcggatatgtaattattggaataattgttggagactcaaatgatggatatgcaagcatgataacttatatgctgttctatatctccatgaatctaggaacttttgcttgcattgtattatttggtctccgtaccagaactgataacattcgagattatgcaggattatacacgaaagatccttttttggctctctctttagccctatgtctcttatccctaggagccttcctccactagcaggtttcttcagaaaactctatctattctggtgtggatggcaagcaggcctatatttcttggtttcaataggactccttacgagcgttctttctatctactattatctaaaaataataaagttattaatgactagacgaaaccaagaaataaccccttatgtgagaaattatagaagatcccctttaagatcaaacaattccatcgaattgagtatgactgtatgtgtgatagcatctactataccaggaatatcaatgaaccccattcttgcaattgctcaggataccctcttttagctgc

SEQ ID NO: 3048 - DNA, 4135 bp, Zea mays
cggaagaaagaactcacagagccgggatcgctaactaatagaatagtactactaactaatactaatatatagataactaatactaatatatagatattaatactaatatatagatatatagaaatagatatctagaaatagaaacgaactaatatatagataatcgaaatcgaaaagaactgtcttttctgtatactttccccgttctattgctaccgcgggtcttatgcaatcgatcggatcatatagatatcccttcaacacaacataggtcatcgaaaggatctcggacgactcaccaaagcacgaaagccagttagaaaatggattcctatttgaagagtgcctaaccgcatggataagctcacattaacccgtcaattttggatccaattcgggatttttcttgggaagtttcgggaagaaattggaataatatcgattcatacagaggaaaaagttctctattgatgcaaacgctgtacctagaggatagggatagaggaagagggaaaaatcgaaatgaaataaataaagaataaagccaaaaaaataagtcgaagatagaagagcccagattcaaaatgaagaaatggaaactcgaaaaggatccttctgattctcaaagaatgaggggcaaggggattgataccgagaaagatttcttcttattataagacgtgatttgatccgcatatgtttggtaaaagaacaatcttctcctttaatcataaatggaaagtgttcaattagaacatgaaaacgtgactcaattggtcttagttagtcttcgggacggagtggaagaagggcggagactctcgaacgaggaaaaggatcccttcgaaagaattgaacgaggagccgtatgaggtgaaaatctcatgtacggttctgtagagggacagtaaggatgacttatctgtcgacttttccactatcaaccccaaaaaacccaactctgccttacgtaaagttgccagagtacgattaacctctggatttgaaatcactgcttatatacctggtattggccataatttacaagaacattctgtagtattagtaagaggaggaagggttaaggatttacccggtgtgagatatcgcattattcgaggaaccctagatgctgtcgcagtaaagaatcgtcaacaagggcgttctagtgcgttgtagattcttatccaagacttgtatcatttgatgatgccatgtgaatcgctagaaacatgtgaagtgtatggctaacccaataacgaaagtttcgtaaggggactggagcaggctaccatgagacaaaagatcttctttctaaagagattcgattcggaactcttatatgtccaaggttaatatggaaattctttcagaggttttcccttactttgtccgtgtcaacaaacaattcgaaatacctcgactttttcagaacaggtccgagtcaaatagcaatgattcgaagcacttctttttccattacactatttcggaaacctaaggactcgatcgtatggatatggaaaatacaggatttccggtcctagcgggaaaaggagggaaacggatactcaatttaaagtgagtaaacagaattccatactcgatctcatagatccctatagaattctgtggaaagccgtattcgatgaaagtcgtatgtacggcttggagggagatctttcctatctttcgagatccaccctacaatatggggccaaaaagccaaaaaaataagtgattcgtttttagcccttataaaaagaaaacggattcttgaacctctttcacgctcatgtcacgtcgaggtactgcagaaaaaagaaccgcaaaatccgatccaatttttcgtaatcgattagttaacatggtggttaaccgtattatgaaagacggaaaaaaatcattggcttatcaaattctctatcgagccgtgaaaaagattcaacaaaagacagaaacaaatccactattggttttacgtcaagcaatacgtagagtaactcccaatataggagtaaaaacaagacgtaataaaaaaggatcgacgcggaaagttccgattgaaataggatctaaacaaggaagagcacttgccattcgttggttattagaagcatcccaaaagcgtccgggtcgaaatatggctttcaaattaagttccgaattagtagatgctgccaaagggagtgggggtgccatacgcaaaaaggaagcgactcatagaatggcagaggcaaatagagctcttgcacattttcgttaatccatgaacagaatctaggtatgtagacacatggatccatacatctcgatcggaaaagaatcaatagaaggagaatcggacgatatctttttcgaaacaaataaaaaggaaaaaaaagagaaaacagaaatcatgatcaactaagccctctcgggggcttgcttaagaataagaaagaggaatcttatggaaatagcatggaataaggtttgatcctattcatggggattccgtaaatatcccattccaaaaatcgaaacaatcgggacttttcggagattggctgcagttactaattcatgatctggcatgtacagaatgaaaacttcattctcgattctacgagaatttttatgaaagcgtttcatttgcttctcttccatggaagtttcattttcccagaatgtatcctaatttttggcctaattcttcttctgatgatcgatttaacctctgatcaaaaagatagaccttggttctatttcatctcttcaacaagtttagtaataagcataacggccctattgttccgatggagagaagaacctataattagcttttcgggaaatttccaaacgaacaatttcaacgaaatctttcaatttcttattttattatgttcaactttatgtattcctctatccgtagagtacattgaatgtacagaaatggctataacagagtttctgttattcgtattaacagctactctagggggaatgtttttatgtggtgctaacgatttaataactatctttgtagctccagaatgtttcagtttatgttcctacctattgtctggatataccaagagagatctacggtctaatgaggctactatgaaatatttactcatgggtggggcaagctcttctattctggttcatggtttctcttggctatatggttcatctgggggggagatcgagcttcaagaaattgtgaatggtcttatcaatacacaaatgtataactccccaggaatttcaattgcgcttatattcatcactgtaggacttgggttcaagctttccccagccccttttcatcaatggactcctgacgtctacgaaggaaaagaagcgaggaatcctcttttcgactctgactcccccactccagtcgttgcttttctttctgttacttcgaaagtagctgcttcagctttagccacgcgaattctcgatattcctttttatttctcatcaaacgaatggcatcttcttctggaaatcctagctattcttagcatgatattggggaatctccttgctattactcaaacaagcatgaaacgtatgcttgcatattcgtccatagggcaaatcggatatgtaattattggaataattgttggagactcaaatgatggatatgcaagcatgataacttatatgctgttctatatctccatgaatctaggaacttttgcttgcattgtattatttggtctacgtaccggaactgataacattcgagattatgcaggattatacacgaaagatccttttttggctctctctttagccctatgtctcttatccctaggaggccttcctccactagcaggtttcttcggaaaactctatctattctggtgtggatggcaagcaggcctatatttcttggtttcaataggactccttacgagcgttctttctatctactattatctaaaaataatcaagttattaatgactggacgaaaccaagaaataaccccttatgtgcgaaattatagaagatcccctttaagatcaaacaattccatcgaattgagtatgactgtatgtgtgatagcatctactataccaggaatatcaatgaaccccattcttgcaattgctcaggataccctcttttagctgc

SEQ ID NO: 3049 - DNA, 3378 bp, Sorghum bicolor
gtcttatgcaatcgatcggatcatatagatatcccttcaacacaacataggtcatcgaaaggatctcggacgactcaccaaagcacgaaagccagttagaaaatggattcctatttgaagagtgcctaaccgcatggataagctcacattaacccgtcaattttggatccaattcgggatttttcttgggaagtttcgggaagaaattggaatggaataatatcgattcatacagaggaaaaagttctctattgatgcaaacgctgtacctagaggatagggatagaggaagagggaaaaatcgaaatgaaataaataaagaataaagccaaaaaaataagtcgaagatagaagagcccagattcaaaatgaagaaatggaaactcgaaaaggatccttctgattctcaaagaatgaggggcaaggggattgataccgagaaagatttcttcttattataagacgtgatttgatccgcatatgtttggtaaaagaacaatcttctcctttaatcataaatggaaagtgttcaattagaacatgaaaacgtgactcaattggtcttagttagtcttcgggacggagtggaagaagggcggagactcccgaacgaggaaaaggatcccttcgaaagaattgaacgaggagccgtatgaggtgaaaatctcatgtacggttctgtagagggacagtaaggatgacttatctgtcgacttttccactatcaaccccaaaaaacccaactctgccttacgtaaagttgccagagtacgattaacctctggatttgaaatcactgcttatatacctggtattggccataatttacaagaacattctgtagtattagtaagaggaggaagggttaaggatttacccggtgtgagatatcgcattattcgaggaaccttagatgctgtcgcagtaaagaatcgtcaacaagggcgttctaaatatggggccaaaaagccaaaaaaataagtgattcgtttttagcccttataaaaagaaaacggattcttgaacctctttcacgctcatgtcacgtcgaggtactgcagaaaaaagaaccgcaaaatccgatccaatttttcgtaatcgattagttaacatggtggttaaccgtattatgaaagacggaaaaaaatcattggcttatcaaattctctatcgagccgtgaaaaagattcaacaaaagacagaaacaaatccactattggttttacgtcaagcaatacgtagagtaactcccaatataggagtaaaaacaagacgtaataaaaaaggatcgacgcggaaagttccgattgaaataggatctaaacaaggaagagcacttgccattcgttggttattagaagcatcccaaaagcgtccgggtcgaaatatggctttcaaattaagttccgaattagtagatgctgccaaagggagtgggggtgccatacgcaaaaaggaagcgactcatagaatggcagaggcaaatagagctcttgcacattttcgttaatccatgaacagaatctaggtatgtagacacatggatccatacatctcgatcggaaaagaatcaatagaaggagaatcggacgatatctttttcgaaacaaataaaaaggaaaaaaaaaaagagaaaacagaaatcatgatcaactaagccctctcgggggcttgcttaagaataagaaagaggaatcttatggaaatagcatggaataaggtttgatcctattcatggggattccgtaaatatcccattccaaaaatcgaaacaatcgggacttttcggagattggctgcagttactaattcatgatctggcatgtacagaatgaaaacttcattctcgattctacgagaatttttatgaaagcgtttcatttgcttctcttcaatggaagtttcattttcccagaatgtatcctaatttttggcctaattcttcttctgatgatcgatttaacctctgatcaaaaagatagaccttggttctatttcatctcttcaacaagtttagtaataagcataacggccctattgttccgatggagagaagaacctataattagcttttcgggaaatttccaaacgaacaatttcaacgaaatctttcaatttcttattttattatgttcaactttatgtattcctctatccgtagagtacattgaatgtacagaaatggctataacagagtttctgttattcgtattaacagctactctagggggaatgtttttatgtggtgctaacgatttaataactatctttgtagctccagaatgtttcagtttatgttcctacctattgtctggatataccaagagagatctacggtctaatgaggctactatgaaatatttactcatgggtggggcaagctcttctattctggttcatggtttctcttggctatatggttcatctgggggggagatcgagcttcaagaaattgtgaatggtcttatcaatacacaaatgtataactccccaggaatttcaattgcgcttatattcatcactgtaggacttgggttcaagctttccccagccccttttcatcaatggactcctgacgtctacgaaggaaaagaagcgaggaatcctcttttcgactctgactcccccactccagtcgttgcttttctttctgttacttcgaaagtagctgcttcagctttagccacgcgaattctcgatattcctttttatttctcatcaaacgaatggcatcttcttctggaaatcctagctattcttagcatgatattggggaatctccttgctattactcaaacaagcatgaaacgtatgcttgcatattcgtccatagggcaaatcggatatgtaattattggaataattgttggagactcaaatgatggatatgcaagcatgataacttatatgctgttctatatctccatgaatctaggaacttttgcttgcattgtattatttggtctacgtaccggaactgataacattcgagattatgcaggattatacacgaaagatccttttttggctctctctttagccctatgtctcttatccctaggaggccttcctccactagcaggtttcttcggaaaactctatctattctggtgtggatggcaagcaggcctatatttcttggtttcaataggactccttacgagcgttctttctatctactattatctaaaaataatcaagttattaatgactggacgaaaccaagaaataaccccttatgtgcgaaattatagaagatcccctttaagatcaaacaattccatcgaattgagtatgactgtatgtgtgatagcatctactataccaggaatatcaatgaaccccattcttgcaattgctcaggataccctcttttag

SEQ ID NO: 3050 - DNA, 1580 bp, Zea mays
ttactaattcatgatctggcatgtacagaatgaaaacttcattctcgattctacgagaatttttatgaaagcgtttcatttgcttctcttccatggaagtttcattttcccagaatgtatcctaatttttggcctaattcttcttctgatggtcgatttaacctctgatcaaaaagatagaccttggttctatttcatctcttcaacaagtttagtaataagcataacggccctattgttccgatggagagaagaacctataattagcttttcgggaaatttccaaacgaacaatttcaacgaaatctttcaatttcttattttattatgttcaactttatgtattcctctatccgtagagtacattgaatgtacagaaatggctataacagagtttctgttattcgtattaacagctactctagggggaatgtttttatgtggtgctaacgatttaataactatctttgtagctccagaatgtttcagtttatgttcctacctattgtctggatataccaagagagatctacggtctaatgaggctactatgaaatatttactcatgggtggggcaagctcttctattctggttcatggtttctcttggctatatggttcatctgggggggagatcgagcttcaagaaattgtgaatggtcttatcaatacacaaatgtataactccccaggaatttcaattgcgcttatattcatcactgtaggacttgggttcaagctttccccagccccttttcatcaatggactcctgacgtctacgaaggaaaagaagcgaggaatcctcttttcgactctgactcccccactccagtcgttgcttttctttctgttacttcgaaagtagctgcttcagctttagccacgcgaattctcgatattcctttttatttctcatcaaacgaatggcatcttcttctggaaatcctagctattcttagcatgatattggggaatctccttgctattactcaaacaagcatgaaacgtatgcttgcatattcgtccatagggcaaatcggatatgtaattattggaataattgttggagactcaaatgatggatatgcaagcatgataacttatatgttgttctatatctccatgaatctaggaacttttgcttgcattgtattatttggtctacgtaccggaactgataacattcgagattatgcaggattatacacgaaagatccttttttggatctctctttagccctatgtctcttatccctaggaggccttcctccactagcaggtttcttcggaaaactctatctattctggtgtggatggcaagcaggcctatatttcttggtttcaataggactccttacgagcgttctttctatctactattatctaaaaataatcaagttattaatgactggacgaaaccaagaaataaccccttatgtgcgaaattatagaagatcccctttaagatcaaacaattccatcgaattgagtatgactgtatgtgtgatagcatctactataccaggaatatcaatgaaccccattcttgcaattgctcaggataccctcttttagctgc

SEQ ID NO: 3051 - DNA, 1578 bp, Oryza sativa
tactaattcatgatctggcatgtacagaatgaaaacttcattctcgattctacgagaatttttatgaaagcgtttcatttgcttctcttccagggaagtttcattttcccagaatgtatcctaatttttggcctaattcttcttctgatgatcgatttaacctctgatcaaaaagatagaccttggttctatttcatctcttcaacaagtttagtaataagcataacggccctattgttccgatggagagaagaacctataattagcttttcgggaaatttccaaacgaacaatttcaacgaaatctttcaatttcttattttattatgttcaactttatgtattcctctatccgtagagtacattgaatgtacagaaatggctataacagagtttctgttattcgtattaacagctactctagggggaatgtttttatgtggtgctaacgatttaataactatctttgtagctccagaatgtttcagtttatgttcctacctattgtctggatataccaagagagatctacggtctaatgaggctactatgaaatatttactcatgggtggggcaagctcttctattctggttcatggtttctcttggctatatggttcatctgggggggagatcgagcttcaagaaattgtgaacggtcttatcaatacacaaatgtataactccccaggaatttcaattgcgcttatatccatcactgtaggacttgggttcaagctttccccagccccttttcatcaatggactcctgacgtctacgaaggaaaagaagcgaggaatcctcttttcgactctgactcccccactccagtcgttgcttttctttctgttacttcgaaagttgctgcttcagcttcagccacgcgaattctcgatattcctttttatttctcatcaaacgaatggcatcttcttctggaaatcctagctattcttagcatgatattggggaatctccttgctattactcaaacaagcatgaaacgtatgcttgcatattcgtccatagggcaaatcggatatgtaattattggaataattgttggagactcaaatgatggatatgcaagcatgataacttatatgcttttctatatctccatgaatctaggaacttttgcttgcattgtattatttggtctacgtaccggaactgataacattcgagattatgcaggattatacacgaaagatccttttttggctctctctttagccctatgtctcttatccctaggaggccttcctccactagcaggtttcttcggaaaactctatctattctggtgtggatggcaagcaggcctatatttcttggtttcaataggactccttacgagcgttctttctatctactattatctaaaaatagtcaagttattaatgactggacgaaaccaagaaataaccccttatgtgcgaaattatagaagatcccctttaagatcaaacaattccatcgaattgagtatgactgtatgtgtgatagcatctactataccaggaatatcaatgaaccccattcttgcaattgctcaggataccctcttttagctg

SEQ ID NO: 3052 - DNA, 1597 bp, Oryza sativa
ttcggagattggatgcagttactaattcatgatctggcatgtacagaatgaaaacttcattctcgattctacgagaatttttatgaaagcgtttcatttgcttctcttccagggaagtttcattttcccagaatgtatcctaatttttggcctaattcttcttctgatgatcgatttaacctctgatcaaaaagatagaccttggttctatttcatctcttcaacaagtttagtaataagcataacggccctattgttccgatggagagaagaacctataattagcttttcgggaaatttccaaacgaacaatttcaacgaaatctttcaatttcttattttattatgttcaactttatgtattcctctatccgtagagtacattgaatgtacagaaatggctataacagagtttctgttattcgtattaacagctactctagggggaatgtttttatgtggtgctaacgatttaataactatctttgtagctccagaatgtttcagtttatgttcctacctattgtctggatataccaagagagatctacggtctaatgaggctactatgaaatatttactcatgggtggggcaagctcttctattctggttcatggtttctcttggctatatggttcatctgggggggagatcgagcttcaagaaattgtgaacggtcttatcaatacacaaatgtataactccccaggaatttcaattgcgcttatatccatcactgtaggacttgggttcaagctttccccagccccttttcatcaatggactcctgacgtctacgaaggaaaagaagcgaggaatcctcttttcgactctgactcccccactccagtcgttgcttttctttctgttacttcgaaagttgctgcttcagcttcagccacgcgaattctcgatattcctttttatttctcatcaaacgaatggcatcttcttctggaaatcctagctattcttagcatgatattggggaatctccttgctattactcaaacaagcatgaaacgtatgcttgcatattcgtccatagggcaaatcggatatgtaattattgaaataattgttggagactcaaatgatggatatgcaagcatgataacttatatgcttttctatatctccatgaatctaggaacttttgcttgcattgtattatttggtctacgtaccggaactgataacattcgagattatgcaggattatacacgaaagatccttttttggctctctctttagccctatgtctcttatccctaggaggccttcctccactagcaggtttcttcggaaaactctatctattctggtgtggatggcaagcaggcctatatttcttggtttcaataggactccttacgagcgttctttctatctactattatctaaaaatagtcaagttattaatgactggacgaaaccaagaaataaccccttatgtgcgaaattatagaagatcccctttaagatcaaacaattccatcgaattgagtatgactgtatgcgtgatagcatctactataccaggaatatcaatgaaccccattcttgcaattgctcaggataccctcttttagctg

SEQ ID NO: 3053 - DNA, 8290 bp, Ricinus communis
accttcgggaaaagcatgaaaaaaaaggctcgaatggtacgatccctccgtcgccccagaatgaaagggacgatctcgtagttcttggtctgtgaagatacgttgttaggtgctccattttattttcccattgaggccgaacctaaacctgtgctcgagagatagctgtccatacattgataagggatgtatggattctcgagaagagaggagccgtggtggtcccccccggaccgcccggatcccacgagtgaatagaaagttggatctacattggatctcacctgaatcgccccatctatcctcctgaggagaagtttggtttcaaaccccggttcgaacaggagaagtacgccatgctaatgtgccttggatgatccacatctcagggtcaggcgctgatgagcacattgaactatccatgtggctgagagccctcacagcccaggcacaacgacgcaattatcaggggcgcgctctaccactgagctaatagcccgtcgtgcgggcctcccgccgggggcccgctatgccaaaagcgagagaaaccccatccctctctttccttttttcgtccccatgtcgccacgcgggaggggcatggggacgaaaaaaggggatcctatcaacttgttccgacctaggataataagctcatgagcttgctcccttcttttggggtgtgaagcagtgtcaaaccaaaatacccaacaagcattacctctccctgaaaaggaggtgatccagccgcaccttccagtacggctaccttgttacgacttcactccagtcactagccctgccttcggcatccccctccttgcggttaaggtaacgacttcgggcatggccagctcccatagtgtgacgggcggtgtgtacaaggcccgggaacgaattcaccgccgtatggctgaccggcgattactagcgattccggcttcatgcaggcgagttgcagcctgcaatccgaactgaggacgggtttttggagttagctcaccctcgcgggatcgcgaccctttgtcccggccattgtagcacgtgtgtcgcccagggcataaggggcatgatgacttgacgtcatcctcaccttcctccggcttatcaccggcagtctgctcagggttccaaactcaacagtggcaactaaacacgagggttgcgctcgttgcgggacttaacccaacaccttacggcacgagctgacgacagccatgcaccacctgtgtccgcgttcccgaaggcacccctctctttcaagaggattcgcggcatgtcaagccctggtaaggttcttcgctttgcatcgaattaaaccacatgctccaccgcttgtgcgggcccccgtcaattcctttgagtttcattcttgcgaacgtactccccaggcgggatacttaacgcgttagctacagcactgcacgggtcgatacgcacagcgcccagtatccatcgtttacggctaggactactggggtatctaatcccattcgctcccctagctttcgtctctcagtgtcagtgtcggcccagcagagtgctttcgccgttggtgttctttccgatctctacgcatttcaccgctccaccggaaattccctctgcccctaccgtactccagcttggcagtttccaccgcctgtccagggttgagccctgggatttgacggcggacttaaaaagccacctacagacgctttacgcccaatcattccggataacgcttgcatcctctgtattaccgcggctgctggcacagagttagccgatgcttattccccagataccgtcattgcttcttctccgggaaaagaagttcacgacccgtaggccttctacctccacgcggcattgctccgtcaggctttcgcccattgcggaaaattccccactgctgcctcccgtaggagtctgggccgtgtctcagtcccagtgtggctgatcatcctctcggaccagctactgatcatcgccttggtaagctattgcctcaccaactagctaatcagacgcgagcccctcctcgggcggattcctccttttgctcctcagcctacggggtattagcagccgtttccagctgttgttcccctcccaagggcaggttcttacgcgttactcacccgtccgccactggaaacaccacttcccgtccgacttgcatgtgttaagcatgccgccagcgttcatcctgagccaggatcgaactctccatgagattcttagttgcattacttatagcttccttgttcgtagacaaagctgattcggaattgtctttcatttcagggcataacttgtatccatgcgcttcatattcgcttagagttcgctccaagaaatatagccatccctaccccctcacgtcaatcccacgagcctcttatctattctcattcgatcacgacggcgggggaacaagtcaaaatagaaaaactcacattgggtttagggataatcaggctcgaactgatgacttccaccacgtcaaggtgacactctaccgctgagttatatccctccccttgcccccatcgagaaagagaactgactaatcctaaggcaaaaggccgagaaactcaacgccactattcttgaacaacttggagtcgggccttcttttcgcactattacggatacgaaaataatgggaaaaattggattcaattgtcaactgctcctatcggaaataggattgactacggattcgagccatagcacatggtttcataaaagcgtatgattttcccgatctaaataaagcaggttttacatgaagaagatttggctcagcatgttctattcgatacgggtaggagaagaccccgactcggtattcttaaaaaaatagagaaatcagaaccaagtcaagatgatacggatcaaccccttcttcttgcgtcaaagatcttaccatttccaaaggaactggagttacatctcttttccatttccattcaagagttcttatgtgtttgtgtttccacacccccttgagaccccgaaaaatggacaaattccttttcttaggaacacatacaagattcgtcactacaaaaaggataatggtaaccccaccattaactatttcatttattaactacttcatttatgaatttcatagtaatagaaacaaaatacatgtatatcctaccgagacagaatttgtaacttgctatcctcttgcctagcaggcaaagatttacctccgtggaaaggatgattcattcggatcgacatgagagtccaactacattgcattgccagaatccatgttgtatatttgaaagaggttgacctccttgcttctttcatggtacaatcctcttctcgctgagcccctttctcctcggtccacagagacaaaatgtaggactgatgccaacagttcatcacggaagaaaggactcactgagccgggatcgctaactaatactaatcgaatactaatagaatagaaaatactaatagaatagaaaagaactgtcttttctgtatactttccccggttccgttgctaccgcgtgctttacgcaatcgatcggatcatatagatatcccaacataggtcatcgaaaggatctcggagacccaccaaagcacgaaagccaggatctttcagaaaatggattcctattcgaagagtgcataaccgcatggataagctcatactaacccgtcaatttgggatccaattcgggattttccttgggaggtgccgggaaggaatcggaatgtaataatatcgattcatacagatatagaagaaaaggttctttattgattcaaacgctgtacctatgggatagggatagcgaaagaggaaaaaaccgaagatttcacatagtacttttgatcgaaaaatcaatcttacccttcgctcaatgagaaaatgggtcagattctacaggatcaaacctatgggacttaaggaatgacggaagggaataaaaaaagaaataaaaaaagaaaagagagggaaaaataataataataaaataataataaaaaaaagaaataaataaataaaaatgaagtagaagagcccagattccaaatgaacaaattcaaacttgaaaaaaatctttctgattctcgaagaatgagggggcaaagggattgatcgagaaagatctcttgttcttattataagatcgtgattggatccgcatatgtttggtaaaaagaagaatcttctcctttgagaataatcaaaaaaggaaagtgttcaattggaacatgaaaacgtgactgaatttgtcctagttactcttcgggacggagtggatgaagggaggaacttctcgaacgaggaaaaggatccaatgacttcgaaagaattgaacgaggagccgtatgaggtgaaaatctcatgtacggttctgtagagtggcagtaagggtgacttatctgtcaacttttccactatcacccccaaaaaaccaaactctgccttacgtaaagttgccagagtacgattaacctctggatttgaaatcactgcttatatacctggtattggccataatttacaagaacattctgtagtcttagtaagagggggaagggttaaggatttacccggtgtgagatatcacattgttcgagggaccctagatgctgtcggagtaaaggatcgtcaacaagggcgttctaaatatggggtcaaaaagccaaaataaatgatttttttagcccttataaaaggaaaactgattcttgagaacccttgcacgctcatgtcacgtcgaggtactgcagaagaaaaaactgcaaaatccgatccaatttatcgtaatcgattagttaacatgttggttaaccgtattctgaaacacggaaaaaaaccattggcttatcaaattatctatcgagccatgaaaaagattcaacaaaagacagaaacaaatccactatctgttttacgtcaagcaatacgtggagtaactcccgatatagcagtaaaagcaagacgtgtaggcggatcgactcatcaagttcccgttgaaataggatccacacaaggaaaagcacttgccattcgttggttattaggggcatcccgaaaacgtccgggtcgaaatatggctttcaaattaagttccgaattagtggatgctgccaaagggagtggtgatgccatacgcaaaaaggaagagactcatagaatggcagaggcaaatagagcttttgcacattttcgttaacccatgaacaggatctatatagacacatagactcatggagccatacatctcgatcggaaaagaatcaatagaaaaagaaagaatcggaattgatcgctatatttctcgaaacaaaggaaaaggaagcgaaagatgaaacataaatcatggatcaattaagccctctcggggacttgcttaagaataagaaagaggtaaatgccatgaaataaggtttgatcatcctatttatggggattccgtaaatattccattccaaaaaaaaaagagaaagttcgaaacaattgggatttttttggagattggatgcagttactaattcatgatctggcatgtacagaatgaaaacttcattctcgattctacgagaatttttatgaaagcctttcatttgcttctcttcgatggaagttttattttcccagaatgtatcctaatttttggcctaattcttcttctgatgatcgattcaatctctgatcaaaaagatataccttggttatatttcatctcttcaacaagtttagtaatgagtataacggccctattgttccgatggggagaagaacctatgattagcttttcgggaaatttccaaacgaacaatttcaacgaaatctttcaatttcttattttactatgttcaactctatgtattcctctatccgtagagtacattgaatgtacagaaatggctataacagagtttctcttattcgtattaacagctactctaggaggaatgtttttatgcggtgctaacgatttaataactatctttgtagctccagaatgtttcagtttatgctcctacctattatctggatataccaagaaagatgtacggtctaatgaggctactatgaaatatttactcatgggtggggcaagctcttctattctggttcatgctttctcttggctatatggttcgtccgggggagagatcgagcttcaagaaatagtgaatggccttatcaatacacaaatgtataactccccaggaatttcaattgcgcttatattcatcactgtaggaattgggttcaagctttccccagccccttctcatcaatggactcctgacgtatacgaaggagtgcggaatcctcttttcgactctgactctcccactccagtcgttgcttttctttctgttacttcgaaagtagctgcttcagcttcagccactcgaattttcgatattcctttttatttctcatcaaacgaatggcatcttcttctggaaatcctagctattctgagcatgatagtggggaatctcattgctattactcaaacaagcatgaaacgtatgcttgcatattcgtccataggtcaaatcggatatgtaattattggaataattgttggagactcaaatggtggatatgcaagcatgataacttatatgctcttctatatctccatgaatctaggaacttttgcttgtattgtattatttggtctacgtaccggaactgataacattcgagattatgcaggattatacacgaaagatccttttttggctctctctttagccctatgtctcttatccctaggaggtcttcctccactagcaggttttttcggaaaactccatttattctggtgtggatggcaggcaggcctatatttcttggttttaataggactccttacgagcgttgtttctatctactattatctaaaaataatcaaattattaatgactggacgaaaccaagaaataacccctcacgtgcgaaattatagaagatcccctttaagatcaaacaattccatcgaattgagtatgattgtatgtgtgatagcatctactataccaggaatatcaatgaacccaattattgaaattgctcaagatacccttttttagcttctagaatctatttcttagttcaagatccctcttactaactggaatcaaagaattagtagatctgttccgcccaaaatgggaatgggttagggttatgaacttataatctataatctgataatcgagtcgattccatgattataagttcattccataccggaccagaccggaataggcttatatacattctcattatgagaaagaaggggttattcgagcgtatctaaatagatactatgtttacatatggatctctccgtcgttacattcttaggaataggcgtaatcggccccgtttttacatatatatctctccttattttggaccctcttctattcacctctttgggcttctattgaatcgagaaatgggtttgattgtccatttttttgatataatatataatataatatataaggcatcttccggataattcaaatcgaagcaattggatgtccgactcgggcctatatgacatgaccgatcaatagaaatactccaacactccacctttgtcatatattccatacatcacactagatagatatcatattcatggaatacgattcactttcaagatgccttggtggtgaaatggtagacacgcgagactcaaaatctcgtgctaaagagcgtggaggttcgagtcctcttcaaggcataatattgagaatgctcattcaatgagcaattcaataagagatctcggatcgaatcggtatatcaatatcgattcgatccgagatcttggaattggaataagttcggcagcggatcacgaaattttggtggtcttctctatctaatgaatggggagtccgctttgaaagcgtccgccctgcaaccacccccgagtatatgcttcaacaggaattacacaagggtagttgatacaataaaaacctctgggaaaatgcccgcccgtaacccaacagataaagtacattacatagtccgttttagggattggcgacttacccattcagtgactttggcactggatgttcccaaaataaaatgggtactctcgggtcgggtgaattcaataatagacgtctgttggcattccggccttccttctcctttccgggcctatccgaaagagaatccagtacttcttggtcgtgaatatctgaataggacgaaccgccccgtggatatctttgcttcggaacaaaacaattagaattaggc

SEQ ID NO: 3054 - DNA, 1574 bp, Populus trichocarpa
agttactaattcatgatctggcatgtacagaatgaaaacttcattctcgattctacgagaatttttatgaaagcctttcatttgcttctcttcgatggaagttttattttcccagaatgtatcctaatttttggcctaattcttcttctgatgatcgattcaacctctgatcaaaaagatatgccttggttatatttcatctcttcaacaagtttagtaatgagtataacggccctattgttccgatggagagaagaacctatgattagcttttcgggaaatttccaaacgaacaatttcaacgaaatctttcaatttcttattttactatgttcaactctatgtattcctctatccgtagagtacattgaatgtacagaaatggctataacagagtttctcttattcgtattaacagctactctaggaggaatgtttttatgcggtgctaacgatttaataactatctttgtagctccagaatgtttcagtttatgctcatacctattatctggatataccaagaaagatgtacggtctaatgaggctactacgaaatatttactcatgggtggggcaagctcttctattctggttcatggtttctcttggctatatggttcgtccgggggagagatcgagcttcaagaaatagtgaatggtcttatcaatacacaaatgtataactccccaggaatttcaattgcgcttatattcatcactgtaggaattgggttcaagctttccccagccccttctcatcaatggactcctgacgtatacgaaggagtgcggaatcctcttttcgactctgactctcccactccagtcgttgcttttctttctgttacttcgaaagtagctgcttcagcttcagccactcgaattttcgatattcctttttatttctcatcaaacgaatggcatcttcttctggaaatcctagctattctgagcatgatagtggggaatctcattgctattactcaaacaagcatgaaacgtatgctcgcatattcgtccataggtcaagttggctatgtaattattggaataattgttggagactcaaatggtggataagcaagcatgataacttatatgctcttctatatctccatgaatctaggaacttttgccagcattgtattatttggtctacgcaccggaactgataacattcgagattatgcaggattatacacgaaagatccttttttggctctctctttagccctatgtctcttatccctactctgtgggcgtacttccagtttcgttttttcagaaaactccatttattctggtgtggatcgcaggcaggcctatatttcttggtttcgataggactccttacgagcgttctttctatctactattatctaaaaataatcaagttattaatgattggacaaaaccaagaaataacccctcacgtgcgaaattatagaggatcccctttaagatcaaacaattccatcgaattgagtatgattgtatgtgtgatagcatctactataccgggaatatcaatgagcccgattattgaaattgctcaagatacccttttttag

SEQ ID NO: 3055 - DNA, 1594 bp, Ricinus communis
ttactaattcatgatctggcatgtaaagaataaaaacttcattctcgattctacgagaatttttatgaaagcctttcatttgcttctcttcgatggaagttttattttcccagaatgtatcctaatttttggcctaattcttcttctgatgatcgattcaatctctgataaaaaagatataccttggttatatttcatctcttcaacaagtttagtaataagtataatggccctattgttccgatggggagaagaacctatgattagcttttcgggaaatttccaaacgaacaatttcaacgaaatctttcaatttcttattttactatgttcaactctatgtattcctctatctgtaaagtatattgaatgtacagaaatggctataacagagtttctcttattcgtattaacagctactctaggaggaatgtttttatgcagtgctaacgatttaataactatctttgtagctccagaatgtttcagtttatgctcctacctattatctggatataccaagaaagatgtacggtctaatgaggctactatgaaatatttactcatgggtggggcaagctcttctattctggttcatgctttctcttggctatatggttcgtccgggggagagatcgagcttcaagaaatagtgaatggccttatcaatacacaaatgtataactccccaggaatttcaattgcgcttatattcatcactgtaggaattgggttcaagctttccccagccccttctcatcaatggactcctaacgtatacgaaggaaaagaagtgaggaatcctctttttgactctgactctcccactctagtcgttgcttttctttctattacttcgaaagtagctgcttcagcttcagccactcgaattttcgatattcctttttatttctcatcaaacgaatggcatcttcttctggaaattctagctattctgagcatgatagtgatgaatctcattgctattactcaaataagcatgaaacatatgcttgcatattcgtccataggtcaaatcggatatgtaattattggaataattattggagactcaaatggtggatatgcaagcatgataacttatatgctcttctatatctccatgaatctaggaacttttgcttgtattgtattatttggtctaagtaccggaactgataacattcgagaatatgcaggattatacacgaaagatccttttttggctctctctttagcccctatgtctcttatccctaggaggtcttcctccactagcaagttttttcggaaaactccatttattctggtgtggatggcaggcaggcctatatttcttggttttaataggactccttacgagcgttgtttctatctactattatctaaaaataatcaaattattaatgactggacgaaaccaagaaataacccctcacgtgcgaaattatagaagatcccctttaagatcaaacaattccattgaattgagtatgattatatgtgtgatagcatctactataccaggaatatcaatgaatccaattattgaaattgcttaagatacccgtttttagcttctataatctatttc

SEQ ID NO: 3056 - DNA, 1592 bp, Ricinus communis
ttactaattcatgatctggcatgtacagaatgaaaacttcattctcgattctacgagaatttttatgaaagcctttcatttgcttctcttcgatggaagttttattttccaagaatgtatcctaatttttggcctaattcttcttctgatgatcgattcaatctctgatcaaaaagatataccttagttatatttcatctcttcaacaagtttagtaatgagtataacggccctattgttccgatggggagaagaacctatgattagcttttcgaaaaatttccaaacgaacaattcaacgaaatctttcaatttcttattttactatgttcaactctatgtattcctctatccgtagagtacattgaatatacagaaatggctataacagagtttctcttattcgtattaacagctactctaggaggaatgtttttatgcggtgctaacgatttaataactatctttgtagctccagaatgtttcagtttatgctcctacctattatctggatataccaagaaagatgtacgttctaatgaggctactatgaaatatttactcatgggtggggcaagctcttctattctggttcatgctttctcttggctatatggttcgtccgggggagagatcgagcttcaagaaatagcgaatggccttatcaatacacaaatgtataactcctcaggacttttaattgcgcttatattcatcactgtaggaattgggttcaagctttccccagccccttctcatcaatggactcctgatgtatacgaaggaaaagaagtgaggaatcctcttttcgactctgactctcctactccagtctttgcttttctttctgttacttcgaaagtagctgcttcagcttcagccactcaaatttttgatattcctttttatttctcatgaaatgaatgacatcttcttttggaaatcctagctattctgagcatgatagtggggaatctcattgctattactcaaacaagcatgaaacatatgcttgcatatttgtccataggtcaaatcggatatgtaattattggaataattgttggagactcaaatggtggatatgcaagcatgataactcatatgctcttctatatctccatgaatctaggaacttttgcttgtattgtattatttggtctacgtactggaactgataacattcgagattatgcaggattatacacgaaagatccctttttggatctctctttagccctatgtctcttatccctaggaggtcttcctccactagcaggttttttcagaaaactccatttattctggtatggatggcaggcaggcctatatttcttggttttaataggactccttacgagcgttgtttctatctactgttatctaaaaataatcaaattattaatgacaagacgaaaccaagaaataacccctcacgtgcgaagttatagaagatcccctttaagatcaaacaattccatcgaattgagtatgattgtatgtgtgatagcatctactatactaggaatatcaatgaacccaattattgaaattgctcaagatacccttttttagcttctagaatctatttc

SEQ ID NO: 3057 - DNA, 1582 bp, Lotus japonicus
gttactaattcatgatctgacatgtacagaatgaaaacctcattctcgattctacgagaatttttatgaaagcctttcatttgcttctcttcgatggaagttttattttcccagaatgtatcctaatttttggtctaattcttcttctgatgatcgattcaacctctgatcaaaaagatatatcttggttctattttatctcttcaacaagtttagtaatgagcattgtggttctattgttccgatggagagaagaacctatgattagcttttcgggaaatttccaaacgaacaatttcaacgaaatctttcaatttcttattttactatcttcaactctatgtattcctctatccgtagagtacattgaatgtacagaaatggctataacagagtttctgttattcgtattaacagctactctaggaggaatgtttttatgcagcgctaacgatttaataactatctttgtagctccagaatgtttcagtttatgctcctatctactatctggatataccaagaaagatgtacggtctaatgaggctactatgaaatatttactcatgggtggggcaagctcttctattctggttcatggtttctcttggctatacggttcatccgggggagagatcgagcttcaagaaatagtgaatggtcttatcaatacacaaatgtataactccccgggaatttcaattgcgcttatattcatcactgtaggaattgggttcaagctctccctagccccttctcatcaatggactcctgacgtatacgaaggaaatcctcttttcgactctgactctcccactccagtcgttgcttttctttctgttacttcgaaagtagctgcttcagctttagccactcgaattttcgatattcccttttatttctcatcaaacgaatggcatcttcttctggaaatcctagctattcttagcatgatattagggaatctcattgctattacccaaacaagcatgaaacgtatgcttgcgtattcgtccataggtcaaatcggatatgtaattattggaataattgttggagactcaaatggtggatatgcaagcatgataacttatatgctgttctatatctccatgaatctaggaacttttgcttgcattgtatcatttggtctacgtaccggaactgataacattcgagattatgcaggattatacacgaaagatccttttttggctctctctttagcactatgtctcttatccttaggaggtcttcctccgctagcaggttttttcggaaaactttatttattctggtgtggatggcaggcaggcctatatttcttggtttcaataggacttcttatgagcgttgtttctatctactattatctaaaaataatcaagttattaatgactggacgaaaccaagaaataacccctcacgtgcgaaattataaaaggtcccctttaagatcaaacaattccatcgaattgagtatgattgtatgtgtgatagcatctactatatcaggaatatcaatgaacccgattattgaaattgctcaggatacccttttttagcttttagaatctatttc

SEQ ID NO: 3058 - DNA, 1594 bp, Medicago truncatula
attactaattcatgatttgacatgtacagaatgaaaatctcattctcgagtctacgagaatttttatgaaagcctttcatttgcttgttttcgatggaagttttatttttccggaattgatcctaatttttggtctaattcttcttctgatgattgattcaacctctgatcaaaaagatctatcttggttctattttatctcttcaacaagtttagtaatgagcataacggcgctgttgttccgatggagagaagaacctatgattagtttttcgggaaatttccaaacgaacaatttcaacgaaatctttcaatttcttattttactatcttcaactctatgtattcctctatccgtagagtacattgaatgtacagaaatggctataacagagtttctgttattcatattaaccgctactctaggaggaatgtttttatgcagcgctaatgatttaataactatctttgtagctctagaatgtttcagtttatgctcctatctactatctggatataccaagaaagatgtacggtctaatgaggctactatgaaatatttactcatgggtggagcaagctcttctattctggttcatggtttctcttggctatatggtttgtccgggggagagatagagcttcaagaaatagtgaatggtcttatcaatacacaaatgtataactcccctggaatttcaattgcgcttatattcatcactgtaggaattgggttcaagctttccctagccccttctcatcaatggactcctgacgtatatgaaggaaaagaagtgaggaatcctcttttcgactctgactctccgactccagtcgttgcttttctttctgttacttcgaaagtagctgcttcagcttcagccactcgaattttcgatattcttttttatttctcatcaaacgaatggcatcttcttctagaaatcctagctattcttagcatgctattagggaatcttattgctattactcaaacaagcatgaaacggatgcttgcttattcgtccataggtcaaattggatatgtaattattggaataattgttggagactcaaatgatggatatgcaagcatgataacttatatgctgttctatatctccatgaatctaggaacttttgcttgcattgtgttatttggtctacgtaccggaaccgataacattcgagattatgcaggattatacacaaaagatccttttttggctctctctttagccctatgtctattatccttaggaggtcttcctccactagcaggttttttcggaaaacttcatttattctggtgtggatggcaagcaggcctatatttcttggtttcaataggacttattacaagcgttgtttctatctactattatctaaaaataattaagttattaatgactggacgaaaccaagaaataactcctcacgtgcgaaattatagaaggtctcctgtaagatcaaacaattccatcgaattgagtatgattatatgtgtgatagcatctactgtaccaggaatatcaatgaaccccattattgaaattgctcaggatacccttttttagcttctaaaatccatttc

SEQ ID NO: 3059 - DNA, 3757 bp, Prunus persica
cgaaacataaatcgtggatcaactaagccctctcggggacttgtttaagaataagaaagaggaatctcatgtaaataccatggaataaggtttgatcctattcatggggattccgtaaaaattccattccaaaaagagaaagttcgaaagaattgggattttttggagattggatgcagttactaattcatgatctggcatgtatagaatgaaaacttcattctcgattctacgagaatttttatgaaagcctttcatttgcttctcttcgatggaagttttattttcccagaatgtatcctaatttttggcctaattcttcttctgatgatcgattcaacctctgatcaaaaagatataccttggttatatttcatctcttcaacaagtttagtaatgagcataacggccctattgttccgatggagagaagaacctacgattagcttttcgggaaatttccaaacgaacaatttcaacgaaatctttcaatttcttattttactatgttcaactctatgtattcctctatccgtagagtacattgaatgtacagaaatcgctataacagagtttctgttattcgtattaacagctactctaggaggaatgtttttatgcggtgctaacgatttaataactatctttgtagctccagaatgtttcagtttatgctcctacctattatctggatataccaagaaagatgtacggtctaatgaggctactacgaagtatttactcatgggtggggcaagctcttctattctggttcacggtttctcttggctatatggttcatccgggggagagatcgagcttcaagaaatagtgaatggtcttatcaatacacaaatgtataactccccaagaatttcaaatgcgcttatattcatcactgtaggaattgggttcaagctttccccagccccttctcatcaatggactcctgacgtatacgaaggagtgcggttcgttcgataaattcctacctctctatctatctctgagatgtttggatttttcaaaactccatggacatgcagaagagaaataagtgaggaatcctcttttcgactctgactctccgactccagttgttgcttttctttctgttactttgaaagtagctgcttcagcttcagccactcgaattttcgatattcctttttatttctcatcaaacgaatgacatcttcttctggaaatcctagctattcttagcatgatattggggaatctcattgctattactcaaacaagcatgaaacgtatgcttgcgtattcgtccataggtcaaattggatatgtaattattggaataattgttggagactcaaatggtggatatgcaagcatgataacttatatgctgttctatatctccatgaatctaggaacttttgcttgcattgtattatttggtctacgtaccggaactgataacattcgagattatgcaggattatacacaaaagatccttttttggctctctctttagccctatgtctcttatccttaggaggtcttcctccactagcaggttttttcggaaaacttcatttattctggtgtggatggcaggcaggcctatatttcttggtttcaataggactccttacgagcgttgtttctatctactattatctaaaaataatcaagttattaatgactggacgaaaccaagaaataacccctcacgtgcgaaattatagaagatcccctttaagatcaaacaattccatcgaattgagtatgattgtatgtgtgatagcatctactataccaggaatatcaatgaacccgattattgaaattgctcaggatacccttttttagcttctagaatctatttcttagttcaagatccctcttactaactggaatcaaagaattagtagatctgttccgcccaaaatgggaatgggctagggttatgaacttataatctataatctgatgatcgagtcgattccatgattataagttcattccataccggaccagaccggaatagggttatatacattctaattatgagaaggggtcattcgagcgtatctaaataggtactatgtttacatatggatccctacgtcgttacattccatttaggattaggaataggcgtaatcggacctgctttttacatatctcgcgttatttgggatgggaccctattcacctctttgggcttctattgaatcgagaaatcggtttgattgtccatctttttgatataataatatatttgataatatatataatatataaggcatcctccggataattcaaatcgaagcaattggatgtccgactcgggcctatatgacatgactgatcaatagaaatactctaacactccacctttgtcatatattccatacatcgcactggataggtatcatattcatggaatacgattcactttcaagatgccttggtggtgaaatggtagacacgcgagactcaaaatctcgtgctaaagagcgtggaggttcgagtcctcttcaaggcataatattgaatattgagaatgctcattgacttggaataagttcggcagcggatcacgaaatcttggtgatcttctctatctaatgaatggggagtctgctttgaaatcgtccgccctgcaccccccccccgagtatatgcttcaacaggaatcacacaagggtagattgatacaatagaaacctctggtaaaatgcccacccgtaatccagcagataaagtacattacatagtccgttttagggattggcgacttacccattcagtgactttggcactggacgttcccaaaatgggtactgtactatcgggtcgggtgaattcaataatagacgcccgttggcattccagccttccttctcctttcaagggcctatccgaaagagaatccagtacttcttggtcgtgaatatctgaataggacgaaccgccccgtggatatctttgcttcggaacaaaacaattagaattagtcggtcaactggaatgtgtattatccatataggggatctttcaattgagaagatccgtcgacctgagatgaagagaaatgtctatctattttatttagttattcagttaaaccaatgagtcattattgtagcagatagcaacaaccatttcatccgacatgcgtttttttgattttccaatggatttacatctttcattaatggaaattttttgatgtagtgagtaatagctctggttgtttgctgttcaagaattcttgtttaggcagttcatacgatccatacataatgttttgatctaagatttcaattgttccatgtttcagcagtagttagtatattgttccatggagctaaggtccaaaatatggaagaaacaggtgtttccacgactctaccacccagtcaattctgttccacttaatccctgtttcatggccacatatctttccggctaaggaatgggaaacctttctcttgttacatgaatccaattttcatttcatccgggaaaagccatctttttctcaacaatgtctttgtcatttgatccaatagcgttccgttagataggaacagctttgataaatactgataactctcggatggagtattagaacggaaaaatccattagataatgaactattggttctaagccatttctggcgatgaatcaacaattcgaagtacctttcttgcgtattcttgataaaccagcgtttatatatagatgtaggaagatctgtttgggaagtaagaagcccc

SEQ ID NO: 3060 - DNA, 1598 bp, Brachypodium distachyon
ttactaattcatgatctggcatgtacagaatgaaaacttcattctcgattctacgagaatttttatgaaagcacttcatttgcttgtcttccatggaagtttcattttcccagaatgtatcctaatttttggcctaattcttcttctgatgatcgattcaacctctaatcaaaaagatagaccttggttctatttcatctcttcaacaagtttagtaataagcataatggccctattgttccgatcgagagaagaacctataattagcttttcgggaaatttccaaacgaacaatttcaatgaaatctttcaatttctcattttattatgttcaactttatgtattcctctatccgtagagtacattgaatgtacagaaatggctataacagagtttctgttattcgtattaacagctactctagggggaatgtttttatgtggtgctaacgatttaataactatctttgtagcttcagaatattacagtttatgttcctacctattgtctggatataccaagagagatctacggtctaatgaggctactatgaaatatttactcatgggtggggcaagctcttctattctggttcatggtttctcttggctatatggttcatctgggggggagatcgagcttcaagaaattgtgaacggtcttatcaatacacaaatgtataactccccaggaatttcaattgcgcttatatccatcactgtaggacttgggttcaagctttccccagccccttttcatcaatggactcctgacgtctacgaaggaaaagaagcgaggaatcctcttttcgactctaactcccccactccagtcattgcttttctttctgttacttcgaaagtagttgcttcagctttagccacgcgaattttcgatattcctttttatttctcatcaaacgaatggcatcttcttctggaaatcctagctattcttagcatgattttggggaatctccttgctattactcaaacaagcatgaaacgtatgcttgcatattcgtccatagggcaaattggatatgtaattattggaataattgttggagacttgaagcgatcctcccccttactagggttcgatctttattcaaatgatggatatgcaagcatgataacttatatgctgttatatatctccatgaatctaggaacttttgcttgcattgtattatttggtctacgtaccggaactgatagcattcgagattatgcaggattatacacgaaagatccttttttggctctctctttagccctatgtctcttatccctaggaggccttcctctactagcagatttcttcggaaaactctatctattctggtgtggatggcaagcaggcctatatttcttggtttcaataggactccttacgagcgttctttctatcttctattatctaaaaataataaagttattaatgactggacgaaaccaagaaataaccccttatgtgagaaattatagaagatcccctttaagatcaaacaattccatcgaattgagtatgacagtacgtgtgatagcatctactatatcaggaatatcaatgaaccccattcttgcaattgctt

SEQ ID NO: 3061 - DNA, 1596 bp, Brachypodium distachyon
tactaattcatgatctggcatgtacagaatgaaaacttcattctcgattctacgagaatttttatgaaagcacttcatttgcttgtcttccatggaagtttcattttcccagaatgtatcctaatttttggcctaattcttcttctgatgatcgattcaacctctaatcaaaaagatagaccttggttctatttcatctcttcaacaagtttagtaataagcataatggccctattgttccgatcgagagaagaacctataattagcttttcgggaaatttccaaacgaacaatttcaatgaaatctttcaatttctcattttattatgttcaactttatgtattcctctatccgtagagtacattgaatgtacagaaatggctataacagagtttctgttattcgtattaacagctactctagggggaatgtttttatgtggtgctaacgatttaataactatctttgtagcttcagaatattacagtttatgttcctacctattgtctggatataccaagagagatctacggtctaatgaggctactatgaaatatttactcatgggtggggcaagctcttctattctggttcatggtttctcttggctatatggttcatctgggggggagatcgagcttcaagaaattgtgaacggtcttatcaatacacaaatgtataactccccaggaatttcaattgcgcttatatccatcactgtaggacttgggttcaagctttccccagccccttttcatcaatggactcctgacgtctacgaaggaaaagaagcgaggaatcctcttttcgactctaactcccccactccagtcattgcttttctttctgttacttcgaaagtagttgcttcagctttagccacgcgaattttcgatattcctttttatttctcatcaaacgaatggcatcttcttctggaaatcctagctattcttagcatgattttggggaatctccttgctattactcaaacaagcatgaaacgtatgcttgcatattcgtccatagggcaaattggatatgtaattattggaataattgttggagacttgaagcgatcctcccccttactagggttcgatctttattcaaatgatggatatgcaagcatgataacttatatgctgttatatatctccatgaatctaggaacttttgcttgcattgtattatttggtctacgtaccggaactgatagcattcgagattatgcaggattatacacgaaagatccttttttggctctctctttagccctatgtctcttatccctaggaggccttcctctactagcagatttcttcggaaaactctatctattctggtgtggatggcaagcaggcctatatttcttggtttcaataggactccttacgagcgttctttctatcttctattatctaaaaataataaagttattaatgactggacgaaaccaagaaataaccccttatgtgagaaattatagaagatcccctttaagatcaaacaattccatcgaattgagtatgacagtacgtgtgatagcatctactatatcaggaatatcaatgaaccccattcttgcaattgct

SEQ ID NO: 3062 - DNA, 1564 bp, Solanum lycopersicum
ttactaattcatgatctatcatgtacagaatgaaaacttcattctcgattctacgagaatttttgtaaaagcctttcatttgcttctctctgatggaagtttgattttcccagaatgtatcctaatttttggcctaattcttcttctgatgatcgattcaacctcttatcaaaaagatataccttggttatatttcatctcttcaataagtttagtaatgagcataacggccctattgttctgatggagagaagaacctatgattagcttttcgggaaatttccaaacgaacaatttcaacaaaatctttcaatttcttattttactatgttcaactctatgtattcctctatccgtagagtacattgaatgtaaagaaatggctataacagagtttctcttattcttattaacaactactctagggggaatgtctttatgcggtgctaacgatttaataactatctttgtagtaccagaatgtttcaatttatgctcctacctattatctggatataccaagaaagatgtacggtctgatgaggctactatgaaatatttactcatgggtggggcaagctcttctattctggttcatcgtttctcttggctatatggttcatccgggggagagattgggcttcaagaaatagtaaacggtcttatcaatacacaaatgtataactccccaggaatttcaattgcgctcatattcattaccgtaagaattgggttcaagctttccccagccccttctcatcaatggactcctgacgtatacgaaggaaaagaagtgaggaatcctcttttcgactctgactctcccactccagtcgttgcttttgtttctgttacttcgaaagtagctgcttcagcttcagccactcgaattttcgatattcctttttatttctcatgaaacgaatggcatcttcttctggaaatcctagctgttcttagcatgatattgggaaatttcattgctgctactcaaacaagcatgaaacgtatgcttgcatattcgtccataggccaaatcggatatgtaattattggaataattgtttgagactcaaataatggatatgcaagcatgataacttatatgttgttctatgtctccatgaatctaggaacttttgcttgcattgtattatttggtcgacgtaccggaactgataacatttgagattatgcaggattatacacaaaagatccttttttggctctctctttagccctatgtctcttatccctaggaggttttttcagaaaactctatttattctggtgtggatggcagacaggcctatatttcttggttttaataggactccttacaagcgttgtttctatctactattatctaaacataatcaagttattaatgactggacgaaaccaagaaataacccctcacgtgcgaaattatagaagatcccctttaagatcaaacaattccatcgaattgagtatgattgtatatgtgatagcatctactataccaggaatatcaatgaaccttattattgcaattgctcaggatagacatgttttagcttct

SEQ ID NO: 3063 - DNA, 1623 bp, Coffea canephora
atgatctggcatgtacagaatgaaaacttcattctcgattctacgagaatttttatgaaagcctttcatttgcttctcttcgatggaagtttgattttcccagaatgtatcctaatttttggcctaattcttcttctgatgatcgattcatcctcggatcaaaaagatataccttggttatatttcatcccttcaacaagtttagtaatgagcataacggccctattgttccgatggagagaagaacctatgattagcttttcgggaaatttccaaacgaacaatttcaacgaaatctttcaatttcttattttactatgttcaactctatgtattcctctatccgtagagtacattgaatgtacagaaatggctataacagagtttctcttattcgtattaacagctactctaggaggaatgtttttatgcggtgctaacgatttcataactatctttgtagctccagaatgtttcagtttatgctcctacctattatctggatataccaagaaagatgtacggtctaatgaggctactatgaaatatttactcatgggtggggcaagctcttctattctggttcatggtttctcttggctatatggttcatctgggggagagatcgagcttcaagaaatagtgaatggtcttatcaatacacaaatgtataactccccaggaatttcaattgcgctcatattcatcactgtaggaattgggttcaagctttccccagccccttctcatcaatggactcctgacgtatacgaaggagtgcggttcgttcgagaaattcctacctctctatctatctctgagatgtttggatttttcaaaactccatggacatgcagaagagaaatatctcccactcccgtcgttgcttttctttctgttacttcgaaagtagctgcttcagcttcagccactcgaattttcgatattcctttttatttctcatcaaacggatggcatcttcttctggaaatcctagctattcttagcatgatattgggaaatctcattgctattactcaaacaagcatgaaacgtatgcttgcatattcgtccataggtcaaatcggatatgtaattattggaataattgttggagactcaaatgatggatatgcaagcatgataacttatatgctcttctatatctccatgaatctaggaacttttgcttgcattgtattatttggtctacgtaccggaacagataacattcgagattatgcaggattatacacgaaagatccttttttggctctctctttagccctatgtctcttatccctaggaggcctgcctccactagcaggttttttcggaaaactctatttattctggtgtggatggcaggcaggcctatatttcttggttttaataggactccttacaagcgttgtttctatctactattatctaaaaataatcaagttattaatgactggacgaaaccaagaaataacccctcacgtgcgaaattatagaagatctcctttaagatcaaacaattccatcgaattgagtatgattgtatgtgtaatagcatctactataccaggaatatcaatgaacccgattattgcaattgctcaggatagccttttttag

SEQ ID NO: 3064 - DNA, 1411 bp, Ricinus communis
ttactaattcatgatctggcatgtacaaaatgaaatcttcattctcgattctacgagaatttttatgaaagcctttcatttgcttctcttcgatggaagttttattttcccagaatgtatcctaattttttgcctaattcttcttctgatgatcgattcaatctctgatcaaaaagatataccttggttatatttcatctcttcaacaagtttagtaatgagtataacgaccctattgttccgatggggagaataacctatgattagcttttcgggaaatttccaaacgaacaatttcaacgaaatctttcaatttcttattttactatgttcaactctatgtattcctctatccgtagagtacattgaatgtacagaaatggctataacagagtttctcttattcgtattaacagctactctaggaggaatgtttttatgcggtgctaacgatttaataactatctttgtagctccagaatgtttcagtttatgctcctacctattatctggatataccaagaaagatgtacggtctaatgaggctactatgaaatatttactcatgggtggggcaagctcttctattctggttcatgctttctcttggctatatggttcgtccgggggagagatcgagcttcaagaaatagtgaatggccttatcaatacacaaatgtataactccccaggaatttcaattgcgcttatattcatcactgtaggaattgggttcaagctttccccagccccttctcatcaatggactcctgacgtatacgaaggaaaagaagtgaggaatcctcttttcgactctgactctcctactccagtcgttgcttttctttttgttacttcgaaagtagctgcttcagcttcagccactcgaattttcgatattcctttttatttctcatcaaacgaatggtatattcttctgtaaatcctagctattctgagcatgatagtggggaatctcattactattactcaaacaagcatgaaacgtatgcttgcatattcgtccataggtcaaattggatatgtaattattggaataattgttggagactcaaatggtggatatgcaagcatgataacttatatgctcttttatatctccatgaatctaggaacttttgcttgtattgtattatttagtctacataccggaactgataacattggagattatgcagaattatacacgaaagatccttttttggctctctctttagccctatgtctcttatccttaggaggtcttcctccactagcaggttttttcggaaaactccatttattctggtgtggatggccggcaagcctatattttttagttttaataggactccttacgagcgttgtttctatttactattatctaaaaataatcaaattattaatgtac

SEQ ID NO: 3065 - DNA, 1022 bp, Sorghum bicolor
gctccattccatttgctgctagtttcctctgcttctcctccgttcgttcattcttccgtgcacttccagttccagcaaccccatcatctgctggctgctctaaccagctgcagagctgctccaatggccaccttgtccgccatctccgccaaggccggctactgcaaggcaccaacgctgagctggaagggaagcagagtttcagcccggaatgtggtctccatggcgaccacccggagaggaggcctcgtctccctaagatcccctcggtttcgcgtctacgcggcaaaggcggagacggtgagcaaggtgatggacatcgtgaagcagcagctggcgctggcggcggacgtggggctgacggcggagtccaagttcgcggacctgggcgccgactcgctggacacggtggagatcgtcatggcgctggaggaggagttcaagatcaccgtcgaggaggacaacgcccagagcatcaccaccatccaggaggccgccgacctcatcgacaagctcgtcgaccagaacccagcggcggcggcgccgccggcatgatgagacgagacaacatcgaaacctctatacatgagcattattggttgatcgatctctagctagagacaatctggacggatggaagagctgatcgttgccaggattttttttgtttcatctgtattccagcattagctagcgtcgttgatgttcgacgacagacattatagccagctctcctttcaatttccgcaactttttagctgtgtgtggtgagtgcgtgggttcttttttgttaggagaagatgattgatgaacatgttatgcgctaaaatgcttccaacttttttccccagctaattaaccggaattggtcgacatgcacgaacgtgttcatgtactcccatactcctgcttcgcagtagtgacctgtatgctaacctgtgtcaggctccaattattgccctgtttgtttggacactgttttgatgatttgttgtaagaaaaaggcgatataaactgtgtca

SEQ ID NO: 3066 - DNA, 1184 bp, Sorghum bicolor
agctcctgggcccacatgcagagataacaggagccaggagcgtgagagtgtatgtaagccggagcgggtggccagaatcgcgccacctcggagcccaggatttaatctaatccaaaacccctcctccggtctcactgccctgctccattccatttgctgctagtttcctctgcttctcctccgttcgttcattcttccgtgcacttccagttccagcaaccccatcatctgctggctgctctaaccagctgcagagctgctccaatggccaccttgtccgccatctccgccaaggccggctactgcaaggcaccaacgctgagctggaagggaagcagagtttcagcccggaatgtggtctccatggcgaccacccggagaggaggcctcgtctccctaagatcccctcggtttcgcgtctacgcggcaaaggcggagacggtgagcaaggtgatggacatcgtgaagcagcagctggcgctggcggcggacgtggggctgacggcggagtccaagttcgcggacctgggcgccgactcgctggacacggtggagatcgtcatggcgctggaggaggagttcaagatcaccgtcgaggaggacaacgcccagagcatcaccaccatccaggaggccgccgacctcatcgacaagctcgtcgaccagaacccagcggcggcggcgccgccggcatgatgagacgagacaacatcgaaacctctatacatgagcattattggttgatcgatctctagctagagacaatctggacggatggaagagctgatcgttgccaggattttttttgtttcatctgtattccagcattagctagcgtcgttgatgttcgacgacagacattatagccagctctcctttcaatttccgcaactttttagctgtgtgtggtgagtgcgtgggttcttttttgttaggagaagatgattgatgaacatgttatgcgctaaaatgcttccaacttttttccccagctaattaaccggaattggtcgacatgcacgaacgtgttcatgtactcccatactcctgcttcgcagtagtgacctgtatgctaacctgtgtcaggctccaattattgccctgtttgtttggacactgttttgatgatttgttgtaagaaaaaggcgatataaactgtgtcaggctgtcagctttgtttctta

SEQ ID NO: 3067 - DNA, 809 bp, Saccharum officinarum
agtcccagccccatctgctggctgctctaaccagctgcagagctgctccaatggccaccttgtccgccatctccgccaaggccggctacggctactgcagggcaccaaccctgagctggaagggaagcagagtctcagaccggaatgtggtctccatggcgaccacccgaagaggaggcctcctcgtctccctaagatcccctcggtttcgcgtctacgcggcgaaggcggagacggtgagcaaggtgatggacatcgtgaagcagcagctggcgctggcggcggacgtggggctgacggcggagtccaagttcgcggacctgggcgccgactcgctggacacggtggaaatcgtcatggcgctggaggaggagttcaagatcaccgtcgaggaggacaacgcccagaacatcaccaccatccaggaggccgcagacctcatcgacaagctcgtcggccagaacccagcagcgccggcggcatgatacgagccgacatcgaaacctacccggacaatccattgctgctcatgcaggctccgttatatatactactatatatgagcattattgattgatcgatctctagcaagagataatatgcatggacggatggaagagctagctgatacctaccaccatcgttgccaggattttcatcgatctgttttgtttcttctttcccagcattagctagcgtcgttgttgttcgacgacagacattatagccagctctcctttcaatttccgcaactttttagccgtgtgtgatgagtgtggttttttttgttaggagaagatgaatgatga

SEQ ID NO: 3068 - DNA, 2149 bp, Sorghum bicolor
tgacagatcacgcctctccagtctccccgttttatgaaaacaaagcaaacaaaaacaaatctcgctgttgctctccgacgactgcagccaccactgcccatcccgctcgccgccgccgccaatggcgagcctccggctcgccgtcacccactgcccggctcttcctctcccgaccccccatagccaccttcgccgccgccaactgcaactccatccctaccccaatcccctctccctctcaccccgcatctcctcccacctctcacctatccctcgccgccacctgcccccgctcttcgcatccgcatcggcctctcaagcggaaaccaagccgccgccaccgccgacggaggcatcgggcggtgctaagccgctgcccctcctcatctcgcttgccgccggcctcgccgtccgcttcctcgtgccgcggccggccgaggtaactccggaagcatggcagctcctctccatcttcctctccaccatcgcggggctcgtcctcggcccgctccccgtcggtgcgtgggcgttcctcggcctcaccgccaccgtcgccacgcgcacgctccccttcaccgccgcgttcggggcgttcactaacgaggtcatctggctcatcgtcatctccttcttcttcgcgcgcggcttcgtcaagaccggcctcggcgaccgcgtcgccacctacttcgtcaaatggctggggcgcagcactttgggcctatcctatgggcttgccatcagcgaggctttcatctcgcctgccatgcctagcactacggccagggcaggaggggttttccttcccatcgtcaagtcgctgtcgctctcgtcgggaagcaagcccaacgacccatcggcgaagaaacttggctcttatcttgtgcagtcgcagctacaggcagctgccaactccagtgctctcttcttgacagcggctgcacagaacctgttgtgtctgaagttagcagaggagattggtgttaatatcggaaacccatggattacttggttcaaggttgctagcgtgccagcacttcttgggcttttagtgactccttatttgatttacaaaatattccccccagaaataaaggacactcctgaagccccagcattagctgccgagaagctaaagttaatgggtccggtaacaaaaaatgaatgggtcatgattgcaacgatgcttcttgcagtctcactatggatttttggggaagctattggcgtatccagcgttgttgctgcaatgattggactctcaatacttcttctgcttggagtgctgaactgggaggattgtttgaatgagaagtctgcatgggacacccttgcttggtttgctattttagttggtttggctgggcagcttactaacctcgggattgtgtcctggatgtcaaattgtgttgccaaggttcttcaatctttctcattgagctggcctgcagcatttggtgttcttcaggcctcatacttcttaattcactatatatttgcaagccaaacagcacatgttggagctttatactcggcatttcttgccatgcatttagcagctggtgtgccagctgtaatgtcggcacttgctttggcatacaatgcaaacctctttggagcactaacacactatagcagcgggcaatctgcagtatactttggagcggggtatgttgaccttccagatgtattcaagctgggttttataacagccgcactcaatgccgtagtctggggagttgctggtgcattctggtggaaatttttgggtctttattgagtcttggggcagtagaagtacatgaaaatggtaccatatattaaacaagtacctcatgatccaccatcggaggtcggtgttcgttttccttctgaggtgcctatgagtgcataataacagaggaacgctcatctttagaaagtttttgagcatgatcaacctaggaagcagatgagtttcgtaggttgtaaagatcatcttatataccccttgatttgattcatgtaccaccatatctcctccccacaagggaaataaatgcatgagtgacttttgaattttgatgacccaaatcttgtgttttgaggcggcggcggcgacaaggcaaatatcaaatccatgaagatgcatgaatgaatgaatatctatagc

SEQ ID NO: 3069 - DNA, 2611 bp, Sorghum bicolor
ccacacagccacacctgacgatcccaatctaccctctcactgcccgtggggctcaggccgattcctgaaacaaaacctgtgatgatctgtcaaacagaaaggttacggaattcacaatgtacagtagagaaactgacattgtggtcccactagtacacttgggcactgtccccagctgtcaggagcactctgacagatcacgcctctccagtctccccgttttatgaaaacaaagcaaacaaaaacaaatctcgctgttgctctccgacgactgcagccaccactgcccatcccgctcgccgccgccgccaatggcgagcctccggctcgccgtcacccactgcccggctcttcctctcccgaccccccatagccaccttcgccgccgccaactgcaactccatccctaccccaatcccctctccctctcaccccgcatctcctcccacctctcacctatccctcgccgccacctgcccccgctcttcgcatccgcatcggcctctcaagcggaaaccaagccgccgccaccgccgacggaggcatcgggcggtgctaagccgctgcccctcctcatctcgcttgccgccggcctcgccgtccgcttcctcgtgccgcggccggccgaggtaactccggaagcatggcagctcctctccatcttcctctccaccatcgcggggctcgtcctcggcccgctccccgtcggtgcgtgggcgttcctcggcctcaccgccaccgtcgccacgcgcacgctccccttcaccgccgcgttcggggcgttcactaacgaggtcatctggctcatcgtcatctccttcttcttcgcgcgcggcttcgtcaagaccggcctcggcgaccgcgtcgccacctacttcgtcaaatggctggggcgcagcactttgggcctatcctatgggcttgccatcagcgaggctttcatctcgcctgccatgcctagcactacggccagggcaggaggggttttccttcccatcgtcaagtcgctgtcgctctcgtcgggaagcaagcccaacgacccatcggcgaagaaacttggctcttatcttgtgcagtcgcagctacaggcagctgccaactccagtgctctcttcttgacagcggctgcacagaacctgttgtgtctgaagttagcagaggagattggtgttaatatcggaaacccatggattacttggttcaaggttgctagcgtgccagcacttcttgggcttttagtgactccttatttgatttacaaaatattccccccagaaataaaggacactcctgaagccccagcattagctgccgagaagctaaagttaatgggtccggtaacaaaaaatgaatgggtcatgattgcaacgatgcttcttgcagtctcactatggatttttggggaagctattggcgtatccagcgttgttgctgcaatgattggactctcaatacttcttctgcttggagtgctgaactgggaggattgtttgaatgagaagtctgcatgggacacccttgcttggtttgctattttagttggtttggctgggcagcttactaacctcgggattgtgtcctggatgtcaaattgtgttgccaaggttcttcaatctttctcattgagctggcctgcagcatttggtgttcttcaggcctcatacttcttaattcactatatatttgcaagccaaacagcacatgttggagctttatactcggcatttcttgccatgcatttagcagctggtgtgccagctgtaatgtcggcacttgctttggcatacaatgcaaacctctttggagcactaacacactatagcagcgggcaatctgcagtatactttggagcggggtatgttgaccttccagatgtattcaagctgggttttataacagccgcactcaatgccgtagtctggggagttgctggtgcattctggtggaaatttttgggtctttattgagtcttggggcagtagaagtacatgaaaatggtaccatatattaaacaagtacctcatgatccaccatcggaggtcggtgttcgttttccttctgaggtgcctatgagtgcataataacagaggaacgctcatctttagaaagtttttgagcatgatcaacctaggaagcagatgagtttcgtaggttgtaaagatcatcttatataccccttgatttgattcatgtaccaccatatctcctccccacaagggaaataaatgcatgagtgacttttgaattttgatgacccaaatcttgtgttttgaggcggcggcggcgacaaggcaaatatcaaatccatgaagatgcatgaatgaatgaatatctatagcctattcacttgagcttatctgccgctttgtatttttctctcacaataaaatcagtgaatactttcagccatgacttatcagccaagccaacagcactatgcgtcaaatcttgtgttttgaggccgccatagcctgcttccccaagcctgctatttgcctgccctgtatacatgagcagaggcgcagtgttgcctgttgatgaccacactcgcccgccaccctgaacggctgtacaaaaactgtacagaactgtggctaaaagggcaaagatt

SEQ ID NO: 3070 - DNA, 2191 bp, Setaria italica
aatatggccccactttcgcagctggacagtagcgccacctgtcagtaacaccctgacagatcacgcctccccgcttgataaaaccaaaacacctattagctgttgctctccgacggctgcaggccagtagcgcccattcgaccgccgcctctcgctcggccgctcgccgccgccgccgccaatggagagcctccggctcgccgtctcccaccgcccggctctcccactccctattccccatggccacctccggcgcggccatctccagctccagccgtcgcccaattctctctccctctcgctccccatctctccccacctcaccctcttccccaccactcgccgccacctccctccgatcctcgcctccgcgtcagcctctgcggtcgcgaaacctagcccggacccgaagcccgcggcggcggcgggcggcgcgaagccgctgcccctcctcatctcgctcgccgccggcctcgccgtccgcttcctcgtgccgcgccccgccgaggtgaccccacaggcgtggcagctcctctccatcttcctctccaccatcgcggggctcgtcctcggcccgctgcccgtcggcgcgtgggcgttcctcggcctcaccgccaccgtcgccacgcgcacgctccccttcaccgccgcgttcggggccttcaccaacgaggtcatctggctcatcgtcatctccttcttcttcgcgcgcggattcgtcaagaccggcctcggcgaccgcgtcgccacctacttcgtgaaatggctggggcgcagcacgctgggtctgtcctacgggcttgccatcagcgaggcgttcatcgcgccggccatgcccagcaccacggcaagggcaggaggggttttccttcccatcgtcaagtcgctgtctctcgcgtcgggcagcaagccgaacgacccatcggcaaagaagctgggctcctaccttgtgcaatcgcagttacaggcttctagcaactccagtgctctcttcttgacagcagctgcgcagaaccttctgtgtctgaagttagcagaggagcttggtgttaagattgcaaacccatgggtaacttggttaaaggttgctagtttgccagcaattgttgggcttttagtgactccttatttgttatacaaaatatttccccctgaaataaaggacactcctgatgccccagcattagctgctcagaaactaaagaacatgggcccagtaacaagaaatgaatgggtcatgattggtacaatgattcttgcagtctcactatggatttttggggaagctattggcgtatcgagtgttgttgctgcaatgattggactctcaattcttctcctgcttggagtgctgaactgggaggattgtttgaatgagaagtctgcatgggacaccttagcttggtttgctattctagttggcttggctgggcaacttaccagcgtggggattgtgtcatggatgtcaaattgtgttgccaatgttctccagtccttctcattgagttggcctgcagcatttggtgttcttcaggcctcgtacttctttattcactatttgtttgcaagccagacagcgcatgttggagctttgttctcggcatttcttgccatgcatttagcagccggtgtaccaggtcaactggcagcgcttgctttgacatacaacgcaaatctctttggtgcactcactcactatagtagtgggcaagctgcagtatactatggagcgggatatgttgaccttcctgacgtattcaagctgggttttacaacagccgcactcaatgctgtaatctggggagttgttggtgcattctggtggaaatttttggggctttattaagtctcggagcagtgttatttcatgaaaatttcaccttactaaaccagtaaatcatgatccattggaggggcgtcattttttcttctgaggcgcttgatgacgcataataatagagtgatgtccatcttagaagtttttggccttgctacatttgcacaaaataatcaacccagaaagcagatgcgtttcggaaggtgattaatacccatcttatatctccttgatgtactatcatatcccccacaggggaattaatggcatgtgttttggtgcctcaaatcttgtgttttgagattgattctccccacgaagggaattaagtgcgtgaacgagtgatgatgcctc

SEQ ID NO: 3071 - DNA, 3872 bp, Oryza sativa
aatacggccctacctttacacgcgagcaatgggccccacctgtcagtagaaccctggtgacctacgtctccccggatataaacaaacaaaataaatcctacccgtagctctctctccgcacgcagcaaccaccactcccccccccaccccattccgcggctcctcccccctcgccgccggtcgccgcgccgccggcgatggagcgcctccgcgtcgccatctcccaccaccgggcggcgcttccacttccgacccaccacaaccacttccgccgccgccatctccagctacagcccttccccagctccctctccctctcgctccccatctcgccccagctctcgcccgcccctcctcgccgccacctcctccccccgctcctcgcctccgcgtccgccgcccaggccgcgggccctgcccccgcgcgggcggcgggcggcggcggcggcggcgcgaagccggttcccctactcgtctccctcgccgtcggcctcgccgtccgcttcctcgcgccgcggccggccgaggtgaccccgcaggcgtggcagctcctctccatcttcctgaccaccatcgccgggctcgtcctcggcccgctccccgtcggcgcctgggcattcctcgggctcactgccaccgtcgccacgcggacgctcccgttcaccgcggcgttcggggcgttcaccaacgaggtcatctggctcatcgtcatatccttcttcttcgcccgggggttcgtgaagaccggactcggcgatcgtgtggccacctatttcgtcaagtggttggggcgcagcacgctgggcttgtcgtacgggctcgccatcagcgaggcatgcatcgcgccggcgatgcccagcaccacggcgagggccggtggggtgttccttccaatagtcaagtcgctatctctttcggctggcagcaagccgaacgacccatcggcgaggaagctgggctcctaccttgtgcagtctcagttacaggcatctggtaactcaagtgctctcttcctgactgctgcagcacaaaatctcttgtgtctgaagttagctgaggagattggtgttaagattgcaaacccatggatatcttggtttaaggttgctagtttgcctgccatcatttctctcttagcgacaccttatttgttatacaaaatattcccacctgaaataaaggacactcctgaggcccctgcaatagctgcacaaaaactgaagaacatgggaccagtaacaagaaatgaatggatcatggttgctacaatgattcttgctgtttcactgtggatttttggggatactatcggtgtgtcaagtgttgttgctgcgatgattggtctttcaattcttcttctgcttggggttctgaactgggaagattgcctgaatgaaaaatctgcatgggacacattagcttggtttgctattctagttggaatggcagggcagctcacgaaccttggaattgtatcatggatgtcaaattgtgttgcaaaagttctccagtctttctcattgagttggcctgcagcatttggtgttcttcaggcctcctatttctttattcactatctctttgcaagccaaacagcacatgttggagctttgtattcagcatttcttgcgatgcatttagcagctggcgttccagctatactgtcggcacttgctttgacatacaattcaaatctctttggtgcactgacacattatagtagtgggcagtctgcagtatactatggagcggggtatgttgatcttcctgatgtattcaaactgggttttacaacagcagcaatcaatgctgtgatatggggagtcgtcggtacattttggtggaagtttttagggctttattgagtcattgcaagtgttaagttgaccaaaagtgttccttactacacctgtaattcatggctccctttctggagtggtagtcattttttcttcagaggagtttgatgagtgcataataatggaacgatgttcctcattagaagtcttgaacatgatacacttgtacaacccagaagggttctcataggcgttttgtacaactcccatgcatttctcatgaacgaaattaactgcaggaatgagtcttgattccttgagcatattgttcatgtactctcggaactgtatggattgcttttgctatatgccgtgattgttaatttattatataggaccatgagtttcatcagacaacacaggattgctaagataaaaacatcaaaggccaaatgtgccatcttcctatccaacaaattggatggcagagtggcagactattttcggagcgtatttgtctacaatatttgccacatgtgaatctttgatgaacttgtgcaaaacccttcagcaggttagtgcatttgacttgaaggttttcgtttatatttgaccatgaaatgaagcatttgacaagtaatctgcaccaatacttgtccatttgtattccagtagtgctaccgattcatcgtgtttgtcactttgttgattgctattcgtcaggagaagtgctgagcaactgaagttagtgaagttttcgaagacattctattcaacttaaacttttgggttgaactgattagcacccgtaacacaatcactcttgtaagttgcaactgttgggaagaatttggttgtttaaacatgacgctaattttgatccgcttctccagagttcaggaccctaggccccctagccaagtctctccttttttccaattccataggagaaacatgaggccatgttcaatgcgtagccccaagtcgtgccttcacaaacggtgtcccgcttccgtcatcgggccgtgtccttggagagaggcgcggctcctggcagaggaacgcacgcctctagctccttttcttgagccaccgcttgggcctatgcgttggacgactgcgtagctcatggatacggcctcccgcaccacaaatttcctcttccacccttggcctcgtcgctgggagtaggcgggaggcacatagcaatgcggaggagtcggaggtagcgaggtggtggaggagccgacggatttgtgacatcgacgacctggggacggcggagggagagggacgggccccgcgaacccgtctgtcagccaccaacgccccagggatggggcaggcccactagatccgacgacgacctcgtgatggcgactgctcgccgtcagccatcagcagtgacgggcgaagggagaggggtggcgacgtgttgggacgaagtcggagcggtgccaccgccgctgttcccttcttgcctcgccgccacctccctcgccctccccagcgtcgccgcgtctcgccccagccgtcggtgaagggagcggtgggagctcgagctgcagccggatttggcgtgggagagtggacgatgagcggcgacggcgggagagagaggcgagcggtggcggcggcagctggggagggcgaggagggaggtggcagcggcatgagggagagggagagggagggggagggggagggggaggacggcgctgagcggagggagtgagacgaggcgaagaagaagaggcaggagcgaaggaaaaagagaagagagagagagaggaagagggagaagagaggggtggtataggaaaacacccattgtgggttttttggttgggacaaccattgtgggcttgagtacctttatccaattgcttcagattttaaagagaccacctagatgtagccttcatcagtttactggtaattgagtgtccctgatagtgtcctcggttagtgaggacttttaggtggggctttgatgatagatgccctgtataggttcagttctcagtctcaaggaccacagtatggcatttttttttccttccagcagccgaa

SEQ ID NO: 3072 - DNA, 2182 bp, Oryza sativa
ccgcacgcagcaaccaccactcccccccccaccccattccgcggctcctcccccctcgccgccggtcgccgcgccgccggcgatggagcgcctccgcgtcgccatctcccaccaccgggcggcgcttccacttccgacccaccacaaccacttccgccgccgccatctccagctacagcccttccccagctccctctccctctcgctccccatctcgccccagctctcgcccgcccctcctcgccgccacctcctccccccgctcctcgcctccgcgtccgccgcccaggccgcgggccctgcccccgcgcgggcggcgggcggcggcggcggcggcgcgaagccggttcccctactcgtctccctcgccgtcggcctcgccgtccgcttcctcgcgccgcggccggccgaggtgaccccgcaggcgtggcagctcctctccatcttcctgaccaccatcgccgggctcgtcctcggcccgctccccgtcggcgcctgggcattcctcgggctcactgccaccgtcgccacgcggacgctcccgttcaccgcggcgttcggggcgttcaccaacgaggtcatctggctcatcgtcatatccttcttcttcgcccgggggttcgtgaagaccggactcggcgatcgtgtggccacctatttcgtcaagtggttggggcgcagcacgctgggcttgtcgtacgggctcgccatcagcgaggcatgcatcgcgccggcgatgcccagcaccacggcgagggccggtggggtgttccttccaatagtcaagtcgctatctctttcggctggcagcaagccgaacgacccatcggcgaggaagctgggctcctaccttgtgcagtctcagttacaggcatctggtaactcaagtgctctcttcctgactgctgcagcacaaaatctcttgtgtctgaagttagctgaggagattggtgttaagattgcaaacccatggatatcttggtttaaggttgctagtttgcctgccatcatttctctcttagcgacaccttatttgttatacaaaatattcccacctgaaataaaggacactcctgaggcccctgcaatagctgcacaaaaactgaagaacatgggaccagtaacaagaaatgaatggatcatggttgctacaatgattcttgctgtttcactgtggatttttggggatactatcggtgtgtcaagtgttgttgctgcgatgattggtctttcaattcttcttctgcttggggttctgaactgggaagattgcctgaatgaaaaatctgcatgggacacattagcttggtttgctattctagttggaatggcagggcagctcacgaaccttggaattgtatcatggatgtcaaattgtgttgcaaaagttctccagtctttctcattgagttggcctgcagcatttggtgttcttcaggcctcctatttctttattcactatctctttgcaagccaaacagcacatgttggagctttgtattcagcatttcttgcgatgcatttagcagctggcgttccagctatactgtcggcacttgctttgacatacaattcaaatctctttggtgcactgacacattatagtagtgggcagtctgcagtatactatggagcggggtatgttgatcttcctgatgtattcaaactgggttttacaacagcagcaatcaatgctgtgatatggggagtcgtcggtacattttggtggaagtttttagggctttattgagtcattgcaagtgttaagttgaccaaaagtgttccttactacacctgtaattcatggctccctttctggagtggtagtcattttttcttcagaggagtttgatgagtgcataataatggaacgatgttcctcattagaagtcttgaacatgatacacttgtacaacccagaagggttctcataggcgttttgtacaactcccatgcatttctcatgaacgaaattaactgcaggaatgagtcttgattccttgagcatattgttcatgtactctcggaactgtatggattgcttttgctatatgccgtgattgttaatttattatataggaccatgagtttcatcagacaacacaggattgctaagataaaaacatcaaaggccaaatgtgccatcttcctatccaacaaattggatggcagagtggcagac

SEQ ID NO: 3073 - DNA, 2154 bp, Avena sativa
agccaccagtatccaacccccgcttcctcccgctcggccgctcgccgctcgccgcgccgccgcgcacagccggcagctaatggagcgcctccgcctcgcggtgtcacaccgcccggctctccccctccctactcctcacaaccaccttcgccgccgacatctccagctccagctctcccccaattctctatccctctcccgcccaatctccccccacctctcccccacccctcgccgccacctccatccgctcctcgcctccgcatccgccgcccaagctgcaagccccgaacctaatcccgcgccagctccgaccgcagccgctgcctcggccggcgcaaagctcatccccctcgttgtctccgtcgcagtcggtctcgccgtccgattcctggcgccgcggccccccgaggtgactccgcaggcgtggcagctcctctccatcttcctctccacaatcgcggggctcgtcctcggcccgctccccgtcggcgcgtgggcattccttgggctcaccgctacggtggccacgcggacgctccccttcacggcggcgttcggtgccttcaccaacgaggtcatctggctcatcgtcatctccttcttcttcgcacgggggttcgtcaagactggcctcggcgaccgcgttgccacctacttcgtcaagtggttgggtgggagcactctgggcctgtcctacggtctcaccatcagcgaagcatgcatcgcgccggccatgcccagcaccacggcgagagctggaggggtgttccttcccattgtcaagtcgctgtcgttgtcagccggcagcaagccgaatgatccatcagcgaagaagctgggagcctaccttgtgcagtctcagttgcaggcatctggcaactctagtgccctcttcctgactgctgctgcgcaaaatctcttgtgtcttaagttagcggaggaggctggtgtcaagattgcaagcccatggatatcatggttcaaggttgctagtttgcctgccattatttccctcttagcaacaccttatttgctgtacaaaatattccctcctgaaataaaggacactcctgaggcccctgcattagctgctgaaaagctgaagaaaatgggcccagtgacaaaaaatgaatgggtcatggtttctacaatgattcttgcagtctcactctggatttttggggatgctattggtgtgtctagtgttgttgctgcaatgattgggctctctattcttcttctgcttggggtgatgaactgggacgattgcttgaatgaaaagtctgcatgggacaccttagcttggtttgctattctagttggaatggcggggcagcttactaacctcgggattgtgtcatggatgtcaaattgtgttgcaaaggttctccagtccttctcattgagttggcctgcagcatttggtgttctccaggcctcctatttctttattcactatctatttgcaagccaaactgcacatgttggagctctatactcggcatttcttgccatgcacctagcagctggtgtccctgctatactctcagcacttgctctgacgtataattcaaatctctttggtgcactaacacattatagcagtgggcagtctgcagtatactatggagcggggtatgttgaccttcctgatgtattcaagctggggtttgcagcagcggcgattaatgctttgatttggggagtagttggtacattttggtggaaattcctgggtctttactgaggatggctgctgcggtgtaagttgacgaaaattgttctttactgccccagtacgccatggctcaccgttctggagagggctgatctttcttgagatgtgctgggtgggaatgtataataagaaagcattgttcaccactcaatttttgaacatgctacatttgtaaaaaaatatttacccagaagggttcacataggtttttaagactgtcttgtatctccatttacccagaaaggttcacataggttgttaagactgtcttgtatctccatttacccagaagggttcacatagtttgttaagactctcttgtatctccatttacccagaagggttcacatggttgttaagactgttgtatctctattttgtataactatatccagtgcagagcgagtttatcc

SEQ ID NO: 3074 - DNA, 2089 bp, Avena sativa
acagccggcagctaatggagcgcctccgcctcgcggtgtcacaccgcccggctctccccctccctactcctcacaaccaccttcgccgccgacatctccagctccagctctcccccaattctctatccctctcccgcccaatctccccccacctctcccccacccctcgccgccacctccatccgctcctcgcctccgcatccgccgcccaagctgcaagccccgaacctaatcccgcgccagctccgaccgcagccgctgcctcggccggcgcaaagctcatccccctcgttgtctccgtcgcagtcggtctcgccgtccgattcctggcgccgcggccccccgaggtgactccgcaggcgtggcagctcctctccatcttcctctccacaatcgcggggctcgtcctcggcccgctccccgtcggcgcgtgggcattccttgggctcaccgctacggtggccacgcggacgctccccttcacggcggcgttcggtgccttcaccaacgaggtcatctggctcatcgtcatctccttcttcttcgcacgggggttcgtcaagactggcctcggcgaccgcgttgccacctacttcgtcaagtggttgggtgggagcactctgggcctgtcctacggtctcaccatcagcgaagcatgcatcgcgccggccatgcccagcaccacggcgagagctggaggggtgttccttcccattgtcaagtcgctgtcgttgtcagccggcagcaagccgaatgatccatcagcgaagaagctgggagcctaccttgtgcagtctcagttgcaggcatctggcaactctagtgccctcttcctgactgctgctgcgcaaaatctcttgtgtcttaagttagcggaggaggctggtgtcaagattgcaagcccatggatatcatggttcaaggttgctagtttgcctgccattatttccctcttagcaacaccttatttgctgtacaaaatattccctcctgaaataaaggacactcctgaggcccctgcattagctgctgaaaagctgaagaaaatgggcccagtgacaaaaaatgaatgggtcatggtttctacaatgattcttgcagtctcactctggatttttggggatgctattggtgtgtctagtgttgttgctgcaatgattgggctctctattcttcttctgcttggggtgatgaactgggacgattgcttgaatgaaaagtctgcatgggacaccttagcttggtttgctattctagttggaatggcggggcagcttactaacctcgggattgtgtcatggatgtcaaattgtgttgcaaaggttctccagtccttctcattgagttggcctgcagcatttggtgttctccaggcctcctatttctttattcactatctatttgcaagccaaactgcacatgttggagctctatactcggcatttcttgccatgcacctagcagctggtgtccctgctatactctcagcacttgctctgacgtataattcaaatctctttggtgcactaacacattatagcagtgggcagtctgcagtatactatggagcggggtatgttgaccttcctgatgtattcaagctggggtttgcagcagcggcgattaatgctttgatttggggagtagttggtacattttggtggaaattcctgggtctttactgaggatggctgctgcggtgtaagttgacgaaaattgttctttactgccccagtacgccatggctcaccgttctggagagggctgatctttcttgagatgtgctgggtgggaatgtataataagaaagcattgttcaccactcaatttttgaacatgctacatttgtaaaaaaatatttacccagaagggttcacataggtttttaagactgtcttgtatctccatttacccagaaaggttcacataggttgttaagactgtcttgtatctccatttacccagaagggttcacatagtttgttaagactctcttgtatctccatttacccagaagggttcacatggttgttaagactgttgtatctctattttgtataactatatccagtgcagagcgagtttatcc

SEQ ID NO: 3075 - DNA, 2031 bp, Brachypodium distachyon
ctctgcttcgtctcccgcttggctgctcgctgcgccgccgcgctcagccggccgccaatggagcgcctccgcctcgccgtgtcccaccgcccggcactccccctccctgctcctcacaaccacctgcgccgccgccatctccagctccagtcctcccccaattccctctccctctcccgccccatctccccccacctctcccccacccctcgccgacacctccaccctctcctcgcctccgcatccgccacccaagccgcaagctcgagccctgagcccacgccagcccccgtcgctgccgtgagctcggccggcgcgaagcttattcccctcatcgcctccgtcgcggtcggcctcgccgtacgattcctggcgccgcggcccgccgaggtgaccccggaggcgtggcagctcctctccatcttcctctccaccatcgcggggctcgtcctcggcccgctccccgtcggcgcctgggcattcctcgggctgaccgccaccgtggccacgcggacgctccccttcaccgcggcgttcggggcgttcaccaacgaggtcatctggctcatcgtcatctccttcttcttcgcacgggggttcgtcaagaccggcctcggcgaccgggtcgccacatacttcgtcaagtggctcgggggcagcactctcggtctgtcctacggtctcaccatcagcgaggcatgcatcgcgccggccatgcccagcaccacggcgagagctggaggagtgttccttcccattgtcaagtcgctgtcactatcggccggcagcaagccgaatgacccgtcagcaaagaagcttggtgcctaccttgtgcaatctcagctgcaggcatctggcaactccagtgctcttttcctgactgctgctgcgcaaaatctcttgtgcctgaagttagcagaggaggccggtgtcaagattgcaagtccgtggatattatggttcaaggttgccagtttgcctgccatcattgccctcttagctacaccctatttgctatacaaaatattccctcctgaaataaaagacactcctgatgcccctgcattagctgctcaaaagctggaaaaaatgggcccagtgacgaaaaatgaatgggtcatggttgctacaatggttcttgcagtctcactctggattttcggggatattattggtgtgtcgagtgttgttgctgcaatgattgggctctcaattcttcttctgcttggagtgatgaactgggatgattgcttgaatgaaaaatctgcatgggacaccttagcttggtttgcaattctagttggaatggcggggcagcttactaacctcgggatagtgtcatggatgtcaaattgtgttgcaaaggttctccagtctttctcattgagttggcctgcagcatttggtgttcttcaggcttcctatttccttattcactatctatttgcaagccaaactgcacatgttggagcactttactcggcatttcttgccatgcacctagcagctggtgttcctgctttactgtctgcactcgctttgacatataattcaaatctctttggtgcactaacacattatagtagtgggcagtctgcagtgtactatggagcggggtatgttgaccttcctgatgtgttcaagctggggtttgcttcagccgcaattaatgctgcgatttggggagtagttggtacattttggtggaaattcttggggctttactgagagttatactgcagtgtaagttgacgaaaattgtactgtactacacctgtaactcatgggctcaccgttctggagcaggcccatttttgttcagaggtgctcggtggaatgtataataagggagcagcgttcattgttggaagttttgaacatgctacatttgtaaaagaaaatgatcaacccagaagggttcacatatgttgctaagactcttgtactcgatgtggatttttgcagaagcagaactaaattcaatggagggataagtttcgatcctgaaactgcattttcttgcttgatgtg

SEQ ID NO: 3076 - DNA, 2132 bp, Brachypodium distachyon
tgaaaataaaactaaatctcagcctcgcaacaaccgccgctatcctctgcttcgtctcccgcttggctgctcgctgcgccgccgcgctcagccggccgccaatggagcgcctccgcctcgccgtgtcccaccgcccggcactccccctccctgctcctcacaaccacctgcgccgccgccatctccagctccagtcctcccccaattccctctccctctcccgccccatctccccccacctctcccccacccctcgccgacacctccaccctctcctcgcctccgcatccgccacccaagccgcaagctcgagccctgagcccacgccagcccccgtcgctgccgtgagctcggccggcgcgaagcttattcccctcatcgcctccgtcgcggtcggcctcgccgtacgattcctggcgccgcggcccgccgaggtgaccccggaggcgtggcagctcctctccatcttcctctccaccatcgcggggctcgtcctcggcccgctccccgtcggcgcctgggcattcctcgggctgaccgccaccgtggccacgcggacgctccccttcaccgcggcgttcggggcgttcaccaacgaggtcatctggctcatcgtcatctccttcttcttcgcacgggggttcgtcaagaccggcctcggcgaccgggtcgccacatacttcgtcaagtggctcgggggcagcactctcggtctgtcctacggtctcaccatcagcgaggcatgcatcgcgccggccatgcccagcaccacggcgagagctggaggagtgttccttcccattgtcaagtcgctgtcactatcggccggcagcaagccgaatgacccgtcagcaaagaagcttggtgcctaccttgtgcaatctcagctgcaggcatctggcaactccagtgctcttttcctgactgctgctgcgcaaaatctcttgtgcctgaagttagcagaggaggccggtgtcaagattgcaagtccgtggatattatggttcaaggttgccagtttgcctgccatcattgccctcttagctacaccctatttgctatacaaaatattccctcctgaaataaaagacactcctgatgcccctgcattagctgctcaaaagctggaaaaaatgggcccagtgacgaaaaatgaatgggtcatggttgctacaatggttcttgcagtctcactctggattttcggggatattattggtgtgtcgagtgttgttgctgcaatgattgggctctcaattcttcttctgcttggagtgatgaactgggatgattgcttgaatgaaaaatctgcatgggacaccttagcttggtttgcaattctagttggaatggcggggcagcttactaacctcgggatagtgtcatggatgtcaaattgtgttgcaaaggttctccagtctttctcattgagttggcctgcagcatttggtgttcttcaggcttcctatttccttattcactatctatttgcaagccaaactgcacatgttggagcactttactcggcatttcttgccatgcacctagcagctggtgttcctgctttactgtctgcactcgctttgacatataattcaaatctctttggtgcactaacacattatagtagtgggcagtctgcagtgtactatggagcggggtatgttgaccttcctgatgtgttcaagctggggtttgcttcagccgcaattaatgctgcgatttggggagtagttggtacattttggtggaaattcttggggctttactgagagttatactgcagtgtaagttgacgaaaattgtactgtactacacctgtaactcatgggctcaccgttctggagcaggcccatttttgttcagaggtgctcggtggaatgtataataagggagcagcgttcattgttggaagttttgaacatgctacatttgtaaaagaaaatgatcaacccagaagggttcacatatgttgctaagactcttgtactcgatgtggatttttgcagaagcagaactaaattcaatggagggataagtttcgatcctgaaactgcattttcttgcttgatgtgaatatttgcgtattgtactgacttgattttacaacttgaatatctttggttctttat

SEQ ID NO: 3077 - DNA, 1998 bp, Secale cereale
ctcgcccgtagctctccgaaggccgcaaccaccagtatccgacccccggttcctccgctcggccgcttgcgccgccgtgcacagccgggcgccaatggagcgcctccacctcgcggtgtcccaccgccccgctctccccctccccactcctcacaaccacctccgccgccgccatctccagctgcagccctccactaattctctctccctctcccgccccatctcccgtcacatctccctcgctactcgccgccacctccatcctctcctcgcctccgcgtccgccacccaagcttcaagcccgaacactgagcccgcaccggcgccggcccccgccgcggcctcggccggcgcgaagttgctccccctcatcgcctctatcgcggtcggcctcgcagtgcgattcctggcgccgcggccccccgaggtgactccgcaggcgtggcagctcctctccatctttctctccaccatcgcggggctcgtcctcggcccgctccccgtcggcgcgtgggcattcctcggcctcactgctaccgtggccacgggtacgctccccttcaccgcggcgttcgaggcgttcaccaacgaggtcatctggctcatcgtcatctccttcttctttgcacgggggttcgtcaagaccggcctcggcgaccgcgttgccacctacttcgtcaagtggttgggtggaagcactctgggcctatcctatggtctcaccatcagtgaggcatgtattgcgccggccatgcccagcaccacggcgagggctggaggggtgttccttcccattgtcaagtcgctgtcgctatcggccggcagcaagccgaatgatccatcagcgaagaagctgggtgcctaccttgtgcagtctcagctgcaggcatctggcaactccagtgctctctttctgaccgctgctgcgcaaaatctcttgtgtttgaagttagcggaggaggctggtgtcaaaattgcaagcccgtggatatcatggttcaaggttgcaagtttgcctgccatcatttcgcttttagcaacaccttatttgctatacaaaatattccctccagaaataaaggacactcctgaagcccctgcattagctgctcaaaaactaaagaaaatgggcccagtgacaaaaaatgaatgggtcatggttgctacaatgattcttgcagtctcactctggatttttggggatgctattggtgtgtcgagtgttgttgctgcaatgattgggctttcaattcttcttctacttggagtgatgaactgggatgattgcttgaatgaaaagtctgcgtgggacactttagcttggtttgctattctagtgggaatggcaggacagctcactaacctcgggattgtgtcatggatgtcaaattgtgttgcaaaggttcttcagtctttctcattgagttggcctgcagcatttggtgttcttcaagcctcctatttctttattcactatctatttgcaagccaaactgcacatgttggagctctatactcggcgtttcttgccatgcacctagcagctggtgttcctgctatactctcagcacttgctctgacgtacaattcaaatctctttggagcactaacacattatagtagtgggcagtctgcagtttactatggagctgggtatgttgaccttcctgatgtattcaagctggggtttacagcagcagcgattaatgctttgatttggggagtagttggtacattttggtggaaattcttggggctttattgagggttcctgcggtgtaagttgatggaaattgttctttactgcaccagtaaaactatgtggctcaccattcggagtgagctcatctttcttcggaggtgcttggtgaaatgtataataagagagggatgttcaccactcagaactttgaacatgctacatttgtaaagaatgatctacccagaagggttcacatagaggaactgtcactatatttattaaaaaaattttggcac

SEQ ID NO: 3078 - DNA, 2107 bp, Triticum aestivum
ccacgcgtccgaggccacagccaccagtatccgacccccggttcctccgctcggccgctcgcgccgccgtgcacagccgggtgccaatggagcgcctacacctcgcggtgtcccaccgcccggctctccccctccccactcctcacaaccacctacgccgccgccatctccagctgcagccctccactagttctctctccctctgccgccccatctcccctcacatctccctcgcccctcgccgccacctccatcctctcctggcctccgcgtccgccacccaagcttcaagccccaacactgagcccgcaccggcgccggcccccgccgcggcctcgtccggcgcgaagctgctccccctcatcgcctccatcgcggtcggcctcgcagtgcgattcctggcgccgcggccccccgaggtgactccgcaggcgtggcagctcctctccatcttcctctccaccatcgcagggctcgtcctcggcccgctccccgtcggcgcgtgggcatttctcggcctcactgctaccgtggccacgggtacgctccccttcaccgcggcgttcggggcgttcaccaacgaggtcatctggctcatcgtcatctccttcttctttgcacgggggttcgtcaagaccggcctcggcgaccgcgttgctacctacttcgtcaagtggttgggtggaagcactctgggcctatcctacggtctcaccatcagtgaggcatgcatcgcgccggccatgcccagcaccacggcgagggctggaggggtgttccttcccattgtcaagtcgctgtcgctatcggccggcagcaagccgaatgatccatcagcgaagaaactgggtgcctaccttgtgcagtctcagctgcaggcatctggcaactccagtgctctctttctgaccgctgctgcgcagaatctcttgtgtttgaagttagcggaggaggctggtgtcaaaattgcaagcccgtggatatcatggttcaaggttgcaagtttgcctgccatcatttcgcttttagcaacaccttatttgctatacaaaatattccctccagaaataaaggacactcctgaagcccctgcattagctgctcaaaaactaaagaaaatgggcccagtgacaaaaaatgaatgggtcatggttgctacaatgattcttgcagtctcactctggatttttggggatgctattggtgtgtcgagtgttgttgctgcaatgattgggctttcaattcttcttctacttggagtgatgaactgggatgattgcttgaatgaaaagtctgcgtgggacactttagcttggtttgctattctagtgggaatggcagggcagctcactgacctcgggattgtgtcatggatgtcaaattgtgttgcaaaggttcttcagtctttctcattgagttggcctgcagcatttggtgttcttcaggcctcctatttctttattcactatctatttgcaagccaaactgcacatgttggagctctatactcggcgtttcttgccatgcacctagcagctggtgttcctgctatactctcagcacttgctctgacgtacaattcaaatctctttggagcactaacacattatagcagtgggcagtctgcggtttactatggagctgggtatgttgaccttcctgatgtattcaagctggggtttacagcagcagcgattaatgctttgatttggggagtagttggtacattttggtggaaattcttggggctttattgaggatttctgcggtgtaagttgatggaaattgttctttactgcaccagaaacctatgtggctcaccatttggagtgagctcatctttcttcggaggtgcttggtgaaatgtataataagagagggatgttcaccactcagaactttgaacatgctacatttgtaaagacccagaagggttcacatagttttcaagactgcattgtatctctattttgcagaactaaatgcaatgtagggatgagtttagatccggaagctctgtattttcttacttgatgtggatattgcgtatgcaatgactttttgtttgtgccaacaatggagagcttctgtcttgattaacaaaaaa

SEQ ID NO: 3079 - DNA, 1644 bp, Sorghum bicolor
gatcctcctggctgccccgcttcctcggcaaccccgagccctaagccggcgccggcgccggcaccggcggcatcgggtggtgctaagccgctgcccctctttatctcgcttgccctcggcctcgccgtccgcttcctcgtgccgcggccggcccaggtaacctcgcaggcttggcagctcctctccatcttcctctccaccatcgcggggctcgtcctcgccccgctccccgtcggtgcgtgggcgttcctcggcctcaccgtcaccgtcgccacgcgcacgctctccttcgccgccgcgttcggggccttcactaacgaggtcatctggcttatcgtcatctccttcttcttcgcgcgcggcttcgtcaagaccggcctcggcgaccgcgtcgccacctacttcgtcaaatggctggggcgcagcactttgggcctatcctatggccttgtcatcagcgaggctgtcatctcgcctgccatgcccagcaccacggccagggcaggaggggttttccttcccatcatcaagtcgctctcgctctcgtcgggaagcaagcccaacgacccctcggcaaagaaactcggctcttatcttgtgcagtcgcagctacaggcagctgccaactccagtgctctcttcttgacagcggctgcacagaacctgttgtgtctgaagttagcagaggagattggtgttaatatcggaaactattggtttacttggttcaaggttgctagcgtgccagcacttcttgggattttagtgactccttatttgatttacaaaatattcccccctgaaataaaggacactcctgaagccccagcgttagctgccgagaagctaaagaacatgggtccagtaacaaaaaatgaatgggctatgattgcaacgatgcttcttgcagtctcattatggatttttgggcaaactattggcgtatccagcgttgttgcttcaatgattggactctcaatacttcttctgcttggagtgctgaactgggaggattgtttgaatgagaagtctgcatgggacaccctagcttggtttgctattttagttggtttggctggtcagcttactaagctcggtattgtgtcctggatatcgagtagtgttgccaagattcttcgatctttctcattgagctggcctgcagcatttggtgttcttcaggcctcattcttctttattcactatatatttgcaagccaaactgcacatgttggagctttatactcggcatttcttgccatgcatttagcagctgatgtgccagctgtaatgtcaacacttgctttggcatataatgcaaacctctttggatcactgacacattatagtagcgggcaatctgcagtatactttggagcggggtacgttggccttggagatgtattcaagctgggttttataacagccgtcatcaatgctgtaatttggggagctgctggtgcattatggtggaaattgttgggtctttattgagatgagtcttggagcagtataagtagcgtatcatatactttgttttctgaggtgcctatgaatgcataataacagatgagtcttagaagtttttgagcataacctagaaagcggatgggttttggtaggctgtaaagaccgtcttatata

SEQ ID NO: 3080 - DNA, 1494 bp, Sorghum bicolor
gatcctcctggctgccccgcttcctcggcaaccccgagccctaagccggcgccggcgccggcaccggcggcatcgggtggtgctaagccgctgcccctctttatctcgcttgccctcggcctcgccgtccgcttcctcgtgccgcggccggcccaggtaacctcgcaggcttggcagctcctctccatcttcctctccaccatcgcggggctcgtcctcgccccgctccccgtcggtgcgtgggcgttcctcggcctcaccgtcaccgtcgccacgcgcacgctctccttcgccgccgcgttcggggccttcactaacgaggtcatctggcttatcgtcatctccttcttcttcgcgcgcggcttcgtcaagaccggcctcggcgaccgcgtcgccacctacttcgtcaaatggctggggcgcagcactttgggcctatcctatggccttgtcatcagcgaggctgtcatctcgcctgccatgcccagcaccacggccagggcaggaggggttttccttcccatcatcaagtcgctctcgctctcgtcgggaagcaagcccaacgacccctcggcaaagaaactcggctcttatcttgtgcagtcgcagctacaggcagctgccaactccagtgctctcttcttgacagcggctgcacagaacctgttgtgtctgaagttagcagaggagattggtgttaatatcggaaactattggtttacttggttcaaggttgctagcgtgccagcacttcttgggattttagtgactccttatttgatttacaaaatattcccccctgaaataaaggacactcctgaagccccagcgttagctgccgagaagctaaagaacatgggtccagtaacaaaaaatgaatgggctatgattgcaacgatgcttcttgcagtctcattatggatttttgggcaaactattggcgtatccagcgttgttgcttcaatgattggactctcaatacttcttctgcttggagtgctgaactgggaggattgtttgaatgagaagtctgcatgggacaccctagcttggtttgctattttagttggtttggctggtcagcttactaagctcggtattgtgtcctggatatcgagtagtgttgccaagattcttcgatctttctcattgagctggcctgcagcatttggtgttcttcaggcctcattcttctttattcactatatatttgcaagccaaactgcacatgttggagctttatactcggcatttcttgccatgcatttagcagctgatgtgccagctgtaatgtcaacacttgctttggcatataatgcaaacctctttggatcactgacacattatagtagcgggcaatctgcagtatactttggagcggggtacgttggccttggagatgtattcaagctgggttttataacagccgtcatcaatgctgtaatttggggagctgctggtgcattatggtggaaattgttgggtctttattga

SEQ ID NO: 3081 - DNA, 1590 bp, Zea mays
cacgcccgcctcgaactctcgaagcttcgagcacgccacaacccaacggcgcgcgggcggcgggcccgtgagcgtgcagtgctgagtacacacgccgagcggcgccactccgggttagcagcaacaatactgtgggattatatgagatgagaaggagactactagactagcagccgtatcactcactactcgctgcccgcgcccgatcgggcgcactgccctgtggtgtactggtgtgtcacgcccctcgtcactcaccccgtcacccgcaaccccatcttctattcttcccgacggcgctcctggcagcaggaacaagatgtccaatagggccacacattggtgttatgcctgtcggcggccaattcgtctccgtgggcaggatatcgcatgccccaactgcaatgatggttttatccaggaaattagtgagatgggtggcatattgaacacttatgggctaattgaaccagactttgaagagcgtcgagctagaagattcggaatgatggatgccatgtcttcccttatgcggcaacggatggaagaaatgggaagagatggtttgtttgatattcgtggtagacaaggaacaggtactgaatatggaaggaggccaactgctgttcctacattggtatttggcggcatcccttctcctggagttgatagcggtgatgttaatgttgtcctcaggggaggccgcagagttggcgctgcccaaccaaatttcagtagtttagttgttggtcccagtctggaagccctttttgagcagctacttctccagaacaaccgtcaaggcccagcacctgctccacagtcagctattgactccatgcctgtggtaaagataaaccgcaggcatcttgacgacgatccacagtgcgcagtttgcaaagacaaattcgaggttggagcagaggcacgggagatgccatgcaagcacctgtaccatactgactgcatcatcccctggctggttcagcacaattcttgccctgtttgccgccatccactgccatcacagagatcaggcagtaccagtagcgcccggccttcagcttactacaacgaagccgctgatcctcctggggtcaccagagcagatcttgaacctgctccaagagacggtggcagggaaagccaggaaaggcgccgctccttctcgtttctgtggccgtttggcccgtcgagttccagatccagttcttaccagtacgaacagaatgttgatgagcctgcagtatacgatccaaaccagatagcatattctgagtggcactatgaccactgactgaaaccctgcagcaatcgcaagctatctgcaattcgtgccttcaaccctcagctttggagaggcattcatcagctgtaatggctgcttgccgtataaaaaaaggatggttcttgcctgttatattgtgttcagtgcatagccttgctccgtatgtccgtcgtatatataatcccttgcgtgtagtaagcgatgaactgaatgcatccagaatatcatgtcatgataaacttgaatatagtttcatggttgttatttcagactgaaaataaaatcagtcttctgttccggtt

SEQ ID NO: 3082 - DNA, 1429 bp, Saccharum officinarum
cgttgcccacgcgtccccgggattactatatgagagcgagagatcagcggccgtttcactccccgcgcccgatcgggcgcactgcacttgtggtgtgccacgcccctcgccactcacccgcaaccccacctcccatcctccccgacggcgctcctggcagcaaggaacaaaatgtccaatagggccacacattggtgttatgcctgtcggcggccagttcgtctccgtgggcaggatatcatatgccccaactgcaatgatggttttatccaagaaatcagtgagatgggtggccgattgaacacttatgggctaattgaaccagaatttgaagagcgtcgagctagaagatttggaatgatggatgccatgtcttcccttatgcggcaacggatggaagaaatggtagaagatagtttgtttgatgttcatggtagacaagggacaggtactgaatatggaaggaggccaactgctgttcctacactggtatttggcggtatcccttctcctggagttggtagcagtgacgttaatgttgtcctcaggggaggccgcagagttggcgctgtccatccaaatttcagtagtttagttgttggtcccagtctggaagccctatttgagcagctactcctccagaacaaccgtcaaggcccagcacctgctccacagtcagctattgactccatgcctgtggtgaagataaatcgcaggcttcttgacgacgatgcgcagtgtgcagtttgcaaagacgaattcgaggttggagcagaggcacgggagatgccatgcaagcacctgtaccatactgactgcatcatcccctggctggttcagcacaattcttgccctgtttgccgccatccgctgccatcacagagatcaggcagtaccagtaccccccgtgtgccttcagcttactacaacgaagccgccgatcctcctggggtcaccagagcagatcttgaacctgctccaagaaacagcggcagcgaaagccaggaaaggcacagctccttctcgtttctctggccatttggcccgtcgaattccagtcccagtgcttaccagtatgaagaaaatgttgatgagcctgcagtatatgatccaaaccagatagcatattctgagtggcactatgaccactgactgaaacccagcattaagtccaagctatcagcaattcgtgccttgaaccttcactttgggaggcattcatcagcagtaatggctgcttgccgtatataaaaaggatggtcttgcctgttggttcaaggcatacccttgctccgcatgtccattggggagctgcagctatgtatagaactgggcgcaatgaactctgctgtaatgcccgtatatattcctgtttggatatcaagtctaaagctacagtacttaatctcttaaaaaaaaaaaaaaaggg

SEQ ID NO: 3083 - DNA, 918 bp, Sorghum bicolor
tcacgggagggagatgtcgccgcagcagcagcagcgggtggcgatagtcggggaggagtactgcgagggcgaggacagggagctgacggtgcggaagacgacgctcttcaccccgggggacgggctggaggcgtacgaccaccggaacggcgcgctggcgttccgcgtcgagacgtacggccgcggcggggcgtgcgggggcggcgccgccaggggggacctcgcgctgctgggcgccaggggggagcccgtcctcacggtgcgccgccgccgccccagcctgcacaaccgctgggacggattcctcggcgacggcgcggcgcagggacagaagcccgtcttctccgcgcgccgctcctccatcctcggcgctgggaccggcgccgccgccgtgctcgtcgacctcctcgcgcccgtcgccggggagttccgcgtcgacgggtccttcccgcgccgctgctgccgcgtcgtcgcctccgccaaggcatgggccgcgggcgacggcaagggggaggaggaggaggcggaggaggatgtggtggtggcggaggtgaggcggaaggtggacgaggacgcgcacgtcatgatgggccgggacgtcttcgtgctctgggtgcgcgcggggttcgacgccgccttcgccatggggatcgtgctcgtgctcgaccggatcaccgaggacgacgtcgacggcgacctgggagaggaactcctcgaggccgccacctcgccggcgtaagcacgcgggatcggcttcccgctcgtgggatcctcgtgatgtagtaaaatccacaaacagtttttctgatggttcttcttcgtcgtcagagtttggatctccaatctttgggttgtactttacctttgagcatgatgtgaattatcttctcaattcggtgcttcctttttccttccacc

SEQ ID NO: 3084 - DNA, 1502 bp, Sorghum bicolor
gttcgagataataaataactttagactctattgtgagtgcccttgtctcgcggcaaagccaaaggctccagctttttcttttttttactcaaacgcgacaacgtctgtacgtacgactcgtcaacattgttccgtgcgcattatactagtacgttatcatcgatcgagttattactactaccaaaaatactacatccacatccaatctgatcccgttgcttcacccgttgcgttcccgcgtctcgcttcgcttgtggccctggcgactgacggcgggcggacggcggatcggatcgaatcaacccgccccatctgctggccccacaccaccaccccgccatggccggcgcgttggcgagcgtgagcgtgtataaactcacccacgcgagggcgacgcgaaagcgaacgccgacatctcttggctctctcgatccgcccccacttggccacttcataaaaccaagctgcttctaccaccaccagcagcccggccgtctccggtctccaccctccgctcacgcgtgtagggtgtcgcacgccgagtcgtgcagcgaggaatcaccagacagagagagatcacgggagggagatgtcgccgcagcagcagcagcgggtggcgatagtcggggaggagtactgcgagggcgaggacagggagctgacggtgcggaagacgacgctcttcaccccgggggacgggctggaggcgtacgaccaccggaacggcgcgctggcgttccgcgtcgagacgtacggccgcggcggggcgtgcgggggcggcgccgccaggggggacctcgcgctgctgggcgccaggggggagcccgtcctcacggtgcgccgccgccgccccagcctgcacaaccgctgggacggattcctcggcgacggcgcggcgcagggacagaagcccgtcttctccgcgcgccgctcctccatcctcggcgctgggaccggcgccgccgccgtgctcgtcgacctcctcgcgcccgtcgccggggagttccgcgtcgacgggtccttcccgcgccgctgctgccgcgtcgtcgcctccgccaaggcatgggccgcgggcgacggcaagggggaggaggaggaggcggaggaggatgtggtggtggcggaggtgaggcggaaggtggacgaggacgcgcacgtcatgatgggccgggacgtcttcgtgctctgggtgcgcgcggggttcgacgccgccttcgccatggggatcgtgctcgtgctcgaccggatcaccgaggacgacgtcgacggcgacctgggagaggaactcctcgaggccgccacctcgccggcgtaagcacgcgggatcggcttcccgctcgtgggatcctcgtgatgtagtaaaatccacaaacagtttttctgatggttcttcttcgtcgtcagagtttggatctccaatctttgggttgtactttacctttgagcatgatgtgaattatcttctcaattcggtgcttcctttttccttccaccacctgatg

SEQ ID NO: 3085 - DNA, 1259 bp, Oryza sativa
ggcgagccctagctaccactagctggtggccccacaccaccgccaccaccaccacgcgacgaagacgaagccgtataggtgaaacgtgtgtgtatcacggcgtctcccaccgagaaaaggcgacgcgattgcaaccccgcgcgagatcgacctcgcgttccactcccactcctctccaccttcaaatccacgcgagttgttgagcgagagagagagagagagagagagagatttgatttgcgtttgcgttttgcgtccatggcgcagcagcagaggatggtgatagtgggggaggagcactgcggcggcggggaggacagggagctgacggtgaggaagacgacgctgttctgccccggcgacgggctggaggcgtacgaccacgggacggggacgctggcgttcagggtggagacgtacgggcgcggcggggtgtgcggcggcggcgcggcggcgggggacctggcgctgctcggccccgagggggagcccgtgctcaccgtccggcgccgccgccccagcctgcaccaccgctgggacgggttcctcggggacggcgccgcctcggggcagaagccgctcttctccgcccgccgctcgtccatcctcggcgtcggctcaggcgccgccgccgtcctcgtcgacctcctcgcccccggcgccgccggcgagttccgcgtcgacgggtccttcccgcgccgctgctgccgcgtggtggccgtcaaggccgctgcccccgccggcggcggcggggaggaggaggaggaggaggtggtggtggcggaggtccggaggaaggtggacgaggacgcgcacgtggtgatggggcgcgacgtgttcgtgctgtggttgcgcgccgggttcgacgccgcgttcgccatggggatcgtgctcgttctcgaccggatcaccggcgacgagctcaacggcgacctgagcgaggacctcgccgtcgccagttcgccggtgtaaaagctttcggtgatcggatcaatgggttcatgcttagagatgtgtaaaatatgtatcatcttgcaaattcttttttgtatgttttcttgtcgaagtttgaatattttgccttgtgaattgagcttgtagctttgagcgaaatgcaagttactcctaattacgttagcctttgacagtagtaataactatagttaattattttgcttgttctttcatgccttttggattatttttgtctctgaatagtactagcagtttatagtttggtgatctaacttaactacgtt

SEQ ID NO: 3086 - DNA, 1025 bp, Oryza sativa
gagatcgacctcgcgttccactcccactcctctccaccttcaaatccacgcgagttgttgagcgagagagagagagagagagagagagatttgatttgcgtttgcgttttgcgtccatggcgcagcagcagaggatggtgatagtgggggaggagcactgcggcggcggggaggacagggagctgacggtgaggaagacgacgctgttctgccccggcgacgggctggaggcgtacgaccacgggacggggacgctggcgttcagggtggagacgtacgggcgcggcggggtgtgcggcggcggcgcggcggcgggggacctggcgctgctcggccccgagggggagcccgtgctcaccgtccggcgccgccgccccagcctgcaccaccgctgggacgggttcctcggggacggcgccgcctcggggcagaagccgctcttctccgcccgccgctcgtccatcctcggcgtcggctcaggcgccgccgccgtcctcgtcgacctcctcgcccccggcgccgccggcgagttccgcgtcgacgggtccttcccgcgccgctgctgccgcgtggtggccgtcaaggccgctgcccccgccggcggcggcggggaggaggaggaggaggaggtggtggtggcggaggtccggaggaaggtggacgaggacgcgcacgtggtgatggggcgcgacgtgttcgtgctgtggttgcgcgccgggttcgacgccgcgttcgccatggggatcgtgctcgttctcgaccggatcaccggcgacgagctcaacggcgacctgagcgaggacctcgccgtcgccagttcgccggtgtaaaagctttcggtgatcggatcaatgggttcatgcttagagatgtgtaaaatatgtatcatcttgcaaattcttttttgtatgttttcttgtcgaagtttgaatattttgccttgtgaattgagcttgtagctttgagcgaaatgcaagttactcctaattacgttagcctttgacagtagtaataactatagttaa

SEQ ID NO: 3087 - DNA, 1096 bp, Setaria italica
gtcacattactcggaagcccacacattcactttgccttcgctttagacctctgtgctgtaacttgcaagggacgtcgaggaggagggtgtacataagcaggacagagctcgcccgccgtcccacggaggacgagacgaggccgcggccacggggatggcgtccaggtgcttcttccccagggacgcggccgcggacgcccggcaccagtcgaaggcggcggcggccgcgctcgagcagctgaaccacggcggccgcctcctgtcccgggaggacgtcggcggcgcggtgcgcgtcaagatcgtcgttagcaagcgcgagctcaagcagatggtcgcggcgctcggcgacggcgccggcgcggtgaccgcggccgccaccgccgcggcggcaaccagcgagcggcaccggcagcgcgcggcgggggccgggccgggcgccgagcagaggctgcagtcgctgcggcggcgcagcatgcggcgggcggccgaggcggcgcgccggatgcaggcgaacggggagtgggagcccggcctgcagagcatccccgaggaggtctactgatgataaccaccgctagtagatgatgggtggcgtccgctgatggctagtaatctcttgactaattatgggtttgggtacgttttgatcaccgctaagtgctagatgtatgtgtacagcgctgttttgctccggaccctgcttatcatgggctccaatggctgcttaatcgtcctccgcgagtttgtgcattttgccctgtgattttttttggtgtgaaccaagcaaagagggaggaaagagatgtgttttggaccttgggttgggtcatcacaatgcaagtgctgacggttgatgaactgatctcaattttggcatccaacctgctgtgaatgatggatggtgtgagcaggttgttcagggggtagcaagctgccaggattgcttctgttttttctctcgtctggcagtgagattttactttgtcgccattccatgccactgtgaacccgtgatgaaacggtgaactgtgaaaccggcatgtgtacatgtactatttactgtggataaatagtttaggtgttcggttgttttgcc

SEQ ID NO: 3088 - DNA, 874 bp, Zea mays
acattactcggcagacggcagcgcacacattcacttggccttggcttttgcctttgtgctgtgacttgcaaggaacgtcggcgagagggccgggcaggcaggcaggcgcacagcacagactcctcctcctcgcccaccggccggccggcgctcccgatggcgtccaggtgcttcttccccagggacgctgcggccgccgaccacccgcagtccaaggcggcggcggcccaggccctcgagcggctgcaccacggcgggcgcctcctgtccagggaggacgtcgggggcgcggtgcgcgtcaagatcgtcgtcagcaagcgcgagctcaagcagatggtcgcggcgctcggcgacggcggtctggtggccgcggccagcagcgagcgccaccggcagcgcgcggcggcagcggcagggccgggcgccgagcagaggctgcagtcgctgcggcggcgcagcgtgcggcgggcggccgaggctgccgcgcggcggatgcaggcgggcggggagtgggagcccggcctgcagagcatccccgaggaggtttgctgatgactaccagaccagtagatgatgtatgatgatggcgtccttctctttcatggctagtagtagtagtagcagtaatctcttgactaattgtggcttggatacgttttgatccatcacttgcctcgctgctgctaaaagcgcgctaggagatgtatggtgttgtacagcgctgttctcgttctgctctgggctatcctggcccagtacggctgcttcttgatgtagtttctgcgtacgttttgccctgtgagttttctctttggtttggtgtggaccaagagaggatcggaggaaattgagagatgtgttttggaccttggat

SEQ ID NO: 3089 - DNA, 1067 bp, Sorghum bicolor
cagaccaccaccaggcgccacgattcagaagcggcgacccgcctcgccttatccgctggaccaacggcaacggcaaacctgctctcccgcctccgcgccagcaggcagtagccatggctccggccgcgtcgtccacgtccgcgtcgccgctgtcccgcctcctcctcctcctcagcctcccgaagccaggcgccgcgaggcaccccaccagctcctcctcctctcccgcgcggccttgcccggacgccggcctcgtcctccggcggcgcgaggccgcggccgccgtgctgtcgaccgccctcctctcccgcttcgtgctccccgcggcggcgtcggcggccgcggatggtgggggagagtgcccgctggaggtggcgccgtccgggctcgccttctgcgaccgcgtcgtcggcaccggcgccgccgcccaggaggggcagctcatcagggcgcattacacggggaggctggaggacggcacggtgttcgacagcagctacaagcgcgggaggccgctcaccttccgcgtcggcgtcggagaggtgatcaaaggatgggatcagggcattgttggcggcgaagggattccgccaatgcttgctgggggtaagcggacgctgaagctgccaccggcgctggcctacggcgagaagggggccgggtgcagagggtgggagcccacctcctgcgtcatcccgccaaactccacgctcctcttcgacgtcgagtacgtcggcagagcctccggctgaggtcaacggaaactctgaactgaatgcacgaggccaagattcagtgatccatgcgtagcttgtagacacgatcgtagctgcccgggctttgagaggggttatttttcttctcgtgtgattgctgtccctgtgtgttaaagagagcgatatttagattgccacagacacgagtctgtataaaaaatatattttttgtatatgggtagcgagacatcagacattcttggtgaagtttattagcacatctctatctctcagaataaaagtgtgttgatttttttatgtcaatccatgctgccgtgtcatgaatcagaa

SEQ ID NO: 3090 - DNA, 1015 bp, Setaria italica
cgccacaattcagaagcggcgagccggcgaccccgccttatccactggagcaacctgctccgtgcctcctgcgtccagggagccgagccagcacagcagcaggccatggctccgtccacctccaccacgtcgccgctgtcccgcctgctcctcagcctcccgaagcccggcgccgctaggcacccccgcccggcgccgtgcccggacgccgcgtgcagcgccaagagccccggcgccggcctcgtcctccgccggcgcgaggccgcggcggccgttctgtccgccgccgtgctctcccgcttcctcctcctccccgcggcggcggaggccgcggacagcggcggggagtgcccgctcgaggtggcgccgtccgggctcgccttctgcgaccgcgtcgtcggcaccggcgccgccgcccaggagggccagctcatcagggcgcattacacgggcaagctggaggacggcacggtgttcgacagcagctacaagcgcgggaagccgctcaccttccgcgtcggcgtcggagaggtgattaaagggtgggatcagggcatagtaggcggcgaggggatcccgccgatgctcgcaggtggtaagcggacgctgaagctgccgccggcgctggcctacggcgagaagggggcggggtgcagaggctgggagcccacctcctgcgtcatcccgcccaactccacgctcctcttcgacgtcgagtacgtcggcacagccttcggctgagctatctcaattctcaaagctctgggaggcctgatttgtaaagtgtcgagagtgatcaacctggcgctcgtggactcgcttgctgatgccttggcatcgtgagggtttcatttcttctcggtgtggtttgctgtctgtctgatagtgtgtcaagagagccacagataagattctgtgtatttttttttcttggtgtgattactgtatattagtagatgatcatgacacaactggtagaatgaaggagatgatcaaggtggcgtttgattccggc

SEQ ID NO: 3091 - DNA, 1463 bp, Sorghum bicolor
cgccacgattcagaagcggcgacccgcctcgccttatccgctggaccaacggcaacggcaaacctgctctcccgcctccgcgccagcaggcagtagccatggctccggccgcgtcgtccacgtccgcgtcgccgctgtcccgcctcctcctcctcctcagcctcccgaagccaggcgccgcgaggcaccccaccagctcctcctcctctcccgcgcggccttgcccggacgccggcctcgtcctccggcggcgcgaggccgcggccgccgtgctgtcgaccgccctcctctcccgcttcgtgctccccgcggcggcgtcggcggccgcggatggtgggggagagtgcccgctggaggtggcgccgtccgggctcgccttctgcgaccgcgtcgtcggcaccggcgccgccgcccaggaggggcagctcatcagggcgcattacacggggaggctggaggacggcacggtgttcgacagcagctacaagcgcgggaggccgctcaccttccgcgtcggcgtcggagaggtgatcaaaggatgggatcagggcattgttggcggcgaagggattccgccaatgcttgctgggggtaagcggacgctgaagctgccaccggcgctggcctacggcgagaagggggccgggtgcagagggtgggagcccacctcctgcgtcatcccgccaaactccacgctcctcttcgacgtcgaaacacaagacatgctcaagagtaaacttattcttgaagatgaatttgcctggagtttaccttcggtgggctcaggttcagatgaacatgaaaggtgcaaactgaagtatattggtgggactgacattagcttcttaaaggaagacccagccacagcatgtgctgcagtggtagtcctcaatgccgatactttagaagttgtccatgaagagttcaatgtcgttcgactgcaagtgccatatattcctggttttcttgcattcagagaggctccagttcttcttggactcttggaaaaggtgaagatcaatgcacctcatttctaccctcagctgctcatggttgatggaaatggattactccatccacgaggttttggtttagcttgtcatctcggcgtccttgcagacgtccctactattggagttggaaaaaatctacatcatgtagatggccttaaccaatcagaagtcagaagactgcttgaatcaaaagagaactgcaacaaggagctgattttgttgactggacagtctgggacaaaatggggcacggcgatgcgctcctgccctggttcattgaagccaatttacatatcagttgggcatcgcatttcacttgattcagccatggtgatagtgaagtcctgttgtaaataccgtgttcctgagcctacaaggcaggcggatataagatcaaaggccttcctgcagaagctccaaaaaccacggcaatgacgacaagactagctt

SEQ ID NO: 3092 - DNA, 1639 bp, Sorghum bicolor
cgcctcgccttatccgctggaccaacggcaacggcaaacctgctctcccgcctccgcgccagcaggcagtagccatggctccggccgcgtcgtccacgtccgcgtcgccgctgtcccgcctcctcctcctcctcagcctcccgaagccaggcgccgcgaggcaccccaccagctcctcctcctctcccgcgcggccttgcccggacgccggcctcgtcctccggcggcgcgaggccgcggccgccgtgctgtcgaccgccctcctctcccgcttcgtgctccccgcggcggcgtcggcggccgcggatggtgggggagagtgcccgctggaggtggcgccgtccgggctcgccttctgcgaccgcgtcgtcggcaccggcgccgccgcccaggaggggcagctcatcagggcgcattacacggggaggctggaggacggcacggtgttcgacagcagctacaagcgcgggaggccgctcaccttccgcgtcggcgtcggagaggtgatcaaaggatgggatcagggcattgttggcggcgaagggattccgccaatgcttgctgggggtaagcggacgctgaagctgccaccggcgctggcctacggcgagaagggggccgggtgcagagggtgggagcccacctcctgcgtcatcccgccaaactccacgctcctcttcgacgtcgaaacacaagacatgctcaagagtaaacttattcttgaagatgaatttgcctggagtttaccttcggtgggctcaggttcagatgaacatgaaaggtgcaaactgaagtatattggtgggactgacattagcttcttaaaggaagacccagccacagcatgtgctgcagtggtagtcctcaatgccgatactttagaagttgtccatgaagagttcaatgtcgttcgactgcaagtgccatatattcctggttttcttgcattcagagaggctccagttcttcttggactcttggaaaaggtgaagatcaatgcacctcatttctaccctcagctgctcatggttgatggaaatggattactccatccacgaggttttggtttagcttgtcatctcggcgtccttgcagacgtccctactattggagttggaaaaaatctacatcatgtagatggccttaaccaatcagaagtcagaagactgcttgaatcaaaagagaactgcaacaaggagctgattttgttgactggacagtctgggacaaaatggggcacggcgatgcgctcctgccctggttcattgaagccaatttacatatcagttgggcatcgcatttcacttgattcagccatggtgatagtgaagtcctgttgtaaataccgtgttcctgagcctacaaggcaggcggatataagatcaaaggccttcctgcagaagctccaaaaaccacggcaatgacgacaagactagcttttcttcaacgtaagctgtaacaagactggacatattgggatcttgatcttcctcgctgtagttgaatttccagaaacaaatgtgtaacatgtatttggcacttccacatgaagcagcttctgcacatctctaaaaccgattgtcgttgccaatctgttgcctgttgtgaggttaccgtcgtttgtaaaatatgttgtgat

SEQ ID NO: 3093 - DNA, 891 bp, Panicum virgatum
  misc_feature (311)..(311): n is a, c, g, or t
  misc_feature (733)..(733): n is a, c, g, or t
  misc_feature (810)..(810): n is a, c, g, or t
  misc_feature (812)..(812): n is a, c, g, or t
ggggagcaccggcaacgtgccagcaaccatcaggcagccatgggtgctccgtccacctccacgtcgccgctgtcccgcctcctcctcagcctcccgaagcccggcgccgcgaggcacccccgcgcctctcccgcagcgccgtgcccggatgtctccaagagcgccggcgccggcgccggcctcgtcctgatccgccggcgcgaggccgtggccgcggtgctgtccggcgccgcgctctcccgctccctccccctcctccccgcgtcggcggaggccgcggacggcggggagtgcccgctcgaggtggcgcngtccgggctcgccttctgcgaccgcgtcgtcggcaccggcgccgccgcccagcagggccagctcatccaggcgcactacacggggaggctggaggacggcacggtgttcgacagcagctacaagcgcgggaggccgctcatcttccgcgtcggcgtcggagaggtgatcaaaggatgggatcagggcatagtaggcggcgaggggatcccgccgatgctcgcagggggcaagcggacgctgaagctgccgccggcgctggcctacggcgagaagggggcggggtgcagaggctgggagcccacctcctgcgtcatcccgcccaactccacgctcctcttcgacgtcgagtacgtcggcagagccgtcagctgagctctctctgctactcagtgtggctttgctggctggctggctgggatcntgtcaagagccacatgcactgatgcacgactccgttttttttttcttttgtgtgtgcttggcatgtatttgtagtananatggtgatgactcgccgccggtagaattatggacatgatgaaatgtgagaccagaatggacatgatgcgttcgtgcttg

SEQ ID NO: 3094 - DNA, 1940 bp, Sorghum bicolor
gactgatggatggatcactcctgcaggctgcagcagctgcagtgcgtcctgcctctggcggcttccttctccatcgtctattaatgcctcgtcttcgtctagctccagcgctcggcttacacaagcctctccaacatgaagctcctcggttggatgcaccggaagttacgacagaatagtaatgatgtcttcaaagagttcaacaacggtggaggtgggacctgcaactgcctcaccgggctggcctcgccggacccggccaccttcctcgcctccgccaacgaatacttcgccggcgaccacgacttcaccaacattcactcatctccgccggacaccgacctcttcacctttggtggcagcggcctcctcaccatcggcactctaggcatcaccgcggtcgcggtccctgcagacgctgacgacgacgattacgacgtcgacgtcgatgccgactccgactctgacgacaacgacgacaccgcggatgagggagacaaggtcgacagcgccgtcacgcccacattcacatacacagcgccgcctacggcactggcagaggccgccgaggtcgtcgagaaggctgcagtcgccgtggtcgaggccatcgccgagaaggacgacgacaccaccacggaggacgacctgatggtggtgagcgccgaactggagaaggtcctcggtggccgcaacagcggtgccgccggcgacctgatcgcgtctgcgcgggtaagcttcgccatgggcgtggactgcccgctgcagggcttcctgttcggctctccggtgagcgatgccgccgaatcgcgcctggagcagccgcgggacagcaatggcggccggcgcacctcgctcggcgagctgttcatgcgcacgcgcttcgccgacgagaaggtggccctcgtcgccgtcgaggaaggcgaggacggcggggatggtggagccgccggtggagaaagggacgacgggaaagcagggaaaggcggcggctgccacaagacaacgaagaagaggagggtgaaagatgataaagtcgccggcggtgatggaacgccggcgagtgcagcggtgaccaagagcaagtttcagaagatcctccaaatcttccacaggaaagtgtaccctgagagcgcggccctggcccggaacctgaccaagaagagccgcaagcgcggcagcggcggcgccgacgagcccgccgagccggcgtcgtccaacaagctccggtgccgcaaggagcagcgcgcgccggggttcggctgctgcgccaaccgggcctccttcggtggcgccgcttctcccatccacgacgacgacgacgacgacgagctcaacggcagcaagagcggccactggatcaagaccgacgctgaatacttggtgctggagttatagaacgagaaacaacaagagagagtcagaatctgttggctggtcaatatcatatatagtgagtatattgagcatgttacttgcgtacttatgtttgtgtgcttgcttgttcttcaccaaaaaaccttgttatatacacatatatgtttgttcatgtcactacctgatggatgatgagttgtatgtgtcattctatctatcaaggggaaaaggactgtgaatgtatgaacttaatgtatggtttgcatcaagattgtgattgctgcctcctgtcctgccttatggatagtacattactactcctagctgatcatagcctttctgtgggtgcatgtgggggcttaggcacttggttggccctggcccccctaatcatgctgcttcttgaactcttgttggtggcctgattgcagaggaatatcccggtgacagggatgtgcctaacaacaacaattgccatttcccgcaataggctggatgcagctttgatatgcatcattattcatatggcccatttaattcagattaggagcttttgtatattcacc

SEQ ID NO: 3095 - DNA, 1859 bp, Sorghum bicolor
ctccatcgtctattaatgcctcgtcttcgtctagctccagcgctcggcttacacaagcctctccaacatgaagctcctcggttggatgcaccggaagttacgacagaatagtaatgatgtcttcaaagagttcaacaacggtggaggtgggacctgcaactgcctcaccgggctggcctcgccggacccggccaccttcctcgcctccgccaacgaatacttcgccggcgaccacgacttcaccaacattcactcatctccgccggacaccgacctcttcacctttggtggcagcggcctcctcaccatcggcactctaggcatcaccgcggtcgcggtccctgcagacgctgacgacgacgattacgacgtcgacgtcgatgccgactccgactctgacgacaacgacgacaccgcggatgagggagacaaggtcgacagcgccgtcacgcccacattcacatacacagcgccgcctacggcactggcagaggccgccgaggtcgtcgagaaggctgcagtcgccgtggtcgaggccatcgccgagaaggacgacgacaccaccacggaggacgacctgatggtggtgagcgccgaactggagaaggtcctcggtggccgcaacagcggtgccgccggcgacctgatcgcgtctgcgcgggtaagcttcgccatgggcgtggactgcccgctgcagggcttcctgttcggctctccggtgagcgatgccgccgaatcgcgcctggagcagccgcgggacagcaatggcggccggcgcacctcgctcggcgagctgttcatgcgcacgcgcttcgccgacgagaaggtggccctcgtcgccgtcgaggaaggcgaggacggcggggatggtggagccgccggtggagaaagggacgacgggaaagcagggaaaggcggcggctgccacaagacaacgaagaagaggagggtgaaagatgataaagtcgccggcggtgatggaacgccggcgagtgcagcggtgaccaagagcaagtttcagaagatcctccaaatcttccacaggaaagtgtaccctgagagcgcggccctggcccggaacctgaccaagaagagccgcaagcgcggcagcggcggcgccgacgagcccgccgagccggcgtcgtccaacaagctccggtgccgcaaggagcagcgcgcgccggggttcggctgctgcgccaaccgggcctccttcggtggcgccgcttctcccatccacgacgacgacgacgacgacgagctcaacggcagcaagagcggccactggatcaagaccgacgctgaatacttggtgctggagttatagaacgagaaacaacaagagagagtcagaatctgttggctggtcaatatcatatatagtgagtatattgagcatgttacttgcgtacttatgtttgtgtgcttgcttgttcttcaccaaaaaaccttgttatatacacatatatgtttgttcatgtcactacctgatggatgatgagttgtatgtgtcattctatctatcaaggggaaaaggactgtgaatgtatgaacttaatgtatggtttgcatcaagattgtgattgctgcctcctgtctactcctagctgatcatagcctttctgtgggtgcatgtgggggcttaggcacttggttggccctggcccccctaatcatgctgcttcttgaactcttgttggtggcctgattgcagaggaatatcccggtgacagggatgtgcctaacaacaacaattgccatttcccgcaataggctggatgcagctttgatatgcatcattattcatatggcccatttaattcagattaggagcttttgtatattcaccatttcaaaga

SEQ ID NO: 3096 - DNA, 1821 bp, Setaria italica
gactgatggatcactcctgcagctgcagtccggctgttctgcctctggcggcttcccacttcatcttctattaatgcctcgtctagctccagctcccggcttagacaagcctctccaagatgaagctcctggggtggatgcaccggaaattacgacagaatagtaatgatgtgttcaaagagttcaacaacggtggaggtgggacctgcaactgcatcaccgggctggcctcgccggaccccgccaccttcctcgcctccgccaacgaatacttcgccggcgacggcttcaccaccaacaaccaatcgccgccggacaccgacctcttcaccttcggtggcagcggcctcctcaccattggcactctaggcatcgccgctgttgcgattccttcagacgcagaggacgaggactacgacgtcgacgacgttgatgccgaatccgactccgacgacaatgacaacaccgtggatgaggaagacgacgtcgacatcgatggcgccgtcacgcccacattcacctaccctcagccgccaccggttgagaccgccgccgtcgaggagaaggcggtcgccgcggtcgaggccatcgccgagaagaacgacgacaccaccacggaggacgacctcatggtggtgagcgccgagctggagaaggtcctcggcggccgcaacagcggcgctgccggcgacctggtggcgtcggcgcgggtgagcttcgccatgggcgtggactgcccgctgcagggcttcctgttcggctccccggtgagcgacgctgagtcgcgcctggagcagccgcgggacagcaacggcggccggcgcacctcgctcggcgagctgttcatgcgcacgcgcttcgccgacgagaaggtggcgctcgtcgccgtcgaggagggcgaggacggcgccgccggtggagaaacggaggacgggaaagaggggaaaggcggcgacggccgcaagacagtgaagaagaggagggtgaacgatggaaaaggcgccggtggtgaaggagcgccggcgagtgcagcggtgaccaagagcaagtttcagaagatccttcaaatcttccacaggaaagtgtaccctgagagcacggcgctggcgaggagcctcaccaagaagagccgcaagcgcggcagcagcagcgccagcgccgacgagcccgagctggcgttgcccaagctccggtgccgcaaggagcagcgcgcgccggggttcggctgctgcgccaaccgagcctccttcggtggcgccgccactcccatcgacgacgacgacgacgagctcaacggcagcaagagcggccactggatcaagaccgacgctgaatatttggtgctggagttatagagaaagaaataaagagagagaaagtcaggatctgttggctggtcaatatcaagcatagtgagtatattgagcatgttgtgtactaaagtttgtgtgcttgcctcctacaaaatccttatatgtttgttcacgtcacctgaatgagttgtatgtgtcagtctataaagggaaataggactgtggatgtatatgaacttaatgtatgctttgcatcaagatgtgattgctgtgttatgaataacagttgatagccttctgtgggtgcatgtggggggcttgcattcagcccttgggccccccctcacaatgctgcttcttgaactcttgttggtggcctgattgcagaggaagatccagtgacagggatgggcctattaacacttgtcattttcctaagtaggctgagtgcagtttagatctgcatcattcttatggccctgtttaggagctttcatatactcatcat

SEQ ID NO: 3097 - DNA, 678 bp, Saccharum officinarum
cactcgcggccttctcactctcgcactagcgcccgcttctcctcccataccctagctcctccgtcctccgaccccctcagctccagcgatggcctccatcccgcacccgccgccggtgatcggtaagtcgggcaacctcacggtgttcgtcacgccaccggcggagccggagagcccgaggtccgagttctctacgcccccgacgagtccccgcgccgaggactcccctgaatcgccgccggcgcaggcggcccctccgcccgcacctgtttattcggtctccacgccgccgcttgtcaagacggtctctccgccgcttcccgcggagaagctctcccgaccctcgctgctccaggcaccaaagctctcttcccgctccttgccaccggtccaggtgccgccgttgcagttcgcgaaggcgtcggaagggtcggacggatcgctgctcgcgttcttctgggacgcggttgcacgcgtgcaagaagcacacgcgagtttggacgagcacatctcgagatggttcgggctggaccagtccaagtaccagtgggcgctcaacgactattatgagaggaccggacaggagatagatttgagccacgctggcactcgtaaggaggacacgttgtaaaaatcagaaagcatgacaaagggaatatttctagtctttatgtgtga

SEQ ID NO: 3098 - DNA, 1874 bp, Sorghum bicolor
caccgcgcgaagaagaaacctcgccgccacggcgccacgcgagcaaaaaccctagcgcgagcaagcaagcgatagggagacagagacctcacgcggacccggcccggcccgacggcatggagagcctcgtcctcgcctcctcctgctccgcgtccccacggctcccgctaatctcctccgccgcccgcttccggaggctgcccggctccgtgccgccgccgacggtggcggcggcgtccaccggcggtgccgcgcggaaagggcccaggaggcccaggctcttcgtcgtcgccgccgcggctcctcgcggatccgggaacgttttcgagggattgagagcaaaaggctttgcaagcgtgtcatcttcgactggcaatgagaatatgtctactggaaccggtaccctgcctcccgtgcctcccccatcatcatactttggttcacctgttttctggattggagttggtgtagcattgtctgtggcgtttaccacggtctcttccatggtaaagagatatgccatggaacaagcatttaagtcaatgatgacccaggcaccaccaaactcatttggctccaactcgcctttcccatttggcatgccaccacaggcatctcctactgcaccaagcagttttccgtacttggaaccaaagaaagatacctccccacaggtgtcaactgttgatgtctcagctaccgaagtggaagctgctggaacatcgaaagaggtggatgtgactgaaactccagagccttcaaagaaatttgcatttgttgatgtttctcccgaagagttgcagcaaaagaacctccaatcttcactggagacagtagatgtaaaacatgatagtacagacagtgaaagtaaggaggatattgaggaaaaagttcttcccacaaatggagcgacttttaagccgaatgaagatgctgctcgtgggccaactgaacctagtaactcgggacctatgctatcagttgagacaattgagaaaatgatggaagatccaactgtgcagaagatggtgtatccctacttgcctgaagagatgaggaacccagattcgttcaagtggatgctgcagaatccaatgtaccgtcaacaactacaggatatgctaaataacatgggtgcatctcctgatcaatgggataaccgcatggttgatcacctgaagaactttgacctcagcagtccagaagtgcggcagcagtttgcgcaagttggcatgactcccgaggaagtggtatcgaaaataatggcaaacccagatgtagctgttgcattccagaatccaaaaatacagacagccatcatggactgttcgcagaaccctctaaacattgtaaaataccaaaacgacaaggaggtcatggacgttttcatgaagatatcacaaatcttcccacaaattaacggctagccgaacttcatcgcgggattgcagttctgattttttgtcggcccatcatccatctcctgtctggaggactgctgcggtttccacgtgtcaagaaagggaacacctgttgggtcatgacgctccagatagatccctcactgtgtcaaggtcctttgagttgcctatgtacgtcgtatgatgtagcggccttggtttagctatgagtatgaccctactttcataaagtcagtctagcgagcatagcagggtcaaaggcttttatttacatttgtatcggcaggcagtcagtgcgctgctttgacgttgcatggttttatctcgtaggatgtggaagccgcagcagaggtggttcgtatcagatcaattttgctatatataattgctatcaatgtgtaacatattagagacacaatggcgattcaagtaatctgtttcgacattttcggc

SEQ ID NO: 3099 - DNA, 2058 bp, Sorghum bicolor
gcgagagccgagagcccgagatggctttggttccgtcgtcaatcgtcatcccatcccaaaaaaaacactctcctcttccctcccgacccggagtcgatatctcaccgcgcgaagaagaaacctcgccgccacggcgccacgcgagcaaaaaccctagcgcgagcaagcaagcgatagggagacagagacctcagttcctcgcgcagcgcggacccggcccggcccgacggcatggagagcctcgtcctcgcctcctcctgctccgcgtccccacggctcccgctaatctcctccgccgcccgcttccggaggctgcccggctccgtgccgccgccgacggtggcggcggcgtccaccggcggtgccgcgcggaaagggcccaggaggcccaggctcttcgtcgtcgccgccgcggctcctcgcggatccgggaacgttttcgagggattgagagcaaaaggctttgcaagcgtgtcatcttcgactggcaatgagaatatgtctactggaaccggtaccctgcctcccgtgcctcccccatcatcatactttggttcacctgttttctggattggagttggtgtagcattgtctgtggcgtttaccacggtctcttccatggtaaagagatatgccatggaacaagcatttaagtcaatgatgacccaggcaccaccaaactcatttggctccaactcgcctttcccatttggcatgccaccacaggcatctcctactgcaccaagcagttttccgtacttggaaccaaagaaagatacctccccacaggtgtcaactgttgatgtctcagctaccgaagtggaagctgctggaacatcgaaagaggtggatgtgactgaaactccagagccttcaaagaaatttgcatttgttgatgtttctcccgaagagttgcagcaaaagaacctccaatcttcactggagacagtagatgtaaaacatgatagtacagacagtgaaagtaaggaggatattgaggaaaaagttcttcccacaaatggagcgacttttaagccgaatgaagatgctgctcgtgggccaactgaacctagtaactcgggacctatgctatcagttgagacaattgagaaaatgatggaagatccaactgtgcagaagatggtgtatccctacttgcctgaagagatgaggaacccagattcgttcaagtggatgctgcagaatccaatgtaccgtcaacaactacaggatatgctaaataacatgggtgcatctcctgatcaatgggataaccgcatggttgatcacctgaagaactttgacctcagcagtccagaagtgcggcagcagtttgcgcaagttggcatgactcccgaggaagtggtatcgaaaataatggcaaacccagatgtagctgttgcattccagaatccaaaaatacagacagccatcatggactgttcgcagaaccctctaaacattgtaaaataccaaaacgacaaggaggtcatggacgttttcatgaagatatcacaaatcttcccacaaattaacggctagccgaacttcatcgcgggattgcagttctgattttttgtcggcccatcatccatctcctgtctggaggactgctgcggtttccacgtgtcaagaaagggaacacctgttgggtcatgacgctccagatagatccctcactgtgtcaaggtcctttgagttgcctatgtacgtcgtatgatgtagcggccttggtttagctatgagtatgaccctactttcataaagtcagtctagcgagcatagcagggtcaaaggcttttatttacatttgtatcggcaggcagtcagtgcgctgctttgacgttgcatggttttatctcgtaggatgtggaagccgcagcagaggtggttcgtatcagatcaattttgctatatataattgctatcaatgtgtaacatattagagacacaatggcgattcaagtaatctgtttcgacattttcggctttgtttgtttgcttggataagggctagggatagggccggatggtgcaggtggatcgtgtttgtttgcc

SEQ ID NO: 3100 - DNA, 2024 bp, Zea mays
cagcgagggccgagcgcccgcccgagtcccgagagggctttggtttcgtcgtcaatcgtcatccattcccaacccaaacactctccgtccgtccctcctctcctgttccctccccgagtcgatatctcaccgtcgtgcgagtaaaacaaagcctcgccgccacggcgccacgcgagcaaagacctagcgcgagcaagcaagggaggcagagaccttagtgcgtcgcgcaacgcggctcggcccgacggcatggagagcctcgtcctcgcctcctcctgctccccgtccccacggctgccgctactctccccctccgcccgcttccgccggctgcccggctccatgccacaggcgccggcgtccaccagcggtgccacgcggaaaggtctcaggaggcacatgctcttcgtcgccgccgccaccgcgactccttccggatccaggaacgttttcaaggaattgagagcaaaaggctttgcaagcatgtcatcttcgactgccaatgagaatatgtctactgaaactggcaccctgcctcccatgcctcccccatcatcatacattggttcgcctgttttctggattggagttggtgtagcattgtctgtggcgtttaccacggtttcttccatgctaaagaaatatgccatggaacaagcatttaagtcaatgatgacccaagcaccaccaaactcatttggctccaactcgcctttcccatttggcatgccaccacaggcatctcctactgcaccaagcagtttttcgtacttggaaccaaggaaaggtacctccccacaggtgtcaactgttgatgtctcagctaccgaagtggatgccgctggaacatcgaaagaggtggatgtgactgagacaccaaaaccttctaagaattttgcatttgttgatgtttctcccgaagatttgcagcaaaaggacctccaatcttcactggagatggtagatgtaaaacatgatagtacagaaagtgaaagtaaggaggatactgaggaaaaggctcccagaaatggagcgacttttaagctgaatgaagatgctgctcgtgggccaactgaatccagtcaatcaggacctatgctatctgttgagacaattgagaagatgatggaagatccagctgtgcagaagatggtttatccctacttgcctgaagagatgaggaacccagattcgttcaagtggatgctgcagaatccaatgtaccggcaacaactacaggatatgctaaagaacatgggtggatctcctgatcaatgggataaccgtatgcttgatcacctgaagaactttgaccttagcagtccagaagtgcggcagcagtttgcgcaagttggcatgactcccgaggaagtggtatcgaaaataatggcaaacccagatgtagctgtcgcattccagaacccaaaaatacagacagccatcatggactgctcgcagaaccctcttaacattgtaaagtaccaaaacgacaaggaggtcatggatgttttcatgaagatatcacagatctttccccaaatcaacggctagctggtcttcactgcgggattgcagtcttgattttttttgtcggcctatcatcccctgtgtctggagggcctgctgcggtaaccatctttgaaggaaaagggaacacctgttgctgttgggccgtgacgctctggatacaccctccctgtgtcgagctttttgagtttcatatgtagtagtacatcgtgtgatgtagcggccttggtctagctatgagtatgattgacccaccctcttcccgcttcataaagtcaggctagtgagcgtagcaggggcaaatatttgttatttacattgcatgggcagccagccggtctgcgctctgacgttgcatggtttatctcgtaggatgtgaaaggcgcagcagacagacatggttcgtatcagatcaattttgatatatactaattgctattgttagtgtgtaatacgtcagtgacacaatggcaatgcaagtaatctgtttcgagact

SEQ ID NO: 3101 - DNA, 1922 bp, Setaria italica
ggcgaggggctttggtttcggcgtccatcgtcatccgaatcaccctctcctgtgtcctctccctctccctcaccgcgcgagtacacaacgagagcctcgccgccacggcgccacgcaagcgataaaccctagcgcgagcgagcgagggagggagacagagagacctcagcgcccccacgcagcgcggcgcggcccggcggcatggagagcctcgtcctcgcctcctcctgctccgcgtccccacgcctccccgtcctctccgccgccgcccgcttccgcgggctccccggcgccgcgccgccgaccgcggcctccaccggcggcgccgcgcggggaggggcgaggaggcccaggctcctcgtcgcggcggcggctcctcgcggatccaggaacgctttcgagggattgagagcaaaaggctttgcaagcgtgtcgtcttcgaccagcaatgagaatacgtctactggaaccggtaccctgcctcccatgcctcccccgtcatcatacattggttctcctgtcttctggattggagttggtgtagcattgtctgtggcgtttaccacggtctcttccatggtaaagaaatatgccatgcagcaagcatttaagtcaatgatgtcccagtcaccatcaaactcatttggctccaactcccctttcccatttgccatgccgccacaggcagctcccactgcaccaagcagttatccttatccatactcagtaccaaagaaagatacctacccacaggctgcaactgttgatgtctcggctactgaagttgaagctgctggaacatcaaaagaggcggatgtggctgaaacaccgaaaccttcaaagaaatttgcatttgtcgatgtttctcctgaagagttgcagcaaaagaacctccaatcttcactggagaccgtagatgtaaaaagtgatagtacagatagtgaaagtaaggaggatactgagcgagaagttcccacaaatggagaggcttttaagccaaatgaaggtgctgctcgtggaccaactgaatctagcaactcaggacctatgctatctgttgagacaatcgagaaaatgatggaagatccagctgtgcagaagatggtgtatccctacttgcccgaagagatgaggaacccagattcgttcaagtggatgctgcagaatccaatgtaccgccaacaactacaggatatgctaaataacatgggttcgtctcctgatcaatgggataaccgcatggttgatcacctgaagaactttgaccttagcagtccagaagtgcgacagcagtttgcgcaagttggcatgactccggaggaagtagtatcgaaaataatggcaaacccagaagtcgctgttgcattccaaaatccaaaaatccagacagccatcatggattgctcgcagaaccctcttaacattgtgaaataccaaaatgacaaagaggtcatggatgttttcatgaagatatcacagatcttccctcaaattaacggctagtggatcttcattgcgagattgcagttttgatttttagggcccaccgtctcgtgtccaaagggctgctgtagcatctgtctaagagaaaggaacagctgttgggtgatgatgctccaggtataccctccctgtgccaagcttttggagttgccaatgtacatcgtgtccttcatctagcgccttttggtgtagctacgagcctatgacccctacttcataaagtcaggctagtcaacgtaacagggtcaaaaatttctatttacatcgtttcgtgctgacgttgcattgcacggtttatcgtaggatgtgaaagacgcaggttcgtatgaccacatttttgatactatgttattatcatgtgtagtatgttattagagatatactatggcgatgcaagtaatcttgttccgacatttcct

SEQ ID NO: 3102 - DNA, 1922 bp, Panicum virgatum
cccaccttctcccccaaccccgactcggctctatctcaccgcgcgagtaaaacgaaagcctcgccgccacggtgccacgccagcgataaaccctagcgcgagcgagcgagccagcgagcggggggagacagtgacgcagagagaccccagcgcctcacgcagcgcgcgcggcccggcccggcggcatggagagcctcgtcctcgcctcctcctgctccgcgtccccgcgcctccccgcctctgccgcgcgcctccgtgggctccccgccggcgccgcaccgccgtcctccgccggcggcgccgccgcgcggagggcggcgaggaggcccaggctcctcgtcgccgtggcggcggcggcagctcctcgcggatccaggaacgttttcgagggattaagagcaaaaggctttgcaagcgtgtcgtcttcaactggcaatgagaatgtgtctactggataccggtaccctgcctcccatgccgccaccatcatcctacattggttcgcctgtgttttggattggagttggcgtagcattgtctgtggcgtttaccacggtgtcttccatggtaaagagatatgccatgcaacaagcatttaagtcgatgatgacccagtcaccatcaaactcattcggctccaactcgcctttcccatttgccatgccgccacagttagctcccactgcaccaagcagttatccatactcacaaccaaagagagatacctcaccacaggttgcaactgttgatgtcttggctactgaagttgaatcctctggaacatcaaaagaggcggatgttgctgaaacgccgaaaccttcaaagaaatttgcgtttgttgatgtttctcctgaggagttgcagcaaaagaaccttcaatcttcactggagacagtagatgtgaaacgtgatagtacagacagtgaaagtaaggaggatactgagcaaaatgttcccacaaatggagcggcttttaagccaaatgaagatgctgcacgtgggccaactgaatctagtaactcgggacctatgctatctgttgagacaatcgagaaaatgatggaagatcctgcagtgcagaagatggtgtatccctacttgccagaagagatgaggaacccagattctttcaagtggatgctgcagaatccaatgtaccgccaacaactacaagatatgctaaataacatggggggttcatctcctgatcaaggggataaccggatgcttgatcacctgaagaactttgaccttagcagtccagaagtgcggcagcagtttgcgcaagttggcatgactccggaggaagtagtatcgaaaataatggcaaacccagaagttgctgtcgcattccaaaatccaaaaatccagacagccatcatggactgttcacagaaccctcttaacattgtaaagtaccaaaatgacaaagaggtcatggatgttttcatgaagatatcacaaatcttcccccaaattaacggctagcggagcttagttgcgggactgcagttttgatttgtaccagctccaccatctcctgcccaaacggctgcggtggcatatctgtgaagagaaaggaacatctgttcggtgacgacgtgccctccctgtgccaagcttctcgagttgcctatgttactatgtacatcgtcggggtccttcgtctagtgccatttggtgtagtatatgaggagcctatgaggctatgacccttcataaagtcaggctagccaacgtagcagggtcaaaagatattttttatccacatcgtttcgtgctctggcgtttgcatggtttgccgtaggatgtgaaagacgcagggacagttcgtggcacctcaattttggtacattgttatcattattacgtgtaatatattggagacttatgggaatgcaattaacttattttgacgtttc

SEQ ID NO: 3103 - DNA, 1866 bp, Pennisetum glaucum
cgcgagtaaaaacgagagccgcgccgccacggcgccacgcaagcgataaaccctagcgcgagcgagggaggaagggagacgtagagagaccgacctcagcgtcccccccaacgcagcgcggcgcggcccggccccgcggcatggagagcctcgtcctcgcctcctcctgctccgcgtccccacgcctctccgccgccgcccgcttccgcgggctcccaggcgccgcgccgcctccgtcctccgcggcctccatcggcggtgccgcgcggagaggggcgaggaggtccaggctcctcgtcgcggtggcggcggctcctcgcggatccaggaacgttttcgagggattgagagcaaaaggctttgcaagtatgtcgtcttctaccaccaatgagaatacgtctactggtactgggaccctgcctcccatgcctcccacgtcatcatacttcggttctcctgtgttctggattggggttggtgtagcattgtctgtggcgttcaccacggtctcttccatggtaaagaaatatgccatgcagcaagcattcaagtcaatgatgtcccagtcaccatcaaactcatttggctccaactcccctttcccatttgccatgccgccacaggcagctcccactgcaccaagcagttatccatactcagtaccaaagaaagatacctacccacaggctgcaactgttgatgtcttggctaccgaggttgaagctgctggagtgtcaaaagaggcggatgtggctgaaacgctgaaaccttcaaagaaatttgcatttgtcgatgtttctcctgaagagttgcagcaaaagaacctccaatcttcactggagaccgtagatgtgaaacgtgatagtgcagatagtgaaagtaaggaggatactgaacaagaagttgccacaaatggagcgtcttttaagccaaatgaagatgttgctcgtggaccaactgaatctagcaactcaggacctatgctatctgttgagacaatcgagaaaatgatggaagatccagctgtgcagaagatggtgtatccctacttgcctgaagaaatgaggaacccagattcgttcaagtggatgctgcagaatccaatgtaccgccaacaactagaggatatgctaaataacatgggtggatctcctggtcaatgggataaccgcatggttgatcacctgaagaactttgacctcagcagtccagaagtgcggcagcagtttgctcaagttggcatgactccagaggaagtagtatcgaaaataatggcgaacccagaagttgccgtcgcattccaaaatccaaagatccagactgccatcatggattgctcgcagaaccctcttaacattgtgaaataccaaaatgacaaagaggtcatggatgttttcatgaagatatcacagatcttccctcaaattaacggctagtggattttcatagcgcgaggttgcagttttgattttttacagcccaccatctccaatccaaaggtctgccgtagcatatgtcaagaggagaaaggaacacctgtacggtgatgatgctccagttacaccctcccctgcttctcgagttgctcgtgtacatcgtgtccttcatctagcgccttttggtgtagctatataatgagcctatgaactactactacttcataaagtcaggttagtcgagcgaagtgtcgtcaaagatttcaattcgcaggtcggtttcgtgctgtgatgttgccgtagtaggatgtgaaaggcgcggggagcagttcgtatgaccacatttttgatactatattgttattgttatgtgtagcactagcatgttgttagagatgtactgttgcaatgcaagtaatcttgtcttgac

SEQ ID NO: 3104 - DNA, 2616 bp, Saccharum officinarum
ctcaccattgctgaagtgcagagctcgcataaataggcaggacccgtggtgctcctctcctgtgccccttccggccttttccccctctggagcttgggggtactctgcctcctcttcgtcgtcttggcgtcctccagtgctctgccttcctgagctggcttcttgttcgcaggagccatggcaaaggactacccagcttctcccaaagcccagcagctgcaggaatccaagaagcagcgcctgacatacatcctcgttgtaagcgcgctctgcatcgccttctacgtcctcggtgcatggcagaacaccacgcttccaaagcccataggcaactcggcgatcacccgggttggctgcgatcccactgtcgccacggcacagtcctctggctctgtgccatcgtttgggccaggctccggcgagatgcttgacttcgacgcacaccaccagctcaccatcaacaacacggacggcgatggggaactgcagcagttcccggcatgccctctcaacttcagtgagtacacgccgtgtgaggaccgtacgcgcgggcgccggttcgaccgcgccatgctagtgtaccgggagcgccattgtcctggcaaggacgagcaggtccgatgcctcatcccagcaccgcctgggtacaggacccccttcaagtggcctcatagcagggactatgcctatttcaacaacatcccccacaaggagctcagcattgagaaagcagtgcagaactggatccaggttgagggcgataagttcaagttccctggtggtggcactatgttcccgcgtggtgctgatgcttacatagatgatatcgataagctaatctcattatcggatggaaagatcaggacggctgttgacacaggttgtggggttgctagtttgggagcttacttgctgaagaggaacatcattgccatgtcatttgcgccaagagacacgcatgaagctcaggtgcaattcgcactggaaagaggtgtccctgccatcatcggtgtgatggggaagcaccggttgccttacccatctagggcatttgatatggcacattgctctcgctgtctgattccttggcatgcacatgatggactataccttgctgaagtcgataggattctaaggccaggaggatattggattctctcgggtcctccaatcaactggaagacgcaccacgcggggtgggagaggacaaaggaggacctcaagcaagagcaagacaagattgaggatgtcgcgaggagcctttgctggaacaaggtggttgagaagagggatctctccatctggcagaagcctaagaaccaccttgagtgttccaacattaagaagacatataagacaccccatatctgcaagagtgacaatcctgatgctgcttggtacagacagatggaagcctgtgttactccattgcctgaagtaagcaaccagggagaagtggcgggaggagcagtggagaaatggccagagagggcattcttagttccccccaggataaaaaggggcatgattccaggattggatgcaaagaagtttgatgaggacaagaagttgtgggagaagagggtggcatactacaagcgcaccatacccatagcagagaatagatacagaaatgtgatggacatgaacgcaaacatgggtgggttcgctgcttctttagtaaagtaccctgtgtgggtgatgaatgtcgtccctgttaactctgaccgggacacccttggggcaatatacgagcgagggttcattggcacataccaggattggtgtgaagctttctcaacgtatccaagaacctatgacctcttgcatgctgacaatttgtttagcatctaccaagacaggtgtgatataaccgacatcctcttggagatggataggatattaaggcccgagggcacagctatcatccgtgacacagttgacgtgctcacgaaagtccaggcaataaccaagcggatgcggtgggaaagccgcatcatggaccacgaggatggccccttcaacccagagaaggtcctcatggcagttaagacgtactggactgccaaagcagaggaggagaattagcacacaggcgacacagctcactgaaagcctgaaccaggcttattctaccagtcggcgaggatggcatcagggttttgccatctcagcgtagtatgagactgcttggtcacatgttcctttcacctttctctaattctttgtagctacaatcagatgagaagttgagggagggttctgaggggtgattggacctctagttgatgcaggaaacggttttgtagcagggtaagattcactggtcttgcgtagattcctggccctgttccacgaggggttgagctaggttttagtttgtaatatgatggcaccgagcagacagtgttaccgtatattggagtaacactaatagcaataggtatttatttagttttcctctgaacactgaagtgcttgaaaattgaaattgaaggttcatttgtcatgcaactagattctggttgttcaggcatgatagtagcagtcgatggtcgctactgtggctttcacttgacagattgaaagttgttcattttatgatcttctagcctg

SEQ ID NO: 3105 - DNA, 2635 bp, Setaria italica
cgccaccacttcactccccctcaccagagctcagtgcctgcctcactcacctcaccatggctgaggcctgaggcagagctcgaataaatagaccggacccctggtgctactctactgccccgttccccttcccccctctggaacttgggggttccctgcctcttcttcgtcgtctactcgtcttggcttcctccactgccctgccttcctgagctggcttcttgttcgcaggagccatgccgaaggagtacccagcctcccccaaagcccagcagctgcaggaatccaagaagcagcgcctgacatacatcctcgtggtgagcgcactctgcatcgccttctatgtcctcggtgcatggcagaacaccacgcttcctaagccagtaggcaactctgcggcgatcacccgggttggctgtgaccctgccaccagcacggcatccagctctgcctccgtgccatccttcggaccaggttccggcgaggtgctcgacttcgacgcacaccatcggctcgccatcaatgacacagatgccggcgcaggactgcagcaatttccggcatgtccgctcaactttagcgagtacacaccatgtgaagaccgtacacgtgggcgccggttcgaccgcaccatgctggtgtaccgggagcggcactgccccggcaaggacgagcaggtccgatgcctcatcccggcgccgcccgggtacaggacccctttcaagtggcctaaaagcagggattatgcttatttcaacaatatcccccacaaggagctcagcatcgagaaggccgtgcagaactggatccaggtggagggcgacaagttccggttccccggtggtggcaccatgtttccccgtggcgctgatgcctacatcgatgatatcaataagctcatctcgttgtcagatgggcagatcaggactgctgtcgacacaggatgcggggttgctagttggggggcttacttgctgaagaggaacatcattgccatgtcgttcgcgccaagggacactcacgaagctcaggtgcaatttgcactggaaagaggtgtccctgccatcattggtgtgatggggaagcacaggttgccttacccatctagggcatttgatatggcgcattgctcacgctgtctaattccttggtatgcacatgatggactataccttgctgaagtcgatagaattctaaggccaggaggatattggattctctcgggccctccaatcaattggaagacgcaccacaaggggtgggagaggacaaaggatgacctcaagcaagagcaagacaagattgaggatgttgcaaggagcctttgctggaacaaggttgttgagaagggggatctctccatctggcagaagcctaagaaccaccttgagtgtgccaacattaagaagacatacaagacaccccatatatgcaagagtgacaatcctgatgctgcttggtacaggcagatggaagcctgtgttactccattgccagaagtaagcaaccagggagaagtggcaggtggagccgtagagagatggccagagagggcattcatagttccccccaggattagaaggggcatgatacccggattagatgcaaagaagtttgatgaggacaagaagttgtgggagaagagaatagcatactacaagcgcaccatacccatagcagagaatagatacagaaatgtgatggacatgaacgcaaacatgggtgggtttgctgcttctttggtgaagtaccctgtgtgggtgatgaatgttgtccctgttaattctgaccgggacacccttggggcaatatatgagcgagggttcattggcacataccaggactggtgtgaagctttctcaacgtatccaagaacctatgacctcctgcatgctgacaatttgtttagcatctaccaagacaggtgtgatataactgacatcctcttggagatggataggatactaaggcccgagggcacagctatcatccgtgacacggttgatgtgctcacgaaagtccaggcaataaccaagcgaatgcggtgggagagccgcatcatggaccatgaggacggccccttcaacccagagaaggtcctcatggcggtcaagacgtactggactgccaaagcaccagaagatcagaattagcacataggcagttactgaaggctgaatcaggcttgttccgccatctgtgacgatggcgtcagggtttcaacatctcagtgtagtatgagaccgcttggtcacatgattcctttcactttctctaattctttgtagttccagtcagatgagaagttgaggagggtttttggggtgtggttgggcctctagctatacaagaactggttctgtagcaggaggaaaatgctgatcttgcataggttcctggcccagttcacatgaggggaagagcatagattttagtttgtaatatgatggcaccgaacgggcagtgttatgctatattgcgttaactgaaataggtatttatccaatttgcctctaaacacccaagtgcttgaaacttgagatggtcagttcggttctcatgtaaaccataattttctttgtgttctttaacagtcacttgcagatatttcatattaggctgttccagcatatag

SEQ ID NO: 3106 - DNA, 2451 bp, Panicum virgatum
gcaggagccatgccgaaggagtacccagcttctcccaaagcccaacagctgcaggaatccaagaagcagcgcctaacatacatccttgtggtgagcgccctctgcatcgccttttatgtccttggtgcatggcagaacaccacgcttccgaagcccgtgagcaactctgcggacatcacccgggttgggtgtgaccccaccaccgccacggcacagtcctccggctctgtgccatccttcggaccaggttccggtgaggcactcgacttcgacgcacaccaccggctcaccatcaatgacacagatgccgccgcgggactgcagcagtttccggcttgcccgctcaacttcagcgagtacacaccgtgcgaggaccgtacacgtgggcgccggttcgaccgcgccatgatggtgtaccgggagcggcactgccctggcaaggacgagcagatacgatgcctcattcccgcaccgcctggttacatgacccccttcaagtggcctaaaagcagggactatgcctatttcaacaacatcccccacaaagagctcagcatcgagaaggctgtgcagaactggatccaggtggagggcgacaagttcaggttccctggtggcggcaccatgttcccacgtggcgctgatgcctacatcgatgatatcaataagctcatctcgttgtcagatgggacgatcaggactgcggtcgacacaggctgcggggttgctagctggggggcttacttgctgaagagaaacatcattgccatgtcttttgcgccaagggacacgcatgaagcgcaggtgcaattcgctctggaaagaggtgtccctgccatcatcggtgtgatggggaagcacaggttgccttacccatctagggcatttgatatggcacattgctcacgctgtctaattccttggtatgaacatgatggattataccttgctgaagtcgatagaattctaaggccaggaggatattggattctctcgggtcctccaatcaattggaagacacactacaaggggtgggagaggaccgaggacgacctcaagcaagagcaagacaagattgaggatgttgcgaggagtctttgctggaagaaggttgttgagaagagagatctctccatctggcagaaacctaagaaccatcttgagtgtgccaatattaagaagacatataagacaccccatatctgcaagagcgacaatcctgatgctgcttggtataggcagatggaagcctgtgttactccattgccggaagtaagcaaccagggagaagtggcaggtggagcggtggagaaatggccagagagggcattcaaagttccccccaggattagaaggggcatgattccaggattagatgcaaagaagtttgatgaggacaataagttgtgggagaagaggatggcatactacaagcgcatcatacccatagcagagaatagatacagaaatgtgatggacatgaatgcaaacatgggtggctttgctgcttctttggtgaagtaccctgtgtgggtgatgaacgtcgtccctgttaattctgaccgggacacccttggggcaatatacgagcgagggttcattggcacataccaggactggtgtgaagctttctcaacatatccaagaacctatgacctcctgcatgctgacaatttgtttagcatctaccaagacaggtgcgatataacagacattctcttggagatggataggatactaaggcccgagggcacagctatcatccgtgacacggttgatgtgctcacaaaagtccaggcaataaccaagcgaatgcgatgggagagccgcatcatggaccatgaggatggccccttcaaccccgagaaggtcctcatggcagtcaagacgtactggactgccaaagcatcggaagaacagaattagcacataggggcagtcgctgaagcctgaatcaggcttgttccaccagctgtgatgatggtgtgagggtttcaccatctcagagtagtatgagaccacttggccacatgattcctttcgcttttctctaattctttgtagttccagtcagatgagaaggttgaggaaggttttggggtgtggttgagcatctagcgatacaagcactggttctgtagcaggggggaaaatgctgatcttgcataggtccaggcccagtttcacgaggggaagaacatagtttttagtttgtaatgtgatggcaccgaacaggccgtgttaggaatatttcgttaactgaaataggtatttattcagtttgcctctaaactctgaactttctagtgcttgaatattgaggcggtcagttcagttctcgtgcaaattgtaagttttgtttgttccctaacactcccaggtactggtttgttccagcatatggatagcagtcgatggttgctgcagttgcagactgaaacttttttattc

SEQ ID NO: 3107 - DNA, 2580 bp, Setaria italica
tgaggcctgaggcagagctcgaataaatagaccggacccctggtgctactctactgccccgttccccttcccccctctggaacttgggggttccctgcctcttcttcgtcgtctactcgtcttggcttcctccactgccctgccttcctgagctggcttcttgttcgcaggagccatgccgaaggagtacccagcctcccccaaagcccagcagctgcaggaatccaagaagcagcgcctgacatacatcctcgtggtgagcgcactctgcatcgccttctatgtcctcggtgcatggcagaacaccacgcttcctaagccagtaggcaactctgcggcgatcacccgggttggctgtgaccctgccaccagcacggcatccagctctgcctccgtgccatccttcggaccaggttccggcgaggtgctcgacttcgacgcacaccatcggctcgccatcaatgacacagatgccggcgcaggactgcagcaatttccggcatgtccgctcaactttagcgagtacacaccatgtgaagaccgtacacgtgggcgccggttcgaccgcaccatgctggtgtaccgggagcggcactgccccggcaaggacgagcaggtccgatgcctcatcccggcgccgcccgggtacaggacccctttcaagtggcctaaaagcagggattatgcttatttcaacaatatcccccacaaggagctcagcatcgagaaggccgtgcagaactggatccaggtggagggcgacaagttccggttccccggtggtggcaccatgtttccccgtggcgctgatgcctacatcgatgatatcaataagctcatctcgttgtcagatgggcagatcaggactgctgtcgacacaggatgcggggttgctagttggggggcttacttgctgaagaggaacatcattgccatgtcgttcgcgccaagggacactcacgaagctcaggtgcaatttgcactggaaagaggtgtccctgccatcattggtgtgatggggaagcacaggttgccttacccatctagggcatttgatatggcgcattgctcacgctgtctaattccttggtatgcacatgatggactataccttgctgaagtcgatagaattctaaggccaggaggatattggattctctcgggccctccaatcaattggaagacgcaccacaaggggtgggagaggacaaaggatgacctcaagcaagagcaagacaagattgaggatgttgcaaggagcctttgctggaacaaggttgttgagaagggggatctctccatctggcagaagcctaagaaccaccttgagtgtgccaacattaagacaccccatatatgcaagagtgacaatcctgatgctgcttggtacaggcagatggaagcctgtgttactccattgccagaagtaagcaaccagggagaagtggcaggtggagccgtagagagatggccagagagggcattcatagttccccccaggattagaaggggcatgatacccggattagatgcaaagaagtttgatgaggacaagaagttgtgggagaagagaatagcatactacaagcgcaccatacccatagcagagaatagatacagaaatgtgatggacatgaacgcaaacatgggtgggtttgctgcttctttggtgaagtaccctgtgtgggtgatgaatgttgtccctgttaattctgaccgggacacccttggggcaatatatgagcgagggttcattggcacataccaggactggtgtgaagctttctcaacgtatccaagaacctatgacctcctgcatgctgacaatttgtttagcatctaccaagacaggtgtgatataactgacatcctcttggagatggataggatactaaggcccgagggcacagctatcatccgtgacacggttgatgtgctcacgaaagtccaggcaataaccaagcgaatgcggtgggagagccgcatcatggaccatgaggacggccccttcaacccagagaaggtcctcatggcggtcaagacgtactggactgccaaagcaccagaagatcagaattagcacataggcagttactgaaggctgaatcaggcttgttccgccatctgtgacgatggcgtcagggtttcaacatctcagtgtagtatgagaccgcttggtcacatgattcctttcactttctctaattctttgtagttccagtcagatgagaagttgaggagggtttttggggtgtggttgggcctctagctatacaagaactggttctgtagcaggaggaaaatgctgatcttgcataggttcctggcccagttcacatgaggggaagagcatagattttagtttgtaatatgatggcaccgaacgggcagtgttatgctatattgcttaactgaaataggtatttatccaatttgcctctaaacacccaagtgcttgaaacttgagatggtcagttcggttctcatgtaaaccataattttctttgtgttctttaacagtcacttgcagatatttcatattaggctgttccagcatatagataattcatagtagtcggc

SEQ ID NO: 3108 - DNA, 2794 bp, Oryza sativa
tgcgggtgtagtatggccaccatggcggcatatggccccctttcacacgcacatcctcctctcctttatttatgaaaggggggttgggttagctgggaagaggaaggaagccgctgctgacatgtgacaccgtgtttggcatcacaccacttcactccactggctcagtggctgcctcactcactcaccaattcaccattgctagtgcaagagctcgcataaataggcagagctgctgctcctctcctctccctctcagcctctggaggaggaagagaagaggaggggtctctgcttcatctttcttcctgagctggcttctttactacagcagccatggctaaagagtatcctgcctcccccaaagctcagcagctgcaagaatccaagaagcagcggctcacctacatcctcgtggtgagcgcgctctgcgtcgccttctacgtcctcggtgcgtggcagaacaccacagtgcccaagccggcggcgagctcggcgatcaccaaggttggctgcgacccggcggcggcggggcagtcctccgccgtgccgtcgttcgggtcggcctcgcaggagtcactcgacttcgaggcgcaccaccagctcagcctcgacgacacgggcgccgaggcggcggtgcagccgttcccggcgtgcccgctcaacttcagcgagtacacgccgtgcgaagacaggaagcgcggccggcggttcgagcgcgcgatgctggtgtaccgggagcggcattgccccggcaaggacgaggagatccggtgcctcatcccggcaccgcccaagtacaggacgccgttcaagtggccgcagagcagggacttcgcctggttcaacaacatcccccacaaggagctcagcatcgagaaggccgtgcagaactggatccaggtggacggccagaggttccggttccccggtggcggcaccatgttcccgcgaggcgccgacgcctacattgacgacattggcaagctcatctcgttgacggacgggaagatcaggacggcgatcgacacaggttgcggggttgctagctggggtgcttacttgctgaagaggaacatccttgcaatgtcgtttgcaccgagggacacccatgaagctcaggtgcaattcgcgctggagcggggtgtgccggccatcatcggcgtgatgggaaagcaacggctgccttacccatctaggtcatttgatatggcacattgttcacgctgcttgattccttggcatgagtttgatggaatatacctagctgaagtcgacagaattctaaggcccgggggatactggattctctcgggtcctccgatcaattggaagacacactacaaggggtgggagaggactaaggaagacctcaaggaagagcaagacaatattgaggatgtcgcgaggagcctttgctggaacaaggtggttgagaagggggatctctccatctggcaaaagcctaagaaccaccttgaatgtgccaacatcaagaagaagtataagacaccccatatatgcaagagtgacaatcctgatgctgcctggtacaagcagatggaagcatgtgttactccattgcctgaagtaagcaaccagggtgagatcgcaggtggagctttggagagatggccacagagggcattcgcggtccctccaagggtgaagaggggtatgattccagggatagatgcgagtaaatttgaggaggacaagaagttgtgggaaaagagggtggcgtactacaagcgcaccctacccatagccgatgggagatacagaaatgtcatggacatgaacgcaaacttgggcggatttgctgcttctttagtgaagtaccctgtgtgggtgatgaacgtcgttcccgtaaattcagaccgggacacgcttggagcaatttatgagcgaggattcattggcacgtaccaggactggtgtgaagctttctcgacgtatcccagaacctacgacctgttgcatgctgacaatttgtttagcatctatcaggacaggtgtgacataaccaacatcctcttggagatggacaggatcctgaggcccgagggcacggcgatcatccgcgacacggtcgacgtcctcaccaaggtccaggcgatagcgaagcggatgcggtgggagagccgcatcttggaccatgaggacgggcccttcaacccggagaaggtccttgtggcggtcaagacatactggactgctgatgaatcagagcagcactagcacactgcacacagcacagaacacaggctcggctacctctctgaagactgaagaagtctgaacccccgattgttttcagagctgtgatgatggcatcggagttttgccatttcggtgtaacataacagaagatatcatctggtcacttgttttcttcctcctttcgctaattctttctatatcaaaggaaaagttatggatggtttttggggtgagattgggcatggttggatgatacatgagtttgttagcaaggggaagaaatgcaaatcttgcataggttcctgccccagtttcacgcatggagcagacagcagaggataggttttttagcttgtaatatgatggcgtccaagtatccaacagacactgttaatctatattgaggttaactaagataggtatttatctagtttatctgtgttagctcttggaattatcagtttattagttaattaagttcttgatgctccttaaaacgatgagaggcacagttacagacttcagtacagtaccttcttgttttgaatcggacttgcccatacattggtcc

SEQ ID NO: 3109 - DNA, 2469 bp, Brachypodium distachyon
gtgttgggcgtcaagccacttcactcacctcttcccatctcagtggccacaccactgcctgcctcgcttcgccattgttcccaagctctcgcataaaaagagttggagcttgggctggagggggcggtgccctcggctccttcctcttctcggtgcggctcctcctaaggcagcttatttccagttcatcatacttgcaggagccatgcctaaagattaccccgcatctcctaaagcccagcacctgcaggaatccaagaagcatcgtcttacctatattctagtggtcagcagcctctgcgtcgccttctatgtccttggcgcatggcagaacaccaccatgccgaagcccgtgggcaattcggcaatcgcccgagttgactgtgatcccacagctcagagagacagctcggtgccatcttttgggtctgcatctgagactgtgctcgactttgatgcacaccaccagttgaacctcactgacacggaggctgtggtccagcagttcccagcgtgctcactcaatttcagtgagtacacaccatgcgaggaccggaagcgaggccggcggttcgaacgggagatgctggcataccgagagcgccactgcccgggcaaggatgaggagatccagtgcctcattcccgcgccaccaaagtacaagaaccccttcaagtggccacagagtagggactttgcttggtttgacaatatccctcacaaggagctcagtatcgagaaggctgtgcagaactggatccaggtggagggcaacaagttccggttccctggtggtggcacgatgtttccacatggtgccgatgcttacattgatgatattgctaagctcatctcattgtcggacgggaagatcaggacggcgatcgatacgggctgtggggttgctagctggggggcttacttgctgaagagaaacatcattgccatgtcgttcgcaccgagggacacacacgaagctcaggtgcaatttgcactggaacgcggtgtccctgctatcatcggcgtgatgggaacgcaaaggttgccttacccatctagggcatttgatatggcacattgctcacgctgtttgattccttggggagcttatgatggactgtacctagccgaagtcgatagaattctaaggccaggaggctactggattctctctggccctccaatcaactggaagacgcatcagcagggttggcaaaggaccaaggaagatctcaagcaagagcaagacaagattgagaatgtcgcaaggagcctttgctggagcaaggtagttgagaagagagatctctccatctggcagaagcctaagaaccaccttgagtgtgccaacataaaaaagaagtataagataccccatatctgcaagagtgacaatcctgatgctgcctggtacaagaagatggaggcatgtgttactcccctgcctgaagttagcaaccagggatcaatcgctggtggagaggtagagagatggccagagagggcgttcacagttcccccaagggttaagaggggtacaattccagggatagatgtaaagaagtttgtggaggacaaaaagctttcggaaaagaggttggcatactacaaacgcaccacacccatagcagaggggaggtacagaaatgtgatggacatgaatgcaaacttgggtggttttgctgcttccttagttaagtaccctgtttgggtgatgaacgtcattccagttaattcagataaagacacccttggagcaatttatgagcgaggatttattggcacataccaggactggtgtgaagctttctcgacgtatcccagaacctacgaccttttgcatgctgacaatttgtttagcatctaccaagacagatgcgatataaccaacatcctcctggagatggataggatactgaggcccgagggcacggccatcatccgcgacacggtagatgtcctcaccaaggtccaggccataaccaagcggatgcgatgggagagccgcatccttgaccacgaggacgggcccttcaacccggagaaggtcctcgtagcggtcaagacatactggacagccgacccgtctgagcacagctagctctctgaacattgaaacggcggctcgtgtgttatgatggcgtcgtagtttcgccatttcagtgtagtagtatcaggtcgcatgtttctttctcttttttttgtctaattctttgtagtttcaatcagaatgaaaaaagagttaagagagggttttggggttgggcatgggcttggtgggtgatactgatattgtgatacaggagttttctgcaggcagggttaaaagagaagtgcagatcttgcataggtttcttgttcccatcccagtttcacgcatcgagggtagagcatagatttctttggcttgtaatatgatggctatatgtttttctagaatacaatatgatggctatatgttgagcttaa

SEQ ID NO: 3110 - DNA, 2713 bp, Brachypodium distachyon
ggcctgtgggtacggtggtggcctccatttcagacctctttatttatgggagagcggagtgcccggatgggggtaactggggcggggcgctactgacaggtgagcgtgttgggcgtcaagccacttcactcacctcttcccatctcagtggccacaccactgcctgcctcgcttcgccattgttcccaagctctcgcataaaaagagttggagcttgggctggagggggcggtgccctcggctccttcctcttctcggtgcggctcctcctaaggcagcttatttccagttcatcatacttgcaggagccatgcctaaagattaccccgcatctcctaaagcccagcacctgcaggaatccaagaagcatcgtcttacctatattctagtggtcagcagcctctgcgtcgccttctatgtccttggcgcatggcagaacaccaccatgccgaagcccgtgggcaattcggcaatcgcccgagttgactgtgatcccacagctcagagagacagctcggtgccatcttttgggtctgcatctgagactgtgctcgactttgatgcacaccaccagttgaacctcactgacacggaggctgtggtccagcagttcccagcgtgctcactcaatttcagtgagtacacaccatgcgaggaccggaagcgaggccggcggttcgaacgggagatgctggcataccgagagcgccactgcccgggcaaggatgaggagatccagtgcctcattcccgcgccaccaaagtacaagaaccccttcaagtggccacagagtagggactttgcttggtttgacaatatccctcacaaggagctcagtatcgagaaggctgtgcagaactggatccaggtggagggcaacaagttccggttccctggtggtggcacgatgtttccacatggtgccgatgcttacattgatgatattgctaagctcatctcattgtcggacgggaagatcaggacggcgatcgatacgggctgtggggttgctagctggggggcttacttgctgaagagaaacatcattgccatgtcgttcgcaccgagggacacacacgaagctcaggtgcaatttgcactggaacgcggtgtccctgctatcatcggcgtgatgggaacgcaaaggttgccttacccatctagggcatttgatatggcacattgctcacgctgtttgattccttggggagcttatgatggactgtacctagccgaagtcgatagaattctaaggccaggaggctactggattctctctggccctccaatcaactggaagacgcatcagcagggttggcaaaggaccaaggaagatctcaagcaagagcaagacaagattgagaatgtcgcaaggagcctttgctggagcaaggtagttgagaagagagatctctccatctggcagaagcctaagaaccaccttgagtgtgccaacataaaaaagaagtataagataccccatatctgcaagagtgacaatcctgatgctgcctggtacaagaagatggaggcatgtgttactcccctgcctgaagttagcaaccagggatcaatcgctggtggagaggtagagagatggccagagagggcgttcacagttcccccaagggttaagaggggtacaattccagggatagatgtaaagaagtttgtggaggacaaaaagctttcggaaaagaggttggcatactacaaacgcaccacacccatagcagaggggaggtacagaaatgtgatggacatgaatgcaaacttgggtggttttgctgcttccttagttaagtaccctgtttgggtgatgaacgtcattccagttaattcagataaagacacccttggagcaatttatgagcgaggatttattggcacataccaggactggtgtgaagctttctcgacgtatcccagaacctacgaccttttgcatgctgacaatttgtttagcatctaccaagacagatgcgatataaccaacatcctcctggagatggataggatactgaggcccgagggcacggccatcatccgcgacacggtagatgtcctcaccaaggtccaggccataaccaagcggatgcgatgggagagccgcatccttgaccacgaggacgggcccttcaacccggagaaggtcctcgtagcggtcaagacatactggacagccgacccgtctgagcacagctagctctctgaacattgaaacggcggctcgtgtgttatgatggcgtcgtagtttcgccatttcagtgtagtagtatcaggtcgcatgtttctttctcttttttttgtctaattctttgtagtttcaatcagaatgaaaaaagagttaagagagggttttggggttgggcatgggcttggtgggtgatactgatattgtgatacaggagttttctgcaggcagggttaaaagagaagtgcagatcttgcataggtttcttgttcccatcccagtttcacgcatcgagggtagagcatagatttctttggcttgtaatatgatggctatatgtttttctagaatacaatatgatggctatatgttgagcttaactggaatgtgtatttattgagtttgcttacgtagtgctagtgcttgaaatggtcagctcagctcgtacaaataattctttccagttcattgatccgtgcacagtggcaaactcgggttttcccgtctatatgttttgaa

SEQ ID NO: 3111 - DNA, 2658 bp, Hordeum vulgare
ggtgtttggcatcgcaccactcacttcactccccggagtgcttctcaggctctcagctcatctcggggtggtgctcgcctgcccgccccattcgccgtcggtccataaatacaaggaccggacggagctcgggcgggctcaccggagacggaccgtgccgcgactccgctcctcctcctccttctccttcttccgtcccggcgcgctccctcctgccgaggtggtctggcttcttcacgacaggagccatggctaaagattacccagcatctcctaaagcccagcatctgcaagaatccaagaagcagcgtctcacctacatacttgtggtgagcgctctctgtgttgccttctacgtgctcggcgcatggcagaacaccaccatgccgaatcctgtcagtgattcggcaatcagccgagttgactgtgatcccgtggcgcggagagacagctcggtgccgtcctttgcgtctgcgtctgagaatgtactcgattttgatgcgcaccaccagctgaacctcagtagcactgagtccgtgttgcagcagttccctgcatgcccgctcaatcagagtgagtacacgccatgcgaggaccggaaacgtggccgcctgttcgaccgtgatatgctgatataccgtgagaggcactgccctggaaaggacgagcagctccgatgcctcattccagcgccaccaaagtacaagaaccccttcaggtggccggagagcagggactttgcttggtttgacaatatccctcacaaggagctcagcattgagaaggccgtgcagaactggatccgagtggaaggaaacaagttccggttccccggcggtggcactatgtttccacatggtgctgatgcttacattgatgagatcagtaaactcatctcattatcagatgggaggatcaggacggcgatcgacacaggctgcggggttgctagctttggggcttacttgctgaagagggacatcattgccatgtcgtttgcaccgagggacacacacgaagctcaggtgcaatttgcactggaacgcggcatacctgccatcctcggggttatgggatcactacggttgccttatccatctagggcatttgatttggctcattgttcacgttgtctgattccttggggaggacatgatggactgtaccttgccgagatcgacagaattctaaggccagggggctactggattcactcgggccctccaatcaactggaggacacaccacaatgggtggcagaggaccgaggaagacctcaagcgggagcaagacaagattgaggatgttgcgaggagcctttgctggaataaggtggccgagaaggaggatctctccatctggcagaagcccaagaaccaccttgagtgtgccgacgtaaaaaagaagtataagataccccatatctgcaagagtgacaaccctgatgctgcctggtacaagaagatggaatcatgtcttactccattgcctgaagtaagcaaccagggatcaatcgctggcggagaggttgcgagatggccaaagagggcattcacggtgcccccaagggttaagaggggcacgattccggggatagatgcaaacaagtttgaggaggacatgaagttgtgggagaagagattgacgtactacaaacgcacgacacccatagcacaggggcggtacaggaatgtgatggacatgaacgcgaacttgggcggtttcgccgcttccctggttaagtaccccgtgtgggtgatgaacgtcgtcccggtcaattcagacaaagacaccctcggagcaatttacgagcgagggttcatcggcacttaccaggactggtgtgaagccttctcgacgtatccgagaacctacgaccttttgcacgccgacagtttgttcagcatctaccaggacaggtgcgacataaccgacatcctcctggagatggacaggatactgaggcccgagggcacggcgatcatccgcgacacggtcgacgtgctcaccaaggtccaggccatcggcaagcggatgcggtgggacagccgcatcctggaccacgaggacgggcccttcaacccggagaaggtcctggtggcggtcaagacgtactggacggcggacccgtcggagcacagctgagctgcagctctccgaactcagaaatggcttgcgcggtaaccggccgtgatggtgatgatcgtgtcggtttcgccatctcagtgtgtgtttgtgtgtgtagtaagcagtgcgcttgtttctctcgcctttttttgtctaattctttgtagttcgggtcgaaatgaaaaaccagaaaaatacgtcgaacagagcataggttttatttagcttgtacgaacagagattgctactatgtactactaccaagattgactaactggaaaaaataggtctttaaacaaaaaccaaaaaaaatataaaaaacaaaaaaaataaaacctggggggggggggcccgcggaccccaacttcgcccttttagggagggcgtatttacatttcaccgggcgcgtgctttttaaaagcgttgtgtaaatggggaaaaacccgtggcgtttcccaactttaattgggccttggagcacaatcccccctttttgccgggtggcggtataagcagagagaggccgcccacg

SEQ ID NO: 3112 - DNA, 2043 bp, Secale cereale
ggagccatggctaaagattacccagcatctcctaaagcccagcacctgcaagagtccaagaagcagcgtctcacctacgttcttgtggtgagcgctctctgcattgccttctacgtgctcggggcatggcagaacaccaccatgccgaatactgtggctgattcggcaatcagccgagttgactgcgataccgtggcgcagagagacggctcggtgccgtctttcgcgcctgcgtctgagaatgtgctcgattttgatgcgcaccaccagctgaacctcagtgacacagagtctgcggtgcagcagttcccggcgtgctcgctcaatcagagtgagtacacgccgtgcgaggaccggaaacgtggccggctgttcgaccgggacatgctgatataccgtgagaggcactgcccgggcaaggacgagcagatccgatgcctcattccagcgccaccaaagtacaagaaccccttcaggtggccggagagcagggacgtcgcttggtttgacaatatccctcacaaggagctcagcatcgagaaggccgtgcagaactggatccgagtggaggggaacaagttccggttccccggtggtggcactatgtttccacatggtgctgacgcgtacattgatgacatcagtaagctcatctcgttgtcggatgggaggatcaggacggcgattgacacgggctgcggggttgctagctttggggcttacttgctgaagagggacatcatcaccatgtcgtttgcaccgagggacacacacgaagctcaggtgcaatttgcactggaacgcggtgtgcctgccatcctcggggtgatgggatcactgcggttgccttatccatctagggcatttgatttggctcattgttcacgctgtctgattccttggggagggcatgatggactgtaccttgccgagatcgatagaattctaaggccagggggctactggattcattcggggcctccaatcaactggaagacgcaccacaatgggtggcagaggaccgaggaagacctcaagcgggagcaagacaagattgaggatgtcgcgaggagcctttgctggaataaggtggccgagaaggaggatctctccatctggcagaagcccaagaaccaccttgagtgtgccgacataaaaaagagtacaagataccccatatgtgcaagagtgacaaccctgatgctgcctggtacaagaagatggaatcctgtcttactccattgcctgaagtaagcaaccaggatcaatcgctggcggagaggttgcgagatggccaaagagggcactcacggttcccccaagggttaagaggggcacgattccggggatagatgagaagaagtttgaggatgacatgaagctgtgggagaagaggttggcgtactacaaacgcaccacgcccatagcacaggggcggtacaggaatgtgatggacatgaacgcgaacttgggcggtttcgccgcttccctggttaagtaccctgtgtgggtgatgaacgtcgtcccggtcaattcggacaaagacaccctcggagcaatttacgagcgagggttcatcggcacttaccaggactggtgcgaagccttctcgacgtatccgagaacctacgaccttctgcacgccgacaatttgttcagcatctaccaggacaggtgcgacataacggacatcctcctggagatggacaggatactgaggcccgagggcacggcgatcatccgcgacacggtcgacgtgctcaccaaggtccaggccataggcaagcggatgcggtgggacagccgcatcctggaccacgaggatgggcctttcaacccggagaaggtcctcgtggcggttaagacgtactggacggccgacccatcggagcacagctgagctgcagctccgaaaatggcttgtccggtaactagccgtgacgcgatgatggcgtcggttttcgccatctcggtgtgtgtgtgtgtgtgtagtaagcagtgtgtgaccacgatcgcttgttcctcgttcttttttttgtctaa

SEQ ID NO: 3113 - DNA, 789 bp, Saccharum officinarum
ctctcccttttctctctctactaggtctctgcaaactcttccccgcagccatggcggaggacgcccccaacgccgccgccgagggcagccagcccgcgccccccgagggatccgccgacgccgccccgccggcggctaccgcgggcgccaaggccgcggaggcgctgctcccgtcgctcagcatctggccgccgtcgcagcgcacgcgcgacgccgtggtgcgccgcctcgtgcagacgctcgcggcgcccagcgtcctctcgcagcgctacggcgccgtcccggagcccgaggccgagcgcgccgccgccgccgtcgaggccgaggccttcgccgctgcctccaagtccgccgccgccgagtccccggcctccgtcgaggaggggatagaggtgctccaggcctactccaaggaggtcagccgccgcctcctcgagctcgccaagtcccggtccgccgcagctgcggcggcgcccgccgaggggagcgcgaaggaggagcccgaggaggactcgttagcgactgctgcagccaccgaggaggctgccgtaaaagaggagtaaggcgtcggaccgcgctttgatccaccgacaattgctggtatttgggcatttcgtcggaatgttattcatcgtttccctggctatgtttactaggatgtggattgtctaactatagaaaatgcttgtgacaagagggactcatgtttgttcatggacatgaaataatttattaagtatatattaaccgtgcatccttcgcattgcatatttgcatatgtgaagggtg

SEQ ID NO: 3114 - DNA, 1065 bp, Sorghum bicolor
acccccgcctgcaagtctcgctgcagcctgcagccacccacacggccacacacacgcaccacgccgctcacccctgccagactccacgccacagatctctccccttttctctctctccagaactctccccccgcagccatggcggaggacgcccccaacgccgccgccgagggcagccagcccgctccccccgagggatccgccgactccgcccccgccccggcggctaccgcgggcgccaaggccgcggaggcgctgctcccgtcgctcagcatctggccgccgtcgcagcgcacgcgcgacgccgtggtgcgccgcctcgtgcagacgctcgcggcgcccagcgtcctctcccagcgctacggcgccgtcccggagcccgaggccgagcgcgccgccgcggccgtcgaggccgaggccttcgccgccgcttccaagtcctcctccgccgccgagtccccggcctccgtcgaggaggggatagaggtgctccaggcctactccaaggaggtcagccgccgcctcctcgagctcgccaagtcccggtccgccgccgctgcggcggcgccgcccgccgaggggagcgcgaaggaggagcccgaggaggactcgtcggcggctgctccagccaccgaggaggctgccgtaaaagaggagtaaggcgtcggaccacgctttgatccaccgacaattgctgttattttggcatttcgtcggaatgttattcatcgtttgcccagcctatgtctactactagtatatctattgtctatctattagagattgcttgtgacaagagggactcgtgtttgtttcgtggacatgatataatgttaagttatatatcaaccgtgcacccttcacattgcatctgtgaaggttgctcgtgtatgttttcacgagctaatttgttctcgttttctggttgtgatttgtgaagtggttaatactcaaagagttcttgcatcgttagggacttagggcttaccccatcatggtctagggagtatcttgaactgtattacttcttgggcttgggaggggatcaatgataaatgaataacc

SEQ ID NO: 3115 - DNA, 1161 bp, Sorghum bicolor
acccccgcctgcaagtctcgctgcagcctgcagccacccacacggccacacacacgcaccacgccgctcacccctgccagactccacgccacagatctctccccttttctctctctccagaactctccccccgcagccatggcggaggacgcccccaacgccgccgccgagggcagccagcccgctccccccgagggatccgccgactccgcccccgccccggcggctaccgcgggcgccaaggccgcggaggcgctgctcccgtcgctcagcatctggccgccgtcgcagcgcacgcgcgacgccgtggtgcgccgcctcgtgcagacgctcgcggcgcccagcgtcctctcccagcgctacggcgccgtcccggagcccgaggccgagcgcgccgccgcggccgtcgaggccgaggccttcgccgccgcttccaagtcctcctccgccgccgagtccccggcctccgtcgaggaggggatagaggtgctccaggcctactccaaggaggtcagccgccgcctcctcgagctcgccaagtcccggtccgccgccgctgcggcggcgccgcccgccgaggggagcgcgaaggaggagcccgaggaggactcgtcggcggctgctccagccaccgaggaggctgccgtaaaagaggagtaaggcgtcggaccacgctttgatccaccgacaattgctgttattttggcatttcgtcggaatgttattcatcgtttgcccagcctatgtctactactagtatatctattgtctatctattagagattgcttgtgacaagagggactcgtgtttgtttcgtggacatgatataatgttaagttatatatcaaccgtgcacccttcacattgcatctgtgaaggttgctcgtgtatgttttcacgagctaatttgttctcgttttctggttgtgatttgtgaagtggttaatactcaaagagttcttgcatcgttagggacttagggcttaccccatcatggtctagggagtatcttgaactgtattacttcttgggcttgggaggggatcaatgataaatgaataacccatgtatgtttaactatgtctatatatgtgcatcgattctgcatctgtgcagttctagaggaattttgaaatatatgaacttaattggagtaaatt

SEQ ID NO: 3116 - DNA, 964 bp, Setaria italica
ccacacacactcttgtcttgtgatcctgactctcccgtctccccttctccatctttctcatccccccaccccccgccacgccacagacagatctcccctccctccctctaggtcactctttcccgcagccatggcggaggacgcccccaacgccgcggccgagggcacccagcccgctccctccgagggatccgccaccgcgccggcctccggcgcgaaggccgcggaggcgctgctcccgtcgctgagcatctggccgccgtcgcagcgcacgcgcgacgccgtcgtgcgccgcctcgtgcagacgctcgcggcgcccagcgtcctctcccagcgctacggcgccgtcccggagcccgaggccgagcgcgccgccgccgccgtcgaggccgaggccttcgccgccgcctccgagtccgccgccggcgcgtccccggcctccgtcgaggaggggatagaggtcctccaggcgtactccaaggaggtcagccgccgcctcctcgagctcgccaagtcccggtccgccgccgccgccgcggcgcccgccgaggccagcgcgcaggattcggaggactcgtcggcgaccgctccggcgcccgcggaggctgccgcttccgaggagtaaggcgctggcgcccgcgttttgatccaccgaaatttgctgttattttggcatttcgttggaaattatccatggtctagtagtatccattgtctattagagatgcgcgtgagatgaggaactggtgtttgtttcatggacctggtgtgctgctaaaatattaagttataaaccgtgaatcttgccattgcatatgtataggttgtgcatgaatgtttgcatgcgctcatccattctggttttcttgttacgaagtggttaatcctcaagaatgattgtatcaatagggcttagagcttatgcttttacccatttcaatgtagggagtatacttgaactttg

SEQ ID NO: 3117 - DNA, 838 bp, Panicum virgatum
atcgtctctctagtccccttctccatctctccatctcatcccccttccacgccccagacagatctcccccttcccgcagccatggcggaggacgcccccaacgccgcggccgaggccacccagcccacgccccccgagggatccgccgacgccgacgccgccccgccggcccccggcgcgaaggccgcggaggcgctgctcccgtcgctcagcatctggccgccgtcgcagcgcacgcgcgacgccgtcgtgcgccgcctcgtgcagacgctcgcggcgcccagcgtcctctcccagcgctacggcgccgtcccggagcccgaggccgagcgcgccgccgccgccgtcgaggccgaggccttcgccgccgcctccgagtccgccgccggcgcgtccccggcctccgtagaggaggggatagaggtcctccaggcgtactccaaggaggtcagccgccgcctcctcgagctcgccaagtcccggtccgccgccgcggcggcgcccgccgccgaggccagcgcgcaggagtcggaggaatcgtcggcgaccgctgcggcgcccgcggagtctgccgcttccgaggagtaaggcgctggccccgcgctttgacccaccgaagtttgctgttattttggcatttcgatggaaattatccgtggtttcctctggctagtagtatccattgtctattagagatgcgcgtgagaggaggaactggtgtttatttcatggacctggtatgctgctatgatattaagttatgaaccgtgaatccttgccattgcatatgtaaaggttgtgcatgcatgtttgcatgagttcatctattcctgttcct

SEQ ID NO: 3118 - DNA, 886 bp, Sorghum bicolor
caagacgagacgcaagctgcaggcacccgctcgcgcccgcgccatgaagtgctggtgcgtgcacgcgccaagaggagcaatggcgacgccgctctccagccccttcgctcccaccaccctccgctcccctctccggcatcgcgccccgctgctgctgttgccgttccctccccgtgcggcctcctccggcgaggacaccgcagcagccgaccaggagccggccccggcggccaccaagacggccaccgcggacgacgacttcgagcagcgcgtgctacagatcaagtcccgcgtcgggcccaagaagcgcggcgcgcgcaagaagaaggccgcggcgtcgtccgcgtccgccaacgccgtgacgctcccgcccgtgccgctgcgggagccccggtcggcgctcggcgcgcccgtcgagttcggcttcaccgcgtacagcgagcggctcaacggcgcgctggccgcggtggggctcgccgcggtgctgctcgtggagctgggatccgggcaggccctggtgaagtaccaccagccggccacgctgttcctgcaggcgtacaccgtcgccgcggccgccgcgctgttcgtcaagtacgagaaggagcggatcagcacgtggccggggccgccggccaagtgaaatggcgagtttttgttccggtagggtgcgtctttttcttgtaattttacctctcgatgtggaatatgtgtgttgtgagaactgggaaatgtcaggacattcgaggaaagaagagcttgattaacagtcgctttaacacccttaatttcatttcatcagtcacattgtgcacaatgctttgtgatgctgttgttgagagaactaagaaattaatcttgaaaggagtttactgtgaccctgttcttc

SEQ ID NO: 3119 - DNA, 1408 bp, Sorghum bicolor
tgaagagattaaagccagaaggagacaaaaagaagagacaaaaacttgggacattagtggaaatcctcttatttgcacgatcaaacttgggtaaaaaaaagtcaaacgtcttatagtttgggatgaagtgagtatatcttttttgttttctttttccaagtgaaatgtctctgaaatattacatgagacacaacattgtatggcaaggcattcaccgctcagtgaccgaagagactatatctaaaataaaatcgtgtttttttgagcaagtaaaataaaatcgtgctaatgtggtgggtttaaaggcccattgcatttttagcccgggcgtgtctgtgtggatattgtagggcagaaacgcaaaagcccagtggaaagcaggccgaactgtgaacgtgacagcgacgcaagccgagctataattttctccaccattttggcacggattttctaacggaaaaatacctcatcacacgagcgcaagctccatgaagactggctgaagcatgaggcagttttcaacgcaccgtgcaaccaccggagccactcgacacccaaccaaccaagaccctatccaaaagcagaggcaagccagaccaagacgagacgcaagctgcaggcacccgctcgcgcccgcgccatgaagtgctggtgcgtgcacgcgccaagaggagcaatggcgacgccgctctccagccccttcgctcccaccaccctccgctcccctctccggcatcgcgccccgctgctgctgttgccgttccctccccgtgcggcctcctccggcgaggacaccgcagcagccgaccaggagccggccccggcggccaccaagacggccaccgcggacgacgacttcgagcagcgcgtgctacagatcaagtcccgcgtcgggcccaagaagcgcggcgcgcgcaagaagaaggccgcggcgtcgtccgcgtccgccaacgccgtgacgctcccgcccgtgccgctgcgggagccccggtcggcgctcggcgcgcccgtcgagttcggcttcaccgcgtacagcgagcggctcaacggcgcgctggccgcggtggggctcgccgcggtgctgctcgtggagctgggatccgggcaggccctggtgaagtaccaccagccggccacgctgttcctgcaggcgtacaccgtcgccgcggccgccgcgctgttcgtcaagtacgagaaggagcggatcagcacgtggccggggccgccggccaagtgaaatggcgagtttttgttccggtagggtgcgtctttttcttgtaattttacctctcgatgtggaatatgtgtgttgtgagaactgggaaatgtcaggacattcgaggaaagaagagcttgattaacagtcgctttaacacccttaatttcatttcatcagtcacattgtgca

SEQ ID NO: 3120 - DNA, 6011 bp, Setaria italica
tgcgcctgctcgtgccggccgcactgagcctgagcgagctctggggacggtggactggtggcgatcacatcagagggcacatactatcggctgattgtccgtgacacggcaagatgtcactagcgaagaaggaagaggtttgcagccaccgacttgtaccgcgattgggtgagccggcagttggtgtgcctattaagaagaggccagttctcttgtctgatagatctgttgcgtcttccatgccgctctcaataaagcctccttctccagtgaaggatatgcctgtttctgctacaggggcaggctgtggccatgaatcattcttcaatattgctaaatcagatacaaatgtgatcaccaaaggtaagggaatcactgatactcagatccaggaccatgccaacaggtcttttacttcgctatcaatgaccagtggccacggagggctgtttaatgcatcaagtgagatcccttctgcggagagtgctgcaaggaggtttccaccagttgttgaatcgcaacgtcaaaattttttggctctggatttacagttaccatctcgtcaaaatggcaaagatagtaactatggctctattgtgaaggaagagaaagtagaccaagctctttccggcctttcttcagcagaagcccacaataatgttcatgttgcaagtgaactcaatgcctcttcttattctaacagtagcgatgggagactacctaacttggatctgaatgtgccgctggacccagctgattcacttgaaggtttgcctacaatgcatgaaagtgggaatgggttgtttcaccatagaacaattcagcatcagaaagctcaggtggccccagcggcacccatttctacaacaagcaatggagttggtcaaaatgttggcagtactgtgaacatgtctaattcatttgggctttctcataagtgtgggccagctgatgttaccttagatttgcaacttaaaccaccaactagacctgagctagggataaactggaaaggacttgttcctgctccagaactgagtctatctctgtttggtaagcccatggacgaatgcaagtctctaggtgctcctaatgctttatttgattctgaaattgccggaagttccaaaaagggcagtgaggagacagcttctacaccggggtcagataaggtgctggttgagaaaatcgttacacctgggccctgcaatgcaaatccacaggatactacatcagcaactgtttctggaattgatcagatgacatctcataatttggtgaagaaagaacctgaagaaacaccccaacagcatattcttaagggtgctgaaaaggcacatctattagaacgacaaagtgttgtgccagctagcaattgcgctgaatctgaaatgactgacagtccaccccaagttcccagtagagctgggtttgatttgaattctgaaatctttccgaataacggtatccatgatgggcttaatgtagcgactgataatgttccaataccagctgaaagtttgcttgatattacccaagctaagaccatgcctgctgttcctgaagttgaaatagatgtgaagcgcgaagaatccactaatcctgtggtagcaccagtaggtggtcattctgcatcattaatggaagcaaaatcattgccttcactaagtactgttgccagccctgctgttggattatgtgaatcttccagtcagccctccgtttctactgtttgcaaaccaccagctagacatgttcctgttcatgccgatacgacaaggaggccctgtgctgctaatgaagcttgtggtgcattgcaaggttcctccaatcctagagctaaatctttgcttcctaattctcgggacaatgctactattgatggtatgtcacaagggagtgctgaaatggactgttcagatgatgagggtaataccgtttcacgatttccaactacaaataagcctcatggtgagtcattggggaatggcccgaccactaaggaggacgatatcaatgccaataacttttgcaaagagctaaagaaagaacaagacagtgatatgcatgaggactgctcatctgtgacaaataaggtcaatacgcaggctgttgatggtgacaagcgtattaaaaccagagtcagtgttgtcagccatgcaggtgagcaggggcatcgaaatgaggtttttgttaccgaaaaatctaaagacaaacaatcattgaattcaggtaagaattctccgccgactaaaactgacaataccatggatgatgttaaggctgccacaggctctggttcaacagatctccaaaggccatcagctctgcaaaaatctactgcccctaaactgcaacctactaggcaatctcctaagacttcagatttgtgccttgagaaggatagaagctcagatataaagtcagaaatgtctccacatggcaaacaagctgcaagttttaatgagaaccatgcaaaaactgctgctgtgaagatggagcatcagactgaaaatgaagaggtcgctagacactcagatttgcaacgaagagattcagtactgggcaaagattcagaggtcgacggggcttcaagcagtcaaccacatagtgaatgtaccaagggcaagtcagcatttgaaaagttagaacatgacaaattccaacctgacttatgtaagacatctcctctacagaatgaaagagatggacagcttgttgggtcacactggagagatctggggcatgcttatgtgaacaggaatgaaagatgggagaggttcatggagtctgagcgggaaaagaacaatggagaatggcatggtggcagacatgcatctgacatgaccaaccaacgaatgacagatcaccgtggtggttggcggggtgctggcccccgtggccatccaaggaactttcgaggtccaagaatgagaaatgagtttgctgatgaacctattggtggcaggagacgctcatttgaagatgaacctgggcatttgaaccgggttccacataggcggcggcgttcaccaccacccgactccctcatgagagaggtggacattgacggcttccatgggagagagattccagaccataggctgctggctcatgggcagatagaagatctcccagatgacatgatggaagataggttttttatgccacgttcccatcgacaccgtggccaaggtgaccatggattcatccagagagataggagccactcccctgcacaaagaaggggtggccatgtgcatttccaccgtggacgatcaccggaagcaatgcccagatcaccgccattaatgcgaaatgagagaccatacttgtcccactgccgtcacagtcgaggccatgatgagagaggaggcatgcagagaaacgcaaggagacgaggcatggaaggggatgcctttgagccactactgcatcctgctgatctagctgaactccacgcagaagaggaactcactggtagaaggaagtatacagagaggagaacatatcttcggtcttcggtcagtgatgaagacgagatgctctcctaccatacagaggatgacatggaatttgctgaagccggtgggggtccacgggagcatgatagccgcttcagaaataggatggcccacgatagagcgaggggagagcaagaggatgggtacaggcaccgtgcccatcaaggttggcgagatggtgactcaaatgatggtaggccgaaaaggaggaggtactgactcacagcaataaccgactgatgcagaagacattggcctttaggaggactgactcccaacactgttttgccggcgtcttctcttccatatattggtttgtttgttgcattcgtttctcaggaaaacatggtgctgtggtgtgatatctacatgcacctgcagcttccaaaacttaccgtctaaatatcagccctggatcctgcttgataagctgggctgctcgtgctcgtggaggtcaagacactgaaatttcaggcaagttaaaagtgaacgaggacaagcctccggcatgtgctattctcgcctggctggaatcgagcaaggagacgaacctctgggcaaaagctacactatacttttacaagcatggtgctggtacggctcttgtattgaagacattatctctatgatttggttggagttggtggggagaagctgccgtgggaccgtacccttgtggtctggtctccgtcgttgcagtctttggttggcctcgctcgctggaccttgctattcaatggttgtacttgcacaactgccgggcattatgcgccgaataaaaatttgtgtgtttttggcacccatccacagtggtgccgtggaaaaggtgcgcgaggaccgtgactttgctggaactccacatgatttgtggaggtatcgggcgtggaacttgaaggagcggcgtagcagccgctgctgccgtgctcttgcggatcgatgtgtatcattggtgcttgacttggttgacgagctttggttggtctgtccgtgctggcgaccgccggggttgacgtgatccggatgcacgagctagcgtatgagaatcgattggtttgtcgctcggcgaatcgtcgctttgaccggcgttgggctgagacgggcgagtcgccgtgtcgtcgtctgcgaagtcacgcgcgtgctcggttttctcgagagcttctggtcccacggtggctatcgtgcgcccgcgcgaattcatggcggactaggtgcgcgagatgccgtggagagcggcggggcgacggcatgggattggattgagaagcggccacagcggtcccagtatatgtgggcctgacgatgatgctccggctgataagcctccatgaactgagcgattcagcaacaaattcgaggccaaaacttgaagaatcagcattcaacaaggcctctagctgtgacggtccggggggcaaatctcaagtgcaaattgcaaagcaaagacgacgatggaggaatggcgaaatcaaacagctgggctcttaccaagaagcccaacctcagaatgactaaagtccaagcaaacacatgcctctcggattgcctcacaatcagtcaatcactttgcataaggtggcggatgtaaagtgttaaacgactgtcaaagattaattaagccttttctttactcagattgttaaaaatttcacaattatcgcaactcacaatatatattttccggcatgacacatcgagaggtaaaattacaagaaaggatgcaccctaccagaacaaaaaaatccccgataagagctcattcatttcgccggcggccccggccacgtgctgatccgctccttctcgtacttgacgaacagcgcggcggccgcggcgacggtgtacgcctgcaggaacagcgtggccggctggtggtacttcaccagggcctgcccggagcccagctccacgagcagcaccgcggcgagccccagcgccgcgagcgcgccgttgagccgctcgctgtaggcggtgaagccgaactccacgggcgcgccgagcgccgaccggggctcccgcagcggcacgggcggcagcgtcacggcgttcgcgggcgcggacgccccagccttcttcttgcgcgcgccgcgcttcttgggcccgacgcgggacttgatccgcaggacgcgctcctcgaagtcgtcgtccgcggtggccgtcttggtggtggccgggccctcctggtcggccactgcttccgcggtgtcctcgccggaggaggccgcgcggggagggaacggcagtagcagcgcgcgatgccggagcggggagcggaggatggtggtgggggcgaaggggctggagagcggcgtcgccatggctcctcccctggccgcgtgcacgcaccagcacttcatggcgcgagcggcgggctgcaggcttgcagcttgcgtctcgtcgaagctttggcttggcttgcctctggttttggatagggtcttggttggtaggcgagtggctccggtggctgcacggtgcgttgaaaactgc

SEQ ID NO: 3121 - DNA, 627 bp, Setaria italica
cccgccgctcgcgccatgaagtgctggtgcgtgcacgcggccaggggaggagccatggcgacgccgctctccagccccttcgcccccaccaccatcctccgctccccgctccggcatcgcgcgctgctactgccgttccctccccgcgcggcctcctccggcgaggacaccgcggaagcagtggccgaccaggagggcccggccaccaccaagacggccaccgcggacgacgacttcgaggagcgcgtcctgcggatcaagtcccgcgtcgggcccaagaagcgcggcgcgcgcaagaagaaggctggggcgtccgcgcccgcgaacgccgtgacgctgccgcccgtgccgctgcgggagccccggtcggcgctcggcgcgcccgtggagttcggcttcaccgcctacagcgagcggctcaacggcgcgctcgcggcgctggggctcgccgcggtgctgctcgtggagctgggctccgggcaggccctggtgaagtaccaccagccggccacgctgttcctgcaggcgtacaccgtcgccgcggccgccgcgctgttcgtcaagtacgagaaggagcggatcagcacgtggccggggccgccggcgaaatgaatgagctcttatcgg

SEQ ID NO: 3122 - DNA, 3566 bp, Sorghum bicolor
ttgacgcctaacttgttctgttctgtgactgccaaccgggcccacacctcgtcaccgcgtccgtgcggcgccgcgaaggagccagtgagccacttttcatgggcgactcgcaaaattcccattttctcgactcggcgaggtcgtcgtcgtgaccaggaaattccatttcattgtcaacggagctgctggcatctgccgtacggcggaaatgatccttcctgtccagtatctactgccgggtgccagttcatcaatcaatcatcagccgtccacgaacccgcgggcgcaacttctcggcacgtacggctcggccttgcgcgagcgcgcggaggagtggcgccgcacgcaaggtgtttgacagattgcctcttccagatcatccccaccgtgccgccttagacacagtcactggcatgcccttgttgaatgaagcccggcgccgcttggcggcaaccgttgcttccgcctctgattcctcgttcgcctgcttgccacacgctcatcaccttcctcgatggctgatgaagccatcagcgcagcgtgctcgtgcctggagcccctgttcggatgtctgctccaggcagcgggccgggaggtggccgcgttccttcgcatcaagtcgaattggggcgacctcgaaagggctcgggacagcctgcgagccgtcgagacgacggtcagggcggcagtcgccgcggaggaggacaagctgaacgtctgtgaccctgaggtggaggtgtggttcaagcgcgtcgacgagcttcgcccggacaccatcgatgaggattacagcagtttgttagggttctcttgcctctgccagtgcaccgtgcacgctcgtcgccgcgcctcgatcggcaagcgtgttgtggaggcgctggaggaggtgaaagaactgaccgagcaagggaggaagttcaggacatttgggctcaagccaccgccgagggccgtcagtcggttatcccaaaccgagaccgttgggttggagcccatgttggctcggctccatgatttgcttgagaagggcgagtcaaacataattggtgtgtggggtcaaggaggcatcggcaagacgactctcctacacgccttcaacaatgatcttgaaaagaaagatcacaactatcaggttgttatctttattgaagtatccaattcagagaccctgaacacagtggagatgcagcagactatctctgataggcttaatttgccatggaatgaattagagacagttgagaaacgggccagattcctggctaaggcactggccaggaaaagatttctattgctacttgatgacgtaaggaagagattccgactggaggatgtcggtatcccaactccagacacaaagagccaaagcaagctgatcctgacatcacgtttccaagaagtatgcttccagatgggtgcacagaggagtcgcattgaaatgaaagttttggatgatgatgctgcctggaacctgttcttgagcaagctgagcaatgagacttttgaagcagttgagtcaccgaatttcaacaaggttgttcgggaccaagccaggaaaatattcttcagttgtggaggtctgccacttgcactcaatgtcattgggactgctgtggcagggttgcaaggaccaaaagaatggatttcagccgctaatgacatcaatgtgttgaacaatgaagatgtggatgaaatgttttatcggctgaaatacagctatgacaggctgaaacccactcaacaacagtgctttttgtactgcacccttttcccagaatatggatctattagtaaggaaccacttgttaattattggctggctgaaggtttactaaatgatcgtcaaaagggtgatcagataattcagagccttatttcagcaagcttgttgcagaccagtagctcattgtcatcaaaggtaaaaatgcaccatgtaatcaggcatatggggatttggttggttaacaagacaggtcaaaagtttctcgttcaagcagggatggctttggatagtgctccaccagcagaagagtggaaggaagctacaaggatctccatcatgtctaatgatatcaaagagcttcttttctcaccggaatgtgaaatcctcactacattattgatccagaataacccaaatttgaacaagctgagttcaggttttttcaagtttatgccgtccttgaaagtgctggatctttctcacactgcaataacatcacttccagaatgcgagacattggttgcattacagcatctcaacttgtcacacacacgtattaggatattacctgagcggctgtggttattgaaagagttgaggcatctggatctcagtgtgactgctgaactcgaagataccttgaataactgctcaaagttgctcaagttgagggtgcttaatctctttcgcagtcactatggtattagtgatgtcaacgacctgaatctggattccctgaacgcactaattttccttggaatcactatttatgcagaggacgtgttaaagaaactgaacaagactagtcctttggcaaagtcaacatatcgtctgaatctcaagtactgtagaaaaatgcattcgctcaaaatctctgatctcaaccacttggtgcacctcgaggagctgtatgtcgagtcgtgctataatctaagcacgctggttgctgatgctgatgctgagctgacaacttcaggcctggaggtcctgaccctctcagttcttcctgtgctggagaacgtcattgttgcaccaatgccccaccattttcggcgcatccgcaaattagccatttcgagttgcccgaagctgaagaacatcacatgggtcctcaaactcgaaatgctcgagaggcttgtcataaccagttgtgatgggttgctgaaggttgttgaagaagatagcggtgatgaggcagagacaaaaacagaaggacagggaggtaagtggattggtgatggtcaaagtgcgtgcaatagcggtgacaacgcgcatgcagagttcctgaacctgcgatcaatcgagctgactgatgtcaagatgctgagaagtatctgcaagccaagaaattttcccagccttgagaccatccgggtggaggattgcccgaatctgagaagcatcccactgagcagcatctacaattttgggaaactgaaacaggtgtgctgttcagttgaatggtgggagaaactggagtgggaggacaaggagggcaaagagagcaagttcttcattccaatctgacagcaaccctgttctccagcggttgctgcgtcatcagcacaatactggcacgaataacccaatcgcaataatctgtatatgcgatgagttgtttgtacatgtaggcaatctgtatgagtgtatatattgctggggttcacaaatctgtacatgttttatttgattgattgattgattcattcattgttgtaaatgctataaataaaactccatttattaacttgcatataaaaaatagtcctgtaatactcggtagcatcaacggattgattgttttcctcaaaaagaaaatcaacggattgatgctcatcgaacg

SEQ ID NO: 3123 - DNA, 5879 bp, Sorghum bicolor
cagattcctcgttcgcctgcttgccacacgctcatcaccttcctcgatggctgatgaagccatcagcgcagcgtgctcgtgcctggagcccctgttcggatgtctgctccaggcagcgggccgggaggtggccgcgttccttcgcatcaagtcgaattggggcgacctcgaaagggctcgggacagcctgcgagccgtcgagacgacggtcagggcggcagtcgccgcggaggaggacaagctgaacgtctgtgaccctgaggtggaggtgtggttcaagcgcgtcgacgagcttcgcccggacaccatcgatgaggattacagcagtttgttagggttctcttgcctctgccagtgcaccgtgcacgctcgtcgccgcgcctcgatcggcaagcgtgttgtggaggcgctggaggaggtgaaagaactgaccgagcaagggaggaagttcaggacatttgggctcaagccaccgccgagggccgtcagtcggttatcccaaaccgagaccgttgggttggagcccatgttggctcggctccatgatttgcttgagaagggcgagtcaaacataattggtgtgtggggtcaaggaggcatcggcaagacgactctcctacacgccttcaacaatgatcttgaaaagaaagatcacaactatcaggttgttatctttattgaagtatccaattcagagaccctgaacacagtggagatgcagcagactatctctgataggcttaatttgccatggaatgaattagagacagttgagaaacgggccagattcctggctaaggcactggccaggaaaagatttctattgctacttgatgacgtaaggaagagattccgactggaggatgtcggtatcccaactccagacacaaagagccaaagcaagctgatcctgacatcacgtttccaagaagtatgcttccagatgggtgcacagaggagtcgcattgaaatgaaagttttggatgatgatgctgcctggaacctgttcttgagcaagctgagcaatgagacttttgaagcagttgagtcaccgaatttcaacaaggttgttcgggaccaagccaggaaaatattcttcagttgtggaggtctgccacttgcactcaatgtcattgggactgctgtggcagggttgcaaggaccaaaagaatggatttcagccgctaatgacatcaatgtgttgaacaatgaagatgtggatgaaatgttttatcggctgaaatacagctatgacaggctgaaacccactcaacaacagtgctttttgtactgcacccttttcccagaatatggatctattagtaaggaaccacttgttaattattggctggctgaaggtttactaaatgatcgtcaaaagggtgatcagataattcagagccttatttcagcaagcttgttgcagaccagtagctcattgtcatcaaaggtaaaaatgcaccatgtaatcaggcatatggggatttggttggttaacaagacaggtcaaaagtttctcgttcaagcagggatggctttggatagtgctccaccagcagaagagtggaaggaagctacaaggatctccatcatgtctaatgatatcaaagagcttcttttctcaccggaatgtgaaatcctcactacattattgatccagaataacccaaatttgaacaagctgagttcaggttttttcaagtttatgccgtccttgaaagtgctggatctttctcacactgcaataacatcacttccagaatgcgagacattggttgcattacagcatctcaacttgtcacacacacgtattaggatattacctgagcggctgtggttattgaaagagttgaggcatctggatctcagtgtgactgctgaactcgaagataccttgaataactgctcaaagttgctcaagttgagggtgcttaatctctttcgcagtcactatggtattagtgatgtcaacgacctgaatctggattccctgaacgcactaattttccttggaatcactatttatgcagaggacgtgttaaagaaactgaacaagactagtcctttggcaaagtcaacatatcgtctgaatctcaagtactgtagaaaaatgcattcgctcaaaatctctgatctcaaccacttggtgcacctcgaggagctgtatgtcgagtcgtgctataatctaagcacgctggttgctgatgctgatgctgagctgacaacttcaggcctggaggtcctgaccctctcagttcttcctgtgctggagaacgtcattgttgcaccaatgccccaccattttcggcgcatccgcaaattagccatttcgagttgcccgaagctgaagaacatcacatgggtcctcaaactcgaaatgctcgagaggcttgtcataaccagttgtgatgggttgctgaaggttgttgaagaagatagcggtgatgaggcagagacaaaaacagaaggacagggaggtaagtggattggtgatggtcaaagtgcgtgcaatagcggtgacaacgcgcatgcagagttcctgaacctgcgatcaatcgagctgactgatgtcaagatgctgagaagtatctgcaagccaagaaattttcccagccttgagaccatccgggtggaggattgcccgaatctgagaagcatcccactgagcagcatctacaattttgggaaactgaaacaggtgtgctgttcagttgaatggtgggagaaactggagtgggaggacaaggagggcaaagagagcaatgccgccacgcccaccacccgttcgacgcgactcctcaccgaacccatcaggcgcgggcatgcggggtccttcacgcgcgggtcctgcgcctcggcctgcccctccggggccgtctcggcgacgcgctcgtcgacctgtacggcaggtccggccgcgtgggctacgcctggcgcgcgctgggctgctgcaccggggctccagcgtcaggcgctgcggcgagctcggtgctgtcctgccacgcgcggtcggggtcccctcgggacgttctcgatgcgttccagcgtctcaggtgttccattggcggcacgccagaccagtttggccttgcggtggttctgtccgcatgttcgcggctgggtgctctcgagcagggcaggcaggtgcattgtgatgtgctgaagagcgggttctgctccagtgccttctgtcaggctgggctggtggacatgtatgccaagtgcgttgaggtcaaggatgcgaggagggtgtttgatgggattgcttgccctgacacaatatgctgggcaagcatgattgcgggctaccatcgggttggacgctaccagcaagcactggctttgttttctaggatggagaagatgggctctgctccagaccaggtaacatacgttaccatcatttccactcttgcaagcatgggcagactgtctgacgcaagaactctgctgaagaggatacaaatgccaagcacggttgcttggaacgctgtcatctcaagttattcacaaagtggtcttgagagtgaagtgtttggcctgtacaaggatatgaagagacagggattgatgccaactaggtccacttttgcgagcatgctaagtgcagcagccagcatgacagcatttgatgaaggtcaacagatacatgcagcggcagtaaagcatggcttagatgcaaatgtttttgtgggcagttcactgatcaacctgtatgtgaaacatggctgcatctctgatgcaaagaaggtgtttgacttctccactgaaaagaacattgtcatgtggaatgcaatgctttatgggtttgttcaaaatgatctccaagaagagaccattcagatgtttcagtatatgaggagggctgatcttgaggctgatgattttacatttgtgagtgtccttggcgcgtgcattaacttggattcacttgatataggtaggcaggtacactgtataacaatcaagaacagcatggatgcagacttgtttgttgctaatgcaatgctagatatgtactcaaaacttggagcaattgatgtcgcgaaagcattattcagtctcattccaggcaaggatagtgtatcctggaatgctcttatagttgggcttgcacataatgaagaggaggaagaagcggtctatatgcttaaaaggatgaagtgctatggtatagctccagatgaggtgtcttttgcaactgcaattaatgcctgttccaacatccgggctactgagactggaaagcaaattcattgcgcatctatcaagtataatgtctgctcaaatcatgctgttggcagctctctgattgacctgtattcaaagtttggagatgtagaatcttctaggaaggttttagcacatgtagatgcaagcagcatggttccaataaatgctctaattacaggtcttgtgcagaacaatagagaagatgaagccatagagttatttcagcaagtgctaaaagatgggttcaagccgtctaactttacatttgcaagcattctttctgggtgtactggacctgtcagttcagtaattggcaaacaagtccatagctacacgctgaaatctgctcttttgaatcaggatacttcacttggcatctctcttgttggaatatatttgaagtgcaagttgcttgaggatgcaaacaaactcttagcagaggtgccagatcacaaaaacctggttgagtggacagctactatttcagggtatgctcaaaatggttacagtgatcaatctttggtgatgttttggagaatgcgcagtcacgatgttcgttcagatgaggccacattcgctagtgttctgaaagcttgttctgagatagcagcacttacagatggaaaagagatacatgggctcattatcaaatctggttttgtttcttatgaaactgcagccagtgccctcatggacatgtactccaagtgtggcgatgttatttcttcctttgaaatcttcaaggaattgaaaaacaagcaaaatataatgccatggaactccatgattgttggttttgcgaaaaatggttatgcaaacgaggcacttcttctcttccagaagatgcaagaatcacaactaaagcctgatgaagtcacactccttggtgttctcattgcttgtagccatgctggtttaatttccgaaggccggaatttgtttgactctatgagccaagtttatgggatagtgcccagagtagatcactatgcatgtctcattgatctacttgggcgtggtggtcatcttcaagaagctcaagaagttattgaccagttacccttcagagctgatggtgtaatctgggctacattccttgcagcatgtcaaatgcacaaggatgaagaaagagggaaagttgcagcaaagaaacttgttgagatggaaccacaaaggtcgtccacgtatgtgttcctttcaagcttgcatgctgcggctggtaattgggttgaagctaaggtagccagagaagctatgcgagaaaaaggggtgatgaaatttccagggtgtagttggatcacagtgggtaacaaaacaaacttatttgttgtacaggacacacatcatccggacactctgggcatctacaaaatgcttgatgatctaactggaatgatgaataaagatgacagaattgaggaatatgatctgcgtagcttgtctgaaatgcttacttgagggatagtgaccatgtttaaataatatatcacgctaaaggattaagggcctagattgatcttctaactcgtcatggaccttaagtagatgtctggttgtttaggtgaggaatttggtacccttgcatagtatatgtaatacattcacttatataaattaaggatttaggctttgatcacttaatgttt

SEQ ID NO: 3124 - DNA, 1365 bp, Sorghum bicolor
gaggccttgagctggggtagctacgacacatacctatccctcccagtccgcagcaccaccacacccactggtgcgccgcggtttgtggtcttgtggacacactggcctccacccatctctctcaccacgtctcgccatcggcagcaaaggccacagtacagattcggcccatcgatttatagccacaccatggccaggaagtgctcccactgtggcaactacggccacaactccaggacctgcggcttaggacacagcagagaagtcatgctctgcgaagccggcgacaatggcggcggccacggcggcagcggcctaaggctcttcggagtgcaggtccgtataggtggcggtggtgcaggctcgtcggcgtccatgaagaagagctacagcatggactgcctgcagctcgcggcggctcaagctggctgctccctcgtctcgccgtcgtcgtcgtcctcgtcgtcgctgctgctgtcgattgaagagggcctggagaggggggcggccgccaatgggtacctgtctgatggacctcatggcagagttgtgcaggagaggaagaaaggagttccatggagcgaggaggagcacaggcagttccttgccggcctggagcagctgggcaagggcgactggcgaggcatctcgaggaactacgtgacgacgaggacgcccacgcaggtcgccagccatgcgcagaaattcttcctcaggcagagcagcatggggaagaagaagcgccgctccagcctctttgacatggtgccgatttgcgagaacagcgcgagcatttccgatccggtgagcagcgaagaaggggcaggctcgacctctctgtcgctgaacgtggcatgccattgccatggcgccgcctccgactccgagagggcagccttggacctgaattcgacggaggaaggcggcgacagcagggcggcaccaggtgcagggacgaccaggccgttcccggcaccggtggcggtagctcagacggagctgctgctgcatcagccttcgtcgtcgtcgcatggccaagggcgcggccaccactgctctccgttggacctggagctgggcatgtccctgcctgccccatccatcggaacatgacgcgtcgtcgtcctagtcatcgccatggagtgactcccacgcaggtcgcgccaaaattcgtcagctcaagttgccaaggtcgaggccggccgccggccgcgcgtgcctgctgtctcgctcagctgtgtctgccagatggaggggcaatacagtattgttggtgaaaacgttgtgcaaatagcactgaactaactgtggatatcgtaccacgtgtactatgctgctatatatatatatgggccttgtttagtt

SEQ ID NO: 3125 - DNA, 1702 bp, Sorghum bicolor
aatcaagttaccactaaagtccaagctacacgatctagaagtagacagcaagtaatatcactttttgtgtggtttgctaaccaatagcatgtccacatccacagccaagcatctatcgcacagagaagcatatttatagtgggctctccgtaagtttctttgcctgccctgaggccttgagctggggtagctacgacacatacctatccctcccagtccgcagcaccaccacacccactggtgcgccgcggtttgtggtcttgtggacacactggcctccacccatctctctcaccacgtctcgccatcggcagcaaaggccacagtacagattcggcccatcgatttatagccacaccatggccaggaagtgctcccactgtggcaactacggccacaactccaggacctgcggcttaggacacagcagagaagtcatgctctgcgaagccggcgacaatggcggcggccacggcggcagcggcctaaggctcttcggagtgcaggtccgtataggtggcggtggtgcaggctcgtcggcgtccatgaagaagagctacagcatggactgcctgcagctcgcggcggctcaagctggctgctccctcgtctcgccgtcgtcgtcgtcctcgtcgtcgctgctgctgtcgattgaagagggcctggagaggggggcggccgccaatgggtacctgtctgatggacctcatggcagagttgtgcaggagaggaagaaaggagttccatggagcgaggaggagcacaggcagttccttgccggcctggagcagctgggcaagggcgactggcgaggcatctcgaggaactacgtgacgacgaggacgcccacgcaggtcgccagccatgcgcagaaattcttcctcaggcagagcagcatggggaagaagaagcgccgctccagcctctttgacatggtgccgatttgcgagaacagcgcgagcatttccgatccggtgagcagcgaagaaggggcaggctcgacctctctgtcgctgaacgtggcatgccattgccatggcgccgcctccgactccgagagggcagccttggacctgaattcgacggaggaaggcggcgacagcagggcggcaccaggtgcagggacgaccaggccgttcccggcaccggtggcggtagctcagacggagctgctgctgcatcagccttcgtcgtcgtcgcatggccaagggcgcggccaccactgctctccgttggacctggagctgggcatgtccctgcctgccccatccatcggaacatgacgcgtcgtcgtcctagtcatcgccatggagtgactcccacgcaggtcgcgccaaaattcgtcagctcaagttgccaaggtcgaggccggccgccggccgcgcgtgcctgctgtctcgctcagctgtgtctgccagatggaggggcaatacagtattgttggtgaaaacgttgtgcaaatagcactgaactaactgtggatatcgtaccacgtgtactatgctgctatatatatatatgggccttgtttagttcccaaaaaattttacaaaatttttcagctccgtcacaccgaatctttagacgtatgcatagagtattaaatatagacgaaaataaaaactaatcgcacagtttggtcgaaattgacgagacaaatcttttgactctagttagtccataattggacaatatttatcaa

SEQ ID NO: 3126 - DNA, 1141 bp, Saccharum officinarum
acggccacaactccaggacctgcggctttggacacagagaaatcatgctctgcgaagccggcgacaatggcggcggcagcggcctaaggctcttcggagtgcaggtccgtatcggcggcggtggtggtgcaggctcatcggcgtccatgaagaagagctacagcatggactgcctgcagctcgcggctccagctggctgttccctcgtctcgccgtcgtcgtcgtcctcgtcgtcgctgctgctgtcgattgaagagggcctggagagggggacggccaatgggtacctgtctgacggacctcatgggagagttgtgcaggagaggaagaaaggagttccatggagtgaggaggagcacaggcagttcctcgccggcctggagaagctgggcaagggcgactggcgaggcatctccaggaactatgtgacgacgaggaccccgacgcaggtcgccagccatgcgcagaaattcttcctcaggcagagcagcatggggaagaagaagcgccggtccagcctctttgacatggtgccgatttgcgagaacagtgcgagcatttccgatccgttgaacagtgaaggggcctcgacctctctgtcgctgaacgtggcacgccatggcgccgcctccgactccgagagggcggccttggacctgaattcgacggagcaagacgacagcagcagggccgacgcgtcgtcggcatcaggtgcagggagtagacagttcccggcagcggcagctcaaacggagctgctgcaaccttcgtcgcatggccatgggcgcggtcaccactgctccccgggggaactggagctgggcatgtccctgcccaccccatccgtcggaacatgacgcgccgccgctgccgtcgtcgtcctagtcatcgccatggactcccacgcaggtcgcgccaaaattcgtcatcgtcaacgcaagttgccaaggcagaggccgtgcgtgcctgctgtctcgctcagctgtgtctgccagatggaggagatgaggcgctaggcaatacagtactgttcgtgaaaaggttgtgcaaatagcactgaactaactgggatatcgtaccacgtgtactgtgctgctatatatctttagctccagaatcggttctgctcctcggctcctgt

SEQ ID NO: 3127 - DNA, 2641 bp, Sorghum bicolor
tccgcccaattatgttccccaaaccgcacgcgcgcgcgcgactccccccggccgctgtcatcgtcgtcgtcgtgttcggggaggagatccgccgggctcgcccatttccctcctccaagctctcctcccccgctcccgcggccagctgctgccactccgcgcgcgccctcgccaaaccctagcttggccgccgcccccgcactgccccggcgccccaccgagcgcgtgcgccgcccgggccagcggcgccgaccgccaccattgccgtacggaggcgtcccgccacgttggaatgcgctgtttgaagtgtgatcattgaggttgtcattgaagaagtgtctagaatcgattggctgcccttcccataatggacaagatacaatctgattgcccttatcctggatgtttcttttgtgtcatgaaggaggcaaacccaagtaaacgaagagcaagtgtgctaaagttctttagggaacttccttcccaagatgatgatggtcaagttctccctattagtggtctctggaacacagcaatggctcacccaaatgatcccgagttcatcaacttgggcatatttgaatgcatggcagctcttatatggaaagggttgaaaaacaggcgttggcttgcacatgatcaaaatatttacatcccatattatgcagctcacataattggatcatacacaatgaatatggaggagtttgcagagcgtgctgttcgtgctggtgtaatacctccattagtcgaactgttaagaggtaggctgacgtgggttgagcaaagagttgccgttagagctttggggcatttggctacatatcctagtacatttcctgcagttgctgatcatggggaagtacttgaacttgccattcaacttgcttcgagctccctagagattgtgtactctcacttttaccaatttgtggatcgaaggcttggctaccattgcgaccttcttactcgtggcatgggtggtgtggaaatggaatcccgcaaagctgaggaatgggcaagtcaactgcagtgctggtctttgcaactcattaactgctttgcatttaagcctgaattcctccatgatatttgtaagcccgattttctagttaagttacctggaatgtggggtggacttgtaaatgagaactcgcctgctggtgttggtttgctaagaacaatctgccagagcaaagttggccgaggtcatgttgctaacattcctggtactattgatgctttatgtaacattgctcgttcttcagatgactggcaatacatggcagttgattgtctgatctggttagtgcaggatgcaagtacctgtcagaaggttatagataaagttgcgccaacactgatagacttagcagatatttcgacactgggtgattataaaaaacttggtgacacaattgtcacagtcctccaagaatgtatgcaacagagtgggaactcacgcggtgcaatcagtgctcaaaccaaagcagaaattgatgagcttttgagatccaagcaaagtttgaaattggaaaagagtatgccaaaggaggatcttcatataaaacaagctgcagcattggtagtcaagttggaaggcaattcgctgttctcttcagggaacattgcaggtgctgcagagaaatactctgaagcacttgcactatgtccaatgaagtctaagaaagagcgggtggttctatacagcaatcgagctcaatgttaccttctcctgcagcagccattggctgccataagcgatgctactcgagcattgtgccttcatagccctgtgaatcgtcatgccaagagtttgtggagaagagctcaagcatacgatatgcttggttttgcaaaagagagcttgttggatgcaatccttttcataaacgagtgctctcagtcaaacgatcctgacttatccctgaagcaaaacaaagttcctgattatgctgagcgattggtgaagaagcagatgcgtgccgcttggctattcagggaagcagctctgaagcatggtggtgtccattgtgaaggagatgcgagcgatgcgtttggtcaagaggctgatgactctgagtgggaaacagctagcgaaagtgatgctgaaaatgatgccacaggagaagcagatgatgaaactgaatggaagaatgatggccaccaggaagatttctgtgagaaaagctgaggaacagggcgagctggatttgtattcagagggagtcaaactgagcaggtacagaagcagcttctggacgttctgcaatctgcaccacgaagcatcaaatctttctaatggaacgatctggtgacatttttattgtcattattaccaaagcaaggcccaattaaattaatttcccacgtcttcttgctgggtcagttgagttgtgcctgtgaccattcagtatttcctcgtagatgttggtccttgtttggtgtttgtaacatgtttttcaccagtttgtcaactctttgaatcaagaaaactgtgcattgtttgttttcttttcttttttttttatcctgaagtttggtgaagacgccataattctggctttcttccctttccactggacctatctggaatgtgaaggccacgtttcctttcttcagagtgtgcttggttttttgg

SEQ ID NO: 3128 - DNA, 3001 bp, Sorghum bicolor
gacggatcgacctcgactcgacccctcccccggcgccgctccatcgtggccgtcgacgcgcgagacggggacctgggagtgggaccggcgagtccgtccgtcgccatcatcgcgcactcccgtcgcgcccacgcccctccgcccaattatgttccccaaaccgcacgcgcgcgcgcgactccccccggccgctgtcatcgtcgtcgtcgtgttcggggaggagatccgccgggctcgcccatttccctcctccaagctctcctcccccgctcccgcggccagctgctgccactccgcgcgcgccctcgccaaaccctagcttggccgccgccgccgccgcccccgcccccgcactgccccggcgccccaccgagcgcgtgcgccgcccgggccagcggcgccgaccgccaccattgccgtacggaggcgtcccgccacgttggaatgcgctgtttgaagtgtgatcattgaggttgtcattgaagaagtgtctagaatcgattggctgcccttcccataatggacaagatacaatctgattgcccttatcctggatgtttcttttgtgtcatgaaggaggcaaacccaagtaaacgaagagcaagtgtgctaaagttctttagggaacttccttcccaagatgatgatggtcaagttctccctattagtggtctctggaacacagcaatggctcacccaaatgatcccgagttcatcaacttgggcatatttgaatgcatggcagctcttatatggaaagggttgaaaaacaggcgttggcttgcacatgatcaaaatatttacatcccatattatgcagctcacataattggatcatacacaatgaatatggaggagtttgcagagcgtgctgttcgtgctggtgtaatacctccattagtcgaactgttaagaggtaggctgacgtgggttgagcaaagagttgccgttagagctttggggcatttggctacatatcctagtacatttcctgcagttgctgatcatggggaagtacttgaacttgccattcaacttgcttcgagctccctagagattgtgtactctcacttttaccaatttgtggatcgaaggcttggctaccattgcgaccttcttactcgtggcatgggtggtgtggaaatggaatcccgcaaagctgaggaatgggcaagtcaactgcagtgctggtctttgcaactcattaactgctttgcatttaagcctgaattcctccatgatatttgtaagcccgattttctagttaagttacctggaatgtggggtggacttgtaaatgagaactcgcctgctggtgttggtttgctaagaacaatctgccagagcaaagttggccgaggtcatgttgctaacattcctggtactattgatgctttatgtaacattgctcgttcttcagatgactggcaatacatggcagttgattgtctgatctggttagtgcaggatgcaagtacctgtcagaaggttatagataaagttgcgccaacactgatagacttagcagatatttcgacactgggtgattataaaaaacttggtgacacaattgtcacagtcctccaagaatgtatgcaacagagtgggaactcacgcggtgcaatcagtgctcaaaccaaagcagaaattgatgagcttttgagatccaagcaaagtttgaaattggaaaagagtatgccaaaggaggatcttcatataaaacaagctgcagcattggtagtcaagttggaaggcaattcgctgttctcttcagggaacattgcaggtgctgcagagaaatactctgaagcacttgcactatgtccaatgaagtctaagaaagagcgggtggttctatacagcaatcgagctcaatgttaccttctcctgcagcagccattggctgccataagcgatgctactcgagcattgtgccttcatagccctgtgaatcgtcatgccaagagtttgtggagaagagctcaagcatacgatatgcttggttttgcaaaagagagcttgttggatgcaatccttttcataaacgagtgctctcagtcaaacgatcctgacttatccctgaagcaaaacaaagttcctgattatgctgagcgattggtgaagaagcagatgcgtgccgcttggctattcagggaagcagctctgaagcatggtggtgtccattgtgaaggagatgcgagcgatgcgtttggtcaagaggctgatgactctgagtgggaaacagctagcgaaagtgatgctgaaaatgatgccacaggagaagcagatgatgaaactgaatggaagaatgatggccaccaggaagatttctgtgagaaaagctgaggaacagggcgagctggatttgtattcagagggagtcaaactgagcaggtacagaagcagcttctggacgttctgcaatctgcaccacgaagcatcaaatctttctaatggaacgatctggtgacatttttattgtcattattaccaaagcaaggcccaattaaattaatttcccacgtcttcttgctgggtcagttgagttgtgcctgtgaccattcagtatttcctcgtagatgttggtccttgtttggtgtttgtaacatgtttttcaccagtttgtcaactctttgaatcaagaaaactgtgcattgtttgttttcttttcttttttttttatcctgaagtttggtgaagacgccataattctggctttcttccctttccactggacctatctggaatgtgaaggccacgtttcctttcttcagagtgtgcttggttttttggtataccatgtcaatcgttatgtgatggaacaactaacaagtagaggtcgttagcttgggtcttggcacttgctctgctagtgcctgcctgaggctttttgagggtgttgttgagggcaaaatgccaacaagtgtgtgtcagtgtgtgcgagtgcgtgcgtgtatgttgtcattgacattgtgtgtttacgttctgtgctttacagtaa

SEQ ID NO: 3129 - DNA, 2759 bp, Zea mays
ccaccatcggccatcgcgccctccccaaatcgcctcgtccgcccaattatgctcctcaaaccgcacgcgcgcgcgcgactcaccgccgttgtcgtcgtcgtgttcgcggagatccgcggggctcgcccatccccctcctccctgctctcctccccagcacccacggcccgctgctgcccctccgcgcgccccctcgccaaaccctagcttggccatctccccccactgccccggcgccaccacctgccctgccctgcgcgtggccggcggcgccgaccgccgccattgtcttacggaggcgtccgagtcccgacgcgttggaatgcgctgactgaagtgtgatcattgaggttctggttaaagaaacttctagtatcgattggcttccctcccatggacaagatacaatctgattgcccttatcctggatgtttcttttgtgtcatgaaggaggcgaaccctagtaaacgaagagcaagtgtgttaaagtactttagggaacttccttcccaagacgatgatggtcaagttctccctattagtggtctctggaacacagcaatggctcacccaaatgatcccgagttcatcaacttgggcatatttgaatgcatggcatctcttatatggaaagggttgaaaaacaggcgttggcttgcacatgatcagaatatttacatcccatattatgcagctcacataattggatcatacacaatgaatatggaggagtttgcagagcgtgctgttcgtgctggtgtaatacctccattagttgaattattaagaggtaggttgacatgggtcgagcaaagagttgctgttagagctttgggtcatttggctacatatcctagtacatttcctgcagttgccgatcatggggaagtacttgaacttgccattcaacttgcttcgagctcgctagaaattgtgtactctcacttttaccagtttgtggatcgaagacttggctaccattgcgaccttcttactcgtggcatgggtggtgtggaaatggagtcccgcaaagctgaggaatgggcaagtcaactgcagtgctggtctttgcaactcattaactgctttgcatttaagcctgaattcctccatgatatttgcaagcctgattttctagtcaagttacctggaatgtggggtggacttgtaaatgagaactcacctgctggtgttggtttgctaagaacaatctgccagagcaaggttggccgaggtcatgttgctaacattcctgctactattgatgctttatgcaacattgctcgttcttcagatgactggcaatacatggcagttgattgtctgatctggttaatgcaggatgcaagtacttgtcataaggttaaagatatagttgcgccaacactgatagatttatcagatatttcggcactgggtgattataaaaagcttggtgacacaattgtcacagtcctccaagaatgtatgcaacagagtgggaactcacgtggtgcaattggtgttcagaccaaatcagaaattgatgagcttttgagatccaagcaaagtctgaaattggaaaagagtatgccaaaggaggatcttcatataaaacaagctgcggcattggttgtcaagttggaaggcaattcactgttctcctcagggaacatcgcaggagctgcagagaaatactctgaagcgcttgcgttatgtccgatgaaatccaagaaagagcgggtggttctctacagcaatcgagctcagtgttaccttctcttgcagcagccattggctgccataagcgatgctactcgagcattgtgccttcacagccccgtgaaccgtcatgccaagagtttgtggcgaagagctcaagcgtatgatatgcttggtcttgcaaaagagagcttgttggacgcaatccttttcataaacgagtgctctcagtcgaacgatcccgacttatccctgaagcaaaacaaagtccctgactatgccgagcggttggtgaagaagcagatgcgctccgcttggctattcagggaagcagctctgaagcacgggggcgtacactgtgaaggagatgctagcgacgcgtttggccaggatgctgacgactctgagtgggaaacggctagcgaaagcgacgccgagaatgatgacacgggagaagcggatgatggaactgaatggaagaacgatggacaccgggaagatatctgtgagaaaagctgaggagcagggcaagctgaacctattcagagggagtcaaactgagcagtgacagaagcagctgctgggccttatgaagtctgctgcgctatcagcctatcaagcatcagatctttctaatgcagcgatctggtaacatttctactgtcctcgtcaaagcaaagccccagttaaactaattccccacgtcttgttgtttggtcagttgagttattgcgcctgcgaccattcaatgtttccccttagatgttggttctggtttggtgtttgtagcatgctctttctttcaccagtttctcaactctttgaatgaacaaaactgtgcattatttgttcttttttttactattatttctgtagtctggcgaagaggccataatactggcacccttccctttccactggacttatctggaacgagaagagcacgtttccgtctacctgctttttttggctataccatgtcaactagcaagtaggggttgttaggttgggtcatgctcttacaatgaaactggcgtgctgggcacttgctctgctag

SEQ ID NO: 3130 - DNA, 2393 bp, Setaria italica
tttgaagtacggttgttgatgttctgattaaggaagctgataggatcaattggctctcataatggacaagatacaatctgattgcccttatcctggatgtttcttctgtgttatgaaggaggcaaaccctagtaaacgaagagcaagtgtgcttaagttttttagggaacttccttctcaagatgatgatggtcaagttctccctattagcggcctctggaacactgcaatggctcacccaaatgatcctgagttcatcaacttgggcatatttgaatgcatggcagctcttatatggaaagggttgaaaaacaggcgctggcttgcacatgatcagaatatttacatcccatattatgcagctcacataattggatcctatacgatgaatgtggaggaatttgcagaacgtgctgttcgtgccggtgtaatacctccattagttgaacttctaagaggtaggctgacttgggtggagcaacgggttgctgttagagctttggggcatttggctacatatcctagtacatttcccgcggttgctgagcatggagaagtgcttgaacttgccattcaacttgcttcgagctccttagagattgtgtactctcacttttaccaatttgtggatcgaagacttggctatcattgcgatcttcttactcgtggcatgggtggtgtggaaatggaatcccgcaaagctgaggaatgggcaagtcaactgcagtgctggtctttgcaactcattaattgctttgcatttaaacctgaattcctccatgatatttgcaaggctgattttcttaacaagttacctggaatgtggggtggacttgtgaatgaaaactcacctgctggtgttggtttgctaagaacaatatgccagaacaaggttggtcgaggtcatgttgctaacattcctggtaccatcgatgctttatgcaacattgctcgttcttcagatgactggcaatacatggcagttgattgtctgatttggctagtgcaggatgcaaatacttgtcatatggttatagataaagttgcaccaacattgatagatttaacaaatatttcgacacttggtgattataaaaggcttggtgacacaattgtcacagtcctccaagaatgtatgcaacagagtgggaactcacgcagtacaattcgcactcagaccaaatcagaaattgacgagctcttgagatccaagcaaagtttgaaattggaaaagagtatgccgagggaggatcttcatataaaacaagctgcagcattggttgtgaagttggaaggcaattctctgttctcttcagggaatattgcaggagctgcagagaaatactctgaagcacttgcactatgtccaatgaagtctaagaaagagcgggtggtgctttacagcaatcgagctcagtgttaccttctcctgcagcagccattggccgccataagcgatgctactcgagcattgtgccttcatagccctgtgaatcgtcatgccaagagtttgtggagaagagctcaagcgtatgatatgcttggttttgcaaaggagagcttgttggatgcaatccttttcataaacgagtgctctcagtcaaacgatcctgacttatccctgaagcaaaacaaagttcctgattacgctgagcgattggtgaagaagcagatgcgtgccgcttggctattcagggaagcatctctgaagcatgggggtgtccattgtgaaggagatgctagcgatgcgtttggtcaagaggctgatgactctgagtgggaaacagctagtgaaagcgatgctgagaatgatgtcaggggagaaggggacgatgaaactgaatggaagaatgatggtcaccaggaagatttctgtgagaaaagctgagaaacatgtctggactgtttatgtgccaattaatatctttgcgacaagatgtgctggtctttgggaatgaaggaaactgtgcattgttttttcattttcttttttgatttctcaagtttggcaaagaggccataattctggcactcttctcttcccactggacatatctggaatctgaagggaacgatcttcagggtgtacttggtttctcggtataccgtgtcgaaccgttgtgtgatgtaacaagtagatttgtagcttgggtcatgaactcatgatgctgtcatgttgaaattaccgtgctgggtacttcctctgcttgcctggtgaaaccttctaagggtgctgttgggggcaaaaatgccaacgaaatgtgaaaagaaagaggaaatgaaatcgagtgcgtgtatgccgtcattgtgtgtttgttttccgtgcctggcacaagcacatcaatgttttatgtataactagtaaagtgcacgaacatactatgaatattttc

SEQ ID NO: 3131 - DNA, 2304 bp, Pennisetum glaucum
tatcctggatgtttcttctgtgttatgaaggaggcaaaccctagtaaacgaagagcaagcgtgcttaagttctttagggaacttccttctcaagatgacgatggacaagttctccctattagtggcctctggaacactgcaatggctcacccaaatgatcctgagttcatcaacttgggcatatttgaatgcatggcagctcttatatggaaaggattgaaaaacaggcgctggcttgcgcatgatcagaatatttacatcccatattatgcagctcacataattggatcctatacaatgaatatggaggaatttgcagaacgtgctgttcgtgctggtgtaatacctccattagttgaacttctaagaggtaggctgacttgggtggagcaaagggttgctgttagagctttggggcatttggctacgtatcctagtacatttcccgcagttgctgagcatggagaagtgcttgaacttgccattcaacttgcttcgagctccctggagatcgtgtactctcacttctaccaatttgtggatcgaagacttggttaccattgtgatcttcttactcgtggcatgggtggtgtggaaatggaatcccgcaaagctgaggaatgggcaagtcaactgcagtgctggtcgttgcaactcattaattgctttgcatttaaacctgaattcctccatgatatttgcaagactgattttcttaacaagttacctggaatgtggggtgggcttgtgaatgaaaactcacctgctggtgttggtttgctaagaacaatatgccagaacaaggttggtcgaggtcatgttgctaacattcctggtaccattgacgctttatgcaacattgctcgttcttcagatgactggcaatacatggcggttgattgtctgatctggcttgtgcaggatgcaagtacttgtcataaggttatagataaagttgcaccaactttgatagatttagcaaatatttcgacactgggtgattataaaaggcttggtgacacaattgttaccgtcctccaagaatgtatgcagcagagtgggaactcacgcagtacaattagcactcagaccaaagcagaaattgacgagctgttgagatccaagcaaaatttgaaaatggaaaagagtatgccgaaggaggatcttcatataaagcaagctgcagcattggttgtgaagttggaaggcaattctctgttctcttcagggaatattgcaggggctgccgagaaatattctgaagcacttgcactgtgtccaatgaagtctaagaaagagcgggtggtgctttacagcaaccgagctcagtgttaccttctcctgcagcagccattggctgccataagcgatgctactcgagcattgtgccttcatagccctgtgaatcgtcatgccaagagtttgtggagaagagctcaagcgtatgatatgcttggttttgcaaaagagagcttgttggatgcaatccttttcataaacgagtgctctcagtcgaacgatcctgacttatccctgaagcaaaacaaagttcctgattacgccgagcggttggtgaagaagcagatgcgtgccgcttggctgttcagggaagcatctctgaagcatgggggtgtccattgtgaaggagatgctagcgatgcatttggtcaagaggctgatgactctgagtgggaaacagctagcgacagtgatgctgaaaatgatgccaggggagaagatgatgatagagaatggaagaatgatggtcaccaggaagatttctgtgagaaaagctgaggaacatgtccggcctgtttgtgttccgattaatatcttcacgacaagatgtgctggcctttgggaatgaaggaaactgtgcactgtttttctttttcttttttgatttctgaagtttggcaaagaggtcataattatggcactcatctcttcccactggacatatctggaatgcgaagggaacgattccttccttccttcagggtgtagttggtttttcggtacaccagtgtcgaaccgttatgtgatgtaacaagtagatttgtagcttgggtcatgaactcgtggtgctgtcatgttgaaattactgtgctgggtacttcctctgcttgcctggtgatgaagccttttaagggtgctgttggggggcaaaaatgccaacgaaatgtgaaaagaaagaggaaatgtaattgggtgcgtgtgtgctgtcattgtgtatttgttttccgtgcttggcacaagcacatcaaatattttatgtattgattgacatgagcataaattgta

SEQ ID NO: 3132 - DNA, 2983 bp, Setaria italica
gtcccgcactcccgcagcacgcaggcggctggcggccgtcgtcgtcgtcgcctagatctcccctccggcgcgcgtggcgccgtcacacccgtcccgttgccgtccctcccctgccccttccgccaccttccaatcctctccagtctcggcctctgcccttcgcggccgtaggactcgcctcctccctccccattccgtgcccccgccgccccgacgacaccatccgcccagcgccgagcgtgtgcgctgcccgggccagcggcgcccacggccgccactgcctctcggcggcggcccgccgcgttatcatgtgcagtttgaagtatgatcattgaggttgtgggcttgtggctaaagaagctgctaggatcgattggctgtcataatggacaagatacaatctgattgcccttatcctggatgtttcttttgtgttatgaaggaggcaaaccctagtaaacgaaaggcaagtgtgctaaagttctttagggaacttccttcccaagatgacgacggtcaagttctccctattagcggtctctggaatacagcgatggctcatccaaatgatcctgagttcatcaacttgggcatatttgaatgcatggcatctcttatatggaagggattgaaaaacaggcgttggcttgcacatgatcagaatatttacatcccatattatgcagctcacataattggatcatatacaatgaatatggaggaatttgctgagtgtgctgttcgtgctggtgtaatacctccattagtcgaactgttaagaggtaggctgatgtgggtggaacaaagggttgctgttagagctttggggcatttggctacatatcctagcacatttcctgcagttgctgatcatggggaagtacttgaacttgccattcaacttgcttcgagctccctagagattgtgtactctcacttttaccaatttgcggatcaaagacttggttaccattgtgaccttcttactcgtggcatgggtggtgtggaaatggaatcccgcaaagctgaggaatgggcaagtcaggtgctgtgctggtctttgcaactcattaactgctttgcatttaagcctgaattcctccatgatatttgcaaggctgattttctagtcaagttacctggaatgtggggtgggcttgtgaatgagaactcacctgctggtgttggtttgctaagaacaatctgccagagcaaggttggccgaggtcatgttgctaacattcctggtactattgatgctttatgcaatatcgctcgttcttcagatgactggcaatacatggcagttgattgtctgatgtggttagtgcaggatgctagtacttgtcataaggttatagataaagttgcaccaacactgatagatttagcagatatttcgacactgggtgattacaaaaagcttggcgacacaattgtcacagtcctccaagaatgtatgcaacagactggaaactcacgcggcagaattagtactcagaccaaggaagcaattgatgagctcttgagatgcaagcaaagtttgaaattggaaaagagtatgccgaaggaggatctttatataaaacaagctgcagcattggtcgtgaagttggaaggaaattccctgttctcttctgggaatatagcaggtgctgcagagaaatactcagaagcacttgcgttatgtccagtgaagtgtaagaaagagcgggtggtgctttacagcaaccgagctcagtgttatcttctcctgcaacagccattggctgccataagcgatgctagtcgagcattgtgccttcatagtcctgtgaatcgtcatgccaagagtttgtggagaagagctcaagcatatgatatgcttggttttgcaaaagagagcttgttggatgcaattcttttcataaacgaatgctctcagtcaagcgatcctgacttatccctgaagcagaacaaagttcctgattatgctgagcaattggtgaagaagcagatgcgtgtcacttggctattcagggaagcagctctgaagcatggaggtgtacattgtgaaggaaatgctagtaatgcttttggtcaggaggctgatgactctgagtgggaaacagctagtgaaagcgatgctgagaatgatgccaggagagaagcagatgatgaaactgaatggaagaatcatggcctatcactaccaggacgatttctttgagaaaagctgaggaacaggcatggattatttacatggtatagctttgcaacaagaaatgtcagtcttttggcaaagataatttcaagcattggcactttctgtttttttgcaaattcctttgctatttatatttcacattttcgcatgtaacatttcttagcaatttatatgttgccgatctatggcaggctgaacctgtatttggaaggtgttgcactgagcagctacagatgcagctgctgggccttgtgcactatcgagcatcaatgctttcaaaaggaacgatctggtgtcatttttattgtcctcatcagaaggcggctcaattgaattcatttccctcatcgtgttgttgggtcagttaaagttgcacctgtgaccgttcagtttgctcttctcatgtgtcagtcctgtgtttgtgtttgatgtttgtagaatatgtttcaccagtttgtcaactcttttttttttctgacttttgaagttttgcgaagaggccataatcctggcactcttccctttccattgggcttatctgtaatctgtagggaggtgtacttggattttggtataccatgtcagttgttacctgatataacaagtaggggtttatagattggttcatgctcttatgtcaaaattagtgcgctagggtcttgctctgcttgcctgttggaaccttttgaaggtgttgttgggacgcaaaatgctaacaaatgtgtgcttccaacaagcacatcaatgtttcatataatatataacaagattctactg

SEQ ID NO: 3133 - DNA, 2177 bp, Setaria italica
atgaaggaggcaaaccctagtaaacgaagagcaagtgtgcttaagttttttagggaacttccttctcaagatgatgatggtcaagttctccctattagcggcctctggaacactgcaatggctcacccaaatgatcctgagttcatcaacttgggcatatttgaatgcatggcagctcttatatggaaagggttgaaaaacaggcgctggcttgcacatgatcagaatatttacatcccatattatgcagctcacataattggatcctatacgatgaatgtggaggaatttgcagaacgtgctgttcgtgccggtgtaatacctccattagttgaacttctaagaggtaggctgacttgggtggagcaacgggttgctgttagagctttggggcatttggctacatatcctagtacatttcctgcagttgctgatcatggggaagtacttgaacttgccattcaacttgcttcgagctccttagagattgtgtactctcacttttaccaatttgtggatcgaagacttggctatcattgcgatcttcttactcgtggcatgggtggtgtggaaatggaatcccgcaaagctgaggaatgggcaagtcaactgcagtgctggtctttgcaactcattaattgctttgcatttaaacctgaattcctccatgatatttgcaaggctgattttcttaacaagttacctggaatgtggggtggacttgtgaatgaaaactcacctgctggtgttggtttgctaagaacaatatgccagaacaaggttggtcgaggtcatgttgctaacattcctggtaccatcgatgctttatgcaacattgctcgttcttcagatgactggcaatacatggcagttgattgtctgatttggctagtgcaggatgcaaatacttgtcatatggttatagataaagttgcaccaacattgatagatttaacaaatatttcgacacttggtgattataaaaggcttggtgacacaattgtcacagtcctccaagaatgtatgcaacagagtgggaactcacgcagtacaattcgcactcagaccaaatcagaaattgacgagctcttgagatccaagcaaagtttgaaattggaaaagagtatgccgagggaggatcttcatataaaacaagctgcagcattggttgtgaagttggaaggcaattctctgttctcttcagggaatattgcaggagctgcagagaaatactctgaagcacttgcactatgtccaatgaagtctaagaaagagcgggtggtgctttacagcaatcgagctcagtgttaccttctcctgcagcagccattggccgccataagcgatgctactcgagcattgtgccttcatagccctgtgaatcgtcatgccaagagtttgtggagaagagctcaagcgtatgatatgcttggttttgcaaaggagagcttgttggatgcaatccttttcataaacgagtgctctcagtcaaacgatcctgacttatccctgaagcaaaacaaagttcctgattacgctgagcgattggtgaagaagcagatgcgtgccgcttggctattcagggaagcatctctgaagcatgggggtgtccattgtgaaggagatgctagcgatgcgtttggtcaagaggctgatgactctgagtgggaaacagctagtgaaagcgatgctgagaatgatgtcaggggagaaggggacgatgaaactgaatggaagaatgatggtcaccaggaagatttctgtgagaaaagctgagaaacatgtctggactgtttatgtgccaattaatatctttgcgacaagatgtgctggtctttgggaatgaaggaaactgtgcattgttttttcattttcttttttgatttctcaagtttggcaaagaggccataattctggcactcttctcttcccactggacatatctggaatctgaagggaacgatcttcagggtgtacttggtttctcggtataccgtgtcgaaccgttgtgtgatgtaacaagtagatttgtagcttgggtcatgaactcatgatgctgtcatgttgaaattaccgtgctgggtacttcctctgcttgcctggtgaaaccttctaagggtgctgttgggggcaaaaatgccaacgaaatgtgaaaagaaagaggaaatgaaatcgag

SEQ ID NO: 3134 - DNA, 1921 bp, Setaria italica
gggagtccgacggcggcccaccacgttggagtgtgctgtttgaagtacggttgttgatgttctgattaaggaagctgataggatcaattggctctcataatggacaagatacaatctgattgcccttatcctggatgtttcttttgtgttatgaaggaggcaaaccctagtaaacgaaaggcaagtgtgctaaagttctttagggaacttccttcccaagatgacgacggtcaagttctccctattagcggtctctggaatacagcgatggctcatccaaatgatcctgagttcatcaacttgggcatatttgaatgcatggcatctcttatatggaagggattgaaaaacaggcgttggcttgcacatgatcagaatatttacatcccatattatgcagctcacataattggatcatatacaatgaatatggaggaatttgctgagtgtgctgttcgtgctggtgtaatacctccattagtcgaactgttaagaggtaggctgatgtgggtggaacaaagggttgctgttagagctttggggcatttggctacatatcctagcacatttcctgcagttgctgatcatggggaagtacttgaacttgccattcaacttgcttcgagctccctagagattgtgtactctcacttttaccaatttgcggatcaaagacttggttaccattgtgaccttcttactcgtggcatgggtggtgtggaaatggaatgggcaagtcaggtgctgtgctggtctttgcaactcattaactgctttgcatttaagcctgaattcctccatgatatttgcaaggctgattttctagtcaagttacctggaatgtggggtgggcttgtgaatgagaactcacctgctggtgttggtttgctaagaacaatctgccagagcaaggttggccgaggtcatgttgctaacattcctggtactattgatgctttatgcaatatcgctcgttcttcagatgactggcaatacatggcagttgattgtctgatgtggttagtgcaggatgctagtacttgtcgtaaggttatagataaagttgcaccaacactgatagatttagcagatatttcgacactgggtgattacaaaaagcttggcgacacaattgttacagtcctccaagaatgtatgcaacagactggaaactcacgcggcagaattagtactcagaccaaggaagcaattgatgagctcttgagatgcaagcaaagtttgaaattggaaaagagtatgccgaaggaggatctttatataaaacaagctgcagcattggtcgtgaagttggaaggaaattccctgttctcttctgggaatatagcaggtgctgcagagaaatactcggaagcacttgcgctatgtccagtgaagtgtaagaaagagcgggtggtgctttacagcaaccgagctcagtgttatcttctcctgcaacagccattggctgccataagcgatgctagtcgagcattgtgccttcatagtcctgtgaatcgtcatgccaagagtttgtggagaagagctcaagcatatgatatgcttggttttgcaaaagagagcttgttggatgcaatcttttcataaacgaatgctctcagtcaagcgatcctgacttatccctgaagcagaacaaagttcctgattatgctgagcaattggtgaagaagcagatgcgtgtcacttggctattcagggaagcagctctgaagcatggaggtgtacattgtgaaggaaatgctagtaatgcttttggtcaggaggctgatgactctgagtgggaaacagctagtgaaagcgatgctgagaatgatgccaggagagaagcagatgatgaaactgaatggaagaatcatggcctatcactaccaggacgatttctttgcaggcatggattatttac

SEQ ID NO: 3135 - DNA, 2548 bp, Secale cereale
tcagcacactcccccctctctctctccaaaatcaaatcaaaccggagccaaatcgaagcagctcttccccggaacaccggccaggaacccctccccgccggatccgcccccgcccgcggttcgatccggcggcgccgcctcccgacctgcattcgaggcctccggtcgccggcgccgagccctcccctcttcgtttgaagtataatttgggaggatctgaataaggaagcacataagatcgacctgttcttgatggataaaataccttctgattgcccttatcctggatgtttcttctgtgttatgaaggaagcaaaccctagcaaacgaagagcaagtgtgctgaaattctttagagagcttccttcccaagatgatgatggccaagttcttcctattagtggcctttggaacactgccatggcacacccaaatgaccctgaattcatcaacttggggatatttgagtgcatggcagctctaatatggaagggcctgaaaaacaggcgttggctttcacatgatcagaacatttacatcccatattatgcagcacatgttattggatcctatacgatgaatatggaggagtttgcagaacgtgctgttcgtgctggagtaatacctccattagttgaactcttaagaggtaggctgacctgggtggagcaaagagttgctgtcagagctttggggcatttggctacataccctagtacattccctgctgttgctgatcatggagaagtgcttgaacttgcaattcaacttgcctcaagctctctagaaattgtgtactctcacttttaccaattcgtagatcggaggcttggctaccactgtgatcttcttacacgtggtatgggtggtgctgaaatggaatctcgtaaagctgaggaatgggctagccaactgcagtgctggtctttacagctcataaactgctttgcatttaagcctgagtttctccatgatatctgcaagcctgaatttctagctaagttacctggtatgtggggtgggcttgtgaatgagaactcacctgctggtgttggtttactaagaacaatctgccagagcaagcttggacgaggtcatgttgctaatatttctggtgtcatcgaagctttatgcaacattgctcgttcttcagatgactggcaatacatggccatcgattgtctactctggttagtgcaggatcctagtacatatcataaggttatagataaaatcgccccgacaatgatagatttagcggatatttccacactcggtgattacaaaaggctgggtgacactattgtcacagtcctccaagagtgtatgcaacaaaatgggaactcacggaactcaattagtagtcacaccaaagaagaaatcgatgaactcttgagtttcaagcagaaactgaaatcggaaaagaatatgccaaaggaggatcttcatataaaacaagctgcagcattagttgtaaaattggaaggtaattctctgttctcttcaggaaatattgaaggagctgcagcgaagtactctgaagcactcgcattgtgtccaatgaagtccaagaaagaaagagtggtgcttcatagcaaccgagctcagtgttatcttctcttgcagcaacctttggctgccatcagtgatgctacccgtgcattgtgccttcatagtccgttgaatcgacatgccaaaagtttgtggagaagagctcaagcatatgatatgcttggtttagcaaaagagagcctgctggatgcaattctatttataaatgaatgctctcagtccagtgatcctgatctttccttgaggcaaaacaaggttcctgattacgctgagcgattggtaaagaagcagatgcgtgctgcttggttattcagggaatcatccctaaaacatggtggaatccattgtgagggagatgctagtgatgcatttggtcaagaggctgatgactcggagtgggagacagtgagtgaaagcgacggtgaggatgatgaaaggagggaagcagatgatgaaactgaatggaagagtggtggtcacagggaagatgcgtacgagaaaagctgagaaacaggttttggtgctattaatcgttatttggtaagcttgctctcattgtgcttgtgtcggaagtggcaacaacaacagaagcagccacttgcctgctgctctaccaaagcaaaattaagttgtggaaactagatgagtctgctactgaaagctcataaaaatgtagctttcaaaagtatgtctggtgtcaccgtattgtcgtcatggagagcaaggccaaaatttagccattgccctcgccatgttctttggtctgtgtgagtcgctatgacagactcttgagaatgttgtcttgctcttgattggtgttgtaaattgaacagaatagtaccttagttctatctcaaacatcatcgatttgtgaatgagctttaccttgaagacgcaatgcaagtgatctgtgcgtcttgaaatttccattcgtggcgcgcagatgatcgagtgcttgatcgacaaaaaaaaaaaa

SEQ ID NO: 3136 - DNA, 3008 bp, Oryza sativa
cttccatcccgttttcatcgtgcacaggaggacgtgcacatgaagaagcacattcctccgcttcctcatttcctcccaccgaaaaaaagctagggtttggagctgtgcgccgctgctcgtcgccgcccccatcctccgtcgcggggcgtcggcaccggctccctcctttccgtcggctggccgccaagaaaatctagggtttgggctgtgcgaggcagcgccggggaagcagggaagcggcgaggcggcaggcaggcaggcaggggcaaggccagatccgccgcgcgcagcggcctcgtcgggccggtggcaacgagggctcgttggctcgtcagatccagtgccccttttctccctccctccccctcctcgatttggtttgcggggggtgctcgccaaaagcttcgggattggagtatgattttgaggatctgaataaaagaagtcagtaaaatcatttgtctctcacgatggagaagatacaatctgattgcccttatcctggatgtttcttctgtgttatgaaagaggcaaaccctagtaaacgaagagcaagtgtactgaagttctttagggaacttccttctcaagatgatgatggtcaagttctccctattagtggtctttggaatactgcgatggcacatccaaatgaccctgaattcatcaacttggggatatttgaatgcatgtcagctcttatatggaagggactgaaaaacaggcgttggctttctcatgatcagaatatttacatcccatattatgcagcacatataattggatcctacacaatgaatatggaggagtttgcggaacgtgctgttcgtgctggtgtaatacctccattggttgaactcttacgaggcaggctaacttgggtagagcaaagggttgctgttagagctttggggcatttggctacatatcccagtacatttcctgcagttgctgaccatggagaagtacttgaacttgctattcaacttgcttcaagttctctagagattgtgtattctcatttttaccagtttgtggaccgaaggattggctaccactgtgaccttctcacacgaggcatgggtggtgtggaaatggaatctcgcaaagctgaggaatgggcaagccaacttcagtgctggtctttgcaactcattaactgcttcgcatttaagtctgaatttctccatgatatttgcaaggctgattttctagtcaagttacctggaatgtggggtggactcgtaaatgagaactcacctgctggtgttggtttgctaagaactatctgccagagcaagcttggccgaggccatgttgctaatattcctagtgttgttgaagctctctgcaacattgcccgttcttcagatgactggcaatacatggctgttgattgtttactttggttggtgcaggattcaaatacatgtcataaggtaatagatagagttgcctcaacactgatagatttagcaaatatctcaatgctcggtgattataaaaaacttggtgacaccattgtcacagtgctccaagaatgtatgcaacaatatgcaaattcacggaattcaattagtactcacaccaaagaacaaattgatgaactcttgagttccaagcagagttttaaattggagaagaatatgccaaaggaggatcttcatataaaacaagcagcagcattggttgttaagttggaaggcaattcacttttctcttcagggaacatagcaggagctgcagcaaagtactctgaagcacttgcgctgtgtccaatgaagtctaagaaagaaagagtggtgctttatagtaatcgagctcagtgttatctactcctgcagcagccattggctgccataagtgatgctacccgtgcattgtgccttcatagtcctttgaatcgccacgcaaaaagcttgtggagaagggctcaagcatacgatatgcttggtttagcgaaagagagcctgttggatgcaattctctttataaatgaatgctctcagtcgaatgatcctgacctgtcattaaagcaaaataaagttcctgattatgctgagcgtttggtgaagaagcagatgcgcacagcttggttattcagggaagcagctttgaaacatgggggaatccattgcgagggagaagctagtgatgcttttggtcaagaggcagatgactctgagtgggaaacagccagtgaaagtgatgctgagaatgatgcaacaggagaggcagatgatgaaactgaatggaagaacgataaccaagtatgagaaaagctgagaaccaggtttccttgccattcaggacgattgttggtgttgcttatgttagtagaaacaatggaaccacctgcttgtcttctgtacgagtaaactgaaacaaagttgtgaactggacggagccagcttacagaaagccttgcaagaatggctttcaaaagtgacaaatctggtgccactgtatttatcctattgagaacgaggctgaatttttcaatgccatttatcatctcatcaccatgttggatttgtcagggttgtgcttgtgattcgttcgatgtgttctattcggggagtagtttcatgtttggtgttgtaaaatgtgtttccaccgatttttcagcttttgaatggacaaaactgtgccttctttttttcctcctttcttgatgtgtgaagttttgccaagaggcaaactctggcactgttttctatattctgcagtattgaatgtacattttcttcagggtggatgctgtgttttcttattgtaaaactctatattggttgaggattaactggtttctagtttatgtgtccgtaggttgagtttactatgtgctcagtggttgtctgcctttgtctgggtgctcagatagcgacctgaaatgtaaggcttgagaacttgagtgtggtgctcaaaccatatgtaaatattgttctgcctattcttaatgttcatttagtacgccgttatgcatataatgatgcaacaacccaggg

SEQ ID NO: 3137 - DNA, 2946 bp, Oryza sativa
gaagaagcacattcctccgcttcctcatttcctcccaccgaaaaaaagctagggtttggagctgtgcgccgctgctcgtcgccgcccccatcctccgtcgcggggcgtcggcaccggctccctcctttccgtcggctggccgccaagaaaatctagggtttgggctgtgcgaggcagcgccggggaagcagggaagcggcgaggcggcaggcaggcaggcaggggcaaggccagatccgccgcgcgcagcggcctcgtcgggccggtggcaacgagggctcgttggctcgtcagatccagtgccccttttctccctccctccccctcctcgatttggtttgcggggggtgctcgccaaaagcttcgggattggagtatgattttgaggatctgaataaaagaagtcagtaaaatcatttgtctctcacgatggagaagatacaatctgattgcccttatcctggatgtttcttctgtgttatgaaagaggcaaaccctagtaaacgaagagcaagtgtactgaagttctttagggaacttccttctcaagatgatgatggtcaagttctccctattagtggtctttggaatactgcgatggcacatccaaatgaccctgaattcatcaacttggggatatttgaatgcatgtcagctcttatatggaagggactgaaaaacaggcgttggctttctcatgatcagaatatttacatcccatattatgcagcacatataattggatcctacacaatgaatatggaggagtttgcggaacgtgctgttcgtgctggtgtaatacctccattggttgaactcttacgaggcaggctaacttgggtagagcaaagggttgctgttagagctttggggcatttggctacatatcccagtacatttcctgcagttgctgaccatggagaagtacttgaacttgctattcaacttgcttcaagttctctagagattgtgtattctcatttttaccagtttgtggaccgaaggattggctaccactgtgaccttctcacacgaggcatgggtggtgtggaaatggaatctcgcaaagctgaggaatgggcaagccaacttcagtgctggtctttgcaactcattaactgcttcgcatttaagtctgaatttctccatgatatttgcaaggctgattttctagtcaagttacctggaatgtggggtggactcgtaaatgagaactcacctgctggtgttggtttgctaagaactatctgccagagcaagcttggccgaggccatgttgctaatattcctagtgttgttgaagctctctgcaacattgcccgttcttcagatgactggcaatacatggctgttgattgtttactttggttggtgcaggattcaaatacatgtcataaggtaatagatagagttgcctcaacactgatagatttagcaaatatctcaatgctcggtgattataaaaaacttggtgacaccattgtcacagtgctccaagaatgtatgcaacaatatgcaaattcacggaattcaattagtactcacaccaaagaacaaattgatgaactcttgagttccaagcagagttttaaattggagaagaatatgccaaaggaggatcttcatataaaacaagcagcagcattggttgttaagttggaaggcaattcacttttctcttcagggaacatagcaggagctgcagcaaagtactctgaagcacttgcgctgtgtccaatgaagtctaagaaagaaagagtggtgctttatagtaatcgagctcagtgttatctactcctgcagcagccattggctgccataagtgatgctacccgtgcattgtgccttcatagtcctttgaatcgccacgcaaaaagcttgtggagaagggctcaagcatacgatatgcttggtttagcgaaagagagcctgttggatgcaattctctttataaatgaatgctctcagtcgaatgatcctgacctgtcattaaagcaaaataaagttcctgattatgctgagcgtttggtgaagaagcagatgcgcacagcttggttattcagggaagcagctttgaaacatgggggaatccattgcgagggagaagctagtgatgcttttggtcaagaggcagatgactctgagtgggaaacagccagtgaaagtgatgctgagaatgatgcaacaggagaggcagatgatgaaactgaatggaagaacgataaccaagtatgagaaaagctgagaaccaggtttccttgccattcaggacgattgttggtgttgcttatgttagtagaaacaatggaaccacctgcttgtcttctgtacgagtaaactgaaacaaagttgtgaactggacggagccagcttacagaaagccttgcaagaatggctttcaaaagtgacaaatctggtgccactgtatttatcctattgagaacgaggctgaatttttcaatgccatttatcatctcatcaccatgttggatttgtcagggttgtgcttgtgattcgttcgatgtgttctattcggggagtagtttcatgtttggtgttgtaaaatgtgtttccaccgatttttcagcttttgaatggacaaaactgtgccttctttttttcctcctttcttgatgtgtgaagttttgccaagaggcaaactctggcactgttttctatattctgcagtattgaatgtacattttcttcagggtggatgctgtgttttcttattgtaaaactctatattggttgaggattaactggtttctagtttatgtgtccgtaggttgagtttactatgtgctcagtggttgtctgcctttgtctgggtgctcagatagcgacctgaaatgtaaggcttgagaacttgagtgtggtgctcaaaccatatgtaaatattgttctgcctattcttaatgttcatttagtacgccgttatgcata

SEQ ID NO: 3138 - DNA, 2208 bp, Brachypodium distachyon
ttgtaatggataaaatacaagctgattgcccttatcctggatgtttcttctgcgttatgaaggaggcaaaccctagcaaacgaagagcgagtgtgctgaagttctttagagaacttccttcccaagatgatgatggccaagttcttcctattagtggcctttggaatactgcaatggctcacccaaacgaccctgaattcattaacttgggaatatttgagtgtatggcagctttaatatggaagggcttgaaaaataggcgctggctttcacatgatcagaatatttacatcccatattatgcagcccacgttattggatcttatacgatgaatatggaggagtttgcagaacgtgctgttcgtgccggagtaataaccccattagttgaactcttaagaggtaggctgacttgggtggagcaaagagttgctgttagagctttggggcatttggctacataccctagtacattcgctgctgttgctgatcatggagaagtacttgaacttgcgattcaacttgcctcaagctcgctagaaattgtgtactctcacttttaccaattcgtagatcggagacttggctaccattgtgatcttcttacacgtggcatgggtggtgcggaaatggaatctcgtaaagctgaggaatgggctagtcaattgcagtgctggtctctgcagctcataaactgctttgcatttaagcctgagtttctccatgatatctgcaagcctgaatttctagccaagttacctggtatgtggggtggacttgtgaatgagaactcgcctgctggtattggtttactaagaacaatctgccagagtaagcttggcagaggtcatgttgctaatatttctggtgtcattgaagctttatgcaacattgctcgttcttcggatgactggcaatatatggccattgattgtctactctggttagtgcaggatcctagtacatatcacaaggttatagataaaattgcaccggcattgatagatttagcagatatttccacactcggtgattataaaaagctgggtgacactattgtcacagtcctccaagaatgtatgcaacaaaatgggaattcacggagttcagttagtagtcacaccagagaagaaattgatgaactcttgagttccaggcagaaacttaaatcagaaaagaatatgccaaaggaggatcttcatataaaacaagctgctgcattggttgttaagttggaaggaaattcgttgttctcttcaggaaatattgaaggagctgcaaccaagtattctgaagcactcgcattgtgtccaatgaagtctaagaaagaaagagtggtgctttatagcaaccgagctcagtgttatcttctcctacagcaaccttcggctgccatcagtgatgctacccgtgcattgtgccttcacagtccattgaatcgacatgccaagagtttgtggagaagagctcaagcatatgatatgcttggtttggcgaaagagagcctgctggatgcaattctctttataaatgaatgctctcagtccagtgatcctgatctgtccttgaggcaaaacaaagttcctgattatgctgagcgattggtaaagaagcagatgcgtgccgcttggttattcagagcatcatccctaaaacatggtggaatccattgtgagggagatgctagtgatgcatttggtcaagaggctgatgactctgagtgggagacagtgagtgaaagtgatggtgagaatgatgaaaggagagaagcagatgatgaaactgaatggaagaatggcagtcactgggaagacgtctatgcgaaaagctgagaaacagggttttgttctattgttcgttaagctttgctatcactgcacttgtagtcagcagcaacaaaaacagaagtagctgctggcctgctgcactgctaaagcaaaactaaatcgttgaaagtagatgaattctgcttgatcaaaggtcagaaaaaattgtagcttccgaaagtaacaatctggtgtatattgtttctatggagagcaaggctaaaacactatgtattgcccgcccttcttgggtctgtctgagtttctgtgattgttaagaattttcgtcttccccgcttgcttttggtgttgtaaaatgaacagaacagtgccttggttttatcttaaacatcatccatttgtgaatgaactttaccttgaa

SEQ ID NO: 3139 - DNA, 2883 bp, Brachypodium distachyon
cagccggcgacggcgaccttcttccgctgcgtcccgcccccgggaggtgcctccgcccggacggggcttccccgacggcggtggcgaagggagcgcggaggccgccgcttccggccacgggaccggacgaccggcggcgacggacgtactccagcaaattccttcgtcgggaagcttccgggactgcaagacagcaagaacgggggacaaaccacacgatgtcacaaacgggtggccccgggtccctgacgaggtgttcgcttggctattcctgttctgtttctcaagtctcaactctcaacgcaaaccaccccaaattggcagcggctccagtttctccctgcgcaggactcctttccccccgcggcccagcctctcagtctaggtcagcgattcaccccgccgccgcccggcggaccgctgctacctctggtgctcctcctcctcctcctcctcctcctcccaagcttgtcgccgactgggtctcggctgccatccccagccccagccgcctctggtctctcggctgctccagggagcaactctcccctctttccccactcggctgctccagtttgaagtagtatgattttgaggatctgaataaagaagggataatatctattgggggtcttgtaagttgtaatggataaaatacaagctgattgcccttatcctggatgtttcttctgcgttatgaaggaggcaaaccctagcaaacgaagagcgagtgtgctgaagttctttagagaacttccttcccaagatgatgatggccaagttcttcctattagtggcctttggaatactgcaatggctcacccaaacgaccctgaattcattaacttgggaatatttgagtgtatggcagctttaatatggaagggcttgaaaaataggcgctggctttcacatgatcagaatatttacatcccatattatgcagcccacgttattggatcttatacgatgaatatggaggagtttgcagaacgtgctgttcgtgccggagtaataaccccattagttgaactcttaagaggtaggctgacttgggtggagcaaagagttgctgttagagctttggggcatttggctacataccctagtacattcgctgctgttgctgatcatggagaagtacttgaacttgcgattcaacttgcctcaagctcgctagaaattgtgtactctcacttttaccaattcgtagatcggagacttggctaccattgtgatcttcttacacgtggcatgggtggtgcggaaatggaatctcgtaaagctgaggaatgggctagtcaattgcagtgctggtctctgcagctcataaactgctttgcatttaagcctgagtttctccatgatatctgcaagcctgaatttctagccaagttacctggtatgtggggtggacttgtgaatgagaactcgcctgctggtattggtttactaagaacaatctgccagagtaagcttggcagaggtcatgttgctaatatttctggtgtcattgaagctttatgcaacattgctcgttcttcggatgactggcaatatatggccattgattgtctactctggttagtgcaggatcctagtacatatcacaaggttatagataaaattgcaccggcattgatagatttagcagatatttccacactcggtgattataaaaagctgggtgacactattgtcacagtcctccaagaatgtatgcaacaaaatgggaattcacggagttcagttagtagtcacaccagagaagaaattgatgaactcttgagttccaggcagaaacttaaatcagaaaagaatatgccaaaggaggatcttcatataaaacaagctgctgcattggttgttaagttggaaggaaattcgttgttctcttcaggaaatattgaaggagctgcaaccaagtattctgaagcactcgcattgtgtccaatgaagtctaagaaagaaagagtggtgctttatagcaaccgagctcagtgttatcttctcctacagcaaccttcggctgccatcagtgatgctacccgtgcattgtgccttcacagtccattgaatcgacatgccaagagtttgtggagaagagctcaagcatatgatatgcttggtttggcgaaagagagcctgctggatgcaattctctttataaatgaatgctctcagtccagtgatcctgatctgtccttgaggcaaaacaaagttcctgattatgctgagcgattggtaaagaagcagatgcgtgccgcttggttattcagagcatcatccctaaaacatggtggaatccattgtgagggagatgctagtgatgcatttggtcaagaggctgatgactctgagtgggagacagtgagtgaaagtgatggtgagaatgatgaaaggagagaagcagatgatgaaactgaatggaagaatggcagtcactgggaagacgtctatgcgaaaagctgagaaacagggttttgttctattgttcgttaagctttgctatcactgcacttgtagtcagcagcaacaaaaacagaagtagctgctggcctgctgcactgctaaagcaaaactaaatcgttgaaagtagatgaattctgcttgatcaaaggtcagaaaaaattgtagcttccgaaagtaacaatctggtgtatattgtttctatggagagcaaggctaaaacactatgtattgcccgcccttcttgggtctgtctgagtttctgtgattgttaagaattttcgtcttccccgcttgcttttggtgttgtaaaatgaacagaacagtgccttggttttatcttaaacatcatccatttgtgaatgaactttaccttgaagctctgttgtgctgcaagtaaagatgcaagcggta

SEQ ID NO: 3140 - DNA, 1812 bp, Oryza sativa
tatcctggatgtttcttctgtgttatgaaagaggcaaaccctagtaaacgaagagcaagtgtactgaagttctttagggaacttccttctcaagatgatgatggtcaagttctccctattagtggtctttggaatactgcgatggcacatccaaatgaccctgaattcatcaacttggggatatttgaatgcatgtcagctcttatatggaagggactgaaaaacaggcgttggctttctcatgatcagaatatttacatcccatattatgcagcacatataattggatcctacacaatgaatatggaggagtttgcggaacgtgctgttcgtgctggtgtaatacctccattggttgaactcttacgaggcaggctaacttgggtagagcaaagggttgctgttagagctttggggcatttggctacatatcccagtacatttcctgcagttgctgaccatggagaagtacttgaacttgctattcaacttgcttcaagttctctagagattgtgtattctcatttttaccagtttgtggaccgaaggattggctaccactgtgaccttctcacacgaggcatgggtggtgtggaaatggaatctcgcaaagctgaggaatgggcaagccaacttcagtgctggtctttgcaactcattaactgcttcgcatttaagtctgaatttctccatgatatttgcaaggctgattttctagtcaagttacctggaatgtggggtggactcgtaaatgagaactcacctgctggtgttggtttgctaagaactatctgccagagcaagcttggccgaggccatgttgctaatattcctagtgttgttgaagctctctgcaacattgcccgttcttcagatgactggcaatacatggctgttgattgtttactttggttggtgcaggattcaaatacatgtcataaggtaggacattaggtaatagatagagttgcctcaacactgatagatttagcaaatatctcaatgctcggtgattataaaaaacttggtgacaccattgtcacagtgctccaagaatgtatgcaacaatatgcaaattcacggaattcaattagtactcacaccaaagaacaaattgatgaactcttgagttccaagcagagttttaaattggagaagaatatgccaaaggaggatcttcatataaaacaagcagcagcattggttgttaagttggaaggcaattcacttttctcttcagggaacatagcaggagctgcagcaaagtactctgaagcacttgcgctgtgtccaatgaagtctaagaaagaaagagtggtgctttatagtaatcgagctcagtgttatctactcctgcagcagccattggctgccataagtgatgctacccgtgcattgtgccttcatagtcctttgaatcgccacgcaaaaagcttgtggagaagggctcaagcatacgatatgcttggtttagcgaaagagagcctgttggatgcaattctctttataaatgaatgctctcagtcgaatgatcctgacctgtcattaaagcaaaataaagttcctgattatgctgagcgtttggtgaagaagcagatgcgcacagcttggttattcagggaagcagctttgaaacatgggggaatccattgcgagggagaagctagtgatgcttttggtcaagaggcagatgactctgagtgggaaacagccagtgaaagtgatgctgagaatgatgcaacaggagaggcagatgatgaaactgaatggaagaacgataaccaagtatgagaaaagctgagaaccaggtac

SEQ ID NO: 3141 - DNA, 2476 bp, Brachypodium distachyon
agacgaaaccaaatcaaagctcccaataccaccgggccacctccgtcgccgtttggatccggcgcggctgctggttccctacctacacttacagttggggtatccaggaccggccgccggcggggcaccagtcgccggcatcgaatctaatcctcacgcgtttgaattatggttttgaggatctgattaagaagtgggcatgattgattggttcttgtaatggataaaatacaatctgattgcccttatcctggatgtttcttctgtgttatgaaggaggcaaacccaagcaaacggagagcaagtgtgctgaaattctttagggaacttccttcccaagatgatgatggccaagttctccctatcagtggcctttggaacactgcaatggcccacccaaatgatcctgaattcattaacttgggaatatttgagtgtatggcagctctaatatggaagggctcgaaaaacaggcgctggctttcacatgatcagaatatttacatcccatattatgcagcacatgtcattggatcctatacgatgaatatggaggagtttgcagaacgtgctgttcgtgccggagtaatacctccattagttgaactcttaagaggtaggctgacttgggtggagcaaagagttgctgttagagctttggggcatttggctacatacccaagtacattccctgctgttgctgatcatggagaagtacttgaacttgccgttcaacttgcctcaagctccctagagattgtgtactctcacttttaccaatttgtagataggagacttggctaccattgtgaccttcttacacgtggcatgggtggtgcagaaatggaatctcgtaaagctgaggaatggggtagtcaactgcagtgctggtctttgcagctcataaactgcttcgcatttaagcccgagtttctccatgatatctgcaagcctgaatttctagctaagttacctggtatgtggggtggacttgttaatgagaactcacctgctggtattggtttactaagaacaatctgccagagtaaggttggccgaggtcatgttgctaatatttctggtgtccttgaagctttatgcaacatttctcattcatcagatgactggcaatacatggccattgattgtatactctggttagtgcaggatcctagtacgtatcataaggttatagataaaattgccccaacattgattgatttagctgatatttccacactcggtgattataaaaagttgggtgacactattgtcacagtcctccaagaatgtatgcagcaaaacaataattcacggaattcagttagtagtcacaccatagaaaaaattgaagaactcttgagttccaggcagaagcttaaatcagaaaggaatatgcctaaggaggatcttcatataaaacaagctgcagcattggttgtaaagttggaaggcaattctttattctcttctggaaatattgaaggagctgcaaccaagtattctgaagcactcgcattgtgtccaatgaagtctaagaaagaaagggtggtgctttatagcaaccgggctcagtgttatcttctcttgcagcaacctttggctgccatcagtgacgctacccgtgctttgtgccttcacagcccattgaatcggcatgccaaaagtttgtggagacgagctcaagcatatgatatgcttggtttagcgaaagagagcctgctagatgcaattctctttataaatgaatgctctcagtccagtgaccctgatctatcgtcgaggcaaaacaaggttcctgattatgctgagcgattggtgaagaagcagatgcgtgccgcttggttatttagggaatcatccctgaaacatgggggaatccattgtgagggggatgccagtgatgcatttggtcaagaggttgatgactctgagtgggagacagtgggtgaaagcgatggtgagaatgacgaaaggagagaagtagatgatgaaactgaatggaagaatgccggtcaccgggaagacgcttttgagaaaagctgaggaacaggacttggtgctgttactcgttgagcttgttgtattgtgcttgtagtcggcagcagcagcaacagaagcagccgtgggcctgctgcagtccgaaagcaaaagtaaactgcggaaaccagacgaagaagtcagcttactgaaagctcacaaaaaatggagagcaggcttctgagtctgtcagagttgctttggttgttgataattttcgtcttgctctgttgtttggcgttgtaaaatgaacaaaaatagttctaatattaaacatcatccttttgtgaatgaactttatattaaagctctgttaagaacttaagattcaagtgctacttccatgcatcttgaaattgcaattgacctcctatttgggtggcacagatgatcgggtggtcgatagaagttctccattgatttaacataaattttc

SEQ ID NO: 3142 - DNA, 2320 bp, Brachypodium distachyon
gcagtttgaattatggttttgaggatctgattaagaagtgggcatgattgattggttcttgtaatggataaaatacaatctgattgcccttatcctggatgtttcttctgtgttatgaaggaggcaaacccaagcaaacggagagcaagtgtgctgaaattctttagggaacttccttcccaagatgatgatggccaagttctccctatcagtggcctttggaacactgcaatggcccacccaaatgatcctgaattcattaacttgggaatatttgagtgtatggcagctctaatatggaagggctcgaaaaacaggcgctggctttcacatgatcagaatatttacatcccatattatgcagcacatgtcattggatcctatacgatgaatatggaggagtttgcagaacgtgctgttcgtgccggagtaatacctccattagttgaactcttaagaggtaggctgacttgggtggagcaaagagttgctgttagagctttggggcatttggctacatacccaagtacattccctgctgttgctgatcatggagaagtacttgaacttgccgttcaacttgcctcaagctccctagagattgtgtactctcacttttaccaatttgtagataggagacttggctaccattgtgaccttcttacacgtggcatgggtggtgcagaaatggaatctcgtaaagctgaggaatggggtagtcaactgcagtgctggtctttgcagctcataaactgcttcgcatttaagcccgagtttctccatgatatctgcaagcctgaatttctagctaagttacctggtatgtggggtggacttgttaatgagaactcacctgctggtattggtttactaagaacaatctgccagagtaaggttggccgaggtcatgttgctaatatttctggtgtccttgaagctttatgcaacatttctcattcatcagatgactggcaatacatggccattgattgtatactctggttagtgcaggatcctagtacgtatcataaggttatagataaaattgccccaacattgattgatttagctgatatttccacactcggtgattataaaaagttgggtgacactattgtcacagtcctccaagaatgtatgcagcaaaacaataattcacggaattcagttagtagtcacaccatagaaaaaattgaagaactcttgagttccaggcagaagcttaaatcagaaaggaatatgcctaaggaggatcttcatataaaacaagctgcagcattggttgtaaagttggaaggcaattctttattctcttctggaaatattgaaggagctgcaaccaagtattctgaagcactcgcattgtgtccaatgaagtctaagaaagaaagggtggtgctttatagcaaccgggctcagtgttatcttctcttgcagcaacctttggctgccatcagtgacgctacccgtgctttgtgccttcacagcccattgaatcggcatgccaaaagtttgtggagacgagctcaagcatatgatatgcttggtttagcgaaagagagcctgctagatgcaattctctttataaatgaatgctctcagtccagtgaccctgatctatcgtcgaggcaaaacaaggttcctgattatgctgagcgattggtgaagaagcagatgcgtgccgcttggttatttagggaatcatccctgaaacatgggggaatccattgtgagggggatgccagtgatgcatttggtcaagaggttgatgactctgagtgggagacagtgggtgaaagcgatggtgagaatgacgaaaggagagaagtagatgatgaaactgaatggaagaatgccggtcaccgggaagacgcttttgagaaaagctgaggaacaggacttggtgctgttactcgttgagcttgttgtattgtgcttgtagtcggcagcagcagcaacagaagcagccgtgggcctgctgcagtccgaaagcaaaagtaaactgcggaaaccagacgaagaagtcagcttactgaaagctcacaaaaaatggagagcaggcttctgagtctgtcagagttgctttggttgttgataattttcgtcttgctctgttgtttggcgttgtaaaatgaacaaaaatagttctaatattaaacatcatccttttgtgaatgaactttatattaaagctctgttaagaacttaagattcaagtgctacttccatgcatcttgaaattgcaattgacctcctatttgggtggcacagatgatcgggtggtcgatagaagttctccattgatttaacataaattttc

SEQ ID NO: 3143 - DNA, 1821 bp, Brachypodium distachyon
tatcctggatgtttcttctgcgttatgaaggaggcaaaccctagcaaacgaagagcgagtgtgctgaagttctttagagaacttccttcccaagatgatgatggccaagttcttcctattagtggcctttggaatactgcaatggctcacccaaacgaccctgaattcattaacttgggaatatttgagtgtatggcagctttaatatggaagggcttgaaaaataggcgctggctttcacatgatcagaatatttacatcccatattatgcagcccacgttattggatcttatacgatgaatatggaggagtttgcagaacgtgctgttcgtgccggagtaataaccccattagttgaactcttaagaggtaggctgacttgggtggagcaaagagttgctgttagagctttggggcatttggctacataccctagtacattcgctgctgttgctgatcatggagaagtacttgaacttgcgattcaacttgcctcaagctcgctagaaattgtgtactctcacttttaccaattcgtagatcggagacttggctaccattgtgatcttcttacacgtggcatgggtggtgcggaaatggaatctcgtaaagctgaggaatgggctagtcaattgcagtgctggtctctgcagctcataaactgctttgcatttaagcctgagtttctccatgatatctgcaagcctgaatttctagccaagttacctggtatgtggggtggacttgtgaatgagaactcgcctgctggtattggtttactaagaacaatctgccagagtaagcttggcagaggtcatgttgctaatatttctggtgtcattgaagctttatgcaacattgctcgttcttcggatgactggcaatatatggccattgattgtctactctggttagtgcaggatcctagtacatatcacaaggtaagacattaggttatagataaaattgcaccggcattgatagatttagcagatatttccacactcggtgattataaaaagctgggtgacactattgtcacagtcctccaagaatgtatgcaacaaaatgggaattcacggagttcagttagtagtcacaccagagaagaaattgatgaactcttgagttccaggcagaaacttaaatcagaaaagaatatgccaaaggaggatcttcatataaaacaagctgctgcattggttgttaagttggaaggaaattcgttgttctcttcaggaaatattgaaggagctgcaaccaagtattctgaagcactcgcattgtgtccaatgaagtctaagaaagaaagagtggtgctttatagcaaccgagctcagtgttatcttctcctacagcaaccttcggctgccatcagtgatgctacccgtgcattgtgccttcacagtccattgaatcgacatgccaagagtttgtggagaagagctcaagcatatgatatgcttggtttggcgaaagagagcctgctggatgcaattctctttataaatgaatgctctcagtccagtgatcctgatctgtccttgaggcaaaacaaagttcctgattatgctgagcgattggtaaagaagcagatgcgtgccgcttggttattcagagcatcatccctaaaacatggtggaatccattgtgagggagatgctagtgatgcatttggtcaagaggctgatgactctgagtgggagacagtgagtgaaagtgatggtgagaatgatgaaaggagagaagcagatgatgaaactgaatggaagaatggcagtcactgggaagacgtctatgcgaaaagctgagaaacaggt

SEQ ID NO: 3144 - DNA, 2192 bp, Elaeis guineensis
gagagattttgttgcgcctttacatgtttagatttggtttctttagttaaatccagatgcgttaagatgctcatttcctagagatgcttcgccttcgtctcaggcttcgtttggagctataacagtaaccagatacaacgcgtaattgaatcaataaagtgagtctaacggttggtccttccatcatggataagatatcatctgactgtccttacccaggatgcttcttctgtgtcatgaaagagggaaatccaaataaacgaagaacaagtatactgaagttctttagagagcttccttctcaagatgatgatggccaggttctccctatcagtggcctttggaacactgccatggcgcatccaaatgatcctgagtttgttaacttgggaatattgaatgcatggctgcattgatatggaagggcttaaagaacaggcgttggcttacacatgaccagaacatatacatcccttattatgcagctcatataattggatcttacacgatgaatatggaagagtttgcagaaactgcagtgcatgctggagtcattcctcccttagttgaacttttacgggtaggttgacctgggtggagcaaagggtagcagttagggccctgggacacttggctacatatcctagtacatttcctgcagtggcaagtcatggagaagtccttgagcttgccattcagctggcatcaagttctctggagattgtctactctcacttttaccagttcgtggataggagactaagctatcactgtgatctacttacacgggggatgggtggtgtggaaatggaatccaggaaagcagaggaatgggccagtcagttacagtgctggtctcttcagctaattaactgctttgctttcaagcccgagtttctccctgatatatgcaagccagtaatttttaatgaaattaccaggcatgtggggtgggcttgtcaatgagaactcaccagctggtattggtttactgcgaacaatttgccagcacaagcttgggaggagtcctgttgctaactgtcctggtactattgacgcactatgtaatattgctcgttcatcagatgactggcagtacatggccattgattgtctcgtttggctacttcaagatccaagtacttgccataaggtgatcgataaggcagccccagcacttatagatttagcagaaatttcaactcttggtgatcataaaagactcggggacaacattgttagtgtccttcaagaatgtatacagtcacatgggacagcacgcaattttatcagtagccatacaaaagagcagattgatgagcttttgagttccaggcagagattaaaatgggaaaagaatatgccaaaggaggatctgcatataaagcaggcagcagctctggttgttaagctggaaggaaattctttattttcttcaggaaatattgcaggagctgcatcaaagtactctgaagcactggcattgtgtcccatgaagtcaaaaaaagagagagttgtgttgtacagcaatagagctcaatgttatcttctcttgcagcagccattggcagccattagcgatgctacacgtgcattgtgccttcataaccctcctaatcgtcatgccaaaagcctgtggagaagagcccaagcatatgatatgcttgctttagctaaagagagcttgttagatgccattcttttcattaatgagtgttctcagtcaaatgatcctgacctttccttgagacagaataaagttcctgattatgctgaaaggttagtcaagaagcagatgcgtgctgcatggctattcagagaagcagctataaagcatgggggagttcattgtgagggtgatactggagacgtatttggccaagaggctgatgattctgagtgggagacagctagcgaaagtgatattggaaatgatggaagaagagaagcagatgatgatgagagtgaatggaaaaatgatgacaaccggaaagatatatatgacaaggcttctacaaaagatatgaatcatggatataatgtgctgcttgctgaagatgatacatgattccccaagtgattaacacaaatgaggtcacaaactgttaatcatcatcagggagcttctttgaaccttggagtgtgaaaggtgttgcgcagttctttgaagtgtaattactgctgaggtattc

SEQ ID NO: 3145 - DNA, 2321 bp, Ricinus communis
attacaaaaacaagagatcctcttctcctcgctgtcctaatcgaacaaacccatcaaagaaaatcacacttcccctccactctgcttcgccacttccacttgctctctcttcatgcggtgccgttttgtttcaacaacaatagacatagacatcgactaacagagaactcaaagaaaaagttaataactttttctttgtttgtgttttggcttttgagaattttagtgcaggttcttcttgtacctataatctctagctagcctttaaacggggtcttcaaagtgctggaagtttcaccattcaatgaagaattgacttggtggtgtgtgaactcaaccaagttgaatatttgagcatggataaagtatcaccagactgtccgtacccaggatgctttttctgtgtcatgaaggaaggaaatccaagtaagcgtagggcaagtatactgaaatttttcagagagcttccttcacaagatgatgatgggcaggttctccctatcagtggcctttggaacactgctatggcacatcctaatgatcctgagttcattgagttgggaatatttgaatgcatggctgcacttatatggaaaggcttaaagaatagacggtggctttctcatgatcagaacatatacattccttactatgctgctcatattattggatcctacaccatgaacatggaagaatttgctgaaagtgctgtccatgctggtgtgattcctcccctggttgagcttttgagagggaggttgacatgggtggaacagagagtggcagttcgagctctaggacatttggccacatatgccagtacttttcctgctgtggcaagtcaaggtgaaatccttgagctctccattcaacttgcaatgagttcattagagatagtttactctcatttttaccagtatgtcgatagaaggctaagttatcactgtgatttgcttactcgtggcatgggaggtgttgaaatggagtccaggaaagcagaggaatgggctagtcagttgcagtgctggtcacttcagcttattaattgttttgctttcaagcctgagtttcttcctaccatatgcaagcctgaattcttagtaaaattgccaggcatgtggggtggacttgttaacgaaaattcacctgctggtattggtttattaagaacaatttgtcatcacaagcttggtaggggaccggttgctagctgtcctggtataattgaggcgttgtgcaacattgctcgctcatctgatgactggcaatatatggctatagattgtctactatggttgcttcaagatccaagtacatgccataaggtgattgacaaggcagtacctgccctgattgacctctcagagatctccacactgggtgatcacaaaaagcttggggattccattgttaatgttcttcaggattgtattcaatcacaaggaacgggtcgtagttctatcagcaaccgcacgaaagaacttattgaggaactgttaacttcaaaacaaagattgaaatgggaaaagaatatgccaaaagaagatttacatattaagcaggcagcagcattagtggtcaagcttgaaggaaattccctattctcatcagggaatatctcaggagctgcatcaaagtactctgaagcattgtcattgtgcccaatgagatccaaaaaagagagagttgttctctacagtaatcgagctcagtgtcatctgctattacagcaacccttggctgctataagtgatgctacacgtgccctttgtctccacaaccctctgaaccgtcatgcaaaaagcctttggagaagagctcaggcttatgacatgctgggattagctaaagaaagcttgttagatgccattctattcattaatgaatgctctcagtcaaatgatcctgatctatgtttgagacaaaacaaagttcccgactatgctgagcgtcttgtgaagaagcagatgcgtgcggcctggttatttagagaggcagctattaaacatgggggtgtccatggtgagggtgatggcgaaatctatggccaggacagtgatgattcagaatgggaaacagcaagtgaaagtgacataggaaatgatggaagagatgaaatgggcgatgatgatgatgatagtgaatggaagaatgaggatgagaggaaagataaatatgataagccatcattaaaagatataaagcatgggtacaatctgcagctcgtggaagatgattcttgagacaggagggagacagatgcaatgagtgaaatgtcttcaacacctttagcacatatatgagctcagaatgactgctgc

SEQ ID NO: 3146 - DNA, 2865 bp, Ricinus communis
ccaatttcctatatctctatttctccacgcgctttctctcaaccccatcttcacgctcctatacaattggatccttcgcaccattcacgcgcgtgaactgctgggcaggagtgtggaaaagagtgttttgttcaaaaaattggatttttattgtttttcatttttaagctattacattaaaacaagagcagtagtagtgtgttttctcattacaaaaacaagagatcctcttctcctcgctgtcctaatcgaacaaacccatcaaagaaaatcacacttcccctccactctgcttcgccacttccacttgctctctcttcatgcggtgccgttttgtttcaacaacaatagacatagacatcgactaacagagaactcaaagaaaaagttaataactttttctttgtttgtgttttggcttttgagaattttagtgcaggttcttcttgtacctataatctctagctagcctttaaacggggtcttcaaagtgctggaagtttcaccattcaatgaagaattgacttggtggtgtgtgaactcaaccaagttgaatatttgagcatggataaagtatcaccagactgtccgtacccaggatgctttttctgtgtcatgaaggaaggaaatccaagtaagcgtagggcaagtatactgaaatttttcagagagcttccttcacaagatgatgatgggcaggttctccctatcagtggcctttggaacactgctatggcacatcctaatgatcctgagttcattgagttgggaatatttgaatgcatggctgcacttatatggaaaggcttaaagaatagacggtggctttctcatgatcagaacatatacattccttactatgctgctcatattattggatcctacaccatgaacatggaagaatttgctgaaagtgctgtccatgctggtgtgattcctcccctggttgagcttttgagagggaggttgacatgggtggaacagagagtggcagttcgagctctaggacatttggccacatatgccagtacttttcctgctgtggcaagtcaaggtgaaatccttgagctctccattcaacttgcaatgagttcattagagatagtttactctcatttttaccagtatgtcgatagaaggctaagttatcactgtgatttgcttactcgtggcatgggaggtgttgaaatggagtccaggaaagcagaggaatgggctagtcagttgcagtgctggtcacttcagcttattaattgttttgctttcaagcctgagtttcttcctaccatatgcaagcctgaattcttagtaaaattgccaggcatgtggggtggacttgttaacgaaaattcacctgctggtattggtttattaagaacaatttgtcatcacaagcttggtaggggaccggttgctagctgtcctggtataattgaggcgttgtgcaacattgctcgctcatctgatgactggcaatatatggctatagattgtctactatggttgcttcaagatccaagtacatgccataaggtgattgacaaggcagtacctgccctgattgacctctcagagatctccacactgggtgatcacaaaaagcttggggattccattgttaatgttcttcaggattgtattcaatcacaaggaacgggtcgtagttctatcagcaaccgcacgaaagaacttattgaggaactgttaacttcaaaacaaagattgaaatgggaaaagaatatgccaaaagaagatttacatattaagcaggcagcagcattagtggtcaagcttgaaggaaattccctattctcatcagggaatatctcaggagctgcatcaaagtactctgaagcattgtcattgtgcccaatgagatccaaaaaagagagagttgttctctacagtaatcgagctcagtgtcatctgctattacagcaacccttggctgctataagtgatgctacacgtgccctttgtctccacaaccctctgaaccgtcatgcaaaaagcctttggagaagagctcaggcttatgacatgctgggattagctaaagaaagcttgttagatgccattctattcattaatgaatgctctcagtcaaatgatcctgatctatgtttgagacaaaacaaagttcccgactatgctgagcgtcttgtgaagaagcagatgcgtgcggcctggttatttagagaggcagctattaaacatgggggtgtccatggtgagggtgatggcgaaatctatggccaggacagtgatgattcagaatgggaaacagcaagtgaaagtgacataggaaatgatggaagagatgaaatgggcgatgatgatgatgatagtgaatggaagaatgaggatgagaggaaagataaatatgataagccatcattaaaagatataaagcatgggtacaatctgcagctcgtggaagatgattcttgagacaggagggagacagatgcaatgagtgaaatgtcttcaacacctttagcacatatatgagctcagaatgactgctgcatcttgctatttcttcgaggagaagcttaatacaaatgattatggatcgtgtcgagagagtaacaactgtttcataaattttgttgtttcattaatatttttttttattccccaattcttctttgtttatgtcaaatgtagaaaatggaagaacgttttatgagtgtagagaacaattatagcccagaggatgtgaagcatttgtttttctttttctttttgggttttctggagtgatttcaaagaaacttttgtgtatataaaataaatcttgggtctttgaactgtcaattctctactcagattcttgcaatagtcttccaggtttgtgcttca

SEQ ID NO: 3147 - DNA, 2597 bp, Populus trichocarpa
cattacaacagctactgggcctctctctctatctctctctctccccgctgtcagaatcaaacaaatccgagaacaccgttcccctttttctcaaactccacttctgtttctctctagccatttctcattctctaacaagagcgaactcaaaaaagcaggccttactttaatctgctttcagacaacacaggagaaaaacacttttttcttccttttgcctgacaaattcattgttgttcttctccttgcttatctctctaaggaaccctctttcaacgtttatgaattcagagtagttgactgtctgaaaatggataaagtatcccccgactgtccttatccaggatgctttttttgtgtcatgaaggaagggaatccaagtaagcgcagagctagtatactgaaattcttcagagaacttccttcgcaggatgatgatggccaggttctcccaatcagtggcctttggaacactgccatggcacatccaaatgaccctgagttcattgaattgggaatatttgaatgcatggttgctcttatatggaaaggcttaaagaatcgccgctggctttctcatgatcagaacatatacattccttactatgcagctcatattatcggatcctacaccatgaacatggaagagtttgcagaaagtgctatccatgctggtgtaactcctcccttagttgagcttttgagggggaggttgacatgggttgaacaaagagtagcggtacgggcactaggacacttggccacatacaccaacactttccctgctgtggcaagtcatggtgaaatccttgaactcgccatccaactagcaatgagttcactagaaatagtttactcacatttttaccaatacgctgatagaaggcttagttatcattgcgatttgcttacccgtggcatgggtggtgttgaaatggagtccaggaaagcagaggaatgggctagtcagttacagtgctggtcccttcaactcattaattgctttgcttttaagcccgaatttcttcctaccatatgcaagcctgaattcttggtaaaactgccaggcatgtggggcgggcttgttaatgaaaactcacctgctggtattggtttattaagaacaatctgtcatcataagcttggtaggggacctgttgctagctgtcctggtattattgaagcattgtgtaatatagctaggtcatcagatgattggcagtatatggctatagactgtcttctttggttgatccaagatccaagtacatgccataaggtcattgataaggcagtacctgcacttgtagacctagcagagattacaaatctgggcgatcacaaaaaactcggggactacattgttaatgttcttcaggaatgtttgcaatcacaagggacagggcgtaacagtatcagtaatcatgtgaaggaactgatcgaggaactattgaattccaaacagagattgaaatgggaaaagagcatgcccaaggaggatctccatattaaacaggcagctgcactggtggtcaagcttgaaggaaattccctattctcatcaggaaacatagcgggagctgcatcgaaatactcagaagcattgtcattgtgtccaatgagatcgaaaaaagagagagttgttctgtacagtaatcgagctcagtgtcatcttctgttgcaacagccattggcagcaataagtgatgctacacgtgcactctgtcttcacagccctcttaaccgacatgccaaaagcctttggagaagagctcaagcttatgacatgcttgacttagcaaaagagagcttgttagatgccattttgttcattaatgaatgctctcagtcaaatgatcctgacctctctttgaggcagaacaaagttcctgactatgctgagcgactagtcaaaaagcagatgcgtgcagcctggttatttagagaggcagccatcaaacatgggggtgtccatggtgagggagatgctggtgacatctatggccaggaaagtgatggttcagaatgggaaacagcgagtgaaagtgacataggaaacgatggaagggctgaaatgggtgacgacgacgatgatgatagtgaatggaagaacgaggataagaggaaagataaatatgataaagtaacattaaaagatttaaagcatgggtacaatgtgcatcttgcggaagatcaatcttgaatccgggccagctggtgatcgctcaaatgttgacataaattcaaacaacgatggagaggcaccatgaaaataggtcagcacgagtcattcaaaactaccaacaaatcctgtatggtttcatgagaagcaagtacgatagaaacatgtgattggctatggtgtccgtaagcaaacttgttctccaagttttgttcatttctttaatttttgttccctgattcttgttgatttcaactgtagaaattgaacgaaaaaaaggttttgagtgtagagcacaatttttagtctagagaatgcgaagcttttgagtgatttatggaagcttgtatatataaaccatctgcaactctcaattcttttctctcgagtgatcattacctatatttactatgca

SEQ ID NO: 3148 - DNA, 2511 bp, Cajanus cajan
cagttttgaagtggttttcttgcttcagctacctgatgaggaattgatttgttgatatatgaggttgttgttctaatttagctagcatggataaagtttcatcagattgtccatacccgggatgcttcttttgtgttatgaaggaagggaatccaagcaaacgcagagcaagtgtactgaaattctttagagaacttccgtgtcaagatgatgatggtcaggttctcccgatcagtggcctttggaacacagctatggcacatccaaatgacccagaattcatagagctgggaatatttgaatgcatgtctgctctcatatggaagggtctgaagaaccggcgctggctttctcatgaccaaaatatatacattccttattatgcagctcatatcattggttcctacacaatgaatatggaggaatttgcagaaaatgctgtgcatgctggggtcattcctcccttggttgagcttttaagaggtagattaacttgggttgagcagagggtagcagttagagcattgggacatttagctacatatgccagcacctttcctgccatagcaagtcatggtgaaattcttgagctgtccatccaattggcaatgagttcgttggaaatagtttattcacacttttaccaatatgttgatagaaggcttagttatcactgtgatctgcttacacgtggtatgggcggtgttgaaatggaatccaggaaggcggaggaatgggctagtcagttgcagtgttggtcgcttcagctaattaattgctttgcttttaaacaggagttccttcctaccatatgcaaacctgaatttctgacaaaactacctggcatgtggggtggacttgttaacgaaaattcaccggctggtattggtttattaagaacaatttgtcatcaaaagcttggtaggggtcctgttgctagttgccctggtattattgatgcattgtgcaatattgctcagtcttcagatgattggcagtatatggctattgattgtcttctatggctgcttcaagatcccaatacatgccacaaggtgattgataaagtggtgcctgcattagttgaccttgcggagattacaactctgggtgatcataaaaagcttggtgattcaattgttaatgttcttcaagagtgcatccagtctcaagggtcaggacgaagctcaactagcagtcgcactaaagaacagattgaggatatattaaattcaaaacagagattaaagtgggaaaagagtatgcccaaggaagatctacatattaagcaggctgcagcattggttgtcaagctcgaaggaaattccctgttctcatctggaaatatttctggagcagcatcgaaatactctgaagcattggcattgtgtcctatgagatccaggaaggagagagttgttctatatagtaatcgtgctcaatgctatcttttgctgcaacaacctttggctgccataagtgatgctacccgtgcgctatgtctccataaacctgtcaatcgtcatgccaaaagcctctggagacgagcacaagcttatgacatgcttggattagcgaaagagagtttattggatgctattttatttataaatgagtgctctcagtcaaatgatcctgatctctcactgaggcaaaataaagttccagattatgccgagcggctagttaagaagcagatgcgtgctgcttggttatttcgagaggcagctattaagcatggtggggtccatagtcagggtgatggaggtgatatgtatggcccggagactgatgattctgaatgggagacagctagtgaaagtgatataggtaatgatggaagggatgatatgggcgatgatgacgatggtgattggaataatgatgacgagaggaaagattatgacaaaccttcaatgaaagatataaagcatggatacaatgtgcagcttgcggaagaagaaccttgacatagttatcctcgcaattaggtgcaattgttctccagcatgaatgaagcagagttggctcctgtgactattctgactctacatgctttgtgggctttaaaagagaaaattaaaattctaagtccctcgttgtaagtggcgggttgaaagtgatgaccgagtttttggtcttcctatttgaggttgaggtttattttatataaagttttccatgttccatatttgttctccccatttttcttgtcaagtgtaaaaattgaagatttcaagtttggagaactacatagcgtttggaagatgtgaaggttttttttttttttttgaggtttgtgtatataaaccctttgtgcttaagttttcattgagtccttttccactgctattccgatcgcagtttgcctgattagttggccatgttatattttctctttcagctacctgatgattggcttctaatttcgaaaatagttatgtactctaagtgctgttgagaaagtaattattatttttaatgaagttaagcataaaacttacgtataaa

SEQ ID NO: 3149 - DNA, 1973 bp, Manihot esculenta
ttcaccgatcgatgaagaattgacctggtggtgtgtgaatcctatccagttgaatatctgagcatggataaagtatcgccagactgtccatacccaggatgctttttctgtgtcatgaaggaaggaaatccaagcaaacgtagagcaagtatattgaaattttttagggaacttccttcacaggatgatgatggccaggttctcccaatcagtggtctatggaacactgccatggcacatcccaatgatcctgaattcattgagttgggaatatttgaatgcatggctgcacttatatggaaaggcttaaaaaatcgtcggtggctttctcatgatcagaatatttacattccttattatgctgctcatattattggttcctacaccatgaatatggaggaatttgcagaaagtgctgtccatgctggtgtaatacctcccctggttgagcttttgagggggagattgacatgggttgaacaaagagtggcagtacgagcgctagggcacttggctacatatgccagcacttttcctgctgtggcaagtcatggtgaaatccttgagctttccattcaacttgcaatgagttcacttgagatagtttactctcatttttatcagtatgtcgatagaagactaagttatcactgtgatctgcttactcgtggcatgggaggtgttgaaatggagtccaggaaagcagaggaatgggccagtcagttgcaatgctggtcacttcagcttattaattgttttgctttcaagcctgaatttcttcctaccatttgcaagcctgaatttttagtaaaactgccaggcatgtggggtggacttgtcaatgaaaattcaccagctggtattggtttattgagaacaatttgtcatcataagcttggtaggggacctgttgccagctgtcctggtataattgaagcattgtgcaacattgctcgctcgtcagatgattggcagtatatggctatagattgtcttctttggttgcttcaagatccaaatacatgccataaggtgattgataaggcagtacctgccctcatagaccttgcagatatcacagctctgggtgatcacaaaaagcttggtgattccattgttaatgttcttcaggattgtattcaatcactagggacagggcgtaactctgttagtaaccgcacaaaagaactgattgaggaactattaaattcaaaacaaaggttgaaatgggaaaaaaatatgccaaaagaagatctacatattaagcaggcagcagcattagtggtcaagcttgaagggaattccctcttctcatcaggaaatatatctggagctgcatcaaagtactctgaagcattgtcattgtgtccaatgagatccaaaaaagagagagtcgttctatacagtaatcgagctcagtgtcatcttctattacaacagcccttggctgccataagtgatgctacgcgtgccctttgtcttcacaaccctcttggccgccatgcaaaaagcctttggagaagagcgcaggcatatgacatgctgggattagctaaagagagcttgttagatgccattctgttcattaatgagtgctctcaatcaaatgatcctgaactatgtttgagacaaaataaagtgcccgactatgcagagcgcctagtcaagaagcagatgcgtgcagcctggctatttagagaggctgctatcaaacatgggggtgtccactgtgagggagatgctgttgatgtttatggccaagacactgatgattcagaatgggaaacagcaagtgaaagtgacataggaaatgatggaagagatgaaatgggcaatgatgatgatgatgatagtgaatggaagaatgaagatgagaggaaagataaatatgataagccatcattaaaagaaataaagcatgtatacaatgtgcagcttgcagaagatgaatcttgattcggaagagatcaact

SEQ ID NO: 3150 - DNA, 2666 bp, Theobroma cacao
agtcaagctcctaacttttcttaccactgctgcataaataagttttaaacaaatttcttcatttgcaagctagatgctgatctaaatcatcattgttatgcagtgttgaggctttcttatatgatttcccatgtggtgaggaatctacttggtgccatatgaatcttatgcagataacaatctgaacatggataaagtatctccggattgtccatacccagggtgctttttctgtgtcatgaaggaaggaaatccaagtaagcgcagagccagtattctgaaattctttagagaccttccttcacaagatgatgatggtcaagttctacctatcagtggcctttggaatactgccatggcacatcctaatgatcctgaattcattgagttggggatctttgagtgcatggctgcactaatatggaagggtctcaaaaatcgccgctggctttctcatgaccaaaacatatatattccttattatgcagcacatattattggatcctacaccatgaacatggaagagttcgctgaaagtgctgtgcatgctagtgtaattcctcccttggttgagcttttgagagggaggttgacttgggttgagcaaagagtggctgtgcgagctctaggacacttggctacatatacaagcacttttcctgctgtagcaagtcatggagaaattcttgaggtctccattcagctagcaatgagttcactggaaatagtttactctcacttttaccaatatgttgatagaaggctaagttatcactgtgatttgcttactcgtggtatgggtggtgttgaaatggagtcaaggaaggcggaagaatgggccagtcagctgcaatgttggtctcttcaactcattaattgctttgcttttaagcctgagtttcttcccaccatatgcaagcctgaatttcttgtaaagctaccaggaatgtggggtggacttgttaatgaaaactcaccagctggtattggtttgttaagaaccatctgtcatcataagcttggtaggggacctgttgctagctgtcctggcattatcgaagcattgtgtaatattgctcgctcatcagatgattggcagtatatggctattgattgtcttctttggttgcttcaggatccaagcacatgtcataaggtgatagataaggcagtacctgctctagtagaccttgcagagattacaactctgggtgatcacaaaaagcttggagattccattgttaatgttcttcaggaatgtattcaatctcaagggacaggacgcagctctctcagtaaccgcacaaaagaactgatcgaagaactgttgagttcgaggcagagattgaagtgggaaaagaatatgccaaaggaggatctccatattaaacaggctgctgctttagtggtcaagctcgaaggaaactctcttttctcatcaggaaatatatctggagctgcatcaaaatactcagaagcattatcattgtgtccaatgagatccaagaaagagagagttgttctctacagtaatcgagctcagtgtcatcttctattgcagcaaccatcggcagccattagtgatgctacacatgcattatgtcttcacaacccacttaaccgtcatgccaaaagcctatggagacgagctcaggcttatgacatgcttggtttagctaaagagagcttgctagatgccattctcttcataaacgaatgctcccagtcaaatgaccctgatctttcattgaggcaaaataaggttcctgactatgctgaacggctagtgaagaagcagatgcgtgcagcttggttatttagagaggcagctatcaaacttgggggtgtgcactgtgagggtgatgcaggtgacatgtatggccaggatactgatgactctgaatgggagacagctagtgaaagtgatattggaaatgatggaagggatgaaatgggtgatgatgatgatgatgatgatagcgaatggaagaatgaagatgagaggaaagataaatatgaaaaaccctcaatgaaagacataaagcacggattcaatgtgcagctcactgatgaaccatgagtgtttgatgaaggacaaacagcttggatgtagccgtccagtgaacaaaagctaccatgatttggcatttgttatctcatactccgaagctatagcctagttgtgcttaaagttgctctcatgtctggcttagtgttagaagaagcaagtgagaaggaaaatttgtcttttgtcattgtttttagaggtaaaacttgcttttacaaacatttcttcttggtttttttttttcctgatttgttcttgttaatttcaactgtagaaagtgacaatagattttgagtgtagagaaccattttgtctggaggggtttgaagctttgagtgatctcaagatccttgtgtatataaaacccttaagggtttttgacactgaactatcatatttgaatgataattgtgatctcttatgatggttcaatattttattgtgtgggaaaagtactggataatcatgctagttatgaggtttatgggaagggttatatcaacaactaagtatatttagctcaatgttcggtgcatgtattttcttttcaaagagtttgttccaatctctttctcaccaataaaaaaattgcgcgatt

SEQ ID NO: 3151 - DNA, 2816 bp, Gossypium raimondii
catttatttttccttctttccttttagtttttgattcttcaagttttcattacatgaacacaagatcttcgctttgctctgccagaatccagacctgaaatcaaacttaagagcaaaagaaaaacctgaaaccaaagcatctccataggtttcttggtattacaatctctgttctaagttcttgaaagcttccgttttgagcaaagaactgaaagctctaccacaggcaaatagaaaaggaaaagcctgttactttttctttttcagcatccgattcttacaagtgttgacgcttttttatattaactcccatgtggtgatgctataagaatcttatgctggtaataatctgaacatggataaggcatctccagattgtccgtaccccgggtgctttttctgtgtcatgaaggaaggaaacccgagcaagcgcagagccagtattctgaaattctttcgagatcttccttcacaagatgatgatggtcaagttcttcctatcagtggcctttggaatactgctatggcacatcctaatgatcctgaattcattgagttagggatttttgagtgtatgtctgctctaatatggaagggtctcaagaaccgccgctggctttctcatgaccaaaatatatacattccttattatgcagcacatattattggatcctacaccatgaacatggaagagtttgcggaaagtgcagtgcatgctggtgtaattcctcccttagttgagcttttgagagggaggttgacttgggttgaacaaagagtggcagtgcgagctttaggacacttggctacatatacgagcacttttccttctgtagcaagtcacggagaaattcttgaggtcgccattcagctagcaatgagttcactggaaatagtttactctcacttctatcagtatgttgatagaaggttaagttatcactgcgatctgcttactcgtggcatgggtggtgttgaaatggagtcaagaaaagctgaagaatgggctagtcagcttcaatgttggtcccttcaactcattaattgcttcgcattcaaacctgagtttcttcccaccatatgcaaacctgaatttcttgtaaaactaccgggaatgtggggtggacttgttaatgaaaactcacctgctggtattggtttgttaagaaccatctgtcatcataagattggtaggggatctgttgccagctgtcctggcattatcgaagcgttggttaatattgcttgctcgtctgatgattggcagtatatggcaattgattgtcttctttggttgcttcaagatccaagcacatgtcataaggtgatcgataaggcagtacctgctcttgtagaccttgcagagattacgactcttggtgatcacaaaaagcttggagataccattgttaatgttcttcaggaatgtattcaatcccaagggacgggacggagctctgtcagtaaccggacaaaagagctaattgaagaactattgagttcaaggcagagattgaagtgggaaaagaatataccgaaggaggatctccacattaaacaggctgctgctttagtggtcaagctcgaaggaaactcacttttctcatcaggcaatatagctggagccgcatcgaagtactcagaagcattatcgttatgtccgatgagatccaagaaagagcgagttgttctctacagtaatcgagctcagtgtcatcttttattgcagcaacccttggctgccataagtgatgctacacgtgcattatgtcttcataatccattgaaccgtcatgccaaaagcctatggagaagagctcaggcttatgacatgcttggtttagctaaagagagtttgctagatgccattctcttcataaatgaatgctcgcaatcaaatgaccccgatctctcgttgaggcaaaataaggttcctgattatgcggaacgattagtcaagaagcagatgcgtgcagcttggttatttagagaggcagctatcaaactcgggggtgtgcactgtgagggtgatgcaggtgacatgtatggccaagataccgatgactccgagtgggaaacagctagcgaaagtgatataggaaatgatggaagggatgaaatgggtgatgaggacgacgatgatagtgaatggaagaacgaagatgaaaggaaagctaaattcaagaaaccctcaatgaaagacataaagcatggattcaacgtacaactcaccgaagatgaaccgtgaactgttgaaggaccaacagcattgatgtagacagtgtagcgaaccaaagcaaccgtgatatatgtttcggatttattatttcgtgttgcagagctatagcctagtcacgtttagaagttggtgtcacatctagctcagtgaagaagcaagttagaggtggtgaagctttggttttggtcattttcatttagagataaaagaactttgttttgcaagcatttcttatttgttttttttttcttatttcctattgattttggtaatgttaatttcaactgtagaaagcgagagtttggagtgtagagaaccattttgtttgcagggtgtgatgaagcttttgtgagaaatcttatgctccttgtgtatataaaaacccttgaaggggggtttttgacattgaactatcatcatatatttgaatcatagtttgcccttttatgataattcttggaatcgtagtacgtgagtttaagtaagggtgtaatcgagttgagctgagttcgaatattgtcaagttcgaattcgattctaaattcaaaactctatatttagttcggattcgatcgaa

SEQ ID NO: 3152 - DNA, 2630 bp, Gossypium hirsutum
cttcgctttgctctgtcagaatccaaacctgaaatcaaacttaagagcaaaagaaaaacctgaaaccaaagcatctccataggtttcttggtattacaatctctgttctaagttcttgaaagctcccattttgagcaaagaactgaaagctctaccacaggcaaataaaaaggaaaagcctgttactttttctttttcagcatctgattcttacaagtgtcgaggcttttcgatattaactcccatgtggtgatgctataagaatcttatgctggtaataatctgaacatggataaggcatctccagattgtccgtaccccgggtgctttttctgtgtcatgaaggaaggaaacccgagcaagcgcagagccagtattctgaaattctttcgagatcttccttcacaagatgatgatggtcaagttcttcctatcagtggcctttggaatactgctatggcacatcctaatgatcctgaattcatcgagttagggatttttgagtgtatgtctgctctaatatggaagggtctcaagaaccgccgctggctttctcatgaccaaaatatatacattccttattatgcagcacatattattggatcctacaccatgaacatggaagagtttgcggaaagtgcagtgcatgctggtgtaattcctcccttagttgagcttttgagagggaggttgacttgggttgaacaaagagtggcagtgcgagctttaggacacttggctacatatacgagcacttttccttctgtagcaagtcacggagaaattcttgaggtcgccattcagctagcaatgagttcactggaaatagtttactctcacttctatcagtatgttgatagaaggttaagttatcactgcgatctgcttactcgtggcatgggtggtgttgaaatggagtcaagaaaagctgaagaatgggctagtcagcttcaatgttggtcccttcaactcattaattgctttgcattcaaacctgagtttcttcccaccatatgcaaacctgaatttcttgtaaaactaccgggaatgtggggtggacttgttaatgaaaactcacctgctggtattggtttgttaagaaccatctgtcatcataagattggtaggggatctgttgccagctgtcctggcattatcgaagcattggttaatattgcttgctcgtctgatgattggcagtatatggcaattgattgtcttctttggttgcttcaagatccaagcacatgtcataaggtgatcgataaggcagtacctgctcttgtagaccttgcagagattacgactcttggtgatcacaaaaagcttggagataccattgttaatgttcttcaggaatgtcttcaatcccaagggatgggacggagctctgtcagcaaccggacaaaagagctaattgaagaactattgagttcaaggcagagattgaagtgggaaaagaatataccgaaggaggatctccacattaaacaggctgctgctttagtggtcaagcttgaaggaaactctcttttctcatcaggcaatatagctggagccgcatcgaagtactcagaagcattatcgttatgtccgatgagatccaagaaagagcgagttgttctctacagtaatcgagctcagtgtcatcttttattgcagcaacccttggctgccataagtgatgctacacgtgcattatgtcttcataatccattgaaccgtcatgccaaaagcctatggagaagagctcaggcttatgacatgcttggtttagctaaagagagtttgctagatgccattctcttcataaatgaatgctcgcaatcaaatgaccccgatctctcgttgaggcaaaataaggttcctgattatgcggaacgattagtcaagaagcagatgcgtgcagcttggttatttagagaggcagctatcaaactcgggggtgtgcactgtgagggtgatgcaggtgacatgtatggccaagataccgatgactccgagtgggaaacagctagtgaaagtgatataggaaatgatggaagggatgaaatgggtgatgaggatgacgatgatagtgaatggaagaacgaagatgaaaggaaagctaaattcaagaaaccctcaatgaaagacataaagcatggattcaacgtacaactcaccgaagatgaaccgtgaactgttgaatgaccaacagcattgatgtagacagtgtagcgaaccaaagcaaccgtgatatatgttcggatttattatttcgtgttgcagagctatagcctagtcacgtttagaagttggtgtcacatctagctcagtgaagaagcaagttagaggtggtgaagctttggttttggtcattttcatttagagataaaagaactttgttttgcaagcatttcttatttgtttttttttttcttatttcctattgattttggtaatgttaatttcaactgtagaaagcgagagtttggagtgtagagaaccattttgtttgcagggtgtgatgaagcttttgtgagaaatcttatgctccttgtgtatataaaaacccttgaagtgggggtttttgacattgaactatcatcatatatttgaatcatagtttgcccttttatgataaaaaa

SEQ ID NO: 3153 - DNA, 2806 bp, Phaseolus coccineus
atacttgtgtagtacagtgtagtagaggctcaacattattccgttgtcttccttcttcgttgctcactctctttttctcctttctctctctttcactggaattttaacctagatcaaaagatgacggtgctgtgagaaaagcgtgagtaagagagagagagagtgaggaaagttcacaaagcatccaaggaacacgtgaattccgacatgaaacggtctcaggttgtaacccaccacggcatatttggatctgtcgtttaccaacatcgccgatcttcgccgtaaacgacgcttccctgaaacgactacacactttctccttactgtttattattgcttgcaactctcttgctctatcacagcttctgtgttctgctttccctgttactgtgagaagaccgtgacttgtgtgcagttttgaagtggttttttgcttcagctacctgatgaggaattgatttgttgatgttcgaggttgttattctaatttgtcgagcatggataaagtttcatcggactgtccataccctggatgctttttttgtgtcatgaaggaagggaatccgagcaagcgcagagctagtgtactgaaattctttagagagcttccatgtcaagatgatgatggccaggttctccctatcagtggcctttggaacacggctatggctcatccaaatgacccggaattcatagagctaggaatttttgaatgcatgtctgctctcatatggaagggactgaagaaccggcgctggctttctcatgatcaaaatatatatattccttattatgcagcccatataattggttcctacactatgaatatggaggaatttgcagaaagtgctgtgcatgctggggtcattcctcccttggttgagcttttaagaggcagattaacttgggtcgagcagagggtggcagttagagcattgggacacttggctacatatgccagcacttttcctgccatagcaagcaatggtgaaattcttgagctctccattcaattggcaatgagttccctggaaatagtttattcacacttctaccaatatgtcgatagaaggcttagttatcattgtgatctgcttacacgcggtatgggtggtgttgaaatggagtccaggaaggccgaggaatgggctagtcagttgcagtgttggtcccttcagctaattaattgctttgcctttaaacatgaatttcttcctaccatatgcaaacctgaatttctgataaaattacctggcatgtggggtggacttgtgaatgaaaattcaccagctggtattggcttattaagaacaatttgtcatcaaaagcttggtaggggacctgttgccagttgccctggtattattgacgcattgtgtaatattgctcgctcttcagatgactggcagtatatggctattgattgtcttctatggttgcttcaagatcccaatacatgtcacaaggtgattgataaagtggtgcctgtattagttgatcttgcggagattacaactctgggtgatcacaaaaagctcggtgattcaattgttagtgttcttcaagagtgcatccaatctcaagggtcaggtcgaagctcaattagtagtcgtactaaagaacagattgaggatatattaaattcaaagcagagattgaagtgggaaaagaatatgcccaaggaagatctacatattaagcaagccgcagctctggttgtcaagcttgaaggaaattccttgttctcatctggaaatatttctggagctgcatcaaaatattctgaagcattgtcattgtgtcctatgagatccaggaaggagagagttgttctatatagtaatcgggctcaatgccatcttttgctgcaacaacctttgactgccattagtgatgctacccgtgcactatgtctccataaacctgtcaatcgccatgccaaaagcctctggagacgagcacaagctaatgacatgcttggattagcgaaagagagtttgttagatgctattttatttataaacgagtgttctcagtcaaatgatcctgatctttcattgaggcaaaataaagttccagattatgcagagcgtttagttaagaagcagatgcgtgctgcttggttattccgagaggcagctgttaagcatggtggggtccatagtcagggtgatggtggtgatatgtatggcccagagactgatgattctgaatgggagacagctagtgaaagtgatataggaaatgatggaagggatgatatgggcgatgatgacgatggtgattggaataatgatgagagtaaagcctatgacaaaccttcaatgaaagatataaagcatggatacaatgtgcaacttgcggaagaagaaccttgacatagaaatccttgcatttagtgcaatatttctctggcacgaatgaagcagggttggatgctgtgactattcttactctacatgtgggcttttaaaagagaaaattcccaacttaagtgacgggttgaaagtgatgactgagtttttggtcttactattatttgaggttgatattttatataaagttttccatgttccatatttgttctccctatttttcttgtcaagtgtaaaaatcgaagatttttagtttggagaactgcatagcgttggaggatgtgaagttttttttcttccggaggtttgtgtatataaactctttgtgcttatgctttatttgggtctgtttccactattatttttattacagattgcctcgtaagcttgtccatgttatattttcttgcactacagaaattggtttttaa

SEQ ID NO: 3154 - DNA, 2700 bp, Glycine max
agaaggagagagccaaaaattcataaagcatccgaggaacacgtgaattccgacatgtaacggtcgaaagttgtaacccacgacgacgaatttggatctgtcgtttacaaccattgccgatctccgccttaaacgacgcttcactgaaaccaccagactcttcctcctcaccgttacaacttcacagcttctgtgtagtgttctacttttcccgttactgtcagaagaccgttgaacaacgaggttttgaagtggttttctttcttcagctgcctgatgaggaattgatttgttgatctccgaggttgttgttctaatttatcgagcatggataaggtttcatcagactgtccgtacccgggatgcttcttttgtgtcatgaaggaagggaatccaagcaagcgcagagcaagtgtactgaaattctttagagaacttccgtgtcaagatgatgatggtcaggttctccctatcagtggcctttggaacactgctatggcacacccaaatgacccggagttcctagagctaggaatatttgaatgcatgtctgctctcatatggaagggactgaagaacaggcgctggctttctcatgaccaaaatatatatattccttattatgcagctcatatcatcggttcctacacaatgaatatggaagaatttgcagaaagtgccgtgcatgctggggtcattcctcctttggtcgagcttttacgaggtagattaacttgggttgagcagagggtggcggttagagcattgggacacttggctacatatgccagcacttttccagccatagcaagtcatggtgaaattcttgagctctccatccaattggcaatgagttccctggaaatagtttattcacacttttaccaatatgttgatagaagacttagctatcattgtgatctgcttacacgtggcatgggtggtgttgaaatggagtccaggaaggctgaggaatgggctagtcagttgcagtgttggtcccttcagctaattaattgctttgcttttaaacatgaatttcttcctaccatatgcaaacccgaatttctgataaaactacctggcatgtggggtggacttgttaatgaaaattcacctgctggtattggtttattaagaacaatttgtcatcaaaaacttggtagggggcctgttgccagttgccctggtattattgatgcattgtgtaatattgctcggtcttcagatgattggcagtatatggctattgattgccttctatggctgcttgaagatcccaatacatgtcacaaggtgattgataaagtggtgcctgcattagttgaccttgctgagattacaactctgggtgatcataaaaagcttggcgatttagttgttaatgttcttcaagagtgcatccagtctcaagggtcaggacgaagctcgattagtagtcatactaaagagcagattgaggatattttaaattcaaagcagagattaaagtgggaaaagaatatgcccaaggaagatctacatattaagcaggctgcagcgctggttgtcaaacttgaaggaaattctctgttctcatctggaagtattgctggagctgcatcaaaatactctgaagctttggcattgtgtcctatgagatcaaggaaggagagagttgttctatacagtaatcgtgctcaatgccaccttttgctgcaacaacctttggctgccataagtgatgctacccgtgcactatgtctccataaacctgtcaatcgtcatgccaaaagcctttggagacgagcacaagcttatgacatgcttggattagcgaaagagagtttattggatgctattttatttataaatgagtgctctcagtcaaatgatcctgatctctcactgaggcaaaataaagttccagattatgccgagcgtttagttaagaagcagatgcgtgctgcttggttatttcgagaggcagctattaagcatggtggggtccatagtcagggtgatggcggtgatatgtatggcccagagactgatgattctgaatgggagacagctagtgaaagtgatataggaaatgatggacgggatgacatgggcgaagacgacgatggtgattggaataatgatgatgagaggaaaaattatgacaaaccctcgatgaaagcatcacttgaccacccttcggaacgctgataaaaccagacgtcctgtacttcttgccttggtactgtgtctgataaaaccattgaatagttcagatcgttgccctttatatgatataaagcatggatacaatgtgcagcttgcggaagaagaaccttgacaatagtaatccttgcatttaattgttctctccagcacgaatgaagcagggttggctgctgtgactaactctacatgctttgtgggatttaaaagagaaaattctaagtcgctcgttgtagtaagtggcaggttgaaagtgatgagtgagtttttggtcttacgattatttgaggttgataatttatataaacttttccatgttccatatttgttctccccatcgttcttgtcaagtgtaaaaattgaagattttaagtttggagaactacatagcgtttggaggatgtgaagtttttttttttttcctttattttccccggaggtttgtgtatataaatcctttgtgcttaagttttctgagtccgtttccactat

SEQ ID NO: 3155 - DNA, 2266 bp, Glycine max
catggataaagtttcatcagactgtccgtacccgggatgcttcttttgtgtcatgaaggaagggaatccaagcaagcgcagagcaagtgtactgaaattctttagagaactaccgtgtcaagatgaagatggtcaggttctccctatcagtggcctttggaacacggctatggcacatccaaatgaccctgaattcatcgagctaggaatatttgaatgcatgtctgctctcatatggaagggactgaagaaccggcgttggctttctcatgaccaaaatatatatattccttattatgctgctcatatcatcggttcctacacaatgaatatggaagaatttgcagaaagtgccgtgcatgctggggtcattcctcctttggttgagcttttacgaggtagattaacttgggttgagcagagggtggcagttagagcattgggacacttagctacatatgccagcacttttcctgccatagcaagtcatggtgaaattcttgagctctccatccaattggcaatgagttccctggaaatagtttattcacacttttaccaatatgttgatagaaggctcagttatcattgtgatcttcttacacgtggcatgggtggcgttgaaatggagtccaggaaggctgaggaatgggctagtcagttgcagtgttggtcccttcagctaattaattgttttgcttttaaacatgaatttcttcctaccatatgcaaacccgaatttctgataaaactacctggtatgtggggtggacttgttaatgaaaattcaccagccggtattggtttattaagaacaatttgtcatcaaaagcttggtaggggacctgttgccagttgccctggtattattgatgcattgtgtaatattgctcggtcttcggatgattggcagtatatggctattgattgccttctatggctgcttcaagatcccaatacatgtcacaaggtgattgataaagtggtgcctgtattagttgaccttgctgagattacaactctgggtgatcataaaaagcttggtgattcaatccttaatgtttttcaagagtgcatccagtctcaagggtcaggacgaagctcaattagtagtcacactaaagaacagattgaggatatattagattcaaagcagagattaaaatgggaaaagaatatgcccaaggaagatctgcatattaagcaggctgcagcgctggttgtcaagcttgaaggaaattccctgttctcatctggaaatattgctggagctgcatcaaaatactctgaagcattggcattgtgtcctatgagatccaggaaggagagagttgttctatatagtaatcgtgctcaatgccatcttttgctgcaacaacctttggctgccataagtgatgctacccgtgcactatgtctccatagacctgtcaatcgtcatgccaaaagcctctggagacgagcacaagcttatgacatgcttggattagcgaaagagagtttattggatgctattttatttataaatgagtgctctcagtcaaatgatcctgatctctcactgaggcaaaataaagttccagattatgctgagcgtttggttaagaagcagatgcgttctgcttggttatttcgagaggcagctattaagcatggtggggtccatagtcagggtgatggtggtgatatgtatggcccagagactgatgattcggaatgggagacagctagtgaaagtgatataggaaatgatggacgggatgacatgggtgatgacgacgatggtgattggaataatgatgatcagaggaaagattatgacaaaccttcaatgaaagatataaaacatggatacaatgtgcagcttgcggaagaagaaccttgacatagtaatccttacatttgttgcaattgttctctccagcatgagtgaagcagggttggctgctgcgactattcaaactctacatgctttgttggctttaaaagagaaaattctaagtcgctcgttgtagtaagtggcgggttgaaagtgatgactgagtttttggtcttactattatttgaggttgatattttatagaaagttttccatgttccatatttgttctccccatttttcttgttaagtgtaaaaattgaagatttcaagtttggagaactacatagcgtttggaggatgtgaagtttttttttttttatcccccgaggtttgtgtatataaaccctttgtgttttaagttttctcagtccgtttccacaatta

SEQ ID NO: 3156 - DNA, 2509 bp, Quercus alba
ctagttgttcggtttggctaaggattttttcttttgttgttagttcccttgttgtacttgttacaaaacgagttcgtcgtccgagtgttgaagaatttattcagttcagctagttgatgaggaattaacttgtcagctctatgaatactgattagttcattgctgagcatggataaagtatcatctgactgtccgtatccaggttgcttcttctgtgtcatgaaggaaggaaatccgagcaagcgcagagcaagtatactgaaattctttagagaacttccttcacaggatgatgatggtcaggttctcccaatcagtggtctttggaatactgccatggcacacccaaatgaccaggagtttattgatttgggaatatttgaatgcatggctgcactcatatggaagggcctaaaaaatcgccgttggctttctcatgaccaaaacatatacattccatactatgcagcccatattattggatcctacaccatgaacatggaagaatttgcagatagtgctgttcatgctggagtgatccctccattggttgaacttctgagagggaggttaacttgggttgaacaaagagtagcagttcgagctttaggacacttggctacatattccagcacttttcctgctttagcaagtcatggtgagattctggagctttccattcagctagcaatgagttccctagaaatagtttactcacatttttaccagtatgttgatcgaaggctaagttatcactgtgatctgcttacccgtggcatgggtggtgttgaaatggagtccagaaaggcagaagaatgggctagtcagttacagtgctggtcccttcagctcatcaattgctttgcttttaaacctgaatttctttctactatatgcaagcctgaattcttaataaagctaccaggaatgtggggtggacttgttaatgaaaattcacctgctggtattggtttattaagaacaatctgccatcataagctgggcaggggacctgttgctagctgtactggcattattgaagcattgtgcaatattgctcgatcatcagatgattggcaatatatggctattgattgtcttctatggttgctacaagacccaagtacttgtcataaggttatcgataaggcggtaccagcacttgtagatcttgcagagatatcagctctaggtgatcacaagaagcttggtgataccattgtatctgttcttcaggaatgcatccaatcacaagggaatggacgtaactctctcagtaaccgcacaaaagaacagatcgaggaactactaaattctaggcagagattgaaatgggaaaagagcatgccaaaggaggatctccacattaaacaggcagcagccctagtggtcaagcttgagggaaattccctcttttcatcaggtaatatatctggagctgcatcaaagtactcagaagcattggcattgtgtccaatgagatccaagaaagaaagagtggttttgtacagtaatcgagctcagtgttatcttcttttgcaacaacctttgtttgccataagtgatgctacacgtgctctttgtcttcacaatcctcttaaccgtcatgccaaaagtttatggagaagagctcaggcatatgacatgctgggtttagctaaagagagtttgttagatgccattctgttcataaatgagtgctctcaatcaaatgaccctgatctgtcattgaggcaaaataaggttcctgactatgctgaacgattagtgaagaagcagatgcgtgcagcttggttattcagggaggcagctatcaaacatgggggtgtccattgtgagggtgatgctggtgacatctatggccgagagactgatgattccgagtgggagacagctagtgaaagtgatattggaaatgatggaagagatgagatgggcgatgatgatgatgatgacagtgaatggaagaatgaggacgagaggaaagataaatatgataaaccctcgataaaagaaccttgatatggaacagacataaagcatggatacaatgtgcagcttgcggaggatgaaccatgaattgtagatgagtgaaccatcatcaaatagaaacacttattgtgacatacataacaaggccatgaatgaagcagatttgttgggtttcacgttcggcacctatagccaccttgatagcagtggcagttgtaacttccatctcatatcaagcagcttggaaaggaaacatgttttgggtcattgtgtttgagagcaaaaacttgttttatatcattgttattattatcattttcttttcttttccattttcattttttaacaaaattttcttattaaaatcaactgtagaaaaatgaacaaagattttgagtctagagtatgtgaaacttttcaagtgatgtaagaggcttgtatatataaaaccttggggtttattgaatttgaaatgcatatttctgtatttgaatgatagtgtgaatgtatgcttttc

SEQ ID NO: 3157 - DNA, 2619 bp, Gossypium hirsutum
gctttgctctgtcagaatccaaacctgaaatcaaacttaagagcaaaagaaaaacctgaaaccaaagcatctccataggtttcttggtattacaatctctgttctaagttcttgaaagctcccattttgagcaaagaactgaaagctctaccacaggcaaataaaaaggaaaagcctgttacttttctttttctagcatctgattcttacaagtgtcgaggcttttcgatattaactcccatgtggtgatgctataagaatcttatgctggtaataatctgaacatggataaggcatctccagattgtccgtaccccgggtgctttttctgtgtcatgaaggaaggaaacccgagcaagcgcagagccagtattctgaaattctttcgagatcttccttcacaagatgatgatggtcaagttcttcctatcagtggcctttggaatactgctatggcacatcctaatgatcctgaattcatcgagttagggatttttgagtgtatgtctgctctaatatggaagggtctcaagaaccgccgctggctttctcatgaccaaaatatatacattccttattatgcagcacacattattggatcctacaccatgaacatggaagagtttgcggaaagtgcagtgcatgctggtgtaattcctcccttagttgagcttttgagagggaggttgacttgggttgaacaaagagtggcagtgcgagctttaggacacttggctacatatacgagcacttttccttctgtagcaagtcacggagaaattcttgaggtcgccattcagctagcaatgagttcactggaaatagtttactctcacttctatcagtatgttgatagaaggttaagttatcactgcgatctgcttactcgtggcatgggtggtgttgaaatggagtcaagaaaagctgaagaatgggctagtcagcttcaatgttggtcccttcaactcattaattgctttgcattcaaacctgagtttcttcccaccatatgcaaacctgaatttcttgtaaaactaccgggaatgtggggtggacttgttaatgaaaactcacctgctggtattggtttgttaagaaccatctgtcatcataagattggtaggggatctgttgccagctgtcctggcattatcgaagcgttggttaatattgcttgctcgtctgatgattggcagtatatggcaattgattgtcttctttggttgcttcaagatccaagcacatgtcataaggtgatcgataaggcagtacctgctcttgtagaccttgcagagattacgactcttggtgatcacaaaaagcttggagataccattgttaatgttcttcaggaatgtcttcaatcccaagggacgggacggagctctgtcagcaaccggacaaaagagctaattgaagaactattgagttcaaggcagagattgaagtgggaaaagaatataccgaaggaggatctccacattaaacaggctgctgctttagtggtcaagcttgaaggaaactctcttttctcatcaggcaatatagctggagccgcatcgaagtactcagaagcattatcgttatgtccgatgagatccaagaaagagcgagttgttctctacagtaatcgagctcagtgtcatcttttattgcagcaacccttggctgccataagtgatgctacacgtgcattatgtcttcataacccattgaactgtcatgccaaaagcctatggagaagagctcaggcttatgacatgcttggtttagctaaagagagtttgctagatgccattctcttcataaatgaatgctcgcaatcaaacgaccccgatctctcgttgaggcaaaataaggttcctgattatgcggaacgattagtcaagaagcagatgcgtgcagcttggttatttagagaggcagctatcaaactcgggggtgtgcactgtgagggtgatgcaggtgacatgtatggccaagataccgatgactccgagtgggaaacagctagcgaaagtgatataggaaatgatggaagggatgaaatgggtgatgaggacgacgatgatagtgaatggaagaatgaagatgaaaggaaagctaaattcaagaaaccatcaatgaaagacataaagcatggattcaacgtacaagtcaccgaagatgaaccgtgaactgttgaaggaccaacagcattgatgtagacagtgtagcgaaccaaagcaaccgtgatatatgtttcggatttattatttcgtgttgcagagctatagcctagtcacgtttagaagttggtgtcacatctagctcagtgaagaagcaagttagaggtggtgaagctttggttttggtcattttcatttagagatgaaagaactttgttttgcaagcatttcttatttgtttttttttttcttatttcctattgattttggtaatgttaatttcaactgtagaaagcgagagtttggagtgtagagaaccattttgtttgcagggtgtgatgaagcttttgtgagaaatcttatgctccttgtgtatataaaaacccttgaaggggggtttttgacattgaactatcatcatatatttgaatcatagtttgcccttttatga

SEQ ID NO: 3158 - DNA, 2718 bp, Gossypium hirsutum
gggctaaagcggaaccgcgctctgcagtcgacctaccggatccaaacaattcgcacgatcaagttttcattacatgaacacaagaacttcgctttgctctgccagaatccagacctgaaatcaaacttaagagcaaaagaaaaacctgaaaccaaagcatctccataggtttcttggtattacaatctctgttctaagttcttgaaagctcccattttgagcaaagaactgaaagctctaccacaggcaaatagaaaaggaaaagcctgttactttttctttttcagcatccgattcttacaagtgttgacgcttttttatattaactcccatgtggtgatgctataagaatcttatgctggtaataatctgaacatggataaggcatctccagattgtccgtaccccgggtgctttttctgtgtcatgaaggaaggaaacccgagcaagcgcagagccagtattctgaaattctttcgagatcttccttcacaagatgatgatggtcaagttcttcctatcagtggcctttggaatactgctatggcacatcctaatgatcctgaattcattgagttagggatttttgagtgtatgtctgctctaatatggaagggtctcaagaaccgccgctggctttctcatgaccaaaatatatacattccttattatgcagcacatattattggatcctacaccatgaacatggaagagtttgcggaaagtgcagtgcatgctggtgtaattcctcccttagttgagcttttgagagggaggttgacttgggttgaacaaagagtggcagtgcgagctttaggacacttggctacatatacgagcactgttccttctgtagcaagtcacggagaaattcttgaggtcgccattcagctagcaatgagttcattggaaatagtttactctcacttctatcagtatgttgatagaaggttaagttatcactgcgatctgcttactcgtggcatgggtggtgttgaaatggagtcaagaaaagctgaagaatgggctagtcagcttcaatgttggtcccttcaactcattaattgcttcgcattcaaacctgagtttcttcccaccatatgcaaacctgaatttcttgtaaaactaccgggaatgtggggtggacttgttaatgaaaactcacctgctggtattggtttgttaagaaccatctgtcatcataagattggtaggggatctgttgccagctgtcctggcattatcgaagcattggttaatattgcttgctcgtctgatgattggcagtatatggcaattgattgtcttctttggttgcttcaagatccaagcacatgtcataaggtgatcgataaggcagtacctgctcttgtagaccttgcagagattacgactcttggtgatcacaaaaagcttggagataccattgttaatgttcttcaggaatgtattcaatcccaagggacgggacggagctctgtcagtaaccggacaaaagagctaattgaagaactattgagttcaaggcagagattgaagtgggaaaagaatataccgaaggaggatctccacattaaacaggctgctgctttagtggtcaagctcgaaggaaactcacttttctcatcaggcaatatagctggagccgcatcgaagtactcagaagcattatcgttatgtccgatgagatccaagaaagagcgagttgttctctacagtaatcgagctcagtgtcatcttttattgcagcaacccttggctgccataagtgatgctacacgtgcattatgtcttcataatccattgaaccgtcatgccaaaagcctatggagaagagctcaggcttatgacatgcttggtttagctaaagagagtttgctagatgccattctcttcataaatgaatgctcgcaatcaaatgaccccgatctctcgttgaggcaaaataaggttcctgattatgcggaacgattagtcaagaagcagatgcgtgcagcttggttatttagagaggcagctatcaaactcgggggtgtgcactgtgagggtgatgcaggtgacatgtatggccaagataccgatgactccgagtgggaaacagctagtgaaagtgatataggaaatgatggaagggatgaaatgggtgatgaggatgacgatgatagtgaatggaagaacgaagatgaaaggaaagctaaattcaagaaaccctcaatgaaagacataaagcatggattcaacgtacaactcaccgaagatgaaccgtgaactgttgaatgaccaacagcattgatgtagacagtgtagcgaaccaaagcaaccgtgatatatgttcggatttattatttcgtgttgcagagctatagcctagtcacgtttagaagttggtgtcacatctagctcagtgaagaagcaagttagaggtgtagaatctttggttttggtcattttcatttagagataaaagaactttgttttgcaagcatttcttatttgttttgtttttttttcttattttcctattgattttggtagtgttaatttcaactgtagaaagcgagagtttggagtgtagagaaccattttgtttgcagggtgtgatgaagcttttgtgagaaatcttatgctccttgtgtatataaaaacccttgaagtggggttttgacattgaactatcatcatatatttgaatcatagtttgccctttatgataaaaaa

SEQ ID NO: 3159 - DNA, 2598 bp, Cicer arietinum
ccgggctgcaggaattcgaattcctcttccccccattgatgcgcacacactctggaatcttaacctaatcaaactgacgatgatacgagaaaagtgtgaaagaatcagataaagaaaaattgtcaccaaagaatccgaatttgacaacaacaaaaatcaccaacttggatctgtcatctacattcatccccgatctacgccaaaaagtgcttcagtgttactaccacactctaacttcactactctctccattcaattttccttctacaaacacacttctacttttacttcttaccgttgaatctccctcgttacttcacagttttgaagtggtttcgttgcttgaggtacctggtgtgaattgacctgttgatctgtgagactattgttctaaatcacaaagcatggataaggtttcatcagattgtccatacccaggatgcttcttttgtgtcatgaaggaagcgaatccaagcaaacgcagatcaagcgtactgaagttctttagagaacttccatgtcaagatgacgatggtcaggttctccctatcagtggcctttggaacacagcaatggcacatccgaatgaccctgaattcatagagctgggaatatttgaatgcatgtctgctctcatatggaaaggactgaagaatcgacgttggctttctcatgaccaaaatatatatattccttattatgcagctcatatcattggttcatacacaatgaatatggaagaatttgctgaaagtgccattcatgctggggtcattcctcctttggttgagcttttaagaggtagattgacttgggttgagcagagggtagcagttagagctttgggacatttagctacatatgctagcacttttcccgctgtagcaagccacggtgaaattctcgagctctctatccaattagcaatgagttccttggaaatagtttattcccacttttaccaatatgctgatagaaggctaagttaccactgtgatctgcttacacgcggcatgggtggtgttgaaatggagtccaggaaggccgaggaatgggctagccaactgcaatgttggtcccttcagctcatcaattgctttgctttcaaaccagaatttcttcctaccatatgcaaacaagaatttctaacaaaactacctggtatgtggggtggacttgttaatgaaaactcaccggctggtattggcttattaagaaccatttgtcatcagaagcttggtaggggacctgttgccagttgccctggaattattgaagcattgtgtaatattgctcggtcttcagatgactggcagtatatggctattgattgtctgctatggctgcttcaagatccgaatacgtgtcacaaggtgattgataaagtggtgccttcattagttgaccttgcggagattacaactctaggtgatcataaaaagcttggtgattccattgtcaatgttcttcaagattgcatccaatcacaaggatcaggaagaagttcaattagtagtcgcactaaagaacagatagaggatctattaagttcgaagcagagattaaaatgggaaaagaatatgcccaaggaagatctacatataaagcaggctgcagcattggtagtcaagcttgaaggaaattccttgttctcatctggaaatatttctggggctgcatcaaaatactcagaagcattggcattgtgtcctatgagatccaagaaggagagagttgttctctatagtaaccgtgctcaatgctatcttttgctgcaacaacctttggctgccataagtgatgctacctgtgcactttgtctccatagacctgtgaatcgtcatgccaaaagtctctggaggcgggcacaggcttatgatatgcttgggttagcaaaagaaagtttattggatgctattctatttataaatgagtgctcccagtcaaatgatcctgatctctcactgaggcaaaataaagttccagattatgccgagcgattagttaaaaagcagatgcgtgctgcttggttatttcgagaggcagctgttaagcatggtggtgtccatagtcagggtgatggtggtgaaatatatggccctgagaccgatgactctgaatgggagacagcgagtgaaagtgatatgggaaatgatggaataggcgatgatgatgatgatgatggtgactggaataatgatgatgatgatgagaggaaagattaagacaaactttcaataaaaaggtataaagcatggatacaatgtgcaacttgcagtagaagaaattttacttgacatggtaatccttgattggtgcaaatgttatcatcatgcatgaatgaagcagagtttgctcatgtcactgttccaacttttacattctgtagagttaaaggggaaaaaaaaactcagtcgtttattgtaagtggtgagttgaaattgactatggtttttggtcttcatgttttgaggttgagatttagtttatatccatattccatgtttgttctccctaaacttcttgtcaagtgtaaaaaaaaatagcaaatttcaagtttggagaactacatgacatttggagtatgtgaagtttacg

SEQ ID NO: 3160 - DNA, 2024 bp, Prunus persica
tagttaatttgattcagctaagagatgaagggttgacctgccctgctttgtatgatcttaagttgtaatccgaacatggataaagtgtcttctgactgtccatacccaggatgcttcttttgtgtcatgaaggaagggaatccaagcaagcgaagagcaagcattctgaaattctttagagagcttcctgcacaggatgacgatggacaagttctccctatcagtggcctttggaacactgccatggcacatccaaatgatcctgagttcatcgagcttggcatctttgaatgtatggctgcactaatatggaagggtctaaagaatcgtcgctggctttctcatgaccagaatatatacattccttattatgcagcccatattattgggtcatacaccatgaacatggaagaatttgcagaaagtgctgtgcatgctggggtaattcctcccttagttgaacttttgagaggaaggttaacttgggtagaacagagagttgcagttcgagctttagggcacttggctacctatgccagcacttttcctgctgtggcaagtcatggtgaaattcttgagctttccattcaactagcaatgagctcactagaaatcgtttattctcatttttaccagtatgttgacagaaggttaagctatcattgtgatctgctcacccgcggtatgggaggtgttgaaatggagtccagaaaggcagaagaatgggcaagtcagttacaatgctggtccctccagcttattaactgctttgcctttaaaccagagtttcttcctaccatatgcaagcctgaattcttaacaaaactacctggcatgtggggtgggcttgttaatgaaaactcaccagctggtattggtttattaagaacaatctgccatcataagttgggtagaggacctgttgctagctgtcctggtattatcgaatcattgtgtaatattgctcggtcatcagatgattggcagtatatgactattgattgtcttctttggttgcttcaagaccctagtacatgtcataaggtgattgataaggctgtacccgcacttgttgaccttgcggagattacaactctgggtgatcacaagaagcttggagattccattgttaatgttcttgaggaatgtgtccagtcacaagggacaggacgcaactctttcagtaacagaacgaaggaattgattgaggaactgttgaattccagacagagattgaaatgggaaaagaatatgcctaaagaggatctccatattaaacaggcagcagctctagtggtcaagctcgaaggaaattcattattttcatcaggaaatatatccggagctgcatcaaagtactcagaagcgttggcattgtgtccaatgagatccaaaaaggagagagttgttctttacagtaatcgagcacagtgtcatcttctgttgcaacagcccttggcagctattagtgatgctactcgtgcactttgtcttcacaacccactgaaccgtcatgccaaaagtctttggagaagagcacaggcttatgacatgcttgggcttgcaaaagagagtttgttagatgccattctgttcataaacgagtgctctcagtcaaatgatcctgatctctcattgaggcaaaataaggttcctgactatgcggagcgattggttaaaaagcagatgcgtgcagcttggttatttagagaggcagctatcaaacatgggggtgtccactgtgagggtgatgctggtgacatctatggccgagagaccgatgattccgaatgggagacagcaagtgagagcgatataggaaatgatggaagagatgaaatgggcaatgatgatgatgatgatgaggatgatgatgatagtgaatggaagaatgatgatgagaggaaagagaaatatgataagtcttcaatgaaagacctaaagcatggatacaatgtgcagcttgcggaagatgagccatgaatttaaatgtggtgatcaccaatcaaacgtgagcacaatgc

SEQ ID NO: 3161 - DNA, 2030 bp, Papaver somniferum
aagtcttgtaatctgttcggaatttggtggaatctgactctaaattgttgtgaagattagttgatttgttgggatggataaaatgacacaagattgtccataccctggatgcttctctgtgttatgaaggaggctaaccctagtaaacgcagacaagtgtattgaagttctttagagaacttccgtctctggatgaggatggtcaggttcttcctataagtggactttggaatactgccatggcacatccgaatgatcctgagttcattgatttgggaatatttgagtgtatgtctgcacttatatgcaagggtttgaagaatcggcgctggctttcgcatgaccagaatatatatattccatactatgcagctcatatcattggatcttacactatgaatatggaagagtttgcagaaagtgctgttcatgctggagtaattcctccattggtcgaacttttaagagggaggttaacatgggtggagcagagagtagcagtgcgagcccttgggcatttggctacttatgctagtacttttccttctgtggcaaatcatggagaggttcttgaactatctattcagcttgcaatgagctcgttagagattgtttactctcatttctaccagcaaatggatagaaggcttaattatcactgtgatttgcttactcgtggcatgggtggtgtcgagatggaatcaaggaaagcagaggaatgggctagtcagttgcagtgctggtctctacagcttattaattgcttcgcgttcaaacctgagtttctatctatcatatgcaaaccagagttcttagtaaaattaccaggcatgtggggtggacttgtaaatgaaaactcaccagctggtattggtttgctgcggacaatttgtcatcataagcttggcagagggcatgttgctaattgtcctggtatagttgaagctctgtgtaatattgctcgctcttctgatgattggcaatatatggctatcgactgccttatttggcttcttcaggatccagctacttgtcacaaggtgactgataaagccgtacctgcacttattgacctggcagagatctcaactttgggagatcacaaaaagcttggggaatcaattgtgaatgttcttcaagaatgtgttgaatcaccagggactgggcgtacctctattagtactcgcactaaagaacaaatagatgaactactaaattctagacagagattgaaatgggagaaaaatatgccaaaggaggatcttcatatcaaacaagcagcagctctagttgtcaagctcgaaggcaattctctgttctcttcaggaaatatatctggagctgcatcaaaatactcagaagcattggcactgtgtcccatgaggtccaaaaaggagagggtggttctttatagtaaccgagctcaatgtcatcttcttcttcaacaacctctgacagccataagtgatgctacacgtgcattgtgcctgcataaccctcttaaccgtcacgcaaagagcttgtggagaagggctcaagcatatgacatgcttggtttagctaaagagagcttactcgatgcaattttattcataaacgagtgctcgcagtcgaatgatcctgacctttccttgaagcaaaataaggttcctgattatgctgagaggctagtcaagaagcagatgcgagcagcttggctattcactgaggctgctactaaacatggtggggttagttgcgagggtgaaggaggaggtaatgtctatggccaagaagcggacgattctgagtgggagacagctagtgaaagtgatataggagacgatggaagggcagatatgggcgacggtgatagtgaactcgacgcagaggagagataggaccggaatatgaaaccaaatgatacttaatgagtgattttaaggacagggtttttgtacataaaaaccccatatgggtttaaactttaaacttgtttggtgcgtgtttatgagtttttgcctattatacacaatatttatcatcttaaa

SEQ ID NO: 3162 - DNA, 2213 bp, Amorphophallus konjac
ttgaactcatgtactttatgaaatagtcagtcagctgaatatggataaagtttctcctgactgtccttatcctgggtgcttcttctgtgtcatgaaggagggaaatccaaataaacggagaacaagtatactcaagttctttagggaacttcctgcccaggatgatgatggccaggttctccctatcagtgggctttggaacactgctatggcacatccgaatgatcctgagttcattgacctgggaatatttgaatgtatggctgcattgatatggaagggtctaaaaaatcgtcgttggctttctcatgatcagaacatatatattccgtattatgcagctcacataattggatcttacactatgaatatggaggagtttgctgaaagtgctgttcatgctggagtaattcctcctttggttgaactcttgagaggaaggttaacctgggtagagcaaagagtagcagtcagagctcttggacacttggctacatatgccagcacatttcctgcagtggcgagtcatggagaagttcttgagctttctattcagctggcactgagttctttagagattgtgtattcacatttttatcagtatccagacagaaggcttagttaccactgtgatcttttgacacgtggtatgggtggcgtggagatggaatccaggaaggcagaggaatgggcaagtcagttgcagtgctggtctcttcagttgattaattgcttcgctttcaagcctgagtttctttctgtgatatgtaagcctgattttttattaaaactacctggtatgtggggtggacttgtcaatgagaattcgcccgctggtattggcttactacgaacaatttgtcaccataagcctggtagggggcctgttgctagcttaccaggtataattgaagcactatgcaatattgctcgttcctcagatgattggcaatacatggctattgactgtctactctggctacttcaggatccaactacttgtcacaaggtggttgataaggtagtgccagcactaatagacttgtctgaaatttcaacacttggtgaccacaagaagcttggggacaccattgtctgtgttctgcaagaatgcattcaaggacaaggaaatggacgtgcctccataagtagtaataccaagaaacagattgatgaacttgtaaattccagagaacggttgaaatgggagaagaagatgccgaaggaggatcttcatatcaaacatgcagcagcactggttgtgaagcttgaaggaaattctcttttctcttcaggaaatatagcaggagctgcatcaaagtactccgaagcattagatttatgccctatcaggtcaaagaaagagagagttgttttgttcagtaatagagctcagtgctatcttctcttgcagcagcctttagcagccataagtgatgctactcgtgcactgtgcttacataaccctattaatcgtcatgccaaaagcttgtggagaagggctcaggcatatgatatgcttggattagcgaaggagagcttgttggatgctatattgtttataaatgagtgctcccagtcgaatgatcctgatctctctttgagacaaaacaaagtgcctgattatgctgaacggttggtcaagaagcagatgcgcgcagcatggttatttagagaggcagctgtaaagcatggtggtgtccattgtgatagtgatgctggagatgtttatggtcaagaggctgataattctgagtgggagacagcaagtgaaagtgatcttgagaatgatgaaagagagcagggtgatgatgataattaatggaaaggcgataataacagtagagagaaatatggaaagcatttgatgaggtgacaaaagaatggggacttggtgacgacgttctgctctcttaaggacggatcgtcattttcagagttgggataatgatatttaggccttctaaagtttgtcgatgtgtgaacttggcggtggcagccaactgaaagtaaaaatacgccctgcagtactgtttggttgcaccgtgtttgtcgtgttagcttattatatgctactgttttattgcgagtaatttgaagcatacagcaaaaggaggaattattgaaatataggttcagaaaattggttgcttggggatgtgactggcacaattgtttgtatatattcttgtgaatttaaaataaactcttct

SEQ ID NO: 3163 - DNA, 2893 bp, Aristolochia fimbriata
ctttttaaattctgtttcctgatttttactcagtgaatccattgctctgatgaatagtaccaatccagttaaagatctgatgccttttctctgccgtctcttctactgggttaattcgctggtttgattaacatttaacagttgttagggacagagagatccaaaaccaatttgtcctgcaacttgcagcgggcctgttggatttgtttgtggggtccaatttacatttcatacttattgattttctatggtatctatatgatattgatctacaaaatttgattgcttacaatttgttgacggttttttgctagtctatgagaatacatttagtaaaataatacctcatggctgttgattttgatttttcataataaatcattgcttgatgcagctctctgtatgccctcacattacttgaagcacaatcatccaaagtctcattaactaatcgcggcaagtgattctcctttcatggataagattacagcagattgcccttaccctggctgcttcttttgtgtcatgaaagaggcaaacccaagcaaacgccgaacaagtatcctgaagttctttcgtgaacttccttctcaagatgatgatggtcaggtgcttcccattagtggtctgtggaacactgcaatggctcatccaaatgaccctgaattcattgacttgggaatatttgaatgcatggctgcacttatatggaagggcctaaagaacagacgctggctatctcatgaccaaaacatttacattccatactatgctgcacatatcattggatcatataccatgaatatggaagaatttgctgaaagtgctgtgcatgctggtgtaattcctccattggttgaacttctgagaggcaggttgacttgggtggagcagagagtggcagtaagggctctaggacacttagctacttatccaagtacattccctgccgtagccaatcatggtgaaattctggagctttcaatacagcttgcaattagctctttggaaattgtgtattctcacttttaccagtacgtagacagaaggcttggctaccactgtgatcttttaacccgtgggatgggtggtgttgagatggagtccaggaaggctgaagagtgggccagtcaattacagtgttggtcccttcagctcatcaattgctttgcttttaagcctgatttccttcctattatctgcaagtcagactttttaattaaactgcctggcatgtggggtggacttgtcaacgagaattcgccagcgggaattggactgttgcgaacaatttgccagcataagcttggtagagggccagttgctaactgtcctagtattatcgattccttgtgtaacattgctcgttcgtctgatgattggcagtatatggctattgactgtcttctgtggctgcttcaggatcagaatacttgtcataaagttatagacaagatagtaccggccctcattgatttggctgaaattacaactctgggtgatcacaagaagcttggggaaaccattgttagtgtcctgcatgaatgcagccaatcactaggaagtactcgcaatcctctgagcagtcgcacaaaagaactgattgatgaactacttagctctaagcagagatcgaaacgcgagaaaaacatgccaaaagaggatctccatatcaaacaggcagcttcccttgttatcaagcttgaaggaaactctctattctcctctggaaatatagctgctgcagcctcaaaatattcagaagctttagccttatgtccactaagatctaaaaaagagagggtagtgttatacagcaatcgggctcaatgttatcttttgctgcaacaaccattagctgcaataagtgatgctacacgtgctttatgcctccataaccctcttaatcggcatgccaagagcttatggaggcgtgctcaggcttatgacatgctaggtttggctaaggaaagcttattggatgcaattctttttataaatgagtgttcgcaatcaactgatcctgacctatctttgaggcaaaacaaggttccagattatgcagagcgtctagtgaaaaaacaaatgagggcagcttggctgtttcgcgaggcagcagtgaaacatggtggggtccactgtgagggtgataacggggagatctatggccaggagggtgatgattctgagtgggagacagcaagtgaaagtgatattgaaaatgatggaaggcgtgacatgggtgatgatgatgaggatgatgatgatgatgatgatgatgacagtgaatggaaaatgatgatgagaggaaagacaagtatgagaagtccttgataaaagatatgaagcatggttacaacgttcaacttgcagaagatgaagcatgatgcagttgaatcacgtgatctctctttttgactttttcctgaatttaatcatctaaacccaaagttgtaaaaagttaatgggtggatgtggcttagtggatcgttgagcttcttgatgcataaatgggaaaaaggcctctttcccctcctatccgtagtgaactttcagataactggagtctgctagggatggaggatttgccattataaacaaatgcagccttaatgctttttctggcagtatttttattttatcagcgtggaattagacatgaagaaagcagagccatgaaaagcttggggaaccgctagaggagtcatatgatccagaagcgtgtgtaatatattcttcttgaattgagcttctttatatggggagaatctaaatgtattttactttgtgggtattgtcctgtttttattattttatttttatcaatgcggaaaacttgtgtacttgtggaacatgtatttatatgagttaagtaatgaaggttttggtgctt

SEQ ID NO: 3164 - DNA, 2725 bp, Fragaria vesca
acactcaaactcactcaaactcagtcgtatcaaacagaaacagtcaaactcagtccaaacaccctccgatctgagctctacctcgcctcctgcgcttttcccgagtcagcggctgcgttgagcaagtcagggctccggattcgggggaccgtgccatccaactcgtcgtcgcctggaggagaacaagtcaatgatgatagagattagtgacggtggagaagagaaggaggtcaataacggcggcgacgatggttatttgatttgatttagctggggaatgaagagttgagtcgccttgatttttgtgagattaacttgcaatctggatatggataaagcgtcttccgaatgcccttacccaggatgcttcttttgtgtgatgaaggaagggaatccaagtaagcgacgagcaagtatcctcaagttctttagagaccttcctacacaggatgataatggtcaggttcttcctatcagtggcctttggaacaccgccatggcacatccaaatgaccctgagttcatcgagcttggtatttttgagtgtatggcttcacttatatggaagggtctaaagaatcgtcgctggctttctcatgaccagaatatatacattccttattatgcagctcacataattggttcatacactatgaacatggaagaatttgcagaaagttctgttcatgccggggtaattgctcccttagttgaacttttgagaggaaggctaacgtgggttgaacagagagtggctgtccgagctttaggccacttggctacctatgccagcacttttccagctgtagcaagtcatggtgaaattcttgagctttccattcaacttggaatgagctcacttgagattgtctattcacatttctaccagtacgttgaccgaaggttaagctatcactgtgatctgctcactcgtggcatgggaggtgttgaaatggagtccagaaaggctgaagaatgggcaagtcagttgcaatgctggtctctccagctcattaactgctttgctttcaaaccggagtttcttccaaccatatgcaagaccgagttcttaacaaagctacctggcatgtggggtgggcttgtcaatgaaaactcaccagccggtattggtttattaagaacgatctgtcatcataagctgggtagaggacctgtagctagctgtcctggtattatcgaagcattgtgtaatattgctcgatcgtcagatgattggcagtatatggctattgactgccttctctggttacttcaagaccctagtacatgtcataaggtcattgataaggctgtacctgcacttgttgaccttgcggagataacaactctgggtgataacaagaaactcggagattccattgtcaatgttcttcaggaatgtatccagtcacaagggactggacgtaactctttcagtagcagaaccaaagaaatgattgaagaactgttgaattccagacagagattgaaatgggaaaagaatatgccaaaagaggatctccatattaaacaggcagcagcacttgttgtcaagcttgaaggaaattccctgttctcatcaggaaatatatctggagctgcatcaaaatactcagaagcattgacattgtgtccaatgagatcgaaaaaggagagagttgttctttacagtaatcgggctcagtgttttcttttgttgcaacagcccttggctgccattagtgatgctacacgtgcactttgtcttcacagcccactaaatcgtcatgccaaaagtctctggagaagagctcaggcttatgacatgcttgggtttgcaaaagagagtctgttagatgccattcttttcataaacgagtgctctcagtcaaatgatcctgatctctcattgaggcaaaataaggttcctgactatgccgaacgattggttaaaaagcagatgcgtgcagcttggttatttagagaggcagcgatcaaacatgggggtgtgcattgtgagggtgatgctggtgacatatatggccgggagagtgatgattctgaatgggagacagcaagtgagagcgatataggaaatgatggaagggatgcaatgggcaatgacgacgacgacgatgatagtgaatggaagaatgaggacgagaggaaagacaaatatgataaatcttcagttaaagacctaaagcatggatacaatgtgcagcttgcggaagatgaaccgtgaatttgggtgcagtgagaacctatcaaaacacaagcactcaacaacaatgacagaatgaacagaaccatggatgaagcttttgaatccagtcatatactcgtatcaatccagattcaacagtaattttcttgcctctgtccaatgtgcataccgagaaaggaactattcttcggtcaattgtgtgaaagattcaattatgttggtttgtgtcattgcgtgtgaattcttactcttcctctctccttttgatttattttctttttatattatgtaaaatttcaactgtgtagaaagaaattgagattattaagtgtagaggatacagttgagtctagaaagtgtggattgagcttgaattttgagtgatttaagaggggtgtgtagtgcgttgtgaatatagaactctgcggttttgtggactttgaactactatttgtcaaaatttgaatggtaaatgtaattttcttctgctatcagcttcagtaatgttgttgagcttgg

SEQ ID NO: 3165 - DNA, 2144 bp, Populus trichocarpa
ttgactgtctgaaaatggataaagtttctcccgactgcccatatccaggatgcttcttttgtgtcatgaaggaaggaaatccaagcaagcgaagagcaagtatactgaaattctttagagaacttccttcacaggatgatgatggccaggttctcccgatcagtggactgtggaacactgctatggcacatccaaatgaccccgagttcattgaattgggaatatttgaatgtatggctgctcttatatggaagggcttaaagaatcgccgctggctttctcatgaccaaaacgtatatattccttactatgcagctcatattattggatcctacactatgaacatggaagagtttgcagaaagtgctgtccatgctggcgtaattgctcccttggttgagcttttgagggggagattgacatgggttgaacaaagagtggcagtacgagcactggggcacttggccacatacaccagcacttttcctgctgtggcaagtcatggcgaaatccttgaactctccatccaactagcaatcagttcactcgaaatagtttactcacatttttaccaatatgttgatagaagaattagttatcattgcgatttgcttacccgtggcatgggcggtgttgaaatggagtccaggaaagcagaggaatgggctagtcagttacagtgctggtcacttcaactcattaattgctttgctttcaagcccgaatttcttcctaccatatgcaagcctgaattcttggtaaaactgccaggcatgtggggtgggcttgttaatgagaattcccctgctggtattggtttattaagaacaatttgtcatcataagcttggtaggggacctgttgctagttgtcctggtattattgaggcattgtgtaatatagctaggtcatcagatgactggcagtatatggctatagactgtcttctttggttgatccaagatccaagtacatgccataaggtcattgataaggcagtacctgcacttgtagacctcgcagagattacaaatctgggtgatcacaaaaagcttggggacaccattgttaatgttcttcaggagtgtttgcaatcacaggggacagggcgtaacactatcagcaaccgtgaaagggaactgattgaggaactattggattccaaacaaagattgaaatgggaaaagaacatgcccaaagaggatcttcatattaagcaggcagctgcactggtggtcaagcttgaaggaaattcccttttctcatcaggaaacatagctggagctgcatcaaaatattcggaagctttgtcattgtgtccaatgagatccaaaaaagagagagttgttctgtacagtaatcgagctcagtgttatcttctgttacaacagccattggcagcaattagtgatgctacacatgcagtgtgtcttcacaaccctcctaactgtcatgccaaaagcctttggagacgagctcaggcttatgacatgcttggcttagctaaagagagcttgttagatgccattctgttcattaacgaatgctctcagacaaatgatcctgacctctctttgaggcaaaacaaagttcctgactatgctgagcgactagtcaaaaagcagatgcgtgcagcttggttatttagagaggcagccatcaaacatggaggtgtccatggtgagggtgatgttggtgacatctatggccaggaaagtgatggttcagaatgggaaacagcaagtgaaagtgacatgggaaatgatgggagggttgaaatgggtgacgatgacgatgatgatagtgaatggaagaatgaagatgggaggaaagataaatatgataaaacaacattaaaagatataaagcatgggtacaatttgcatcttgcagaagatgaatcttgaattcaggccagcaggtgatcattcaaatgctgaaataaataccagcagcaatggagaggcgccataaaaaagatcaacaaatcctgcatggtctcatgagatgcaagtacaatagaaatatatgattggccattgtgtctagaaacaaacttctctaagttttgtttatttccttaatttttgttccccgattcttttttatttcaactgtagaaattgaacgcagaggttttgagt

SEQ ID NO: 3166 - DNA, 1909 bp, Manihot esculenta
catggacaaagtatctccagactgtccatacccaggatgctttttctgcgtcatgaaggaaggaaacccgagtaagcgtagagcaagtatattgaaatttttcagggaacttccttcacaggacgatgatggccaggttctcccaatcagtggtctttggaacactgccatggcacatcccaatgatcctgagtttattgagttgggaatatttgaatgcatggctgcacttacttggaagggcttaaagaatcgccgatggctttctcatgatcagaacatctatattccttattatgctgctcatatcattggatcctacaccatgaatatggaagaatttgcagaaagtgctgttcatgctggtgtaattcctcccctggttgagctactgagggggagattgacatgggttgaacagagagtggcagtacgagctctaggacacttggctacatatgccagcacttttccttctgtgtcaagtcatggtgaaatccttgagctttcgattcaacttgcaatgagttcactagaaattgtttactctcatttttaccagtatgttgatagaaggctaagctatcactgtgatttgcttactcgtggtatgggaggcgttgaaatggagtccaggaaagcagaggaatgggctagtcagttacaatgctggtcacttcagcttattaattgttttgctttcaagccggagtttcttcctaccatttgcaagccagaattcttagtaaaactgccaggcatgtggggtggacttgttaatgagaattcacctgctggtattggtttattgagaacaatttgtcatcataagcttggtaggggacctgttgctagctgccctggtataattgaggcactgtgtaacatagctcgctcgtcagatgattggcagtatatggctatagattgtcttctttggttgcttcaagatccaaatacatgccacaaggtgatcgataaggcagtacctgtccttgttgaccttgcggagatcacgacgctgggtgatcaaaaaaagcttggagattccattgttaatgttcttcaggattgtattcaatcacaagggacagggcgtacttctgttagtagccgcacaaaggaaccgattgaggaactgttgaactcaaaacaaaggatgaaatgggaaaagaatatgccaaaggaagatctacatatcaagcaggcggctgcattagtagtcaagcttgaaggaaattcactgttctcgtcaggaaatatatctggagctgcatcaaagtactctgaagcattgtcattgtgcccaatgagatccaaaaaagagcgagttgttctatacagtaaccgagctcagtgtcatcttctactacaacaacccttggctgctattagtgatgctacacgagcactttgtcttcacaaccctctcaatcgtcatgcaaaaagcctttggagaagagctcaggcttatgacatgctaggattagctaaagagagcttgttagacgccattctgttcattaacgaatgctctcaatcaaatgaccctgatctatgttcgaggcaaaataaagttcctgactacgcggagcgcttagtcaagaagcagatgcgtgcagcctggttatttagagaggcagctattaaacatggtggggtacactgtgaaggagatgctcgtgatgtttatggccaagacagtgatggttcagaatgggaaacggcaagtgaaagtgatataggaaatgatgggagagatgaaatgggtgatgatgatgatgatattgaatggaagaatgaggatgagaggaaagataaatatgacaaggcaacattaaaagacataaagcaagggtacagtgtgcagattccggaaatgaatcggaatttggaagggacgacatga

SEQ ID NO: 3167 - DNA, 2471 bp, Solanum phureja
aaaaaaacacaatcttttgtctgaaagctgcttcttgctgtattcttttgcatacccaagttttattttttgaaaaagaaccactctgcctcttctttccaagcttcttaagaccaagtacattgccgacaagaaggtggatttaaaagtaaattctgactctttcggttagatgagcatggataaagcttctgctgactgtccatacccgggatgcttcttctgtgtcatgaaagaaggaaacccaagcaagcgccgagcaagtatattgaagttttttcgagaacttccttcacaggatgatgatggtcaagttcttcccatcagtggcctatggaacactgccatggcacatcctaacgatccggagttcattgaattggggatttttgaatgcatgtcagcacttatttggaaaggtttaaagaaccgccgctggctttcacatgaccaaaatatatatattccttattatgcggcacatataattggatcatatactatgaatatggaagagtttgctgatagagctgtgcgtgctggaatcatccctcctttagttgaacttttgagaggtaggctaacttgggttgaacagagagttgcagtgagagctttaggacacttagctacctatgccagcacttttccagctgttgcaagtcatggtgagattctagagctctccatccaactcgcgatgagttctcttgaaattgtttactctcacttttaccaatatgttgatagaagacttagttatcattgtgaccttcttacacgtggcatgggtggagttgaaatggagtcccggaaggcagaagaatgggccagtcagctacaatgttggtcccttcagcttattaattgctttgctttcaagcctgaatttcttcctactatttgcaagccagaatttctagcaaagcttccaggaatgtggggtggacttgttaatgaaaactcccctgctggaatcggcctgttaaggacaatttgccatcacaagcttggtagagggcctgttgctgcatgtcctggtataatagaggcattgtgcaatatagctcgctcatcggatgactggcagtatatggcaattgactgtcttttgtggttgctccaggatccaagtacctgtcataaggttattgaaaaggctgtacctgcacttgtggatcttgcggagatatcatcccttggggatcataagaagcttggagactctattgtcaatgttctacaagaatgtattgaatcacaagggacaggtcgtactcaaatcaatagccatgtgaaagaagaagttgaagaactactgaattccaaacagagactaaaatgggagaaaaatatgcctaaagaggaccttcatatcaaacaggcagctgcactggtggtaaaacttgaagggaattccctgttttcatcaggaaatatttctggggctgcagctaaatactcagaagcattggcgttgtgcccaatgaggtcaaagaaagagagagtggtgctctacagcaatcgcgctcaatgtcatctcttgttgcaacaacccttggctgctataggtgatgctactcgtgcattgtgtcttcataatcctgtgaaccgtcatgccaaaagcctttggagaagagcacaggcatatgacatgcttggtttagctaaggagagcttattagatgctattctgtttataaatgagtgttcacaatcaaatgatcctgatctgtctttaaggcaaaacaaggttcctgattatgctgagcgtttggtaaaaaagcagatgcgtgcagcttggttatttagagaggctgctattaaacatggtggagttcaatgtgagggtgatgctggagacatgtgtggccaggaaactgatgattcagaatgggagacagcaagtgaaagtgaaattggaaatgaggagagagatgaaatcggtaatgatatttgtggatgggaaaatgaggttgaaaggaaggataagtacaaaaaggcttcactcaaagagataaagcatggatataatgtgcagcttactgaagacaacgtgtaaattttcgccaattagccctgtcctgggaaatttatcatctagtagcttgagaatctaagtctctcttgctgtgtctactctgcacaaaggacagagatgttcgttcgttgtttttgcacgtcgcattgctgaataaaccccctccccctcccagccaccctttttttacatatagtttaaatagatctagaggaaaagaaaagaattgttagtgtgtttatttctcttgttttcctttttggttttggtttgtttccaagtcattctttgagaatatcgacaaagtcgaaagtggtttctgtacatacacactttggtgatttttttttgttggctaattctggaaaaatacagttgtgagttatcttcattaatgtgattgcatcaaaaaaatgttctctggtattta

SEQ ID NO: 3168 - DNA, 2551 bp, Solanum lycopersicum
caaatttacccaaaagaaccagtcttgaaatttgacagtgaagagtgaggagacgtacaaaattctcaaacaataattttaaaaaacaaaatcttttgtctgaaagctgcttcttgctgtattcttttgcatacccaagttttatttttttgaaaaagagccttctttccaagcttcttaagaccaagtatagttgccgacaagaaggtggattaaaaagtaaattctgactctttcggttagatgagcatggataaagcttctgctgactgtccatacccaggatgcttcttctgtgttatgaaagaaggaaacccaagcaaacgccgagcaagtatattgaagttttttcgagaacttccttcacaggatgatgatggtcaagttcttcccatcagtggcctatggaacacagccatggcacatcctaacgatccggagtttattgaattggggatttttgaatgcatgtcagcacttatttggaagggtttaaagaaccgccggtggctttcacatgaccaaaatatatatattccttattatgcagcacatataattggatcatataccatgaatatggaagaatttgctgatagagctgtgcgtgctggaatcatccctcctttagttgaactcttgagaggtaggctaacttgggttgaacagagagttgcagtgagagctttaggacacttagctacctatgccagcacctttccagctgttgcaagtcacggtgagattctagagctctccatccaactcgctatgagttctcttgaaattgtttactctcacttttaccaatatgttgatagaagacttagttatcattgcgaccttcttacgcgtggtatgggtggagttgaaatggagtccaggaaggcagaagaatgggccagtcagctacaatgttggtcccttcagcttattaattgctttgctttcaaacctgaatttcttcctactatttgcaagccagaatttctagcaaagcttccaggaatgtggggtggacttgttaatgaaaactcccctgctggaatcggtctgttaaggacaatttgccatcacaagcttggtagagggcctgttgctgcatgtcctggtattatagaggcattgtgcaatatagctcgctcatcggatgactggcagtatatggcaattgactgtcttttgtggttgctccaggatccaagtacctgtcataaggttattgaaaaggctgtacctgcacttgtggatcttgcggggatatcatcccttggggatcataagaagctaggagactctattgtcaatgttctacaagaatgtattgaatcacaagggacaggtcgtactcaaatcaatagccatgtgaaagaagaagttgaagaactactgaattccaaacagagactaaaatgggagaaaaatatgcctaaagaggaccttcatatcaaacaggcagctgcactggtggtaaaacttgaagggaactccctgttttcatcaggaaatatttctggggctgcagctaaatactcagaagcattggcattgtgcccaatgaggtcaaagaaagagagagtggtgctctacagcaatcgtgctcagtgtcatctcttgttacaacaacccttggctgctataggtgatgctacgcgtgcattgtgtcttcataatcctgtgaaccgtcatgccaaaagcctttggagaagagcacaggcatatgacatgcttggtttagctaaggagagcttattagatgctattctgtttataaatgagtgttcacaatcaaatgatcctgatctgtctttaaggcaaaacaaggttcctgattatgctgagcgtttggtaaaaaagcagatgcgtgcagcttggttatttagagaggctgctattaaacatggtggagttcaatgtgagggtgatgctggagacatgtgtggccaggaaactgatgattcagaatgggagacagcaagtgaaagtgaaattggaaatgaggagagagatgaaattggcgatgatatttgtggatgggaaaatgaggttgaaaggaaggataagtacaaaaaggcttcactcaaagaggtaaagcatggatataatgtgcagcttactgaagacaacgtgtaaattttctccaactagccttatcctgggtaatttagcatctattagcttgagaatctaagtgtctctcttgctgtgtctactctgcacaaaggacggagatgttctttcgttgtttttgcacgtcgcattgctgaataatctccctccccttcccagccaccctctttttacatatagtttaaatagatctagaggaaaagaaaagaattgttagtgtgtttatttctcttgttttcctctttggttttggtttgtttccaagtcattctttgagaatatcgacaaagtcgaaagtggtttctgtacatacacactttggtgattttttttttgttgttgttggctaattctggaaaagtacagttgtgagttatcttcattaatgtgattgcatcaaaaaaatgttctttggtattta

SEQ ID NO: 3169 - DNA, 2547 bp, Solanum lycopersicum
caaatttacccaaaagaaccagtcttgaaatttgacagtgaagagtgaggagacgtacaaaattctcaaacaataattttaaaaaaacaaaatcttttgtctgaaagctgcttcttgctgtattcttttgcatacccaagttttatttttttgaaaaagagccttctttccaagcttcttaagaccaagtatagttgccgacaagaaggtggattaaaaagtaaattctgactctttcggttagatgagcatggataaagcttctgctgactgtccatacccaggatgcttcttctgtgttatgaaagaaggaaacccaagcaaacgccgagcaagtatattgaagttttttcgagaacttccttcacaggatgatgatggtcaagttcttcccatcagtggcctatggaacacagccatggcacatcctaacgatccggagtttattgaattggggatttttgaatgcatgtcagcacttatttggaagggtttaaagaaccgccggtggctttcacatgaccaaaatatatatattccttattatgcagcacatataattggatcatataccatgaatatggaagaatttgctgatagagctgtgcgtgctggaatcatccctcctttagttgaactcttgagaggtaggctaacttgggttgaacagagagttgcagtgagagctttaggacacttagctacctatgccagcacctttccagctgttgcaagtcacggtgagattctagagctctccatccaactcgctatgagttctcttgaaattgtttactctcacttttaccaatatgttgatagaagacttagttatcattgcgaccttcttacgcgtggtatgggtggagttgaaatggagtccaggaaggcagaagaatgggccagtcagctacaatgttggtcccttcagcttattaattgctttgctttcaaacctgaatttcttcctactatttgcaagccagaatttctagcaaagcttccaggaatgtggggtggacttgttaatgaaaactcccctgctggaatcggtctgttaaggacaatttgccatcacaagcttggtagagggcctgttgctgcatgtcctggtattatagaggcattgtgcaatatagctcgctcatcggatgactggcagtatatggcaattgactgtcttttgtggttgctccaggatccaagtacctgtcataaggttattgaaaaggctgtacctgcacttgtggatcttgcggggatatcatcccttggggatcataagaagctaggagactctattgtcaatgttctacaagaatgtattgaatcacaagggacaggtcgtactcaaatcaatagccatgtgaaagaagaagttgaagaactactgaattccaaacagagactaaaatgggagaaaaatatgcctaaagaggaccttcatatcaaacaggcagctgcactggtggtaaaacttgaagggaactccctgttttcatcaggaaatatttctggggctgcagctaaatactcagaagcattggcattgtgcccaatgaggtcaaagaaagagagagtggtgctctacagcaatcgtgctcagtgtcatctcttgttacaacaacccttggctgctataggtgatgctacgcgtgcattgtgtcttcataatcctgtgaaccgtcatgccaaaagcctttggagaagagcacaggcatatgacatgcttggtttagctaaggagagcttattagatgctattctgtttataaatgagtgttcacaatcaaatgatcctgatctgtctttaaggcaaaacaaggttcctgattatgctgagcgtttggtaaaaaagcagatgcgtgcagcttggttatttagagaggctgctattaaacatggtggagttcaatgtgagggtgatgctggagacatgtgtggccaggaaactgatgattcagaatgggagacagcaagtgaaagtgaaattggaaatgaggagagagatgaaattggcgatgatatttgtggatgggaaaatgaggttgaaaggaaggataagtacaaaaaggcttcactcaaagaggtaaagcatggatataatgtgcagcttactgaagacaacgtgtaaattttctccaactagccttatcctgggtaatttagcatctattagcttgagaatctaagtgtctctcttgctgtgtctactctgcacaaaggacggagatgttctttcgttgtttttgcacgtcgcattgctgaataatctccctccccttcccagccaccctctttttacatatagtttaaatagatctagaggaaaagaaaagaattgttagtgtgtttatttctcttgttttcctctttggttttggtttgtttccaagtcattctttgagaatatcgacaaagtcgaaagtggtttctgtacatacacactttggtgattttttttttgttgttgttggctaattctggaaaagtacagttgtgagttatcttcattaatgtgattgcatcaaaaaaatgttctttggt

SEQ ID NO: 3170 - DNA, 2518 bp, Aquilegia formosa
cttctacatacttcagttctctctctcgaatctcgattgcaatcagtttgatttcagttcagatttcaaagctctcagtttcttctacttcacactccgtacagatcttaatttgaagtatatataagatattctttgtccttggagggatctagtcgatattcttgtgaggaataattcagtatatatctacatggataaaatgtctcaggagtgtccatacccaggttgtttcttttgtgtcatgaaggaagggaatcctagtaaacgtagacaaagtatactaaagttcttcagagaacttccttctcaggacgaggatggtcaagttcttccaatcagtggcctttggaacactgccatggcacatcctaatgaccacgagttcatcgacttgggaatatttgagtgcatggctgcacttatatggaaagggctgaagaaccgacgttggcttgcccatgaccaaaatatatacattccgtattatgcagcacacattataggatcttacaccatgaacatggaagaatttgctgaaagtgctgtgcatgctggagtaatacctcccttagtcgaacttctgagagggagattaacttgggtagaacagagagtagcggtgcgtgctataggacacctggcgacatatgcaagcacctttcctgctgtagctagtcatggggaagttcttgagctttccattgagctggcaatgagttcgctggaaattgtttactctcatttttaccaatatgttgacagaagacttagttatcattgcgatttgcttacacgtggtatgggaggtgtagaaatggaatccagaaaagcagaggaatgggctagtcaattacagtgctggtctcttcagctgattaattgctttgctttcaagcctgaattcctctctgttatatgcaagcctgaattcttagttaaattaccaggcatgtggggcgggcttgtcaatgagaactccccagctggtactggcttattgcgaacaatttgtcatcataaggttggtagggtcccagttgccaactgtccgactgttgtggaagcattatgcaatattgcccgctcatcagatgactggcagtatatggcaattgactgtcttctttggttgctccaagatccaaatacttgtcaaaaggtaattgataaggcagtacctgcactcatagacctagcagaaatttcaactttaggggatcacaagaaactaggtgataccattgttaatgttcttcaagaatgtattgaatcacaaggtacaggacgtagctcgctcagtaatcgaattatagaacagactgaagaactattaaattgcagacagagattaaaatgggaaaagagtatgccaaaggaggatctccatataaaacaagctgcagcactagttgtcaagcttgaaggcaattcattattctcttctggaaatatatcaggagccgcatccaaatactcagaagcaataactttgtgtccagtgaggtcaaagaaggagagagtggtgttatacagcaaccgagctcaatgtcatcttctcttgcaacaacccttggcagccataagcgatgctacacgtgcattatgccttcataaccctgttaaccgccatgccaagagtctatggagaagagctcaggcatatgatatgctaggtttagcaaaagagagcttgttagatgccatcctcttcatcaatgagtgttcacagtcaaatgatccggacctttccttgagacaaaacaaggttcctgactatgctgagcggttagtgaagaagcagatgcgtgcagcttggctatttagggaagctgctatcaaacatggaggtgttcattgtgatggtgaggcaggtgacatatatggccaggaggctgatgattctgagtgggaaactgcaagtgaaagtgacataggaaatgatggaagaggagagatgcttgatgatgacagtgagtggaaaatcgatgatgagaggaataagtacgagaagccttctttgaaaggtataggacggcattagtgatgaagttgcagaaattccataggggtgatgcttcttgaaatgcttatgagcacaaagaacagagggatattaacataactcgtgaagagataaagcatggatacaatgtgcagcttgctgaggatgatgcttgattctatatgattaaagtctagttcaactttcaacatcttaattgtaaacataaatgagaaagattttggagcgattgatctcatcttttgttcacatcaacaaatcgaaggtgttaaacttgatctctttgtagagtaagtttgacagaatgatcttgcactacttgtgttaaaattaattttgttctatgtttctttcatttttatcttgtgcttttatctttgcctttcgagattaaacaacaaaaaagtaaagatattgtgtggctcataacttccgtaaataagtgattgagtttgtgtatatttaacccatatggttttcatgaatctttgt

SEQ ID NO: 3171 - DNA, 2861 bp, Citrus clementina
cacctagctagtagctacagggaggaaagctacaataacacaagatgttctctttgctgtcagaatccgaacccctcaaaaactaaactgaatgaaaaacactgccaacctcttcaccctcgacactcaccaccacttccccctcatccctttttagtaagctttgcaaacaacagaagctgtggaatcacttcactagtactagtaatcttgattacctttgcttcgttcaaaaaggaaaggctctgcctttcttcttcattttttttttctggggctaaagttctttaacgaacaggctgctggctagctgttcctcctcctccgagtgttgaaatagtacagtattctatctgcccagtgagaaattgacgcgacactccatgattgtgattgcttaaccatccaaaaatggaaaaagtatctccagattgtccatacccaggatgttttttttgtgtaatgaaggaaggaaatccaagtaaacgcagggcaagtatattgaaattcttcagagaacttccctcacaggatgatgatggtcaggttctccccatcagtggtctttggaacactgccatggctcatccgaatgaccctgaattcatcgagttaggaatatttgaatgcatggctgcactaatatggaagggtctgaagaatcgtcgttggctttctcatgatcagaatatatacattccttattatgcagcacacattattggatcctacaccatgaacatggaagaatttgctgaaagtgctgtccatgctggggtaatccctccattagttgaactcttgagaggaaggttgacttgggttgagcagagagtggcagtccgagctctagggcacttggctacatatccgagtacctttcccactgtagcaagtcatgctgaaatccttgagctctccattcaactagcaatgagttcactggagatagtttattcgcatttttaccagtattttgatagaaggctgagttatcattgtgatctacttactcgtggcatgggtggtgtcgaaatggagtccaggaaggcggaggaatgggctagtcagctgcagtgctggtcccttcagctcattaattgctttgcttttaagcctgagtttcttcctgctatatgcaaacctgaatttctagctaaattaccaggcatgtggggaggacttgttaatgaaaactcgccagctggtatcggtttattgagaactatttgtcatcataagcttggtaggggacctgttgctagttgcccaggccttattgaagcattgtgcaatattgctcgctcttctgatgattggcagtatatggccattgactgtcttctctggttgctccaggacccaagtacatgtcataaggtgattgataaggctgtacctactcttatagaccttgcagagatcacaaatctgggtgatcacaaaaagcttggggattctatagttaatgttctccaagactgtatccaattacaagggacagtacgaagctctccaagtaatcgcagtaaagaacagattgaggaattgttaaattcccgtcagagattgaagtgggaaaagaatatgctaaaagaggatcttcacattaaacaggcagcggctctagtggtcaagcttgaaggaaattccctgttctcagcagggaatatatctggagctgcatcaaaatactctgaagctttggcattatgtccgatgagatccaaaaaggagagagttgttttgtatagtaatcgagcccagtgtcatcttctgatgcaacaaccattggccgccataagtgatgctacgcgtgcactttgtcttcacaacccacttaaccgtcatgccaagagcctgtggagaagagctcaggcttatgacatgcttgctttagccaaagagagtttgttagatgctattctgttcattaatgaatgctctcagtcaaatgaccctgatctttcactgaggcaaaataaggttcctgactatgctgagagactagtcaagaagcaaatgcgtgcagcttggttatttagagaggcggctattaaacatgggggcgtccatggtgaaggcaattctggcaacatctatggccatgaaaccgatgattcagagtgggagacagcaagcgaaagtgatattgggaatgatggaagagatgaaatgggtgatgaagatgatgatagcgagtggaagaatgaggatgagaggaaagataaatatgataagccgccaatgaaagcttgatgctcactactgccttctttatatccggcggatgttctgtaatgtgtgcatgtttgttcgttggcctcctaaacattattgtggtacagacatgaagcatggatgccatgtgcagcttgctgaagacaaaccctgaatatggcaggaaggagcaaacattcgtaaatgtaaattggctttggtttatgagttatagaattttcatcacctcttgagtgtgaaacggcagctagggtatcgtgctcagtctcttgggaagaagtttgaaaataaacatggtattgatcaatgttttttagtaagtataaacttgtttaattagttttcttgtttgtttgcccattttattatgttgatttcaagtgtaggaaatgagccaagtgtgagtacagaggagggctttagtctagatgatgtgaagcttttttaatcagtttgaatttgaagagtccttgtatataaaccccaagggttttttggacattgaatcatctacatgtgactttgatattgtaatcttctaaaggtggttcctttgcaatcaacttttggattttccattaaatctttgtttgctttctttgggcatgtattgagactat

SEQ ID NO: 3172 - DNA, 2148 bp, Euphorbia peplus
gaacatggataaagcatcaccagactgtccatacccgggatgctttttctgtgtcatgaaggaaggaaatcccagcaagcgtagagccagtattcttaaattcttcagggaacttccttcacaggatgacgacggtcaggttcttcccatcagtggcctatggaacactgccatggcacatcccaatgatcccgagttcatcgagttgggaatatttgaatgcatggctgctctcatatggaaaggcttaaagaaccgtagatggctttcacatgatcagaacatatacattccttattacgctgctcatattattggatcctacaccatgaatatggaagagtttgcagaaactgctgttcatgctggtgttattccacctttagttgagcttttgaggggaagattgacatgggtcgaacaaagagtggcagttcgagctctaggacacttggctacttatgccagcacgtttcctgcggtggcgagccaaggagaaattcttgagctttccattcagcttgcaatgagttcattagaaatagtttactctcatttttatcagtatgttgatagaaggctaagttatcactgtgatttgcttactcgtgggatgggaggtgttgaaatggagtcaaggaaggccgaggaatgggctagtcagttgcaatgctggtcccttcagcttattaattgttttgctttcaaacccgagtttcttccgagtatatgcaaggctgaattcttagtaaaattggctggtatgtggggtggacttgttaatgaaaattcacctgcggggattggtttattaagaacaatatgtcatcacaagcttgggagaggacctgttgctagctgtcccgggattgttgaggcgctctgcaacattgctcgctcatcagatgactggcagtatatggccattgattgtcttctttggcttcttcaggatcctaatacttgtcacaaggtgatcgataaggcagtgcctgcactcatagaccttgcggaaatttcagctctaggcgaccacaaaaagcttggagattccattgttagcgttcttcatgattgtatccaatcccaagggaccgggcgtagttctatcagtaacaagacgaaagaaatggttgaggaactgctaaatgcaaaacaaagattgaaatgggaaaaaaatatgccgaaagaagatctacatattaagcaggcagcagcattggtggtcaagcttgaaggaaactcactcttctcttcaggaaacatatcaggagctgcatcaaagtattcagaagcattgtcgttgtgtccaatgagatccaagaaagagagggttgttctctacagtaaccgagctcagtgccatcttctgctacaacagcctctggctgctataagcgatgctacacgtgcgctttgtctccacaacccgcttaaccgtcatgcaaaaagtctttggagaagagctcaggcttatgatatgcttggattagccaaagagagccttttagatgcaattttgttcatcaatgaatgctctcaatcaaatgatccggacctatgtttgaggcaaaacaaagttccagactatgcagagcgccttgtcaagaagcagatgcgtgcagcatggttgtttagagaggcagcaatcaaacacgggggtgtccatggtgaggctgatgctgctggggacatgtatgggcaggatactgatggttcagagtgggaaacagctagcgaaagtgatatagggaatgatggaagagatgaaatgggtgatgacgacgaagaagaagatgatgatggtgagtggaagaacgaagatgaaaggaaagataaatacgataagcattcattaaaagacataaaacgtggatacaatgtgcagcttgcggaagatgaatcttgaatttgaaagtgaaaagagaaggaagccatcagcatgttgagcttcgaatacgactccatctttcacaagaagcaaagttcgatagatatttgcaatttgatattgtgttcagaaaggtattaagcttgttttcgtatttcaatttttttgttacctcaaattcttgtttatgtcaactgtagaaagtgaaagtaaaggtttttctgtgtgtttgtgtgtagagaacaattgaggatgtg

SEQ ID NO: 3173 - DNA, 1921 bp, Cucumis sativus
ttctgttgatttttcttgaaccaactcagtaatgagactttaattcttgcccttctgatacttaagtagttgctgagtatggagaaagtgtctacagactgtccttatccgggatgtttcttttgtgtcatgaaagaaggaaatcctagtaagcgcagagcaagtatcttgaagttctttagagaacttccttctcaagatgatgatggtcaagttctccccattagtgggctttggaacacagcaatggcacatcctaatgatcctgaatttattgaattggggatatttgaatgtatgtctgcacttatatggaagggactgaaaaatcggcgttggctttctcacgaccaaaacatttatattccgtattatgctgcacatatcattggatcctacacgatgaacatggaggagtttgctgaaactgctgtgcatgctgcggtgattccaccactagttgaacttcttagcggaagattaacttgggttgagcagagagtagctgttcgtgcccttggtcatctagctacttatgcaagtacttttcctgctgtggctagtcatgccgagatactcgagctctcaattcaactggcaatgagttctcttgaaattgtttatactcacttttaccagtatgtagacagaaggcttagttatcattgtgatcttcttactcgtggaatgggtggggtcgaaatggaatctagaaaggcagaggaatgggccagtcagttacagtgttggtccttacaacttatcaactgctttgcattcaaacctgagtttcttccgactatatgcaagcccgaattcttagtaaagctacctggcatgtggggtggtctcgtaaatgaaaactcaccagctggtattggtttactaagaacaatctgccaccataaacttggtaggggacctgttgctaactgtcccagtattattgaagcattgtgtaacattgcccggtcttcagacgattggcagtctatggcaattgattgtctgatgtggttgcttcaggatccaaatacaagccataaggtaatcgacaaagctgcaccaacacttctggatctagcggagatatcatctctgggtgatcaccggaaactgggggaatccataactaatgttcttcaggaatgtatccaatcccaaggtgccggacgcaattctatcagcaatcgtacaaaggaacagatcgaagaactattaaaatcaaggcaaagactcaagtgggaaaagagcatgccaaaagaggatctgcgaatcaagcaggctgcagctcttgttatcaagcttgaaggaaattccatgttttcatcaggaaatatatccgcagctgcatccaagtattcagaagcactagcattatgccccatgagatccaaaaaggaaagagtcgttctgtacagtaaccgtgctcaatgctatcttctgttgcagcagcccatagctgccattggtgatgctacacgtgctctctgtcttcacaatcccgtaaaccgtcatgctaaaagtctttggagaagagctcaggcctatgatatgcttggcttggccaaagaaagtctgttggatgccatattgttcataaacgagtgctctcagtctaacgacccagatctttcattaaggcaaaacaaggttcctgactacgctgagcgactcgttaagaagcagatgcgtgctgcttggttattcagggaggcagctattaaacatggaaatgtccaatgtgaagatggtgctggtgatgtctacggtagagagactgatgattctgaatgggaaacagccagtgaaagtgatattggcaacgatggaagggacgaaatgggagaagaagaagaagacgatgaagattgcgattggaaggatgaagataaatacgataaatcttcaatcaaaggta

SEQ ID NO: 3174 - DNA, 2770 bp, Citrullus lanatus
cttcttgattgtcggaatcaaaacgccaaaacgttgtcgtatcgcccaccaccgtcttctctctctctctctctctttctccctctcttcagtcctcatttttgtagcacagagctctgaattgaatcaaatcaaaccaaaacactttcttatacacaaaattttgaatttttctttttcccctttgcctttcctcgttgttgctgacgattactacctccttactcagcttattacaactacgagcagctttttttcttttttctttgtctttttttttttttttttttttttttttttttttttttttttttttgaattttcttgaaccaactcagtaatgagactttagttgttgcccttctgatacttaagtagttgctgaccatggagaaagtatctacagactgtccttatccaggatgtttcttttgcgtcatgaaagaaggaaatcctagtaagcgtagagcgagtatcttgaaattctttagagaacttccttctcaagatgatgatggtcaagttctccctattagtggactttggaacacagcaatggcacatcctaacgatcctgaatttatcgaattggggatatttgaatgtatgtctgcacttatatggaagggactgaaaaatcgccgctggctttctcacgaccaaaatatttatattccatattatgctgcgcatatcattggatcctacacgatgaacatggaggagtttgctgaaagtgctgttcatgctggggtgattgcaccgcttgttgaacttctgaggggaagattaacatgggttgagcagagggtagctgttcgtgccctcggtcatctggctacatatgctagtacttttcctgctgtggccagtcatgccgagatactcgagctctcaattcaactggcgatgagttctcttgaaattgtttatactcacttttaccagtatgtggacagaaggcttagttatcactgtgatctgcttactcgtggaatgggcggggtcgaaatggaatctaggaaggcagaggaatgggccagtcagttacagtgttggtccttacaactcatcaactgctttgcattcaaacctgagtttcttccgactatttgcaaacccgaattcctagtaaagctacctggcatgtggggcggtctcgttaatgaaaattcaccagctggtattggtttattaagaacaatctgccatcataaacttggtaggggacctgttgctagctgccccagtattattgaagcattgtgtaacattgcccgctcttcagacgattggcagtctatggcaattgactgtctgatgtggttgcttcaggatccaaatacaagtcataaggtgatcgacaaagctgcacctacacttctagatcttgcagaaatttcatctctgggcgatcaccggaaactgggggaatccataattaacgttctgcaggaatgcgtccaatcacaaggggctggacgcaattctatcagcaatcgtacaaaggaacagattgaagaactattaaaatcaaggcaaagactcaagtgggaaaagaacatgccaaaagaggatctccgaatcaagcaggctgcagcacttgtaatcaagcttgaaggaaactccatgttttcatcaggaaacatatctgcagctgcatccaagtactcggaagcgctggcattatgtcccatgagatccaaaaaagaaagagtcgttttgtacagtaaccgtgcccagtgttatctgctgttgcagcagcctttggctgccattggtgatgccacacgagctctctgtcttcacaatcccgttaaccgtcatgctaaaagtctttggagaagagctcaggcctatgatatgcttggcctggccaaagaaagcctgttggatgccatattgttcataaacgagtgctctcagtccaatgatcctgatctttcactaaggcaaaacaaggttcctgactacgccgagcgactcgttaagaagcagatgcgtgcagcttggttattcagggaggcagctattaaacatggaaatgtccagtgtgaagatggtgctggtgatatctatggtagagagactgatgattctgaatgggaaacagccagtgaaagcgatatcggtaatgatggaagggacgaaatgggggatgaagaggatgacgatgaagattgcgattggaaggatgaagataaatacgataaatcttcaatcaaaggtacctttgaactcatttattctgggtaattgagttacaatctgttgaattccaattctagtagatggtttgtcagtactgctactgttttttaagtgtttatgttttgcatagaaattttgaatggaaagttgatttgatacagagatgtagcataaggatgcaatgtgcagtttgctgagaatgaagcataaattagaagaatcacaaagcagctgactgtatacaaagtgagttgcaatgagttattatttcaagctggctctgaagaagtcatctttctgataattgttcaaaatgtaaaacttgaatctctttttggtcttattactctctttctctctctcatggttttgtttcccccaaaatttattcttcaatccaatccccaactgtagaaaatgaattaggaatgtctagaagatttctcttttcttttttttcctttccctcagagtgattgattattacaggcttgtgtacatagagaattcccagtgttctttatttttaaacggcatattccaatgttatcattttctt

SEQ ID NO: 3175 - DNA, 1271 bp, Setaria italica
ccactttaaaacaagagacaacgttacatcacgcacacacgcgcaccaaagccaagcccggcacacgacaccgcccaccccgccccgcgcacacgcacacacagtgagcacgcgcaccgagccgcgcactgtcctgggaagcggcgggaggagaccgatggggagcagcggcggcagcagcgagcacttcctgcggcagctgagctccagcgacggcggcggcagcgcgccgcaccagctgctgcagcaggagtgggagtgcggcggcggcagcaggcgcgggtcgcggcgctggtccaggaagaaggcgcgggcccgcggccaccgccgcggcggcgggttctgccggacggaggaggccgcggcggcggggcggaagcgcgtgatggtggtggtggaccagagctccggcgccaagcacgccatgatgtgggcgctcacccacgtcgccagcaagggcgacttcctcaccctgctccacgtcctgccgccgcagaccgggaacggcggcggcggcggccgcggaggcggggtggacgcctccgcgctcgccaactccctcggcgcgctctgcaaggcctgcaagcctgaggtggaggtggaggcgcttgtgatccaggggcccaagctgtcgaccgtcctcagccaggtgaagaagctggaggcgtccgtgctcgtgctcagccaacgcaagccctcgcctttctgctgcttcatgcggagcgggagcgaggcgttcgtggaggagtgcatcaaccgggcggagtgcctgacgctggcggtgcggcggcagagcaagggcgtcggtggctacctcgtcagcacccggtggcagaagaacttctggctcctggcttgacgacgctgacgctgacggtgacgggccctcctcattgtgtgcaaacttttactgccaaggctgagcttttaaattacaaacaaggtcgataagctagctgtaactgcatcaataacctccactgtctgtcccagtgtgtgtgtgcctgatctatgtgtgtgtccgtgcgacgctgttgtgatgctgtgtgtattatatatcctcttggttggctctactgctgtagctgtgcctcactgcctcactttgctgatgcaaaagccaggatctgacccgctgcctaacagtgtccgtttgtaaatgtggttttgcatttttcgtttgtagagcacaagagcagggtgcaggagcgcagcaggacgtacattgcataaactacggtttgtgtgttgcgcgatgtgtttgtttgttt

SEQ ID NO: 3176 - DNA, 1400 bp, Zea mays
ccaaatataaaacaagaaagaatggttgcatcacgcgcacacgcgcaccaaagccaagcccagctctcgacagtcgacaccaccacagagcgcgcacgcaccaagccgcgcgcacacacgcacctcgcggcggtagcgggagtggatcgatggggagcagcgggggcagctgcgagcacttcctggggcagctgagctcgagcgacggcggcagcgcgccgcaccagctgctgcagcgggagtgggactgcggcaccggcaccggcagcaggcgtgggtcgcggcgctggtccaggaagaagggcagggcgcggggacaccgccgcggcggcgggttctgcaggactgaggaggccgcggcggcgtcgcggaagcgggtggtggtggtggtggaccagagctccggcgccaagcacgccatgatgtgggcgctcacccacgtcgccaacaggggcgacttcctcaccctgctccacgtcctgccgccgcacagcgggagcggcggcggcggccgcggtgctggggaggaggacgcctccgcgctcgccaactccctcggcgcgctttgcaaggcctgcaagcctgaggtggaggtggaggcgctcgtgatccaggggcccaagctgtcgaccatcctcagccaggtgaagaagctggaggcgtccgtgctggtgctcagccaacgcaaaccctcgcctttctgctgcttcctgcggagcaggagcagcagcgaggaggaggagctggtggaggagtgcataaaccgggcggagtgcctgacgctggcggtgcggcggcggagcaagggcgtgggcggctacctcgtgagcacccggtggcagaagaacttctggctgctcgcctgaccggtccacgaggactccccctcctcatcctcatcctttgacgcaacgcaagagttttacttacttcccgggctaatcgtttttacaaagtccaataataagtaaccaccaccaccaccactactgcatctgtttgttgatctgtaacctccagtgtcctagggtgtgtgccagccagtgtgcgtgtgcctgatcctctctctctccccacgatgtggtgctgtattctatgtatcgtcttggtttagctgtgctgctgtagcctgtagagtgtaagctagctgttgtgtagtgaaggcacgcagaagctgagccgatccgtttgccctgtctgttctgcgggaatctgtctgttttgcagagcggggatgcagaggcgcgggacggggacgtcagtacactgcgttgcgttgcgttgcgttgcataaactacgacttgtgtattgtgcttgtgcgatgtgtttgtttgcttgcttgcttgctacaatggttggtacagagttccataatgaagtgatgatgcgttttgactaa

SEQ ID NO: 3177 - DNA, 1337 bp, Sorghum bicolor
caaagccagagcccagcacacgacagtcgacaccaccaccacagcgcgcacacgcaccgagccgcgcgcacacgcacctcgcggcgggagcgatggggagcagcgggggcagcagcgagcacttcctgcggcagctgagctcgagcgacggcggcggcagcgcgccgcaccagctggtgcagcgggagtgggagtgcggcggcggcggcaccggcagcaggcgcgggtcgcggcgctggtccaggacgaagaaggccagcagggcgcggggacaccgccggttctgcaggacggaggaggctgcggcggcggctgcggcggggcggaagcgggtgatggtggtggtggaccagagctccggcgccaagcacgccatgatgtgggcgctcacccacgtcgccaacaagggcgacttcctcaccctgctccacgtcctgccgccgcagagcgggagcgggatcgggaccagcgtcggcggcggccgcggcgttgcggaggacgcctccgcgctcgccaactccctcggcgcgctttgcaaggcctgcaagcctgaggtggaagtggaggcgcttgtgatccaggggcccaagctgtcgaccatcctcagccaggtgaagaagctggaggcgtccgtgctggtgctcagccaacgcaagccctcgcctttctgctgcttcctgcggagcagcagcgaggaggtggtggaggagtgcatcaaccgggcggagtgcctgacgctggcggtgcggcggcagagcaagggcgtcggcggctacctcgtcagcacccggtggcagaagaacttctggctcctcgcttgaattgatccacaaggcctcccctccttggaacttggatgcaagatttcactgcccgggctaagctttgtacaaggccaataagtaaccactactgcatctactactccaatgtcctcgggttagagtactattgatctactataacctccaatgtccttgggtgtccagtcagcgtgcgtgtgcctctctctctctctctctctctctctctctctctctctctctctctcttatctgatgtgctgctgtattctatcgccttggtttagctgtgccgctgtagtctgtagctgttgtgtagtgaagctgtgctgctcccgtttaccctgtctgttctgcctgcgggaaatctgtctgtttgtagagcagggtgtgcaggagcgcaggacgtacgtacgtacactgcattgcattgcattacgtaaactagaatttaattgtgtattgtgcgatgtgtttgtttgcttgctgaaatgctgagtacggaatgaactgatgacgatgtgtttgaccaac

SEQ ID NO: 3178 - DNA, 1442 bp, Sorghum bicolor
acctgatttattagaggcgggcatagattaactctgacctgtgcgggtgtgcccgcctccactttaaaacaagaaagaacgttacatcacgcacacacgcgcaccaaagccagagcccagcacacgacagtcgacaccaccaccacagcgcgcacacgcaccgagccgcgcgcacacgcacctcgcggcgggagcgatggggagcagcgggggcagcagcgagcacttcctgcggcagctgagctcgagcgacggcggcggcagcgcgccgcaccagctggtgcagcgggagtgggagtgcggcggcggcggcaccggcagcaggcgcgggtcgcggcgctggtccaggacgaagaaggccagcagggcgcggggacaccgccggttctgcaggacggaggaggctgcggcggcggctgcggcggggcggaagcgggtgatggtggtggtggaccagagctccggcgccaagcacgccatgatgtgggcgctcacccacgtcgccaacaagggcgacttcctcaccctgctccacgtcctgccgccgcagagcgggagcgggatcgggaccagcgtcggcggcggccgcggcgttgcggaggacgcctccgcgctcgccaactccctcggcgcgctttgcaaggcctgcaagcctgaggtggaagtggaggcgcttgtgatccaggggcccaagctgtcgaccatcctcagccaggtgaagaagctggaggcgtccgtgctggtgctcagccaacgcaagccctcgcctttctgctgcttcctgcggagcagcagcgaggaggtggtggaggagtgcatcaaccgggcggagtgcctgacgctggcggtgcggcggcagagcaagggcgtcggcggctacctcgtcagcacccggtggcagaagaacttctggctcctcgcttgaattgatccacaaggcctcccctccttggaacttggatgcaagatttcactgcccgggctaagctttgtacaaggccaataagtaaccactactgcatctactactccaatgtcctcgggttagagtactattgatctactataacctccaatgtccttgggtgtccagtcagcgtgcgtgtgcctctctctctctctctctctctctctctctctctctctctctctctcttatctgatgtgctgctgtattctatcgccttggtttagctgtgccgctgtagtctgtagctgttgtgtagtgaagctgtgctgctcccgtttaccctgtctgttctgcctgcgggaaatctgtctgtttgtagagcagggtgtgcaggagcgcaggacgtacgtacgtacactgcattgcattgcattacgtaaactagaatttaattgtgtattgtgcgatgtgtttgtttgcttgctgaaatgctgagtacggaatgaactgatgacgatgtgtttgaccaact

SEQ ID NO: 3179 - DNA, 1053 bp, Secale cereale
ccgcgcactcgcaccgagccgaccgccgcgcgctgcaaggcggggaggggaggggagaagatcgatggggagcagcgggggcagcagcgactacttcctgcgccagctgagctccagcgacggcggcagcgcgccggcgccggcgccgcgccagccggaggaatgggagtgcggggccggcaccggcaccggcaggcgcgggtcgaggaggtggtcgaggaagaaggcgcgggcgagaggccaccggcgcggcgggttctgcggcgccccggaggaggccgcggtggccgggaggaagcgggtgatggtggtggtggaccagagctccggggccaagcacgccatgatgtgggcgctcacccacgtcgccaaccggggcgacttcctcacgctgctccacgtcctgccgcgcggcggcgccggccgcggcgaggacgcctccgcgctcgccaactccctcggctccctctgcaaggcctgcaagcccgaggtggaggtggaggcgcttgtgatccaggggcccatgctggccaccgtcctgagccaggtgaagaagctggaggcgtccgtgctcgtgctcagccaaagcaagccgtcccctttctgctgcttcatgcggagccgcggcgaggtgctggtggaggagtgcatcagcagggcggagtgcctgacgctggcggtgcggcggcagagcaagggcgtcggcggctacctcgtcagcacccggtggcagaagaacttctggctcctggcttgacactcactcgcaacaagagcctccctggatgattttactgccgatcgagaggctaataagtgacgatcactgcaacaatgaccctccggtactgcttgtatgtttgcttctgtgcgtgtttgttgtcattccttggttaattagcaataactctcaccatgctgatgtaaagccaaaagctgacccgactcatgtaacatatctgtgctctgcgtttatgtttgttttgttgagtttgagcaggacagacagtgcatgaactaccatctgtactattactcgacatgtttcttcgc

SEQ ID NO: 3180 - DNA, 1045 bp, Triticum aestivum
aggcggggaagggaggtgaggggaggggatcgatggggagcagcgggggcagcagcgactacttcctgcgccagctgagctccagcgacggcggcagcgcgccggcgccggcgccgcgccagccgggggaatgggagtgcggcggcggcaggcggggctcgaggaggtggtcgaggaagaaggcgcgggcgagaggccaccggcgcggcggcggcgggttctgcggggcgccggaggaggccgcggcggcggggaggaagcgggtgatggtggtggtggaccagagctccggggccaagcacgccatgatgtgggcgctcacccacgtcgccaaccggggggacttcctcacgctgctccacgtcctgccgcgcggcggcggcgcccgcggcgacgacgccgccgcgctcgccaactccctcggctccctctgcaaggcctgcaagcccgaggtggaggtggaggcgcttgtgatccaggggcccatgctggccaccgtcctgagccaggtgaagaagctggaggcgtccgtgctcgtgctcagccaaagcaagccctcccctttctgctgcttcatgcggagccgcggcgaggtgctggtggaggagtgcatcagcagggcggagtgcctgacgctggcggtgcggcggcagagcaagggcgtcggcggctacctcgtcagcacccggtggcagaagaacttctggctcctcgcttgacgctccttcactcgcaccaagagcctccctggatgattttaccgccgatcgagaggctaataagtgatgatcactgcaacaatgaccctccggtactctctccttgtatgtttgaatatgtgcgtgtgttttctctctctttctctgtgtgcatgcttgttgtgcgtgtgtgttgtcattccttggttgattactatgctgatgtaaagccaaaagctgacccgcttcatgtaacatatctgtgctctgcgtgtatgtttgtttgttgagtttgagcaggacacagtgcatgagctctaccatttgtgataatattacgccacgtg

SEQ ID NO: 3181 - DNA, 1075 bp, Secale cereale
ccgcgcactcgcaccgagccgaccgccgcgcgctgcgaggcggggaggggagaagatcgatggggagcagcgggggcagcagcgactacttcctgcgccagctgagctccagcgacggcggcagcgcgccggcgccggcgccgcgccagccggaggaatgggagtgcggcgccggcaccggcaccggcaggcgcgggtcgcggaggtggtcgaggaagaaggcgcgggcgagaggccaccggcgcggcgggttctgcggcgccccggaggaggccgcggtggtcgggaggaagcgggtgatggtggtggtggaccagagctccggggctaagcacgccatgatgtgggcgctcacccacgtcgccaaccgggggggacttcctcacgctgctccacgtcctgccgcgcggcggcgccggccgcggcgaggacgcctccgcgctcgccaactccctcggctccctctgcaaggcctgcaagcccgaggtggaggtggaggcgcttgtgatccaggggcccatgctggccaccgtcctgagccaggtgaagaagctggaggcgtccgtgctcgtgctcagccaaagcaagccgtcccctttctgctgcttcatgcggagccgcggcgaggtgctggtggaggagtgcatcagcagggcggagtgcctgacgctggcggtgcggcggcagagcgaagggcgtcggcggctacctcgtcagcacccggtggcagaagaacttctggctcctggcttgacgttcgttcgctcacgacaagagcctccctggatgattttattgccgatcgagaggctaataagtgacgatcactgcaacaatgaccctccggtactgcttgtatgtttgcttctgtgcgtgttttttttcttgtgtgtgtgtgtgtgtgtgtgtgcatgcttgtgcgtgtgtgttgtcattccttggttaattagcaataactctcaccatgctgatgtaaagccaaaagctgacccgactcatgtaacatatctgtgctctgcgtttatgtttgtttgttgagtttgagcaggacagacagtgcatgaactaccatctg

SEQ ID NO: 3182 - DNA, 653 bp, Zea mays
aacggtctattgccttcccctctgctgctctgctctgttcgcttgtgctccttctttccatggcggcatacgccggaatcctagttccaccgctccccgtccgcctctcggtctctcaccttagatccgttaccccggcttcctactccctgaaccaccgtcccccccgccccgcggtcgcccgtgcggcttcccgcggcaacggcaacggcgggccaccggtggagggggagaaggagcggcgacgctcgtcgctcccggcgctgtcggagatccggttgggagagcttctgtccccggaccccgccaatgccgtggctgtggtgctcacgggcgcgctcgtatgggctggcgcctcactgctgctgcagctcacgctcatctccgcagcaatcttcgccgccgccgtcaagtactcgtttgtcgccgcgctcctgctaatcgtccttatcgccctgctgtgatcgacccggccaagaaaaaaagctgtaaattcgcacgaagcattccgattgaagatcatgtagatggcaaagcagcggatttcaaatgtttccattatttttgaatggagcagtagaaaatatttgcctgccagtgccaggtgcgtatattattattattgttttttttttgcacactgagataattgg

SEQ ID NO: 3183 - DNA, 457 bp, Sorghum bicolor
cttccatggcggcacacgccggaaccctagttccacaccacctccccgtgcgcctcgcggtcgcccaccccagaccggtcacccatccttcctgctccctcctccgcccgcgtctcccccgcctcgcggtcgcccgtgcggcctcccgcggcggcaacggcgacggcgggcccccggcggagggggagaaggagcggcgagccccgtcgttcccggcgctttcggagatccggtggggcgagctgctgtcccctgaccccgccaacgccgcggccgtggtgctcacgggcgcgctcgcgtgggctggcgcctcgctgctgctgcagatcgcgctcatttccgcggcaatcttcgctgccgccatcaagtactcgtttgttgccgcgctcctgctcttcgtccttatcgcgctgctgtgactgtgatcaacccgcccaagttttgattggccttgcag

SEQ ID NO: 3184 - DNA, 1128 bp, Sorghum bicolor
cacccacccattcccttcccctcagggctgctctgcttgtgctcctcctcctcccttccatggcggcacacgccggaaccctagttccacaccacctccccgtgcgcctcgcggtcgcccaccccagaccggtcacccatccttcctgctccctcctccgcccgcgtctcccccgcctcgcggtcgcccgtgcggcctcccgcggcggcaacggcgacggcgggcccccggcggagggggagaaggagcggcgagccccgtcgttcccggcgctttcggagatccggtggggcgagctgctgtcccctgaccccgccaacgccgcggccgtggtgctcacgggcgcgctcgcgtgggctggcgcctcgctgctgctgcagatcgcgctcatttccgcggcaatcttcgctgccgccatcaagtactcgtttgttgccgcgctcctgctcttcgtccttatcgcgctgctgtgactgtgatcaacccgcccaagattcaagttgcagagatggcactcgtggcaaacatacactgactttgctttgctctcaagttgatacgcatgcattgacacggcttgcttttatatagcaatccaccttcaagggaatatgacctttgggcagcattggttgcatctctgtgggccacttgaaagcaccttgcaggtcactgtacatctttatttatgctcctgtaaattctcatgaacattgtaatatgatatagttgtatatttgtgttatgattaagttaactcatcttaagattctgctccactattctgcgtgtaaggagaatttgttgttattgcttaccctgaacataacgacatgttggtagatttgatgtttaatagtcatcctttcttgtgtaagatctacttttaaccatgttttctgtttctgcggtagaacaagttcctgtactataataagaatctagcttttctgtcagaagtggatgaaaaagtagaagtttagggttcaagctgttttctccatgatactgtaccagctttaggacttgtttttaggtcacatattccaaaattgttaatcattccttagtttatactctagctcacactggatttatctgataaatcttcatcgcactggtgtattt

SEQ ID NO: 3185 - DNA, 4688 bp, Sorghum bicolor
cccgccctgagattattagttacttattcatcccaccaacaccatcaccatgtgatctggacctgacctcggatgtggaggaggaattgaggatgagatcatgagagagagtgagcagcagggtgcgtggtggtggaagcaaggaatgttagtttactgtttcttgccctgcaactcctggattagccataggcctcctccttgttccttcaaccaataaagctttctctgtcttttttttaacactccagtagtaatttttttctgttactattaggaggaggatgctagcagtaatttattcctagctactaccagcctactaccagaccttttcctcccccgtaaactactaccactccttgctctactctaccggtacctgtattattactggcggtggtggtgtggtgctgctgtcttggctcctgctcctgcctccggggcgcggcaccttcccctcttcctcctcctgtcctccacacctcctctcccactgctcggactcctccgccacatgggttcggtgtcctccatggcgtggtgccaaaatgtcggtcgggcctcgtcgtcttcctgcgcttcaggggcttcctgcggttgcgacgggaggagcagctagcgccgcggctgtgatctggggccgcgccgcattgccgactgcctgccgccgggctcgcgcgccgttcctgctgtggtgagggggggcaaggcaagatgcggcctcttgctctcgtcgcgcttcttcttgcttccgttctcggatccagaggtaccactctggccccttctcctgctgtcactgattctcctgcaaaccaaggacaggcttctagtcctcctcaacctgcatttgctcttggtccagtaactgttccaacagggccggctactccatcagcaagtccttccccagagaaggcagctgtaagtcctgcttctcccgtggagccacaaaatgctcccagtccagtgacttctcctaaagagaataatgcacctcctccaattgaggtggcaccccctgatcccaccgatgaggttcctccaccagtagctccaccacaagctgcagctggaaatcctactccaattcttcctgggacacctgcattgctaccttctgttcaggctcctgctccttctgttgttctcaagcctagtccaccagtagctccaccacaagctgcagttggaaatcccactccaattcttcctgggacacctgcattgctaccttctgttcaggctcctgctccatctgttgttctcaaggctaatccaccagtcgcgtcacctccatctgcgagcaatcaaccaagtaggccagttggctcagtccctccttatcgaccccctgtattgccccctccggcaaatgacgttccaccatacccaccttcaggaagttttcctgctattcctccttccacttcagacccacctccgaccgcatcacctgttattgcacaagcaccacaacggcaagcagatcctcgaagcagagattataagaatggaaacacggcgccgtcagcaaatacttaccctcctacaagtctcaagaagcatcatgttccacatgcatcccctccaaaggagtccactggccaaactgccccagttcacaaatcaccagttacaggatctgcgcctgcaacaagtcctttgccccagaacacaaacatgccttcaatcccgaagaatgcttcatcagtgtcacatgcccaaccctcaccaccaagtgtagctccaaaattggcacccactggtagatctcatgctcggggatggaaatccagaaatcctaataacggaacaaatagatcatctgccccatcttatccaccacctcgtgctcaagggcccgaggtctcacgagctccaagacagactgggactaaaagccatactcaccatgcgcctccaccaatccctcaaggacacccaagcttacctgtacactccccgtccccttcaccagcgtcatcgaggagtcctgctaacgggaagaaaagtcatcgtatttctcctactctgcctccaatccctccccttccagagccaaaagcaccatcagcacatcctatctggacattacctccaccaccacctaattcagattgcaattcattatcatgcccagagcctctaacagatccacctgcgggagcaccatgtgcctgtgtgctaccaatcagagttggaattcgtctaagcgttgacctttattcattttttccattggtctctgattttgctgaagaggtagcttcaggggtaaacatggcacagagtcaggtccgtgtaatgggtgcaaatgttgcaggtgatcaacctgacaaaacaatggttcttgttgatctagttccaatgcaagtgaagttcgacaatgcaacagcgttttcagcatttgaaagcttgtggggcaaaaaagtttctttaaaaccatcagtctttgggaactatgcgattctctatgttgtatatccagggcttcctccttcaccaccttcagggccagaaggtgttggggacggggcatttggcaacaacggaaatgcaagggccatgaagcctcttggggtcgatgtaggaagacccaagagaaaagtgaatggcagcctcattgctgttgctgttttgtctactgttatagcattgattatttgctgtctggctgcatggttgctgatactcagattcaggggtccgagtgacacggctcaaggatttccacgtactgtacttccaaaattttctaggtcatctggcacaggtcacacacttttagttggtgctggtcgctatagttcaccttcaggtccatcaggttcactgggctcaagcatcgcaacatatgcagggcaggcaaaaacattcaaatttgctgagattgacaaggccacaaatggctttgatgattcaaaagtacttggagaaggtggcttcggatgtgtctaccagggcacacttgaagatggaactacggttgcagtgaaggttctgaagagatatgatggccaaggtgagcgagagttcttggctgaggttgagatgctgggacgtttgcatcaccggaatttggtcaagttgttaggcatctgcatcgaggagaatgcacggtgtctggtgtacgagcttattccaaatggcagcgtagaatcccatttgcatggagtggaccgtgagacagctccacttgattggaattctcgtatgaagatagcgctcggggcagcacgagcacttgcatatctacatgaagattctagtccttgtgtgattcatcgcgattttaagtcaagcaacattcttctggaggatgattacacaccaaaagtgtcagactttggacttgccaggactgcaaggggagaggggaaccagcacatctctacacgtgtcatgggaacatttggctatgtggcgccggagtatgctatgacgggtcatcttcttgtaaagagtgatgtgtacagttatggagttgtattacttgagcttctcactggtaggaaacctgtggatatgtctcaacctgctgggcaagaaaacctagttgcatgggctcggccccttctaacaaatgttctgagcctacgccaagctgtcgatccacttcttggccctaacgttccactggacaatgtagcaaaagcagctgccatcgcatcaatgtgcgtacaacctgaggttgcgcaccgccccagcatgggtgaagtagtgcaggccttgaaacttgtgtgcagcgagggtgacgattgccttgcatcaggaagattcagccaggagttgcccatgcaaagtagggcaatttatgacgcgactggaatggaagctgagagagtgctaatatccgagatatatggctccacaccagtctttactccagctgctgattcggattcttttcgcaagcagtcaagttcaggcccgctgatgacaggcaagaacaggaagttctggcagaggttgcgaagcctgtcaaggggcagcatgagtgagcatggcgtctcaccagactatgaaacacgctcgcaatatagtggtaggtgaggaaacttttgcttggcttccattagaagatggattgatgctcagtcgattgggaataaaagagtttcaagctgagctagtgtaaattatgcatctggagacaaaaagctatagttcaggatgtcatcagggagcaaactggagcctgagctttggattgctggacataagctctgctccagaaccctgataccccacttctgtttagagcttgttaatttgagtttttgagctcttcttttgtctaggtagtagtttattttttgcttaatcttttgtttggtcagttgtttgttagggctgttgatttgtatagattcaggctacatttctttgggcttgtggacttccatagttgttgtacactgacatatgctggtcttaaatgaggatgataggtttttggttctaatttgtgactagttgcttcttatgaattccatctgatgttcagaaaaatgttcttgggtatgttgtcaactgaacatttgtaatgtctgcgattctgaatcagagaagctgtaaaggttatctagcacaatggcaggggttttctctttgagaatatactgaacgtacataccagcaggggttttctctttgagaatatactgcagcatgagatcctg

SEQ ID NO: 3186 - DNA, 3994 bp, Setaria italica
gctcttgccttgcctccgggtcggcacctcctcaccttcctctattcctcctccccttccctccctcccactgccaggcttcctactcctccacatgggtttggtgccctccatggcgtgccgccaaaatgtcggtcaggctccgtcgtcttcccgcgcttcaggggcttcttgcggttgcggcgggaggagcggcgtcgcagcggagccggcaaggttgtgatctgtgccggcattgacggctgctgctgggcttgctgatttcccactgcggcggcgcgcgcgtgaggggagcgagatgcggactcttgctctcgtggcgcttcttcttgcttcggctcttggatccagaggtactactctggccccttctcctgctgtcactgattctcctccagaccaaggacaagcttctagtcctcctgaacctgcatttgctcttggtccagtaactattccaacagcaccatctactccatcagcaagtccttcccccgagaaggcagctgttagccctgctgctcccactgagccgcaaaatgctcccagtccaataactcctcctgaagtgtataatgcacctcctccaattgaggttgcacccactgatcccacggatgaggttcctgcaccggtagctcctccacaagctgcagctgaaaatcccactccaattcttcctggggcacctgcactgctaccttctgttcaggctcctgctccgtccgttgccctcaagcctattccaccagtcgtgccacctccatctgtgaacaatcaaccaaataggccggttgggtcagtcccacctcatccaccccctgcattgccccctccagcaaatgacgttccgccatacccaccttcaggaagttttcctgctatccctccttccgcttcagttccacatgtaaatcctccgattgcatcacctgtagtacaagcaccgcgacagcaggcagaggctccaagaagtgagcataagaatggaaacacagcacccccagcaaatatttcccctcctgcaaatctcaagaagcatcatgttccacatgcatctcctccaaaggaatccactggtcaaactgtcccagatcacaaaccaccagttacaggatctgcacctgcaacaagtccttcgccccagaacacaaatatgccttcaatcccgaagaatgcttcatcagtttcacatgcccaaccttcaccaccaagtttagctcctaaatcggcacccactggtagatctcatgctcggggatggaaatccaatactccaaagaatggaggaaatccatcaattgccccatcattcccgccgtcacgtgctcaagggcccgaggtctcgcgagctccaagacagactgggactaaaaggcaaaatcaccatgcacctccaccaatccctcaaggacatccaagctttcctgtacatcccccatctccttcgccagcatcgtcgaggggtcccacgaaaggaaagaaaaggcatcatctttctcctactttgcctccaatccctcccctgccggagccaaaagcaccatctgctcatcctatttggacattgcctccgccaccacctaattcagattgcaattcattatcatgccctgagcctctaacagatccacctgcgggagccccatgtgcctgtgttctaccaatcagagttggaattcgtctaagtgttgacctttattcattctttccattggtctctgattttgctgaagaggtatcgtctggggtaaacatggcagagaggcaggtccgtgtaatgggtgcaaatgttgctggtgatcaacctgacaaaacaatggttcttgtcgatctagtaccaatgcaagtgaagttcgacaatgctacagcattttcagcatttgaaagcttgtggagcaaaaaaatttctttaaaaccatcagtctttggggactatgagattctgtatgttgtatatccaggtcttcctccttcaccaccttcagcaccagaaggtgttggtgatggggcatttggcaacaacagaaatgcgagggcaatgaaaccccttggggttgatgtaagaagacccaagagaaaagtgaatggcagcctaatcgctattgccgttttgtctaccgttatagcattgattatttgctgtcttgctgcatggttgctgatactaagattcaggggcccaagtgacacagctcaaggatttccacataatgtacttccaaaattttctaggtcatctggcacaggtcacacgcatttagctggtgttggtcgctatagttcaccttcaggtccgtcaggttcactaggctcaagcatcgcaacgtacgcagggcaggcaaaaacattcaaatttgctgagattgacaaggccacaaacggctttgatgattcaaaagtacttggcgaaggtggcttcggatgtgtctatcagggcacacttgaagatggaacgacagttgcggtgaaggtccttaagagatatgatggccagggtgagcgagagttcttggctgaggttgagatgctgggacgtttacaccaccggaatttggtcaagttgttaggcatctgcgttgaggagaatgcacggtgtctgatatacgagcttattccaaatggcagtgtagaatcccatttgcacggagtggaccgtgagacagctccacttgattggaattcccgtatgaagatagccctgggggcagcgcgagcgctcgcatacctacatgaagattcaagcccgtgcgtgattcatcgcgatttcaagtcaagcaatattcttctggagcatgatttcacgccaaaagtatcagacttcggactagccaggaccgcgaggggggaggggaaccagcacatctccactcgtgtcatgggaacattcggctatgttgcaccggagtacgccatgacagggcatctccttgtaaagagtgacgtgtacagttatggggttgtattgcttgagctcctaactggtaggaagccggtggacatgtctcagcctgcagggcaagaaaacctagtggcttgggctcggccccttctaacaaatgttctgagcctacgccaagcagtcgatccacttcttggccctaatgtgccactggacaatgtagcaaaagcagccgccatcgcatcaatgtgcgtacaacctgaggttgcgcaccgccccagcatgggtgaagtagtgcaggccttgaaacttgtttgcagcgagggtgacgattgccttgcatcaggaagattcagccaggagttgcccatacacactacagcggtttatgacgtgactggcatggaagcagagagagtgctgatatctgagatatttggctccacgccagtcttcactcctgctgatgactcaggctctttccgcaagcagtccagttcaggcccactgatgacaggcaagaacaggaagttctggcagaggttacgaagcctgtctagggggagcatgagcgagcatggcgtttcaccagattatgagacacgctcccaatacagcggcaggtgaggaaaattttgctcggcatccaattttccaaagacagatggatattcagttgattgggaataaaagagtttcaagctgagctagtgtaaattatgcatctggattctggagaaaaaagctatataatatagttcagatcacatcagagtagcagcggactgctcatatatggccagactccagaaccctgatacccctcgttcctttacaggttgttagttttgagttttttgttcttttgtttagttagcagtttatttgcgcttagttttttgtttggtagttgtttgttagggctgttgtgtatagattcggaatacatttcttgggcttgtggatttcgacagacttgttgtacactgacatttgctggtctgaaatgaggatgatagattcttggttctggctcgtgactagttgttactgacgaattccatctgatttgaagaaaaaacattcttgaga

SEQ ID NO: 3187 - DNA, 647 bp, Sorghum bicolor
acacttcagtcttcacaagagaacaactgcactgttccagcgtgagatagagaaagagagagagagagagagagcaaggatggcgtctctgcttagcctgtacggaagcggcggccggaggaggatgagccgcagtagtggcacggcggcgccggtgaggcggctgctgaggagactgaggtccagcttcggccggagcgcggcgcggccaaggcgaagaagcgcggtgaggttcgggtacgacctgcacagctactcccagaacttcgacgacggcgttgcctcgtcagctccggcggccatggcttgtgcgtagctaggattctagaaccagccaatcaggattctgcttctcttatgtgtaaataactatagccaagatattagtgtggcttaatgcttcctcactgagagattgaccgagtccagggttaatttccggtgattagctatctactgtaggttcgttagttgttgtatatacaagttgtttcgtctgtgtaataagctacccacaagacagcagttctatgcctgccatagatcaacacacaaggggatttatagattgctttggtcagctgttggaatatggatggatttgatctgttgatttaagctactctttatgctaaattgctgatata

SEQ ID NO: 3188 - DNA, 718 bp, Sorghum bicolor
gcagggtcttcacacttcagtcttcacaagagaacaactgcactgttccagcgtgagatagagaaagagagagagagagagagagcaaggatggcgtctctgcttagcctgtacggaagcggcggccggaggaggatgagccgcagtagtggcacggcggcgccggtgaggcggctgctgaggagactgaggtccagcttcggccggagcgcggcgcggccaaggcgaagaagcgcggtgaggttcgggtacgacctgcacagctactcccagaacttcgacgacggcgttgcctcgtcagctccggcggccatggcttgtgcgtagctaggattctagaaccagccaatcaggattctgcttctcttatgtgtaaataactatagccaagatattagtgtggcttaatgcttcctcactgagagattgaccgagtccagggttaatttccggtgattagctatctactgtaggttcgttagttgttgtatatacaagttgtttcgtctgtgtaataagctacccacaagacagcagttctatgcctgccatagatcaacacacaaggggatttatagattgctttggtcagctgttggaatatggatggatttgatctgttgatttaagctactctttatgctaaattgctgatatatagatttatccaggtgaccggcacacctcttgcaatataatgcgtatgtttgattgctaa

SEQ ID NO: 3189 - DNA, 527 bp, Triticum aestivum
caaggatggcgtctctgcttagcctgtacggaagcggcggccggaggaggatgagccgcagtagtggcacggcggcgccggtgaggcggctgctgaggagactgaggtccagcttcggccggagcgcggcgcggccaaggcgaagaagcgcggtgaggttcgggtacgacctgcacagctactcccagaacttcgacgacggcgttgcctcgtcagctccggcggccatggcttgtgcgtagctaggattctagaaccagccaatcaggattctgcttctcttatgtgtaaataactatagccaagatattagtgtggcttaatgcttcctcactgagagattgaccgagtccagggttaatttccggtgattagctatctactgtaggttcgttagttgttgtatatacaagttgtttcgtctgtgtaataagctacccacaagacagcagttctatgcctgccatagatcaacacacaaggggatttatagattgctttggtcagctgttggaaaaaaaaaaaaa

SEQ ID NO: 3190 - DNA, 1170 bp, Sorghum bicolor
atggcgtcatcttcctgcgtccgcctccatcacctgccgtccacctctcgccgggcgaccgctccaaccaaccttcagttccgcgcggcgagctgccggtggcggcggctttccattcccgttcccggcgtgtcccctcctcccctccgcctccgcgccacgggtgcctcgcagccgcttggtactgacagcaacgaggaggtcgagaaggtggaggagcagcctcagcctccgccgcggctcaagatcgccgtggtcgggttcggcaccttcggacagttcctggcgcgcacgctggtggcgcaggggcacacggtgctggcgcactcccggtccgaccactccgccgcggcggcgtccatgggcgcgctcttcttctcggacccgcacgacctgtgcgagtgccacccggacgtggtgctcctggccacctccatcctgtccgcggagtccgtggtccggtcgctcccgctgcaccgcctccgccgcgacaccctcttcgccgacgtgctctccgtgaaggagttccccaagaggctcctcctgggcttgctcccggaggagatggacatcctctgcacgcacccgatgttcgggccggagtcggcgcgcgccggctgggcgggcctccccttcatgttcgacaaggtgcgcgtccgggacaccgtcccggcgcgccgcgcccgcgccgaggcgttcctggacgtgttcgcgcaggaagggtgccggatggtggagatgtcgtgcgccgagcacgacgcgcacgccgccgagacgcagttcctgacgcacaccgtcggtaggatgctggcggcgctggagctccgggcgacgccgatcgacacgagagggtacgagacgctgctccggctggtggagaacacgtgcagcgacagcttcgacctctacaacggcctgttcatgtacaacaacaactccaccgagctgctcaaccgcctcgactgggccatggacgccgtcaagaggaggctcttcgacggcctccacgacgtgctccggaggcagttgttccacgtcggggaggtggagggggaggcggagcgcatggaggagctggcggtggtgccgggtggtggtccggacaccgatgacgacgggtgcgcgacggcgacggcgacgagcatcaagtcgggagaggagaataattga

SEQ ID NO: 3191 - DNA, 1433 bp, Sorghum bicolor
atggcgtcatcttcctgcgtccgcctccatcacctgccgtccacctctcgccgggcgaccgctccaaccaaccttcagttccgcgcggcgagctgccggtggcggcggctttccattcccgttcccggcgtgtcccctcctcccctccgcctccgcgccacgggtgcctcgcagccgcttggtactgacagcaacgaggaggtcgagaaggtggaggagcagcctcagcctccgccgcggctcaagatcgccgtggtcgggttcggcaccttcggacagttcctggcgcgcacgctggtggcgcaggggcacacggtgctggcgcactcccggtccgaccactccgccgcggcggcgtccatgggcgcgctcttcttctcggacccgcacgacctgtgcgagtgccacccggacgtggtgctcctggccacctccatcctgtccgcggagtccgtggtccggtcgctcccgctgcaccgcctccgccgcgacaccctcttcgccgacgtgctctccgtgaaggagttccccaagaggctcctcctgggcttgctcccggaggagatggacatcctctgcacgcacccgatgttcgggccggagtcggcgcgcgccggctgggcgggcctccccttcatgttcgacaaggtgcgcgtccgggacaccgtcccggcgcgccgcgcccgcgccgaggcgttcctggacgtgttcgcgcaggaagggtgccggatggtggagatgtcgtgcgccgagcacgacgcgcacgccgccgagacgcagttcctgacgcacaccgtcggtaggatgctggcggcgctggagctccgggcgacgccgatcgacacgagagggtacgagacgctgctccggctggtggagaacacgtgcagcgacagcttcgacctctacaacggcctgttcatgtacaacaacaactccaccgagctgctcaaccgcctcgactgggccatggacgccgtcaagaggaggctcttcgacggcctccacgacgtgctccggaggcagttgttccacgtcggggaggtggagggggaggcggagcgcatggaggagctggcggtggtgccgggtggtggtccggacaccgatgacgacgggtgcgcgacggcgacggcgacgagcatcaagtcgggagaggagaataattgatgccacggcagggcgcggcggtgtggcataaaggcacgacgtcgatctgtcgcggcgtgcggcttgccttgcgttgcatgttggttggatcttgctgtcttccttgttaatcgttgatgtggagtgtcgatctttcgctttactccgtttccatttcagtgcgataaataataaactgtgacatgacaactgtatcagtgagagtgaagtgatcgatcatctacagtacagatgaattctgggttgcactgcaccgcgtcatt

SEQ ID NO: 3192 - DNA, 3377 bp, Setaria italica
tgactttgttacaatgggtcatgtcctaatcaaaagaaggaccacattttcatgtcaacattgaacatactatctttcattattgctgggtagttggaacacacaagtgcatattcaagatgacggacatgaggcgtcactctgtggatgttccactgtcaaggaccttagtgcagctcaagcgtgtgagatcgctgcgggatccagcgacaaactcattgagcaagtacgcatctccttctgatcacatgatctgggagactgcttctagcaatggggtgactctggagctcggcaggtcagtacatcatcagctggttgaagaagatgaagatctgggagctgaggctacaatggggtcagagcggagttttcgggcaccaaatgcaaggactgcatcgtatagaaaaacttctgctgtcaagatcagaggcttgaacccgccaagaaacaagcaggttcatcgtgtccgccaagatggtcaccgcaagtcattggattctaaccactccaatcatagttctatccggcaattggcaaacaatatagtcaacaatgtggatgcagagaaggaagaggaggaagtgaattcttatgaaagaccaaattttgcactgccagataaggatgatgaagaagtgaagatgccaggctacccaaatttcagaaccaagtcttctgctgcgatgagccgtgttggcagcccttgtatgtcagccagtgaggcacgctctgttgcgtcaagacgaagcactttaggtcatggaactgaggatacacgcctgaggtcgaatgatgttgttggatcaaattttagtggctgtggcataagctattgctggtcaggagcgtcaaaataccgagaactttattctgatagtgatggtccagagcaacctctcttatctactgatgggactgaggcagcatttcaaagcaatgtaccatacactgagacgccaagatgtttaagccagaaatttcgccctcggtcattcagtgaactgatcggcctaaatgttgttgctcagtccctcttatattcctcttgcaaaggaaaagttgctccaatgtacttgttccatggcccccggggtacagggaagacgtccacagcaaggatttttgccgctgctctaaattgtgtctctcttgaagagcaaaggccatgtgggttctgtaaagagtgtgtcattcttttctctgggaagagtagagatgtgaaagaacttgatgcagcaaaaatggatcgtttaggtcgagtaaaggcacttctcaagagtgcatctctcgtcccatactcttcacgcttcaaggttttcataatagatgaatgccatctcttgcaagaagatgcatggtcagcaatactgaagagtcttgatgagccataccggcatacagtgtacattatgattacttctgacatagaaagcctgcctcgcacttccatcacacattgccagaagttccattttccgaagataaaggttgcagatatagtctacaggttggagaggatctgtatagaagaaggattggaatttgaccatgatgggttgtacttcattgctgcaaagtctaatggttctcttagagattcagaaataatgcttgaccaactcagtttgcttgggaaaaagatcacaatttctcttgttcatgaacttgtaggatcagtgtctgatgacgagctgattgaattgcttgatctagcattgtcatccgacaccaccaatactgtaagacgagctcgagaacttatgggatcagcaattgatcctctgcagctggtctctcagttggccaaccttattatggacattctctcggggcggtgtcaatctgcagtcactgaagtcagcaaaagcttcttgggtagatatgcattatcagaggtcggaataaagaaattaagacatgcactgaagatactatcagaaactgaaaagcaattgaggacatcaaggaatcaggctacttgggttacagtcgcgcttttacagtttggcaccactgaatctaaccttgttgctgaaccgaatgatatgcatgcacactcagtaactggatatacagatgactgggtttccaaggtgcactcaagctccaatttttgtcaggcatgtaatagcaacaagtccaactgttctgagagacactgtaggcggcttaagcttgagaacatatggaggagagccattggaaagtgtcgatcaaggtcagcgaaaagtttcctcaggaaagaaggcttcttatcatcggtccatgttaccgaagaacttgccatagcagaagttggatttggacacccggatcacctttcaagagcagagaaaatgcaaagtctaatagaatgcgctttacaacatgttctcgggtgtaatgtggagatcagattcaaacttgtatcatgtccagtgaggaaagatgctaggttgaagagacagtcgttcagttttctcaactgctcaggccggaagcaagagctgtcagattcagtggtgactgatgaagatgaagctgtgaggcctggagcaagagagacaccccttaaaggctacacctccagtcagaaggaatcaccatatgtcatgcaacgtgttgattcgaaaccaacagtccatgggtgtgaggatgatgcccggagtaccctgacgtcaaacagatccgtgacagatgacctgacaaggacgtgcaggtcggaaactaactactcaaagggtgtcagtgagcagggtcgtttcgatagcatccaagagcctgacctacaaccgaattgcttctcacgaacgctcaagcttcaaaagaagctattgtcgtctggtgcagcacacacaatctgtttgaggatccagccacataacaaaatggatttcctacctaagaaagaatttgatacatacttctgtgcgtatgagccttacgagcagtgttcaagatcaacttcacgggctacttacagttcaagggatgatgacttgtggagcaagaattcacggtttggttcgaatctactctgctggagggccccaaaacaatccatgtaacagagtaaaggatgagcagactagacggaacacatcaagtgatcaattttgcccgaagctggagacatggacatctgaggtggcaatttttgaaggaaaagttcagggatggggcctgcgttaatcttgttcttggtaggaaaactgagaaattattgtttgatccgtagcctgcatttagtgatattttcttggtactgaaggtttttttatgataggaataatgctagtggtcagttgtacagcacgccaatgatgaaaccctgtgtatactgaatagttctgttgtttctcaattttgtaggacgatttgatgctcaagtcccc

SEQ ID NO: 3193 - DNA, 3581 bp, Oryza sativa
ctcatcactcatcagtgcttgctcgctcactccactcacctcaactcaaggggacctgagctagtagtacgacacagcctacggccggagtagtatagagccatgcaggtgcatgctacaaggttacaatggaactagtcctaatcaagaaaagtaccaatactgaagattcataggatcatatcatatactattgctgggaaactaaagccagaaatggcggacatgaggcgccattcggtagatgttccactgtcaagaacattggtgcagctgaagagagtgaggtcgctgcgggatccagcaacaaactctttgagcaagtatgcatctccttctgacaatatgatctgggagaccgcttctagcaatggggttgcaatggacctaggcaggtcagcacatcatcagttgatcgaagaagatggagatttggaagctgaagctacattgggttcagagcggagttttcgggcaccaaatgcaagaaccgcatcatatcggaaatcttctgttgtcaagatccgaggcttaaacccgcctagaaataagcaagctcatcgtgcacgccaagatggtcatcgcaagtcagtggactctagccactctaaccatagctctattcgacaattggcaaacactatggttaacaatgtagctgaggagaaggaagaagaggaggaagtgaattcttatgaacgttcagttcccacaccgccggcgaagactgatgaagaagtgaagatgccagggttttccaaattcaggaacaaatcttccgctgcaatgagccgtgtcggtagcccttgtatgtcagccagtgaggcacgctcagttaggtcgagaagaacagaggaaacacaagtgaggtcaaatgatgttgttggatcaaatttcagtgggtgtgggattagctactgctggtccggggcatcaaaataccgtgaactttattatgacagtgatggtccagagcaacctttgttatcgcctgaagggaccgatgcagcgtttcaggaaaatgtaccatacactgagacgccaaggtgtttaagtcagaaatttcgccctcggtccttcagtgagctgattggcctcaatgtggttgctcagtccctcttatattcctcttgcaaaggaaaagttgctccaatgtacttgttccatggtcctcgaggtacaggcaagacatccacggcacgaatttttgctgcagctctaaactgcctctctctcgaagagcaaaggccatgtggattctgtaaagagtgtgtcatcctcttctccgggaggagtagagatgttaaagaacttgatgcagcaaaaatggatcgtttaggtcgagtgaaggcgcttctcaagagtgcatctcttgtcccatactcatcacgcttcaaggtcttcatagttgatgaatgccatctgttgccagaggatgcttggtcagcaatactgaagagtcttgatgagccataccggcatgctgtgtacattatgattacttctgacatagatagcctccctcgcacttctatcacacactgccagaaattccattttccaaagataaaggtggcagatattgtctacaggttggagagaatctgcatagaggaaggattagaatttgaccatgatgggttgtacttcatttctgcaaagtctaatggttctcttagagatgcagaaataatgcttgatcaactcagtttgctcgggaaaaagatcacaatttctcttgtccatgaacttgtaggatcagtgtctgatgatgagttgattgaattgcttgatttagctttgtcgtcagacaccaccaacacagtaaggcgagcacgagagcttatggcatctgcaattgatcctctgcagctggtctctcaattggcaaaccttattatggacattctctcaggaagatgccagtctgcagtcactgaagtcagcaaaagtttcttaggaagatatgcattagccgaggttggtataaagaaacttagacatgcactgaaaatactttcggaaactgaaaaacaattgaggacatcaagaaatcaggctacttgggtgacagttgcgcttttgcagtttggcaccaatgaatctaaccttatcgcagagtcaaatgacatgcatgcacattcagcaattggatatacagatgattgggtttccaaggtgaactcaagctccaatttctgccatgcttgcaacagcaacaagtccaactgttctgagaggcactgtaggcgtcttaagcttgaaaacatctggaggagagcaataggaaagtgtcaatcaaggtcagccaaaaatttcctgaggaaagaaggtttcctatcatcagtccatgttactgaagagctggctattgcggaagttggatttagccatccagatcacatatcaagagcagaaaaaatgcaaagcctaatagaaagcacactgcagaatgttctcgggtgcaacgtggaggttaagttcaaacttgttccacggccagtgagaaaagatgcaaggtcaaagagacagtcattcagtctcctcagctgctcaggccggaagcaagaactgtcagattcagctgtgaccgacgaagatgaaactgtgaggcatggagcaagagaaacaccgtctaaaggctactctagtcagcaacaatcaccattcatcatgcaacgcactgattctaaaccaacagttcacggctgcgaggatgatgctcggagcaccttgacatcaaacagatccatgactgatgacatgacaaggacatgcaggtcagagactaactactcaaagggagtcagtgagcagggccgttttgatagcatccaggagcctgaccttcaaccaaactgcttctcacggacattaaagcttcagaagaggttcttctcttcagatgctgcacacacaatctgtttgaagatacagcctcacaacaagatggatttcctacctaagaaggaattcgacacatatttctgcgcatatgagccttatgagcagtgttcaagatcaaattcacacgctacttgcagctcaagagatgataacttgtggaacaagaattcgcggtttggctcacatttgctctgctggaggggccctaaacaagccatctaacaggacagaaaatggatgcgcaaactagatgaatcaatagatgctgccacaattgtttttgcccggagccggaaattgggacacctatggcagcagcaattttgagggaaaagtagcggattgtactcattctggaatagctgatagggttgcacttgagcgagttcttgttcttggtgaacaaccaatgaacttatgttcaatctgtaagctgcatactagctttttgaaagggagtaggctgcatttagtcttagttgctcttatttgacaagagatttgggtagcctttttccagctctttactttcatcaaaaggaataatgctggcggtcagatgtacagcatggtagtgattccagtgattacttctgttacttcttataattcaagtaccttttggtaaacagaacatgattgccattctaaggagaaaaagttcagactagtca

SEQ ID NO: 3194 - DNA, 3383 bp, Brachypodium distachyon
caggttcctccgacatggttataatgaaagcaaccatattcaaggacagattcaaaattgaatcataatcatataatatagccgggcaaggcagactgaaaatgacggacatgaggcgccactctgtggatgttccactgtcgagaaccttagtgcagctcaagcgtgtaaggtctctgcgggatcctgcaacaaactctctaagcaggtatgcatctgcttctgacaatatgatatgggagactgcttctagcaatggagttccaatagagctaagcaggtcgacacatcatcagttaatcgaagaggatggagatttcgaagctgaagctgctatggggtctgaacggagcttacgggcaccaaatgcaagaacaacatcttataggaaatcttccgttgtcaagatcagaggattaaatccgccgagaaacaagcaagttcatcgtgtccgcggagatggtcatcgaaaatcagtcgattcgaaccactctaataatagctctctgcggcaattggcaaacaatgtggtaaacaacatggaggagaagaaagaagaagaagaagaggtgaattcttatgagcgagcagatgttttgttgccagagaaaactgatgaagaagtgaaaatgccaggtcaatctaaattcagggacaagtcttctgccgcaatgagccgtgttggcagcccctgcatgtctgccagtgaagcgcgctcggttgggtcgagaagaagcaccttagggcatggaactgaggacacacgagtgagatcgaatgatgttgttggatcaaatttcagtggatgcgggataagctactgctggtcaggcgcatcaaagtaccgtgatctttattccgatagtgatggtccagagcaaccactgttatccactgaggggactgaggtagcgttccaggacaacgcaccatacactgagacaccgaggtgtttaagccagaaatttcgacctcgatcctttagtgaactgattggcctcaatgttgttgctcagtccttgttatattcctcttgcaaaggaaaggttgctccaatgtacttgttccatggcccccgtggtacaggtaagacgtctacggcgcggattttcgctgctgctctaaactgcctctctctcgaagagcaaagaccatgtgggttctgtaaagagtgtgttattctcttctctgggaggagcagagacgtgaaagaacttgatgcggcaaaactggaccgtttgggtcgagtaaaggcacttctcaagagtgcatctcttgtcccatactcgtcacgcttcaaggttttcatagttgatgaatgtcatctgttgcaagaagatgcatggtccgcaataatgaagagtcttgatgagccataccgacatactgtgtatattatgattacttctgatctagatagcctgcctcgtgcttccatcacacattgccagaagttccattttccaaagataaaggtcgcagatattgtctacaggttggagagaatctgcatagaggaaggattagaatttgaccatgatgggttgtacttcattgctgcaaagtctaatggttctcttagagactcggaaataatgcttgatcaacttagtttgcttgggaagagagtcacggtttctcttgtgcatgaacttgtaggattagtgtcagatgatgaattgattgagttgcttgatctagcattgtcatcagacacaaccaatacggtcagacgagctcgggaacttatggcgtcatcaattgatcctctccagctggtctctcagttggcgaaccttattatggacattctctcaggacgatgtcaatctgcggtgactgaagtcagcaaaagtttcttggagagatatgcgttagcagaggttggaatacagaaactgagacatgcactgaaaatactgtcagaaactgaaaaacaattgaggacatcaagaaataaggctacttgggttacagttgcgcttttgcagtttgggaccaatgaatgtaatatagtagcagacacaaatgatatgaatgcacattcagcaactggatatacagatgactgggtttccaaggtaaattcaagctccaatttctgtgatgcgtgtaacagcaacaagtccaactgttccgagagatactgcaggcggcttaagcttgaaaacatctggaggagagccattgggaagtgtcaatcaaggtcagccaaaagttttctgaagaaagaaggaatcctatcatcagtccatgttaccgaagagctggctatagcagaagttggatttagtcatccggatcacctatcaagggcagagaaaatgcaaagcctgatagaaagcatgttgcagcatgttcttgggttcaatgtggaaatcaaattcaaaatagtaccacgtgcagcgaggaaagatggaaggttgaagagacattcattcagcctgctcagctgctcaggacgaaagcaagagctgtcagattcaactgtgactgatgaagatgaaactgtgaggcatggagcaagagaaacgccgctcaaaggctactcgtctagtcagcagcaatcgccattcattgtgcaacgtgtggattctaaaccaagagttcatggctgtgaggatgatgcacggagcaccttgacatcgaacagatcgatgacagatgaccagacaaggacatgtaggtcagagactaactactcaaagggtgccagtgagcagggtcgttttgatagcatccaggagcctgaccttcaaccgaattgcttctcacgaacattgaagcttcaaaagaggtttttctcatcagatgcagcacacacaatctgcttcaggatccagccgcacaacaaaatgggtttcctaccaaagaaagaatttgatacatatttctgcgcatacgagccttatgagcagtgtccaagatcaaattcacgagctacttacggttcaagagatgaggacttgtcgataaagagttcccggtttggttcgaatctgctctgttggaggggccccaaacagtcaatataacagaaatggatgatcacgatcacataaattctgcaaagtcagttttcttgcctggaagcgacacctttggcagcaatttttagggtctctgcggatgcgattcattctaaacgattgaggcgtttgagctgagttcttagttctttgtaaaacaactgaggaaacctgctgtctgtagacaggatttagtattttttagaaggatgtagtcagtttttagctccgcagacctgtttggctgtttccacttctttcatgacacatggttaaataacggcagtggtcatttgtacagcatgccagtgttcaatccaagtgaaatatttctgaatttgaacaacttttcct

SEQ ID NO: 3195 - DNA, 1119 bp, Sorghum bicolor
aatgggccattcggcccatttcctgcggtggcggcggcttgtgtctccaaagtccaaacggcgtctgacggctcaccccaactcgtcgccttccccgtccttcccgccgtcgtggagaggaggtcgcgcggctggctcccgccgcttccggacgggttcggagggagcaggatcagctgccgcgatgttccccaggatctcccggctcggggcgcgcctcctgcgcgagtctagagccgagacgagagctggaaatttgctaagcagtcgaggcattttgtatcaaggtcatgttaaccggcattcgaccccagtgatgacccctactgtattatcgttgcggaatgtccttttgtcaactgcaacaagtggtgagcaggatgaaagcagtcagccaaaagataaaatctcagtaacatttgtcaacaaggatggctcagaaaagacaataagtgttccagttggcatgtccatgttagaagctgctcatgaaaacgacatagagcttgaaggagcatgtgagggctcacttgcgtgttctacttgtcatgtaatagtaatggatgtaaactattataacaagttagaagatccagcagatgaagaaaatgatatgcttgaccttgcatttgggctcacagaaacatcacgccttggttgccaagtgatcgcgaagcctgaacttgatggtatgcggctggcattacctgtagccacaagaaactttgcagtagatggctatgtaccgaaaccacactgaagagacagtcatctatccaccaaactgaggaggcagtcatcttggggaacacggattcttacaacagtcagttttgtagtttataacctgtaacttaactacagctttgtttacttgtagtccggctggcttcggactacctttttgagggagggtttgttcattgatgaacccccgggttacttgctgagaacagtgcttcatctgggcgaataaacatagtatttcgttctttgtgcagggcgaaaccagcgaataaacatctttcgttctgtgtgtactcagaaacaattgcatcatattttgctcccaatatttggtcctttgcaactttggccgctgttccgaggccagaagta

SEQ ID NO: 3196 - DNA, 1248 bp, Setaria italica
atggaggcggcgcaggcgtccccctctggcggcggacggggagaagagagggttagggcgggtttctccgaggctcttatagctagagcggtgatgggctgggctttcgttgtcccatttagatatttccgttactgggccgtacggcccacttgttgcggcggcggtggtgggtcatggcctcatgggtgtgcgtctcttccattctccagactcctccacggcacggcggcgcacggcctcacccgactcgtcgtcttgccctcctccttcccgccgtcgtggagaagagctccccgcggctggcgcccgccgcttccggacggttcggcccctcagcttcgccctgagttcgcctcgggttcggagggagcagggccggctgtcgcgatgttctccaggatctcccggctcggggcgcggctcctgcgcgaggctagggccgagacgagagctggaaacttgcttagcagtcgaggcagtttatatcaaggtcatgtcagccagcattcaacccctttggttactcctacagtgaaatcaatgagtaatgtcctcttttcaactgcaacaagtggtgatcaggatgaaagcaatcaggaaaaaatctctgtgacatttgtcaacaaggatggctcagaaaagacaatccgtgtgccagttggaatgtccatgttagaagctgctcatgaaaatgacatagagcttgaaggtgcatgtgaaggctcactggcttgttctacttgtcatgtaatagttatggatgtaaatcattataacaagttagaagacccaacagatgaagaaaatgatatgcttgaccttgcatttgggctcacagaaacatcacgtcttggctgccaagtgattgcaaggcctgagcttgatggcatgcggctggcactacctgcagccacaaggaactttgcggtagacggctatgtaccgaaaccacactgaagagactgccgtcacctacggggacacggattcttacagcagagtcaattttgtagcctacaatctgtaacttaactgtagcttcgctatttgtagtccgggtggcatcggactttgttgttgagccaggatttgttccttgacaagctcctgggttacttgcagagacccagtgttgtctggtcgaaaaaacatctctgttctgtatgagtatactcagaaacgtttgcatcatatttccttcccaaatcccaatatttggccctctgcggcatctgctgctgttca

SEQ ID NO: 3197 - DNA, 926 bp, Panicum virgatum
  misc_feature (11)..(11): n is a, c, g, or t
  misc_feature (17)..(17): n is a, c, g, or t
  misc_feature (29)..(30): n is a, c, g, or t
  misc_feature (37)..(38): n is a, c, g, or t
  misc_feature (58)..(58): n is a, c, g, or t
  misc_feature (66)..(66): n is a, c, g, or t
  misc_feature (96)..(96): n is a, c, g, or t
  misc_feature (134)..(134): n is a, c, g, or t
  misc_feature (142)..(143): n is a, c, g, or t
  misc_feature (155)..(155): n is a, c, g, or t
  misc_feature (167)..(168): n is a, c, g, or t
  misc_feature (393)..(393): n is a, c, g, or t
ggttcggaggnagcagngccggctgccgnnatgttcnncaggatctcccggctagggntgcggctnctgcgcgagggtagggccgagacgagagcnggaaacttgctcagcagtcgaggcagtttgtatcaagntcatgtcnnccagcattcgantccagttgtaanncctactttacaatcgttgaggaacgtcctcttttcaactgcaacaagtggtgatcaggatggaagcggtcaggagaaggagaaaatctctgtaacatttgtcaacaaggatggctcagaaaagacgatcagtgtgcccattggaatgtccatgttagaagctgcacatgaaaatgacatagaacttgaaggggcatgtgaaggctcacttgcttgttctacttgncatgtaatagttatggatgtgaatgattataacaagttagaagaaccaacagatgaagaaaatgatatgcttgaccttgcatttgggctcacagaaacgtcgcggcttggctgccaagtgattgcgaagcctgagcttgatggcatgcggctggcattacctgcagcgacaaggaactttgcggtagacggctatgtaccgaaaccacactgaagagactgtcatctacggggacacggattcttacagcagagtcagttttgtcttggagctgcaatctggtgcgttagatggagcaccgggtggagtcatcttcaaagaagcaagacatcttctgagtttgcactttgttttgtttggtgttgcttacacacctcgttctcacacaaactagctcgttcaggcttagacagggacccggatcgaccaagcatctggtctgatcccctcccagattttgtaacatgtcttgtgggtcgcgactttgctgtcccggcgggtgaataaagcatgagccaagcatgatttttttt

SEQ ID NO: 3198 - DNA, 947 bp, Pennisetum glaucum
cgacgcccaatcccaacggagcccttgctgttttgctcgcccggcgcgaggtggttgttgcgctgattcagtgtctcgtgagctgttcttagctagggttcggagggaacagggccggctgccgcgatgttctccaggatcccccggcttggatcgcggctcctgcgcgaggctagggccgagacgggagctggaaacttgcttagcagtagaggcagtttatatcaaggtcatgtcaaccggtatccaacccctttggttactcctacagtaaaatcgatgaggaatgttctcttttcaactgcaacaagtggtcatcagaatgaaagcaatcaggaaaaaatctctgtgacatttgtcaacaaggatggctcagaaaagacaatcagtgtgccagttggaatgtccatgttagaagctgctcatgaaaatgacatagagcttgaaggtgcatgtgaaggctcattggcttgttctacttgtcatgtaatagttatggatgttaatcattataacaagttagaagacccaacagatgaagaaaatgatatgcttgatcttgcatttgggctcacagaaacatcacgtcttggctgccaagtgatcgcgaagcctgagcttgatggaatgcggctggcactacctgcagccacgaggaactttgcggtagacggctatgtaccaaaaccacactgaagagaccgggacacggattcttacagcagagtcaattttgtagcctacagtatgtaacttaagcttttgctacttgctcgcagtctgggtggcttgggactttcttgttgagccaggatttgttcattgacaggctcctgggttagttgcagagaccagcgtttgatctggtcgaataaacatctttgttctgtacgagtatactcggaaacgtttgcaccatatttacttgccgaatcccaatatttggc

SEQ ID NO: 3199 - DNA, 783 bp, Setaria italica
cgcggctcctgcgcgaggctagggccgagacgagagctggaaacttgcttagcagtcgaggcagtttatatcaaggtcatgtcagccagcattcaacccctttggttactcctacagtgaaatcaatgagtaatgtcctcttttcaactgcaacaagtggtgatcaggatgaaagcaatcaggaaaaaatctctgtgacatttgtcaacaaggatggctcagaaaagacaatccgtgtgccagttggaatgtccatgttagaagctgctcatgaaaatgacatagagcttgaaggtgcatgtgaaggctcactggcttgttctacttgtcatgtaatagttatggatgtaaatcattataacaagttagaagacccaacagatgaagaaaatgatatgcttgaccttgcatttgggctcacagaaacatcacgtcttggctgccaagtgattgcaaggcctgagcttgatggcatgcggctggcactacctgcagccacaaggaactttgcggtagacggctatgtaccgaaaccacactgaagagactgccgtcacctacggggacacggattcttacagcagagtcaattttgtagcctacaatctgtaacttaactgtagcttcgctatttgtagtccgggtggcatcggactttgttgttgagccaggatttgttccttgacaagctcctgggttacttgcagagacccagtgttgtctggtcgaaaaaacatctctgttctgtatgagtatactcagaaacgtttgcatcatatttcc

SEQ ID NO: 3200 - DNA, 9537 bp, Sorghum bicolor
atatctccggaaaagattttgagttctgtatggcttttttttctcttcactcggaccaatccacctagtcgacttcttgtattttttgtgagttgtgtatcgactccaataatactattgtcaagtacctttagggatgaggatctcggcaagatatgcagttcttgaagaatgaaaaaaaaccgatctacttctttttggtattttagactaaattcttttgttcctcgatgctcaataaaaccctctttttttaagatagaatcttcctccgggctcccatattcgtcttctgagtcttcctctgagtcttcctctgagtcttcttctaaagtcccatattccttctctgagccatcttcagagctcccatattcttcttctgagtcttcctctaggatttcatattcgccctctccctctcgggtcctatatttgttctctaggctcccatattcttcctctgagtctttctctagagtcctatattcgtcctctaggatcccatactcatcttctagggtttcatattcgtcctctagagtcctatattcgtcttctaggatttcatattcgccctctccctctcgggtcctatatttgttctctgggctctcatattcgtcttctgagtcttcctctcgagtcctatactcttcctctcgggtccgatattcttcctctagggtcctatatctaaatttaacaattcctgaaccccttttatcttttctgtatcgtggatcgtcaaaataagcaaaaatagtatttctacgtaaaacacccataaagggtatttccattgaaatacccaaacaggatattcgctctttttcttgttcttgatgatattgtaatggaacggcaaacctatttcttcgctttttcgccaacaaatccgaattatcttgaagaatagaaggatagaaacaattccaatgaccgttggacacgattcgatctggcgttaaataatcaagaatttccctatcttttttaccaaaagtatccaacagtctatggcttacttgatcattagccattgagaagtcaaagatatatcttccatcaacagaaaaagaataagtattcatttgatcttgatccttgtgcagtgaaaaagatgctatactggatctgcacatacttactgacaatatccataaatggcttgtttttggtaatcgacgaagattaccatattgatattcgggcgcatggtaaacatcagtactccagtgcatttccccgtctgattcggaataaatatgcttttgtaccttttctttaaaatgcaaagtggacgttccggcacgaatctccgcaattacttgttcagattctacatattgatcattttgcactagaatcaagctttttaacggaatattcacactatgtagaatatcctgactctgaatagttacatgcaagtctatatagcatagaaaagcaggctgcccatgacgggtacgtgtggggtgaaccaaatcctcattgaattggatttttccattcgagggggatcgtataaggtcggcagtaccccctgtgaatactccaccagtatgaaaagttcttaatgttagttgagtccctggctccccaattgattgacccgcaataatacctacagcttcccccaattcgaccagatccccatgagtgggactccgcccataacataattgacagatccaagatgtgctccggcaagtaaagggggttctaatatatattggttgtgctcgaaacggttgtgctcgaaaggcagttatgaatcgattgactaatccaattccaatatcttgatttcgagaagcaatgcatcgtgaaccaatatatatatcgtctgctaatacacgaccaattagtgtttggacaaaaagtttttccgtcatcccattttgaggactcacagaaataccttggatagtaccacaatctcttctacgcacaataatatgttgaactacttcaacaagtctacgtgtaagatagccagcatccgctgttcgtacagcagtatctacaaccccttttcgggctccgtagcaggaaattatatattctgtcaaagaaagtccctcgcgtaaattgctttgaataggtaaatcaatcatttgtccttgaggatccgccattaaccctctcatacctactaattggtgtacctgagatgcatttcctctggctcctgaaaaagacattagatagactggattagaaggatccgttattcgaaaattcgaattcatttcttgtttcaaatattcacttgtagcataccatatctcaacggattggcgtaatttttctaccgcgtgtacagctccataataatagtgtttctccaaaagaaaactctgttgttccgcgtcttggactaaccatcctttagagggtattgttaaaagatcctcgattcctaaagaaatcgatgtagtagtggcttgatggaagcccagagtctttatttgatccagtatatgggaggtatatcccattccgaaatgatctattaatctgctaataagccgtttcatagcagttccgtctatctctttattatgaaagaccaggttggcccgttctgccatacataagtacccccttttttggctgagtaggattcgacaattgctgagtaggattcgacaatgggcctgagtcagtgattcgaaaactttatttactccctttcctcaatctcaatctggatttgcgcggcaaaaaagatggtactagcgaaatcggaatgccccccgaaaggggcatcgccgaatttcacttccttgtttagatagtgtatgaataggcccgactaaatccttgtatggcttcctctatttctctataaaaagaaatatgaccaagagtggttcgaatgtatatagaacggatttctttttttctatttcccactactagatagtgggcataaatctcatgataagtcccaaaagattcatattgaacttcaatcggaacttctcttgacccaacgatgcgttgatctagtttccatcggagccacaagggactgtttaaaccgattcgtttctgtctataagctcccagtgcatcataggaactagaaaaatggggttctttatctttcgtatacttataataattgttattattgtagttgatttttttatttggagagtttccgcaactattatatctatttgcacaaatacctcgacggtttccaatcgttaatacataaagtccgataagcatgtcttgggttggcacgcaaataggatctccaatagcgggagacaggagattcatatgagaaaacataagtaaacgggcttccgcctgagcttccaaggataaaggtaggtgaacagccatttgatccccatcaaagtccgcattgaaacccttacacactaatggatgtaaacaaatagtacgtccctctactaaagtgggttggaaggcctgtatgcctaatctatgcagggtaggtgctctgttcaacagtacaggatgtccccgcataacttcttgaagtatttcccatacaatgggttccttttcccaaattttccttttagcaatcctgacattagaagtagcacgtttcgtgattaaatcgcgaattacaaatagctgaaaaagctttattgctatctctagaggtaatccacattgatgtaatgaaagcgaaggacccacaacaatgacagaacgccccgagtaatcgacccgtttcccaagcagagtctcgcgaaacctcccctctttaccctcaattacatctgaaagtgatttgtatactttattgtgaccatccctcatcggttgcccgcgggacccactatcaagaagtgtatccacggcttcttgtaccaatttttcctggcacattactaaatctgctggtgctaattcacttctttttaatagataggcaaggttgttgttccggcggataactctcttataaagttcattaatatctgaagtcactactttatccccagatctataaacaatgggtctcaattcgggaggaagaaccggtaataagcacaaaaccatccattctggttctacatttgtttgaataaaatgtttcgccaattgcatgcgtctaatcaaaaaaacttttcttattcgtctttttctatcttcccattcatctccactatacccctcgtcttctaattccttccattcaaccaaagaattctctataataattcgcaaatctaaatccgctaattgttctctaatagcacctgctcctgttgcaatttcccgatttcgaaatgttgcaaagcctggggtagaaaaaaagggagaaatactgtggttacaggatgaaatttcatcctcgaataaaccccgtaatcgtaagaaagtaggttttttagcgctgggcctagcaaaagagaaatcaccatatactaggccctccaatttcttaaggggtttatctaaaagattcgcaatataactaggaagacctttcaaataccacacatgagtcactggacatgctagtttgatgtatcccatttgatatcttcgtatccgagaatcaacaaattctaccccgcatttttgacaaaatctttcgtctttgttttcagctacgctcgctcgagagtttccacaagcacaaattccgctttttatgggtccaaagattctttcgcaaaacaatccatctttttctggtttatcggttttataatgaaaagtggagggccttgtgacttcgccaacgacttccccattaggtaggatttttttagcccaagcctttatttgttgaggggaaacgagtccaatttgaagttgtttatgtttatattggtcaatcataaaatagaaataagaaaaaaatttatatttattccgatcaaacatcctccctattaacccggaagttcttctcagatacaaggaaatggttcagttctagagccaaagatcgtagttctcgaacgagcactcgaaaagattctggcggatcctcgtgattaggcactctttttccccagatcgtagcattaagtatttcttggcgagctataagatgatcagatttataagtaagtatctcttgtaaaatatgagcaacaccaaatccttctaaagcccaaacttccatttctcctattcgttgtcccccttgcttggctcttcctctaacgggttgttgggtaacaagtgagtagggcccagtagaacgtccatgaattttctcatcaacttgatgaattaattttaagatataggacttccctattagaacaggctgttcgaagggatctcctgttcttccatcaaatattctgctttttcccgggtactcgggttcaaatacccatggattttttgtttgtttactggcttcatataattccgaaaacacaagttttcttgaagcctcttgctcatatctctcatcaaagggtgctattctataatgtttctttagcagatcccctgctaatccgagcgagctttcaaatatttgtcccacattcattcgtgagggtactcctaagggattgaagaccatatcaacaggtgttccatcttgcaaatagggcatatcttgcctaggcaaaattttggaaatgatccccttattcccgtgtcttccggctactttatccccaactttgatttcacgtttctgtaaaatatatacacgaaccattatgtcaaaggggtccctctggatccatttcacatcgataacgcgccctcttccacctataggtagtttgagagaagtttcttttgaagtggatacctcaagaccaaaaatagcccgtaataatccagcttccgcgatatacgacgattcgctcgctatctgaggcgttaatttacctactaaaatatcgccagtttctacccaggatcccaacctcacaactccatttctgtccaaattgcggagtaaatgttcttctagatgtggtatttgtttagtgattttttcagcggagccttggcttgtcgtatccgtctgaatttcatattttcggatgtgaaaagaagtataaatatcctcatataccaaacgttcactaattagtactgcgtcttcaaaattgtaaccctcccagggcatataagctactaaaacgttttttcctaaagcaagttccccgccaactgtagctgctccctccgctaaaatttgcccttttttaatggatttaccccgcggaacccgaggtttttggtgcatacaagtatttttgttagagcgccgatgggcaactaaaggaatacttatggtcttcccactacttgataaaaggatcttgtgactatcactagaaatgatctttccctcgcgttcggctataacggaaaccctcgaatctagagctgtttgtcgttccaatccagttccaacaatgcacttctcggaccgagaaagtggaactgcttggcgctgcatattagaactcattaaagcccgattcgcatcattatgctcaataaaaggaatgagagaacctccaatagaaaaatattggaaaggaaaaatacttctaacatgaatctgttcccatgcaatagtcaggaattcttgacggtatctagctggaacaacctgttcttcctgaataccctgattcaaggacaaagaatttcctgctgctatcatataatattcatctctatttggtgataaataaactacctgtctctcttttttttcttttgctttctcagatatttcataaaacggactctctatagatccccaccagtgatcaattctcgcatgaatagctaacgatccggtaagtccaacattgattccttcggacgtgtcaattggacaaatacgcccatagtgactcggatgaatatctcggctacgaaaacttgcagttctccccgtcaatcctccaggacccaaacaactcacttttcgcccatgaaccgtttgtgtcaatggattggtttgatcaaaaacttgagctaaggggtatgtgccaaaaaaggtctcataagtagtgattaataaaatcgaagttgaagttggagttaccaaagtttgtggagtcggtttcgattgacgtatgaatactctacggatagttttttgaaccgcatgttgtaaacggccaagagccagtccgaattgatcttgtaacagatctgcaaccgaacgaatacgtttatttttcaagtgattcatatcgtcatcgtcaagtatacccgttccaaatttcattccaatcaaatgatccgtagcggccaatacatctcgtggtaacaagaatgtattgttctgagggatatcaagattcagtctccgattcatatttcgtcgaccaactcttcctaattcacatttttgttgaaaaaatttcttttgtaattcctcgcataaggactccgaaaataccaggtccccacctacacaagcaaattgttgataaaactccaaaatagctttttcttttgactcaatcctcttcttctccttagcattcgggaaagacaagaaaatttcggggtaggaaacattatctaaaatttctcttagattcgaacccatagctgatgatagaactaaaatagatatcttttgttttctactcacgcgagcccatatcctttcttttttatcaattgctaattccgaccttcctccccaatctgatattatagtaccggtgtatatagaaattcccttatggtctaattccgagcggtagtaaataccaggacttagcaatatttgattgatcacaattcggtatattccatttattataaaggttcctaaggaattcattataggaatgtttccaatagaaatggtttgcttttgcacatcgaaaccaaaaattaatctcgcggatacatataattcggaagaataggtgagtgattcatacacagcattcctttcttttatcgagggttctagcaattgatatcctttcgcaaataattgaaatgcaatttcgtgatctggatctttaattgtgggaaacttctcaagttcttccgccaatccttgattaatgaatctacaaaatccctcgaattggatctgactaaatccgggtattgtggacattccctcatttccattccggagcatttgaatcttaagtttcctatttatagaagaaaaattccattatcagctcactcttcatcaatccctacggatcaatctagcaatcatggaatccatattctgtttactgaatcacatgaaattctagggaactccacatacgtatttcatatatgtatttcatacatatgaatagagacgatttcgacgaaagttcgaatttcgcaggggtcgaaatggaataaaaatgaattgataaaacagtcctagaaaaaaattatgccacttaaactttatgatattctaaaaagattggatagcaaagatttctcgttttatctcctttctatgaaagggataaagccataataatttataagcactagaaagtttgacttcagttcgatttagaatagcacgcttagtttctttttcaaaaagaatttgaagggtcttttttgtttcgtagtagtagaattgctagaaaataaaggatttcgttgtagaatcctaaaataaagataaagtactttatttttaaaatacttgccaatctagttatccacctatctacatatcaaattccctcttttttttattcaaaatatttaatgcaatgaaaaattaaagcacgattccccatagggatatgtacataagggggatctgtagataataatgctgttcggacctggagtttccctatatacagattagggaaacatttattcttattctattttattatgccattcaaaataatgggggggggggggaataccgatttaagagtcgttcactactgcaattcaaaaaaaaattatattaattatattatagttaatggttctaatttgttctgaattttgcagcctgcgactggaaatccactttttcttctttgtcatctcaatagaatagaaagaaacgggaagttttctagtgttagcaatgtgtgttttaagatagaatccatcgaggagaataagcgaaactggatccaaaaaagcagaaatcgattttttgaaaaagattcgaaaaaagaaagtaagtagaattagattcaagataaaagaaaaaaaggttttagtaattttagtaattagtaaaaaaatgtggatgaatacttgctcttttctcgattttagatcggattttttggcggcatggccaagtggtaaggcaggggactgcaaatcctttacccccagttcaaatctgggtgccgcctgatcaataaaatacttaggattatagtactgatcaaactcgacaaattcgtacccccctaagttggggcacgagagtaactaggtttggcgatactggattttgagaatccataccatagttctaccctcaaactagggtttgttttgtgggcagtggcccaaacggttaccaatagggatgaggtagcgtttccttattcttttattaat

SEQ ID NO: 3201 - DNA, 3365 bp, Sorghum bicolor
tggatccactcgagtgattgctagattgatccgtagggattgatgaagagtgagctgataatggaatttttcttctataaataggaaacttaagattcaaatgctccggaatggaaatgagggaatgtccacaatacccggatttagtcagatccaattcgagggattttgtagattcattaatcaaggattggcggaagaacttgagaagtttcccacaattaaagatccagatcacgaaattgcatttcaattatttgcgaaaggatatcaattgctagaaccctcgataaaagaaaggaatgctgtgtatgaatcactcacctattcttccgaattatatgtatccgcgagattaatttttggtttcgatgtgcaaaagcaaaccatttctattggaaacattcctataatgaattccttaggaacctttataataaatggaatataccgaattgtgatcaatcaaatattgctaagtcctggtatttactaccgctcggaattagaccataagggaatttctatatacaccggtactataatatcagattggggaggaaggtcggaattagcaattgataaaaaagaaaggatatgggctcgcgtgagtagaaaacaaaagatatctattttagttctatcatcagctatgggttcgaatctaagagaaattttagataatgtttcctaccccgaaattttcttgtctttcccgaatgctaaggagaagaagaggattgagtcaaaagaaaaagctattttggagttttatcaacaatttgcttgtgtaggtggggacctggtattttcggagtccttatgcgaggaattacaaaagaaattttttcaacaaaaatgtgaattaggaagagttggtcgacgaaatatgaatcggagactgaatcttgatatccctcagaacaatacattcttgttaccacgagatgtattggccgctacggatcatttgattggaatgaaatttggaacgggtatacttgacgatgacgatatgaatcacttgaaaaataaacgtattcgttcggttgcagatctgttacaagatcaattcggactggctcttggccgtttacaacatgcggttcaaaaaactatccgtagagtattcatacgtcaatcgaaaccgactccacaaactttggtaactccaacttcaacttcgattttattaatcactacttatgagaccttttttggcacataccccttagctcaagtttttgatcaaaccaatccattgacacaaacggttcatgggcgaaaagtgagttgtttgggtcctggaggattgacggggagaactgcaagttttcgtagccgagatattcatccgagtcactatgggcgtatttgtccaattgacacgtccgaaggaatcaatgttggacttaccggatcgttagctattcatgcgagaattgatcactggtggggatctatagagagtccgttttatgaaatatctgagaaagcaaaagaaaaaaaagagagacaggtagtttatttatcaccaaatagagatgaatattatatgatagcagcaggaaattctttgtccttgaatcagggtattcaggaagaacaggttgttccagctagataccgtcaagaattcctgactattgcatgggaacagattcatgttagaagtatttttcctttccaatatttttctattggaggttctctcattccttttattgagcataatgatgcgaatcgggctttaatgagttctaatatgcagcgccaagcagttccactttctcggtccgagaagtgcattgttggaactggattggaacgacaaacagctctagattcgagggtttccgttatagccgaacgcgagggaaagatcatttctagtgatagtcacaagatccttttatcaagtagtgggaagaccataagtattcctttagttgcccatcggcgctctaacaaaaatacttgtatgcaccaaaaatctcgggttccgcggggtaaatccattaaaaaagggcaaattttagcggagggagcagctacagttggcggggaacttgctttaggaaaaaacgttttagtagcttatatgccctgggagggttacaattttgaagacgcagtactaattagtgaacgtttggtatatgaggatatttatacttcttttcacatccgaaaatatgaaattcagacggatacgacaagccaaggctccgctgaaaaaatcactaaacaaataccacatctagaagaacatttactccgcaatttggacagaaatggagttgtgaggttgggatcctgggtagaaactggcgatattttagtaggtaaattaacgcctcagatagcgagcgaatcgtcgtatatcgcggaagctggattattacgggctatttttggtcttgaggtatccacttcaaaagaaacttctctcaaactacctataggtggaagagggcgcgttatcgatgtgaaatggatccagagggacccctttgacataatggttcgtgtatatattttacagaaacgtgaaatcaaagttggggataaagtagccggaagacacgggaataaggggatcatttccaaaattttgcctaggcaagatatgccctatttgcaagatggaacacctgttgatatggtcttcaatcccttaggagtaccctcacgaatgaatgtgggacaaatatttgaaagctcgctcggattagcaggggatctgctaaagaaacattatagaatagcaccctttgatgagagatatgagcaagaggcttcaagaaaacttgtgttttcggaattatatgaagccagtaaacaaacaaaaaatccatgggtatttgaacccgagtacccgggaaaaagcagaatatttgatggaagaacaggagatcccttcgaacagcctgttctaatagggaagtcctatatcttaaaattaattcatcaagttgatgagaaaattcatggacgttctactgggccctactcacttgttacccaacaacccgttagaggaagagccaagcaagggggacaacgaataggagaaatggaagtttgggctttagaaggatttggtgttgctcatattttacaagagatacttacttataaatctgatcatcttatagctcgccaagaaatacttaatgctacgatctggggaaaaagagtgcctaatcacgaggatccgccagaatcttttcgagtgctcgttcgagaactacgatctttggctctagaactgaaccatttccttgtatctgagaagaacttccgggttaatagggaggatgtttgatcggaataaatataaatttttttcttatttctatttt

SEQ ID NO: 3202 - DNA, 11902 bp, Zea mays
gtacgataaagtgtatgtagtaagatgtacgataaataaaatgtatgataattaggaagtctttctatttcttcgcaaagtcccttcttcaatcttagattgaaaaaagaatgccccttagggacctttggctacgaagatttctgacatcttagtctcgtagttttaaattcccgaatcgaatcgatttaaattaataaaagaataaggaaacgctacctcatccctattggtagccgtttgggccactgcccacaaaacaaaccctagtttgagggtagaactatggtatggattctcaaaatccagtatcgccaaacctagttactctcgtgccccaacttaggggggtacgaatttgtcgagtttgattagtactataatcctaagtattttattgatcaggcggcacccagatttgaactgggggtaaaggatttgcagtcccctgccttaccacttggccatgccgccaaaaaatccgatctaaaatcgagaaaagagcaagtattcattcacatttttttactaattactaaaacctttttttcttttatcttgaatctaattctacttacttttttagaatctttttcaaaaaatagatttctgcttttttggatccagtttcgcttattctcctcgatggattctatcttaaaacacacattgctaacactagaaaacttcccgcttctttctattctattgagatgacaaagaagaaaagaagaaaaagtggatttccagtcgcaggctgcaaaattcagaacaaattagaaccattaactataatataataaaattagaatataataatataattaactataatataataaaataaaactataatataataatataataaatataatattattattattttttgaattgcagtagtgaacgactcttaaatcggtattcccccccattattttgaatggcataataaaatagaataagaataaatgtttccctaatctgtatatagggaaactccaggtccgaacagcattattatctacagatcccccttatgtacatattcctatggggaatcgtgctttaatttttcattgtattaaatatcttgaataaaaaaaaaaaagagggaatttgctctgatatagattatagccaggccttcttggcccacctaagtgcaattacgataaaagaaaggatatgtagataggtggataactagattggcaagtacttaaaaaataaagtactttatctttattttaggattctacaacgaaatcctttattttctagcaattctactactacgaaacaaaaaagacccttcaaattctttttgaaaaagaaactaagcctgctattctaaatcgaactaaagtcaaactttctagtgcttataaattcttatggctttatccctttcatagaaaggagataaaacgagaaatctttgctatccaatctttttagaatatcataaagtttcagtggcagaatttttttctaggactgttttatcaattcatttttattccatttcaacccctgctaaattcgaactttcgtcgaaatcgtctctattcatatgtatgaaatacatatatgaaatacgtatttggagttccctataatttcatgtgattcagtaaacagaatatggattccatgattgctagattgatccgtagggattgatgaagagtgagctgataatggaatttttcttctataaataggaaacttaagattcaaatgctccggaatggaaatgagggaatgtccacaatacccggatttagtcagatccaattcgagggattttgtagattcattaatcaaggcttggcggaagaacttgagaagtttcccacaattaaagatccagatcacgaaattgcatttcaattatttgcgaaaggatatcaattgctagaaccctcgataaaagaaaggaatgctgtgtatgaatcactcacctattcttccgaattatatgtatccgcgagattaatttttggtttcgatgtgcaaaaggaaaccatttctattggaaacattcctataatgaattccttaggaacctttataataaatggaatataccgaattgtgatcaatcaaatattgctaagtcctggtatttactaccgctcggaattagaccataagggaatttctatatataccgggactataatatcagattggggaggaaggtcggaattagcaattgataaaaaagaaaggatatgggctcgcgtgagtagaaaacaaaagatatctattttagttctatcatcagctatgggttcgaatctaagagaaattttagataatgtttcctaccccgaaattttcttgtctttcccgaatgctaaggagaagaagaggattgagtcaaaagaaaaagctattttggagttttatcaacaatttgcttgtgtaggtggggacctggtattttcggagtccttatgcgaggaattacaaaagaaatttttttcaacaaaaaatgtgaatttaggaagaagttggtcgacgaaatatgaatcggagaactgaaatcttggatatccctccagaacaatacatttcttgttaccacgagatgtattggccgctacggatcatttgattggaatgaaattttggaacgggtatacttgacgatgacgatatgaatcacttgaaaaataaacgtattcgttcggttgcagatctgttacaagatcaattcggactggctcttggccgtttacaacatgcggttcaaaaaactatccgtagagtattcatacgtcaatcgaaaccgactccacaaactttggtaactccaacttcaacttcgattttattaataactacttatgagaccttttttggcacataccccttagctcaagtttttgatcaaaccaatccattgacacaaacggttcatgggcgaaaagtgagttgtttgggtccaggaggattgacggggagaactgcaagttttcggagccgagatattcatccgagtcactatgggcgtatttgtccaattgacacgtccgaaggaatcaatgttggacttaccggatcgttagctattcatgcgagaattgatcactggtggggatctatagagagtccgttttatgaaatatctgagaaagcaaaagaaaaaaaagagagacaggtagtttatttatcaccaaatagagatgaatattatatgatagcagcaggaaattctttgtccttgaatcagggtattcaggaagaacaggttgttccagctagataccgtcaagaattcctgactattgcatgggaacagattcatgttagaagtatttttcctttccaatatttttctattggaggttctctcattccttttattgagcataatgatgcgaatcgggctttaatgagttctaatatgcagcgccaagcagttccactttctcggtccgagaagtgcattgttggaactggattggaacgccaaacaactctagattcgagggtttccgttatagcccaacgcgaggagaaagatcatttctagtgatagtccacaagatccttttatcaagtagtgggaagaccataagtattcctttagttgccccatcggcgctctaacaaaaatacttgtatgcaccaaaaacctcgggttccgcggggtaaatccattaaaaaagggcaaattttagcggagggagcagctacagttggcggggaacttgctttaggaaaaaacgttttagtagcttatatgccctgggagggttacaattttgaagacgcagtactaattagtgaacatttggtatatgaggatatttatacttcttttcacatccgaaaatatgaaattcagacggatacgacaagccaaggctccgctgaaaaaatcactaaacaaataccacatctagaagaacatttacttcgcagtttggacagaaatggagttgtaaggttgggatcctgggtagaaactggtgatattttagtaggtaaattaacgcctcagatagcgagcgaatcgtcctatatcgcggaagctggattattacgggctatttttggtcttgaggtatccacttcaaaagaaacttctctcaaactacctataggtggaagagggcgcgttatcgatgtgaaatggatccagagggacccctttgacataatggttcgtgtatatattttacagaaacgtgaaatcaaagttggggataaagtagctggaagacacgggaataaggggatcatttccaaaattttgcctaggcaagatatgccctatttgcaagatggaacacctgttgatatggtcttcaatcccttaggagtaccctcacgaatgaatgtgggacaaatatttgaaagctcgctcggattagcaggggatctgctaaagaaacattatagaatagcaccctttgatgagagatatgagcaagaggcttcaagaaaacttgtgttttcggaattatatgaagccagtaaacaaacaaaaaatccatgggtatttgaacccgagtacccgggaaaaagcagaatatttgatggaagaacaggagatcccttcgaacagcctgttctaatagggaagtcctatatcttaaaattaattcatcaagttgatgagaaaattcatggacgttctactgggccctactcacttgttacccaacaacccgttagaggaagagccaagcaagggggacaacgaataggagaaatggaagtttgggctttagaaggatttggtgttgctcatattttacaagagatacttacttataaatctgatcatcttatagctcgccaagaaatacttaatgctacgatctggggaaaaagagtgcctaatcacgaggatccgccagaatcttttcgagtgctcgttcgagaactacgatctttggctctagaactgaaccatttccttgtatctgagaagaacttccaggttaatagggaggatgtttgatcggaataaatataaatttttttcttatttctattttatgattgaccaatataaacataaacaacttcaaattggactcgtttcccctcaacaaataaaggcttgggctaaaaaaatcctacctaatggggaagtcgttggcgaagtcacaaggccctccacttttcattataaaaccgataaaccagaaaaagatggattgttttgcgaaagaatctttggacccataaaaagcggaatttgtgcttgtggaaactctcgagcgagcgtagctgaaaacgaagacgaaagattttgccaaaaatgcggggtagaatttgttgattctcggatacgaagatatcaaatgggatacatcaaactagcatgtccagtgactcatgtgtggtatttgaaaggtcttcctagttatattgcgaatcttttagataaaccccttaagaaattggagggcctagtatatggtgatttctcttttgctaggcccagcgctaaaaaacctactttcttacgattacggggtttattcgaagatgaaatttcatcctgtaaccacagtatttctccctttttttctaccccaggctttgcaacatttcgaaatcgggaaattgcaacaggagcaggcgctattagagaacaattagcagatttagatttgcgaattattatagagaattctttggttgaatggaaggaattagaagacgaggggtatagtggagatgaatgggaagatagaaaaagacgaataagaaaagtttttttgattagacgcatgcaattggcgaaacattttattcaaacaaatgtagaaccagaatggatggttttgtgcttattaccggttcttcctcccgaattgagacccattgtttatagatctggggataaagtagtgacttcagatattaatgaactttataagagagttatccgtcggaacaacaaccttgcctatctattaaaaagaagtgaattagcaccagcagatttagtaatgtgccaggaaaaattggtacaagaagccgtggatacacttcttgatagtgggtcccgcgggcaaccgacgagggatggtcacaataaagtatacaaatcactttcagatgtaattgagggtaaagaggggaggtttcgcgagactctgcttgggaaacgggtcgattactcgaggcgttctgtcattgttgtgggtccttcgctttcattacatcaatgtggattacctctagagatagcaataaagctttttcagctatttgtaattcacgatttaatcacgaaacgtgctacttctaatgtcaggattgctaaaaaggaaaatttgggaaaaggaacccattgtatgggaaatacttcaagaagttatgcggggacatcctgtactgttgaacagagcacctaccctgcatagattaggcatacaggccttccaaacccactttagtagagggacgtactatttgtttacatccattagtgtgtaagggtttcaatgcggactttgatggggatcaaatggctgttcacctacctttatccttggaagctcaggcggaagcccgtttacttatgttttctcatatgaatctcctgtctcccgctattggagatcctatttgcgtgccaacccaagacatgcttatcggactttatgtattaacgattggaaaccgtctaggtatttgtgcaaatagatataatagttgcggaaactctccaaataaaaaagtaaactacaataataacaattattataagtatacgaaagataaagaaccccatttttctagttcctatgatgcactgggagcttatagacaaaaacgaatcggtttaaacagtcccttgtggctccgatggaaactagatcaacgcatcgttgggtcaagagaagttccgattgaagttcaatatgaatcttttgggacttatcatgagatttatgcccactatctagtagtgggaaatagaaaaaaagaaatccgttctatatacattcgaaccactcttggtcatatttctttttatagagaaatagaggaagccatacaaggatttagtcgggcctattcatacactatctaaacaaggaagttagattcggcgatgcccctttcggggggcattccgatttcgctagtaccatcttttttgccgcgcaaatccagattgagattgaggaaagggagtaaattaagttttcgaatcactgactcaggcccattgtcgaatcctactcagcaattgtcgaatcctactcagccaaaaaaagggggtacttatgtatggcagaacgggccaacttggtctttcataataaagagatagacggaactgctatgaaacggcttattagcagattaatagatcatttcggaatgggatatacatcccatatactggatcaaataaagactctgggcttccatcaagccactactacatcgatttctttaggaatcgaggatcttttaacaataccctctaaaggatggttagtccaagacgcggaacaacagagttttcttttggagaaacactattattatggagctatacacgcggtagaaaaattacgccaatccgttgagatatggtatgctacaagtgaatatttgaaacaagaaatgaattcgaattttcgaataacggatccttctaatccagtctatctaatgtctttttcaggagccagaggaaatgcatctcaggtacaccaattagtaggtatgagagggttaatggcggatcctcaaggacaaatgattgatttacctattcaaagcaatttacgcgagggactttctttgacagaatatataatttcctgctacggagcccgaaaaggggttgtagatactgctgtacgaacagcggatgctggctatcttacacgtagacttgttgaagtagttcaacatattattgtgcgtagaagagattgtggtactatccaaggtatttctgtgagtcctcaaaatgggatgacggaaaaacttttgtccaaacactaattggtcgtgtattagcagacgatatatatattggttcacgatgcattgcttctcgaaatcaagatattggaattggattagtcaatcgattcataactgcctttcgagcacaaccgtttcgagcacaaccaatatatattagaaccccctttacttgccggagcacatcttggatctgtcaattatgttatgggcggagtcccactcatggggatctggtcgaattgggggaagctgtaggtattattgcgggtcaatcaattggggagccggggactcaattaacattaagaacttttcatactggtggagtattcacagggggtactgccgaccttatacgatccccctcgaatggaaaaatccaattcaatgaggatttggttcaccccacacgtacccgtcatgggcagcctgcttttctatgctatatagacttgcatgtaactattcagagtcaggatattctacatagtgtgaatattccgttaaaaagcttgattctagtgcaaaatgatcaatatgtagaatctgaacaagtaattgcggagattcgtgccggaacgtccactttgcattttaaagaaaaggtacaaaagcatatttattccgaatcagacggggaaatgcactggagtactgatgtttaccatgcgcccgaatatcaatatggtaatcttcgtcgattaccaaaaacaagccatttatggatattgtcagtaagtatgtgcagatccagtatagcatctttttcgctgcacaaggatcaagatcaaatgaatacttattctttttctgttgatggaagatatatctttgacttctcaatggctaatgatcaagtaagccatagactgttggatacttttggtaaaaaagatagagaaattcttgattatttaacgccagatcgaatcgtgttcaacggtcattggaattgtttctatccttccattcttcaagataattcagatttgttggcgaaaaagcgaagaaataggctcgtcgttccattacaatatcatcaagaacaagaaaaagagcgaatatcctgtttgggtatttcaatggaaataccctttatgggtgttttacgtagaaatactatttttgcttattttgacgatccacgatacagaaaagataaaaggggttcaggaattgttaaatttagatataggaccctggaggaagaatatcggacccaagaggaagagtataggactcaagaggaagaatatcggactcgagaggaagactcagaagacgaatatgagagcccagagaacaaatataggacccgagagggagagggcgaatataaaatcctagaagacgaatataggactctagaggacgaatatgaaaccctagaagatgaatatgggatcctagaggacgaatataggactctagagaaagactcagaggaagaatatgggagcctagagaacaaatataggactcgagagggagagggcgaatatgaaatcctagaggaagaatcagaagaagaatatgggagctctgaagatggctcagagaaggaatatgggactttagaagaagactcagaagaagactcagaggaagactcagaagacgaatatgggagcccggaggaagattctatcttaaaaaaagagggttttattgagcatcgaggaacaaaagaatttagtctaaaataccaaaaagaagtagatcggttttttttcattcttcaagaactgcatatcttgccgagatcctcatccctaaaggtacttgacaatagtattattggagtcgatacacaactcacaaaaaatacaagaagtcgactaggtggattggtccgagtgaagagaaaaaaaagccatacagaactcaaaatcttttccggagatattcattttcctgaagaggcggataagatattaggtggcagtttgataccaccagaaagagaaaaaaaaagattctaaggaatcaaaaaaaaggaaaaattgggtttatgttcaacggaaaaaatttctcaaaagcaaggaaaagtattttgtttcggttcgacctgcagtcgcatatgaaatggacgaagggataaatttagcaacacttttcccgcaggatctcctgcaagaagaggataatctccaacttcgacttgtcaattttatttctcatgaaaatagcaagttaactcaaagaatttatcacacgaatagtcaattcgttcgaacttgcttagtagtgaattgggaacaagaagaaaaagagggagctcgtgcttctcttgttgaggtaagaacaaatgatctaattcgcgatttcctaagaattgagttagtcaagtctactattttgtatacacgaagaaggtatgataggacaagtgtaggattgattcccaataataggttagatcgcaacaataccaattccttttattccaaggcgaagattcaatcacttagccaacatcaagaagttattggcaccttgttgaatcgaaataaagaatatccatctttgatgattttgttggcatccaactgttctcgaattggtttattcaagaattctaaatatcccaatgcggtaaaagaatcgaatcctagaattcctattcgagatatttttgggctcttaggcgttattgtacctagtatatcgaatttttcttcatcttactatttattaacgcataatcagatcttgttaaaaaaatacttgttccttgacaatttgaaacaaaccttacaagtacttcaaggactttaaatactctttaatagacgaaaataaaaggatttcgaattttgacagtaacatcatgttggagccattccatttgaattggcactttctccatcatgactcatgggaagagacattggcaataattcaccttggacaatttatttgtgaaaatttatgtctatttaaattacacataaaaaaatctggtcaaattttcattgttaatatggactcctttgttctaagagcagctaagccttatttggccactataggagcaactgttcatggtcattatggaaaaatcctttacaaaggagataggttagttacgtttatatatgaaaaatcgagatccagtgatataacgcaaggtcttccaaaagtagaacaaatcttcgaagcgcgttcaattgattcactatcgccgaatctcgaaaggagaattgaggattggaatgaacgtataccaagaattcttggggttccctggggattcttgattggagctgagctaaccatagcccaaagtcgtatctctttggttaataagatccaaaaggtttatcgatcccaaggggtacagatccataatagacatatagagattattatacgccaagtaacatcaaaagtaagggtttccgaagatggaatgtctaatgtttttttacctggggaattaataggactattgcgagcggaacgagcagggcgggctttagatgaatcgatctattatcgggcaatcttattgggaataacaagggcttccctgaatacccaaagtttcatatctgaagcaagttttcaagaaactgctcgagttttagcaaaagctgccctacgaggtcgtattgattggttgaaaggtctgaaagaaaacgtagttctgggggggattatacctgttggtaccggattccaaaaatttgtgcatcgttccccacaagacaagaacctttatttagaaattcaaaaaaaaatctattcgcgtcggaaatgagagatattttgtttctccatacagaattagtttcttctgattctgacgtaacaaacaatttctatgaaacatcagagaccccgtttacccctatttatacgatttaagtatacataaagcaattttttttactttaatttaaactat

SEQ ID NO: 3203 - DNA, 10587 bp, Brassica rapa
aactagattggcatgtacttaaaaaagggacttacttgattttagaattccacaatgaaatactgaattttctagtaattatactactccgatccgaaataaaaaagaaccctcaaattattttgagaaattaaagtaagcacgctattctaaatcgaagcaaagtcaaacaaactttctagtatattatattacggctttattacattcatagaaaggagataaaatgagaaatctttgccatccaatctgattagaatatcataacataaagtataagtggcagaatttttttttttaggaatgttttatcaattcattttcatttcatttgtacccctggcaaactcgaactttcgtccaaatggtctctattcatatgtatgaaatacatatatgaaatacgtatgtggagttccctagaatttcatgtgattcagtaaacagaatatagattccatgattgctagatcgatccagagggattgatgaagagtgagctgataatggaatttttctttgataaacaggaaacttaagattaagatgctccggaatggaaacgagggaatgtccacaatacccggatttagtcagatccaattcgagggattttgtaggttcattaatcaagccttagcagaagaacttgacaagtttccaacaattaaagatccagatcacgaaattgcatttcaattatttgcgaaaggatatcaattgctagaaccctcgataaaagaaagagatgctgtgtatgaatcactcacctattcttccgaattatatgtatctgcgagattaatttttggtttcgatgtgcaaaagcaaaccatttctatcggaaacattcctataatgaattccttaggaacctttattataaatggaatataccgaattgtgatcaatcaaatattgctaagtcctggtatttactaccgctcggaattagatcataagggaatttctatctacactggcactataatatcagattggggggggagatcggaattagcaattgataaaaaagaaaggatatgggctcgcgtgagtagaaaacaaaagatatctattctagttctatcatcagctatgggttcgaatctaagagaaattctagataatgtttcctaccctgaaattttcttgtctttcccgaatgctaaggagaagaagaggattgagtcaaaagaaaaagctattttggagttttatcaacaatttgcttgtgtaggtggggacctggtattttcggagtccttatgcgaggaattacaaaagaaattttttcaacaaaaatgtgaattaggaaggattggtcgacgaaatatgaatcggagacttaatcttgatatacctcagaacaatacattcttgttaccacgagatgtattggccgctacggatcatttgattggaatgaaatttggaacgggtatacttgacgatgacgatatgaatcacttggaaaaataaacgtattcgttcggttgcagatctgttacaagatcaattcggattggctcttggtcgtttacaacatgcagttcaaaaaactattcgtagagtattcatacgtcaatcgaaaccgactccccaaactttggtaactccaacttcaacttcaattttattaataactacttatgagaccttttttggcacatacccgttatctcaagtttttgatcaaacgaatccattgacacaaactgttcatgggcgaaaagtgagttgtttaggtcctggagggttgacggggagaaccgcaagttttcggagccgagatattcatcatccgagtcactatgggcgtatttgtccaattgacacgtctgaaggaatcaatgttggacttactggatccttagcaattcatgcgagaattgatcacttgtggggatccatagagagtccgttttatgaaatatctgctgagaaagcaaaagaaaaaaaagagagacaggtggtttatctatcaccaaatagagatgaatattatatgatagcagcaggaaattctttgtccttgaatcaaggtattcaggaagaacaggttgttccggctagataccgtcaagaattcttgactattgcatgggaacagattcatgttagaagtatttttcctttccaatatttttctattgggggttctctcattccttttattgagcacaatgatgcgaatcgggctttaatgagttctaatatgcagcgccaagcagttccgctttctcggtccgagaaatgcattgttggaactggattggaacgccaaacagctctagattcgagggtttccattatagccgaacgcgagggaaagatcatttctactgatagtcataagatacttttatcaagtagtgggaagactataagtattcctttagttaaccaccgtcgctctaacaaaaatacttgtatgcaccaaaaaccccgggttccacggggtaaatccattaaaaaaggacaaattttagcagaaggagctgctacagttgggggcgaacttgctttaggaaaaaacgtattagtagcttatatgccatgggaaggttacaattttgaagacgcagtactaattagcgaacgtttggtatatgaagatatttatacctcttttcacatccggaaatatgaaattcagacggatacgacaagccagggctccgctgaaaaaatcactaaagaaataccacatctagaagaacatttactccgcaatttggacagaaatggagttgttaggttgggatcctgggtagaaactggcgatattttagtaggtaaattaacgcctcagatagcgagcgaatcatcttatatcgcggaagctggattattacgggccatatttggccttgaggtttccacttcaaaagaaacttctctgaaattacctataggtggaagagggcgcgttatcgatgtgaaatggatccaaagggacccgctcgacataatggttcgtgtatatattttacagaaacgtgaaatcaaagttggggataaagtagccggaagacatgggaataaagggatcatttccaaaattttgcctaggcaagatatgccctatttgcaagatggaacacccgttgatatggtcttcaatcccttaggagtaccctcccgaatgaatgtgggacaaatatttgaaagctcgctcggattagcgggggatctgctaaagaaacattatagaatagcaccctttgatgagagatatgagcaagaggcttcaagaaaacttgtgttttcagaattatatgaagccagtaaagaaacaaaaaacccatgggtatttgaacccgagtacccgggaaaaagcagaatatttgatggaagaacaggcgacccctttgagcaacctgttctaatagggaagtcctatatcttaaaattaattcatcaagttgatgagaaaattcatgggcgttctactgggccctactcacttgttacacaacaaccggttagaggaagagccaagcaagggggacaacgagtaggagaaatggaagtttgggctttagaaggatttggtgttgctcatattttacaagagatacttacttataaatctgaccatcttatagctcgccaagaaatacttaatgctacgatctggggaaaaagaatacctaatcatgaggatcctccagaatcttttcgagtgctcgttcgagaactacgatctttggctctagaactgaatcatttccttgtatctgaaaagaacttccaggttaatagggaggaagtttgatcggaataaatataaattcttttcttatttctattttatgattgaccaatataaacatcaacaacttcaaattggactcgtttcccctcaacaaataaaggcttgggctaacaaaaacctacctaatggagaagtcgttggcgaagtcacaaggccctctacttttcattataaaaccgataaaccagaaaaagatggattgttttgcgaaagaatctttggacccataaaaagcgggatttgcgcttgtggcaattctcgagcgagcggagctgaaaacgaagacgaaagattttgccaaaaatgcggggtagaatttgtggattctcggatacgaagatatcaaatgggatacatcaaactcgcatgtcccgtgactcatgtgtggtatttgaaaggtcttcctagttatatcgcgaatcttttagataaacctcttaagaagttggagggcctagtatacggcgatttctcttttgctaggcccagcactaaaaaacccacttttttacgattacgaggtttattcgaagaggaaattgcatcctgtaaccacagcatttctccctttttttctaccccaggctttgcaacatttcgaaatcgggaaattgcgacaggagcaggtgctattagagaacaattagcagatttggatttgcgaattattatagagaattctttggtcgaatggaaggaattagaagacgaggggtatagtggagatgatgagtgggaagatagaaaaagacgaataagaaaagtttttttgattagacgcatgcaattggcgaaacattttattcaaacaaatgtagaaccagaatggatggttttgtgcttattaccggttcttcctcccgaattgagacctattgtttataggtctggagataaagtagtgacttcagacattaatgaactttataagagagttatccgtcggaacaacaatcttgcctatctattaaaaagaagtgaattagcgccagcagatttagtaatgtgccaggaaaaccccccccccccccaagaagccgtggatacacttcttgatagtgggtcccgcgggcaaccgacgagggatggtcacaataaagtatacaaatcactttcagatgtaattgaaggtaaagagggaaggtttcgcgagactctgcttgggaaacgggtcgattactcggggcgttctgtcattgttgtgggtccttcgctttcattacatcaatgtggattacctctagagatagcaataaagctttttcagctatttgtaattcgcgatttaatcacgaaacgcgccacttctaatgtaaggattgctaaaaggaaaatttgggaaaaagaacccattgtatgggaaatacttcaagaagttatgcggggacatcctgtactgttaaatagagcacctaccctgcatagattaggcatacaggcctttcaacccactttagtagaggggcgtactatttctttacacccattagtgtgtaagggtttcaatgcggactttgatggagatcaaatggctgttcatctacctttatccttggaagctcaggcagaagcccgtttacttatgttttctcatatgaatctcttatctcccgctattggggatcctatttgcgtaccaacccaagacatgcttatcgggctttatgtattaacgattggaaagcgtcgaggtatttgtgcaaatagatataatagttgcagaaactgcccaaatctaaaagtaaattacaataataataataattctaaatataggaaagataaagaaccccatttttctagttcttatgatgcactgggagcttatagacaaaaactaatcagtttagatagtcccttgtggctacgatggaacctggatcaacgcgtcattgggtcaagagaagttccgattgaagttcaatatgaatctttggggacttatcatgagatttatgcccactatctaataatgggaaatagaaaaaaagaaattcgttcgatatacattcgaaccactcttggtcatatttctttttatagagaaatagaggaagccatacaaggatttagtcaggcctattcatacactacctaaacaagaaagaaagttagattcggcgatgcccctcccctttcggggggcattccgatttccctagtatcatcattatttgccacgcgaatccagattgagattgaggcaagttaattaaattttcgaatcactgactcaggcccattgtcgaatcctactcagcaattgtcgaatcctactcagccgaaaagggggtacttatgtatggcggaacgggccaatctggtctttcataataaagagatagacggaactggtatgaaacgacttattagcagattaatagatcattttggaatgggatatacatcccatatactggatcaactaaagactctgggcttccatcaagccactactacatcgatttcgttaggaatcgaggatcttttaacaataccctctaagggatggttagtccaagacgcggaacaacagagttttcttttggagaaacactattattatggggctgtacacgcggtagaaaaattacgccaatctgttgagatatggtatgcgacaagtgaatatttgaaacaagaaatgaattcaaattttcggataacggatccttctaatccagtctatctaatgtctttttcaggagccagaggaaatgcatctcaagtacaccaattagtaggtatgagaggattaatgtcggatccccaaggacaaatgatttatttacctattcaaagcaatttacgcgagggactttctttgacagaatatataatttcctgctatggagcccgcaaaggggttgtagatactgctgtgcgaacagcagatgctggatatcttacacgtagacttgttgaagtagttcaacatattattgtgcgtagaagagattgtggtactatccgaggtatttctgtaagtcctcaaaatgggatgacggaaaaactttttgtccaaacactaattggtcgtgtattagcagacgatatatatatcggttcacgatgcattgccgcgcgaaatcaagatattggaattggattagtcaatcgattcataactgcctttcgagcacaaccatttcgagcacaaccaatatatattagaaccccctttacttgccgaagcacttcttggatctgtcaattatgctatggccggagtcctactcatagtgatctggtcgaattgggagaagccgtaggtattattgcgggtcaatcaattggggagccagggactcaactaacattaagaacttttcatactggcggagtattcacagggggtactgccgaccttgtacgatccccttcgaatggaaaaataaaattcaatgagaatttggttcaccccacacgtacccgtcatgggcagcctgcttttctatgttatatagacttgcatgtaactattcagagtcaagatattctatatagtgtgaatattccctcaaaaagcttgattctagtgcaaaatgatcaatatgtaaaatccgaacaagtaattgcggagattcgtgccggaacgtccactttacattttaaagaaagggtacaaaagcatatttattctgaatcagacggcgaaatgcactggagtactgatgtttaccatgcgcccgaatatcaatatggtaatcttcgccgattaccaaaaacaagccatttatggatattgtcagtaagtatgtgcagatccagtatagcgtctttttcactccacaaggatcaagatcaaatgaatacttatggtaaaaaagatagggaaattcttgattattcaacgtcggatcgaatcatgtccaatggccattggaattttatctatccttctatttttcaagataattcagatttgttggcgaaaaagcgaagaaataggttcgtcattccattcccccccatcaagaacaagagaaagaactaatatcctgttttgggatttcgattgaaatcccccttatgggtgttttacgtagaaatactatttttgcttattttgacgatccccgatacagaaaagataaaaagggttcaggaattgttaaatttagatataggaccctagaagaagaatataggactcgagcggaagactcagaagaggaatatgagaccctagaagacgaatacaggacccgagaggacgaatatgaatatgaaaccctagaagaatctaaatatggaatcctagaagacgaatacgaatatgaaaccctagaagacgaatatgggagcccagaaaacgaatatgggaacccagagaacgaatataggactttagagaaagactcagaagaggaatatgggagcccagagagcaaatataggacccaagaggacgaatatggaactctagaggaagactcagaagacgaatatggcagccccggggaaagcgcagaggaaaaatatggtactttagaggaagactcagaagaagattcagaggacgaatacgagagcccagaggaagattccatcttaaaaaaagagggtttgattgagcatcgaggaacaaaagaatttagtctaaaataccaaaaagaagtagatcggttttttttcattcttcaagaacttcatatcttgccgagatcttcatccctaaagatacttgacaatagtattattggagtggatacacaactcacaaaaaatacaagaagtcgactaggcggactggtccgagtgaagagaaaaaaaagccatacggaactcaaaatattttccggagatattcattttcctgaagaggcggataagatattaggtggctgtttgataccgccagaaagacaaaaaaaagattctaaggaatcaaaaaaaaggaaaaattgggtctatgttcaacggaaaaaaattctcaagagcaaggaaaagtattttgtttccgttcgccctacagtggcatatgaaatggacgaaggaagaaatttagcaacacttttcccgcaggatctcttgcaagaagaaaataatctccaaattcgacttgtcaattttatttctcatgaaaatagcaagttaactcaaagaatttatcacacaaatagtcaatttgttagaacttgcttagtagtgaattgggaacaagaagaaaaagaaaaggctggtgcttcccttgttgaggtaagagcaaatgatcttattcgcgatttcctaagaattgagttagtcaagtccactatttcgtatacacgaaaaaggtatggtaggacaagtgcaggaccgattccccataataggttagatcgcgccaatatcaattctttttattccaaggcgaagattgaatcacttagccaacatccagaagctattggcactttgttgaatcgaaataaagaataccactctttgatgattttgtcggcatccaactgttctcgaattggtttattcaagaattcaaaacatcccaatgcgataaaagaatggaatcctagaattcctattcgagaaatttttgggcccttaggcgctattgtagctagtatatcgcatttttcttcatcttactatttactaacgcataataaaatcctgttaaaaaaatatttgttcgttgacaatttaaaacaaaccttccaagtacttcaagaacttaaatactctttaatagatgaaaataaaaggatttctaatttcgatagtaacataatgttggatccattccttttgaattgtcactttgtccatcatgattcttgggaagagacattggcaataattcaccttggacaatttatttgtgaaaatgtatgtctatttaaatcgcacataaaaaaatccggtcaaattttcattgtaaatatgaattcctttgttataagagcagctaaaccttatttggccactacaggagcaactgttaatggtcattatggagaaatcctttacaagggagataggttagttacgtttatatatgaaaaatcgagatctagtgacataacgcaaggtcttccaaaagtggaacaaatctttgaagcgcgttcaattgattcattatccccgaatctcgaaaggagaattgaggattggaatgagcgtataccaagaattcttggggtcccttggggattcttgattggagctgagctaaccatagcccaaagtcgtatctctttggttaataaaatccaaaaggtttatcgatcccaaggggtacagatccataatagacatatagagattattatacgccaagtaacatcaaaagtgcgggtttccgaagatggaatgtctaatgttttttcgcctggggaattaatcggactattgcgagcggaacgagcaggacgagctttggatgaatcgatctattatcgggcaatcttattgggaataacaagggcttccctaaatacccaaagtttcatatctgaagcaagttttcaagaaactgctcgagttttagcaaaagctgccctacgaggtcgcattgattggttgaaaggcttgaaagaaaacgtagttctgggggggattatacctgttggtaccggattccaaaaatttgtgcatcgttccccacaagacaagaacctttatttcgaaataaaaaaaaaaaatctattcgcgtcggaaatgagagattttttgtttctccatacagaattagtttcttcagattctgacgtaacaaacaatttttatgagacataagaacccccatttaacatttaaccctatatcatttaaggatacataaaaaatattttttatttcaa

SEQ ID NO: 3204 - DNA, 7597 bp, Brassica rapa
aactagattggcatgtacttaaaaaagggacttacttgattttagaattccacaatgaaatactgaattttctagtaattatactactccgatccgaaataaaaaagaaccctcaaattattttgagaaattaaagtaagcacgctattctaaatcgaagcaaagtcaaacaaactttctagtatattatattacggctttattacattcatagaaaggagataaaatgagaaatctttgccatccaatctgattagaatatcataacataaagtataagtggcagaatttttttttttaggaatgttttatcaattcattttcatttcatttgtacccctggcaaactcgaactttcgtccaaatggtctctattcatatgtatgaaatacatatatgaaatacgtatgtggagttccctagaatttcatgtgattcagtaaacagaatatagattccatgattgctagatcgatccagagggattgatgaagagtgagctgataatggaatttttctttgataaacaggaaacttaagattaagatgctccggaatggaaacgagggaatgtccacaatacccggatttagtcagatccaattcgagggattttgtaggttcattaatcaagccttagcagaagaacttgacaagtttccaacaattaaagatccagatcacgaaattgcatttcaattatttgcgaaaggatatcaattgctagaaccctcgataaaagaaagagatgctgtgtatgaatcactcacctattcttccgaattatatgtatctgcgagattaatttttggtttcgatgtgcaaaagcaaaccatttctatcggaaacattcctataatgaattccttaggaacctttattataaatggaatataccgaattgtgatcaatcaaatattgctaagtcctggtatttactaccgctcggaattagatcataagggaatttctatctacactggcactataatatcagattggggggggagatcggaattagcaattgataaaaaagaaaggatatgggctcgcgtgagtagaaaacaaaagatatctattctagttctatcatcagctatgggttcgaatctaagagaaattctagataatgtttcctaccctgaaattttcttgtctttcccgaatgctaaggagaagaagaggattgagtcaaaagaaaaagctattttggagttttatcaacaatttgcttgtgtaggtggggacctggtattttcggagtccttatgcgaggaattacaaaagaaattttttcaacaaaaatgtgaattaggaaggattggtcgacgaaatatgaatcggagacttaatcttgatatacctcagaacaatacattcttgttaccacgagatgtattggccgctacggatcatttgattggaatgaaatttggaacgggtatacttgacgatgacgatatgaatcacttggaaaaataaacgtattcgttcggttgcagatctgttacaagatcaattcggattggctcttggtcgtttacaacatgcagttcaaaaaactattcgtagagtattcatacgtcaatcgaaaccgactccccaaactttggtaactccaacttcaacttcaattttattaataactacttatgagaccttttttggcacatacccgttatctcaagtttttgatcaaacgaatccattgacacaaactgttcatgggcgaaaagtgagttgtttaggtcctggagggttgacggggagaaccgcaagttttcggagccgagatattcatcatccgagtcactatgggcgtatttgtccaattgacacgtctgaaggaatcaatgttggacttactggatccttagcaattcatgcgagaattgatcacttgtggggatccatagagagtccgttttatgaaatatctgctgagaaagcaaaagaaaaaaaagagagacaggtggtttatctatcaccaaatagagatgaatattatatgatagcagcaggaaattctttgtccttgaatcaaggtattcaggaagaacaggttgttccggctagataccgtcaagaattcttgactattgcatgggaacagattcatgttagaagtatttttcctttccaatatttttctattgggggttctctcattccttttattgagcacaatgatgcgaatcgggctttaatgagttctaatatgcagcgccaagcagttccgctttctcggtccgagaaatgcattgttggaactggattggaacgccaaacagctctagattcgagggtttccattatagccgaacgcgagggaaagatcatttctactgatagtcataagatacttttatcaagtagtgggaagactataagtattcctttagttaaccaccgtcgctctaacaaaaatacttgtatgcaccaaaaaccccgggttccacggggtaaatccattaaaaaaggacaaattttagcagaaggagctgctacagttgggggcgaacttgctttaggaaaaaacgtattagtagcttatatgccatgggaaggttacaattttgaagacgcagtactaattagcgaacgtttggtatatgaagatatttatacctcttttcacatccggaaatatgaaattcagacggatacgacaagccagggctccgctgaaaaaatcactaaagaaataccacatctagaagaacatttactccgcaatttggacagaaatggagttgttaggttgggatcctgggtagaaactggcgatattttagtaggtaaattaacgcctcagatagcgagcgaatcatcttatatcgcggaagctggattattacgggccatatttggccttgaggtttccacttcaaaagaaacttctctgaaattacctataggtggaagagggcgcgttatcgatgtgaaatggatccaaagggacccgctcgacataatggttcgtgtatatattttacagaaacgtgaaatcaaagttggggataaagtagccggaagacatgggaataaagggatcatttccaaaattttgcctaggcaagatatgccctatttgcaagatggaacacccgttgatatggtcttcaatcccttaggagtaccctcccgaatgaatgtgggacaaatatttgaaagctcgctcggattagcgggggatctgctaaagaaacattatagaatagcaccctttgatgagagatatgagcaagaggcttcaagaaaacttgtgttttcagaattatatgaagccagtaaagaaacaaaaaacccatgggtatttgaacccgagtacccgggaaaaagcagaatatttgatggaagaacaggcgacccctttgagcaacctgttctaatagggaagtcctatatcttaaaattaattcatcaagttgatgagaaaattcatgggcgttctactgggccctactcacttgttacacaacaaccggttagaggaagagccaagcaagggggacaacgagtaggagaaatggaagtttgggctttagaaggatttggtgttgctcatattttacaagagatacttacttataaatctgaccatcttatagctcgccaagaaatacttaatgctacgatctggggaaaaagaatacctaatcatgaggatcctccagaatcttttcgagtgctcgttcgagaactacgatctttggctctagaactgaatcatttccttgtatctgaaaagaacttccaggttaatagggaggaagtttgatcggaataaatataaattcttttcttatttctattttatgattgaccaatataaacatcaacaacttcaaattggactcgtttcccctcaacaaataaaggcttgggctaacaaaaacctacctaatggagaagtcgttggcgaagtcacaaggccctctacttttcattataaaaccgataaaccagaaaaagatggattgttttgcgaaagaatctttggacccataaaaagcgggatttgcgcttgtggcaattctcgagcgagcggagctgaaaacgaagacgaaagattttgccaaaaatgcggggtagaatttgtggattctcggatacgaagatatcaaatgggatacatcaaactcgcatgtcccgtgactcatgtgtggtatttgaaaggtcttcctagttatatcgcgaatcttttagataaacctcttaagaagttggagggcctagtatacggcgatttctcttttgctaggcccagcactaaaaaacccacttttttacgattacgaggtttattcgaagaggaaattgcatcctgtaaccacagcatttctccctttttttctaccccaggctttgcaacatttcgaaatcgggaaattgcgacaggagcaggtgctattagagaacaattagcagatttggatttgcgaattattatagagaattctttggtcgaatggaaggaattagaagacgaggggtatagtggagatgatgagtgggaagatagaaaaagacgaataagaaaagtttttttgattagacgcatgcaattggcgaaacattttattcaaacaaatgtagaaccagaatggatggttttgtgcttattaccggttcttcctcccgaattgagacctattgtttataggtctggagataaagtagtgacttcagacattaatgaactttataagagagttatccgtcggaacaacaatcttgcctatctattaaaaagaagtgaattagcgccagcagatttagtaatgtgccaggaaaagggggggggggggcaagaagccgtggatacacttcttgatagtgggtcccgcgggcaaccgacgagggatggtcacaataaagtatacaaatcactttcagatgtaattgaaggtaaagagggaaggtttcgcgagactctgcttgggaaacgggtcgattactcggggcgttctgtcattgttgtgggtccttcgctttcattacatcaatgtggattacctctagagatagcaataaagctttttcagctatttgtaattcgcgatttaatcacgaaacgcgccacttctaatgtaaggattgctaaaaggaaaatttgggaaaaagaacccattgtatgggaaatacttcaagaagttatgcggggacatcctgtactgttaaatagagcacctaccctgcatagattaggcatacaggcctttcaacccactttagtagaggggcgtactatttctttacacccattagtgtgtaagggtttcaatgcggactttgatggagatcaaatggctgttcatctacctttatccttggaagctcaggcagaagcccgtttacttatgttttctcatatgaatctcttatctcccgctattggggatcctatttgcgtaccaacccaagacatgcttatcgggctttatgtattaacgattggaaagcgtcgaggtatttgtgcaaatagatataatagttgcagaaactgcccaaatctaaaagtaaattacaataataataataattctaaatataggaaagataaagaaccccatttttctagttcttatgatgcactgggagcttatagacaaaaactaatcagtttagatagtcccttgtggctacgatggaacctggatcaacgcgtcattgggtcaagagaagttccgattgaagttcaatatgaatctttggggacttatcatgagatttatgcccactatctaataatgggaaatagaaaaaaagaaattcgttcgatatacattcgaaccactcttggtcatatttctttttatagagaaatagaggaagccatacaaggatttagtcaggcctattcatacactacctaaacaagaaagaaagttagattcggcgatgcccctcccctttcggggggcattccgatttccctagtatcatcattatttgccacgcgaatccagattgagattgaggcaagttaattaaattttcgaatcactgactcaggcccattgtcgaatcctactcagcaattgtcgaatcctactcagccgaaaagggggtacttatgtatggcggaacgggccaatctggtctttcataataaagagatagacggaactggtatgaaacgacttattagcagattaatagatcattttggaatgggatatacatcccatatactggatcaactaaagactctgggcttccatcaagccactactacatcgatttcgttaggaatcgaggatcttttaacaataccctctaagggatggttagtccaagacgcggaacaacagagttttcttttggagaaacactattattatggggctgtacacgcggtagaaaaattacgccaatctgttgagatatggtatgcgacaagtgaatatttgaaacaagaaatgaattcaaattttcggataacggatccttctaatccagtctatctaatgtctttttcaggagccagaggaaatgcatctcaagtacaccaattagtaggtatgagaggattaatgtcggatccccaaggacaaatgatttatttacctattcaaagcaatttacgcgagggactttctttgacagaatatataatttcctgctatggagcccgcaaaggggttgtagatactgctgtgcgaacagcagatgctggatatcttacacgtagacttgttgaagtagttcaacatattattgtgcgtagaagagattgtggtactatccgaggtatttctgtaagtcctcaaaatgggatgacggaaaaactttttgtccaaacactaattggtcgtgtattagcagacgatatatatatcggttcacgatgcattgccgcgcgaaatcaagatattggaattggattagtcaatcgattcataactgcctttcgagcacaaccatttcgagcacaaccaatatatattagaaccccctttacttgccgaagcacttcttggatctgtcaattatgctatggccggagtcctactcatagtgatctggtcgaattgggagaagccgtaggtattattgcgggtcaatcaattggggagccagggactcaactaacattaagaacttttcatactggcggagtattcacagggggtactgccgaccttgtacgatccccttcgaatggaaaaataaaattcaatgagaatttggttcaccccacacgtacccgtcatgggcagcctgcttttctatgttatatagacttgcatgtaactattcagagtcaagatattctatatagtgtgaatattccctcaaaaagcttgattctagtgcaaaatgatcaatatgtaaaatccgaacaagtaattgcggagattcgtgccggaacgtccactttacattttaaagaaagggtacaaaagcatatttattctgaatcagacggcgaaatgcactggagtactgatgtttaccatgcgcccgaatatcaatatggtaatcttcgccgattaccaaaaacaagccatttatggatattgtcagtaagtatgtgcagatccagtatagcgtctttttcactccacaaggatcaagatcaaatgaatac

SEQ ID NO: 3205 - DNA, 4539 bp, Setaria italica
tttttttctaggactgttttatcaattcatttttattccatttctacccctgctaaattcgaatttcgtcgaaatcgtctctattcatatgtatgaaatacatatatgaaatacatatgtgaagttccctagaatttcatgtgattcagtaaacagaatatagattccatgattgctagattgatccgtagggattgatgaagagtgagctgataatggaatttttcttcgataaatagaataggaaacttaagattaaaatgctccggaatggaaatgagggaatgtccacaatacccggatttagtcagatccaattcgagggattttgtagattcattaatcagggcttggcagaagaacttgagaagtttccaacaattaaagatccagatcacgaaattgcatttcaattattgcgaaaggatatcaattgctagaaccctcgataaagaaagggatgctgtgtatgaatcactcacctattcttccgaattatatgtatccgcgagattaatttttggtttcgatgtgcaaaagcaaaccatttctattggaaacattcctataatgaattccttaggaacctttataataaatggaatataccgaattgtgatcaatcaaatattgttaagtcctggtatttactaccgctcggaattagaccacaagggaatttccatatacaccgggactataatatcagattggggaggaaggtcggaattagcaattgataaaaaagaaaggatatgggctcgcgtgagtagaaaacaaaagatatctattttagttctatcatcagctatgggttcaaatctaagagaaattttagataatgtttcctaccccgaaattttcttgtctttcccgaatgctaaggagaagaagaggattgagtcaaaagaaaaagctattttggagttttatcaacaatttgcttgtgtaggtggggacctggtattttcggagtccttatgcgaggaattacaaaagaaattttttcaacaaaaatgtgaattaggaagagttggtcgacgaaatatgaatcggagactgaatcttgatatccctcagaacaatacattcttgttaccacgagatgtattggccgctacggatcatttgattggaatgaaatttggaacgggtatacttgacgatgacgatatgaatcacttgaaaaataaacgtattcgttcggttgcggatctgttacaagatcaattcggactggctcttggccgtttacaacatgcggttcaaaaaactatccgtagagtattcatacgtcaatcgaaaccgactccacaaactttggtaactccaacttcaacttcgattttattaataactacttatgagaccttttttggcacatatcccttatctcaagtttttgatcaaaccaatccattgacacaaacggttcatgggcgaaaagtgagttgtttgggtcctggaggattgacggggagaactgcaagttttcggagccgagatattcatccgagtcactatgggcgtatttgtccaattgacacgtccgaaggaatcaatgttggacttaccggatcgttagctattcatgcgagaattgatcactggtggggatctatagagagtccgttttatgaaatatctgagaaagcaaaagaaaaaaagagagacaggtggtttatttatcaccaaatagagatgaatattatatgatagcagcaggaaattctttgtccttgaatcagggtattcaggaagaacaggttgttccagctagataccgtcaagaattcctgactattgcatgggaacagattcatgttagaagtattttccctttccaatatttttctattgggggttctctcattccttttattgagcataatgatgcgaatcgggctttaatgagttctaatatgcaacgccaagcagttccactttctcggtccgagaagtgcattgttggaactggattggaacgccaaacagctctagattcgagggtttccgttatagccgaacgcgagggaaagatcatttctagtgatagtcataagatccttttatcaagtagtgggaagactataagtattcctttagttgcccatcagcgctctaacaaaaatacttgtatgcaccaaaaacctcgggttacgcggggtaaatccattaaaaaagggcaaattttagcggagggagcagctacagttggtggggaacttgctttaggaaaaaacattttagtagcttatatgccctgggagggttacaattttgaagacgcagtactaattagcgaacgtttggtatatgaggatatttatacttcttttcacatccgaaaatatgaaattcagacggatacgacaagccaaggctccgctgaaaaaatcactaaagaaataccacatctagaagaacattactccgcaatttggacagaaatggagttgtgaagttgggatcctgggtggaaactggcgatattttagtaggtaaattaacgcctcagatagcgagcgaatcgtcgtatatcgcggaagctggattgttacgggctatttttggtcttgaggtatccacttcaaaagaaacttctctcaaactacctataggtggaagagggcgcgtatcgatgtgaaatggatccagagggacccccttgacataatggttcgtgtatatattttacagaaacgtgaaatcaaagttggggataaagtagccggaagacacgggaataaggggatcatttcaaaaatttgcctaggcaagatatgccctatttgcaagatggaacacctgttgatatggtcttcaatcccttaggagtaccctcacgaatgaatgtgggacaaatatttgaaagttcactcggattagcagggatctgctaaagaaacattatagaatagcaccctttgatgagagatatgagcaagaggcttcaagaaaacttgtgttttcggaattatatgaagccagtaaacaaacaaaaaatccatgggtatttgaacccgagtacccgggaaaaagcagaatatttgatggaagaacaggagatcccttcgaacagcctgttctaatagggaagtcctatatcttaaaattaattcatcaagttgatgagaaaattcatggacgttctactgggccctactcacttgttacccaacaacccgttagaggaagagccaagcaagggggacaacgagtaggagaaatggaagtttgggctttagaaggatttggtgttgctcatatttacaagagatacttacttataaatctgatcatcttatagctcgccaagaaatacttaatgctacgatctggggaaaaagagtgcctaatcacgaggatcctccagaatcttttcgagtgctcgttcgagaactacgatctttggctctagaactgaacaatttccttgtatctgagaagaacttccaggttaatagggaggatgtttgatcggaataaatataaattcttttcttatttctattttatgattgaccaatataaacataaacaacttcaaattggactcgtttcccctcaacaaataagggcttgggctaaaaaaatcctacctaatggggaagtcgttggcgaagtcacaaggccctccacttttcattataaaaccgataaaccagaaaaagatggattgttttgcgaaagaatctttggacccataaaaagcggaatttgtgcttgtggaaattctcgagcgagcgtagctgaaaacgaagacgaaagattttgtcaaaaatgtggggtagaatttgttgattctcggatacgaagatatcaaatgggctacataaaactggcatgtccagtgactcatgtgtggtatttgaaaggtcttcctagttatatcgcgaatcttttagataaaccccttaagaaattggagggcctagtatatggcgatttctcttttgctaggcccagcgctaaaaaacctactttcttacgattacggggtttattcgaagatgaaatttcatcctgtaaccacagtatttctccctttttttctaccccaggctttgcaacatttcgaaatcgggaaattgcgacaggagcagtgctattagagaacaattagcagatttagatttgcgaattattatagagaattccttggttgaatggaaagaattagaagacgaggggtatagtggagatgaatgggaagatagaaaaagacgaataagaaaagttttttgattagacgcatgcaattggcgaaacatttattcaaacaaatgtagaaccagaatggatggttttgtgcttattaccggttcttcctcccgaattgagacccattgtttataggtctggggataaagtagtgacttcggatattaatgaactttataagagagttatccgtcggaacaacaaccttgcctatctattaaaaagaagtgaattagcaccagcagatttagtaatgtgtcaggaaaaattggtacaagaagccgtggatacacttcttgatagtgggtcccgcgg

SEQ ID NO: 3206 - DNA, 7169 bp, Oryza sativa
ataaatatgatacatagccctttcttattaataaaagaataaggaaacgctatctcatccctattggtatcggtttgggccactactgctaaaacaaaccccagtttgaggaaagaacggtgggttctcaaaatccagtatcgccgagccttgttattctcttgccccaacttatgcggggtgcaaatttgtcgatttggatcagtactataagcctaagtattttattgatcaggcggcacccagatttgaactggggataaaggatttgcagtcccctgccttaccgcttggccatgccgccaaaaaatacgatctaaaatcgagaaaagagcaagtattcatccacgtttcttactaaaactaactttcttttatcttaaatctaattctacttacttttttccaatctttttcaaaaaatctattcatgctttttttggatccagtttcgattattctcctcaaaggattctatcttaaaacacacattgctaacactagaaaacttcccttttctttctattgaaatgaaaaaggagaaaagtggatttctagtcacaagctacaaaattaagaacaaattggaaccattaactagaattctctttttattttgaatttcggtattctctcccgcctgccatttaatgtcataataaaagacaatggatttatgcctaatccgtatataggtaaactccaggtccgaacagcattattatctatggatcccccttatgtacatatctctgtggagaatcgttctttaatttttcattgcattaaatatcttgaataaaaaaaagaaaattcgactttgctatgtggaggtccagaactagattggcatgtacttaaaaaagtacttactttattttaggattctacaacgaaatcttatatcttatattttatagaaattctactactacgaaacaaaaaagaaccttcaaattcttttttgaaattaaactaagcgtgctattctcaatcgaactaaagtcaaactttctagtgcttataaattattatattttggttttatcccattcatagaaaggagaaaaaatgagaaatctttgccgtccaatctaagaatatcataaactgtaagtggcagaatttttttcgaggttctaggaatgttttatcacttcattttcattccatttggacccctgggaaattcgaactttcgttgaaattgtctctattcatatgtatgaaatacatatatgaaatacgtatgtggagttcccgagaatttcatgtgatttagtaaacagaatatagattccataattgctagatcgatctgtagggattgatgaagagtgagctgataatggaatttttcttcgataaacaggaaacttaagattaagatgctccggaatggaaatgagggaatgtccacaatacccggatttagtcagatccaattcgagggattttgtaggttcattaatcaaggcttggcagaagaacttgagaagtttccaacaattaaagatccagatcacgaaatttcatttcaattatttgcgaaaggatatcaattgctagaaccttcgataaaagaaagggatgctgtgtatgaatcactcacctattcttccgaattatacgtatccgcgcgattaatttttggtttcgatgtgcaaaagcaaaccatttctattggaaacattcctataatgaattccttaggaacctttataataaatggaatataccgaattgtgatcaatcaaatattgctaagtcctggtatttactaccgctcggaattagaccataaaggaatttctatctacaccgggactataatatcagattggggaggaagatcggaattagcaattgataaaaaagaaaggatatgggctcgcgtgagtagaaaacaaaagatatctattctagttctatcatcagctatgggttcaaatctaaaagaaattctagataatgtttcctaccctgaaattttcttgtctttccctaatgctaaggagaagaagaggattgagtcaaaagaaaaagctattttggagttttatcaacaatttgcttgtgtaggtggggacctggtattttcggaatccttatgtgaggaattacaaaagaaattttttcaacaaaaatgtgaattaggaaggattggtcgacgaaatatgaatcgaagactgaatcttgatatacctcagaacagcaccttcttgttaccgcgagatgtattggccgctacggatcatttgattggaatgaaatttgaaacgggtatacttgacgatgacgatatgaatcacttgaaaaataaacgtattcgttcggttgcggatctgttacaagatcaattcggactggctcttggtcgtttacaacatgcggttcaaaaaactatccgtagagtattcatacgtcaatcaaaaccgactccacaaactttggtaactccaacttcaacctcgattttattaataactacttacgagaccttctttggtacatatcccttatctcaagtttttgatcaaaccaatccattgacacaaacggttcatgggcgaaaagtgagttgtttgggtcctggaggattgacggggagaactgcaagttttcggagccgagatatccatccgagtcactatgggcgtatttgtccaattgacacgtccgaaggaatcaacgttggacttactggatctttagctattcatgcgagaattgatcattggtggggatccgtagagagtcctttttatgaaatatctgagaaagcaaagaaaaaaaaagagagacaggtggtttatttatcaccaaatagagatgagtattatatgatagcagcaggaaattctttgtccttgaatcggggtattcaggaagaacaggttgttccagctagataccgtcaagaattcctgactattgcatgggaacagattcatgttagaagtatttttcctttccaatatttttctattgggggttctctcattccttttattgagcataatgatgcgaatcgagctttaatgagttctaatatgcagcgccaagcagttccgctttctcggtccgagaagtgcattgttggaactggattggaacgccaaacagctctagattcgagggtttctgttatagccgaacgcgagggaaagatcatttctactaatagtcacaagatccttttatcaagtagtgggaagactataagtattcctttagttacccatcggcgctctaacaaaaatacttgtatgcaccaaaaacctcgggttccgcggggtaaatccattaaaaaaggacaaattttagcggagggggctgctacggttggtggggaacttgctttaggaaaaaacgtattagtagcttatatgccatgggaaggttacaattttgaagacgcagtattaattagcgaacgtttggtatatgaggatatttatacttcttttcacatccgaaaatatgaaattcagacggatacaacaagccaaggctccgctgaaaaaatcactaaagaaataccacatctagaagaacatttactccgcaatttggacagaaatggagttgtgaagttggggtcctgggtagaaacaggcgatattttagtaggtaaattaacgcctcagatagcgagcgaatcgtcctatatcgcggaagctggattattacgggccatatttggtcttgaggtatccacttcaaaagaaacttctctcaaactaccgataggtggaagaggacgcgttatcgatgtgaaatggatccagagggatcccctcgacataatggttcgtgtatatattttacaaaaacgcgaaatcaaagttggggataaagtagccggaagacacgggaataaggggatcatttccaaaattttgcctaggcaagatatgccctatttgcaagatggaacgcctgttgatatggttttcaatcccttaggagtaccctcccgaatgaatgtgggacaaatatttgaaagctcgctcggattagcaggggatctgctaaagaaacattatagaatagcaccctttgatgagagatatgagcaagaggcttcaagaaaacttgtgttttcagaattatatgaagccagtaaacaaacaaaaaatccgtgggtatttgaacccgagtacccgggaaaaagcagaatatttgatggaagaacaggagaccccttcgaacagcctgttctaatagggaagtcctatatcttaaaattaattcatcaagttgatgagaaaatccacggacgctctactgggccctattcacttgttacacaacaacccgttagaggaagagccaagcaagggggacaacgaataggagaaatggaagtttgggctttagaaggatttggtgttgctcatattttacaagagatacttacttataaatctgatcatcttatagctcgccaagaaatacttaacgctacgatctggggaaaacgagtacctaatcacgaggatcctccagaatcttttcgagtgcttgttcgagaactacgatctttggctctagaactgaaccatttccttgtatctcagaagaacttccaggttaatagggaagaagtttgatcggaataaatataaattcttttcttatttctattttatgattgaccaatataaacatcaacaacttcaaattggactcgtttcccctcaacaaataaaggcttgggctaacaaaacactacctaatggggaagtcgttggcgaagtcacaaggccctccacttttcattataaaaccgataaaccagaaaaagatggattgttttgcgaaagaatctttggacccataaaaagcagaatttgtgcttgtggaaattctcgagcgagcggagctgaaaacgaagacgaaagattttgccaaaaatgcggagtagaatttgttgattctcggatacgaagatatcaaatgggatacatcaaactcgcatgtcccgtgactcatgtgtggtatttaaaaggtcttcctagttatatcgcgaatcttttagataaaccccttaagaaattggagggcctagtatatggcgatttctcttttgctaggcccagtgctaaaaaaccaactttcttacgattacgaggtttattcgaggatgaaatttcatcctgtaaccatagcatttccccctttttttctaccccaggctttacaacatttcgaaatcgggaaattgcgacaggagcaggtgctattagagaacaattagcagatttggatttgcgaattattttagagaattcctcggtcgaatggaaggaattagaagacgaggggtatagtggagatgaatgggaagatagaaaaagacgaataagaaaagtttttttgattagacgcatgcaattggcgaaacattttattcaaacaaatgtagaaccagaatggatggttttgtgcttattaccagttcttcctcccgaattaagacccattgtttataggtctggggataaagtagtgacttcggatattaatgaactttataagagagttatccgtcggaacaacaatcttgcctatctattaaaaagaagtgaattagcgccagcagatttagtaatgtgccaggaaaaattggtacaagaagccgtggatacacttcttgatagtgggtcccgcgggcaaccaacgagggatggtcacaataaagtatacaaatcactttcagatgtaattgaaggtaaagaggggaggtttcgcgaaactctgcttgggaaacgggtcgattactcggggcgttctgtcattgttgtgggtccttcactttcattacatcaatgtgggttacctctagagatagcaataaagctttttcagctatttgtaattcgcgatttaatcacgaaacgtgctacttctaatgttaggattgctaaaaggaaaatttgggaaaaggaacccattgtatgggaaatacttcaagaagttatgaggggacatcctgtactgttgaatagagcacctaccctgcatagattaggcatacaggctttccaacccactttagtagaggggcgtactatttgtttacacccattagtgtgtaaaggtttcaatgcagactttgatggggatcaaatggctgttcatctacctttatccttggaagctcaggcggaagctcgtttacttatgttttctcatatgaatctcctatctcccgctattggggatcctatttgcgtaccaacccaagacatgcttatcggactttatgtattaacgattggaaaccgtcgaggtatttgtgcaaatagatataatagttgcggaaactatccaaaccaaaaagtaaattacaataataataatcctaagtatacgaaagataaagaatctcttttttctagttcctatgatgcactgggagcttatagacagaaacaaatctgtttagacagtcccttgtggctccgatggaaactagatcaacgcgtcattgggttaagagaagttccgattgaagttcaatatgaatctttggggacttatcgtgagatttatgcccactatctagtagtgggaaatagaaaaaaggaaatccgttctatatacattcgcaccactcttggtcatatttctttttatagagaaatagaggaagccatacaaggatttagtcaggcctattcatacactatctaaacaaggaagttagattcggggatgcccctttcgaggggcattccgatttcgctagtatcatcatttttgccgcacgaatccagattgagattgaggaaaggaagttaactaagttttcgaatcactgactcaggcccattgtcgaatcctactcagcaattgtcgaattatactcagccgaaaaagggggtacttatttatggcggaacgggccaatctggtctttcagaataaagagatagatggaactgctatgaaacgacttattagcagattaatagatcatttcggaatgggatatacatcccatatactggatcaaataaaaacgctgggcttccatcaagccactactacatcgatttcattaggaatcgaggatcttttaacaataccctctaagggatggttagtccaagatgcggaacaacagagttttcttttggaaaaacactattattatgggg

SEQ ID NO: 3207 - DNA, 6704 bp, Oryza sativa
ataaatatgatacatagccctttcttattaataaaagaataaggaaacgctatctcatccctattggtatcggtttgggccactactgctaaaacaaaccccagtttgaggaaagaacggtgggttctcaaaatccagtatcgccgagccttgttattctcttgccccaacttatgcggggtgcaaatttgtcgatttggatcagtactataagcctaagtattttattgatcaggcggcacccagatttgaactggggataaaggatttgcagtcccctgccttaccgcttggccatgccgccaaaaaaatacgatctaaaatcgagaaaagagcaagtattcatccacgtttcttactaaaactaactttcttttatcttaaatctaattctacttacttttttccaatctttttcaaaaaatctattcatgctttttttggatccagtttcgattattctcctcaaaggattctatcttaaaacacacattgctaacactagaaaacttcccttttctttctattgaaatgaaaaaggagaaaagtggatttctagtcacaagctacaaaattaagaacaaattggaaccattaactagaattctctttttattttgaatttcggtattctctcccgcctgccatttaatgtcataataaaagacaatggatttatgcctaatccgtatataggtaaactccaggtccgaacagcattattatctatggatcccccttatgtacatatctctgtggagaatcgttctttaatttttcattgcattaaatatcttgaataaaaaaaaaagaaaattgactttgctatgtggaggtccagaactagattggcatgtacttaaaaaagtacttactttattttaggattctacaacgaaatcttatatcttatattttatagaaattctactactacgaaacaaaaaagaaccttcaaattcttttttgaaattaaactaagcgtgctattctcaatcgaactaaagtcaaactttctagtgcttataaattattatattttggttttatcccattcatagaaaggagaaaaaatgagaaatctttgccgtccaatctaagaatatcataaactgtaagtggcagaatttttttcgaggttctaggaatgttttatcacttcattttcattccatttggacccctgggaaattcgaactttcgttgaaattgtctctattcatatgtatgaaatacatatatgaaatacgtatgtggagttcccgagaatttcatgtgatttagtaaacagaatatagattccataattgctagatcgatctgtagggattgatgaagagtgagctgataatggaatttttcttcgataaacaggaaacttaagattaagatgctccggaatggaaatgagggaatgtccacaatacccggatttagtcagatccaattcgagggattttgtaggttcattaatcaaggcttggcagaagaacttgagaagtttccaacaattaaagatccagatcacgaaatttcatttcaattatttgcgaaaggatatcaattgctagaaccttcgataaaagaaagggatgctgtgtatgaatcactcacctattcttccgaattatacgtatccgcgcgattaatttttggtttcgatgtgcaaaagcaaaccatttctattggaaacattcctataatgaattccttaggaacctttataataaatggaatataccgaattgtgatcaatcaaatattgctaagtcctggtatttactaccgctcggaattagaccataaaggaatttctatctacaccgggactataatatcagattggggaggaagatcggaattagcaattgataaaaaagaaaggatatgggctcgcgtgagtagaaaacaaaagatatctattctagttctatcatcagctatgggttcaaatctaaaagaaattctagataatgtttcctaccctgaaattttcttgtctttccctaatgctaaggagaagaagaggattgagtcaaaagaaaaagctattttggagttttatcaacaatttgcttgtgtaggtggggacctggtattttcggaatccttatgtgaggaattacaaaagaaattttttcaacaaaaatgtgaattaggaaggattggtcgacgaaatatgaatcgaagactgaatcttgatatacctcagaacagcaccttcttgttaccgcgagatgtattggccgctacggatcatttgattggaatgaaatttgaaacgggtatacttgacgatgacgatatgaatcacttgaaaaataaacgtattcgttcggttgcggatctgttacaagatcaattcggactggctcttggtcgtttacaacatgcggttcaaaaaactatccgtagagtattcatacgtcaatcaaaaccgactccacaaactttggtaactccaacttcaacctcgattttattaataactacttacgagaccttctttggtacatatcccttatctcaagtttttgatcaaaccaatccattgacacaaacggttcatgggcgaaaagtgagttgtttgggtcctggaggattgacggggagaactgcaagttttcggagccgagatatccatccgagtcactatgggcgtatttgtccaattgacacgtccgaaggaatcaacgttggacttactggatctttagctattcatgcgagaattgatcattggtggggatccgtagagagtcctttttatgaaatatctgagaaagcaaagaaaaaaaaagagagacaggtggtttatttatcaccaaatagagatgagtattatatgatagcagcaggaaattctttgtccttgaatcggggtattcaggaagaacaggttgttccagctagataccgtcaagaattcctgactattgcatgggaacagattcatgttagaagtatttttcctttccaatatttttctattgggggttctctcattccttttattgagcataatgatgcgaatcgagctttaatgagttctaatatgcagcgccaagcagttccgctttctcggtccgagaagtgcattgttggaactggattggaacgccaaacagctctagattcgagggtttctgttatagccgaacgcgagggaaagatcatttctactaatagtcacaagatccttttatcaagtagtgggaagactataagtattcctttagttacccatcggcgctctaacaaaaatacttgtatgcaccaaaaacctcgggttccgcggggtaaatccattaaaaaaggacaaattttagcggagggggctgctacggttggtggggaacttgctttaggaaaaaacgtattagtagcttatatgccatgggaaggttacaattttgaagacgcagtattaattagcgaacgtttggtatatgaggatatttatacttcttttcacatccgaaaatatgaaattcagacggatacaacaagccaaggctccgctgaaaaaatcactaaagaaataccacatctagaagaacatttactccgcaatttggacagaaatggagttgtgaagttggggtcctgggtagaaacaggcgatattttagtaggtaaattaacgcctcagatagcgagcgaatcgtcctatatcgcggaagctggattattacgggccatatttggtcttgaggtatccacttcaaaagaaacttctctcaaactaccgataggtggaagaggacgcgttatcgatgtgaaatggatccagagggatcccctcgacataatggttcgtgtatatattttacaaaaacgcgaaatcaaagttggggataaagtagccggaagacacgggaataaggggatcatttccaaaattttgcctaggcaagatatgccctatttgcaagatggaacgcctgttgatatggttttcaatcccttaggagtaccctcccgaatgaatgtgggacaaatatttgaaagctcgctcggattagcaggggatctgctaaagaaacattatagaatagcaccctttgatgagagatatgagcaagaggcttcaagaaaacttgtgttttcagaattatatgaagccagtaaacaaacaaaaaatccgtgggtatttgaacccgagtacccgggaaaaagcagaatatttgatggaagaacaggagaccccttcgaacagcctgttctaatagggaagtcctatatcttaaaattaattcatcaagttgatgagaaaatccacggacgctctactgggccctattcacttgttacacaacaacccgttagaggaagagccaagcaagggggacaacgaataggagaaatggaagtttgggctttagaaggatttggtgttgctcatattttacaagagatacttacttataaatctgatcatcttatagctcgccaagaaatacttaacgctacgatctggggaaaacgagtacctaatcacgaggatcctccagaatcttttcgagtgcttgttcgagaactacgatctttggctctagaactgaaccatttccttgtatctcagaagaacttccaggttaatagggaagaagtttgatcggaataaatataaattcttttcttatttctattttatgattgaccaatataaacatcaacaacttcaaattggactcgtttcccctcaacaaataaaggcttgggctaacaaaacactacctaatggggaagtcgttggcgaagtcacaaggccctccacttttcattataaaaccgataaaccagaaaaagatggattgttttgcgaaagaatctttggacccataaaaagcagaatttgtgcttgtggaaattctcgagcgagcggagctgaaaacgaagacgaaagattttgccaaaaatgcggagtagaatttgttgattctcggatacgaagatatcaaatgggatacatcaaactcgcatgtcccgtgactcatgtgtggtatttaaaaggtcttcctagttatatcgcgaatcttttagataaaccccttaagaaattggagggcctagtatatggcgatttctcttttgctaggcccagtgctaaaaaaccaactttcttacgattacgaggtttattcgaggatgaaatttcatcctgtaaccatagcatttccccctttttttctaccccaggctttacaacatttcgaaatcgggaaattgcgacaggagcaggtgctattagagaacaattagcagatttggatttgcgaattattttagagaattcctcggtcgaatggaaggaattagaagacgaggggtatagtggagatgaatgggaagatagaaaaagacgaataagaaaagtttttttgattagacgcatgcaattggcgaaacattttattcaaacaaatgtagaaccagaatggatggttttgtgcttattaccagttcttcctcccgaattaagacccattgtttataggtctggggataaagtagtgacttcggatattaatgaactttataagagagttatccgtcggaacaacaatcttgcctatctattaaaaagaagtgaattagcgccagcagatttagtaatgtgccaggaaaaattggtacaagaagccgtggatacacttcttgatagtgggtcccgcgggcaaccaacgagggatggtcacaataaagtatacaaatcactttcagatgtaattgaaggtaaagaggggaggtttcgcgaaactctgcttgggaaacgggtcgattactcggggcgttctgtcattgttgtgggtccttcactttcattacatcaatgtgggttacctctagagatagcaataaagctttttcagctatttgtaattcgcgatttaatcacgaaacgtgctacttctaatgttaggattgctaaaaggaaaatttgggaaaaggaacccattgtatgggaaatacttcaagaagttatgaggggacatcctgtactgttgaatagagcacctaccctgcatagattaggcatacaggctttccaacccactttagtagaggggcgtactatttgtttacacccattagtgtgtaaaggtttcaatgcagactttgatggggatcaaatggctgttcatctacctttatccttggaagctcaggcggaagctcgtttacttatgttttctcatatgaatctcctatctcccgctattggggatcctatttgcgtaccaacccaagacatgcttatcggactttatgtattaacgattggaaaccgtcgaggtatttgtgcaaatagatataatagttgcggaaactatccaaaccaaaaagtaaattacaataataataatcctaagtatacgaaagataaagaatctcttttttctagttcctatgatgcactgggagcttatagacagaaacaaatctgtttagacagtcccttgtggctccgatggaaactagatcaacgcgtcattgggttaagagaagttccgattgaagttcaatatgaatctttggggacttatcgtgagatttatgcccactatctagtagtgggaaatagaaaaaaggaaatccgttctatatacattcgcaccactcttggtcatatttctttttatagagaaatagaggaagccatacaaggatttagtcaggcctattcatacactatctaa

SEQ ID NO: 3208 - DNA, 7903 bp, Oryza sativa
tcgaaatggctgtgctcgaaaggtggttatgaatcgattgactaacccaattccaatatcttgatttcgagtggcaatgcaccgtgaaccgatatatatatcgtttgctaatacacgaccaattaatgtttgtacaaaaagtttttccgtcatcccattttgaggactcacagaaatagcttggatagtaccacaatctcttctacgcacaataatatgttgaactacttcaacaagtctacgtgtaagatatccagcatccgccgttcgtacagcagtatctacaacccctttgcgggctccgtagcaggaaattatatattctgtcaaagaaagtccctcgcgtaaattgctttgaataggtaaatcaatcatttgtccttgaggatccgccattaatcctcgcatacctactaattggtgtacctgcgatgcatttcctctagctcctgaaaaagacattagatagactggattagaaggatctgttatccgaaaattcgaattcatttcgtgtttcaaatattcacttgtagcataccagatttcaacggattggcgtaatttttctaccgcgtgtacagccccataataatagtgtttttccaaaagaaaactctgttgttccgcatcttggactaaccatcccttagagggtattgttaaaagatcctcgattcctaatgaaatcgatgtagtagtggcttgatggaagcccagcgtttttatttgatccagtatatgggatgtatatcccattccgaaatgatctattaatctgctaataagtcgtttcatagcagttccatctatctctttattctgaaagaccagattggcccgttccgccataaataagtaccccctttttcggctgagtataattcgacaattgctgagtaggattcgacaatgggcctgagtcagtgattcgaaaacttagttaacttcctttcctcaatctcaatctggattcgtgcggcaaaaatgatgatactagcgaaatcggaatgcccctcgaaaggggcatccccgaatctaacttccttgtttagatagtgtatgaataggcctgactaaatccttgtatggcttcctctatttctctataaaaagaaatatgaccaagagtggtgcgaatgtatatagaacggatttccttttttctatttcccactactagatagtgggcataaatctcacgataagtccccaaagattcatattgaacttcaatcggaacttctcttaacccaatgacgcgttgatctagtttccatcggagccacaagggactgtctaaacagatttgtttctgtctataagctcccagtgcatcataggaactagaaaaaagagattctttatctttcgtatacttaggattattattattgtaatttactttttggtttggatagtttccgcaactattatatctatttgcacaaatacctcgacggtttccaatcgttaatacataaagtccgataagcatgtcttgggttggtacgcaaataggatccccaatagcgggagataggagattcatatgagaaaacataagtaaacgagcttccgcctgagcttccaaggataaaggtagatgaacagccatttgatccccatcaaagtctgcattgaaacctttacacactaatgggtgtaaacaaatagtacgcccctctactaaagtgggttggaaagcctgtatgcctaatctatgcagggtaggtgctctattcaacagtacaggatgtcccctcataacttcttgaagtatttcccatacaatgggttccttttcccaaattttccttttagcaatcctaacattagaagtagcacgtttcgtgattaaatcgcgaattacaaatagctgaaaaagctttattgctatctctagaggtaacccacattgatgtaatgaaagtgaaggacccacaacaatgacagaacgccccgagtaatcgacccgtttcccaagcagagtttcgcgaaacctcccctctttaccttcaattacatctgaaagtgatttgtatactttattgtgaccatccctcgttggttgcccgcgggacccactatcaagaagtgtatccacggcttcttgtaccaatttttcctggcacattactaaatctgctggcgctaattcacttctttttaatagataggcaagattgttgttccgacggataactctcttataaagttcattaatatccgaagtcactactttatccccagacctataaacaatgggtcttaattcgggaggaagaactggtaataagcacaaaaccatccattctggttctacatttgtttgaataaaatgtttcgccaattgcatgcgtctaatcaaaaaaacttttcttattcgtctttttctatcttcccattcatctccactatacccctcgtcttctaattccttccattcgaccgaggaattctctaaaataattcgcaaatccaaatctgctaattgttctctaatagcacctgctcctgtcgcaatttcccgatttcgaaatgttgtaaagcctggggtagaaaaaaagggggaaatgctatggttacaggatgaaatttcatcctcgaataaacctcgtaatcgtaagaaagttggttttttagcactgggcctagcaaaagagaaatcgccatatactaggccctccaatttcttaaggggtttatctaaaagattcgcgatataactaggaagaccatttaaataccacacatgagtcacgggacatgcgagtttgatgtatcccatttgatatcttcgtatccgagaattaacaaattctactccgcatttttggcaaaatctttcgtcttcgttttcagctccgctcgctcgagaatttccacaagcacaaattctgctttttatgggtccaaagattctttcgcaaaacaatccgtctttttctggtttatcggttttataatgaaaagtggagggccttgtgacttcgccaacgacttccccattaggtagtgttttgttagcccaagcctttatttgttgaggggaaacgagtccaatttgaagttgttgatgtttatattggtcaatcataaaatagaaataagaaaagaatttatatttattccgatcaaacttcttccctattaacctggaagttcttctgagatacaaggaaatggttcagttctagagccaaagatcgtagttctcgaacaagcactcgaaaagattctggaggatcctcgtgattaggtactcgttttccccagatcgtagcgttaagtatttcttggcgagctataagatgatcagatttataagtaagtatctcttgtaaaatatgagcaacaccaaatccttctaaagcccaaacttccatttctcctattcgttgtcccccttgcttggctcttcctctaacgggttgttgtgtaacaagtgaatagggcccagtagagcgtccgtggattttctcatcaacttgatgaattaattttaagatataggacttccctattagaacaggctgttcgaaggggtctcctgttcttccatcaaatattctgctttttcccgggtactcgggttcaaatacccacggattttttgtttgtttactggcttcatataattctgaaaacacaagttttcttgaagcctcttgctcatatctctcatcaaagggtgctattctataatgtttctttagcagatcccctgctaatccgagcgagctttcaaatatttgtcccacattcattcgggagggtactcctaagggattgaaaaccatatcaacaggcgttccatcttgcaaatagggcatatcttgcctaggcaaaattttggaaatgatccccttattcccgtgtcttccggctactttatccccaactttgatttcgcgtttttgtaaaatatatacacgaaccattatgtcgaggggatccctctggatccatttcacatcgataacgcgtcctcttccacctatcggtagtttgagagaagtttcttttgaagtggatacctcaagaccaaatatggcccgtaataatccagcttccgcgatataggacgattcgctcgctatctgaggcgttaatttacctactaaaatatcgcctgtttctacccaggaccccaacttcacaactccatttctgtccaaattgcggagtaaatgttcttctagatgtggtatttctttagtgattttttcagcggagccttggcttgttgtatccgtctgaatttcatattttcggatgtgaaaagaagtataaatatcctcatataccaaacgttcgctaattaatactgcgtcttcaaaattgtaaccttcccatggcatataagctactaatatgttttttcctaaagcaagttccccaccaaccgtagcagccccctccgctaaaatttgtccttttttaatggatttaccccgcggaacccgaggtttttggtgcatacaagtatttttgttagagcgccgatgggtaactaaaggaatacttatagtcttcccactacttgataaaaggatcttgtgactattagtagaaatgatctttccctcgcgttcggctataacagaaaccctcgaatctagagctgtttggcgttccaatccagttccaacaatgcacttctcggaccgagaaagcggaactgcttggcgctgcatattagaactcattaaagctcgattcgcatcattatgctcaataaaaggaatgagagaacccccaatagaaaaatattggaaaggaaaaatacttctaacatgaatctgttcccatgcaatagtcaggaattcttgacggtatctagctggaacaacctgttcttcctgaataccccgattcaaggacaaagaatttcctgctgctatcatataatactcatctctatttggtgataaataaaccacctgtctctctttttttttctttgctttctcagatatttcataaaatggactctctacggatccccaccaatgatcaattctcgcatgaatagctaaagatccagtaagtccaacgttgattccttcggacgtgtcaattggacaaatacgcccatagtgactcggatggatatctcggctccgaaaacttgcagttctccccgtcaatcctccaggacccaaacaactcacttttcgcccatgaaccgtttgtgtcaatggattggtttgatcaaaaacttgagataagggatatgtaccaaagaaggtctcgtaagtagttattaataaaatcgaggttgaagttggagttaccaaagtttgtggagtcggttttgattgacgtatgaatactctacggatagttttttgaaccgcatgttgtaaacgaccaagagccagtccgaattgatcttgtaacagatccgcaaccgaacgaatacgtttatttttcaagtgattcatatcgtcatcgtcaagtatacccgtttcaaatttcattccaatcaaatgatccgtagcggccaatacatctcgcggtaacaagaaggtgctgttctgaggtatatcaagattcagtcttcgattcatatttcgtcgaccaatccttcctaattcacatttttgttgaaaaaatttcttttgtaattcctcacataaggattccgaaaataccaggtccccacctacacaagcaaattgttgataaaactccaaaatagctttttcttttgactcaatcctcttcttctccttagcattagggaaagacaagaaaatttcagggtaggaaacattatctagaatttcttttagatttgaacccatagctgatgatagaactagaatagatatcttttgttttctactcacgcgagcccatatcctttcttttttatcaattgctaattccgatcttcctccccaatctgatattatagtcccggtgtagatagaaattcctttatggtctaattccgagcggtagtaaataccaggacttagcaatatttgattgatcacaattcggtatattccatttattataaaggttcctaaggaattcattataggaatgtttccaatagaaatggtttgcttttgcacatcgaaaccaaaaattaatcgcgcggatacgtataattcggaagaataggtgagtgattcatacacagcatccctttcttttatcgaaggttctagcaattgatatcctttcgcaaataattgaaatgaaatttcgtgatctggatctttaattgttggaaacttctcaagttcttctgccaagccttgattaatgaacctacaaaatccctcgaattggatctgactaaatccgggtattgtggacattccctcatttccattccggagcatcttaatcttaagtttcctgtttatcgaagaaaaattccattatcagctcactcttcatcaatccctacagatcgatctagcaattatggaatctatattctgtttactaaatcacatgaaattctcgggaactccacatacgtatttcatatatgtatttcatacatatgaatagagacaatttcaacgaaagttcgaatttcccaggggtccaaatggaatgaaaatgaagtgataaaacattcctagaacctcgaaaaaaattctgccacttacagtttatgatattcttagattggacggcaaagatttctcattttttctcctttctatgaatgggataaaaccaaaatataataatttataagcactagaaagtttgactttagttcgattgagaatagcacgcttagtttaatttcaaaaaagaatttgaaggttcttttttgtttcgtagtagtagaatttctataaaatataagatataagatttcgttgtagaatcctaaaataaagtaagtacttttttaagtacatgccaatctagttctggacctccacatagcaaagtcaattttcttttttttattcaagatatttaatgcaatgaaaaattaaagaacgattctccacagagatatgtacataagggggatccatagataataatgctgttcggacctggagtttacttatatacggattaggcataaatccattgtcttttattatgccattaaatggcaggcgggagagaataccgaaattcaaaataaaaagagaattctagttaatggttccaatttgttcttaattttgtagcttgtgactagaaatccacttttctcctttttcatttcaatagaaagaaaagggaagttttctagtgttagcaatgtgtgttttaagatagaatcctttgaggagaataatcgaaactggatccaaaaaaagcatgaatagattttttgaaaaagattggaaaaaagtaagtagaattagatttaagataaaagaaagttagttttagtaagaaacgtggatgaatacttgctcttttctcgattttagatcgtattttttggcggcatggccaagcggtaaggcaggggactgcaaatcctttatccccagttcaaatctgggtgccgcctgatcaataaaatacttaggcttatagtactgatccaaatcgacaaatttgcaccccgcataagttggggcaagagaataacaaggctcggcgatactggattttgagaacccaccgttctttcctcaaactggggtttgttttagcagtagtggcccaaaccgataccaatagggatgagatagcgtttccttattcttttattaataagaaagggctatgtatcatatttatacttaatgctccccaattctaccagaaatactctaagaatttgttaaattctaccagaaatactctaagaatttgttaagagtaaattctttgaactgattcatccatagttttaggtcagaacccctttttgactctgtacccttgattc

SEQ ID NO: 3209 - DNA, 4653 bp, Oryza sativa
ataaatatgatacatagccctttcttattaataaaagaataaggaaacgctatctcatccctattggtatcggtttgggccactactgctaaaacaaaccccagtttgaggaaagaacggtgggttctcaaaatccagtatcgccgagccttgttattctcttgccccaacttatgcggggtgcaaatttgtcgatttggatcagtactataagcctaagtattttattgatcaggcggcacccagatttgaactggggataaaggatttgcagtcccctgccttaccgcttggccatgccgccaaaaaaatacgatctaaaatcgagaaaagagcaagtattcatccacgtttcttactaaaactaactttcttttatcttaaatctaattctacttacttttttccaatctttttcaaaaaatctattcatgctttttttggatccagtttcgattattctcctcaaaggattctatcttaaaacacacattgctaacactagaaaacttcccttttctttctattgaaatgaaaaaggagaaaagtggatttctagtcacaagctacaaaattaagaacaaattggaaccattaactagaattctctttttattttgaatttcggtattctctcccgcctgccatttaatgtcataataaaagacaatggatttatgcctaatccgtatataggtaaactccaggtccgaacagcattattatctatggatcccccttatgtacatatctctgtggagaatcgttctttaatttttcattgcattaaatatcttgaataaaaaaaagaaaattgactttgctatgtggaggtccagaactagattggcatgtacttaaaaaagtacttactttattttaggattctacaacgaaatcttatatcttatattttatagaaattctactactacgaaacaaaaaagaaccttcaaattcttttttgaaattaaactaagcgtgctattctcaatcgaactaaagtcaaactttctagtgcttataaattattatattttggttttatcccattcatagaaaggagaaaaaatgagaaatctttgccgtccaatctaagaatatcataaactgtaagtggcagaatttttttcgaggttctaggaatgttttatcacttcattttcattccatttggacccctgggaaattcgaactttcgttgaaattgtctctattcatatgtatgaaatacatatatgaaatacgtatgtggagttcccgagaatttcatgtgatttagtaaacagaatatagattccataattgctagatcgatctgtagggattgatgaagagtgagctgataatggaatttttcttcgataaacaggaaacttaagattaagatgctccggaatggaaatgagggaatgtccacaatacccggatttagtcagatccaattcgagggattttgtaggttcattaatcaaggcttggcagaagaacttgagaagtttccaacaattaaagatccagatcacgaaatttcatttcaattatttgcgaaaggatatcaattgctagaaccttcgataaaagaaagggatgctgtgtatgaatcactcacctattcttccgaattatacgtatccgcgcgattaatttttggtttcgatgtgcaaaagcaaaccatttctattggaaacattcctataatgaattccttaggaacctttataataaatggaatataccgaattgtgatcaatcaaatattgctaagtcctggtatttactaccgctcggaattagaccataaaggaatttctatctacaccgggactataatatcagattggggaggaagatcggaattagcaattgataaaaaagaaaggatatgggctcgcgtgagtagaaaacaaaagatatctattctagttctattatcagctatgggttcaaatctaaaagaaattctagataatgtttcctaccctgaaattttcttgtctttccctaatgctaaggagaagaagaggattgagtcaaaagaaaaagctattttggagttttatcaacaatttgcttgtgtaggtggggacctggtattttcggaatccttatgtgaggaattacaaaagaaattttttcaacaaaaatgtgaattaggaaggattggtcgacgaaatatgaatcgaagactgaatcttgatatacctcagaacagcaccttcttgttaccgcgagatgtattggccgctacggatcatttgattggaatgaaatttgaaacgggtatacttgacgatgacgatatgaatcacttgaaaaataaacgtattcgttcggttgcggatctgttacaagatcaattcggactggctcttggtcgtttacaacatgcggttcaaaaaactatccgtagagtattcatacgtcaatcaaaaccgactccacaaactttggtaactccaacttcaacctcgattttattaataactacttacgagaccttctttggtacatatcccttatctcaagtttttgatcaaaccaatccattgacacaaacggttcatgggcgaaaagtgagttgtttgggtcctggaggattgacggggagaactgcaagttttcggagccgagatatccatccgagtcactatgggcgtatttgtccaattgacacgtccgaaggaatcaacgttggacttactggatctttagctattcatgcgagaattgatcattggtggggatccgtagagagtcctttttatgaaatatctgagaaagcaaaaaaaaaaaaagagagacaggtggtttatttatcaccaaatagagatgagtattatatgatagcagcaggaaattctttgtccttgaatcggggtattcaggaagaacaggttgttccagctagataccgtcaagaattcctgactattgcatgggaacagattcatgttagaagtatttttcctttccaatatttttctattgggggttctctcattccttttattgagcataatgatgcgaatcgagctttaatgagttctaatatgcagcgccaagcagttccgctttctcggtccgagaagtgcattgttggaactggattggaacgccaaacagctctagattcgagggtttctgttatagccgaacgcgagggaaagatcatttctactaatagtcacaagatccttttatcaagtagtgggaagactataagtattcctttagttacccatcggcgctctaacaaaaatacttgtatgcaccaaaaacctcgggttccgcggggtaaatccattaaaaaaggacaaattttagcggagggggctgctacggttggtggggaacttgctttaggaaaaaacgtattagtagcttatatgccatgggaaggttacaattttgaagacgcagtattaattagcgaacgtttggtatatgaggatatttatacttcttttcacatccgaaaatatgaaattcagacggatacaacaagccaaggctccgctgaaaaaatcactaaagaaataccacatctagaagaacatttactccgcaatttggacagaaatggagttgtgaagttggggtcctgggtagaaacaggcgatattttagtaggtaaattaacgcctcagatagcgagcgaatcgtcctatatcgcggaagctggattattacgggccatatttggtcttgaggtatccacttcaaaagaaacttctctcaaactaccgataggtggaagaggacgcgttatcgatgtgaaatggatccagagggatcccctcgacataatggttcgtgtatatattttacaaaaacgcgaaatcaaagttggggataaagtagccggaagacacgggaataaggggatcatttccaaaattttgcctaggcaagatatgccctatttgcaagatggaacgcctgttgatatggttttcaatcccttaggagtaccctcccgaatgaatgtgggacaaatatttgaaagctcgctcggattagcaggggatctgctaaagaaacattatagaatagcaccctttgatgagagatatgagcaagaggcttcaagaaaacttgtgttttcagaattatatgaagccagtaaacaaacaaaaaatccgtgggtatttgaacccgagtacccgggaaaaagcagaatatttgatggaagaacaggagaccccttcgaacagcctgttctaatagggaagtcctatatcttaaaattaattcatcaagttgatgagaaaatccacggacgctctactgggccctattcacttgttacacaacaacccgttagaggaagagccaagcaagggggacaacgaataggagaaatggaagtttgggctttagaaggatttggtgttgctcatattttacaagagatacttacttataaatctgatcatcttatagctcgccaagaaatacttaacgctacgatctggggaaaacgagtacctaatcacgaggatcctccagaatcttttcgagtgcttgttcgagaactacgatctttggctctagaactgaaccatttccttgtatctcagaagaacttccaggttaatagggaagaagtttgatcggaataaatataaattcttttcttatttctatttt

SEQ ID NO: 3210 - DNA, 4054 bp, Oryza sativa
aggtccagaactagattggcatgtacttaaaaaagtacttactttattttaggattctacaacgaaatcttatatcttatattttatagaaattctactactacgaaacaaaaaagaaccttcaaattcttttttgaaattaaactaagcgtgctattctcaatcgaactaaagtcaaactttctagtgcttataaattattatattttggttttatcccattcatagaaaggagaaaaaatgagaaatctttgccgtccaatctaagaatatcataaactgtaagtggcagaatttttttcgaggttctaggaatgttttatcacttcattttcattccatttggacccctgggaaattcgaactttcgttgaaattgtctctattcatatgtatgaaatacatatatgaaatacgtatgtggagttcccgagaatttcatgtgatttagtaaacagaatatagattccataattgctagatcgatctgtagggattgatgaagagtgagctgataatggaatttttcttcgataaacaggaaacttaagattaagatgctccggaatggaaatgagggaatgtccacaatacccggatttagtcagatccaattcgagggattttgtaggttcattaatcaaggcttggcagaagaacttgagaagtttccaacaattaaagatccagatcacgaaatttcatttcaattatttgcgaaaggatatcaattgctagaaccttcgataaaagaaagggatgctgtgtatgaatcactcacctattcttccgaattatacgtatccgcgcgattaatttttggtttcgatgtgcaaaagcaaaccatttctattggaaacattcctataatgaattccttaggaacctttataataaatggaatataccgaattgtgatcaatcaaatattgctaagtcctggtatttactaccgctcggaattagaccataaaggaatttctatctacaccgggactataatatcagattggggaggaagatcggaattagcaattgataaaaaagaaaggatatgggctcgcgtgagtagaaaacaaaagatatctattctagttctatcatcagctatgggttcaaatctaaaagaaattctagataatgtttcctaccctgaaattttcttgtctttccctaatgctaaggagaagaagaggattgagtcaaaagaaaaagctattttggagttttatcaacaatttgcttgtgtaggtggggacctggtattttcggaatccttatgtgaggaattacaaaagaaattttttcaacaaaaatgtgaattaggaaggattggtcgacgaaatatgaatcgaagactgaatcttgatatacctcagaacagcaccttcttgttaccgcgagatgtattggccgctacggatcatttgattggaatgaaatttgaaacgggtatacttgacgatgacgatatgaatcacttgaaaaataaacgtattcgttcggttgcggatctgttacaagatcaattcggactggctcttggtcgtttacaacatgcggttcaaaaaactatccgtagagtattcatacgtcaatcaaaaccgactccacaaactttggtaactccaacttcaacctcgattttattaataactacttacgagaccttctttggtacatatcccttatctcaagtttttgatcaaaccaatccattgacacaaacggttcatgggcgaaaagtgagttgtttgggtcctggaggattgacggggagaactgcaagttttcggagccgagatatccatccgagtcactatgggcgtatttgtccaattgacacgtccgaaggaatcaacgttggacttactggatctttagctattcatgcgagaattgatcattggtggggatccgtagagagtccattttatgaaatatctgagaaagcaaagaaaaaaaaagagagacaggtggtttatttatcaccaaatagagatgagtattatatgatagcagcaggaaattctttgtccttgaatcggggtattcaggaagaacaggttgttccagctagataccgtcaagaattcctgactattgcatgggaacagattcatgttagaagtatttttcctttccaatatttttctattgggggttctctcattccttttattgagcataatgatgcgaatcgagctttaatgagttctaatatgcagcgccaagcagttccgctttctcggtccgagaagtgcattgttggaactggattggaacgccaaacagctctagattcgagggtttctgttatagccgaacgcgagggaaagatcatttctactaatagtcacaagatccttttatcaagtagtgggaagactataagtattcctttagttacccatcggcgctctaacaaaaatacttgtatgcaccaaaaacctcgggttccgcggggtaaatccattaaaaaaggacaaattttagcggagggggctgctacggttggtggggaacttgctttaggaaaaaacatattagtagcttatatgccatgggaaggttacaattttgaagacgcagtattaattagcgaacgtttggtatatgaggatatttatacttcttttcacatccgaaaatatgaaattcagacggatacaacaagccaaggctccgctgaaaaaatcactaaagaaataccacatctagaagaacatttactccgcaatttggacagaaatggagttgtgaagttggggtcctgggtagaaacaggcgatattttagtaggtaaattaacgcctcagatagcgagcgaatcgtcctatatcgcggaagctggattattacgggccatatttggtcttgaggtatccacttcaaaagaaacttctctcaaactaccgataggtggaagaggacgcgttatcgatgtgaaatggatccagagggatcccctcgacataatggttcgtgtatatattttacaaaaacgcgaaatcaaagttggggataaagtagccggaagacacgggaataaggggatcatttccaaaattttgcctaggcaagatatgccctatttgcaagatggaacgcctgttgatatggttttcaatcccttaggagtaccctcccgaatgaatgtgggacaaatatttgaaagctcgctcggattagcaggggatctgctaaagaaacattatagaatagcaccctttgatgagagatatgagcaagaggcttcaagaaaacttgtgttttcagaattatatgaagccagtaaacaaacaaaaaatccgtgggtatttgaacccgagtacccgggaaaaagcagaatatttgatggaagaacaggagaccccttcgaacagcctgttctaatagggaagtcctatatcttaaaattaattcatcaagttgatgagaaaatccacggacgctctactgggccctattcacttgttacacaacaacccgttagaggaagagccaagcaagggggacaacgaataggagaaatggaagtttgggctttagaaggatttggtgttgctcatattttacaagagatacttacttataaatctgatcatcttatagctcgccaagaaatacttaacgctacgatctggggaaaacgagtacctaatcacgaggatcctccagaatcttttcgagtgcttgttcgagaactacgatctttggctctagaactgaaccatttccttgtatctcagaagaacttccaggttaatagggaagaagtttgatcggaataaatataaattcttttcttatttctattttatgattgaccaatataaacatcaacaacttcaaattggactcgtttcccctcaacaaataaaggcttgggctaacaaaacactacctaatggggaagtcgttggcgaagtcacaaggccctccacttttcattataaaaccgataaaccagaaaaagacggattgttttgcgaaagaatctttggacccataaaaagcagaatttgtgcttgtggaaattctcgagcgagcg

SEQ ID NO: 3211 - DNA, 4037 bp, Brachypodium distachyon
aggtccagaactagattggcatgtacttaaaaaagtacttactttattttaggattctacaacgaaatcttatatcttatattttatagaaattctactactacgaaacaaaaaagaaccttcaaattcttttttgaaattaaactaagcgtgctattctcaatcgaactaaagtcaaactttctagtgcttataaattattatattttggttttatcccattcatagaaaggagaaaaaatgagaaatctttgccgtccaatctaagaatatcataaactgtaagtggcagaatttttttcgaggttctaggaatgttttatcaattcattttcattccatttgtaccctggcaaattagaactttcgtcgaaattgtctctattcatatgtatgaaatacatatatgaaatacgtatgtggagttccctagaatttcatgtgattcagtaaacagaatatagattccatgattgctagatcgatccgtagggttgatgaagagtgagctgataatggaatttttcttcgataaacaggaaacttaagattaagatgctccggaatgggaatgagggaatgtccacaatacccggatttagtcagatccaatttgagggattttgtaggttcattaatcaaggcttggcagaagagcttgagaagtttctaacaattaaagatccagatcacgaaattgcatttcaattattgcgaaaggatatcaattgctagaaccctcgataaagaaagggatgctgtgtatgaatcactcacctattcttccgaattatatgtatctgcgagattaatttttggtttcgatgtgcaaaagcaaaccatttctattggaaacattcctataatgaattccttaggaacctttataataaatggaatataccgaattgtgatcaatcaaatattgctaagtcctggtatttactaccgctcggaattagaccataagggaatttctatctacaccgggactataatatcagattggggagggagatcggaattagcaattgataaaaaagaaaggatatgggctcgcgtgagtagaaaacaaagatatctattctagttctatcatcagctatgggttcgaatctaagagaaattctagataatgtttcctaccctgaaattttcttgtctttcccgaatgctaaggagaagaagaggattgagtcaaaagaaaaagctatttagagttttatcaacaatttgcttgtgtaggtggggacctggtattttcggagtccttatgtgaggaattacaaaagaaattttttcaacaaaaatgtgaattaggaaggattggtcgacgaaatatgaatcggagactgaatcttgatatacctcagaacaatacattcttgttaccacgagatgtattggccgctacggatcagttgattggaatgaaatttggaacgggtatacttgacgatgacgatatgaatcacttgaaaaataaacgtattcgttcggttgcagatctgttacaagatcaattcggactggctcttggtcgttacaacatgcggttcaaaaactatccgtcgagtattcatacgtcaatcgaaaccgactccccatactttagtaactccaacttcaacttcgattttattaataactacttatgagaccttttttggcgcataccccttatctcaagtttttgatcaaacgaatccattgacacaaactgttcatgggcgaaaagtgagttgtttaggtcctggagggttgactgggagaactgcaagttttcggagccgagatattcatccgagtcactatgggcgtatttgtccaattgacacgtccgaaggaatcaatgttggacttactggatccttagcaattcatgcgaaaattgatcacttgtggggatctgtagagagtccgttttatgaaatatctgctgagaaagcaaaagaaaaaaaagagagacaggtggtttatctatcaccaaatagagatgaatattatatgatagcagcaggaaattctttatccttgaatcaaggtattcaggaagagcaggttgttccagctagatatcgtcaagaatttctgactattgtatgggaacagattcatgttagaagtatttttcctttccaatatttttctattgggggctctctcattccttttattgagcacaatgatgcgaatcgggctttaatgagttctaatatgcagcgccaagcagttccgctttctcggtccgagaagtgcattgttggaactggattggaacgccaaacagctctagattcgagggtttccgttatagccgaacgcgagggaaagatcattctactgatagtcataggatccttttatcaagtagtgggaagaccataagtattcctttagtaaaccaccggcgctctaacaaaaatacttgcatgcaccaaaaaccgcgggtgccgcggggtaaatccattaaaaaaggacaaattttagcagagggagctgccacagttgggggggaacttgctttaggaaaaaacgtattagtcgcttatatgccatgggaaggttacaattttgaagacgcggtactaattagcgaacgtttggtatatgaagatatttatacctcttttcacatccgtaaatatgaaattcagacggatacgacaagtcaaggctctgctgaaaaaataactaaagaaataccacatctagaagaacatttactccgcaatttggacagaaatggagttgttaggttgggatcctgggtagaaactggcgatattttagtaggtaaactaacgcctcagatagcgagcgaatcgtcgtatatcgcggaagctggattattacgggctatatttggccttgaggtatccacttcaaaagaaacttctctcaattacctataggtggaagagggcgcgttatcgatgtgaaatggatccagagggaccccctcgacataatggttcgtgtatatattttacagaaacgtgaaatcaaagttggggataaagtagccggaagacatgggaataaggggatcatttccaaaattttgactagacagatatgccctatttgcaagatggaacacctgttgatgtggtcttcaatcccttagagtaccctcccgaatgaatgtgggacaaatatttgaaagctcgctcggattagccggggatctgctaaagaaacattatagaatagcaccctttgatgagagatatgagcagaggcttcaagaaaacttgtgttttcagaattatatgaagccagtaaggaaacaaaaaatccatgggtatttgaacccgagtacccgggaaaaagcagaatatttgatggaagaacaggagaccccttcgaacaacctgttctaatagggaagtcctatatcttaaaattaattcatcaagttgatgagaaaattcatgggcgttctactgggccctactcacttgttacacaacaacccgttagaggaagagccaagcaagggggacaacgagtaggagaaatggaagtttgggctttagaaggatttggtgttgctcatattttacaagagatacttacttataaatctgatcatcttatagctcgccaagaaatacttaatgctacgatctggggaaaagaatagctaatcacgaggatcctccagaatcttttcgagtgctcgttcgagaactacgatctttggctctagaacttaatcatttccttgtatcggagaagaacttccaagttaatagggaggaaatttgatcggaataaatattaattattttctttattttatgattgaccaatataaacatcaacaacttcaaattggactcgtctcccctcaacaaataaaggcttgggctaacaaaaacctacctaatggagaagtcattggccaagtcacaaggccctctacttttcattataaaaccgataaaccagaaaaagatggattgttttgcgaaagaatctttggacccattaaaagcggaatttgcgcttgtggaattctcgagcgagcg

SEQ ID NO: 3212 - DNA, 9252 bp, Brachypodium distachyon
gtattcatttgatcttgatccttgtggagtgaaaaagaccctatactggatctgcacatacttactgacaatatccataaatgacttgtttttggtaatcgacgaggattaccatattgatattcgggcgcatgataaacatcagtactccagtgcatttctccgtctgattcggaataaatatgtttttgtaccctttctttaaaatgtaaagtggacgttccggcacgaatctccgcaattacttgttcggattttacatattgatcattttgcactagaatcaagctttttgagggaatattcacactatatagaatatcctgactctgaatagtaacatgcaagtctatataacatagaaaagcaggctgtccatgacgggtacgtgtggggtgaaccaaattctcattgaattggatttttccattcgaaggggatcgtacaaggtcggcagtaccccctgtgaatactccgcccgtatgaaaagttcttaatgttagttgagtcccaggctccccaattgattgacccgcaataatacctacggcttctcccaattcgaccagatcagtatgagtaggactccgaccataacataattgacagatccaagaagtgctccggcaagtaaagggggttctaatatatattggttgtgctcgaaatggttgtgctcgaaaagcagttatgaatagattgactaatccaactccaatgtcttgatttcgagcggccatgcatcgtgaaccgatatatatatcgtctgctaatacacgaccaatgagtgtttggacaaaaagtttttccgtcatcccattttgaggactcacagaaatacctcgtatagtaccacaatctcttctacgcacaataatatgttgaactacttcaacaagtctacgtgtaagatatcctgcatctgctgttcgtacagcagtatccacaacccctttgcgggctccgtagcaggaaattatatattcggtcaaagaaagtccctcgcgtaaattgctttgaataggtaaatcaatcatttgtccttgagggtccgccattaatcctctcatacctactaattggtgtacctgagatgcatttcctctggctcctgaaaagacattagatagactggattagaaggatctgttatccgaaaattcgaattcatttcttgtttcaaatattcacttgtcgcataccatatctcaacggattggcgtaatttttctaccgcgtgtacagccccataataatagtgtttctccaaaagaaaactctgttgttccgcgtcttggactaaccatcccttagagggtattgttaaaagatcctcgattcctaacgaaatcgatgtagtagtggcttgatggaagcccagagtctttagttgatccagtatatgggatgtatatcccattccgaaatgatctattaatctgctaataagtcgtttcataccagttccgtctatttctttattatgaaagaccagattggctcgttccgccatacataagtaccccctttttcggctgagtaggattcgagaattgctgagtaggattcgacaatgggcgtgagtcagtgattcgaaaatttaattagcttcattttctcaatctcaatctggattcgcgcggcaaaaataaaatgatgatactaaggaaatcggaatgccccccgaaaagggcggggcatccccgaatctaacttccttgtttagatagtgtatgaataggcctgactaaatccttgtacggcttcctctatttctctataaaaagaaatatgaccaagagtagttcgaatgtatatagaacagatttccttttttctatttcccactattagatagtgagcataaatctcatgataagtccccaaagattcatattgaacttcaatcggaacttctcttgatccaatggcgcgttgatctagtttccatcgtagccacaagggactgtctaaactgattagtttctgtctataagctcctagtgcatcataagaactataaaaaatgggttctttatctctcgtatacgtagaattattattattgtaatttactttttgatttggatagtttccgcaactattatatctatttgcacaaatacctcgagggtttccaatcgttaatacataaagcccgataagcatgtcttgggttggtacgcaataggatccccaatagcgggagataagagattcatatgcgaaaacataagtaaacgagcttccgcctgagcttccaaggataaaggtagatgaacagccatttgatccccatcaaagtccgcattgaaacccttacacactaatgggtgtaaagaaatagtacgcccctctactaaagtgggttggaaggcctgtatgcctaatctatgcagggtaggtgctctatttaacagtacaggatgtccccgcataacttcttgaagtatttcccatacaatcggttccttttcccaaattttccttttagcaatcctgacattagaagtagcgcgtttcgtgattaaatcgcgaattacaaatagctgaaaaagctttattgctatctctaggggtaatccacattgatgtaatgaaagcgaaggacccacaacaatgacggaacgacccgagtaatcgactcgtttcccaaggagagtctcgcgaaaccttccctctttaccttcaattacatctgaagcgatttgtatactttattgtgaccatccctcgtcggttgcccgcgggacccactatcaagaagtgtatccacggcttcttgtaccaatttttcctggcacattactaaatctgctggcgctaattcacttctttttaatagataggcaaggttgttgttccggcggataactctcttataaagttcattaatgtccgaagtcactactttatccccagacctataaacaatgggcctcaattcgggaggaagaaccggtaataagcacaaaaccatccattcaggttctacatttgtttgaataaaatgtttcgccaattgcatgcgtctaatcaaaaaaacttttcttattcgtctttttctatcttcccattcatctccactatagccctcgtcttctaattccttccattcgaccaacgaattctctataataatttgcaaatccaaatctgctaattgttctctaatagcacctgctcctgtcgcaatttcccgatttcgaaatgttgtaaagctcggggtagaaaaaaagggagaaatgctgtggttacaggatgcaatttcctcttcgaataaacctcgtaatcgtaagaaagtaggttttttagtgctgggcctagcaaaagagaaatctccatatactaagccctccaacttcttcagaggtttatctaaagattcgcgatataactaggaagacctttcaataccatacatgagtcaccggacatgcgagtttgatgtatcccatttgatatcttcgtatccgagaatccgcaaattctaccccgcatttttggcaaaatctttcatcttcgttttcagccccgctcgctcgagaattccacaagcgcaaattccgcttttaatgggtccaaagattctttcgcaaaacaatccatctttttctggtttatcggttttataatgaaaagtagagggccttgtgacttggccaatgacttctccattaggtaggtttttgttagcccaagcctttatttgttgaggggagacgagtccaatttgaagttgttgatgtttatattggtcaatcataaaataaagaaaataattaatatttattccgatcaaatttcctccctattaacttggaagttcttctccgatacaaggaaatgattaagttctagagccaaagatcgtagttctcgaacgagcactcgaaaagattctggaggatcctcgtgattagctattcttttccccagatcgtagcattaagtatttcttggcgagctataagatgatcagatttataagtaagtatctcttgtaaaatatgagcaacaccaaatccttctaaagcccaaacttccatttctcctactcgttgtcccccttgcttggctcttcctctaacgggttgttgtgtaacaagtgagtagggcccagtagaacgcccatgaattttctcatcaacttgatgaattaattttaagatataggacttccctattagaacaggttgttcgaaggggtctcctgttcttccatcaaatattctgctttttcccgggtactcgggttcaaatacccatggattttttgtttccttactggcttcatataattctgaaaacacaagttttcttgaagcctctgctcatatctctcatcaaagggtgctattctataatgtttctttagcagatccccggctaatccgagcgagctttcaaatatttgtcccacattcattcgggagggtactctaagggattgaagaccacatcaacaggtgttccatcttgcaaatagggcatatctgtctagtcaaaattttggaaatgatccccttattcccatgtcttccggctactttatccccaactttgatttcacgtttctgtaaaatatatacacgaaccattatgtcgagggggtccctctggatccatttcacatcgataacgcgccctcttccacctataggtaattgagagaagtttcttttgaagtggatacctcaaggccaaatatagcccgtaataatccagcttccgcgatatacgacgattcgctcgctatctgaggcgttagtttacctactaaaatatcgccagtttctacccaggatcccaacctaacaactccatttctgtccaaattgcggagtaaatgttcttctagatgtggtatttctttagttattttttcagcagagccttgacttgtcgtatccgtctgaatttcatatttacggatgtgaaaagaggtataaatatcttcatataccaaacgttcgctaattagtaccgcgtcttcaaaattgtaaccttcccatggcatataagcgactaatacgttttttcctaaagcaagttcccccccaactgtggcagctccctctgctaaaatttgtccttttttaatggatttaccccgcggcacccgcggtttttggtgcatgcaagtatttttgttagagcgccggtggtttactaaaggaatacttatggtcttcccactacttgataaaaggatcctatgactatcagtagaatgatctttccctcgcgttcggctataacggaaaccctcgaatctagagctgtttggcgttccaatccagttccaacaatgcacttctcggaccgagaaagcggaactgcttggcgctgcatattagaactcattaaagcccgattcgcatcattgtgctcaataaaaggaatgagagagcccccaatagaaaaatattggaaaggaaaaatacttctaacatgaatctgttcccatacaatagtcagaaattcttgacgatatctagctggaacaacctgctcttcctgaataccttgattcaaggataaagaatttcctgctgctatcatataatattcatctctatttggtgatagataaaccacctgtctctcttttttttcttttgctttctcagcagatatttcataaaacggactctctacagatccccacaagtgatcaattttcgcatgaattgctaaggatccagtaagtccaacattgattccttcggacgtgtcaattggacaaatacgcccatagtgactcggatgaatatctcggctccgaaaacttgcagttctcccagtcaaccctccaggacctaaacaactcacttttcgcccatgaacagtttgtgtcaatggattcgtttgatcaaaaacttgagataaggggtatgcgccaaaaaaggtctcataagtagttattaataaaatcgaagttgaagttggagttactaaagtatggggagtcggtttcgattgacgtatgaatactcgacggatagtttttgaaccgcatgttgtaacgaccaagagccagtccgaattgatcttgtaacagatctgcaaccgaacgaatacgtttatttttcaagtgattcatatcgtcatcgtcaagtatacccgttccaaatttcattccaatcaactgatccgtagcggccaatacatctcgtggtaacaagaatgtattgttctgaggtatatcaagattcagtctccgattcatatttcgtcgaccaatccttcctaattcacatttttgttgaaaaaatttcttttgtaattcctcacataaggactccgaaaataccaggtccccacctacacaagcaaattgttgataaaactctaaatagctttttcttttgactcaatcctcttcttctccttagcattcgggaaagacaagaaaatttcagggtaggaaacattatctagaatttctcttagattcgaacccatagctgatgatagaactagaatagatatctttgttttctactcacgcgagcccatatcctttcttttttatcaattgctaattccgatctccctccccaatctgatattatagtcccggtgtagatagaaattcccttatggtctaattccgagcggtagtaaataccaggacttagcaatatttgattgatcacaattcggtatattccatttattataaaggttcctaaggaattcattataggaatgtttccaatagaaatggtttgcttttgcacatcgaaaccaaaaattaatctcgcagatacatataattcggaagaataggtgagtgattcatacacagcatccctttctttatcgagggttctagcaattgatatcctttcgcaataattgaaatgcaatttcgtgatctggatctttaattgttagaaacttctcaagctcttctgccaagccttgattaatgaacctacaaaatccctcaaattggatctgactaaatccgggtattgtggacattccctcattcccattccggagcatcttaatcttaagtttcctgtttatcgaagaaaaattccattatcagctcactcttcatcaaccctacggatcgatctagcaatcatggaatctatattctgtttactgaatcacatgaaattctagggaactccacatacgtatttcatatatgtatttcatacatatgaatagagacaatttcgacgaaagttctaatttgccagggtacaaatggaatgaaaatgaattgataaaacattcttataaaaaaattatgccacttataacttatactttatgatattctagtcagattgaatgatgatattctagtcagattgaatggcaaagatttctcattttatctcctttctatgaatgcgataaagccgtaatataatacactagagagtttgttgactttacttcgatttagaatagcgcgcttagtttaatttcaaaaaagaatttgagggttccgcttttgtttcggtctagtagaattgctagcaaatttaggatttcattgtagaatcctaaaataaagtaagtgcccttttaagtacatgccaatctagttatccgcctctccacatatccctgcttttcttttttcagcaaatttcctttttttattcaagatatttaatgctttgaaaaattaaagcacgattccccatagagatatacataagggggatctttggataataatgctgttcggacctggagtttacctatacacggattaggtataaaaaaatcctttattatgcctttaaaaggaagaggggggaaaatacacatttagagtcgtttactactgcaaataaaaaaaagagaattctagttaatggttcccattttttatgaattttgcagccctagaaatctactttttctcctttttcatctcaatagaaagaagcagaaagttttctagtgttagcaatgtatgttttaacatagaatccatcgaggagaataatcgaaacaggatcaaaaagaagcagaaatagattttttgaaaaagattggaaaaaagtaagtagaattagattcaaaataaaagaaaggggattttcgtaagaaaacgtgggtgaatacttgctcttttctcaattttcgatcggattttttggcggcatggccaagtggtaaggcaggggactgcaaatcctttatccccagttcaaatctgggtgccgcctgatcgataaatacttaggcttatagtactgatcgaactcgagaaattcatacttcgcataagttcgggcaagagagtaactaggcttggcgatactggattttgagaatccatagttctatcctcaaactagggtttgttttggcggtactggcccaaaccattaccactagggataaggtagcgttttcttattcttttattatatgaatttgaattagttcttaattgatcctattttagaattaaaaactacgaagctaagatttcagaaatcttggtatccaaagaaaggaaaggtccctaaagggcattccgcttttttcaatctaagattgaagaagggactccacgaaagaatatcaagacttcctaattatcatacatttttttatcgtacatcttatgttacctacatacactaaagtaagggctacttattctagcgaaaatcagattaaataggccgatcctaaataaatttaggagttgtggataaagtctcttcattttttcatagaatgatagaaagcgaggttgtaggattaagtcaaaactaaacataggtaaggtaggtatccaataaatatttatctatcctatccataattttatggtatattcgggcgtcctttacttataaaaaaggagtaacaaaaggaataaaaaatcttcctattcccgcttcttatattcaggacatcattcccgtattcttttttacggaaaagaaagggctatgtatcgtatttatatttaatgttctctaattctaccagaattcctataataatttgttaggagtaaattcttggaactgattgatccatagtcttagggcagaatccctttttgactctgtacccttgattccgctatgattattgatcaatagtagaaaaattccttcatagaaataggagacgtaatttagatggatatagtaagtcttgcttgggctgctttaatggtagtctttacattttctctttcactagtggtgtgggggaggagtggactctagggatactactactaattga

SEQ ID NO: 3213 - DNA, 3127 bp, Brachypodium distachyon
atgctccggaatgggaatgagggaatgtccacaatacccggatttagtcagatccaatttgagggattttgtagaaccctcgataaaagaaagggatgctgtgtatgaatcactcacctattcttccgaattatatgtatctgcgagattaatttttggtttcgatgtgcaaaagcaaaccatttctattggaaacattcctataatgaattccttaggaacctttataataaatggaatataccgaattgtgatcaatcaaatattgctaagtcctggtatttactaccgctcggaattagaccataagggaatttctatctacaccgggactataatatcagattggggagggagatcggaattagcaattgataaaaaagaaaggatatgggctcgcgtgagtagaaaacaaaagatatctattctagttctatcatcagctatgggttcgaatctaagagaaattctagataatgtttcctaccctgaaattttcttgtctttcccgaatgctaaggagaagaagaggattgagtcaaaagaaaaagctattttagagttttatcaacaatttgcttgtgtaggtggggacctggtattttcggagtccttatgtgaggaattacaaaagaaattttttcaacaaaaatgtgaattaggaaggattggtcgacgaaatatgaatcggagactgaatcttgatatacctcagaacaatacattcttgttaccacgagatgtattggccgctacggatcagttgattggaatgaaatttggaacgggtatacttgacgatgacgatatgaatcacttgaaaaataaacgtattcgttcggttgcagatctgttacaagatcaattcggactggctcttggtcgtttacaacatgcggttcaaaaaactatccgtcgagtattcatacgtcaatcgaaaccgactccccatactttagtaactccaacttcaacttcgattttattaataactacttatgagaccttttttggcgcataccccttatctcaagtttttgatcaaacgaatccattgacacaaactgttcatgggcgaaaagtgagttgtttaggtcctggagggttgactgggagaactgcaagttttcggagccgagatattcatccgagtcactatgggcgtatttgtccaattgacacgtccgaaggaatcaatgttggacttactggatccttagcaattcatgcgaaaattgatcacttgtggggatctgtagagagtccgttttatgaaatatctgctgagaaagcaaaagaaaaaaaagagagacaggtggtttatctatcaccaaatagagatgaatattatatgatagcagcaggaaattctttatccttgaatcaaggtattcaggaagagcaggttgttccagctagatatcgtcaagaatttctgactattgtatgggaacagattcatgttagaagtatttttcctttccaatatttttctattgggggctctctcattccttttattgagcacaatgatgcgaatcgggctttaatgagttctaatatgcagcgccaagcagttccgctttctcggtccgagaagtgcattgttggaactggattggaacgccaaacagctctagattcgagggtttccgttatagccgaacgcgagggaaagatcatttctactgatagtcataggatccttttatcaagtagtgggaagaccataagtattcctttagtaaaccaccggcgctctaacaaaaatacttgcatgcaccaaaaaccgcgggtgccgcggggtaaatccattaaaaaaggacaaattttagcagagggagctgccacagttgggggggaacttgctttaggaaaaaacgtattagtcgcttatatgccatgggaaggttacaattttgaagacgcggtactaattagcgaacgtttggtatatgaagatatttatacctcttttcacatccgtaaatatgaaattcagacggatacgacaagtcaaggctctgctgaaaaaataactaaagaaataccacatctagaagaacatttactccgcaatttggacagaaatggagttgttaggttgggatcctgggtagaaactggcgatattttagtaggtaaactaacgcctcagatagcgagcgaatcgtcgtatatcgcggaagctggattattacgggctatatttggccttgaggtatccacttcaaaagaaacttctctcaaattacctataggtggaagagggcgcgttatcgatgtgaaatggatccagagggaccccctcgacataatggttcgtgtatatattttacagaaacgtgaaatcaaagttggggataaagtagccggaagacatgggaataaggggatcatttccaaaattttgactagacaagatatgccctatttgcaagatggaacacctgttgatgtggtcttcaatcccttaggagtaccctcccgaatgaatgtgggacaaatatttgaaagctcgctcggattagccggggatctgctaaagaaacattatagaatagcaccctttgatgagagatatgagcaagaggcttcaagaaaacttgtgttttcagaattatatgaagccagtaaggaaacaaaaaatccatgggtatttgaacccgagtacccgggaaaaagcagaatatttgatggaagaacaggagaccccttcgaacaacctgttctaatagggaagtcctatatcttaaaattaattcatcaagttgatgagaaaattcatgggcgttctactgggccctactcacttgttacacaacaacccgttagaggaagagccaagcaagggggacaacgagtaggagaaatggaagtttgggctttagaaggatttggtgttgctcatattttacaagagatacttacttataaatctgatcatcttatagctcgccaagaaatacttaatgctacgatctggggaaaaagaatagctaatcacgaggatcctccagaatcttttcgagtgctcgttcgagaactacgatctttggctctagaacttaatcatttccttgtatcggagaagaacttccaagttaatagggaggaaatttgatcg

SEQ ID NO: 3214 - DNA, 49496 bp, Oryza sativa
ggctaaagagatcgtcaacttcaccttggcatgcttccatcagcgctgaaaagacagcattgaacgagaagagaactaaggcaaggctggtgatgtgccactgtacggggagctctgagaaagtagaagtgctttccttcacgctgagcgtgaactctcgatttcgctatacgaggaagattgcttatgacatcaatcagctaagtccgtctgtcgaagaatttctcattgcattcgatgtttagagtaatagtatagagtgtttggtctcgcttttaagttgtatcggctggcaatatgccatagcggctggttcagaatatccccctcgcgaacctccacccgcggaccaagactccaaccgaagcacagacctgagaattggtagtcggagaatcagtagcttgtaaatagattttctgttatgcgatgctcgtaattctcaatagggccccctttctgttaagtgaagtgaggcggggtcgccgaacgaacgacgttagtttacttgcacgcgatctccttccagagccaagacattaacagtctagaatcttttttcattttttacgttctgttaggttcttatcttagattccgtcatgacggagcctagaccttttcttcttttacttcacacaatagaaaattgaattaatatatattaaatatattattttataagggcaaatatatataatatataataatattaaatatattattttttatgggcaatagttaggagaggtgcgcctagctttttgtctctttgatagctggaagttctccaaaagtatgaaaggctggagggctttgtaccaaccattctagtgtggttggattctgttcaacagcccaaggactttccgcacatcttttgttctttccactgcttgaagtgattgcgacaactacgaagaaacgacgaatcccaactacggatatataagaaccgaaactgctcagagcattccatccggcgtaagcatctggataatctggaatgcgacgtggcatgcccgaaagccctaagaaatgcatgggaaagaaggtcagattaaccccgaaaaaagtaatccaaaaatggatttggcctaaagtttcaggatatgtccgaccaaagattttacccacccaatagtaaaatccagcaaataaagcaaaaacggctcccatagaaagtacataatggaaatgtgcgaaccacataataagtatcatgtagagcaatgtctagcccagagtttgctagaacaattccagtgagccctcctatggtgaacaaaaagatgaaccctacagcaaataacatgggtgttttgtattgtatcgaacctccccacatggtagcaatccaactaaagatttttattccagtgggcacagctatgatcatggtagctgcggtgaagtaggcacgcgtatcaacgtctaagcccacagtaaacatatgatgagcccaaactagaaatccaagaacacctatacttatcatggcataaaccatgcctagatacccgaagaccggttttcttgaaaaggtcgatacgatatgactaataataccgaatccaggcagaatgagaatatacacctctggatgaccgaagaaccaaaagagatgctggtataatattgggtctccccctcctgcaggatcaaaaaaggttgtattaaagtttcgatcggttaataacattgtaattgcccctgccagtaccggaagtgataataaaagtaggaatgctgtcactagaacggaccacacaaaaagtggtaatctatgcatagtcattccaggtccacgcatgttgaagatagttgttataaaattgatagaacctaaaattgatgaaacacctgatagatgaagactaaaaattgctaaatcaactgctcctccagaatggctggtaataccacttaagggcggatagaccgtccacccagtgccgctgcccacttctactaaggctgagcttaataggagcaagagacttggtggcaacaaccagaatgatatattatttaatcgtggaaatgccatgtcaggtgcacctatcagaatcggaacaaaccaattaccaaatccacctatcatcgccggcataaccataaaaaagatcattaaaaaagcgtgagccgttattaaaacattataaagttgatgattcccaccaagaatttgatcgccgggtcgggctaattccatacgaatcagtacggagaagcatgtgcccatcactcctgcaatggcaccgaagatgaaatatagagtaccgatatccttgtggttagtggagaagagccatcggaccagatttgtcatttgattttcgttttgaaaactttcaagccttatcagagaggggctcggggctggaagagaagaaccttgatactaaaccaagtttcgataacttcttcagctttcatttcctccgtcttcaaaatcgcagagttaattcaaaagtcctgttaggtcacatatgcttgcttttgaaaaaaaaagtggtatacggcatattattccccccccctctttcgatcttctaattggaagatcagtagagtgtgttggaattcggttctttcgagccttgcttgggctcgttctatctttgaatatagcgaattccgttccacctcaatccacgttcttttcgcgctttgcgcttccaggaaatcacggttgtgggaaaccacatcacggaagaaaaatgatccttcctcatgatcccgcagatcctgataagctgcctggagaatagagaaatcatccgttgctcggatagagtcaagataggaacgaagcgccccctccaaaaggtagggttctaccggaagtacggctccgttcctcgcgtatagagctagaaattcttgaattagatccatcctaacattggatgtcctttcttccattaggaagagcctcagccgcccaggtatgtcctccagaggggtgttgtgattcagctcctgctgaatgaacgcaacccactccggatcctgctcgtaaaggctcagatagaagtttagcccttctaaatgagctagagcctgtgggtcttgaacttctgggggaagagtgataagaaaggagcaacaagttagaagggaaaacatctgtactatggggaggactatccgataaaagactagaaaaactaaaatggaaatcttcaaaaagaagatcaaatatggaatacataacatataaaaataaatagtcgacgaaatttcgctacttatccttttttttcgctcctgtagtgatttaagcactactttaaagataacccccccagccgaacgactactaaatgctcggcaaagcgctctcccctttatgctttgtctcattctatctctcgtcatcactcgatgaaacctctacttcaatgaaagctcctcctactactcccccttatccttctcactcgtcgtttcgttggtcttttatatacccattgattgtcctcggaacaactattgcacgcagcagggagttcactggtcaaactatgtcaattgaaaaggggggatccggtggtctggtctctgtgcttcgctttacctctacccatttccgcaccaataggaatcttgcgattcgaaccctccactcaatctctctcgcctctatccatctcttttgttctatcatccatcagctcttgtcctacaattctctttcacttgcattttctttcgttctgaggtggaatcgaaccactgaaggatttcaagggcaatgccccttgctcttcccactgaaacaagcaaaaaaggatttgcagtcctttgctctaaccagctgagctaccagaaccacttgcctaaagtctcttttcttcatctatgagcatcccagtggaggagtttgctcaagaaccgagagccggccagggactggacggccctcgttcgggaaggtcttcttcgctatagacgccaccaagaacaagaaaggggcgctccgctcctagtcactaagtagtgctattctgtccgacggcggactccatcaatctgaggttctttctctcacgtaatttcgcccgcccgttctacttccgtgccggaggaaatgggattcgaacccatgatacaatcttcttgtatgtcgatttagcaaaccaatgccttaagccactcagccatacctccaagttgttgatcggaattggatgtgccgggttggttgcccgaagatccactgcgtaagccgtagcgcgcgtactcttctttactgagcgagaaagactctatccagatctatggatctcccctgcgtccaagcgagaccccatccacataaccccttattttctctccaatggtagattcgaaccccaaatcatagaaactacactatatatgagtttctgtcccgcgtttcaatgggactccctggcagtacggtgctgaattctctggcttttctagcacgcacgccctttttcatatagcaccaggatgattaagacttttcataagaacgagtgaagctaatactttctttgctgtgctatctcaagagtttagctttgagagttggaaaggaaatagggcggtgggtaaggcctatttcagaattttgttggtgggtggtactatacgggtgactgaggtccatcaaaactgtaggtgcattcgtctaaagggcagacccttgaattcactctgcctgctttcggcaactgcattcaactttacctgtctgtggggctttgactatggtggctcctcctttgactctaacctctgcctacctatagtttcactccagtcgcttcttcctttttacttatttgaaagtgggcggcgaaaggagtaagtatcctatttttggaatggaatttcagtaaagtctttttttctgctttatccttctctcaatcaaagaaagggaatgcagatgttctgtcgccctctcttcgtatgccaccagccttcctatcaaaaaaagattcattccttgaacataggcctctctcttgcggctagcgagattggctcacgcgaaaaaggctactaatcctacaacggtaacactaattacggacgaaaaaatatttctttgatctaacatatatatagcggggatttccactcttatgcgtatggttttgagaggaaggacctattgattgaagcacttctttcaacacgtaggagaacatacctacctttacgtgcgctttgataagtaggtcgacaaagtatttaaataagacatccactggtaaggacaaacgaaaggagagtgaagttgaggcaaaagctctttatctcagcttgagaatgctactctattcctggaattagccatccccttctttgactattcgacctgctcctcgaagtaaggaagggaatgaagatggcattgaatgccctttccgcaagaaggataggagttggcttaccgcatctaccttctcatcgcgggataagggctggggctaacttaagtactaaagctgcgggagcggctgccttcgttgattccccacgaaggaatcggaatatcgctacttccccttactgtcctaagcgggggagatggattaaaaaccttgtgtgaaggaaaggctgtcaaagtcgttgaccattaatccggttgaaggacaaatagacagtgaatcaacagaatcgagttgttctaaggataaggattcggcagtcgagacatctatatctatggaatttgaaaagagagaaaaggccgaggacgagctcaaaccttagggtttgaaaagaagaagtaaagctctcgtttacttcaatcaaaaaaggtaggtcataacacagattgaattagaccttactcaatcactcatcgctggaaaaagtagagcgatttcctcgcaaaaaaagcacgagcgagatattcatccttaacagggatctcaattgcgggaagaagattttttcttcaggatggagcgcatcagatattaacagccaactgataattagtgcaaactggagtttatcccgcaattcatcacttagtaggtggtcattaacaattttaccacttagtatatccgttatcttcacattatgaacattaagacaatctctgaaagattcaaaatacgtattacgatcattaatagccatattttctacttcatcattgaaacttttcactatgtttttatggtaccagctagatttacatatagagggtagggttctactacctataagtatcttcatcgacttcccccgcatggagcagcatagatctaaatttaggaggattatccagatcgtagtactctaaaagctctttatagcaatgactctctaaacgtgatatagatgttctattagattttatccagcggtgaatacgtaggaattgccagaatatatcgcacttaaatcccatctatgattttgaatagaattcgtaggtttcgacctggtgttgtaacaaccatatctagataggttcttggtgctttctcgagtacccctagactttcctcttgccacacctcttttcgtgataaaaactcataaggggtaaactctttatcattgtataatgtatcaactaacggatgtcttattggaggtgatcgaagttcttttaacctttcccatacttttgaaccttctaaatgaatgtcattatgttttgataatacacggttttcaataaggctttgcccgcagcatgttaaaagatatggaatcctacgaggagataccattcccgagaacagcaaaccataagcaaggaagggaaaatattgatataaaatgaaaatggcgtgttggtgttagtttgggtatcattataggtttctgttttgctattggcgtatatccaacagaataacaaccctaataggaaccctagtgcccttacttttttcactaaacaactccatcttcaggggtcataaggatatttatgagcgctagcaacagtccatgcttctcctcttgagacagaggtgtcaagggtacatttataatagaagtaaatagctatgtacaatatcaaaatgcaaatacagcattcaactgttgtaattaggtgtgggtgatgcaataagagtgggtagctgaagatggtgatactcgttgtgatgctacggctgctggcatctagtgtagttgagggctcttaactacagcgcgggtacaacacccactttaaactacttccttgtagatgagtgagaagactcatcgagttacgaaaaaatccttgcgatggagcagtgctgatgggtccactatggaggaacttcgttgtggggtggaacgggtcttcttaagaagagttgctttgatgagacaagagtgtacccatgatgctaaggctgggggagccctgtgaaggcaagccatgtgtttgtaggggttatgaggagtgaatggaaatgaatcatcttgaacaataccagtctgtagcacacccagctaagagttggaccaatacgttggaatagatagctcagttgcttactttaaagctttagatagctctgtttgttacaagcaaagaagaaaagatatagcttttgtttaacacctgctacgaaaggtacgcagacgacatggtctttggggattccctaactgggacccgagatatatattgctgagaggtttgcaacttaggatttcagtactgtgttgcttggtccagtccgtccggggtcatgtccttcccattcgaacttctttccactaatctaatggtttcattctcccggttatgatactagcaagagtcctattcttctcctctcgatcctaccttgggttatgtttaacagggatggtcagtgaacttctattggtttcaaaggaggatagagatccattggggaaggctcgaaaggttattcgatatcaaggttgaccctcgacgcgccgcagccactatttttactccttttatgcaattatgaacgaaactttctcgattccaatgcaacttatccttttggagttgacgtaacaaactacgcgagccccccgatgaagccaacagaaatcctatccgaatactaaaaagaaaaggcaatttcattatggtggtataccagccgccagttctggaacttccagttccaatcgaagcatatagatccgtaaatggatttgtatgtatagccacttcagtcgtgctcctcgtttctcgaatggaaaaaaagtatcttctttctgggaacatgctaaacctgaaattcttatgttcgtgattcttcatccaccgatgcagaaaatcttccagttttccattctcatatgaggcaggaaagtttatgggcaacaggtcggcacgaagtgattcatcatgttcaaacatgaacctttcgctcgttggggacggtttataaatcatcaaattcccacaaatggaatgagaagtgggtccatgtaaatgatcgagacctcgcaaacaacaacgttccttccccatatggagttcggaacccaaaggcaatcgttgagtgaactgtatcttattcgtattagttgacctaagccgcaccattattgcaggggtggggctcggcctccgaaccgtacgtgggacgagtttctgcctcatacagctcgggccgaagaccggggaagctgaggagagatggggaaacccaactgctgccggtcgggacggacaggaaaggggcggggataagcttgtgaagaagcaagcttattgccccaaaaaacaaaccgacccagcaagaaaacgtatgcgctttagcaacaaagcgctcatcccttgcttgttgcttcgcgttctttctattccatcccagtccattccgggataggcggctaatataatatgtgcggtagtcgtcgtctgaccaatcggctcggacaccagaccgcttgtgcccgcccattctgtctcgccctaaatggaatggctctcttatcttagttacgctgtgccccgacccgagtccccacgtccgcttttatccgcccgcaacccggccaacacaacattagggccgtcccccccattctatgctgacccgggccggggctcgctttttgggaagcccgttcccaccgcgctcacggcccggctggcctgccagcggtagtgggaattctcccgttccctggtcaaaaaagggttggttggatgcgggatctactccacgaggagcggtacggacgtagatgatatcatcacgacctctctttgcgtaccgctagggatgcttaacgccacttcgccaactggcattacctgcgctttcgtgtctctcagtgtggtcagcactgggtgtttccgagcagcgaggcttacacccattcgcattaattcatccaaagttccttacccttatgcacgaattttggaataagccatcttcctatcaaggttaaggagtcaactgagcatctcagcggcgggattgaatacccggatcgaatcagagttcacgccgcccgccctaaacaaatagaataggaggcgtgggccacaggtcgcacataagccatcgggtcgcacgacagaagaacacccaacataaagatgcacactcctccatgtgaaatagaaagattcatcttcacttttttgtagtagtcgtgaccaacagccatcagcagtcggctcgttggtaaggcgagagcttcaagcccgatttcaggtggccccaaacaagcaccactcgacgaggggggagcggggaaagctacaggcccaaaaccttcgacccttctttctatatgggggtgcccggggcacctcatcttgtcattttgttgctcattccccttaggccgaagtgtttggcctttacttcggagcgcccgctcacgcttcgctgacctatcgcgtggtaaagagaagagagtacgaaagaattgtaaacagagcagaccgcagaaagattctaaatatgacaagtcccccatggattcgataataaggaaatgaagaacgggaacgaaacgaaataaagcatttctagcggatgagcttctccctattttgtctggtaatagaatagggcggcttgctttgaccaacactccactttttgctctgtccatggagcgtatgaatttccttgaatgtagatagaccaaaaaagggaataaagagataggaataggaattatagtaccattggaagaagaggcaccagtgggaacatctctactgacgaaccatttcaatagtacgggtgctgccgtgccacggggcacgaccatggaagtaatgaaaaagaagaagttctgtagttggaccatctgctctatccgttcgatttgagcttctccagagaagatgagacgctaaaaatgaaagtgttcgcaacgcataccgaaaaagggtacctatgttgccgaccattaatgactagttcgaagaccaggagcaggggcacgtgccaagaaagatttgttactttccctatggttttcgaacgttttcaataaaaccttctcgtagaagtattttcacaaagttttcggtaatataatattagtagatgctattcgaacccttccttttattaagattataattcttattcttattattatataattattattttattttcatgtatatgcgtcagacataatctactaattgatctatattctgataccctactatatcatagtctctactactagtatttataatacctcaggagctcatgagactctttttgtgaaattcataagtctcaattccccaaaaactcgagttccttttggatttccttcttgattaatgacaaccgtcatcatatcgtattatcataccgttgtcacgtttgagttctttacatgtacgtacaattacagctcgtcttacttctgtctgatctttctagaggcattttgggcactgcttctttgattacagcaacaataacgtcaccaatatgagcatatcagtgattaccagctcctaagattcgaatacatatcaattcgatagccccgctccgttgttatccgctacattcaaaagggtctgagtgagatggatcttggaagtctggtttttgattggatagtgatctcgggcacgagtggttgatcttcgcgggccgtgaatggccatggaaaggagtattgatgtcaatatgttcgatcgagaagattggacgatgaaagacggatcctttgtggtttgaataataggctgtggtctcgatattgggctatgggctgattgctttctgtatgagcctcttgtgattgggctctcgtgggcggattacccgatgtgtactcatcttccaacaaagaggagaggacagggctactgctggtccacgcatgagagctcctctgtgtctttccggaaattacttcgactcgcaaaggtgaaaccagaggagattcagaggcccagttgagaacagcaagcgtacaatcaatcggtgtatggaagttcggtgaagctatatgaaaacagaagattgaggggcacaatcaggttctggctgagacccgctattggaaggaagaaggaagtctacgaagcgtcaattctaagtaagttcgggtccaatttggttatcccatttttctagcaaccgctttgaaattatcactcttgtgcttcgagctctttccaaaaacaaaaccgcccattgccgatacagctacccggctacactgaaagagggaagcgaatagcctgaagattctttcctttgttgtctcactatcagagcttgcgagagaaacaaaaaatactctcttcggcgacttagacttactcattttggcgatgtctggcacccgcgctggaagggatgaattgtctgaatgtcgttcactctgtgagataatggatctaacgttagggctttgttactccatctctcttgccggcaacgccgaactacttgaacccgagtaattagcttccttaagccatgtccatactttaagagctaaatcggatggtaactagattcattccgtagcatgggattctgtaagagcatctctaaataatagctaggcatcagtttgagttcgagattgaaaagtcctctcaagttgactatttatggaaaaatgggtcctgtcaaactgttgtgactggcatcaaaatacgaaaggcttgttagattaccaatactatgttagcattatcaagactgcaatctatcacaatttttagatgctctataattatagataccaagaaaacatgattatctgtaaattgaggacttggtccagaagtgagaaaataggtgtgaaattccaggctagggttagcaaggaattgtttgggctgattgaggatatagagctgatggagctacctttgcaagggcgcaaattcacttggaacaatgctgtgtcagctgctaagttagacagattcctttttacaatagactggggattaaatgttgtatacccatgctgtggtgactgcccttcctagatatggttcagaccatgttcctttgttgctggagtgtgagactgaactgttcaaagggttttcaagtttgaaagatcatggtttcaacaagattattcagaggatggagttttagtggcatgcacagttgttaaaaggagaattggggaagcctttggagtacatttacaacagatgataaagtgttttagggggtggagtgcaaatgtgaatggagagattaggagaacaaaggaagaattgttgaccagtctggataagttggagcttttgcaggaaagagagggaattggagcaagaggagtgggagtgcgttgattactgatttcactggggttcccctaccgtccagaaagagttgtcgccaggtcctcgaaaaaagaatccgccataaaagagatggagattgaccagattccaccattcttttatttgtaggaaaactctggaacatctatagaagcgaaccttggcatgtatattatctttgaccttagcggccttcttcataggaaagagcatttctccaccagcattgcattggcttcattcttacctatgatattaccaatagctgattcgatagcaagaggaaagagaacagcatattctttttaagagcccaaagggaccggaacagtctagtctctagctgcctaagagcaacccctatttgcccaatccaaagtaaacctattgcccaagaccatccctcaatccctactgtcctaattctgctttaggacaaaggaaaggggaagacttcctctaataaaggaggaaaggagagattttcattaaaccaaaagccaaccaaagaaccggaaccgatacagtcgactggtccatagaatagagataaaagcattaccacaggctcattcatcgaaaatcatagagactattaaataaaggatagagcaattcctttttttcaaataggaaagtggagggttcaaaaacgttggtttcttgtagcaaacttttatgtgcttgtacctgtcaatgtattggtaacccgtgtccatgagggcacttaacaaactaagtttgaatagattactaagaaataaccgtagaagaaaaagaaaggaggttgctacaattgtggcaaacctggggcacccatgccgttcatttaccaacgaactctattttgcatatttcattctcacattgcgaaatccctcccgatctttcgatcagtggaatcgagtggagcaaggctacctcactcccattaggaaaacctatggcactaaaaagtccgaagagtgagagcgaatggaagactttgaatgagctgagagagttgtgtagccgccgggggtactatttggggacaacttgcatgaagaagaaagatgatatggtgacagcagtgctagaagtacaactgccagaattgcgtgtcacaagaagtgcaattgacaagaacacaaaagaggcgaaaggaaagctctgcttcccttgttatgccagaagcaaaaccagtgaatacctggttcggtactcctacttccagaaaagggaaatcaaaaagatagtggatgaattgttgcagcagggcttcgctcctcaactagcccctatgcatcgcctatcctcttggtcaagaagaaggacgggagctggaggctctgtgtctactatagagctctcaatacacaaactgcgaagaaccggtatcccattccactgatagatgatctccttgaccaattgcgtggtgccaccattatctctaaaatggacctcgggataccaccggatcaggatggatgagaaggatgtgtataagactgcattccagacccaccaaggccatttcgaatacaaggtcatgccatttggtctgaccaacgcaccggccacgttcaacaatttgatgaacatggtattcaaaccactgcggagaaggtttgtactcgtattcttcgacgatatcctggtgtacagtgaagggttagaatcacatggtgaccacctcaggctaatgctcccccttctactttatttgagttaggcagagattgacatctgtggtttaccatttcaaccagagattgacatctccatcgtaaccttggcagtacgaaagaaaggtagtccatgatgggtttgaatacctattcttttgagaaagacagagttaaggtgatccttggtccgttgaaaatcggagacacatccaaatcggttcttgcggagaatagccttttccttaaaaagacctaacttcacgaagccttagaatagtttcaggtagtctttgccttattggtaaaagagaccgcccctcaaaacggagacctcgaagtccccgcagagctgaaacctctccttgaagagttccgagacatcgttccagctgattcaaatacctaactaagcgacctgaatggaaggctaaccaatgaatgaactgttctccccagctgttacgaactatcagatggtcaagaattgacaggaatgaagggaattgatttcagggatcagataaagagggaatttatgaaataagagttacgagaacaactagtcgaacagaagcatgagttaagtggtgttgctaacttccttactcattgtagctgctttgatgggggacatggaaggattgaaataacaagaggtaatgtgaatcagctaaggttgcctttttcaagcaagtaaactagtggcttcgcctaccttattgtgttgtagacatcttgaacagtaagtaaggatcaacttaggcttaagctagagctgctccttctatcacatcggattctagtaaagagatggcccttctcgtctgatctgcatcaacaggaatgcgggaaaagcttcttctggccccagagtccctagcagccttaagcccgtaagctacttcctttagttgaactggttgctttataggtcaattgaatcttagccagtttcttcttactccttttgttctcattcccggccaaccgtgccatgaagagtcgagcaagagcaatcgcagctttatctctgcctttgctgctctcattcctgccttataaaagcttcaatctacaaaagtagaactactgatgacaggtctggcctacaactgacttgctttcagacttactggctgaagagcaaagagatatctattttacagtaaattcctcttagaatagcctaccgctctttataggtttagtaaggctaccttgagcccaacgagtgtaatacttggagcgagtaatagagaggacggaagatatagactctgtctttcctttctggcttgaccatgaggccataactattataatcttacaggaagcaaccgctgtaccccgccgatatcagaaatcaagtacaaatgagccctcttattaaggaaataaaatgatagccttccgagccattctcatttcaaaagcaaaagatcaccatcgcggagacatccttacacactatgcggttggtttaagtgcatctctctccatagaggacggacaaccataatcaatttctctctttttcagcatggccctggaaagttttttaatatgatttgacagacgttcctagggcttccaaatacattagccaatatgagacgtaaacatgtcagtcagccaggtctaaaatccacttttcagtcatattgctttctttttgagtaaaaaataatttgcaattatggaatcctatcttaaaggccagccctatatttttttaaataaaattgaatagaaatttcatgagatgggaatttgtatcaaagagagaaagaaatggcttctctgcttgagaatttttggctatgaggctctttgaagatccaggtagacaaaggattcctcatgggggcaaggggaaaagggatgtttgctttggtacctgtcaatcattttgaatcccgctttcattgaccttgaagtctgagagaaggctttttctttctattaaaagataaaaaatctgaggggtgatcagtcctctttcaatccttcttatgagtagccgccgcggggggtcctcagtctgaatcctccactagcattagaccaacagtcagtctagctctcgctcttatccaatttccttatccttttagggcaaggtcggagtagtaggcaaatacaatttcttttgttgcatgcggacccgcttgtgagactgaagaaattgaagctaaatgacaatctgaacctacttgcttacaggatctttaagaaactgtggacttttgcacctttctgtctagcttgagttatcttttagttctctcccctcggcaaagtggataggaaagagtcttgcttccattccactagccaagaataaggagagtgactttctcttttgaacctcttaagctgacttgaaaaaaaaacagtggtacacccctctgagatatagggaccgccatgctcgtccactttcttgataaacgactcgatgcattttctcttccttgccgctgagacatatcaaaaagatctattactaaaaggagattgggatcatcctgtggttaccggatgatgggaataactaagcagaaattttgaaatgagcacgaaatgtctataaatgaattttctcattatttgttatttccgggtcttttcgttgcattcacttacaacaagaaacaaccaccagcgtttggtgcagcacctgcattttggtgcattcttcttcctttccttggtctttcgttccgtcatattccaaataacttatctaattacaacgtattaaccggtaatgcatcttttttttatcaaatctcaggggcatggtctaatcatgagggtagtattttatcatggtgttggatcccaagtttttatggattccttttttgttaccggggtcgaccccaaagccataatgtctcaaaacgaagaggctatagagaaacttttattttttcctttgtctcgaacttcgtgaagaactccattctatctctccaacaaaaaagtggggctgcgccccagttgtacacccccttcgttcggagaacctttgttgattctgaacttcgttcgcaaagtaagcgtccttttaacgggccagccctttttaatgcgccgcttgaccctgttttgaaaatgagctttgctcttctgggcgctgggcgctcccgtggttcgcgagaaggaaaaaggactaatcttttgttacatctggcacgagatgaaaaagagagagcttcgtctatcgatgaacagcagattgacggagctcttgccattgctttgtttttctcttctttcctatcagcgagttccgatccttttgttcgaaatttcttcgttcgtaccgaaccgcttgcagaatcaaatcctgttccacaagatcctatatcagctatacatcctccttgcatttatgccggagacgtcgccagtgctatgggctttgggttatgtagatcaaaaatgatgaatgggattgtggcactccactcgccgccaatgcggaaggatgccgccgaaaagaatggaacgctgcttcgctctgctggatgcgtcggatcccatataagaagctcgctctttacccgatcattcaaacattttgtgggcggcgcgcctgctctattgttgcgtagcaatagaagcctgctcatgctgcttcggcggcgctttttcgccttctcttcgctctggacaggagcgctaatggacacggggagggagcaggcgaagcgtgtcgttcgtaatggaaagaaagacaccactacttcgcctctttgttggaccgccggcgcgaacacagtggtctctgaccaggaccaggaaccaattcgaatttggatcttgacatgtcggttgtttttaaccgtaggcatctcgccaggaagttggtgggctcatcatgaattaggtcggggtggctggtggtttcgggatcccgtagaaaatgcgtcttttatgcctcgggtattagccacagctcgtattcattcagtaattctaccccttcttcattcttggacctcgctcctgaatattttgactcttccatgctgtgtctcaggaaccttttcaatacggtccggattgctagctcccgttcatagttctgctacagacgatacacgaggaagatttttatggcggttcttccttctaattacaggcatatctatgactcttttttaccagatgaagcaggaggcatcggtccgtagaacctataaaaaagagatggttgtggcgcgaagtactcttgtgcacctacgtcactcggctcgcgcgcaaccccgccccgttatgttatggaagaatttagcttattgctgggctggttattcagagccagcaactggctgccggatttcgtcccgtccgtagcgcttcggaagtcactctggcgtggcgctgctggatacttctgatcaataggaatagggggaaaaaaaagcttatgatgagcatctattggagtcgatcatttccaagatctaattctagtttcttattatgtagtggaaacgcctcacaatcttcagttttacgcttacgcttaagggaagaaatgttcttggtggatgcaggccttggtacccccaaaatttgtatgcaagatgagcttacaggactgccaatcaagcgagccaccaggtttgagaataaggtgggatccaagaatgtagtggctggtgaatcactgatcaaaaagcggattgaagagagattcttcatcgatctagtggccggtgaatcactgatcaaagagcgagcagccgccaggtttaatgattttgtgggatccctggatgtagcggctggcgaaccgcttcttcttccacaaagattcagacaaaaccgagcttggatagaactgaagaagatttggcaaacgaagaaaaaggtcaaagggtttcgtattaaaaaaatcaaaggaggttattcagtagccatcgcaggtttcattacttttcttccattcgctaaaaaaaaaaaaaggatagcgaatgatcgattcaccattgatagctttaaccctaaaaggagggatattgtgataatagcggcagatcaaacaagaacttgatgaaaaaaataataaattattaaaaatccgaagcccaccttaatccattttgttgaggatcttgcacttattccggccctatatttacatagccaagaaaggctctggcgatcatgtgtgactgcggagcgcctatcgccctggcacggcactctaaaatgtatgttgggttgggccagcaagaagacttcgactagggagacgaagaatggaattgaagaaggcagcatagtctaagataacagaatggaacaccaaccaacaagtaagtggtggatttggatggagtctcgcagaagaagagtacgcgcgctagcgcgccccaagacgtcagtcctttttctgcttgttggccaaggtcagtttactgaatcccttccaaacaccaacccaatccccattccttgatgggaaatgagcaagaccatatgtttatataaaatatagcccctatataaacccagcccttactacccgaacttcttacctgaaaataggactaactgcccgaacccgcttgcttatcttctacgatctaattaagttaagcagtggttattttttttttagtgactagaacttctatcaactactattctagcacccagctgtgccatgtgtttattctattcttcaggtattcctttgaataactcatcttttcaggtaagacaattttaagatcttcttagtcagcctatctgtattcttatcctctagtgcggatccaatcagattttatgaagccaaggcctgacatccattgtggggatcatcttttatcgggagacatggcctggtggtttctgatcgagattcctaatcaatagggcgaagagttcttcgcatgatctggtcctaccttttgtctacgctattttttttcccttctcagctgctgtccttactccggataaattggaacacattgattccgttcgttcctgcccttcgcttcaggccatagtgcttctgaattatttctatacccctttgatgatgcagcctctgactttcgtgggtaaactcctacttgattagtcaaaacttctctgtctcaactcgtggacctatctatcttcttctttataagagataggggtttgctattctcacggattgctcatatttatttaccccattttaaagtttttgccttgtttcagcccttccttcatctgaaccttccagtacaatctatctttatggggaggacccttcatctgacctccgagctaccctgtcaattgtaaaaagtagttgagtcgtgtctcgcaggagcaaaaagagtgaaatgaggacgtaagccccctaggtcttcctcttccttctaaactaattgctttcgcttgactcttccagtaaaaaagtatactgagtggttgaaggaaagcgaaaaggaatggctttttcatgtaccagatccggtgagccagacatcaagcaaaaatggacatacagtcaaagagtaaggagcagttatttgcaatgacgggtggattggtcagagctgcaaggagagactcggttatggtgcgataaagagcttgcttcaatgctcggattcaggtagaaagtaagagcagtagcatattcataggagagctttgtacttgaaattagtagtcccggtagttggaaaaaagctctgaatacagattcaaagcatcaagataggtagtccgatcattagttggccagtcatagcaatttaagtataaagctagcttcgggatcagatcattcaactaaagctgtcaggccgggtaggcttatcggaacattgggggttccttatgttgtgactgagcagatatgtctattgtgcccggcaaaaacggatttggaaggccaaaggctttctcattcggaaaaaaacaatttcaagtatatttcccttctccattctctgctcggatgattgccgcttgtgtgaatttcattgctgtgggttcgaataagattgttttaggattctatttagtttaatttattgactccacggtgctggttatcgagtttatggcgccgccgaccagccaaaaagtaaaagatggcgtcggcatttacttattatgctctcttctaatagtggtcccttggtattcaggttgtaaaatcctgataggaaagtcgactgttataccttgtttttgtaatggcctatcttctttaaaaagccgaaagataaggatttctaaaaacttttgcgttcctttttattttttaggatgctggtctcatgtttgatctggtagcgagaatgaatcttgctctggcgatcatggtgggattggtacacctctatatgctgtaaaatgaaggtactctttttttcatgctacgaccgccgattgttcctgtgaccacacgccgtaccaacagaaaactatcaacctatcggtatggtttgttgttcacgtgttatgatctcgctcatcagattgttcccccctcccctggtcaatggcggtgagttgattgaccaaggccttcccttacgacgatggaatttcttccatcggcaagagtacctttgtttgtctccttcaactttaatgaaaagcctagtctctcgatactaactaattagttaggagaggtgcttacttttttagttaaggattcataccccatcccattcctttttctttgaaaagaaaaccttaccatttttgggccgctgttaccatttccatttccggaacctaaacctaactaatacttagttgtttccatttcctcatctggtgatagatcctcatcttcttatggctcaaatccctttttcatatccagggcaggctttaggtacgctttagttttaaatcattaaagatatgctcgacctcgtttatgtccatggtaccatcgtacgtaccttctactatcaaccagatgagatagggctttgaaaggtcagagtcagtctcctttttcttttaggtcgtttagcagttccccaacctgctttctccccgagaaagccttcctgagattaaaagaaaaaggtttgaaggttctgggatcagtgatagttcggaaccagcaaagggaggctgaaaagccgtagtgctaacgcacgccctgtagttttgaagcaggcttcgacagcagcgagctccgcgtcgaaaagcgaagcgagccgcgctagcgcgctactcttcctttatgagcgagactctatccagatctactgatctaagaactccgcgagcgaactgagcgagccatgaggcgcctatcggcaaggcttggaaaagccttaagtttaggctcccttccttcactgaactgattcacccgtgtccaaacctgctgagctagctaatttttcctttacgagatctcggctcttcggaatgattggagagagccccacctcctcttggttggtgccgggcccgagagtgatgggactacttcctgaaagagcctttcgttcgggccggcaggaggggccctgatctatcaattgagggagcaaaaaacaggctttgctcccctttttttaaatgaagaaagaaagaagggtcgaagtttagaccgctcacagtagttccacccatagaaaagatcatgaaagaggcgatcagaatggtacccgaatccatttacgatcccgagtttccagacacatcgcacttccgctcgggtcgaggctgccactcggccctcagacggatcaaagaagagtggggaacctctcgctggtttttggaattcgacatcaggaagtgttttcacaccatcgaccgacatcgattcatctcaatcttgaaggaagagatcgacgattccaagttcttttaccccactcagaaacagttttccgccggacgactcgtaggaggtgagaagggccctgactccgtcccaaacagtgtactactatcggccctactaggcaatatctacctacacaagctcgatcaggagatagggaggatccggcagaagcacgaaattcctcttgtagtgaaaatcagatcggttctattaagaataggtcgtcgtattgatgaccaagaaaagtatggaaaagaagcaggcttcaacgctccccaagacaacagagccctcatagtggggagggtaaagagcatccaacgcaaagcaacctttcattcccttgtttcgtcgtggcacaccccccccacaagcacccccaggcgaaggggagaccagaaaacgccttttgttttccccccttcagcggccctagccgccttccttaacaagccctcgagcctcctttgcgccgccttcctcatagaagccgctgggttgaccccgagggccgaattcaatggtagagaaggctttaataagaatttggccatgagagaccttcttaagtattgcaaaagaaggggcctgctgatagagctgggcggggaggcgatactagttatcaggtcagagagaggcctggcccgtaagctggccccctttaaaagccattccttattaataaggatttgttacgcgcgatatgccgacgacttactactgggaatcgtgggtgccgtatttcttctcatagaaatacaaaaacgtatcacccacttcctacaatccggcctgaacctttgggtgggctccgcagaatcaacaaccatagctgcacggagtacggtagaattcctcggtacggtcattcgggaagtccccccgaggacgactcccatacaattcttgcgagagctggagaagcgtctacgggtaaagcaccgtatccatataactgcctgccacctacgctccgccatccattccaagtttagggacctaggttatagtatccctatcaaagagctgacgaaggggatgagcggaagaggtcgtctactggacgcggttcaactagcggagactcttggaaaaaatggactaaaaagtccccaagttagcgtattatgggggaccgtcaagcacatccggcaaagatcaagggggatcccgttgttgcatagctcaggtcagagcaaggtgccatcaggcgttcaacaggcagtctcacgatcgggcatgagtgtcctgaagacaaaattgtatactccctttggtcggaaggcggcgggggaaggaagggggcactgggcgggatctttcagcagcgaattccccatacagatagaggcgcctatcaaaaagatactccgaaggcttcgggatcgaggtctcattagccgaagaagacccaggccaatccacgtggcctctttgaccaacgtcagcgacagagacatagtaaattggtccgcgggcatcgcgataagtcctctgtcctactacaggtgctgcgacaacctttaccaagtccgtaccattgtcaactaccagatccgctggtccgctatattcaccctagcccacaagcacaaatcttcggcgcggaatataatcccaaagtaccccaaagactcaaatatagtcaatcaagaaggtggtaagacccttgcggagttcccaaacagcatagagcttgggaagcttgggctcggtcaagatccgaacaacgacggagcactcaactacatgtttaataagtagttgtctttttctatttggatttttgcgaacaggcgtttacatgagattagttgagtaggcttgcctagttgtctgctataagatagctagttgtggggctttcgaaaaaaagccttcaggcttcgctatcgctcatggcttgtattgtagtcgtagtcttgtagtcggccctccatgcctctttagtctttctaatcctgaggcctttttccttcattcattttgcggtagcttacgcgtcagaaaaaggcctcctttccggcccggaagatcgcttcgcttctggcgactagcttctacccacaatggctaaagctaccttgaatcaatcaatgaatgaatgattcataacccccatgggttcgaggacccgttggtcaaaggaaaggggggggtccagattccaggacggagccgtatgaggcgagagtctcacgtacggttcctttgagaagggtgtgataccaccacctatcaggcccgacgagcggtccacggagctgcatccctactcacccggtctatgcacatcgctctttccaggaggttggccgcctatcctagatcttcccatttccaagaagatcccttgttcgatctggtttagtatcaaggttcttctttttctgtttctatatatatgggtccgtgcagcatttccacgatatcgttatgatcaattaatgggacttggccggaaagtgttcttgcctctatcattagctcgggtagtccccgtttcaggtgtttcagtcacctttcgatggctcccttaatgtatgtgccaggaagtttcttctgaagggggctactccccgaaaatgccccgccccttgttcgtttgtcgttggggattcattgctcgttctgcggttataagtaacgtagccagccaaatttctagaatagggctgcgggcaggagggctttgtttgtgcaatcttgctcgcaacaccctctcctccggcgaacctacgatcgccgtctctaactgaatgctcaactgagggcgtgtacaacaaccttaaccgcacaagcctgggctgggcctacccccatccctagaggagccgtatgaggcggaagctccacgtacggttttgaagccgagcctttccagcaatggggcctagggaccgatatgatgattggtttaggtagggcggccggcctactatgggcacctgtagagattagtgcgtgagaccgcgatccacaaactgacgcatgggactcacccttgacttgagaatggaagaagggaaacatagcatgtcacaagagcgaggcgagggggctccgccctacagcgagagggacgcctcgcgagccgggctttggagatgaggccttttggcgaagccaagtcaatttcgggccaccaaaccctgcaactgaggaaaaggccctatggagtaaagggaagcgtgtacgttgtcacactccctgccccccaaaggtgcctagaggacgggccagacgcagcagagcgacgccccaggagcggattccccacgagcagggagacaggagacggccatctcgaggcacatcacgacctacaggcaacaccggcgagacccgggaaggtaacccgattgggagtcagaggatccatagtacccgcagcctcccggacttcatattcatcattttctaaaaaaagggtaaggggtctcttttctgcaacggaaaaaaatcagctccgctgatttgactcagcacaacctaacgatatatccaataccaatgatctgtgcctaccgatacgatactcaaaaaataaattactatataaagagctagtgtcaataaaaaggctaatgacagagaagagtcaatctcctttactcctcccgacacctcaagatgagaaaatcccttcatctaggcgggcgctcatgcctactcagggagctacttctaccatggctgacacattatctccacaaaaaccaacgacccatcccgaagagaagttgactgacggggatgtctcgagaagaaattccagaattggtagcctcccaaatcaaacatacattgacaggggttgccaactacggattatcgggttaattcgattcgtgggtggagatagaaggcaagctggttacgaaaatggagatacccggatctagaaaagcaagggttgtaggtttgggttcatcaacccggaacgaggtaaatcccttgaccgagtgaaggcgagctcggattcagagatagatggactagggctaggatgattgttaggagttaagaagaaaaggaaagtcaactcccattcgaaagaacaagcaacggaattcggatagtgagctggttagaaaaaacagggaggatggttgtagctgtcatcaacccggagcggggccaaggagaatcagagcaggtaaggaaacaggcactaggtgtggcacaagcccatgaatcaccccatttgatttagctgtttccagtatgttagctaaagcatccaccacaaaatgaaaaagaagaggtgagagaggatcgtaatggagggctaggactagcccacttattgaacctgttatttgatcctctattttccgtgcattcgcatggatttcggccgagacggggcgctatcactcttttccaggaagtcaaacgttggcctacggtcaatagagtcataaaagcagatatcaaaagcaaaagctgtcaactaggcaagggcgggctataacatagtatgacgataggctaacgactttggagagatttacctatgatacgtaactaagcccccaggcgttgggaaagctacagcagatttggcagattagtagtctccaacttattttattagtggatcgagcggattggtcttgttgccgtaagcctacggagggaggggacccatcctgtagaaggcaagcggtaggtaaattgtaatttatcacttttgtcgataggggaatcgctcttttcacttccgttacgttcagctttctttctttacctttccttccttcccctaatcacttccgttccaccactggctttggtatctttttgactctcaaccagcagtcaagtcatttcattacgaaaaagtcattgaattggttgcccagctccactcgagctaatttagttccttggcactccttcgttggtactcaaaaactcgtatagccgtttgtttcaaatctgcaaatcgaagatgacgaagggaggaataccatggaaatataagaaaatctcctattagcgatgctcagatttcaatggaaggaagatagttattccaatcacttttctcgataggcagggctaggttaccagcgtacgggcaagagaacttttatctgctcgtcttttcccaggatttctttctgaacttgtacgggtatgacccgcgttcctttcatattaaaaacactagcttgtttagttccacttcttttcacaggagaacttgccggtacctctagactcgcttcattgtcattccactcgcggcactgggtatcagttatcggagtgatcggggtgatggtgatagttgttacgatccgtaactggtgatgaaccgcaaaggtttttggttagttgaccctgttaaccgtaaagaaaaggagaaagataagtggactgggcaataaatgactatgtccatattgtaataacccgagtaagtatctgagtaagaccaataaggaaagtacacggagatgtattaaagttaaatccgctttattgggacaactcggatggattggattggatatagtagcaggctgaatccttggagcatataaggataggctaataaagtggaactgggattttttgatagaatctacccaatgaggaattttcaggaatggagaatgttgtggtaagaccgatgatattccgatagaacccatggttggacgtagattgcactatacttccccaccacaggacgtaaagacggaacgctgaaatcaggagatgaagtagctgttggtcttgcctaaattcagtattctaagttggcgaagcctcatacataccgataggaggttgagggatccggaaagtctccgttacgttctatcttgctttgggttttgctgactccgtccagcaggcgtatccacctacggttgcaatggtgagttgtgaactttgtagagcttcgttctagttccatcatttttctgcattctttctaaagtgctagtttcctctatttctaatatcagagtaacacgggaattctctctgggaatccgctccccctgcttgcttgtattgggcatttggcagaggcaggttctccatcattaagaggcttctcactttggtatcgatatgcgtctgaactcctccactctttcactaggggtacacacaactctggacttgtgcagctaatagattcctttctcaaaacagcctatttttgaggaaatgcccatgggaatacggttattgggataccacagggagtaccatctcaccggtccttatgaacagctttccccactgaatcattagatcacccgcttatgttccctagttgtccaggtgtgacctagtttgcttagtaagtatggaaggacaaaagacgagtacagatgactactattctccggcagaaagtcactcatttcctcttaaaggcatatttccctgaaaaaaagatatgagtaaaaaactcttccaaatcaaagatttgcctattcttcgtagtacgagaatactcttacttctcattgacacagacgagaaagaagtagaataaaggcagaatgttagtaaaaggaaaagaaaaatccattatatatgctatatctcattcactgagtagtgcaataagcaactattcgttgacaccaactcacttatacttgaagacaggaacatagtaaagtcagctaatccattgacacattgtctattctaagacaagaaaaaagagtaactgaagaatagtactctttctattgttcatttcctatgaatctttcttcattgaaaagatattgtgcatttaccgaatttcctgtcatagatagtctagtgaagctagcttactaatgccaagaactactactcaccaaaacctatccttactaatacacggctatatgatattcttattattctatttctatatttactcatattctagtttcgtaaagctatactttagagaaggaaagagagattctaggaccacttgcccataagaataagaccgaacttaactacctgtaactgtcccaactgcccatgtgtactaaccccccgaaatcactttccctactgctacgttgaaatgaaaatgcccgcctccaatccgcttagttagaccagactctcagacatatgattgttgagttagccaagtgaggggttcgttcagcccgtcaataaagctattctcggtatagaaatagataagaagagctccaattaggggcaggcgcaataaggaaggtaatcgattgacgagacccaccggaacttcaactttcagtcttctatacgttacctgcctggaaacatgtaagttcgtgtcccgcgggttagcgaggttggtcggcataaaatatagatagtggtttgttggcttcatctctaggttgggatggctttccttctgtgtatcgaaagctggaattggaagtagaacggaatacttttattttgtttgaggattgaggaaagaaaaaaggagtagttgttccccgcctggtgctgaatctatttcacttttccagcgggaattcaagttcctctgttaacgcgccccccttatataagtgcttgctgatgaaagttggcatgaaagtgctaactaaccttaccttatttctaggagcaagtggaatatctgacctgattataagctctattaatttctatgctttgcgataagctttcatattactacaaagaaggttttccatgagagagtagaacattgatttacgggtcaataaacatattaaataaagcgaagtagataagtatggtatgagggaagaagtatttgattaaatacctatccagatgcctttcttttgatacctaatacaccggtgcttctacctatacaggcaaacaaacccatcccttgcttgacgagcagctctttctattcgcttgaccaagccgctgctgctctttcttaatgcctcactgcctgaccttagagaagacgaattagactgcctgatagactactacttccttttcttacccggccaaaaagctatagatttcaaataagagcacatcgactagggcccaactattgctttttttactaatagttagcaggtgtcctcgtaactaatcttattccgtttaactattagtagatgaccttcccttctatcaatgtgataggaaatcctactaccatcggcaaatcataggagctaatcctcacccggggggggccgtggaataggcgtacatggaattctgggcctgcccctactggtaattcaccgtcccgctcttatgggcagacagaaagatctgattctaaaactgccttttcaaaaggagtgccctcggcggctgggacacacgctgggtactacttgtggaaagtgatgcttgggatgagcatgtgcatttgttggctttcgaccattaactgcatcggggcgggatacttggttgttcaattgatcctctgatgttggcccttctgcatcatccagcaaggctcggaagtctgagctattaaggtccggttgacggataagaggccttcgatatgttaagggagagaggggagagtcattccagagttgggtgggaatcgttgatagaaattttattttccctgaggtatgatagcgtctgaactaaagaaagggaatatggaaagtgaatgtggtaaaggataccaagagccctgaatgatttttaggcgtcttttctttgaacaaataaatctataaagaaaattggatggatcttccacctatgctatgagtgaatcttatcatcactggcgagtggtatcgtatcaccgtcttcgtcctgaaaacatctgcagagctaagccagtgtaggctttgacactacttatattcgctacaagtattacactcgcttcgctacactcttctcttatgcttcgtgcttcgcataggctaaataagccgctcatccctggcgaatcctacccacattggaatgcggaaccatcggggaaaggcaaaacatattcaatcccaggagagaagtcactggttcgataggaccagggagaggaccctgatcaccttgccaacgaattcaaggccttagaaaaatcatcctacaatggaccatagggactgagaacgaagaagacatcaaaatcaggttagggggggataaaaagaaaacctcctcccattcaaagtcgtcttcaagtacctttttgattctttaccgagtacatcagtattaaatcaactataggttcgagtttagccaagatacgtacacggctaagtgtattaaaatccaagaaagaatcagggctatctaaaagctaggaaggagaagaccgggtgattgaatatgacttgctaacagatcctactcttccttaagcgctagttctattcacgatggttcagtttcgagaacagctaaagtagttacctaataagatagatgaatattccacgatctacgattatcaaaatcttcttatagaagtctagttctttcttcttttagaaaaggaagtcttgctctcctttcttgccgctacttgcgttgcgagccaatcttcaaactgttacggagaagtcgtttactgattagctgcttgaacgtggaaatatttcggcatatctgctcttaggttagtacgagaactcgactctactcgtgctatagtcgaggatgtacttatactaccctaaagagggatcaattaatggggtgcatttttttttaaggcaattctaggcaaaaccttgaatcacagggtttgttcctggcaacccagcattccttatcttggcgtagattggtgtgatgggaccgtgaaaaagcttttttctttgaccggaatcgacaagtgtgaacccatctaggatgagtcaaacatagggagaagggcctccaggcaatatccggcatactagtaatcgattatttggccttttgcgatcgaacaacctatgaacagttgtagcctacataacctacctacccagaccaagggaagaaggtatcagatcactgtagttctagaccccttttttttcaaataaaggaagtgacaacgtttgcccgaagaggttgaatcaatagtaagaagataccacccaggcacagaatccgaaataacaatcaggaataggactaggagaatgaagtctaattaacggagtaaagcagtaattgggcttagtgctccgattgcgccttaggactaggactgataggtaaatgccccttactcaaccaatgaaggcgggtagggcttttctttcttttgtttaggattggcaagaggatggctgcctcggcttcaaagctgttagagaatgcgctcttatcactacagggacgcgagagaaattccccgaagtgagaccagagagagaagagttttcccacaaaccatagcgactagctagtctcaaaacaaaagagttctttttacagtagcggggttgggaaagtaaggaaagtcaagcccgatgattctgtgggaagggacggatttcaaattcctttttccttcctttttacgccacctccacccaatccttgaagatatgaagcaatcttttattaagactaagtgaaggttggtatggcccaatcccatcatttaaatgagagtggatcgagggaatggaatctagactatagattgaactagactatcaattcaatctattcatctcatcttccattttagaaagtagcaagcagcgaataaaacggctgcagcaagaagtttcgcactctaactcgaaacggatttcgcgcattgaaagcccttgctttgttccccttcctttaagttaaagtattcgaaactcttcctagaatttgagagtttatttagtatagaatagggggagaagaataatgaaagtcgaaagatgaccggggatgtgttaaaagagatcaattgaagcgtcgtcaaaatggaggcatttggcaccaatactcaattaactcctaattaagcacaaaagtagccttattcggatcactccacacccggacagttcgcccatggccaatacgccagatgctggattccttggttttagttagtcgctgctctttgccatggcagtggttgatcctctcgtcagaggtgggtcggtttagtcatcagctcgagaggacaggggagagataggagacaatctatgtaaccttagcctaccccaatagtaagtatcggaaaaaggactccttctcgaaagagataggcagtcatcgcattatctacttgattatgatattgattttgatccaacggataatgcaaatcgagggctcgcccacctataaattaaataaattcaagtgaaagttcagtacgaactggtagagcgagagcagctagtttagaaggaaaagaaaaagggcgcctactcagtggtaagttaggtcattcctttccggctatcagaaaagagtatgatcgagggtcccataaggcaaagggaaggtgctcccccgacctactaccctcggagagattcctacggttggtttgtcttttattcaataatacataggtgggaaagtggtatgaatatggggttcgaagtcgcctaaaagaaaaagtatcattcgcaaagctaaacaaagtagagaaaagggggtcatcccattggccagactgagcatcaagccagccaagaagtaaaagctgagaaggagtgactcgcatgagtcaacacttactactcaggtccggtagagcaatctcaaattatcatatagaaatgttaatgttatgatttcggtattgatcaaaaggtgctgggaccttagggcatacattagtgccatgccctattgcggaacggtcgtatcctggtaacctagcccccgtaagagctctacctaatcgtcggggtagaaggctgtgcttattctcggcaaatagctaagtcgacaccccgagggagcaactcaactcttcgtagatcaaaacaagtgttcactggaaagtggatcaaagaaaaaaacttcttcgtttcgttggaaaaaccgacgccaatatcatattgactctctctcgtccaataagagtttccgagagttactttattcaaattctctcctttccaaagctccacaaggcaggcaaaaagagtaataggacaacaagcaatcttgtctttcatttatttggagttctttctttgttgagatggaaatcgacgttcttttgaaaagggctaggtagtttgcacgcaggcaaaacttcttcatgaaaggtaataaatagacttttttttcatgggtttcttaatgactagtcgttcgtttgaagccttaagaaaccggcagttttttttccgaatgaccttatttcgagaatcaactaaccgacaaatccgtagcccaggtgattcgctgcctccctctcgccaaaatgggatgaatcttctcatgcagcttttttcttgttcagggcgcagcgaagccaatttccatcaaggcaagggggtaaataagggggaagaggagttgtcacgatagaaaagagaaatgactataaggaaccaacgattctctcttcttaaacaacctatatactccacacttaaccagcatttgatagattatccaactccgagcaatcttagttattggtgggggttcggttcgttagcaggtatttgtttagtcattcagatagtgactggcgtttttttagctatgcatcacacacctcatgtggatctagctttcaacagcgtagaacacattatgagagatgttgaagggggctggttgctccgttatatgcatgctaatggggcaagtatgtttctcattgtggttcaccttcatatttttcgtggtctatatcatgcgagttatagcagtcctagggaatttgtttggtgtctcggagttgtcatattcctattaatgattgtgacagcttttataggatacgtaccaccttggggtcagatgagcttttggggagcaacagtaattacaagcttagctagcgccataccagtagtaggagataccatagtgacttggctttggggtggtttctccgtggacaatgccaccttaaatcgtttttttagtctccatcatttactcccccttattttagtaggcgccagtcttcttcatctggctgcattgcatcaatatggatcaaataatccattgggtgtacattctgagatggataaaatagcttcttacccttatttttatgtaaaggatcttgtaggtcgggtagcttctgctatctttttttccatttggattttttttgctcctaatgttttggggcatcccgacaattatatacctgctaatccgatgcccaccccgcctcatattgtgccggaatggtatttcctaccgatccatgccattcttcgcagtatacctgacaaagcgggaggtgtagccgcaatagcaccagtttttatatctctcttggctttacctttttttaaagaaatgtatgtgcgtagttcaagttttcgaccgattcaccaaggaatattttggttgcttttggcggattgcttactactaggttggatcggatgtcaacctgtggaggcaccatttgttactattggacaaattccttctttctttttcttcttgttctttgccataacgcccattccgggacgagttggaagaggaattccaaaatattacacggatgagactcatcgcaccggatcagtctcttagacggatgagactgatcacacctgatcagtgatcaattctggcacaatgaatttacgagttattttacacaatgaatttacaagcagatgagtttgcaacggtagacctatctcctgaaaagagttcagtaaacaagggaacgaagcgaccgataacgtcccctcggggaggagtgttttaagggattgacttcggctcctattatctttgtttacaaatcttaaaattggtgaattggttaataggaagtgcgcgctagcacgcttcatatttctagtaacaagggcagttgcttgtttggtcgttacatcagagggcgctcatcccttgctcggtccctgaaaatgagataacataggcttttgatatctgctctgtcaacaagccctggttcaatccctgcttcttccgggccttatcccgaaagaggtcaacaattctttttgtgtaaagccttttgttcactggtcttcacttcaagcaattccattagtccaagtctgctgcaattggtaataggagataagcaattggtggtcgtaggctcactcacctctagctctttttctttgcgatgaccccgtccttgttgaacatccgtcctctagcaaaaaatctatcttctcctgtatgtagcagcagtggcattcgactttgaagtaccaggaaagacgttcctttcgaatccccagataagagtttttgagcagccatacatataagaatccgactaatccgataaatatagcactagcacttcatcttccagcacctcatccactcggaccaaggactctctctaggctcccgccccccatgagaaaaattactcgcagaactacaaggcaacataggatctattaggggcttcggcacgaacatagacaacgttcaggcatacgaagatctaccagttttgcataaagattccggacctaccgaataccttttttaaaaaaggatggctcaagtagccgctctggatcttgctcgatcttccttggcttccgtgctctttgacacaaccatcttcagtctttacttagccgccggagcaagagtgaatttgatcataccatctgccttatcttatcaaataaggataatttggctaactccctgttatatgtgttttctttttctgtgaatagttagaggcatgatgtactataggagagctttgaagcttcaagcgttccttgacatggcttctgaatctggtaagcttcttcagattccaggtggagcattatttttagtgccttcaaaaatagttactgatctgtgccctgtatttctttcaagatattggaaggatataaagcagttgcagatccagcagaggaggagaagaaaagccaaagatctttgtcctctcaactcgaggctgtagcagacatgaaatttacatatgttgctacttgccagatatacggaaatctgaaacaagctggtgatcggcgtgcaacagatatcttgaacttgatggtgaagtaagtcatttcttccgagaaataaataagaattggaacattttgccaattacaagatacgacatatctaagatctaagatgttttttgttcaattttacgagactagttcagttgatgtttacttcagtagttaacatttaattataattaaatctcccaaaaaaagagaattgctttgaggtaatttcaatttcaattccaatttcaatttgaaactacagttaccccggtctgcgtgtggcatacattgatgaagttgaagagagggatggtgacaaggtgaagaaggtcttttattcagttctagtaaaagctctcgacaatcatgatcaggtaggcatacccacaaagtagaagtctttaccattccaaacctatgatgtcaacctcaatagcgcttacactttgtatcctgtgaaggaaatataccgtataaaattgccaggaccagcaaaattaggtgaagggaaacctgaaaaccaaaatcatgcgatcatttttacccggggtgaagccctccaaactattgatatgaaccaggtgaattgagtggttatggtacaggtcatgatatatgttgcaatatgtgttgtatttacgaattatcttcaggacaactatttggaggaagctttgaaaatgcggaatttgctggaagaattcaacgaaaaccatggtgtccgtcaacccacgattcttggagtgcgtgagcacatatttaccggaaggtaggttgaaaactttgcagttatcattgcattttcttcaccttagttcccaaatcagcaactaatttctgagaatgctggattgtagtgtgtcgtcacttgcatggtttatgtcgaaccaggagaccagctttgtgacaataggacagagggtcctagctaatccattaaagtaagtatgaatcattttcttatgtcatattggaatgaaacaatatccattattatcatactgtaaacactgagtgtcttatatgttgcaatacgatgttggatctgctgagcatctgtggtgactatcccctagaaaaagattgcgagatgaccctttaaggatattctttctgcccttgaaaatgcacatgaacatgtgtctgagattacaagtaaataaggtgttacagattagatcaataatctacattgcttgaaactttttctgcattgaagcttttcaagtttaagcatgttgacgggataaagtgtggcagtactgtctgagagggcagaaggcatcagacttgtagtctaaatgctgtgtatctgacatacttcattctctgtgcagggtacgatttcactatggacatcctgatgtgttcgacaggatttttaacattacaagaggaggcattagcaaggcttcctgtggtataaatttaagtgaagacatttttgctggtatgtgattcttcatgtatcttcttaatgaaacacgtgctcaggcacattctcgaaagaagtgattcttcatgtatttctggctgttacccatttatgctcttgaaggcatggagttgaatattgttttcaggtttcaactcaacgctaagacgtggaaacgtcacccatcatgagtacatccaagtgggaaagtcggtcttaatcaaatttatctctttgaggatattggctatataatttgaagaaggaaaagctcataatcagcagagatatctacaggcttggtcatcgctttgacttcttccgaatgctttcgtgctattttacaactgttgggttttatattagctcaatggtaacgtatatagggcagtagcatgcattatatttgttactgtacagttggccgtcatgcatattttatcatgttcttgtcttaatgttgtgcagatggttgtcataatagtgtatgttttcttgtacggaagactttacttagcattaagtggacttgagtttgcaattatgaagcaagcacggatgagagggaatcgtgcacttcaagcggctatgggatctcagtctattgtgcagctaggtcttttgatggccttgccaatgtttatggggattggactagaaagaggtttcagaagcgccctgggggatttcataatcatgcagcttcagctctgttcagtgttcttcactttctaccttgggaccaagtcacattattttggccgcacaattctccatggtggtgcaaaatatagagcaactggcagaggttttgttgttcgccatgtaaggtttgctgagaattacagaatgtactccagaagccattttgtgaaaggacttgagctgatgttactgctagtagtctatcagttgtatggtgatgttgctacggattcgactgcctatatacttctgacatcatcaatgtggttcttggttatcacttggctattcgctccattcctcttcaatccatcaggatttgagtggcagaaaatagtagatgactggaccaagtggattagcagtcgaggtggcatcggggttcctgctaacaaagcttgggaatcccggtgggaggaggagcagcaagccgccccattgcctttatgagcaaacctctcggccctttcgtggtctctcaacgtacgagaaggaatgcctcgccatccttatgtagagcaatggtgcccgtacttgcagcattctgaattcataattcgaactgatcagcgcagtctcgtgcatttagaagatcaacgactacaccttggcagcagaaggccttcactaagcttcttggacttcaataccgacgcaagggagccaagaatggagcagctgatgctttgtcccgacgcagccatagagtcgatcccgcagataggcggaggtacgattgcttgctccttgcatgtgaaggtgggaaacaaggaaacagaggaaatgcttactgggacatagccttcggtacgagttgaagggaagaggattgcttggaacctctaagacatggcacccctgccctagccgccttttcttatgatgtctcgaaagcggattcttactagctcactggctataaaggttctcacttgctttcaatcgctctaatggaaagaggacggacggatggattagcaaaaaggaaagaatgagaactggtctgcaaacaattcctgcctatagagcttatttttgctcgcaacaaacaaaaatcaaaaagaaagaagagaacgaaaggaaaacagaactttgtatttggtaactcccctgtagttatgtttaaccttgaatgcaatttataaattcgacagcaatagtccctcggactcgaaaagtaataacgaaaatggctaatccaatagcagattccgcagctgccactgttggaactaatgaagcaaatgattgacccatcatatcatccaaagaaacggaaaataccaaaaagttcaaattgacagctaataacattgattcaattggcattgacataataagaatatttcgtctattaaggaggattccccgaatacctaaaatagagatgatcatagaaaaagtgaaatattttataggatccgtttcggaaacatggaatgtcagagaaattcaaattatgtgaggcctagaaagaagtcctgcgtagagtccagggagagcctatttggattttttctctagttaccccttctcaaacaacgcgtttgatttccttccttataccaaaggaattccatctttctcttgccgatcacatccaagggtcgaatacatcctgtctttgaacctttgtagtcctatgcatagtcagtactatagcctcactagtcctcgtcgaggaatctccttgccgccctagaagtttgagatcgtgcccgaccgttttggagtctgttcaggagctccttcagcgcccggggattgacgtcggactggagtcggctcaacatgaaatcaagcatggtgcgatagtcttcttcatggagctcctctccattcttcagagtaatatcacgcaatgtgtccagaatctgggcgtgacaggcgcgggccttttgtagagaactttcctttcaaagagagagaggtcgtccctcccaagaaaaagaaggagggttctgttctgcttccgcggccgctccagggattggagcgggattcggatgccgctcttgactgaccacagcttccgggggagcggtctgctcctgggatgcagaggtgtcctcacagtcagccagaaaacctttgaatagctcttccgagttagtggatccggagggaggcattgaagggcctgggtcccccattccgtcccagtcggactcggagcgaagcatctcccaacaagatttgaaaaaatcattatccccaacctagggctggtcgagtatgaagaaaagacctatatgggattcggattaccgaatatgtcgcttagactttactttttcccctttctgccctttcctctatttgtttgatagggtcttcgtctccgtgtaaaagcaaactctccaaatttatgaccaacctttccttcagtgatcttacaacgaacaggagtttttccattgtaaatgagtacggagcaatcaacgaattccggcgaaatagaagatctacgtgaccaaattttcctgctcatcagactttctctgttcttctttattctaaacaggaaagcatcaacaaaacttcccttccatatagatcgtcgtggcatgaactaaattctgcgtttccccacccccactcctgcccgaaatcctgctttggtgggcttcccccaaggtgacaccgaaggtctacctcctttcgtgcgcccctcacctcctccatgaggatgatccactggattcattgcaacaccacgaacaatggggcgtctgcctgaccaccggctttgtcctgcttttctaagcttacgtgcaccatggttgggattggaaactataccaatagtagctcggcatcgggaatctatgaatttttcaacacccgatggtagccgcacaagacattgtggggctggctccttaattattttagcataagttcctgcggcccgagccagctttgcgccttgacctggatgacattcaatatcatgtacccatgttcccatacgtatatcagctaatggtatgctatttcctacttttgaatttagatccaatatctcgtgtctataagcaggggggcgtggccaagaagctgccagctgactgcccccttcaacccgacctttattcactgtgcgtccaagctcttggaaccgaaggtatgtatgagcattctgggcaggtcgcaagaagccgcttttagaaggtttggagcaatcgcaatttatcaccatattacccgcttccaattgatgactggctaatatataagtgttgacctaagcccctgtgcagtggctcggctcccgaaccgtacgtgagcagcctcgtacggctcttcctaagaaggtcgaagcccccctctataaataagttcgaaaaagccttcgccctcctattcaacggggttattagagaagctgcttcgttccttgacttctttgctttttattttggaagggcttcgtttctgataccggctttcttagttacgagctcactttcgctgacttcttccttagtgtagtctcggtaactactttaagactccgttccttagcctagtctatatccacagctgacgtaccgacgcctttccctttgtagacggataagtgagtctgtaacctttacgtacttttttcatactttttcccatcaggtctaacgggctttcgtcccttcgcctataggcggcttcgctatcgctcatgacttggtatagaaatttctccgtgtagtgtagtggtcggccttcccatctccatgcctccttccttacttttcttataagcccttgactatgcaaatctaaaggacagggggctgttcacctttgcttttgaaacttagctataatgaaaaaagaaagaaaaactcaagactctagtaaaggcaaacggggctcccggggcgtctggcagaatgcttggcctcctgcgccagaagctcacccttcgggtgtcgcttctggcggttagcttaacgtcagtaggcattctgggctggaaggaggcaagcaaatgaagggaggcatggagggccaactacaagaagcaaagctttgtaaactcgacaagtcgcttatagaatgccgactactttttttcataaggggggaagcgaagcttagcgagctttaattggccgaccactacataagccgctggcggagaaagctcgaagagctttctccccttcattcgtagctaagccaaggtctcaggtctccgagtcagcccgcgctttttcgaagaatcctgcacccatgagcatacggcctggcaggccttccctttgccggagcttcatgggcgttgccccgttccccaatcagatgtttggatgtgagctatactccgcgaggagccacacgggcgtatggccttttgctttgccatttgacctctcttcccgtgtgagacggaatgctcagtgacaacctctcaattgtcaccgccgggcctctcttgctaccacggtagcacctagtgtggtcagcaccaatcgtgttcgggcaacgaagcttacactcattcacattggttcatcctgctatgccccgggccttttgctcttctaacaacaatggtgaacggccatttgtcaaggccccggaatccgctggacatcccagcggcgggattggatacccgcatcagatcgaagttccatttttttgcctcctaaaaggagagctgtttctaggtgggtcgcttcgcgaaagacattgcttaggaccaacgggtcacacgacaggtgcacgatcgactttgtacgctccatccttcggcccttcgcctataggcggcttggcgggcaagctaccgaagcgactagcttctaccggaagcaaagctttgtagaagcttctagaggcatgaaggtaggaaggccgaccactacataaagcgtaagcaagcacttgccttgggagcaagctaccttgatccgccttcagcttcgattcgttatgctcagcagctccaacaagttctaaagttttttgctgcctcaaactctgccaagaaagcgctgctttacgtttgatcctatgtgcccagagaacgcaatgcgttctccactttcggatctcgcaaagagaaaacgtcttttttccgattttcttctctctcattcgctccgcgaagaaagcgggctttgccccagctaccgctatccttgggaaacctaaagagctgccgaaggaaagggatgcagtctctccctgggccaagggagaggacagggaagagaacgaaaaaaggcaaaagatagtggccgtggtggattcgaggatcttacgcggcagagcgaactcttctatcgtcttgaatttcctctggcggccgggcagcaccccttcgatccatcgtactagagcgatccgagaagaacgattagggtcatattcgatcctttccacaatgccaatagacgaagtgcttcgtttaaggtcaatttttcgctgcaatcgcttcgatccaccccctcggtgaaaaacagtaatacgcccggaagaattcctccctgcggacttccccgtactcaaagtgaaatgtctaagcgctctcccctttatgctttgtctcattctatctctcgtcatcactcgatgaaacctctacttcaatgaaagctcctcctactactcccccttatccttctcactcgtcgtttcgttggtcttttatatacccattttcattccatttggacccctggcaaattcgaactttcgttgaaattgtctctattcatatgtatgaaatacatatatgaaatacgtatgtggagttcccgagaatttcatgtgatttagtaaacagaatatagattccataattgctagatcgatctgtagggattgatgaagagtgagctgataatggaatttttcttcgataaacaggaaacttaagattaagatgctccggaatggaaatgagggaatgtccacaatacccggatttagtcagatccaattcgagggattttgtaggttcattaatcaaggcttggcagaagaacttgagaagtttccaacaattaaagatccagatcacggaatttcatttcaattatttgcgaaaggatatcaattgctagaaccttcgataaaagaaagggatgctgtgtatgaatcactcacctattcttccgaattatacgtatccgcgcgattaatttttggtttcgatgtgcaaaagcaaaccatttatattggaaacattcctataatgaattccttaggaacctttataataaatggaatataccgaattgtgatcaatcaaatattgctaagtcctggtatttactaccgctcggaattagaccataaaggaatttctatctacaccgggactataatatcagattggggaggaagatcggaattagcaattgataaaaaagaaaggatatgggctcgcgtgagtagaaaacaaaagatatctgttctagttctatcatcagctatgggttcaaatctaaaagaaattctagataatgtttcctaccctgaaattttcttgtctttccctaatgctaaggagaagaagaggattgagtcaaaagaaaaagctattttggagttttatcaacaatttgcttgtgtaggcggggacctggtattttcggaatccttatgtgaggaattacaaaagaaattttttcaacaaaaatgtgaattaggaaggattggtcgacgaaatatgaatcgaagactgaatcttgatatacctcagaacagcaccttcttgttaccgcgagatgtattggccgctacggatcatttgattggaatgaaatttgaaacgggtatacttgacgatgacgatatgaatcacttgaaaaataaacgtattcgttcggttgcggatctgttacaagatcaattcggactggctcttggtcgtttacaacatgcggttcaaaaaactatccgtagagtattgatacgtcaatcaaaaccgactccacaaactttggtaactccaacttcaacctcgattttattaataactacttacgagaccttctttggtacatatcccttatctcaagtttttgatcaaaccaatccattgacacaaacggttcatgggcgaaaagtgagttgtttgggtcctggaggattgacggggagaactgcaagttttcggagccgagatatccatccgagtcactatgggcgtatttgtccaattgacacgtccgaaggaatcaacgttggacttactggatctttagctattcatgcgagaattgatcattggtggggatccgtagagagtccattttatgaaatatctgagaaagcaaagaaaaaaaaagagagacaggtggtttatttatcaccaaatagagatgagtattatatgatagcagcaggaaattctttgtccttgaatcggtgtattcaggaagaacaggttgttccagctagataccgtcaagaattcctgactattgcatgggaacagattcatgttagaagtatttttcctttccaatatttttctattgggggttctctcattccttttattgagcataatgatgcgaatcgagctttaatgagttctaatatgcagcgccaagcagattcgagggtttctgttatagccgaacgcgagggaaagatcatttctactaatagtcacaagatccttttatcaagtagtgggaagactataagtattcctttagttacccatcggcgctctaacaaaaatacttgtatgcaccaaaaacctcgggttccgcggggtaaatccattaaaaaaggagaaattttagcggagggggctgctacggttggtggggaacttgctttaggaaaaaacgtattagtagcttatatgccatgggaaggttacaatttggaagacgcagtattaattagcgaacgtttggtatatgaggatatttatacttcttttcacatccgaaaatatgaaattcagacggatacgacaagccaaggctccgctgaaaaaatcactaaagaaataccacatctagaagaacatttactccgcaatttggacagaaatggagttgtgaagttggggtcctgggtagaaacaggcgatattttagtaggtaaattaacgcctcagatagcgagcgaatcgtcctatatcgcggaagctggattattacgggccatatttggtcttgaggtatccacttcaaaagaaacttctctcaaactaccgataggtggaagagggcgcgttatcgatgtgaaatggatccagagggatcccctcggcataatggttcgtgtatatattttacaaaaacgcgaaatcaaagttggggataaagtagccggaagacacgggaataaggggatcatttcaaaaattttgcctaggcaagatatgccctatttgcaagatggaacgcctgttgatatggttttcaatcccttaggagtaccctcccgaatgaatgtgggacaaatatttgaaagctcgctcggattagcaggggatctgctaaagaaacattatagaatagccaccctttgatgagagatatgagcaagaggcttcaagaaaacttgtgttttcagaattatatgaagccagtaaacaaacaaaaaatccgtgggtatttgaacccgagtacccgggaaaaagcagaatatttgatggaagaacaggagaccccttcgaacagcctgttctaatagggaagtcctatatcttaaaattaattcatcaagttgatgagaaaatccacggacgctctactgggccctattcacttgttacacaacaacccgttagaggaagagccaagcaagggggacaacgaataggagaaatggaagtttgggctttagaaggatttggtgttgctcatattttacaagagatacttacttataaatctgatcatcttatagctcgccaagaaatacttaacgc

SEQ ID NO: 3215 - DNA, 6703 bp, Brachypodium distachyon
ataaatatgatacatagccctttcttattaataaaagaataaggaaacgctatctcatccctattggtatcggtttgggccactactgctaaaacaaaccccagtttgaggaaagaacggtgggttctcaaaatccagtatcgccgagccttgttattctcttgccccaacttatgcggggtgcaaatttgtcgatttggatcagtactataagcctaagtattttattgatcaggcggcacccagatttgaactggggataaaggatttgcagtcccctgccttaccgcttggccatgccgccaaaaaaatacgatctaaaatcgagaaaagagcaagtattcatccacgtttcttactaaaactaactttcttttatcttaaatctaattctacttacttttttccaatctttttcaaaaaatctattcatgctttttttggatccagtttcgattattctcctcaaaggattctatcttaaaacacacattgctaacactagaaaacttcccttttctttctattgaaatgaaaaaggagaaaagtggatttctagtcacaagctacaaaattaagaacaaattggaaccattaactagaattctctttttattttgaatttcggtattctctcccgcctgccatttaatgtcataataaaagacaatggatttatgcctaatccgtatataggtaaactccaggtccgaacagcattattatctatggatcccccttatgtacatatctctgtggagaatcgttctttaatttttcattgcattaaatatcttgaataaaaaaaaaagaaaattgactttgctatgtggaggtccagaactagattggcatgtacttaaaaaagtacttactttattttaggattctacaacgaaatcttatatcttatattttatagaaattctactactacgaaacaaaaaagaaccttcaaattcttttttgaaattaaactaagcgtgctattctcaatcgaactaaagtcaaactttctagtgcttataaattattatattttggttttatcccattcatagaaaggagaaaaaatgagaaatctttgccgtccaatctaagaatatcataaactgtaagtggcagaatttttttcgaggttctaggaatgttttatcacttcattttcattccatttggacccctgggaaattcgaactttcgttgaaattgtctctattcatatgtatgaaatacatatatgaaatacgtatgtggagttcccgagaatttcatgtgattcagtaaacagaatatagattccatgattgctagatcgatccgtaggggttgatgaagagtgagctgataatggaatttttcttcgatacacaggaaacttaagattaagatgctccggaatgggaatgagggaatgtccacaatacccgaatttagttagatccaatttgagggattttgtaggttcattaatcaaggcttggcagaagagcttgagaagtttctaacaattaaagatccagatcacgaaattgcatttcaatatttgcgaaaggatatcaattgctagaaccctcgataaaagaaagggatgttgtgtatgaatcactcacctattcttccgaattatatgtatctgcgagattaatttttggtttcgatgtgcaaaagcaaaccatttctattggaaacattcctataatgaattccttaggaacctttataataaatggaatataccgaattgtgatcaatcaaatattgctaagtcctggtatttactaccgctcggaattagaccataaaggaatttctatctacaccgggactataatatcagattggggaggaagatcggaattagcaattgataaaaaagaaaggatatgggctcgcgtgagtagaaaacaaaagatatctattctagttctatcatcagctatgggttcaaatctaaaagaaattctagataatgtttcctaccctgaaattttcttgtctttccctaatgctaaggagaagaagaggattgagtcaaaagaaaaagctattttggagttttatcaacaatttgcttgtgtaggtggggacctggtattttcggaatccttatgtgaggaattacaaaagaaattttttcaacaaaaatgtgaattaggaaggattggtcgacgaaatatgaatcgaagactgaatcttgatatacctcagaacagcaccttcttgttaccgcgagatgtattggccgctacggatcatttgattggaatgaaatttgaaacgggtatacttgacgatgacgatatgaatcacttgaaaaataaacgtattcgttcggttgcggatctgttacaagatcaattcggactggctcttggtcgtttacaacatgcggttcaaaaaactatccgtagagtattcatacgtcaatcaaaaccgactccacaaactttggtaactccaacttcaacctcgattttattaataactacttacgagaccttctttggtacatatcccttatctcaagtttttgatcaaaccaatccattgacacaaacggttcatgggcgaaaagtgagttgtttgggtcctggaggattgacggggagaactgcaagttttcggagccgagatatccatccgagtcactatgggcgtatttgtccaattgacacgtccgaaggaatcaacgttggacttactggatctttagctattcatgcgagaattgatcattggtggggatccgtagagagtcctttttatgaaatatctgagaaagcaaagaaaaaaaaagagagacaggtggtttatttatcaccaaatagagatgagtattatatgatagcagcaggaaattctttgtccttgaatcggggtattcaggaagaacaggttgttccagctagataccgtcaagaattcctgactattgcatgggaacagattcatgttagaagtatttttcctttccaatatttttctattgggggttctctcattccttttattgagcataatgatgcgaatcgagctttaatgagttctaatatgcagcgccaagcagttccgctttctcggtccgagaagtgcattgttggaactggattggaacgccaaacagctctagattcgagggtttctgttatagccgaacgcgagggaaagatcatttctactaatagtcacaagatccttttatcaagtagtgggaagactataagtattcctttagttacccatcggcgctctaacaaaaatacttgtatgcaccaaaaacctcgggttccgcggggtaaatccattaaaaaaggacaaattttagcggagggggctgctacggttggtggggaacttgctttaggaaaaaacgtattagtagcttatatgccatgggaaggttacaattttgaagacgcagtattaattagcgaacgtttggtatatgaggatatttatacttcttttcacatccgaaaatatgaaattcagacggatacaacaagccaaggctccgctgaaaaaatcactaaagaaataccacatctagaagaacatttactccgcaatttggacagaaatggagttgtgaagttggggtcctgggtagaaacaggcgatattttagtaggtaaattaacgcctcagatagcgagcgaatcgtcctatatcgcggaagctggattattacgggccatatttggtcttgaggtatccacttcaaaagaaacttctctcaaactaccgataggtggaagaggacgcgttatcgatgtgaaatggatccagagggatcccctcgacataatggttcgtgtatatattttacaaaaacgcgaaatcaaagttggggataaagtagccggaagacacgggaataaggggatcatttccaaaattttgcctaggcaagatatgccctatttgcaagatggaacgcctgttgatatggttttcaatcccttaggagtaccctcccgaatgaatgtgggacaaatatttgaaagctcgctcggattagcaggggatctgctaaagaaacattatagaatagcaccctttgatgagagatatgagcaagaggcttcaagaaaacttgtgttttcagaattatatgaagccagtaaacaaacaaaaaatccgtgggtatttgaacccgagtacccgggaaaaagcagaatatttgatggaagaacaggagaccccttcgaacagcctgttctaatagggaagtcctatatcttaaaattaattcatcaagttgatgagaaaatccacggacgctctactgggccctattcacttgttacacaacaacccgttagaggaagagccaagcaagggggacaacgaataggagaaatggaagtttgggctttagaaggatttggtgttgctcatattttacaagagatacttacttataaatctgatcatcttatagctcgccaagaaatacttaacgctacgatctggggaaaacgagtacctaatcacgaggatcctccagaatcttttcgagtgcttgttcgagaactacgatctttggctctagaactgaaccatttccttgtatctcagaagaacttccaggttaatagggaagaagtttgatcggaataaatataaattcttttcttatttctattttatgattgaccaatataaacatcaacaacttcaaattggactcgtttcccctcaacaaataaaggcttgggctaacaaaacactacctaatggggaagtcgttggcgaagtcacaaggccctccacttttcattataaaaccgataaaccagaaaaagatggattgttttgcgaaagaatctttggacccataaaaagcagaatttgtgcttgtggaaattctcgagcgagcggagctgaaaacgaagacgaaagattttgccaaaaatgcggagtagaatttgttgattctcggatacgaagatatcaaatgggatacatcaaactcgcatgtcccgtgactcatgtgtggtatttaaaaggtcttcctagttatatcgcgaatcttttagataaaccccttaagaaattggagggcctagtatatggcgatttctcttttgctaggcccagtgctaaaaaaccaactttcttacgattacgaggtttattcgaggatgaaatttcatcctgtaaccatagcatttccccctttttttctaccccaggctttacaacatttcgaaatcgggaaattgcgacaggagcaggtgctattagagaacaattagcagatttggatttgcgaattattttagagaattcctcggtcgaatggaaggaattagaagacgaggggtatagtggagatgaatgggaagatagaaaaagacgaataagaaaagtttttttgattagacgcatgcaattggcgaaacattttattcaaacaaatgtagaaccagaatggatggttttgtgcttattaccagttcttcctcccgaattaagacccattgtttataggtctggggataaagtagtgacttcggatattaatgaactttataagagagttatccgtcggaacaacaatcttgcctatctattaaaaagaagtgaattagcgccagcagatttagtaatgtgccaggaaaaattggtacaagaagccgtggatacacttcttgatagtgggtcccgcgggcaaccaacgagggatggtcacaataaagtatacaaatcactttcagatgtaattgaaggtaaagaggggaggtttcgcgaaactctgcttgggaaacgggtcgattactcggggcgttctgtcattgttgtgggtccttcactttcattacatcaatgtgggttacctctagagatagcaataaagctttttcagctatttgtaattcgcgatttaatcacgaaacgtgctacttctaatgttaggattgctaaaaggaaaatttgggaaaaggaacccattgtatgggaaatacttcaagaagttatgaggggacatcctgtactgttgaatagagcacctaccctgcatagattaggcatacaggctttccaacccactttagtagaggggcgtactatttgtttacacccattagtgtgtaaaggtttcaatgcagactttgatggggatcaaatggctgttcatctacctttatccttggaagctcaggcggaagctcgtttacttatgttttctcatatgaatctcctatctcccgctattggggatcctatttgcgtaccaacccaagacatgcttatcggactttatgtattaacgattggaaaccgtcgaggtatttgtgcaaatagatataatagttgcggaaactatccaaaccaaaaagtaaattacaataataataatcctaagtatacgaaagataaagaatctcttttttctagttcctatgatgcactgggagcttatagacagaaacaaatctgtttagacagtcccttgtggctccgatggaaactagatcaacgcgtcattgggttaagagaagttccgattgaagttcaatatgaatctttggggacttatcgtgagatttatgcccactatctagtagtgggaaatagaaaaaaggaaatccgttctatatacattcgcaccactcttggtcatatttctttttatagagaaatagaggaagccatacaaggatttagtcaggcctattcatacactatctaa

SEQ ID NO: 3216 - DNA, 2917 bp, Zea mays
acttgataaactttctcaccatatatagcatgcttaatgaaacttcgtaaaatgatgcagtttaatatgaaaacttgctcggaattagaccataagggaatttctatatataccgggactataatatcagattggggaggaaggtcggaattagcaattgataaaaaagaaagaatatgggctcgcgtgagtagaaaacaaaagatatctattttagttctatcatcagctatgggttcgaatctaagagaaattttagataatgtttcctaccccgaaattttcttttctttcccgaatgctaaggagaagaagaggattgagtcaaaagaaaaagctattttggagttttatcaacagtttgcttgtgtaggtggggacctggtaatttcggagtccttatgcgaggaattacaaaagaaattttttcaacagaaatgtgaattaggaagagttggtcgacgaaatatgaatcggagactgaatcttgatatccctcagaacaatacattcttgttaccacgagatgtattggccgctacggatcatttgattggaatgaaatttggaacgagtatacttgacgatgacgatgtgaatcacttgaaaaataaacgtattcgttcggttgcagatctgttacaagatcaattcggactggctcttggccgtttacaacatgcggttcaaaaaactatccgtagagtattcatacgtcaatcgaaactgactccacaaactttggtaactccaacttcaacttcgattttattaataactacttatgagaccttttttggcacataccccttagctcaagtttttgatcaaaccaatccattgacacaaaacggttcatgggcgaaaagtgagttgtttgggtccaggaggattgacggggagaactgcaagttttcggagccgagatattcattcgagtcactatgggcgtatttgtccaattgacacgtccgaaggaatcaatgttggacttaccggatcgttagctattcatgcgagaattgatcactggtggggatctatagagagtccgttttatgaaatatctgagaaagcaaaagaaaaaaagagagacatgtagtttatttatcaccaaatagagatgaatattatatgatagcagcaggaaattctctgtccttgaatcagggtattcaggaagaacaggttgttccagctagataccgtcaagaattcctgactattgcatgggaacagattcatgttagaagtatttttcctttccaatatttttctattggaggttctctcattccttttattgagcataatgatgcgaatcgggctttaatgagttctaatatgcagcgccaagtagttccactttctcggtccgagaagtgcattgttggaactggattggaacgccaaacagctctagattcgagggtttccgttatagcccaacgcgagggaaagatcatttctagtgatagtcacaagatccttttatcaagtagtgggaagaccataagtatttttacccatcggcgctctaacaaaaatacttgtatgcaccaaaaacctcgggttccacggggtaaatccattaaaaatgggcaaattttagcggagggagcagctacagttggcggggaacttgctttaggaaaaacgttttagtagcttatatgccctgggagggttacaattttgaagacgcggtactaattagtgaacgtttggtatatgaggatatttatacttcttttcacatccgaaaatatgaaattcagacggatacgacaagccaaggctccgctgaaaaaatcactaaacaaataccacatctagaagaacatttacttcgcaatttggacagaaatggagttgtaaggttgggatcctgggtagaaactggcgatatttttgtaggtaaattaacgcctcagatagcgagcaaatcgtcctatatcgcggaagctggattattacgggcaatttttggtcttgaggtatccacttcaaaagaaacttctctcaaactacctataggtggaatagggcgcgttatcgatgtgaaatggatccagagggacccctttgacataatggttcgtgtatatattttacagaaacgtgaaatcaaagttggggataaagtagctggaagacacgggaataaggggatcatttccaaaattttgcctaggcaagatatgccctatttgcaagatggaacacctgttgatatggtcttcaatcccttaggagtaccctcacgaatgaatgtgggacaaacatttgaaagctcgctcggattagcaggggatctgctaaagaaacattatagaatagcaccctttgatgagagatatgagcaagaggcttcaagaaaacttgtgttttcggaattatatgaagccagtaaacaaacaaaaaatccatgggtatttgaacccgagtacccgggaaaaagcagaatatttgatggaagaacaggagatccctttgaacagcctgttctaatagggaagtcctatatcttaaaattaattcatcaagttgatgagaaaattcatggacgttctactaggccctactcacttgttacccaacaacccgttagaggaagagccaagcaagggggacaacgaatatgagaaatggaagtttgggctttagaaggatttggtgttgctcatattttacaagagatacttactcataaatctgatcatcttatagctcgccaagaaatacttaatgctacgatctggggaaaaagagtgcctaatcacgaggatccgctagaatcttttcgagtgctcattcgagaactacgatctttggctctagaactgaaccatttccttgtatctgagaagaacttctaggttaatagggaggatgtttgatcggaataaatataaat

SEQ ID NO: 3217 - DNA, 36555 bp, Aristolochia fimbriata
ctaagtcccagtggtttccagaaatcctaggcactacttctgttatgtgagcccgcttagctcaggggttagagcatcgcatttgtaatgcgatggtcatcggttcgattccgatagccggcttttccatttattctatttttttccatgattgataatgtcttcttgagatcaagagaaattgaaaagacagaaattgaaaagactcttccattttctccaaatgtcgggtcaacatagtatgttatgggaactcccaactatgaataaaaaagaataaaaaaaggattcaagcccttagatctctacagaacaagaaggggatacttaacttcctatatataactctataaaataatccggttattgagacaatttttcccattcttctttatagtacttcagcgagtttagcttcgtttatcgtttagttcagtctaaatttttttattctgtgaaatagaatttcaataaaattaaggagtctttatgtctcgttaccgagggcctcgtttcaaaaaaatacgccgtctgggggctttaccgggactcactagtaaaagacctagatccgtaagggatcttagaaaccaaccgcgttccgcgaaaagatctcaatatcgtattcgtctagaagaaaaacaaaaattgcgttttcattatggtctgacagagcggcaattacttagatatgttcgtatcgctgggaaagccaaagggtcaacaggtcaagttttactacaactacttgaaatgcgtttggataacatcctttttcgattgggtatggcttcgaccattcctggagctagacaattagttaaccatagacatattttagttaatggtcatatagtagatatcccaagttatcggtgtaaaccccgagatattattactacgagggatgaacaaagatcaagagctctgattcaaaattatgtggatttatccccccacgaggaattgccaaaacatttgactcttgacccattacactataaaggaatagtaaatcaaataatagatagtaaatggatcggcttaaaaatcaatgaattactagtcgtggaatattattcccgtcagacttaaacttaattaaaataattaagctttggacaattttgtccacccggtttcaccaaacaaagtaaatagaactaagctaagggatttaatctggattttccccatttgtatatcgcaagtggatccgcggttagattctcattccttgtctaccctttccgatattttatctaccacagtaattggcaatagagaatcactagaaaagaaaggccctactcttggggtatccattgttatttgatacattgtggttggtaacgttggtgaatttggtgtaagtcaaggtacggaaagagagggattcgaaccctcggtaagcaaaagcctacatagcagttccagtgctacgccttgaaccactcggccacctttcctgcggaatcttaggattattgcccggaaacccagtgaatagcgagtcattcatattattgaattgtattattgcaataacaataaaggtacgaccgatcgattataaatcgaaaactttccgtcaaagatcttccttggaggctcgagggataaaacacatttttttttattgaatattaacttaatattatattaaaaaaatgatctattcatctttatctattcatctttgtcaagacgatggtcctctccatcttattcggatatttataccggattaaacaaccaatgaattgggacgaatccactaactctatagtattttatactatggttatatttagaggtcggtaggaattacaaaatgcatttctagtttattcagatttatcaacagcaactcttctcatgagccaccccatggatccattataaaaaaattcacggtcgccctatgatttttatattatatttccattgtattgtttgtgtatacgcgctattcaccaaaaatggatgggttggttattctattttcatcatggaatgattatttgattctttttactctttggatcataatataataaaataaaaaaataaataaataaaataaaaactcctcgagttagatcagaatctgtaggaaaaattctttgattccttaacttcgctaaaatgaggagtaagagttctgttcattggcataaataccacattgggctgaaatccaatctgattccaatatttcctatctatccctgtcttaacttaaaagggacaatttttggggtcttttttttttttacaattactccgtttttatgtgatttcgtactgtacaattcctttgtttatgggagcattttccctcaagggagaggataatgagaagaattatggaatgggttgtaaactatgcctagatctcggataagtggaaattttattgataagacctcctcaattgtagccaatatcttattacgaataattccgacaacttcaggagaaaaagaggcatttacctattacagagatggtgtgatttgatttgattcgttttttttttatttatattaatattaattaaatattagattcgatttgtttggcctctttcagtcttatgagaaggggacatggttcaggacacaaaaaaaaaaaaaaaaaaattcttgaaataaacttccgcttggtgaaggtgaagtttgggttagtagagatcgaacaattccttctgtcgtgtatccccgattgatgcaacctcagatgcttcaattattgattttagcattgagcgaaaggttacacctataggttctgtattgcaggttaatcctactccaccagtaccaataggcggcgcatagggaaagaagcactacacctaggaatcaacaacacgaaaactttgttatatattatactattataccccttttccttattgggatcgggactaacaagaatggttgggacaacaaacatccatctcgtttgtgcttttggatacccgtataaccatcgaagatcgttgaagtgactaattcctgcaaagcaaatagagggcgttgaggacaaagaaattgttggagtgagcatttctatctagcatcaacacgtttggtgttaagaaaaagacctcttacaggaaggttggctagagatttcttgtaaaaacactagcccccatcagttcataatgagaatatttcaatcttttttgattccacggattattccctttattactatgcacagaagggaggagccgtatgagatgaaagtctcacgtacggttctgaaacggagattctttgaatataatgaacgaccgtaacggatgtcagctcaatccgaaggaaattatgcggaagctttacaaaattattatgaagctacgcgactagaaattgatccctatgatcgaagttatatactctataacataggccttatccacacaagcaatggggaacatacgaaggctttggaatattatttccgggcactagagcgaaacccattcttaccacaagcttttaataatatggccgtgatctgtcattacgtgcgactatctccactatagaaagaaggaaagaaagatcaaatacgctagtcaatactagaaaaaaaatgggctttctacatatgcatcgtccaaagcaacgatttttatcagctgtagcaaagaaagacttcatggaggccaaaatatgaagaaatgggtatggcctatatactagattccatggataaaggatctaatttaattgatagggtaagcgccgtaaagatcaattagagaggtattagagaggttttggggccgatagaataagaactgcttacataacatatcttttgatatgagataaaataaaagttaggaatcaacttatgtaatagagtcgatctactaaggtattgagcagcggtgtagcatcagatcccaaagatagtaagtcctttctttcttatggaggaaagtctttttcaaagattctatatcaatttctatatgaaaccgagatagttacctttcagaggattctaatgatatagggggtacggtacctatgctttattcttctgaaggtgggagaaaagataaaacgaattattgatcaaaataagagtttgaaacttatgtaattaacctcttctggttaacccgggatagatttacgagaaatctcattcaattatggatatggtagattaagatgggacaccaaaagaattggcggcggagccgtatgaggtaggaaactctcaagtacggttctaagggaaggaagtggcccacctattccgaccggggagaacaggccattcgacagggggattctgaaattgcggaggcttggtctgatcaagctgctgaatattggaaacaagcaatatcgcttactccaggtaattatattgaagcccataattggttgaaaatcacagggcggtaagaacactctttttttttttttttaattcaattatcatgttatgttggatccattaatcaaataaaatggatcgttcctctgggaagagccaatcaagtaatttcattatatcccttctaagatcgttctattttgtctggtacttccgaagtataaaccatacagatactgtacagaatacattacttttttctatgctaataaagctatatactcgaatgactaaatatggatatcgggatgtctctttttaatgactaatgactaattctttgatttggaatagagtaataaatacgttccatgtgagatatatgtaagatctaaactgaagtagattcatctaggcatttatccattgagatatgaatacattggattgcactaaaaaataaaaggtttttgcaccatgccatgcgaggaaggacctttagtattagataaaggtccgttgagcgccaaaaaaatatgtcataatagattcgaacacttgcccggattgacttccatatcataattgttctagtaaataactaaagaaaataactagatgggggataggaactaattctaaatagaaatatccatctctcagaggttcactaattactgacagttggcgggtctctttgtatgtgttgtccggaaagaggaggactcaatgattattcgttcgccggaaccagaagtgaagattatggtagacagggatcccgtaaaaacttctttcgaggaatgggccaaacccggtcatttctcaagaacaatagctaaaggccctgatactaccacttggatctggaatctacatgctgatgctcacgacttcgatagccataccagtgatttggaggagatctctcgaaaagtctttagtgctcatttcggtcaactctccatcatctttctttggctgagtggcatgtatttccacggtgcccgtttttccaattatgaagcatggctaagcgatcctactcacattggacccagcgcccaggtggtttggccaatagtgggtgaagaaatattgaatggtgatgtgggtggaggtttcccaggaatacaaataacctccaaattttttcagatttggagagcgtctggaataactagcgaatttacaactctattgtaccgcaattggtgcattagtatttgcagcgttaatgctttttgccggtggttccattatcacaaagctgctcctaaattggcttggttccaagatgtggaatccatgttaaatcaccacttagcggggttactaggactggggtttctttcttgggcgggacaccaagtacatgtatctttgccgattaaccaatttctagatgctggggtagatcctaatgagatcccgcttcctcatgaatttatcttgaatcgggattttttggcttaactttatccaagttttgctgagggagcaaccccttttttcaccttgaattggtcaaaatacgcggaatttcttacttttcggggaggattagacccagtaacagggggtctatggctgaccgatattgcacaccatcatttagctattgcaattcttttcctgatagctggtcacatgtataggactaactggggcattggtcacagtctgaaagatattttagaggctcataaaggtccatttacaggtcaggggcataaaggtctctatgagatcctaacaacgtcatggcatgctcaattatctcttaacttagctatgttaggctcttcaaccattgttgtagctcaccatatgtattccatgcccccatatccatacttagctactgactatggtacacaactttcgttgttcacacatcacatgtggattggtggatttctcatagttggtgctgctgcacacgcagccatttttatggtaagagactatgatccaactactcgatacaacgatctattagatcgtgtacttaggcatcgcgacgcaatcatatcacatctcaactgggcatgtatatttctaggctttcacagttttggtttgtatattcacaatgataccatgagtgctttagggcgtccccaagatatgttttcagataccgctatacaattacaacccatctttgctcaatgggtacaaaacacccatgctttagcacctagtgcaacagctcctggtgcaacaacaagcaccagcttgacttgggggggtagtgatttagtggctgtagggggcaaagtcgctttgttacctattccattaggaaccgcagattttttggtacatcacattcatgcatttacgatccatgtgactgtattgatattactgaaaggtgttctctttgctcgtagctcacgattgatacctgataaagcaaatcttgggtttcgtttcccttgtgacggccctggaagagggggaacatgccaagtatccgcctgggatcatgtcttcttaggcctattctggatgtacaattctatttcggtagtgatattccacttcagttggaaaatgcagtcagatgtttggggcagtataagtgatcaaggggtggtaactcatatcacgggggggaactttgcgcagagttccactactattaatgggtggctccgcgatttcttatgggcacaagcatctcaggtaattcagtcttatggttcctcattatccgcatacggcctttttttcctaggtgctcattttgtctgggcgtttagtttaatgtttctattcagcggccgcggttattggcaagaactcattgaatccatcgtttgggctcataacaaattaaaagttgctcctgctattcagcctagagccttgagcattgtacaaggacgcgctgtaggagtaacccattaccttctgggtggaattgccacaacatgggcattcttcttagcaagaattatttcactaggataatggctaggaggatttgaaaggcattatggcattaagatttccaaggtttagccaaggcttagctcaggaccctactactcgtcgtatttggtttggtattgctaccgcacatgatttcgagagtcatgatgatattactgaggaacgtctttatcagaacatttttgcttctcacttcgggcagttagcaataatctttctgtggacttccggaaatctgtttcatgtagcttggcaaggaaattttgagtcatgggtacaggaccctttacatgtaagaccaattgctcatgcaatttgggatcctcattttggtcaaccggcggtagaagcttttactcgagggggtgctctcggcccagtgaatatcgcttattccggtgtttatcagtggtggtatacaatcggcttacgtaccaatgaggatctttatactggagctctttttctattatttctttctgctatatccttaatagcgggttggttacatctacagcctaagtggaaaccaagtgtttcgtggtttaaaagtgctgaatctcgtctcaatcatcatttgtcaggactattcggagtaagttccttggcttggacagggcatttagttcatgtcgctattcccggatcaagggggcagtacgtcagatggaataatttcttagatgtattaccgtatccccaggggttgggccctctttttacaggtcagtggaatctttatgcccagaaccccgattccagtagtcatttattcggcacctccgaaggggcgggaacttccattctaacccttcttggggggttccatccacaaacacaaagtttatggttgaccgacattgcccatcatcatttagctattgcatttatttttctcgttgctggccatatgtatagaactaacttcggtattgggcatagtatgaaagatcttttagaagcacatattcctccgggaggtagattggggcgtgggcataagggtctttatgacacaatcaataattcgcttcatttccaattgggtcttgccctagcctctttaggggttattacctccttggtagctcaacacatgtactctttacccgcttacgcattcatagcacaagactttactactcaagctgcgttatatactcatcaccaatacatcgcagggttcatcatgacaggagcctttgctcatggagctatattcttcattcgagattacaatccagaacagaatgaggataatgtattggcaagaatgttagaccataaagaagctatcatatctcatttaagttgggccagcctgtttctggggtttcatactttaggactctatgttcataacgacgtcatgctcgcttttggtactccggagaaacaaatcttgatcgagcctatatttgcccaatgggtacaatctgctcacggtaagacttcatatgggttcgacgtactcttatcgtcaacgaatggcccagcatttaatgctggtcgaagcatatggttacctggctggttgaatgccgttaatgagaatagtaattccctatttttaacaataggtcctggagacttcttggttcatcatgcgattgctctaggtttgcatacaactacattgattttagtaaaaggtgctttagacgcgcgcggttccaagttaatgccagataaaaaggatttcggttatagtttcccttgtgatggcccgggacgaggtggtacttgtgatatttcggcttgggacgcattttatttggcagttttctggatgttaaataccataggatgggttactttttattggcattggaagcacatcacgttatggcaaggtaacgtttcccaatttaacgaatcctccacttatttgatgggatggttaagagattatctatggttaaactcttcacaacttatcaatggatataacccttttggtacgaatagtttatccgtctgggcatggatgttcctatttggacatcttgtttgggcgactggatttatgttcttaatttcctggcgtggatattggcaggaattgattgaaactttagcatgggctcatgaacgcacacctttggctaatttgattcgatggagggataaaccagtggctctttccattgtgcaagcaagattggttggattagcccacttttctgtaggttatatattcacttatgcagccttcttgattgcctccacatcagggaaatttggttaattcatttttcttgtaatgtgctccatcggcgacaatctcatttgattcggtggagaagggggactaccactaccctcttatatttctacatctaggatccgacccgtatcattgataataaaataggaactgaacaattatggcaaggaaaagtttgattcaaagggaaagtaaaaggcagaaattaaaagagaaatatcatttgattcgccgatccccaaaaaaagaaataagcaaagtttcgtcgttgagtgacaaatgggaaattcatggaaaattgcaatccccgccacgtaatagtgcacctatacgtcttcatcgacgttgcttttcgaccggaaggcccagaggtaactatcgggactttgggctatccgggcacatacttcgcgaaagggttcatgcatgtttgttgccgggggcaacgagatcaagttggtaagggtaaaaatactccttcttcatatttctatgggtctctatgatctatgatcatagaggggcccctttaccattctgtagaaatgggctagtctatttattatggtagaggggcaacccaatacttcttgttccacaagttcccgggtatttcgtgcggggtagagcagtttggtagctcgcaaggctcataaccttgaggtcacgggttcaaatcctgtctccgctacatttttgtttgtcagaaattctgttttaggctaggcattaggtgtaactccgttaatgttaattgttttgggatagtaggagagaaggagagtgggagagaagagggaagatagaaccactacattatcgtggtcaactagaccgaatcatttatcatattaatattagattattttaccctgggcggatagcgggaatcgaacccgcgtcttctccttggcaaagagaaattttaccattcgaccatatccgcatttcttcgttctgatatgaacatcatcatgttcacacatatatgatatatcatatatatatatatatgtgtgtctggatcatatttgtacaaggccatataatataatggattcctattattttattttaacattagattattcatttttttttttcattcaagaagtgacccctctccctccaacttttttctttatttatttatttatttattttcgcgactcatattgaattttaatgtgtctcacagtcggaattccttcgggggaggggtcacttttttgattctgtacgaggagattttctgtacgaggaggttcaagagattagagaattaaggatagcgactagaaagaccaatccaatccataatgatgtacccgaaaatacaacatttttgttacttgaccaaccatcaggagaagcaaatacaacgggtacactaattactaaaattgatgaagtagcaattaatgcaaaaacagccaattggaaagcaatagtcatgcttgtaatcctccaagctaccaacaaatgaacttgaactataccatttgatccccctctcagtccaaattgtactaaaatctatcgtgggggatttgcccatgaatatattgatcctttcgaacttattccgaattaaatctttaatttagtatttttttttatttgttacatggcggagccgagaggccatttttatttacttcacaaacgggcatactggctcatgcatatatctatataaacagatagatactatactagaactagacagatagatacagcaaaatatagctggatgcttttagagatagttatggtatcaactcatatggccatgttccattttggggaataaaatagagattgtctctcggagagatggccgagtggttgatagctccggtcttgaaaaccggtatagttctgaacaaagaactatcgagggttcgaatccctctctctccttttactcgttgaatagatttgtttctttattaatttggcctgacctgtgttataaagaggcacggctcggctaggtgggatagccgagccagaaaaaagaagtaaatataaataaataaataaaattaaatattttatttgaatttttaattttatttagaataaatctttatatatagaaatataaagaaaagaaatataaagaaatggataaatagatataatctaatctatgaatcaaaaaaaaaaaaagaaaaggaaaaataaatactttttaaaatttgagtatgccccgatcctaatatgtataatggaatcaaatggattcctacttcatgcatttgatctcctgtctcaattaaggggggtcatggaaagaacaggttcaaaatcgcgatcgattcctttttcaaatcccgctgcagctgcgcgagcccttcccgcatgccacaaatgccccacgaatagaaagaatcctagaacaaaatgagaggtagctaaccaacttctaggagagacataattgactgcattgatctcggtagctacgccacccacggaatttaaagaacctaaaggggcatgagtcatatactctgcagaacgtcgttcttgccaaggttgtatgtcttttttcagtctactcaagtccaacccattcggaccccttagaggttccaaccaaggagcacggagatcccaaaaacgcatagtttctcctccaaaaataacctctccagttggagaacgcattagatatttacctaaaccggtgggtccttgagcggatcccacgttagccccaagacgttggtctctaaccagaaaagtaaatgcttgagcttgagaagcttctggaccagtgggaccgtaaaactcactaggataagcggtattattgaaccagacgaaacaacaagcgatgaatccaaaaacggataaagcacctaaactataagacaagtaagcctccccagaccatacaagcgctcggcgagcccatgcaaagggtttggttaagatatgccagattccgccaagtatacaaatggaacctaaccacacatgtcctccaattatatcttctaaatcgtccacactaacaatccatccttctcctccaaagggggattttagtaaataaccaaatataacacttgggctaagggtcaagttggtaatttttcttacatctccacccccgggggcccaggtatcatatacgcccccaaaataaagagccttgagtactagaagaaaagcacctacacctaacaagattaagtgaatacccaaaattgtggtcattttatttctatctttccatacataaccgaagaatggaaaggattcttcaagagtctcagggccgataagtgcatgataaataccgccaaagcctaggactgcggaggaaattaagtgaagtactccggatacaaagtatggaaaggtgtctataacttccccacccggacctactccccaacctagagtagctaaatggggaagtaaaatcaatccttgttcatacatgggtttctctggtacgaaatgagccacttcaaataggttcattgctccggcccagaatacgattaatccggcatgggctacgtgagctccaagtagtttaccggacaaattgataagtcgggcattcccggcccaccaagcaaaaccggtggtttcttggtcacgaccagctaaagctaaagttccattaaagagcgtttccacggggtagaacctcctcagggaatataaggttttcatgaggctgatcctgagccgccatccaagcgcgaataccttcgtttaagagaatatttttggtgtaaaaagtctcaaattcaggatcttccgctgcacggatttcctgggaaacgaagtcataggcacgtaggttcagagccaggccgactactccaagagcgctcatccataaaccggttactggtacaaataacataaagaaatgtaaccaacgtttattggaaaaagcaaccccaaaaatttgggaccaaaagcggttagcagtgaccatcgaataagtctcttcagcttgagttggattaaaagcgcggaatgtatttgcaccgtcaccatcttcgaataaagtattttccacggtagcaccatgaatagcgcatagcagagcagcccccaatactccggcaactcccatcatatgaaatgggttcaacgtccaattatgaaacccttggaagaagaggatgaatcgaaatatagctgctacgccaaaactaggcgcaaagaaccaaccagactgacctagtggataaatcaagaatacagaaacaaaaacagcaattggaccggagaatgcgattgcattataaggtcgcaattgaacagatcgagcaagttcgaattgacgtaacatgaaacctattagtccaaaagcgccatggagagcaacaaaagtccacagaccgcctaattgacaccaacgagtaaaatccccctgtgcttcagggccccatagtagcaacaaagaatgtgctaaactattagcaggagtagaaaccgcagcggttaagaaattgcaaccttccaaataggaactagccaatccatgggtataccatgaagttacaaaggttgtacctgtgaaccaacctcctaaagcgaaataagcacaagggaagagcaatagaccagaccatcctacaaaaacgaaacggtccctacgtaaccagtcatccataatatcaaataagtcactttcttctttggtaactctaccaagggctatagtcatagtaatcctcctatttaactacttcaaccatttccgaacaccccatcgcattctcagggcatacgacggttcgattatctacggacgacgaatcatctactgactctttccaatgggtttcgaagatacaaacaaacaaatctttccttcctattggaaggctacaaccgaaccataagtaaatctatgagctcgcttcgattattatttcctatttttaataaacatatgaactcctaattttcttctgactcatcaatcagataatatttgatgagataactgtcaaggagcaggggatcctttctttcgctaccagttcttctactcatctatctctccgttccatcaacgaatcttattcttggatttcattcgtgatatgatattgagaaaagatcaataaatatctctatggattctcctaatttcatttagggtatactaaacggctacgatatcatatattacggtatcatatatatataatgaaactccatttttttcctttatttgattgttttttgtttcttattgttttctttagcttagttatatttccttcggatgaatctaaaataccagactatacctttcccatttcgcgggtagaagaaaaaaaaaggggggggggggagtattcccaatatcttttgtccctgcccttttaaaatcgaaattaaataggaagtggggactggaaatgaaaatcccgttctcgcattcgttctccattacattggtggaacaaaaatatctgatgcatccatatggaaatatttgatacatgaagtcatgtgacccaatatccatatctaagtcctatatggatataaaccaatctttttctggaaccaaaaaaagatattcaaaaaaagattgttcttgtgactcggaataaacatttctttgtggaggaaagggatgggcgatttattcctatgggtcatctaggaacaagaggattcaatcggaaatatcgacaaattcttgcgtggtccaaggaaataaaaaaggcccggcttccacaatttcatctctattgaaattgaatattttttaatatcagaatagccgatatagtcaccattcaatgggtcaggtccacttactttttcttttattgattttcaaatttgccgatcgggtttattggaacaatggagaagtaggaatgttttggtttgctgattcataatctgaattggatatataaaatagatatgatatgtaccaggaccagaaaaaataggaataatgaaaaatgaggcgaagtatatcctgtaatgacaacatagcagtcctcctaataagattagtgcaattacttatcatcataatgaacaaatgtttaactttgtacctataactcattctctaattttattagaataataactcattatgtgggcagttacctattacaaataactctaaaaaatctctcttttctctgctgaataatcaacactaagactgcaagctggagcttcatggaaaaagccccttatcggatttgaaccgatgacttacgccttaccatggcgttactctaccactgagttaaaagggcccgctttattcaattcaggaagaagccactcgctgctatgagtctactacatgatctatacatttagtatatgtacatatatatatgtatccatagggattcactgaggaacaaaaaatgggatttacctatacctatgagattctataggaaaaaaaaaatgattatttctatttcttttgttttgtatatttgaaaaatagcaatggtaatgcaatgaattctttcagggtcgggcctatactaatagctttgcttttattaacccgtccagacgagattcacttgattgatacatgtaccaatctgacatcgatccagaatataatatttcatcaaatcccttcccagatttaccaattctacatcatctttctgaatcgatcaaaaaaaagcattctatcgtttttaaatttcctggcttagtattagtgtgagataaagataggttatatcccatcttaatgttatatcccatcttaatgatgggtgagtcgatgagtaaaaatggaagaagggtttgacttaccttttctgtctgtcgaccaaatcatttcctgaagggattccatacttcgttatatatatatataggatataggacgggacggttcatgaatgataggatataggacgggatggttcatgaatgaaaatccaaaattctatggaatcatagaagcaggaaagatttttcggatctagtcatcccattatacattacattatattgacaattccaaaaaactgctcatactatgagcatagtatgatggcgatcgggcaggtatgcccctatcgtctagtggttcaggacatctctctttcaaggaggcagcggggattcgacttcccctgggggtagggtactacgaaaggaagttgatcatggattatcaataagcctagaatttattcttcctgggtcgatgcccgagcggttaatggggacggactgtaaattcgttggcgatatgtctacgctggttcaaatccagctcggcccactaattcgccgatccatgataaccaaatttgtcctccagaaatgcccattatttataatgccccatatattctaagtattctaaggatatacgggaataaaataaagtatatagggctaaagggaaagggtccattttttctacaatacccccttggtttctttcctatttctcacatcttctgatctgtctaaagatctagattaccaatttgttgcaaaggtaaggtagtaaagaaaaaaagaaaaagagtcatttttccattgaaaaatggattatcaatatattggcaggattaccagtaatccgtgtcattcggactcgagtccgtatccatgtggatatcagtatatcagtcgtgtttctgttacaacacaataatatttctcgtaaatagaaacgaaacgaatgaaagcataagaatacatatatgcatgctgtatacctcacccccgggattgtagttcaattggtcagagcaccgccctgtcaaggcggaagctgcgggttcgagccccgtcagtcccgacctcggatccggatgaatccatcaattcatctccccattttctgtgaggagagggaccccggacaggattgaatttcctgtggggatccttaatttacttttatttcgtttttcgtttcgaatttctcatcggacaaagacgggaatttctattatttgaacgagtactgattgctgggagagaggcatatgtagtcggaggtatcgccatactgggattccaagagagacctactggtttgactttttcaattgtttctgatccatgaaatggaatagggtacagagtaccaatatgtttccaaggagtacatatacaaattgtactcgtttattctacgatacacagttaactaacttagtgacatagttacccgggcagcagagtactattaaacctactcccttttgttttcgagatacgattttgtgcaacctcaattagtaaagtaattaaaaacaatatatcttattcaaattgcatgctgaatttcgctttctgtctcagtcccaatccaaggaaaaagagggtccttactttttattttaataataataataataagtcaaacaatgatccgccccttttgtttcttttctacggaggggatgaatcagtttttttttctttatctttatatatatattttagggtttcatcgaagaaggagaaaaatcaataaagaaagaatttgtcggaatattagatcttttttttttttatttatatcgggaccttcctttatctcatttctctgtcttccaggaagattagatcattacgcaaatttcgcttcgagcttaactccttcccttttccatttcactcctactgtttaggtctgttaccaatggaagggcggcaacggaacacaggtcagatgataccccgtcggatgattcttataaggaagatgataggttttataaactaaagaatgaaaaaaaaaagatgagaaattcaatgggattcttgattggatcaggaatcctatttttgattcggtatggataaaagatcttcctatgttatactattcaattctcgacgatgaatcgatttaatagatcagatattgttattcataatattgatccgattcagtatcaaccatcaggatgcaatccatcccattgaatttacaggatcaatagttttttttttttttttttctatgggattagatcccgagttattgcgaagcaaaaaaaacgatgagattatggaagtcaatattctcgcatttattgctactgcgctgttcattttagttcctactgcttttttacttatcatctacgtaaaaacagtcagtcaaaatgattagaattaaacttgacttattagctcttatcaatgattgacgaaataaaagggattgcaattccaagtcttaaatgaaatgagagaactggaatcaacagtataatagatggtgtagtagaaaggttcatatagttctttctaccacactatctattattatattgattgtataaatattctattgtataaagtgtataaagtagtattgtataaattaataaaatggatgggtttgatatagactagatacaatatctatccacataaatgaagtaattgattgagtcgttaacagataccccacggagttttatagtcacttcttcggatttgaaaaagaagtagtaaacctcacccatttttcatgcttgagccatgacatggggtgagtgaataaagcataaataagattactagaagtataaaacttaagtgaacacacacggatcacccaacgcaagatcttattatgcgtagtacgtagtacctctttgaacaaccacagcgcctatggcatctccagtagaaagtacgtatccacgtaatagtagcagtacttcctctttgaacagtcaagaaggaaaaacaaataaaaaataaaaaaataggggttggttgctcctcattgtaatgtaatatccataattatggtaagagcgggttcatcaaaatcaaatattctatttaggaaaggaataggaagagttcgtctggaaaaatttcctatcatgcgtattcctttgagtttcgaaatacgaacaacatcagaatcaaatcattgaaatatttgtttgatcgaaagatcattgttcatatattactggattaccctagaattttttgaaatggattatcttaaaacgcttcgcggaacggtctattaaacataaaccattgatccaatttgattactcaacttaattagtagtacccctagagcccacttcttccccatactacgagtgaaagggaaaacgtaaagaccaccattaaagcagcccaagcgagacttactatatccatgtaaattatctccctgatctctatgaatatgaaggaattattccattattaatcactaataatagtggaatcaatggtgcagagtcaaaatggcatttttctctaacgctattgatgaaccaacccaatgaatacaagagttcctatactctaactatactataagtatctctggtcgaatcggaaagcagtaagcaaaagcaagatatacagctacccttgggtatcttaaaggaatgttactaatgaaagatgtaggataggaatagtaaggcccattgtttgttttgttagctttcataagcataagcaaaaaaaaacggaaataaaataaaatagaaaatatatataccatcaagatggaaaagatcactatcttaactacctatcacatacctctatcttcccgcccatctaagtcttactgtctctgtttctttctgtgaaagaatcgggggacaccccattctgttcttagcagggtgttacaaaaaggggagaagttcttttttttttacttttattagaaaatgagattctctatatatattatagaatatggatataagatatagaatagttagttattgttagttattgtataactataatagttatagttaagagtcaattactcatccacatccaatctaatattgattggatacccgagtaagtactcagggactctcacgagtctcgatataaaataaaaactagccctttctgcaactcctaatttgattccccgccaacctacccaatctaattaaagactcagtcagtgggcatcaccctagtaaggtagggtaattaggaagtattgatagtatttcctataatctccctcagatcctagaatagaagcaaggattgggttttcatttaggaaccccctttcctttggctacctcaattttaggtatctgactttcgtagttatgaatctcacaattgaagttttactatcgattcgattgaaaaataaaatacaaataaatgaaatagcccgaacccatcggtaatcagtaataaataataaatgaggtttttttcatattgatacccgattttgaccataaccaaatggaaaaaattcaagtctttttttttttttattagagcctctatattcttaaatattcttaaagtattcttaaaatacagtatcgacaaccctagttatgctgccatcaggcaagaattttgtgagttctatttagcatagagggataaggtattccgaagcttttcttttgttgatcaggcgacacccggatttgaactggggagaaagggatttgcagtcccgcgccttaccactcggccatgccgccaaaataacccaaaatagacctaactctttcttttttgttttcgttttttttttgttttggggggggttactcaacctttttttggtttgtgttggattttgaaaacgggtttctttatccctttccaaaggggattcccgggtccagggttctcttgattgtagagtctttcaaaacatacagatcttttttttttatttttgatattgaaacataaaaaaaaaatcgatttctagacacagagtcaaaaattcagggtaaattagaactattaattattccctgtgaattcatgaatagttcttggatttggatctaacgttttctttccttaacttaataattaaattaataacataagaaaacaaaaaagttgatacacgactaatcagtatcaattgttttcaatttcaattataacaacatatatgtgtatatgtaaaccctcgagtagaaattgttacacggatacctagtcctatccaccttattttatagggaattgtcgtgcttgaattttgcattgaatatttttctattgaataagttgaatctaaattgcaaattctcatatagcaacatcgaaaagatgggatatgcagataactagatagctatatctgtatatacttatacaacgccctttacgcgtttcaatcgtattctactaattctactaacactaacaagggctccctattctctgggaatccttttttgaataatggtggaatcaatgaaatgagttaagtgtaaaaaccaactcgatactgttccagattattctgtctttatctcattcatagagaatggatcaaatcatgaatctatttatggtacccaatcttattgtaatatcataataacaataacaggtagaaattggatccatttgtatattctatacaagactccatcagtctaagctaagggacagaattttgtttcaaagaatgttttattaatccatctccatttggattaatccatctccatttggatccgtctaaaattctctctcttttttcctccgtctatgccaatttcattggtatatggaattggataaaatttcatgtgattcagtaaaaagaatatacattccatcattgctcgatccatctatatggttcgataaagagttaaccaataatgggattttatcaataaaagggaaactaaattaagatgctccgggatgaaaatgagggaatgtctacaatacctggatttagtcagatacaatttgaaggattttgtagattcattgatcaaggtttgaccgaagaacttcataagtttccaaaaattgaagatacggatcaagaaatcgaatttcaattatttgtggaaacatatcaattggtggaacccttgataaaagagagagatgctgtgtatgaatcactcacgtattcttctgaattatatgtacccgcggggttaatttggaaacccggtagagatatgcaagagcaaaccctatttattggaaatattcctctaatgaattccctgggaacttttatagtaaatggaatatacaggattgtgatcaatcaaatattgcaaagccctggtatttattaccgttcagaattggaccataacggaattgctgtctataccggaacaataatatcagattgggggggaaggtcagaattagagattgatagaaaagcaagaatatgggcccgcgtgagtaggaaacaaaaaatatctattctagttttactatcagctatgggttcgaatctaagagaaattctagataatgtttgctaccctgaaattttcttgtctttcctgaatgaaaaggaaaaaaaaagatcgggtcaagggaaaatgccattttggagttttatcaacaatttgcgtgtgtaggtggggatccggtattttcggagtccttatgtaaggaattacaaaagaaattttttcaacaaagatgtgaattaggaaggattggtcgacgaaacatgaaccggagacttaatcttgatatacctcagaacaatatatttttgttaccacgagatatattggctgctgccgatcatttgatcggaatgaaatttggaatgggcacacttgacgatatgaatcacttgaaaaataaacgtattcgttctgtagcggatctgttacaggatcaattgggattggctctggttcgtttagaaaatgtggttcgaggaactatatgtggagcaatcaggcataaattgataccgactcctcaaaatttggtaacttcaactccattaacaactacttatgaatcctttttcggactacaccctttatctcaagttttggatcgaacgaatccattgacacaaatagttcatgggcgaaaattgagttatttaggtcctggaggattaacaggtcgaactgctagttttcggatacgggatatccaccctagtcattatggacgtatttgtccaattgacacgtccgaagggatcaatgttggacttattgggtccttagctattcatgcgaggattggtcattggggtctatagagagtcctttttatgagatatctcagagatctaaagaagcacaggtgttttatttagcaccaagtatagatgaatactatatggtagcgacaggaaattctttggccttgaaccgggatattcaggaagaacaggttgttccagctcgataccgtcaagaattcctgactattgcatgggaacagattcatcttcgaagcatttttcccttccaatatttttctattggagcttccctcattccttttattgagcataatgatgcgaatcgggctttaatgagttctaatatgcagcgccaggcggttccgctttctcggtccgagaagtgcattgttggaactgggttggaacgccaagcggctcttgattcgggagtttccgctatagccgaatgcgagggaaagattgtttataccgatactgacaagatagttttatcaggtaatggagacactataagcattccattagttatgtatcaacgttccaacaaaaacacttgtatgcatcaaaaacctcaggctccgcggggtaaatgcattaaaaagggacaaattttagcgggtggtgcggctactgttggcggtgaactcgctttgggaaaaaatgtattagtagcttatatgccgtgggaaggctacaattttgaagacgcggtactcattagcgagcgtttggcatatgccgatatttatacttcttttcacatccggaaatatgaaattcagactcatgtgacaagccaaggtcctgaaagaatcactaaggaaataccccatttagaagctcatttactccgcaatttagacagaaacggaattgtgatgctgggatcttgggtagaaacaggtgatattttagtaggtaaattaacgcctcaggcggcgaaagaatcatcgtatgccccagaagatagattattacgagccatactcggcattcaggtatccactgcaaaggaaacttgtctaaaattacctatagggggaaggggccgggttattgatgtgagatggatccagaaaaaaaaagggtccagttataatccagaaatgattcgtgtatatatttcacagaaacgtgaaatcaaagtaggtgataaagtagctggaaggcatggaaataagggtatcatttcaaaaattttgcctagacaagatatgccttatttgcaagatggaacaccagtggatatggtcttcaacccattaggagtaccctcgcgaatgaatgtgggacagatatttgaatgctctctcgggttagcggggaacttgctgggcagacattatagaatagcaccctttgatgaaagatatgagcaagaagcttcgagaaaactcgtgttttctgaattatatgaagccagcaagcaaacagcaaatccatgggtctttgaacccgagtatccaggaaaaagcagaatatttgatggaagaacaggagatccttttgagcaacctgttataataggaaaaccctatatcctgaaattaattcatcaagttgatgataaaatccatgggcgctccagtggacattatgcacttgttacacaacaaccccttagagggagggccaagcaagggggacaacgagtaggagaaatggaagtttgggctctagagggatttggtgttgcgcatattttacaagagatgcttacttataaatccgatcatattagagctcgccaggaagtacttgggactatgattattggaggaacaatacctaacacggaggatgctcccgaatcttttcgattactcgttcgagaactacggtctttggctctggaactgaatcatttccttgtatctgagaagaacttacagattcatagggaggaagcttgatcggaatgaatccgaatttttcttctatgatcgatcggtataaacatcaacaacttcgaattggatcggtttctcctcaacaaataagtacgtgggccaccaaaatcctacctaatggagaaatagttggagaggtgacaaaaccctatacttttcattacaaaaccaataaaccggaaaaagatggattgttttgcgaaagaatctttggacctattaaaagtggaatttgtgcttgtggaaattttcgagtgatcggagatgaaacagaagacgcgaaattttgtgaacaatgcggagtcgaatttgttgattctcgggtacgaagatatcaaatgggatacatcaaactggcatgcccagtgactcacgtgtggtatttgaaacgtcttcccagttatatcgcgaatcttttagataaaccccttaaggaattagaaggcctagtatactgcgatgtgtgatttgatcgaaatcttgattttacagattcggaatgagaaactgtcatcccattcaatccgattgggatgcccccgactctgacatgtctctttagaggaggaacatgaagctcagaattatgggtgtattaaatacttccaaatagaaaggggaattgatccatggtcgattccgtaatagaaaaatgggaattgctagttatacctcgtgaaaaaaaaaaaaaaaaaaaacttctttcgtggaattagccattccatttcttttttgaaagagattccattcaagtaaacataaacaaatatgacatggttacaggagtttatccatcgcatatatgcttcaaaggatattatagcataaccatcgaggtgaagtagggacctaaaagatcgaatggaacgatacatagacaagtaaatcccttaccttatgagatgagtgagttcgaagatattcgaattttaattttaataattaaaattaaaggaatttctcattcgaagggaagtagactactcaataatttctcatttcctttatgtcataattgagttgaataactaattcataaagtaaaagtaagaatgaatcaatgagatattggttggtcctcgctgtgaacttgagtaaggagtaaatctttatggggcttctagaacaaaattggaattgtaaaataagaacccctttctttatttgatgtaactacttgagccggatgagaggaaaccttcacgtccgatttttaaggggggaattcataggaacctatcctaatttttcttttgctaggcccattgctaaaaaacccactttcttacgattacgaggttcattcgaatatgaaatccaatctcggaaatacagcatcccacttttttttactacccaaggcttcgatacatttcgaaatagagaaatctctacaggagcgagtgctatcagagaacaattagccgatctggatttgcgaattattatagatcattcattggcagaatggaaggaattaggggaagaagggcccaccgggaatgaatgggaagatagaaaaattggaagaagaaaggattttttggttagacgcatagaattagctaagcattttatccgaacaaacgtagaaccagagtggatggttttgtgcttattaccagttcttcctcccgagttgagacccattattcagatagatgggggtaaactaatgagttcggatattaatgaactctatcgaagagttatctatcggaacaatactcttactgatccattaacaacaagtagatccacaccaggggaattagtaatgtgccaggagaaattggtacaagaagccgtggatacacttcttgataatgggatccgcggacaaccaatgagggacggtcataataaagtttacaagtcgttttcggatgtaattgaaggcaaagagggaagatttcgcgagactttacttggtaaacgagtcgattattcggggcgctccgtcattgttgtgggcccttcgctttcattacatcaatgtggattgcctcgagaaatagcaatagagcttttccagacatttttaattcgtggtttaatcagacaacatcttgcttccaacatagggattgctaaaagtaaaattcgggaaaacaaacctattgtatgggaaatacttcaagaagttatgcaggggcatcccgtattgctgaatagagcaccaaccctgcatagattaggcatacaggcgttccaacccattttagtggaaggacgtgctatttgtttacatccattagttcgtaagggattcaatgcagactttgatggggatcaaatggctgttcatgtacctttatcttttgaagctcaagcagaggctcatttacttatgttttctcatatgaatctcttgtctccagctattggggatcccatttccgtaccaacgcaagatatgcttatgggactctatatattaacaattgggaatcgtcgaggtatttgtgcaaataggtataatccatggaatcgcggaaactatgaaaataaaataggtggtgataataactataagtatacgaaagagaaagaaccttatttttgtagttcctatgatgcacttggagcttatcgtcagaaacgaatcaatttagatagccctttgtggctccggtggcgactagatcaacgtgtcattgcctcaagagaacttcctatagaagttcaatatgaatcctcgggaacctatcatgagatttatgggcactttttaatagtgaaaagtgtcaaaaaagaaatcctttgtatatacattcgaaccacagttggtcatatttctttttatcgagaaatagaagaagccatacaagggttttggcgggcctactcatacggtgcctaagctaagtaattatgtgatatgatatccgggcgagcctccttggttcaaccggtatcctaattcctgaatttctacgtgaatcaagatcgaggaaaggaagtcttagaatcactgactcaaccccattgtcgaatcccactcagacgaatatggaggtacttatggcagaacgacccgatctagtctttcacaataaagtgatagatggaactgccatgaaacgacttattagcagattaatagatcacttcgggatggcatatacatcacatatactggatcaagtaaagactctgggtttccggcaagccactgctacatccatttcattaggaattgatgatcttttaacaataccttctaaaggatggctagtccaagatgctgaacaacaaagtttgattttggaaaagcaccatcattatgggaatgtacacgcggtagaaaaattacgtcaatctattgagatatggtatgctacaagtgaatatttgagacaagaaatgcatcttaattttaggatgactgatccttctaatccagtccatataatgtccttttcaggagctagaggaaatgcatctcaggtacatcaattagtaggtatgagaggattaatgtcggatccccaaggacaaatgattgatttacccattcaaagcaatttacgtgaaggactttctttaacggaatatatcatttcctgctacggggcccgcaaaggggttgtggatactgctgtacgaacatcagatgctggatacctcacgcgtagacttgttgaagtagttcaacacattgttgtacgtagaacggattgtggcactatccgaggtatttccgtgagtccccaaaacgggatgacggaaaaaatgttgatccaaacattaattggtcgtgtattagcagacgatgtatatatgggtctaaggtgtattgccgctcgaaatcaagatatcgggattggacttgtcaatcgcttcataacttttcaggcacaaccgatatatattcgaacccccttcacttgccgtagtacatcttggatctgtcgattatgttatggtcgaagtcccactcatggtgacctggttgaattaggggaagcagtgggtatcattgcgggtcaatcaattggggaaccggggactcaactaacattaagaacttttcatactggtggagtattcacaggtggtactgcagaacaggtacgagctccttttaatggaaaaattcaatttaatgaggatttagttcatccaacacgtacacgtcatgggcatcctgcttttctatgttatatagacctgtatgtaactattgagagtcagggcattatccatagtgtgaatattccaccaaaaagttttcttttagttcaaaatggtcaatatgtagaatcagaacaagtgatcgctgagattcgcgctggaacatctactttgaattttaaagaaagagttcgaaaacatatttattctgactcagagggagaaatgcactggagtaccgacgtgtaccatgcacctgaatatacatatgggaatgttcatctcttaccaaaaacaagccatttatggatattatcgggggacccgtgcagatctaatagagtgcccttttccctccacggggatcaagatcaaatgaatgttcattctctttctgtcgaacagagatatatttctggcctctcagtgactaatgatcgagtgagacacaaattgtttagttcggatcctttcggtaaaaaagtagataggagttttgataattcaagatcagatcgaatcatatccaacggccattggaatttcatatactccgccattctctacgagaattctgatttattggggaagaggcgaagaaatagattcatcctcccattccaatatgatcaagaacgagagaaagaactaatgtcctgttctggtatctcaattgaaatacccataactggtattttacgtaaaaattgtattcttgcttattttgacgatccccaatacagaagaagcaattcaggaattactaaatatggtaccgtagaggtggatttcatcctaaaaaaagaagatttgattgaatatcgaggagcaaaagaatttaggccgaaataccaaacgaaagtagatcgcttttttttcattcccgaagaagtgcatattttacccagatcttcgtccataaaggtacgtaacaatagtatcattggagtaggtacacgaatagctttaaatacaagaagccgagtaggtggattggtccgagtggagagaaaaaagaaaaagattgaattgaaaatattttctggagatatacattttcccggagagacagataaaatctctcggcatagcggcatcttgataccaccaggaacgggagaaaaaaattctaaggactcaaaaaaattgaaaaattggatctatgtccaacggattacacccatcaagaaaaagtattttgttttggttcggcctgtagtcacatatgaaatagccgatggcataaatttagcaacgcttttcccccaggatctgttgcaggaaagagataatgtgcaactacaagttgtcaattatatcctttatggaaacggcaaacccattcgaggaatctcccacacaaatattcaattagttcgaacttgtttagtattgaattgggaccaaggacaaaatagttctatagaagaagtccatgcttcctttgttgaagtaaggacaaatgatctgattcgaaatttcataagaattgacttagttaagtcccctatttcgtgtaccggaaaaagggatgataggggagattcgggattgaatctcgataatggatcagatcgcaccaatattaatcctttttaccccaaggcgaagattcaatcacttacccaacagcaagggactatccatttgttgctgaataaaaataagcaatgccaatcttttctaattttgtcatcatctaattgttctcgaattggtccattcaatggttccaaatctctcagtgtgagaaaaaaatcaattaaagaagattccacgattgctattgctattagcaatttgttgggccccctgggtactgtatttaaaattgcgaatttttattcatcttgttgcttaataacttataatcagatcttgttaaataaatatttgcgacttgaaaatttaaaacagactttccgagccattcaatattatttaatagatgaaaatgggggaatttacaattgcgatccttttagtaacatcatttttaatccattcgatttaaattggcgctttctccatctcaattattgtgagaagacatccacaacaattagccttgggcagtttatttgtgaaaatgtatgtatatccaaatatggaccgcgcataaaatccggtcaagttataattgttcatgttgactccttagtaataagattggctaagcctcatttggccactccgggagcaaccgttcatggccattatggagaaattctttatgaaggagatacattagttacatttatatatgaaaaatcgagatcgggtgatataacgcagggtcttccaaaagtggaacaagtgttagaagtgcgctcaattcattcaatatcgatgaacttagagaagagagttgaaggttggaacaaacatataacaaaaattattggaaatccctggggatttttaattggagctgagctaaccatagcgcaaagtcgtatttctttggttaataagatccaaaaggtttatcgatcccagggggtgcagatccataataggcacatagagattattgtacgtcaaataacatcaaaagtgttagtttcagaagatggaatgtctaatgttttttcacccggagaactaatcggattgttgcgagcggaacgggcagggcgcgctttagaagaagcaatctgttaccgagccattttattgggaataacgaaggcatctctgaatactcaaagtttcatatccgaagcgagttttcaagaaaccgctcgagttttggcaaaagctgctctacgaggtcgtattgattggttgaaaggcctgaaagagaatgttgttctggggggtatgatacctgttggtaccggatttaaaggattagtgcatcgttctaggcaacacaacaacattcctttggaaatcaaaaagaagaatctattcgaggggaaaataagagatatttttttccaccacagagaattatttggtttttgcacacaaaatactttccatgatacaacagaacaatcatttacaggatttaatgattcctaataagagcatattcattcttttcttttaacttttaactatatagggtatggtatgtatggtccggtcatttgatttgttaataaagataataacgaatagaaagtaattaacgacttggaccgtgtatcaatggccaatccccggcagaaggttccgtcggaacaattatttatttcaaggtaccttgtttcttaaaacaaaaaataaaagataaagtgtggggggaaatgacaagaagatactggaacatcaatttagaagagatgatggaagcgggagtgcatttcggtcatggtactaggaaatggaatcctagaatggcaccttacatctctgcaaagcgtaaaggtattcatattacaaatcttactagaactgctcgttttttgtcagcagcttgtgatttagtttttgatgcagcaagtaggggaaagaactttttaatagttggtaccaaaagtaaagctgcggattcagtagcagcagctgcaataaaggttcggtgtcattatgttaataaaaaatggctcgggggtatgttaacaaattggtctactacagaaacgagacttcataagttcagggacttgagagtagaggcggggaaactcaaacgtctcccgaaaagagacgctgcaatgttgaagagacaattatctcacttgcaaacatatctaggtgggatcaaatatatgacggagttacccgatattgtcatcatcgttgatcagcaagaagaatatacggctcttcgagaatgtatcactttgggtattccgacgatttgtttaatcgatacaaattgcgacccggatctcgcagatatttcgattccagccaacgatgacgctatagcttcaatccgattgattcttaacaaattagtatccgcaatttgtgagggtcgttctagctatataagaaatcgttgattaataataagattaagataagtcaataactttgggaactccatagattgattgaatcggttaccattcctgaatctcaaaaaagagatcaaaattgatggggatattctgtgattccttggcacctgaaacatacgattaaagtcaaagtaggcgagtcgagaaagagatggttgaatctgaatcaaaataattactttttaagttgtatttctgtcagagggtaatatgaattttctaccatgttccataagcacactaagggatatatacgatatatctggtgtggaagtaggccaacatttctattggcaaatagggggtttccaagtccatgcccaagtacttatcacttcttgggtcgtaattgctatcttattaggttcagctgctatagctgttcggaatccacaaaccgttccaaccgacggtcagaattttttcgaatatatccttgaattcattcgagatttgagcaaaactcagattggagaagattatggcccctgggttccctttattggaactatgtttctatttatttttgtttctaactggtcgggtgctcttttaccttggaaaatcatacagttacctcatggagagttagcagcacctacgaatgatataaatactactgttgctttagctttacccacatcagtggcatatttctacgcgggtcttaccaaaagagggttgggttatttcggtaaatacattcaaccaactccaatacttttaccaattaacatcctagaagatttcacaaaacctttatcacttagttttcgacttttcgggaatatattggctgatgaattagtagttgttgttcttgtttctttagtaccttcagtagttcctatacctgtcatgttccttggattattcacaagtgggattcaagctcttatttttgcaaccttagccgcggcttatataggtgaatccatggagggtcatcattgactagctttcaaaaaaaaaaaagcttatcccaattccaactctcgagtgtctcaagataatctactgggggaacacaatatatccaaaaagtgcatgtatggtctagagtaggaacaaaaaagatgtacgatattggggaattgtaaaaaaaaaagggaagagatctaaaagatctttttcctaagatttacttttggtccatttatgttacgtctctctaatcaatattctataattctataatataatcgtatttgttcagtcaattactatattttaaaaatttaactaagaattgttatcttatctgtctctgacatgcgcctaaaacaactaaaataaaaagagtatgttctatagaaacaatcattccgtttttatttgatttgattcaatttgattcaacgattgatcaaagttgtcattaattgcaatcaaatctttatacagaatgattcgggctaacgatcccgtctatttatattcatgcaggagtcgcgataatgtaaaaggaagagaagagtttacaagcaaataagattcataaaaaagtggattaggggctcgtgctgagctaggtatggatatatatatatatatatatataatggctataagccaattcctgtgtatgtttcgaagcatgattcaattcttcggctagaatccaattcaacagcataaagaatggtttacgttatggaagaaacacttgtatatgtgatattagatattcattaattgtctatatatggattatacatacaaataatatatatggattatacatacaaataaaataaatatataaatataaaaatagaatctattatttatttattattatttattttatatatatttattcttttaccataccatcctactgaattaaatgaattcaaattcaataggagttcttccgttttatctgtgaccggggattgaatgaataaacagatgaagtcaagcatatagagaagaacgtgccaagaataaaaagagtggcttagaacaaagaaattgaataactagaatcttttggatttacaaagactacacggtagaaattataaaggagatattgaagtcgttcggctaattcaggaatattattacctcaattcacttttctgttcttatcttagttacttcgcccgaatgggtctttgaaataataagtaataattcattggttgattgtatcattaaccatttctttattttggtgtgaggagcttactatgaatccactgatttccgccgcttctgttattgctgctgggttggccgtagggcttgcttctattggacctggggttggtcaaggtactgctgcgggccaagccgtagaaggtatcgcgagacaaccggaagcagagggtaaatacgaggtactttattacttagtctggctttatggaagctttaacaatttatgggctagtcgtggcattagcgcttttatttgcgaatccttttgtttaatcccataaatattttaaatacgtactcattttcttatttttttgttgtgtacttgcctcttgcttcttagaattagatcaacacttcacccctatcatctaatcacttgttgatctaatcacttgttcgttgaaacaataccccggggaaggactaatttgaggatgaggaatttgcgaatccactcgctttcttccttcccgcccttaatggaaaggaaacccccctttttttttttttagttttacttttttttattagattaggatggagcaaacgcaattgacatgaggcctggggcctaggcctaataagtgtcttattgagaacttccataattcataattctaataataataaaaaaaaaaaagaatagatttcatttctttatttcattttttttttcttaatttctaaaaaaaaaagagctcaatcaaacaaaacacaaaggatgaggtgatacaaaaagaactctgtttgattttcttagtcctatctatatctataagaggagatcatatgaaaaatgta

SEQ ID NO: 3218 - DNA, 4169 bp, Vitis vinifera
taatcaggtatcttatctatatatgaatatgatgcccatagtaaattcaaatgatcgtgtttcaattttcattgaatagaaaataaaaatttgaattttgatagagcacgacctgtgctgacccgaatagaaatgcaataaaggaggagacggatatatagatagctatatctgtacatgtttaataaatataacccttcttatgcacttcaatcgtattctacgaattatactaaaaaaaataggtaaaaacatttctcttctgtgtgaattttttttttgaataatggaatcaaagtgaagtgctaaaaaatcaactctatattgtttatgattattctgtctttatcttagtgaacagatcaaaatcttagtgaacagatcaaatcctgaatccatttatatttttttttttttctgatatccaatcggattggaatacgtaaaatcataataatggtataaatggaatcacttttttttttatattctatacaaaactccataagtctaagtagcatttatcaattactttacatttgtatctgttgcagattccaatttgaatagaaaattctctttattcctccgttcatatgtatttcatacattagattagatatatggagttgggtaaaatttcatgcgattcagtaaacggattataaattccatcattgctagatctcgatcgatccatatgattcgatgaagaacgaaccaatccaataacaataatgggattttttcgataaatgggaaacaaaaaatgttccggggtggaaatgagggaatgtctacaatacctgggtttaatcagatccaatttgaaggattttgtaggtttattgatcagggcttgacagaagaactttataagtttccaaaaattgaagatacagatcaagaaattgaatttcaattatttgtggaaacatatcaattggtggaaccattgataaaagaaagagatgccgtgtatgaatcactcacatattcttctgaattatatgtatctgcgggattaatttggaaaaccagcagagatatgcaagaacaaacaatttttattggaaacattcctctaatgaattccctgggaacttctatagtaaatggactatacagaattgtgattaatcaaatattgcaaagccccggcatttattaccggtcagaattggaccataacggaatttcggtctataccggcaccatagtctcagattggggaggaagattagaattagagattgatagaaaagcaaggatatgggctcgtgtgagtaggaaacaaaaaatatctattctagttctatcatcagctatgggttcgaatctaagagaaattctagagaatgtttgctatcctgagatttttttgtctttcctgaatgataaggagaaaaaaaaaattgggtcaaaagaaagtgccattttggagttttatcaacaatttgcttgtgtaggtggggatccggtattttctgaatcattatgtaaggaattacaaaagaaattctttcaacaaagatgtgaattaggaaggattggtcgacgaaatataaaccggagactgaatcttgatatacctcagaacaatacatttttgttaccgcaagatatattggcagctgcggatcatttgattggaatgaaatttggaatgggtatacttgacgatatgaatcatttgaaaaataaacgtattcgttctgtagcggatctcttacaagatcaattcggactggctctaattcgtttagaaaacgtggttcgaggaactatatgtggagcaattaggcataaattaataccgactcctcagaatttggtaacttcaactccagtaacaactacttatgaatcttttttcggcttacacccattatctcaagttttggatcgaactaatccattgacacaaatagttcatgggcgaaaatcgagttatttgggccccggtggattgacagggcgaactgccagttttcggatacgagatatccatcctagtcactatggacgcatttgcccaattgacacgtctgaaggaatcaatgttggacttattggatccttagcaattcacgcgaggattggtcattggggatctctagaaagcccattttatgaaatttctgagagatcaaaaaaggtacggatgctttatttatcaccaagtagagatgaatactatatggtagcggcaggaaattctttggcactgaatcagggtattcaggaagaacaggttgttccagctcgataccgtcaagaattcctgactattgcgtgggaacaggttcatcttcgaagtatttttcctttccaatatttttctattggagcttccctcattccttttatcgagcataatgatgcgaatcgggctttaatgagttctaatatgcaacgccaagcagttccgctttctcggtccgagaagtgcattgttggaactgggttggaacgtcaagcggctctagattcaggggttcccgttatagccgaacacgagggaaagatcgtttataccgatactgacaagatcattttatcaggtaatggagatactctaagtattccattagttatgtatcaacgttccaacaaaaatacttgtatgcatcaaaaagcccaggttcggcggggtaaatgcattaaaaagggacaaattttagcggatggggccgctacagttggcggagaactagctttggggaaaaacgtattagtggcttatatgccatgggaaggttacaattctgaagatgcggtactcattagcgagcgtctggtatatggagatatttatacttcttttcacatacggaaatatgaaattcagacccatgtgacaagccaaggccccgaaaggatcactaacaaaataccgcatttagaagcacatttactccgcaatttagacaaaaatggaattgtgatactgggatcttgggtagagacgggcgatattttagtaggtaaattaacgcctcagatggcgaaagaatcatcgtatgccccggaagatagattattacgagccatacttggcattcaggtatccacttcaaaggaaacttgcctaaaactacctataggtggtcgaggtcgagttattgatgtgcgatggatccagaaaaagggtggttctagttataatccagaaacgattcgtgtatatatttcacagaaacgtgaaatcaaagtaggtgataaagtagctggaagacatggaaataagggtatcatttccaaaattttgcctagacaagatatgccttatttgcaagatggaagacctgttgatatggtctttaacccattaggagtaccgtcacgaatgaatgtaggacagatatttgaatgctcgctggggttagcggggggtctgctagacagacattatcgaatagcaccttttgatgagaaatatgaacaagaggcttcgagaaaactagtgttttctgaattatatgaagccagtaagcaaacagcgaatccatgggtatttgaacccgagtatccgggaaaaagcagaatatttgatggaagaacgggagatccttttgaacaacctgttataataggaaagccttatatcttgaaattaattcatcaagttgatgataaaatccatggacgttccagtggacattatgcacttgttacacaacaaccccttagaggaagggccaagcaagggggacaacgggtaggagaaatggaggtttgggctctagagggatttggagttgctcatattttacaagagatgcttacttataaatctgatcatattagagctcgccaggaagtacttggtactacgatcattggaggaacaatacctaaccctgaggatgctccagaatcttttcgattgctcgttcgagaactacgatctttggctctagaattgaatcatttccttgtatctgagaagaacttccagattaataggaaggaagcttaatcgaatcggactgaatcagaatttttcttctatgatcgatcggtataaacatcaacaactccgaattggatcagtttcccctcaacaaataagtgcttgggccaataaaatcctacctaatggagagataattggagaggttacaaaaccctatacttttcattacaaaactaataaaccggaaaaa

SEQ ID NO: 3219 - DNA, 3430 bp, Vitis vinifera
ttgaatagaaaattctctttattcctccgttcatatgtatttcatacattagattagatatatggagttgggtaaaatttcatgcgattcagtaaacggattataaattccatcattgctagatctcgatcgatccatatgattcgatgaagaacgaaccaatccaataacaataatgggattttttcgataaatgggaaacaaaaaatgttccggggtggaaatgagggaatgtctacaatacctgggtttaatcagatccaatttgaaggattttgtaggtttattgatcagggcttgacagaagaactttataagtttccaaaaattgaagatacagatcaagaaattgaatttcaattatttgtggaaacatatcaattggtggaaccattgataaaagaaagagatgccgtgtatgaatcactcacatattcttctgaattatatgtatctgcgggattaatttggaaaaccagcagagatatgcaagaacaaacaatttttattggaaacattcctctaatgaattccctgggaacttctatagtaaatggactatacagaattgtgattaatcaaatattgcaaagccccggcatttattaccggtcagaattggaccataacggaatttcggtctataccggcaccatagtctcagattggggaggaagattagaattagagattgatagaaaagcaaggatatgggctcgtgtgagtaggaaacaaaaaatatctattctagttctatcatcagctatgggttcgaatctaagagaaattctagagaatgtttgctatcctgagatttttttgtctttcctgaatgataaggagaaaaaaaaaattgggtcaaaagaaagtgccattttggagttttatcaacaatttgcttgtgtaggtggggatccggtattttctgaatcattatgtaaggaattacaaaagaaattctttcaacaaagatgtgaattaggaaggattggtcgacgaaatataaaccggagactgaatcttgatatacctcagaacaatacatttttgttaccgcaagatatattggcagctgcggatcatttgattggaatgaaatttggaatgggtatacttgacgatatgaatcatttgaaaaataaacgtattcgttctgtagcggatctcttacaagatcaattcggactggctctaattcgtttagaaaacgtggttcgaggaactatatgtggagcaattaggcataaattaataccgactcctcagaatttggtaacttcaactccagtaacaactacttatgaatcttttttcggcttacacccattatctcaagttttggatcgaactaatccattgacacaaatagttcatgggcgaaaatcgagttatttgggccccggtggattgacagggcgaactgccagttttcggatacgagatatccatcctagtcactatggacgcatttgcccaattgacacgtctgaaggaatcaatgttggacttattggatccttagcaattcacgcgaggattggtcattggggatctctagaaagcccattttatgaaatttctgagagatcaaaaaaggtacggatgctttatttatcaccaagtagagatgaatactatatggtagcggcaggaaattctttggcactgaatcagggtattcaggaagaacaggttgttccagctcgataccgtcaagaattcctgactattgcgtgggaacaggttcatcttcgaagtatttttcctttccaatatttttctattggagcttccctcattccttttatcgagcataatgatgcgaatcgggctttaatgagttctaatatgcaacgccaagcagttccgctttctcggtccgagaagtgcattgttggaactgggttggaacgtcaagcggctctagattcaggggttcccgttatagccgaacacgagggaaagatcgtttataccgatactgacaagatcattttatcaggtaatggagatactctaagtattccattagttatgtatcaacgttccaacaaaaatacttgtatgcatcaaaaagcccaggttcggcggggtaaatgcattaaaaagggacaaattttagcggatggggccgctacagttggcggagaactagctttggggaaaaacgtattagtggcttatatgccatgggaaggttacaattctgaagatgcggtactcattagcgagcgtctggtatatggagatatttatacttcttttcacatacggaaatatgaaattcagacccatgtgacaagccaaggccccgaaaggatcactaacaaaataccgcatttagaagcacatttactccgcaatttagacaaaaatggaattgtgatactgggatcttgggtagagacgggcgatattttagtaggtaaattaacgcctcagatggcgaaagaatcatcgtatgccccggaagatagattattacgagccatacttggcattcaggtatccacttcaaaggaaacttgcctaaaactacctataggtggtcgaggtcgagttattgatgtgcgatggatccagaaaaagggtggttctagttataatccagaaacgattcgtgtatatatttcacagaaacgtgaaatcaaagtaggtgataaagtagctggaagacatggaaataagggtatcatttccaaaattttgcctagacaagatatgccttatttgcaagatggaagacctgttgatatggtctttaacccattaggagtaccgtcacgaatgaatgtaggacagatatttgaatgctcgctggggttagcggggggtctgctagacagacattatcgaatagcaccttttgatgagaaatatgaacaagaggcttcgagaaaactagtgttttctgaattatatgaagccagtaagcaaacagcgaatccatgggtatttgaacccgagtatccgggaaaaagcagaatatttgatggaagaacgggagatccttttgaacaacctgttataataggaaagccttatatcttgaaattaattcatcaagttgatgataaaatccatggacgttccagtggacattatgcacttgttacacaacaaccccttagaggaagggccaagcaagggggacaacgggtaggagaaatggaggtttgggctctagagggatttggagttgctcatattttacaagagatgcttacttataaatctgatcatattagagctcgccaggaagtacttggtactacgatcattggaggaacaatacctaaccctgaggatgctccagaatcttttcgattgctcgttcgagaactacgatctttggctctagaattgaatcatttccttgtatctgagaagaacttccagattaataggaaggaagcttaatcgaatcgga

SEQ ID NO: 3220 - DNA, 3243 bp, Vitis vinifera
aatgggaaacaaaaaatgttccggggtggaaatgagggaatgtctacaatacctgggtttaatcagatccaatttgaaggattttgtaggtttattgatcagggcttgacagaagaactttataagtttccaaaaattgaagatacagatcaagaaattgaatttcaattatttgtggaaacatatcaattggtggaaccattgataaaagaaagagatgccgtgtatgaatcactcacatattcttctgaattatatgtatctgcgggattaatttggaaaaccagcagagatatgcaagaacaaacaatttttattggaaacattcctctaatgaattccctgggaacttctatagtaaatggactatacagaattgtgattaatcaaatattgcaaagccccggcatttattaccggtcagaattggaccataacggaatttcggtctataccggcaccatagtctcagattggggaggaagattagaattagagattgatagaaaagcaaggatatgggctcgtgtgagtaggaaacaaaaaatatctattctagttctatcatcagctatgggttcgaatctaagagaaattctagagaatgtttgctatcctgagatttttttgtctttcctgaatgataaggagaaaaaaaaaattgggtcaaaagaaagtgccattttggagttttatcaacaatttgcttgtgtaggtggggatccggtattttctgaatcattatgtaaggaattacaaaagaaattctttcaacaaagatgtgaattaggaaggattggtcgacgaaatataaaccggagactgaatcttgatatacctcagaacaatacatttttgttaccgcaagatatattggcagctgcggatcatttgattggaatgaaatttggaatgggtatacttgacgatatgaatcatttgaaaaataaacgtattcgttctgtagcggatctcttacaagatcaattcggactggctctaattcgtttagaaaacgtggttcgaggaactatatgtggagcaattaggcataaattaataccgactcctcagaatttggtaacttcaactccagtaacaactacttatgaatcttttttcggcttacacccattatctcaagttttggatcgaactaatccattgacacaaatagttcatgggcgaaaatcgagttatttgggccccggtggattgacagggcgaactgccagttttcggatacgagatatccatcctagtcactatggacgcatttgcccaattgacacgtctgaaggaatcaatgttggacttattggatccttagcaattcacgcgaggattggtcattggggatctctagaaagcccattttatgaaatttctgagagatcaaaaaaggtacggatgctttatttatcaccaagtagagatgaatactatatggtagcggcaggaaattctttggcactgaatcagggtattcaggaagaacaggttgttccagctcgataccgtcaagaattcctgactattgcgtgggaacaggttcatcttcgaagtatttttcctttccaatatttttctattggagcttccctcattccttttatcgagcataatgatgcgaatcgggctttaatgagttctaatatgcaacgccaagcagttccgctttctcggtccgagaagtgcattgttggaactgggttggaacgtcaagcggctctagattcaggggttcccgttatagccgaacacgagggaaagatcgtttataccgatactgacaagatcattttatcaggtaatggagatactctaagtattccattagttatgtatcaacgttccaacaaaaatacttgtatgcatcaaaaagcccaggttcggcggggtaaatgcattaaaaagggacaaattttagcggatggggccgctacagttggcggagaactagctttggggaaaaacgtattagtggcttatatgccatgggaaggttacaattctgaagatgcggtactcattagcgagcgtctggtatatggagatatttatacttcttttcacatacggaaatatgaaattcagacccatgtgacaagccaaggccccgaaaggatcactaacaaaataccgcatttagaagcacatttactccgcaatttagacaaaaatggaattgtgatactgggatcttgggtagagacgggcgatattttagtaggtaaattaacgcctcagatggcgaaagaatcatcgtatgccccggaagatagattattacgagccatacttggcattcaggtatccacttcaaaggaaacttgcctaaaactacctataggtggtcgaggtcgagttattgatgtgcgatggatccagaaaaagggtggttctagttataatccagaaacgattcgtgtatatatttcacagaaacgtgaaatcaaagtaggtgataaagtagctggaagacatggaaataagggtatcatttccaaaattttgcctagacaagatatgccttatttgcaagatggaagacctgttgatatggtctttaacccattaggagtaccgtcacgaatgaatgtaggacagatatttgaatgctcgctggggttagcggggggtctgctagacagacattatcgaatagcaccttttgatgagaaatatgaacaagaggcttcgagaaaactagtgttttctgaattatatgaagccagtaagcaaacagcgaatccatgggtatttgaacccgagtatccgggaaaaagcagaatatttgatggaagaacgggagatccttttgaacaacctgttataataggaaagccttatatcttgaaattaattcatcaagttgatgataaaatccatggacgttccagtggacattatgcacttgttacacaacaaccccttagaggaagggccaagcaagggggacaacgggtaggagaaatggaggtttgggctctagagggatttggagttgctcatattttacaagagatgcttacttataaatctgatcatattagagctcgccaggaagtacttggtactacgatcattggaggaacaatacctaaccctgaggatgctccagaatcttttcgattgctcgttcgagaactacgatctttggctctagaattgaatcatttccttgtatctgagaagaacttccagattaataggaaggaagcttaatcgaatcggactgaa

SEQ ID NO: 3221 - DNA, 8564 bp, Vitis vinifera
aaatctttctaccagtctatctattattctattatatttactattatattaatgttatttaaagttgtactgtataacatcttaatatagatcaatccacgatatgtattttcatatatgtagatatcaattacatatatgtacatagcaccccaattctatttctttgctttgatttgtattgattacaatcaatttgaaataatcgaaagtgaactcttactcttatgggtctaattcctagatttctgattatttcaaatatgaatcctggtatccatcgaaagaatcaaatcaatgaaggaaaaacagtatgggcatatataaaagaaaaccaagtaatcttttttttagcatttcaaagaagtaattgattgagccattgatagatgatccagggaattatatgataacttcttcggatttcaaaaagaagtatagtaaaagtaaaacccaccgattttgaacctttgaactatgatttgaaatgagtcgataaagcataaatccaattttttaaataataaaacaagtggtaagtccacaatatgggactcgcccaagacaggatcttattatgtgtaatatctccctggacaaccaccatgtctatgttctttcccatagaaagtgcgtatccacttaataacagaacgacttcctctttctctttgaacagtaaagagggaaacaactaaaacaaataagaaaaagggtccgttgttcctcattgtccatataaaattctggtaagaatcagttcatcgaaatagaaaatttaggaagaatagaattcaaatttggctggaataaatttcctatcatctgtatcccttttactttactttcgaaatacaaacatgggaatcgttgaaatattcttttgattgaaaaggtattattcatataatacattattccactagaatacaatagaatttcaaaatgaagatatttttatttatatttttatttattatataaaatagttaaaaaaacgctttgcagaacgatctataaaacaattgatacagtttgattcctcaactgaatcaatagtacctctagagtccacttcttccccatactacgagtgaaagagaaaatgtaaagactaccattaaagcagcccaagcgagacttactatatccatgtgaattatgtcccctatctctatgaatatgaaagaatttttccattattgctcactaataatagtggaatcgatggtgcagagtcaaaaaaggattctgacccaagaccattgatgaaccaatcccataaatccacttataacaaaacaagttcttataagatttctagtagaatcagaaaacattaagcacaagcaaaatacgagtgacacccttggaaagtatcaagggaatgttactaatgaacatgtaagaataataagaccccttgtttcttttgttcccagtattaatgaaaggcataaaaatatagaatcaagatagatcactatctactatcacatacctctatttcccattttatctaatccttattgtctcccgattgtttcacagagacaatcgggagacagtctatcgttgactagggattaccgaaaagaaagaatttctttttgcacttttctattttatataaaattatacagccaatctaatattgattgaatgctcgagcactcagaaactctcatgaatctgtatacaaagtatcttctgccctttccacaactactaattagattccccctacagctatccaatataattcaagaccgggccagtagacagattagtagtggaagggctatcaagactttccgattaccttccactactataataaaaagaatctttctttgaatcctagacgatttatagccctttagattagagaacccccagatgcttagaatcaagcaagtatcaacagttcttttctgaccttctgctgggaaataattcggcgaattatatcagcagaacataatatgggatttcgagtcttttgttgatcaggcgacacccggatttgaactggggaaaaaggatttgcagtcccccgccttaccactcggccatgccgccaaaacgatacaaaaaaagaaacccccctctcttttctattgaaattaaaaagccaaacgagtcacaaaagctcaatttcaggacaaattggaaccattaactattactattgactgtgaattcatgaacgactcttgtatttgaatctcaaattgcgtttccctaatgacataagggaatccaaattgatacataactaatcagtattgattcttttcgataaaaaatccttcgtaattttattataagagcaattatgagtatatgtaaaccccaaaacataaattcttacatagatatctaatcaggtatcttatctatatatgaatatgatgcccatagtaaattcaaatgatcgtgtttcaattttcattgaatagaaaataaaaatttgaattttgatagagcacgacctgtgctgacccgaatagaaatgcaataaaggaggagacggatatatagatagctatatctgtacatgtttaataaatataacccttcttatgcacttcaatcgtattctacgaattatactaaaaaaaataggtaaaaacatttctcttctgtgtgaattttttttttgaataatggaatcaaagtgaagtgctaaaaaatcaactctatattgtttatgattattctgtctttatcttagtgaacagatcaaaatcttagtgaacagatcaaatcctgaatccatttatattttttttttttctgatatccaatcggattggaatacgtaaaatcataataatggtataaatggaatcacttttttttttatattctatacaaaactccataagtctaagtagcatttatcaattactttacatttgtatctgttgcagattccaatttgaatagaaaattctctttattcctccgttcatatgtatttcatacattagattagatatatggagttgggtaaaatttcatgcgattcagtaaacggattataaattccatcattgctagatctcgatcgatccatatgattcgatgaagaacgaaccaatccaataacaataatgggattttttcgataaatgggaaacaaaaaatgttccggggtggaaatgagggaatgtctacaatacctgggtttaatcagatccaatttgaaggattttgtaggtttattgatcagggcttgacagaagaactttataagtttccaaaaattgaagatacagatcaagaaattgaatttcaattatttgtggaaacatatcaattggtggaaccattgataaaagaaagagatgccgtgtatgaatcactcacatattcttctgaattatatgtatctgcgggattaatttggaaaaccagcagagatatgcaagaacaaacaatttttattggaaacattcctctaatgaattccctgggaacttctatagtaaatggactatacagaattgtgattaatcaaatattgcaaagccccggcatttattaccggtcagaattggaccataacggaatttcggtctataccggcaccatagtctcagattggggaggaagattagaattagagattgatagaaaagcaaggatatgggctcgtgtgagtaggaaacaaaaaatatctattctagttctatcatcagctatgggttcgaatctaagagaaattctagagaatgtttgctatcctgagatttttttgtctttcctgaatgataaggagaaaaaaaaaattgggtcaaaagaaagtgccattttggagttttatcaacaatttgcttgtgtaggtggggatccggtattttctgaatcattatgtaaggaattacaaaagaaattctttcaacaaagatgtgaattaggaaggattggtcgacgaaatataaaccggagactgaatcttgatatacctcagaacaatacatttttgttaccgcaagatatattggcagctgcggatcatttgattggaatgaaatttggaatgggtatacttgacgatatgaatcatttgaaaaataaacgtattcgttctgtagcggatctcttacaagatcaattcggactggctctaattcgtttagaaaacgtggttcgaggaactatatgtggagcaattaggcataaattaataccgactcctcagaatttggtaacttcaactccagtaacaactacttatgaatcttttttcggcttacacccattatctcaagttttggatcgaactaatccattgacacaaatagttcatgggcgaaaatcgagttatttgggccccggtggattgacagggcgaactgccagttttcggatacgagatatccatcctagtcactatggacgcatttgcccaattgacacgtctgaaggaatcaatgttggacttattggatccttagcaattcacgcgaggattggtcattggggatctctagaaagcccattttatgaaatttctgagagatcaaaaaaggtacggatgctttatttatcaccaagtagagatgaatactatatggtagcggcaggaaattctttggcactgaatcagggtattcaggaagaacaggttgttccagctcgataccgtcaagaattcctgactattgcgtgggaacaggttcatcttcgaagtatttttcctttccaatatttttctattggagcttccctcattccttttatcgagcataatgatgcgaatcgggctttaatgagttctaatatgcaacgccaagcagttccgctttctcggtccgagaagtgcattgttggaactgggttggaacgtcaagcggctctagattcaggggttcccgttatagccgaacacgagggaaagatcgtttataccgatactgacaagatcattttatcaggtaatggagatactctaagtattccattagttatgtatcaacgttccaacaaaaatacttgtatgcatcaaaaagcccaggttcggcggggtaaatgcattaaaaagggacaaattttagcggatggggccgctacagttggcggagaactagctttggggaaaaacgtattagtggcttatatgccatgggaaggttacaattctgaagatgcggtactcattagcgagcgtctggtatatggagatatttatacttcttttcacatacggaaatatgaaattcagacccatgtgacaagccaaggccccgaaaggatcactaacaaaataccgcatttagaagcacatttactccgcaatttagacaaaaatggaattgtgatactgggatcttgggtagagacgggcgatattttagtaggtaaattaacgcctcagatggcgaaagaatcatcgtatgccccggaagatagattattacgagccatacttggcattcaggtatccacttcaaaggaaacttgcctaaaactacctataggtggtcgaggtcgagttattgatgtgcgatggatccagaaaaagggtggttctagttataatccagaaacgattcgtgtatatatttcacagaaacgtgaaatcaaagtaggtgataaagtagctggaagacatggaaataagggtatcatttccaaaattttgcctagacaagatatgccttatttgcaagatggaagacctgttgatatggtctttaacccattaggagtaccgtcacgaatgaatgtaggacagatatttgaatgctcgctggggttagcggggggtctgctagacagacattatcgaatagcaccttttgatgagaaatatgaacaagaggcttcgagaaaactagtgttttctgaattatatgaagccagtaagcaaacagcgaatccatgggtatttgaacccgagtatccgggaaaaagcagaatatttgatggaagaacgggagatccttttgaacaacctgttataataggaaagccttatatcttgaaattaattcatcaagttgatgataaaatccatggacgttccagtggacattatgcacttgttacacaacaaccccttagaggaagggccaagcaagggggacaacgggtaggagaaatggaggtttgggctctagagggatttggagttgctcatattttacaagagatgcttacttataaatctgatcatattagagctcgccaggaagtacttggtactacgatcattggaggaacaatacctaaccctgaggatgctccagaatcttttcgattgctcgttcgagaactacgatctttggctctagaattgaatcatttccttgtatctgagaagaacttccagattaataggaaggaagcttaatcgaatcggactgaatcagaatttttcttctatgatcgatcggtataaacatcaacaactccgaattggatcagtttcccctcaacaaataagtgcttgggccaataaaatcctacctaatggagagataattggagaggttacaaaaccctatacttttcattacaaaactaataaaccggaaaaagatggattattttgtgaaagaatttttggccctataaaaagtggaatttgtgcttgtggaaattatcgagtaatcggagatgaaaaagacgacccaaaattttgtgaacaatgcggagtcgaatttgttgattctcggatacgaagatatcaaatgggctacatcaaactggcatgcccagtaacgcatgtgtggtatttgaaacgtcttcctagttatatcgcaaatcttttagataaacctcttaaagaattagaaggcctagtatattgcgatgatcctatcccaatttttcttttgctaggcccatagagaaaaaacctactttcttacgattacgaggttcattcgaatatgaaattcaatcttggaaatacagcatcccacttttttttactacccaaggtttcgatacatttcgaaatcgagaaatctctaccggagccggtgctatacgagaacaattagacgatctggatttgcgaattattatagattattcattggtagaatggaaagaattaggggaagaagggcccacaggtaatgaatgggaagatcgaaaaattggaagaagaaaggattttttggttagacgcatggaattagctaagcattttattcgaacaaatatagaaccagaatggatggttttgtgtctattaccagttcttcctcccgagttgagaccgatcattcagatagatgggggtaaactaatgagctcggatattaatgaactctatagaagagttatctatcggaacaatactcttaccgatctattaacaacaagtagatctacaccaggggaattagtaatgtgtcaggagaaattggtacaagaagccgtggatacacttcttgataatggaatccgcggacaaccaatgagggacggtcataataaggtttacaagtcgttttcagatgtaattgaaggcaaagaaggaagatttcgtgagaccctgcttggcaaacgggtcgattattcggggcgttccgtcattgtcgtaggcccttcactttcattacatcaatgtggattgcctcgcgaaatagcaatagaacttttccagacatttttaattcgcggtctaattagacaacatcttgcttcgaacataggagttgctaagagtcaaattcgagaaaaagaaccgattgtatgggaaatacttcaggaagttatgcgggggcatcctgtattgctgaatagggcacctactctgcatagattaggcatacaggcattccaacctattttagtggaaggacgtgctatttgtttacatccattagttcgtaagggattcaatgcagattttgatggggatcaaatggctgttcatgtacctttatctttggaggctcaatcggaggctcgcttacttatgttttctcatatgaatctcttgtctccagccattggggatcccatttccgtaccaactcaagatatgcttattggactctatgtattaacgagcgggaatcgtcgaggtatttgtgcaaataggtataatccatgtaatcgaagaaactatcaaaatgaaagaattgacgataataactataggtatacgaaagaaaaagaaccctttttttgtaattcctatgatgcaattggagcttatcggcataaaagaattaatttatatagtcctttgtggctccggtggcaactagatcaacgccttattgcttcaaaagaagctcccatcgaagttcactatgaatctttgggtacctatcatgagatttatgggcactatctaatagtaagaagtgtaaaaaaagagattccttgtatatacattcgaaccactgttggtcatatttctctttatcgagaaatcgaagaagccatccaaggcttttgtcgggcctgctcatatgagacctaatcatatgatacttaggctaagtaattatatgatatgataccggtattaattcgggtctctccggttcaactaggatcatagttcttgaatttctacgcgaagcaag

SEQ ID NO: 3222 - DNA, 4611 bp, Vitis vinifera
tttagattagagaacccccagatgcttagaatcaagcaagtatcaacagttcttttctgaccttctgctgggaaataattcggcgaattatatcagcagaacataatatgggatttcgagtcttttgttgatcaggcgacacccggatttgaactggggaaaaaggatttgcagtcccccgccttaccactcggccatgccgccaaaacgatacaaaaaaagaaacccccctctcttttctattgaaattaaaaagccaaacgagtcacaaaagctaaatttcaggacaaattggaaccattaactattactattgactgtgaattcatgaacgactcttatatttgaatctcaaattgcgtttccctaatgacataagggaatccaaattgatacataactaatcagtattgattcttttcgataaaaaatccttcgtaattttattataagagcaattatgagtatatgtaaaccccaaaacataaattcttacatagatatctaatcaggtatcttatctatatatgaatatgatgcccatagtaaattcaaatgatcgtgtttcaattttcattgaatagaaaataaaaatttgaattttgatagagcacgacctgtgctgacccgaatagaaatgcaataaaggaggagacggatatatagatagctatatctgtacatgtttaataaatataacccttcttatgcacttcaatcgtattctacgaattatactaaaaaaaataggtaaaaacatttctcttctgtgtgaattttttttttgaataatggaatcaaagtgaagtgctaaaaaatcaactctatattgtttatgattattctgtctttatcttagtgaacagatcaaaatcttagtgaacagatcaaatcctgaatccatttatattttttttttttctgatatccaatcggattggaatacgtaaaatcataataatggtataaatggaatcacttttttttttatattctatacaaaactccataagtctaagtagcatttatcaattactttacatttgtatctgttgcagattccaatttgaatagaaaattctctttattcctccgttcatatgtatttcatacattagattagatatatggagttgggtaaaatttcatgcgattcagtaaacggattataaattccatcattgctagatctcgatcgatccatatgattcgatgaagaacgaaccaatccaataacaataatgggattttttcgataaatgggaaacaaaaaatgttccggggtggaaatgagggaatgtctacaatacctgggtttaatcagatccaatttgaaggattttgtaggtttattgatcagggcttgacagaagaactttataagtttccaaaaattgaagatacagatcaagaaattgaatttcaattatttgtggaaacatatcaattggtggaaccattgataaaagaaagagatgccgtgtatgaatcactcacatattcttctgaattatatgtatctgcgggattaatttggaaaaccagcagagatatgcaagaacaaacaatttttattggaaacattcctctaatgaattccctgggaacttctatagtaaatggactatacagaattgtgattaatcaaatattgcaaagccccggcatttattaccggtcagaattggaccataacggaatttcggtctataccggcaccatagtctcagattggggaggaagattagaattagagattgatagaaaagcaaggatatgggctcgtgtgagtaggaaacaaaaaatatctattctagttctatcatcagctatgggttcgaatctaagagaaattctagagaatgtttgctatcctgagatttttttgtctttcctgaatgataaggagaaaaaaaaaattgggtcaaaagaaagtgccattttggagttttatcaacaatttgcttgtgtaggtggggatccggtattttctgaatcattatgtaaggaattacaaaagaaattctttcaacaaagatgtgaattaggaaggattggtcgacgaaatataaaccggagactgaatcttgatatacctcagaacaatacatttttgttaccgcaagatatattggcagctgcggatcatttgattggaatgaaatttggaatgggtatacttgacgatatgaatcatttgaaaaataaacgtattcgttctgtagcggatctcttacaagatcaattcggactggctctaattcgtttagaaaacgtggttcgaggaactatatgtggagcaattaggcataaattaataccgactcctcagaatttggtaacttcaactccagtaacaactacttatgaatcttttttcggcttacacccattatctcaagttttggatcgaactaatccattgacacaaatagttcatgggcgaaaatcgagttatttgggccccggtggattgacagggcgaactgccagttttcggatacgagatatccatcctagtcactatggacgcatttgcccaattgacacgtctgaaggaatcaatgttggacttattggatccttagcaattcacgcgaggattggtcattggggatctctagaaagcccattttatgaaatttctgagagatcaaaaaaggtacggatgctttatttatcaccaagtagagatgaatactatatggtagcggcaggaaattctttggcactgaatcagggtattcaggaagaacaggttgttccagctcgataccgtcaagaattcctgactattgcgtgggaacaggttcatcttcgaagtatttttcctttccaatatttttctattggagcttccctcattccttttatcgagcataatgatgcgaatcgggctttaatgagttctaatatgcaacgccaagcagttccgctttctcggtccgagaagtgcattgttggaactgggttggaacgtcaagcggctctagattcaggggttcccgttatagccgaacacgagggaaagatcgtttataccgatactgacaagatcattttatcaggtaatggagatactctaagtattccattagttatgtatcaacgttccaacaaaaatacttgtatgcatcaaaaagcccaggttcggcggggtaaatgcattaaaaagggacaaattttagcggatggggccgctacagttggcggagaactagctttggggaaaaacgtattagtggcttatatgccatgggaaggttacaattctgaagatgcggtactcattagcgagcgtctggtatatggagatatttatacttcttttcacatacggaaatatgaaattcagacccatgtgacaagccaaggccccgaaaggatcactaacaaaataccgcatttagaagcacatttactccgcaatttagacaaaaatggaattgtgatactgggatcttgggtagagacgggcgatattttagtaggtaaattaacgcctcagatggcgaaagaatcatcgtatgccccggaagatagattattacgagccatacttggcattcaggtatccacttcaaaggaaacttgcctaaaactacctataggtggtcgaggtcgagttattgatgtgcgatggatccagaaaaagggtggttctagttataatccagaaacgattcgtgtatatatttcacagaaacgtgaaatcaaagtaggtgataaagtagctggaagacatggaaataagggtatcatttccaaaattttgcctagacaagatatgccttatttgcaagatggaagacctgttgatatggtctttaacccattaggagtaccgtcacgaatgaatgtaggacagatatttgaatgctcgctggggttagcggggggtctgctagacagacattatcgaatagcaccttttgatgagaaatatgaacaagaggcttcgagaaaactagtgttttctgaattatatgaagccagtaagcaaacagcgaatccatgggtatttgaacccgagtatccgggaaaaagcagaatatttgatggaagaacgggagatccttttgaacaacctgttataataggaaagccttatatcttgaaattaattcatcaagttgatgataaaatccatggacgttccagtggacattatgcacttgttacacaacaaccccttagaggaagggccaagcaagggggacaacgggtaggagaaatggaggtttgggctctagagggatttggagttgctcatattttacaagagatgcttacttataaatctgatcatattagagctcgccaggaagtacttggtactacgatcattggaggaacaatacctaaccctgaggatgctccagaatcttttcgattgctcgttcgagaactacgatctttggctctagaattgaatcatttccttgtatctgagaagaacttccagattaataggaaggaagcttaatcgaatcggactgaatcagaatttttcttctatgatcgatcggtataaacatcaacaactccgaattggatcagtttcccctcaacaaataagtgcttgggccaataaaatcctacctaatggag

SEQ ID NO: 3223 - DNA, 24861 bp, Vitis vinifera
aaatctttctaccagtctatctattattctattatatttactattatattaatgttatttaaagttgtactgtataacatcttaatatagatcaatccacgatatgtattttcatatatgtagatatcaattacatatatgtacatagcaccccaattctatttctttgctttgatttgtattgattacaatcaatttgaaataatcgaaagtgaactcttactcttatgggtctaattcctagatttctgattatttcaaatatgaatcctggtatccatcgaaagaatcaaatcaatgaaggaaaaacagtatgggcatatataaaagaaaaccaagtaatcttttttttagcatttcaaagaagtaattgattgagccattgatagatgatccagggaattatatgataacttcttcggatttcaaaaagaagtatagtaaaagtaaaacccaccgattttgaacctttgaactatgatttgaaatgagtcgataaagcataaatccaattttttaaataataaaacaagtggtaagtccacaatatgggactcgcccaagacaggatcttattatgtgtaatatctccctggacaaccaccatgtctatgttctttcccatagaaagtgcgtatccacttaataacagaacgacttcctctttctctttgaacagtaaagagggaaacaactaaaacaaataagaaaaagggtccgttgttcctcattgtccatataaaattctggtaagaatcagttcatcgaaatagaaaatttaggaagaatagaattcaaatttggctggaataaatttcctatcatctgtatcccttttactttactttcgaaatacaaacatgggaatcgttgaaatattcttttgattgaaaaggtattattcatataatacattattccactagaatacaatagaatttcaaaatgaagatatttttatttatatttttatttattatataaaatagttaaaaaaacgctttgcagaacgatctataaaacaattgatacagtttgattcctcaactgaatcaatagtacctctagagtccacttcttccccatactacgagtgaaagagaaaatgtaaagactaccattaaagcagcccaagcgagacttactatatccatgtgaattatgtcccctatctctatgaatatgaaagaatttttccattattgctcactaataatagtggaatcgatggtgcagagtcaaaaaaggattctgacccaagaccattgatgaaccaatcccataaatccacttataacaaaacaagttcttataagatttctagtagaatcagaaaacattaagcacaagcaaaatacgagtgacacccttggaaagtatcaagggaatgttactaatgaacatgtaagaataataagaccccttgtttcttttgttcccagtattaatgaaaggcataaaaatatagaatcaagatagatcactatctactatcacatacctctatttcccattttatctaatccttattgtctcccgattgtttcacagagacaatcgggagacagtctatcgttgactagggattaccgaaaagaaagaatttctttttgcacttttctattttatataaaattatacagccaatctaatattgattgaatgctcgagcactcagaaactctcatgaatctgtatacaaagtatcttctgccctttccacaactactaattagattccccctacagctatccaatataattcaagaccgggccagtagacagattagtagtggaagggctatcaagactttccgattaccttccactactataataaaaagaatctttctttgaatcctagacgatttatagccctttagattagagaacccccagatgcttagaatcaagcaagtatcaacagttcttttctgaccttctgctgggaaataattcggcgaattatatcagcagaacataatatgggatttcgagtcttttgttgatcaggcgacacccggatttgaactggggaaaaaggatttgcagtcccccgccttaccactcggccatgccgccaaaacgatacaaaaaaagaaacccccctctcttttctattgaaattaaaaagccaaacgagtcacaaaagctcaatttcaggacaaattggaaccattaactattactattgactgtgaattcatgaacgactcttgtatttgaatctcaaattgcgtttccctaatgacataagggaatccaaattgatacataactaatcagtattgattcttttcgataaaaaatccttcgtaattttattataagagcaattatgagtatatgtaaaccccaaaacataaattcttacatagatatctaatcaggtatcttatctatatatgaatatgatgcccatagtaaattcaaatgatcgtgtttcaattttcattgaatagaaaataaaaatttgaattttgatagagcacgacctgtgctgacccgaatagaaatgcaataaaggaggagacggatatatagatagctatatctgtacatgtttaataaatataacccttcttatgcacttcaatcgtattctacgaattatactaaaaaaaataggtaaaaacatttctcttctgtgtgaattttttttttgaataatggaatcaaagtgaagtgctaaaaaatcaactctatattgtttatgattattctgtctttatcttagtgaacagatcaaaatcttagtgaacagatcaaatcctgaatccatttatattttttttttttctgatatccaatcggattggaatacgtaaaatcataataatggtataaatggaatcacttttttttttatattctatacaaaactccataagtctaagtagcatttatcaattactttacatttgtatctgttgcagattccaatttgaatagaaaattctctttattcctccgttcatatgtatttcatacattagattagatatatggagttgggtaaaatttcatgcgattcagtaaacggattataaattccatcattgctagatctcgatcgatccatatgattcgatgaagaacgaaccaatccaataacaataatgggattttttcgataaatgggaaacaaaaaatgttccggggtggaaatgagggaatgtctacaatacctgggtttaatcagatccaatttgaaggattttgtaggtttattgatcagggcttgacagaagaactttataagtttccaaaaattgaagatacagatcaagaaattgaatttcaattatttgtggaaacatatcaattggtggaaccattgataaaagaaagagatgccgtgtatgaatcactcacatattcttctgaattatatgtatctgcgggattaatttggaaaaccagcagagatatgcaagaacaaacaatttttattggaaacattcctctaatgaattccctgggaacttctatagtaaatggactatacagaattgtgattaatcaaatattgcaaagccccggcatttattaccggtcagaattggaccataacggaatttcggtctataccggcaccatagtctcagattggggaggaagattagaattagagattgatagaaaagcaaggatatgggctcgtgtgagtaggaaacaaaaaatatctattctagttctatcatcagctatgggttcgaatctaagagaaattctagagaatgtttgctatcctgagatttttttgtctttcctgaatgataaggagaaaaaaaaaattgggtcaaaagaaagtgccattttggagttttatcaacaatttgcttgtgtaggtggggatccggtattttctgaatcattatgtaaggaattacaaaagaaattctttcaacaaagatgtgaattaggaaggattggtcgacgaaatataaaccggagactgaatcttgatatacctcagaacaatacatttttgttaccgcaagatatattggcagctgcggatcatttgattggaatgaaatttggaatgggtatacttgacgatatgaatcatttgaaaaataaacgtattcgttctgtagcggatctcttacaagatcaattcggactggctctaattcgtttagaaaacgtggttcgaggaactatatgtggagcaattaggcataaattaataccgactcctcagaatttggtaacttcaactccagtaacaactacttatgaatcttttttcggcttacacccattatctcaagttttggatcgaactaatccattgacacaaatagttcatgggcgaaaatcgagttatttgggccccggtggattgacagggcgaactgccagttttcggatacgagatatccatcctagtcactatggacgcatttgcccaattgacacgtctgaaggaatcaatgttggacttattggatccttagcaattcacgcgaggattggtcattggggatctctagaaagcccattttatgaaatttctgagagatcaaaaaaggtacggatgctttatttatcaccaagtagagatgaatactatatggtagcggcaggaaattctttggcactgaatcagggtattcaggaagaacaggttgttccagctcgataccgtcaagaattcctgactattgcgtgggaacaggttcatcttcgaagtatttttcctttccaatatttttctattggagcttccctcattccttttatcgagcataatgatgcgaatcgggctttaatgagttctaatatgcaacgccaagcagttccgctttctcggtccgagaagtgcattgttggaactgggttggaacgtcaagcggctctagattcaggggttcccgttatagccgaacacgagggaaagatcgtttataccgatactgacaagatcattttatcaggtaatggagatactctaagtattccattagttatgtatcaacgttccaacaaaaatacttgtatgcatcaaaaagcccaggttcggcggggtaaatgcattaaaaagggacaaattttagcggatggggccgctacagttggcggagaactagctttggggaaaaacgtattagtggcttatatgccatgggaaggttacaattctgaagatgcggtactcattagcgagcgtctggtatatggagatatttatacttcttttcacatacggaaatatgaaattcagacccatgtgacaagccaaggccccgaaaggatcactaacaaaataccgcatttagaagcacatttactccgcaatttagacaaaaatggaattgtgatactgggatcttgggtagagacgggcgatattttagtaggtaaattaacgcctcagatggcgaaagaatcatcgtatgccccggaagatagattattacgagccatacttggcattcaggtatccacttcaaaggaaacttgcctaaaactacctataggtggtcgaggtcgagttattgatgtgcgatggatccagaaaaagggtggttctagttataatccagaaacgattcgtgtatatatttcacagaaacgtgaaatcaaagtaggtgataaagtagctggaagacatggaaataagggtatcatttccaaaattttgcctagacaagatatgccttatttgcaagatggaagacctgttgatatggtctttaacccattaggagtaccgtcacgaatgaatgtaggacagatatttgaatgctcgctggggttagcggggggtctgctagacagacattatcgaatagcaccttttgatgagaaatatgaacaagaggcttcgagaaaactagtgttttctgaattatatgaagccagtaagcaaacagcgaatccatgggtatttgaacccgagtatccgggaaaaagcagaatatttgatggaagaacgggagatccttttgaacaacctgttataataggaaagccttatatcttgaaattaattcatcaagttgatgataaaatccatggacgttccagtggacattatgcacttgttacacaacaaccccttagaggaagggccaagcaagggggacaacgggtaggagaaatggaggtttgggctctagagggatttggagttgctcatattttacaagagatgcttacttataaatctgatcatattagagctcgccaggaagtacttggtactacgatcattggaggaacaatacctaaccctgaggatgctccagaatcttttcgattgctcgttcgagaactacgatctttggctctagaattgaatcatttccttgtatctgagaagaacttccagattaataggaaggaagcttaatcgaatcggactgaatcagaatttttcttctatgatcgatcggtataaacatcaacaactccgaattggatcagtttcccctcaacaaataagtgcttgggccaataaaatcctacctaatggagagataattggagaggttacaaaaccctatacttttcattacaaaactaataaaccggaaaaagatggattattttgtgaaagaatttttggccctataaaaagtggaatttgtgcttgtggaaattatcgagtaatcggagatgaaaaagacgacccaaaattttgtgaacaatgcggagtcgaatttgttgattctcggatacgaagatatcaaatgggctacatcaaactggcatgcccagtaacgcatgtgtggtatttgaaacgtcttcctagttatatcgcaaatcttttagataaacctcttaaagaattagaaggcctagtatattgcgatgtgtgatttgatcgaaattctgattttacagattcagaatgagaaactgtcatcccattcaatccaattgggatgcctcggctctgacatgtctcttaagaggagtaacatgaagctcagaattatgggtgtattctatactaccaaataaaagggtaattgatctatggtcgattccgtaacaaataaataggaatgtttagttgtacctcgtgaaaaaagacttctttcttttgcttttgtggaattaaccattctcttttctctttcttttagaaagaattttttttatgttcaagtaaacaaatatgtcatggttacaggagtctatccatcgcatataggctttaagggcatcgtggcataaccgtcgaggcgaagtcaggacctaaaaagatcgaatgaaacgatacatagacaagtaaatcccttatgaattctaaggtactcctttaattttgaatttaagtttaaggggattcatcattcgaagggaagtagactactcaataatatttcatttatgtcgtaattgaataaagaattcagaaaatctaaataataaggaagaatgaatcaatgaaatgttgcttggtcttcactgggaacttgagtaaggagtagttgttttgaggattttctagaatttgaaagccagaacccctttctttatctttatttggtgtaactacttgagccggacgagaggaaactttcacgtccgattttgaaggggggagatcctataggatcctatcccaatttttcttttgctaggcccatagagaaaaaacctactttcttacgattacgaggttcattcgaatatgaaattcaatcttggaaatacagcatcccacttttttttactacccaaggtttcgatacatttcgaaatcgagaaatctctaccggagccggtgctatacgagaacaattagacgatctggatttgcgaattattatagattattcattggtagaatggaaagaattaggggaagaagggcccacaggtaatgaatgggaagatcgaaaaattggaagaagaaaggattttttggttagacgcatggaattagctaagcattttattcgaacaaatatagaaccagaatggatggttttgtgtctattaccagttcttcctcccgagttgagaccgatcattcagatagatgggggtaaactaatgagctcggatattaatgaactctatagaagagttatctatcggaacaatactcttaccgatctattaacaacaagtagatctacaccaggggaattagtaatgtgtcaggagaaattggtacaagaagccgtggatacacttcttgataatggaatccgcggacaaccaatgagggacggtcataataaggtttacaagtcgttttcagatgtaattgaaggcaaagaaggaagatttcgtgagaccctgcttggcaaacgggtcgattattcggggcgttccgtcattgtcgtaggcccttcactttcattacatcaatgtggattgcctcgcgaaatagcaatagaacttttccagacatttttaattcgcggtctaattagacaacatcttgcttcgaacataggagttgctaagagtcaaattcgagaaaaagaaccgattgtatgggaaatacttcaggaagttatgcgggggcatcctgtattgctgaatagggcacctactctgcatagattaggcatacaggcattccaacctattttagtggaaggacgtgctatttgtttacatccattagttcgtaagggattcaatgcagattttgatggggatcaaatggctgttcatgtacctttatctttggaggctcaatcggaggctcgcttacttatgttttctcatatgaatctcttgtctccagccattggggatcccatttccgtaccaactcaagatatgcttattggactctatgtattaacgagcgggaatcgtcgaggtatttgtgcaaataggtataatccatgtaatcgaagaaactatcaaaatgaaagaattgacgataataactataggtatacgaaagaaaaagaaccctttttttgtaattcctatgatgcaattggagcttatcggcataaaagaattaatttatatagtcctttgtggctccggtggcaactagatcaacgccttattgcttcaaaagaagctcccatcgaagttcactatgaatctttgggtacctatcatgagatttatgggcactatctaatagtaagaagtgtaaaaaaagagattccttgtatatacattcgaaccactgttggtcatatttctctttatcgagaaatcgaagaagccatccaaggcttttgtcgggcctgctcatatgagacctaatcatatgatacttaggctaagtaattatatgatatgataccggtattaattcgggtctctccggttcaactaggatcatagttcttgaatttctacgcgaagcaagatcgagaaaaggaagttttacaaccactgactcaaacccattgtcaaatcctactcagcggaatatgggggtacttatgacagaaagggctaatctggtctttcacaataaagtgatagatggaactgccatgaaacgacttattagcagattaatagatcacttcggaatggcatatacatcacacatcctggatcaagtaaagactctgggtttccagcaagccactgctacatccatttcattaggaattgatgatcttttaacaataccttctaagggatggctagtccaagatgctgaacaacaaagtttgattttggaaaaacaccatcattatgggaatgtacacgcggtagaaaaattacgccaatccattgagatctggtatgctacaagtgaatatttgcgacaagaaatgaatactaattttaggatgactgacccctttaatccagttcatataatgtctttttcgggagctagaggaaatgcatctcaggtacaccaattagtaggtatgagaggattaatgtcagatccccaaggacaaatgattgatttacccattcaaagcaatttacgtgaggggctctctttaacagaatatataatttcttgctacggagcccgcaagggggttgtagatactgctgtacgaacatcagatgctggatatctcacgcgtagacttgttgaagtagttcaacacattgttgtacgtagaacagattgtggcactatccgaggtatttctgtgagtcctcgaaatgggatgataccggaaagaatttttattcaaacattaattggtcgtgtattagcagacgatatatatatgggcccacgatgcatcgccattcgaaatcaagatattgggattgggcttgtcaatcgattcataacctttcaagcacagacaatatcgattcgaaccccctttacttgtaagagcacatcttggatctgtcgactatgttatggtcggagtcctactcatggcgacctggtcgaattgggagaagctgtaggtattattgcggggcaatctattggagaaccgggtactcaactaacattaagaacttttcataccggcggagtattcactgggggtactgcagagcatgtacgagccccttctaatggaaaaataaaattcaatgaagattgggttcatcccacacgtacacgtcatggacatcctgcttttctatgttatatagacttgtatgtaactattgagagtgaaggaattatacataacgtgaatattcccccaaaaagttttcttctagttcaaaatgatcaatatgtagaatcagaacaagtgattgctgagattcgtgcaggaacatacactttcaattttaaggaaagggttcgaaaacatatttattctgactcagagggagaaatgcattggagtaccgatgtgtaccatgcacctgaatttacatatggtaatgttcatctattaccaaagacaagtcatttatggatattatctgggggttcatgcagattcagtatagtccctttttcgatccacaaggatcaagatcaaatgagcgttcgttctctttctgtcgaacgaagatatatttctaacccctcagtgactaatgatcaagtgatacacgaattctttagttctgatctttctggtaaaaaagaaggtaggattcctgcttattcagaacttaatcgaatcatatatactggtcgttataatctcatagatcctgccattctacacgagaattctgatttattggcaaagaggcgaagaaatagattcatcattccattccaatcgattcaagaaggagagaaagaactaatgcccccttcaggtatctcgattgaaatacctataaatggtattttccgtagaaatagtattcttgcttatttcgacgatcctcgatacagaagaaacagctcaggaattactaaatatgggactatagaggcgcattcaatcgttaaaaaagaggatttgattgaatatcgaggagtcaaagaatttaagccaaaataccaaatgaaagtagatcgattttttttcattcccgaggaagtgcatattttacccggatctgcttccataatggtacggaacaatagtatcattggagtagatacacgaatcactttaaatacaagaagccgagtaagtggattggtccgagtggagagaaaaaaaaaaaggattgaacttaaaatcttttctggagatatccagtttcctggagagacaaataagatatcccgacacatcggcatcttgataccaccaggaacgagaaaaaaaaattccaaggaatcaaaaaaattgaaaaattggatctatgtccaagggatcacacctaccaagaaaaagtattttgttttggttcgacccgtagtcacatatgaaatagcggacggtataaatttagcaacacttttccctcaggatctgttgcaggaaagggataatatgcaccttcaagttgtcaattatatcctttatggaaatggcaaaccgattcggggaatttctgatacaagtattcaattagttcggacttgtttagtattgaattggtaccaagaaaaaaaaagttctcctatcgaaaagacccatgcttcctttatggaagtaaggacaaatggtctgattcgagatttcctaacaattaacttagtgaaatcctatatttcatataccggaaaaaggaatgatccgtcaagttcaggattgatcgctgataatggatcagatcacaccaatatcaatccgttttattccatttatccgaaggaaaggattcaacaattacttagacaaagacaaaaaaaaaatcaaggaactattcgtacgttattaaatagaaataaggaatgccaatctttgataattttgtcatcatccaattgttctcgaatgggtccattcaacgatgtaaaatatcacaatgtgataaaagaatcaattaaaaaagataccccaattccaattaggaattcgttgggtcctttaggaacagcccttcaaattacgaatttttattcattttaccatttaataactcataatcatatcttggtaactaaatatttccaacttgacaattttaaacagacttttcaaacacttaaatattatttaatggatgaaaatgggataacttataatcccgatccatgcagtaacatcattttgaatccattcaatttgaattggtattttctccatcataattattgtgaagagacatccacaataattagtctcggacagtttatttgtgaaaatgtatgtatagccaaaaacggaccacacctaaaatcaggtcaagttctaattgttcaagttgactctgtagtaataagatcagctaagccttatttggctactctgggagcaactgttcatggacattatggggaaatcctttacgaaggagatacattagttacatttatatatgaaaaatcaagatctggtgatataacgcagggtcttccaaaagtggaacaagtgttagaagtgcgttcgattgattccatatcgatgaacctagaaaagagagttgagggttggaacgagcatataacaagaattcttggaattccttggggattcttcattggtgctgagctaactatagcgcaaagtcgtatctctttagttaataagatccaaaaggtttatcgatcccagggggttcagatccataataggcatatagaaattattgtacgtcaaataacatcaaaagtgttggtttcagaagatggaatgtctaatgttttttcgcccggagaactaattggattgttgcgagcggaacgaacggggcgtgctttcgaagaagctatttgttaccgaaccattttattgggaataacgagagcgtctctgaatactcaaagtttcatatccgaggcgagttttcaagaaactgctcgagttttagcaaaagctgctctgtggggtcgtatcgattggttgaaaggcctaaaagaaaacgtcgttctgggggggatgatacccgttggtaccggatttaaaggattagtgcaccgttcaaggcaacataacaacatccctttggaaatggaaaccaaaaagaataatttattcgagagggaaatgagagatattttgttccaccacagagaattatttgattcttgcagttcaaagaatttccatgatacatcagaacaatcatttatgggatttaatgattcctaagagcagattcattcttttaactatctgtatttggtctggtatttgatttggtaatagtaataaagataaaaacgaatagaaaagaattaatggcttggatcgtgtatcaacggccaatctccggtataagagaaggttccatcggaacaattatttatttcggggtacctcgtctcttttttttttattttaaaaaaaagagaaagtgtgtggagaaatgacaagaagatattggaacatcaatttggaagagatgatggaagcaggagttcattttggtcatggtactaggaaatggaatcctagaatggcgccttatatctcggcaaagcgtaaaggtattcatattacaaatcttactagaactgctcgctttttatcagaagcttgtgatttagtttttgatgcagcaagtaggggaaaacaattcttaattgttggtaccaaaaataaagcagcggattcagtagcacgggctgcaataaaggctcggtgtcattatgttaataaaaaatggctcggtggtatgtcaacgaattggtccactacagaaacgagacttcataaattcagggacttgagaacggaacaaaagacggggagactcaatcgtcttccgaaaagagatgcagctatgttgaagagacaattatctcacttgcaaacatatttgggtgggattaaatatatgacggggttacccgatattgtaataatcgttgatcagcaagaagaatatacggctcttcgagaatgtatcactttaggaattccaacgatttgtttaatcgatacaaattgtgaccccgatctcgcagatatttcgattccagcaaatgatgacgctatagcttcaatccgattaattcttaataaattagtattcgctatttgtgagggtcgttctagctatataagaaatccttgattaataataagataaataataactttgggaactccatagatttatggaaatggaatcggttactagttttgaatctcaaaaaagagataaaaaactggggatattatgtgattagttggtattcaaaatagacaattcaagtaggtaagtcgagaaagagatggttgaatcaaaataattccttttaaagttctattcctatcagagggcaatatgaatgttctatcatgttccatcaacacactaaaagggttatacgatatatctggtgtggaagtcggccaacatttctattggcaaatagggggtttccaagtccatgcccaagtacttattacttcgtgggttgtaatcgctatcttattaggttcagctactctagctgttcgaaatccacaaaccattcctactgacggtcagaatttcttcgaatatgtccttgaattcattcgagacgtgagcaaaactcagattggagaagaatatggttcttgggttccttttattggaactatgtttctatttatttttgtttcgaattggtcaggggctcttttgccttggaaaatcatacagttacctcatggggagttagctgcacccacgaatgatataaatactactgttgctttagctttactcacatcagtggcctatttctatgcgggtcttaccaaaaagggattaggttatttcggtaaatacattcaaccgactccaatccttttacctattaacatcttagaagattttacaaaacctttatcacttagttttcgacttttcggtaatatattagctgatgaattagtagttgttgttcttgtttctttagtaccttcaattgttcctatacctgtcatgttccttggattatttacaagtggtattcaagctcttatttttgcaactttagccgcggcttatataggcgaatccatggagggtcatcattgactagttttcgaaataagctttttttagcttagtccaacgtactctatgaatggtttaagataatctacttagggaacataaatatacaaatacggtatatatatgatctagagtaatatcaaaaaagattaggatattagggaattgtaaaaaagggaaagggatctaaaactaaaagatctttttcctaaaattcccctttgggccgtttatatcatacttacctagaataaatattctatttatattgttcagccaattccattccaatattaaatattaggagtctgaatttgaataagaattcttatagtatctgtttacgacttacgacgtgcaattaaataaaaaaaaaggatgttctatggaacgattcccatttcttgtggatgttccgaagaatgattttagaatccgattgaatctaagatacgaatagttgggttgcgttatggaagaaacacatgtatatgtgatattatgactagttatatatgagactagttatatatgaactaaagatatatataatttgacttactattgtgaatttagatggggattctaatagaagtccttccgtttcgtctgtgactatgaattgaatgaataaagaaaagggatgaaatcaagaaaaagagcgaagaattcaaagaaaagaatggttcggaacaaagaaatggggaagaactaaagtcgtatggattcacaaagacgccatgtataggaactaaaaaagaaatatcgaaatagttctgatgattcaataatattattacttcaattcagagttcttagttacttcgactggatgaatgttatcaatggaataattaagtcataattcattggttgattgtatcattaaccatttctttattttggtgcgaggaacttatcatgaatccactgatttctgccgcttccgttattgctgctggattggccgtagggcttgcttctattggacctggcgttggtcaaggtactgctgcgggccaagctgtagaaggtatcgcaagacagcccgaggcggagggaaaaatacgaggtactttattgcttagtctggcttttatggaagctttaacaatttatggactggttgtagcattagcacttttatttgcgaatccttttgtttaattgtttaatcctagaaatatgaaaaatacgtatttttcatattttcttattttatttccttggacctgtcgcttgctttttagaattatatcaagattgaactacgacaattacttattcgttgagataataacccatgggaaggactgatttgaggatgaggaagatttgaggatgaggaattagcaaatcgactcgctttcttccttcccttcccgttcttagtccaatgaaaaccttttttttagtaagtgttggaacaaacgaagtatttcgtaattgacatgagactcggtatctcatttttcattcttattggaaatttcaattgaaaaaataaaatccagttataaattataaatcgaatatttttttttctgtttagaaatagagaaattaataaaaaagaaaataaaaaataaggggtgaagtgatagaaaaagaactctgttcgatttttttagtctatctattttagtctatctataagaggagatcatatgaaaaatgtaaccgattctttcgtttccttgggtcactggccatccgccgggggtttcgggtttaataccgatattttagcaacaaatccaataaatctaagtgtagtgcttggtgtattgatcttttttggaaagggagtgtgtgcgagttgtttatttcaagaataggctggactcgaccagctgcactttttttcgttataactaggaacgaaaggtgcatgatcccgcgaattacttctgaataaattaagaaatcatatgtaagaaccatagcatttcgtgattcattggtaaatatattttgattctctatcaaccaatgatgcggtaccattaacatggttaaagctaaaccgtttgaagtccagacccagcatggtattctttctaccactatattaatgcggaggtagtttcaaaatgaatagttggaaattttttcggtatagaacactcatgtcgataaaatgatttgaaccatttattggaaaaatgggtatttcgttcccttttttttattttatccaatgctgaatcgatgacctatgtctatgtataaagtaagaataatttttttggatttgaataaaaaaaaagaaacaactttgctgacaactacatatgtttggtcagaagagtcctccgaatattctggtcttggattagtatgatcagtttcgatatttttatttttggggggaatatgaacagagaagagaggataggctcattacattcaaaacaaaaatatatgggaatttcccataagtaatttaagtaattgaagtaattgagcgcgagagccaaatgaatcgaaagattcgtgtttggttcgggaagggatcatggaagtttttaaatgaatggaaagataatctactttcattaagtgatttattagataatcgaaaacagaggatcttgaatactattcgaaattcagaagaactacgtgagggggccattgaacaactcgaaaaagcccgggcccgcttacggaaagtggaaatggaagcagatcagtatcgagtgaatggatactctgagatagaacgagaaaaattgaatttgattaattcaacttataatactttggaacaattagaaaattacaaaaatgaaaccattcattttgaacaacaaagagcgattaatcaagtccgacaacgggttttgcaacaagccttacaaggagctctaggaactatcaatagttgtttgaacaaggaattacatttacgtactatcagtgctaatattggcatgtttgggtcgatgaaagaaataagaaataactgattagtccttactactgtaggcattattttttttttttctttccaaaaaagaattaagaaatattcatggtaaccatccgagccgacgaaattagtaatattatccgtgaacgcattgaacaatataatagagaagtaaagattgtaaatactggtaccgtacttcaagtaggcgatggcattgctcgtattcatggtcttgatgaagtaatggcaggtgaattagtagaatttgaagaaggtacaataggcattgctttgaatttggaatcaaataatgttggtgttgtattaatgggtgacggtttgatgatacaagagggaagttctgtaaaagcaacaggaagaattgctcagatacctgtgagtgaggcttatttgggtcgtgttataaatgccctagcgaaacctattgatggtagaggtgaaatttcagcttctgaatctcggttaattgaatctcccgctccaggtattatttcgagacgttccgtatatgagcctcttcaaacagggcttattgctattgattcgatgatccctatagggcgtggtcaacgagaattaattattggggatagacagaccggtaaaacagcagtagccacagatactattctcaatcaacaagggcaaaatgtaatatgtgtttatgtagctattggtcaaaaagcatcctctgtagctcaggtagtgactactttccaggaaaggggagcgatggaatacactattgtggtagctgaaacggcggactcgcctgctacattacaataccttgccccttatacaggagcagctctggctgaatattttatgtaccgtaaacgacacactttaattatttatgatgatccctccaaacaagcacaagcttatcgtcaaatgtctcttctattacgaagaccacctggtcgcgaagcttatccaggagatgttttttatttgcactcacgccttttggaaagagccgctaaatcaagttcttctttaggtgaaggaagtatgactgctttaccaatagttgagacccaatcgggagatgtttcggcttatattcccacgaatgtaatttccattacagatggacaaatattcttatccgccgatttattcaatgctggaatcaggcctgctattaatgtgggtatttccgtctccagagtaggatccgcggctcaaattaaagccatgaaacaagtagctggcaaatcaaaattggaactggcgcaattcgcagaattagaagcctttgcacaattctcttctgatcttgataaagctactcagaatcaattggcaagaggtcaacgattacgtgaattgctcaaacaatcccaagcagcccctcttacggtggaagaacagataatgactatttatactggaacaaatggttatcttgattcattagaaattggacaggtaaggaaatttcttgctgagttacgtaattacttaaaaacgaataaacctcagttccaagaaatcatatcttctaccaagacattcaccgaggaagcagaaacccttttgaaagaaactattcaggaacagatggaacgctttctacttcaggaacaagcataaagaaattgatcactcttaattcttagtctaattaatgaatttaataataaataaaaaaaatgaatatttaataataaaaaggtaatcctttatattaaatattaagaaaataaaataaataataaataaaagcgtctctgatttaaatcattccaaatttctttactgataaaagaatagaatatatggaaataagttgcgtccaataggatttgaacctataccaaaggtttagaagacctctgtcctatccattagacaatggacgcttttcattccgatttttttttcttttcgcatttttgctttcctatctcttgttcggaaaaaaagaatcggattgtgtgtgagagaatttcgggaattgcatattcaattcaatgatgcattaatttcattttcattctaaataatatagagtataatattgagcgggtagcgggaatcgaacccgcatcgttagcttggaaggctaggggttatagtcgacgtcgattcattttatttttaacgtctctaattcaaaaccgaacatgaaactttggtttcattcggctcctttatggaggatggataaatttccagatttaagacatgaatgaaataaaaaaaaaattcgatccataacatctatgtcagcttttctgcctgaatgcattcaaaacgattggctttctagatgatccctctagaacagggtgattataagaatctttctagttacttcgttctctatttctatttgagagaatcctgaggaaaagcattttgtttccaccgagctaaaacaatatttcgatgtctctagtaaaccaaagacatcctttactagctagtttgcttcaatcgcccctctacaaatacaaacaaacttagaattgaagatttagttacgattagaaatacacttttctatcttcatccatggatcctttactcacactcattcaattggaagtattgatccaattcataaaaattatgtttcgtaatttcataatccaatttccaaatttcatacaagtcacgagaatgtgtattcttcctcaaatccatcattgagaggtaaaggattaaatccttttaagataagaaataaagtttttcgtcggaatttgaatcaaatcaaaccgaaggaacccttaactattagggggggttaatagaacgaatcacacttttaccactaaactatacccgctacaatgtgattattgtatataaattgaccttttgtcgaacaaaggaatcggacacgatcaagatagaatcagaaaagaatcatgaaaattagagttttgttggggacttaatgagattaggaaaagaggtctcatttaaataactaaataacaagttctattttttgctggaggatttttagtttttacagatacgtctcgacaaaaccacttaagtcataacataaaaacgcattgtgcaagaatccatagttcccttttttttttttaacttccccattcttttctttgcttgaaagaaaagaaaggattttctcaaaaaagagagagtttgaatcttttttttaaggtattcccttatgtctatgtcgaatttttttataaaattcgggaaaactgaatcgaataaaaaataaaatcacagtcttttttgtggactcaagcgttcaaataaagtttttttcttgaataactaaattcattataattataaaaaggaatttaataaataattttttaaattattaaataataggtccttttttcttgtttttagtccagcaaagtaaatgtaaatagtaaagaaaaaaacaagaaaaaaagaattataaaataataagaagaactcacattttgattctattttgactctatatcataggaatggaaatagttcttcttattattgttgttgctttaataacaagcatttttgttttcaaatcagataaatttttttctatctatgattcattggaacaaaaaagggcctggataggtcagtacctatccgggccgtgggaataaaataaaaaggcccttttgaacaaactcaaagaaagattctttttttttctatatttctattggaaatatatttttcgagcccttactttatggaattggaattgctgataaaagttgtatatatctatataataaaaagagataaaaaaataataaagaaagataaagaaagactttttcaatctttactttatgtatgggagagatggctgagtggactaaagcggcggattgctaatccgttgtacgagttattcgtaccgagggttcgaatccctctctttccgtttccattgatgaattgatattttatttatctttcgaatttctcgaaccctttttcttttttcatagttaaaggtgtggaatagataaaatccgaagaaaatttgaaaatcaagtaaggaaaatgcctttattttttattcttcattcttcacgcccaggattacgtcccggatcattagataggaatccgaagatgaagagagaaacaaagaatatcactactgtgtaaacgaagagtttgagagtaagcattacacaatctccaagatcattttttgggaaaaagagaatagattttccatttttataccacatatcctattttgactcctattttgacaccaagacatgagaagtagtttctagaaatggaaaagcattttcaaaaaatcatttgtaattaagagtctttcattgccaaaattttctttcatacccacaattagatattgtgggggaccctaattaatagtgcctttcactggaaaaaggaaagggttagaatgaggtgatacagatttattgcgactatccgatactttgactttcaatgttttaattgagggttcataatctaagatttttctaatcttatcaattgttagaattttttttctcgaagaaatcatgaatttttctagggcagtattaaatatttcatcgaaaacttacagcggcttgccaaacaaaggctaagagaaaaaagaacagaggtatgactggcataacatctacgattggattcaaaaaagcataggcttcgggcaatttggcgaagaaaaaattactcgaataaagggcagaattaagacagatacagatcaaactaaagatattaagcataacaaacattttgttcttggagataattgaattttgattgagttattgatatggtattgatataagggaaaaaagaataaagtagggtagaccaaaaaatccttctttttcttttaactcacccaatcaagaatacttcaagtctcaaaagagaatagaagaaatcatactttcataaatatcttaattgaattatatgtaatgatcaataaattcagtttaattctatgtctatacgtgtcaaaatcctagcaacaatctaatctattccataaatatttggactggaattgacgaacgactaataacaatattagtgtttattagtgtcgactagaaatctaaatggggcgtggccaagtggtaaggcaacgggttttggtcccgctattcggaggttcgaatccttccgtcccagagcataccaattatatcagaataaagattgctttaaaagtcggaggggcctttgattctatgcctatccccttcatattgaaggttagttacttagaaaaaccttacgtctcatatccatttgcattctcaatgatgcattctagatcgaaatccgaaagaaaagcctctatattccctatctattattccctatcccttaaatgaggtagcctaattattaattctctgtggattgttttattaaaaaataaacaagagggttttcttggtactaatggaattcaattaatgggattaaatctcttaaggctaggttaggggaaactaaaataaaaataggaacaaagactcgtttggctttgtacctagacaagatagtctagcatcccgtaaaagaggatctttttttttatttatgattcatcatcccatattatttgtgaaatagatcagtaaatagatcagtagtggaaggtatcaatttcaatatcggtgtctgtacaaatctcattaacaaacaatcaagttacatatgtaacaaatccattttctttgaacctcagttttaggtatttcgtctttggctctaatgaattattgtaaatctattattgtaaatctatgtaacaattcagacggggcaattcatacattctatttactttttactttatggaaagattcttatggaaaaattacagaaagattactgaacctcaagtcaaacaaaatataacaaaatacctaaaaaatgaggaaggaaatttttagatgtatgtatttgttatcgttctatttcagcgacaatgaggtttcgattttcgtgaaaaagatttatgatctttaaaattttttaaattaaaatatttcacatagaatatccataattacttccagtaacaattgttcagtctaagatacagaaatctcctattctttcggttcttattttatcaatcatatgaaagaataacgatctaaatcttcttcacgaaaaaaaacgaagagaaattggatttttttttgatctatctatttgctttaaatcattgttggttcagttcaaaacgaaacatggatttatctctcttatttataaggatcaaatgcggttttttttattgtttgtaaaactttattcaactcaaataatgatgtaatgatgtcgaagtagtcaattttttcaattaaatatttgtaatgatttattattagattagtctttcgtacttgaagaagtattagattgatgaatctatcctattgtgtcacttgaagatgcagattcaaaaataactcatttattttatattt

SEQ ID NO: 3224 - DNA, 4433 bp, Eucalyptus grandis
gatgattataatgtctttatatcatcgaacagatgaaatccgaatccatttctttttctggtacccaatcggattagagtatgtaatatcataataatggtagaaatggaatcactttttttttgatattctatccaaaactccataagcctaagtggcatttattaattcctttcgattttctatctgttccaaattccaatttgaatataaaattgtctttattcctccgttcatatgcatttcatacattccatatacggggtgagtaaaatttcatgcgattcagtaaacaaaatagaaattccatcattgctaaatcaatccatatgatttgatgaagaatgggtcaataatggaattttttgagaaaagggaaattcaaaatgctcggggatggaaatgagggaatgtctacaatacctgggtttaatcagatacaatttgaaggattttgtagattcattgatcagggcttaacagaagaactttataagtttccaaaaattgaagatacagatcaagaaattgaatttcaattatttgtggaaacatatcaattggtagaacctttgataaaagaaagagatgctgtatatgaatcactcacatattcttctgaattatatgtatccgcgggattaatttggaaaaccagtagggatatgcaagaacaaactctttttattggaaacattcctttaatgaattccctgggaacttttatagtaaatggaatatacagaattgtgatcaatcaaatattgcaaagtcccggtatctattaccggtcagaattggaccataacggaatttcggtctataccgggaccataatatcagattggggaggaagattagaattagagattgatcgaaaagcaaggatatgggctcgtgtgagtaggaaacagaaaatatctattctagttctattatcagctatgggtttgaatctaagagaaattctagagaatgtttgctatcctgagattttcttgtctttcctgaatgataaagagaaaaaaaaaattgggtcaaaagaaaatgccattttggagttttatcaacaatttgcttgtgtaggcggagatccggtattttctgaatccttatgtaaggaattacaaaaaaaattctttcaacaaagatgtgaattaggaaggattggtcgacgaaatatgaatcggagactaaatcttgatatacctcagaacaatacatttttgttaccgcgagatatattggcagctgcggatcatttgattggaatgaaattcggaatgggtacacttgacgatatgaatcatttgaaaaataagcgtattcgttctgtagcggatctcttacaagatcaattcggattggctctggttcgtttagaaaatgtggttaaaggaactatatgtggagcaattaggcataaattgataccgactcctcagaatttggtaacttcaactccattaacaaccacttatgaatcttttttcggattacacccattatctcaagttttggatcgaacgaatccattgacacaaattgttcatgggagaaaattgagttatttgggccctggaggattaacagggcgaactgctagttttcgaatacgagatatccaccctagtcactatggacgcatttgcccaatcgacacgtctgaaggaatcaatgttggacttattggatctttagcaattcatgcgagaattggtcagggggggtctctagaaagcccattttatgaaatctccgagagatcaaaatcaaaaaaagtacggatgctttatttatcaccaagtagagatgaatactatatgatagcggcgggaaattctttagcgctgaatcagcgtattcaagaagaacaggttgttccagctcgataccgtcaagaattcctaactattgcatgggaacaggttaatcttcgaagtatttttcctttccaatatttttctattggagcttctctcattccttttatcgagcataatgatgcgaatcgagctttaatgagttcgaatatgcaacgccaagcagttccactttctcggtccgagaagtgcattgttggaactgggttggaacgccaagcggctctagattcaggggttaccactatagccgaacacgagggaaagatcatttataccaatactgacaagatcattttattgggcaatggagatactttaagcattccattagttatgtatcaacgttccaacaaaaatacttgtatgcatcaaaaaccccaggttccgcggggtaaatgcattaaaaaaggacaaattttagcggatggtgccgctacagttggtggcgaactcgctttgggtaaaaatgtattagtagcttatctgccatgggaaggttacaattttgaagatgcagtactcattagcgagcgtctggtatatgaagatatttatacttcttttcacatacggaaatatgaaattcagactcatgtgacaagccaaggacccgaaaggatcactaacgaaataccgcatctagaagcccatttactccgcaatttagacaaaaatggaattgtgatgttgggatcttgggtagaggcgggcgatgttttagtaggtaaattaactccccagacggcgaaagaatcatcgtatgccccagaagatagattattacgagccatacttggcattcaggtatccacttcaaaggaaacttgtctaaaactacctataggtggtaggggtagagttattgatgtgagatggatccagaaaaaagggggttcgaattataatccagaaactatttgtgtctatattttacagaaacgtgaaatcaaagtgggtgataaagtagctggaaggcatggaaataaaggtatcatttccaaaattttacctagacaagatatgccttatttgcaagatggaagacctgttgatatggtcttcaatccattaggagtaccctcacgaatgaatgtaggacagatatttgaatgctcactcgggttagcgggggatctgctagatagacattatcgaatagcaccctttgatgagagatatgagcaagaggcttcgagaaaactagtgttttctgaattatatgaagccagtcagcaaacagcgaatccatgggtatttgaacccgagtatccgggaaaaagcagaatatttgatggaagaacgggagatccttttgaacaacctgttataataggaaagccttatatcttgaaattaattcatcaagttgatgataaaatacacggacgttccagtggacattatgcacttgttacacaacaaccccttagaggaagggccaagcaagggggacaacgggtaggagaaatggaggtttgggctctcgaggggtttggtgttgctcatattttacaagagatgcttacttataaatcggatcatattcgagctcgtcaagaagtacttggtactacaatcattgggggaacaatacctaaacctaaagatgctccagaatcttttcgattgctcgttcgagaactacgatctttgtctctggaactgaatcatttccttgtatctgagaagaacttccagattaataggaaggaagcttaatcggaatgaatcataatttttcttctatgatcgatcggtataaacatcaacaactccgaattggatcagtttctcctcaacaaataagtgcttgggccaaaaaaatcctccctaatggagagatagttggagaggtgacaaaaccctatacttttcattacaaaaccaataaaccggaaaaggatggattgttttgtgaaagaatttttggtcctataaaaagtggaatttgtgcttgtggaaattatcgagtaatcggagatgaaaaagaggacccgaaattttgtgaacaatgcggagtagaatttgttgattctcggatacgaagatatcaaatgggatacatcaaattagcatgtccagtaacccatgtgtggtatttgaaacgtcttcctagttatatcgcgaatattttagataaacctcttaaagaattagaagggctagtatactgcgatgtgtgatttgatcgaaattctgattttacagattcgaaatgagaaactgtcatcccagtcaactgaattgggatgccccagatctgacatgtctcgtgaaaggagtaacatgaagctcagaattatgggtgtataaaatattccaaggggattggtctatggtcgattcagtaaaaaagaaatagtaattcttagttggacctcgtgaaaaaaagacttctttattttgtgaaattaatcattaatttcttttagaaggaaataaaattatgtttatgttcaagtagcaaatatgtcatggttgcaggagtctatccatcgcatataggctttaaggacatcgtagcataaccgtcgaggtgatgtcagg

SEQ ID NO: 3225 - DNA, 3346 bp, Ricinus communis
ctgtaaacagaatataaattccatcattgctagatcgatccatataatttgaatgaagaacgatccaatacaataatggaatttttttaataaacgggaaattcaaaatgctcggggatggaaatgagggaatgtctacaatacctggattgaatcagatacaatttgaaggattttgtaggttcattgatcagggcttaacagaagaactttataagtttccaaaaattgaagatacagatcaagaaattgaatttcaattatttgtggaaacatatcaattagtagaaccgttgataaaagaaggagatgctgtatatgaatcacttacatattcttctgaattatatatatccgcgggattaatttggaaaactagtagggatatgcaagaacaaactatttttattggaaacattcctctaatgaattccctgggaacttttataataaatggaatatacagaattgtgatcaatcaaatattgcaaagtcccggtatctattaccggtcagaattggatcataacggaatttcggtctataccggcaccataatatcagattggggggggcgagtagaattagagattgatagaaaagcaaggatatgggctcgtgtaagtaggaaacagaaaatatctattctagttctattatccgctatgggtttgaatctaagagaaattttagagaatgtgcgctaccctgaaattttcttatctttcctgaatgataaggaaaaaaaaaaaattgggtcaaaggaaaatgccattttggagttttatcaacaatttacttgtgtaggcggagatccggtattttctgaatccttatgtaaggaattacaaaagaaattctttcaacaaagatgtgaattaggaaggattggtcgattaaatatgaaccggagactgaatcttgatatacctcataacaatacatttttgttaccgcgagatatattggcagctgcggatcatttgattggaatgaaatttggaatgggtacacttgacgatatgaatcatttaaaaaataaacgtattcgttctgtagcggatcttttacaagatcaattcggattggctctgattcgtttagaaaatgtggttagagggactatatgtggagcaattaggcataaattgataccgactcctcaaactttggtaacttcaactccattaacaaccacttatgaatcttttttcgggttacacccattatctcaagttttggatcgaactaatccattgacacaaatagttcatgggagaaaatcgagttatttgggtcctggaggattgacagggcgaactgctagttttcggatacgagatatccaccctagtcactatgggcggatttgcccaattgacacatctgaaggaatcaatgttggacttattggatctttagcaattcatgccaagattggtcattgggggtctttagaaagcccattttatgtaatctctgaggaatcaaaaaaagtacggatgttttatttatcaccaaatagagaggaataccatatggtagcggcaggaaattctttggcgctaaatcgaggtgttcaggaagaacaggttgccccagctcgatatcgtcaagaattcctgactattgcatgggaacaagtgcatcttcgaagtatttttcccttccaatatttttctatcggagcttccctcattccttttatcgagcataatgatgcgaatcgggctttaatgagttctaatatgcaacgtcaagcagttccactttctcggtccgaaaaatgcattgttgggactggattggaacgccaagtggctctagattcaggggttcccgctatagccgaacgcgaaggaaagataatttatactgatattgacaagatcattttatcgggcaatggggatactctacgcattccattagttatgtatcaacgttccaacaaaaatacttgtatgcatcaaaaaccccaggttccgcggggtaaatgcattaaaaagggacaagttttagcggatggtgccgctacaattggtggcgaactcgccttgggcaaaaacgtattagtggcttatatgccgtgggaaggttacaattttgaggatgcggtactcattagcgaacgtctggtatatgaagatatttatacttcttttcacatacggaaatatgaaattcagactcatgtgacaagccaaggacctgaaaggatcactaatgaaataccgcatctagaagcccatttactccgaaatttagacaaaaatggaattgtgatgctaggatcttgggtagagacgggcgatattttagtaggtaaattaacgcctcaaatggcgaaagaatcatcgtatgctcccgaagatagattattaagagccatacttggtattcaggtatctacttcaaaggaaacttgtctaaaactacctataggtggtagggggcgagttattgatgtgagatgggtccagaaaaaggggggttccagttataatccggaaacgattcgtatatatattttacagaaacgtgaaatcaaagtgggtgataaagtcgctggaagacatggaaataaaggcatcatttccaaaattttgcctagacaagatatgccttatttgcaagatggaaggcctgttgatatggtcttcaacccattaggagtaccttcacgaatgaatgtaggacagatatttgaatgctcactcgggttagcgggaggtctgctagatagacattatcgaatagcaccctttgatgagagatatgaacaagaggcctcgagaaaacttgtattttctgaattatatgaagccagtaagcaaacagcaaatccgtgggtatttgaacccgaatatccgggaaaaagtagaatatttgatggaagaacgggggatccctttgagcagcctgttataataggaaagccttatatcttgaaattaattcatcaagttgatgataaaatacatggacgttccagtggacattatgcacttgttacccaacaaccccttagaggaagggccaagcaagggggacaacgagtcggagaaatggaggtttgggctctagaaggatttggtgtttctcatattttacaagaaatgcttacttataaatctgatcatattagagctcgccaagaagtgcttggtactacaatcatcggaggaacaatacctaaacctgaagacgctccagaatcttttcgattgctcgttcgagaactacgatctttggctctggaactgaatcatttccttgtatctgagaagaacttccagatgaataggaaggaagcttaatcgggatgaatcagaatttttcttct

SEQ ID NO: 3226 - DNA, 3858 bp, Ricinus communis
ttcataagtctaaggtaagtggaatttctcaattcttttccagctgtctctgttgcaaattcgaatttgagtataaacttctctttattcctccgttcatacgtatttcatacattccatatctatggagatagataaaattttatgtgattctgtaaacagaatataaattccatcattgctagatcgatccatataatttgaatgaagaacgatccaatacaataatggaatttttttaataaacgggaaattcaaaatgctcggggatggaaatgagggaatgtctacaatacctggattgaatcagatacaatttgaaggattttgtaggttcattgatcagggcttaacagaagaactttataagtttccaaaaattgaagatacagatcaagaaattgaatttcaattatttgtggaaacatatcaattagtagaaccgttgataaaagaaggagatgctgtatatgaatcacttacatattcttctgaattatatatatccgcgggattaatttggaaaactagtagggatatgcaagaacaaactatttttattggaaacattcctctaatgaattccctgggaacttttataataaatggaatatacagaattgtgatcaatcaaatattgcaaagtcccggtatctattaccggtcagaattggatcataacggaatttcggtctataccggcaccataatatcagattggggggggcgagtagaattagagattgatagaaaagcaaggatatgggctcgtgtaagtaggaaacagaaaatatctattctagttctattatccgctatgggtttgaatctaagagaaattttagagaatgtgcgctaccctgaaattttcttatctttcctgaatgataaggaaaaaaaaaaaattgggtcaaaggaaaatgccattttggagttttatcaacaatttacttgtgtaggcggagatccggtattttctgaatccttatgtaaggaattacaaaagaaattctttcaacaaagatgtgaattaggaaggattggtcgattaaatatgaaccggagactgaatcttgatatacctcataacaatacatttttgttaccgcgagatatattggcagctgcggatcatttgattggaatgaaatttggaatgggtacacttgacgatatgaatcatttaaaaaataaacgtattcgttctgtagcggatcttttacaagatcaattcggattggctctgattcgtttagaaaatgtggttagagggactatatgtggagcaattaggcataaattgataccgactcctcaaactttggtaacttcaactccattaacaaccacttatgaatcttttttcgggttacacccattatctcaagttttggatcgaactaatccattgacacaaatagttcatgggagaaaatcgagttatttgggtcctggaggattgacagggcgaactgctagttttcggatacgagatatccaccctagtcactatgggcggatttgcccaattgacacatctgaaggaatcaatgttggacttattggatctttagcaattcatgccaagattggtcattgggggtctttagaaagcccattttatgtaatctctgaggaatcaaaaaaagtacggatgttttatttatcaccaaatagagaggaataccatatggtagcggcaggaaattctttggcgctaaatcgaggtgttcaggaagaacaggttgccccagctcgatatcgtcaagaattcctgactattgcatgggaacaagtgcatcttcgaagtatttttcccttccaatatttttctatcggagcttccctcattccttttatcgagcataatgatgcgaatcgggctttaatgagttctaatatgcaacgtcaagcagttccactttctcggtccgaaaaatgcattgttgggactggattggaacgccaagtggctctagattcaggggttcccgctatagccgaacgcgaaggaaagataatttatactgatattgacaagatcattttatcgggcaatggggatactctacgcattccattagttatgtatcaacgttccaacaaaaatacttgtatgcatcaaaaaccccaggttccgcggggtaaatgcattaaaaagggacaagttttagcggatggtgccgctacaattggtggcgaactcgccttgggcaaaaacgtattagtggcttatatgccgtgggaaggttacaattttgaggatgcggtactcattagcgaacgtctggtatatgaagatatttatacttcttttcacatacggaaatatgaaattcagactcatgtgacaagccaaggacctgaaaggatcactaatgaaataccgcatctagaagcccatttactccgaaatttagacaaaaatggaattgtgatgctaggatcttgggtagagacgggcgatattttagtaggtaaattaacgcctcaaatggcgaaagaatcatcgtatgctcccgaagatagattattaagagccatacttggtattcaggtatctacttcaaaggaaacttgtctaaaactacctataggtggtagggggcgagttattgatgtgagatgggtccagaaaaaggggggttccagttataatccggaaacgattcgtatatatattttacagaaacgtgaaatcaaagtgggtgataaagtcgctggaagacatggaaataaaggcatcatttccaaaattttgcctagacaagatatgccttatttgcaagatggaaggcctgttgatatggtcttcaacccattaggagtaccttcacgaatgaatgtaggacagatatttgaatgctcactcgggttagcgggaggtctgctagatagacattatcgaatagcaccctttgatgagagatatgaacaagaggcctcgagaaaacttgtattttctgaattatatgaagccagtaagcaaacagcaaatccgtgggtatttgaacccgaatatccgggaaaaagtagaatatttgatggaagaacgggggatccctttgagcagcctgttataataggaaagccttatatcttgaaattaattcatcaagttgatgataaaatacatggacgttccagtggacattatgcacttgttacccaacaaccccttagaggaagggccaagcaagggggacaacgagtcggagaaatggaggtttgggctctagaaggatttggtgtttctcatattttacaagaaatgcttacttataaatctgatcatattagagctcgccaagaagtgcttggtactacaatcatcggaggaacaatacctaaacctgaagacgctccagaatcttttcgattgctcgttcgagaactacgatctttggctctggaactgaatcatttccttgtatctgagaagaacttccagatgaataggaaggaagcttaatcgggatgaatcagaatttttcttctatgattgatcggtataaacatcaacaactccgaattggatcagtttcgcctcaacaaataagtgcttgggccaaaaaaatcctacctaatggggagattgttggagaagtgacaaaaccctatacttttcattacaaaaccaataaacctgaaaaaggtggattgttttgtgaaagaatttttgggcctataaaaagtggaatttgtgcttgtggaaattatcgagtaatcagaaatgaaaaagaagaccaaaaattttgtgaacaatgcggagtcgaatttgttgattctcggatacgaagatatcaaatgggctacatcaaactggcatgcccagtaactcatgtgtggtatttgaaa

SEQ ID NO: 3227 - DNA, 11913 bp, Ricinus communis
aatataagaatcacaaaattctatcgaatcatgaagggcggaaagattcttcgaatctagtcataccatttcgttatattgacaatttcaaaaaactgttcatactatgagcatagtatgctggtggtcgggcaaatgcgcccccatcgtctagtggttcaggacatctctctttcaaggaggcagcggggattcgacttcccctgggggtagggtattacgaaaggaagttgatcatggattcttaataagtctggaattgattcttcctgggtcgatgcccgagcggttaatggggacggactgtaaattcgttggcaatatgtctacgctggttcaaatccagctcggcccaataattcactgatccgccatgaatgatataacccctttgttctctcgaaatgcctgatacagaaaaaaaaaaagtcataatttcggatatatctttacctgttctttatttgatttgctttattttatttagtttttttctcataaattctgatcttgctaatgatctagattcagattttgaaataacgaaaagctgactagtactccctatcccttttagcactaaagtgcatatccatgtggatatcaatatactacccccgtttctgttatatacaacgcggtgattccagtctaaaaccgaaatagtaaaatttaaatagtaaatagaaggggtatgaatgaaatcataagaatatatatgctgtacactttcttgtattgcatttcccggggattgtagttcaagtggtcagagcaccgccctgtcaaggcggaagctgcgggttcgagccccgtcagtcccgacggatccaaatccaataatctaataaaaaatacattaattcatctttcccttttctgcgaaagggggacaaatagcataatttcattcccaaggggaccatttattttcttttcgttttacatttctcatctaagtaaatacaaatacgggaattttcattttttcaaccagtactgattgatagggacatatgtggattagtacaattattggtaacgttatatccaagattcaaaaagatactatactgagtttggattttttgattactcccgacccatataatgaaatcgaatcaagtaccatatcttttccggtaacgcatacacaaatggaatttttatttatttgtatgtatgtatgtacgatacaaaatcaatttaattgctttgatagaatccttttaatctttatctgaaaagtctctttttttttggctccgattttgtgtaatctcaattacaaatttgaatttgaaacaatctatctcattcaaattgcgcactgaagtttttttatttttaatatattctatgcattccattaccaaagaatggggatattaataaaataaatatcaaataaaaaaaaaagaaagtaatggaaaaaaaaattatcaattgaatcaagaatccagccatttttgaattcagtatggataaacgatctttctatgttatactattcaattctcgacgatgaatcgatttgataactcagatattgttattcatgatattgatcagactcgatatcatcgagatggaattcatcccattgaatttagaggcgaaagattttttatttattatctctatgggattaaatcccgagttattacgaagtaaagaaaaagaaacgatgagattatggaagtaaatattcttgcgtttattgctactgccctgttcattctagttcctactgcttttttacttataatttacgtaaaaacggttagtcaaagtgattaatttgaatgaaacttgacttctttgacttcttagttcttatcaatgattgaagaaaaaaaatgaaaaggattccttttttgagtcttaaatgaaatgagcagactagaattagcagtattctatgagatccgatagtatgatagaaagaaatctatttctttctatcatactatccgtttttttttattctagtgtatacagttgtactatataaagatataggcttaatctagatataaattaatctatatctataatatcatctcatattcatatgtctagatatcaattatctatatggaatgtccataacgtcccaattctatttcttcatctatttgatttgtgttgattccaattaatgtcgaaaggcaactcttactcttacttttaggattctaattcctagatttctgattatttaaaatatgaatcctaccatgtaccgaaacaataaaatcaatcaaaaggaattctataaaaaaactttataaaaaaactttttcagatttcaacgaaaaggattagtaaaccctgccgattttgaacctttgaatcataatatgaaatgagtcaaatcaataaggtatagcacaaatccaatttctctaaaataataaaacaaatactaaactaagcactaagcaagaaaatatcttagtatgcgtagtatctcattggagaaccactatgtctatcttatttcccataaaaaattcacttaatttaatcacttttaataactaataaaagaactgctttcgtttctctttgaacagaaaaaagacaaaaaaaaggggggggttctgttcttcctcattgttcatatataattctggtaagaaccagtttaccgaaatagagaatttaggaagaattgggttggaataaatttcctatcgtttgtattccctttcctttcgaaatatgaacacgagaatcattgaaatatttgtttgattatgattaaaaggctattattcatatattattcatagaatacattacttcgctcgaatccaatatactttggaaatgaagatatgaagatatttttaattcaatttctaaatttggaagaaattagaaattgaattaaataattcaatattcaatttaattattaattaataaattcaaaaatctttaatctttgcagaacgatctataaaacaagcgatagagtttgatttctcaactcaattagtaatacccctaaagtccacttcttccccatactacgagcgaaagggaaaatgtaaagactaccattaaagcagcccaagcgagacttactatatccatgtgaattatgtcctctatctctatgaatatgaatgaatttttccattattgttcactaataatagtagaattgttggcacagagtcaaaaaaaaagattctgttcaatatagtgatgaaaaaaaatccaaaaatccaattaattcaaagaagttcttatcttattcttataagattgatagtagaatcgaaaaatgtttagtacaatttttagtacaaacaaaatagccagcaataccctgggaagtatcagtatcaagaagccttttcctccgcgtacttctgttgggagcaaatttgataagttatatcagcaaaaaaagggaataagatattttgcgttttttgttgatcaggcgacacccggatttgaactggggaaaaaggatttgcagtcccccgccttaccactcggccatgccgccaaggcaacacaaaatagacgaaaatattcccacccttttttttttctttttttttttttttagagggaggagtttctttttttcttttttggattggatctatcttttccatttattttgtatagtatctcaaaacacacactatctaaatttttctattatctattgaaatgaaaagtcaattttcagtcacaaactcaaaaattaaggacaaattggaaccattaactattaactgtgaattcataaacgattcttggatttcaatcgaaaattgtatttctctaatcctaatgatataagaaaataaaaattgatacgtaaccaatccgtattgattcttttcaataaaaaaaaattcttctcagtttcaattataacaacaattatgagtatatgtaaaccctagaacataaaattttatgcggatatctatcttatccgtctatgattcctataggaaaatttctattcaatgaaaatggaatataaattttgatagagcatgacatgcgctgtccaaaatagaactgcagtaaaaggagagacgtatatatagtatagatagctataattatgagatagctatagttatgcccgcatatgtttaataagccttcttatgtttgttttatgttatgcacttcaatcgtattatatgaactcgattaaaaaaaagatataaaaaaatctctcttctatgcaaatttttttgaactaaacaatgaaatccgcgaaaaagctaagtgctaaaaaaaaaatcaaaaaatcaactttatattgtttcggattattggttttttctctcatcgaaagatttaatcccgaattcagttattttattggtatccaagcgtattggaaattggtatccaagcgtattggaatatgtaatatcataataatggtagaaattgaatcactttttgttttgctattctatacaaaatttcataagtctaaggtaagtggaatttctcaattcttttccagctgtctctgttgcaaattcgaatttgagtataaacttctctttattcctccgttcatacgtatttcatacattccatatctatggagatagataaaattttatgtgattctgtaaacagaatataaattccatcattgctagatcgatccatataatttgaatgaagaacgatccaatacaataatggaatttttttaataaacgggaaattcaaaatgctcggggatggaaatgagggaatgtctacaatacctggattgaatcagatacaatttgaaggattttgtaggttcattgatcagggcttaacagaagaactttataagtttccaaaaattgaagatacagatcaagaaattgaatttcaattatttgtggaaacatatcaattagtagaaccgttgataaaagaaggagatgctgtatatgaatcacttacatattcttctgaattatatatatccgcgggattaatttggaaaactagtagggatatgcaagaacaaactatttttattggaaacattcctctaatgaattccctgggaacttttataataaatggaatatacagaattgtgatcaatcaaatattgcaaagtcccggtatctattaccggtcagaattggatcataacggaatttcggtctataccggcaccataatatcagattggggggggcgagtagaattagagattgatagaaaagcaaggatatgggctcgtgtaagtaggaaacagaaaatatctattctagttctattatccgctatgggtttgaatctaagagaaattttagagaatgtgcgctaccctgaaattttcttatctttcctgaatgataaggaaaaaaaaaaaattgggtcaaaggaaaatgccattttggagttttatcaacaatttacttgtgtaggcggagatccggtattttctgaatccttatgtaaggaattacaaaagaaattctttcaacaaagatgtgaattaggaaggattggtcgattaaatatgaaccggagactgaatcttgatatacctcataacaatacatttttgttaccgcgagatatattggcagctgcggatcatttgattggaatgaaatttggaatgggtacacttgacgatatgaatcatttaaaaaataaacgtattcgttctgtagcggatcttttacaagatcaattcggattggctctgattcgtttagaaaatgtggttagagggactatatgtggagcaattaggcataaattgataccgactcctcaaactttggtaacttcaactccattaacaaccacttatgaatcttttttcgggttacacccattatctcaagttttggatcgaactaatccattgacacaaatagttcatgggagaaaatcgagttatttgggtcctggaggattgacagggcgaactgctagttttcggatacgagatatccaccctagtcactatgggcggatttgcccaattgacacatctgaaggaatcaatgttggacttattggatctttagcaattcatgccaagattggtcattgggggtctttagaaagcccattttatgtaatctctgaggaatcaaaaaaagtacggatgttttatttatcaccaaatagagaggaataccatatggtagcggcaggaaattctttggcgctaaatcgaggtgttcaggaagaacaggttgccccagctcgatatcgtcaagaattcctgactattgcatgggaacaagtgcatcttcgaagtatttttcccttccaatatttttctatcggagcttccctcattccttttatcgagcataatgatgcgaatcgggctttaatgagttctaatatgcaacgtcaagcagttccactttctcggtccgaaaaatgcattgttgggactggattggaacgccaagtggctctagattcaggggttcccgctatagccgaacgcgaaggaaagataatttatactgatattgacaagatcattttatcgggcaatggggatactctacgcattccattagttatgtatcaacgttccaacaaaaatacttgtatgcatcaaaaaccccaggttccgcggggtaaatgcattaaaaagggacaagttttagcggatggtgccgctacaattggtggcgaactcgccttgggcaaaaacgtattagtggcttatatgccgtgggaaggttacaattttgaggatgcggtactcattagcgaacgtctggtatatgaagatatttatacttcttttcacatacggaaatatgaaattcagactcatgtgacaagccaaggacctgaaaggatcactaatgaaataccgcatctagaagcccatttactccgaaatttagacaaaaatggaattgtgatgctaggatcttgggtagagacgggcgatattttagtaggtaaattaacgcctcaaatggcgaaagaatcatcgtatgctcccgaagatagattattaagagccatacttggtattcaggtatctacttcaaaggaaacttgtctaaaactacctataggtggtagggggcgagttattgatgtgagatgggtccagaaaaaggggggttccagttataatccggaaacgattcgtatatatattttacagaaacgtgaaatcaaagtgggtgataaagtcgctggaagacatggaaataaaggcatcatttccaaaattttgcctagacaagatatgccttatttgcaagatggaaggcctgttgatatggtcttcaacccattaggagtaccttcacgaatgaatgtaggacagatatttgaatgctcactcgggttagcgggaggtctgctagatagacattatcgaatagcaccctttgatgagagatatgaacaagaggcctcgagaaaacttgtattttctgaattatatgaagccagtaagcaaacagcaaatccgtgggtatttgaacccgaatatccgggaaaaagtagaatatttgatggaagaacgggggatccctttgagcagcctgttataataggaaagccttatatcttgaaattaattcatcaagttgatgataaaatacatggacgttccagtggacattatgcacttgttacccaacaaccccttagaggaagggccaagcaagggggacaacgagtcggagaaatggaggtttgggctctagaaggatttggtgtttctcatattttacaagaaatgcttacttataaatctgatcatattagagctcgccaagaagtgcttggtactacaatcatcggaggaacaatacctaaacctgaagacgctccagaatcttttcgattgctcgttcgagaactacgatctttggctctggaactgaatcatttccttgtatctgagaagaacttccagatgaataggaaggaagcttaatcgggatgaatcagaatttttcttctatgattgatcggtataaacatcaacaactccgaattggatcagtttcgcctcaacaaataagtgcttgggccaaaaaaatcctacctaatggggagattgttggagaagtgacaaaaccctatacttttcattacaaaaccaataaacctgaaaaaggtggattgttttgtgaaagaatttttgggcctataaaaagtggaatttgtgcttgtggaaattatcgagtaatcagaaatgaaaaagaagaccaaaaattttgtgaacaatgcggagtcgaatttgttgattctcggatacgaagatatcaaatgggctacatcaaactggcatgcccagtaactcatgtgtggtatttgaaacgtcttcctagttatatcgcaaatcttttagataaacctcttaaagaattagaaggcctagtatattgcgatgtgtgatttgatcgaaattctgattttacagttttgaaatgaaaaactgtcatcccatttattttgggatgccctggatctgacatgtctcttgagaggagtaacatgaagctcagaattatgggtgtattcaatactccccaataaaagaggaattggtctatggtcgatgcagtaacgaaaaaataggaattcctagttgtacctcgtgaaaaccgacttctttctttctttttattttaaaaatagaaagaaactatgtttatactcaagtaatcaaatatgtcatggttacaggagtctatacatcgcatataggctttaacagcatcgtggcataaccgtcgaggtgagttcgggacctaagagatcgaatagaaagagacatagacaaataaatcccttatgaattctaaggtactaggattttatcattcgaagggaagtagactactcaagaatttcacatttcatttagatcgtaattgtgaaaattgaataagttgtgataattgaataaagaattcagaaattcgaaaaaaaaaaaggaagaaggaattaatgagagcttgcttggtgttcattattcattgggaacttgagtaaggagtagctctttttttggtttttatcgattttgaaatttgaaagcaggaacccttttctttctatttggtataactacttgagccggatgagaggaaactttcacgtccgattttgaaggggggagacctatagtataggagtataggatcctatcccaatttttcttttgctaggcccatagctaaaaaacctacttttttacgattacgaggttcattcgaatacgaaattcaatcctggaaatacagtattccacttttttttactgcccaaggcttcgatacatttcgaaatcgagaaatttctacaggagctggtgctatccgagaacaattagccgatctagatttgcgaattattatagattattcatcggtagaatggaaagaattaggggaagaagggcctacggggaatgaatgggaagatcgaaaagttggaagaagaaaggattttttggttcgacgcgtggaattagctaagcattttattcgaacaaatatagaaccagaatggatggttttatgtctattaccagttcttcctcccgagttgagaccgatcattcagatagatgggggtaaactaatgagttcagatattaatgaactctatagaagagttatctatcggaacaatactcttattgatctattaacaacaagtagatctacgccaggagaattagtaatgtgtcaggaaaaattagtacaagaagccgtggatacacttcttgataatggaatccgcggacaaccaatgagagacggtcataataaggtttacaagtcgttttcggatgtaattgaaggcaaagaaggaagatttcgtgagactatgcttggaaaacgggttgattattcggggcgttctgtcattgtcgggcatccggtattactgaatagagcgccgactttgcatagattaggcatacaggcattccaacccattttagtggaaggccgcgctatttgtttacatccattagtttgtaagggattcaatgcagactttgatggggatcaaatggctgttcatgtacctttatcatcgagaaaaggaagtttccaatcattgactcaaatccattgtcgaactctactcagcggaatatggaggtacttatggccaaacgggccaatctggtctttcacaataaaactctgggtttccagcaagccactgctacatccatttcattaggaattgatgatcttttaacaataccttctaagggatggctagttcaagatgctgaacaacaaagtttgattttggaaaaacactatcattatggaaatgtacacgcggtagaaaaattacgccaatctattgagatatggtatgctacaagtgaatatttgcgacaagaaatgaatcttaattttaggatgacggaaccctttaatccagtccatataatgtctttttcgggagctaggggaaatgtatctcaagtacaccaattagtaggtatgagaggattaatgtcggatccacaaggacaaatgatcgatttacctattcaaagcaatttacgcgaaggactatctttaacagaatatatcatttcttgctacggagcccgcaaaggggttgtcgataccgctgtacgaacatcagatgctggatatcttacgcgtagacttgttgaagtagttcaacacattgttgtacgtagaacagattgtggcaccacccgagggatttctgtgagtcctcaaaatgggatgatgtcggaaagaatttttattcaaacattaattggtcgtgtattagcagacaatatatatatgggtctacgatgcattgccattcgaaatcaagatattgggattagacttgccaatcgattcataacctttcgaacacaaacaatatctattcgaactccctttacttgtaggagtacgtcttggatctgtcgattatgttatggccggagtcctactcatggcgatctagtggaattgggggaagccgtaggtattattgcaggtcaatccattggagagccgggtactcaactaacattaagaacatttcataccggcggagtattcacagggggtactgcagaacatgtacgagccccctctaatggaaaaataaaatttaacgaggatttggttcatcccatacgtacacgtcatgggcatcctgcttttctatgttatatagacttgtatgtaactattgaaagtcacgatattatacataacgctactattccaccaaagagtttccttttagttcaaaacaatcaatatgtagaatcagaacaagtgattgctgaaattcgggcgggaacatacactttgaattttaaagagaaggttcgaaaacatatttattccgattcagaaggggaaatgcactggagtactgatgtataccatgcacctgaatttacatatagtaatgtccatctcttaccaaaaacaagtcatttatggatattatcaggaaattcgtgcagatccagtatagttcctttttcgctccataaggatcaagatcaaatgaacgttcattctctttctatcaaaagaagatatatttctagtccttccgtaaattccgtaaataatgatcaagttaaacccaaattctttagttcagatttttcgggtaaaaaaccaagtaggattccttattattcagaacttaatcgaatcgtatgtactggtcattgtaatctcatatatcccgcgattctctacgagaattctgatttattggcaaagaggcgaagaaataaattcatcatcccattccaatcaattcaagaacaagaaaaaaaactaatgacccgctcctcggctatctcgattgaaataccgctaaatggtattttccgtagaaatagtgtttttgcttattttgacgatcccc

SEQ ID NO: 3228 - DNA, 7715 bp, Brachypodium distachyon
atgggttcaaatctaaaagaaattctagataatgtttcctaccctgaaattttcttgtctttccctaatgctaaggagaagaagaggattgagtcaaaagaaaaagctattttggagttttatcaacaatttgcttgtgtaggtggggacctggtattttcggaatccttatgtgaggaattacaaaagaaattttttcaacaaaaatgtgaattaggaaggattggtcgacgaaatatgaatcgaagactgaatcttgatatacctcagaacagcaccttcttgttaccgcgagatgtattggccgctacggatcatttgattggaatgaaatttgaaacgggtatacttgacgatgacgatatgaatcacttgaaaaataaacgtattcgttcggttgcggatctgttacaagatcaattcggactggctcttggtcgtttacaacatgcggttcaaaaaactatccgtagagtattcatacgtcaatcaaaaccgactccacaaactttggtaactccaacttcaacctcgattttattaataactacttacgagaccttctttggtacatatcccttatctcaagtttttgatcaaaccaatccattgacacaaacggttcattggcgaaaagtgagttgtttgggtcctggaggattgacggggagaactgcaagttttcggagccgagatatccatccgagtcactatgggcgtatttgtccaattgacacgtccgaaggaatcaacgttggacttactggatctttagctattcatgtgagaattgatcattggtggggatccgtagagagtccattttatgaaatatctgagaaagcaaagaaaaaaaaagagagacaggtggtttatttatcaccaaatagagatgagtattatatgatagcagcaggaaattctttgtccttgaatcggggtattcaggaagaacaggttgttccagctagataccgtcaagaattcctgactattgcatgggaacagattcatgttagaagtatttttcctttccaatatttttctattgggggttctctcattccttttattgagcataatgatgcgaatcgagctttaatgagttctaatatgcagcgccaagcagttccgctttctcggtccgagaagtgcattgttggaactggattggaacgccaaacagctctagattcgagggtttctgttatagccgaacgcgagggaaagatcatttctactaatagtcacaagatccttttatcaagtagtgggaagactataagtattcctttagttacccatcggcgctctaacaaaaatacttgtatgcaccaaaaacctcgggttccgcggggtaaatccatcaaaaaaggacaaattttagcggagggggctgctacggttggtggggaacttgctttaggaaaaaacgtattagtagcttatatgccatgggaaggttacaattttgaagacgcagtattaattagcgaacgtttggtatatgaggatatttatacttcttttcacatccgaaaatatgaaattcagacggatacaacaagccaaggctccgctgaaaaaatcactaaagaaataccacatctagaaaaacatttactccgcaatttggacagaaatggagttgtgaagttggggtcctgggtagaaacaggcgatattttagtaggtaaattaacgcctcagatagcgagcgaatcgtcctatatcgcggaagctggattattacgggccatatttggtcttgaggtatccacttcaaaagaaacttctctcaaactaccgataggtggaagaggacgcgttatcgatgtgaaatggatccagagggatcccctcgacataatggttcgtgtatatattttacaaaaacgcgaaatcaaagttggggataaagtagccggaagacacgggaataaggggatcatttccaaaattttgcctaggcaagatatgccctatttgcaagatggaacgcctgttgatatggttttcaatcccttaggagtaccctcccgaatgaatgtgggacaaatctttgaaagctcgctcggattagcaggggatctgctaaagaaacattatagaatagcaccctttgatgagagatatgagcaagagacttcaagaaaacttgtgttttcagaattatatgaagccagtaaacaaacaaaaaatccgtgggtatttgaacccgagtacccgggaaaaagcagaatatttgatggaagaacaggagaccccttcgaacatcctgttctaatagggaagtcctatatcttaaaattaattcatcaagttgatgagaaaatccacggacgctctactgggccctattcacttgttacacaacaacccgttagaggaagagccaagcaagggggacaacgaataggagaaatggaagtttgggctttagaaggatttggtgttgctcatattttacaagagatacttacttataaatctgatcatcttatagctcgccaagaaatacttaacgctacgatctggggaaaacgagtacctaatcacgaggatcctccagaatcttttcgagtgcttgttcgagaactacgatctttggctctagaactgaaccatttccttgtatctcagaagaacttccagagagttatccgtcggaacaacaatcttgcctatctattaaaaagaagtgaattagcgccagcagatttagtaatgtgccaggaaaaattggtacaagaagccgtggatacacttcttgatagtgggtcccgcgggcaaccaacgagggatggtcacaataaagtatacaaatcactttcagatgtaattgaagactttgatggggatcaaatggctgttcatctacctttatccttggaagctcaggcggaagctcgtttacttatgttttctcatatgaatctcctatctcccgctattggggatcctatttgcgtaccaacccaagacatgcttatcggactttatgtattaacgattggaaaccgtcgaggagctagaggaaatgcatcgcaggtacaccaattagtaggtatgcgaggattaatggcggatcctcaaggacaaatgattgatttacctattcaaagcaatttacgcgagggactttctttgacagaatatataatttcctgctacggagcccgcaaaggggttgtagatactgctgtacgaacggcggatgctggatatcttacatgtagacttgttgaagtagttcaacatattattgtgcgtagaagagattgtggtactatccaagctatttctagtcaggatattctatatagtgtgaatattccctcaaaaagcttgattctagtgcaaaatgatcaatatgtaaaatccaaacaagtaattgcggagattcgtgccggaacgtccactttacattttaaagaaaggacggagaaatgcactggagtactgatgtttatcatgcgcccgaatatcaatatggtaatcctcgtcgattaccaaaaacaagtcatttatggatattgtcaaaatactatttttgcttattttgatgatccacaatacagaaaagataaaaagggttcaggaattgttaaatttagatataggaccctagaatacgaatataggattcgagaggaatactcagaagacaaatatgagaccctagaagacgaatataggattcgagaggaatactcagaagacaaatatgagaccctagaagatgaatatgaaaccctatataaaaatgagatcctacaggacgaatacgaatatgaaaccctagaagacgcatatgggaggccagagaacgaatatgggaatctagagaacgaatataggactttagagaaagattcagaagatgaatataggagcccagagagcaaatataggacccgagaggacaaatatggaactctagaggaagactcagaagacgaatacgagagctttagaggaagactcagaagaagactcagaagacgaatatgagagcccagaggaggattccatcttcaaaaaggaggatttgattgagcatcaaggaacaaaagaatttagtataaaataccaaaaagaagtagatcggttttttttcattcttcaagaactgcatatcttgccgagatcttcatccctaaagttgaattatcactttgcccatcatgattcttgggagaacacattggcaataattcaccttggacaatttatttgtgaaaatgggcaactgttaatggtcattatggagaaatcctttacaagggagataggttagttacgtttatatatgaaaaatcgagatcgagtgacataacgcaaggtcttccaaaagtggaacaaatctttgaagcgcgttcaatcgattcattatctccgaatctggaaaggagaattgaggattggaatgagcgtataccaagaattcttggtgtcccttggggattcttgattggagctgagctaaccatagcccaaagtcgtatctctttggttaataaaatccaaaaggtttatcgatcccaaggggtacagatccataatagacatatagagattattatacgccaagtaacatcaaaagtgcgggtttccgaagatggaatgtctaatgttttttcacctggggaattaattggactattacgagcggaacgagcaggacgagctttggatgaatcgatctattatcgagcaattttattgggaataacaagagcttcccttaatacccaaagtttcatatcgaagcaagttttcaagaaactactcgggttttagcaaaagctgccctacgaggtcgtattgattggttgaaaggcctgaaagaaaacgtagttctggggggaattatacctgttggtactggattccaaaaatttgtgcatcgttccccacaagacaagaatctttatttcgaaattaaaaaaaaaatcgcgtcgaaaatgagagattttttctttctccatacagaattagtttcttctgattctgacgtaacaaacaatttcgatgagacatcagaacccccatttacccccatttataccatttaaggatacataaagcagattttttactttaaactagatttttgaccttagaacgctaagaggttagattttctatttttattttaatttaaaaagaagtttagttaattcattaaggttatgcttataccatgtagaaggttccctcggaacaattattatatatttcaagttatttcggatctttcttaatcttcaaaaagatattccctaatggaatggtaggatgaaaaaaagaaaaaataaaaaggaagtgtggaaaaaatgacaagaagatattggaacatcaatttgaaagaaatgatagaagcgggagttcattttggtcatggtattaagaaatggaatcctaaaatggccccttacatttcggcaaagcgtaaaggtactcatattacaaatctcgctagaacggctcgttttttatcagaagcttgtgatttagtttttgatgcagcaagtcagggaaaaagtttcttaattgttggtaccaaaaaaagagcagcggatttagtagcatcagctgcaataagggctcgttgtcattatgttaataaaaagtggttcagtggtatgttaacgaattggtcaattacgaaaactagactttctcaatttagagacttaagagcagaagaaaagatgggaaaattccaccatctcccaaaaagagatgtggcaatcttgaaaagaaaattatctaccttgcaaagatatctcggcgggatccaatatatgacgaggttgccagacattgtgatcgtccttgatcagcaaaaagagtatatagctcttcgggaatgtgccattttggggattcctactatttctttagttgatacaaattgtgacccagatctcgcgaatatatcgattccagccaacgatgacactatgacttcaattcgattgattcttaacaaattagtatttgctatttgtgagggccgttctctctatataagaaacctttaattaagaagaatagtgaattcttgggcaactccatagatttctggaatcacttactattcttttttgttttgcatagataaaagaaggggaatattgatatatattagagggtattgatatatattatgatctgatgtgctttcttagtaccctaaatataacattaatacttcaagttgctgagttgagaaagagatggttgaatcaaaacaataccttttttgaagttcaatttttatcagaggacaatatgaatattataccttgttccattaaaacactcaaggggttatacgatatatcaggtgtagaagtaggccaacacttctattggcaaataggaggtttccaaattcatgcccaagtactcatcacttcttgggtcttaattactatcttgctaggttcagttctcatagctgttcggaatccacaaaccatcccgaccgacggtcagaatttctttgaatatattcttgagtttattcgagacttgagcaaaactcagattggagaggaatatggtccctgggttccttttattggaactatgttcctttttatttttgtttcgaattggtcgggtgctcttttaccttggaaaattatagagttaccccacggggaattagcagcgcccacgaatgatataaatactactgttgctttagctttactcacgtcagcggcatatttttatgcgggtcttagcaaaaaaggattgagctatttcgagaaatatattaaaccaaccccaatccttttaccaatcaacatcctggaagatttcacaaaaccattatcgcttagctttcgacttttcaggaatatattggcagatgaattagtcgttgttgttcttgtttctgctttacccctagatgtccagtcaactgctgcgcctcaacgcatttcggggagaaccagctagctctgggttcgagtggcatttcacccctaaccacaactcatccgctgattcttcaacatcagtcggttcggacctctgcttagtttcatccaagcttcatcctggtcatggatagatcacccaggttcgggtccataagcagtgacaatcgccctatgaagactcgctttcgctacggctccggtgggttccgttcccttaaccaagccactgcctatgagtcgccggctcattcttcaacaggcacgcggtcagagatcactttcccctcccactgcttgggagctcagcacggtttcacgttctatttcactacccactgggggttcttttcacctttccctcacggtactacttcgctatcggtcacccaggagtatttagccttgcaaggtggtccttgctgattcacacgggattccacgtgccccatgctactcgggtcagagcgtaagctagtgatgctttcggctactggactttagccatctagggtgcggcactcaaccgcttcgcctagcagcacaacgcttgtattgctctcccacaaccccgttttcatgtttaaaaggttgacctatttgggaatctccggatctatgcttattttcaactccccgaagcatttcgtcgcttgctatgcccttcctcgtctctgggtgcctaggtatccaccgcaagcctttcctcttttgaacctcgccataagccactctgcgttgataccactgctt

SEQ ID NO: 3229 - DNA, 9396 bp, Oryza sativa
atgggttcaaatctaaaagaaattctagataatgtttcctaccctgaaattttcttgtctttccctaatgctaaggagaagaagaggattgagtcaaaagaaaaagctattttggagttttatcaacaatttgcttgtgtaggtggggacctggtattttcggaatccttatgtgaggaattacaaaagaaattttttcaacaaaaatgtgaattaggaaggattggtcgacgaaatatgaatcgaagactgaatcttgatatacctcagaacagcaccttcttgttaccgcgagatgtattggccgctacggatcatttgattggaatgaaatttgaaacgggtatacttgacgatgacgatatgaatcacttgaaaaataaacgtattcgttcggttgcggatctgttacaagatcaattcggactggctcttggtcgtttacaacatgcggttcaaaaaactatccgtagagtattcatacgtcaatcaaaaccgactccacaaactttggtaactccaacttcaacctcgattttattaataactacttacgagaccttctttggtacatatcccttatctcaagtttttgatcaaaccaatccattgacacaaacggttcattggcgaaaagtgagttgtttgggtcctggaggattgacggggagaactgcaagttttcggagccgagatatccatccgagtcactatgggcgtatttgtccaattgacacgtccgaaggaatcaacgttggacttactggatctttagctattcatgtgagaattgatcattggtggggatccgtagagagtccattttatgaaatatctgagaaagcaaagaaaaaaaaagagagacaggtggtttatttatcaccaaatagagatgagtattatatgatagcagcaggaaattctttgtccttgaatcggggtattcaggaagaacaggttgttccagctagataccgtcaagaattcctgactattgcatgggaacagattcatgttagaagtatttttcctttccaatatttttctattgggggttctctcattccttttattgagcataatgatgcgaatcgagctttaatgagttctaatatgcagcgccaagcagttccgctttctcggtccgagaagtgcattgttggaactggattggaacgccaaacagctctagattcgagggtttctgttatagccgaacgcgagggaaagatcatttctactaatagtcacaagatccttttatcaagtagtgggaagactataagtattcctttagttacccatcggcgctctaacaaaaatacttgtatgcaccaaaaacctcgggttccgcggggtaaatccatcaaaaaaggacaaattttagcggagggggctgctacggttggtggggaacttgctttaggaaaaaacgtattagtagcttatatgccatgggaaggttacaattttgaagacgcagtattaattagcgaacgtttggtatatgaggatatttatacttcttttcacatccgaaaatatgaaattcagacggatacaacaagccaaggctccgctgaaaaaatcactaaagaaataccacatctagaaaaacatttactccgcaatttggacagaaatggagttgtgaagttggggtcctgggtagaaacaggcgatattttagtaggtaaattaacgcctcagatagcgagcgaatcgtcctatatcgcggaagctggattattacgggccatatttggtcttgaggtatccacttcaaaagaaacttctctcaaactaccgataggtggaagaggacgcgttatcgatgtgaaatggatccagagggatcccctcgacataatggttcgtgtatatattttacaaaaacgcgaaatcaaagttggggataaagtagccggaagacacgggaataaggggatcatttccaaaattttgcctaggcaagatatgccctatttgcaagatggaacgcctgttgatatggttttcaatcccttaggagtaccctcccgaatgaatgtgggacaaatctttgaaagctcgctcggattagcaggggatctgctaaagaaacattatagaatagcaccctttgatgagagatatgagcaagagacttcaagaaaacttgtgttttcagaattatatgaagccagtaaacaaacaaaaaatccgtgggtatttgaacccgagtacccgggaaaaagcagaatatttgatggaagaacaggagaccccttcgaacatcctgttctaatagggaagtcctatatcttaaaattaattcatcaagttgatgagaaaatccacggacgctctactgggccctattcacttgttacacaacaacccgttagaggaagagccaagcaagggggacaacgaataggagaaatggaagtttgggctttagaaggatttggtgttgctcatattttacaagagatacttacttataaatctgatcatcttatagctcgccaagaaatacttaacgctacgatctggggaaaacgagtacctaatcacgaggatcctccagaatcttttcgagtgcttgttcgagaactacgatctttggctctagaactgaaccatttccttgtatctcagaagaacttccagagagttatccgtcggaacaacaatcttgcctatctattaaaaagaagtgaattagcgccagcagatttagtaatgtgccaggaaaaattggtacaagaagccgtggatacacttcttgatagtgggtcccgcgggcaaccaacgagggatggtcacaataaagtatacaaatcactttcagatgtaattgaagactttgatggggatcaaatggctgttcatctacctttatccttggaagctcaggcggaagctcgtttacttatgttttctcatatgaatctcctatctcccgctattggggatcctatttgcgtaccaacccaagacatgcttatcggactttatgtattaacgattggaaaccgtcgaggagctagaggaaatgcatcgcaggtacaccaattagtaggtatgcgaggattaatggcggatcctcaaggacaaatgattgatttacctattcaaagcaatttacgcgagggactttctttgacagaatatataatttcctgctacggagcccgcaaaggggttgtagatactgctgtacgaacggcggatgctggatatcttacatgtagacttgttgaagtagttcaacatattattgtgcgtagaagagattgtggtactatccaagctatttctagtcaggatattctacatagtgtgactattccttcaaaaagcttgattctagtgcaaaatgatcaatatgtagaatccgaacaagtaattgcggagattcgtgccggaacgtccgctttgcattttaaagaaaagatggggaaatgcactggagtaccgatgtttatcatgcgcccgaatatcaatatggtaatcttcgtcgattaccaaaaacaagccaattatggatattgtcaaaatactatagttgcttattttgacgacccacgatacaaaaaagataaaaagggttcaggaattgttaaatttagatataggaccctagaggacgaatataggactcgagagaaagactcagagaacgaatacgggagcccagaaaacgaatataggacccgagaggaagaatgtaaaaccctagaagacgaatataggactcgagaggaggagtatgaaaccctagaagatgaatatgggatcccagagaacgaatatgaaaccctagaagatgaatatggaatcctagaggacgaatataggactcgagaggaggaatccgaggacgaatatgggagtccagagaacaaatataggccccgagaggataaatatggcactttagaggaagactcagaggtcgaacatgggactttagaggaagactcagaggaagactcagaggacgaatatgggaacccgggggaagattccgtcttaaaaaagggggttttgattgagcatcgaggaacaaaagaatttagtctaaaataccaaaaagaagtagatcggttttttttcattctccaagaactgcatatcttgccgagatcctcatccctaaagttaaattggcactttctccctcatgattcttgggaagagacatcagcaaaaattcaccttggacaatttatttgcgaaaatgagcaactgttcatggtcattatggagaaatcctttacaaaggggataggttagttacgtttatatacgaaaaagcgagatctagtgacataacgcaaggtcttccaaaagtagaacaaatcttcgaagcgcgttcaattgattcactatcgccgaatctcgaaaggagaattgaggattggaatgagcgtataccaagaattcttgggggtccttggggattcttgattggagctgagttaaccatagcccaaagtcgtatctctttggttaataagatccaaaaggtttatcgatcccaaggggtacagatccataatagacatatagagattattatacgccaagtaacatcaaaagtgcgggtttccgaagatggaatgtctaatgtttttttacctggggaattaattggactattgcgagcagagcgagcagggcgggctttggatgaatcgatctattatcgggcaatcttattgggaataacaagggtttccctgaatacccaaagtttcatatctgaagcaagttttcaagaaactgctcgagttttagcaaaagctgccttacgaggtcgtattgattggttgaaaggcctgaaagaaaacgtagttctgggggggattatacctgttggtaccggattccaaaaatttgtgcaccgttacccacaaaacaagaacctttatttcgaaattcaaaaaaaaaaactatttgcgtcggaatgagagatattttgtttctccatacagaattagtttcttctgattctgacgtaacaaacaatttctatgagacatcagaatcaccatttaccccatttatatgatttaaggatacataaagcagattttttactttaaactagatttttgaccttagaacgctaagaggttagattttctatttttattttaatttaaaaagaagtttagttaattcattaaggttatgcttataccatgtagaaggttccatcggaacaattattatttatttcaagctatttcggctctttcttaatcttcgaaaagaaagaaatttcgtaatggaaaggtaggatgaaaaaaaagaaaaaatcaaaaggaagtgtggaaaaaatgacaagaagatattggaacatcaatttgaaagagatgatagaagcgggagttcattttggtcatggtattaagaaatggaatcctaaaatggccccttacatctcggcaaagcgtaaaggtactcatattacaaatctcgctagaaccacccgttttttatcagaagcttgtgatttagtttttgatgcagcaagtcagggaaaaagcttcttaattgttggtaccaaaaaaagagcagcggatttagtagcatcagctgcaataagggctcgttgtcattatgttaataaaaagtggttcagtggtatgttaacgaattggtcgattactaaaactagactttctcaatttagagacttaacagcagaagaaaagatggaaaaattccaccatctcccaaaaagagatgtggcaatcttgaagagaaaattatctaccttgcaaagatatctcggcgggatcaaatatatgacgaggttgcctgacattgtgatcgtcctcgatcagcaaaaagagtatatagctcttcgggaatgtgccattttggggattcctactatttctttagccgatacaaattgtgacccagatctcgcgaatatatcgattccagccaatgatgacactatgacttcaattcgattgattcttaacaaattagtatttgcaatttgtgagggccgttctctctatataagaaatcattgattaagaagaatagttaattcttgggcaactgcgtagatttatggaatcacttactattcttttttgttttgcatagaaaaaagacggggaatattgatatatattagagggtattgatatatattatcatctgatgtgatttcttgatatcctaaatataagattaatacttcacgttgctgagttgagaaaaagatggttgaatcaaaagaattctttttttgaagttcattttttatcaggggacaatatgaatattataccgtgttccattaaaacactcaaggggttatacgatatatcgggcgtagaagtaggccaacacttctattggcaaataggaggtttccaaattcatgcccaagtacttatcacttcttgggtcgtaattactatcttgctaggttcagttatcatagctgttcgcaatccacaaaccatcccaaccgatggtcagaatttcttcgaatatgtccttgagtttattcgagacttaagcaaaactcagattggagaagaatacggtccctgggttccctttattggaactatgttcctttttatttttgtttcgaactggtcgggtgctcttttaccttggaaaattatacagttaccccatggagaattagcagcgcccacgaatgatataaatactactgttgctttagctttactcacgtcagcggcatatttttatgcgggtcttagcaaaaaaggattgagttatttcgagaaatatattaaaccaactccaatccttttaccaattaacatattagaagatttcacaaaaccattatcgcttagttttcgacttttcgggaatatattggcggatgaattagtcgttgttgttcttgtttctttagtccccttagtagttcctataccggtcatgtttcttggattatttacaagcggtattcaagctcttatttttgcaacgttagccgcagcctatataggtgaatccatggagggtcatcattgaattgactagttttcaaaatagtcttttttttagcttaactcaattcatgcatggttgcggaaaattcgcttggttggaaaacaaaatagttagaattgcgtatgaatatacaatctagagttgtagaagagagaataggctatattacggaattgccaaacaaagtatataggcattagggaggggcggagtcaggctagatctatatcctttatgtctataagttcagtcatcttttgtatgggtttccactttaaggaattttttttgaatccgattcaatagaaaatgagaaaatacacaaacaaaatagaagaaacaaattgatatgggatattatatattcccaagttagattcattatctaatccgatatatggaatcggattccatatccaattcgatgcagcatattgttatcaattggatatcttgatttaattcctattggatctggattaggtcgatttccataggggttcttcctctatttcaccttttattatgaattagatgataggggaaaaaatagaaactcaaggatatcgaagaggaaagaaagaaggatggaatgaaagatcagttggttggaaagaaagagaaatagaataatgagtacacaaacctctaatgattagaaactaaaaaggagatctcgaagcagttcggagaattcagattatcgtttcaatttgtactttttagttacttctgtccaatagagcttagaaatatgaatttcttggttgattgtatccttaaccatttcttttttttgacacgaggaactcatcatgaatccactaattgctgctgcttccgttattgctgctggattggccgtaggtcttgcttctattgggcctggagttggtcaaggtactgctgcaggacaagctgtagaaggtattgcgagacagccagaagcagaaggtaaaatacgcggtactttattgcttagtctagcttttatggaagctttaacaatttatggactagttgtggcactggcgcttttatttgcgaacccttttgtttaatcctaaaaaagaaaacgagtcctttagattagatactttcttctttttttagtaaattggtatttgcttctgcaattccaattatatcaatactttactcctaatttattactcctagagttttctatttatggggacagacaataccccaccccaggaatagctgatttgaggatgatcaatttagaggatatgttcgccgtcttgcttcccgccctttgtttagggcagtggaaagtatttttccttttattttaggaattttgggaacatttcaacaaaggaggtctttcacaggtcaaacgagatctaagacttaatctaaaagaaattactaaattgaatctatttctattaaaaaaaattgcattaaaaaaaccgatcaaaaagggcgagcgaagtaagtgatcgaaaaactttgttctttgttcgtcctatctataagaggagagcatatgaaaaatgtaacccattctttcgtttttttagctcactggccatccgctgggagtttcgggcttaataccgatattttagcaacaaatctaataaatctaactgtagtggttggtgtattgatttattttggaaagggagtgtgtgcgagttgtctatttcaagaatagattggatctatccggctgcactttagaatattttttagtatttttcgaataaataagaaaagggtgcacgatctcgacgaattacttctgaataaatgcagaaatcatatgaaagaaccatagcatttcgcgacctattggtaaatcaaatcaactttgattctctatagaccaataatatgagaccattaacacggttaaagctaaactgcttgaagtctaggcaaaagggggtactctttctacaactatattagtattagtaccaaatgctttaaacaggaaatagctaatgtagaatttatctgatatagaacactcatatcgataaaatggtttgaactatttactagaaggggcaccctgcccttttttatccaatgccgaatcgacgacctatgtataaaaaaggagaaagtttttggatttgaagaaaaaagtaggaattctatccattttcattttccatttttctatttagtttttcttaatgaaattgaaaattttaactaaagggcaaatacaaataaaaaaacaactttgctgcccacgatagatttttatctaggcggaagagtcctcttaatatttatctagtcttatatgggtttcggtatattgaaatataaacagaaaagagagggtagaggataggctcattacattaaaaaaaatatggaagtagccatagc

SEQ ID NO: 3230 - DNA, 3416 bp, Cannabis sativa
ttgagaataaaattctctttattcctccgttcatacgtattgctccatctatttatattatatggagttaagtaaaatttcatgtgattcagtaataaacagaatagaaattccatcattgctatatcgatctatcttatttgatgaagaatgggaaaataatgggatttttttctataactataaacgggaaataaaaaaaaatgcttggggatggaaatgggaaaatgtctacaatacccggatttaatcagatacaatttgaagggttttgtaggttcattgatcagggcttaacagaagaactttataagtttccaaaaatggaagatacagatcaagaaattgaattccaattatttgtggaaacatatcaattggcagaaccgttgataaaagaaagagatgctgtatatgaatcactcacatattcttctgaattatatgtatctgccggattaatttggaaaaccagtagggatatgcaagaacaaactatttttattggaaacattcctctaatgaattccctgggaacttctatagtaaatggaatatacagaattgtgatcaatcaaatattgcaaagccctggtatctattaccggtcagaattggaccataacggaatttcggtctataccggcaccataatatcagattggggaggaagattagaattagagattgatagaaaagcaaggatatgggctcgtgtgagtaggaaacagaaaatatctattctagttctatcatcggctatgggctcaaatctaagagaaattctagagaatgtttgttaccctgaaattttcttgtctttcctgaatgataaggagaaaaaaaaaattaagtcaaaagaaaatgccattttggagttttatcaacaatttgcttgtgtaggcggagatccggtattttctgaatccttatgtaaggaattacaaaagaaattctttcaacaaagatgtgaattaggaagaattggtcgacgaaatatgaaccgtagactgaatcttgatatacctcagaacaatacatttttgttaccacgagatatattggcagcagcggatcatttgattggaatgaaattcggaatgggtatacttgacgatatgaatcatttgaaaaataaacgtattcgttctgtagcggatcttttacaagatcaattcggattggccctggttcgtttagaaaatatggttagaggaactatgagtggggcaattaggcataaattgataccgacccctcagaatttggtaacttcaactacattaacaacaacttttgaatcttttttcggattacacccattatctcaagttttggatcgaactaatccattgacacaaatagttcatgggagaaaattgagttatctgggccctggaggattgacaggacgaactgctagttttcggatacgcgatatccaccctagtcactacggacgcatttgtcctattgatacgtccgaaggaattaatgttggacttattggatccttatcaattcatgcgaggattggtccttggggatctctagaaagtccgttttatgaaatctctgagagatcaaaaaaagtacggatgctttatttatcaccaagtcgagatgaatactatatggtagcggcaggaaattctttggcactgaatcgaggtagtcaggaagaacaggttgttccggctcgataccgtcaagaattcctgactattgaatgggaacaggttcatcttcgaaatatttttcccttccaatatttttctattggagcttccctcattccttttatcgagcataatgatgcgaatcgtgctttaatgagttctaatatgcaacgtcaagcagttcctctttctcgatcggaaaagtgcattgttggaactgggttggaatcccaggtggctctagattcaggagttcccgctatagccgaacatgagggaaagatcgtttataccgatactgacaagatcattttatcgggcaatggagatactttaagcattccattagttagatatcaacgttccaacaaaaatacttgtatgcatcaaaaaccccaagttgcgcgaggtaaatgtattaaaaaggggcagattttagcagacggtgctgcgacagttggcggcgaactatctttgggaaaaaatgtattagtagcttatatgccatgggaggggtacaattttgaggatgcagtactcattaatgagcgtttggtatatggggatatttatacttcttttcatatacggaaatatgaaattcaaactcatgtgacaagccacgggcctgaaagaatcactaatgaaataccacatctagaagctcatttactccgaaatttagacaaaaaaggcgttgtgatgttggggtcttgggtggagacgggcgatattttagtaggtaaattaacgcctcagatggcgaaagaatcatcgtatgctccggaagatagattattacgagccatacttggcattcagatatccacttcaaaggaaacttgtctaaaactacctataggtagtagaggtcgagttattgatgtgagatggatccagaaaaaagggggttctagttataatccagaaacgattcgtgtatatatttcacaaaaacgtgaaatcaaagtgggtgataaagtagctggaagacatggaaataaaggtatcgtttcaaaaattttacccagacaagatatgccttatttgcaagatggaagacctgttgatatggtcttcaacccattaggagtcccttcacgaatgaatgtaggacagatatttgaatgctcgctcgggttagcgggggagttgctagatagacattatcgaatagcaccctttgatgagagatatgaacaagaggcttcgagaaaactagtcttttctgaattatatgaagccagtaagcaaacagcgaatccatgggtatttgaacccgagtatccgggcaaaagtagaatatttgatggaagaacgggggatccttttgagcaacctgttataataggaaaaccatatatcttgaaattaattcatcaagttgatgataaaatacatggacgttgcagtggacattatgcacttgttacacaacaaccccttagaggaagggccaagcaagggggacaacgggtaggagaaatggaagtttgggctctagaaggatttggtgttgctcatattttacaagagatgcttacttataaatcggatcatattagagctcgccaagaagtacttggtactacgatcatcggaggaccaatacctaaacccgaggatgctccagaatcttttcgattacttgttcgagaactacgatccttggctctggaattgaatcatttccttgtatctgagaagaacttccagattaataggaaggacgcttaa

SEQ ID NO: 3231 - DNA, 12028 bp, Cannabis sativa
aatttggaatacggaatatcataataatggtagaaattgaatcactttttgttttgattgatattctatacaaaactccctaagtctaagtggaatttatcaccccctttccgtttgtatctgttgcaaattccgatttgagaataaaattctctttattcctccgttcatacgtattgctccatctatttatattatatggagttaagtaaaatttcatgtgattcagtaataaacagaatagaaattccatcattgctatatcgatctatcttatttgatgaagaatgggaaaataatgggatttttttctataactataaacgggaaataaaaaaaaatgcttggggatggaaatgggaaaatgtctacaatacccggatttaatcagatacaatttgaagggttttgtaggttcattgatcagggcttaacagaagaactttataagtttccaaaaatggaagatacagatcaagaaattgaattccaattatttgtggaaacatatcaattggcagaaccgttgataaaagaaagagatgctgtatatgaatcactcacatattcttctgaattatatgtatctgccggattaatttggaaaaccagtagggatatgcaagaacaaactatttttattggaaacattcctctaatgaattccctgggaacttctatagtaaatggaatatacagaattgtgatcaatcaaatattgcaaagccctggtatctattaccggtcagaattggaccataacggaatttcggtctataccggcaccataatatcagattggggaggaagattagaattagagattgatagaaaagcaaggatatgggctcgtgtgagtaggaaacagaaaatatctattctagttctatcatcggctatgggctcaaatctaagagaaattctagagaatgtttgttaccctgaaattttcttgtctttcctgaatgataaggagaaaaaaaaaattaagtcaaaagaaaatgccattttggagttttatcaacaatttgcttgtgtaggcggagatccggtattttctgaatccttatgtaaggaattacaaaagaaattctttcaacaaagatgtgaattaggaagaattggtcgacgaaatatgaaccgtagactgaatcttgatatacctcagaacaatacatttttgttaccacgagatatattggcagcagcggatcatttgattggaatgaaattcggaatgggtatacttgacgatatgaatcatttgaaaaataaacgtattcgttctgtagcggatcttttacaagatcaattcggattggccctggttcgtttagaaaatatggttagaggaactatgagtggggcaattaggcataaattgataccgacccctcagaatttggtaacttcaactacattaacaacaacttttgaatcttttttcggattacacccattatctcaagttttggatcgaactaatccattgacacaaatagttcatgggagaaaattgagttatctgggccctggaggattgacaggacgaactgctagttttcggatacgcgatatccaccctagtcactacggacgcatttgtcctattgatacgtccgaaggaattaatgttggacttattggatccttatcaattcatgcgaggattggtccttggggatctctagaaagtccgttttatgaaatctctgagagatcaaaaaaagtacggatgctttatttatcaccaagtcgagatgaatactatatggtagcggcaggaaattctttggcactgaatcgaggtagtcaggaagaacaggttgttccggctcgataccgtcaagaattcctgactattgaatgggaacaggttcatcttcgaaatatttttcccttccaatatttttctattggagcttccctcattccttttatcgagcataatgatgcgaatcgtgctttaatgagttctaatatgcaacgtcaagcagttcctctttctcgatcggaaaagtgcattgttggaactgggttggaatcccaggtggctctagattcaggagttcccgctatagccgaacatgagggaaagatcgtttataccgatactgacaagatcattttatcgggcaatggagatactttaagcattccattagttagatatcaacgttccaacaaaaatacttgtatgcatcaaaaaccccaagttgcgcgaggtaaatgtattaaaaaggggcagattttagcagacggtgctgcgacagttggcggcgaactatctttgggaaaaaatgtattagtagcttatatgccatgggaggggtacaattttgaggatgcagtactcattaatgagcgtttggtatatggggatatttatacttcttttcatatacggaaatatgaaattcaaactcatgtgacaagccacgggcctgaaagaatcactaatgaaataccacatctagaagctcatttactccgaaatttagacaaaaaaggcgttgtgatgttggggtcttgggtggagacgggcgatattttagtaggtaaattaacgcctcagatggcgaaagaatcatcgtatgctccggaagatagattattacgagccatacttggcattcagatatccacttcaaaggaaacttgtctaaaactacctataggtagtagaggtcgagttattgatgtgagatggatccagaaaaaagggggttctagttataatccagaaacgattcgtgtatatatttcacaaaaacgtgaaatcaaagtgggtgataaagtagctggaagacatggaaataaaggtatcgtttcaaaaattttacccagacaagatatgccttatttgcaagatggaagacctgttgatatggtcttcaacccattaggagtcccttcacgaatgaatgtaggacagatatttgaatgctcgctcgggttagcgggggagttgctagatagacattatcgaatagcaccctttgatgagagatatgaacaagaggcttcgagaaaactagtcttttctgaattatatgaagccagtaagcaaacagcgaatccatgggtatttgaacccgagtatccgggcaaaagtagaatatttgatggaagaacgggggatccttttgagcaacctgttataataggaaaaccatatatcttgaaattaattcatcaagttgatgataaaatacatggacgttgcagtggacattatgcacttgttacacaacaaccccttagaggaagggccaagcaagggggacaacgggtaggagaaatggaagtttgggctctagaaggatttggtgttgctcatattttacaagagatgcttacttataaatcggatcatattagagctcgccaagaagtacttggtactacgatcatcggaggaccaatacctaaacccgaggatgctccagaatcttttcgattacttgttcgagaactacgatccttggctctggaattgaatcatttccttgtatctgagaagaacttccagattaataggaaggacgcttaatcggaaggaatcagaatttttcttctatgatcgatcggtataaacatcaacaacttcgaattggatcagtttctcctcaacaaataagtgcttgggccaaaaaaatcctacctaatggagaaataattggagaggtgacaaaaccctacacttttcattacaaaaccaataaacctgaaaaagatggcttattttgtgaaagaatttttgggcctataaaaagtgggatttgtgcttgtggaaattatcgagtaattggaaatgacaaagaagacccgaaattttgtgaacaatgcggagtcgagtttgttgattctcgaatacgaagatatcaaatgggttacatcaaattggcatgcccagtaacccatgtgtggtatttgaaacgtcttcctagttatatcgcaaatcttttagataagccgcttaaagaattagaaggcctggtatactgcgatttttcttttgctaggcccatagctaaaaaacctactttcttacgattacgaggttcattcgaatatgaaatccaatcctggaaatatagcattccccttttttttactactcatggcttcgatgcgtttcgaaatcgagaaatttctactggagcgggtgctatcagagaacaactagccgatctggatttgggaattattatcgattattcgttagcagaatggaaagaattaggggaagaagggcccacgggtaatgaatgggaagatcgaaaagttggaagaagaaaggattttttggttagacgcatagaattagctaagcattttattcgaacaaatatagaaccagaatggatggttttatgtctattaccggttcttcctcccgagttgagaccaatcattcaaatagatggcggtaaactaatgagttcggatattaatgaactctatagaagagttatctatcggaacaatactcttatcgatttattaacaacaagtagatctacgccaggggaattagtaatgtgtcaggagaaattggtacaagaagctgtggatacccttcttgataatggaatccgcggacaaccaatgcgagacggtcataataaggtttacaagtcgttttcggatgtaattgaaggcaaagagggaagatttcgtgagactctacttggtaaacgagttgattattcggggcgttctgtcattgtcgtaggtccttcactttcattacatcgatgtggattgccgcgcgagatagcaatagaacttttccagacatttgtaattcgtggtttaattagacaacattttgcttcgaacataggagttgctaagagtaaaattcgagaaaaagagccggttgtatgggaaatacttcaggaagttatgcaagggcatcccgtattgctgaatagggcgcccactctacatagattaggcatacaggccttccaacccattttagtagaaggacatgctatttgtttacatccattagtttgtaagggattcaatgcagactttgatggggatcaaatggctgttcatgtacctttatctttagaagctcaagcagaggctcgtttacttatgttttctcatacaaatctgttgtctccagctattggggatcccatttccgtaccaactcaagatatgcttattgggctctatgtattaacgagcggtaatcgccgaggtatttgtgcaaataggtataatccctctaatcacagaaattatcaaaatgaaagaattggcgataatacctataaatatataaaagaacccttttttggtaattcctacgctgcaattggagcttatcggcagaaaagaatccatttagatagtcctttgtggctccggtggcgactcgatcaacgcgttcttacttcaagagaagctcccatcgaagttcactatgaatctttaggtacctatcatgagatttatggacatttactaatagtaagaagtataaaaaaagaaattctttgtatatatgttcgaactactgttggtcatatttctctttatcgcgaaatcgaagaagctatacaagggttttgccgggcctgctcatacggtacctaatcatatggtatccaagctaagtagttctctgaatccagtgtgaattcgagtccctccggttcaacaaagaacataattcctgaatttctactcgaatcaagatcgagaaaaggaagttttccaatcattgactcaaacccattgtcaaaccccactcatcagaatatggaggtacttatggcagaacgggccggtctggtctttcacaataaagtgatagatggaactgccattaaacgacttattagtagattaatagatcatttcggaatggcatatacatcccacatcctggatcaagtaaagactctggggttccggcaagcgactgctacatctatttcattaggaattgatgatcttttaacaataccttctaagggatggctagttcaagatgctgaacaacaaagtttgattttggaaaaacaccatcattatggaaatgtacatgcggtcgaaaaattacgacaatctattgagatatggtatgctacaagtgaatatttgcgacaagaaatgaatcctaattttcggatgactgatccttttaatccagttcatatgatgtccttttcgggagctagaggaaatgcatctcaagtacaccaattagtaggtatgagaggattaatgtcggatccacaaggacaaatgattgatttacctattcaaagcaatttacgagaaggactgtctttaacagaatatatcatttcttgttacggagcccgcaaaggagttgtggatactgctgtacgaacatcggatgctggatatcttacacgcagacttgttgaagtagttcaacacattgttgtacgtagaacagactgtggcaacatccgagggatttctgtgagttctcgaaatgggatgatgtcggaaagaatttttatccaaacattgattggccgtgtattagcggacgatatatatataggaccacggtgcattgccgttcgaaatcaagatattggtattggacttgtcaatcgattcataacttttcaaacacaacccatctctatccgaactccctttacgtgtaaaagtacgtcttggatctgccgattatgttatggtcggagccctactcatggcgacctcgtcgaattgggagaagctgtaggtattattgcgggtcaatctattggggaaccgggcactcaactaacattaagaacttttcataccggtggagtattcaccggaggtactgccgaacatgtacgagccccttctaatggaaaaatcaaattcaatgaggatttggctcatcccacacgtacacgtcatgggcatcccgcttttctatgttctatagacttggatgtaattattgagagtgaagatattatccacaacgtgactattccaccaaaaagtttgattttagttcaaaacgatcaatatgtagaatcagaacaagtgattgctgagattcgcgcaagaacatccacttttaattttaaagagaaggttcgaaaacatatttattctgactccgagggagagatgcactggagtaccgatgtatatcatgcaccagattttacgtatagtaatgtgcatcttttaccaaaaacaagtcatttatggatattatcaggaagctcgtaccgatccagtgtagtccctttttcaatccataaagatcaagatcaaacgaatgtttattttctttcggccgaaggaaaaaatatttctagccgttcagtaaatacagtaaataatgatcaagggaaagggaaattctttagttcagatttttctggtaaaaaagaaagcactattcctgattattcagaatttaatcgaattatagatagggatcattggaatttaatattcccctctattctccataaaaattatgatttatttttattggcaaagaggagaagaaatagattcatcattccattccaatggattcaagaacgagagaacgaactaatgctccgttccagtatttcgattgaaataccgataaatggtgtttttcggaaaaatagtattcttgcttattttgatgatcctcaatacagaagaaagagttccggaattactaaatatggggctataggtttgcattcaatcttcaaaaaagaggatttaattgagtatgtaggaatcaaagaacttaagccaaaataccaaacgaaagtagatcgattttttttcattcccgaggaagtgcatattttacccgaatcttcttccataatggtacgaaacaatagtattattggaataaatacacaaatcactttaaatacaagaagccgagtaggcggattggtccgagtggagaaaaaaaaaaaaaggattgaacttaaaatcttttctggggagatccagtttcctgtagagatggataagatatttcgccacagtggcatcttgataccaccgggaagggtaaaaaaaaaaattaaggaatccaaaaaattgaaaaattggatctatgtccaatggatcacacctaccaagaaaaaatattttgttttggttcgacccgtaatcatatatgaaatagcggacggtataaatttagaaacactttttccacaggatttgttgcaggaaaaggataatctagaacttagagttgtaaattatattctttatggaaatggcaaacccattttgggaatttctggaactagtattcaattagttcggacttgtttaatgttgaactgggatcaagacaacaaaagttcttctagcgaagaagcccacgtttactttgttgaagtaagtacaactggtctgattcgcgatttcctaagaatcaacttagcgaaatccaatatttgctatatcagaaaaagaaatgatccgttaggttcaggattgatctctgataataggtcagattgtaccaatccattttattctatttattccaaggaaaagattcaacaatcacttagacaaaatcaaggaactattcatacgttgttgaatagaagtaaggaatctcaatctttgataattttgtcatcatctaattgttttcaaatgagtccattcaaggatgtacaatattccaatgggataaaagaatcaattaaagtagaacctctaattccaattaggaattcgttaggccctttaggaacatcctctcaaattgagaacttttattaccttttaaaaactcataatcagatctcggtaactaaatatttgcaacttgacaatttcacacagccttttcaagtacttcaatattatttaatggacgaaaacgggatagtttataattccgatccatgcagtaacactcgtttgaatccattcaacttgaattggcatttttttcataataattatgataataattattatcaaaaaaaatccccaataattagccttgggcggtttttttgtgaaaatgtatgtatagtcaaacatggaccgcacctaaaatcgggtcaagttataattgttcaaatcgactctgtagtaataagattggcgaagccctatttagccactccaggagcaactgttcatggccattatggagaaaaactttccgaaggagatacattagttacatttatatatgaaaaatcgagatctggtgatataacgcagggtcttccaaaagtggaacaagtgttagaagttcgttcgattgattcaatatcaatgaacctagaaaagagagttgagggttggaacgaccttctaacaagaattcttggaattccttgggggttcttgattggtgctgagctaactatagtgcaaagtcgtatctctttggttaataagatccaaaaggtttatcgatcccagggtgtgcagatccataatagacatatagaaattattgtccgtcaaataacatcaaaagtggtggtttcagaagatggaatgtctaatgtttttttacccggagaacttattggattgttgcgagcggaacgaacggggcgtgctttggaagaagcaatttgttaccgagctatattattgggaataacgaaagcatctctaaatactcaaagtttcatatccgaagcgagttttcaagaaactgctcgcgttttagcaaaagccgcgttacgcggtcgtatcgattggttgaaaggtctgaaagaaaatgttgttctaggggggatgatacccgttggtaccggattcaaaggattagtgcactgttcaaggaagcataataacattcctttggaacccaaaaataagaatttatttgagtgggaaatgagagatattttattccaccacagagaattattttctttttgtatttcaaagaatgtacaggatacatcagaacaatcatttataggatttaatgattcctaacagcagactcatcctttttgtctatttgtggttgcagtcatttgatttggtaatagtaataaggagaataataaaataaagaaaataatgaatagaaagattgaaaaaaaaaaatgaacggcttggatcgcgtatcaacggccaatttccgttagaagagaaggttccatgggaactattattttttttctattttcagggtacctcatctcttttttttctttgaaaaaaaaaaaaaagagaagaagtgtggggagaaatgacaagaagatattggaacatcaatttggaagagatgatggaagcaggagtacattttggtcatggtactaagaaatggaatcctagaatggcaccttatatatctgcaaagcgtaaaggtattcatattataaatcttactagaacagctcggtttttatcagaagcttgtgatttagtttttgatgcagcaagtaggggaaaacaattcttaattgttggtaccaaaaataaagcagctgattcagtagccggggcagcaataaaggctcggtgtcattatgttaataaaaaatggcttggtggtatgttaacgaattggtatactacagaaacgaggcttcataagttcagagacttgagaacggaacaaaagacgggcagactcaaccgtcttccgaaaagagatgcggctgtgttgaagagacaactatctcatttgcaaacatatttgggcgggattaaatatatgacggggttacctgatattgtaataattgttgatcagcaagaagaatatacggctcttcgagaatgtatcactttgggaattccaacgatttgtttaatcgatacaaattgtgacccggatttagcagatatttcgattccagcgaatgatgacgctatagcttcaatccgattaattcttaacaaattagtatttgcgatttgtgagggtcgttctagctatatacgaaattcttgattaataataagataaggaaataaggaaattattttgggaactccatataatatagatttattgaaccggttactatatcctgaatcgcacaaaagagataaaaataactgaggctttgatgtgattagttgatattcaaaatagacaattcctgtgggcgagtcgaaaaagagctaggtgaatcaaaataatttcttttaaagttcgatttctttcagagggtaatatgaattttttattatgttccatcaacacactaaaagtgttatacgatatatccggcgtggaagtaggccagcatttttattggcaaataggaggttttcaagtccatgcccaagtacttattacttcttgggttgtaattgctatcttattaggttcggccattctagctgttcgtaatccacaaactattcctacagacggtcagaatttttttgaatatgttcttgaattcattcgagacgtgagcaaaactcagattggagaagaatatggcccatgggttccatttattggaactctgtttttatttatttttgtttcgaattggtcaggggctcttttaccttggaaaatcatagagttacctcatggtgagttagccgcacccacaaatgatataaatactaccgttgctttagctttactcacgtcagtagcatatttctatgcgggccttagcaaaaaaggattggggtattttggtaaatacattcaaccaactccaatccttttacccattaacatcttagaagatttcacaaaacccttatcacttagttttcgacttttcggaaatatattagctgatgaattagtagttgttgttcttgtttctttagtacctttagtggttcctatacctgtcatgttcctgggattatttacaagtggtattcaagctcttatttttgcaactttagctgcggcttatataggagaatccatggaaggtcatcattgactagttttcgccatagtctttttttagcttagcctgacacaatgcatacgcgtcgcaagggaatccacttaggcttagggaagataagagtttacaaaaaaggaataaaaaaaaaaaaa

SEQ ID NO: 3232 - DNA, 3573 bp, Amborella trichopoda
ggatagataagataattaaattaggtagaaatttgatcgaaaagacccaaccctattctattcttattctataacaaaaacaaagctcaactcaataagtgccagaatccttgttacaggaatatcatttccatttgcatttgtaaccaattcgaattgaagtacaaaattctctttatccctccttcatacgtatatggagttggataaaatttcatgtgattcagtaaacagaatatacattccatcattgctggatcgatccgtatggttcgataaagagtgatccaataatgggatttttcgagaaatggaaaacttaagtaagatgctacgggatggaaatgagggaatgtctacaatacctggatttagtcagatacaatttgaaggattttgtaggttcgttgatcagggcttggcagaagaacttcataagtttccaaaaattgaagatacagatcaagaaattgaatttcaattacttgtggaaacatatcaattggcggaacccttgataaaagaaagagatgctgtgtatgaatcactcacacattcctctgaattatatgtacccgcggggttaatttggaaagttggtagagatatgcaagaacaaaccgtgtttattggaaacattcctctaatgaattctctgggaacctttatagtaaatggaatatacagaattgtgatcaatcaaatattgcaaagccccggtatttattacagttcagaattggaccataacgggatttctgtttataccggcaccataatatcagatcggggaggaagatcagaattagagattgatagaaaagcaaggatatgggcccgtgtgagcaggaaacaaaaaatttctattctagttctaccatcagctatgggttcgaatctaagagaaattctagacaatgtttgctaccccgaaattttattgtatttcccgaatgagaaagagaaaaagaaaattgggtcgaaggaaaatgctattttggagttttatcaacaattttcttgtgtaggcggggatccggtattttctgagtccctctgtaaggaattacaaaagagattttttcaacaaagatgtgaattaggaaggattggtcgacaaaatatgaaccagagattgaatattgatataccccagaacaatacatttttattaccacgagacgtattggctgctacagatcatttgatcggaatgaaatttggaatgggtacacttgacgatatgaatcacttgaaaaataaacgtattcgttctgtagcagatctgttacaggatcaattcggattggctctggttcgtttggaaaatgtggttcgaggaactatatgtggagcaatcaggcataaatttataccgactcctcaaaacttggtaacttcaactccattaacaaccacttatgaatcgtttttcggtctacaccctttatctcaagttttggatcgaactaatccattgacacagatagttcatgggcgaaaatcaagctatttgggtcccggaggattaacagggcgaactgctagttttcgcatacgagatatccatcctagtcactatggacgtatttgcccaattgacacgtccgaaggaatcaatgttggacttatcggatccttagctattcatgcaaggatcggcgattggggatctatacgaagtccgttttatgaaatatctgagagatcaaaagaggaacagatggtttatttatcaccaaggagagatgaatactatatggtaatggtagcagcaggaaattctttggccttgaatcaggatattcaagacgaacaggtcgttccagcccgataccgtcaagaattcgtgactattgcatgggaacatattgatcttcgaagcatttatcccctccaatatttttctattggagcttccctcattccgtttatcgaacacaatgatgcgaatcgagctttaatgagttctaatatgcagcgtcaagcagttccgctttctcggtccgagaaatgcattgttggaactgggttggagcgccaagcggctttagattcggggggttcagctatagcccaacacgagggaaaggtcatttataccgatactgaaaagatccttttatcagggaatggagacactataagcattccattgcttatgtatcagcgttccaacaaaaatacttgtatgcatcaaaaacctcaggttcatcgggataaatatgttaaaaagggacaagtcttggcggatggtgcggctacagttggtggggaactcgctttgggaaaaaacgtattagtagctcatatgccatgggaaggctacaattttgaagatgcagtactaattagcgaacgtctggtatatggagatatttatacttcgtttcacatccggaaatatgagattcagactcatgtgacaagccacggccctgaaaagatcactaacgaaatacctcatttagaagctcatttgctccgtaatttagacagaaatggaattgtgatgctcggatcttgggtggaaacgggtgatgttttagtaggtaaattgacgcctcagacagcgaaagaatcatcgtatgccccggaagatagattattacgagtcatacttggaattcaagtatccactgcaaaggaaacttgtctaaaactacctataggtggaagaggtcgagttattgatgtgagatggatccagaaaaaaggggcttccagttataatccagaaaaaattcgtgtatatatttcacagaaacgtgaaatcaaagtgggtgataaagtcgccggaagacatggcaataagggtatcatttccaaaattttgcctagacaagatatgccttatttgcaagatggaacaccagttgatatggtcttcaacccattaggagtaccttcacgaatgaatgtgggacagatctttgaatgctcgctggggttagcgggagatctgctggacagacattatagaataacaccctttgatgagagatatgagcaagaggcttcgagaaaactagtgtttcctgaattatatgaagccagtaagcgaacagcaaatccatgggtatttgaacccgagtatcctggaaaaagcagaatatttgatggaagaacaggagatccttttgaacaacctgttataataggaaagtcctatatgctgaaattaattcatcaagtagatgataaaatccatggacgttccagtggacattatgcacttgttacacaacaaccccttagaggaagggccaagcaagggggacaacgagtaggagaaatggaagtctgggctctagagggatttggtgttgctcatattttacaagagatgcttacttataaatccgaccatattagagctcgtcaggaactacttggtaccacgatcgttggaggaacaatacctaagcctgagggtgctccagaatcttttcgattgctcgttcgagaactacgatctttggctctggaactgaagcatttccttgtatctgagaagaacttccagattaataggaaggaagcttgatcggaatgaatcagaatttttcttct

SEQ ID NO: 3233 - DNA, 16725 bp, Malus domestica
ggtagaaattgaatcacttttcgttttgatattctatacaaaattccataagtctaagtagaatttatcaatttctttccatctgttgcaaattccaattttagtaaaaaaattatccttattcctccgttcatacgtatttcatacattccatatattatatggagttaggtaaaatttcatgtgattcagtaaacagaatataaattccatcattgctagatcgatccatatgattcgatgaagaatgagcaaataatggggtttttgtctttaaacgggaaataaaaaaaaaaatgcttgggggtggaaatgaggcaatatctacaatacctggatttaatcagatacaatttgaagggttttgtaggttcattgagcagggcttaacagaggaactttataagtttccaaaaattgaagatacagatcaagaaattgaatttcaattatttgtggaaacatatcaattggtagaacccttgataaaagaaagagatgctgtatatgaatcacgcacatattcttcggaattatatgtatccgcgggattagtttggaaaaacagtagggatatgcaagaacaaacaatttttattggaaacattcctctaatgaattccctgggaacttctatagtaaatggaatatacagaattgtaatcaatcaaatattgcaaagccccggtatctattaccggtccgaattggaccataacggaatttccgtctataccggcatcataatatcagattgggggggaagattagaattagagattgatagaaaagcaaggatatgggctcgtgtgagtaggaaacaaaaaatatctattctagttctattatcagctatgggttcgaatctaagagaaattctagagaatgtttgctaccctgaaattttcttgtctttcctgaatgataaggagaaaaaaaaaattgggtcaaaagaaaatgccattttggagttttatcaacaatttgcttgtgtaggcggagatccggtagtttctgaatccttatgtaaggaattacaaaagaaattctttcaacaaagatgtgaattaggaagggttggtcgacgaaatatgaaccgaaggttgaatcttgatatacctcagaacaatatatttttgttaccgcgagatatattggcagctgcggatcatttgattggaatgaaatttggaatgggtacccttgacgatatgaatcatttgaaaaataaacgtattcgttctgtagcggatctcttacaagatcaattcggattggctctggttcgtttagaaaatatggttagagggactatatgcggagcaattaagcataaattgataccgactcctcagaatttggtaacttcaactccattaacaaccacttatgaatcttttttcggattacacccattatctcaagttttggatcgaactaatccattgacacaaatagttcatggaagaaaatcgagttatctgggccctggaggattgacagggcgaactgctagctttcgtatacgagatatccaccctagtcactatggacgcatttgccccattgacacgtctgaaggaatcaacgttggacttattggatccttagcaattcatgcgaagattggttattgggggtctctagaaagtccgttttatgaaatttctgagagatcaaaaaggatgctttatttatcaccaagtaaagatgaatactatatggtagcggcaggaaattctttggcgttgaatcgaggtattcaggaagaacaggttgttccagctcgataccgtcaagaattcctgactattgaatgggaacaggttcattttcgaagtatttttcccttccaatatttttctattggagcttccctaattccttttatcgagcataatgatgcgaatcgggctttaatgagttctaatatgcaacgtcaagcagttccgctttctcggtctgaaaagtgcattgttggaactggattggaacgccaagtggctttagattccggagttactgctatagccgaacatgagggaaaggtcatttataccgatactgacaagatcattttatcgggaaatggggctactcgaaacattccattagttatatatcaacgttccaacaaaaatacttgtatgcaccaaaaaccccaggttcggcgaggtaaatgtattaaaaagggacaaattttagcagatggtgctgctacggttggcggcgaactcgctttgggaaaaaacgtattagtagcttatatgccatgggaaggttacaattctgaagatgcggtactcattagtgagcgtctggtatatggagatatttatacttcttttcatatacggaaatatgaaattcagactcatgtgacaagcaatggccctgaaagaatcactaacgaaataccgcatctagaagcccatttactccgcaatttagacaaaaatggaattgtgaggctgggatcttgggtaaagacgggtgatattttagtaggcaaattaacgcctcagatggcgaaagaatcgtcgtatgctccggaagatagattattacgagccatacttggcattcaggtatccacttcaaaggaaacttgtctaaaattacctataggtggtagaggtcgagttattgatgtgagatggatccagaaaaaggggggttctagttataatccagaaacgattcgtgtatatatttcacaaaaacgtgaaatcaaagtaggtgataaagtcgctggaagacatggaaataagggcattgtttcaaaaattttatctagacaagatatgccttatttgcaagatggaagacctgttgatatggtcttcaacccattaggagtgccttcacgaatgaatgtaggacagatatttgaatgctcgctcgggttagcggggggtctgctagatagacattatcgaatagcaccttttgatgagagatatgaacaagaggcttcgagaaaactagtgttttctgaattatatgaagccagtaagcaaacagcgaatccatgggtatttgaacctgagtatccgggcaaaagcagaatatttgatggaagaacgggagatccttttgaacaacctgttataataggaaagccttatatcttgaaattaattcatcaagttgatgataaaatacatggccgttccagtggacattatgcacttgttacacaacaaccccttagaggaagggccaagcaagggggacaacgggtaggagaaatggaagtttgggctctagagggatttggtgttgctcatattttacaagagatgcttacttataaatctgatcatattagagctcgccaagaagtacttggtactacaatcattggaggaacaatacctaaacccgaggatgctccagaatcttttcgattgctcgttcgagaactacgatctttggctctggaactgaaccatttccttgtatctgagaagaacttccagattaataggaaggaagcttaatcggaatgaaatgaatcagaatttttcttctatgatcgatcggtataaacatcaacaacttcgaattggattagtttctcctcaccaaataagtgcttgggccaaaaaaaccctacctaatggagaggtagttggagaggtgacaaaaccctatacttttcattacaaaaccaataaacccgaaaaagatggattattttgtgaaagaattttcgggcctataaaaagtgggatttgtgcttgtggaaattatcgagtaatcggagatgaaaaaaaagacccgagattttgtgaacagtgtggagtcgaatttgttgattctcggatacgaagatatcaaatgggctacatcaaactggcatgcccagtaacccatgtgtggtatttgaaacgtcttcctagttatatcgcgaatcttttagataaacctcttaaagaattagaaggcctagtatattgcgatgatcctatccaaatttttcttttgctaggcccatagctaaaaaacctactttcttacgattacgaggttcattcgaatatgaaatccaatcctggaaatacagcatcccacttttttttactacccagggcttcgatacatttcgaaatagagaaatttctactggagcaggtgctatccgagaacaattagccgatttggatttgcgaattattatagattattcgttggtagaatggaaagaattaggggaagaggggcccacgggtaatgaatgggaagatcgaaaagttggaagaagaagggattttttggttaggcgcatggaattggctaagcattttattcgaacaaatatagaaccagaatggatggttttatgtctattaccagttcttcctcccgagttgagaccgatcattcagatagatgggggtaaactaatgagctcagatattaatgaactctatagaagagttatttatcggaacaatactcttatcgatctcttaacaacaagtagatctacgccaggggaattagtaatgtgtcaggagaaattggtacaagaggctgtggatacacttcttgataatggaatccgcggacaaccaatgagggacggtcataataaggtttacaagtcgttttcagatgtaattgaaggaaaagagggaagatttcgtgaaactctgcttggcaaacgggtcgattattcggggcgttctgtgattgtcgtaggtccctcactttcattacatcgatgtggattgcctcgcgaaatagcaatagagcttttccagacatttgtaattcgtggtttaattagacaacactttgcttcgaatataggagttgctaagagtaaaattcgggaaaaagagccggttgtatgggaaatacttcaggaagttatgcaaggtcatcccgtattactgaatagggcgcctactctgcatagattaggcatacaggcgttccaacccattttagtagaaggacatgctatttgtttacatccattagtttgtaagggattcaatgcagactttgatggtgatcaaatggctgttcatgtacctttatcattggaggctcaagcggaggcccgtttacttatgttttctcatatgaatctcttgtctccagctattggggatcctatttccgtaccaactcaagatatgcttattgggctctatgtattaacgagtggaaatcgtcgaggtatttgtgcaaataggtataatccatgtaatcgcagaaattatcaaaataaaagaattgatgataataactataagtatacgaaagaaccttttttttgtaattcctatgatgcaattggagcttatcggcagaaaagaatcaatttagatagccctttgtggctccggtggcgactagatcaacgcgttattacttcaagagaaactcccatcgaagttcactatgaatctttgggtacctatcatgagatttatgggcactatctaatagtaagaagtataaaaaaagaaattatttgtatatacgttcgaaccacagttggtcatatttctctttatcgagaaatcgaagaagctatccaagggttttgccgagcctactcatatggtacctaatcatatggtatctaaactaagtaattctatgacacccgtgtcattttgggtttctccagttcacctaggactatagttcctgaatttctatgcgaatcaagatcgagaaaaggaagttttccaatcattgactcaaacccattgtcgaaccccactcagcggaatagggaggtacttatggcagaacgggccaatctggtctttcacaataaagtgatagatggaactgctattaaacgacttattagtagattaatagatcacttcggaatggcatatacatcacacatcctggatcaagtaaaaactctggggttccgacaagccactgctacatccatttcattaggaattgatgatcttttaacaataccttctaaggggtggctagtccaagatgctgaacaacaaagttttattttggaaaaacaccatcattatggaaatgtacacgcggtagaaaaattacgccaatctattgagatatggtatgctacaagtgaatatttgcgacaagaaatgaatcctaattttaggatgaccgacccctttaatccagtccatatgatgtccttttcgggagctagaggaaatgcatcccaagtacaccaattagtagaatatatcatttcttgttacggagcccgaaaaggggttgtggatactgctgtacgaacatcggatgctggatatcttacacgcagacttgttgaagtagttcaacacattgttgtacgtagaacagattgcggcaccatacgaggcatttctgtgagtcctcaaaatgggatgatgccggaaagaatttttatacaaacattgattggccgtgtattagcggacgatatatatataggcccccgatgcattgccgttcgaaatcaagatattgggattggacttgtcactcgattcataacctttcaaacacaaccaatatctatccgaaccccctttacttgtaagaggggtactgcagaacatgtacgagccccttctaatggaaaaataaaattcaacgaggatttggttcatcccacacgtacacgtcatgggcaccctgcttttctatgttatatagacttgtatgtaactattgagagtgaaaatcttatacataacgtgactattccacccaaaagtttgattttagttcaaaatgatcaatacatagaatcagaacaagtgattgctgagattcgcgcgggagcatatactttaaattttaaagagagggttcgaaaacatatttattctgattcagagggagaaatgcactggagtactgatgtataccatgcgccggaatttacgtatagtaatatcaaacgaacgttcattctctttctgctgaaggaagatatatttctagcctttcagtaaatacagtaaataatgatcaagtgaaacacaacagtttgaatctttctggtaaaaaagaaagtagtattcctgattattcagaatttaatcgaatcatatatacgggtcattgtaatctcatacttcctactattctccatgataattctgatgtttttttattgacaaagaggcgaagaaatagattcatcattccattccaatcgattcaagaacgagagaaagaactaatgccccgtcccggtatttcgattgaaatacccataaatggtatttttcgtagaaatagtattcttgcttatttcgatgatcctcaatacagaagaaagagttcgggaattactaaatatggaaccatagggttgcattcaatcctcaaaaaagaggatttaattgagtatcggggagtcaaagaatttaagccaaaatatcaaacgaaagtagatcgattttttttcattcccgaggaagtgcatattttacccgagtcttcgtccataatggtacggaacaatagtatcattgggatagatacacgaatcactttaaatacaagaagccgagtaggcggattggttcgaatggagagaaaaaaaaaaaggattgaactaaaaatattttctggagatatccattttcctggagagatggataagatattccgacacagcggcatcttgataccaccgggaacggtaaaaaaaaattctaaggaatcaaaaaaattgaaaaattggatttatgtccaatggatcacacccaccaagaaaaagtattttgttttggttcgacccgtaatcatatatgaaatagcagacggtataaatttagcaacacttttcccccaggatccattgcgggaaagggataatctagaacttagagttgtaaattatatactttatggaaatggtaaaccaattcggggaatttctggcacaagtattcaattagttcggacctgtttactattgaactgggaccaagataaaaaaaattcttctatcgaggaggcccgctcttcctttattgaagtaagtgcaaatggtctgattcaagatttcctaagaatcaacttagtgaaatcccatacttcgtatatccgaaaaaggaatgatccgttaggttcgggattaacctctgataataggtcggatcgtaccaatataaatccatttgattctatttattccaaggcaaggattcaacaaccatttagccatagccaaaatcaaggaacttttcgtacgttgttgaatagaagtaaagaatcccaatctttgataattttgtcatcatacaattgttttcaaatgagtccattcaacgatctaaaatattacaatgggataaaagaatcaattaaaagagatcttctaattccaattacgaattcgttaggccctttcggaacagcctctcaaattgataatttttattcattttaccatttaataactcataatcagatttcgttaactaaatatttgcaactcgccaatttaaaacagacttctcaagtatttcaatattatttaatggatgaaaacgaaagaatttctaattccgatacgaacatacttttgaattcattcaatttgaattggcattttctccatcataattataatcataattattgtgatgaaacatccacaataattagcctcgggcagtttatttgtgaaaatctatgtatagcccaaaaaggatcacacctaaaatcggggcaagttataattgttcaaattgactctgtagtaataagatcggcgaagccctatttagccactccaggagcaactgttcatggacattatggagaaatcctttccgaaggagatacattcgttacatttatatatgaaaaatctagatctggtgatataacgcagggccttccaaaagttgaacaggttttagaggtgcgttcgattgattcaatatcgatgaacctagaaaagagagttgagggttggaacgagtgtataacaagaattcttggaattccttggggatttatgattggtgctgagctaactatagtgcaaagtcgtatctctttggttaataagatccaaaaggtttatagatcccagggggtgcagatccataatagacatatagaaattattgtacgtcaaataacatcaaaagtgttggtttcagaagatggaatgtctaatgttttttcacccggagaactaattggattgctgcgagctgaacgaacggggcgcgctttggaagaagcaatttgttaccgagccatattattaggaataacgaaagcatctctaaatactcaaagtttcatatccgaagcgagttttcaagaaactgctcgagttttagcaaaagccgctctccggggtcgtatagattggttgaaaggtttgaaagagaacgttgttctaggggggatgatacctgttggtaccggattcaaaggattagtgcaccgttcaaggcaacataacaacattcctttggaaaccaaaaagaagaatttattcgagggggaaatgagagatattttgttccaccacagagaattattttatttttgcatttaaaagaatttccatgatacatcagaacaatcatttttaggattcctaagagtgaatttatcctttatgggatttaatgattcgaaagagagaattcatccttttacggtcatttgatttggtaataaagatactaacgaatggaaagaaatgaacggtttggatctgtatcaacggccaatttccgttagaagagaaggttccatgggaacaattatttatttctattttcagggtacttcatctcattttttttaagaaaaaaaaaaaaagagaagaaaagaagtgtggggagaaatgacaagaagatattggaacatcaatttggaagagatgatggaagcaggagttcattttggtcatggtactcggaaatggaatcctagaatggcaccttatatctctgcaaagcgtaaaggcattcatattataaatcttactagaactgctcggtttttatcagaagcttgtgatttagtttttgatgcagcaagtaggggaaaacaattcttaattgttggtaccaaaaataaagcagctgattcagtagcacgggctgcaataaaggctcggtgtcattatgttaataaaaaatggctcggtggtatgttaacgaattggtatactacagaaacgagacttcataagttcagggacttgagaacagaacaaaagacggggagactcaaccgtcttccgaaaagggatgcggctgtgttgaagagacaattatttcacttgcaaacatatctcggcggaattaaatatatgacggggttacccgatattgtaataatcgttgatcagcaagaagaatatacggctcttcgagaatgtatcactttgggaattccaacgatttgtttaatcgatacaaattgtgacccggatctcgcagatatttcgattccagcgaatgatgacgctatagcttcaatccgattaattcttaacaaattagtatttgcaatttgtgagggtcgttctagctatatacgaaattcttgattaataataagataagtaaatttttgggggaactccatagaatagatttattgcatcggttactattcttgaatagtacaaaagagataaaaataactgtggggatattatgtgattagttgatattcaaaatatacaattcaagtaggcaagtcaaaaaacgatggttgaatcaaaataattcctttaaaagttctatttctttcagagggtaatatgaatgttctattatgttcgatcaaaacactaaaagggttgtacgatatatccggtgtggaggtaggccaacatttctattggcaaataggaagtttccaagtccatgcccaagtacttattacttcttgggtcgtaattgctattttattagggtcagccattatagccgttcgtaatccacaaaccattcctactgacggtcagaatttctttgaatatgtccttgaattcattcgggacgtgagcaaaactcagattggagaagaatatggtccatgggttccctttattggaactatgtttctatttatttttgtttcgaattggtcaggggctcttttaccttggaaaatcatacagttacctcatggggagttagccgcacccacaaatgatataaatactacggttgctttagctttactcacttcagtagcatatttctatgcgggccttacaaaaaagggattaggttatttcggtaaatacattcaaccaactccaatccttttacccattaacatcttagaagatttcacaaaacccttatcgcttagttttcgacttttcggaaatattttagctgatgaattagtagtggttgttcttgtttctttagtaccttcagtagttcctatacctgtcatgttccttggattatttacaagcggtattcaagctcttatttttgcaaccttagctgcggcttatataggcgaatccatggaaggtcatcattgactagttacatagtcttagcctgacgcaatgtatgcgcgactcaaggtaatccacttagggaagataaataaggtataaataaaggtatatacgatctatagtaaaaaagattacgatacgatattagggaattgaaaaaaaaaaaaggaaagagatctaaaagatctttttcctaaaattgttgtttggcccatttatacctccctccaatgaatattctctttatagtgttttgtttattcaattccaatatccaatataaagtattaggagatatattaaatattaggagtcataatcctcccagtaagaatttttactgtatctgtttacgacgggcgatttttatggtatagagaataattctcatttcagtcgattttattcaattttttttttttttggtcaatcggtaaattgaataaatactaaattacatgaatttagatcaatcaaatactgatatttctatgtaatgattcggcctaacaaattcttccatttaaattgattgtacctatccttgtgggataataaaaatggaagattaaggatttacaaaaaacgagatttataaaaaaaagattggttagcggagaaaaaaaaaggggggggggggtcgaactaggtgtatgtaatctaatcgctataagacaactcttgtccatgtttcgaagaatggattcttgaatcccattgaatctaagatacaatatttggtttacggtatgggggaaaggcatgtatatgtgatattagatattaactaggtatatatgaacgaaagatatatctaatttgtcctaatttagatagggattccaatggaagtccttccgtttcgtctgtaattgtgaattgaatattgaatgaatttaaatcacgaaaaagaacaaagaatggttcgaaaaaaagaaatgaaatgtaagaaaagaacaaaagtcgtacagattcacaaaaactccgtgggtaggaactcaaaaagagatatcgcagtcgttctgcggattcaataatattattaattattatttcaatattgaaatattgaaattcggggttctagttagtttaactggatgatcttagcgacggaataattaagtcataattcattggttgattgtatcattaactatttcttttttttttttggggggtgcgaggaacttaacatgaatccactgatttctgccgcttccgttattgctgctgggttggctgtcgggcttgcttctattggacctggggttggtcaaggtactgctgcgggacaggctgtagaagggatcgcgagacaaccagaggcggagggaaaaatccgaggtactttattgcttagtctggcttttatggaagctttaacaatttatggactggttgtcgcattagctcttttatttgcgaatccctttgtttaatccaaaaatacatatttctattttcttggatttgctgctcttgttttttcgcattatattaagatttaactcctacaattaaattacttagggacaacaacccccggaaagagctgatttgaggatgaggaattcgcactccaacccgctttcttcctttaccttcttagtccaatggaaaaactttttttaggaagtatttcaacaaacgagatatttcgcaactgacctgacataagatcgggtacctaattctaataagtatcattcttattggaaatttccacttattggaaatttccaattgaaaaaaaatccatttagaaatcaatatattttttgactctatttagtatattctatttagaaatagggaaattcataataaaaataatacaaaaataatataaataaaataattagtctatctataagaaagaggatatcatatgaaaaatgtaaccgattctttcctttccttgggttattggccatccgccgggagtttcgggtttaataccgatattttagcaacaaatccaataaatctaagcgtagtgcttggtgtgttgattttttttggaaagggagtgtgtgcgagttgtttatttcaagaataggctggatacgaccaactgcattttttcgttataacgcgaaaaaaaaaggtgcatgattccgcgaatttcttctgaaaaaaaaattgaagaaccatagcatttcgcgattcattggtaaatctactttgattctctatcaaccaataatgtaaaccattaacagggttaaagctaaaccgtttgaagttcagatgcagcatggtattctttctactactatgttagttaataagttaagacagaaatggtttcaaaacaaatagttggaattttttttcgatataaaacactcatgtcgataaaatgatttgaatccgttatttgattggaaaaaatgggtatttcatcccacgttttatcttttttatccaatgctgaatcgatgacctatgtattatgtattaaagtaagaagaattctttgaaaaaaaaaaaaaaaagaaacaaccttgctgacaattatttgtttggtcagaagagtcctccgaatattatgttcttggattagtgatcagtttatatattttcgaatatgaatatagaagagaggataggctcattacattttccattaaaaagaatatgtgaattctcaaaaggaattcaataaattgagcgtgagagccaaatgaatcgaaagattcatgtttggttcgggaagggatcgtggaagttttgaaatgaatggaaagataatctactttcattaagtgatttattagataatcgaaaacaaaggatcttgaagactattcgaaattcagaagagctgcgcgagggggccctagaccagctggaaaaagcccgggcccgcttacggaaagtagaaacggaagcggatcagtttcgaatgactggatattctgaaatagaacgagaaaaattgaatttgattaattccacttataagactttggaacaattagaaaattacaaaaacgaaaccattcattttgaacaacaaagggcgattaatcaagttagacaacgggtttttcagcaagccttacaaggagctctaggaactctgaatagttgtttgaacaacgagttacatttacgtaccataagtactaatattggtatgtttggaacggtgaaagaaataacggattagtccttctactgcaggcattatttttttcttccaaaaaaaaaataagaaatactcatggtaaccattcgagcagatgaaattagtaatattatccgcgaacgtattgagcaatataatagagaagtaaagattttaaataccggtactgtacttcaagtaggcgatggcattgctcgtatttatggtcttgatgaagtaatggcaggtgaattagtagaatttgaagagggtaccataggcattgctctgaatttggaatcaaataatgttggtgttgtattaatgggtgacggtttgatgatacaagaggggagttctgtaaaagcaacaggaagaattgctcagataccagtaagtgaggcctttttaggtcgtgttataaatgcactggctaaacctattgatggtcggggtgaaatttcatcttctgaatctcgattaattgagtctcccgctcctggtattatttcgagacgttccgtatacgagcctcttcaaacaggacttattgctattgattcgatgattcctatagggcgtggtcagcgagaattaattattggggacagacagaccggtaaaacagcagtagccacagatactattctcaatcaacaagggcaaaatgtaatatgcgtttatgtagctattggtcaaaaagcatcttctgtagctcaggtggtgactgctttacaggaaaggggagcaatggaatacactattgtggtagctgaaactgcggactcccccgctacattacaataccttgctccttatacaggagcagctctggctgaatattttatgtaccgtgaacaacacacttcaatcatttatgacgatctctccaaacaagcgcaggcgtatcgacaaatgtctcttctattacgaagaccaccgggccgcgaagcttatccgggagatgttttttatttacattcacgccttttggaaagagccgctaaatcaagttctcgtttcggtgaaggaagtatgactgctttaccaatagttgagacccaatcgggagatgtttcggcttatattcctactaatgtaatttccattacagatggacaaatattcttatctgccgatttattcaattctggaatcagaccggccattaatgtgggtatttcggtttccagggtaggatccgcagctcaaattaaagccatgaaacaagtagctggcaaatcaaaattggaattggcacaatttgcagaattagaagcctttgcacaattcgcttctgatctcgataaagctactcagaatcaattggcaagaggtcaacgattacgtgagttgcttaaacaatctcaatcatccccgctttcggtggaagaacagatactgactatttataccggaacgaacggttatcttgattcattagaaattggacaggtaaggaaatttcttgttgagttacgtacttacttaaaaacgaataaacctcagtttcaagaaataatatcttctaccaagacatttaccgacgaagcggaagcccttttgaaagaagctattcaggaacagatggaacgttttctacttcaggaacaagtataaacaaagtaattactttgaatcttcatcaatcttaatttaattctattaattctataaacctttacaatttaaaatattgtataatcattattattatacattataaatattatataatctttataatataatctttataatatattttatatcataacttgacttgatattatagtaatatcacttgaatattatagtttctattaaaatttaatggaattcaaaaatttttattataaaataaaagaattccatttttaaaaatttaaaattcaatttttgaatttattaaataacttattaaaaataacttattaattaatatattaaataacttattaattaataatataataacttaaataatataataacttattaatttagaatatctttatttattaatttagaatatctttatataaataataacttattaatttaatttagaatatctttatataaactaaaatct

SEQ ID NO: 3234 - DNA, 18265 bp, Amborella trichopoda
aaatcaacggaaacactttttccactgaatgatttcttattttatttcatcttgatcctgaatcccctttcccttatccctttccaaaaatgcaccttttatttgattgatcaagttgaaatttttttcttcgattgattgtctatcacaatcacaacacctaaagacttcctttttagattgaaaaggataaagaaagaatttctagtcacagaagaataaagaattcctgactaattggaaccattaactgttgaatgaatctgaattcatgaacggtttttggatctctgtttccttaatggcacaagagaatcaaattgatacacaactaattagtatcaattcttttcaattcaaattacattgattcaatattcaattcatattcaaatgaaattaatcataattataacaacgactctgtgtatatgtaaaccccaaacaagaattattacacacctagtcaggtattttatttacacatccttacagggaaccgtcgtgttccaactttgaatattttgaatagaaaatagaaataaatcatgatatggcacgaatatattggagctacgataaaagatggaatatgtggctagctagatggctatatctgcgttgcatttacttagatatttaatctaatagatataactcttcctatgcagtattcaaatgggtcaaaatagaaaataagaaaatatcaaaatttctttctgtgaactgaaccatggaatcaacgaaacgaaataagtgctaagctaagcgttaactctttttaatgctcctgattattctgtctttctatcattatcataaagaaggatcaaattctgaatcaatctatttttctggtacccactttgattatcataatggatagataagataattaaattaggtagaaatttgatcgaaaagacccaaccctattctattcttattctataacaaaaacaaagctcaactcaataagtgccagaatccttgttacaggaatatcatttccatttgcatttgtaaccaattcgaattgaagtacaaaattctctttatccctccttcatacgtatatggagttggataaaatttcatgtgattcagtaaacagaatatacattccatcattgctggatcgatccgtatggttcgataaagagtgatccaataatgggatttttcgagaaatggaaaacttaagtaagatgctacgggatggaaatgagggaatgtctacaatacctggatttagtcagatacaatttgaaggattttgtaggttcgttgatcagggcttggcagaagaacttcataagtttccaaaaattgaagatacagatcaagaaattgaatttcaattacttgtggaaacatatcaattggcggaacccttgataaaagaaagagatgctgtgtatgaatcactcacacattcctctgaattatatgtacccgcggggttaatttggaaagttggtagagatatgcaagaacaaaccgtgtttattggaaacattcctctaatgaattctctgggaacctttatagtaaatggaatatacagaattgtgatcaatcaaatattgcaaagccccggtatttattacagttcagaattggaccataacgggatttctgtttataccggcaccataatatcagatcggggaggaagatcagaattagagattgatagaaaagcaaggatatgggcccgtgtgagcaggaaacaaaaaatttctattctagttctaccatcagctatgggttcgaatctaagagaaattctagacaatgtttgctaccccgaaattttattgtatttcccgaatgagaaagagaaaaagaaaattgggtcgaaggaaaatgctattttggagttttatcaacaattttcttgtgtaggcggggatccggtattttctgagtccctctgtaaggaattacaaaagagattttttcaacaaagatgtgaattaggaaggattggtcgacaaaatatgaaccagagattgaatattgatataccccagaacaatacatttttattaccacgagacgtattggctgctacagatcatttgatcggaatgaaatttggaatgggtacacttgacgatatgaatcacttgaaaaataaacgtattcgttctgtagcagatctgttacaggatcaattcggattggctctggttcgtttggaaaatgtggttcgaggaactatatgtggagcaatcaggcataaatttataccgactcctcaaaacttggtaacttcaactccattaacaaccacttatgaatcgtttttcggtctacaccctttatctcaagttttggatcgaactaatccattgacacagatagttcatgggcgaaaatcaagctatttgggtcccggaggattaacagggcgaactgctagttttcgcatacgagatatccatcctagtcactatggacgtatttgcccaattgacacgtccgaaggaatcaatgttggacttatcggatccttagctattcatgcaaggatcggcgattggggatctatacgaagtccgttttatgaaatatctgagagatcaaaagaggaacagatggtttatttatcaccaaggagagatgaatactatatggtaatggtagcagcaggaaattctttggccttgaatcaggatattcaagacgaacaggtcgttccagcccgataccgtcaagaattcgtgactattgcatgggaacatattgatcttcgaagcatttatcccctccaatatttttctattggagcttccctcattccgtttatcgaacacaatgatgcgaatcgagctttaatgagttctaatatgcagcgtcaagcagttccgctttctcggtccgagaaatgcattgttggaactgggttggagcgccaagcggctttagattcggggggttcagctatagcccaacacgagggaaaggtcatttataccgatactgaaaagatccttttatcagggaatggagacactataagcattccattgcttatgtatcagcgttccaacaaaaatacttgtatgcatcaaaaacctcaggttcatcgggataaatatgttaaaaagggacaagtcttggcggatggtgcggctacagttggtggggaactcgctttgggaaaaaacgtattagtagctcatatgccatgggaaggctacaattttgaagatgcagtactaattagcgaacgtctggtatatggagatatttatacttcgtttcacatccggaaatatgagattcagactcatgtgacaagccacggccctgaaaagatcactaacgaaatacctcatttagaagctcatttgctccgtaatttagacagaaatggaattgtgatgctcggatcttgggtggaaacgggtgatgttttagtaggtaaattgacgcctcagacagcgaaagaatcatcgtatgccccggaagatagattattacgagtcatacttggaattcaagtatccactgcaaaggaaacttgtctaaaactacctataggtggaagaggtcgagttattgatgtgagatggatccagaaaaaaggggcttccagttataatccagaaaaaattcgtgtatatatttcacagaaacgtgaaatcaaagtgggtgataaagtcgccggaagacatggcaataagggtatcatttccaaaattttgcctagacaagatatgccttatttgcaagatggaacaccagttgatatggtcttcaacccattaggagtaccttcacgaatgaatgtgggacagatctttgaatgctcgctggggttagcgggagatctgctggacagacattatagaataacaccctttgatgagagatatgagcaagaggcttcgagaaaactagtgtttcctgaattatatgaagccagtaagcgaacagcaaatccatgggtatttgaacccgagtatcctggaaaaagcagaatatttgatggaagaacaggagatccttttgaacaacctgttataataggaaagtcctatatgctgaaattaattcatcaagtagatgataaaatccatggacgttccagtggacattatgcacttgttacacaacaaccccttagaggaagggccaagcaagggggacaacgagtaggagaaatggaagtctgggctctagagggatttggtgttgctcatattttacaagagatgcttacttataaatccgaccatattagagctcgtcaggaactacttggtaccacgatcgttggaggaacaatacctaagcctgagggtgctccagaatcttttcgattgctcgttcgagaactacgatctttggctctggaactgaagcatttccttgtatctgagaagaacttccagattaataggaaggaagcttgatcggaatgaatcagaatttttcttctatgatcgaccgatataaacatcaacaacttcgaattggattagtttctcctcaacaaataactgcttgggccaacaaaatcctacctaatggagagatggttggagaagtgacaaaaccctatacttttcattacaaaagcaataaaccggaaaaagatggattgttttgtgaaagaatctttgggcctatcaaaagtggaatttgtgcttgtggaaattaccgagtcatcggggatgaaaaagaagacccgaaattttgtgaacaatgcggagtcgaatctgttgattctcggatacgaagatatcaaatgggatacatcaaactggcatgtccagtgactcatgtgtggtatttgaaacgtcttcccagttatatcgcgaatctttcagatagacctcttaaagaattagaaggcctggtatactgcgatgtgtgatttgatcaaaattacaattctacaggttcagaatgaaaaactgtcatcccgttcaatccaattgggatgcctccagctctgacatgtctcttaggagaagtaacatgaagctcagaattatgggtctattcaatacttccaaatgaaagaggaattgatccatggtcgattccgtagcggatcaatcaatagggaattctagttgtacctcgtaaaaaaagcgtctttcgtgaaactagaaccagccattgtatttcttttagtttagaaagaggttctgttcaaataagcagatattacatggttacaggagtctatccatcgcatatatgcttcacttcaagggacaccatggcataaccgtcgaggcgaagtagggacctaaaagatcgaatggaatgatacatagacaagtaaatcccttatgaattccaaagtcttcttttaatttaagagaattcatcattcgaagggaaggagactactcaataattccactttgtcgtaattgaatgagtcattgaggagaagaggtgaatcaatgaaatatggattggccctcaccgagaacttgagtaaggagtagttttgggatttatctagagtaaaatttgggagtgagaacccctttatttggtacaactacttgagccggatgagaggaaaccttcacgtccgattttgagggggggattctataggaacttatcccaatttctcttttgctaggcccatagctaaaaaacccactttcttacgattacgaggttcattcgaatatgaaatccaatcccggaaatacagcatcccacttttttttactacccaatgcttcaatctatttagaaatagagaaatatctactggagcaggtgctatcagagaacaattagccgacccggatttgcgaattattacagatcgttcattggtagaatggaaggaattgggggaagaaagatccgctgagaatgaatgggaagataaaaaaatcgtaagaagaaaggattttttggttagacgcatggaattggctaagcatcttcttagaacaaatgtagaaccagaacggatggttttgtgcctattaccagttcttcctcccgagttgaggccaatcattcagatagatgggggtaaaccaatgagttcggatattaatgaactctatagaagagttatctatcggaataatactcttattgatccattaacaacaagtagatctacgccaggggaatcagtgatgtgtcaggaaaaattagtacaagaagccgtagatacacttcttgataatgggatccgcggacaaccaatgagggacggtcacaataaagtttacaagtctttttcagatgtaattgaaggcaaagagggaagatttcgcgagactctacttggtaaacgggtcgattattcgggtcgttctgtcattgtggtgggcccttcgctttcattacatcgatgtggattaccccgagaaatagcaatagagctctttcagacatttgtaattcgtggtctaatcagacaacatgttgcttccaacatagggattgctaaaagtaaaattcgggaaaaagaaccaattgtatgggaaatacttcaaaaggttatggaaggacatcctgtattgttgaatagagcacctactttgcatagattaggcatacaggcgttccaacctattctagtggagggacgtgctatttgtttacatccattagttcgtaagggattcaatgcagacttcgatggggatcagatggctgttcatgtacctttgtctttggaagctcaagcggaagcccgtttacttatgttttctcatatgaatctcttgtctccggctattggagatcctatttctgtaccaactcaagatatgcttattggcctctatgtactaacgattgggaatcgccgaggtatttgtacaaataggtataatccatgtaactacagaaactatcaaaatgaaatagttgacgataataactataagtatacaaaagagaaagaaccttatttttgtagttcctacgatgcgcttggagcttatcgtcagaaacgaatcgacttatacagtcctttgtggctccggtggcggctagatcaatgcgtgattgcctcaataaatagagaagttcccattgaagttcaatatgaatctttgggtatctaccatgagattcacgagcactatcgaatagtaaaaagcgtaaaaaaagaaatcgtttgtatatacattcgaaccactgttggtcatatttctttttatcgagaaatagaagaagctatacaagggttttgtcggacctattgatctggtacctgagtaattctgtgatacccgtgagaatacggatatctccggttcaacaggtatcacaattccaaaatttgtacgtgaatcaagatcgaggaaaaggaaaataagtcttcgaatcactgactgaaactcattgtcgaatcttactcaccggaatatggaggtacttatggcagaacgggccgatctggtctttcacaataaagcgatagatggaactgccatgaaacgacttattagtagattaatagatcattttggaatggcatatacatcacacattctggatcaagtaaagactctgggtttccggcaagccactctgacatcaatttcattaggaattgatgatcttttaacaacgccttctaagggatggttagtacaagatgcggaacaacaaagtttgattttggaaaagcaccatcattatgggaatgtacacgcagtagaaaaattacgccaatcaattgagatatggtatgctacaagtgaatatttgagacaagaaatgaatccaaatttcaggatgactgatccttttaatccagtctatataatgtccttttcgggagctagaggaaatgcatctcaggtccaccaattagtaggtatgagaggattaatgtcggatccccaaggacaaatgattgatttgcccattcaaagcaatttacgcgaagggctttctttaacggaatataccatttcctgttacggagcccgcaaaggagttgtggatactgctgtacgaacatcagatgctggatacctcacgcgtagacttgttgaagtagttcaacacattgttgtacgtagaacggactgtggcactatccgaggtatttccgtaagtcctcgaaatggggttggggtgacggaaaggatttttatccaaacactaattggtcgcgtattagcgaacgatgtatatatgggtctgcgatgcattgcgactcgaaatcaagatattgggattggacttgtcaatcgattcataacctctcgggcacaaccaatatatattcgaagccccttcacttgcaggagtacatcttggatctgtcaattatgttatggtcggagtaccactcacggtaacctggtcgaattaggagaagctgtaggtattattgcgggtcaatcaattggagaaccgggaactcaactaacattaagaacttttcataccggtggagtattcacaggcggtatcgcagaacatgtacgagctccttctaatggaaaaattaaattcaatgaggatttagttcatcccacacgtacacgtcatggacatcccgcttttctatgccatatagacctgcatgtaactattgagagtcaggatattatacataaagtgaatattccaccaaaaagttttcttttggttcaaaacgatcaatatgtagaatcagaacaagtgattgctgagattcgcgctggaacatccactttaaaggagagggttcaaaaacatatttattctgactcagagggagagatgcactggagtaccgatgtgtaccatacacctgaatatacgcatggtaatgttcatctcttacccaaaacaagtcatttatgggtattatcaggaagtccatgcagatccagtatagtgccttttccactccacaaggatcaagatcaaatgaatgttcaatctctttatgtcgaagagagatatatttctgacctctcgatgaataatgatcgagtgagacacaaattgtttgggtgggatcaaaaaagggggagggtttcttattattcaggacctgatcgaatcatatccaacaggaattgggattccatatatcctcttattctccacgagaattctgatttattggcgaagaggcgaagaaatagattcatcatcccattccaatatgatcaagaacaggagaaggaactaaggcctcctggtatcgtgattaaaatacccataaaaggtattttacgtagaaatagtattcttgcctatttcgacgatccccgatacagaagaagtagttcaggaattgccaaatatgggaccatagaagtcgattcgataataaaaaaagaagatttaattgaatatcgaaagacaagagagtttggaccaaaataccaaatccaaatcaaagtaaatcgattttttttcattcctgaagaagtgcatatcttacctagatcttcgtccataatggtacggaataatagtatcattggagtagatacacgaatcactttgaatataagaagtcaagtaggcggcttggtccgagtggagaaaaaaaaaaaaaggattgaattgaaaatatcttctggagatatccattttcctggagagacggataatatagcccggtacagcggcatcttgataccacctggaagggtaaaaaacacggaatcaaaattcaaaaattggatctatgtccaacggatcacacctatcaagaaaaagtattttgtttcagtccgacccgtagtgacatatgaaatcgccgatgggataaatctagcaacgttttttccccaggatctgttgcaggaaaagaataatttgcaactacgagttgtcaattatattctttatggagatggcaaacccattcgaggaatttttcacacaagcattcaattagttcggacttgcttagtattgaattgggatcaagaccgggctggttctatagaagaagaagaggcttatacttccctcgctgaagtaagggtaaacgatctgattcgaaattttataagaattgatttggtgaagtctcctatttcgtctactggaaaagagaatgatatggcgggttcaggattgattcctaataatggatcagatcgcatcaataccaatccttttttttccaaggcgaagactcaatcacttagccaacatcaaggaactattcgtacattgctgaatagaaataaggaaggccagggcgaatctcttatggttttgtcatcatccaattgttctcgaattggtccattgaatggttcgaaatatcacaatgtgacaaaagaatcaattcaagaggatcccatgatttcaattaggaattcgttgggtccgttagggactgtacctaacattttgaatttttcctcatcttatcattcaataactcataatgagatcttgttcaataaatatttactacctgacaattcaagagagactttcctagtacctaaatcttatttcatggatgaaaatagaaggatttataatcttgatccatgcagtaacatcattttgactccattcaatttgaattggtgctttctccatcacgattattgggaagatacatcaacaataattagccttggacagtttctttgtgaaaatatatgtatatccaaagacggaccatgcgtaaaatctggtcaaattataattgttcatgttgactctttagtaataagattagctaagtaccatttggctacccgcggagcaaccgttcatggtcattatggagaaatcctttacgagggagatacattagttacttttatatatgaaaaatcaagatctggtgatataactcaaggtcttccaaaagttgaacaagtgttagaagttcgttcgattgattcaatatcgatgaacctagaaaagagggttgaaggctggaacgaacgcataacaggatttcttggaattccctgggaattctttattagtgctcagctaaccatagtgcaaagtcgtatctctttggttaataagatccaaaaggtttatcgatcccagggggtgcagatccataataggcatatagaaactattgtacgacaaataacatcaaaagtcttggtttcagaagatggaatgtctaatgttttttcacccagagaactaatcggattgttgcgagcagaaagaataggtcgtgctttggaagacgatatatgttaccgagctattctattgggaataacgagggcatctctgaatactcaaagtttcatatcagaagcgagttttcaagaaaccactcgggttttagcgaaagccgctctccgaagtcgtattgattggttgaaaggcctgaaagagaatgttgttctgggggggatgatacctgttggtaccggattcaaaggattcgttcaccactccagggaacacaacaacatttctttggaaataaaaaagaagaatctattcgatgggaagatgagagatattttgttctaccacagagaattttgtggttcgtgcatcccaaagaattttcatgatacatcagaacaataattctatgggatttaatgattcataagagcggattcattattttatctatattatattattattatacagttacagattatacagtcgtttgataatgaattgaattgaatttcaatttaatcaaggaatagaaaggagtgaatggcttggaccatgtatcaacggtccatccccggtataaggttccgtaggaacaattctatatttcagatttcagggtacctcattcctgaaaaaaaagaggaagtgtgggtagaaatggcaagaagatattgggacatcaatttggaagagatgatgggagcaggggttcattttggtcatggtactaggaaatggaatcctagaatggcaccttatatctctggaaagcgtaaaggcattcacattacaaatcttactagaacggctcgtcctttatcagaagcctgcgatttagtttttgatgcagcaagtagaggaaagcacttcttaatagtaggtacgaaagataaagcagccgattcagtagcatcagctgcaatacgggctcggtgtcattatgtcaataaaaaatggcttggtggtatgtcaacgaattggtccactacagaaacaagacttcataagttcagggacttgagagcagaacaaaagatgggtcgatttaagcgtctcccgaaaagagatgcggcaatgttgaagagacaattatctcacttgcaaacatatctgggcgggatcaaatatatgacggggttacccgatattgtaatcatcgtggatcaccaagaagaatatacggctattagagaatgcctcactttgggtattccgacgatttgtttaatcgatacaaattgtgatccggatctcgcagatattccgattccagccaacgatgacgctatagcttcaatccaattgattcttaacaaattagtattggcaattcgtgagggtcattatagctatctaggaagtcattgattaaaaataagataagtcaattataataagataagtcaattatttcggtaaatcaagaatttattgaatcggttactattcctgaatctggaaaaagagattcaaatcaatagtcatgatatctgattacttcttactgggtatccggaatatactatgcaagtaggagagtcgagaaagagatgattgaatcaaaataattccttcttaacttaagtttcatttctgtcagggggtaatatgagtgttctaccatgttccatcaacacactaaaagggatatacgatctatccggtgtggaagtaggccaacatttctattggcaaattgggggtttccaagtccatgcccaagtacttataacttcttgggtcgtaattgctatcttattaggttcagccactatagttgttcggaatccacaaaccattccgaccgacggtcagaatttcttcgaatatgtgcttgaattcattcgagacttgaccaaaactcagattggagaagaagaatatggtccctgggttccctttattggaactatgttcctatttatttttgtttctaactggtccggcgctcttttacctcggaaaatcatagagttacctcagggggagttagctgcacctacaaatgatataaatactactgttgctttagctttacccacgtcagtggcatatttctatgcaggtattagcaagaaaggattgggttatttcggtaaatatattcaaccaactcccatacttttaccaattaatatcttagaagatttcacaaaacctttatcacttagttttcgactttttgggaatatattggctgatgaattagtagttgttgttcttgtttctttagtcccttcattggttcctatacctgtcatgttcctcggattattcacaagcggtattcaagctttgatttttgcaactttagccgcggcttatataggcgaatccatggagggtcatcattgaataactttcaaaatcaatcacaatcaaaatagtcctttttaaaataaaaatgaaaaagcccatgaatcttattccaattcatgggtggctaaagagaccccttggggttggggaacatgatagatacggcaatctacggtacatacgatatagaatggtagaaagagatatgtacgatattgcggaattctaaaagcaaacaaaaaggaaaaaccctaaaaagtctttttcctaagatccccatttgtcccattcatgtcataatttgaataacaattgttatctgtttgcgacatgcgacaaaaaaaaagaacttacttctacttccatgtatatgtaaccattaaccgttctcatttcatttggtttccttctattcaatcaacgattgatcgaaaattgtaattaattgcaatcggatccagtgaattttgatgtgtgacgattcaagctgatggatctgtccgtttgtatccgtgtgttgataaagaaaaggaggagtttacgaatacgaataagattcaaagtgggttaggaatgattctaggatacgatccaattctataaaatccaattctattctatataagaataagactaagatgcggatggtttacattatggaagagacacatgtatatgtgatattagatactcattagtcattagttatatatggacgatccgttatggactatccatatagtgtaattttctatttcccacttcccaccaaaccaaattagatagattatgatataagctcttcctgtgactgtggattgaatgaataaacagatcagataaaatcaatcaaatcatatgcatataaaggagaaagagcgaagaattgaaagaaaggttcgggaacagaacaaagaaatagaagaactagaaccaaatggatttccatctgacagtaatatcatcatttcaattcagagttattagttacttcgatcatatggatcttagtgatggaataatgagcaataaaataattaattagttgattgtatcattaaccatttcttaattttggtacgaggagcttaccatgaatcccctgatttctgctgcttccgttattgctgctggattggccgtaggacttgcttctattggacccggagtcggtcaaggtactgctgcgggtcaagccgtagagggtatcgcgagacaaccagaagcagagggtaaaatacgaggtactttattgcttagcctggcttttatggaagctttaacaatttacggactggtcgtggcattagcgcttttatttgcgaatccctttgtttaatcctaaaaagacataatatacctattaccctggccttgccacttcttcgaattatatcaacacttcactcctacaataaattattcattttgagacaatcccccccggggtaaggactgattcgaggaattagcagatccttagttctcttccttcccgctcttagtccaaaggaaacaacttttcggagtgttgcaacgcgcgaggtatttccaaaatgatacgagacccgggacctgacctaaccgtcggaagtatcttatcgggaacttcaattaaataaaaataagatatggggtgaagtgatacaaaaagaactccgtttggttttgttagtcctatctagaagaggagagtatatgaaaaatgtaaccgactctttcgtttccttgggccactggccatctgccggaagtttcggatttaataccgatatttttgcaacaaatccaataaatctaagtgtggtgcttggtgtgttgatttttttcggaaagggagtgtgtgcgagttgtttatttcaagaataggttggatcctaccagctgcactttactcattataaataaaaaaaaaaagaattaaggtgcatgatcccgacgaattacttctgaataaataaagaaatcatatgtaggaactatagcatttcgtgactcattggtaaattcactttgattctctatcaaccaatccaataatgtaggaccctttacatggttaaagttaaagtttgaagtccaggcacaacggggtactctttctaccactgcattcgtagagatggtttcaaaacgaagagttggtaatttatccgatatagaacactcatatcgataaaataattgtgaaccattcactgtaaaaaaaatgggcactccgactttttttatccaatgctgaattgacgacctatgtagaataaaaattctttggatttaaagataatcaaataaaagaaacgactttcctgacagttacctggtcggaagagccctccggggatcctggtcttgtatcagtttcgatatcttagaagacgaagagagagggtaggctcattaaaagatacgggagtgtcccataagtaactgagcgtgagagccaaatgaattgaaagattcatgttcggttcgggaagagatcatagaagttgtggaattgatatggagacaatctactttcattaagtgatttattagataatcgaaaacagagaatcttgagtacgattcgcaattcagaagaactacgtgggggagccattgagcagcttgaaaaagcccgggctcgcttacggaaagtggaaattgaagcagatgagtttcgagtgaatggatactctgagatagaacgagaaaaaagtaatttgattaatgctgcttatgaaaatttagaacgattagaaaattacaaaaatgaaagcattcattttgaacaacaaagagcgatgaatcaggtccgacagcgagttttccaacaagccttgcaaggagctctagaaactctgaatagttatttgaacagcgagttacatttacgcaccatcagtgctaatattggcatgctcgggaccatgaaaaatataactgattagtttaccgctaccataggcattattttttttttttttcttttgatttttccttgttttgcttccgaaaaagaattaagagacactaatggtaaccattcgagctgacgaaattagtaatattatccgtgaacggattgagcaatataatagagaagtaaagattgtcaatactggcactgtacttcaagtgggcgacggcattgctcgtattcatggtcttgatgaagtaatggcgggcgaattagtagaatttgaagagagtacaataggcattgctccaaatttggaatccaataatgttggtgttgtattaatgggtgatggtttaatgatacaagagggcagttctgtaaaagcaacaggaagaattgctcagataccagtgagtgaggcttatttaggtcgtgttataaatgctctggctaaacctattgatgggagaggtgaaatttcatcttccgaatctcggttaattgaatcccccgcaccaggtattatttcgagacgttccgtatatgaacctcttcaaacaggtcttattgctattgattccatgattcctataggacgcggtcagcgagaattaattattggggacagacagaccggtaaaacagccgtagctacagatactattctgaatcaaaaggggcaaaatgtaatatgtgtttatgtagctattggtcaaaaagcatcttccgtggctcaggtagtgactactttccaggaacaaggagcaatggaatacactattgtggtagctgaaacggcggattcacctgctacattacaatacctcgctccttatacaggagcagccttggctgaatattttatgtaccgtgaacgacatactttaataattcatgatgatccctctaaacaagcacaagcttatcgccaaatgtctcttctattaagaagaccgcctggtcgcgaagcttatccaggagatgttttttatttgcattcccgacttttggaaagagccgctaaatcaagttctcgtttaggcgaaggaagtatgactgctttaccaatagttgagactcaatctggggacgtttcggcttatattcccactaatgtaatttccattacagatggacaaatcttcttatctgccgatctattcaatgctggaatccggcctgctattaatgtgggtatttccgtttccagagtaggatccgcagctcaaattaaagctatgaaacaagtagctggcaaatcaaaattggaactggctcaatttgcagagttagaagcctttgcacaattcgcttctgatctcgataaagctactcagaatcaattggcaagaggtcaacgattgcgcgagttgctcaaacaatcccaagcagcccctctcgcggtggaagaacaggtagttactatttatacaggagcgaatgggtatcttgatccattagaaattggacaggtgaagaaatttctcgttcagttacgtacttatttaagaacaaataagcctcagttccaagaaatcatatcttctacccggacgttcaccgaggaagcagaagccattctgaaagaagctattcaggaacagatagaactgtttctatttcaggaacaaacataaatcaatgaattcattgattattttgaggtgtcttttagtacaataggaatcgttgagaaagatctctatttctgatttgaatcattcaaaatttgtttgcaatcgaaacaaaaaaatagatggaaataaattgcgtccaataggatttgaacctataccaaaggtttagaagacctctgtcctatccattagacaatggacgcttttgattctgattctcttctttccctcccattcctcttttcccgtcatcccttcggataaaaacataatccagttgattgtattccgtgcggga

SEQ ID NO: 3235 - DNA, 1735 bp, Setaria italica
gatttctgccatgggcacattgcaaacgccacctctgaagttctgatggatgccacctacactgctgcagcagggccagagcaaagagcttcattgctctgcacgcccaagcacagggttgctgccggtgggaggagaagcctgagcttcaccgcgagggccagtctgaactcaggcgccaaggtgagcatcccgaagcaatggtacaacctcgtcgccgacctgccggtgaagccgccgccgccgctgcacccgcagacgcaccagcctctgaatcccagcgacctgtcgcccctgttccccgacgagctgatcaggcaggaggtcaccgacgagcggttcgtcgacatacccgaggaggtcatcgacgtctacaagctctggcgcccgacgccgctcatcagggccaggaggcttgagaagctgctgggcacgccggcgaagatctactacaagtacgaggggaccagtccggcggggtcgcacaagcccaacaccgccgtgccgcaggcatggtacaacgccgcggcaggggtcaagaacgtcgtcaccgagaccggcgccggccaatggggcagcgctctctccttcgccagcagcctctttggcctcaactgcgaggtgtggcaggtgcgcgcgtcgttcgatcagaagccgtaccggaggctgatgatggagacgtggggcgccaaggtgcacccgtcgccgtcggaggcgacggaggccgggaggaagatcctggcggcggacccgaccagccccggcagcctcgggatcgccatctcggaggccgtggaggtggcggccaccgacgccgccaccaagtactgcctgggcagcgtgctcaatcacgtcctgctccaccagaccgtcatcggcgaggagtgcctggagcagctggcggcgctcggcgaggcgcccgacatcgtcatcggctgcaccggcggcggctccaacttcggcgggctcgcgttccccttcatgcgcgagaagctcgccggcaggatgagcccggagttcagggccgtggagcccgcggcgtgccccacgctcaccaagggcatctacgcctacgacttcggcgacaccgccgggctcacgccgctgatgaagatgcacacgctcggccacggcttcgtccccgacccgatccacgcaggtgggcttcgctaccatggaatggcacctctgatctcgcacgtgtacgagctgggcttcatggacgccgtcgccatacagcagactgaatgcttccaagcggcattgcaattcgcccggacggagggcattatcccggcgccagagccgacgcacgcgatcgcggcggcgatcagggaggcgatggagtgcaagaagaccggggaggagaaggtcatcctgatggccatgtgcggccacggccacttcgacctcgctgcgtacgagaagtacctgaggggcgacatggtcgacctgtcgcactcggccgacaagctggaggcgtccctcgccgccgtgcccaaagtctgatgatgctgaagagatagctgcaatgattgatatttagttcttgaatcttgtgatgatccatcagctgtggaccttgggaaacttacgagatccaaataatgaaatgaatgaataaattttatcaataaaaataataaatttgaggggaatgtttgatatggattttttttgagaagattgcagatatgccgtgtttgaactttgaacgtgacatgatcttattttc

SEQ ID NO: 3236 - DNA, 1857 bp, Zea mays
gtgtccacctctgatctcttcatcctcgggtcgggactcctctgtctccttgccctgtccccaaacaacctctgaataaagggtaactaccattacgccattcgcataaaaaaaactgagcctgcccgcccgcccgcccgcgcgctccgctccgtgaactatatctatctatcacctgctgctccaaggaggcggacagaggcaggcaggaaggcactcacttctccaggagcccggagtcggcagcaagagagaatggccgccgacgccgccgccgccgccacccttcgtactgctctctcccaaggtctggtgctgtggcatgtttagtgcaatcttcattgcttgctgtcttgctgcatttaacacagcacgagcttcagagaatagtccaagcctatctgtgttgccaagagatctcatccaaggtttacggcaatgaaccatttctaaagcacaaagacgtgatgtctttatcaattcatcaggagagcaaatggcgtcaacaggaggtcaccgacgagcggttcgtcgacatacccgaggaggtcatcgacgtgtacaagctctggcgcccgacgcccctgatcagggccaggaggctggagaagctgctcggcacgccggcgaagatctactacaagtacgaggggaccagcccggcggggtcgcacaagcccaacaccgccgtgccgcaggcgtggtacaacgccgcggcgggggtgaagaacgtggtcaccgagaccggcgccggccagtggggcagcgcgctgtccttcgccagcagcctcttcggcctcaactgcgaggtatggcaggtgcgcgcgtcgttcgaccagaagccgtaccggaggctgatgatggagacgtggggcgccaaggtgcacccgtcgccgtcgacggcgacggaggccggcaagaggatccttgaggcggacccgtccagcccgggcagcctcgggattgccatctccgaggcggtggaggtggcggccaccagcgccgacaccaagtactgcctgggcagcgtgctcaaccacgtcctgctccaccagaccgtcatcggggaggagtgcctggagcagctggcggcgctcggcgagacgcccgacgtcgtcatcggctgcaccggcggcgggtccaacttcggcgggctcgcgttcccgttcttgcgcgagaagctgcgcggcaagatgagccccgcgttcagggccgtggagcccgccgcgtgccccacgctcaccaagggcgtctacgcgtacgacttcggcgacacggccgggctcacgccgctgatgaagatgcacaccctcggccacggcttcgtccccgacccgatccatgcaggtgggcttcggtaccatggaatggcacctctgatctcgcacgtgtacgagctgggcttcatggatgccgttgctatacagcagactgaatgcttccaagctgccttgcaattcgccaggacggagggcatcatcccggcgccggagccgacgcacgcaatcgccgcggcgatcagggaggcgctggagtgcaagcggaccggggaggagaaggtcatcctgatggccatgtgcgggcacggacatttcgacctcgccgcgtacgagaagtacctgaggggagacatggtcgatctctcgcacccggcggacaagctggaggcctccctcgctgccgtgcccaaagtctgacggcgttggagccaacagcacatgcgactggaatgggacgaataatccattgatatcggcttcttgaatcttgtggtcatccatcgcccatcggcagtgggatacttgtgttccttatgaaatgaatgaataaaatttcaataaaagcattaattttatc

SEQ ID NO: 3237 - DNA, 1829 bp, Sorghum bicolor
caacaatgcaactaaatcaaaacacaacgcccatagaaactaagcatagagaaatagcgccaacaaattaaatgggcccttttcacatccccagtacaagtggtcctcgcaagttttatcaccttgtgctcttccatgtgcacccgttctggatccaactcttgtacttcctttccatctccgtcttgggtttcttgatgctgagagctctgcccatgaagtccatctccgtccctaggccctcggctctcgacctagtcttcacgtccgtgtcagcgacgacagtctccagcatggtcgccgtcgagatggaatccttctccaactcccagctcctcctcatgaccctcctgatgctcctcggcggcgaggtgttcacaagcatgcttggtctccacttcaccttcaccaagttcatcaagaagagagaaatacctcatagtaataataatagtctccatggtaatatcaatggaccggcaccggcggcacctagtagcttagagcacggtcaccgtcgccgtcccatggagatggaagcccaggccgccgccgtccaaatggagctagcagggttcaacaacgacgaccaacgtgattttgcatccatagctaggctgctaatgttcatcgtgcttggctacctctcggtggtgcacctcgccggctacacgctcattctaatctacctcagcgtggtcggcagcgcgagagaagtgctggtcggcaagaggatcagcctgagcaccttctccgtcttcacggtcgtctcgacgttcgcgaactgtggcttcgtgccaacgaacgaggggatggcgtccttcaagtccttcccgggcatgctcctcctcgtcatgccacacatcctcctcgggaacacgctcttccccgtcttcctcaggctctccattacagcgctcgagagggtcaccaggaggggagacctccgcgagctgctgagggacggaggacccggcggcggcggcggcggcggcggcggaccagctgctgctgctataggctacgaccacctgctgcccggaggccgcacatggtgcctggctctcaccgtggcggtgttcctggcggggcagctgctgctctactgcgccatggagtggggctccgatgggcttcgagggctcaccgcgttccagaagctcgttgccgcgctcttcatgtccgtcaactccaggcactccggcgagatggttgtcgacctcgccaccgtgtcgtccgccatcgtcgtgctctatgtgctcatgatgtatctaccgccttacaccacatttttacccatagcgatggaagaccaccagcagcagcaaaatgaggcacaatccgacgacaagagcaagagcagcagcagtattagcatctggcagaagctgctcatgtccccgctctcgtgcctaaccatcttcatcgtcgtcatctgcatcaccgagcgccggcagatcgctgacgacccaatcaacttcagcgtcctcaacatcgtcgtcgaagtcatcagtgcgtatggcaatgtgggattcagcaccgggtacagctgcagcaggcaggtgacgcccgacggcagctgcagggacgcgtgggttggcttctccggcaagtggagcagggaagggaagctcacgctcatggccgtcatgttctacggcaggctcaagaagttcagcatgcatgggggtcaggcatggaagctaggctaaatcaaagtactgcttcgacactcgatctgctcgttattattgtacatttctctatagatactagcagctagatcaacctgctctccaagactagtacttgatgttggtgtaagcttg

SEQ ID NO: 3238 - DNA, 1625 bp, Sorghum bicolor
agtttcacacttgagcatactcattcaaccatccatccgaagcaaacaaactcccatccttctctctctctcttgtctgtatgcttgcctggttttgaattttcttttaaaataaaaaaggaagagaggcatggcggccacagcgtccctgaagagcagccttctcctcccgtctcctatctccgacttcagcggcgcagccgtctccatctcagtctcagcgcagaagaggaggtcatcatggcagccaagaggggcgagggtgcaggtctcggcggcggcggcggcggactccaagaacattttggtgatggggggaacaaggttcattggggtcttcctgtccaggatccttgtcaaggagggtcatcaggttacattgttcactaggggaaaggcacccataactcagcagttaccaggagaatccgacgcagagtacgcagagttctcctccaaggttcagcacttgaaaggtgacaggcaggacttcgaattcgtcaagacaagcctggctgctaagggatacgatgtcgtttacgacatcaatggacgtgaggctgtgcaagttgagcctatcattgacgccttgcctaacctggaacagtacatctattgctcatcggcaggagtgtacctgaaatctgacattcttccacactgtgaggttgacgcggtggaccccaagagccgtcacaaggggaagctggagacggagagcctgctgacatcgcgcggcgtgaactggacgtccatcaggcccgtgtacatctacggcccgctcaactacaaccccgtggaggagtggttcttccaccggctaaaggccggccgccccatccccatccccggcgccggcaaccagatcacccagctcggccatgtcaaggacctggcaagagccttcaacctggtgctgggcaaccccaaggcgagccagcagatcttcaacatctccggcgccaagtacgtcaccttcgacggccttgcgcgggcctgcgcaaaggctggagggttccctgagccggagctcgtccactacaaccccaaggacttcgacttcggcaagaagaaggctttccccttcagggaccagcacttctttgcgtctgtggagaaggcgatcagcgagctcgggtggacgccggagttcgacctcgtcgacgggctcaccgactcgtacaacctcgacttcggccgcggcacgttccgcaaggcggctgacttcaccacagacgacataatcctcggcaagaagcttgccaccacccgagctcttatctgattctgatacctccccatatcccggtgtcgtgatcggggctgttggtgagcggataactgtatgtcatatggctaagggtcagtgcacgcagctgctagggtgccaatatgtacgattgctggctgcaaatgcgggaaaaatgcatgaatggaaagatgatctcaattttttgtctgcaatgatgcgcgtacccttgtacatatagagaacttatggtacgaccacgggtacatatcagctcttatctcatacctctgttcgcttgtcttatatgagtatatttttagctagtcatatttttttctcataataaatcagcgattatggcttttcagaccaa

SEQ ID NO: 3239 - DNA, 1786 bp, Sorghum bicolor
tcagaatgcttccaagtggacagatgaaagaaggagaggagagcatccaggacaggatagggctgtcgcccccctccacacatgccaaaaaccatcccattcccagcacctcatttctcgtcgtctttgtatgctccattagcagactgatgaagcacaagtttcacacttgagcatactcattcaaccatccatccgaagcaaacaaactcccatccttctctctctctcttgtctgtatgcttgcctggttttgaattttcttttaaaataaaaaaggaagagaggcatggcggccacagcgtccctgaagagcagccttctcctcccgtctcctatctccgacttcagcggcgcagccgtctccatctcagtctcagcgcagaagaggaggtcatcatggcagccaagaggggcgagggtgcaggtctcggcggcggcggcggcggactccaagaacattttggtgatggggggaacaaggttcattggggtcttcctgtccaggatccttgtcaaggagggtcatcaggttacattgttcactaggggaaaggcacccataactcagcagttaccaggagaatccgacgcagagtacgcagagttctcctccaaggttcagcacttgaaaggtgacaggcaggacttcgaattcgtcaagacaagcctggctgctaagggatacgatgtcgtttacgacatcaatggacgtgaggctgtgcaagttgagcctatcattgacgccttgcctaacctggaacagtacatctattgctcatcggcaggagtgtacctgaaatctgacattcttccacactgtgaggttgacgcggtggaccccaagagccgtcacaaggggaagctggagacggagagcctgctgacatcgcgcggcgtgaactggacgtccatcaggcccgtgtacatctacggcccgctcaactacaaccccgtggaggagtggttcttccaccggctaaaggccggccgccccatccccatccccggcgccggcaaccagatcacccagctcggccatgtcaaggacctggcaagagccttcaacctggtgctgggcaaccccaaggcgagccagcagatcttcaacatctccggcgccaagtacgtcaccttcgacggccttgcgcgggcctgcgcaaaggctggagggttccctgagccggagctcgtccactacaaccccaaggacttcgacttcggcaagaagaaggctttccccttcagggaccagcacttctttgcgtctgtggagaaggcgatcagcgagctcgggtggacgccggagttcgacctcgtcgacgggctcaccgactcgtacaacctcgacttcggccgcggcacgttccgcaaggcggctgacttcaccacagacgacataatcctcggcaagaagcttgccaccacccgagctcttatctgattctgatacctccccatatcccggtgtcgtgatcggggctgttggtgagcggataactgtatgtcatatggctaagggtcagtgcacgcagctgctagggtgccaatatgtacgattgctggctgcaaatgcgggaaaaatgcatgaatggaaagatgatctcaattttttgtctgcaatgatgcgcgtacccttgtacatatagagaacttatggtacgaccacgggtacatatcagctcttatctcatacctctgttcgcttgtcttatatgagtatatttttagctagtcatatttttttctcataataaatcagcgattatggcttttcagaccaacg

SEQ ID NO: 3240 - DNA, 1573 bp, Setaria italica
ccaaaaccgtcccatcacctcatttctctcctctttccttgttccattagcacagactgaaccacaagatccagacaagcgatacacagccatcaatccttctctctcttgttttcttcttcgttttatagtagagcggaggaagagcgacatggcggccacggcgtccctgaagagcagcttcctcctcccatctcctatctccgacttcagcggcgcggccgtctccgtctcaacgcagaagaggaggaggtcatggcagccgagaggggcgaggattcaggtctcggcggctgcggactccaagaacattcttgtcatggggggaaccaggttcattggtgtcttcctgtccaggctccttgtcaaggagggccatcaggttacattgttcactagaggaaaggcacccatcacccagcagctgccaggagagtccgatgcagagtacgcagagttctcctccaagattcagcacttgaaaggtgacaggatggacttcgaattcgtcaagacaagccttgctgctaagggatacaatgtcgtttacgacatcaacggacgcgaggctgtcgaagttgagcccataatcgaagccttgcccaacctggaacagtacatctactgctcatcagccggagtgtacctgaaatccgaccttcttccacactgcgagagcgatgcggtggaccccaagagccgtcacaaggggaagctggagacggagagcctgctgacctcccgcggcgtgaactggacgtcgatcaggcccgtgtacatctacggcccgctcaactacaaccccgtcgaggagtggttcttccaccgcctcaaggaaggccgccccatccccatccccggcgccggcaaccagatcacccagctcggccatgtcaaggacctggccacggcgttcaacctggtgctcggcaaccccaaggcgagccagcagatcttcaacatctccggggccaagtacgtcaccttcgacggcctcgcacgggcctgcgcaaaggctggagggttccctgagccggagctcgtccactacaaccccaaggacttcgacttcggcaagaagaaggccttcccgttcagggaccagcacttcttcgcgtcgatcgagaaggcgaccagggagcttgggtggacgccggagttcgacctcgtcgaggggctcaccgactcgtacaacctcgacttcggccgcggcacgttccggaaggccgccgacttcaccacggacgacatgatcctcggcaagaagcttgccaccgtctgagcttctcgggatctttgggatcgatggctgtaacacgtgacacggctaagggccggtacgtgcagctggtagggcgaaaatacggttgctggctgtaaatgtgggggatacatatggaaaattatctcaattttgatttaggttccggatctgtgtgcatcgactgtttgggaatcttgtaggttgtttcacctgtaaatggattccagatgtaatttgttgtgcaaaaaaaaccctctgcaaagcaactccaagagctctcttagaaaatgagttattgagggttatgct

SEQ ID NO: 3241 - DNA, 1503 bp, Setaria italica
acacagccatcaatccttctctctcttgttttcttcttcgttttatagtagagcagaggaagagcgacatggcggccacggcgtccctgaagagcagcttcctcctcccatctcctatctccgacttcagcggcgcggccgtctccgtctcaacgcagaagaggaggaggtcatggcagccgagaggggcgaggattcaggtctcggcggctgcggactccaagaacattcttgtcatggggggaaccaggttcattggtgtcttcctgtccaggctccttgtcaaggagggccatcaggttacattgttcactagaggaaaggcacccatcacccagcagctgccaggagagtccgatgcagagtacgcagagttctcctccaagattcagcacttgaaaggtgacaggatggacttcgaattcgtcaagacaagccttgctgctaagggatacaatgtcgtttacgacatcaacggacgcgaggctgtcgaagttgagcccataatcgaagccttgcccaacctggaacagtacatctactgctcatcagccggagtgtacctgaaatccgaccttcttccacactgcgagagcgatgcggtggaccccaagagccgtcacaaggggaagctggagacggagagcctgctgacctcccgcggcgtgaactggacgtcgatcaggcccgtgtacatctacggcccgctcaactacaaccccgtcgaggagtggttcttccaccgcctcaaggaaggccgccccatccccatccccggcgccggcaaccagatcacccagctcggccatgtcaaggacctggccacggcgttcaacctggtgctcggcaaccccaaggcgagccagcagatcttcaacatctccggggccaagtacgtcaccttcgacggcctcgcacgggcctgcgcaaaggctggagggttccctgagccggagctcgtccactacaaccccaaggacttcgacttcggcaagaagaaggccttcccgttcagggaccagcacttcttcgcgtcgatcgagaaggcgaccagggagcttgggtggacgccggagttcgacctcgtcgaggggctcaccgactcgtacaacctcgacttcggccgcggcacgttccggaaggccgccgacttcaccacggacgacatgatcctcggcaagaagcttgccaccgtctgagcttctcgggatctttgggatcgatggctgtaacacgtgacacggctaagggccggtacgtgcagctggtagggcgaaaatacggttgctggctgtaaatgtgggggatacatatggaaaattatctcaattttgatttaggttccggatctgtgtgcattgactgtttgggaatcttgtaggttgtttcacctgtaaatggattccagatgtaatttgttgtgcaaaaaaaaacctctgcaaagcaactccaagagctctcttagaaaatgagttattgagggttatgctaaaaacttttccc

SEQ ID NO: 3242 - DNA, 1467 bp, Cynodon dactylon
aggagaggcagcagggaactgaaacagagagaaatggcggccacggcgtccctgaagagcagcctcctccttccctcccgtatctccgacttcagtggcgcggccgtctccatctcaacccagaagcggaggcggtcatgccagtcgaggggtgcacggatgcaggtgtcggcagctgccgactccaagaacattcttgtcatgggaggcacaaggttcattggtgtcttcctgtccaggctcctcgtcaaggaaggccatcaggtgacattgttcactagaggaaaggcaccaattacgcagcagctgcctggagagcctgatgcagagtatgcagagttctcctcaaagattctgcacttgaaaggggacaggcaagacttcgactttgtcaagacaagccttgctgccaagggcttcgatgtcgtttatgacattaatgggcgcgaggccgtcgaggttacacctattctggacgccttgcccaacctcgaacagtacatctactgttcgtcagctggagtttacctgaaatctgaccttctcccgcattgtgagacggacgcagtggacccgaagagccggcacaaggggaagctggagacggagagcctgctgacctcacgcggcgtgaactggacgtcgatcaggccagtgtacatctacggcccgctcaactacaacccggtggaggagtggttcttccaccggctcaaggccggtcgcccgatccccatccccggcgccggcaaccagatcacccagctcggccacgtcaaggatctagcagcggcctttatcaaggtgcttggccacccgaaggcgagccagcagatcttcaacatttccggggccaagtacgtcacctttgatggcctggcacgggcatgcgcaaaggctggagggttccctgagccggagctcgtccactacaaccccaaggacttcgactttggtaagaagaaggccttcccattcagagaccagcatttctttgcatcgatcgagaaggcgacaagggagctcgggtggacgccggagttcgacctcgtggaggggcttaccgactcatacaatcttgactttggccgtggcacgttccggaaagaggctgacttcaccacagacgatgtgatccttgacaagaaactcgccgccgtctgagcccgtcgtttgctgtggtatactggtagctagggctggcaaagctggatcagcttggagggaactgggctcgtttcaattctaaacgagataagctagatttttaactcgtagatgttcaagctagctcgagcactcaagagcctaatgggaaaatggtatggttattgctttcatccttaatcccaggttcaaatgaggtttatttttgcgcatgtgccgctctgttttttgcgcatgtgctgtcagccacaaatataaatgttaactcaagtttctcgatcttttaaaaaaaaaaaaaaa

SEQ ID NO: 3243 - DNA, 1472 bp, Panicum virgatum
gggtcgacccacgcgtccggagagagcgagcgagagagagagagagagagagagagagagagagagagagaggggcagagcagaggaagagcgacatggcggccacggcgtccctgaagagcagcctccgcctcccgtctcctatctccgacttcagcggcgcagccgtctccgtctcagcgcagaagagtaggaggtcatggcagccgaggggggcgagggtgcaggtctcggcggcggcggcggactccaagaacattcttgtcatgggtggaaccaggttcattggtgttttcctgtccagactccttgtcaaggagggccatcaggttacattgttcactaggggaaaggcgcccatcacccagcagctgccaggagagtccgatgcagagtacgcagagttctcctccaagatccagcacttgaaaggtgacaggatggacttcgaattcgtcaaggcaagccttgctgctaagggctacgatgtcgtctacgacatcaacggacgcgaggctgcggaggttgagcctataatcgacgccttgcccgacctggaacagtacatctactgctcatcggccggagtgtacctgaaatcggaccttctcccacactgcgaggccgacgccgtggaccccaagagccggcacaaggggaagctggagacggagagcctgctcaccgcccgcggcgtgaactggacgtccatcaggccggtgtacatctacggcccgctcaactacaaccccgtcgaggagtggttcttccaccgcctcaaggccggccgccccatccccatccccggcgccggcaaccagatcacccagctcggccatgtcaaggacctcgcagcggcattcaacctggtgctcggcaacccgaaggcgagccagcagatcttcaacatctccggggccaagtacgtcaccttcgacggcctcgcacgggcgtgcgcgaaggctggagggttccctgagccggagctcgtccactacaaccccaaggagttcgacttcggcaagaagaaggccttcccgttcagggaccagcacttcttcgcgtcgatcgagaaggcgaccagggagctcgggtggacgccggagttcgacctcgtcgaggggctcaccgactcgtacaacctcgacttcggccgcggcacgttccggaaggcggccgacttcaccacagacgacatgatcctcggcaagaagcttgcgaccgtctgaaccttccgtgatctttgggaacgatggctgcacgtgacacggtgaagggccggtgcagctgctggggtgcaaatgctggctgtagccgtggggaatgctaatcttcaaaaaaaaaaagatgtggggaatgcatggaaaaatatctcagttttggattcgttccggatcgatgtatcgtacttatgagaacttatctaagtgaactagaaataatccgcgaaactaaaagcagctcaaattaat

SEQ ID NO: 3244 - DNA, 1712 bp, Oryza sativa
gctttgttccattagcacacaagactgaaccacaagtttcagacaagggatatactaccatcctgaacaaacaaagcccctcctcttgtttgtaccttgtttttttttataacagctcaagcacagggagaggagggttgaggagagtaaacaagaaaaaaaagagagagagatggcagcaacagcctccctgaagagcagcctcctgctaccatctcctatctctgacttcagtagtgcagcactctccatctcaacccaggctaggaggaggtcatggcagccaaggggggcaaggatgcaggtagcagcagctgcagactccaagaacattcttgtgatggggggaaccaggttcattggtgtcttcttgtccaggctccttgtcaaggaggggcaccaggtcacattgttcactagaggaaaggcccccattacccagcagttgccaggagagtcagatgcagagtatgcagagttctcttcaaaggtgttgcacttgaaaggtgacaggcaagactttgatttcgttaagacaagccttgcggcaaagggcttcgatgttgtttacgacataaacgggagagaagctgttgaggtagccccaatcctagacgcattgccgaaccttgaacagtacatctactgctcatcagcaggagtgtacctgaaatcagacctgctcccgcacttcgagaccgacgccgtcgacccgaagagccggcacaaggggaagctggagacggagagcctgctggagacccgggacgtgaactggacgtcgatcaggccggtgtacatctacggcccgctcaactacaaccccgtggaggagtggttcttccaccggctcaaggctggccgccccatccctgtccccggtgccggcaaccaaatcacccagctcggccatgtcaaggacttggcgacggcgttcgtgctggcgctcggcaacccgaaggcgagcaagcaggtgttcaacatctccggcgccaagtacgtcaccttcgacggtctagcacgggcgtgcgccaaggctggaggattccccgagccggagatcgtccactacaaccccaaggacttcgatttcgggaagaagaaggccttccccttcagagaccagcatttcttcgcgtcaatcgagaaggcgaccttggagctcgggtggaagccggagtacgacctggtggagggcctcaccgactcgtacaacctcgacttcggccgcggcacgttcaggaaggcggccgacttcaccaccgacgacatgatcctcggcaagaagctcgtcagcgtctgagctcgccgccgtcctttccggacagcggacggattgcttgctgcgcgacgcgagcggctgaccggccgggccgccatggccggtgggcaggagcaagcggagacggtttcagttttgttatcaacgctggtttggtacaatatggatagttggatacacgcgtacaggcgtaagctgcaatgtattgggattgggaaactgtaagatgtgatacaagggagactaaacttcatctaatatatatgatataactagcaaaatgcgtgtgcttcactacgagtgaaaagaacgttgaatgctaaaaggcacaactaaacatgagcataaaacccaatgatattcacggctgatataaacagcagtattgcaaactgatagactcgtatatatgtagtagattttatatgac

SEQ ID NO: 3245 - DNA, 1526 bp, Oryza sativa
agtttcagacaagggatatactaccatcctgaacaaacaaagcccctcctcttgtttgtaccttgtttttttttataacagctcaagcacagggagaggagggttgaggagagtaaacaagaaaaaaaagagagagagatggcagcaacagcctccctgaagagcagcctcctgctaccatctcctatctctgacttcagtagtgcagcactctccatctcaacccaggctaggaggaggtcatggcagccaaggggggcaaggatgcaggtagcagcagctgcagactccaagaacattcttgtgatggggggaaccaggttcattggtgtcttcttgtccaggctccttgtcaaggaggggcaccaggtcacattgttcactagaggaaaggcccccattacccagcagttgccaggagagtcagatgcagagtatgcagagttctcttcaaaggtgttgcacttgaaaggtgacaggcaagactttgatttcgttaagacaagccttgcggcaaagggcttcgatgttgtttacgacataaacgggagagaagctgttgaggtagccccaatcctagacgcattgccgaaccttgaacagtacatctactgctcatcagcaggagtgtacctgaaatcagacctgctcccgcacttcgagaccgacgccgtcgacccgaagagccggcacaaggggaagctggagacggagagcctgctggagacccgggacgtgaactggacgtcgatcaggccggtgtacatctacggcccgctcaactacaaccccgtggaggagtggttcttccaccggctcaaggctggccgccccatccctgtccccggtgccggcaaccaaatcacccagctcggccatgtcaaggacttggcgacggcgttcgtgctggcgctcggcaacccgaaggcgagcaagcaggtgttcaacatctccggcgccaagtacgtcaccttcgacggtctagcacgggcgtgcgccaaggctggaggattccccgagccggagatcgtccactacaaccccaaggacttcgatttcgggaagaagaaggccttccccttcagagaccagcatttcttcgcgtcaatcgagaaggcgaccttggagctcgggtggaagccggagtacgacctggtggagggcctcaccgactcgtacaacctcgacttcggccgcggcacgttcaggaaggcggccgacttcaccaccgacgacatgatcctcggcaagaagctcgtcagcgtctgagctcgccgccgtcctttccggacagcggacggattgcttgctgcgcgacgcgagcggctgaccggccgggccgccatggccggtgggcaggagcaagcggagacggtttcagttttgttatcaacgctggtttggtacaatatggatagttggatacacgcgtacaggcgtaagctgcaatgtattgggattgggaaactgtaagatgtgatacaagggagactaaacttcatctaatatatatgatataactagca

SEQ ID NO: 3246 - DNA, 1381 bp, Festuca arundinacea
  misc_feature (72)..(72): n is a, c, g, or t
  misc_feature (75)..(75): n is a, c, g, or t
ggcacgaggctgccatcctgaacaaatttaaagcccatcatcttgcttgcacctcgtttttctgttagcacnagntcacggagggaagtgaagtaaacaagagagaggaaaagagatggcggcggcaatggcttccctgaagagcagcctcctcctgccttctcctctctccgacttcagcggtgcagccgtctccatctcaactcagcataggagaaagtcatggcagccaaggggggcaagaatgcaggtagcggcagctgcagacgccaagaacattcttgtcatggggggcaccaggttcattggtctcttcctgtccaggcaactcatcaaggaaggacaccaggtcactttgttcaccagaggaaaggcacccataacccagcagttgccgggtgaatcagatgcagagtatgcagagttctcttccaaggtgctacatttgaaaggtgacaggcaagacttcgactttgtcaagaccagcctctctgctaagggcttcgatgtcgtttacgatattaatgggcgcgaggccacacaggtatcccccatactagatgcgttgccgaacctggaacagttcatctattgctcatcagcgggagtgtatctgaaatcagacctgctgccacactttgagaccgacgcggtggacccgaaaagccggcacaagggaaagctggagacggagagcctgttggagacaagcggcgtgaactggacatccatcaggccggtgtacatctacggccccctgaactacaaccccgtggaggaatggttcttccaccggctcaaggccggccgcccgatccccatcccgggcgccgggaaccagatcacccagctcggtcacgtcaaggatttggcggaggccttcaccagggtcctcggcaaccccaaggcgagcaagcaggtctacaacatctccggtgccaagtacgtcaccttcgacggcctagcaaaggcatgcgcaaaggctggagggtttcctgaaccggagatagttcactacaaccccaaggacttcgacttcggcaagaagaaggctttcccgttcagagaccagcacttcttcgcctcggtggagaaggccagcaaggacctcggaatcacgccggagttcgacctcgtcgatggcctcaccgactcttacaacctcgacttcggccgcggcacgttcaggaaggaggccgacttcaccacggacgacatgatcctcggcaagaagctcgtgagcgtgtgagtccatctgaagcgtgtacgcaccatgcctgactcatgacagtgaaggcgtgttgcagtcacccccaaatacccagcaggatggcagcccagccaaacgtgaaacaagggtccgcaagccaaactcgcgtta

SEQ ID NO: 3247 - DNA, 1567 bp, Avena sativa
atgctgtgccatcctgaacaaatttaaagcccatcatcttgcttgtaccttgtttttctgttagcacaagtgcagggaggggagtaaagtaagcaagagaagggaagagagatggcggcggcaatggcttccctgaagagcagcctcctcctgccttctcctctctctgatttcagcggtgcagccgtctccatctcagctcagaataggagaaagtcatggcagccaaggggggcaagaatgcaggtggcggcagccgcagacagcaagaacattcttgtcatggggggaaccaggttcattggtctcttcctgtccaggcaactcatcaaggaaggacaccaggtcactttgttcaccagaggaaaggcacctataaccaagcagttgccaggtgaatcagatgcagagtatgcagagttctcttccaaggtactacatttgaaaggtgacaggcaagacttcgacttcgtcaagaccaacctctctgctaagggcttcgatgtcgtgtacgatattaatgggcgcgaggccacagaggtagcccccatactagatgcgcttccgaacctggaacagttcatctactgctcatcagcgggagtgtatctgaaatcagacttgctgccacactttgagaccgacgcggtggacccgaagagccggcacaagggaaagctggagacggagagcctgctggagacgagcggcgtgaactggacgtcgatcaggccggtgtacatctacggccctctcaactacaaccccgtggaggagtggttcttccaccggctcaaggccggccgcccgatccccatccccggcgccgggaaccagatcacccaactcggccacgtcaaggatttggcggaggccttcatcaaggtcctcggcaaccccaaggcgagcaagcaggtgtacaacatctccggcgccaagtacgtcaccttcgacggcctagcacgggcatgcgcaaaggctggagggtttcctgaaccagagatagtccactacaaccccaaggacttcgacttcggcaagaagaaggccttcccgttcagagaccagcatttcttcgcgtcggtggagaaggccagcaaggacctcgggatcacgccggcgttcgacctcgtcgagggcctcaccgactcctacaacctcgacttcggccaggggacgttcaggaaggaggccgacttcaccaccgacgacatgatcctcggcaagaagctcgtcaccgtgtgaggtgaccctggctcatgagtcatgagttgacagtgcaggcgtgtgatcctgacacccagggctcagcaggagggtggtgtggtggcccagccaaacgtgaagcaagggtccgcaagcccaaccccctgtttgtttacagtgcaggcgactttttcaaacgctttcttttcttgcttggccggcgatggatttgcttgctatatgttgcaccgacaaaatcgctgcgttttgctgcattcggaatatagtgaagagggcaactgtcgtataaatgatatgataatggttcaactaagcttcttgttagaaagaattaactttt

SEQ ID NO: 3248 - DNA, 1752 bp, Avena sativa
tttttttttttatctattggcatgcaccggaccacaagtttcagcacaagtgcagggaggggagtaaagtaagcaagagaagggagaagagatggcagctgcaatggcttccctgaagagcagcctcctcctgccttctcctctctctgatttcagcggtgcagccgtctccatctcagctcagaataggagaaagtcatggcagccaaggggggcaagaatgcaggtggcggcagccgcagacagcaagaacattcttgtcatggggggaaccaggttcattggtctcttcctgtccaggcaactcatcaaggaaggacaccaggtcactttgttcaccagaggaaaggcacctataaccaagcagttgccaggtgaatcagatgcagagtatgcagagttctcttccaaggtactacatttgaaaggtgacaggcaagacttcgacttcgtcaagaccaacctctctgctaagggcttcgatgtcgtgtacgatattaatgggcgcgaggccacagaggtagcccccatactagatgcgcttccgaacctggaacagttcatctactgctcatcagcgggagtgtatctgaaatcagacttgctgccacactttgagaccgacgcggtggacccgaagagccggcacaagggaaagctggagacagagagcctgctggagacgagcggcgtgaactggacgtcgatcaggccggtgtacatctacggccctctcaactacaaccccgtggaggagtggttcttccaccggctcaaggccggccgcccgatccccatccccggcgccgggaaccagatcacccaactcggccacgtcaaggatttggcggaggccttcatcaaggtcctcggcaaccccaaggcgagcaagcaggtgtacaacatctccggcgccaagtacgtcaccttcgacggcctagcacgggcatgcgcaaaggctggagggtttcctgaaccagagatagtccactacaaccccaaggacttcgactttggcaagaagaaggccttcccgttcagagaccagcatttcttcgcgtcggtggagaaggccagcaaggacctcgggatcacgccggcgttcgacctcgtcgagggcctcaccgactcctacaacctcgacttcggccaggggacgttcaggaaggaggccgacttcaccaccgacgacatgatcctcggcaagaagctcgtcaccgtgtgaggtgaccctggctcatgagtcatgagttgacagtgcaggcgtgtgatcctgacacccagggctcagcaggagggtggtgtggtggcccagccaaacgtgaagcaagggtccgcaagcccaaccccctgtttgtttacagtgcaggcgactttttcaaacgctttcttttcttgcttggccggcgatggatttgcttgctatatgttgcaccgacaaaatcgctgcgttttgctgcattcggaatatagtgaagagggcaactgtcgtataaatgatatgataatggttcaactaagctttttgttagaaagaattaacttttgtttggaaaatggcgttttacacggcccgagaggataaatacgagtatgaaaccctagaagaggaatgggagcccagataacgaatgtaggacttcggagaaagactcataagacgaatatgggagcttagatagtaaatataggatccaagagggcaagtatggaacttcagaggaagagtcggaaaattgcatcctattcact

SEQ ID NO: 3249 - DNA, 1467 bp, Avena sativa
aagggactgaagtaaacaagagaaaggaagagagatggcggctgcaatggcttccctgaagagcagcctcctcctgccttctcctctctcagactttagtggcgcagccgtttccatctcagctcagaataggagaaagtcatggcagccaaggggggcgaagaatgcaggtggcggcagccgcagacagcaagaacattcttgtcatggggggaaccgaggttcattggtctcttcctgtccagacaactcatcaaggaaggacaccaggtcactttgttcaccagaggaaaggcacctataaccaagcagttgccaggtgaatcggatgcagagtatgcagagttctcttccaaggtcctacatttgaaaggtgacaggcaagacttcgacttcgtcaagaccaacctctccgctaagggcttcgatgtcgtttacgatattaatgggcgcgaggccacagaagtagcccccatactagatgcgttgccgaacctggaacagttcatctactgctcatcggcgggagtgtatctgaaatcagacctgctgccacactttgagaccgacgcggtggacccgaagagccggcacaagggaaagctggagacggagagcctgctggagacgagcggcgtgaactggacgtcgatcaggccggtgtacatctacggccctctcaactacaaccccgtggaggagtggttcttccaccggctcaaggccggccgcccgatccccatccccggcgccgggaaccagatcacccaactcggccacgtcaaggatttggcggaggccttcatcaaggtcctgggcaaccccaaggcgagcaagcaggtgtacaacatctccggcgccaagtacgtcaccttcgacggcctagcacgggcgtgcgcaaaggctggagggtttcctgaaccagagatagtccactacaaccccaaggacttcgacttcggcaagaagaaggccttcccgttcagagaccagcatttctttgcgtcggtggagaaggccagcaaggacctcgggatcacgccggcgttcgacctcgtcgagggcctcaccgactcttacaacctcgacttcggtcaggggacgttcaggaaggaggcggacttcaccacggacgacatgatcctcggcaagaagctcgtcagcgtgtgagtcggacctgaagcgtgtatgccctggctcatgagtcatgagtcatgacagtgcaggcgtgtgaccttgacacccaggctcagcaggagggtggtggcccggccaaatgtgaagcgacggtccgcaagcccacaaacccctgtttcagcgcaggcgtctttttcaaacgttttcttttctttgcttggtcggcgatggatttgcttgctatatgctgcaccgacaaaatcgctgcgctttgctgcatttcggaatatggtgaagagggcaactgtcgtataaatgatatgataatgg

SEQ ID NO: 3250 - DNA, 1537 bp, Avena sativa
atatgctgtgccatcctgaacaaatttaaagcccatcatcttgcttgtacctcgtttttctgttagcacaagcgtagggaggggactgaagtaaacaagagaaaggaagagagatggcggctgcaatggcttccctgaagagcagcctcctcctgccttctcctctctcagactttagtggcgcagccgtttccatctcagctcagaataggagaaagtcatggcagccaaggggggcaagaatgcaggtggcggcagccgcagacagcaagaacattcttgtcatggggggaaccaggttcattggtctcttcctgtccagacaactcatcaaggaaggacaccaggtcactttgttcaccagaggaaaggcacctataaccaagcagttgccaggtgaatcggatgcagagtatgcagagttctcttccaaggtcctacatttgaaaggtgacaggcaagacttcgacttcgtcaagaccaacctctccgctaagggcttcgatgtcgtttacgatattaatgggcgcgaggccacagaggtagcccccatactagatgcgttgccgaacctggaacagttcatctactgctcatcggcgggagtgtatctgaaatcagacctgctgccacactttgagaccgacgcggtggacccgaagagccggcacaagggaaagctggagacggagagcctgctggagacgagcggcgtgaactggacgtcgatcaggccggtgtacatctacggccctctcaactacaaccccgtggaggagtggttcttccaccggctcaaggccggccgcccgatccccatccccggcgccgggaaccagatcacccaactcggccacgtcaaggatttggcggaggccttcatcaaggtcctcggcaaccccaaggcgagcaagcaggtgtacaacatctccggcgccaagtacgtcaccttcgacggcctagcacgggcatgcgcaaaggctggagggtttcctgatccggagatagtccactacaaccccaaggacttcgactttggcaagaagaaggccttcccgttcagagaccagcatttcttcgcgtcggtggagaaggccagcaaggacctcgggatcacgcctgcgttcgacctcgtcgagggcctcaccgactcttacaacctcgacttcggccaggggacgttcaggaaggaggccgacttcaccacggacgacatgatcctcggcaagaagctcgtcaccgtgtgagtccacctgaagcgtgtatgcgctggctcatgagtcatgagtcatgacagtgcaggcgtgtcacccagacgcccaggcccagcaggagggtggtggcccagccaaacgtgaagcaatgggcccgcaaggccaactcctgttacagtgcaggcgtctttttcaaacttttccttttcttgcttggccggcgatggatttacttgctgtatgttgcaccgacaaaatcgctgcgctttgctgcattcggaatatactgaagagggcaactgtcgtataaatgatatgataat

SEQ ID NO: 3251 - DNA, 1647 bp, Avena sativa
atatgctgtgccatcctgaacaaatttaaagcccatcatcttgcttgtacctcgtttttctgttagcacaagcgtagggaggggactgaagtaaacaagagaaaggaagagagatggcggctgcaatggcttccctgaagagcagcctcctcctgccttctcctctctcagactttagtggcgcagccgtttccatctcagctcagaataggagaaagtcatggcagccaaggggggcaagaatgcaggtggcggcagccgcagacagcaagaacattcttgtcatggggggaaccaggttcattggtctcttcctgtccagacaactcatcaaggaaggacaccaggtcactttgttcaccagaggaaaggcacctataaccaagcagttgccaggtgaatcggatgcagagtatgcagagttctcttccaaggtcctacatttgaaaggtgacaggcaagacttcgacttcgtcaagaccaacctctccgctaagggcttcgatgtcgtttacgatattaatgggcgcgaggccacagaagtagcccccatactagatgcgttgccgaacctggaacagttcatctactgctcatcggcgggagtgtatctgaaatcagacctgctgccacactttgagaccgacgcggtggacccgaagagccggcacaagggaaagctggagacggagagcctgctggagacgagcggcgtgaactggacgtcgatcaggccggtgtacatctacggccctctcaactacaaccccgtggaggagtggttcttccaccggctcaaggccggccgcccgatccccatccccggcgccgggaaccagatcacccaactcggccacgtcaaggatttggcggaggccttcatcaaggtcctgggcaaccccaaggcgagcaagcaggtgtacaacatctccggcgccaagtacgtcaccttcgacggcctagcacgggcgtgcgcaaaggctggagggtttcctgaaccagagatagtccactacaaccccaaggacttcgacttcggcaagaagaaggccttcccgttcagagaccagcatttctttgcgtcggtggagaaggccagcaaggacctcgggatcacgccggcgttcgacctcgtcgagggcctcaccgactcttacaacctcgacttcggtcaggggacgttcaggaaggaggcggacttcaccacggacgacatgatcctcggcaagaagctcgtcagcgtgtgagtcggacctgaagcgtgtatgccctggctcatgagtcatgagtcatgacagtgcaggcgtgtgaccttgacacccaggctcagcaggagggtggtggcccggccaaatgtgaagcgacggtccgcaagcccacaaacccctgtttcagcgcaggcgtctttttcaaacgttttcttttctttgcttggtcggcgatggatttgcttgctatatgctgcaccgacaaaatcgctgcgctttgctgcatttcggaatatggtgaagagggcaactgtcgtataaatgatatgataatggttcaactaagctttgtagaaagagtttaacttttgtttggaaaatgacgttttacacatgcccgagaggacaaatacgaatatgaaaccctagaaaaaaaaaa

SEQ ID NO: 3252 - DNA, 2103 bp, Leymus cinereus x Leymus triticoides
  misc_feature (947)..(947): n is a, c, g, or t
  misc_feature (1788)..(1788): n is a, c, g, or t
  misc_feature (2030)..(2030): n is a, c, g, or t
ggcaggggcgcgatctgcgcgaggccctggaggagaccggcgtgcgcggcgacacgggtgcgacgctgggctggtggatgcgcgagcgcctcatccagtagaggtgaagctggccgaagacctcggaggccactccgccgagcagctccaggccaacggccagctgcagcgccgcaccatcctgagagaacggaagatcgaggaggccgccggcagcgcgcaggcagataatcagagtcgctggcgacggcgaagatggtggatctcgccggaaacggaggggcgtggagcgggagatggaggccaaggcggaggggatgaagcgtgtgccgtagctgcctttcttttctcccttcacgcgacggcacctcctgggtctacgtcttctacgccatggctcctatgtttgactgacatcagaagaagagaagagaaaacaaatgtcgccatcagttgatcagaatgttgctgcccattaagtggacacacgaaaggatgagaggagaggatccaacagaggatagatagggctggctcccccctccacacaagccaagacaatctctagcactcatttttcttttctattagcacgcactgaaccacaagtttcaggcaagagatatactgccgccatcctggacaaacaaagccccctcctcttgtttgcacatcgtattttcagtagcacaagctcagggagaggggagacagaagggaagagagatggcggcggcaagtgtctccctaaagagcagcctcttcctgtcttcccctctttccgacttcggcggtgcagccatctccatctcagcccagaataggagaaggtcatggcagccaaggggcgcaagaatgcaggtggcagcagctgcagactccaagaacattctgatcatggggggcaccaggttcattggtctcttcctgtccaggaaacttgtcanggagggacaccaggtcacattgttcaccagaggaaaggcacccataacccagcagttgccaggtgaatcagatgcagagtatgcagagttctcttccaaggtgctgcatttgaaaggtgataggaaagactttgatttcgtcaagaccagcctttctgctaagggctttgatgtcgtctatgatattaatgggcgcgaggccactgaagtatcccccatactagaagcgttgccgaacctggaacagtttatctattgctcatcggcaggagtataccttaaatcagacctgctcccacactttgagaccgacgctgtggacccgaaaagccggcataagggaaagctggagacggagagcctgctcgagacgagcggcgtgaactggacgtccatcaggccggtctacatctacggccctctcaactacaaccccgtggaggagtggttcttccaccggctcaaggctggtcgcccgatccccatccctaacgctgggaaccagatcacccagctcggccacgtcaaggatttggcgacggccttcatcaaggtcctcggcaaccccaaggcgagcaagcaggtgtacaacatctccggcagcaagtacgtcacctttgacgggcttgcacgggcatgcgcaaaggctggagggttccctgagccggagatcatccactacaaccccaaggacttcgatttcggcaagaagaaggccttccccttcagagaccagcatttcttcgcgtcggtggagaaggccagcaaggacctcggggttacgccggagtacgacctcctcgacggcttgacggactcgtacaacctcgacttcggccgngggaccttcaggaaggaggctgacttcaccacggacgacatgatcctcggcaagaagctcgtgagcgtgtgagtcgacctgaggcgtgcatggatgggcacatggctcatggctcatggctcatggtagtgcaaagcgtgtggcaactgcgtgcgcggtgtgcatatgtagcacagggaagacgatctcagttttgggatataggttgaggttcactcatccgatgaactgtactgctgacncctaattctctcctcgtggaatttggtttatttcggttcagtttatactgtttataataataatggttttcta

SEQ ID NO: 3253 - DNA, 2137 bp, Triticum aestivum
aacaattcggaggaggattgcgcgagaagcgattcccccagcgatgccaaggaggaagaaagtattagctccagaagaagatgtttggcttgcctatgtgctgtaacattaatcagtgcatcaggcccaacgttttatgcgccgaatggatttgctgcggacatgacgaacaagcctggcatacaaaaggctgtatgcagaaattgtggtggcggcggtgctataatatgtgacatgtgtggtggcacaggaaaatggaaggccctcaaccgaaagagagcaaaagatgtttatgaattcacagaatgcccaaattgctatggccgtgggaagctggtctgccccatctgtctcggaaccggcgtgcccaacaacaaaggactcctgcggcgaccgggcgccaaagagctgctggacaagatgtacaatggcaagctattgccgagctcgtagatacatagcatcttcagtactgcatagccaggagtatagggccacatattgaaagcagaagattttcgcgtcggtgtaatactgtaatttgagattcgcattagatctacggatgtagtacgggtttttttgcgagacacacaagtaaagcttgtatgattttgttcaagtgtcggatcggatgcaattatctgtctatatgtgtagtaaaacagagaccatggacatgcaaaaaaaaaactggacaggcaaacaaagccctctcctcttgtttgcgcatcgtattttcagtagcacaagctcagggagaggggagagagatggcggcggcaagcgtctccctgaagagcagcctcttcctgtcttcccctctttccgacttcggcggcgcggccatctccatctcagcccagaataggagaaggtcatggcagccaaggggggcgagaatgcaggtggcagcagctgcagactccaagaacattctcatcatggggggcaccaggttcatcggtctcttcctctccaggaaacttgtccaggagggacaccaggtgacattgttcaccagaggaaaggcacccataacccagcagttgccaggtgaatcagatgcagagtatgcagagttctcttccaaggtgctgcatttgaaaggtgataggaaagactttgatttcgtgaaaaccagccttgctgctaagggcttcaatgtcgtctatgatattaatgggcgcgaggccactgaagtatcccccatactagaagcgttgccgaacctggaacagtttatctattgctcatcggcaggagtctaccttaaatcagacctgctcccacactttgagaccgacgccgtggacccgaaaagccggcacaagggaaagctggagacggagagcctgctggagacgagcggcgtgaactggacgtccatcaggccggtctacatctacggccctctcaactacaaccccgtggaggagtggttcttccaccggctcaaggctggtcgcccgatccccatccctaacgccgggaaccagatcacccagctcggccacgtcaaggatttggcgacggccttcatcaaggtcctcggcaaccccaaggcgagcaagcaggtgtacaacatctctggcagcaagtacgtcaccttcgacgggctagcacgggcatgcgcaaaggctggagggttccctgagccggagatcatccactacaaccccaaggacttcgatttcggcaagaagaaggccttccccttcagagaccagcatttcttcgcgtcggtggagaaggccagcaaggacctcggggttacaccggagtacgacctcctcgacggcttgacggactcctacaacctcgacttcggccgcgggaccttcaggaaggaggccgacttcaccacggacgacatgatccttggcaagaagctcgtgagcgtgtgagccgatctgaggcgtgcatggacggacacatggctcatggcagcgcaaagcgtgtggcgactgtgcctgtgcgggtgcatatgtagcacagggaagacgatctcagttttgggatataaggttcactcatctgatgaaatgtactgctgacacctaattctctcctcgtgccatttggtttatttcggttcagtttatattgtttataataaatatcagttttctaacaa

SEQ ID NO: 3254 - DNA, 1357 bp, Leymus cinereus x Leymus triticoides
  misc_feature (5)..(6): n is a, c, g, or t
ctctnntttgcacttcgtctttttagtagcacaagcgcagggaggggggagagaaggcaagagagatggcggcggcaagtgtctccctgaagagcagcctcttcctgtcttcccctctttctgactttggcggtgcagccctctccgtctcagcccagaataggagaaggtcatggcagccaaggggggcaagaatgcaggtggcagcagctgcagactccaagaacattctggtcatggggggcaccaggttcattggtctcttcctgtccaggaaacttgtcaaggagggacaccaggtcacattgttcaccagaggaaaggcacccgtaacccaacagttgccaggtgaatcagatgcagagtacgcagagttctcttccaaggtgctgcatttgaaaggtgataggcaagactttgatttcgtcaagaccaacctttctgctaagggctttgatgtcgtctatgatatcaatgggcgcgaggccactgaggtagcccccatactagaagcgctgccgaacctggaacagtttatctattgctcatcagcaggagtataccttaaatcagacctgctcccacactttgagaccgacgccgtggacccgaaaagccggcacaagggaaagctggagacagagagcctgctggagacgagcggtgtgaactggacgtctatcaggccggtctacatctacggccctctcaactacaaccccgtggaggagtggttcttccaccggctcaaggctggccgccctatccccatccccggcgccgggaaccagatcacccaactcggccatgtcaaggatttggcgacggccttcatcagggtcctgggcaaccccaaggcgagcaagcaggtgtacaacatctccggcagcaagtacgtcaccttcgacgggcttgcacgggcatgcgcaaaggctggagggttccctgagccggagatcatccactacaaccccaaggacttcgatttcggcaagaagaaggccttccccttcagagaccagcatttcttcgcgtcggtggagaaggccagcaaggacctcggggttacgccggagtacgacctcctcgacggcttgacggactcgtacaacctcgatttcggccgtgggaccttcaggaaggaggctgacttcaccacggacgacatgatcctcggcaagaagctcgtgagcgtgtaagccgatctgaggcgtgcatggatggacacatggctcatggcagcgcaaagcgtgtggcaaatgtgcgtgtgcgggttatgtagcacagggaagacgatctcagttttgggatataggttgaggttcactcatccgatgaaatatactgctgacaacta

SEQ ID NO: 3255 - DNA, 1585 bp, Secale cereale
gggggtaggtattcctaactagaggatagatagggcgggctcccccctccacacaagccaagacaatctgtagcactcattttttcattcctattagcacgcactgcaccacaagtttcagacaagggatataccgccgccatcctggacaggcaaacaaagtcctctcctcctgtttgcacatcgtgttttcagtagcacaagctcagggagagggaagagagatggcggcggcgagtgtctccctgaagagcagcctcttcctgtcttcccctctttccgacttcggcggtgcagccatctccatctcagcccagaataggagaaggtcatggcagccaaggggggcgagaatgcaggtggcagcagctgcagactcgaagaacatcctgatcatggggggcaccaggttcatcggtctcttcctgtccaggaaacttgtccaggagggacaccaggtcacattgttcaccagaggaaaggcgcccataacccagcagttgccgggtgaatcagatgcagagtatgcagagttctcttccaaggtgctgcatttgaaaggtgataggaaagactttgatttcgtcaagaccagcctctctgctaagggcttcaatgtcgtctatgatattaatgggcgcgaggccactgaagtatcccccatactagaagcgctgccgaacctggaacagtttatctattgctcatcggcaggagtctaccttaaatcagacctgctcccacactttgagaccgatgccgtggacccgaaaagccggcacaagggaaagctggagacggagagcctgctggagacgagcggcgtgaactggacgtccatcaggccggtctacatctacggccctctcaactacaaccccgtggaggagtggttcttccaccggctcaaggctggtcgcccgatccccatccctaacgctgggaaccagatcacccagctcggccacgtcaaggatttggcgacggccttcatcaaggtcctcggcaaccccaaggcgagcaagcaggtgtacaacatctccggcagcaagtatgtcaccttcgacgggctagcacgggcatgcgcaaaggctggagggttccctgagccggagatcatccactacaaccccaaggacttcgatttcggcaagaagaaggccttccccttcagagaccagcatttcttcgcctcggtggagaaggccagcaaggacctcggggttacgccggagtacgacctcctcgatggcttgacggactcgtacaacctcgacttcggccgcgggaccttcaggaaggaggctgacttcaccacggacgacatgatcctcggcaagaagctcgtgagcgtctgagtcgatctgcggcgtgcatagatggaaacatggctcatagcagcgcaaagcgcgtggcaactgttggtgtgcgggtgcatatgtatcacagggaagatgatctcagttttgggatataggttgaggttcactcatccgatgaaatgtactgctgacacctaattccctcctcgtggcatttggtttatttcggttcagtttatactgtttataataatattggtttt

SEQ ID NO: 3256 - DNA, 1672 bp, Hordeum vulgare
gccgattaagtggacacgagaaaggatgggaggagaggacccaacagaggatagataggggtggctcccccctccacacaagccgagacaatctctagcactcatttttcattcccattagcacgcaccgaaccacaagtttcaggcaagagatatactgccatcctggacaggcaaacaaagccctctcctcttgtttacacttcatctttttagtagcacaatcgcagggaggggacagagaagggaagagagatggcggcggcaagcgtctccctgaagagcagcctcttcctgtcttcccccctttccgacttcggcggcgcggccatctccatctcagcccagaataggagacggtcatggcagccgaggggggcgagaatgcaggtggcagcagctgcagactccaagaacattctgatcatggggggcacgaggttcattggtctcttcctgtccaggaaacttgtccaggagggacaccaggtcacattgttcaccagaggaaaggcacccataacccagcagttgccaggtgaatcagatgcagagtatgcagagttctcttccaaggtgctgcatttgaaaggtgataggaaagactttgatttcgtcaagaccagcctttctgctaagggctttaatgtcgtctatgatattaatggacgcgaggccactgaagtatcccccatactagaagcgttgccaaacctggaacagtttatctattgctcatcggcaggagtctaccttaagtcagacctgctcccacactttgagaccgacgctgtggacccgaaaagccggcataagggaaagctggagacagagagcctgctggagacgagcggcgtgaactggacgtccatcagaccggtctacatctacggccctctcaactacaaccctgtggaggagtggttcttccaccggctcaaggctggtcgcccgatccccatccctaacgctgggaaccagatcacccagctcggccatgtcaaggatttggcgacggccttcatcaaggtcctcggcaaccccaaggcgagcaagcaggtgtacaacatctccggcagcaagtatgtcaccttcgatgggctagcacgggcatgcgcaaaggctggagggttccctgagccggagatcatccactacaaccccaaggacttcgatttcggcaagaagaaggccttccccttcagagaccagcatttcttcgcgtctgtggagaaggccagcaaggacctcggggttacgccggagtacgacctcctcgacggcttgacggactcgtacaacctcgacttcggccgcgggaccttcagaaaggaggctgacttcaccacggacgacatgatcctcggcaagaagctcgtgagcgtctgaggcgtgcatggacgggcacatggctcatggctcatggcagtgcaaagcgtgtggcaacagcgtgtgcggcgtgcatatgtagcacagggaagacgatctcagttttgggatgtaggttgaggttcactcatccgatgaaatgtactgctgaccaaacctaattctctcctcgtgtcatttgctttacttcggttcagtttatacctgtttttttttgtaataatatatcggttttctaagatcggaactgaatttgaccactcaagattttgaaaatcaaatc

SEQ ID NO: 3257 - DNA, 1395 bp, Pseudoroegneria spicata
  misc_feature (69)..(69): n is a, c, g, or t
  misc_feature (1179)..(1179): n is a, c, g, or t
  misc_feature (1243)..(1243): n is a, c, g, or t
gttttttcagtagcacaagcgcagggaggggagagagatggcggcggcaagcgtctccctgaagagcancctcttcctgtcttcccctctttccgacttcggcggtgccgccatctccatctcggcccagaataggagaaggtcatggcagccaaggggggcaagaatgcaggtggcagcagctgcagactccaagaacattctcatcatggggggcaccaggttcattggtctcttcctgtccaggaaacttgtccaggagggacaccaggttacattgttcaccagaggaaaggcacccataacccagcagttgccaggtgaatcagatgcagagtatgcagagttctcttccaaggtgctgcatttgaaaggtgataggaaagactttgatttcgtcaagaccagcctttctgccaagggctttgatgtcgtctatgatattaatgggcgcgaggccactgaagtatcccccatactagaagcgttgccaaacctggaacagtttatctattgctcatcggcaggagtctaccttaaatcagacctgctcccacactttgagaccgacgctgtggacccgaaaagccggcataagggaaagctggagacggagagcctcctggagacaagcggcgtgaactggacgtccatcaggccggtctacatctacggccctctcaactacaaccccgtggaggagtggttcttccaccggctcaaggctggtcgcccgatccccatccctaacgctgggaaccagatcacccagctgggccacgtcaaggatttggcgacggccttcatcaaggtcctcggcaaccccaaggcgagcaagcaggtgtacaacatctccggcagcaagtacgtcaccttcgacgggctagcacgggcatgcgcaaaggctggagggttccctgagccggagatcatccactacaaccccaaggacttcgatttcggcaagaagaaggccttccccttcagagaccagcatttcttcgcttcggtggagaaggccagcaaggacctcggggttacgccggagtacgacctcctcgacggcttgacggactcgtacaacctcgacttcggccgcgggaccttcaggaaggaggccgacttcaccacggacgacatgatcctcggcaagaagctcgtgagcgtgtgagtcgaccngaggcgtgcatggatgggcatatagctcctggctcatggcagcgcaaagcgtgtggcaactgcntgctcggtgtgcatatgtagcacagggaagatgatctcagttttgggatatagattgaggttcactcatccgatgaaatgtactgctgacacctaattctctcctcatggcatttggtttacttcggttcagtttatactgtttataataaa

SEQ ID NO: 3258 - DNA, 1421 bp, Triticum aestivum
aagccctctcctcttgtttgcacttcatctttttagtagcacaagctcagggagaggggagacagaagggaagagaaatggcggcggcgagtgtctccctgaagagcagcctcttcctatcttcccctctttccgacttcggcggcgcagccatctccatctcagcccagaataggagaaggtcatggcagccaaggggggcgagaatgcaggtggcagcagctgcagactccaagaacattctgatcatggggggcaccaggttcatcggtctcttcctctccaggaaacttgtccaggagggacaccaggtcacattgttcaccagaggaaaggcacccataacccagcagttgccaggtgaatcagatgcagagtatgcagagttctcttccaaggtgctgcatttgaaaggtgataggaaagactttgatttcgtcaagaccagcctttctgctaagggcttcaatgtcgtctatgatattaatgggcgtgaggccaccgaagtatcccccatactagaagcgttgccgaacctggaacagtttatctattgctcatcggcaggagtctaccttaaatcagacctgctcccacactttgagaccgacgccgtggacccgaaaagccggcataagggaaagctggagacagagagccttctagagacgagcggcgtgaactggacgtccatcaggccggtctacatctacggccctctcaactacaaccccgtggaggagtggttcttccaccggctcaaggctggtcgcccgatccccatccctaacgctgggaaccagatcacccagctcggccacgtcaaggatttggcgacggcgttcatcaaggtcctcggcaaccccaaggcgagcaagcaggtgtacaacatctccggcagcaagtacgtcaccttcgacgggctagcacgggcatgcgctaaggctggagggttccctgagccggagatcatccactacaaccccaaggacttcgatttcggcaagaagaaggccttccccttcagagaccagcatttcttcgcgtcggtggagaaggccagcaaggacctcggggttacgccggagtacgacctcctcgacggcttgacggactcgtacaaccttgacttcggccgcgggaccttcaggaaggaggccgacttcaccacggacgacatgatcctcggcaagaagctcgtgagcgtgtgagccgacctgaggcgtgcatggttgggcacatggctcatggcagcgcaaagcgtgtggcaactgcgtgtgcggtgtgcatatgtagcacagggaagacgatctcagttttgggatataggttgaggttcactcatccgatgaaatgtactgctgacgcctaattctctcgtggcattcggtgtatttcggttcagtttatactgtttataa

SEQ ID NO: 3259 - DNA, 1419 bp, Secale cereale
aggcaaacaaagccctctcctcttgtttgcacatcgtgttttcagtagcacaagctcagggagagggaagagagatggcggcggcgagtgtctccctgaagagcagcctcttcctgtcttcccctctttccgacttcggcggtgcagccatctccatctcagcccagaataggagaaggtcatggcagccaaggggggcgagaatgcaggtggcagcagctgcagactcgaagaacatcctgatcatggggggcaccaggttcatcggtctcttcctgtccaggaaacttgtccaggagggacaccaggtcacattgttcaccagaggaaaggcgcccataacccagcagttgccgggtgaatcagatgcagagtatgcagagttctcttccaaggtgctgcatttgaaaggtgataggaaagactttgatttcgtcaagaccagcctctctgctaagggcttcaatgtcgtctatgatattaatgggcgcgaggccactgaagtatcccccatactagaagcgctgccgaacctggaacagtttatctattgctcatcggcaggagtataccttaaatcagacctgctcccacacttcgagaccgacgccgtggacccgaaaagccggcacaagggaaagctggagactgagagcctgctggagacgagcggcgtgaactggacgtccatcaggccggtctacatctacggccctctcaactacaaccccgtggaggagtggttcttccaccggctcaaggctggtcgcccgatccccatccctaacgccgggaaccagatcacccagctcggccacgtcaaggatttggcgacggccttcatcaaggtcctcggcaaccccaaggcgagcaagcaggtgtacaacatctccggcagcaagtacgtcaccttcgacgggctagcacgggcatgcgcaaaggctggagggttccctgagccggagatcatccactacaaccccaaggactttgatttcggcaagaagaaggccttccccttcagagaccagcatttcttcgcgtcggtggagaaggccagcaaggacctcgaggttacgccggagtacgacctcctcgacggcttgacagactcatacaacctcgacttcggccgcgggaccttcaggaaggaggctgacttcaccacggacgacatgatcctcggcaagaagctcgtgagcgtctgagtcgatctgcggcgtgcatagatggaagcatggctcatggcagcgcaaagcgcgtggcaactgttggtgtgcgggtgcatatgtatcacagggaagatgatctcagttttgggatataggttgaggttcactcatccgatgaaatgtactgctgacacctaattccctcctcgtggcatttggtttatttcggttcagtttatactgttta

SEQ ID NO: 3260 - DNA, 1420 bp, Secale cereale
cttcatctttttagtagcaaaagcccagggagaggggaggcagaagggaagagaaatggcggcagcgagtgtctccctgaagagcagcctcttcctgtcttcccctctttccgacttcggcggcgcagccatctccatctcagcccagaataggagaaggtcatggcagccaaggggggcgagaatgcaggtggcagcagctgcagactcgaagaacatcctgatcatggggggcaccaggttcatcggtctcttcctgtccaggaaacttgtccaggagggacaccaggtcacattgttcaccagaggaaaggcgcccataacccagcagttgccgggtgaatcagatgcagagtatgcagagttctcttccaaggtgctgcatttgaaaggtgataggaaagactttgatttcgtcaagaccagcctctctgctaagggcttcaatgtcgtctatgatattaatgggcgcgaggccactgaagtatcccccatactagaagcgctgccgaacctggaacagtttatctattgctcatcggcaggagtataccttaaatcagacctgctcccacactttgagaccgacgccgtggacccgaaaagccggcacaagggaaagctggagacggagagcctgctggagacgagcggcgtgaactggacgtccatcaggccggtctacatctatggccctctcaactacaaccccgtggaggagtggttcttccaccggctcaaggctggtcgcccgatccccatccctaacgctgggaaccagatcacccagctcggccatgtcaaggatttggcgacggccttcatcaaggtcctcgacaaccccaaggcgagcaagcaggtgtacaacatctccggcagcaagtacgtcaccttcgacgggctagcacgggcatgcgcaaaggctggagggttccctgagccggagatcatccactacaaccccaaggacttcgatttcggcaagaagaaggccttccccttcagagaccagcatttcttcgcgtcggtggagaaggccagcaaggaccttggggttacgccggagtatgatctcctagacggcttgacggactcgtacaatctcgacttcggccgcgggacgttcaggaaggaggccgacttcaccacggacgacatgatcctcggcaagaagctcgtgagcgtgtgagtcgacctgaggcgtccaatggatgggcacatggctcatggcagcgcaaagcgtgtgtggtgactctgcgtgtgcgggtgcatatgtagcacaggcaagatgatctcagttttgggatataggttgaggttcactcatccgatgaaatgtactgctgacacctaattccctcctcgtggcatttggtttatttcggttcagtttatactgtctataataatattggttttc

SEQ ID NO: 3261 - DNA, 1682 bp, Secale cereale
ggatctatgtttgactgacaccagaagaagagaagaggaggaaaacaaatgtcgccatcagttgatcagaatgctgctgcccattaagtggacacgagaaaggatgggaggaggggatccaacagaggatagatagggcgggctccccccctccacacaagccaagacaatctctagcactcatttttcattcctattagcacgcactgaaccacaagtttcagacaagagatataccgccgccatcctggacaggcaaacaaagtcctctcctcctgtttgcacatcgtgttttcagtagcacaagctcagggagagggaagagagatggcggcggcaagcgtctccctgaagagcagcctcttcctgtcttcccctctttccgacttcggcggcgcagccatctccatctcagcccagaataggagaaggtcatggcagccaaggggggcgagaatgcaggtggcagcagctgcagactccaagaacatcctgatcatgggtggcaccaggttcatcggtctcttcctgtccaggaaacttgtccaggagggacaccaggtcacattgttcaccagaggaaaggcacccataacccagcagttgccatgtgaatcagatgcagagtatgcagagttctcctccaaggtgctgcatttgaaaggtgataggaaagactttgacttcgtcaagaccagcctttctgctaagggcttcaatgtcgtctatgatattaatgggcgcgaggccactgaagtatcccccatactagaagcgctgccgaacctggaacagtttatctattgctcatcggcaggagtataccttaaatcagacctgctcccacactttgagaccgacgccgtggacccgaaaagccggcacaagggaaagctggagactgagagcctgctggagacgagcggcgtgaactggacgtccatcaggccggtctacatctacggccctctcaactacaaccccgtggaggagtggttcttccaccggctcaaggctggtcgcccgatccccatccctaacgccgggaaccagatcacccagctcgggcacgtcaaggatttggcgacggccttcatcaaggtcctcgacaaccccaaggcgagcaagcaggtgtacaacatctccggcagcaagtacgtcaccttcgacgggctagcacgggcatgcgcaaaggctggagggttccctgagccggagatcatccactacaaccccaaggacttcgatttcggcaagaagaaggccttccccttcagagaccagcatttcttcgcctcggtggagaaggccagcaaggacctcggggttacgccagagtacgacctcctcgatggcttgacggactcgtacaacctcgacttcggccgcgggaccttcaggaaggaggctgacttcaccacagacgacatgatcctcggcaagaagctcgtgagcgtctgagtcgatctgcggcgtgcatagatggaaacatggctcatagcagcgcaaagcgcgtggcaactgttggtgtgcgggtgcatatgtatcacagggaagatgatctcagttttgggatataggttgaggttcactcatccgatgaaatgtactgctgacacctaattccctcctcgtggcatttggtttatttcggttcagtttatactgtttataataatatt

SEQ ID NO: 3262 - DNA, 1281 bp, Secale cereale
ttttagtagcacaagctcgggagaggggaaacgagaagggaagagagattggcggcggcgagtgtctccctgaagagcagcctcttcctgtcttcccctctttccgacttcggcggcgcagccatctccatctcagcccagaataggagaaggtcatggcagccaaggggggcgagaatgcaggtggcagcagctgcagactcgaagaacatcctgatcatgggtggcaccaggttcatcggtctcttcctgtccaggaaacttgtccaggagggacaccaggtcacattgttcaccagaggaaaggcgcccataacccagcagttgccaggtgaatcagatgcagagtatgcagagttctcctccaaggtgctgcatttgaaaggtgataggaaagactttgatttcgtcaagaccagcctttcagctaagggcttcaatgtcgtctatgatattaatgggcgcgaggccactgaagtatcccccatactagaagcgctgccgaacctggaacagtttatctattgctcatcggcaggagtctaccttaaatctgacctgctcccacactttgagaccgacgccgtggacccgaaaagccggcataagggaaagctggagacggagagcctgctggagacgagcggcgtgaactggacgtccatcaggccggtctacatctacggccctctcaactacaaccccgtggaggagtggttcttccaccgactcaaggctggtcgcccgatccccatccctaacgctgggaaccagatcacccagctcggccacgtcaaggatttggcgacggccttcatcaaggtcctgggcaaccccaaggcgagcaagcaggtgtacaacatctccggcagcaagtacgtcaccttcgacgggctagcacgggcatgcgcaaaggctggagggttccctgagccggagatcatccactacaaccccaaggacttcgatttcggcaagaagaaggccttccccttcagagaccagcatttcttcgcctcggtggagaaggccagcaaggacctcggggttacgccggagtacgacctcctcgacggcttgacagactcgtacaacctcgacttcggccgcgggaccttcaggaaggaggccgacttcaccacggacgacatgatcctcggcaagaagctcgtgagcgtctgagtcgatctgcggcgtgcatagatggaaacatggctcatggcagcgcaaagcgcgtggcaactgtgggtgtgcgggtgcatatgtagcacagggaagacg

SEQ ID NO: 3263 - DNA, 1469 bp, Secale cereale
tcagctttttagtagcaaaaagctcagggagaggggagacagaagggaagagagatggcggcggcgagtgtctccctgaagagcagcctcttcctgtcttcccctctttccgacttcggcagcgcagccatctccatctctgcccagaataggagaaggtcatggcagccaagggggcgagaatgcaggtggcagcagctgcagactccaagaacatcctgatcatggggggcaccaggttcatcggtctcttcctgtccaggaaacttgttcaggagggacaccaggtgacattgttcaccagaggaaaggcacccataacccagcagttgccaggtgaatcagatgcagagtatgcagagttctcctccaaggtgctgcatttgaaaggtgacaggaaagactttgatttcgtcaagaccagcctttctgctaagggcttcaatgtcgtctatgatattaatgggcgcgaggccactgaagtatcccccatactagaagcgctgccgaacctggaacagtttatctattgctcatcggcaggagtctaccttaaatcagacctgctcccacactttgagaccgacgccgtggacccgaaaagccggcataagggaaagctggagacggagagcctgctggagacgagcggcgtgaactggacgtccatcaggccggtctacatctacggccctctcaactacaaccccgtggaggagtggttcttccaccggctcaaggctggtcgcccgatccccatccctaacgctgggaaccagatcacccagctcggccacgtcaaggatttggcgacggccttcatcaaggtcctcggcaaccccaaggcgagcaaggcaggtgtacaacatctccggcagcaagtacgtcaccttcgacgggctagcacgggcatgcgcaaaggctggagggttccctgagccggagatcatccactacaaccccaaggacttcgatttcggcaagaagaaggccttccccttcagagaccagcatttcttcgcctcggtggagaaggccagcaaggacctcggggttacgccggagtacgacctcctcgacggcttgacagactcgtacaacctcgacttcggccgcgggaccttcaggaaggaggccgacttcaccacggacgacatgatcctcggcaagaagctcgtgagcgtctgagtcgatctgcggcgtgcatagatggaaacatggctcatggcagcgcaaagcgcgtggcaactgtgggtgtgcgggtgcatatgtagcacagggaagacgatttcagttttgggatataggctgaggttcactcatccgatgaaatgtactgctgacacctaattccctcctcgtggcatttggtttatttcggttcagtttatactgtttataataatatattaggttttacttaaagtaaaaaaaaaaaaaactaaaagagaacgtagtcaacggacaca

SEQ ID NO: 3264 - DNA, 689 bp, Cenchrus ciliaris
attgagccccctcagcttcttcatcagcgccggcagattcttcgttgtgacatggccggaatccctcttcagggacacgaacttggccttgagcgatcggagctcgacctgcgtgaactgcccctgcagcgaggggtcggacacgacgaccccgacgaatccggcggacatctccccaccgccgcggcccgactccgcccgcgcccgcagcggcctcgctcgctcgcctttccccaccttccccgtcgccgcggcgcccgccagctagggtttcgtgccccgctcccccccgatccgccatgtcgaagcaaggagggaaggccaagccgctgaaggcgcccaaggtcgacaagaaggagtacgacgagtctgatcttgcgtatctgcagaagaagaaagacgaggaaaaggcgttgaaggagctgaaggctaaggcacagaagggtgcgattggtggctctggcctgaagaagagtgggaagaaatgagtctcatatctgtgatacttgggaaatgataaaccttctgcctatatgtgctgcatttcaccaaatgtgattgtaacaaaactattttaagtggttctgtgttagtaatatcgcagttggttgcttgatccgaagatgatgttggctatgatgcagattatctatgataataatgtggcattctaaaatgttgcctttcca

SEQ ID NO: 3265 - DNA, 458 bp, Setaria italica
agccgcagtctcgcttgcctttccccacctcccccgtcgccgcggcacccgccagctagggtttcgtgccccgctcgccgatccgccccgtccgccatgtcgaaacaaggagggaaggccaagccgttgaaggcgcccaaggtcgacaagaaggagtacgacgagtctgatcttgcgtatctgcagaagaagaaagatgaggaaaaggcgctgaaagaactgaaggccaaggcacagaagggtgcgattggcggctctggcctgaagaaaagtgggaagaaatgagtctgttacttgggaaatgataaatcttctgcctatatgtgctgtggttcaccaaatgtgattgtaacaaaactattttaagtgggttctgtgttagtaatgttgcagtcagttgcttgatccgaagatgatgttggctatgatgcagatggttctatgataataacatggca

SEQ ID NO: 3266 - DNA, 758 bp, Eragrostis curvula
  misc_feature (3)..(3): n is a, c, g, or t
  misc_feature (7)..(9): n is a, c, g, or t
ggncccnnnggtgtcggcagcactcgtgtatttaacgccgttctctcgcgcaccttggccgtcttgtctcgtctcgctctcgcttcgcctttcccctcgcctcgtcgccgcggcgctctaccactagggtttcgttcctccgccgatccaccccgtccgccatgtcgaagcaaggagggaaggccaagccgctgaaggcgcccaagaccgataagaaggagtacgacgagagtgaccttgcgtacttgcagaagaagaaagatgaggaaaaggcactgaaggagctgaaggccaaggcccagaagggtgcgattggaggctctggtctcaagaagagtggcaagaaatgagtcttgctacccatcaataactacctagaaaattattatctaagctgcctatctgtattgggctttgcatatgtgactgtaacaatgccaccttgagtgctttctgtgcttagcaaatgttgcagctggttgtttgatctaagatgtttcagcctctctgctagctatgatacagatggtttcgtgatgataataatctggcattctatgatggaagcatgaaaactgttttccaacgaaaaaaaaaaaaaaaaaaaaaaaaaaaagtactcggggttgaaacccgggtttaaccccaagggaattccgggcccccggggggtcaaccattggggaaaccccccaccgcgtgggaggcatagctggaatattcaatagggcccccaaaatagttgggcgaaaccgggg

SEQ ID NO: 3267 - DNA, 712 bp, Zea mays
caaaagcccatactagaaaaggcccttcccgtcccgagttcccccgaccaaaagattcccacgggctcgccgctcgcatctcgccagcgcgaacgcagcctccgtgcatatcaccagcctcctcgcgcacccggtcccgcttgcctttccccacctactcgccgtcgcggtgccgtgcgccggtgctgtccagtctagggtttcggccctcgcccgccgatccgtccccccgccggccatgtcgaagcaaggagggaaggccaagccgctgaaggcgcccaaggtcgacaagaaggagtacgacgagagtgatcttgcttatttgcagaagaaaaaagatgaggaaaaggcgctgaaggagctgaaggccaaggcacagaagggcgcaattggaggctcgggtctcaagaaaagtggaaagaaatgagcattgcccacccacccatctccaaaacacctaagagaacgataagacagctgcttatctgtgttgcgcttcactatatgatatatgtggctgtgagacaatgttgcctcttgtattccgtgtttcgcggtgttccagttggtttgcttgatccgaagatgtttcagcctctcatctgctagctttgatacacgagttatttgctattatgatattcatttgaagtggattcttcggcattgtttgaatgcactagcatatagttagtagctaaaattagttgag

SEQ ID NO: 3268 - DNA, 553 bp, Pennisetum glaucum
cttgcctttccccacctcctccccaccttccccgtcgacgcggcgcccgccaagctagggtttcgtgccccgctcgcccgatccgcccagtccgccatgtcgaagcaaggagggaaggccaagccgctgaaggcgcccaaggtcgacaagaaggagtacgacgagtctgatcttgcgtacctgcaaaagaagaaagatgaggaaaaggcgttgaaggagctgaaggctaaggcacagaagggtgcaattggaggctctggcctgaagaaaagtgggaagaaatgagccccatatctttgatacttgggaaatgataaacctatgtgctgcgtttcaccaaatgtgattgtaacgaaactatttaaagtggttctgtgttagtaatgtcgcagtcggttgcttgatccgaagatgatgtcggctaagatgcagattatctattgttaataacgtggcattctaagatgttgccttttcaatttatttgtgctgaccttttcttttccactttcatgccttcctcaataagcaacttatttgcttgatccatttt

SEQ ID NO: 3269 - DNA, 493 bp, Pennisetum glaucum
cttgcctttccccacctcctccccaccttccccgtcgacgcggcgcacgccaagctagggtttcgtgccccgctcgcccgatccgcccagtccgccatgtcgaagcaaggagggaaggccaagccgctgaaggcgcccaaggtcgacaagaaggagtacgacgagtctgatcttgcgtacctgcaaaagaagaaagatgaggaaaaggcgttgaaggagctgaaggctaaggcacagaagggtgcaattggaggctctggcctgaagaaaagtgggaagaaatgagccccatatctttgatacttgggaaatgataaacctatgtgctgcgtttcaccaaatgtgatcgtaacgaaactatttaaagtggttctgtgttagtaatgtcgcagtcggttgcttgatccgaagatgatgtcagctatgatgcagattatctattgttaataacgtggcattctaagatgttgccttttcaatttatttgtgctga

SEQ ID NO: 3270 - DNA, 589 bp, Sorghum bicolor
gcgcacgcagccgccgagcatatcactcgcctcctcgcccgtctcctctcgctctcgcccacgcgcacccgattcccccgcttgcctttccccacctgtcgcggcgctcgccagtctagggtttcgccccccttcgcccgccgatccgcccccgccggccatgtcgaagcaaggagggaaggccaagccgctgaaggcgcccaaggtcgacaagaaggagtacgacgagagtgatcttgcttatttgcagaagaagaaagatgaggaaaaggcactgaaggagctgaaggccaaggcacagaagggcgcaattggaggctcgggtctcaagaaaagtggaaagaaatgagcctggtcacctgtctctaatacttagagaatgataaggtggctgcttatctgtgttgcgcttcactatatgtgattgtaaccgtgctacctattgtgttctgtgttttgcaaattgcaatgttgcagttggttgcttgatccgaaaatgtttcagcctcgcatctgctatctatgaaactgatggttccctgataataatgatgacattatgtgatggatgccacaagcctacaacaca

SEQ ID NO: 3271 - DNA, 1329 bp, Sorghum bicolor
gggctcgcgtcgcgtctcgcgcacgcagccgccgagcatatcactcgcctcctcgcccgtctcctctcgctctcgcccacgcgcacccgattcccccgcttgcctttccccacctgtcgcggcgctcgccagtctagggtttcgccccccttcgcccgccgatccgcccccgccggccatgtcgaagcaaggagggaaggccaagccgctgaaggcgcccaaggtcgacaagaaggagtacgacgagagtgatcttgcttatttgcagaagaagaaagatgaggaaaaggcactgaaggagctgaaggccaaggcacagaagggcgcaattggaggctcgggtctcaagaaaagtggaaagaaatgagcctggtcacctgtctctaatacttagagaatgataaggtggctgcttatctgtgttgcgcttcactatatgtgattgtaaccgtgctacctattgtgttctgtgttttgcaaattgcaatgttgcagttggttgcttgatccgaaaatgtttcagcctcgcatctgctatctatgaaactgatggttccctgataataatgatgacattatgtgatggatgccacaagcctacaacacaagtttttttcttttagatatttcagtttctgggtagttttatcttgatcccaactaggaatgggaagtcactctttggcctggcctgcactcgagtgagaatcaattttctgtgtggtagtgccgaagaatacatacaccagcaggggcaagataaattcggtgctctatctataacatcttcactttacacaacaatttctttctgatagtgaccgtcccaattgtgtatctatttactctagtgattgtaggcgatgttaaacaaagtatacacatccttgttcgtttggctgataagtcgtggcagaaagtactattgactgatttattatgagaaaaaaaacactgctaaatagctgtcagattcgactgataagcctatacgaacaaggcaatcacttgcttgcatccctggcagtctggcacagatgtttgcatctggatctttgaatccttttgtggtagttttacagctgcttggtctacttctgttcgtgtttacctaataatcctaacaaggtgtttccgtttgctatatactactctgcagatgaagcacgtctttcagggctagtgtacaaagaagagagtagtgatgaaaaagacatcatatagggccttgtttagttccgaaatttttttggttttcgggactgtaacactttcgtttttatttgactaacattgttcaatcatgtaataactaggcttaaaagattc

SEQ ID NO: 3272 - DNA, 568 bp, Saccharum officinarum
gcatatcactcgcctcctcgcccgtctcctttcgctctcgccctcgcgcacccgattccgcttgcctttccccacctactcgccgtcgcggcgctcgccagcctagggtttcgccccctcgcccccgatccgcccccgccggccatgtcgaagcaaggagggaaggctaagccgctgaaggcgcccaaggccgacaagaaggagtacgacgagagtgatcttgcttatttgcagaagaagaaagaggaggaaaaggcactgaaggagctgaaggccaaggcacagaagggcgcaattggaggctcgggtctcaagaaaagtggaaagaaatgagcctggtcgcctgtctctagtacctagagaatgataaggcagttgcttatttgtgttgcggttcactatatgtgattgtaacagtgctacctattgtgttctgtgtttcgcaatgttgcagttggttgcttgatccgaagatgtttcagcctcgcatctgctagctatggtactgatggttccctgataataatgatgacattatgtgatggatgccacaacacaagttttttgc

SEQ ID NO: 3273 - DNA, 498 bp, Saccharum officinarum
cttgcctttccccacctactcgccgtcgcggcgctcgccagcctagggtttcgccccccgcccgccgatccgcccccgccggccatgtcgaagcaaggagggaaggctaagccgctgaaggcgcctaaggctgacaagaaggagtacgacgagagtgatcttgcttatctgcagaagaagaaagaggaggaaaaggcactgaaggagctgaaggccaaggcacagaagggcgcaattggaggctcgggtctcaagaaaagtggaaagaaatgagcctggtcgcctgtttctagtacctagagaatgataaggcagttgcttatttgtgttgcggttcactatacaccctccatccctaaatgtttgtctctataaaaccgtgtttccctcacaaacacgtttcccgagcgacaaacaaaaagggacagagtagtatgtgattgtaacagtgctacctattgtgttctgggttcgcaatgtagcagtggttgcttgatc

SEQ ID NO: 3274 - DNA, 477 bp, Triticum aestivum
tgcctttccccacctgtcgcggtgctcgccagtctagggtttcgccccccttcgcccgccgatccgcccccgccggccatgtcgaagcaaggagggaaggccaagccgctgaaggcgcccaaggtcgacaagaaggagtacgacgagagtgatcttgcttatttgcagaagaagaaagatgaggaaaaggcactgaaggagctgaaggccaaggcacagaagggcgcaattggaggctcgggtctcaagaaaagtggaaagaaatgagcctggtcacctgtctctaatacttagagaatgataaggtggctgcttatctgtgttgcgcttcactatatgtgattgtaaccgtgctacctattgtgttctgtgttttgcaaattgcaatgttgcagttggttgcttgatccgaaaatgtttcagcctcgcatctgctatctatgaaactgatggttccctgataataatgatgacatt

SEQ ID NO: 3275 - DNA, 481 bp, Triticum aestivum
  misc_feature (296)..(296): n is a, c, g, or t
  misc_feature (361)..(361): n is a, c, g, or t
  misc_feature (374)..(374): n is a, c, g, or t
  misc_feature (397)..(397): n is a, c, g, or t
  misc_feature (423)..(423): n is a, c, g, or t
  misc_feature (441)..(441): n is a, c, g, or t
  misc_feature (443)..(443): n is a, c, g, or t
  misc_feature (455)..(455): n is a, c, g, or t
cccggttccgcgtgcctttccccacctactctcgcggctctcgccaaccaagtctagggtttcggtcccggcgtgcttatccgcccccgccggccatgtcgaagcaaggagggaaggccaagccgctgaaggcgcccaaggccgacaagaaggagtacgacgagacggatcttgcatatctgcagaagaagaaagatgaggaaaaagcactgaaggagcttaaggccaaggcacagaagggcgcgattggggggtcgggtctgaagaaaattgggaaagaaatgagactggcaccntctccaatacctaagaggatgataagcactgtctactgtgttgccctcacaatgtgattgtacangggactccttgtntctgtttcccccatttgcattgntgcttgatccaaaagttcaactcccnctgctactatgatacagngnccctgataatangatgacatattgtgaaaaaaaaaaaa

SEQ ID NO: 3276 - DNA, 534 bp, Cynodon dactylon
gccgggggccgtctcgctctcgctcctcgactttcccctcccatcctcgttgccgcggcgcccaacctctagggtttcgtcctcggccgatccgccccgtacgccatgtcgaagcaaggagggaaggccaagccgttgaaggcgcccaagaccgagaagaaggagtacgacgagtctgacctcgcgtacttgcagaagaagaaagatgaggaaaaggcactgaaggagctgaaggccaaggcacagaagggtgcgattggaggctctggtctcaagaagagtggcaagaaatgagccttcgtatccatctctaatacctagtagaaaattattatccaagcagcctatctgtattgggcgttgcagtatgtgactgtaagaatgcaaactttcagtgttttatgtgcttcgcaaacgttgtagttggttgtttgatcgaagatgtttcaacctctctactaccatctatgatacagatggtttcctaatggtaataatatgccatgttctgcgatggaagcatggaatgcttgc

SEQ ID NO: 3277 - DNA, 498 bp, Panicum virgatum
ggccccgtctcctcccgcagtctcgctcgctcgcctttccccacacagctagggtttcgtcgccccgcgcgccgatccgccccccgtccgccatgtcgaagcaaggagggaaggccaagccgctcaaggcgcccaaggccgacaagaaggagtacgacgagagtgatcttgcatatctgcagaagaagaaagaggaggaaaaggcactgaaggatctgaaggccaaggcacagaagggtgcgatcggaggctctggcttgaagaaaagcgggaagaaatgagtctgtcatgcgtatctgggaaatgataaaccccctgccttatgtgctgtgtttggccatatgtgattgtaacaaactagtggttctgtgttagtaatgctgcagttggttgcttgatccgaaaagatgatgttggctatgatccgaaaacatggcattctaagatgttatctcaaattttctgtgctgattttgttttcattgccatttcgtcctt

SEQ ID NO: 3278 - DNA, 715 bp, Oryza sativa
gcccaatacaagatggtctagagaacttaatgggccaacaaaccaaggcccagcccaatacagccacaatcatgagattcccattcgcagccgcgaccaaccactacactaggctaggctagctatatacgcctctgcctctcgcgtctcccatttcctcgcctttcccttcttccatctcctcctcgtcgtcgcggcgcgcgagctagggtttctcgactcgccctcgccgatccggtcagccatgtcgaagcaaggagggaaggccaagcccctcaaggcgcccaaggccgagaagaaggagtacgacgagagtgatctcgcgtatctgcagaagaagaaagatgaggaaaaggcactgaaggagcttaaggccaaggcaggacagaagggtgcactgggaggctctggtctgaagaagagcgggaagaaatgaggctgataccaatctgtaatgcctgaaaaatgataaaccagctacctgtctgtgttacttcactatgtgcggatgtaacaaaactacctttaagcatgttatgcattaagcaatgttgcagttggttgcttgatccgaagatgtttcgggctctcttctgctagctatgatacatctggtcccgtatgatgataatataacataactcatggtgaaaattccacttgtttgcgctcaagtcttgcagtttctttgctatatgattgattgatctgattc

SEQ ID NO: 3279 - DNA, 560 bp, Oryza sativa
acactaggctaggctagctatatacgcctctgcctctcgcgtctcccatttcctcgcctttcccttcttccatctcctcctcgtcgtcgcggcgcgcgagctagggtttctcgactcgccctcgccgatccggtcagccatgtcgaagcaaggagggaaggccaagcccctcaaggcgcccaaggccgagaagaaggagtacgacgagagtgatctcgcgtatctgcagaagaagaaagatgaggaaaaggcactgaaggagcttaaggccaaggcaggacagaagggtgcactgggaggctctggtctgaagaagagcgggaagaaatgaggctgataccaatctgtaatgcctgaaaaatgataaaccagctacctgtctgtgttacttcactatgtgcggatgtaacaaaactacctttaagcatgttatgcattaagcaatgttgcagttggttgcttgatccgaagatgtttcgggctctcttctgctagctatgatacatctggtcccgtatgatgataatataacataactcatggtgaaaattccacttgtt

SEQ ID NO: 3280 - DNA, 483 bp, Panicum virgatum
gagtctccctcgctcgctcgcctttccccacctcccccctcgtcgccgcggcgcccgccagctagggtttcgtgcccccgcgcgccgatccgccatgtcgaagcaaggagggaaggccaagccgctcaaggcgcccaaggtagacaagaaagagtacgacgagtctgatcttgcgtatctgcagaagaagaaagaggaggaaaaggcactgaaggatctgaaggccaaggcacagaagggtgcaatcggaggctctggcttgaagaaaagcgggaagaaatgagtctgttatgtgtatctgtgatacttgggaaatgataaacctcctgccaatatgtgctgtctttggccatatgtgattgtgacaaaactagtggttctgtgttagtaatgctgcagttggttgcttgatccgaaaagatgatgttggctatgatgcagatggttctatgataataacaaggcattctaagatgttatcac

SEQ ID NO: 3281 - DNA, 641 bp, Fagopyrum esculentum
ttcggtcttcgtataactcacgccatatccgtcgaggaacagaacttagcagatcaaaccctaaccctagacgaacgcagccatgtctaagcaaggtggaaagttgaagcccttgaaggcacccaaaactgataagaaagagtatgacgagtcagacttggcatatcttcagaagaagaaggacgaggaaaaggcattgaaggaacttaagacgaaggcacagaaaggagcattgggaggctcgggtctgaagaagagtgggaagaaatgaggattctcgacacaacaatgatgcttgtgcttgaaattggtgctcatgttatctcaagtgcttttctcttatgaatcgttaactggcttgtcatattaacctaaataaaactcgactctggtttgtgtttgcttacattgtgaactttacttcgaaacatatctctcgtagcaatgtgtgcaacaagtgaccaatatatgtggccttgtaaatttgacgcgagcagatcatcaaccttcgaagatctcgagaatgcaattagtgaatgccttacaaaagtcatcaattgtctcaactatgctactataacttttagttattgaaagagtgattacgtctttcaacttattctaaagtttcaactatacac

SEQ ID NO: 3282 - DNA, 626 bp, Fagopyrum esculentum
tccgtttaactcacgccatctctgtcgaggaacagaatttagcagatcaaaccctaaccctagacgaacgcagccatgtctaagcaaggtggaaagttgaagcccttgaaggcacccaaaactgataagaaagagtatgacgagtccgacttggcatatcttcagaagaagaaggacgaggaaaaggcattgaaggaacttaagacgaaggcacagaaaggagcattgggaggctcgggtctgaagaagagtgggaagaaatgaggattgtcgacacaacaatgatccttgtgcttgaaattggtgctcatgttatctctccgtgcttttctcttatgaatcgttaactggcttgtcatattaacctaaataaacaaaattctggtttgtgtttgcattgtgaactttactttgaagcatgtctctcgtggcaatgtctgcaacaagtgaccaatatatgtggcctttgtaaatttgacgcgagtagatcattaaaccttacatagatctctagaatgcgatttacactaatgccctgttttttccgttactaaaaaaagaaacaactaaactagtcgtgtagtaaccacctacgtcttcttcgtagaacgtacgccaacggacga

SEQ ID NO: 3283 - DNA, 504 bp, Cynodon dactylon
gactttcccctcccatcctctcgccgcggcgcgcaacctctagggtttcgtcttccgccgatccgtcccgtcaaccatgtcgaagcaaggagggaaggccaagccgttgaaggcgcccaagaccgagaagaaggattacgacgagtctgacctcgcctacttgcagaagaagaaagaggaggaaaaagcactgaaggagctgaaagccaaggcgcagaagggtgcgattggaggctctggtctcaagaagagtggcaagaaatgagtctttgtacccatctgtaatacctagaaaattattatccaaccagcctatctgtattgggcgttgcagtatgtgactgtaagaatgccacatttaagtgttttctgtgcttagcaaacgttgcaattggttgtttgatcgaagatgtttcagcctctactgctagctatgatacagatggtttcctaatggtaataatatgacatgctctgtgatggaagcatggaatgtttgcaatc

SEQ ID NO: 3284 - DNA, 501 bp, Brachypodium distachyon
ctcccctgcccaaattcttctcgcctttcccttcctcctgtcctcatcgtcgcggcccttccgaactagggtttctcgcctctcctgcccggccaccgctcccatcagccatgtcgaagcaaggaggcaaggccaagccgctgaaggcgcccaaggccgcggagaaggactacgacgagactgaccttgcatatcttcagaagaagaaggatgagcaaaaggcactgaaggagcttaaggccaaggcaacccagaagggtgctctgggaggttctggtctgaagaagagtgggaagaaataaggctagctatccgtatgtagtgcccagaaaatgatgaatcgtctacatatctgtgttgcgcttcagtatttatggttgtaacaaactaccttaagtgtgtcgagcgtcaagcaacgcctctatccaagtgtgtttcagcctatcttagctatgatgcgggtgcttctctatgataataatctgatatgatggaacacgg

SEQ ID NO: 3285 - DNA, 923 bp, Brachypodium distachyon
aactcctgtcttatatagccttttctctctctcccttcccctcccctgcccaaattcttctcgcctttcccttcctcctgtcctcatcgtcgcggcccttccgaactagggtttctcgcctctcctgcccggccaccgctcccatcagccatgtcgaagcaaggaggcaaggccaagccgctgaaggcgcccaaggccgcggagaaggactacgacgagactgaccttgcatatcttcagaagaagaaggatgagcaaaaggcactgaaggagcttaaggccaaggcaacccagaagggtgctctgggaggttctggtctgaagaagagtgggaagaaataaggctagctatccgtatgtagtgcccagaaaatgatgaatcgtctacatatctgtgttgcgcttcagtatttatggttgtaacaaactaccttaagtgtgtcgagcgtcaagcaacgcctctatccaagtgtgtttcagcctatcttagctatgatgcgggtgcttctctatgataataatctgatatgatggaacacggaaatttgtagtgttcgtgcccaagcttctcattttgctttggcagtttgattgtcttcgtcacttggcatattatcttctgtctgctagcaaccaaagaatgcatctcttaggcgcttgcttccttgcagttaagatatctgggtaacagattgcaaaatcatggactgtatgcattggcgatgacttgagacaaagataataatccagattcaggcgttgagtgtcagctatcaagaatgaaaatgctgggaagcgattcatgcttgaaggatgtagtcactcgttactgttccttcatcctcatgcaagcatgttttatcccctttgctactccctctgttacctacataaagcagatcaaatgtgctttccaagaccat

SEQ ID NO: 3286 - DNA, 354 bp, Bupleurum chinense
taattattaaccatgtcgtccaagcaaggtggaaaagctaagcctttgaaagcacccaaggctgaaaagaaggaatacgacgaggatgatttggctaaacttcagaagaaaaaggaagaggaaaaggcactgaaggagctcaaagcgaaggctcaacagaaaggcgcatttggaggttctgggctaaagaaaagtgggaagaaatgagtcttcagtaatgctgaagccgatgctttgtgacttgtatttctattgtataatatgatttggtttgaggacattggctggggttgtacaacgtactaacagatgctgaaccttcgtaccatgtcctatggataccattaataagat

SEQ ID NO: 3287 - DNA, 486 bp, Bupleurum chinense
ttaaccatgtcgtccaagcaaggtggaaaagctaagcctttgaaagcacccaaggctgaaaagaaggaatacgacgaggatgatttggctaaacttcagaagaaaaaggaagaggaaaaggcactgaaggagctcaaagcgaaggctcaacagaaaggcgcatttggaggttctgggctaaagaaaagtgggaagaaatgagtcttcagtaatgctgaagccgatgctttgtgacttgtatttctattgtataatatgatttggtttgaggacattggctggggttgtacaacgtactaacagatgctgaacctttgtaccatgtcctatgtataccattaataagattgtaagcttgttgtttatgcagacaatttgtgttttcaagttttaataccttaatctgtgttgagcgaattgaccaaaaaaaagatatactgtatacagtaacagttgaaaacttgcatgttctaagaacatgctatc

SEQ ID NO: 3288 - DNA, 424 bp, Bupleurum chinense
aacagctgctgaactgtacaacaccaaccaacccctttcttacgaaaaaccctaacctaataattaaccatgtcgtccaagcaaggtggaaaagctaagcctttgaaagcacccaaggctgaaaagaaggaatacgacgaggatgatttggctaagcttcagaagaaaaaggaagaggaaaaggcactgaaggagctcaaagcgaaggctcaacagaagggcgcatttggtggttctgggctaaagaaaagtgggaagaaatgagtcttcagtatcgctgaagctgatgctttgtgacttgtatttctgttgtataatatgatttggtttgaggattggttggggttggacaacgtaccaacagatgttgaacctttgtaccatgtccaatgtataccattaataagattgtaagcttgttgtt

SEQ ID NO: 3289 - DNA, 435 bp, Bupleurum chinense
aacagctgctgaactgtacaacaccaaccaacccccttttcttcggaacaaccctaaccctaataattaaccatgtcgtccaagcaaggtggaaaagctaagcctttgaaagcacccaaggctgaaaagaaggaatacgacgaggatgatttggctaaacttcagaagaaaaaagaagaggaaaaggcactgaaggagctcaaagcgaaggctcaacagaagggcgcatttggtggttctgggctaaagaaaagtgggaagaaatgagtcttcagtatcgctgaagctgatgctttgtgacttgtatttctgttgtataatatgatttggtttgaggattggttggggttggataacgtaccaacagatgttgaacctttgtaccatgtccaatgtataccattaataagattgtaagcttgttgtttgtgcaaa

SEQ ID NO: 3290 - DNA, 446 bp, Bupleurum chinense
aacagctgctgaactgtacaacaccaaccaacccctttcttcgaaaaaccctaaaccctaataattaaccatgtcgtccaagcaaggtggaaaagctaagcctttgaaagcacccaaggctgaaaagaaggaatacgacgaggatgatttggctaagcttcagaagaaaaaggaagaggaaaaggcactgaaggaactcaaagcgaaggctcaacagaagggcgcatttggtggttctgggctaaagaaaagtgggaagaaatgagtcttcagtatcgctgaagctgatgctttgtgacttgtatttctgttgtataatatgatttggtttgaggacattggttggggttggacaacgtaccaacagatgttgaacctttgtaccatgtcctatgtataccattaataagactgtaagcgtgtttttgtgcagacaatttgtgttt

SEQ ID NO: 3291 - DNA, 448 bp, Bupleurum chinense
aacagctgctgaactgtgcaacaccaaccaaccccttttactacgaaaaaaccctaacctaataattaaccatgtcgtccaagcaaggtggaaaagctaagcctttgaaagcacccaaggctgaaaagaaggaatacgacgaggatgatttggctaaacttcagaagaaaaaggaagaggaaaaggcactgaaggagctcaaagcaaaggctcaacagaagggcgcatttggtggttctgggctaaagaaaagtgggaagaaatgagtcttcagtatcgctgaagctgatgctttgtgacttgtatttctgttgtataatatgatttggtttgaggacattggttggggttggacaacgtaccaacagatgttgaacctttgtaccatgtcctatgtataccattaataagactgtaagcgtgttgtttgtgcagacaatttgtgttt

SEQ ID NO: 3292 - DNA, 681 bp, Eucalyptus grandis
tttatcaacgagtgcccattacggccgggggtgccataattgagttgcggtgttcggtcgatttccgcgtgctctctcggttcgtcgaatcctctgaatcgggcaccaaaccctaaccctagattcgcgatcatgtcgtccaagcaaggtggcaaggcgaagcctttgaagcagccgaaggctgataagaaggagtacgacgagaatgatttggcctaccttcaaaagaagaaggaagaagagaaggcattgaaggagcttaaagccaaggctacgcagaagggatcccttggaggatctggactcaagaagagtggcaagaagtgagggttgtctccaacaatgattggaatacaggacattagatttgggcactgtgattacatctgtattgaacctcgtttaggtcaagtatgaccgtcctgtgtcgttctacttgtgtttgtgcttgtgttttaatggagactaatcagatcacttaaagctgtgtgtcagttacgctgcttgtccttaattatcgcatggcattgatttctgattgtgctttagctggcaactgctgattattgaatcgaacaatgttcctttcgaatgttttaaattgacatgcttagtagggcaataaatgtattcatcctcggttgtggtcgctgtctctattgaaatgctggtctacgacaa

SEQ ID NO: 3293 - DNA, 655 bp, Ricinus communis
aaaaaggtaaggataaaaactgtcttcggctaaacttaagggatgtgattgtaattgttacaaataattttggtacaaaaactagcggccaccatcgatcacgagatgcgcacgtgcaacttccaccatttatttaccgataattgcctgtcctgaattagggttaggcgtttttttccatctttctctcaaattctctctcgattcttcaaattcaagcactaaccctaaccctaactaccagccatgtcttccaagcaaggtggaaaagccaagccattgaagcaaccaaaggctggcaagaaggaatacgacgagactgatttggccaacattcagaaaaagaaggacgaggaaaaggcactcaaggagctcaaagccaaggcagcacagaaaggagctcttggaggttccggtctcaagaagagcggaaaaaaatgagggttctgaaaacccaaatcagaatagaatatatgattcatgctatgtgattatagataatactatgttgacatgttttctcaagtgtgatgggctgtgacatctttgcttagtgtgacaagtctatgttcgtgctaaatgctactgaacttcgacttaatgtcattttgtgacactcaataaaccttttgtactctccccttgtgccaagatt

SEQ ID NO: 3294 - DNA, 722 bp, Ricinus communis
aaaaaggtaaggataaaaactgtcttcggctaaacttaagggatgtgattgtaattgttacaaataattttggtacaaaaactagcggccaccatcgatcacgagatgcgcacgtgcaacttccaccatttatttaccgataattgcctgtcctgaattagggttaggcgtttttttccatctttctctcaaattctctctcgattcttcaaattcaagcactaaccctaaccctaactaccagccatgtcttccaagcaaggtggaaaagccaagccattgaagcaaccaaaggctggcaagaaggaatacgacgagactgatttggccaacattcagaaaaagaaggacgaggaaaaggcactcaaggagctcaaagccaaggcagcacagaaaggagctcttggaggttccggtctcaagaagagcggaaaaaaatgagggttctgaaaacccaaatcagaatagaatatatgattcatgctatgtgattatagataatactatgttgacatgttttctcaagtgtgatgggctgtgacatctttgcttagtgtgacaagtctatgttcgtgctaaatgctactgaacttcgacttaatgtcattttgtgacactcaataaaccttttgtactctccccttgtgccaagattcattttgcttgcatttgtttcaaactggatatcattagtctcgtacatccctcccattaagtgcttt

SEQ ID NO: 3295 - DNA, 650 bp, Eucalyptus grandis
gtcgtgccataattgagttgcggtgttcggtcgatttccgcgtgctctctcggttcgtcgaatcctctgaatcgggcaccaaaccctaaccctagattcgcgatcatgtcgtccaagcaaggtggcaaggcgaagcctttgaagcagccgaaggctgataagaaggagtacgacgagaatgatttggcctaccttcaaaagaagaaggaagaagagaaggcattgaaggagcttaaagccaaggctacgcagaagggatcccttggaggatctggactcaagaagagtggcaagaagtgagggttgtctccaacaatgattggaatacaggacattagatttgggcactgtgattacatctgtattgaacctcgtttaggtcaagtatgaccgtcctgtgtcgttctacttgtgtttgtgcttgtgttttaatggagactaatcagatcacttaaagctgtgtgtcagttacgctgcttgtccttaattatcgcatggcattgatttctgattgtgctttagctggcaactgctgattattgaatcgaacaatgttcctttcgatgttttaaattgacatgcttagtagggcaataaatgtattcatcctcggttgtggtcgctgtctctattgaaatgctggtctacga

SEQ ID NO: 3296 - DNA, 412 bp, Bupleurum chinense
ccccctttaccttcgaaaaaaccctaaccctaatattaacgtgtcgtccaagcaaggtggaaaagctaagcttgaaagcacccaaggctgaaaagaaggaatacgacgaggatgatttggctaaacttcagaagaaaaaggaagaggaaaaggcactgaaggagctcaaagcgaaggctcaacagaagggcgcatttggtggttctgggctaaagaaaagtgggaagaaatgagtcttcagtatcgctgaagcgatgctgaagctgatgctttgtgacttgtatttctgttgtataatatgatttggtttgaggacattggttggggttggacaacataccaacagatgttgaacctttgtaccatgtcctatgtataccattaataagattgtaagcttgttgtttgtgca

SEQ ID NO: 3297 - DNA, 401 bp, Vinca minor
ttgccgctgttcacgtttctttctgtgatcagacaaatcgaaaaacctagccctagaatcgcaataatcatgtcttccaagcaaggtggaaaagctaagcctttgaaggcaccaaaggctgataagaaagaatatgacgaggaagataaggctttccttcagaagaagaaagaggaggaaaaggcactaaaggagctgaaggcaaaggctcaaaaaggatccatcggtggcgcaggtttgaagaaaagtgggaagaagtgatgctttagggaaataacaataaccttttaaaggattcttgtatcaagattgggtcattttcttgtttgttctacatgttaggacttgctttctactgttgtttcaattatagaccatgtgaaattctatctttctatgag

SEQ ID NO: 3298 - DNA, 257 bp, Fraxinus spp
accttttcattttcaagcgattacgtgatcacagcgaaaccctaacctagattttaacaatgtcttccaagcaaggtgggaaagcgaagaccttgaaagcaaccaaaggctgacaagaaagagtacgacgaggatgacaaggcttttctacagaagaagaaggaagaggagaaggctctgaaggagcttaaaagcaaaggctcaaaagggagcgcttggaggcgccgggctgaagaaaagtggaaagaaatgaaact

SEQ ID NO: 3299 - DNA, 610 bp, Malus domestica
atgtccgaatttccgaatttagctactcaagacacagagattcaaagagaatctcaacttcttatatggcatagtgaattgccattcgggcggctgcgtgttattgcaagtagggttgtcctgactcccgtggatttgtggtcgctctcaaataccaaccgagcaagccttttgccctagatcccagccatgtcttccaagcaaggtggaaaagcaaagcccttgaaggcacccaaggccgacaagaaggagtacgacgagtccgatttggccaaccttcagaagaagaaagaggaggaaaaggcactgaaggagcttagagccaaggcacaacagaaagggtccttcggaggttctgggctcaagaaaagcgggaagaaatgagtgggtttatcgaaccccaatccgggatacaatatattgttcttgagctgtaattatgaactctgttgtgttaacgtctttcaattcatgttattgtcgagcatctaatgtgcgcgagatgctcgagtgaatttcagtgtgtaacattatgacccggtctaaataaattgagttgtccaatcttaagcttttctgagttgtttctagtgttaccatgtttgttttt

SEQ ID NO: 3300 - DNA, 479 bp, Malus domestica
gggcagctgcgtattattgcgaatagggctgtcctgtggatttgtcgttgctcccaattccaaccgagcaagacttttgccctagatcgcagccatgtcttccaagcaaggtggaaaagctaagcccttgaaggcacccaaggccgataagaaggagtacgacgagtccgatttggccaaccttcagaagaaaaaagatgaggaaaaggcactgaaggagcttagagccaaggcacaacagaaggggtcattcggaggtgctgggctcaagaaaagtgggaagaaatgagtgggtttatccaaccccaagctgggatacaatatatcgatcttgagctgtaattacgaactctattgtgttggcgtctttcaatttatgcgctgttctagtttctaatgtgcgctagatctagcttgagtgaatttcagtgtgcaacattatgacccagtctaaataaattgagtttgtctaatctgaa

SEQ ID NO: 3301 - DNA, 451 bp, Lippia dulcis
ggaatttggttagggcatcatattgatcacttttattcgcagcgagaccctaaccatacaattcaatcatgtcaaccaagcaaggaggaaaagccaagcctttgaagcaacccaaggctgagaagaaagagtacgacgagaccgacaaggctaatattcaaaagaagaaagaagaagagaaggctcttaaggagctcaaggcaaaggcccagcagaaaggggcgtttggcggttctggtctgaagaaaagtggcaaaaaatgagtccagaagcaacgtggtgaaatagctagctagctcgttgcttgccattgttacttgttctgtttgtcaatttctatgtacgtaatttaaacatgttagcttgttcccactaatggttatcgagccgtgaagggattgtggatgtaagtttgtatgttcaacaattgaatctatgagatgacttatgt

SEQ ID NO: 3302 - DNA, 494 bp, Malus domestica
tgcgtgttattggaagtagggttgtcctgactcccgtggatttgtggtcgctctcaaataccaaccgagcaagccttttgccctagatcccagccatgtcttccaagcaaggtggaaaagcaaagcccttgaaggcacccaaggccgacaagaaggagtacgacgagtccgatttggccaaccttcagaagaagaaagaggaggaaaaggcactgaaggagcttagagccaaggcacaacagaaagggtccttcggaggttctgggctcaagaaaagcgggaagaaatgagtgggtttatcgaaccccaatccgggatacaatatattgttcttgagctgtaattatgaactctgttgtgttaacgtctttcaattcatgttattgtcgagcatctaatgtgcgcgagatgctcgagtgaatttcagtgtgtaacattatgacccggtctaaataaattgagttgtccaatcttaagcttttctgagcctcgtg

SEQ ID NO: 3303 - DNA, 446 bp, Malus domestica
tcctgtggatttgtcgttgctcccaattccaaccgagcaagacttttgccctagatcgcagccatgtcttccaagcaaggtggaaaagctaagcccttgaaggcacccaaggccgataagaaggagtacgacgagtccgatttggccaaccttcagaagaaaaaagatgaggaaaaggcactgaaggagcttagagccaaggcacaacagaaggggtcattcggaggtgctgggctcaagaaaagtgggaagaaatgagtgggtttatccaaccccaagctgggatacaatatatcgatcttgagctgtaattacgaactctattgtgttggcgtctttcaatttatgcgctgttctagtttctaatgtgcgctagatctagcttgagtgaatttcagtgtgcaacattatgacccagtctaaataaattgagtttgtctaatctg

SEQ ID NO: 3304 - DNA, 441 bp, Arabidopsis lyrata
attcgatgccgtctgcaactctcagctactttttccccaaattctgagctcaacatcgaaccctagctcaacgaaccaatcaatcatgtcttccaagcaaggaggaaaggcgaaacctttgaagcagccaaaagctgataagaaggaatacgacgagaccgacttagctaacattcagaaaaagaaagatgaggaaaaggctcttaaagagcttagagccaaggcatcgcagaagggatcctttggaggttctggacttaagaagagtggcaagaaatgatccgttttatccatgaagggtgttaaaatgcaaatttatcaagttaaaaaacagataatcgtgtgatgatgtaactttttatcataattcgagagaagagtaacttcgcttctccttacagttttcatgaaaaggaaaaatggtatctaccttaaaatcat

SEQ ID NO: 3305 - DNA, 482 bp, Arabidopsis thaliana
accgtagccccaatcagagagattcgataccgtctgcaactctcagctactttttccccaattttgagctcaacatcgaaccctagctcaacgaaccaatcatgtcttccaagcaaggaggaaaggcgaaacctttgaagcagcctaaagctgataagaaggaatacgacgagactgacttagctaacattcagaagaagaaagatgaggaaaaggcccttaaagagcttagagccaaggcatcgcagaagggatcctttggaggttctggacttaagaagagtggcaagaaatgatccgttttatccatgaagtgtgttttaaaatgcaaatttatcaagtgaaaaaaacagataatcctgtgttgatgtaactttttatcataattcgagaagagtaacttcgcttctccatacatatgtttgctttctccattttttcatgaaaaagaaaagtggtatctaccctaaaatcattttgtc

SEQ ID NO: 3306 - DNA, 485 bp, Panax ginseng
attcaatcccacctttgttaaggccgccttgtcttccatattccgggccttctttctagatcagaaaaaaccctaaccctaaaaatcaacaatgtcgtcaaagcaaggtgggaaagcaaagcctttgaagcagcccaaggctgaaaaaaaagaatatgatgaggatgatttggctaaactccagaagaagaaggaagaggaaaaggcactcaaggagctcaaagccaaagctcaacagaagggtgcttttggaggttctgggctaaagaaaagcgggaagaaatgagtcttcaatatcaatagacacggaggcttttgtgtcatgcttctatgatgtattttgtaatttggttggacatcattggtttcatttgtaccaagtttaccgcgtgacttatcctatgcaaaaccataaataaaattatcaacctttaatgttttctgagaaaccatccctttaataatggtttgcgggttgatcctta

SEQ ID NO: 3307 - DNA, 584 bp, Brassica napus
attctagaggccggggaccgaccttttttttttccccaattcgcatcaagccctagctcaacagactagtcatgtcgtccaagcaaggaggaaaggcgaaacctttgaagcagccaaaggctgataagaaggaatacgatgagcatgatatggccaacctgcagaagaagaaagacgaggaaaaggcacttaaggaactaagagccaaggcgtcgcagaagggatcctttggaggctctggacttaaagaagagcggcaagaaatgatccgttttaatcatgaagcttgtattcgacagtgcaaatttatcaacttaataacagataatcgtgtgtttgtgtaacttgtatcatgtttctaggagagtgactttgcgtcttcgctttcgccactttttcatataatattgataaatggtttctatcctgatgttgtcgtagttctcctgattcaggattcagtcatgtttctgcatctcagggtccagttttaaacatatgttggttaggtaactgagagggacatgtgtgttttaccaaagatgaatgtgaaatatatgtgagaagggcagcagctatttatg

SEQ ID NO: 3308 - DNA, 560 bp, Brassica napus
tttttttttccccaattcgcatcaagccctagctcaacagactagtcatgtcgtccaagcaaggaggaaaggcgaaacctttgaagcagccaaaggctgataagaaggaatacgatgagcatgatatggccaacctgcagaagaagaaagacgaggaaaaggcacttaaggaactaagagccaaggcgtcgcagaagggatcctttggaggctctggacttaaagaagagcggcaagaaatgatccgttttaatcatgaagcttgtattcgacagtgcaaatttatcaacttaataacagataatcgtgtgtttgtgtaacttgtatcatgtttctaggagagtgactttgcgtcttcgctttcgccactttttcatataatattgataaatggtttctatcctgatgttgtcgtagttctcctgattcaggattcagtcatgtttctgcatctcagggtccagttttaaacatatgttggttaggtaactgagagggacatgtgtgttttaccaaagatgaatgtgaaatatatgtgagaagggcagcagctatttatg

SEQ ID NO: 3309 - DNA, 739 bp, Raphanus sativus
gggtagttgtaaatgttttctttataaggcttgtgtagtaccatcgaaacataaaccttctactacatttttgcttctatcttataagacagaggaagacatgatttaaagcttttgcttctatcttattcaaaaaacataaaacataaagcttctatcttgttttccttttaccacatattctcaaataatttcagtttaccacatttattttccaaattcacatttcttgcttctcactttcttaaatggcatcttcttcttcttctaataatattgaagacattatggatgaacaattcgaccaatttttcgatgaaaaatttgatcaacttttcgatcaacgattcgaaaatctttttaatcgtcatgatcagcatcaaaccctagggctcgaggaaccagccatgtcgtccaagcaaggaggaaaggcgaaacctttgaagcagccaaaagctgataagaaggaatacgatgagccgatatggccaaccttcagaagaagaaagacgaggaaaaggcacttaaagaactaagagccaaggcatcgcagaagggatcttttggaggatctggtcttaagaagagtggcaagaaataatcccgttttgtatccatgaagcctgtctttgacagagtgcttatttatcaacttataatgttgtgtaacttcctatcatatctgtaggggagtgacttttccttatcccataacataacatatgttttgctttcgcca

SEQ ID NO: 3310 - DNA, 457 bp, Vinca minor
agacaaatcgaaacctagccctagccctagaatcgcaatcatgtcttccaagcaaggtggaaaagctaagcctttgaaggcaccaaaggctgataagaaagaatatgatgaggaagataaggctttccttcagaagaagaaagaggaggaaaaggcactgaaagagctgaaggcaaaggctgcaaaaggatccatcggaggcgcaggtttgaagaaaagtgggaagaagtgaagctttagggaaataaaaataacctttctaaaggattcttgtatcaagattggcaattatcttgttcgttctgcatgttgggacctgctttccactgttgtttccaactatagaccatgtgaaattgaatctcttttatgagtatttgcaccttagtcatgtagcaattgtgtatccattggctttaactgctactactaatttatgggttatgctttgtgaaaa

SEQ ID NO: 3311 - DNA, 585 bp, Solanum melongena
aaaaaagctagtttgggtcagtggaggagggcatttccgttctcatcaacagatccaaactcttaacctagataatcaaccatgtcttctaagcaaggtggaaaggcaaagcctttgaaggcaccaaaggctgataagaaggagtacgatgagaatgacaaggcctttcttgcaaagaagaaagaagaagaaaaggccctaaaggagctcaaggcaaaggctcagaaagggtccattggtggtaccggcctgaaaaagagcggaaagaagtgaggatgttgttatattctcctagtattgaaaaaatctcgtcctacccatggctagatttggtgttctaagttcaaatagttaagtttttgtgaacttttggatgttactatggtgattgaatgaattaggatggggcacttgctcctttccaatatatgatgacatgtattgtggtgcctttgcctatcaataattcatgttggcattaatatttgtgcgacatgcttgactgactcactattatgtaattccaacctctatattgtgcatgtcttaaattctgagatgaagtcattcagtcttttgtgcaag

SEQ ID NO: 3312 - DNA, 492 bp, Festuca arundinacea
ggcacgaggcttccctcctcctcgtcgcggctcgagctagggtttctcgcctccgccctcccgccctgcaccaccggccccgtcagccatgtcgaagcaaggagggaaggccaagccgctgaagcaggccaaggtcgccgagaaggactacgacgagactgacctggcatacctccagaagaagaaagatgagcaaaaggcactgaaggagctgaaggcaaaggcaggccagaagggtgcactgggaggatccggcctcaagaagagtgggaagaaatgagtccgcctatcctagaaaatgataaaccatctatctatcggtgttgcgcttcgctatctgtggctgtaacaaactacctttcaaatttgttgagcgttaagcttcatcttcgcagtctggttgctggaacctattgtgttctcagcctcttctgcttggctatgatacagatggtttccctagctaataatatgacgtaatttgtgactgat

SEQ ID NO: 3313 - DNA, 508 bp, Ipomoea batatas
gcacgggttaggagaaaagccatcgttctcagaatcaatcagatcgatctcttaaccctagcttgcaaccatgtcttccaagcaaggtggaaaggcaaagcctttgaagcagccaaaggctgataagaaagagtacgacgaggctgacaaggctttccttcagaaaaagaaggatgaggaaaaggcacttaaggatctcaaggcaaaagctcaaaagggagcattaggaggtgcaggactgaagaaaagtggcaagaagtgataaaacacgatgtccaacaaaatcattgaaagacttattgtgtgtatggctggtttagatgtgttgttcttcaagttgttatagattgcatgtttgactttgctaagacctatccttcatgaaactgaaagaacatttctgcaatgcttcctttgaatatgaaagttgtgttagtgttgctcgtaatgtcaataattcatgatttcctcgtaaactctttgatgcactggttacgctttctttcgt

SEQ ID NO: 3314 - DNA, 467 bp, Lolium multiflorum
ctcgtcgcggctccagctagggtttctcccctccgccccaccaccgaccccgtcagccatgtcgaagcaaggaggaaaggccaagccgctgaagcaggccaaggtcgccgagaaggactacgacgagactgacctggcatacctccagaagaagaaagatgagcaaaaggcactgaaggagctgaaggcaaaggcaggccagaagggtgcactgggaggatccggcctcaagaagagtgggaagaaatgagtctagaaaatgataaaccatctatctatctgtgttgcgctccactatctgtggttgtaacaaactgtctttcaaatgtatcgagctttaaacttcattgtcgcggtcgggttgctggaacctattgtgtctcagcctcttctgcttagccatgatacagattgttccctagctaataatatgacgtgatttgtgactgaaagtttccaatgtgtac

SEQ ID NO: 3315 - DNA, 443 bp, Fraxinus spp
cggccggggctagcgattgggttagggcaccttttcatttttcaagcgatttcgtgatcacagcgaaaccctaaccctagatttcaaccatgtcttccaagcaaggtgggaaagcgaagcctttgaagcaaccaaaggctgacaagaaagagtatgacgaggatgacaaggcttttcttcagaagaagaaggaagaggagaaggctctgaaggagcttaaaaacaaaggctcaaaagggagcacttggaggtgccgggctgaagaaaagtggaaagaaatgaaaacttgtgaagaactacaagaaacaaaaaactcctttagttagtcgattgtatcgtgatatactatttggttaaaccattttagcatgatattcttgcttatgctaaactattgagacaacttttcaatgaaatttctgtgtagaactatttgtttggat

SEQ ID NO: 3316 - DNA, 627 bp, Amorphophallus konjac
cctccgtgacgttattttctccgagttcggtcttcgtcttcctgtggaggaggccttctagggtttccatccccgccttacccttctctctctctctgtgggaggccgcgaccatgtcgtcgaagcaaggtggcaaggcgaagcccctcaagcagcccaaggtggagaagaaggactacgacgaggctgacctggcctaccttcaaaagaaaaaggatgaggagaaggcactcaaggacctaaaagcaaaagcgtcacagaagggggcacttggaggttcaggcctcaagaagagtggaaagaagtgaggaggcgcatttcctcctgatacttggatgaagatgatgttgtctcttgaaacaccgttcaaggcttggatccctattggacttatggcaaacccaccccctccatgtgtttcactttagacgtgcacggtgcaactgtcacctgaacctagcaatggttggacacatttcaaattaaatgtgtttggttgcttgtctaatgccgggtccttattgaggtgcttttatgtcacgtgtgtcgtggtattgctcgactctgtgttacatggcgctgaatacttataaattaagcatctgaaaataagaaaatttggtttgg

SEQ ID NO: 3317 - DNA, 1918 bp, Brassica rapa
ttgttactacgaacacaatatatataacagcaagtggttagagattctatctaagacacaagtccgtcgtctgaaactttactttcttccgcaaattctcagacaagcagcatcaaaccctagctccagaaactagtcatgtcgtccaagcaaggaggaaaggctaaacctttgaagcagccaaaagctgataagaaggaatacgacgagcacgatatggccaaccttcagaagaagaaagacgaggaaaaggcacttaaagaactaagagccaaggcatcgcagaagggatcctttggaggctctggacttaagaagagcggcaagaaatgattccgttcttatccatgtagcctgtctttgacagtgcatatttatctacttgaaaaaacaaaataatcgtgtgctgtgtaacttcaatcatgttcctaagagagtgactttgcttctcccatacatatatgtttgctctcaccacttcttcatgaaattgaaaatggttactatcctaatatcaaatgctgtttgcttgtcatcaatgaagactctataagatgagataacttaagactataaggtactacagaggtagtaaccgagggtgacatgtgattttaccaaagaagtaacgagtgaaatatatgtactgcgtaataggataaacaacctttcttaagtagtgcatgctctaaacgagagcgaagctgatcaagaggggttttagagtctgaaagatcctgctttccttcttgaaccgttgatgctcgaagaggtgcgtggatcagagaactcgtagtacatgtctgtgaaaaagttgtcaacaatgtctagatagacagggctcctaatgtttgaatagcatcgaagcgcttcttttacatccaatgcatgctccacgtctctgagatcaaccatgttgagatctttcatcttctgcgccagcatgtcacctcttctcctcgcctcctcgaatggccttgcaaccttttctttcggtttcttcttatgttggcttttgttgatgagtctctcatctctggtatctgcaacaaccttgctctcacaggatagaacgctgtatgtttcttcagtttgggaatcttgtggacatgggtggctaagactgcatgagaaggggctcaagagtggagtgttgttgttagggaagttgtggtgtttaccaaagcagacagtggacttgatgctcccaaggctcttccttaagaaacgaccaactctctgaattgatttcgctgagggtttcatcattgtagctatttttgtctctcctgctgttcctttattgagacgataaccatatttatgcaactcaagacgaaacctaacattcattcagtggcatgttagaagaagggagctgatatgatatgtcaaagtcagacttaaagaaggtgtcatgtggatgagtgtcaaggacacttttataggtaagaaatcgtcatcacattgataagcagtgttcacaatggtccccaacttatcgttgttgccaccactgctcatcaatcatcatacatgtcagctgcacaggcttaaataattagaaccaagcccttaatgggtaagcccatgttttgagagaagaaagtgttgtgccaattggctttgaaactactactacgttttcttgaaatgctttgatggtatatatgattcattcattgaaatgctttcgtgatctcttcactgtataaacatatttagcaatactcaacttaagattgggaggagttgcaacgcacaatctaaggatcaggttggtggtgtgtattgaccaaagagatgtttttcttcttgcaactgtttgaaagactgctccatttccggaaacgccgaggttagcaacagctccacaaggtcatatgccaacagttttagacatactgatgactgaaac

SEQ ID NO: 3318 - DNA, 553 bp, Brassica rapa
atcgaatggtttgcaagtccatcgtctccgactctctcacctaccttttattttcccaattcgcatcaaacattagctctacagaccagtcatgtcgtccaagcaaggaggaaaggcaaaaccattgaagcagccaaaggctgataagaaggagtacgatgagcatgacatggccaacctgcagaagaagaaagacgaggaaaaggcacttaaggaactaagagccaaggcgtcgcagaagggatcctttggaggctctggacttaagaagagcggcaagaaatgatccgttttaatcacgaagcttgtatttgacaagtgcaatttatcaacttaataacagataatcgtgtgtttgtgtaacttgtatcatgtttcgccactttttcataatattgataaatggtttctgcattcaggattcagtctaagactatcatgtttctgcatctcagggtccagttttaaacatatgttgctaaagatgagttggttaggtaactgagagtgacatgtgttttttaccaaagatgaatgtgaaatatatatgtga

SEQ ID NO: 3319 - DNA, 408 bp, Brassica napus
tctcagatcagcatctagccctagctcgacaaatccgtcatgtcgtccaagcaaggaggaaaggcgaaacctttgaagcagccaaaagctgataagaaggaatacgatgagcacgatatggccaaccttcagaagaagaaagatgaggaaaaggcacttaaagagttaagagccaaggcatcgcagaagggatcttttggaggctctggtcttaagaagagtggcaagaaatgatcccttataatccatgaagcctgtttttgacagtgcttatttatcaagttataacagatacttgtgtaacttgtctgtaagagagttactttgcgtctctcccataacatatgtttgcgttcgacactatttcattttataaagaaaaaaagagaaaagaacgatggttttact

SEQ ID NO: 3320 - DNA, 770 bp, Brassica napus
caactctctcacctaccatttttttttccccatttcgcatcaaacgttaggctctacagaccagtcatgtcgtccaagcaaggaggcaaggctaaaccattgaagcagccaaaggctgataagaaggagtacgatgagcatgacatggccaacctgcagaagaagaaagacgaggaaaaggcacttaaggaactgagagccaaggcgtcgcagaagggatcctttggaggctctggacttaagaagagcggcaagaaatgatccgttttaatcacgaagcttgtatttgacaagtgcaatttatcaacttaataacagataatcgtgtgtttgtgtaacttgtatcatgtttcgaggagaacttgaacaagatcgcgctcgatgtgcacgaagactacgacgacgaagatgaagaggctcttcacagttacggttcagctaataatgtcggtggtcggaggagctccaggtcagcttcgaggtatcagatctccaatggaatcgaatcgcctgctcatcacgagattgagaggtataaggcagagattaagaagcttcaggagtctgaatcagatatcaaagctttatcagttaattacgcagctcttttaagagataaagaggatcagatctccagactgaaccaggagaatggctcattgaagcaaagtcttacctctactagtgctgccttagaagacggccagaactagctatttacaaggaaatacaaaacaataatgactatacgaaagggaaacaacgataca

SEQ ID NO: 3321 - DNA, 549 bp, Lippia dulcis
aatagattctgacgaattcgattagggcatagtgttgatctctacaatccgaagctcaattttgcgatcactgcgaaatcctaaccagatcattcaatcatgtcatccaagcaaggtggaaaagccaagcctttgaagcaacctaaggctgaaaagaaagagtatgacgagactgacaaggctaatattcaaaagaagaaagaagaggagaaggctcttaaggagctgaaggcaaaggcccagcagaaaggggcatttgggggttctggtttgaagaagagtggcaaaaaatgagtcctgaaacacgatttggtgaaacagctagctcgttgcttgccagtgctgtcgtgtttgtcgatttctctatatgctatttaaacattttagcttgtgcctactaatggttgtggagttgtgaagggcttgtggatataagattgttatgttcaacagttgaatctatgaaatggcttgtgtctgaatgtatcatcactgttatgtttctggtagtaatttcatggttatgtatggattatttgataaaaagaa

SEQ ID NO: 3322 - DNA, 633 bp, Eutrema parvulum
ttttaattgggtgggtcacaaactctctgagcccatttcatgggttgcgtcgttactacgaactcaataaatactacaagcaattagagtttctatcgaatatatcgtctgaaacttttacttcatttatccccaattctcagatcagcatcaaaccctagctcctcgaaccagtcatgtcgtctaagcaaggaggaaaggcgaaacctttgaagcagccaaaggctgacaagaaggaatacgacgagcacgatatggctaaccttcagaagaagaaagacgaggaaaaggcacttaaagaactaagagccaaggcatcgcagaaggggtcctttggaggctctggacttaagaagagcggcaagaaatgatccattttatccatgaagcctgtgtttgacagtgcaaatttatcaacttaaaacagataatcatgtgttgtgtaacttctatcttgttttctaggagagtgactttgtgtctcccatacatatgtttgctttctccactttttcatgaaaaagaaaaaatggttactatcataaaatcaaatactgtcattctccttctctccgggttcaggattcaatagtagactgccatatttctctatctcaggatccactactagaa

SEQ ID NO: 3323 - DNA, 460 bp, Brassica juncea
tgaaactttactttcttccgcaaattctcagacaagcagcatcaaaccctagctccagcaactagtcatgtcgtccaagcaaggaggaaaggcgaaacctttgaagcagccaaaggctgataagaaggaatacgatgagcatgatatggccaacctgcagaagaagaaagacgaggaaaaggcacttaaggaactaagagccaaggcatcgcagaagggatcctttggaggctctggacttaagaagagcggcaagaaatgattccgttcttatccatgtagcctgtctttgacagtgcatatttatctacttgaaaaaacaaaataatcgtgtgttgtgtaacttcaatcatgttcctaagagagtgactttgcttctcccatacatatatgtttgctctcaccacttcttcatgaaattgaaaatggttactatcctaatatcaaatgctgtttgctt

SEQ ID NO: 3324 - DNA, 436 bp, Brassica juncea
tcctccttgcttggacgacatgactagtttctggagctagggtctgaaactttactttcttccgcaaattctcagacaagcagcatcaaaccctagctccagcaactagtcatgtcgtccaagcaaggaggaaaggctaaacctttgaagcagccaaaagctgataagaaggaatacgacgagcacgatatggccaaccttcagaagaagaaagacgaggaaaaggcacttaaagaactaagagccaaggcatcgcagaagggatcctttggaggctctggacttaagaagagcggcaagaaatgatttccgttcttatccatgtagcctgtctttgacagtgcaaatttatcaacttaaaaacaagattatcgtgtgtatcatgtccgtaggagagtgactttacttctcccttgcatatgttttgctttcgcca

SEQ ID NO: 3325 - DNA, 282 bp, Brassica juncea
gatccgtcgtctgaaactctgctttttcccccaattctcagatcagcatcagaccctagctctacaaatccgtcatgtcgtccaagcaaggaggaaaggcgaaacctttgaagcagccaaaagctgataagaaggaatacgatgagcacgatatggccaaccttcagaagaagaaagatgaggaaaaggcacttaaagaattaagagccaaggcatcgcagaagggatctttcggaggctccggtcttaagaagagtggcaagaaatgatccctttatatcc

SEQ ID NO: 3326 - DNA, 381 bp, Brassica juncea
ctaagacacaagtccgtcgtctgaaactttactttcttccgcaaattctcagacaagcagcatcaaaccctagctccagaaactagtcatgtcgtccaagcaaggaggaaaggctaaacctttgaagcagccaaaagctgataagaaggaatacgacgagcacgatatggccaaccttcagaagaagaaagacgaggaaaaggcacttaaagaactaagagccaaggcatcgcagaagggatcctttggaggctctggacttaagaagagcggcaagaaatgattccgttcttatccatgtagcctgtcgttgacagtgcatatttatctacttggataagaacggaatcatttcttgccgctcttcttaagtccagagcc

SEQ ID NO: 3327 - DNA, 444 bp, Brassica juncea
tctgaaactttactttcttccgcaaattctcagacaagcagcatcaaaccctagctccagaaactagtcatgtcgtccaagcaaggaggaaaggcgaaacctttgaagcagcccaaagctgataagaaggaatacgacgagcacgatatggccaaccttcagaagaagaaagacgaggaaaaggcacttaaagaactaagagccaaggcatcgcagaagggatcctttggaggctctggacttaagaagagcggcaagaaatgattccgttcttatccatgtagcctgtctttgacagtgcatatttatctacttgaaaaaacaaaataatcgtgtgttgtgtaacttcaatcatgttcctaagagagtgactttgcttctcccatacatatatgtttgctctcaccacttcttcatgaaattgaaaatggttactatcctaat

SEQ ID NO: 3328 - DNA, 450 bp, Brassica juncea
gtaatccgtcgtctccaactctcagctcccttttccggttttccccaattcgcatcaaaccctagctctacacaccagtcatgtcgtccaagcaaggaggaaaggcgaaacctttgaagcagccaaaggctgataagaaggaatacgatgagcatgatatggccaacctgcagaagaagaaagacgaggaaaaggcacttaaggaactaagagccaaggcgtcgcagaaaggatcctttggaggctctggacttaagaagagcggcaagaaatgacccgttttatccgtggaaagcctgtacttgacagtgcaaatttatcaacttaataacagacagtcctgtgttgtgtaacttgtatcatgttctctaggggagtgacttcgcgtcccttacatatgttcgctttcgccattgtttcataataaaaggaaaagggtttctatcctac

SEQ ID NO: 3329 - DNA, 333 bp, Brassica juncea
gatacaaaaagtccgtcgtctgaatactttcttccccaatccttagctcagcaagcatcaaaccctagctccagaaaccagtcatgtcgtccaagcaaggaggaaaggcgaaacctttgaagcagccgaaagctgataagaaggaatacgacgagcacgatgtggctaaccttcagaagaagaaggacgaggaaaaggcacttaaagaactaagagccaaggcatcgcagaagggatcctttggaggctctggacttaagaagagcggcaagaaatgatctccttttatcccagaagcctgtctttgacagtgcaaatttatcatcttaaaaa

SEQ ID NO: 3330 - DNA, 378 bp, Brassica juncea
gcagagtttcagacgacggatttttcccccaattctcagatcagcatcagaccctagctctacaaatccgtcatgtcgtccaagcaaggaggaaaggcgaaacctttgaagcagccaaaagctgataagaaggaatacgatgagcacgatatggccaaccttcagaagaagaaagatgaggaaaaggcacttaaagaactaagagccaaggcatcgcagaagggatcctttggaggctctggacttaagaagagcggcaagaaatgatccctttatatccatgaagcctgtttttatcaagttataacagatactcgtgtgttgtgtaacttgtctgtaggagagttgactttgcgactctcccataacatatgtttg

SEQ ID NO: 3331 - DNA, 459 bp, Brassica juncea
cgggaagacacaagtccgtcgcctgaaactttactttcttccgcaaattctcagacaagcagcatcaaaccctagctccagaaactagtcatgtcgtccaagcaaggaggaaaggctaaacctttgaagcagccaaaagctgataagaaggaatacgacgagcacgatatggccaaccttcagaagaagaaagacgaggaaaaggcacttaaagaactaagagccaaggcatcgcagaagggatcctttggaggctctggacttaagaagagcggcaagaaatgattccgttcttatccatgtagcctgtcgttgacagtgcatatttatctacttgaaaaaacaaaataatcgtgtgctgtgtaagagagtgactttgcttctcccatacatatatgtttactctcaccacttcttcttgaaattggaaaatggttactatcctaatatcaaatgctg

SEQ ID NO: 3332 - DNA, 460 bp, Brassica juncea
aagacacaagtccgtcgtctgaaactttactttcttccgcaaattctcagacaagcagcatcaaaccctagcttagtcatgtcgtccaagcaaggaggaaaggctaaacctttgaagcagccaaaagctgataagaaggaatacgatgagcacgatatggccaaccttcagaagaagaaagatgaggaaaaggcacttaaagagttaagagccaaggcatcgcagaagggatcttttggaggctctggtcttaagaagagtggcaagaaatgatcccttataatccatgaagcctgtttttgacagtgcttatttatcaagttataacagatacttgtgtaacttgtctgtaagagagttactttgcgtctctcccataacatatgtttgcgttcgacactatttcatttttcatctaaatttttttttttttgaagcttgatcaaaaaatgtgcaatca

SEQ ID NO: 3333 - DNA, 457 bp, Brassica oleracea
gcgggggtcgtctgaaactcaagagttgctttttctgagatcagcatctaaccctagctcgacaaatccgtcatgtcgtccaagcaaggaggaaaggcgaaacctttgaagcagccaaaagctgataagaaggaatacgatgagcacgatatggccaaccttcagaagaagaaagacgaggaaaaggcacttaaagaattaagagccaaggcatcgcagaagggatcttttggaggctccggtcttaagaagagtggcaagaaatgatccgttattatccatgaagcctgtttttgacagtgcttattttatcaagttataacatataaactcgtgtgttgtgtaacttgtctgtaggagagtgactttgcgtctctcccataacatatgtttgctttcgacacttatttcattttataaagaaaaaaaaagagaaaagaaagatggttttctatgg

SEQ ID NO: 3334 - DNA, 570 bp, Brassica rapa
ggtaaccttgtgcaatgtgtgcttcttgcattccttgttcttgcagtacgtcttctttgtctttggaatgttcaccattttcgctactctgatctctctctctctcgggtgaagattgtccgtcgtctgaaactttactttcttccgcaaattctcagacaagcagcatcaaaccctagctccagaaactagtcatgtcgtccaagcaaggaggaaaggctaaacctttgaagcagccaaaagctgataagaaggaatacgacgagcacgatatggccaaccttcagaagaagaaagacgaggaaaaggcacttaaagaactaagagccaaggcatcgcagaagggatcctttggaggctctggacttaagaagagcggcaagaaatgattccgttcttatccatgtagcctgtctttgacagtgcatatttatctacttgaaaaaacaaaataatcgtgtgctgtgtaacttcaatcatgttcctaagagagtgactttgcttctcccatacatatatgtttgctctcaccacttcttcatgaaattgaaagtggttactatcctaata

SEQ ID NO: 3335 - DNA, 1563 bp, Brassica rapa
tcgtgactacgaagtcaatatatataattttatcgaacacaaagagatccgtcatctgaaactcaagagttgctttttccccaattctcagatcagcatctagccctagctcgacaaatccgtcatgtcgtccaagcaaggaggaaaggcgaaacctttgaagcagccaaaagctgataagaaggaatacgatgagcacgatatggccaaccttcagaagaagaaagatgaggaaaaggcactaaaagaactaagagccaaggcatcgcagaaaggatcttttggaggctccggtcttaagaagagtggcaagaaatgatcccttatttccatgaagcctgtttttatcaagttataacagatactcgtgtgttgtgtaacttgtctgtaggagagttgactttgcgactctctcataacatacgtttgctttcgacgctatttcattttataaagaaaaaaaatggtttctatttaaaagtcaagttctgccatagttctcctgattcaagattcagtttggtccaatcttagaaactgttgtttgtcataaattgaagacaacatatgttgcattgataacataaggctctataagatgaggtagtaacaagtaactaaaaggtgcaggtttctttttatacaaacatgtaactagtaagtgaaatttttgagctgcgtaatggataacaagacgtcttaggaagtgcatattctaaacgaaatagcttcaccctagcctgaaagctgatcgagaggggtcttagagcctgaaagagcctgcttttcttcttgaacccttgatactggaagtaatggtgagcggatcagagaactcgtagtacatgtcagtgaagaaattgtcaacaatgtcaaggtacacagggcttctaatgcttgaatagcatctaagcgcttcctgtacatccgaagcatgctccacgtctctgagatccaccatgttgaaatctttcatcttttgcgccagcgtctcacctcttctcttagcctcctccaatggctctgcaactttcttcttcttcggtttctttttatgttggaccttgttgatgagactctcatctctggtttctgcaacagctgtgctctcagaagagaaaacgctgtacgtttcttcagtttgggaatcttgtggacagctacggtggagactgcacgagaaggggctcaagagtggagagttgttgtttttaggtacggtgtggtgtttaccaaagcagatagtggacttgatgctcccaaggctcttccttaagaaacgaccaactctctcaattgatttcgctgtgggtttcatcatcttatcttttgttttcttttgtctctcatgccgttccttttggacaatagctatatttatttcactcaaaaccaaacaatatcattcattcaatggcatgtagtagctgaagaaggaagctgatatgatatgtcagagtcaagaattaaagaaggtgtcatcttgatatgtgcccacttttattggtaaggaatcattcagcgcattgataagcaatgttcaaaatggtcccctacttatcc

SEQ ID NO: 3336 - DNA, 439 bp, Brassica rapa
catcttgaaactcaagagttgctttttccccaattctcagatcagcatctagccctagctcgacaaatccgtcatgtcgtccaagcaaggaggaaaggcgaaacctttgaagcagccaaaagctgataagaaggaatacgatgagcacgatatggccaaccttcagaagaagaaagatgaggaaaaggcacttaaagaattaagagccaaggcatcgcagaagggatcttttggaggctccggtcttaagaagagtggcaagaaatgatccctttatatccatgaagcctgtttttatcaagttataacagatactcgtgtgttgtgtaacttgtctgtaggagagttgactttgcgactctcccataacatatgtttgctttcgacactatttcattttataaagaaaaaaagagaagagaacgatggttttctattt

SEQ ID NO: 3337 - DNA, 558 bp, Bruguiera gymnorhiza
  misc_feature (20)..(20): n is a, c, g, or t
  misc_feature (28)..(28): n is a, c, g, or t
  misc_feature (31)..(31): n is a, c, g, or t
  misc_feature (49)..(49): n is a, c, g, or t
  misc_feature (65)..(65): n is a, c, g, or t
  misc_feature (67)..(67): n is a, c, g, or t
  misc_feature (70)..(71): n is a, c, g, or t
  misc_feature (78)..(78): n is a, c, g, or t
  misc_feature (85)..(85): n is a, c, g, or t
  misc_feature (91)..(91): n is a, c, g, or t
  misc_feature (97)..(99): n is a, c, g, or t
  misc_feature (103)..(105): n is a, c, g, or t
  misc_feature (109)..(109): n is a, c, g, or t
  misc_feature (111)..(111): n is a, c, g, or t
  misc_feature (113)..(113): n is a, c, g, or t
  misc_feature (126)..(126): n is a, c, g, or t
gaaaatcaaggagcagcctncaataaantgngtaaaattagggttaggnttttctccacccaaancntcnnaatttcntcttctncttttntttttnnntttnnntttntngnttataataatcanaactcctaaccctaaatctgcattttcagccatgtcttccaagcaaggtggaaaggccaagcctttgaagcagcccaaggccgacaagaaagagttagatgaggtagataaggctaaccttcagaaaaagaaggaagaggaaaaggcgcttaaggagctcaaggccaaggcacaacaaaagggggcttttggaggatctggtcttaagaaaagtggaaagaaatgaggatttccaaggcaaatcaacgcagaatgcacgaatcctagcaatatgattacaaattttaccattgatgcttttatgccactttctgtgtaatgcaacagttctttgtgctaaatgctactaaaccttgagtcaacgtgattgtattgataaatattgcatgttttgttgcttaacattgatgatcgaataatttggtccctgca

SEQ ID NO: 3338 - DNA, 434 bp, Brassica napus
gtctgaaactcaagagttgctttttccccagttctcagatgcatctaaccctagctcgacaaatccgtcatgtcgtccaagcaaggaggaaaggcgaaacctttgaagcagccaaaagctgataagaaggaatacgatgagcacgatatggccaaccttcagaagaagaaagacgaggaaaaggcacttaaagaattaagagccaaggcatcgcagaagggatcttttggaggctccggtcttaagaagagtggcaagaaatgatcccttataatccattaagcctgtttttgacagtgcttattttatcaagttattataacagatactcgtctgttgcgtaacttgtctgtaggagagtgactttctgtctctcccataacatatgtttgctttcgacacttgtttcattttataaagaaaaaaaaagagaa

SEQ ID NO: 3339 - DNA, 521 bp, Brassica napus
gacacaagtccgtcgtctgaaactttactttcttccgcaaattctcagacaaggcatcaaaccctagctccagaaactagtcatgtcgtccaagcaaggaggaaaggcgaaacctttgaagcagcccaaagctgataagaaggaatacgacgagcacgatatggccaaccttcagaagaagaaagacgaggaaaaggcacttaaagaactaagagccaaggcatcgcagaagggatcctttggaggctctggacttaagaagagcggcaagaaatgattccgttcttatccatgtagcctgtctttgacagtgcatatttatctacttgaaaaaacaaaataatcgtgtgttgtgtaacttcaatcatgttcctaagagagtgactttgcttctcccatacatatatgtttgctctcaccacttcttcatgaaattgaaaatggttactatcctaatatcaaatgctgtttgcttgtcatcaatgaagactctataagatgagataacttaagactataag

SEQ ID NO: 3340 - DNA, 510 bp, Brassica napus
ggtctgaaactttactttcttccgcaaattctcagacaagcagcatcaaaccctagctccagaaactagtcatgtcgtccaagcaaggaggaaaggcgaaacctttgaagcagccaaaagctgataagaaggaatacgacgagcacgatatggccaaccttcagaagaagaaagacgaggaaaaggcacttaaagaactaagagccaaggcatcgcagaagggatcctttggaggctctggacttaagaagagcggcaagaaatgattccgttcttatccatgtagcctgtctttgacagtgcatatttatctacttgaaaaaacaaaataatcgtgtgttgtgtaacttcaatcatgttcctaagagagtgactttgcttctcccatacatatatgtttgctctcaccacttcttcatgaaattgaaaatggttactatcctaatatcaaatgctgtttgcttgtcatcaatgaagactctataagatgagataacttaagactataag

SEQ ID NO: 3341 - DNA, 460 bp, Brassica napus
atctgaaactcaagagttgctttttccccaattctcagatgcatctagccctagctcgacaaatccgtcatgtcgtccaagcaaggaggaaaggcgaaacctttgaagcagccaaaagctgataagaaggaatacgatgagcacgatatggccaaccttcagaagaagaaagatgaggaaaaggcacttaaagagttaagagccaaggcatcgcagaagggatcttttggaggctctggtcttaagaagagtggcaagaaatgatcccttataatccatgaagcctgtttttgacagtgcttatttatcaagttataacagatacttgtgtaacttgtctgtaagagagttactttgcgtctctcccataacatatgtttgcgttcgacactatttcattttataaagaaaaaaagagaaaagaacgatggttttctatttaaaaaatcaagtgatgcca

SEQ ID NO: 3342 - DNA, 431 bp, Brassica napus
gtctgaaactcaagagttgctttttccccaattctgagatgcatctaaccctagctcgacaaatccgtcatgtcgtccaagcaaggaggaaaggcgaaacctttgaagcagccaaaagctgataagaaggaatacgatgagcacgatgtggccaaccttcagaagaagaaagacgaggaaaaggcacttaaagaattaagagccaaggcatcgcagaagggatcttttggaggctccggtcttaagaagagtggcaagaaatgatcccttataatccatgaagcctgtttttgacagtgcttattttatcaagttataacagatactcgtgtgttgtgtaacttgtctgtaggagagtgactttgcgtctctcccataacatatgtttgctttcgacacttatttcattttataaagaaagaaaaagagaa

SEQ ID NO: 3343 - DNA, 599 bp, Coffea canephora
ccggcaattcaactattgggttagggctcgctccattcgtcacgcttttcaagaatccactaaatcgaaccctagcccaagaattcaaccatgtcttccaagcaaggtggaaaagcaaagcctttgaagcagccaaaggctgacaagaaagaatacgacgaggaagataaggctcatctgcaaaagaagaaagaggaggaaaaggcactgaaggagctcaaggcaaaggctcaaaaaggagctttgggaggttctgggctcaaaaaaagtggcgggaagaagtgaggatttagaaacctaatgcgaagcctaagcatccttgtgttagattggtttatcatcaagcatttgctcttatggctgggaatgattgttgaattcagtgaaatgtgtgaaacatttgcacccttcggaatacataagccgtgttagaatttgtttctgtttcctttaacatggttttaatgttgaattgtatgttgtttctggttttatgttttcatattgtattgaacttcacagttcatggttgtgttttatctgatggtaaaggaccattgcatttatctcagtaactgattcttcctgaaagtccagcc

SEQ ID NO: 3344 - DNA, 719 bp, Vitis vinifera
ctagtaacaaaatccctctatatatatagaggccttgcccatttaccaatccccagacgacgcttcttatcgtggcattagggtgagggcttctacttcgcgattccctctttctgtgatcacaccacaaaccctaaccctagagacaagccatgtcgtccaaagccgggggaaagctgaagcctttgaagcaacccaaggccgacaagaaagaatacgacgaggatgatctggccaaacttcaaaagaaaaaagaggaggaaaaggcactgaaggagcttaaggccaaggctgcacaaaagggcgcatttggaggttctggactcaagaagagtgggaagaaatgaaaacctgagtcataatgcaatatctacttaatatatgcatatgtggtgaatatccttcggtggatgcaattggtctatcgagatgctacattaacttctgaacattttcttatccccagtaaaactgagttgcactgtcatgttctggatattgtactagtaattgatgctgcttgaatctgcttgtggttgctttgagattgatctatgatatcaagtgttattgatgtggtgatgaccacttttacttcattttcataaattattccctgtgccctgcaaccaataccctccactcctggttgatttgagattgatgaaattgatatatgatgcggcttatacacactttcagattaattcctatttcca

SEQ ID NO: 3345 - DNA, 584 bp, Vitis vinifera
atttaccaatccccagacgacgcttcttatcgtggcattagggtgagggcttctacttcgcgattccctctttctgtgatcacaccacaaaccctaaccctagagacaagccatgtcgtccaaagccgggggaaagctgaagcctttgaagcaacccaaggccgacaagaaagaatacgacgaggatgatctggccaaacttcaaaagaaaaaagaggaggaaaaggcactgaaggagcttaaggccaaggctgcacaaaagggcgcatttggaggttctggactcaagaagagtgggaagaaatgaaaacctgagtcataatgcaatatctacttaatatatgcatatgtggtgaatatccttcggtggatgcaattggtctatcgagatgctacattaacttctgaacattttcttatccccagtaaaactgagttgcactgtcatgttctggatattgtactagtaattgatgctgcttgaatctgcttgtggttgctttgagattgatctatgatatcaagtgttattgatgtggtgatgaccacttttacttcattttcataaattattccctgtgccc

SEQ ID NO: 3346 - DNA, 424 bp, Raphanus sativus
gggctgctagtccgtcgtctccaccaactctcagctcctttttttttcccatttcgcgtcaaaccctagctagctctacaaaccagtcatgtcgtccaagcaaggaggaaaggcgaaacctttgaagcagccaaaggctgataagaaggaatacgatgagcatgacatggccaacctgcagaagaagaaagacgaggaaaaggcacttaaggaactaagagctaaggcgtcacagaagggatcctttggaggctctggccttaagaagagcggcaagaaatgatccgttttatccatgtagcctgagtgcaaatttatcaacttaataaatgataacagataattgtgtgttgtgtaaacttgtatcatgttcgctttcgctactttttcatgataaaagataaatggtttccttaccgctggt

SEQ ID NO: 3347 - DNA, 463 bp, Raphanus sativus
  misc_feature (428)..(428): n is a, c, g, or t
gatcgaatacacaaagtccgtcgtctgaaagtctacttttccgcaaattctcagacaagcagcatcaaaccctagctccagaaaccggtcatgtcgtccaagcaaggaggaaaggcgaaacctttgaagcagccgaaagctgataagaaggaatacgacgagcacgatatggctaaccttcagaagaagaaagacgaggaaaaggcacttaaagaactgagagccaaggcatcacagaagggatcttttggaggctctggacttaagaagagcggcaagaaatgatttccgttcttatccatgtagcctgtctttgacagtgcatatttatcaacaacttggaaaacaaaataaatcgtttgttgtgtaacttctatcatgttcctaggagagtaactttgcgtctcccccatacatatgtttgcttnttatattatgataaaagaaaaatggtttttatcca

SEQ ID NO: 3348 - DNA, 897 bp, Raphanus sativus
tttaagaactcataggggttgtgaacttcattaagtacacaatttaatattaatatttatatctgaattgtgaaatattgttctttataaaaagtaaaaaatatttaatcccaacttttttttaaaaaaaaacacaaatttatctttttaattatgaacatacttttttatatcattaaataaaaataaattaattatataggagagtaggtaagcggcaccaaaactgttaaaactggatttttaattgggccaaaatatctttgagcacattcatgggttgcgttgttactacgaactcaatataataaacgagcagctagagattctatcgcatactcacagcaggtccatcgtctgaaacttaaattttccccaattctcagatcagcatcaaaccctagggctcgaggaaccagccatgtcgtccaagcaaggaggaaaggcgaaacctttgaagcagccaaaagctgataagaaggaatacgatgagcacgatatggccaaccttcagaagaagaaagacgaggaaaaggcacttaaagaactaagagccaaggcatcgcagaagggatcttttggaggatctggtcttaagaagagtggcaagaaataatcccgttttgtatccatgaagcctgtctttgacagagtgcttatttatcaacttataatgttgtgtaacttcctatcatatctgtaggggagtgacttttccttatcccataacataacatatgttttgctttcgccactttttcatttcaaaagattgtttctatctaaaagccaagtgatgccgtagttctccatctcctggttcaagattcagtttggtccaatcttagatactgttgtttgtcacaatttgaagacaagaacatatgttgcattgat

SEQ ID NO: 3349 - DNA, 449 bp, Raphanus sativus
  misc_feature (21)..(21): n is a, c, g, or t
  misc_feature (45)..(45): n is a, c, g, or t
acacactgcaagtccatcgtntgaaacttaaattttccccaattntcagatcagcatcaaaccctagagctcgaggaaccagccatgtcgtccaagcaaggagggaaggcgaaacctttgaagcagccaaaagctgataagaaggaatacgatgagcacgatatggccaaccttcagaagaagaaagacgaggaaaaggcacttaaagaactaagagccaaggcatcgcagaagggatcttttggaggctctggtcttaagaagagtggcaagaaataatcccgctttgtatccatgaagcgtgtctttgacagagtgcttatttatcaacttataatgtttgtgtaacttcctatcatgtctgtaggggagtgactcttcctatcccataacatatgtttgctttcgccacaatttcatttcaaaagaaaagaaagatggtttctatc

SEQ ID NO: 3350 - DNA, 509 bp, Salvia sclarea
ctactagaccttggctgtcactcaaaaacttattgctcaggagttttggttagggcatctctcttttattcgcagctcaattttgcgatcacaaccaaaaccctaaccatacaattcaatcatgtcgagcaagcaaggaggaaaagccaagcctttgaagcaacccaaggctgaaaagaaagaatacgacgagactgacatggctaatattcaaaagaagaaagaagaagagaaggctctcaaggagcttaaggcaaaggcccagcagaaaggggcatttggaggttctggtctcaagaaaagtgggaaaaaatgagtccacttggtgaagtagctaattcgttgcttgccattgttgtcctgtttgtcaatttctatgtatgctatttaaacatgtttgctacttcctactaatggttaatggttattgagccctaaagaacttgtggatatatagcatttgtctgttcagcagttgaatctataaaatggtttacgtctgaacgtat

SEQ ID NO: 3351 - DNA, 569 bp, Sesamum indicum
ccgctattgggttagggctctctcctttttccatcgttcgaagcctctctttgcgatcaccgcgaaaccctaaccctagaattcgacaatgtctagcaagcaaggagggaaagcgaagcctttgaagcaacctaaggccgaaaagaaagagtacgacgagattgacaaggctaatattcaaaagaaaaaggatgaagaaaaggctctgaaggagctcaaggcaaaggctcagcagaagggagcatttggtggttctggtctgaagaaaagcggcaaaaaatgagactttctgaaaagcaaatggtctcgattgctccattcttgtcattgtggtgttgtgttattgtgtcctcgagttcctagcatacaacttaaatgtgttagcttgttattgtctggttatcaagcttccaaaagcttttcgataaaagattttcagctttttctaatagatgcatgatgcctttattctgcctgtaatttacaatatgtacccctttctgaaacgtcaatgggtggtttccatgtgttcctggtagtgaattatcttcaaaagttgatcttttatg

SEQ ID NO: 3352 - DNA, 697 bp, Fragaria vesca
ccaccttcaaatcttcaattgaggagggtataagtgtaaaatacaataagaagaaaagtagaggctctgtaaaaagcatgtaatctctgtctatatatggcggtgtgactcgtcttccactaataatatctctcggctgctgcaaatagggttcggtcttcttctttcttctagctctcgatttccgaccaggccttcctccctagatcgcagccatgtcatccaagcaaggtggaaaggcaaagcctttgaagcaacccaaggctgataagaaggagtacgatgaggatgatttggctaagcttcagaagaagaaggatgaggaaaaggcactgaaggagcttagagccaaggcatcacagaagggttcttttggaggtgctggcctcaagaagagtggaaagaaatgagaggggttttcggtacccaaagttgggatgtgatataatattatctgtgttgaagtctttcaatttatgggatggtctaatttctagctgaatgtgctcctaacgctcatatgagtgtcagtgtaacattaagactaaataaactgaagtgtccttcttaattatcttgttatgtatggagcaagttccccctatgagcaaatgagaatgataaatgtgctacttcgttctttggagttcctcttgtgagcaaatgagaatgataaatgtgctgccttgtatgtgct

SEQ ID NO: 3353 - DNA, 468 bp, Camellia sinensis
cactaaaatttgctgtctggggtagggctctctctgtctgcgataatccttcttcgcatccaaacgaaaccctaaccctagaaaaaaaaccaaccatgtcgtccaagcaaggtggaaaagcaaagcctttgaagcaacccaaggctgacaagaaggaatacgacgagtctgatttggctaacatccaaaagaagaaagacgaggaaaaggcacttagggagcttagagccaaggctcaacagaagggagcatttggaggttctggactcaagaaaagtgggaagaagtgagggttctcaaatcctaattcagcctccaatttgttatgctatgattacaatatgcacttgtgatttctttggatagatgtgcttgccctagttcttgctaagttagctgtcaaacttttcatggagtgttctgatgaaaaatctaaataaaaattgtgttggacttctttgatatgca

SEQ ID NO: 3354 - DNA, 460 bp, Triphysaria pusilla
aaagttccgtgattgggttagggcatcgtcattttccccgtccaaagcttgtcttgcaatcgcagcgaatcctaaccctagaactaatcatgtcttccaagcaaggaggaaaagcgaagcccttgaagcaaccgaaggctgataagaaagaatacgacgagattgacatggctaatattcaaaagaaaaaggacgaagaaaaggctcttaaggagctcaaggcgaaggctcagcagaagggatcctttggaggctctggtctgaagaaaagtggcaaaaaatgagcctctaactgagactagttcttgtattattatgttattgtgttttcttgttcacaacttaaacaatgttatgcttccgttattgatggcttgtagttatcaagcctgccagagattttgatatcggattatataaatggcattttagtattatgtatggtattttctaatggttg

SEQ ID NO: 3355 - DNA, 519 bp, Triphysaria pusilla
tatctaaagctccgtgattgggttaggtcatcgtcatttttcccgtccaaagcttatcttgcaatcacatcgaaccctaaccctagaaataatcatgtcttccaagcaaggtggaaaagcgaagccgttgaagcaaccgaaggcggataagaaagaatacgatgagattgacatggctaatattcaaaagaaaaaggatgaagaaaaggctcttaaggagctcaaggcgaaggctcagcagaagggatcctttggaggctctggtctgaagaaaagtggcaaaaaatgagcctctactgagttcagttcttgtgttgttatgttatcgtgttttcttgtgtacaacttaaacaatgttatgcttccgttattgatggcttgtggttaacaagcgtgccagagattttgataacggattatttaaatggcattttagtatcatgtatggtattttctaatggttgtaatttgttgtgtggtttctgttttattcttatgtctatgaatttttattggtct

SEQ ID NO: 3356 - DNA, 658 bp, Zostera marina
tttcaatgtatggtgtcggatttaatatttgggtcgaagatcgcctatttttctatttaatctcttgaaagttcaagcaataccaaaaatttacgttatcgcgactttactcatttcagattagggtttcatttttttcccctccctctctcaagcgatcatgtcttccaagcaaggtggtaaagcgaaacctttgaagcagcccaaggcaaaaggaaaggagtacgacgagactgatcttgccaatcttcagaaaaagaaagatgaagaaaaggcattgaaggagctgaaggcaaaggcatcgcagaagggttcttttggtggagctggtcttaagaagagtggaaagaaataagcgtgcttcctcttatttattgtattgtattaataatcccatataaatcataaacgccacatttatgatttagcaaatataaatcctcaagtcctgaacgttgtctgtctgctttttgttctttaaaatttcgtacatatcagtatatgactattatttttttagtagttttgttttataatgttggtacctacctagtttataagtgttcgtcttttatttttgtttggcaattattttgtttgtaattctgaaggttaatattttttgtattccagtttttaagttttatgagtagttgac

SEQ ID NO: 3357 - DNA, 472 bp, Brassica napus
ggtctgaaactcaagagttgctttttccccagttctcagatcagcatctaaccctagctcgacaaatccgtcatgtcgtccaagcaaggaggaaaggcgaaacctttgaagcagccaaaagctgataagaaggaatacgatgagcacgatatggccaaccttcagaagaagaaagacgaggaaaaggcacttaaagaattaagagccaaggcatcgcagaagggatcttttggaggctccggtcttaagaagagtggcaagaaatgatcccttataatccattaagcctgtttttgacagtgcttattttatcaagttattataacagatactcgtctgttgcgtaacttgtctgtaggagagtgactttctgtctctcccataacatatgtttgctttcgacacttgtttcattttataaagaaaaaaaagagaaaataaagatcattttctattacgaaaaaaaaaaaaa

SEQ ID NO: 3358 - DNA, 2232 bp, Phalaenopsis aphrodite
aaattaattgaatagagtgcagttacattatcaaaggtgaaaaactggtttctcagtccaagatttcctattaatttataaggcggcaattaaacaaacagataaagcatgcactccatcctcaataatcatcaatacgagcacagctaacaagaaaaagtaccaagcattacaataataaatctttagaccaaacatattaaaagtaagtgattcagaaggctgacttgagcatataacagcaattgttatttcttcccgctgctcttcttgagtccagaccctccaaacgcacccttctgagaagccttggccttcaactccttcagtgccttctcctcatctttcttcttctggagatgagcaacgtcatcctcatcgtattccttctttgaagctttgggttgcttgagcggcttcgcctttccaccttgcttcgtcgacatggctgcacacgaaaaaaaaaagcgagacaagctggagacgaaaacgcgcagagcggcgagagcttggcgggcgcgcgctctatctttctatcttccccttcttcttccacctccagacaccggggaatgcgtcgcgatgaggagatctgatcccgacctcgccggcaggcgcaagcagcacgacggccggtcctgccaccggaagcacgttgaagacgggtagacgctgccgccgtttatcctcccctgtttccactctttaatccaaacttttcaaccatcaaatttcttccgagcttaaactctgaaaacatcttatataaatggaggagctagattcgtcctcgccgacggcagagggacggagcgttctccatggccgctatgaactgggccgcgtcctcggtcaaggcacgtttgccaaggtatacgttgcccgcaacctgcgcaccggtaagaacgtcgccatgaaagttgtcgacaaggagaaggttatcaaggtggggatgaccgagcaagtaaagcgggagatatccgtcatgaagatggtcacccacccaaatatcgtcgagcttcacgaagtgatggctacgagatccaagatatacttcgccatggagctcgtacgcggcggggagctgttttccatgatcgcccaatctggacgtctcagggaggacgccgctcgctcctacttccgacagctcatttccgctgtggatttctgccattcgcgcggcgtatatcaccgcgatctcaagccggagaatctcctcctcgacgaagccggaaacctaaagattgccgactttggtctctccgccttcgcagatcatgtccgcgccgacggcctacttcacaccacttgtggcacgccggcctatgttgctccggaggtcatcggaaataagggttacgatggcgctaaagcagatctctggtcctgcggggttatcctctacgtcctcctcgccggatcccttcccttcaaagatgataacatcatcaacatgtacaggaagatccaccgaggcgatttcaaatgccccccatggttctctactgacgctcgcagcctcgttacgaagttgctcgatcccaatcccagcacccgtatcaccgtcgctaacctgatcgaaaacccctggttccgtaaaaacccctttcccaaaccgatctccgaagacccaccagctgcctcagcaaagaaagatggggatgaaccggagagactgaatgcgttccatctgatatctctatcagaggggttcgatctctctcctctcttcgaaagcagggaaaacatgagagaagaagggatgaggtttgcaacgaaggggccggcgagtgggatcgtatcaagactagaagaactggcggcgagagttcccggtaagctccgtgtgacgaagagctcagccgcaggggttaggttggaaggagaggagcggggccgcaaagggcgacttgcggtggccgcagagatcttcgcagtggcgccatccgtgcttgtggtggacgtgaaaatggacggcggcgatacgctggagtacaagaggttctgctgcaacgatctccggcctgcgctcaaggatataatgtggcaatcatcggaagttcagaccacctccgccgcttgagtattcaacgtaggtttctcctccggcctttgtgtttgtacagtgagtgatggaatagaaggcttggttggaagcaatctctgtgatgtttaagcttcagtctgttggatttggtttcatattaatgtggttgtaattgtataatt

SEQ ID NO: 3359 - DNA, 544 bp, Secale cereale
cccaccttccgtcctacccccgtcgtcgcggctccagctagggtttctcgcctccgcgctcccgccccaccgccggccccgtccgccatgtcgaagcaaggagggaaggccaagccgctcaagcaggccaaggtcgccgagaaggactacgacgagaatgacctggcatacctccagaagaagaaggatgagcaaaaggccctgaaggagctgaaggccaaggcaggccagaagggtgcgctgggaggatccggcctcaagaagagtgggaagaaatgagtctgcccacccattcgtaatgcccagaaaatgataatctatctacctatctgtgttgcgcttcactacctgtggttgtaacagactaccttcagttgtgttgagcattaagcatcgtcgcagtcggttgctgaaacctatggcatttgagcagcctcttctgcttatctatgatacagatggtctctagctaataatgacatgacttgttttgtgatgaaaaatctctaatgtgtgcatcaagtcttccaatttctttgcgttg

SEQ ID NO: 3360 - DNA, 557 bp, Euphorbia peplus
ggcgaattagggttagctctatcttcgtctcttctccagtttctctgaattcttcgaatcaaactcttaaccctaagcagtagccatgtcttctaagcaaggtggaaaagcaaagcctttgaaggcacccaaggctgcaaagaaggaatacgacgaggatgatttggccaacattcagaaaaagaaggaagaggagaaggcacttaaggagcttagagccaaagcacagaaaggacctattggaggtgctggccttaagaagagtggaaagaaatgagggttttcaaaacccataatcaaatatagctatcgatggcttgttataatagattattttgaccatattttcctctgtttaacatgaatgattgggtaccgacaatgtggaattgtatgagtttgagttaatgtgatactcaataatattgtactgtctccatgtgtgtgttcttgtgctctttcgaaattttaatcatttgcattttgtggttagacttggtgatggttcagtctaagattgatcttagcttataaatagatctaagtttgtggttatc

SEQ ID NO: 3361 - DNA, 509 bp, Fraxinus spp
ctagcgccgggtctcttttcgaattttcgtggccccttttttactacatatttgcgcgtcgccaaaattgtaccgctaactgggttagggttactttcattgttcaagcgatttcgtgatcacagcgaagcgaaaccctaacccaccctatattccaaacatgtcttccaagcaaggtgggaaagcaaagcctttgaaggcgccaaaggttgacaagaaagattacgacgaggatgacaaggcttttcttcagaagaagaaggaagaggagaaggctctgaaggagcttaaagcaaaggctcaaaagggagcacttggaggtgcagggctgaagaaaagtggaaagaaatgataacttatgaagaactactagacctttgttgtcattgtaatgcgatcttactatttggtttaaatctgtttagcttgacgtcttgcttagataaacaattgagcaactttttatgaagtttgtgtaaaaactattttctttggagcaataaacgtgt

SEQ ID NO: 3362 - DNA, 434 bp, Fraxinus spp
accttttcatttttcaagcgatttcgtgatcacagcgaaaccctaaccctagatttcaaccatgtcttccaagcaaggtgggaaagcgaagcctttgaagcaaccaaaggctgacaagaaagagtatgacgaggatgacaaggcttttcttcagaagaagaaggaagaggagaaggctctgaaggatcttaaagcaaaggctcaaaagggagcacttggaggtgccgggctgaagaaaagtggaaagaaatgaaacttgtgaagaactacaagaaacaaaaaactcctttgttgtcgattgtatcgtgatatactatttggtttaaaccattttagcatgatgttcttgcttatgctaaactattgagcaacttcctatgaaatttctttgtgtagaactatttgtttggatcaataaacgtgttgttttgtat

SEQ ID NO: 3363 - DNA, 435 bp, Fraxinus spp
gggttagggttaccttttcattgttcaagagattttgtgatcacagcgaagcgaaaccctaacccaccctatattccaaacatgtcttccaagcaaggtgggaaagcaaagcctttgaaggcgccaaaggttgacaagaaagattacgacgaggatgacaaggcttttcttcagaagaagaaggaagaggagaaggctctgaaggagcttaaagccaaggctcaaaagggagcacttggaggtgcagggctgaagaaaagtggaaagaaatgaaaacttatggagaactactagacctttgttgtcattgtaatgcgatctttttatttggtttaaatctgtttagtgcgacgtcttgcttagataaacaatcgagcaactatttatgaagtttgtgtaaaactatttctttggagcaataaacgtgtgtggttt

SEQ ID NO: 3364 - DNA, 417 bp, Fraxinus spp
gggttacctattcattgttcaagcgatttgtgatcacagcgaagcgaaaccctaacccaccctatattccaaacatgtcttccaagcaaggtgggaaagcaaagcctttgaaggcgccaaaggttgacaagaaagattatgacgaggatgacaaggcttttcttcagaagaagaaggaagaggagaaggctctgaaggagcttaaagccaaggctcaaaagggagcacttggaggtgcagggctgaagaaaagtggaaagaaatgaaaacttctggagaactactagacctttgttgtcattgtaatgcaatctttttatttggtttaaatctgttttagcgcgacgtcttgcttagataaacaatcgagcaactatttacgaagttttcgcgttaaaaacttctttcgttaggagt

SEQ ID NO: 3365 - DNA, 401 bp, Fraxinus spp
gcgatttgtgatcacagcgaagcgaaaccctaacccaccctatattccaaacatgtcttccaagcaaggtgggaaagcaaagcctttgaaggcgccaaaggttgacaagaaagattatgacgaggatgacaaggcttttcttcagaagaagaaggaagaggagaaggctctgaaggagcttaaagccaaggctcaaaagggagcacttggaggtgcagggctgaagaaaagtggaaagaaatgaaaacttctggagaactactagacctttgttgtcattgtaatgcaatctttttattggtttaaatctgtttagcgcgacgtcttgcttagataaacaatcgagcaactatttatgaaagttttgtgtaaaactatttctttggagcaattaaacgtgt

SEQ ID NO: 3366 - DNA, 526 bp, Carpinus betulus
aaaagggtttcgtctctctccttctgactctgcttttgctttccaatccaggccaaaccctagcctagatcacagccatgtcgtccaagcaaggaggaaaggcaaagcctttgaagcagcccaaggctgacaagaaggaatacgacgagattgatatggccaatattcagaagaagaaggatgaagaaaaggcactcaaggagctcagagccaaggcccagaagggacccattggaggtgctgggctgaagaaaagtgggaagaaataagggtttaggacccaaataagggctctctctatcaatctatcaattcttcagcttgaaccaaaattattatgatgatgtactatgattaaagttacaattatcttcgtactatgtgtgttaccaaactttgtggagtcatcttcatgcaagactaaatttgcaagttgaatgtttgtgctatttacctgttcctaaaactgtcgtactatgagctttttgtttgagaacattgattttgattttgtgccttgctaagt

SEQ ID NO: 3367 - DNA, 494 bp, Avena sativa
ctgcttccttccttcctcctcgtcgcggctcgagctagggtttctcgcctccgccctcccgacccccaccgcctgctccatcagccatgtcgaagcaaggagggaaggccaagccgctgaagcaggccaaggtcgccgagaaggactacgacgagaatgacctggcttacctccagaagaagaaagatgagcaaaaggcactgaaggagctgaaggccaaggcaggccagaagggtgcactcggaggatccggtctcaagaagagtgggaagaaatgagcctgtctactccatctgtaatgcccagaaaatgataaaccatctatctacctgtgttgcgcttcactatctgtggttgtaacaaactacctttcaactgtgtcgagcgttaagcttcatcatcgcggtcggttgctgtagcctattgtgtttcagcctctcttctgcatggctatgatacagatggtttccttagctaataatttgacgtgattt

SEQ ID NO: 3368 - DNA, 436 bp, Olea europaea
ccgtggcaatttggcaccttttcatttttctagcgatttcgtgatcagagcgaaaccctaaccctatatttcaaccatgtcttccaagcaaggtgggaaagcaaagcctttgaagcaaccaaaggctgacaagaaagagtacgacgaggatgacaaggtttttcttcaaaagaagaaggaagaggagaaggctctgaaggagcttaaagcaaaggctcaaaagggagcacttggaggtgctgggctgaagaaaagtggaaagaaatgaaacttaaggaacaaaaaactcctttgttgccaattgtaacgcgatattaccatttgttttaaaccattttaccgtcttgttcttgcttatgcaaaactattgagcaacttcctactaactttcattgcgtacaactatttgtttggagcaatattcgtgtggttttgt

SEQ ID NO: 3369 - DNA, 502 bp, Olea europaea
tagcgatttcgtgatcagagcgaaaccctaaccccctaaccttagatttcaaccatgtcttccaagcaaggtgggaaagcaaagcctttgaagcaaccaaaggctgacaagaaagagtacgacgaggatgacaaggcttttattcagaagaagaaggaagaggagaaggccctgaaggagcttaaagcaaaggctcagaagggagcacttggaggtgctgggctgaagaaaagtggaaagaaatgaaacttaaaaagtactacaagaaacaaaaaactcctttgttgtcaattgtatcgcgatattaccatttggtttaaaccattttagcatgatgttcttgcttatgctagactattgagcaactttctacgaagtttcattgtgtagaactatttgtttggagcaataaacgtgtggttttgtatgtctgagaggctttgatcctttctggaagcctttttgttgattgtctaagttttcgtgcgtcagtttcaaaccg

SEQ ID NO: 3370 - DNA, 567 bp, Plantago ovata
accaattaacggctggggaacatcaataataatagtactatttctctgcagctgcaacagcgatagggtttgaggagcatcttttctctcttccaattccgatcgcatccaatccctaaccaaccaccaaccatgtctagcaagcaaggaggaaaagcaaagcctttgaagcaacccaaggccgaaaagaaagagtacgacgagattgacaaagctaatattcaaaagaaaaaggatgaggagaaggctctcaaggagctcaaggcaaaggctcagaaaggtgctcttggaggtgctggtctgaagaagagtggcaaaaaatgatttccaagtaccagttgtctccaatgagtgttcatgactcgttgatgttatcatatttttatttagtgtgtcgcataaacctgttggctcgttcttatctgacagacggtctttagttattgaacttacggagtcttcacttctggggttatatatattctgctattaaactttgttcttgtaggtttttaccgtctcatgatttaaatggtctttactctactgatttctcagcatctggtg

SEQ ID NO: 3371 - DNA, 863 bp, Primula obconica
gtaccacttactagcaaaattactttctttctagagcctttacgtaatacttatcgttaggctgaactacttctttcctagcccctcgcacagttgttcaggctcttcctcccactcctttgctgaatacgtatatgtacgtactctttggttccacgggggggcccgaatcgtcgctggcttcagcaaatagggtcggaaagcatgggaatactggacgtcgagttcaaccatgtatttaaagtgatgagtgactagagaccctgttgcggcacgaaagcttgggagcagaatcgaatttctttcttcttcttctgggcgaagtagaacaatcagatcgattatgattttcggccgcccattacggccgaaaataattcaattattggtcaaaattggttctctctctctctctagaaaaaattcccaaaaccctaaccctagctttcaaccatgtcgacgaagcaaggtggaaaagcaaagcctttgaaggcacccaaggttgacaaaaaggaatacgatgaggttgacaaggcaaacatacagaagaaaaaggatgaggaaaaggcactcaaggagcttaggaccaaggctcaaaagggtgcacttggaggtgctggactcaagaagagtgggaagaaatgagtagttctaataacagggctggaccttttaatttgtgtactatttcttaagtgaaagcacaataactacttttattgtgattgttctggattgggttgagcttgttgccaagccgtttagtttgtgtgaaatccaagttacgtaatacatatattcgtgtcttttgcagtattgtctttaattaactaggaggtcggttggggtcggtcgtctctacg

SEQ ID NO: 3372 - DNA, 541 bp, Secale cereale
ccccttccgtcgtggtccgttcggtcgacgtaccgtcgaccgcgtaccccccgtcgtcgcggctccagctagggtttctcgcctccgcgctcccgccccaccgccggccccgtccgccatgtcgaagcaaggagggaaggccaagccgctcaagcaggccaaggtcgccgagaaggactacgacgagaatgacctggcatacctccagaagaagaaggatgagcaaaaggccctgaaggagctgaaggccaaggcaggccagaagggtgcgctgggaggatccggcctcaagaagagtgggaagaaatgagtctgcccacccattcgtaatgcccagaaaatgataatctatctacctatctgtgttgcgcttcactacctgtggttgtaacagactaccttcagttgtgttgagcattaagcatcgtcgcagtcggttgctgaaacctatggcatttgagcagcctcttctgcttatctatgatacagatggtctctagctaataatgacatgacttgttttgtgatgaaaaatctctaa

SEQ ID NO: 3373 - DNA, 540 bp, Secale cereale
tctcgcctttcccctccttccgtcctccccccgtcgtcgcggctccagctagggtttctcgcctccgcgctcccgccccaccgccggccccgtccgccatgtcgaagcaaggagggaaggccaagccgctcaagcaggccaaggtcgccgagaaggactacgacgagaatgacctggcatacctccagaagaagaaggatgagcagaaggccctgaaggagctgaaggccaaggcaggccagaagggtgcgctgggaggatccggcctcaagaagagtgggaagaaatgagtctgcccacccattcgtaatgcccagaaaatgataatctatctacctatctgtgttgcgcttcactacctgtggttgtaacagactaccttcagttgtgttgagcattaagcatcgtcgcagtcggttgctgaaacctatggcatttgagcagcctcttctgcttatctatgatacagatggtccctagctaataatgacatgacttgttttgtgatgaaaaatctctaatgtgtgcatcaagtcttcc

SEQ ID NO: 3374 - DNA, 478 bp, Antirrhinum majus
ctattattttccgcgattgggttagggcactcgattatacttccattgtccccaaaattctcttgatcctaaccctagaattaaatcatgtcttcaaagcaaggaggaaaagcgaagccgttgaaggcacctaaagcggagaagaaagagtacgacgagattgacaaggctaatattcagaagaagaaagaagaagaaaaggcacttaaggagctcaaggccaaggctcagaaaggagcacttggaggagctggtctgaagaaaagtggcaaaaaatgaggtctgctagaagcaaattggcccagacagacattcttgggtcactgtgtttttattgtcttcttaactagtatgcttatcaaaacaaacattagcttgctttcattgattgtctgtagtcaaacctgctggagtttttttgtttgagataatatgtgtggcatttaaatatatcatactcctgcttttctttggattt

SEQ ID NO: 3375 - DNA, 590 bp, Hordeum vulgare
gcctccttccgtccttcctcgccccaccgtcgtcgcggctccagctagggtttctcgcccccgccgggcccgtccgccatgtcgaagcaaggagggaaggccaagccgctcaagcaggccaaggtcgccgagaaggactacgacgagaatgacctggcatacctccagaagaagaaggatgagcaaaaggccctgaaggagctgaaggccaaggctggccagaagggtgcgctgggaggatctggtctcaagaagagtgggaagaaatgagtctgcctgcccattcgtaatgcccagaaaatgataatctatctatctacctatctgtgtcgcgcttcactatctgtggttgtaacagactaccttcagttgtgttgagcattatgcatcgtcgcagtcggttgctgaaacctatggtattccagcagcctcttctgcttatctgtgatacagatggtccgtagctaataatgacatgacgtaatttgtgatgaaatctgcaatgtgtgcatcaagtcctgtgttgattgcttgcttgctctggtgtttgaagcttcttccacttgattagttggtttctgatattgcta

SEQ ID NO: 3376 - DNA, 466 bp, Setaria italica
gtttctcgcccccgccctcccgcctcaccgccggccccgtacgccatgtcgaagcaaggagggaaggccaagccgctcaagcaggccaaggtcgccgagaaggactacgacgagaatgacctggcatacctccagaagaagaaggatgagcaaaaggccctgaaggagctgaaggccaaggcaggccagaagggtgcgctgggaggatccggtctcaagaagagtgggaagaaatgagtctgcccacccttacgtaatgcccagaaaatgataatctatctatctacctatctgtgtcgcgcttcactatctgtggttgtaaaagactaccttcagttgtgttgagcattaagcatcgtcgcagtcggttgctgaaacctatggcatttgagcagcctcttctgcttatctgtgatgcagatggtccctagctaataatgacatgacttgttttgtgatgaaaatc

SEQ ID NO: 3377 - DNA, 425 bp, Setaria italica
gtccgccatgtcgaagcaaggaggaaaggccaagccgctcaagcaggccaaggtcgccgagaaggactacgacgagaatgacctggcatacctccagaagaagaaggacgagcaaaaggccctgaaggagctgaaggccaaggcaggccagaagggtgcgctgggaggatctggtctcaagaagagtgggaagaaatgagtctgcccacccattcgtaatacccagaaaatgataatctatctatctacctatctgtgtcgcgcttcactatctgtggttgtaacagactaccttcagttgtgttgagcattgtgcatcgtcgcagtatgtcgctgaaacctatggcatgtcagcagcctcttctgcttatctatgatacagatggtccgtagctaataatgacatgacttgttttgtgatgaaa

SEQ ID NO: 3378 - DNA, 495 bp, Avena sativa
cttccttccttcctcctcgtcgcggctcgagctagggtttctcgcctccgccctctcgctccccaaccgcctgccccatcagccatgtcgaagcaaggagggaaggccaagccgctgaagcaggccaaggtcgccgagaaggactacgacgagaatgacctggcatacctccagaagaagaaagatgagcaaaaggcactgaaggagctgaaggccaaggcaggccagaagggtgcactgggaggatcaggtctcaagaagagtgggaagaaatgagcttgcctactccatctgtaatgcccagaatatgataaaccatctatctacctgtgttgcgcttcgctatctgtggttgtgagaaactacctttcaaatgtgttgagcgttaagcatcatcatcgcagtcgggttgctggaacctatcgtgctttggcctgttctgcttatctatgatacagatggttccctagctaataatatgacgtaatttgtgac

SEQ ID NO: 3379 - DNA, 538 bp, Avena sativa
ccctctttccttcctcctcgtcgcggctcgagctagggtttctcgcctccgccctctcgctccccaaccgcctgccccatcagccatgtcgaagcaaggagggaaggccaagccgctgaagcaggccaaggtcgccgagaaggactacgacgagaatgacctggcatacctccagaagaagaaagatgagcaaaaggcactgaaggagctgaaggccaaggcaggccagaagggtgcactgggaggatcaggtctcaagaagagtgggaagaaatgagcttgcctactccatctgtaatgcccagaatatgataaaccatctatctacctgtgttgcgctttgctatctgtggttgtgagaaactacctttcaaatgtgttgagcgttaagcatcatcatcgcagtcgggttgctggaacctatcgtgctttggcctgttctgcttatctatgatacagatggttccctagctaataatatgacgtaatttgtgactggtctcctaggaggaacgttcaaccccctaccagtctccga

SEQ ID NO: 3380 - DNA, 657 bp, Avena sativa
tctcgcctttcccctgcttccttccttcctcctcgtcgcggctcgagctagggtttctcgcctccgccctcccgacccccaccgcctgctccatcagccatgtcgaagcaaggagggaaggccaagccgctgaagcaggccaaggtcgccgagaaggactacgacgagaatgacctggcttacctccagaagaagaaagatgagcaaaaggcactgaaggagctgaaggccaaggcaggccagaagggtgcactcggaggatccggtctcaagaagagtgggaagaaatgagcctgtctactccatctgtaatgcccagaaaatgataaaccatctatctacctgtgttgcgcttcactatctgtggttgtaacaaactacctttcaactgtgtcgagcgttaagcttcatcatcgcggtcggttgctgtagcctattgtgtttcagcctctcttctgcatggctatgatacagatggtttccttagctaataatttgacgtgatttgtgacgtgatatgggagctctgttcctctggtgattgtttgctcctattctgctccattttcacttgctgcttccacttcgtcagctggttgccgatattgtttgttccgactgtgcttcattttcatctgattcataaccatcattgga

SEQ ID NO: 3381 - DNA, 642 bp, Avena sativa
cttccttcctcctcgtcgcggctcgagctagggtttctcgcctccgccctcccgacccccaccccctgccccatcagtcatgtcgaagcaaggagggaaggccaagccgctgaagcaggccaaggtcgccgagaaggactacgatgagaatgacctggcatacctccagaagaagaaagatgagcaaaaggcactgaaggagctgaaggccaaggcaggccagaagggtgcactcggaggatctggtctcaagaagagtgggaagaaatgagcctgcctactccatctgtaatgcccagaaaatgataaaccatctatctacctgtgttgcgcttcactatctgtggttgtaagaaactacctttcaactgtgttgagcgttaagcttcatcatcgcagtcggttgctgtagcctattgtgtttcagcctctcttctgcttagctatgatacagatggtttccttagctaataatttgatgtgatttgtgacgtgatatgggagctctgttcctctggtgattgtttgctcctattctgctccattttcacttgctgcttccacttcgtcagctggttgccgatattgtttgttccgactgtgcttcattttcatctgattcataaccatcattggattttt

SEQ ID NO: 3382 - DNA, 523 bp, Capsicum annuum
ggcacgaggaaaattccaacgccgcttatagatcaagcattttgggttaggagagaacaaggatatttccgttctcatcaacagatccaaactcttagcctagaaaatcaaccatgtctaccaagcaaggtggaaaggcaaagcctttgaaggcagcaaagactgaaaagaaggagtacgacgagactgacaaggcttttcttgcaaagaagaaggaagaggaaaaggccctaaaggagctcaaggcaaaggctcagaaagggtccattggtggtgctggcctgaaaaagagcggaaagaaatgaggatgttatattcttcgtagtattgaaaaactctcttcttacccatggctagatttggtgttctatgttctactagttgatgtttttgttaacttttgggatgtttctatggtgactcaatgattaggatggggcacttgctcctttccaatatattatgacatgcattgtgctgcctttgcctataaataattcatattggcgtaaatttttgtgtg

SEQ ID NO: 3383 - DNA, 558 bp, Euphorbia esula
  misc_feature (416)..(416): n is a, c, g, or t
ggcgaattagggttagctctatcttcgtctcttctccagtttctctgaattcttcgaatcaaactcttaaccctaagcagtagccatgtcttctaagcaaggtggaaaagcaaagcctttgaaggcacccaaggctgcaaagaaggaatacgacgaggatgatttggccaacattcagaaaaagaaggaagaggagaaggcacttaaggagcttagagccaaagcacagaaaggacctattggaggtgctggccttaagaagagtggaaagaaatgagggttttcaaaacccataatcaaatatagctatcgattggcttgttataatagattattttgaccatattttcctctgtttaacatgaatgattgggtaccgacaatgtggaattgtatgagtttgagttaatgtgatnctcaataatattgtactgtctccatgtgtgtgttcttgtgctctttcgaaattttaatcatttgcattttgtggttagacttggtgatggttcagtctaagattgatcttagcttataaatagatctaagtttgtggttatc

SEQ ID NO: 3384 - DNA, 453 bp, Juglans hindsii x Juglans regia
  misc_feature (382)..(382): n is a, c, g, or t
gggggatcatttcgtctttcatactgttagggctctctctttcggattctgcttttgctttcgaatccgcaccagactgtagccctagatcgcagccatgtcgtcaaagcaaggtggaaaggcaaagcctttgaagcaacccaaggctgacaagaaagaatacgacgaggttgataaggccaatattcagaagaaaaaggatgaggaaaaggcacttaaggagctgagggctaaggcacagaagggacccattggaggtgctgggcttaagaaaagcgggaagaaatgaggggtttaagaccgaaattggggactcctattaaattttccagcttgtaacaatcattaccatgatgattatatccatgatgtgtgtgatctngctgctttcttaatttgttactgtactttcggagtcttctttatatgatactaagttttcgtgtttgtgat

SEQ ID NO: 3385 - DNA, 513 bp, Triticum aestivum
cgcctttccccaccttccgtccttcccccgtcgtcgcggctccagctagggtttctcgcccccgccctcccgcctcaccgccggccccgtccgccatgtcgaagcaaggagggaaggccaagccgctcaagcaggccaaggtcgccgagaaggactacgacgagaatgacctggcatacctccagaagaagaaagatgagcaaaaggccctgaaggagctgaaggccaaggcaggccagaagggtgcgctgggaggatccggtctcaagaagagtgggaagaaatgagtctgcccacccattcgtaatacccagaaaatgataatctatctatctacctatctgtgtcgcgcttcactctctgtggttgtaacagactaccttcagttgtgttgagcattgtgcatcgtcgcagtacgtcgctgaaacctatggcatgtcagcagcctcttctgcttatctgtgatacagatggttcgtagctaataatgacatgacttgttttgtgatgaaa

SEQ ID NO: 3386 - DNA, 499 bp, Triticum aestivum
ccaccttccgtccttcccccgtcgtcgcggctccagctagggtttctcgcccccgccctcccgcctcaccgccggccccgtccgccatgtcgaagcaaggagggaaggccaagccgctcaagcaggccaaggtcgccgagaaggactacgacgagaatgacctggcatacctccagaagaagaaagatgagcaaaaggccctgaaggagctgaaggccaaggcaggccagaagggtgcgctgggaggatccggtctcaagaagagtgggaagaaatgagtctgcccacccattcgtaatacccagaaaatgataatctatctatctacctatctgtgtcgcgcttcactctctgtggttgtaacagactaccttcagttgtgttgagcattgtgcatcgtcgcagtacgtcgctgaaacctatggcatgtcagcagcctcttctgcttatctgtgatacagatggttcgtagctaataatgacatgacttgttttgtga

SEQ ID NO: 3387 - DNA, 492 bp, Triticum aestivum
gcctttccccaccttccttcctcccccgtcgtcgcggctccagcttagggtttctcgcccccgccctcccgcctcaccgccggccccgtacgccatgtcgaagcaaggagggaaggccaagccgctcaagcaggccaaggtcgccgagaaggactacgacgagaatgacctggcatacctccagaagaagaaggatgagcaaaaggccctgaaggagctgaaggccaaggcaggccagaagggtgcgctgggaggatccggtctcaagaagagtgggaagaaatgagtctgcccacccttacgtaatgcccagaaaatgataatctatctatctacctatctgtgtcgcgcttcactatctgtggttgtaaaagactaccttcagttgtgttgagcattaagcatcgtcgcagtcggttgctgaaacctatggcatttgagcagcctcttctgcttatctgtgatgcagatggtccctagctaataatgaca

SEQ ID NO: 3388 - DNA, 508 bp, Triticum aestivum
cgcctttccccaccttccgtccttcccccgtcgtcgcggctccagctagggtttctcgcccccgccctcccgcctcaccgccggccccgtccgccatgtcgaagcaaggagggaaggccaagccgctcaagcaggccaaggtcgccgagaaggactacgacgagaatgacctggcatacctccagaagaagaaagatgagcaaaaggccctgaaggagctgaaggccaaggcaggccagaagggtgcgctgggaggatccggtctcaagaagagtgggaagaaatgagtctgcccacccattcgtaatacccagaaaatgataatctatctatctacctatctgtgtcgcgcttcactctctgtggttgtaacagactaccttcagttgtgttgagcattgtgcatcgtcgcagtacgtcgctgaaacctatggcatgtcagcagcctcttctgcttatctgtgatacagatggttcgtagctaataatgacatgacttgttttgtga

SEQ ID NO: 3389 - DNA, 564 bp, Triticum aestivum
ccgcgactggagcacgaggacactgacatggactgaaggagtagaaatcccctcgcctttccccaccttccgtcctccccccgtcgtcgcggctccagctagggtttctcgcccccgccctcccgccccaccgccggccccgtccgccatgtcgaagcaaggaggaaaggccaagccgctcaagcaggccaaggtcgccgagaaggactacgacgagaatgacctggcatacctccagaagaagaaggatgagcaaaaggccctgaaggagctgaaggccaaggcaggccagaagggtgcgctgggaggatctggtctcaagaagagtgggaagaaatgagtctgcccacccattcgtaatacccagaaaatgataatctatctatctacctatctgtgtcgcgcttcactatctgtggttgtaacagactaccttcagttgtgttgagcattgtgcatcgtcgcagtatgtcgctgaaacctatggcatgtcagcagcctcttctgcttatctatgatacagatggtccgtagctaataatgacatgacttgttttgtgatga

SEQ ID NO: 3390 - DNA, 911 bp, Cirsium arvense
cttcaactatggcgagtctaattatggctccccaattgttctcggtctccaaaacaaacaaacctgaacgtaaaacttcacattctaccaacgttaggatcagatcaatgcagagacctttggaagagatatatagcataagggtagaaagaaatgtgtctaaagagcgattagccgagctcgaggtctctaaatggtcaacatggaagacgggcaaatgcaacgttccatgggattggcacgtcgaccaactggttttcatcgaagaaggagaggtaagggtcgtgcctgaaggcagtgaacgacacatgagttttgtggctggtgatttggtacggtatccgaaatggttcgaggccgacctctggtttaacgactattatcaagaacgatatagctttcgggcatatggtgatgattagggtttcttggagtagtttgtgagttgttatttgttgtagtattcagcagttattttcttctagtttttggtgtgatatgaatgagacaaagtactatggaagaagttattgtattagttcagaaattgtaacttttttcttttttcaagaccaatatcagcaatatgattattaccagaaatttgatttaccaacaaattgtgaaaaggtctaaatagcagttttactagtcacaagtcacaacatcatatatcgtttcgtatgcaagaattttcgatcctgcagatctcatttctttccacttttcttcaggccagttcctccgagtgctcctttttgagcttttgctctaagctccttcagtgccttttcctcgtccttcttcttttgaatgttggccttgtctacctcatcgtattctttcttctcagccttaggttgcttcaatggcttcgcttttcctccttgcttggacgacatgatcggaat

SEQ ID NO: 3391 - DNA, 1057 bp, Cirsium arvense
ttccactttgccgtccaagctcactgtcaatttcgtcctcccttactcttccgagctctctcaaacggaggttgatatggtgatagttccagcaacaactgggcagatgggtattttaccaggacatgtacccacaattgcagagctgaagccaggtgtcctgtccgtccacgaagggactgatgtgaagaaatacttcatcagcagtgggtttgcttttgtgcactccaactcgtatgcagatatattggctgttgaggctgttcctcttgaccgaatcgatccggcccaagtacagaagggactgagcgagttcactcagaagctgagttcggcatcaaccgagttggacaaggctgaagcccagattggagtggatgttcacagtgctctcaactctgctcttacaggttagagttaaaaagagtataatgattggtgagtgagtagtttgttgtgatccttttaactcaaaaataagagttgtctctcaacactttctttatgcatatggggaaatatgtatcacatttgatatcaattttatcaaatttggttttctttttggacaaatatcatatctaaaatcaagattcaagaatcaacagccttatacaaaccataaagcattaataataacttgcataaatcagtacaccccataaaacaacaataccaaatgtcagtcagtatgattgttcctattgagtttttacacaggaacaaccacaaaagacttaatacaaagacattaaggacatcattcattagaataatatagaatatgcaataagttttacctcatttcttcccacttttcttcagaccagcacctcccaatgctcccttttgagctttggctctaagctccttcagtgccttttcctcttccttcttcttttgaagatttgccttatccatctcatcgtactctttcttctcagcctttggttgcttcaatggcttcgcttttccaccttgcttggacgacatgatcgaaatttagggttagggtttgctgtgattgcgggaatcggaagagaaaacgagaaccaaa

SEQ ID NO: 3392 - DNA, 431 bp, Fraxinus spp
ttcgtgatcacagcgaagcaaaaccctaacccaccctatattccaaacatgtcttccaagcaaggtggaaaagcaaagcctttgaaagcgccaaaggttgacaagaaagattacgacgaggatgacaaggcttttcttcagaagaagaaggaagaggagaaggctctgaaggagcttaaagcaaaggctcaaaagggagcacttggaggtgcagggctgaagaaaagtggaaagaatgaaaacttatggagaactactagacctttgttgtcattgtaatgcaattttactatttggttaaatctgtttagcatgacgtcttgcttagataaacaatcgagcaactttttaaggagtttgtgtaaaaactatttctttaggagcaaataaacacgtgtggtttcgtatatgtgagaggctttgatcctgcc

SEQ ID NO: 3393 - DNA, 388 bp, Carthamus tinctorius
gcttcgaacaacttttacgaattttctctatcatgtcgtctaagcaaggtggaaaagcgaagccgttgaagcaaccgaaggccgataaaaaggaatacgatgagatagacaaggctaacattcagaaaaagaaggaagaagagaaggcattgaaagagcttagagccaaagctcagaaaggagcattgggaggtacaggtctcaagaaaagtgggaagaaatgataactcaacaattagacctttaaccctaaaccctacatgtcttaatgtggttttggatgaaagttgttgtcaaagatttgtggggtttcaattttcttgttaaacaataattacaagtgtgttgcattacaaaaatatatgcatacaagagagcaagtgatcct

SEQ ID NO: 3394 - DNA, 594 bp, Cucurbita pepo
agtttgataacttgacaagaacagcaattttgttgaccgacccaatacctttcgggttggattcgggcatctccgtatacaaaaacgcaacctagggctgccattcgtccggttttgccttgatttccaccggcttctgcttctcattctcttctttgctaaagttgccggttgtgatactttgcgagccgttgattgccgcccacgggcgttccttctttgtgctattcgattcaggccaaaccttatctttccgccatgtcgtccaagcaaggagggaaagcaaagcctttgaagcaacccaaggttgacaagaaagaatatgatgaggttgatctggcgaataagcaaaagaagaaggacgaggaaaaggcgctgagagagctgaaagcgaaggcccaacagaaggggcctttggaggtgctgggctgaagaagagtgggaagaaatgatgaacttcccacgcaatatatggtataatgaaaactgaataatgtaagagtcgaatgctttcttctcttctcttctcttctgttctgtgcaaaatctggaaaccagaatgaaatatgaatgaatgattattgaagtttgagt

SEQ ID NO: 3395 - DNA, 465 bp, Abies balsamea
ggaagggtttgctaaggaaggaaggaggctctcagtctgtccccatatacgcagcgaccatgtctactaagcaaggtggaaaggccaagcccctcaagcagccaaagaaggataaagctgaatatgatgaggctgacctagctcacattcagaagaaaaaggatgaggagaaggcattgaaggagttgaaagctaaggcagcacagaagggtagctttggaggaacagggttgaagaaaagtggtaaaaagtagtctgcaattgagtgcttttttcacatgtagaattcatgccactaaaagcataattatggggactggttaggggagtgtttactcaatttcaaagtttgtgatactgtcaataatggaccttctgaactcacagctgttttaatgtgaatgaatatttaatgtcacaatgataatgtgagatatgtattgaaatttctaagagatatttggg

SEQ ID NO: 3396 - DNA, 458 bp, Amsonia hubrichtii
ttctttatttattatattatataagctcctctcgagaggattccaagatcaggaaatcagtatctgggctgggttgtctttgccgctgttcacgcttttctgtgatcagagatagttcgaaacctagccctagagatcaaccatgtcttccaagcaaggtggaaaagctaagcctttgaagcaaccaaaggctgacaagaaggagtactttgacgaggataaggctttccttcagaagaagaaagatgaagaaaaggcactgaaagagctgaaggcaaaggctcaacaaaaagggtcctttggaggttcaggactgaagaaaagtgggaagaagtgagactttaggatccatcaatgcccttctaaaggattcttgtatcagattgggccatcatcttgtttgttctacatgttaggaactgctttttcctcttgtttctagttataaccatgtgaaa

SEQ ID NO: 3397 - DNA, 634 bp, Cicer arietinum
aggtctttctttctgccgtgtcgtttgctgttattttctgtcgttttcctattcagaccgaaccctaatttttcacccaaaccatgtcgaccaagcaaggtggaaaagctaagcctttgaagaaaccaaagtctgataaaaaggattacgatgagattgacatggctaacatccagaagaaaaaggatgaggagaaggctctaaaggagttaaaagctaaggcacaacagaagggatcttttggaggatctgggctcaagaaaagtggaaagaaatagaggagctctttctcatgatttcatacttccagtattgagctctgtaattacgattatgactatgacaatatctcttattgtgtgacgtgttttattactgatgttagtactgaaccaaggcatgttatgatgtaaaacacaataagttacttgtttgtacctttattgtgtctccctttggagttatgataattacatctgtttagtgttttggctgtgataataacattcttgacacggtttaattttaaattatgtgtttggttctaactttaaggagggggaggacagcaaaaatcacttttcaagtggtttttattctcccagcattttaggagatttggatgggaggggag

SEQ ID NO: 3398 - DNA, 472 bp, Cucurbita pepo
gtccttgatttccaccggcttctgcttctcattctcttctttgctaaagttgccggttgtgatactttgcgagccgttgattgccgcccacgggcgttccttctttgtgctattcgattcaggccaaaccttatctttccgccatgtcgtccaagcaaggagggaaagcaaagcctttgaagcaacccaaggttgacaagaaagaatatgatgaggttgatctggcgaataagcaaaagaagaaggacgaggaaaaggcgctgagagagctgaaagcgaaggcccaacagaagggggcctttggaggtgctgggctgaagaagagtgggaagaaatgatgaacttcccacgcaatatatggtataatgaaaactgaataatgtaagagtcgaatgctttcttctcttctcttctgttcttctcttctgttctgttctgtgcaaaatctggaaaccagaatgaaatatgaatg

SEQ ID NO: 3399 - DNA, 596 bp, Distylium racemosum
ggggcactcataatttacaaacaaaactagtacacctgacatttccatgtcaatgcaaacgttacacttccttttgtacaggaggcacagaaagactcaaaagttggctcacatctggactgcattcctgagcggacaaaaggcggcggaagtacgtactcagcgaccatgtctagcaagcaaggtggaaaggcaaagcccctgaagcagccaaagcaggataaaaaagaatatgatgaggttgacctagccaatattcagaagaaaaaggatgaggaaaaggcattgaaggacctgaaagctaaggcacaacagaagggttcttttggtggatcggggttgaagaagagtggcaaaaaatagtgcaatagatttttatataggatgtccctagtgtctactagggtatgatgatgcatgcatggttaacatgcaatgtgggccatattgtccttaattatggttctcatcctaattaactctttttaatcatgcatcttataatgtaagaataacttactgaaagatgtttctctaactgggctgagataaattagatgatctaaaactgatttgatgctttaaagtttcttttt

SEQ ID NO: 3400 - DNA, 550 bp, Euonymus alatus
ggggaaccaaatcacgagtgcccttcaataattgatcaacgttagggtttggtgaattgctgttctttcagcaccaaatctttaattccggtggcagccatgtcttccaagcaaggtggtaaattgaagcccttgaagcaacccaaaggcgataagaaagagtacgacgagattgataaggctaacattcaaaagaagaaagatgaggaaaaggcactaaaagagcttaaagccaaggcccagcagaaaggagcctttggaggatctggcctcaagaaaagtgggaagaaatgagggatttgaaacccaaatcataatacgaattcttatggtgtgattacaaagtaaactattatgaatcctttgtctagtttgatgggcctatgatgtaactttggaggttgggatggtccagtctctttataaatcccacttgtacacttttcatgttgtgtaaaaaaccgggtaattcttaagttgtgtgcttgctctattagtctgttaattggctacatatccatgtaactttgcttgaagaagtgattttagt

SEQ ID NO: 3401 - DNA, 559 bp, Euonymus alatus
cggccgggggaaccaaatcacgagtgcccttcaataattgatcaacgttagggtttggtgaattgctattctttcagcaccaaatctttaattccggtggcagccatgtcttccaagcaaggtggtaaattgaagcccttgaagcaacccaaaggcgataagaaagagtacgacgagattgataaggctaacattcaaaagaagaaagatgaggaaaaggcactaaaagagcttaaagccaaggcccagcagaaaggagcctttggaggatctggcctcaagaaaagtgggaagaaatgagggatttgaaacccaaatcataatacgaattcttatggtgtgattacaaagtaaactatcatgaatcttttgtctagtttgatgggcctatgaggcaactttggaggttgggatggtccagtctctttataaatcccacttgtacacttttcatgttgtgtaaaaaaccgggtaattcttaagttgtgtgcttgctctattcgtctgttaatcggctatatatccatgtaactttgcatgaagaagtgattttagtgtt

SEQ ID NO: 3402 - DNA, 473 bp, Tropaeolum majus
cggccggggtccagaccatcaattattgctttagggttggggcttcctatctccgcctttcccctattctttgtgttcgttgttcaggccaaattctaaaatctataatttcaaccatgtcgtctaagcaaggaggtaaagctaagcctttgaagcaacccaaggctgataagaaagaatacgacgagcatgatttggccaacatccagaaaaagaaggatgaggagaaggcacttaaagagcttagaagcaaggcacaacaaaagggatcatttggaggatctggacttaagaagagtggaaagaaatgagagaatcttaaaacacaccaaactgaagattcaaaacttataattcttgtgttgtgatttatatattttgaatataacgcaagtaattgtagccttcacaatatcttcggtaacttggtttatatgatggttgctcgttttgaatgctaaaactcagtttgg

SEQ ID NO: 3403 - DNA, 421 bp, Lippia dulcis
  misc_feature (101)..(101): n is a, c, g, or t
aatttccgatctcgcgcatctttttcccaatcacagcgagccctaaccctagaattcgaccatgtctagcaagcaaggaggtaaagcgaagccgctgaagnaacctaaggccgataagaaggaatacgacgagacggacatggctaacattcaaaagaagaaggaagaggagaaggctcttaaggagctaagggcaaaggctcagcagaaaggatcatttggaggttctggcttgaagaaaagtggcaagaaatgagacccaattttgggtcaacacactcctttttcgtgttgtggtatgcttgcttgatttggatttgtacgtttcaaacgtgccatcttttttctgattgatgtttggtaacctgcaaacttagcaggattcttttatgtggaattgatttgcatatgacaaaaagaa

SEQ ID NO: 3404 - DNA, 770 bp, Trigonella foenum-graecum
cggccgggggagtgagggtaaggtctttttgttcgcgtgctgttatttttctctgtcgttttcattttcagaccgaaaccctaactcttcccccaaaaccatgtcgaccaagcaaggtggaaaagctaagcctttgaagaaaccaaagtctgataaaaaggattacgatgaggttgacatggctaacatccagaagaaaaaggatgaggagaaggcgctaaaggagttgaaggctaaggcatcacagaagggatcttttggaggatctggactcaagaaaagtggaaagaaatagaagggctctctgtcatgatttcgtatttccattattgagctctgtaattactattatgaccatgagaacatttcttattgtgtgtcctttttaattgctgatcctagtcctgaaccaaagcttgtcatttgatgatgtaaaagcaataagttacttgtttgtagcttcactgtgtctccctttggggttatgatgataattacacctgtttagtgttgtggctttggcatagatttttatttttcttggtaaaaatggcttggcatgcaaaatttcaattatcaaattccattatgccaccttatgctaacagcttacattgtgagagatgagattcttgagttgagtctgtgccaatttcttggcatttgctttggaatcatagtgagtttatggctacctttgcttgtgtcaaactcaccgtatacgagtgtgattccttgtgcggaccattttttataatgaattttgcttg

SEQ ID NO: 3405 - DNA, 431 bp, Valeriana officinalis
tcaaatccgggtttaggcgactcttctctattcccctaccggatcaaaccctaaccctagaaatcaaccatgtcgtccaagcaaggtggtaaagcaaagcctttgaagcaacccaaggccgataagaaagaatacgatgaggatgatttggctaaacttcagaagaagaaggaagaggaaaaggcactaaaggaactcagagctaaagcttcacagaaaggttcatttggaggcgctggactcaagaaaagtggcaagaaatgaagcaaaacttactactactatttctattattatcgttttataatcgtgctgtgaacatgtgattgttgaatttctcgacgtttgataacaactctgcttcgactttgtacttaaaagatctctacagggaatcgcatatatcccttttaagttttaatccttcataa

SEQ ID NO: 3406 - DNA, 377 bp, Valeriana officinalis
ccctagaaatcaaccatgtcgtccaagcaaggtggtaaagcaaagcctttgaagcaacccaaggctgataagaaagaatacgatgaggatgatttggctaaacttcagaagaagaaggaagaggaaaaggcactaaaggaacttagagctaaagcttcacagaagggttcattcggaggcgctggactcaagaaaagtggcaagaaatgaagcaaaacttactactactatttctattattatcgttttataatcgtgctgtgaacatgtgattgttgaatttctcgacgtttgataacaactctgcttcgactttgtacttaaaagatctctacagggaatcgcatatatcccttttaagttttaatccttcataa

SEQ ID NO: 3407 - DNA, 496 bp, Brassica juncea
gtctgaaactctgctttttcccccaattctcagatcagcatcagaccctagctctacaaatccgtcatgtcgtccaagcaaggaggaaaggcgaaacctttgaagcagccaaaagctgataagaaggaatacgatgagcacgatatggccaacattcagaagaagaaagacgaggaaaaggcacttaaagaactaagagccaaggcatcgcagaaaggatcgtttggaggctctggtcttaagaagagcggcaagaaatgatcccgtttaatatccatgagaaagcccgtctttgaccagtgcttatttatcaacttttaatgttgtgtaactttctatcatggctgtatgagagtgactttgcctatctatcccataacatatgtttgcttccgccactttttttttttcatttcaaaagaaaaagaaagatgttttctagttaaaaaccaagtgacgccatagttcttcatttcctgattcaagattcagtttg

SEQ ID NO: 3408 - DNA, 437 bp, Ocimum basilicum
gcacgagggaggagctgggctagggcatcttattgatccccctttattcgcacctcaattttgcgatctcatcaaatttccaagcgcataattcaaccatgtcgagcaaggcaggaggaaaagccaagcctttgaagcaacctaaggtggccaagaaagagtacgatgaggatgaccttgctaaacttcaaaagaagaaagaagaagagaaggctctcaaggaacttaaggcgaaggcccagcagaaaggagcatttggaggttctgggttgaagaaaagtggcaaaaaatgatgggaattattgaaatagctcattgattgccatgtttgtcaatttctgcatatgctatttcaacatgttagatgttcctagtaatcgagtctgcaaaagctttgcagatataagattgtatcccaacatttgaatctatgatat

SEQ ID NO: 3409 - DNA, 463 bp, Ocimum basilicum
ctcgcgccccgcatcaattttctgtcttctgattgcaccgaataccaaccctagaagtcagccatgtctagcaagcaaggaggaaaggcaaagccgctgaagcaacctaaggcggagaagaaggaatacgacgagatggacaaggctaacattcaaaagaagaaggaagaagaaaaggccctgaaggagctgaaagcaaaggctcagcagaagggagcgtttggaggttctggattgaagaaaagtgggaagaaatgagaccaccaattgatgtgtgcttgatttttagtttgtgatttggacatgttagcttgcgcttattgatgtttggaaacatttgaacttcccgaggagactttctatgcataattgcgtgcataattgtcatcttacatttcacttccttgttttctaacactgaatgatcaagtgatatatgaacaccctatgcctcgactttgct

SEQ ID NO: 3410 - DNA, 497 bp, Manihot esculenta
acctgcaataattcagtgaattagggttaggactctcttcgtctttctcccaatttctctttcgtttcttcaaatcagatcctaaccctagctaccagccatgtcttccaagcaaggtggaaaagcaaagcctttgaaacaacccaaggctgataagaaggaatatgatgagactgatatggccaacattcagaagaaaaaggaagaggaaaaggcactcaaggagcttagggccaaggcaactcagaaaggaactttcggaggttctgggctcaagaagagcgggaagaaatgagggtttgcaaacccatggaatagaatatatcgattcatggcgtgtgactgcagattatattgtgatgacatcttttctttagtgttggtttaagacatccttagcttaacgcaatggtgtacttttatgttaaatgccactcaacctcgagtcaaatgtcagtaatcgtgtgaaactaaataaaaggttatgcttttgtgat

SEQ ID NO: 3411 - DNA, 529 bp, Cicer arietinum
cgcgggcaggtacgcggggggggagggtaaggtctttctttctgccgtgtcgtttgctgttattttctgtcgttttcctattcagaccgaaccctaatttttcacccaaaccatgtcgaccaagcaaggtggaaaagctaagcctttgaagaaaccaaagtctgataaaaaggattacgatgagattgacatggctaacatccagaagaaaaaggatgaggagaaggctctaaaggagttaaaagctaaggcacaacagaagggatcttttggaggatctgggctcaagaaaagtggaaagaaatagaggagctctttctcatgatttcatacttccagtattgagctctgtaattacgattatgactatgacaatatctcttattgtgtgacgtgttttattactgatgttagtactgaaccaaggcatgttatgatgtaaaacacaataagttacttgtttgtacctttattgtgtctccctttggagttatgataattacatctgtttagtgttttggctgtgata

SEQ ID NO: 3412 - DNA, 755 bp, Citrus sinensis
ggggaacaacgagaactttcaatcattgtgtgttagggttggatctgtctctgtgtttccctcccaattgcttagcttcttcgagttctcgtcgaaaccctaatcacagttcccagccatgtcgtccaagcaaggtggaaaggccaagcctttgaagcaacccaaagctgacaagaaggagtatgacgagcaagatttggccaacatccagaaaaagaaggaagaggagaaggccctgaaggagctcagagccaaggcgcaacagaagggatcatttggaggttcagggctcaagaagagcgggaagaaatgagatttttgaatcccaaatcagaattcaaactatgaaatcttgtaccgtggttatgaatttcattgttatgggtggactttgtttagtgtgattatctatgacatcaattggtcaatgatggtatatgtcatgttaagtatggttctaaacttttgtttagtgtctgtctccatgtaaacctcaaataaatttgggttgcatgttgtgttttactgtgccgcaaaattatttgcttgcttaatgcttaatacggtttcaaatacgtatttgattccaggtagtcaggagactagtctactgctggtcctacttgttttcgaatcaagtcacttaactagatgtatttggctgtaatgttttagaaataggctatatacttgtcaagtactcctcctttcatctttctcaatctatttcctatggtactgtctcttattggaaa

SEQ ID NO: 3413 - DNA, 621 bp, Unknown
  Sequence found in Organisms: Citrus clementina, Citrus sinensis
aaaataaaaagaaaactgaaacaatttatcacgcactacgcacgtgcaacctccccaaatccgctcctctatatatagccctaaatcgacagtaatcctcgaacaacgagaactttcaatcattgtgtgttagggttggatctgtctctgtgtttccctcccaattgcttagcttcttcgagttctcgtcgaaaccctaatcacagttcccagccatgtcgtccaagcaaggtggaaaggccaagcctttgaagcaacccaaagctgacaagaaggagtatgacgagcaagatttggccaacatccagaaaaagaaggaagaggagaaggccctgaaggagctcagagccaaggcgcaacagaaaggatcatttggaggttcagggctcaagaagagcgggaagaaatgagatttttgaatcccaaatcagaattcaaactatgaaatcttgtaccgtggttatgaatttcattgttatgggtggactttgtttagtgtgattatctatgacatcaattggtcaatgatggtatatgtcatgttaagtatggttctaaacttttgtttagtgtctgtctccatgtaaacctcaaataaatttgggttgcatgttgtgtttt

SEQ ID NO: 3414 - DNA, 584 bp, Cycas rumphii
  misc_feature (453)..(453): n is a, c, g, or t
tgcccaccggctgttttaggtgtcctcggttcattgcatcaggtaccaaggttccactggtctatcagggatcggcagcccgcctccaatcatgtcaaccaagcaaggtgggaaagctaaacccctaaagcaaccaaagcatgagaaaaaagagtatgacgagagtgacttggctcatcttcaaaagaagaaggatgaggagaaggcattgaaagatctgaaatctaaagcagcacaaaaaggagcacttggcggttcaggtatgaagaaaagtggcaaaaagtaatatgatcgtctgaatgatgttgggccttgttgtgtaagaattagtaaatatgcaagatttatttcatgattatgccccttcgtgggtgactgattatgaccttggagttatcatacagctaccttaactttgtgcttatttttttcttgtcacatgatagtatgtanggtttgataatagcttgaactctagtaagttaaaaggaattaccttctctaatttgaagtttaaattattggttgagttgcttcgtgcatttcctgtgaatggaaactatttaaacctcattgaggagacg

SEQ ID NO: 3415 - DNA, 451 bp, Zingiber officinale
gcacgagggaaaccctagattttcatcctccgcctcttcgccttcttccatcgagccgaagcgatcatgtcgtccaagcaaggtgggaaggcgaagcccctcaagcagcccaaggctgagaagaaggagtatgatgagactgatctagtgaatattcaaaagaagaaagatgaagagaaggcactcaaggagctgagagccaaggcttcccagaaaggaacatttggaggctctggtctaaaaaagagtggaaagaaatagtgtgtttgtgtctattacgtattataagacttcattctaaaacttggccatctgggaccgagtgcagtcactctaacttggcaaactatcccacatgtgtgttttatttgattataacgatgaaatgtgaaagcgtgtgatactttgacagtgatttgatcaccgctgtttaaactgaatgacttaaata

SEQ ID NO: 3416 - DNA, 507 bp, Medicago truncatula
aatttagtgagggtaaggtctttttgttcgcgtgctactttttttcttcgtcgttttcgtattcagacccaaaccctaactcttcaaccaaaaccatgtcgaccaagcaaggtggaaaagctaagcctttgaagaagccaaagtctgataagaaggattacgatgaggttgacatggctaacatccagaagaaaaaggatgaggagaaggcgctaaaggagctgaaggctaaggcctcacagaagggatcttttggaggatctggactcaagaaaagtggaaagaaatagaagggctctctgtcatgatttcatactttcattattgagctctgtaattacaattatgaccatgagaacatctcttattgtgtggccttttaattgctgatgttagtactgaaccaaagcttatcgtgatgatgtaaaagcaataagtacttgtttgtagcttctttgtgtctccctttgggcttaatacatctgtttagtgttgtggctttggcat

SEQ ID NO: 3417 - DNA, 861 bp, Medicago truncatula
ttcgtcgtttagctatatatatagaatcgaatacccttgaaaataatttagtgagggtaaggtctttttgttcgcgtgctactttttttcttcgtcgttttcgtattcagacccaaaccctaactcttcaaccaaaaccatgtcgaccaagcaaggtggaaaagctaagcctttgaagaagccaaagtctgataagaaggattacgatgaggttgacatggctaacatccagaagaaaaaggatgaggagaaggcgctaaaggagctgaaggctaaggcctcacagaagggatcttttggaggatctggactcaagaaaagtggaaagaaatagaagggctctctgtcatgatttcatactttcattattgagctctgtaattacaattatgaccatgagaacatctcttattgtgtggccttttaattgctgatgttagtactgaaccaaagcttatcgtgatgatgtaaaagcaataagtacttgtttgtagcttctttgtgtctccctttgggcttaatacatctgtttagtgttgtggctttggcatagacttctcttggtaataatgccttgcaatgcaaaatttcaattatcaaattctattatgttctcaccttatggtaacagcttaccctgtggaagatgagattcttgagttgagtcattgccaatttttggcattagcttttgaattagtgaattttgacaaaaattaccgtgacactgattttgttgaagctcttaagtgtagtttttacaaaatttcagtggctcgttgtgattatgtcaaactcacggcgaatgtagttcttacagaatttcagtggctcgttgtgattatgtcaaactcatggcga

SEQ ID NO: 3418 - DNA, 492 bp, Mimulus guttatus
aaccatcttttcgtaaattccacgcgattgggttaggggttgtcttctctttttctcctctgttcaaaggtgaattccacaatcacagcgaaaccctagccctagaattcaatcatgtctaccaagcaaggaggaaaagccaagcctttgaagcaacctaaagccgagaagaaagagtacgacgagattgacaaggctaatattcaaaagaagaaggacgaagaaaaggctattaaggagctaaaggcaaaggctcagcagaagggagcgtttggcggtgccggtttgaagaaaagtggcaaaaaatgaatccagcttttttaatgaacattgacgcagtgtttactcataccccattgtgttattaagttattgcgttcgtaatacaatttatgaatttaaacatgttatagcttgttgttattgaccggtaaccaatatcgagcctgcaagagcttttacacataatatcacacacatttggcgattttt

SEQ ID NO: 3419 - DNA, 544 bp, Tropaeolum majus
cggccgggtattacggccggggagaccatcaattattgctttagggttggggcttcctatctccgcctttcccctattctttgtgttcgttgttcaggccaaattctaaaatctataatttcaaccatgtcgtctaagcaaggaggtaaagctaagcctttgaagcaacccaaggctgataagaaagaatacgacgagcatgatttggccaacatccagaaaaagaaggatgaggagaaggcacttaaagagcttagaagcaaggcacaacaaaagggatcatttggaggatctggacttaagaagagtggaaagaaatgagagaatcttaaaacacaccaaactgaagattcaaaacttataattcttgtgttgtgatttatatattttgaatataacgcaagtaattgtagccttcacaatatcttcggtaacttggtttatatgatggttgctcgttttgaatgctaaaactcagtttggttattgctcttatctgatgttgtgccgctggaatgaggtatagaaaaccatgactcttacg

SEQ ID NO: 3420 - DNA, 588 bp, Raphanus sativus
  misc_feature (564)..(564): n is a, c, g, or t
  misc_feature (570)..(571): n is a, c, g, or t
gttaaactagatattttaattgggccaaaatatctttgagcacattcatgggttgcgttgttactacgaactcaatataataaatgagcagctaagctagagattcattcgcaaacacacagcaggtccatcgtctgaaacttaaattttccccaattctcagatcagcatcaaaccctagagctcgaggaaccagccatgtcgtccaagcaaggaggaaaggcgaaacctttgaagcagccaaaaactgataagaaggaatacgatgagcacgatatggccaaccttcagaagaagaaagacgaggaaaaggcacttaaagaactaagagccaaggcatcgcagaagggatcttttggaggctctggtcttaagaagagtggcaagaaataatcccgctttgtatccatgaagcgtgtctttgacagtgcttatttatcaacttaaaatgttgtgtaacttcctatcatgtctgtaggggagtgactcttatcccataacatatgtttgctttcgccactttttcatttcaaaagaaaagaaagatggtttctatcttaaagncaagtnntgccatagttctccatc

SEQ ID NO: 3421 - DNA, 440 bp, Rosa hybrid cultivar
tgccggggaatatcggccgctgctgcaaatagggttgggtcttctttcttcttctagctctcgatttccgaccaaaccttcccccctagatcgcagccatgtcgtccaagcaaggtggaaaggcaaagcctttgaagcagcccaaggctgagaagaaggagtacgacgaggatgatttggccaagcttcagaagaagaaggatgaggaaaaggcactgaaggagcttagagccaaggcatcacagaaagggtcttttggaggtgctggcctcaagaagagtggaaagaaatgaggagttttcaaaacccaaagtttggatgtgatatatattatctgcgttgaagtctttcaatttatgggatggtctaattcctagctgaatgtgctcctaaacgcttcagtgtgtaacattaagactaaataaattgaattgcctttc

SEQ ID NO: 3422 - DNA, 510 bp, Rosa hybrid cultivar
gatcggccgctgctgcaaatagggttgggtcttctttcttcttctagctctcgatttccgaccaaaccttcccccctagatcgcagccatgtcgtccaagcaaggtggaaaggcaaagcctttgaagcaacccaaggctgagaagaaggagtacgacgaggatgatttggccaagcttcagaagaagaaggatgaggaaaaggcactgaaggagcttagagccaaggcatcacagaaagggtcttttggaggtgctggcctcaagaagagtggaaagaaatgaggggttttcaaaacccaaagtttggatgtgatataatattatctgcgttgaagtctttcaatttatgggatggtctaattcctagctgaatgtgctcctaaacgcttcagtgtgtaacattaagactaaataaattgaattgcctttcttaattagcttgtttcatttttttgtatggagtaaattccttctatgagcaaatgagaatgatgaatgtgctggttgaa

SEQ ID NO: 3423 - DNA, 448 bp, Triphysaria pusilla
gcaagcatccatctaaagttctgtgattggggtctgggcatcgtctttttatccttcaaactcagttttccgatcacagcgaatctaaccatgtctaccaagcaaggaggaaaagcgaagcccttgaagcaacccaagaccgaaaagaaagaatacgacgagattgacaaggctaatattcaaaagaaaaaggatgaagaaaaggctcttaaggagctcaaggcgaaggctcaacagaagggatcgtttggaggctctggtttgaagaagagtggcaaaaaatgatcctctgctgagattcgttcttgggttattatgttattgtgttgtttgtgtacaacataaacaatgttatgcttttgttattgatggtttgtaatttactgtatgttttctcatatggtatacaaatgacattttagtattatgaaaggtattctcatatggt

SEQ ID NO: 3424 - DNA, 674 bp, Sarracenia psittacina
cggggaatcctcttctataaaggccatcgttttccagacaattagaaactagaaagctactttcgggttagggcttcctacgatcctcagtattcgcatccaaaccaaaccctaaccctaatccaagaaaccaaccatgtcgtccaagcaaggtggaaaagcaaagcccttgaagcaacccaaggctgaaagaaggaatacgacgagagtgatttggctaacctccagaagaagaaggacgaggaaaaggcacttagggagcttagagccaaggctcaacagaagggatcatttggaggtgctggcctcaagaaaagtgggaagaaatgagggcttcaaacccaaaacaacctcggagttggtgtaatatgactacagaatgcacttttccttgtgtttgggtatatgggtagatacgattcattgcccgcccttttaagttagctgcaaaacagttcgtggctttgtgtatgaatttctgaataaatttgtgtttaatgtatggatctgtgttttagttgttaaggaattttgattgtggtaaggtttatattctgggttgttttttactgctcttgtattgaaaacttctttcaaaactcattctggagattaggttagtttgattaaccatcctaactaatcttgcctaattgtggagaacctcattctgc

SEQ ID NO: 3425 - DNA, 307 bp, Brassica juncea
gagtacgcgggggtcatctgaaactcaagagttgctttttccccaattctcagatcagcatctagccctagctcgacaaatccgtcatgtcgtccaagcaaggaggaaaggcgaaacctttgaagcagccaaaagctgataagaaggaatacgatgagcacgatatggccaacattcagaagaagaaagatgaggaaaaggcacttaaagagttaagagccaaggcatcgcagaagggatcttttggaggctctggtcttaagaagagtggcaagatgaggaaaaggcacttaaagagttaagagcc

SEQ ID NO: 3426 - DNA, 519 bp, Elaeis guineensis
attcgccgcggaaaggtgaacgaaggcctcctgtctctcctctccctccttgctctcgggttgggcttgctcccttctcctccgatcgaacaaccatgtcgtcgaagcaaggtggaaaggcgaagcctttgaagcaaccaaaggtccagaagaaggaatacgatgaggcggatcttgcaaatcttcagaagaagaaagaggaggaaaaggcaatgaaggaattgaaggctaaggcatcccagaagggaacatttgggggctctggtcttaagaagagcggaaagaaataaatcccctgtttcctcatgtaatgctcatgttaaaccatccaacaatgctaaagcaaccatccgggtcaactctagtagtgttctcataatgtagtacctaactatcatctccgagatatgcatggatttgtctggctaatatgagtcgtgaggcggtgactgttgctaaaatgaaacaaatggaaaatctactactgcattaaactctaaatattggtttttttctgat

SEQ ID NO: 3427 - DNA, 344 bp, Bupleurum chinense
ccatgtcgtccaagcaaggtggaaaagctaagccttgaaagcacccaaggctgaaaagaaggaatacgacgaggatgatttggctaaactcagaagaaaaggagaggaaaaggcactgaaggagctcaaagcgaaggctcaacagaaaggcgcatttggaggttctgggctaaagaaaagtgggaagaaatgagtcttcagtaatgctgaagccgatgctttgtgacttgtatttctattgtataatatgatttggtttgaggacattggctggggttgtacaacgcactaacagatgctgaacctttgtaccatgtcctatgtataccattaataagattgta

SEQ ID NO: 3428 - DNA, 529 bp, Cephalotaxus harringtonia
aaggaagggtttcaggcgaaaaaaagtcagttgcattccgtgcgtggataagtcgaaatcatgtctagcaagcaaggtggaaaagcaaagcccttgaagcagccaaagcaggataaaaaggagtatgacgagcatgacctcgctaatattcagaagaaaaagatgaggaaaaggccttgaaggagctaaaatccaaggcacaacagaaaggttctttcggtgggtcagggctgaagaagagtggcaaaaaataggccacaaaggatgctttctgcatccagaattcaccatagtttgtgcgtaggggagtgtttttattaaaatatttgatgcagtcaaggttgtctttcgtcatagccctttcagactaagtaaactttcatttatgtattaagtgttgtgatatcttaattattaattaagaacacttttgtgagatgtggttctcattttgctatgctttagtagcagagatattgtgtcgttttagtgtggtttgatatcttgttactgaagaggatttagattt

SEQ ID NO: 3429 - DNA, 436 bp, Ambrosia trifida
cctgttctgttgaaagtcgtcactttctttcgattcgcctatctatctatacgtatcagagcaaaccctaaccctaaaacttcaataatgtcatccaaacaaggtggaaaggccaagccattgaagcaaccaaaggctgaaaagaaagaatacgatgagatagataaggccaacattcagaaaaagaaggacgaggaaaaggccctcaaggagcttagagccaaggctcaaaagggagctttgggaggtactggtctcaagaagagtggcaagaaatgaggtctataacggtaaagttattgcaacctctaaattactaatgaatgccgcacttacaatatttatggttacagttggtttgctattttatgtatcaagtctttgttggtcgttcttgtgtagatctcaagataaacaatcttgatgacatttgata

SEQ ID NO: 3430 - DNA, 412 bp, Ambrosia trifida
cgttattattacgctatcatcccatccccaaatcattaatatcataaatatcgttattccctgtacaacaccaaaaccctagattcattcacatcatgtcgtccaagcaaggtggaaaagctaagccgttgaaacaacccaaggccgagaagaaagaatacgatgagatagataaggccaacattcaaaagaagaaggatgaggagaaggctcttaaggaacttagagcaaaagcccaaaagggagcacttggaggtactggtctgaagaaaagtggaaagaaatgagaggcttgacttattgcataacttaagtttcttatgttgtgatttgtgaaatgttgctttgaatatgtttggttatatagctgaatatgttggctacattaatgttgaatctctggtaataatca

SEQ ID NO: 3431 - DNA, 438 bp, Ambrosia trifida
cctgttctgttgtaaagtcctcacgttctttcgattcgcccatctatacatacgtatcaaagcaaaaccctaaccctaaaacttcaataatgtcatccaaacaaggtggaaaggccaagccattgaagcaaccaaaggctgaaaagaaagaatacgatgagatagataaggccaacattcagaaaaagaaggacgaggaaaaggccctcaaggagcttagagccaaggctcaaaagggagctttgggaggtactggtctcaagaagagcggcaagaaatgaggcctataacggtaaagttattgcaacctctaaattactaatgaatgccgcacttacaatgtttatggttacagttggtttgctattttatgtatcaagtctttgttggtcggtcttgtgtagatctcaagataaacaatcatgatgacatttgata

SEQ ID NO: 3432 - DNA, 468 bp, Fagus grandifolia
gatcacagccagccatgtcgtccaagcaaggtggaaaggcaaagcctttgaagcaacccaaggctgagaagaaagagtacgacgaggttgacatggccaatattcaaaagaagaaggatgaggaaaaggcactcaaggagcttagggccaaggcacagaaaggacccattggaggtactgggctgaagaaaagtgggaagaaatgagggctttatgtcccaaataggactgcttatcaaatcttcttcttgtacaagcattattatgacaataacctacctttgattattgtgattatctagcatcttgctaagtgtgttactaaactttgggagtaatctatgtaagactaaattctcaagttgcatgtttgtgatattttcctgttcctaaaatgtctgctttgcatatttgtggagatgattttttagttggtagggggtcttacttatttgtatttgaaacgta

SEQ ID NO: 3433 - DNA, 445 bp, Cirsium arvense
ttttcttccgattcgcgcatctctctacggatcagagcaaaccctaaccctagatttcgatcatgtcgtccaagcaaggtggaaaagcgaagccattgaagcaaccaaaagctgaaaagaaagagtacgacgagatggataaggcaaaccttcaaaagaaaaaggaagaggaaaaggcactaaaggagcttagagccaaagctcaaaagggagcattgggaggtgctggtctgaagaaaagtgggaagaaatgaggtaaaagttatttgcatattctattatgtgataaatgaatgatgtccttaatgtgtttgtatcaagtcttttgtgattaacaatcataccggctggaatttggtattgttgttttcttcttgggtgtactgatttttatggaagttattattattaatgggttgaatcttgatctagatatgatcttgtt

SEQ ID NO: 3434 - DNA, 667 bp, Cirsium arvense
ttttaggggttttcggttctcgttttttcttccgatttcgcgcatctctacggatcaacagcaaaccctaaccctaaatttcgatcatgtcgtccaagcaaggtggaaaagcgaagccattgaagcaaccaaaggctgagaagaaagagtacgacgagatggataaggcaaatcttcaaaagaagaaggaagaggaaaaggcactgaaggagcttagagccaaagctcaaaagggagcattgggaggtgctggtctgaagaaaagtgggaagaaatgaggtaaaacttattacatattctatattattctaaggaatgatgttcttgatgtctttgtattaagtcttttgtggttgttcctgtgtaaaaactcaataggaacaatcatactgactgacatttggtattggtgttttatggggtgtactgatttatgcaagttattattaatggtttatggtttgtactttgtaaggttgttgatttttgaatcttgatttagatgtgaaaaagaaaaaagtaccgactgcgactctgtttcggtttttctattgttgcgaggcttttttgttgcgaggcttttgttttttgtttgagtcgcttgggatcaacagtctcactttaattctgtttttcatcgattcaatgtaaaatttattgaactaat

SEQ ID NO: 3435 - DNA, 446 bp, Cirsium arvense
tcgttttctcttccgattcgcgcatctctacggatcaacagcaaaccctaaccctagatttcgatcatgtcgtccaagcaaggtggaaaagcgaagccattgaagcaaccaaaggctgagaagaaagagtacgacgagatggataaggcaaatcttcaaaagaagaaggaagaggaaaaggcactgaaggagcttagagccaaagctcaaaagggagcattgggaggtgctggtctgaagaaaagtgggaagaaatgaggtaaaacttattgcgtattttatattattctaatgaatgatgtccttaatgtctttgtattaagtcttttgtggttgttcctgtgtaaaaactcaataggaacaatcatactgacagacatatggtattgttgttttatggggtgtactgatttatgcaagttattattaatggtttatggtttgta

SEQ ID NO: 3436 - DNA, 437 bp, Plantago ovata
aatttgtgcagcgatagggttagaggagcatctttttctctcttccaattccgatcgcatccaatccctaaccgatcaattatgtcgagcaagcaaggaggaaaagcaaagcctttgaagcaacccaagtcggaaaagaaagagtacgacgagattgacaaagctaatattcaaaagaaaaaagatgaggaaaaggctctcaaggagcttaaggcaaaggctcagaaaggagctcttggaggtgctggtctgaagaagagtggcaaaaaatgatttctaagtaccagttcctcgattgagtgttcatgactctttgatgttattatgttgttatctagtataaaccagttggcttgttcgcaactgacagacagtctttagttattgaactgaaggagtcttcacttatggggttatatatattctgcaattaaact

SEQ ID NO: 3437 - DNA, 588 bp, Helianthus annuus
ggggtcttaaattagtgggtatacaaaaaccaatcatggttcgcttataaataacgtcaactcgtcaagtggtattcgaacaataacgcgttatatttacgctatcactcatccccaaatcatatcatttttctgcaaacaccaaaaccctaatttccgaattccaatcatgtcttccaagcaaggaggaaaagcaaagccgttgaaacaaccaaaggccgagaagaaagaatacgatgaggtagacaaggccaacattcaaaagaagaaggacgaggagaaggctctgaaggaacttagagcaaaagctcaaaagggagcacttggaggtactggtctgaagaaaagtggaaagaaatgaggcttgattgattgcagaactcaagtatgttatgttgtgatttgtgaaatgttgctttgaatatgttgcttatatagctgaatatgttggctagatttacgttgaatctcgggtaataatcaagctaatatttggttttaaacgcaggaaacagccctttaaataaaaatccgtacgtatcattgctaaaaataccatctaaaggacggatatataagcagccaatt

SEQ ID NO: 3438 - DNA, 450 bp, Artemisia annua
gggggcgttaaaactaggttttgccttctttttcacattaacacaaacaaagaaaccctaattcgcaaatccaatcatgtcgtcaaagatgggtggaaaagctaagccattgaaggcaccaaaagctgagaagaaggaatacgatgaggtagacaaggccaacattcaaaagaagaaggatgaggaaaaggcacttaaggagctcagagctaaagctcaaaagggagctttgggaggtgctggtttgaagaaaagtgggaagaaataagtcgggtctctctgaagtgaagttgcgtaatgtgctatggtgtgattagtaaatgttgctcctaatatgtctgaatgtgtcgactgaattcagtattaaaaccttttacaatttgttagtgcatttgaatcttgggtaataatcatgttctaatattttgtcttgatgctattttgggtcta

SEQ ID NO: 3439 - DNA, 376 bp, Artemisia annua
tatttccatccccaattccacaaccgaaaccctaattcccaaaactcgatcatgtcgtcaaagatgggtggaaaagctaagccgttgaaggcaccaaaagctgagaagaaggaatacgatgaggtagacaaggccaacattcaaaagaagaaggatgaggaaaaggcacttaaggagctcagagctaaagctcaaaagggagccttgggaggtgctggtttgaagaagagtgggaagaaatgagtcgggtcattctgaagagaagttgcttaatgtgctatggtgtgattagtaaatgttgctcctaatatgtctgaatgtgtcagttgaattcagtattaaaaccgtttacaatttgttagtgcatttgaatctc

SEQ ID NO: 3440 - DNA, 462 bp, Artemisia annua
tcaacgcagtactccgacgggggcgttaaaactaggttttgccttctttttcacattaacacaaacaaagaaaccctaattcgcaaatccaatcatgtcgtcaaagatgggtggaaaagctaagcccttgaaggcaccaaaagctgagaagaaggaatacgatgaggtagacaaggccaacattcaaaagaagaaggatgaggaaaaggcacttaaggagctcagagctaaagctcaaaagggggctttgggaggtgctggtttgaagaaaagtgggaagaaatgagtcgggtctttctgaagtgaagttacttaatgtgctatggtgtgattagttaatgttgctcctaatatgtctgaatgtgtcagctgaattcagtattaaaaccgttcacaatttgttagtgcatttgaatctccggtaataatcatgttctaatattttgtctaaactacagtgct

SEQ ID NO: 3441 - DNA, 502 bp, Artemisia annua
gtatcaacgcagtactccgacggggattccgcgttaaaactaggttttatattttccacccccaattccacaatcaaaccctaattcccaaaactcgatcatgtcgtcaaagatgggtggaaaagctaagccgttgaaggcaccaaaagctgagaagaaggaatacgatgaggtagacaaggccaacattcaaaagaagaaggatgaggaaaaggcacttaaggagctcagagctaaagctcaaaagggagctttgggaggtgctggtttgaagaaaagtgggaagaaataagtcgggtctctctgaagtgaagttgcgtaatgtgctatggtgtgattagtaaatgttgctcctaatatgtctgaatgtgtcgactgaattcagtattaaaaccttttacaatttgttagtgcatttgaatcttgggtaataatcatgttctaatattttgtctcgaaaaaaaaaaaaaaaaaacatgtcacatctagaatgacacgcgag

SEQ ID NO: 3442 - DNA, 533 bp, Artemisia annua
cgtgcgcctatataaactcacccaaacgcatccaataatcatattccgcgttaaaactaggttatatattttccatccccaattccacaaccgaaaccctaattcccaaaactcgatcatgtcgtcaaagatgggtggaaaagctaagccgttgaaggcaccaaaagctgagaagaaggaatacgatgaggtagacaaggccaacattcaaaagaagaaggatgaggaaaaggcacttaaggagcttagagcaaaagctcaaaagggagctttgggaggtgctggattgaagaaaagtgggaagaaatgagtcgggtctttctgaagtgaagttacttaatatgctatggtgtgattagtaaatgttgctcctaatatgtctgaatgtgtcagctgaattcagtattaaaaccgtttacaatttgttagtgcatttgaatttcgggtaataatcatgttctaatattttgtccgaaactattggggctgcattcccaaacatttgcgtactacgcttatacccgtcggagtaa

SEQ ID NO: 3443 - DNA, 612 bp, Fagus grandifolia
gagtagaattgatcacacacgtagcacgtgttaggcctgccccatcttctatataatcttcaaagggttaggtttagatccgtctctgtaggaactttctttgtagctttgggaatttttaccgaaacctaaccctagatcacagccagccatgtcgtccaagcaaggtggaaaggcaaagcctttgaagcaacccaaggctgagaagaaagagtacgacgaggttgacatggccaatattcaaaagaagaaggatgaggaaaaggcactcaaggagcttagggccaaggcacagaaaggacccattggaggtactgggctgaagaaaagtgggaagaaatgagggctttatgtcccaaatataactgtttatcaaatcttcttcttgtacaagcattattatgacaataatgctttgattattgtgattatctagcttcttgctaagtgtgttactaaactttgggggtaatctatgtaagactaaattctcaagttgcatgtttgtgatattttcctgttcctaaaatgtctgctttgcatatttgtggagatgattttatttgaggtcggtcttcgcgtacgtgaggttcgacacgggcccaacgttgg

SEQ ID NO: 3444 - DNA, 440 bp, Fagus grandifolia
ctttctttgtagctttgggaatttttaccgaaacctaaccctagatcacagccagccatgtcgtccaagcaaggtggaaaggcaaagcctttgaagcaacccaaggctgagaagaaagagtacgacgaggttgacatggccaatattcaaaagaagaaggatgaggaaaaggcactcaaggagcttagggccaaggcacagaaaggacccattggaggtactgggctgaagaaaagtgggaagaaatgagggctttatgtcccaaataggactgcttatcaaatcttcttcttgtacaagcattattatgacaataacctacctttgattattgtgattatctagcatcttgctaagtgtgttactaaacttttgaagtaatctatgtaagactaaattctcaagttgcatgtttgtgattatttttcctagttaaacct

SEQ ID NO: 3445 - DNA, 484 bp, Centaurea maculosa
  misc_feature (16)..(16): n is a, c, g, or t
gcgggggagcgggagngttgtttttggggtttttggttctcgttttttcttccgattcgcgcatctcttcggatcaacagcaaaccctaaccctagatttcgatcatgtcgtccaagcaaggtggaaaagcgaagccattgaagcaaccaaaggctgagaagaaagagtacgatgagatggataaggcaaatcttcaaaagaagaaggaagaggaaaaggcactgaaggagcttagagccaaagctcaaaagggagcattgggaggtgctggtctgaagaaaagtgggaagaaatgaggtaaaacttattgcatattatatgtatgatcctaatgaatgatgtccttaatgtatttgtattaagtcttttgtgattgttactgtgtaaaactcaataggaacaatcatactggctgacatttggtattgttgttttatggggtgtactgatttatgcaagttattattaatggtttatggtttg

SEQ ID NO: 3446 - DNA, 481 bp, Cichorium intybus
aggttcgggttaggttatatttcatttccaagtctgcgtatttgtttctagcatcaaaccctaatataaattccaattatgtcgtccaagcaaggaggaaaagcaaagccattgaagcaacccaaggctgagaagaaagaatacgacgaggtagataaggccaacattcaaaagaagaaggacgaagaaaaggcactcaaggagctaagagccaaagctcagaagggagcattgggaggtactggtctgaagaaaagtggaaagaaatgagaagttggttcatatactactatgttgtgatatgtgaatcttgcatttaatatccatggttatttaactaaatgtatttgctaaattcagtataaaccttttgcagtttgcctgtaataatcagttaatcatggtgatatttggtctagatattgtttaggctgtgctgatcccgtcataatctggaactggttatattttgtttggctct

SEQ ID NO: 3447 - DNA, 484 bp, Cynara scolymus
cgggagcgggactgttaggggttaggttctctcgttttgtttaccgatccgcgtatactctctacggatcagagcaaaccctaaccctagatttggatcatgtcgtccaagcaaggtggaaaagcgaagccattgaagcaaccaaaagctgaaaagaaggagtacgacgagatggataaggcaaaccttcaaaagaagaaggaagaggaaaaggcactgaaggagcttagagccaaagcgcaaaagggagcattgggaggtgctggtctcaagaaaagtggtaaaaaatgaggtaaaagttattacatattgtatgtcataaatgaatgatgatgtttttaatgtgtttgcatcaagtcttttgtgattgttcttgtgtaaaactcaagaggaacaatcatactggctgccatttggtattgttgttttctggggtgtactgattttatatggaagttattagtaatggtttatggtttatggc

SEQ ID NO: 3448 - DNA, 677 bp, Gerbera hybrid cultivar
gcatccccaaaccgatcgaagtttcagtacgggttaggttttctttctcaaaattcgcgaatctttaaggatcagaacacaccctaaccctagatttctaccatgtcgtccaagcaaggtggaaaagcaaagccgttgaagcaacccaaggccgagaagaaagaatacgatgagatagacaaggctaacattcagaaaaagaaggatgaggaaaaggcacttaaggagcttagggccaaagctcaaaagggagcattgggaggtactggtcttaagaaaagcggcaagaaatgagttcttgcatatgctgcttataattataattataagatagatgatacatagatctaatttgtatgtctaaccatcaaatgatgacacttgtaaaaagtgagaaaaaaaaaagtggagccggattatcgtgtgttggttagacatacaaattagctctctgtatcatttctcaaattatgattatggccctacatatgtttgctaaattctgtattagaccttttgcaatgatttctatgtaaactaaacacattagttcacatgtgtgcccattaggcattttttaatcacagattaatatctaatcgaatgttttaaaatttgtaattaagtggacaatggatgtcatctccactcatccgaacttcacttttacgaagatt

SEQ ID NO: 3449 - DNA, 471 bp, Gerbera hybrid cultivar
cgggtttggtcatttatttacccaattatctcgtctctgtctatcgctccaaaccctaaccccagatttcgaccatgtcgtccaagcaaggaggaaaagcgaaaccattgaagcaacccaaggctgaaaagaaagaatacgacgagatagataaggccaacattcaaaagaagaaggatgaggaaaaggctttgaaggagcttagagccaaagctcaaaagggagcgctgggaggtaccggtctcaagaagagtgggaagaaatgaggccatatactatgttgtgattagtaaatgcttttcttgatatgtttagctgaatgtgtttgctaaatttcgtattagaccttttttccgatttgtcactgtgtcgaattcaaaataataatcatgcttatgtttggtcttgatgttgttttgggtgtacctatttgtgcaaagtgatttggttattaaaaaaaaaaaaaaaaaa

SEQ ID NO: 3450 - DNA, 406 bp, Lolium multiflorum
gaagcaaggagggaaggccaagccgctgaagcaggccaaggtcgccgagaaggactacgacgagactgacctggcatacctccagaagaagaaagatgagcaaaaggcactgaaggagctgaaggcaaaggcaggccagaagggtgcgctgggaggatctggcctcaagaagagtgggaagaaatgagtctagaaaatgataaaccatctatctatctgtgttgcgcttcactatctgtggttgtaacaaactgtctttcaaatgtatcgagctttaagcttcactgtcgcagtcgggttgctggaacctattgtgtctcagcctcttctgcttagccatgatacagatggttccctagctaataatatgacatgatttgtgactgaaagcttccagtgtgtacct

SEQ ID NO: 3451 - DNA, 681 bp, Petunia hybrida
tcaatcctcatatggtataaattcccactcccgtccataaagttgccaacgccactatacaaataagcaaagcttttgggttaggagacattctcaactaccaccaaataatacagatctaactcttaaccctaacaaaatcaatcaaccatgtcttccaagcaaggtggaaaggccaagcctttgaaggcaccaaagactgaaaagaaggaatacgatgataatgacaaggcttttcttcaaaagaagaaggaagaggaaaaggcactaaaggagctcaaggcaaaggctcagaagggttccattggtggtgctggcctgaaaaagagtggaaagaaatgagaatcttatattatcagagatattaaagaattcttcctgttagtagtgcaaggctcttttcttgcccatggctagatttggtgttctaagatcttactgttaagtttccgtaactttgggatatttccgtggtcactgaatggtttggtatggtgcattcgctcctttaaatgcatgtattgtgatgcctttgcctatcagtaactcagattgtcatcttgtgtgatatgcctactcactcagtagttaatgtaatttcgacatctctccgaccccccaaatgaacgtaaaattggaaaaaacaggatttggggtttccatcatgtttgactctggaat

SEQ ID NO: 3452 - DNA, 680 bp, Solanum tuberosum
cgccactttacaaaaaaagcttatttgggttaggggagagttttcatcaacagatccaaactcttaaccctagaaaatcaaccatgtcttccaagcaaggtggaaaagcaaagcctttgaaggcaccaaagagtgaaaagaaggagtatgatgagaatgacaaggcttttcttgcaaagaagaaggaagaagaaaaggccctgaaggagctcaaggcaaaggctcagaaagggtccattggtggtgctggcctgaaaaagagcggaaagaagtgaggatgttatattcttcctcgtagtattaaaaagcccttacccatggcttggtttggtgttcaaaagttcaaatagttgcgtttttgtttacttttgggatgtttctatgttgactgaatgatttaggatggggcacttgctcctttccaatatatactgacatgtattgtggtgcctttgcctatcaataattcatattggcgttaagtttgtgtgatatgttgacagactcctcactataatggatgtaattccaacttccctgttctatgtttggcaagttttatgcatgtcttaaattcctggcagtgtcttttgcgttgtttatcattctgagttgacagccaaagaagtccttttaaccttttgctctaattgtcgattatctactaaaccttttgtcct

SEQ ID NO: 3453 - DNA, 516 bp, Solanum tuberosum
cgccactttacaagaaaaagcttatttgggttaggagagaaagttttcatcaacagatccaaactcttaaccctagaaaatcaaccatgtcttccaagcaaggtggaaaagcaaagcctttgaaggcaccaaaaagtgaaaagaaggagtatgatgagaatgacaaggcttttcttgcaaagaagaaggaagaagaaaaggccctgaaggagctcaaggcaaaggctcagaaagggtccattggtggtgctggcctgaaaaagagcggaaagaagtgaggaatgtgatatattcttcctcctagtattaaaaagcccctcacccatggcttggtttggtgttctaagttcaaatagttacgtttttgttaacttttgggatatttctatgttgactgaatgaattaggatggggcacttgctcctttccaatatatactgacatgtattgtggtgcctttgcctatcaataattcatattggcgttaattttgtgtgatatgttgaccgactcctc

SEQ ID NO: 3454 - DNA, 420 bp, Carthamus tinctorius
gcccattacggccggggaggttttatttgttcccaaattctatcgcgttttgtgtataactccaaaccctaactccagattccgatcatgtcgtccaagcaaggaggaaaagcaaagccattgaagcaacctaaggccgagaagaaagaatacgacgagattgacaaggccaacattcaaaagaagaaagacgaggaaaaggcactgaaggagcttagagcaaaagctcaaaagggggcactgggaggtaccggcctgaagaaaagtggaaagaaatgagacccgaaaagaatcgaagtttgttgcatacgatatgatgttgtgacactagtgaactgctattaaatctttttacagtttttgttggtacacatcaaatttccagtaataataatcatattgctgatattggtcataaaa

SEQ ID NO: 3455 - DNA, 605 bp, Solanum phureja
aacgaagaggataaaatagtaaaaaaccacaacttttattcctactccaataatacaataaagaaaaatattagtataaattttggcacaatccatcaaaattccaacgccactttacaaaaaaagcttatttgggttaggagagaaagttttcatcaacagatccaaactcttaaccctagaaaatcaaccatgtcttccaagcaaggtggaaaagcaaagcctttgaaggcaccaaaaagtgaaaagaaggagtatgatgagaatgacaaggcttttcttgcaaagaagaaggaagaagaaaaggccctgaaggagctcaaggcaaaggctcagaaagggtccattggtggtgctggcctgaaaaagagcggaaagaagtgaggaatgtgatatattcttcctcctagtattaaaaagcccctcacccatggcttggtttggtgttctaagttcaaatagttacgtttttgttaacttttgggatatttctatgttgactgaatgaattaggatggggcacttgctcctttccaatatatactgacatgtattgtggtgcctttgcctatcaataattcatattggcgttaattttgtgtgat

SEQ ID NO: 3456 - DNA, 477 bp, Helianthus annuus
gaacaataaggcgttatatttacgctatcactcatccccaaatcatatcattttccctaatttccgaatttccaatcatgtcttccaagcaaggaggaaaagcaaagccgttgaaacaaccaaaggccgagaagaaagaatacgatgaggtagacaaggccaacattcaaaagaagaaggacgaggagaaggctctgaaggaacttagagcaaaagctcaaaagggagcacttggaggtactggtctgaagaaaagtggaaagaaatgaggcttgattgattgcagaactcaagtatgttatgttgtgatttgtgaatatgttgcttatatagctgaatatgttggctagatttacgttgaatgtcgggtaataatcaagctaacaaaaaaatgatatgatttggggatgagtgatagcgtaaatataacgcgttattgttccccaaatcatatcatttttctgcaaactaccaaaa

SEQ ID NO: 3457 - DNA, 608 bp, Solanum lycopersicum
aacaaagagaataaaatagtaaaacatcactacttttatccctactccaataatacaaataaaaaaaaattagtataaattttggcactatccatcaaaattccaacgccacttcacaaaaaaaagcttatttgggttaggagagagagttttcatcaacagatccaaactcttaaccctaaaaatcaaccatgtcttccaagcaaggtggaaaagcaaagcctttgaaggcaccaaagactgaaaagaaggagtatgatgagaatgacaaggcttttcttgcaaagaagaaggaagaagaaaaggccctgaaggagctcaaggcaaaggctcagaaagggtccattggcggtactggcttgaaaaagagcggaaagaagtgaggatgtgatattcttcctcctagtattaaaaagcccttatccatggcttggtttggtgttgttctaagttcaaatagtgttacgtttttgttaacttttgggatgtttctgtgttgactgaatgaattaggaccggggcacttgctcctttccaatatatactgacctgtattgtggtgcctttgactatcaataattctatattggcgttaatttttgtgtgat

SEQ ID NO: 3458 - DNA, 608 bp, Solanum lycopersicum
aacaaagagaataaaatagtaaaacatcactacttttatccctactccaataatacaaataaaaaaaaattagtataaattttggcactatccatcaaaattccaacgccacttcacaaaaaaaagcttatttgggttaggagagagagttttcatcaacagatccaaactcttaaccctaaaaatcaaccatgtcttccaagcaaggtggaaaagcaaagcctttgaaggcaccaaagactgaaaagaaggagtatgatgagaatgacaaggcttttcttgcaaagaagaaggaagaagaaaaggccctgaaggagctcaaggcaaaggctcagaaagggtccattggcggtactggcttgaaaaagagcggaaagaagtgaggatgtgatattcttcctcctagtattaaaaagcccttatccatggcttggtttggtgttgttctaagttcaaatagtgttacgtttttgttaacttttgggatgtttctgtgttgactgaatgaattaggaccggggcacttgctcctttccaatatatactgacatgtattgtggtgcctttgactatcaataattctatattggcgttaatttttgtgtgat

SEQ ID NO: 3459 - DNA, 483 bp, Tragopogon dubius
tttgaagttcccgttcgggttaggctatttcatctcacagtcttcgtttttgtgcataacaccaaaccctaaccccagattccgatcatgtcgtccaagcaaggtggaaaagcaaagccattgaagcaacccaaggctgagaagaaagaatacgatgaggtagataaggccaacattcaaaagaagaaggatgaggaaaaggcactgaaggagcttagagcaaaagctcaaaagggagcactgggaggtgctggtttgaagaaaagtggaaagaaatgaggtttgcagaactgaggttgctgcatatactatgttgtgatttgtgaatcttgcacttaatatgtaactgaatgtgtttgctaaattcagtactaaacccttaccaatttgttattatatgccatctctagtgataatcatgctgatatttgctaaggtgacctagtggttgatcgtttaggaatttaagcaaattgtgccagc

SEQ ID NO: 3460 - DNA, 445 bp, Tragopogon dubius
tcggggatcaaagatttcttccaattcgcgcatctctacggatcagagcaaaccctaaccctagaatttgataatgtcgtccaagcaaggtggaaaagcgaagccattgaagcaaccaaaggccgaaaagaaagaatacgatgaggtcgataaggccaacattcaaaagaagaaggatgaggaaaaggcactcaaggagcttagagccaaagctcaaaagggagcgttgggaggaactggtctgaagaagagtgggaagaaatgaggcctgcagaagtgaaggtataagcatcttctatgtgacacttatggtgctaagttctgtattcaggtaatctgattgttttcgtgtagaaatgaagaacatcatatgacttttggtatcgttgttttcttgttgtacttgtttatggaggttattgtggcttgttatttatataatcgc

SEQ ID NO: 3461 - DNA, 462 bp, Triphysaria pusilla
attcgtcagtgagccctaaaccctagaattcaatcatgtctaagcaaggaggaaaagcgaagcctctgaaacaaccaaagtctgacaagaaagaatacgacgagtttgacatggctaatattcaaaagaagaaggaagatgaaaaggcactaaaggagctcaaggcaaaggctcagcagaagggttcgtttggaggttccggtttgaagaaaagtggcaaaaaatgatgattttttaattatttaaacatgtgaaaaagtagttttattggggtttaaaacttcgtttgtcattctgttattgcttggatttctggtatcgtttagctggcttttagtgtgtgtttttctgatcatattttccagtaaattgtctccattttaggaacttttttggagtgattttattcagaaatgtcttattatcaaatcatattaaactattagtttgctatatttaggt

SEQ ID NO: 3462 - DNA, 511 bp, Juglans hindsii x Juglans regia
ccgggggtggagtcataaatttttgcgtcaaaagttcagggctctctctgcccggctccgattcagctgacgcatccagagtccagaccagaccgcagtcctagatcgcagtcatgtcgtctaagcaaggtggaaaggcaaagcctttgaagcaacccaagtccgacaagaaagaatacgacgaggttgacttggccaatcttcagaagaagaaggaagaggaaaaggcactcaaggagcttagagccaaggcacagaaaggacccgttggaggtgctggactcaagaaaagcgggaagaaataagggttttaagacccaaattgtggattgtatcaatgcttctttccaagtgtgttgctaagcttatggagtactcttaatgtaaagattatatatatccaggctgcatgtttgtgctatttgcatgtttctaaaatgtcattgtctctgtgatccaaatggtaaaaacacatttcacgggtttgttgattccaatggttgactattat

SEQ ID NO: 3463 - DNA, 324 bp, Arnica chamissonis
tccaagcaaggaggaaagcaaagccattgaagcaacccaaggctgagaagaaagaatacgacgaggtggacaaggccaacattcaaaagaagaaggacgaggagaaggctcttaaggaacttagagcaaaagctcaaaagggagcacttggaggcactggactgaagaaaagtggaaagaaatgaggcttgattgattgcagaactgaatttgcttatgttgtgtatttgtagaaattgttggttttgaattattgtttttggttattaagctgaattatgttggctaagaattatgttgaatcgtacgggtaataatcatgct

SEQ ID NO: 3464 - DNA, 374 bp, Epimedium sagittatum
aatggaaagggggaataggagtggatcgagtatcgttgacaatcgttcgagaattttttagaagtggtgggcgttctggctcctttatgttagggagagggttctctttctcttctctactactcaagctcgtctaggggtctactgctcaaccaaccaagcatgtcgtccaagcaaggtggaaaagctaagcctttgaagcaacccaaagctgaaaagaaggagtacgacgaggctgacctagcgaatcttcaagaaaaagaaagatgaggaaaaggcactgaaggagctgagagccaaggctacacagaagggatcattcggaggtgctgggcttaaagaaaaggtgggaaagaaatgaataaaagagtgtg

SEQ ID NO: 3465 - DNA, 730 bp, Cannabis sativa
ttattgcccactcattaaaatatcccaaggttgcgttatatttaggcgttgggtttttttctttctcttgttctgaattttgaagcttagggttctgtttcccttttcctttcgattccaaatcaaaaaccctagctacaaccatgtcttccaagcaaggtggaaaagctaagcctttgaagcaacccaagaaggaccagaaagattatgacgagactgacttggccaacattcagaaaaagaaggaagaggaaaaggctctgaaagacctcaaagccaaggcacaacagaagggagcttttggaggttctgggctcaagaaaagtgggaagaaataagggggtctaatactacaattccgatgggaatgggaattagtattcagtatttgtgagctgatgtattagtagaatcgttgtcataagtcacgataacgttctgtggatttacttatcatttatgtgatggtctatgttgtttatgaatttgctccttaacttgtttgataccccattcttaatagtattttaaacttgctctataattttcattgcgttccttctaactttgctgctgcagactgtttggctaaatgggccagggaatttgagatctctggtttatttagaagaaaaaaagtgtaaataaattgcatgcccttaaccaaattatctttattctacattgaggttgatacaatttgactttgaatggttaaagttctgatata

SEQ ID NO: 3466 - DNA, 869 bp, Chelidonium majus
aggagttggattgcaacacaactctcgggagtacaggatccagattctctctctctataaattcccactaaaatttggggtttgtaagatcggtgttaataatttggctagggttccctctgcgtttcttctcttcttcgttccttcctcctttaacctaccgatcgaatcatgtcgtccaagcaaggtggaaaggcgaagcctttgaaggcacccaaagttgaaaagaaagaatatgatgaggatgatttagcaaagcttcaaaagaagaaagaagaagaaaaggcactcaaggagctgagggccaaggcatcacagaaaggctcgtttggtggtgctggactcaagaaaagtgggaagaaatgagtgttgttcctgaacacactgtaacaactatttttcttgcacccatgcttccattatgtgacgatatcatatataagctgtctattaatgtcgtccatatgggatgaaattactatgttatattcacttgcaaagtctcgtctgacataatacccgcacaatgggaagaaaatgtagttgcaacatcttttctatttgcacgtatatgtgtttttattagggtcaaaaaaaaaaaaaaaggatctcctgtggttttgatacaagaggttctagggtgttatactagctaattttatctgcaattatatctacatatggacctgattgcatcttcattgtcaagaaagatcgttagttaaaatcttgctaaagttatcagactttatctaatgtaaggaagtgtctttctatttaaacaactaggaaatcagattatggtgctctcgcataaaacaatgtggaactttcttttttgtttctgaataagcaaaggattattcatc

SEQ ID NO: 3467 - DNA, 526 bp, Cicer arietinum
ggtgagggtaaggtctttctttctgccgtgtcgtttgctgttattttctgtcgttttcctattcagaccgaaccctaatttttcacccaaaccatgtcgaccaagcaaggtggaaaagctaagcctttgaagaaaccaaagtttgataaaaaggattacgatgagattgacatggctaacatccagaagaaaaaggatgaggagaaggctttaaaggagttaaaagctaaggcacaacagaagggattttttggaggatttgggctcaagaaaagtggaaagaaatagaggagctttttttcatgatttcatacttccagtattgagctctgtaattacgattatgactatgacaatattttttattgtgtgacgtgttttattactgatgttagtactgaaccaaggcatgttatgatgtaaaacacaataagttacttgtttgtacctttattgtgtctccctttggagttatgataattacatctgtttagtgttttggctgtgataataacattcttgacac

SEQ ID NO: 3468 - DNA, 606 bp, Humulus lupulus
ggacactgagacccttacggccgaaaatatcgaagggtgcgtattattgaggctttagggttgtgtttctctctttcagcggagctttccctttgccttccgattccgatcacaaaccctagctacaaccatgtcttccaagcaaggtggaaaagctaagcctttgaagcaacccaagaaggaccagaaagattacgacgagactgacttggccaacattcagaagaagaaggaagaggaaaaggctctgagggaactcaaagccaaggcacaacagaagggagcttttggaggttctggactcaagaaaagtggaaagaaataagagggggtcttgtaccttgattcgaatgggaaatagtattctgcattcgtgagctgatgtattaatagaatcgttgtcagtaatcacgatgacgtccttcgaattacttatcatttatgtgatggtctatgtctttaatgaatttgctgcttaactttgtgctagtgacaaatgtgtaacatcaaataaatggtttgccttttttcttacctagcaaaaaaaaaaaaacaaaaaaactaagaggactacgccgaacgtacgacacgaggggtagtaaggtg

SEQ ID NO: 3469 - DNA, 476 bp, Elaeis guineensis
ttctcctccgatcgaacaaccatgtcgtcgaagcaaggtggaaaggcgaagcctttgaagcaaccaaaggtccagaagaaggaatacgatgaggcggatcttgcaaatcttcagaagaagaaagaggaggaaaaggcaatgaaggaattgaaggctaaggcatcccagaagggaacatttgggggctctggtcttaagaagagcggaaagaaataaatcccctgtttcctcatgtaatgcatgttaaaccatccaacaatgctaaagcaaccatccgggtcaactctagtagtgttctcataatgtagtacctaactatcatctccgagatatgcatggatttgtctggctaatatgagtcgtgaggcggtgactgttgctaaaatgaaacaaatggaaaatctactactgcattaaactctaaatattggttttttctgtataaattatggaactggaaactggagtaccatcaa

SEQ ID NO: 3470 - DNA, 489 bp, Platanus occidentalis
ttttgggggtcgggttggggacttagggttctctgcaattctctcttccacgaccgagccaatccgacccaaccatgtcgtccaagcaaggtggaaaggcgaagccgctgaagcaaccaaaggccgataagaaagaatatgacgagattgatatggcaaatattcagaagaagaaagatgaggaaaaggcactcaaggaactgagagccaaagcatcccaaaaggggtcattcggaggtacaggtctgaagaaaagtgggaagaaatgatcgttccggcagatgcagatttctattgctactgtaccccctagtgtgatcccttataaatcaattgctaaagcacattgaactgtcctatgtaaactgaaaaagactaatttgcattttctctcgttgctcatctgtgttgtttccatccatgcatttagttgctttaaattagggaaatatgtttatctaacaaaactttaggatgacatggtttatg

SEQ ID NO: 3471 - DNA, 671 bp, Papaver somniferum
tttttgcgtcttatttcgttggctagggtttcctgctctctttcgttcttccaatcacagatcgaatcatgtcttccaagcaaggtggaaaagctaagcctttgaagcaacccaaggcacaacagaaagaatatgatgagactgacttagcaaatcttcagaagaagaaagaggaggaaaaggcactcaaggagctgaggaccaaggcacagaagggtggtgctttaggtggtgctggactgaagaagagtggaaagaaatgagtgttcgtgactagtaatatgcactgtaacagggttgtattatcttgcatccatccacaagtttatgtgatgatataattccatgtcagtagtagtgtctatggtctgagacatcagtgaatggatgaacctgcctctttattaagttaaacttgccaagtcttgtatatgacttaaatatgacatatttgtgcttcttgtcgtgtgctgtggctcttttattttcatttatttagtaattatccctatgtacagcatgctcttttattttgatccagcaagttcatgccgcatggtactacctagtataacatgcactgggaaatgaaggtataagagcaactgtatgtgactggatttctttgacatgagcatccgttctataaatgtccactgctgacttaaata

SEQ ID NO: 3472 - DNA, 532 bp, Sarracenia psittacina
ggcttcccctccaatacattgccatcgttttccagaccattccgaggacaaaacattcgcagtagggttcgggctctgtattctgggatccgagctcggaccaaactctaaccctaaaaatcaacaatatgtcgtcgaagcaaggaggaaaagcaaagcctttgaagcaacccaaggttgataagaaggattacgacgagaatgatttagctaaccttcagaagaagaaggaagaggaaaaggcactcaaggatcttagagccaaggctcaacagaaaggagcatttggaggttctggactcaagaaaagtgggaagaaatgaggagcgtttccaagtcaaatgtaccctttaaattcttgtgctatgatattacaaaatgcacagatgatgtctttggttaggctatgattgctcgagtttatgataagttgctaaaccttctatgaatgtgtgtaaactcttaaataaacttgattctgaacttgactttcaaggcagaaaactaatttgaagcattggttttcttttct

SEQ ID NO: 3473 - DNA, 582 bp, Sarracenia psittacina
cgggggcggtcgtaactgtaaaattaaggattctcttgccaatgttttccactgggaatcctcttctataaaggccatcgttttccagacaattagaaactagaaaagctactttcgggttagggcttcctacgataacttaacaaagtaattcgcatccaaaccaaaccctaaccctaatccaagaaaccaaccatgtcgtccaagcaaggtggaaaagcaaagcccttgaagcaacccaaggctgaaaagaaggaatacgacgagagtgatttggctaacctccagaagaagaaggacgaggaaaaggcacttagggagcttagagccaaggctcaacagaagggatcatttggaggtgctggcctcaagaaaagtgggaagaaatgagggcttcaaacccaaaacaacctcggagttagtgtaatatgactacagaatgcacttttcctgtgtttgggtatatgggtagatacgattcattgcccgtccttttaagttagctgcaaaacagttcgtggctttgtgtatgaatttctgaataaatttgtgtttaatgtatggatctgtgttttagttgtt

SEQ ID NO: 3474 - DNA, 451 bp, Sarracenia psittacina
attcgcagtagggttcgggctctgtattctgggatccgagctcggaccaaactactaaccctaaaaatcaacaatatgtcgtcgaagcaaggaggaaaagcaaagcctttgaagcaacccaaggttgataagaaggattacgacgagaatgatttagctaaccttcagaagaagaaggaagaggaaaaggcactcaaggatcttagagccaaggctcaacagaaaggagcatttggaggttctggactcaagaaaagtgggaagaaatgaggagcgtttccaagtcaaatgtaccctttaaattcttgtgctatgatattacaaagtgcacagatgatgtctttggttaggctatgattgctcgagtttatgataagttgctaaaccttctatgaatgtgtgtaaactcttaaataaacttgattctgaacttgactttcaaggcagaaaa

SEQ ID NO: 3475 - DNA, 844 bp, Picea glauca
cccccccccccccccggtaaagttgcgggatgatgcgctaagctccagcgaaatacgaaagggcgaataacagacaaagttcccgtcaatcaacgggtattcaatatacgtctcaacaaatctaggcgaaaatatatgcagtgaatatacatccagtagggtatatataaccgggcttacaccgttccattttggcgtggcaagtaagggttcgagaaggaaggcaagagtctctcacagtctgtccccatatacacagcgaccatgtcgagcaagcaaggtggaaaggctaagcccctcaagcagccaaagaaggataaggccgagtatgacgaggctgatctagctcacattcagaagaagaaggacgaggagaaggctttgaaggagttaaaagccaaggcatcacagaagggtagttttggtggaacagggttgaagaaaagtggcaaaaagtagtttgccatttactgctttctctacatcatgccactaaaattatacgtatggggactggttaggagagtgtttactcaattacaaagtatgtgattacggttaagaatggaccttctgagccacacacttgctgttttaatgtgaatggatatttaatgttgaaattacaatgtgatataggttttaaatttttttaagagataatcgggatgaattgttaaagacttactactgttgtgatgtcagatttgttagtttaagattgcctatatctgaaacatgtgggctatgattcgaatttagacatatttgggtggaattaattcgttgatgtttttgatgactgagtaggagtgttaaaaaatattttgttattgtagcaaaa

SEQ ID NO: 3476 - DNA, 773 bp, Picea glauca
tatacatccagtagggtatatatagccgggcttacaccgttccattttggcgtggcaagtaagggttcgagaaggaaggcaagagtctctcacagtctgtccccatatacacagcgaccatgtcgagcaagcaaggtggaaaggctaagcccctcaagcagccaaagaaggataaggccgagtatgacgaggctgatctagctcacattcagaagaagaaggacgaggagaaggctttgaaggagttaaaagctaaggcatcacagaagggtagttttggtggaacagggttgaagaaaagtggcaaaaagtagtttgccattgactgctttctctacatcatgccactaaaattatacttatggggactggttaggagagtgtttactcaattacaaagtatgtgattacggttaagaatggaccttctgaatcacacacttgctgttttaatgtgaatggatatttaatgttgaaattacaatgtgatataggttttaattttttttaagagatattcgggatgaattgttaaagacttactactgttgtgatgtcagatttgttagtttaagattgcctatatctgaaacatgtgggctatgattcgaatttagacatatttgggtggaattaattcgttgatgtttttgatgactgagtaggagtgttaaaaaatattttgttattgtagcaaaatatttgtgcaggttgatttgtttcgatttgggggtttatatgtatgttcttgaataatttatagatatagatat

SEQ ID NO: 3477 - DNA, 916 bp, Picea glauca
tacccgggggggatgatgcgctttaaaaggcctacccaggcgaaaatacgaaagggcgaataacagacaaagttcccgtcaagcaacgggtattcaatatacgtctcaacagatctaggcgaaaatatatgcagtgaatatacatccagtagggtatatatagccgggcttacaccgttccattttggcgtggcaagtaagggttcgagaaggaaggcaagagtctctcacagtctgtccccatatacacagcgaccatgtcgagcaagcaaggtggaaaggctaagcccctcaagcagccaaagaaggataaggccgagtatgacgaggctgatctagctcacattcagaagaagaaggacgaggagaaggctttgaaggagttaaaagccaaggcatcacagaagggtagttttggtggaacagggttgaagaaaagtggcaaaaagtagtttgccattgactgctttctctacatcatgccactaaaattatacttatggggactggttaggagagtgtttactcaattacaaagtatgtgattacggttaagaatggaccttctgagccacacacttgctgttttaatgtgaatggatatttaatgttgaaattacaatgtgatataggttttaaatttttttaagagataatcgggatgaattgttaaagacttactactgttgtgatgtcagatttgttagtttaagattgcctatatctgaaacatgtgggctatgattcgaatttagacatatttgggtggaattaattcgttgatgtttttgatgactgagtaggagtgttaaaaaatattttgttattgtagcaaaatatttgtgcaggttgatttgtttcgatttgggggtttatgcgtatgttcttgaataatttatagatatagatatatggt

SEQ ID NO: 3478 - DNA, 974 bp, Picea glauca
gctaagctccagcgaaatacgaaagggcgaataacagacaaagttcccgtcaagcaacgggtattcaatatacgtctcaacagatctaggcgaaaatatatgcagtgaatatacatccagtagggtatatatagccgggcttacaccgttccattttggcgtggcaagtaagggttcgagaaggaaggcaagagtctctcacagtctgtccccatatacacagcgaccatgtcgagcaagcaaggtggaaaggctaagcccctcaagcagccaaagaaggataaggccgagtatgacgaggctgatctagctcacattcagaagaagaaggacgaggagaaggctttgaaggagttaaaagctaaggcatcacagaagggtagttttggtggaacagggttgaagaaaagtggcaaaaagtagtttgccattgactgctttctctacatcatgccactaaaattatacttatggggactggttaggagagtgtttactcaattacaaagtatgtgattacggttaagaatggaccttctgaatcacacacttgctgttttaatgtgaatggatatttaatgttgaaattacaatgtgatataggttttaaatttttttaagagatattcgggatgaattgttaaagacttactactgttgtgatgtcagatttgttagtttaagattgcctatatctgaaacatgtgggctatgattcgaatttagacatatttgggtggaattaattcgttgatgtttttgatgactgagtaggagtgttaaaaaatattttgttattgtagcaaaatatttgtgcaggttgatttgtttcgatttgggggtttatatgtatgttcttgaataatttatagatatagatatatggtcccaaaaagcaaaatagcatatctttgttgtacgaaaaaaaaaaaaaaaacaaatactcgtgtacacaccatcgtccttttcgtagg

SEQ ID NO: 3479 - DNA, 884 bp, Picea glauca
aaagggcgaataacagacaaagttcccgtcaagcaacgggtattcaatatacgtctcaacagatctaggcgaaaatatatgcagtgaatatacatccagtagggtatatatagccgggcttacaccgttccattttggcgtggcaagtaagggttcgagaaggaaggcaagagtctctcacagtctgtccccatatacacagcgaccatgtcgagcaagcaaggtggaaaggctaagcccctcaagcagccaaagaaggataaggccgagtatgacgaggctgatctagctcacattcagaagaagaaggacgaggagaaggctttgaaggagttaaaagccaaggcatcacagaagggtagttttggtggaacagggttgaagaaaagtggcaaaaagtagtttgccattgactgctttctctacatcatgccactaaaattatacttatggggactggttaggagagtgtttactcaattacaaagtatgtgattacggttaagaatggaccttctgagccacacacttgctgttttaatgtgaatggatatttaatgttgaaattacaatgtgatataggttttaaatttttttaagagataatcgggatgaattgttaaagacttactactgttgtgatgtcagatttgttagtttaagattgcctatatctgaaacatgtgggctatgattcgaatttagacatatttgggtggaattaattcgttgatgtttttgatgactgagtaggagtgttaaaaaatattttgttattgtagcaaaatatttgtgcaggttgatttgtttcgatttgggggtttatgtgtatgttcttgaataatttatagatatagatatatggtcccaaaaagcaaaatagc

SEQ ID NO: 3480 - DNA, 670 bp, Picea glauca
gggcgaataacagacaaagttcccgtcaagcaacgggtattcaatatacgtctcaacaaatctaggcgaatatacatccagtagggtatatatagccgggcttacaccgttccattttggcgtggcaagtaagggttcgagaaggaaggcaagagtctctcacagtctgtccccatatacacagcgaccatgtcgagcaagcaaggtggaaaggctaagcccctcaagcagccaaagaaggataaggccgagtatgacgaggctgatctagctcacattcagaagaagaaggacgaggagaaggctttgaaggagttgaaagccaaggcagcacagaagggtagttttggtggaacagggttgaagaaaagtggcaaaaagtagtttgccattgactgctttctctacatcatgccactaaaattatacttatggggactggttaggagagtgtttactcaattacaaagtatgtgattacggttaagaatggaccttctgaaccacacacttgctgttttaatgtgaatggatatttaatgttgaaattacaatgtgatataggttttaaaatttttaagagatatttgggatgaattgttaaagacttgctactgttgtgatctcagatttgctagtttaagattgcctatatctgaaacatgtgggc

SEQ ID NO: 3481 - DNA, 540 bp, Eutrema halophilum
aggtcattccgcattcgtctgaaactctcagctcctttttcccaaaattctcagatcagcgacgaaccctagctctacaaaccagtcatgtcttccaagcaaggaggaaaggcgaaacctttgaagcagccaaaagctgataagaaggaatacgacgagcacgacatggctaacattcagaagaagaaagaggaggaaaaggcacttaaagaactaagagccaaggcatcgcagaagggatcctttggaggctctggacttaagaaaagcggcaagaaatgatctgttttatccatgaagcctgtttgacagttcaaatttatcaattaaaacagttaaatcgtgtgtttatgtaactttaatcataattgtaggagagtaactttgcgtctccttacatatgtttgctttcgccactttttcatgaaaaaaatgataaatggtttctaccctaatatttcaacatctccggattcagaattcagtaggttgactctcatatttctctttctcgggatccagttttagaaagtgctattt

SEQ ID NO: 3482 - DNA, 290 bp, Tripterygium wilfordii
taattgatcgcgttagggtttggtgtattgcttgcttctctttctgcaccaaatccttaattccgtagcagccatgtcttccaagcaaggcggaaaattgaagcccttgaagcaacccaaaggcgataagaaagagtacgacgagattgatatagctaacattcaaaagaagaaagaggaggaaaaggcactaaaagagcttaaagccaaggcccagcagaaaggggcctttggaggatctggcctcaagaaaagtgggaagaaatgagagatttgaaccacatcaaaat

SEQ ID NO: 3483 - DNA, 503 bp, Utricularia gibba
cgggcctagggttccctgattgcagcattgcgttggaagcgagttcccagctctagatccaaccatgtcttcgaaacaagggggtaaagcaaagcctttgaagcagccgaaggtcgaaaagaaggagtacgatgagattgacaaagctaatattcagaagaagaaggatgaagaaaaggccctaaaggatctcaaagctaaagctcagcagaagggggcatttgggggttcaggcctgaagaaaagcggcaaaaagtaagacatgcctaccccgaactcatgaccgtgtcatgttcttgtgtcattgttctgtgatgcttgcttgtttcccaactcaaaactagcttgtatcaataacacagtgaaatctaagacttccttataatctaccaagcttcattactcagtgtagactaggcctctcccctgtgggactgccgactagtttggacgtggttgctaacaattgaagtttaagaccactattttatggtacaaaaaat

SEQ ID NO: 3484 - DNA, 445 bp, Brassica juncea
atataatacagagattctactatggaatgaactgtaatccgtcgtctccaactctcagctcccttttccggttttccccaattcgcatcaaaccctagctctacacaccagtcatgtcgtccaagcaaggaggaaaggcgacacctttgaagcagccaaaggctgataagaaggaatacgatgagcatgatatggccaacatacagaagaagaaagacgaggaaaaggcacttaaggaactaagagccaaggcgtcgcagaagggatcctttggaggctctggacttaagaagagcggcaagaaatgacccgttttatccatggaaagcctgtatttgacagtgcaaatttatcaaacttaataacagataatcctgtgttgtgtaacttgtatcatgtttcctagaggagtgactttgcgtcccttacaaatgttcgctttcgc

SEQ ID NO: 3485 - DNA, 424 bp, Brassica juncea
aactttactttcttccccgattctcagctcagcagcatcaagacctagctccaggaagcagtcatgtcgtccaagcaaggaggaaaggcgaaacctttgaagcagccgaaagctgataagaaggaatacgacgagcacgatatggctaacattcagaagaagaaggaagaggaaaaggcacttaaagaactaagagccaaggcatcgcagaagggatcctttggaggctctggacttaagaagagcggcaagaaatgatttccgttcttatccatgtagcctgtctttgacagtgcaaatttatcaacttaaaaacaagattatcgtgtgtatcatgtccgtaggagagtgactttacttctcccttgcatatgttttgctttcgccactttttcatcataaaagaaaaatggtttctatccta

SEQ ID NO: 3486 - DNA, 475 bp, Brassica oleracea
gaaactttactttcttccgcaaattctcagacgagcagcatcaaaccctagctccagaaaccagtcatgtcgtccaagcaaggaggaaaggcgaaacctttgaagcagcccaaagctgataagaaggaatacgacgagcacgatatggctaacattcagaagaagaaagaagaggaaaaggcacttaaagaactaagagccaaggcatcgcagaagggatcctttggaggctctggacttaagaaaagcggcaagaaatgattcctgtgttttatccatgtagcctgtctgttgacagtgcaaatttatcacctttaaaaaacaaaacaagataatcatgtgttgtgtaacttctctatcatgttcgtaggagagtgactgcgcttctcccatacatatgtttgctttcaccacttttttcatgaaatggaaataaatggtttctatcctaatatcaaatgctttcatggttctt

SEQ ID NO: 3487 - DNA, 439 bp, Musa acuminata
tcgatttggtattggacatcaaaaattggggttcgctttcccttccggttcgaagcagccatgtcgtcgaagcaaggtggaaagttgaagcccctgaagcaacctaaatccgataagaaggagtacgatgagacggatttagcaaacctccagaagaaaaaagatgaggagaaggcagtgaaggagctcagggccaaggcatcccagaagggatcatttgggggtacaggtctaaagaagagtgggaagaaataatgttcttcctactgtactactaatattatgtttgtcttatcttttcttggattctgattcctacgtggtgataagtagtacttcacatgttctatcacattccgaagcaagtcatgatatgagattgtactatttgagtctatctgctatgtcctgtgcatcattttaaaatatatattccccg

SEQ ID NO: 3488 - DNA, 549 bp, Phaseolus coccineus
gttgaggcgagggtaaggtcgcgtcgtttcgtttcgtgctttgttcctttcgttgtcgtttttgtgtccagacctaaccctagctccgcaacgcaaccatgtcgaccaagcaaggtggaaaagctaagcctttgaagaagcccaagtctgataagaaggattacgacgacgttgacatggccaaccttcagaagaaaaaagaggaggagaaggctttaaaggagttgaaggccaaggcccaacagaagggaagttttggaggttctgggctcaagaaaagtggaaagaaataagggatttttataattactgcatacatgcaatattgagctctgtaattacagttgctaccataagaacttctcttttattgctaatgttagtactgtatgaactgacgtatgtctgatgtaagctgcaacaagttacttgttggctgctaacctactgtgtctttgtggggtttgattattacacccatttattagtgttgtgggtttggcatagacttgttcgagttataataatggcttggctttcaaattttaa

SEQ ID NO: 3489 - DNA, 352 bp, Phaseolus coccineus
ttcgttgtcgtttttgtgtccagacctaaccctagctccgcaacgcaaccatgtcgaccaagcaaggtggaaaagctaagcctttgaagaagccgaagtctgataagaaggattacgacgacgttgacattgccaaccttcagaagaaaaaggaagaggagaaggcgctaaaggagttgaaggccaaggcgcaacagaagggaagttttggaggttctgggctcaagaaaagtggaaagaaataagggttttttttataattactgcatacatgcaatattgagctctgtaattacagttgctaccaaaagaacttctctcttattgtggcctactttattgctaatgttag

SEQ ID NO: 3490 - DNA, 450 bp, Brassica napus
gacacaagtccgtcgtctgaaactttactttcttccgcaaattctcagacgaggcatcaaaccctagctccagaaaccagtcatgtcgtccaagcaaggaggaaaggcgaaacctttgaagcagcccaaagctgataagaaggaatacgacgagcacgatatggctaacattcagaagaagaaagaagaggaaaaggcacttaaagaactaagagccaaggcatcgcagaagggatcctttggaggctctggacttaagaaaagcggcaagaaatgattcctgtgttttatccatgtagcctgtctgttgacagtgcaaatttatcacctttaaaaaacaaaacaagataatcatgtgttgtgtaacttctctatcatgttcgtaggagagtgactgcgcttctcccatacatatgtttgctttcaccacttttttcatgaaatggaaaa

SEQ ID NO: 3491 - DNA, 505 bp, Brassica napus
gggattcggccttatggccggggacaagtccgtcgtctgaaactttactttcttccgcaaattctcagacgagcagcatcaaaccctagctccagaaaccagtcatgtcgtccaagcaaggaggaaaggcgaaacctttgaagcagcccaaagctgataagaaggaatacgacgagcacgatatggctaacattcagaagaagaaagaagaggaaaaggcacttaaagaactaagagccaaggcatcgcagaagggatcctttggaggctctggacttaagaaaagcggcaagaaatgattcctgtgttttatccatgtagcctgtctgttgacagtgcaaatttatcacctttaaaaaacaaaacaagataatcatgtgttgtgtaacttctctatcatgttcgtaggagagtgactgcgcttctcccatacatatgtttgctttcaccacttttttcatgaaatggaaataaatggtttctatcctaatatcaaatgctttca

SEQ ID NO: 3492 - DNA, 575 bp, Vigna unguiculata
ggggcgacgaatcattgttgaggcgagggtaaggtcgcgtagtttcgtgttttgttccttttcattgtcgtttttgtgtccagacctaaccctaactccgcaacgcaaccatgtcgaccaagcaaggtggaaaagctaagcctttgaagaagcccaagtctgataagaaggattacgacgaggttgacatggccaacattcagaagaaaaaggaagaggagaaggcgctaaaggagttgaaagccaaggcgcaacagaagggaagttttggaggttctgggctcaagaaaagtggaaagaaataaggtgtttttataattattgcatgcatgcaatattgagctctgtaattacagttgctaccataagaacttctctcttattgtggcctactttattgctaatgttagtaccgtatgaactgacgtatgtctgatgtaagctgcaacaaattacttgttggtggctaacttaattgtcttcgtgggttctgattgttacatccatttcttagtgttgtgggtttggcatatacttgtttgagttataataatggcatggcattcaacttttaa

SEQ ID NO: 3493 - DNA, 706 bp, Cryptomeria japonica
tagacgattaacaaggcatttgcagaccctgcgtagataacctgcaaccatgtctagcaagcaaggtggaaaggcaaagcccctgaagcagccaaagcaagagaaaaaggagtatgatgagcatgacctcgcaaatattcaaaagaaaaaggatgaggagaaggccttgaaggagttaaaaaccaaggcacaacagaaaggttcttttggtggatccggattgaagaaaagcggaaaaaaataggcactgcaaatgatggttatttgcagcctgaatttactatagtgtttgcataggagagtgtttacttaaatatgcaacatggttaaggatgcctaaaattatagcccttccagactaagctaactttcatttatgtgtcaatgtggtgatatctgagtaagtaattaaggacttttgtagtatacggttttctttctgctattttgagttagatttatgtctttaattttactgaaatgaatgtggtatgatatgttattactgaagatgatttaggtttggagttggggactatatgcaaagttagttaactcaagatctatagttgcattgctaaatgatttctgtttttgggaaattttgcctcctaatgcaaaactgtactaaacaatgatatttttacatgactccatcatgaagtattttacctgccgcataaatacttgacaacctgagcttttt

SEQ ID NO: 3494 - DNA, 648 bp, Gnetum gnemon
tcctatctgcatctttgtattaaaatgatctgttattacctccactacagttacgtgttgcaatatataatatttcacatgaaaatattaaattccaggcagttaaaattccgcatcactttacctgccaaagcaagaacacaagaattaaagtgggtctctgtttcttcgtctgcgttggggaacgataaatttggacgcgaaggttgcaggatcaggcctattccttttccttcttctgcgaagaacaaattagcgttcaatccgcatcgctcccaacagatctactttcttcgctgcaggatgtcttcaaagcagggtggtaaggtgaagcctcttaagcaaccaaagcaagacaaaaaggaatacgacgagagtgaccttgcatatcttcagaagaagaaggatgaggaaaaggcattgaaggagatgaaatccaaggccacacagaagggtgcctttagtggagctggattaaagaaaagtggcaaaaaatagaaatgtgaaaatatagttgatgtattttagaatgaatacgtggattatgaactaagcctgtgatcttgtactgcgtgttaacttttattttatgcattaacatatttcttgggctgttatcatcatgatcttgtatttgcagactctttc

SEQ ID NO: 3495 - DNA, 603 bp, Heritiera littoralis
ctcctaatttctctgatctcccctgaatttcagtaggaaacctaaccctaaccctaagcttttaatcatgtcgtccaagcaaggtggcaaattgaagcctttgaagcaagccaaatctgataagaaagagtacgacgagcatgatttggctaacattcagaaaaagaaggaagaagagaaggcacttaaagagctgaaagcaaaggcgcaacagaagggagcatttggtggttctggtcttaagaagagtgggaagaaatgagggtctaaaaacccagctaaacagaaactatttgactcttgtgttgggagacatcgcttgggatgctttgatgctctagtttcatgctgaatttgctataaaacactgtgtggaatgtcatactaaataaatttaagttctacatatttgcttttgtgtgtgcttttaaatctcctatagttgtgtcttgccatttgctgttgcctggatttgattggtgaatctgattccttcagcagccgggacacactgaccttgccttcttccttgctttgcagcgcattatgaactttcattttattaggtctttctatcttgtattaaattaaaattacttgata

SEQ ID NO: 3496 - DNA, 500 bp, Glycyrrhiza uralensis
acgaggtgaagggtgaggtcgtgccgtgttgtgtgctgtttctttctctgtcgtttctgcgttcagaccgaaccctagctctacaccgcaaccatgtcgaccaaacaaggtggaaaagctaagcctttgaagaaacccaagtctgataaaaaggactacgacgagattgacatggccaacatccaaaagaaaaaggaagaggagaaggcactaaaggagttgaaagccaaggcacagcagaaggggtcttttggaggatctgggctcaagaaaagtggaaagaaataagggctctttaccatgtgattgcatacatccattattgagctctgtaattacagttgtgaccatgagaaacaactcttaattgtgtcctactttgttgctgatgtttgtattaaaccgatgcatgtcatgatataagcgcgataagttacgtgtttgtagctttattgtgtctcactttggtgttctgataattacgtctatttggtgttgtg

SEQ ID NO: 3497 - DNA, 590 bp, Glycyrrhiza uralensis
agggtgaggtcgtgccgtgtcgtatgctgtttctttctctgtcgtttctgcgttgagaccgaaccctagctctacaccacaatcatgtcgaccaaacaaggtggaaaagctaagcctttgaagaaacccaagtctgataaaaaggactacgacgagattgacatggccaacatccagaagaaaaaggaagaggagaaggcactaaaggagttgaaagccaaggcacaacagaaggggtcttttggaggatctgggctcaagaaaagtggaaagaaataagggctctttaccatgtgattgcatacatccattattgagttctgtaattacagttgtgaccatgagaaacaactcttaattgtgtcctatgttgctgatgtttgtattgaaccgatgcatgtcatgatataagcgcaataagttacgtgtttgtagctttattgtgtctcactttggtgtttgtagctttattgtgtctcactttggtgttctgataattacatctatttagtgttgtggctttggaatagacttttccaagtaaataatggcttgtcttgcgaaatttaaattatcaaattttattatgc

SEQ ID NO: 3498 - DNA, 707 bp, Arachis hypogaea
ggggggggtttgggttatgtgagtcctataaatagcaaaatagaagcgtaaataaaaagcgtgaagcgctgagggtataagcttgtctcgtgtcgtgcgccatcaacgttctttggttttgcgattcggacccaaccctaatcccccttttgcatctcaaccatgtcgaccaagcaaggtggaaaggctaagcctttgaagaaacctaagtctgacaagaaagactacgatgaggttgacatggccaacatccaaaagaaaaaagaagaggagaaggcgctaaaggaattgaaagccaaggcgcaacagaaaggttcatttggaggttctgggctcaagaagagtggaaagaaatgagggctctcagccatgatacttaacattagtatacttccatcattaagctctgtaattacaattattatgagcacatctcttattgtgacctacttttgttgttagtgttggtaatgaacctaggcatgtcatgatgtactcccaataagttactgatttgtatttctactgtgtgcccttcttgggtcctgacagctgataattccatcttttccttttcttggatttcgtacacacaaacttagtaatgtagttagatattgtgctgcccaagttaatggtttaactgtgcctcaactgaaaaataatattgttttactttgtctgactgttaattggttaataatatg

SEQ ID NO: 3499 - DNA, 466 bp, Pisum sativum
ttcgagcggccgcccgggcaggtgttttcagaccgaaaccctaactctgcaccgtaaccatgtcgaccaagcaaggtggaaaagctaagcctttgaagaaaccaaagtctgataagaaggactacgatgaggttgacatggctaacatccataagaaaaaggatgaggagaaggcactaaaggagttgaaagctaaggcctcacagaagggatcttttggaggatctggcctcaagaaaagtggaaagaaatagaagggctctttgtcatgattttatattttcattattgagctctgtaattacgaacatgatcatgaaacttctcttgttgtgtgacctgttttattgctgatgttagttctaaatcaaagcttgttataatgatgtaaacgcaataagttactgctttgtagctctattgtgtctccctttagggttatgataattacatctgtttacttgct

SEQ ID NO: 3500 - DNA, 594 bp, Cajanus cajan
gggggggtatgaggcgagggtaaggtcgcgttttgttgtgtcgtgcgctgtctcctttgtcgtttttgtgttcagaccgaaccctagctccgcagcgcaaccatgtcgaccaagcaaggtggaaaagctaagcctttgaagaagcccaagtctgataagaaggattacgacgagattgacatggctaacattcagaagaaaaaggaagaggagaaggcactgaaggagttgaaagccaaggcacaacagaaggggagttttggaggttctgggctcaagaaaagtggaaagaaataagggctctttatcatgataattcaatactgagatctataattacagatgtgaccataagaacttctcttattgtgacctactttcttgctaatattagtacgaggtctgtccatatgtaagctgcaataagttacttatttgtagctttattgtgtgtttctcatggggttctgataactagtgttgtggatttgatatagacttgttcaagtaataatggcttggctttcaactgcttaacatttgtcatgattcatatgagatcctttagtcaatattcaattgtttggcttttgt

SEQ ID NO: 3501 - DNA, 759 bp, Cajanus cajan
aatccgaaaattgagttacgcttatccaaatgaatgcgtactatatatagaatggaacgggaggaagaataaatatgaggcgagggtaaggtcgcgttttgttgtgtcgtgcgctgtctcctttgtcgtttttgtgttcagaccgaaccctagctccgcagcgcaaccatgtcgaccaagcaaggtggaaaagctaagcctttgaagaagcccaagtctgataagaaggattacgacgagattgacatggctaacattcagaagaaaaaggaagaggagaaggcactgaaggagttgaaagccaaggcacaacagaaggggagttttggaggttctgggctcaagaaaagtggaaagaaataagggctctttatcatgataattcaatactgagatctataattacagatgtgaccataagaacttctcttattgtgacctactttcttgctaatattagtacgaggtctgtccatatgtaagctgcaataagttacttatttgtagctttattgtgtgtttctcatggggttctgataactagtgttgtggatttgatatagacttgttcaagtaataatggcttggctttcaactgcttaacatttgtcatgattcatatgagatcctttagtcaatattcaattgtttggcttttgttcttcagtattttgttggatatgcgtctctaaaatcttgtaaattttcttaagaagaaaattatagaggtgatgtagcgagtaaaatagaattaaaaaa

SEQ ID NO: 3502 - DNA, 610 bp, Podocarpus macrophillus
ctcctactatatatataccatttagtggccatagtattgcaacagcaagggtttcaagacgccaaaggtgctttcagcgtactcggcaaccatgtctggcaagcaaggtggaaaggcaaagcccttgaagcaggcaaagcaagagaaaaaggagtatgacgaggttgaccttgccaatatccagaagaaaaaagatgaggagaaggcactaaaggaattgaaatccaaggctcaacaaaagggttcttttggtggatccggactgaagaaaagtggcaaaaaatagatctgatgttttcttatatagaatgtcactgtaggaggtttttttataaaaaaagtggtatgtctaagattgtcctttataaaggacctttctaagtaatgtgcttttaattatcaatatggtgacatgaaatgccattcgtgagatgtgtttttatttggaccaagtcactcatgtgattaatatgttaaaagtacctagtgtttataaatgtttggtttttagatttgctcttagatggtattaatgtgtagaatgaacaatgggcatgcgagcagtggaagagatgttgcaaatttgaacatgttgttcaacggatatttt

SEQ ID NO: 3503 - DNA, 618 bp, Populus trichocarpa
cagtccacatgtatatatagggctccaacccactaagcagccccttataattgctttgaattagggttaggtttctcccagtttcgttcctccttcgaatcgtagaaaatcaaaccctaacccaaagcttcaatcatgtcttccaagctaggtggaaaagctaagcctttgaaggcaccaaagtctgagaagaaggattacgacgagactgatctggccaacattcaaaagaaaaaggatgaagaaaaggcacttaaggagctcagagccaaggcacagcagaaagggagctttggaggttctgggctgaagaaaagtgggaagaaatgaagatttcaaacccagatagacatggtttcctttagtgtattctgaactatattatgatgatatctcgtgtttagtgtgatggtcgctgatgtcctatgcttgatgtgttggtcttcatcttgagccagaattacgtaaaactttataaattgtgtgcatctgtcctctatccatgtgccaacaatgtatttgctggcattgttggaaactttgttctatgtaactcgtttgcaatttgttgattgcgcttagtaataatggtctcctgggtaattgatttcctgagga

SEQ ID NO: 3504 - DNA, 571 bp, Sciadopitys verticillata
aagcaaggatttgagaagaagtcagggcgttcagagaaactctgcaaccatgtctagcaagcaaggtggaaaggcaaagcccctgaagcaaccaaagcaggaaaagaaggagtatgatgaggttgaccttgcaaatatacagaagaaaaaagacgaggagaaggcactgagagagttgaaggccaaggcgcaacaaaaaggttcttttggtggatcagggttgaagaaaagtgggaaaaaataggctgcaaatgatactttttgctttgtgctaaatatgcaacatgatcaaagttatctttaatcatggcccgtactaagctaaactttatttatatattgatgatgtgatctcagaataattaattaaggatatgcttatatgagtttctaattctgttacataagattcattatcatattttattttgatgaataggatttgcttgttagtgtagtgacgtaatgggcaggtcatattagggatttatatttttactgttcatattgaaatctgttctttcagagttactctgtatatttgatatgtggttatctgctatctgctggc

SEQ ID NO: 3505 - DNA, 648 bp, Glycine max
aatccgaaaattcagtgacgcctatcctatatatatatattcgtactatataaggaatcgaatgggaggaagaataattgtgaggcgagggtaaggtcgcgttgtgttgcgtcgtgtcgtgcgctgttcctctgtttctcgtttttgtgttcagaccgaaccctagctccgcatcgcaaccatgtcgaccaagcaaggtggaaaagctaagcctttgaagaaacccaagtctgataagaaggattacgacgagattgatgtggctaacattcagaagaaaaaggaagaggagaaggcgctaaaggagttgaaagccaaggcgcaacagaagggaagctttggaggttctgggctcaagaaaagtggaaagaaataagggctctttatcatgattgtatgcattcaatattgagccctgtaattacagttgctaccatgataacttctcttattattgtggcctactttattgctaatgtgtactgaactgaggtatgtcgtgatgtaagctgcaataagttaattgtctgtagctttattgtatccccttcatggggttctgataattacatccttttagtagtgttgtggatttggcatagacttgttcaagtaaataatggcatggcttgcgaaattttatttgtc

SEQ ID NO: 3506 - DNA, 570 bp, Glycine max
gggaggaagaataattgtgagacgagggtaaggtcgcgttgtgttgcgtcgtgtcgtgcgctgttcctctgtctgtcgtttttgttttcagaccaaaccctagctccgcatcgcaaccatgtcgaccaagcaaggtggaaaagctaagcctttgaagaaacccaagtctgataagaaggattacgacgaggttgacatggctaacattcagaagaaaaaggaagaggagaaggcgctaaaggagttgaaagccaaggcgcaacagaagggaagctttggaggttctgggctcaagaaaagtggaaagaaataagggctctttatcatgattgtatacatccaatattgagccctgtagtttattaccatgataacttctgtcttattgtggccttctttattgctctaatgttagtactgaactgaggtatttcgtgatgtaagctgcaacaagttacttgtttgtagctttattgtgtggcccttcatggggttctgataattacatcctattagtagtgctgtggatttggcatagacttgttcaagtaataatgacttggcttgcga

SEQ ID NO: 3507 - DNA, 1187 bp, Picea glauca
ttgtaaagttgcgggatgatgcgctaagctccagcgaaatacgaaagggcgaataacagacaaagttcccgtcaagcaacgggtattcaatatacgtctcaacagatctaggcgaaaatatatgcagtgaatatacatccagtagggtatatatagccgggcttacaccgttccattttggcgtggcaagtaagggttcgagaaggaaggcaagagtctctcacagtctgtccccatatacacagcgaccatgtcgagcaagcaaggtggaaaggctaagcccctcaagcagccaaagaaggataaggccgagtatgacgaggctgatctagctcacattcagaagaagaaggacgaggagaaggctttgaaggagttgaaagccaaggcagcacagaagggtagttttggtggaacagggttgaagaaaagtggcaaaaagtagtttgccattgactgctttctctacatcatgccactaaaattatacttatggggactggttaggagagtgtttactcaattacaaagtatgtgattacggttaagaatggaccttctgaaccacacacttgctgttttaatgtgaatggatatttaatgttgaaattacaatgtgatataggttttaaaatttttaagagatatttgggatgaattgttaaagacttgctactgttgtgatctcagatttgttagtttaagattgcctatatctgaaacatgtgggctatgattcgaatttagacatatttgggtggaattaattcgttgatgtttttgatgactgagtaggagtgttaaaaaatattttgttattgtagcaaaatatttgtgcaggttgatttgtttcgatttgggggtttatgtgtatgttcttgaataatttatatatatagatatatggtcccaaataaaaaaacacctattcaaacctaatatattctatcactcttaacttttcttggtacccggggattttataaaatcaacttttaggcttacatccttaatttttatatactgtcccccacataccctcttttatttactgctatattatcgctccctgtgcgaaatttgcttcccccccctacttccccactacattcaaccccggaaaatataaatgaataaactcctgaggacgaaaataaattaatcttattcgattacataacattttc

SEQ ID NO: 3508 - DNA, 953 bp, Picea glauca
ttaattaaattaatcccccccccccccggtaaagttgcgggatgatgcgctaagctccagcgaaatacgaaagggcgaataacagacaaagttcccgtcaagcaacgggtattcaatatacgtctcaacaaatctaggcgaaaatatatgcagtgaatatacatccagtagggtatatatagccgggcttacaccgttccattttggcgtggcaagtaagggttcgagaaggaaggcaagagtctctcacagtctgtccccatatacacagcgaccatgtcgagcaagcaaggtggaaaggctaagcccctcaagcagccaaagaaggataaggccgagtatgacgaggctgatctagctcacattcagaagaagaaggacgaggagaaggctttgaaggagttaaaagccaaggcatcacagaagggtagttttggtggaacagggttgaagaaaagtggcaaaaagtagtttgccattgactgctttctctacatcatgccactaaaattatacttatggggactggttaggagagtgtttactcaattacaaagtatgtgattacggttaagaatggaccttctgagccacacacttgctgttttaatgtgaatggatatttaatgttgaaattacaatgtgatataggttttaaatttttttaagagataatcgggatgaattgttaaagacttactactgttgtgatgtcagatttgttagtttaagattgcctatatctgaaacatgtgggctatgattcgaatttagacatatttgggtggaattaattcgttgatgtttttgatgactgagtaggagtgttaaaaaatattttgttattgtagcaaaatatttgtgcaggttgatttgtttcgatttgggggtttatgtgtatgttcttgaataatttatagatatagatatatggtcccaaaaagcaaaatagc

SEQ ID NO: 3509 - DNA, 524 bp, Tamarix hispida
aaaaggaggttgttgctcttccgaacttccgaggaggaacatcttacgatccgagaattcagaccctgatcttaaccctaaccctaattttcagtagcgcccatgtcttctaagcaaggtggaaaggcgaagcctttgaagcaaccaaaatctgataagaaggattatgatgagactgataaggcaaacttgcagaagaagaaggaagaggagaaggcattgaaggagcttagagcaaaagcatctcagaaaggttcatttggtggctctggactgaagaagagcgggaagaaatgagcatgggggatggaatcatgacaaggaatgttgggattgtgtgtcacgtgcattttgtgatttccgttaattatataaattttcttgtggtgtttagtctaccgaacttggttattggtttgtcaagtaaaaccaattaaactaattaagtttctgttactttcttataatatcactttctttcctatttttcatgcgtaaattcctgtcatttttcgatgttcaat

SEQ ID NO: 3510 - DNA, 500 bp, Thellungiella halophila
tgaggtcattccgcattcgtctgaaactctcagctcctttttcccaaaattctcagatcagcgacgaaccctagctctacaaaccagtcatgtcttccaagcaaggaggaaaggcgaaacctttgaagcagccaaaagctgataagaaggaatacgacgagcacgacatggctaacattcagaagaagaaagaggaggaaaaggcacttaaagaactaagagccaaggcatcgcagaagggatcctttggaggctctggacttaagaaaagcggcaagaaatgatctgttttatccatgaagcctgtttgacagttcaaatttatcaattaaaacagttaaatcgtgtgtttatgtaactttaatcataattgtaggagagtaactttgcgtctccttacatatgtttgctttcgccactttttcatgaaaaaaatgataaatggtttctaccctaatatttcaacatctccggattcagaattcagtaggttgactctc

SEQ ID NO: 3511 - DNA, 683 bp, Phaseolus coccineus
gaccgtggcttattcagttgcgcttatccttacatattctccctatataagccattatgtgggacgacgaatgattgttgaggcgagggtaaggtcgcgtcgtttcgtttcgtgctttgttcctttcgttgtcgtttttgtgtccagacctaaccctagctccgcaacgcaaccatgtcgaccaagcaaggtggaaaagctaagcctttgaagaagcccaagtctgataagaaggattacgacgacgttgacatggccaaccttcagaagaaaaaagaggaggagaaggctttaaaggagttgaaggccaaggcgcaacagaagggaagttttggaggttctgggctcaagaaaagtggaaagaaataagggatttttataattactgcatacatgcaatattgagctctgtaattacagttgctaccataagaacttctcttttattgctaatgttagtactgtatgaactgacgtatgtctgatgtaagctgcaacaagttacttgttggctgctaacctactgtgtctttgtggggtttgattattacacccatttattagtgttgtgggtttggcatagacttgttcgagttataataatggcttggctttcaaattttaattatttattctattattctctcgtctcaccaaagtcaataacgaattttgtttttggt

SEQ ID NO: 3512 - DNA, 686 bp, Catharanthus roseus
cgctgttcgcgtttttctgtgatcagagaaatcgtaacctagccctagattgaacgtaatcaatcatgtcttccaagcaaggtggaaaagctaagcctttgaagcagccaaaggctgaaaagaaagattacgacgaggtagataaggcttttcttcagaaaaagaaagaagaggaaaaggcactgaaggatctgaaggcaaaggctcaaaaaggatccattggaggcacagggctgaagaaaagtgggaagaagtgaaagagtttaagaaatagtaataacgttttaaaggattcttgtactaagctttggtcatttgatcttgttctctacatgttaggacctgctttctactgttctttccaattatagaccatgttaaattgaatcttatcatgagcgtttgcaacttttatcatatagcaatgccttcttctgccactacttcctaagggtatgtgctttgtgatactctttgctgattcctttttaactctattcgaccaaatgttaaccacggggacagttgtactagtggagatagcttttaggagttcttttagcatcagctgttcaacttggaatggaacaacttgtgctctacagttatgtaacctgtggaacaagttgtctaatatatgctcctcaacagattggaatcaagttggcactctgggtgtgcatttt

SEQ ID NO: 3513 - DNA, 358 bp, Euphorbia peplus
tcggtctatcttcgtttctcttccaatttctcaaaatccttcaaatctactcttaaccctcagtagtggccatgtcttccaagcaaggtggaaaagcaaagcctttgaagcaacccaagactgcaaagaaggaatatgacgagagtgatctagccaacattcagaaaaagaaggaagaggagaaggcacttaaggagcttagagccaaagcacagaaaggacctattggaggtgctggccttaagaagagtggaaagaaatgaggggtttcaaacccataatcaaatataactatggatggcttgttataaacttataatagattattttgaccttcttttcctctgtttaacatgat

SEQ ID NO: 3514 - DNA, 457 bp, Flaveria ramosissima
acctgaatttcgcgtcaaagttaggttatcatctcatccccaaattcaatcgtacaacaccaaaaccctagatttcaatcatgtcttcaaagcaaggaggaaaagcaaagccattgaagcaacccaaggctgagaagaaagagtacgatgagatagataaggccaacattcaaaagaagaaggaagaggagaaggctctcaaggagctaagagcaaaagctcaaaagggagcacttggaggtactggtctgaagaaaagtggaaagaaatgagggtttattgattgcagaactgaagttgcttatgttgtgatttgtgaaatgttgctatgaatatgtttggttattaagctggatatgtggctagatctatgttgaatctcaggtaataatcatgctggtatttggtcctgatgttgatgtatctgttgtgatgtttcgatttgtgttctttttat

SEQ ID NO: 3515 - DNA, 672 bp, Flaveria ramosissima
cttccccaaaaacgtcaaagttgacgttatttgcttgcttaaagtcctccatttcttccgattcgcccatctctacagatcagagcaaaccctaaccctagatttcgataatgtcatcgaagcaaggtggaaaggcgaagccattgaagcaaccaaaagctgaaaagaaagaatacgatgagatagataaggccaacatccaaaagaagaaggaagaggaaaaggccctcaaggagcttagagccaaagctcagaagggagctttgggaggtactggtctcaagaagagtggaaagaaatgaggtctgcaatggtaatgttactgcatcttctatattactaatgaatgttgcacttgctatatttatggttacttgtttcccaagtcttcgtgattgttcttgtgtataactcaagaggaacgatcatactgatatttgatattgttgatttctggggtgtaatggttaatggcgattataatgtttttgggtcaggtctcagtcaatcttgcctaaaatctgtataaaagtttgatattagatcaaaggacagacataattgccttttgtgtttcatggttatcattgtgtgaagaatataaaaacaaagcatcaaagacgattcaatttttcactccctcatcaatgataataaatttagtattcatac

SEQ ID NO: 3516 - DNA, 525 bp, Flaveria ramosissima
aaagttgacgttatttgcttgcttaaagccctccatttcttccgattcgcccatctctacggatcggagcaaaccctaaccctagatttccataatgtcgtcgaagcaaggtggaaaagcgaagccattgaagcaaccaaaagctgaaaagaaagaatacgatgagatagataaggccaacatacaaaagaagaaggaagaggaaaaggccctcaaggagcttagagccaaagctcagaagggagctttgggaggtgctggtctcaagaagagtgggaagaaatgaggtttgcaatgttaaagtttccgcatcttctaaagtactaatgaatgttgcacttactatatctacggttacttgttttgaagtctttcatgattgttgttgtgtagaactcaattggaccaataatatcgatatctggtattgttcatttatcaggtgtagtgattaagggaaggtattatggttttgggtcgagtctcggttattatgttatttatgatttctattggtagtgcgtt

SEQ ID NO: 3517 - DNA, 420 bp, Linum usitatissimum
agggtttgagagctcaagaaatttttctcccagcttccatcttccagagaatcaaaccctaatcggaagtcttcaattccataccagccatgtcttctaagcaaggtggaaaggctaagcctttgaagcagcccaagtccgacaagaaggagtacgacgatgttgacaaggccttccttcagaagaagaaggaagaggagaaggctcttaaggacctgaaggccaaggcgcagaagggagcagtgggaggtgctggcctcaagaagagcggcaagaagtgagctctgcgatgccaagagatgtgcttaagaaattgtgttctgttgaaaacttacattgtttatgacatctttcattagttattgtggtggtgatgatggtctgtgacctcatttggctaatgtaatccgacggtttaac

SEQ ID NO: 3518 - DNA, 420 bp, Linum usitatissimum
agggtttgagagctcaagaaatttttctcccagcttccatcttccagagaatcaaaccctaatcggaagtcttcaattccataccagccatgtcttctaagcaaggtggaaaggctaagcctttgaagcagcccaagtccgacaagaaggagtacgacgatgttgacaaggccttccttcagaagaagaaggaagaggagaaggctcttaaggacctgaaggccaaggcgcagaagggagcagtgggaggtgctggcctcaagaagagcggcaagaagtgagctctgcgatgccaagagatgtgcttaagaaattgtgttctgttgaaaacttacattgtttatgacatctttcattagttattgtggtggtgatgatggtctgtgccctcatttggctaatgtaatccgacggtttaac

SEQ ID NO: 3519 - DNA, 513 bp, Olea europaea
ttccgtccactacctattctaacgaacctacctccccgtcccgtacctctggtagtcaacgacagagtacgcgggggggcggtagggtaaccttttcattgttcaagcgatttcgtgatcacagcgaagcgaaaccctaacccttgatttcagacatgtcttccaagcaaggtgggaaagcgaagcctttgaaggcgccaaagagtgagaagaaagagtacgacgagaatgacaaggcttttatccagaagaagaaggaagaggagaaggctctgaaggagcttaaatcgaaggctcaaaagggagcacttggaggtgcagggctaaagaaaagtggaaagaaatgaaaatttatgaagaactactagccctttgttgtcattgtaatgcgatctttctatttggtttaaatcaattcagcactacgttcttgcttagataaactatcgagcaacttctcataaagtttgtgtaaaactattcgtttgggccaataaacgtgcgtggttttgt

SEQ ID NO: 3520 - DNA, 553 bp, Helianthus annuus
gcgccccgatttcttccgattcgtccatctctacggatccaaacaaaccctaaccctagacttcaataatgtcatccaagcaaggtggaaaagcgaagccattgaagcaaccaaaggctgaaaagaaagaatacgatgagatagataaggccaacattcaaaagaagaaggaagaagaaaaggcgctcaaggagcttagagccaaagctcaaaagggagctttgggaggtaccggtctgaagaaaagcggcaagaaatgaggcctacaatgataaagttatcacatgttctaaattactaatgaatgctgctgcctgcacctactgtatttatggttacgtggtttgctattttatgtatcaagtcttttgtgattgttcttgtgtagatctcaagaggaacaatcatactgacatttgatattgttgatttatggggtgtaatgattcagtgaagttattatggttttgggtccggtaaaaaaaaaaaaaaaaaggccaccacgacccagtcgactctgaacacgagcaagcttatgaatgcgatcgcaatt

SEQ ID NO: 3521 - DNA, 430 bp, Helianthus annuus
aaacaaaccctaaccctagacttcaataatgtcatccaagcaaggtggaaaagcgaagccattgaagcaaccaaaggctgaaaagaaagaatacgatgagatagataaggccaacattcaaaagaagaaggaagaagaaaaggcgctcaaggagcttagagccaaagctcaaaagggagctttgggaggtactggtctcaagaagagcggcaagaaatgaggcctacgatgataaagttatcacatgttctaaattactaatgaatgctgccgcctgcacctaccatatttatggttacgtggtttgctatttaatgtatcaagtcttttgtgattgttcttgtgtagatctcaagaggaacgaacaaccataccgacatttgatattgttgatttatggggtgtaatgatttagtgaagttattatggt

SEQ ID NO: 3522 - DNA, 490 bp, Catharanthus roseus
ctagtggatccaaagaattcggcacgagggggttgggttgccgtttgccgctgttcgcgtttttctgtgatcagagaaatcgtaacctagccctagattgaacgtaatcaatcatgtcttccaagcaaggtggaaaagctaagcctttgaagcagccaaaggctgaaaagaaagattacgacgaggtagataaggcttttcttcagaaaaagaaagaagaggaaaaggcactgaaggatctgaaggcaaaggctcaaaaaggatccattggaggcacagggctgaagaaaagtgggaagaagtgaaagagtttaagaaatagtaataacgttttaaaggattcttgtactaagctttggtcatttgatcttgttctctacatgttaggacctgctttctactgttctttccaattatagaccatgttaaattgaatcttatcatgagcgtttgcaacttttatcatatagcaatgccttcttctgccact

SEQ ID NO: 3523 - DNA, 465 bp, Cleome spinosa
aaaaaacatcggtaattaaaaaaacaaaaggttagggcttggaaaggtgcctctgttatcgactttgagctccaggtctaaccctaaccctagaattcagccatgtcgtccaagcaaggaggaaaattgaaacccttgaagcaacccaagggggggaagaaagagtacgatgagcatgatctagagaacctccagaagaagaaggaagaagagaaggcgcttaaagagctgagggccaaggcgcaaaagggtgcaatcggaggagctgggcttaagaagagtggaaagaagtaagaataaaccatgttcctctttcttaggaaaaccgctttatccgctccccaagttatgccatctatctctcgatctatctatatagattatatatcctttgttggacatgtaataccttacaatttcgatctattgttctcgaaatgggaatgaatctagagtgtgtcttgc

SEQ ID NO: 3524 - DNA, 668 bp, Taraxacum officinale
cttggcggggacgcatctaagttcgcgttcgggttaggttacaggttattcattccccagtctgcgtattgtgtatagcatcaaaccctaacttcagtttccatcatgtcgtccaagcaaggaggaaaagcaaagccattgaagcaacccaagtctgagaagaaagaatacgacgaggtagataaggccaacattcaaaagaagaaggatgaggaaaaggcacttaaggagcttagagccaaagctcaaaagggagcactgggaggtactggtttgaagaaaagtggaaagaaatgaaacctaaattgctccacatatatactaatatgttgtgatttgtgaatcttgctcttaatatgttatattgctaaattcagtatagaccttttacagtttgcttgtaataatcatggtgatatattgcctctcatatagttttaggccttgctgatcttgtcataaattacaactagttggaggttcagatttaaaaaaaaaaaattgtgttgtttaaacttattttttatttgaaatttgaaatgagcttttagggttgtttgtaaattcagatgtagtaattagcaaaaagttgatgtagtcatatatttgactatgaattacttgtaatctaaacatttagatttttatgactataactttattcatga

SEQ ID NO: 3525 - DNA, 535 bp, Taraxacum officinale
gtatacccatcgtataaataagcctcactttaccttaccagaatcatatttcttcctcttcacgcatctccacggatcagagctaaccctaaccctagattcgacaatgtcgtccaagcaaggtggaaaagcgaagccattaaagcaaccaaagtctgaaaagaaggaatacgatgaggttgataaggccaacattcaaaagaagaaggatgaggaaaaggcactgaaggagcttagagccaaagctcaaaagggggctttgggaggtactggtctcaagaagagtgggaagaaataaggcctgctgaagtggaaggtatcatgtgactactttctgtatcaagtattatgtgattgttcttgtagatttaagaggaacaatcatgacatttggttctgtattgttgttttcttgattgtacttgattatggagcttattgtgccttgtgtcattgtcatggaaatctgttataccaccctgcactaaataacctaaggttgttcatctatatgttcattgttcagtatgcaacg

SEQ ID NO: 3526 - DNA, 513 bp, Linum usitatissimum
gaaagttagggtttgagagctcaagaaatttttctcccagcttccatcttccagagaatcaaaccctaatcggaagtcttcaattccataccagccatgtcttctaagcaaggtggaaaggctaagcctttgaagcagcccaagtccgacaagaaggagtacgacgatgttgacaaggccttccttcagaagaagaaggaagaggagaaggctcttaaggacctgaaggccaaggcgcagaagggagcagtgggaggtgctggcctcaagaagagcggcaagaagtgagctctgcgatgccaagagatgtgcttaagaaattgtgttctgttgaaaacttacattgtttatgacatctttcattagttattgtggtggtgatgatggtctgtgacctcatttggctaatgtaatccgacggtttaacgttggtgctatgttatgttatgtgtgtcaaaagctttgtgagactcttgttgttttggttcaccccaataaacttacctcttgcgc

SEQ ID NO: 3527 - DNA, 558 bp, Linum usitatissimum
gatcactcgctccccagtaattgcgaaagttagggtttgaaagctcaagaattttttctcccagttttcatcttccagagaatcaaaccctaaccggaagtcttcaatttccataccagccatgtcttctaagcaaggtgggaaggctaagcctttgaaacagcccaaatcggacaagaaggagtacgacgatgttgacaaggccttccttcagaagaagaaggaagaggagaaggctctgaaggacctgaaagccaaggcacagaagggagcagtgggaggtgctggactcaagaagagcggcaagaagtgagctctgtgggatgccaacagatgtgcttaagcattcgaattgtgttctgttgaaaacttacattgtttatgacatcatttattagttgttgtggtgatgatggtctgtgacctcatttggctaaatgtaatccgacggtttaacgttggtgctatcttatgatgttatgtgtgtcaaagctttgtgagactcttgttgttttggttcaccccaataaacttacctcttgcacgtcagttcttttg

SEQ ID NO: 3528 - DNA, 709 bp, Lactuca sativa
cgttcaggttaggttatttcattttccattctgcgtgtttctttacagcatcaaaccctaaccgatcatgtcgtccaagcaaggaggaaaagcaaagccattgaagcaacccaagtctgagaagaaagaatacgacgaggtagataaggccaacattcaaaagaagaaggatgaggaaaaggcacttaaggagcttagagccaaggctcaaaagggagcactaggaggtactggtctgaagaaaagtgggaagaaatgagatgaagcagagctgaagttgctgcatataactactactattatgttgtgatttgtgaattctgcttctaatatcttagctgaacgtgtttggtaaattcagtataaaccttttgcagtttgcttgtaataataatcatggtgatatttggtctagatgttgtttaggctgtatgctgactctgtcataaactggaactggttatgttttgtttggttatgagttctaaatttttaaaaaaggcaggcttttgggtgaaggttgaaacgttaagttcttttaaaactcaaccccatggttaaacctaactggaattgtgttgtcttcatgtgtaaatcttgaaaacatcattttccaggtgttagaatgtccatctaaagtgtttattggatgctgtagtcacaatgaggaaaacatcatgtttttggtgttggaacaagaattttgtac

SEQ ID NO: 3529 - DNA, 457 bp, Lactuca sativa
aagatttcttccgcttcccgcatttctacggatcagagcaaaccctaaccctagattcgataatgtcgtccaagcaaggtggaaaagcgaagccattaaagcaaccaaagtctgaaaagaaggaatacgatgaggttgataaggccaacattcaaaagaagaaagatgaggaaaaggcacttaaggagcttagagccaaagctcaaaagggagctttgggaggtactggtctcaagaagagtggaaagaaatgataccaagtgattgttatgtgcactgatttctgtatcaagttttctgtgattgttcttgtagaaatttaagaggaacaatattggtggtattcttgttttctggttctacttgtttgtgttcaatatgcaacttttattttctttgttttcaatttgaaagatgtagcatttttaaatgggttgattcagattatgattggtgc

SEQ ID NO: 3530 - DNA, 422 bp, Lactuca sativa
cgttcgggttaggttatttcatttcccagtctgcgtgtttctgtatagcatcaaaccctaaccgatcatgtcgtccaagcaaggaggaaaagcaaagccattgaagcaacccaagtctgagaagaaagaatacgacgaggtagataaggccaacattcaaaagaagaaggacgaggaaaaggcacttaaggagcttagagccaaagctcaaaagggagcactgggaggtactggtctgaagaaaagtgggaagaaatgagatgaagcagaactgaagttactgcatatactactactatgttgtgatttgtgaatcctgcttctaatatcttagctgaatgtgtttgcttaattcagtataaaccttttgcaatttgcgtgtaataatcatggtgatatttggtctagatgttgtttaggct

SEQ ID NO: 3531 - DNA, 505 bp, Lactuca sativa
cgttcaggttaggttatttcatttcccattctgcgtgtttctttacagcatcaaaccctaaacgatcatgtcgtccaagcaaggaggaaaagcaaagccattgaagcaacccaagtctgagaagaaagaatacgacgaggtagataaggccaacattcaaaagaagaaggacgaggaaaaggcacttaaggagcttagagccaaagctcagaagggagcactgggaggtactggtctgaagaaaagtgggaagaaatgagctgaagttgctgcatatactactactattactactatgttgtgatttgtgaatcctgcttctaatatcttagctgaatgtgtttggtaaattcagtataaacctttgcagtttgcttgtaataatcatggtgatatttggtctagatgttgtttaggctgtatgttgactctgtcataatctggaacgggttatgttttgtttttggttatgagttctaaatttttaaaaaaggcaggcttttgg

SEQ ID NO: 3532 - DNA, 689 bp, Quercus alba
gtggttgacgcagagtacgcgggggtctgcgactctgcgttgttactttctttttcggctttgggaattccagttcgaaccctaaccctagatcgcagccagccatgtcgtccaagcaaggtggaaaagcaaagcctttgaagcaacccaaggctgacaagaaagactacgacgaggttgacatggccaatattcaaaagaagaaagaagaggaaaaggcactcaaggagcttagggccaaggcacagaaaggtcccattggtggtgctgggctgaagaaaagtgggaagaaatgaggggttttaggccccaataggactgtgtttacaagcattattatgatgattacctttgattaatgtgattgtctagcttcttgctatgtgtgtactaaactatgggagtcatctatgtaagactaaatcttcaatttgcatgttagtgatattttcttgttcctaaaatgaccccattgcattatgtgtggagatgattatgattctgatgcttagcttctgctactgctttttaatggtaaaatttgttgactatgatttgtaatttgtccaataaataatttcgctacttatgatgaataagtgcaggccttttgcaattggtcaaattatatattcttttgtaaaaagaaaaaatagagtgaccaaaaattaacatgtggggtttagcat

SEQ ID NO: 3533 - DNA, 476 bp, Orobanche aegyptiaca
aaaagagctgtgtgggttgggagaaggtatttccattctctaattaaccgataatcagatccaaactcttaaccctagaaaatcaaccatgtcttctaagcaaggtggaaaggcaaagcctttgaaggcaccaaagagtgaaaagaaggaatacgacgagaatgacaaggctttccttgcaaagaagaaggaagaggaaaaggcactaaaggagctcaaggcaaaggctgcgaaaggctccattggtggtactggcctgaaaaagagcggaaagaaatgagaatgttatattcttcctcctagtattgggatcttcttttctcgcccatggctagatttggtgttctaagcttttacggttaacttaacttttgggatgtctctatggtgactgaatgaattagtatgggggacttgttcctttccaatataatgacttgtattgtggtgcctttccctatcaataattcatatag

SEQ ID NO: 3534 - DNA, 476 bp, Helianthus annuus
tccaccttggcgttgtttgaactttgaagcgacccgatttcttccgattcgcccatctctaaacaaaccctaaccctagacttcaataatgtcatccaagcaaggtggaaaagcgaagccattgaagcaaccaaaggctgaaaagaaagaatacgatgagatagataaggccaacattcaaaagaagaaggaagaagaaaaggcgctcaaggagcttagagccaaagctcaaaagggagctttgggaggtaccggtctgaagaaaagcggcaagaaatgaggcctacaatgataaagttatcacatgttctaaattactaattaatgctgctgcacctactgtatttatggttacgtggtttgctattttatgtatcaagtcttttgtgattgttcttgtgtagatctcaagaggaacaaccatactgacatttgatattgttgatttatggggtgtaatgatttagtgaagttat

SEQ ID NO: 3535 - DNA, 530 bp, Helianthus annuus
taactagcttgcttgtttgaagcgccccgatttcttccgattcgtccatctctacggatccaaacaaaccctaaccctagacttcaataatgtcatccaagcaaggtggaaaagcgaagccattgaagcaaccaaaggctgaaaagaaagaatacgatgagatagataaggccaacattcaaaagaagaaggaagaagaaaaggcgctcaaggagcttagagccaaagctcaaaagggagctttgggaggtaccggtctgaagaagagcggcaagaaatgaggcctacaatgataaagttatcacatgttctaaattactaatgaatgctgcacctgctatatttatggttacgtggtttgctattttatgtatcaagtcttttgtgattgttcttgtgtagatctcaagaggaacaaccatactgacatttgatattgttgatttatggggtgtaatgatttagtgaagttattatggttttgggtcgggttaatggtagatctcgcccaaaaccataataacttcact

SEQ ID NO: 3536 - DNA, 464 bp, Tamarix hispida
  misc_feature (396)..(396): n is a, c, g, or t
gggggtgtttggaaaagggttacgtcgttgtcgttcttccgaacatcagaggaatttccacggtaagataataaccgatccttactaccacccagcagcagccatgccttccaagcaaggtggaaaagcgaagcccttgaagcaacccaagtccgataaggagtacgatgagattgacagggctaacctgcagaagaagaaggaagaggagaaggcattgaaggagcttagagcaaaagctcagaaaggttcactgggtggttctggattgaagaagagtggaaagaagtgaggcttcctgaacgcaagaaaggacagaaccatgagaagatatgttgggggtgtgtcacatttgtttttgtgatttccgtcaattatcattgtaattgtgatgtngtgctaatgaacttggctgtaggcgtctcatatgtaatcaatgaaaacttgaaaggtattggtcacaa

SEQ ID NO: 3537 - DNA, 503 bp, Nicotiana tabacum
cactttacaaaagagctgtgtgggttgggagaaggtatttccattctctaattaaccgataatcagatccaaactcttaaccctagaaaatcaaccatgtcttctaagcaaggtggaaaggcaaagcctttgaaggcaccaaagagtgaaaagaaggaatacgacgagaatgacaaggctttccttgcaaagaagaaggaagaggaaaaggcactaaaggagctcaaggcaaaggctgcgaaaggctccattggtggtactggcctgaaaaagagcggaaagaaatgagaatgttatattcttcctcctagtattgggatcttcttttctcgcccatggctagatttggtgttctaagcttttacggttaacttaacttttgggatgtctctatggtgactgaatgaattagtatgggggacttgttcctttccaatataatgacttgtattgtggtgcctttccctatcaataattcatatagtcgttaatctttgtgtgaa

SEQ ID NO: 3538 - DNA, 724 bp, Amborella trichopoda
gtcccgtcaaggtctttgtagagagctggggcgacttgggatttgaagcttctcttcattgcccgcctcatcaaccccgatatctctgcacatcatgtcttctaagcaaggtggaaaggccaagccattgaagcaaccaaaggctgaaaagaaagactatgatgaggatgatctagcaaatattcagaagaaaaaagaggaggaaaaggcactcaaagagttgagggccaaggcatcgcagaagggagcctttggaggtgcggggctcaagaaaagcgggaagaaatgagtatggagcgcgcttgtgcccagccgaagcaatgagtatcttgtaattctgtcatggaagtgctttccttccatgttcagagtaaattcaatgctaaacactaccacatttgcatatatagctttggtttggtcgggatggttaggcctgcttttaaagacatggtctgatgtgtgatagggatggttaggcccgcttttaaagacatggtctgatttgtgataggtatctatctacacatttggatgataattttattgtggttgctaaggttcgccctttttcgtttttctttttatggtttaaacgctggaagtgtatctcagtgcttgttcgtcttctattgattttgagtttcataataaatcggatgggactattttagccctttaagtctccaaatgggtgacagttatgtaaattaaaaaaaagaaa

SEQ ID NO: 3539 - DNA, 866 bp, Cedrus atlantica
gaaacacggttaggcgattagcatataaagtttccgtcaatcaacgggtatttaatatacgtcaacgaatcaagggcaaaacatatacagtgagtatacatccaataggatatatatagaaaggcataccccggtgcattttggcgtggcaagtaagggttcggaaaggaaggaaagaagctctcagtctgcccccatatacacagcgaccatgtctagcaagcaaggtggaaaggctaagcctctaaagcagccaaagaaggataaagctgagtatgacgaggctgacctagctcacattcagaagaaaaaggatgaggagaaggcattgaaagagttgaaaacgaaggcagcacagaagggtagtttcggtggaacagggttgaagaaaagtggcaaaaagtagtctgccatagagtgctttttctacatctagactttatgccactagaaatatacttatggggtttgtttattcaattgcaaagtttgtgattaccgttaagaatggaccttcttaaccacacacttactgctgttttaatgttaagagatatttgggatgaattgctaggtttactgttgtgatgtaagaattattattttaagattgcttatgtgaaacgtgtggtctgtgctttgaaattagacatacaagagtggaattaatttgttgaatgaggagtgtagaacaatatatgttatggaagacgctccccggaggaagaggaccttattctcagattacacagactccttggcaacaggtggtctctcatagcaggccgtataccggggcgaacagataacgagataaaaaattactggaacactcatctaagtaaacagcttatcagtcaaggcat

SEQ ID NO: 3540 - DNA, 592 bp, Cucurbita pepo
aagatctttcaggttagattcgggacccgactttgccttctccgtatacaaatggaaaacgcaacctagggcttccattcttgcgctcttgcctccacttccaccggcttcttctttgccttctcttctttggtgaagtagctggtcgctgcgatccctctttgtgctcttcgacccgggccaaatccctgcactatctcagccatgtcttccaagcaaggagggaaagcaaagcctctgaagcaacccaaggctgataagaaagaatacgacgaggttgatatggccaatatgcaaaagaagaaggatgaggaaaaggcgctcagggagcttagagcaaaggcccaacagaagggtacatttggaggtgctggactcaagaagagtgggaagaaatgagtcctcctacgccacatatgttagattacttgatcttcaattgcagatatctgatgtctttgtaagcaattgattgtgtgacatgttatcctctgcatgaaccgaataacatgaagtcttcaaacgctttactattttcttgttgtgtgtaaaacctggaagaagataacattgctatggtccttgtttctgg

SEQ ID NO: 3541 - DNA, 663 bp, Cucurbita pepo
tatacaaatggaaaacgcaacctagggcttccattcttgcgctcttgcctccacttccaccggcttcttctttgccttctcttctttggtgaaggtaacctaattccgtttctgaagtagctggtcgctgcgatccctctttgtgctcttcgacccgggccaaatccctgcactatctcagccatgtcttccaagcaaggagggaaagcaaagcctctgaagcaacccaaggctgataagaaagaatacgacgaggttgatatggccaatatgcaaaagaagaaggatgaggaaaaggcgctcagggagcttagagcaaaggcccaacagaagggtacatttggaggtgctggactcaagaagagtgggaagaaatgagtcctcctacgccacatatgttagattacttgatcttcaattgcagatatctgatgtctttgtaagcaattgattgtgtgacatgttatcctctgcatgaaaccgaataacatgaagtcttcaaacgctttactattttcttgttgtgtgtaaaacctggaagaagataatattgctatggtccttgtttctggagtggaatgattaatagaagtcgaaccctttgcaatattctaaactatctttagaccaaaagctaaatgaatgatcgtcgtaggctctgct

SEQ ID NO: 3542 - DNA, 531 bp, Cucurbita pepo
cgctcttgcctccacttccaccggcttcttctttgccttctcttctttggtgaagtagctggtcgctgcgatccctctttgtgctcttcgacccgggccaaatccctgcactatctcagccatgtcttccaagcaaggagggaaagcaaagcctctgaagcaacccaaggctgataagaaagaatacgacgaggttgatatggccaatatgcaaaagaagaaggatgaggaaaaggcgctcagggagcttagagcaaaggcccaacagaagggtacatttggaggtgctggactcaagaagagtgggaagaaatgagtcctcctacgccacatatgttagattacttgatcttcaattgcagatatctgatgtctttgtagcaattgattgtgtgacatgttatcctctgcatgaaaccgaataacatgaagtcttcaaacgctttactatttcttgttgtgtgtaaacctggaagaagataatattgctatggtccttgtttctggaggtggaatgattaatagaagtcg

SEQ ID NO: 3543 - DNA, 520 bp, Cucurbita pepo
cgctcttgcctccacttccaccggcttcttctttgccttctcttctttggtgaagtagctggtcgctgcgatccctctttgtgctcttcgacccgggccaaatccctgcactatctcagccatgtcttccaagcaaggagggaaagcaaagcctctgaagcaacccaaggctgataagaaagaatacgacgaggttgatatggccaatatgcaaaagaagaaggatgaggaaaaggcgctcagggagcttagagcaaaggcccaacagaagggtacatttggaggtgctggactcaagaagagtgggaagaaatgagtcctcctacgccacatatgttagattacttgatcttcaattgcagatatctgatgtctttgtaagcaattgattgtgtgacatgttatcctctgcatgaaaccgaataacatgaagtcttcaacggcttacttatttcttgttgtgtagtaaacctaggaagaagataacattgctatggtccttgtttctggagtggaatga

SEQ ID NO: 3544 - DNA, 542 bp, Euonymus alatus
aattattacttgattgagttagggtttcagggtttggagtattgcttctcttcctgctccaaatccttagattccgatagcagccatgtcgtccaagcaaggtggaaaagcgaagcctttgaagcaacccaaaagcgagaagaaagagtacgacgagattgataaggctaacattcaaaagaagaaagaagaggaaaaggcaataaaggagcttaaagccaaggcacagcagaaaggggcttttggaggatctggcctcaagaaaagtgggaagaaatgagggatttgaaacccaaatcagaacacaactcacaaattcttatgtcgtgattatgaatttaaactattatgcatcgtttgatgggtctatgatgattacctttggaggttgggatggtctagtctctttctaaatcccacttctaaactttcatgttatgtaaaaaccctgtaattcttaagccgtgtgatggcctccatttgactgctaattttggctatatatccatataactttgtttgaataagtgatgatttggctg

SEQ ID NO: 3545 - DNA, 539 bp, Euonymus alatus
cacagtcaattattacttgattgcgttagggtttggagtattgcttctcttcctgctccaaatccttagattccgatagcagccatgtcgtccaagcaaggtggaaaagcgaagcctttgaagcaacccaaaagcgagaagaaagagtacgacgagattgataaggctaacattcaaaagaagaaagaagaggaaaaggcaataaaggagcttaaagccaaggcacagcagaaaggggcttttggaggatctggcctcaagaaaagtgggaagaaatgagggatttgaaacccaaatcagaacacaactcacaaattcttatgtcgtgattatgaatttaaactattatgcatcgtttgatgggtctatgatgagtacctttagaggttgggatggtctagtctctctctaaatcccacttctaaacttttatgttatgtaaaaacccagtaattcttgagttgtgtgatggctccatttgactgctaattggctgtatatccatataactttgtttgaataagtgatgatttggctgt

SEQ ID NO: 3546 - DNA, 734 bp, Gossypium raimondii
aaaaaaaagagcggcgggggctgcttttctttattcagtatttggtaatttcaggcagcaattagtcacgcgcaaggcgcgtgcaaatttactttctctatttatacgggcatcttagttgattcccaaatgctcaataattgtgtttttagggttagggctctttattttctctgttcatcaggttctttttatctcttcgaattttcattacagaccctgatcctaaactctcaattatgtcttccaagcaaggtggcaaagcaaagcctttgaagcaacccaaagctgagaagaaagaatacgacgagcatgatttggctaacattcagaaaaagaaagaagaagagaaggcccttagagagctgagagcaaaggcatcacaaaagggatcatttggtggttctggtcttaagaagagtggcaagaaatgagtttcttaaaaacccgagctaaaccgaacttattgagtcatgtcttgggattaaaacatctattatgctgatgtctcttgtttctattgtgatagttgggatgatttgatgctctagtttcattctgaatttgctataaaaaacattgtgtgtaatttcgtgacgtataacttaataaattcaagttctacgtttgtgttttttgtctatacatttgtaaatctcctattgttgtggttcgctattgcttcaatttggcttgtgaatttgatcccttcagtatccgagacaatcggccct

SEQ ID NO: 3547 - DNA, 617 bp, Pinus pinaster
acgtctcagcgaatctattaatatatacagtattcaatagggtctatatagcagggcatacagcattgcagtttggcgtggaagaggccgagaaggaaggaaatagtctctcatagtctgtctcctttaacacagcgaccatgtctagcaagcaaggtggaaaggctaagcccctcaagcagccaaagaaggataaagctgagtatgacgaggctgatctagctcacattcagaagaaaaaggatgaggagaaggctttgaaggacttgaaggctaaggcagcacagaagggtagttttggtggaacagggttgaagaaaagtggtaaaaagtagtcagcaattgagtgtttactcaattacaaagtatgtcattaccattaagaatggaccttctgaactacacgctgctcttttgatgtgaatgaatatttaatgctgcaattataatgtgagataggtttggaattttttaagtagacattgtggatgaattgctaaagaattactactgttgtgatctctgaattgttagttcaagattgcatgtatctgaaacatgtgggatgtgatatgaatttagacatttggatagaattaatttgtttgatgtttttg

SEQ ID NO: 3548 - DNA, 720 bp, Pinus pinaster
ctagatggttgtatataagaatctcctttgaagaagcataaaacaaattgtaaagtttcgggatgatgcgctaagcaacagcgaaagacgccaaggtgaataacaggcagagttcccgtcaagcaacgggtattcagtatacgtctcggcgaatccaggggcaaatatatacagtgaatatacatcgaatagggtatatataccagggcatactccgttgcagttttgtgtggcaggcaagggctcgagaaggaacgaaagagtctcacagtccatccccatatacacagcggccatgtctagcaagcaaggtggaaaggctaagcctctcaaacagccaaagaaggataaggctgaatatgacgaggctgatctagctcacattcagaagaaaaaggatgaggagaaggctttgaaggagttgaaaactaaggcatcacagaagggtagttttggtggaacagggttgaagaaaagtggtaaaaagtaggctgcaatagagtgctttctctacatcaagccagtaaaaacatacttatgggactggtagggagagtgtttgctactaaaagcgtacttatggggactggttaggagagtgtttgctcaattacaaaatatgtgattactattaagaatggaccctctgaaccacacgcttactgctgttttaatgcgagtaaatatttaatgttgcaattataatgttagatgggtttt

SEQ ID NO: 3549 - DNA, 509 bp, Lippia dulcis
tctccaattgtaccaatctgtggttttccatctctgcgaagccctaaccctataattcagccatgtcgtccaagcaaggaggaaaagccaagcctttgaagcaacccaagtcggaaaagaaagagtacgacgagattgacaaggctaacattcaaaagaagaaggaagaggaaaaggctctcaaggagctaaaggcgaaggctcagcagaagggctcatttggtggttctggtctgaagaaaagtggcaagaaatgagtcctcaataagcaaaggctaatatgggccgttgtgctattgtgttctttaattcctagtattaatgtttttcatattgaagaatgaaacttgaccttgtcgatgtaacaatatatttcgcatttcagtatataaatgcctaaatggtatgtccctgtttctttaaatttcttcagcttcccgtatgagggtgataagtgtgataaatgtcttaagagtcgatattgccaagtgtcatgtcttaatttttcc

SEQ ID NO: 3550 - DNA, 582 bp, Sarracenia psittacina
agtagggttcgggctctgtattctgggatccgagctcggaccaaactctaaccctaaaaatcaacaatatgtcgtcgaagcaaggaggaaaagcaaagcctttgaagcaacccaaggttgataagaaggattacgacgagaatgatttagctaaccttcagaagaagaaggaagaggaaaaggcactcagggatcttagagccaaggctcaacagaaaggagcatttggaggttctggactcaagaaaagtgggaagaaatgaggagcgtttccaagtcaaatgtaccctttaaattcttgtgctatgattacaaaatgcacagatgatgtctttggttaggctatgattgctcgagtttatgataagttgctaaaccttccatgaatgtgtgtaaactcttaaataaacttgattctgaacttgactttcagggcagaaaacagatgggttaaagtaatttgaagcattggttttacttttctacaaaaaaagtggatttagaaattaggaaataacgacaagtagttaggatactcatccgacacctacagtaataattataagtatggtcaggtgggga

SEQ ID NO: 3551 - DNA, 453 bp, Scabiosa columbaria
aaccccttttcaatttagggcacactgctattcaacaatcaactagttcttggcgataaccctaaaccaaaccctagcgatcaatcatgtcatccaagcaaggtggaaaagcaaagcctttgaagcagccaaaggctgataagaaggaatacgacgaggatgatttggctaaactggccaagaagaaggaagaggaaaaggcgcttaaggagctgaggaacaaagctcaacagaagggctcattcggtggtgctggtctcaagaaaagtgggaagaaataattatccatcatctttgatatgatatataactctgcttgtgcttatttaagtactgagcctattcgagttttcgatgtataactaaataaagatttgtgatttatttcgacctttgatttcgggcatggaagtgtggaactgtgtttcttgtttattcttacttttgatgtca

SEQ ID NO: 3552 - DNA, 505 bp, Picea glauca
agcgaccatgtcgagcaagcaaggtggaaaggctaagcccctcaagcagccaaagaaggataaggccgagtatgacgaggctgatctagctcacattcagaagaagaaggacgaggagaaggctttgaaggagttaaaagccaaggcatcacagaagggtagttttggtggaacagggttgaagaaaagtggcaaaagtagtttgccattgactgctttctctacatcatgccactaaaattatacttatggggactggttaggagagtgtttactcaattacaaagtatgtgattacggttaagaatggaccttctgagccacacacttgctgttttaatgtgaatggatatttaatgttgaaattacaatgtgatataggttttaattttttttaagagataatcgggatgaattgttaaagacttactactgttgtgatgtcagatttgttagtttaagattgcctatatctgaaacatgtgggctatgattcgaatttaga

SEQ ID NO: 3553 - DNA, 378 bp, Thalictrum flavum
tgtgagtgtttctggggtttggccacaaaacaatctctacgcttcttctctgtttctctctcctacaatcttcacatcaacaacaacaacaatcatgtcgtcaaagcaaggtggaaaggccaaacctttgaagcaacccaagtctgaaaagaaagaatacgacgagaatgatctcgcgaatctgcagaaaaagaaagaagaggaaaaggcactcaaggagctgagagctaaggcttcacaaaagggttcctttggcgggactggactgaagaaaagtgggaagaaatgagtgttttctatttggtacaccaccaattatgttaagcttgtgtgtaaccctttttaagtgagatcattttgcacttttgatcatataca

SEQ ID NO: 3554 - DNA, 449 bp, Musa acuminata
ggccggaaagccatctcgcctgttcctctcaccgatcgtcgccttcccgccgcaccagacgatcatgtcgtccaaacaaggtgggaagttgaagcccctgaagcagccaaaggctgacaagaaggagtacgacgagatggacaaagcaaatattcagaagaagaaagatgaggaaaaggcgctaaaggaattaagggctaaggcatctcagaagggatcatttggaggcactggtcttaagaagagcggaaaaaaataacgtctctgttgcatatgtttaaaaaaaaaggaactaccgctctgaatgtagtaagcatattctgagtgtgctttgtcttatcaggttgatgaaagctgtctttaagtgaatgctttgaacgctataatgtactaaacaagtattttcatggatgtgcttcgatttatcgggttgataaaagtcgttttgg

SEQ ID NO: 3555 - DNA, 476 bp, Musa acuminata
ggtatcggacatcgaaaactggggttcgctttcccttcctgtccgaagcagccatgtcgtcgaagcaaggtggaaagttgaagcccctgaagcaacctaaatccgaaaagaaggagtacgatgaggcggatttagcaaacctccagaagaaaaaagatgaggagaaggcactgaaggagctcagggctaaggcatcccaaaagggatcatttggggggacaggtctcaagaagagtgggaagaaataatgtttttcctactctactactaatataatgtttgtctaccttttcttggattctgattcctatgtggtgataagtggtaacttcacatgctctatcagattccgaagcgagtcatgatatgacattgtactatttgagtctaccaactagaccttgtcctatgcatcattttaaaatatatattccccatccatgaagatggtgctgccaaaaaaaaaaaaaaaaaaa

SEQ ID NO: 3556 - DNA, 541 bp, Gossypium hirsutum
actttctctatttattcgggcatcttagttgattcccaaatgctcaataattgtgtttttagggttagggctctttattttctctgttcatcaggttctttttatctcttcgaattttcattacagaccctgatcctaaactctcaattatgtcttccaagcaaggtggcaaagcaaagcctttgaagcaacccaaagctgagaagaaagaatacgacgagcatgatttggctaacattcagaaaaagaaagaagaagagaaggcccttagagagctgagagcaaaggcatcacaaaagggatcatttggtggttctggtcttaagaagagtggcaagaaatgagtttcttaaaaacccgagctaaaccgaacttatcgagtcctgtcttgggattaaaacatctattatgctgatgtctcttgtttctattgtgatagttgggatgatttgatgctctagtttcattctgaatttgctataaaaaacattgtgtgtaatttcgtgacgtataacttaataaattcaagttctacgtttgt

SEQ ID NO: 3557 - DNA, 450 bp, Hevea brasiliensis
gactctcttcgtctttctctcaattcttctttcgtttcttcaaatcagaccctaatcctaagtaccagccatgtcttccaagcaaggtggaaaagcaaagcctttgaagcagcccaaggctgaaaagaaggattacgatgagactgatacggcaaacattcagaagaaaaaggaagaggaaaaggcacttaaggagcttagggccaaggcagcacagaaaggaactttcggaggttctgggctcaagaagagtggaaagaaatgagggttttcaaacccatatgagaatagaatatattgattcatggcgaatgattacggattgtattatgacatcttttctttagtgttggcttgtgacatcctttgcttaacatcacatgatggtgtactgtcatgctaaatgcatcttaaccttgagtcaatgtcattatgtgaaactcgatgaat

SEQ ID NO: 3558 - DNA, 722 bp, Mesembryanthemum crystallinum
gcctcgtgccgaattcggcacgaggttcttaagcccatcgtcagccacccactatatataaagactctcagccccaattgaaaatctcgtgttgagtcaataatttgtgaaagaggggttaggtttctcttcgttttttgctactactttacccaaatccgatcaaaccctaaccctagacgacaccaacgatgtcttccaagcaaggtggaaaggccaagcctttgaaggcacccaagaaggatgccaaggactacgatgaggttgacatggcaaatatgcaaaagaagaaggaagaggaaaaggcacttagagaactcaaagccaaggcacaacaaaagggagcatttggaggctcaggattgaagaagagtggaaagaaatgagagcattctctggtcacaattcatgatgggaccatgcaactgtggtgtggattgtgatgtcttatattcggatgccttctttagtaatctatgttaatgtgatgtttattcgattgttgtgttgctactaggtgtttcttgtaaaaccaaataagctttaaatcaagaacaacagttttatttggatatacgctacattagctactctactttttcaagctgtcctcagccaattgatgccccactcttcatagttctattattatgctggatctatgtcggtgatgttggaatgtcaccattgattgcttactactactattatatctttcaact

SEQ ID NO: 3559 - DNA, 511 bp, Jatropha curcas
cgcagagtacgcgggggcaccaaatagctgcaataatagcgtgaattagggttaggcttctcttcgtctctttcaaatttcttttttattcttcaaatcagaccctaattctaagtaccagcaatgtcttccaagcaaggtggaaaggcgaagcctttgaagcaacccaagtctgacaagaaggaatatgatgagaatgatttggccaacattcagaaaaaaaaggaagaagaaaaggcacttagagagctaagagccaaggcatcccagaaaggagcatttggaggtactgggctcaagaagagcggaaagaaatgaggttcttgaaacccatatcagaatagaatatatgatttgatttgtgcttgtgtgattacacgtgttattatgttaccatggcacatgttttatttgagtattggtttgtgacatcctttggttaacatgatggtgtacttccatttttaatgctactggacctttgaacctttaagttaatgtcactgtgtga

SEQ ID NO: 3560 - DNA, 656 bp, Liriodendron tulipifera
catctcgtctcggagattgattgttctagggcttttgcagatcatctcgtccggtttccacctcccttctccgacccgactaccatgtcgagcaagcaaggtggaaaagcaaagcccctgaaacaacccaaggcagaaaagaaagactacgacgagaatgatctggcaaacattcagaagaagaaagatgaagaaaaggcgctgaaggagatgagggctaaggcatcccagaaaggagcgtttggaggtacagggctgaagaagagtgggaagaaatgagtcccagtccaactaaaataccttcaccttacacatacatgttttcaattgcattacaatctagtgtgtgagatatgaaaagacaatcctagccttttgaacctcttaagaaatcccgtgtgatgtatcgatatgaatctgattcctggataatgcttgttgctatttgctactagatttcctctaatttcgaattgcagcctgtgtgtgcatgttatccattttagcgtgctgtcatttgttgtgtgaatgcaccgagagagtctcttctcgtaattaccctctctaacatatgctactactatctgatcacccctctcttgatcttttacttttgggggtcatttggcagccctgatttgagagtatttgggtgt

SEQ ID NO: 3561 - DNA, 559 bp, Lotus japonicus
ggaaactgagtccagggtaaggtcgtatcgtgttgcgtgctattgctttctttgtcgtttctgtattcaggaccgaaccctagctctacatcgcaaccatgtcttccaagcaaggtggaaaagctaagcctttgaagaaacccaagtccgataagaaggattacgatgaggttgacatggctaacattcagaagaaaaaagaagaggagaaggctctaaaagagttgaaagccaaggcatcacagaagggaagctttggaggttctggcctcaagaaaagtggaaagaaataagggctctatatcatgactgtatacatctattattgagctctgtaattactatgagtactttgtctacttaattgctggttctagtagttaacctgagtcatgtcatgagattagtgcaataagttacatgtttgtagctttattgtgtgttgactttggggttctgataataacatctctttagtgttggcttgttgcttttgcatatacttgttcaactaatgcttgccttgcaaatttcaattatctaatttgattatgcttcg

SEQ ID NO: 3562 - DNA, 576 bp, Mimulus guttatus
aattaaagtgtagaaattcctcccctttaaatccgcgatttgtgtgaattgtgacattcttcttcatcgatttctaccttgcgctatttggtgattgcagctaaaccctaaccctagaatctaatccaaccatgtcaagcaaacaaggaggaaaagcaaagcctttgaagcaacccaaggccgccagtaaagaatacgacgaggttgacatggctaatattcaaaagaagaaggaagaagaaaaggcgctgaaggagctcaaggctaaagctcagcagaagggatcgtttggaggttcgggtttgaagaaaagtggcaaaaaatgagccctgctaaaagaaaacctattggctcaatgcaaatgtttttcggcattgtgttgtattttaacctctattatcgaatctttcgaacctattagcttgttcttatttgatggctgatgactgtcaaacttttttcgggtgcttttctatgcaaaatatgtattccattttaatggaccaatgatattttccttacctgaaatattttatcttgctgtgcgattgaaggttgagtttttcctgactttta

SEQ ID NO: 3563 - DNA, 524 bp, Orobanche aegyptiaca
ttgattgggttagggcatcgtcatttccccccttcgtacgaagcttaacttttgcgatctgagcgaatagccctagaattcaaccatgtctaccggcaagcaaggaggaaaagcgaagcccttgaagcaacctaaatccgataagaaagagtacgatgagtttgacaaggctaatatccagaagaagaaggacgaagaaaaggctcttaaggagctcaaggaaaaggctaagcagaaaggatccttcggaggctctggtctgaagaaaagtggcaaaaaatgagccaccaggaagaagcttactggatgaggctctgatcttgttatatcatgttatagccgtatttttcatttccgttgtgtacgatttaaacatgctacgatgtcgttattgatggtttatggtcgttgtgtgagtcggagctttttgatatattcgatgggttaaatattgggctttggcatgtcgtgcaacagaacattgcaacggaacattacaaaatcacctgaggaaattattctca

SEQ ID NO: 3564 - DNA, 631 bp, Ananas comosus
ccccttttcttctcgcccttttcctcgtctttgtgcgattagggtttgcttcgtctcttcgtcctcctcgtgcatccgcttcttcatcaactatgtcgtccaggcaaggtggaaagttgaagcccttgaagcaagctaaggctgataagaaggaatacgatgagacggatctagcaaacatccagaagaagaaagatgaggagaaggctttgaaggagctgagggccaaggcttcgcagaagggaagctttggaggtgcaggccttaagaagagtgggaagaaataagaaagacaagcgtactccctctctctctctctctctctctctttcgcgcactctctatctcttgtaatagtaaatcaatgacttagatctggggtttatcatcgctattgcatgttagctctatgattggaagacaactactggcatcgcaggtgtgatcattttctgtatctgccggttttcaggagtttggtacactccctatctattaagtttctggtatatcctgtggtctctttgtctcttccatttaagcgtgtttgtttcaaagcgaaataattgcctcatgtagcgtcatctcgacatgagccgtactgatagttggtgattattactttcttgtg

SEQ ID NO: 3565 - DNA, 809 bp, Pinus taeda
gtaaagtttcgggatgatgcgctaagcaacaccgaaagacgccaaggtgaataacaggcaaagttcccgtcaagcaacgggtattcaatatacgtctcagcgaatccagggccaaatatatacagtgaatatacatccaatagggtatatataccagggcatactacgttgcagttttgtgtggcaagcaagggctcgagaaggaacgaaagagtcccacagtccattcccatatacgcagcggccatgtctagcaagcaaggtggaaaggctaagcctctcaaacagccaaagaaggataaggctgaatatgacgaggctgatctagctcacattcagaagaaaaaggatgaggagaaggctttgaaggagttgaaaactaaggcatcacagaagggtagttttggtggagcagggttgaagaaaagtggtaaaaagtaggctgcaatagagtgctttctctacatcaagccactaaaaacatacttatgggactggtagggagagtgtttgccactaaaagcgtacttatggggactggttaggagagtgtttactcaattacaaagtatgtgattactgttaagaatggaccctctggaccacacgcttactgctgttttaatgtgagtaaatatttaatgttgcaatcataatgttgatgggttttgaaaatttaagagatatttgtgatgaattgctaaaaacttattactgttgtgatgtcagaattgctattttaaagtttgcatatatctgaaacatgtgggctgtgagtcaaatttagacattagacatgtctgggtggc

SEQ ID NO: 3566 - DNA, 535 bp, Pinus taeda
atacagcattgcagtttggcgtggaagaggccgagaaagaaggaaaatagtctgtctcctttaacacagcgaccatgtctagcaaacaaggtggaaaggctaagcccctcaagcagccaaagaaggataaagctgagtatgacgaggctgatctagctcacattcagaagaaaaaggatgaggagaaggctttgaaggacttgaaggctaaggcagcacagaagggtagttttggtggaacagggttgaagaaaagtggtaaaaagtagtcagcaattgagtgtttactcaattacaaagtatgtcattaccattaagaatggaccttctgaactacacgctgctcttttgatgtgaatgaatatttaatgctgcaattataatgtgagattggaatttttttaagagacattgtggatgaattgctaaagaattactactgttgtgatctctgaattgttagttcaagattgcatgtaactgaaacatgtgggatgtgatatgaatttagacatttggatagaattaatttgtt

SEQ ID NO: 3567 - DNA, 730 bp, Pinus taeda
agtttcgcgtggaagaggccgagaaggaaggaggggaaaatatatacagtattcaatagggtctatatagcagggcatacaccattgcagtttcgcgtggaagaggccgagaaggaaggaaatagtctctcatagtctgtcccctttaacacagcgaccatgtctagcaagcaaggtggaaaggctaagcccctcaagcagccaaagaaggataaagctgagtatgacgaggctgacctagctcacattcagaagaaaaaggatgaggagaaggctttgaaggacttgaaagctaaggcagcacagaagggtagttttggtggaacagggttgaagaaaagtggtaaaaagtagtcagcaattgagtggttatcctatatcatgacacaaaaaacatacttatggagactggttaggagagtgtttactcaattacaaagtatgtcattaccattaagaatggaccttctgaactacacgctgttgttttgatgtgaatgaatatttaatgttgcgattataatgtgagataggtttggaaattttttaagatatattgtggataaattgctaaagatttactactgttgtgatctctgaattgttagttcaagattgcctatatctgaaacatgtgggatgtgatatgaatttagacatttggttagaattaatttgttgatgcttttgttaatatttaagtggatttaatttgttgatgcttttgttg

SEQ ID NO: 3568 - DNA, 471 bp, Prunus persica
aaggctgtgcgtattattgcagtagggttgtcctgggaattcctccttcctctcagattcgacccaagccttttgcctagatcgcagccatgtcttccaagcaaggtggaaaggcgaagcctttgaagcaacccaagtccgagaagaaagagtacgacgagtctgatttggccaacattcagaagaaaaaagatgaggaaaaggcactgaaggagcttagagccaaggcacaacagaagggatcctttggaggtgctgggctcaagaaaagtgggaagaaatgagagggttattagaaccccctagttggggtgcaatatatttttcttgggctgtaattataaacactattgtgttgaagtctttcaatttatgtgatggtctagtttctaatgtgctgctagacgcatgagtgactttcagtgtgtaacagtatgactatgtctaaataagttagttggagtttgccta

SEQ ID NO: 3569 - DNA, 648 bp, Pseudotsuga menziesii
taatacagtgaatatatatccaagagggtatataaatataggagggcatacaacattgcagtttggcgtggcaagtaagggttcgagaaagaaggaaagagcctctcacagtcttttcacatatatacagcggccatgtctagcaagcaaggtggaaaggctaagcccctcaagcagccaaagaaggataaagctgagtatgacgaggctgacctcgctcacattcagaagaaaaaggacgaggagaaggcattgaaggagttgaaatctaaggcagcacagaagggtagttttggtggaacagggttgaaaaaaagtggtaaaaagtagactgcaatatgtgctctatctacatttagaattcatgccactaaacacattcttatggggactggttaggagagtgtttactcaattacaaaggatgtgtgattatcgttaagaatataccttctgaacgacacacttactgctgttttcatatgaatgaataattaatgttctattataatgtgatacttatagggacttgttaggagagtgtttcctcaattacaaagtatgtggttaccgttcagaatggcttttctgaaccacacacttctgttttaatgtgaatgaatatttaaagttgcaattataatgtga

SEQ ID NO: 3570 - DNA, 380 bp, Salvia sclarea
ctactagaccttggctgtcactcagaggaaaagccaagcctttgaagcaacccaaggctgaaaagaaagaatacgacgagactgacatggctaatattcaaaagaagaaagaagaggagaaggctcttaaggagcttaaggcaaaggcccagcagaaaggggcatttggaggttctggtctcaagaaaagtgggaaaaaatgagtccacttggtgaagtagctaactcgttgcttgccatcgttgtcatgtttgtcaatttctatatatgctatttaaacatattagcttcttcctactaatggttcatggttattgagccctgaagagcttgtggatataacattgtatgttcagcagttgaatctataaaatggttta

SEQ ID NO: 3571 - DNA, 510 bp, Triticum aestivum
catttcccctcgcctttccccaccttccgtcctccccccgttgttgcgggtccagctagggttttttggccccggcgttccggcccaccgccgggcccgttcaaaaagtcgaagggaggaggaaaggccaagccgctcaagcaggccaaggtcgccgagaaggactacgacgaggatgacctggcatacctccagaagaagaaggatgagccaaaggccctgaaggagctgaaggccaaggcaggccagaagggtgcgctgggaggatctggtctcaaaaagagtgggaagaaatgagtttgcccacccattcgttatacccaggaaatgataatctatctatctacctatctgtgtcgcggttcactatctgtggttgtaacagactaccctcaattgtgttgagccttgtgcattgtcccagtatgtcgctgaaacctatggcatgtcagcagccttttttgcttatttatgatacagatggtccggaacttattaagacatgacttg

SEQ ID NO: 3572 - DNA, 531 bp, Rosa hybrid cultivar
catctcctccttcctcttcttcgtcttatctcagatcgccttcttcttcagctctcgtacatctcaacatatggcggtgacttgtcttccaccaatattattattggctgctgctgcaaatagggttgggtcttctttcttcttctagctctcgatttccaaccaaaccttccgccctagatcgtagccatgtcgccaagcaaggtggaaaggcaaagcctttgaagcaaaccaaggctgagaagaaggagtacgacgaggatgatttggccaagcttcagaagaagaaggatgaggaaaaggcactgaaggagcttagagccaaggcctcacagaaagggtcttttggaggtgctggcctcaagaagagtggaaagaaatgaggggttttcgaaacccaaagtttggatgtgatataatataatctgcgttgaagtctttcaatttatgggatggtctaattcctagctgaatgtgctcctaaacgcttcagtgtgtaacattaagactaaataaattgaattgcctttc

SEQ ID NO: 3573 - DNA, 414 bp, Picea glauca
agaaggaaggcaagagtctctcacagtctgtccccatatacacagcgaccatgtcgagcaagcaaggtggaaaggctaagccctcaagcagccaaagaaggataaggccgagtatgacgaggctgatctagctcacattcagaagaagaaggacgaggagaaggctttgaaggagttaaaagctaaggcatcacagaagggtagttttggtggaacagggttgaagaaaagtggcaaaaagtgtttgccattgactgctttctctacatcatgccactaaaattatacttatggggactggttaggagagtgtttactcaattacaaagtatgtgattacggttaagaatggaccttctgaatcacacacttgctgttttaatgtgaatggatatttaatgttgaaattacaat

SEQ ID NO: 3574 - DNA, 300 bp, Ceratodon purpureus
gggcgtggcaagtaagggttcgagaaggaaggcaagagtctctcacagtctgtccccatatacacagcgaccatgtcgagcaagcaaggtggaaaggctaagcccctcaagcagccaaagaaggataaggccgagtatgacgaggctgatctagctcacattcagaagaagaaggacgaggagaaggctttgaaggagttgaaagccaaggcagcacgagaagggtagttttggtggaacagggttgaagaaaagtggcaaaaagtagtttgccattgactgctttctctacatcatgcc

SEQ ID NO: 3575 - DNA, 554 bp, Sequoia sempervirens
gggaaaggaagggattccagacgattaccaaggtatttgcaacccgtgcgtacataaccggcaaccatgtctagcaagcaaggtggaaaggctaagcccatgaagcagccaaagcaagagaaaaaggagtatgatgagcatgacctcgcaaatattcaaaagaaaaagatgaggagaaggccttgaaagagttaaaagccaaggcacaacagaaaggttcttttggtggatcaggattgaagaaaagtggcaaaaaataggcactgcaaatgatggttatttgcagccagaatttactatagtgtttgcataggagagtgtttactaaaatatgcaacatggttaagaatgcctaaaattatagcccttccagactaagttaactttcatttatgtgtcgatgtggtgatatctgaataagtaattaaggacgggtagagacgaattgtttgagccatgatactaatagaaaaccgccccctacccttttctattagtatcatggctcaaacaattcgtctctccccgtccttaattacttatccagatatcac

SEQ ID NO: 3576 - DNA, 426 bp, Linum usitatissimum
agggtttgaaagctcaagaattttttttcccagttttcattttccagagaatcaaaccctaaccggaagtcttcaatttccataccagccatgttttttaagcaaggtgggaaggctaagcctttgaaacagcccaaattggacaagaaggagtacgacgatgttgacaaggccttccttcagaagaagaaggaagaggagaaggctttgaaggacctgaaagccaaggcacagaagggagcagtgggaggtgctggactcaagaagagcggcaagaagtgagctttgtgggatgccaacagatgtgcttaagcattcgaattgtgttttgttgaaaacttacattgtttatgacatcatttattagttgttgtggtgatgatggtttgtgacctcatttggctaaaagtaatccgacggtttaac

SEQ ID NO: 3577 - DNA, 426 bp, Linum usitatissimum
agggtttgaaagctcaagaattttttttcccagttttcatcttccagagaatcaaaccctaaccggaagttttcaatttccataccagccatgttttttaagcaaggtgggaaggctaagcctttgaaacagcccaaatcggacaagaaggagtacgacgatgttgacaaggccttccttcagaagaagaaggaagaggagaaggctttgaaggacctgaaagccaaggcacagaagggagcagtgggaggtgctggactcaagaagagcggcaagaagtgagctctgtgggatgccaacagatgtgcttaagcattcgaattgtgttctgttgaaaacttacattgtttatgacatcatttattagttgttgtggtgatgatggtctgtgacctcatttggctaaatgtaatccgacggtttaac

SEQ ID NO: 3578 - DNA, 580 bp, Castanea mollissima
ggtttgggaattccagtttgaaccctaaccctagatcgcagccagccatgtcgtccaagcaaggtggaaaagcaaagcctttgaagcaacccaaggctgagaagaaagactacgacgaggttgacatggccaatattcaaaagaagaaggaagaggaaaaggcactcaaggagcttagggcaaaggcacagaaaggtcccattggtggtgctgggctgaagaaaagtgggaagaaatgaggggttttatgccccaataggactgtgtgtacaagcattattatgatgattgcctttgattaaagtgattatctagcttcttgctaagtgtgtactaaactttgggagtcatctatgtaagactaaatcttcaatttgcatgttagtgatattttcttgttcctaaaatgaccccattgcattatgtcaggggatggttatgattctgatgcttagcttctgctactgctttttaatggtaaaatttgttgaggggctagtggatgattgtactatgatttgtattttgtccaataaataacttcgctactaatgatgaataagagcagcccaaagctttt

SEQ ID NO: 3579 - DNA, 451 bp, Cichorium intybus
gcacgagccctcgtgccgaattcggcacgaggctccgtcgcgcatctttacggatcagagcaaaccctaaccctagatccgatcatgtcgtccaagcaaggtggaaaagcgaagccattgaagcaaccaaaggctgaaaagaaagaatacgatgaggtcgataaggccacattcaaaagaagaaggatgaggaaaaggccttaaggagcttagagctaaagctcaaaagggagctttgggaggtactggtctcaagaagagtgggaagaaatgagcatgcagaagtgaaggaattatgtcttttatatgacaaatgatatgctaagttctgtatcagtcttctgtgactgttcttgtgtagaattcaagatttggtattgttgttttctacttgtacttgtttatggaggtattgttgatttcatggaattctattgaaacccatttgccc

SEQ ID NO: 3580 - DNA, 559 bp, Cleome gynandra
gggctgggggctttagaggtgtttcttgtatctatcgtgtttgagtttcaggtctaaccctaaccctacaattccgccatgtcgtccaagcaaggaggaaaattgaagcccttgaagcagcccaagggtagcaagaaagagtacgatgaacatgatctagagaacattcagaagaagaaggaagaagagaaggcacttaaagagctcagggccaaggcgcaaaagggtgcaattggaggagctgggcttaagaagagtgggaagaaatgagagtaatcaacgtcttcttcatctttcctaggaaaactgcttgaaaggttcctccagttacactatctatctttcactccttgttggagatgttatatctttcaaccttgatttgtgattgtgcgtgcaacacaacctttggttaaccatcactgtcatgttgttgaagtggaaataaacctagattttgtcttgtttggcattaagtctttggttcggtgtgtctctgtggggatgatccctggggtcatttgttcatgttcttttatttccgtaaccaaagattaca

SEQ ID NO: 3581 - DNA, 371 bp, Sarracenia psittacina
  misc_feature (42)..(42): n is a, c, g, or t
cgataagcgtatattacgctatcactcatccccaaatcatancatttcttgcaaactaccaaaacctaattaccgaatttccaatcatgtcttccaagcaaggagaaagcaaagccgttgaaacaaccaaaggccgagaagaaagaatacgatgaggtagacaaggccaacattcaaaagaagaaggacgaggagaaggctctgaaggaacttagagcaaaagctcaaaagggagcacttggaggtactggtctgaagaaaagtggaaagaaatgaggcttgattgattgcagaactcaagtatgttatgttgtgatttgtgaaatgttgctttgaatatgttgcttatatagctgaatatgttggctaga

SEQ ID NO: 3582 - DNA, 524 bp, Orobanche aegyptiaca
gtgattgggttagggcatcgtcatttccccccctcgtacgaagcttaacttttgcgatctgagcgaataaccctagaattcaaccatgtctaccggcaagcaaggaggaaaagcgaagcccttgaagcaacctaaatccgataagaaagagtacgatgagtttgacaaggctaatatccagaagaagaaggacgaagaaaaggctcttaaggagctcaaggcaaaggctcagcagaaaggatcattcggaggctctggtctgaaaaaaagtggcaaaaaatgagccaccatgaagaagcttactggatgaggctctgattttgttatatcatgttatagccgtatttttcatttccgttctgtacgatttaaacatgctatgatgtcgttattgatagtttatggtcgttatgtgagtcggagctttttgatatattcgatgggttaaatattgggctttcgcatttagtgcaatgaaacgttgcaacggaacattacaaaatcacctgaggaaattattctca

SEQ ID NO: 3583 - DNA, 827 bp, Physcomitrella patens
accgatacgcgtttcaatcgatggctggaattctgtttttccatccaagtggagaagttccttcgcacacatatacctcacatctgctggccagtggtttgttgcggctctaactctttctgttcgcgtttgttgttgtggttgtgcttctacgtttcagtgttcatcagccatgtcgggaagacaaggtggaaagctgaagcccttgaaagctcctaagggcaaggagaaagagtatgatgagacggaccttgcaaacctccagaagaaaaaagacgaagagaaggccttgaaggaattgaaggccaaggctgcggggaagggtgcttttggtggagctggtttgaaaaagagtggtgggaagaagtagatgcgtgaacatggtgccttgtagttcattaagtgatgctaaactgcagctgaatgaactgcaagggtgaaggacatcctcagtgcactaatgagcttctgagtgtctggaagctgcagagtcatggcaggaaattgcttagggttatatgatcatatgcgcatatttgttctgaatttgcaatagaccatagttcttaacagaaaaaaaaaaaaagaagatagcttccatgaatcgttgcagcgagttccgtgtgattttgttcctcctaacgtgaggtgatcaattgtggactgcatgttgtaattcatgtgcctaaactgcacctcgttgccaaaggttacagtgtgtaccttgcacatggatgtggtgtttatggacacagtgagttgcagatgaaccctgtctggacgtcagattacgtaatgaagcgtcttacttaggagatgtttttttc

SEQ ID NO: 3584 - DNA, 1155 bp, Saccharum officinarum
ctggtacgtagcgggtcccagttcccaggtcgacccacccgtccggaaaccctcgcctcccccttccttcccggccgccgcctcttcccctcctccccgccgccggaaggagaaaaaaaatgggcgccgatggggaagaagcgtcgcggataatcgtaccgatggcggtggaggggaccccggggcagctggcgttcgtggaggagtcgaagctgaagaagcgcaaggagaacgtggactgggccgtcaggaaccgggagcgcaaggcggccaagcgccagcgcatccgcgacgagcacaaggtcatcgtcaagcggcccgaggatttcgtcaccgcgttccgcaacaaggagcgcgacttcctgcggatgaggacccgcctcaaggtccgcaagcagccgcccgccgaggcgctcagctccaagctcatcttcgcgattcgcatccctggctccgtggacttgcatccgcacattaggaaggttttgaggaagctacggctgacaaaggtcctcactggggtgttcctcaaggccaccgagttgacgctgaagaggctgcttgtggttgaaccctttgtcacctacggatttccaaacttgaagaatgtgaaagagcttatttacaagaagggccgtgggttcttggacaaggagcctttccctcttaccagcaacgatctaattgagaaggctcttggagaacacggcatcatatgcttggaagatgttgtgcatgagatcgccactgttgggccgcactttcgagaagcatcgaagttcctcatgcccttcaagctcaagtgtccagagaggaggctgcagatgaagaggaaaccctacaaggatggtggtgactcaggcaaccgtggcgacaaaatcaacgaactaattgagaagttgaactaaagcagaccttgcctcccgttgtcattttgccttggagtgatggatctgttaccttatcagttttgtaatagcatagctggatgtacctttaactttgaaaccttacctgcttttgtgcgattagatcatgaaatagcagaagcttccttggtcatcccctgccttctgctcgacatgtgcctttggttgatgcgacaatatcaactctgttatgctgtagtgtgctattgattgttgaattgagtat

SEQ ID NO: 3585 - DNA, 1163 bp, Sorghum bicolor
aaccctcgcctccctcttccttcccggccgccgcctccctcctcgtcctcttcctcgccgccgccgccgccggcggaacccgcccgccggagggagaagggatgggtgccaatggggatgaagcgtcgcggataatcgtaccgatggcggtggaggggaccccggagcagctggcgttcgtccaggagtcgaagctgcagaagcgcaaggagaacgtggactgggccgtcaggaaccgggagcgcaaggcggccaagcgccagcgcatccgcgacgagcacaaggtcgtcgtcaagcggcccgaggatttcgtcaccgcgttccgcaacaaggagcgcgacttcctgcggatgaggacccgcctcaaggtccgcaagcagccgcccgtcgaggcgctcagctccaagctcgtctttgcgattcgcatccctggctccgtggacttgcatccgaacatcaggaaggttttgaggaagctacgactgacgagggtcctcactggggtgttcctcaaggccaccgcgttgacgctgaagaggcttctcattgttgaaccctttgtcacctacgggtttccaaacttgaagaatgtgaaagagcttatttacaagaagggtcgtgggttcttggacaaggagcctttccctcttaccagcaacgatctaattgagaaggctcttggagatcacggcatcatatgcttggaagatgttgtgcatgagatcgccactgttgggccacactttcgagatgcatcgaggttcctcatgccctttatgctcaagtgtccagagaggaggcttcagatgaagaggaaaccctacaaggatggtggtgactctggcaaccgtggcgacaaaatcaacgaactaattgagaagttgaactaaagtagatcttgactccggttgtcactttgtgttggagtgatggatctgttaccttatcagttttgtaatagcatagctggatgtaccttttaactttgaaactttacctgcatttgtgcgatcagatcatgaaatagcagaagcttctttggtcatcccctgccttctgctcgacatgtgccttctggttggtgcgacaatatatcaactctgttatgctgtagtgtactattgattgttaaattgagtatatatcctgatccctttgctgtt

SEQ ID NO: 3586 - DNA, 1247 bp, Sorghum bicolor
caaaaaatcctcacgattcagaaaccctcgcctccctcttccttcccggccgccgcctccctcctcgtcctcttcctcgccgccgccgccgccggcggaacccgcccgccggagggagaagggatgggtgccaatggggatgaagcgtcgcggataatcgtaccgatggcggtggaggggaccccggagcagctggcgttcgtccaggagtcgaagctgcagaagcgcaaggagaacgtggactgggccgtcaggaaccgggagcgcaaggcggccaagcgccagcgcatccgcgacgagcacaaggtcgtcgtcaagcggcccgaggatttcgtcaccgcgttccgcaacaaggagcgcgacttcctgcggatgaggacccgcctcaaggtccgcaagcagccgcccgtcgaggcgctcagctccaagctcgtctttgcgattcgcatccctggctccgtggacttgcatccgaacatcaggaaggttttgaggaagctacgactgacgagggtcctcactggggtgttcctcaaggccaccgcgttgacgctgaagaggcttctcattgttgaaccctttgtcacctacgggtttccaaacttgaagaatgtgaaagagcttatttacaagaagggtcgtgggttcttggacaaggagcctttccctcttaccagcaacgatctaattgagaaggctcttggagatcacggcatcatatgcttggaagatgttgtgcatgagatcgccactgttgggccacactttcgagatgcatcgaggttcctcatgccctttatgctcaagtgtccagagaggaggcttcagatgaagaggaaaccctacaaggatggtggtgactctggcaaccgtggcgacaaaatcaacgaactaattgagaagttgaactaaagtagatcttgactccggttgtcactttgtgttggagtgatggatctgttaccttatcagttttgtaatagcatagctggatgtaccttttaactttgaaactttacctgcatttgtgcgatcagatcatgaaatagcagaagcttctttggtcatcccctgccttctgctcgacatgtgccttctggttggtgcgacaatatatcaactctgttatgctgtagtgtactattgattgttaaattgagtatatatcctgatccctttgctgttcacttgctgttaaaaagacaataatggttcatagtctgcatcagaggctggttcgtaggctg

SEQ ID NO: 3587 - DNA, 1146 bp, Zea mays
ctcgcgattttgaaaccctcgcctccctcttcctttccggccgccgcctgccgccggaaggagaaaaaatgggtgccggtggggaggaagcgccgcggataatcgtgcctatggcggtggagggtaccccgaatcagctggcgtttgtagaggagtcgaagctgcagaagcgcaaggagaacgtggactgggccgtgaggaaccgggagcgcagggcggccaagcgccagcgcatccgcgacgagcacaaggtcgccgtcaggcggcccgaggagttcgtcaccgcgttccgcaacaaggagcgcgacttcctgcggatgaggacccgcatcaaggtccgcagccagccgcccgtcgaggcgctcggctccaggctcgtcttcgcgattcgcatccctggctccgtggacttgcacccgcacatcaggaaggttttgaggaaactacgactgacgaaggtcctcactggggtgttcctcagggccaccgagttgacgctgaagaggctgcttgtggtcgaaccctttgtcacatacgggtttccgaacttaaagagtgtgaaagagcttatctacaagaagggccgcgggttctttgacatggaacctttccctcttaccagcaacgatctaattgagaaggctcttggagatcatggcatcatatgcttggaagaccttgtgtacgagatcgccactgtaggcccgcacttccgagaagcatcgaggttcctcatgcccttccagctcaagtgtccggagaggaggctgcagatgaagaggaaaccgtacagggatggtggcgactcaggcaaccggggcgacaaagtcaacgaactaattgaaaaattgaattaaagcagagttgttcgcttcggactggtacggattaaaaccaaacgaacaggcctgtctctctctagttgtgattttgtggtggagtgatggatctgttactttgtcagttttgtaatagtatagctggatgtaatctagaggtgctgtttggtttacgaaatataatggtaacgataatgattcacactcgaatgatgttggtaataagtttgaatagttagtattaacttttggtgtaatatctaattactgttgaacctaaataaatatggtttaacgttaccagtta

SEQ ID NO: 3588 - DNA, 1160 bp, Setaria italica
ccccaaaccctcgccgcctccctcctcctccctctcctctgacctcgccgccgccgtctccgacctacgccgccggtcgagcctatccgaccggagagaaggatggctagcggcggggatgaagcctcgcgaacagtaccgccgctggcgctggggggtaccacggaggagctggcgttcgtgaaggagacggtgctgaagaagcggaaggagaacgccgactgggccgtgaggaaccgggagcggaaggcggcgaagcgccagcgcatccgcgcggagaacaaggtcgtcgtcaagcggcccgaggagttcgtcacggcgttccggaacaaggagcgcgacttcctgcggatgaggacccgcctcaaggtccgcaagcagccgtccgtcgaggcgctcagctccaagctcatcttcgcgattcgcatccctggctctgtggacttgcatcctcacatcagaaaaaaattgaggaagctacggctgacgaaggtcctcaccggcgtgttcctgaaggccaccgagctgacgctgaagatgctccttgaggtggaaccgtttgtcacctacgggtttccaaacttgaagaatgtgaaagagcttatttacaagaagggccgtgggttcgtggataaggaacctttccctcttaccagcaacgatctaattgagaaggctcttggagataatggcattatatgcttggaagacctcgtgcacgaaatcgccactgtcggaccgcactttcgagacgcaacgaagttcctcatgcccttcaagctcaagtgtccggagaggaggctgcagatgaagaagaagccctacaaggatggtggtgactcgggcgaccgaggcgacaaaatcaacgaactaattgagaagttgaactaaaagcatagcttgtctccagttgtcatttgcgtacgagtgatggatctgttaccttatcagttttgtaatagcatagctggatgtaccttaaaccttgaagtgttacctgaatttgtgcgatcagatcgagaaatagcagaagctgctttcatcaaccactgtcttctgcttgatgccttgatgcgtcagtatatcgcactgagaaagctatcatatttcctatgtttgtgctcctgtttgttgaattgagaatcccatatccctctgct

SEQ ID NO: 3589 - DNA, 1157 bp, Setaria italica
caaaccctcgccgcctccctcctcctccctctcctcggacctcgccgccgccgtctccgacctacgccgccggtcgagcctatccgaccggagagaaggatggctagcggtggggatgaagcctcgcgaacagtaccgccgctggcgctggggggtaccacggaggagctggcgttcgtgaaggagacggtgctgaagaagcggaaggagaacgccgactgggccgtgaggaaccgggagcggaaggcggcgaagcgccagcgcatccgcgcggagaacaaggtcgtcgtcaagcggcccgaggagttcgtcacggcgttccggaacaaggagcgcgacttcctgcggatgaggacccgcctcaaggtccgcaagcagccgtccgtcgaggcgctcagctccaagctcatcttcgcgattcgcatccctggctctgtggacttgcatcctcacatcaggaaaaaattgaggaagctacggctgacgaaggtcctcaccggcgtgttcctgaaggccaccgagttgacgctgaagatgctccttgaggtggaaccgtttgtcacctacgggtttccaaacttgaagaatgtgaaagagcttatttacaagaagggccgtgggttcgtggataaggaacctttccctcttaccagcaacgatctaattgagaaggctcttggagataatggcattatatgcttggaagacctcgtgcacgaaatcgccactgtcggaccgcactttcgagacgcaacgaagttcctcatgcccttcaagctcaagtgtccggagaggaggctgcagatgaagaagaagccctacaaggatggtggtgactcgggcgaccgaggcgacaaaatcaacgaactaattgagaagttgaactaaaagcatagcttgtctccagttgtcatttgcgtacgagtgatggatctgttaccttatcagttttgtaatagcatagctggatgtaccttaaaccttgaagtgttacctgaatttgtgcgatcagatcgagaaatagcagaagctgctttcatcaaccactgtcttctgcttgatgccttgatgcgtcagtatatcgcactgagaaagttatcatatttcctatgtttgtgctcctgtttgttgaattgagaatcccatatccctctgcg

SEQ ID NO: 3590 - DNA, 936 bp, Pennisetum glaucum
ggggggcaccagggaggagctggcgttcgtgaaggagacggtgctgaagaagcgcaaggagaacgccgactgggcgttgaggaaccgagagcggaaggcggcgaagcgccagcgcatccgcgcggagaacaaggtcatcgtcaagcggcccgaggatttcgtcgcggcgttccggaacaaggagcgcgacttcctgcggatgaggacccgcctcaaggtccgcaagcagccgcccgtcgaggccttcagctccaagctcatcttcgcgattcgcatccctggctctgtggacttgcatcctcatatgagaacaaaattgaggaagctgcggcttacgaaggtcctcaccggcgtgttcctgaaggccaccgagttgacgctgaagatgctccttgaggtggaaccgtttgtcacctacgggtttccaaacttgaagaatgtgaaagaccttatttacaagaagggccgagggttcttggacaaggagcctttccctcttaccagcaacgatctaattgagaaggctcttggagatcatggcatcatatgcttggaagacctcgttcatgaaatcgccactgtcggaccgcactttcgagatgcatcaaggttcctcatgcccttcaagctcaagtgtccagagaggaggctgcagatgaagaagaagccctacaaggatggtggtgactcaggcgaccgaggagacaaaatcaacgaactaattgagaagttgaactaaaagcatagcttgcctcccgttgtcatttgtgtacgagtgatggatctgttaccttgtcagttttgtaatagcatagatggatgtaccttaaactttgaagtgttgcctgaatttgtgatatcagatcgagaaatagcagaagctgctttcattaaccactgtctgttgcttgatgccttgatgggtcagaatatcac

SEQ ID NO: 3591 - DNA, 1087 bp, Sorghum bicolor
caacaggcccatctgcccgacgccgcgtgcccccgactgctctcagcgacgctctccgtccgtttgctcagcgcctccactcgctccccgtcgcccgccacgaagccatccgcagtccgcccccgggacgcgagcgccgccagggagccgaaagtacgcttcggttccgccggcacgggaggggattcgagctgggtcttgggtagcgcctctcacgatgccgccagcccccaagtccggcgacgccctcttcgccagcgtggatcgcgtcaatgccgagctgttcacgctcacgtacggcgccatcgtgcggcagctgctcacggatctggaggaggtcgaggaggtcaacaagcagctcgatcagatgggttacaacattggaactcgattggttgatgagttcttagcaaagtcaaatgtatcaaggtgtgttgacttcaaggagactgccgatgttattgcaaagcttggcttcaaaatgttcttgggtgtgactgccactgtgaccaattgggatgcggagggtacaagttgcagccttgtcctggaagacaaccctcttgttgattttgttgagctccctgacacttgccaaggccttcagtattgcaatttgttaagtggagttattaggggggcattagaaatggtgtcaatgaagacagaggtgacatgggtccgtgacatgcttcgtggggatgatgcctatgagatgcgggtgaaacttatcaagcaagtcccggaggaatacccctacaaggatgatgactagttctatttcagtggaagatttcggcacaggacgaggcctgtttgcttgtttggatttttcacatcattgtcgtcgacggattctagttctgctataacctgatgtcatacgaggaagctgtggattatattttacacttaccgtgtgtattgcttatgtattgtagaaatcatacatgatcttccatgagttgcgctgaggctttgaattagtctgcagaattcagagcattagcaatgcaaattgtgttacctagaaataaagtattttcaatctctttagctgtcagatcttctcgtaatagtttacgtt

SEQ ID NO: 3592 - DNA, 1159 bp, Sorghum bicolor
ccaccacctcgattttcgggcaggcacagcccttccatgcccaatgcgaacacacccaatccgctaaaggcccaacaggcccatctgcccgacgccgcgtgcccccgactgctctcagcgacgctctccgtccgtttgctcagcgcctccactcgctccccgtcgcccgccacgaagccatccgcagtccgcccccgggacgcgagcgccgccagggagccgaaagtacgcttcggttccgccggcacgggaggggattcgagctgggtcttgggtagcgcctctcacgatgccgccagcccccaagtccggcgacgccctcttcgccagcgtggatcgcgtcaatgccgagctgttcacgctcacgtacggcgccatcgtgcggcagctgctcacggatctggaggaggtcgaggaggtcaacaagcagctcgatcagatgggttacaacattggaactcgattggttgatgagttcttagcaaagtcaaatgtatcaaggtgtgttgacttcaaggagactgccgatgttattgcaaagcttggcttcaaaatgttcttgggtgtgactgccactgtgaccaattgggatgcggagggtacaagttgcagccttgtcctggaagacaaccctcttgttgattttgttgagctccctgacacttgccaaggccttcagtattgcaatttgttaagtggagttattaggggggcattagaaatggtgtcaatgaagacagaggtgacatgggtccgtgacatgcttcgtggggatgatgcctatgagatgcgggtgaaacttatcaagcaagtcccggaggaatacccctacaaggatgatgactagttctatttcagtggaagatttcggcacaggacgaggcctgtttgcttgtttggatttttcacatcattgtcgtcgacggattctagttctgctataacctgatgtcatacgaggaagctgtggattatattttacacttaccgtgtgtattgcttatgtattgtagaaatcatacatgatcttccatgagttgcgctgaggctttgaattagtctgcagaattcagagcattagcaatgcaaattgtgttacctagaaataaagtattttcaatctctttagctgtcagatcttctcgtaatagtttacgtt

SEQ ID NO: 3593 - DNA, 1058 bp, Saccharum officinarum
ctctcctccgtccgtttgctcagcgcctccactcgctacccgtcgcccgccacaagccatccgcagtccgcccccgtgacgcgagcgccgccagggagccgaaagtacgcttcggttccgccggcgcgcgaggggattcgagctgggtgttgggtagcctctcacgatgccgccagcccccaagtccggcgacgccctcttcgccagcgtggatcgcgtcaatgccgagctgttcacgctcacgtacggcgccatcgtgcggcagctgctcacggatctggaggaggtcgaggaggtcaacaagcagctcgatcagatgggttacaacattggaactcgattggttgatgagttcttagcaaagtcaaatgtatcaaggtgtgttgacttcaaggagactgccgatgttatcgcaaagcttggcttcaaaatgttcttgggtgtgactgcaactgtgaccaattgggatgctgagggtacaagttgcagccttgtcctggaagacaacccgcttgttgattttgtcgagctccctgacacttgccaaggccttcagtattgcaatcttttaagtggagttattaggggggcattggaaatggtgtctatgaagacggaggtgacatgggtacgtgacatgcttcgtggggacgatgcctatgagatgcgggtgaaacttatcaagcaagtcccggaggaatacccctacaaggatgatgactagttctatttcagtggaagattttgggacaggacgcctgtttgcttgtttggattttcacatcgttgtcgtcaacggattctagttctgctataacctgatgtcatacgaggaagctgtggattatattttacacttgccttgtgtattgcttatgtattgtagaaatcatacatgatcttccatgagttgcggctttgaattagtctgctgaattcagagcattcgctatgcaaattgtgttatctagaattaagtattttaaatctccttaaaaaaaaaaaaagggcggccgtttaaagattcaagcttactacccgtgcttgccaactataac

SEQ ID NO: 3594 - DNA, 1148 bp, Zea mays
ctgtgatttactaaaaataaatataaaacaaaatatgaaatcacttaggggacttgtcgattttaggaaacgagaaagaaattatttctggttttgcaatgttgagaaagataaaatcaaccttttctcttccaagatcctgtattttacaaccaagttacgaaatagcacaatgcgaacacacccaatactcttaaggcccaacaggcccatgtagccgacgcactggcactgtgcccccgactgctctcactcagtctcagagacgttctcctccgtccgtccgcccccgtgacgcgagcgtcgccagggagccgaaagtaagcctcagttccgccggcgtgcgaggggttcgatctgggttagcctctcacgatgccgccagcccccaagtccggcgacgccctcttcgccagcgtggatcgcgtcaatgcggagctgttcacgctcacgtacggcgccatagtgcggcagctgctcacggatctggaggaggtcgaggaggtcaacaagcagctcgatcaaatgggttacaacattggaacacgattggtcgatgagttcttagcaaagtcaaatgtatcaaggtgtgttgacttcaaggagactgccgatgttattgcgaagcttggcttcaaaatgttcttgggtgtgactgcaactgtgaccaattgggatgttgagggtacaagttgcagcattgtcctcgaagacaaccctcttgttgattttgttgagctccctgacacttgccaaggccttcagtattgcaatttgttaagcggagttattaggggggcattggaaatggtgtctatgaagacggaggtgacatgggtacgtgacatgcttcgcggggatgatgcctatgagatgcgggtgaaacttatcaagcaagtcccggaggaatacccctacaaggatgacgactagttctatctcattggaagatacaggacgcctgtttgcttgtttggattttttcacattgttgtcgttgacggattctagttctgctataacctgatgccatacgaggaaggtgtggattatattttatactcgccgtgtgtattgcttatgtattgtagttgtagaaatcatacatgatcttccatgagttgaggctttgaattatagtcagctga

SEQ ID NO: 3595 - DNA, 1069 bp, Setaria italica
gctgctccgattcttctgcccgagcgcttcgtcgtctcagcctcgtcgcctgctagcggcctagccggcgccatcacacccgcaggccccgccggaagcgaggagctgcggaagcaggggagggccaacgcggcgactccgctcgtcgactccgccaccgtcggcggcctctcgcgatgccgcctctcacggctcccaagtccggcgacgccctcttcgccagcgtcgatcgcgtcaatgcggagttgttcaccctcacgtatggcgccatcgtgcggcagctgctcacggatctggaggaggtcgaggaggtcaacaagcagctagatcagatgggttacaacattggaacacgattggtcgatgagttcttagccaagtcaaatgtatcaaggtgtgttgacttcaaggagactgctgatgttatcgcaaagcttggattcaagatgttcttgggtgtgactgcaactgtaaccaactgggatgctgagggtacaagctgtagctttgtattggaggacaatcctcttgttgattttgttgagctccctgacacttgccaaggccttcagtattgcaatgtgttaagtggagtaatcaggggagcattggaaatggtgtctatgaagacagaggtgacatgggtccgtgacatgctccgtggggatgacgcctacgagatgcgggtaaagcttatcaagcaagtccctgaggaatacccctacaaggacgatgactagtttgattttcaggccaggttcatgcagcagggcgccagtttgcttgtctggatgctcattttgctgtactttgttgtggatccagttctggtattacatgatgtcacatgagtaaaccgttgattgcatttgcacttgccgtgtgtattgtagaaatgctacatatcttccatgcctcggggctttgaattagtccggtgaattaagggcatttgtgatgctcgcgatagttcttgctgtgtttatccagacataaagctttttttcaggctggttaactagcagatcatctggaaagagttgacaacgtgcttctccatcagtttttc

SEQ ID NO: 3596 - DNA, 986 bp, Panicum virgatum
ccgagcacttcgtctccgcctcgtcgcctgcaagcggccgagccggttccaccacagccgcaggcccggccggaagcgaggagcttcggaagcagaggagcggcgactgcgctcgtcgtctccgccaccgtcggcggcctctcgcgatggcgcctctcacggcccccaagtccggtgacgccctcttcgccagcgtcgatcgcgtcaacgcggagctgttcacgctcacgtatggcgccatcgtgcggcagctgctcacggatctggaggaggtcgaggaggtcaacaagcagctagatcagatgggttacaacattggaacacggttggttgatgagttcttagcaaagtcaaacgtatcaaggtgtgttgacttcaaggagactgctgatgttatcgcaaagattggatttaagatgttcttgggtgtgactgcaactgtaaccaattgggatgctgagggtacaagctgcagctttatattggaggacaatcctcttgttgattttgttgagctccctgacacttgccaaggccttcagtattgcaatgtgttaagtggagtaatcaggggagcattggaaatggtgtccatgaagacagaggtgacatgggtccgtgacatgctccgtggggatgatgcctatgagatgcgtgtgaagcttatcaagcaagtcccagaggaatacccctacaaggatgatgactagttgagtttaggcgaagttcctgcagcagggcgcttgtttacttgtctggatgttaattttgctgtggatatagccctggtattactttatgtcacaagagtaaactgttgattgcatttacaattgccgtgtgtattgagtattgctgatgtattgtagaaatattgcatatctaccatgccttgcgggcatctgtgctgctccggatctttcctgctgtgctagccaaaaaataaagttttctttccagtctggttaactggcccattttgtgga

SEQ ID NO: 3597 - DNA, 2407 bp, Oryza sativa
acatgtttgaccgttcgtcttattcaaatttttttttgaaatatgtaaaactatatgtgtacatgaaagtatatttaacaatgaatcaaatgatatgaaaagaataaataaataattaaatattttaaataagacgaatgatcaaacatgtacttaaaaaattaacggtgtcaaacatattgaaacggagcgagtatctactattaatcacattgaattgaatgactctggtagtctggttgaagaggacatcatctgcgaaaggaacagtgttgtgaggtcgcaatcccgtctcggcccatctagtaagtaggctacaaggcccataggcggttctcgcctccggctttacactccgatctctctctctcacacacccgcctcaccctcaccgccaccgccaccgacgagctccggtcgccgccggcgagaggcgccgcgcgatcccgggagatgccgccgctcacggggcccaagtccggggacgccctcttcggcagcgtcgagcgcgtcaacgcggagctgttcacgctcacgtacggggccatcgtcaggcagctgctcacggatctggaggaggtcgaggaggtcaacaagcagcttgatcagatgggctacaacattggaactcggttggttgacgagttcttggccaaatcaaatgtatcaaggtgtgttgacttcaaggagactgccgatgtcatcgcaaagcttggattcaaaatgttcttgggtgtgactgcaactgtcaccaattgggatgctgagggtacaagctgcagctttgtattggaggacaatcctcttgtagactttgttgaacttcctgatacttgccaaggtcttcagtactgcaatgtgctaagtggagttattaggggtgcactggaaatggtgtccatgaagaccgaggttacatgggtccgtgatatgcttcgtggggatgatgcctacgagatgcgagtgaagcttaccaagcaagtcccagaggaatacccctacaaggatgatgactgacttgacaatttcgtggatagtttctcagttctcacatgctgcctgtttgttcgtctggatttcccttcttttctttcctatgtgactctggttctggatcgacttggctggacgctacatgagatagctgtgcattatattctacacttgaccttttcacggcagcatcaagtaggtatggaattaattcacttcattgtccttaagattttaacatgctgatcaagtatgttatccgcacgctaccatcagcaacatggatatgccatgtggtcatttgtgaggtttggctccgagcgggcacggaattaattcacttcaatcaccttagagcgagctcagtaacagagccaactatcggctgcaatatattgacacactgcagtaaccattatagtcaactgatacaatagagatatcatatacttattggaacacaaatattttttttatttttatgggcccaccatccctctattctcttgcttgctcccatccatccctttcagctttcttcttgccggtgaggcggtgataacgaggcagtgtcccagccaaatgcacggatgcggctggggcgaggccggggcgagggagacggcggcagctgcagtggacacggtgacggcagccacggaggacgagggcgacgaacgcgtgagagggacggcaaccgcgggagaaaaagtgggatgggcgcaggagacggcgacggggacggtggccgctgcagacgtggacgagggtggtgggacgggcgcgtgcaaggacgaggggatggatgaggacggggacggcggggcgcgatggatgtgggtgaggacggtgggatggacgaggacaacggccgtggcgcgacggatgcgggcgaggacgacggcagccactgaggacgaggacggtgaccgtggagtggcagatgcgggcgacgacggcggaagggatgcagggcacggcgtggtggatgcgagcgaggatggtggccatgacgcagcggatgcgggcgaggacagcggctgcggcgcggcggttgccgcgggaggatgaggacgagctgacagcgaccgcagcagcaggacaaggatggcggctgcggcggaggcggtgggacaatgactgggcgactgcgatggccgcgaaggaagaggacgacacgcgtgaggatggtagcatttattcccttccatcacagcgggccccacaaccttgggccgcgcgtgtagccgggtggcaaatttagtcgccgcgcgttctctgtttccttctctcctccagcttagcaaaaaaatcctacgttgatctcctaccgcccattactgtgccatctgtagaaagaatcaattgagcaagggtaagacaaggaatttcccctcctaccctgatcctagcc

SEQ ID NO: 3598 - DNA, 1830 bp, Oryza sativa
tctcgcctccggctttacactccgatctctctctctcacacacccgcctcaccctcaccgccaccgccaccgacgagctccggtcgccgccggcgagaggcgccgcgcgatcccgggagatgccgccgctcacggggcccaagtccggggacgccctcttcggcagcgtcgagcgcgtcaacgcggagctgttcacgctcacgtacggggccatcgtcaggcagctgctcacggatctggaggaggtcgaggaggtcaacaagcagcttgatcagatgggctacaacattggaactcggttggttgacgagttcttggccaaatcaaatgtatcaaggtgtgttgacttcaaggagactgccgatgtcatcgcaaagcttggattcaaaatgttcttgggtgtgactgcaactgtcaccaattgggatgctgagggtacaagctgcagctttgtattggaggacaatcctcttgtagactttgttgaacttcctgatacttgccaaggtcttcagtactgcaatgtgctaagtggagttattaggggtgcactggaaatggtgtccatgaagaccgaggttacatgggtccgtgatatgcttcgtggggatgatgcctacgagatgcgagtgaagcttaccaagcaagtcccagaggaatacccctacaaggatgatgactgacttgacaatttcgtggatagtttctcagttctcacatgctgcctgtttgttcgtctggatttcccttcttttctttcctatgtgactctggttctggatcgacttggctggacgctacatgagatagctgtgcattatattctacacttgaccttttcacggcagcatcaagtaggtatggaattaattcacttcattgtccttaagattttaacatgctgatcaagtatgttatccgcacgctaccatcagcaacatggatatgccatgtggtcatttgtgaggtttggctccgagcgggcacggaattaattcacttcaatcaccttagagcgagctcagtaacagagccaactatcggctgcaatatattgacacactgcagtaaccattatagtcaactgatacaatagagatatcatatacttattggaacacaaatattttttttatttttatgggcccaccatccctctattctcttgcttgctcccatccatccctttcagctttcttcttgccggtgaggcggtgataacgaggcagtgtcccagccaaatgcacggatgcggctggggcgaggccggggcgagggagacggcggcagctgcagtggacacggtgacggcagccacggaggacgagggcgacgaacgcgtgagagggacggcaaccgcgggagaaaaagtgggatgggcgcaggagacggcgacggggacggtggccgctgcagacgtggacgagggtggtgggacgggcgcgtgcaaggacgaggggatggatgaggacggggacggcggggcgcgatggatgtgggtgaggacggtgggatggacgaggacaacggccgtggcgcgacggatgcgggcgaggacgacggcagccactgaggacgaggacggtgaccgtggagtggcagatgcgggcgacgacggcggaagggatgcagggcacggcgtggtggatgcgagcgaggatggtggccatgacgcagcggatgcgggcgaggacagcggctgcggcgcggcggttgccgcgggaggatgaggacgagctgacagcgaccgcagcagcaggacaaggatggcggctgcggcggaggcggtgggacaatgactgggcgactgcgatggccgcgaaggaagag

SEQ ID NO: 3599 - DNA, 1090 bp, Oryza sativa
acctatagacttgccgttctcgcgacgtggcctctcccccgatctctctctctctctctcctccgcatcaccaccaccgccgccgacgagctccggtcgccgccggcgagaggcgccgcgcgatccgggagatgccgccgctcacggggcccaagtccggggacgctctcttcggcagcgtcgagcgcgtcaacgcggagctgttcacgctcacgtatggggccatcgtgaggcagctgctcacggatctggaggaggtcgaggaggtcaacaagcagcttgatcagatgggctacaacattggaactcggttggttgatgagttcctggccaaatcaaatgtatcaaggtgtgttgacttcaaggagactgccgatgtcattgcaaagcttggattcaaaatgttcttgggtgtgactgcaactgtcaccaattgggatgctgagggtacaagctgcagctttgtattggaggacaatcctcttgtagattttgttgaacttcctgatacttgccaaggtcttcagtactgcaatgtgctaagtggagttattaggggtgcactggaaatggtttctatgaagacagaggttacatgggtccgtgatatgcttcgtggggatgatgcctacgagatgcgagtgaagcttaccaagcaagtcccagaggaatacccctacaaggatgatgactgacttgacgatttcgtggatagtttctcagttctcacatgatgcttgtttgctcgtctggatttcccttcttttctttcctctgtgactgtgattctggttcgacttggctggatgctacatgagatagctgtgcattatattttacacttgcactttgcacggcagcatgtattgtagaaatctatcataacttctgaatttgtttgctaagtttgacaaagcgtttacgatccatatgagatttcttctagctgtgctgcccggaaatctatataaagaggctttttagcctgatttcatggcacaccttgttcagcggttgtgcttctccctgataacagattgttagggaatggtctcatgtcagtgataaaggcaccgtgtttttaactaca

SEQ ID NO: 3600 - DNA, 1001 bp, Oryza sativa
acctatagacttgccgttctcgcgacgtggcctctcccccgatctctctctctctctctcctccgcatcaccaccaccgccgccgacgagctccggtcgccgccggcgagaggcgccgcgcgatccgggagatgccgccgctcacggggcccaagtccggggacgctctcttcggcagcgtcgagcgcgtcaacgcggagctgttcacgctcacgtatggggccatcgtgaggcagctgctcacggatctggaggaggtcgaggaggtcaacaagcagcttgatcagatgggctacaacattggaactcggttggttgatgagttcctggccaaatcaaatgtatcaaggtgtgttgacttcaaggagactgccgatgtcattgcaaagcttggattcaaaatgttcttgggtgtgactgcaactgtcaccaattgggatgctgagggtacaagctgcagctttgtattggaggacaatcctcttgtagattttgttgaacttcctgatacttgccaaggtcttcagtactgcaatgtgctaagtggagttattaggggtgcactggaaatggtttctatgaagacagaggttacatgggtccgtgatatgcttcgtggggatgatgcctacgagatgcgagtgaagcttaccaagcaagtcccagaggaatacccctacaaggatgatgactgacttgacgatttcgtggatagtttctcagttctcacatgatgcttgtttgctcgtctggatttcccttcttttctttcctctgtgactgtgattctggttcgacttggctggatgctacatgagatagctgtgcattatattttacacttgcactttgcacggcagcatgtattgtagaaatctatcataacttctgaatttgtttgctaagtttgacaaagcgtttacgatccatatgagatttcttctagctgtgctgcccggaaatctatataaagaggctttttagcctgatttcatggcaca

SEQ ID NO: 3601 - DNA, 3598 bp, Brachypodium distachyon
gattctcctccgatccccccctctcacctacacggccacaaacaccaccgcgcgctagtctccccgccggccgcgatcccggccatgccgccgctcacgccgcccaagtccggcgacgcactcttctccagcgtcgagcgcgtcaacgcggagctcttcacgctcacgtacggcgccatcgtgcgccagctgctcacggatctggaggaggtcgaggaggtcaacaagcagctcgatcagatgggttataatattggaactcggctggtcgatgaattcttagccaagtcaaatgtatcaaggtgtgttgacttcaaggagactgccgatactattgcaaagcttggattcaaaatgttcctaggtgtgactgcaactgtaaccaattgggatgctgagggtacaacttgtagctttgtgttggaggacaacccacttgtagattttgttgagcttcctgatacttgccaaggcctccagtattgcaatgtgttgagtggagttattaggggagcactggaaatggtttccatgaagacggaggttacatgggtccgtgatatgcttcgtggggacgacgcctatgaaatgcgggtgaagctcaccaagcaagtcccagaggaatacccctacaaggatgacgactacaccatcaacgggcgcgagagcgtcagcctcgtccgcgagcccctcaatcgctacgacgccaacgccatcgccgcccacaaccgccgcggcgaaaaggtcggccacgtcgaccgcgacaccgccagggtcctggcccatctcctcgacacccgcctcgtcgccgccacccacgccatagtgcccaagcacccctccggcaagaacaggcccaagcccttcaaactcccctgccaggtccacctcttcgcccacccggcctccgccgacgccgttcggagcgccgtctccggcagcggcctctccctcatcgacaccggccacgccgagttctccttctccgagtccgccatcgtgcaggagcagaccaagaagtccgaccgggatgtcgacaggctgttcgcgcgtgtggtcaaggaaggggagggccggatcaagccgatggaggcgcccgaggatgtcgtggtgtcggacctgttcgagcaccagaaggatgctttgggatggctggtgcaccgggaggagtcctgtgacctgccgccgttctgggaagaggataaagatggtggctatcagaatgtgcttacgagccagaagacaaaggagcggccgctgccactaaagggcgggatttttgctgatgatatggggcttggcaagacactcacgctgttgtcgttgattgcgagaagtaaagctcgcaatgtagttgcgaagaaggggaaggggactaaaaggaggaaggttgatgatgcggggcaggagtcgaggacgacacttgtggtgtgcccgccctcagtgttctcgtcttgggtgacacaattggaggagcacacggaggcaggcagcctgaaggtgtatatgtaccatggggagagaacaaaagataagaaggagctgttaaagtatgacattgtgattaccacttacagcatcttgggcatcgagtttggacaggagggctcacccgtgaacgatattgagtggttccgagtgattctcgatgaggcccatgtgatcaagaactctgcagctcggcagactaaggctgtgattgctttgaacgcacagaggcggtgggtggtcacagggacaccaattcagaatagctcatttgatttgtacccgcttatggcatttttgaagttcgaacctttctcaatcaagagctactggcagagtttgatccagagccccctagtgaaaggggataaggctgggctgtcacggctacaaaacctcctaggtgctatctcgctgcgcagaaccaaggagacagagagtggaagcaagagcttggttaacattccgcctaaaactgttgtagcatgctacattgagctttcttcagaggaacgtgagtactatgaccagatggaattggaagggagaaacaaaatgctggagtttggtgctggagattctattatgcgtaattactctactgtgctctatttcattctgaggctccgtcagctctgcaacgatgtagcactgtgccctttagacatgaaggcatggcttcctggcagctcccttgaagatgtgtctaaaaacccagagttgttgaagaagctagcctcactggtggacgatggagatgatttcgactgtccaatttgcctctctcctccatctaaaactgtcataaccagctgcactcacatatactgccaaacctgcatcttaaaaatcctgaagagctctagctcccgttgtccaatatgccggcacgccctatccaaggaagacctctttattgctccggaggtacaacatcctgatgaagatggctcaggcaatcttggctctgacaaacctctctcttccaaggtgcaagctctgctggagctactgaagcgttcgcagaaggaagaccccctatcaaagtctgtcgtcttctcccagttcaggaggatgttgattctgctcgaagggccactgaaaagagcaggcttcaacatactacgtcttgatggctccatgagcgcgaagaagaggtcagatgtcatcaagcgttttgccatggttggccctgacaccccaaccgtgctgctggccagcctgaaggccgcgggagccggcataaacctgacggcagcgtcgacagtatacctgttcgacccctggtggaaccctggggtggaggagcaggccatggaccgggtgcaccggatcgggcagaagaaagcggtgaaggtggtgaggctcctggtgaagggcagcatcgaggagaggatcctggagctgcaggagaggaagaagaggctgatcagcggcgccttcgggaggaaaggaggagccaaggagaacaaggagatgcgcctcgaggagctgcgtctgatgatgggcatatcatcgcctgcctggggccgttagcctggtagtggagtaccattttctgaatcctatcccacccaaagggaaagtgatgatggtagcctcagagaatgttgctgcactgcatgcatgtatttttggtccgtgtggtggaacatgtatgcatgcctgaggccaaagagggaaggaaacttgctgaagaggagctcccctgttttgcaaaaacttgtagtagtagctggtgcacctggcatcgatcccctctagtatctttttgctgtgtagcatctcatatcattgcaggagtatggaatataggacagtaggtgtagaacaagtttcctgcacaagtgatatggaataggacaacatgcatgtatgtgtatgcctgtgatgatgctaaaacactgacctcacctaggttcgttcagacttcagtgttagttagagatagtcaaggatgcagggttctagacttgagttacgttgctgtgcttgcttgtgtgttggtggtatgccttccttggcctcgtcagatcatctgactgagacgaggctgaagaaacgatttcagaacggatcgaagatggggaaccagattttgtcactccct

SEQ ID NO: 3602 - DNA, 1027 bp, Brachypodium distachyon
gacgggcctagctagcttataacccaaaccctttcacggccggtgacgattctcctccgatccccccctctcacctacacggccacaaacaccaccgcgcgctagtctccccgccggccgcgatcccggccatgccgccgctcacgccgcccaagtccggcgacgcactcttctccagcgtcgagcgcgtcaacgcggagctcttcacgctcacgtacggcgccatcgtgcgccagctgctcacggatctggaggaggtcgaggaggtcaacaagcagctcgatcagatgggttataatattggaactcggctggtcgatgaattcttagccaagtcaaatgtatcaaggtgtgttgacttcaaggagactgccgatactattgcaaagcttggattcaaaatgttcctaggtgtgactgcaactgtaaccaattgggatgctgagggtacaacttgtagctttgtgttggaggacaacccacttgtagattttgttgagcttcctgatacttgccaaggcctccagtattgcaatgtgttgagtggagttattaggggagcactggaaatggtttccatgaagacggaggttacatgggtccgtgatatgcttcgtggggacgacgcctatgaaatgcgggtgaagctcaccaagcaagtcccagaggaatacccctacaaggatgacgactagttccatctcagcgatagccgcgtgctggctctctgtttgctcaccttctggattttccttttgctttccttgtggctgtaattctggcatggcatgatgttttacatgaagcgcctgtgcgttttattttgcagctgcattgtgtatgtactgccgatgtattatagagaccttgtatggttttcctgcttttgatctgttggataaatttggccagagcaaatcttggtactggcaaaatttggcctagaaatttagtcttttttactctgattagctcccaaatatgaaggtctaaggatcatttggaaaccataaaggcataaacaaag

SEQ ID NO: 3603 - DNA, 866 bp, Avena sativa
cgatctctctctgtccctcgatcgccaccaccaccgctgcgcgccagtcgccgccggcgcgatcccggcgccggatgccgcccctcacgacccccaagtccggcgacgccctcttcgccaacgtcgaccgcgtgaacgcggagctcttcacgctcacatatggcgccatcgtgcggcagctgctcacggatctcgaggaggtcgaggaggtcaacaagcagctcgatcagatgggttacaatattggaactcgattagttgacgaattcttagccaagtcaaacgtatcagggtgtgttgacttcaaggagaccgccgatactatagcgaagcttggattcaaaatgttccttggtgtgactgcaactgtaaccaattgggatgctgagggtacaacttgcagctttgtattggaggacaatccacttgtagattttgttgagcttcctgatacctgccagggccttcagtattgcaatgtgttgagtggagttatcaggggagcactcgaaatggtttccatgaagacggaggtcacatgggtccgtgatatgctccgcggggacgacgcctacgagatgcgggtgaagctcaccaagcaggtcccggaggagtatccctacaaggacgacgactagtttcaatctcaagggggtagttattttggcacgctggtgctcgtctggttttctctgtggctgtaatttctgaaacgattgtgaaggtttacaggcggcacccaccggtgcataatattttgcagctgcactgtgtactgctgatgtatttagtagagatttgtatggctttcctgctttggaagagtgataaatttagtcagggaaatatctgatgctggctagatt

SEQ ID NO: 3604 - DNA, 881 bp, Secale cereale
agaccggcgactctctggaagtggttctctcctctgatctctctcgcccgccaccggccccgatctcggcgatgccgcctctcacgacccccaagtccggcgacgccctcttcgccagcgtcgagcgcgtaaacgcggagctcttcacgctcacgtacggcgccatcgtgcggcagctgctcacggatctcgaagaggtcgaggaggtcaacaagcagctcgatcagatgggttacaatattggaactcggttggttgatgaattcttagctaagtcaaatgtatcaaactgtgctgacttcaaggagactgctgatactatagcaaagcttgggttcaaaatgttcctgggtgtgactgcgactgtaacgaattgggatgctgagggtacaacttgcagctttgtattggaggacaacccacttgtagattttgttgagcttcctgatacttgccaaggccttcagtattgcaatgtgttgagtggagttatcaggggagcactggaaatggtttccatgaagacggaggttacatgggtccgcgatatgcttcgcggggacgatgcctacgagatgcgggtgaagctcaccaagcaagtcccggaggaatacccctacaaggatgatgactagtttcatctcaaggggtagctcttccgcacggtggcgctcatttgctcgtctggatatccgttttgctttccatgtggctgtaattctggtattagacatgtttacatgaggcacctgtgcattgtattttgcagctgcactgtgtaccgcagatgtattgtagagatcttgtatggttttcctgctttggaacaacgcctggaaatgaagtgtttttactctgattagctgccaaatcttttttaa

SEQ ID NO: 3605 - DNA, 972 bp, Hordeum vulgare
cggcacgaggcaactactcgagaccggcgactcccaagtggttctctcctctgatctctctcgcccgccaccggccccgatctcggcgatgccgcccctcacgacccccaagtccggcgacgccctcttcgccagcgtcgagcgcgtaaacgcggagctcttcacgctcacgtacggcgccatcgtgcggcagctgctcacggatctcgaagaggtcgaggaggtcaacaagcagctcgatcagatgggttacaatattggaactcgattggttgatgaattcttggccaagtcaaatgtatcaaactgcgctgacttcaaggagactgctgatactatagcaaagcttgggttcaaaatgttcctgggtgtgactgcgactgtaaccaattgggatgctgagggtacaacttgcagctttgtattggaggacaacccacttgtagattttgttgagcttcctgatacttgccaaggtcttcagtattgcaatgtgttgagtggagttatcaggggagcactagaaatggtttccatgaagacggaggttacatgggtccgcgatatgcttcgcggggacgacgcctacgagatgcgggtgaagctcaccaagcaagtcccagaggaatacccctacaaggatgacgactagtttcatcgcaaggggtatctcttctgcacggtggcactcgtgtgctcgtctggatatccgttttgctttccctgtggatgtaattctggtacaaccgtcatgtttacatgaggcacctgtgcattgtattttgcagctgcactgtgtaccgcagatgtattgtagagatcttgtatggttttcctgctttggaacagtgcttggaaatgaagtgcctttactctgattagctgccaaatcttttgggaataaactggtctggaaaagatcttttggagctaatcgacaaagcattttctgcaatgaagttatacattttt

SEQ ID NO: 3606 - DNA, 854 bp, Triticum aestivum
gcctctcacgacccccaagtccggcgacgccctcttcgccagcgtcgagcgcgtaaacgccgagctcttcacgctcacgtacggcgccatcgtgcggcagctgctcacggatctcgaagaggtcgaggaggtcaacaagcagctcgatcagatgggttacaatattggaactcggttggttgatgaattcttagccaagtcaaatgtatcaaactgtgctgacttcaaggagactgctgatactatagcaaagcttgggttcaaaatgttcctgggcgtgactgcaactgtaaccaattgggatgctgagggtacaacttgcagctttgtattggaggacaacccacttgtagattttgttgagcttcctgatacttgccaaggtcttcagtattgcaatgtgttgagtggagttatcaggggagcactggaaatggtttccatgaagacggaggttacatgggtccgtgatatgcttcgcggggatgatgcctacgagatgcgggtgaagctcaccaagcaagtcccagaggaatacccctacaaggatgatgactagtttcatttcaaggggtagctcttccgcacggtggcgcttgtttgcttgtctggatatccgttttgctttccctgtggctgtaattctggtacaaccgtcatgtttacttgaggcacctgttcattgtattttgcagctggactgtgtaccgcagatgtattgtagagatcttgtatggctttcctgctttggaacagtgcctggaaatgaagtgtttttactctgattagctgccaaatctttttggaataaactggtctggaaaagatcttccggagctcatcgacaaagcatt

SEQ ID NO: 3607 - DNA, 774 bp, Pseudoroegneria spicata
  misc_feature (31)..(35): n is a, c, g, or t
ccaagtccggcgacgccctcttcgccagcgnnnnncgcgtgaacgccgagctcttcacgctcacgtacggcgccatcgtgcggcagctgctcacggatctcgaagaggtcgaggaggtcaacaagcagctcgatcagatgggttacaatattggaactcggttggtcgatgaattcttagccaagtcaaatgtatcaaactgtgctgacttcaaggagactgctgatactatagcaaagcttgggttcaaaatgttcttgggtgtgactgcgactgtaaccaattgggatgctgagggtacgacatgcagctttgtattggaggacaacccacttgtagatttcgttgagcttcctgatacttgccaaggccttcagtattgcaatgtgctgagtggagttatcagaggagcactggaaatggtttccatgaagacggaggttacatgggtccgtgatatgcttcgcggggatgatgcctacgagatgcgggtgaagctcaccaagcaagtcccagaggaatacccctacaaggatgacgactagttccatcccaaggggtagctcttcctcacggtggcgctcgtttgctcgtttggatatccgttttgctttccctgtggatgtaattctggtacaaccgtcatgtttacatgaggcaactgtgcattgtattttgcagctgcactgtgtaccgcagatgtattgtagagatcttgtatggtttccctgctttggaacagtgcctgcaaatgaagtgcttttactctgatta

SEQ ID NO: 3608 - DNA, 929 bp, Coffea canephora
gacaatcctgaaaacgctgccaggactccctcgaaactcgcacgcgatcatcagctactggagtggaaaccaaagtattcaaagtaaatctcgccggagaattcaagagcgtggaagccttccccgatgcctcccgttgctcccagatccggtgacgccattttcgccagcgtggaacgggtgaacgcggagcttttcactctaacctatggcgcgatcgttcgtcagctgctaaccgatctggaagaggtcgaggaagtcaacaagcagcttgaccagatgggttataatattgggattcggctaatcgatgagtttcttgcgaagtccaatgtttctagatgtgtggatttcaaggaaactgctgaagtcattgccaaggttggtttcaaaatgttcctaggggtcactgcaactgtgactaattgggatgctgagggtacaacctgcagtcttgttttggaagataacccgctggtagattttgttgaacttcctgacacttgtcaaggcttgtattattgcaacgtcctgagtggagttatcaggggagctctggagatggtgtcaatgaaaactgaagtgacatggatccgtgatatgctgagaggggatgatgcatttgaaatgcaagtgaagcttgtgaagcaagttcctgaggagtacccctacaaagatgatgagtaacatgttgcttgaccgcatgatcaatgtatatacatagagtgctgtttaacatcatggtgttgtatttgagttcattcatcatctttttttcctcaagacatgcatatatggctttgcttgttagtcttaagtttggaagacaaccttagaagttttgatagacttgacatggcttaaatcttttaggctgtatgccagttgagaatgctgatgcaagtgagacaattcacgctcttgttgcg

SEQ ID NO: 3609 - DNA, 850 bp, Catharanthus roseus
tctaactaagctgttgctgccggaatattttacagacgacggtgatcgttgattgctgatggcgcccgtggctcctagatctggtgacgccatttttgccagtgttgaacgcgtgaacgctgagcttttcactctaacatatggtgcgatcgtccgtcagctgcttacggatctggaagaggtcgaggaagtcaacaaacagcttgaccaaatgggttacaacattgggattcgactaattgatgagtttcttgcaaaatccaatgtctctagatgtgttgatttcaaggaaacagctgaagtaatcgcaaaggtaggcttcaaaatgttcctaggggtcactgccaccgttactaactgggatgctgagggaacaacatgcagcttaattttggaggacaacccattggtagattttgttgaactacctgatacgtgtcaaggtctgtattattgcaacatcttaagtggagtcatcagaggagctttagagatggtttcaatgaaaacggaagtaacatggatacgcgacatgctaagaggggacgatgcttatgaaatgcaagtgaaacttcttaagcaggtccctgaagagtacccttacaaagatgacgagtaaaatgttttttgcccacttgaacttgtgtaaatacatcttgatttctcaaattccttagatcctatcttctcttagtaatttatttgcctttcaccttgtcaaatttggttctatgcagaactactttaaaagttcgctcagttgtctggattcttctcgttggtttaatttttgggattttgcagttatcgtccaagatttgttttttattgaatgccaataagatcttta

SEQ ID NO: 3610 - DNA, 695 bp, Tabernaemontana elegans
tcaccgtctctcacaatcgagccgaagcttagctcgcaaaaaatcacccccaaaaatcactgcgacaaaaacgaaaaacgaatcaccgatctcctatggctcccgtcgctcctagatccggcgacgccattttcgcaagcgttgaacgagtgaacgctgagcttttcaccctgacatacggtgcgatcgtccgtcagctgcttacagatctggaggaggtcgaggaagtcaacaaacagctagaccagatgggatataacattgggattagattaattgatgagttccttgcaaaatccaatgtctctagatgtgttgatttcaaggaaacagctgaagtcattgcaaaggttggtttcaaaatgttcctgggggtcactgcaactgtgactaactgggatgctgaggggacaacatgcagcttaattttggaggacaacccactggtagattttgttgaacttcctgatacgtgccaaggcttgtattactgcaacatcttaagtggagttatcaggggtgctttagagatggtttcaatgaaaaccgaagttacgtggctacgtgatatgctaagaggggatgatgcttatgaaatgcaggttaagcttctgaagcaagttcctgaggagtacccctacaaagatgacgaatagaatgctttttgaccagttgaattggtgtaaatacaacat

SEQ ID NO: 3611 - DNA, 839 bp, Catharanthus roseus
  misc_feature (90)..(90): n is a, c, g, or t
atccaaagaattcggcacgaggtctaactaagctgttgctttcggccggaatattttacagacgacggtgatcgccgattactgatggcncccgtggctcctagatctggtgacgccatttttgccagtgttgaacgcgtgaacgctgagcttttcactctaacatatggtgcgatcgtccgtcagctgcttacggatctggaagaggtcgaggaagtcaacaaacagcttgaccaaatgggttacaacattgggattcgactaattgatgagtttcttgcaaaatccaatgtctctagatgtgttgatttcaaggaaacagctgaagtcatcgcaaaggtaggcttcaaaatgttcctaggggttactgccaccgttactaactgggatgctgagggaacaacatgcagcttaattttggaggacaacccattggtagattttgttgaactacctgatacgtgtcaaggtctgtattattgcaacatcttaagtggagtcatcagaggagctttagagatggtttcaatgaaaacggaagtaacatggatacgcgacatgctaagaggagacgatgcttatgaaatgcaagtgaaacttcttaagcaggtccctgaagagtacccctacaaagatgacgagtaaaatgttttttgcccacttgaacttgtgtaaatacatcttgatttctcaaattccttagatcctatcttctcttagtaatttatttgcctttcaccttgtcaaatttggttgtatgcagaactactttaaaagtttgctcagttgtctggattcttctggttggtttaatttttgggattttgagtacttctaga

SEQ ID NO: 3612 - DNA, 764 bp, Avena sativa
cgcggggggacggcccgtccttcgccagcgtcgagcgcgtcaacgcggagctcttcacgctcacgtacggcgccatcgtgcggcagctgatcacggatctggaggaggtcgaggaggtcaacaagcagctggatcagatgggttacaatattggaactcgattggttgatgaattcctagccaagtcaaatgtatcaaattgtgttgacttcaaggagactgctgatactatagccaagcttggattcaaaatgttccttggtgtgactgcaactgtaaccaattgggatgctgagggtacaacttgcagctttgtattggaagacaacccacttgtagattttgttgagcttcctgatacttgccaaggcctacattactgcaatgttttgagtggagttattaggggagcactggaaatggtttccatgaaaacggaggtcacatgggtccgagatatgcttcgtggggatgacgcctatgagatgcgagtgaagctcaccaagcaagtcccagaggaatacccctacaaggatgacgactagtttgttctcaggaatagttcgtgacacgttgttgttgctcatttgcatttccatgttaagctcctccgtggttgtaattctggtacaacatgatgtttacatgaggtgcctgtgcattatattttgcagttgcgctgtgtaccgctgacgtgtttagagaaggtctattgtttttacttgtctttggtattcttaaatttaaaaaacaaacaaaaaccg

SEQ ID NO: 3613 - DNA, 953 bp, Elaeis guineensis
aggtgatctaataacagtggttagatcaactcttccccctcgccggccaccctgaaaggaactccaatggcccctctcgccccaaggaccggcgatgcagtcttcgccagcgtcgaacgcgtcaatgcggagctgttcacgcttacgtacggcgcgattgtgcggcagctcctcacggatctggaggaggtggaggaggttaacaagcagctcgatcagatgggttacaatattggagttagattgattgatgagtttctggccaagtctggtgtatccagatgtgttgacttcagggaaacagctgatgtgattgcgaaggttggtttcaaaatgttcttaggggtcactgcatctgtgaccaattgggatgctgaggggacaagttgcagccttgttttggatgataatcccctagtggactttgttgagcttcctgatacatgccagggcctttactactgcaacatcttgagtggagttataagaggagcattggaaatggtgtcaatgaagactgaagtcacctgggtccgagatatgctacatggggatgatgcgtatgagctgcgagtgaaacttctgaagcaagttccagaggaatacccatacaaggatgatgagtaacttctgaagcaagtaatatcctgtagatgcagatcctcttttctaccaggaattggctactcttgttatggttgcactagttagttttccaggccttcttattttctggaggtgttctatttggatctagattagaaagctatgttatattttccactttcgtcatttgctttcatacatgtgtaaaggatgttcagatgttcgtttaaaatgcattacaggactagaacttatggcacacttttaaccttgactgcaacagaaaaacacttgcatcgtatcaatttatatgacattgaattaaaaaaaaaaaaactaataagaac

SEQ ID NO: 3614 - DNA, 963 bp, Antirrhinum majus
  misc_feature (759)..(759): n is a, c, g, or t
  misc_feature (816)..(816): n is a, c, g, or t
  misc_feature (818)..(819): n is a, c, g, or t
ctctcacaaagcaaagatctaataagctttttccgatctaatggcacctgcgattcccaagtccggcgatgcgatcttcgccagcgttgatcgagtgaatgctgagctgtttactcttacgtacggtgctatcgtgcgccagctgctcacggatctggaggaggtggaggaggtcaacaagcagctcgatcaaatgggctataatattggagttcggctagtcgatgagtttctcgcgaaatcgaatgtttcgagatgtgttgattttagagagactgctgaagtcattgccaaggtcggattcaaaatgttcctgggtgtcactgcgtctgtcactaactgggacgctgaggggacaacctgcagtctaattctggaggacaatcctctagtagactttgttgagcttcctgatacctgtcaaggactgtactattgcaacatcttaagtggagttgtgaggggagctctagagatggtgtcaatgaaaacagaggtgacatggttgcgcgacatgcttagaggggatgatgtatttgagttgcaggtgaaacttctgaagcaagttccagaggagtacccgtataaagacgatgagtgacatgcttcttctgcctatagtatatattaacgatgatccatgtactctttctctgtcagtgagcgtttcttttgctcgtgcagttagttattctggcctagaaacattagtcatataactgcagtatttttctgaaacggccttacaaactactttgntttcttgtccctattttggttgttagccgcttgttgtttgtggcattgctgtcgcanannctttcgcgtgaattatttcatcgttggctgattaaaattgtgatggttgccagtacccagcaattagccctcggctcaattgagttatgaatttacggaatgggatatccggcttttggtttctgatatacggatctataaagt

SEQ ID NO: 3615 - DNA, 759 bp, Nuphar advena
ttcctcgatcgggggacgctgtgttcgcgagtgtcgaacgcgtgaacgcggagttgttcaccctcacatacggagcgatcgtgcggcagctcctcacggatctcgaagagacggaggaggtcaacaagcaactcgatcagatgggatataatattggaattcgtcttattgatgaatttttagcaaaatcaaatgtctccagatgtgttgacttcaaggagacagcagaggtaattgcaaaggtaggatttaaaatgtttttgggggtcactgcaactgtcactaattgggatgctgaagggacaagttgcagtcttgttcttgaagataatcccttggtagactttgtggagcttcctgatacctgccaaggtctgtattattgtaatatcttaagcggagttgtccgaggagcactagaaatggtatcgttgaaaactgaagttacatgggttcgtgatatgcttcatggagatgacgcatatgagctcagagtgaaacttctgaagcaagttccagaggaatatccatacaaagatgatgaatagatctgcaacatgcaggtgcatgtttataaagtacaatgattctaattctatattttgtttagttttgtagtagcatgaaattcaacaaagatcattctaggatgacttgatcactcttcctagagtttagttggttttatctttattctgtaatatttctaaaaaatatttttcccttttcccagttcctcttttaaggaacatggtgtac

SEQ ID NO: 3616 - DNA, 643 bp, Avena sativa
cttcgccagcgtcgagcgcgtcaacgcggagctcttcacgctcacgtacggcgccatcgtgcggcagctgatcacggatctggaggaggtcgaggaggtcaacaagcagctggatcagatgggttacaatattggaactcgattggttgatgaattcctagccaagtcaaatgtatcaaattgtgttgacttcaaggagactgctgatactatagccaagcttggattcaaaatgttccttggtgtgactgcaactgtaaccaattgggatgctgagggtacaacttgcagctttgtattggaagacaacccacttgtagattttgttgagcttcctgatacttgccaaggcctacattactgcaatgttttgagtggagttattaggggagcactggaaatggtttccatgaaaacggaggtcacatgggtccgagatatgcttcgtggggatgacgcctatgagatgcgagtgaagctcaccaagcaagtcccagaggaatacccctacaaggatgacgactagtttgttctcaggaatagttcgtgacacgttgttgttgctcatttgcatttccatgttaagctcctccgtggttgtaattctggtacaacatgatgtttacatgaggtgcctgtgcat

SEQ ID NO: 3617 - DNA, 696 bp, Olea europaea
cgatttatgtactgcatcacgctttcagttcactgccacgcgctttcaaaaggcgttcacttcatggtactctgttctcactcggatcttcaatttcacagctagtaaagcaaaaaagaaatctgaattttctccatgcctcccgttgctccaaggtccggcgatgctattttcgctagcgttgaacgcgtgaatgcggagctcttcactctgacatatggtgctatggtgcgtcagcttctcaccgatctggaggaggtggaggaggtcaacaaacagctcgatcaaatgggctataatataggggtccggctagtggatgaatttctcgcgaaatctaatgtatcgagatgtgttgattttaaggaaacagctgaagtcattgccaaggtaggattcaaaatgttcctgggagttactgcatcagtctccaactgggatgctgagggaacaacctgcagtataatattggaggataatcctcttgtagattttgttgagcttcctgatacctgtcaaggtctatattattgcaacattttaagtggagttatcagaggggctctcgagatggtgtcaatgaaaactgaagtcacatggctgcgagatatgcttagaggggatgatgcatttgagttgcaggtgaaacttctgaagcaagttcccgaggagtatccatacaaagacgacgagtaa

SEQ ID NO: 3618 - DNA, 929 bp, Papaver somniferum
agagccagagccagagccagagccagagggggagaaaagaaaactagggcatatctttgagctcagctgagaaggtgttattgattattgaagatcttcatcttacgaaatttcaatggctccacttgttccaagatctggagatgcaattttcgctaatgttgaacgtgttaatgcggagttatttacgttaacttatggtgcaatggtgagacaattgcttacggatttagaagaggtagaggaagtcaacaagcagcttgatcagatgggttataatattggaattcgactaattgacgagtttctagctaaatctaatgtttctagatgtgttgatttcaaagaatctgctgatgtgattgcaaaggtcggtttcaagatgttcttagggatcaccgcaactgttaccaattgggatgctgatggaacaagttgcagtcttatcttagaggataatccccttgtggactttgttgagcttcctgacacatgccaaggtctatattattgcaatgtccttagtggagttatcagaggagccctagagatggtttctatgaagaccgaagtcacatgggttcgtgatatgttgcgtggagatgacgcatacgagttacgggtgaaacttctgaagcaagttcctgaagagtacccttacaaagacgacgagtaacttgtgacagtatgaattggtaatttcatgaatgtgcagtttatgtttgttgttttccttatattaaagaattttgaacttctcctgtttatattaatgacttgtaaacaaccaagctctctgcataaacttactagactgtaattctttggtgttcaacttcctgctttagaagctaacatcaattatttctgtgtagcatttttggacttatatgtttcactaaaaatatcagtaggaatgaataattttt

SEQ ID NO: 3619 - DNA, 835 bp, Aquilegia formosa
aaaagatatttcacagatctcgaggattaatggcaccattagctccaagaacaggtgatgcagtcttcgctaatgttgaacgtgtgaatgcagagttattcacattaacatatggagcaattgtacgacaactacttacagatctcgaagaagttgaagaagtcaacaaacaacttgatcaaatgggatataatattggaatccgactgattgatgagtttctagctaagtctaatgtctctagatgcgttgacttcaaggagacggccgatgtaattgcgaaggttggtttgaaaatgttcttaggggtcactgcttctgtgaccaactgggatgtggatggaacaagttgtagtcttgttttggaggataaccccctggtggacttcgtcgagcttcctgatacatgccaaggtctttactactgcaacatcttgagcggggttatcagaggagccctagagatggtttcaatgaaaactgaagttacatgggttcgtgatatgttacgtggagatgatgcatatgagttgcgattgaaacttctaaagcaagtcccagaagaatatccctacaaagatgatgaataactgtccctacttggtaacatatgtatatgtagcttacagcatcaccttcgaatcctaaaatctgagcggatggacatttttttttagcctgtttcggcaaacttgtggacgtacattacacttgttatcctttattcgtcagtttatgctaagttttcatgttaaatgtaatagaggactactttctcagtagctggttgttttggtttctttctatgatttcaaaagtatctgaatggactgtc

SEQ ID NO: 3620 - DNA, 1063 bp, Aristolochia fimbriata
gagtgccgttcgcgcttcattttgagccggaaatcgcccaggcagggatacagatccgtgtttccggcgcttaacagctttgcgggagcctgcgattgagcaaaattgattctcgcttctcgttacgaattgctgagatttagagttctgcggtcaccatggctcctgtggctccaagaaccggagatgcagtttttgcaaatgttgagcgagtgaacgctgagctctttacgcttacttacggagcaatagtgcggcagcttctgacagatttagaggaggtggaggaagtcaacaaacaacttgatcaaatgggatataacattggaattcgacttattgatgagtttctggcaaagtccaatgtgactagatgtgttgacttcaaagagacagctgaagttattgcaaaggttggtttcaaaatgtttctaggggtcacggcatctgtgaccaattgggatgctgatggaacaagttgcagtctggtgttggaagataatccccttgtggactttgttgaacttcctgatacctgtcagggtctgtactattgcaacattttaagtggagtaatcagaggagcccttgagatggtatctatgaagacagaagttacatggatccgtgatatgttgcgtggggatgatgcatacgagctgcgagttaaactactgaagcaagttcctgaggaatacccttacaaagatgatgagtaatgatgtagtacagaagatgagtctgtttatgcaattaacatgtttaactttgattgtcacaacgtttatttgcttaaattcagcacacaggttcactgtctcattgacaacttcgttaaagtcattagccttgccagttatttgaggcctgggatttgaccccctattagtgtggttcaatgttgttttctgtttcactgcaaatcttaaccccttcagacgaagcaccttatttgatctgttcattggcatctacaatgaactagttacagaaaagcatttgcatatacgaacgcacttcaacaggccgtgaaacaattactcaagtttcgattctttgcaaa

SEQ ID NO: 3621 - DNA, 875 bp, Musa acuminata
gggaagcccattgttccgtgagtcgaaatccacaagcgagagcgaggaggaggaggaagaggaggagaatggctcctctcgcacccaagaccggggacgcagtctttgccagcgtcgatcgcgtgaatgcggagctgttcaccctgacttacggggcgatggtgcggcagctcctcacggatctggaggaggtcgatgaggtcaacaagcagctcgatcagatgggatacaacattggagtccggttgattgatgaattcctagccaagtccaatgtatctagatgtgttgacttcaaggagacagctgatgtaattgcaaaggttggtttcaaaatgttcttagggatcactgcatcagttaccagttgggatgctgaaggaacaagtttcagccttgttctggaggataatcccttggtagactttgttgagcttccggatacttgccaaggtcttcattactgcaatatcttgagtggagttttacgaggagcactggagatggtgtcgatgaagactgaagtcacttgggttcgggatatgctgcatggggacgatgcatatgagctcagggtgaaacttttgaagcaagtgcctgaggagtacccttataaagatgacgagtaaaatggatatgctacggcaatgattcgagtaaagaccttctgttttgttttgctctcgtgagattatcttgctttactgaaagagccatgttactctatataccaacatattgcttagtctctttgacttattttaagtttcctccatcttaaaaattaaccgtccatttggaaagatgaacggttgacatattttgcaggcttttgatctgtttattgtctctccaatagaaatgctattttagcg

SEQ ID NO: 3622 - DNA, 981 bp, Orobanche aegyptiaca
caaccatgtcgctttaaagaaaacgtccggcctttcacggtttaatcctattttttccagtcaactgatctccacccacactcaaaacttagggatctaaatctatctaccatttctcatggctccagccgctcccaaatccggcgacgcaattttcgccagtgtcgatcgcgtgaacgcagagctgtttactcttacatacggcgctatcgtgcgccagctgctcaccgatctggaggaagtagaggaggtcaataaacaactcgatcaaatgggttataatatcggggtccggctagtagatgagtttcttgcaaaatctaatgtgtcgagatgtgtcgattttcgggaaaccgctgaagtcattgccaaggttggattcaaaatgttccttggagtcacagcatcagtcactaactgggacgcagaaggcacaacttgcagtctaattttggaggataatcctttggtggactttgttgagcttcccgacacatgtcaaggtcttcaatattgcaacattttgagtggagttgtcagaggagctcttgagatggtttcaatgaaaactgaggtcacatggcaacgtgacatgcttaaaggagatgacgtgttcgagttgcaggtgaaacttctcaaacaagttcctgaggagtatccgtataaagatgacgagtaacatacttcctataatctattattcctgtaatttttctgcgacttggatcttttgcacgtcctctcgcttatctatattgagcgttagccagtaagttggtttggaacgtttctccaacacatcagaaagaaaagataacgaggtagtgtcttggtctttcatattatcttcttttagtaatgtgctaggagtatgtcggatcattttatttcgaagaagatgacacaataattctgaaatcttgctacatggactcgttgctatcgaagtgttctgtaatgtgtaatgtgtcttgattatgt

SEQ ID NO: 3623 - DNA, 592 bp, Secale cereale
tctctggagtggttctctcctctgatctctctcgcccgccaccggccccgatctcggcgatgccgcctctcacgacccccaagtccggcgacgccctcttcgccagcgtcgagcgcgtaaacgcggagctcttcacgctcacgtacggcgccatcgtgcggcagctactcacggatctcgaagaggtggaggaggtcaacaagcagctcgatcagatgggttacaatattggaactcggttggttgatgaattcttagctaagtcaaatgtatcaaactgtgctgacttcaaggagactgctgatactatagcaaagcttgggttcaaaatgttcctgggtgtgactgcgactgtaacgaattgggatgctgagggtacaacttgcagctttgtattggaggacaacccacttgtagattttgttgagcttcctgatacttgccaaggccttcagtattgcaatgtgttgagtggagttatcaggggagcactggaaatggtttccatgaagacggaggttacatgggtccgcgatatgcttcgcggggacgatgcctacgagatgcgggtgaagctcaccaagcaagtccc

SEQ ID NO: 3624 - DNA, 731 bp, Vinca minor
cggctggaaaatctctctgtcgactatctccgatggctccgattgctcacgttgctcctaggtccggtgactccatattcgccagcgttgaacgtgtgaacgccgaacttttcactctaacatatggcgcgatcgtccgtcagctgcttacggatctggaagaggtcgaggaagtcaacaaacagctagaccagatgggatataacattgggattcgattgatcgatgagtttcttgcaaaatcgaatgtctctagatgcgtcgatttcaaggaaacagctgaagtcattgcaaaggttggttttaaaatgttcctaggggtgactgcaactgtgactaactgggatgttgagggaacaacatgcagcttaattttggaggacaacccattggtagattttgttgaacttcctgatacatgtcaaggcttgtattattgcaacatcctaagcggagtcatcagaggagctttagagatggtttcaatgaaaactgaagtgacatggttgcgtgatatgctaagaggggatgatgcttatgaaatgcaggtgaagcttctgaagcaagtccctgaagagtacccctacaaagatgacgagtaaaatgctttttggccacttgaatttatgtaaatataacatattgatttctctatttctctagaccttatattttcatgtagtcatagaaatgtctttcaccttctcttatctgcttatacgcaggaagta

SEQ ID NO: 3625 - DNA, 653 bp, Chelidonium majus
gcactgtcctctgcaattagctccgcctataacgggtgatcatctggtttgagggagaatcatatatcaatggctcctgttgctccaagatcaggagatgcagtttttgccaatgttgaacgtgtgaacgctgagttatttaccctaacgtacggggcaatggtaagacaactgcttacggatcttgaagaggtggaggaagtaaacaagcaacttgatcagatgggttataatattggaattcgactaattgacgagtttctagcaaagtctaatgtctccagatgtgttgacttcaaggagtctgctgatgtaattgcaaaggttggtttcaaaatgttcttaggggtcactgcagctgtgaccaattgggatgccgacggaacaggtttcagtcttgttttggaggataacccccttgtggactttgttgagcttcctgatacatgccaaggtctgtattattgtaacgtccttagtggagttatcagaggagccctagaaatggtatcgatgaagactgaagtcacatgggttcgtgatatgttgcgtggagatgacgcatatgagttgcgggtgaagcttttgaagcaaattcctgaagaatacccttacaaagacgacgagtaacttgacattacggattggccggt

SEQ ID NO: 3626 - DNA, 1227 bp, Gossypium raimondii
gtagcaagagatatattaacccaagaataaaaatgaaaaagcgatagaagttgatcatataggttttgagaagcgcgaaatcgtctttcatctagaggtcgtgggtttttctcgtccttaaagctcatcttctaatttggtgccatctttggatctctcacttttctacctttcagatttcgtgaaacggagaggagatatctttattcttctgaacttgcaactggaagaggaaaatttcattacagcaactggtccaggccttttcgttcgtctttacggtacttccctccgtttgaacacttccagatctgaagaaaaatgcctcccgccgctcctcgatccggagatgcgatcttcgccagcgtagaacgcgtgaatgcagaactattcactttgacttatggagcaatagtgcgtcaattgcttactgacttggaggaggttgaggaggttaacaaacagcttgatcaaatgggctataatataggaattagactaattgatgagtttctagcaaaatcaaatgtgtccagatgtgttgactttaaggagacagcggaaatgattgccaaggtgggtttcaaaatgttccttggggtcactgcatctgtcatgaactgggatgctgatggcacttgttgcagcattgttttggaggataatccccttgtggactttgtagagcttcctgatacttgtcaaggcctctactattgcaacattttaagtggagtcataagaggagccctagagatggtggcaatgaagacggaagtcacctggattcgtgatatgcttagaggagatgatgcatatgagttgcaggttaaacttttgaagcaagttccagaagagtatccttacaaggatgatgagtaacatgccttacttacctctattaatggccttgcgcacttgccgatgttctatttccattgtttttctgtttctgaagaacattaatatacgttttgtatgtcatcttgaccacaatgtatcttccattttcatttagggtttatatgatctatactccgaagttattaatgttattaatcctgcacatcagtagtgatggcaaatgggtggattggattggattttggtatggaccctttgggtcaggtattctaagtttgagcattttgatgttgaattatctcaagtatggattattttacaccttcaaatcaattttgttttattcttgttttcttaggtttg

SEQ ID NO: 3627 - DNA, 993 bp, Humulus lupulus
ttacggccggggaccgacacataccgcagctaaagaaaacgggaggatatttatcaaaccaaatcggttcttttaagaatcttaccgtccttccaccgaatagacgccgtcgattcttctagtttccggcgatagtccgaatcgtttccggagataagctcttcagctcagatcttcatggctcctgtcgctcctcgttccggtgatgccattttcgctagtgttgatcgcgtgaatgcggagctttttactttgacctatggcgcaatcgtgcgccagttgcttacggatctggaggaggttgaagaggtcaacaaacagcttgatcaaatgggttataatattggcattcgtctggttgatgagttcctagcaaagtctaatgtctccagttgtgttgacttcaaagaaacagctgaagttattgcaaaggtcggctttaaaatgttcttgggagtcactgcatctgtgacaaattggaatgctgatggaacaagctgtagtattgttttggaggataatcctctggtagatttcgttgagcttcctgatacttgtcagggtctgtattactgcaacatcctaagtggggtcattagaggagccttagaaatggtgtcaatgaagactgaaatcacgtgggtccgtgacatgcttagaggtgatgatgcatttgagttgcaagtaaaactcctaaagcaaattccagaagagtatccctacaaagatgatgagtaaattgatcctgcattatacacaattttaacttgtctctctttggtagaacgcaaaaattgtaggatctatttttttatttttactttacatgctaatacctttgaatggatgagattatatatatttatatgataccgttttattgttaaaaaggaaaattgttgattagatggagggtgggtgcgctgttcctctgtttcatttgatttttttttatatactgtaaagcctctttatagtaactaaaaagtttga

SEQ ID NO: 3628 - DNA, 825 bp, Citrullus lanatus
actctgaatttcttcacttatgtagcggcaaccaccgcagcgtcggcgaaaactttcctttgtgctcagttcagaattcagatccatcatgcctcccgctggtcctcgatctggtgatgcgatcttcgctagtgttgagcgagtgaatgcggagctgtttacgttgacttatggagcgactgtccgtcaattgcttacagatctggaggaggttgaggaggttaacaaacagctcgatcagatgggttataatattggaatcaggctaattgatgagtttctagcaaaatctaatatctctagatgtgtggacttcaaggagacagctgatgtgattgcaaaggttggcttaaaaatgtttctgggagtgaatgcaacggtgaccaactgggatgctgaaggcacatgctgcagcattgttctggaggacaatccactagtggactttgttgagcttcctgatacttgtcaaggtctccattactgcaacatcttaagtggagtaattagaggagcacttgagatggtgtcaatgaaaacagaagtaacatggctacgcgacatgctgagaggagacgacagcttcgaattacaagtaaaattgctgaagcaagtccctgaagagtacccttacaaagacgatgaataaaatcttcaaccagaataactctttagtttcatctcatttgcttgtttttttttcctgctctgttcatttgctccaaaaaagatagttacatttcttccttcaacctaacatcttaatcaagttaaatttattatatacacttttttgctgttgtgatggatgaaagggaatgtata

SEQ ID NO: 3629 - DNA, 1331 bp, Theobroma cacao
aagcttaaatttgagcaggcacgtgacaatagcattccagtaaagaaaaaatacgttaaaagagataaaataacctttgtaaaaaaaaaaaaaaaccttcatatactgattacagaaaaaatcgaaattcaaaacagaaaactctcttcacttctttgtcgtcacagccttactcttcccctgcgtagccacaggcgttcttctttgccgcttctgcaggccaccgccatagccgcagtcgttcttcttcttcacggcctctccctccgtttgagcatttgcagttattatttatttcggatttaagttattataaaacttcgcataaactttttcgtagttagattgaactgagtttaggaatttgaattgattagatcttaagagaaatggctcctgcggctcctcgatccggtgatgcgatcttcgccagcgtcgaacgcgtgaatgcagaactattcactttgacttatggagcaattgtccgtcagttgcttactgatctcgaggaggttgaggaggtcaacaaacagcttgatcaaatgggttataatataggaattcgactaattgatgagtttctggcaaaatctaatgtgtccagatgtgttgactttaaggagacagcagaagtgattgcaaaggtgggtttcaaaatgttccttggggtcactgcatctgttacgaattgggatgctgatgggacctgttgcagcattgttttggaggataatccccttgtagacttcgtagagcttcctgatacatgtcaaggtctctactactgcaacatcttaagtggagtcataagaggatccctagagatggtgtcaatgaagactgaagttacctggatccgtgatatgcttagaggggacgatgcatatgagttgcaggtgaaacttttgaagcaagttccggaagagtacccgtacaaggacgacgagtaataagcgaacctaggccttgatgtgacaatgcacacttaaccataatattatttttcctattgtcctcaatgtcttcatgaagaataggagttgaaaaacacttgactggatatacagttgcatgcctattaaggaccagagtggattttccattttcattgaaggtttagattatccattttcccaatatataaatgttattaaggctgccgcatttattatgtttcatttctctgtttatgatctgagtggaatttgttttgggtttgtctttgtcaccttgtttttctcgtgctgctaaaccaattaattagcacattatgaatttttttattagtattttgtgaataatttttattttcataaaagactaaactgtta

SEQ ID NO: 3630 - DNA, 1141 bp, Gossypium hirsutum
agaagttgatcatataggttttgagaagcgcgaaatcgtctttcatctagaggtcgtgggtttttctcgtccttaaaactcatcttctaatttggtgccatctttggatctctcacttttctacctttcagatttcgtgacggagaggagatatctttatttttctgaacttgcaactggaagaggaaattttcattacagcaactggtccaggccttttcgttcgtctttacaatacttccctccgtttgagcacttccagatctgaagaaaaatgcctcccgccgctcctcgatccggagatgcgatcttcgccagcgtagaacgcgtgaatgcagaactattcactttgacttatggagcaatagtgcgtcaattgcttactgacttggaggaggttgaggaggttaacaaacagcttgatcaaatgggctataatataggaattagactaattgatgagtttctagcaaaatcaaatgtgtccagatgtgttgactttaaggagacagcggaaatgattgccaaggtgggtttcaaaatgttccttggggtcactgcatctgtcatgaactgggatgctgatggcacttgttgcagcattgttttggaggataatccccttgtggactttgtagagcttcctgatacttgtcaaggcctctactattgcaacattttaagtggtgtcataagaggagccctagagatggtggcaatgaagacggaagtcacctggattcgtgatatgcttagaggagatgatgcatatgagttgcaggttaaacttttgaagcaagttccagaagagtatccttacaaggatgatgaataacatgccttacttacctctattaacggccttgcgcacttgccaatgttctatttccattgtttttctgttgctgaagaacattaatatacgttttgtatgtcatcttgaccacaatgtatcttccattttcatttagggtttatatgatctatactccgaagttattaatgttattaatcctgcacatcagtagtgatggcaaatgggtggattggattggatttttttatggaccctttgggtcaggttattctaagtttgagcattttgatgttgaattatcccaagtatggattattttacacc

SEQ ID NO: 3631 - DNA, 1119 bp, Gossypium hirsutum
tataggttttgagaagcgcgaaatcgtctttcatctagaggtcgtgggtttttctcgtccttaaagctcatcttctaatttggtgccatctttggatctctcacttttctacctttcagatttcgtgaaacggagaggagatatctttattcttctgaacttgcaactggaagaggaaaatttcattacagcaactggtccaggccttttcgttcgtctttacggtacttccctccgtttgaacacttccagatctgaagaaaaatgcctcccgccgctcctcgatccggagatgcgatcttcgccagcgtagaacgcgtgaatgcagaactattcactttgacttatggagcaatagtgcgtcaattgcttactgacttggaggaggttgaggaggttaacaaacagcttgatcaaatgggctataatataggaattagactaattgatgagtttctagcaaaatcaaatgtgtccagatgtgttgactttaaggagacagcggaaatgattgccaaggtgggtttcaaaatgttccttggggtcactgcatctgtcatgaactgggatgctgatggcacttgttgcagcattgttttggaggataatccccttgtggactttgtagagcttcctgatacttgtcaaggcctctactattgcaacattttaagtggagtcataagaggagccctagagatggtggcaatgaagacggaagtcacctggattcgtgatatgcttagaggagatgatgcatatgagttgcaggttaaacttttgaagcaagttccagaagagtatccttacaaggatgatgagtaacatgccttacttacctctattaatggccttgcgcacttgccgatgttctatttccattgtttttctgtttctgaagaacattaatatacgttttgtatgtcatcttgaccacaatgtatcttccattttcatttagggtttatatgatctatactccgaagttattaatgttattaatcctgcacatcagtagtgatggcaaatgggtggattggattggattttggtatggaccctttgggtcaggtattctaagtttgagcattttgatgttgaattatcccaagtatggat

SEQ ID NO: 3632 - DNA, 934 bp, Zingiber officinale
  misc_feature (89)..(89): n is a, c, g, or t
  misc_feature (119)..(119): n is a, c, g, or t
  misc_feature (143)..(143): n is a, c, g, or t
  misc_feature (158)..(158): n is a, c, g, or t
  misc_feature (170)..(170): n is a, c, g, or t
  misc_feature (173)..(173): n is a, c, g, or t
  misc_feature (182)..(182): n is a, c, g, or t
  misc_feature (215)..(215): n is a, c, g, or t
  misc_feature (224)..(224): n is a, c, g, or t
  misc_feature (227)..(227): n is a, c, g, or t
  misc_feature (293)..(293): n is a, c, g, or t
  misc_feature (467)..(467): n is a, c, g, or t
  misc_feature (471)..(471): n is a, c, g, or t
  misc_feature (497)..(497): n is a, c, g, or t
  misc_feature (506)..(506): n is a, c, g, or t
  misc_feature (521)..(521): n is a, c, g, or t
  misc_feature (524)..(524): n is a, c, g, or t
  misc_feature (533)..(533): n is a, c, g, or t
  misc_feature (708)..(708): n is a, c, g, or t
  misc_feature (711)..(711): n is a, c, g, or t
  misc_feature (729)..(729): n is a, c, g, or t
  misc_feature (740)..(740): n is a, c, g, or t
  misc_feature (745)..(745): n is a, c, g, or t
  misc_feature (766)..(766): n is a, c, g, or t
  misc_feature (776)..(776): n is a, c, g, or t
  misc_feature (796)..(796): n is a, c, g, or t
  misc_feature (801)..(801): n is a, c, g, or t
  misc_feature (809)..(810): n is a, c, g, or t
  misc_feature (813)..(813): n is a, c, g, or t
tgaatcgaagccaacgcaagcgagagcagcgacaacgaggagcgtctggaagaatggctcctcttgcccccaagactggagacgcagtnttcgccagcatcgatcatgtgaatgcgganctgttcacgctcacatacggggcnatggtacggcagctncttacggatctngangaggtagangaggtcaacaagcagctcgatcagatgggatanaacattggngtncgattgatagatgagttcctggccaaatccaatgtctctagatgtgttgacttcaaggagacagcngatgtaattgcaaaggtaggttttaaaatgttcctaggggtgactgcatctgtgaccaactgggatgctgagggaacaagtttcagtcttgtgctggaggataatcccttggtagactttgttgagcttcctgatactttccaaggtcttcactactgcaacatcttaagtggngttnttcgaggagcactggagatggtgtcnatgaagacngaagtcacttgggtncgngatatgctncatggagatgatgcatacgaactccgagtgaagcttctgaagcaggtcccggaggagtacccatacaaggatgatgagtaaactagatgcttagctaatgatctggtttgtgaacatctatgatccttcttatctccctcataagattctcatccttttcttgtcctgcacaccntangctatgtatatcgtctancaactattganttttntaaaactttaggaaaacaaanatgaattgtnaacttctgttgctggtgcantagtntgctattnnatnggaattgattccttgctaccaaagcatgaaaattttacattaataccaagcctttgtgatgcataatcacagtgtgactcattttctcagaattatcaaaagctgccactcaaaaaaaaag

SEQ ID NO: 3633 - DNA, 963 bp, Vitis vinifera
cttcatttgtagaagctactctctttaaacgaatcaagccattgaatcaacatcggctcagttctccatccccatattcgtcctttcacttctaactccagcttccatggctcccgctgctccaagatctggagatgcaatattcgctaacgttgagcgcgtgaatgcggaactgttcacactaacctatggtgcgatcgtgcgtcaactgcttacggatctggaggaggttgaagaagtcaacaaacagctcgatcaaatgggttataatattggaattcgattgattgatgagtttctagcaaaatctaacgtctccagatgcgtcgacttcaaggagacagctgaagcaattgcaaaggttggtttcaaaatgttcttgggggtcactgcatcagtgaccaattgggatgctgatggtacaagttgcagtcttgttttggaggataatccactggtagattttgttgagcttcctgatacttgtcaaggtctgtactactgcaacatcttgagtggagttgttagaggagctctagaaatggtgtcaatgaagactgaagtcacatggatccgtgatatgcttcgaggggatgatgcttatgagttgcaggtaaaacttctgaagcaagttccagaagaatacccttacaaagatgacgagtaagaagctagctagctttccttgatgttgatgagtacatgcagtgagatgttttattattgtcttctaacacaaatgattcctctttacagtttgaaagatttttgtttcatataaactgatccaattttagaagggttagtgattgatcgaaccaagccatacctatcacaatgaaatgcaaaagagaagtaaatagtagtcgcgaaatcatcctaataaatgatgtcttggttaggttaagtattaatttaggatgattttgttatggcctgaattctaaattgaattgattgttc

SEQ ID NO: 3634 - DNA, 931 bp, Vitis vinifera
agaagctactctctttaaacgaatcaagccattgaatcaacatcggctcagttctccatccccatattcgtcctttcacttctaactccagcttccatggctcccgctgctccaagatctggagatgcaatattcgctaacgttgagcgcgtgaatgcggaactgttcacactaacctatggtgcgatcgtgcgtcaactgcttacggatctggaggaggttgaagaagtcaacaaacagctcgatcaaatgggttataatattggaattcgattgattgatgagtttctagcaaaatctaacgtctccagatgcgtcgacttcaaggagacagctgaagcaattgcaaaggttggtttcaaaatgttcttgggggtcactgcatcagtgaccaattgggatgctgatggtacaagttgcagtcttgttttggaggataatccactggtagattttgttgagcttcctgatacttgtcaaggtctgtactactgcaacatcttgagtggagttgttagaggagctctagaaatggtgtcaatgaagactgaagtcacatggatccgtgatatgcttcgaggggatgatgcttatgagttgcaggtaaaacttctgaagcaagttccagaagaatacccttacaaagatgacgagtaagaagctagctagctttccttgatgttgatgagtacatgcagtgagatgttttattattgtcttctaacacaaatgattcctctttacagtttgaaagatttttgtttcatataaactgatccaattttagaagggttagtgattgatcgaaccaagccatacctatcacaatgaaatgcaaaagagaagtaaatagtagtcgcgaaatcatcctaataaatgatgtcttggttaggttaagtattaatttaggatgattttgttatggcctgaa

SEQ ID NO: 3635 - DNA, 892 bp, Euphorbia peplus
aggtttactgatcgatccttgttgttgatatttgcgatttggtgagttttgaattgggaatttgtgatttgaaaattgaattgttactcttcaagtggagttgtaattgttgagatctgcgagaaaaatgcctgctgctgctgggcctcgatccggagatgcaattttcgccagtgttgaacgtgtcaatgcggagctgtttacattgacctatggcgctattgtccgccagttgcttaccgatctcgaggaggttgaggaagtcaacaaacagcttgatcaaatgggttacaacattggaatccgacttgtcgatgagtttctagccaaatctaatgtcactcgatgtgtagactttaaggagacatgtgaagttattgcaaaggtgggtttcaaaatgttccttggtgtgagtgcatctgtgaccaattgggatgctgaaggaacatgctgcagcattattttggaggacaatcccttggtagaatttgtagagcttcctgatacatgccaaggcctatactactgcaatgtcttaagtggagtcattagaggcgcactggagatggtgtcaatgaagactgaggtaacatgggttcgtgatatgcttcgaggtgatgatgcatttgagttgcaggtgaaactggttaaacaagttccagaagaatacccatacaaggatgatgattaacaacctttattattcgtcttgtgtgatgtataccttaataatgacgtttgtcatgtttatgcgtaaaatacaatcttaacagtgtttcttggatacctgtttgaaacgtagaagatctgatttgctgtgagttattctgaaaaagtcaggaatgcagttcttcacagaaatatgtgttctggaatgcacttatgggatgtg

SEQ ID NO: 3636 - DNA, 812 bp, Cirsium arvense
ggtaattttagtttttgttggtggatctctttacgcctgaagtctgaacccccttcctgctcctcgccggctgttggaaagatccgtcgctccctcgaatacgaaacgaaactctccgtctgatacaccaaacgctgcctaatctctcaccgccggcgtcaagatcgataccactggatactgaagaaactgtgttcagaagcacgactgtattactacacaaactaacctaagacatcgatggctcctgctgttcctagatctggagatgcaattttcgctaacgttgagcgcgtgaacgcggagttgttcactctgacgtatggagcgatcgtgcgacaattgctgacggatctggaagaggttgaggaagtcaataagcagctcgatcaaatgggttataatatcgggattcgtctaattgatgagttccttgcaaaatctaatgtcaccagatgtgtggattttagggagactgctgaagtcattgcaaaggttggcttcaaaatgtttctaggggtcactgcgtctgtgactaattgggattctgagggaacgtcctgtagcctcattttggaggataatccacttgtagacttcgttgagcttccagacacttgtcaaggtttatattactgcaacatactaagcggagttgtcaggggagctctagaaatggtgtcgatgaagaccgaagtcacgtgggtgcgtgatatgcttagaggagatgatgcatttgagttgcaggtaaagcttctgaagcaagttccagaggagtacccatacaaagatgatgagtaagtaacatacat

SEQ ID NO: 3637 - DNA, 768 bp, Elaeis guineensis
cgagaccattgttctattgctataggcgtcaccaacaccagccgcagctccttttccctgcagctccgatggcccctctcgccccaaggaccggggatgcgatcttcgccaacgtcgaacgcgttaacgcggagctgttcaccctcacatatggggcgatcgtgcggcagctactcacggatctggaggaggtggaggaggtgaacaaggagctcgatcagatgggttataatattggagttcgattgattgatgagtttctagccaagtccaatgtatcaagatgtgttgacttcaaggaaacagccaatgttattgcaaaggttggtttcaaaatgttcttaggggtcactgcttctgtgaccaattgggatgctgagggcacaacttgcagcctcgttttggaggataatcccttggtagactttgtggaacttcctgatacatgccaaggtcttcactactgcaacatcttgagtggggttataagaggtgcattggagatggtgtcaatgaagactgaagtcgcctgggttcgggatatgctacatggtgatgatgcatacgagctgcaagtaaaacttgtaaagcaagttccagaggagtacccatacaaagaggatgactaacttgacactgtggagccaatagttcttttgatctcttaagcatcatttattttcgtgcttgtgatattagttctgccaacatttcgagacgtttccctttaacatgagatagaaagaaatggttatatgttattctttg

SEQ ID NO: 3638 - DNA, 840 bp, Lippia dulcis
tgggtaaaatgcgaagacggtgaatcagttcccaattacattctcttcgaagatctgaccgttgagaaatcatttcacaaatcccttccgatctctctctctctcatggctccagctgctcccaagtccggtgatgtgattttcgccagtgtagatcgcgttaacgcggagctctttactctgacatacggtgctatcgtgcgccaattgattaccgatctcgaggaggtggaggaggttaacaagcagctcgatcaaatgggttataatatcggggtccgtctggttgatgaattcctcgctaaatcaagcgtttcaaggtgtgtcgatttcagggaaacagctgatgtgattgctaaggttggattcaaaatgttcctaggtgtcactgcatctatcactaactgggatgcagaagggacaacctgtagtctcattctggaggacaatcctttggtagactttgttgagctgcctgatacctgtcaaggtcttcattactgcaatattttaagtggagttgtcagaggggctcttgagatggtctcaatgaaaaccgaggtcacatgggtgcgcgacatgcttagaggagatgatgtatttgagttgcaagtcaagcttctgaagcaagttcctgaggagtacccatacaaagatgatgaataacttacttcttttgctctcatgtgttatccttgtaccttccactcttcatttggacattttgcacctccttttggtctagctacattttgcacctccattcgtcatgtatgaatctaagacactctattaaatgattacaacatctggcagtggcggtgcttgagtccgtcaaca

SEQ ID NO: 3639 - DNA, 1045 bp, Platanus occidentalis
cattctctgcactcaggtcctgagtgcacacattggaaaacttcaaacgaaaaataaaataaaataattgaaaagaatcggacgtccttaaggagatgaccaaaataccccttttacagaattcgtgtcgcatcttcgcaggaaactgaacacccggcacttgtttaagaaaagttctcaatcggacttccatagttactaccgagcttcgaccagcagcagggcaggtatcatcatttccatggctcctctcgtcccaagatctggagatgcagttttcgccaatgtcgagcgtgtgaacgcggagttgtttaccttaacttatggggcgatggtacggcagctgcttacggatctggaggaggttgaggaagtcaacaagcagcttgatcagatgggttacaatattggaattcgactgattgacgaatttctagccaagtctggtgtctccagatgtgttgacttcaaggagactgctgaagtaattgcaaaggtggggtttaaaatgtttttaggggtcactgcatctgtgactaattgggatgctgatggaacaagttgcagtcttgttctggaggataatccattggtagattttgttgagcttcctgatacatgccaaggtctgcactactgcaacattttaagtggagtgatcagaggagccttagagatggtgtcgatgaagactgaagtcacatggatacgtgatatgctccgcggggatgatgcattcgagttgcgagtgaaacttctgaaacaagttccagaagagtacccatacaaagatgatgagtaatttgttattttggaaagcagttccatctatatgcagttattgtatttcctttcatgtggagtagtttcttgactgaaccaattgttggaaacctacattcttaaaggtcaaatattccaaacactttcaagagggaaattctgtcacgtcatttcgtaatataggagtgagtgacaaggattccattctaagcttggatttatttgacgcattggatgtatcttgaatttatttgtgttggtt

SEQ ID NO: 3640 - DNA, 855 bp, Persea americana
tgcttttggattccacagccctcaaattccgatccttctttcttccctctttcacatacacgcacagcaccaattccccttgggctcttacgtgagaggaattcgtttaaatctcattgtttcctaagcagtatcactcggtttttcgagtaaagcatggcacctctcgctccaagatccggagatgctgtcttcgccaacatcgagcgcgttaacgcagagcttttcaccctaacatatggcgccatcgtacgccaacttctgacagatctggaagaggtggaagaagtcaacaagcagctcgatcaaatgggctataacattggaattcggctgattgatgagttcttagcaaagtccaacgtctctagatgtgttgacttcaaggagacagctgaagtaattgcgaaggttggttttaaaatgttccttggggtcactgcttctgttaccaattgggatgctgacgggacaacttgcagtttggtcttggaggacaaccccctggtagactttgttgagcttcctgacacgtgccaaggtctttattattgcaacatcttaagtggagttgtcagaggagctttagaaatggtatcaatgaaaactgaagtcacatggattcgcgatatgctgcgaggtgacgacacatatgaactgcgagtgaaacttctgaagcaagttccagaagaatacccatacaaagatgacgagtagtattatacactgggttattttgcgtagatgatgtgatttatgtgcttttctttttgttaatcttcaaactagaacagctcaaacttttgatgatgagcttgacaaatttattgacacatatctaatcattacctaaat

SEQ ID NO: 3641 - DNA, 984 bp, Cucumis melo
tttctctgctccaaagcctttctgcaccgtgaccgcccttatcgtcggcatcggctacactcttcgctttccgaatcaattctccgggccaataagtacagcgttttcgaaaacttttctttgtgctcagctcacaattcagatccatcatgccgaccgctggtcctcgatctggtgatgcaatcttcgctagtgttgagcgagtgaatgcggagctgtttaccttgacttatggagcgactgtccgtcaattgcttacggatctagaggaggttgaggaggttaacaagcagctcgatcagatgggttataatattggaatcaggctgattgatgaatttctagcaaaatctaatatctctagatgtgtggacttcaaagagacagctgatgtgattgcaaaggttggtttaaagatgtttttgggagtgaatgcaacggtgaccaactgggatgctgaaggcacatgctgcagcattgttctggaggacaatccattagtagacttcgttgagcttcctgatacttgccaaggtctccattactgcaacattttaagtggagtaattagaggagcacttgagatggtgtcaatgaaaacagaagtaacatggctacgggacatgctgagaggagacgacagctttgaattgcaagtaaaattgctgaagcaagtccctgaagaatacccttataaagacgatgaatgaaatcacccaccaaagtcactcttagtttcacgtcatttcctcctgttctttctttctcttttcttttctttttttttttttttttttgttctgttcatttgctccagaaagagatagtgacgtttctaattccttcaaccatctaacatcgtaatcaaagttatattatatataacatgttttctattgtgatgggttaaaatgaattatatggtaaaataatttacagtcaataaagtcaatggccgggctgcatagattacactgtttcaac

SEQ ID NO: 3642 - DNA, 837 bp, Quercus alba
tgaaagtcgatgatgcgtcactgacactccaaatctggaaccaaaaacgcaacctctcaaagaaattattaaaagcgagactcagatcagatcagatctcactctcactctctcatcacatggctcctgttgctcctcgatccggcgacgcaatcttcgccagcgtcgaacgtgtgaatgcggagctgtttaccttgacgtacggtgcgatcgtgcgccagttgcttaccgatctggaggaggtcgaggaagtcaacaagcagcttgatcaaatgggttataatattggaattagactaattgatgagtttctagcaaaatctaatgttgccagatgtgttgacttcaaggagacagctgaagtaattgcaaaggttggttttaaaatgttcttaggggtcacagcatctgtaagcaattgggatgctgatggaacatgttgcagtattgttttagaagacaatcctctggtagactttgttgagcttcctgacacatgtcaaggtctatactattgcaatgtcttaagtggagtcatcagaggggccttagagatggtttcaatgaagacagaagttacatgggttcgtgacatgcttcgaggtgatgatgcatttgagttgcaagtgaaacttctgaagcaagttccagaggaatacccatacaaagatgacgagtaacatgtcaagctcttatgttatatgtatacaatttatgatttttgtttgttctttatttcccaatgtgtagaatgttggtagcttagcttctcttctaatgcacaaatctcgtgaacttaattaagccaattttatttcttaaatttatatgacactg

SEQ ID NO: 3643 - DNA, 1109 bp, Populus trichocarpa
ctcaattcgacaagaaccaaaaaaaaaaacaaataaaattagcgcagttaatgagttcttcgtcttcctactgaaagcagcaaagaaggacatcaccataaaaatcacacacttcagatctctttctcctatcggttaacacaatggctcctgttgctcctcgatccggagacgcaatcttcgctagcgttgagcacgtgaatgcggagttatttacgttgacttatggagcaattgtgcgtcagttgcttacggatcttgaagaagttgaggaagttaataaacagcttgatcagatgggttataatattggagttcgactgattgatgagtttctagcaaaatccaatgtttccagatgtgtggacttcaaggagacagctgatgtaatcgcaaaggttggattcaaaatgttcctaggggtaggtgcctctgttaccaactgggatgctgatgggacatgttgcagcattgttttggaagacaatcccctggtagactttgttgaacttccagacacatgtcaaggtctatactattgcaacatcttaagtggagtcgtaagaggggcactagagatggtgtcaatgaagactgaagtgacatgggttcgtgatatgcttcgaggtgatgatgcattcgagttgcaggtgaaacttctaaagcaagttccagaggagtacccatacaaggatgatgagtaacataattgggcttttggtgtgctctttatacagtttatgctctttatttctcgtctttatcttatgaagaacatagatttttcaacatattgtcttctactaatactcatttacatgaacgttaaatgcacttattttagtatttgtattctttcagcgagtacgattagacgtaaccaccggaatacttgattggttgttgtgtttggttgattttgtttatgttttgggagtgagtatatatatcagacaaccagccttgatggaaccatagcttcagttatcaccttcagtttatatataacagtgggctagtcgcgccaaatatccttgaaatattttgagactgatgtgaattgccaaggcagaagaatatgatggaaggaccgccataggcactcatgg

SEQ ID NO: 3644 - DNA, 867 bp, Euphorbia esula
  misc_feature (11)..(13): n is a, c, g, or t
  misc_feature (742)..(742): n is a, c, g, or t
ccgttgctgtnnnaaacagatccgtaaattaagaaaaagaaaaatccctggtttctcatttttggtttacctccttcttcatcgatccttgttcttcatatttgcgatttcctctcttctaattgcagttgcgatttcatctgttttgaattgcggtttcttcccaatttcttctgacttctcatttccttgcatagaagaaaatcctttgagcacttgtaattgttcggatctctcacgaaaatgcctgctgctggccctcgatccggtgatgcaattttcgccagtgttgaacgtgttaatgcagagctgtttacattgacctatggcgcaattgtgcgccagttgcttacggatctggaggaggttgaggaagtcaacaaacagctcgatcaaatgggttacaacattggaattcgactggtcgatgagtttctagccaaatctaatgtcactagatgtgtagactttaaggagacatgtgaagtaattgcaaaggtgggtttcaaaatgttcctgggtgtgagtgcatctgtgaccaattgggatgctgaaggaacatgctgcagtattattttggaggacaatcccttggtagaatttgtagagcttcctgatacatgccaaggcctatactactgcaatgttttaagtggagtcattagaggggccctggagatggtgtcaatgaagactgaggtaacatgggttcgtgatatgcttcgaggagatgatgcatttnagttgcaggtgaaactggtaaaacaagttccagaagagtacccatacaaggatgatgattagcaacctttattatttgtcttgtgtgctttgtaccttaataatgacattacttaggttatgctt

SEQ ID NO: 3645 - DNA, 791 bp, Bupleurum chinense
aacagtcatggctcccgtagctcccaaatctggtgatgcaattttcgctaatgtcgatcgagttaacgctgagcttttcactttaacatatggtgcaatcgtaaggcaactgcttacggatctcgaggaggttgatgaagtgaacaaacagcttgatcagatgggttataatattggaatccgtttaattgatgagtttctcgcaaaatcaaatgtttccacatgtgtggattttaaggaaactgctgaagtgattgcgaaggttggtttcaaaatgttcttaggggtcactgcgtctgtgactaattgggatcccgagggaacaacttgtagtattatattggaggataacccattggtagactttgtggagcttcctgatacttgtcagggtctttcctactgcaatattctaagtggagttgtcagaggagcactagagatggtgtcaatgaagaccgaaatcacatgggctcgagatatgcttagaggagatgatgcttatgaattacgcttgaagcttataaaacaagttcctgaggagtatccatacaaagatgatgagtagcaatctttacctcaagaatcacgtattgcattttagtttgaacctgcatcaccaaaatgctgaaaagcatgtaactcagttatatgaaattacaaacatagtgtttctttcatcttagtaactttttttttaacttgttagtaaatttgtcgcacttcttgtataattgttgatgatctaatcctttcggagcagatcatttatccaacatgttggcaacatg

SEQ ID NO: 3646 - DNA, 765 bp, Cirsium arvense
cgggggccaaacggagtacgtacaatcccttgacgatcttggctgccggcatccagattgatcaataagacgaaactaggaggactgtcttactactacacaactaaccttaatggctcctgctgttcctagatctggagatgccatttttgctaacgtcgagcgcgtcaactctgagctcttcactcttacatatggagccatcgtccgacaattgcttacggatctggaagaggttgaggaagtcaataagcagctcgatcaaatgggttataatatcgggattcgtctaattgatgagttccttgcaaaatctaacgtcaccagatgtgttgattttagggagactgctgaagttatcgcaaaggttggcttcaaaatgtttcttggggtcactgcgtctgtgactaattgggatgtggagggaacgtcttgtagcctcattttggaggacaatccacttgtagacttcgttgagcttccagacacttgtcaaggtttatattactgcaacatactaagcggagttgtcaggggagctctagaaatggtgtcgatgaagaccgaagtcacttgggtgcgtgatatgcttagaggagatgatgcatttgagttgcaggtaaagcttctgaagcaagttccagaggagtacccatacaaagatgatgagtaagttacatacatctatgtatttctttctcttcaataaactatatacacacatagatattggttatggtatttggttataatgattgatatgtt

SEQ ID NO: 3647 - DNA, 1081 bp, Cucurbita pepo
ggagttgaaactattctttgctccaaatccttttggatccatcacacagttttcatccacttcgcatattggaaccgcgattaccgtcggcgtcggccacactcttcgctcccggtatcaacttccgtcttcgatcgccggaactcggtaaccagcaaagcgtctactaaacgttcctttgaattcatatcaatcatgcctaccgctggtcctcgatctggtgatgcaatcttcgctagcgttgagcgagtgaatgcggagctgtttaccttgacttatggagcaactgtccgtcaattgcttacagatctggaggaggttgaggaggttaacaaacagctcgatcagatgggttacaatattggaatcaggctgattgatgagtttctagcaaaatctaatatctctagatgtgtggacttcaaagagacagctgacgtgattgcaaagatcggtttaaaaatgtttttgggagtgaatgcaacggtaaccaactgggatgctgaaggcacatgctgcagcattgttcttgaggacaatccattagtggactttgttgagcttcctgatacttgccagggtctacattactgcaacatcttaagtggagtcattagaggagcccttgagatggtgtcaatgaaaaccgaagtaacatggctacgtgacatgctgagaggagacgacagcttcgaattacaagtaaaattgttgaagcaaatccccgaagagtacccttacaaagatgatgaatgaaatatctccctatctcttgtgagaaccatttagatgcgccggtccaaacacgtgactcatgtgtgtaagaaaataaactgttttttttttttttcacagcaaaatttggttctttctaaacagtaatggaagctatcgtcttatcaagttggagaacggtaggagtagagggaatttcctttctttactagttaattcgatattgtttattgttcctttccatatggatattaacgtcgtcgtcttgactacttttcgttgttgggttagttcgaaccaaccaacgtccttattagaaattggaatgaagtggaacgagaatatc

SEQ ID NO: 3648 - DNA, 878 bp, Flaveria ramosissima
ccctaatccgttatatgaaaccctaattccatactcagactcttgaatcttataattctggtgtagtaccggagttcgattttatctccgacgaattaagatagattctagagaagacatactatttgtgtttggttgcatcgtgtatcggtagctaactaaccaaccgtagaccttcaatggcccctgctgttccaagatctggtgatgctatatttgccaacgttgagcgagtgaatgctgagttgtttactctgacttatggggcaatagtgcgacaattgcttacggatctggaagaggttgaggaagtcaataagcagctcgatcaaatgggctataacattggaatccggctgatcgacgagtttcttgcaaaatctaatgtcacaaggtgtgttgagtttagggaaaccgctgaagtcattgccaaggttggcttcaagatgtttttaggggtaaccgcctctgtgactaactgggatacagaaggaacttcatgcagtctcattttggaggataacccgcttgtcgattttgttgagcttccagacacatgccaaggtttatattactgcaacattctaagtggagtcattaagggagctctagagatggtgtcgatgaagactgaagtcacttgggtcagggatatgctaagaggagatgatgccttcgagttacaggtgaagcttcttaaacaagttccagaggagtatccttacaaagatgacgagtaacgtgttttctttgatctttatgaatgtatatacaatatgattttcgcattttcgtttggtttgtaataaattaataatgtcttcactactttgtcctacgttttatcatgctagaacatgttttgtttcctccacctg

SEQ ID NO: 3649 - DNA, 966 bp, Flaveria ramosissima
cgtcaatcgcaggtgagatcggtagatttcgaccctagcgactaaccaaatcgaatcgctttgctgattgcgatccagagaaggggcgatatttctcgctcagatagattttgtagcaagacctgcaaactgtgttcaattgcacgctgtattgctagctaatcaaccaacagtagaccttcaatggctcccgcagttccgagatctggtgatgctatattcgccaacgtcgaacgcgtgaatgctgagttgttcactctgacgtatggggcaattgtgcgacaattgcttacagatctggaagaggttgaggaggttaataagcagcttgatcaaatgggttacaacattggaatccggctaattgacgaatttcttgcaaaatctaatgtcacgagatgtgttgattttagggaaaccgctgaagtcattgccaaggttggattcaagatgtttttaggggtaactgcatctgtgactaactgggatacagagggaactagttgcagtctcattttggatgataacccgcttgtagactttgttgagcttccagatacctgccaaggtttatattattgcaacattttaagtggagttgttaggggagctctggagatggtgtcgatgaagacggaggtcacatgggtcagggatatgcttagaggtgatgatgcattcgagttacaagtgaagcttcttaaacaagttccagaggagtatccatacaaagatgacgagtaacgtgtttttaatctctattgatgtatatacaatatgatttttcgcatttctgttttggcttgccataaattaagaatacatctttagtactttgtcctaagtttgtcatgctagaataacatagttttgttcctcacctgggagtgttgtctgtaattcgaggattcggatagaactattattattagtattataagtattgttggtatgttgtcttggtac

SEQ ID NO: 3650 - DNA, 792 bp, Flaveria ramosissima
acgcttggatcttataatctggtgttgtaccggagttagattatatctgcgacgaattaagattctagagaaggcatacaactagagttcggttgcttcgtgtattgctagctagctaaccaaccatagaccttcaatggctcccgcggttccaagatctggtgatgctatatttgccaatgttgagcgtgtgaatgctgagttgttcactctgacttatggggcaatagtgcgacaattgcttacagatctggaagaggtcgaggaagtcaataagcagctcgatcaaatgggctataacattggaatccgactaatcgacgagtttcttgcaaaatctaatgtcacaagatgtgttgattttagggaaaccgctgaagtcattgccaaggttggcttcaagatgtttttaggggtaactgcatctgtgagtaactgggatagcgaaggaacttcctgcagtctcattttggaggataacccgcttgtcgactttgttgagcttccagacacctgccaaggtttatattactgcaacattttaagtggagttgttaggggagctctagagatggtgtcgatgaagactgaagtcacttgggtcagggatatgctaagaggagatgatgcattcgagttacaggtgaagcttcttaaacaagttccagaggagtatccttacaaagatgacgagtaacatgtttccttgatctttaatgatgtatatacaatatgattttgcattttggtttggtttgcaataaactaataatgtcttcactactttgtcct

SEQ ID NO: 3651 - DNA, 1131 bp, Phalaenopsis aphrodite
tttgggttgagtttagttctatactttatttttgttgaataaaaatctgacggtgtcgccgtcgtccaaatccacccaacgatctcaccgccgattaaaggcttactcctccttgctatcccactacgatccggcttctcattttgacatggctcccgtcgttccgaggtccggcgacgcagtcttcgcgaacgttgagcgcgttaatgcggaacttttcactctcacgtacggggccatcgttcggcaactgctcacggatctggaggaagtggaggaggttaacaagcagctcgatcagatgggctataacattggagtccgtttgattgatgagtttctagccaagtcaaatacttccagatgtgtagacttcagggaaactgcagaagtgattgcaaaggttggtttcaaaatgttcttgggtgttactgcaacagtaacaaattgggatgttgagggtaccagttgcagccttgtgctggaggataacccacttgttgaatttgttgagcttccagactcttgccaaggcctttattactgtaatatcttgagcggaattattaggggagcgttggagatggtgtccatgaaaactgaggtcacttgggtacgagatatgctgcatggtgatgatgcgtatgagctgcgactgaaacttataaaacaagttccagaggaatacccatacaaggatgacgagtaaatagatttgctagattaaagttgcttactgtaaaacacagaggatctttttttatttatttcttaaatctaattttcaaagtaatgtctgcaatatgaattaaaaacaattatttttcttcgcttaccatcattgtaatcatttgcccgatcgcttgggtcataaactcaagacttaagagcacagtgaaaaagttgcaaaatcggcgacgccatcgccctttgccgccaacctcttagagagaaacagagaagtgcagaaacccttgaaaattttgttcgatcacttctctcaggactaatcgatcaatggagttcttcgtcttggctcgggaatctcgagccaagacagagggcaggttgctaccaaacgaagaatcgactaactaaaccctaaagaatatctccgtctcttcactaccc

SEQ ID NO: 3652 - DNA, 966 bp, Papaver somniferum
aaaatttgggaggaaattcatttgcagagcaactgaacagagaagtagatcagaattttgttatccagctgattgattgtctttgaagatctcgacttaacgaattttcggatggctccggttggtccaagatctggagatgcaattttcgctaatgttgaacgtgtgaatgcggaattgtttagcttaacttatggagcaatggtaagacaattacttaccgatttagaagaggtagaggaagttaacaagcagcttgatcagatgggttataatattggaattcgactaattgacgagtttcttgcaaaatccaatgtttctagctgtgctgacttcaaggaatctgctgatgtaattgcaaaggttggttttaagatgttcttaggggtcactgcaactgtggccaattgggatgctgatggaacaagttgcagtctcatcctggaggataacccccttgtagactttgttgagcttcctgatacatgccaaggtctatattattgcaatgtccttagcggagtcatcagaggagctctagaaatggtgtcaatgaagactgaagtcacatgggttcgtgatatgttgcgcggagatgatgcatacgagttacgagtgaagcttctgaagcaagttcctgaagagtacccgtacaaagatgatgagtaacttctgacggtatgcataagtaatttcattttcttgtgcaatgttaaaaaaaaaaatctccaaatcatcagaagtttttatacttttgctctttgctcgtaatgatttctgcacaaacaagctctcttagaaaccttactagaattgtggtttttgggtgtttaacgtcctactttagtagcaaacatcaattgtttctgtgtctttaaagtccatttgtttcactaaatttactgtgtaggattgaaccagatcagttgataaaagttcttgtgattgccgaaaaaaaaaaaa

SEQ ID NO: 3653 - DNA, 982 bp, Papaver somniferum
tgacaaaccgggaattggaaaatatagggctacagaggaaaatttgggaggaaattcatttgcagagcaactgaagagagaagtagatcataattttgttatccagctgttgattggctgtgaagatctagactttacgaattttcggatggctccggttggtccaagatctggagatgcaattttcgctaatgttgaacgtgtgaatgcggagttgtttagcttaacttatggagcaatggtaagacaactgcttaccgatttagaagaggtagaggaagttaacaaacagcttgatcagatgggttataatattggaattcgactaattgacgagtttcttgcaaaatccaatgtttctagctgtgctgacttcaaggaatctgctgatgtaattgcaaaggttggttttaaaatgttcttaggggtcactgcaactgtggccaattgggatgctgatggaacaagttgcagtctcatcctggaggataaccccctggtagactttgttgagcttcctgatacatgccaaggtctatattattgcaatgtccttagcggagtcatcagaggagctttagagatggtgtcaatgaagactgaagtcacatgggttcgtgatatgttgcgtggagatgatgcatacgagttacgagtgaagcttctgaagcaagttcctgaagagtacccgtacaaagatgatgagtaacttctgacggtatgcattagtaatttcattttcttgtgcaatgttaaaaaaaaaatgtctccaaatcatcagaagtttttatacttttgctctttgctcgtaatacacaaacaagctctcttagaaaccttactagaattgtggtttttgggtgtttaacgtcctactttagtagcaaacatcaattgtttctgtgtcttttaagtccatttgtttcactagatttactgtgtaggattgaaccagatcagttgataaaagttcttgctattg

SEQ ID NO: 3654 - DNA, 929 bp, Silene vulgaris
aaagaggaagaactcaaccaaaattaaataaaattactataaatctgtaaaaatgcctgcaattgctccacgatctggggaagcgatctttgcaagtgctgaacgtgttaatgctgaattgttcactttaacttatggagcaatagttcgtcaacttctgacagatcttgaagaggttgatgaagttaacaaacagcttgatcttatgggttataatattggcattcgtctaattgatgagtttctagctaagtccaatgtgtcgagatgtgtggacttcaaggagactgcagaagtaattgctaagattgggttcaaaatgtttttgggggtgaccgcaaccgtcactaactgggatcaagatggaactacttgcagcttggtacttgaggacaatcctttggtagattttgtcgagcttcctgacacttgccaaggtcttcactactgcaacgttttgagcggtgttatcagaggagccttggagatggtatccatgaagacggaagtgacttgggtcaaagatatgctacacggtgatgatgcatacgagttgcaagtcaaacttctgaagcaagttcctgaagaatacccatacaaggacgatgagtaacaaacttgctgatgtcatttgtcagtttcgagaatgctgctagattctcatcctgcaatcatttttccgagtgaataatgaatgtaggagaagaagaagctctcttcggttagataaacctgtattattgacaagttggcgtgccccaaatttgtttaccatatcgttttcattgcaatggataatgtattcgttttttagtaaatcagtagtctcttgtcacattgtataggctctgcctgtgcactagtttgctgtataatgatcattatcccttgtgttaagtaaacccttataatgctgatgcctttttatt

SEQ ID NO: 3655 - DNA, 776 bp, Centaurea maculosa
  misc_feature (27)..(27): n is a, c, g, or t
  misc_feature (29)..(29): n is a, c, g, or t
  misc_feature (50)..(50): n is a, c, g, or t
  misc_feature (52)..(52): n is a, c, g, or t
  misc_feature (585)..(585): n is a, c, g, or t
gatcttcgctgccggcatccagattantnaataccagtgaggaaacgaancnaggactgtcttactatggctcctgctgttcctagatctggagacgccattttcgctaacgtcgagcgcgtcaactctgagttgttcactcttacatatggagccatcgtccgacaattgcttacggatctggaagaggttgaggaagtcaataagcaactcgatcagatgggttacaatatcgggattcgtctaattgatgagttccttgcaaaatctaacgtcaccagatgtgttgattttagggagaccgcggaagtcattgcaaaggttggcttcaaaatgtttctaggggtcactgcgtctgtgactaattgggattcggagggaacgtcttgtagcctcattttggaggataatccacttgtagacttcgttgagcttccagacacttgtcaaggtttatactactgcaacatactaagcggagttgtcaggggagctctagaaatggtgtcgatgaagactgaagtgacgtgggtgcgtgatatgcttagaggagatgatgcatttgagttgcaggtaaagcttctnaagcaagttccagaggagtacccatacaaagatgatgagtaagttagatacacatctatgtatgtcttcctcttcaataatatatacatatatatgtctatgtagtttcttggttatggatttggttacaatgatttatatgttataatttgttcgtattattgatatggaatttgatgcttcatttctta

SEQ ID NO: 3656 - DNA, 797 bp, Castanea mollissima
caaaaacgcaacttctcaaaataattattaagagcgagactcagatcagatctcactctcactctcacatcacatggctcctgttgctcctcgatccggcgacgcaatcttcgccagcgtcgaacgtgtgaatgcggagctgtttaccttgacgtacggtgcgatcgtgcgccagttgcttaccgatctggaggaggttgaggaagtcaacaagcagcttgatcaaatgggttataatattggaattagactaattgatgagtttctagcaaaatctaatgttgccagatgtgttgacttcaaggagacagctgaagtaattgcaaaggttggttttaaaatgttcttaggggtcacagcatctgtaagcaattgggatgctgatggaacatgttgcagtattgttttagaagacaatcctctggtagactttgttgagcttcctgacacatgtcaaggtctatactattgcaatgtcttaagtggagtcatcagaggggccttagagatggtgtcaatgaagacagaagtttcatgggttcgtgacatgcttcgaggtgatgatgcatttgagttgcaagtgaaacttctgaagcaagttccagaggaatacccatacaaagatgacgagtaacatgtcaagctcttatgttatatgtatacaatttatgatttttgtttgttctttaattcccaatgtgtagaatgttggtagcttagcttctcttttaatgcaaaaatcttgtgaacttaattaagtcaattttatttcttaaatttatatgacactgttataa

SEQ ID NO: 3657 - DNA, 714 bp, Papaver somniferum
atttggggaggaaattcatttgcagagcaactgaacagagaagtagatcagaattttgttatccagctgattgattgtctttgaagatctcgacttaacgaattttcggatggctccggttggtccaagatctggagatgcaattttcgctaatgttgaacgtgtgaatgcggaattgtttagcttaacttatggagcaatggtaagacaattacttaccgatttagaagaggtagaggaagttaacaagcagcttgatcagatgggttataatattggaattcgactaattgacgagtttcttgcaaaatccaatgtttctagctgtgctgacttcaaggaatctgctgatgtaattgcaaaggttggttttaagatgttcttaggggtcactgcaactgtggccaattgggatgctgatggaacaagttgcagtctcatcctggaggataacccccttgtagactttgttgagcttcctgatacatgccaaggtctatattattgcaatgtccttagcggagtcatcagaggagctctagaaatggtgtcaatgaagactgaagtcacatgggttcgtgatatgttgcgcggagatgatgcatacgagttacgagtgaagcttctgaagcaagttcctgaagagtacccgtacaaagatgatgagtaacttctgacggtatgcataagtaatttcattttcttgtgcaatgt

SEQ ID NO: 3658 - DNA, 1341 bp, Fragaria vesca
tgtattaagagattatgaacgtgtatttaaaatttcaatgagaggaaaaacaaacaggaaatctcaactctcacagtacacaagctttggctctaagtttctactctcccttcatttccgatttcattctccgactgagctctctgaattttgatccctcgatctccgaaactttgaagttctcactctcgagctcagatcgcgatgcctcctgttggtccccgatccggcgatgcaatcttcgccaacgtcgagcgcgtgaatgcggagctgtttacgttgacctatggtgccattgtgcgccagctgctcactgatcttgaggaggttgaagaggtcaacaagcagcttgatcagatggggtataatattgggattcgcctaattgatgagtttctggcaaagtctaatgtttctagatgcgtcgactttaaggagacagctgaagtaattgcaaagattggcttcaaaatgttcttgggggtcactgcatctgttacaaattgggatgctgatggaacatgctgcagtattgttctggaggacaatccgctagttgactttgttgagcttccagatacttgtcagggactttactattgcaacatcttaagtggagtcgtaagaggtgccttagaaatggtgtctatgaaaactgaaatcacctggatccgggatatgcttcgaggtgatgatgcattcgagttgcaagtgaaactcctgaagcaagttccagaggagtacccgtacaaagatgatgagtaaaatgtttgctatatgtacacagttatgatatttggcccccttctctccttgaaaatgttacaactttttcctcttttccggacacatgtgtacaacattaaataggcaacttcattttgttagtcactacactttccatttttctattggttctgagcctttcgttcttgtctggggttggtaattagtacttagaagttagaagactgaatgctcttgtgttggcccaaataaatgcatcgatgttttgggttaaactggttgaattcccagtgatttgatctatatgttttatttgtggagatatatatattttgaccgggagaattgcagacatggttgccttcatctatttgggatatagatgcaatggggaatactataacaggggtgctgaagttgagctacagagttagcctcttggcttgcagacccgattatcagggcgggtcctgaaggatccaaggcccagtgtggattttttcggggttccaaacctagtcaagtgtaatgttatgaggctcatcctcacgcctgaattttttttattgatatgctaaaacatgatacaatgga

SEQ ID NO: 3659 - DNA, 979 bp, Triphysaria pusilla
catccttcggcttcaggcataattctcacctcactcgactctattcacaagtcgcaactaaatctagggatctaatctatcgctttccctttaccatttttcatggctccgaccgcccccaaatccggcgatgccattttcgccagtgttgaccgcgtgaatgcagagctgttcactcttacttacggcgccatcgtacgccagctgctcaccgatctggaggaggtggatgaagtcaataagcagctcgaccaaatgggttataatatgggggtccgtcttgtagacgagtttcttgcaaaatctaatgtgtcgagatgtgtcgattttagagaaacagctgaagtcattgccaaggttggattcaaaatgttcctaggagtcactgcatctgtcactaactgggactcagaaggcacaacatgcagtctaattttggaggataatcctttggtagactttgttgagcttcccgacacctgtcaaggtcttcactattgcaacattttgagtggagttgtcagaggagctcttgagatggtgtcaatgaaagctgaggtgacatggctgcgtgacatgcttagaggagatgatgtgttcgagttgcaggtgaaacttctcaaacaaattcctgaagaatacccttataaagatgatgagtaaacacgcttcctttgctatcaagtacctatgatattttatccttgtaatttctcttccgtttggatctttttgtacgccctctagtttatttggtagcgagtgttagccaggtatcaaatagacttcaaaacgtgaaataataccttgagttttctcgatcctgcaaaccaaccacccgacattcctaccagtctactacagctcagttctattcccctcgttttaagtgtttatcatctgggaaactttagaagaaaaaaatgtcaatttaagattttatctatgtcgattaaaatgataaacccatatttcctgt

SEQ ID NO: 3660 - DNA, 887 bp, Rosa hybrid cultivar
gccagtggaagtccccaacaaagcttggctctaaatttcttctctcccaatcttttccatttccgatttctttctccgactggatctccgaaaaacctttgaagttgtcactgtcgagctcagatcgccatgcctcccgttggtccccgatccggtgatgcaatcttcgctaacgtcgaacgcgtgaatgcggagctgtttactttgacctatggtgccattgtgcgccagctgctcactgatcttgaggaggttgaagaggtcaacaagcagcttgatcaaatgggctataatattgggattcgtctaatcgatgagtttctagcaaaatctaatgtttctagatgcgtcgacttcaaagagacagctgaagtaattgcaaagattggcttcaaaatgttcttgggggtcacagcatctgttacaaattgggatgctgatggaacatgctgcagtattgttctggaggacaatcctctggttgattttgttgagcttccagatacttgtcaaggactgtactactgtaacatcttaagtggagtcgtacgaggtgccttagaaatggtatcaatgaaaactgaaatcacctggatccgggatatgcttagaggtgatgatgcattcgagttgcaagttaaactcctgaagcaagttccggaggagtacccgtacaaagatgatgagtaatatgtttgctatatgtacacagttatgatatttggtcctcttctttccctgaaaatcaaatgttacagttgtttcctctttttcgtacacatccatgtagaacattaaatagatgacttcgtgttgttagtcactacaacttttatgctttattgattctgagcctttctttgttgtcaaaaaaaaaaaaaaaacta

SEQ ID NO: 3661 - DNA, 992 bp, Momordica charantia
ggaaggtttcctttccatccactttctcacaccggaaccgccttcgccgtcggccgcgatcttcgtttaccgactcagtttccgtcatccgatcgccggaactcgacgactggcacagcgtctggggaaaacactcctttgagctcagttcggatcaatcatgcctcccgctggtcctcgatctggtgatgcaatcttcgctagcgttgagcgagtgaatgcggagctgtttaccttgacttatggagcaactgttcgtcaattgcttacggatctggaggaggttgaggaggtcaacaaacagctcgatcagatgggttataacattggaatccgactgatcgatgagtttctagcaaaatctaatatctccagatgtgttgacttcaaagagacagctgaagtaattgcgaaggtgggtttaaaaatgttttgggtgtgaatgcaacggtgaccaactgggatgctgaaggcacctgctgcagtatagttctggaggacaatccattggtagactttgtagagcttcctgatacttgtcaaggtcttcattattgcaacatcttaagtggagtcattagaggagcacttgagatggtgtcaatgaaaacagaagtgacatggctacgcgacatgctgagaggagacgacacgtttgaactacaagtaaaactcctcaagcaagtccctgaagagtacccctacaaagacgacgagtaagcaatttccatatctacgtaaaagaataactcttattttactagttttgcttcctgtctgtgttcatttggtctgaaaaagatagctatattctctgattccttgaaccaacttttaatcttaatcccaagttatatatatagtctttttgctatttgtagtttcttatgaatggatttatgtcttttataggccaaatataccaaatagtctatcatctttaagcttattaccaaggtaaattcaacaaggggtaattcacaccgtcaaag

SEQ ID NO: 3662 - DNA, 699 bp, Eschscholzia californica
agatctggagatgcaatttttgccaatgttgaacgtgtgaatgccgagttgtttaccctaacttatggggcaatggtacgacaattgcttacagatctggaagaggtggatgaagtcaacaaacagcttgatctaatgggttataacattgggattcgactaattgatgagtttctagcaaagtctaatgtctctagatgcgtggacttcaaggattctgccgatgttatcgccaaggttggtttcaagatgttcttaggggtcacagcaactgttaccaactgggatgccgatggaacaagctgcagtcttgtgttagaggaaaacccacttgtagattttgttgagcttcctgatacatgtcaaggtctgtattattgcaatgtccttagcggagttatcagaggagcactagagatggtatcaatgaagactgaagtgacatgggttcgtgatatgttgcgtggagacgatgcatatgagttacgtgtaaaacttctaaagcaggttcctgaagaatacccatacaaagacgatgagtaacttgacctgatggattgataacttgatgtatatgcagtttaagatttttgttttccttagattcaaatcttacaacttaagctattaatgactctacaaaaactagttctggtgaaatcttcttgaatgtaatttgtatttgtataaccttcctta

SEQ ID NO: 3663 - DNA, 842 bp, Triphysaria pusilla
tgccgaatacatttacacaaataaatcttccaatctttctatcttctcagcaggcttagcttcaagttccagatcggaattctcagctcaagcgttttggaccttctctcatggctccagcagcagctcccaaatccggcgatgcgattttcgccagtattgaccgcgtgaatgcagagctgtttactcttacatacggcgctatcgtgcgccagctgctcactgatctggaagaggtggaggaggtcaataaacagctcgatcaaatgggttataatatgggggtccggcttgtagacgagtttcttgcaaaatctaatgtgtcgagatgtgtcgattttagggaaacagctgaagtcattgccaaggttggattcaaaatgttcctaggtgtcactgcgtctgtgactaactgggactcagaaggcacgacatgcagtctaattctggaggataatcctttggtagactttgttgagcttcccgacacctgtcaaggtcttcactattgcaatatcttgagtggagttgtcagaggtgctcttgagatggtctcaatgaaaactgaggtaacgtggctgcgtgacatgcttagaggagacgatgtgttcgagttacaggtgaaacttctcaaacaaattcccgaggagtacccttataaggatgacgagtaatcacgcttttcctttgctatcaagtacttatgatattttatccttgtaatttctcttctgtttgggtcttttgcatgtcctctggtttatttagtagtgagtgctacccagttatttgacgtggaacgttttgccaacacacaaaaatgataaaaaaaaaaaaaaaaa

SEQ ID NO: 3664 - DNA, 922 bp, Malus domestica
ttttttgtaatttgcacagaaaccttcaaacttctcagtctcagctcagatcaccatgcctccagccggccctcgatctggtgacgcaatctttgccaacgttgaacgtgtgaatgcggagttatttacgttgacgtatggtgcaattgtgcgccagctgctcacggatcttgaggaggttgaagaggttaacaagcagcttgatcaaatgggctataatattggcattcgattaattgatgagtttctagcaaaatctaatgtatctagatgtgttgacttcaaggagacagctgaagtgattgcaaaggttggtttcaaaatgttcttgggggtcaccgcatctgttacaaattgggatgctgatggaacatgttgcagtattgttctggaggacaatcctctggtagactttgttgagcttccagatacttgccaaggtctttactattgcaatatcttaagtggagttgtaagaggggccttagaaatggtatcgatgaagactgaaatcagttggatccgtgatatgcttcgaggagatgatgcattcgagttgcaagttaagctcctcaagcaaattccagaagagtacccgtacaaagatgatgagtaaaatgcttgcacagcgtagcctgagatgtaaactgttttattccttgaaatcaaatgttatgtatttagtatgcattcgcgggcacattgaatagataaccgtgtgtttctttaccctccgttaggttttaccattccgatgaaccatggaaacgactaaatgtgcaatttacatgttttgtgactctcaaccatatttttctttcatgtaatgggttgtaagaaaaacatgtatgttttcaggaaagtgtattgtaacgtgaactaacaatgcattattttactgaaccagaaagtttgtcatcaa

SEQ ID NO: 3665 - DNA, 867 bp, Arnica chamissonis
ctcgatctgagttttgatctacggcggagagagtccaaagagctcgatcatcgaagatcaagtgtagaacggagttcagattatagagaagaccttcaagctgtgtttaattgcacgctgtattgctagcaactaaccaaccatagaccttcaatggctcccgccgttccaagatctggtgatgctatatttgccaatgtcgagcgcgtgaacgctgagttgttcactctgacttatggggcaatagtgcgacaattgcttacggatctggaagaggttgaagaagtcaataagcagctcgatcagatgggttataacattggaatccggctaatcgatgaattccttgcgaaatctaatgtcacaagatgtgttgattttagggaaaccgccgaagtcattgccaaggttggcttcaagatgtttttaggggtaactgcatctgtgactaactgggatacagcgggaacttgttgcagtctcattttagaggataacccgctcgtagactttgttgagcttccagacacatgccaaggtttatattactgcaacattttaagcggagttgttaggggagctctagagatggtgtcgatgaagactgaagtcacatgggtcagggatatgcttagaggagatgatgcattcgagttacaggtgaagcttctcaaacaagttccagaggagtatccttacaaagatgacgagtaacgtgttattgtttatacgatatgatttttgcatttctgttttggtttgtaataaatcaataatttgtctttagtactttgtcctatgttttatcatgatagaacatgttttgtttcctccacctaggagagtgtttctgtgatttgaggattt

SEQ ID NO: 3666 - DNA, 756 bp, Euonymus alatus
ccatttgtgcatccgacagagcagaattaggcatcagatcccactcaaagcttagcaccgtccaaagatctctgtgatgcctcctgttgctcctagatccggtgatgcaatcttcgccagcgttgaacgcgtgaatgcggagctgtttacgttgacttatggggcaattgtccgtcagttgcttacggatctggaggaagtcgaagaggtcaacaagcagcttgatcaaatgggctacaatattggaattaggatgatagatgagtttctagcaaagtcaggtgtttcacggtgtgttgactttaaggagactgcagaagtgatagcaaaggtgggtttcaaaatgttcttaggggtcactgcatctgttaccaattggaatgctgatgggacatgctgcagcatcgtttttgaggataatcccctggtagagtttgttgagcttcccgacacatgtcaaggtttaaactattgcaacatcttaagtggagtcgttaggggagccctagaaatggtatcaatgaaaacggaagtaacatggacccgtgatatgcttcgaggggatgatgcatttgagttacaggtgaaacttataaaacaagttccggaagaatatccatacaaggatgatgagtaaacatttaacgctccttgccttttgatctgtaaatactatacattgtgttaatttctgtgttactttcgtcgaaaaacaaaatgaattcacttttcttcctttaatgcagaatattgagg

SEQ ID NO: 3667 - DNA, 626 bp, Euphorbia peplus
cactcacaaaattatacataaaagaacaccaattcctttctgcaattcaatacttcggatctctcataaaaatgcctcctcctggtccccgatccggtgatgcaattttcgccagcgttgaacgcgtgaatgcggagctctttacattgacctatggcgcaatcgtgcgccagttgctaacggatctggaggaggtcgaggaagtcaacaaacagctagatcaaatgggttacaatattggaattcgactggtcgacgagtttctagcaaaatctaatgtcacaagatgtgtagactttaaggagacggctgaagtaattgcaaaggtgggttttaaaatgttcctcggggtgagtgcatctgtgaccaattgggatgcagaagggacatgctgtagtattattttggaggacaatcccttagtagaatttgtagagcttcctgatacatgccaaggtctatactactgcaatattttaagtggagtcattagaggggcactagagatggtgtcaatgaagactgaggtaacatgggtccgtgatatgcttcgaggtgatgatgcatttgagttgcaggtgaaactcgtaaaacaagttccagaagagtacccatacaagatgacg

SEQ ID NO: 3668 - DNA, 987 bp, Flaveria ramosissima
attcatttctcccaaagcacccagatcttgcgtcaatcgcaggtgagatcgtttgatttcgacattagcgactactcaaatcgaatcgcttgactgattgcgatccagagaaggtgcgatatctctctctcagatagattcgctagcagacctgcaaactgtgttcaattgcacgctgtattgctagctaatcaaccaacagtagaccttcaatggctcccgcggttccgagatctggtgatgctatatttgcgaatgttgaacgcgtgaatgctgagttgttcactctgacgtatggggcaatagtgcgacaattgcttacggatctggaagaagttgaggaagtcaataagcagcttgatcaaatgggctacaacattggaatccggctgatcgatgaatttcttgcaaaatctaatgtcacaagatgtgttgattttagggaaaccgctgaagtcattgccaaggttggattcaagatgtttttaggggttactgcatctgtgaccaactgggatacagagggaacttgttgcagtcttattttggatgataacccgctcgtggactttgttgagcttccagatacctgccaaggtttacattattgcaacattctaagtggagttgttaggggagctctagagatggtgtcgatgaagactgaggtcacatgggtcagggatatgcttagaggagatgatgcatttgagttacaagtgaagcttttaaaacaagttccagaggagtatccatacaaagatgacgagtaatgtgttttaatctctattgatgtatatacaatatgatttttcgctatttccgttttggcttgtcataaattaagaatacatctttagtactttgtccttaagttttcatgctagaagaacatgttttgtttcctcctacctgggtagtgttgcttgtaatttgaggtattcggtatggaacttatttattatttagtatttataagtattgttg

SEQ ID NO: 3669 - DNA, 843 bp, Lippia dulcis
ctcagaattcagagtgaagatttcactttcacagttgcgaagaaaatatctgaattcttagctgatttcggtctcagatggctcccatagctccgaagtccggcgatgcgatttttgccagcgttgatcgtgtgaatgcggagctattcaccctgacgtacggtgctatcgtgcgccagctgctcaccgatctggaggaggttgaggaggtcaacaagcagctcgatcaaatgggttataatattggggtccggctagtggatgaatttctggcgaaatccagtgtttcgagatgtgttgatttcagagaaactgcggaagtcattgctaaggttggattcaaaatgttcctgggtgtcactgcatcagtctctaactgggactcagagggcacaacctgcagtttaatattggaggataatcctctggtagactttgttgagcttcctgatacctatcaaggattgtattactgcaatattttgagtggagttgttagaggagctctcgaaatggtttcaatgaaaactgaggtcacatggctgcgtgatatgcttagaggagacgatgtgtttgagctgcaggtgaaacttctgaagcaagttccggaggagtacccatataaggatgatgagtaacatgctatacatccgactgcatgtgtaatctatgactcgttccgggtattgtatgttttgagaaatctctttggtaaaagaattgggtgtattttcttattccagttgatggaaaatttgcgtaggtgatttgtagtttcggttaaactcgaatggatggaatgatttttactcattatgttcgtggttgtgccatttttgtcct
